United States Patent 11,851,653 (MATERIALS AND METHODS FOR TREATMENT OF ALPHA-1 ANTITRYPSIN DEFICIENCY) - sequence listing, part 2

SEQ ID NO: 31408 - DNA, 22 bp, Artificial Sequence
  chemically synthesized
cttacctccattgtggagttgt

SEQ ID NO: 31409 - DNA, 22 bp, Artificial Sequence
  chemically synthesized
acctccattgtggagttgtaga

SEQ ID NO: 31410 - DNA, 22 bp, Artificial Sequence
  chemically synthesized
cctccattgtggagttgtagac

SEQ ID NO: 31411 - DNA, 22 bp, Artificial Sequence
  chemically synthesized
cattgtggagttgtagactgat

SEQ ID NO: 31412 - DNA, 22 bp, Artificial Sequence
  chemically synthesized
tggagttgtagactgatttcat

SEQ ID NO: 31413 - DNA, 22 bp, Artificial Sequence
  chemically synthesized
tagactgatttcatcttgatag

SEQ ID NO: 31414 - DNA, 22 bp, Artificial Sequence
  chemically synthesized
atttcatcttgatagtctgggt

SEQ ID NO: 31415 - DNA, 22 bp, Artificial Sequence
  chemically synthesized
catcttgatagtctgggttaat

SEQ ID NO: 31416 - DNA, 22 bp, Artificial Sequence
  chemically synthesized
atcttgatagtctgggttaatc

SEQ ID NO: 31417 - DNA, 22 bp, Artificial Sequence
  chemically synthesized
gatagtctgggttaatcaccgc

SEQ ID NO: 31418 - DNA, 22 bp, Artificial Sequence
  chemically synthesized
atagtctgggttaatcaccgca

SEQ ID NO: 31419 - DNA, 22 bp, Artificial Sequence
  chemically synthesized
ggttaatcaccgcagccaacac

SEQ ID NO: 31420 - DNA, 22 bp, Artificial Sequence
  chemically synthesized
atcaccgcagccaacactgtaa

SEQ ID NO: 31421 - DNA, 22 bp, Artificial Sequence
  chemically synthesized
taactctcttcttagcctgttg

SEQ ID NO: 31422 - DNA, 22 bp, Artificial Sequence
  chemically synthesized
tcttcttagcctgttgacttaa

SEQ ID NO: 31423 - DNA, 22 bp, Artificial Sequence
  chemically synthesized
ttcttagcctgttgacttaaag

SEQ ID NO: 31424 - DNA, 22 bp, Artificial Sequence
  chemically synthesized
cttagcctgttgacttaaaggt

SEQ ID NO: 31425 - DNA, 22 bp, Artificial Sequence
  chemically synthesized
ttagcctgttgacttaaaggtg

SEQ ID NO: 31426 - DNA, 22 bp, Artificial Sequence
  chemically synthesized
agcctgttgacttaaaggtggg

SEQ ID NO: 31427 - DNA, 22 bp, Artificial Sequence
  chemically synthesized
gcctgttgacttaaaggtggga

SEQ ID NO: 31428 - DNA, 22 bp, Artificial Sequence
  chemically synthesized
ttgacttaaaggtgggaggagc

SEQ ID NO: 31429 - DNA, 22 bp, Artificial Sequence
  chemically synthesized
acttaaaggtgggaggagccca

SEQ ID NO: 31430 - DNA, 22 bp, Artificial Sequence
  chemically synthesized
aaaggtgggaggagcccaaagt

SEQ ID NO: 31431 - DNA, 22 bp, Artificial Sequence
  chemically synthesized
aaggtgggaggagcccaaagtg

SEQ ID NO: 31432 - DNA, 22 bp, Artificial Sequence
  chemically synthesized
aatttgcagtttaatggaatca

SEQ ID NO: 31433 - DNA, 22 bp, Artificial Sequence
  chemically synthesized
atttgcagtttaatggaatcat

SEQ ID NO: 31434 - DNA, 22 bp, Artificial Sequence
  chemically synthesized
gcagtttaatggaatcattatt

SEQ ID NO: 31435 - DNA, 22 bp, Artificial Sequence
  chemically synthesized
cagtttaatggaatcattattg

SEQ ID NO: 31436 - DNA, 22 bp, Artificial Sequence
  chemically synthesized
aatggaatcattattgtgtcac

SEQ ID NO: 31437 - DNA, 22 bp, Artificial Sequence
  chemically synthesized
atggaatcattattgtgtcacc

SEQ ID NO: 31438 - DNA, 22 bp, Artificial Sequence
  chemically synthesized
ttgtgtcacctggcggcagtgt

SEQ ID NO: 31439 - DNA, 22 bp, Artificial Sequence
  chemically synthesized
tgtcacctggcggcagtgttcc

SEQ ID NO: 31440 - DNA, 22 bp, Artificial Sequence
  chemically synthesized
gcggcagtgttcctccctctgg

SEQ ID NO: 31441 - DNA, 22 bp, Artificial Sequence
  chemically synthesized
ctccctctggaactaagacctc

SEQ ID NO: 31442 - DNA, 22 bp, Artificial Sequence
  chemically synthesized
cctctggaactaagacctctaa

SEQ ID NO: 31443 - DNA, 22 bp, Artificial Sequence
  chemically synthesized
tggaactaagacctctaagcca

SEQ ID NO: 31444 - DNA, 22 bp, Artificial Sequence
  chemically synthesized
gaactaagacctctaagccagc

SEQ ID NO: 31445 - DNA, 22 bp, Artificial Sequence
  chemically synthesized
agacctctaagccagcagaaca

SEQ ID NO: 31446 - DNA, 22 bp, Artificial Sequence
  chemically synthesized
taagccagcagaacataatgcc

SEQ ID NO: 31447 - DNA, 22 bp, Artificial Sequence
  chemically synthesized
agccagcagaacataatgccat

SEQ ID NO: 31448 - DNA, 22 bp, Artificial Sequence
  chemically synthesized
tgctagtggaacactaggggtg

SEQ ID NO: 31449 - DNA, 22 bp, Artificial Sequence
  chemically synthesized
gctagtggaacactaggggtga

SEQ ID NO: 31450 - DNA, 22 bp, Artificial Sequence
  chemically synthesized
ctagtggaacactaggggtgat

SEQ ID NO: 31451 - DNA, 22 bp, Artificial Sequence
  chemically synthesized
gtggaacactaggggtgatggt

SEQ ID NO: 31452 - DNA, 22 bp, Artificial Sequence
  chemically synthesized
ggggtgatggtgagtggtgcca

SEQ ID NO: 31453 - DNA, 22 bp, Artificial Sequence
  chemically synthesized
ccacttccacttccaccctttg

SEQ ID NO: 31454 - DNA, 22 bp, Artificial Sequence
  chemically synthesized
cacttccacttccaccctttga

SEQ ID NO: 31455 - DNA, 22 bp, Artificial Sequence
  chemically synthesized
ccacttccaccctttgattcct

SEQ ID NO: 31456 - DNA, 22 bp, Artificial Sequence
  chemically synthesized
cacttccaccctttgattcctg

SEQ ID NO: 31457 - DNA, 22 bp, Artificial Sequence
  chemically synthesized
ccaccctttgattcctggaccc

SEQ ID NO: 31458 - DNA, 22 bp, Artificial Sequence
  chemically synthesized
caccctttgattcctggacccg

SEQ ID NO: 31459 - DNA, 22 bp, Artificial Sequence
  chemically synthesized
tgattcctggacccgtgaatcc

SEQ ID NO: 31460 - DNA, 22 bp, Artificial Sequence
  chemically synthesized
gattcctggacccgtgaatcct

SEQ ID NO: 31461 - DNA, 22 bp, Artificial Sequence
  chemically synthesized
attcctggacccgtgaatcctg

SEQ ID NO: 31462 - DNA, 22 bp, Artificial Sequence
  chemically synthesized
ctggacccgtgaatcctgtcta

SEQ ID NO: 31463 - DNA, 22 bp, Artificial Sequence
  chemically synthesized
gacccgtgaatcctgtctatgg

SEQ ID NO: 31464 - DNA, 22 bp, Artificial Sequence
  chemically synthesized
tctatgggagaaacagtaccat

SEQ ID NO: 31465 - DNA, 22 bp, Artificial Sequence
  chemically synthesized
tgggagaaacagtaccatatat

SEQ ID NO: 31466 - DNA, 22 bp, Artificial Sequence
  chemically synthesized
gacactgattcagagcatacac

SEQ ID NO: 31467 - DNA, 22 bp, Artificial Sequence
  chemically synthesized
attcagagcatacacagccttc

SEQ ID NO: 31468 - DNA, 22 bp, Artificial Sequence
  chemically synthesized
agagcatacacagccttctgga

SEQ ID NO: 31469 - DNA, 22 bp, Artificial Sequence
  chemically synthesized
ctggagaactttgccccaggcc

SEQ ID NO: 31470 - DNA, 22 bp, Artificial Sequence
  chemically synthesized
tggagaactttgccccaggcct

SEQ ID NO: 31471 - DNA, 22 bp, Artificial Sequence
  chemically synthesized
gagaactttgccccaggcctgc

SEQ ID NO: 31472 - DNA, 22 bp, Artificial Sequence
  chemically synthesized
tgccccaggcctgcaaagtatt

SEQ ID NO: 31473 - DNA, 22 bp, Artificial Sequence
  chemically synthesized
gccccaggcctgcaaagtattg

SEQ ID NO: 31474 - DNA, 22 bp, Artificial Sequence
  chemically synthesized
ccccaggcctgcaaagtattgt

SEQ ID NO: 31475 - DNA, 22 bp, Artificial Sequence
  chemically synthesized
caaagtattgtcacctagttgg

SEQ ID NO: 31476 - DNA, 22 bp, Artificial Sequence
  chemically synthesized
tcacctagttggcattgtaatc

SEQ ID NO: 31477 - DNA, 22 bp, Artificial Sequence
  chemically synthesized
gttggcattgtaatcgtgactt

SEQ ID NO: 31478 - DNA, 22 bp, Artificial Sequence
  chemically synthesized
gcattgtaatcgtgacttcaaa

SEQ ID NO: 31479 - DNA, 22 bp, Artificial Sequence
  chemically synthesized
taatcgtgacttcaaaaggcca

SEQ ID NO: 31480 - DNA, 22 bp, Artificial Sequence
  chemically synthesized
caaaaggccattcaaaagctgc

SEQ ID NO: 31481 - DNA, 22 bp, Artificial Sequence
  chemically synthesized
aaaaggccattcaaaagctgct

SEQ ID NO: 31482 - DNA, 22 bp, Artificial Sequence
  chemically synthesized
aaaagctgcttcaggatgatag

SEQ ID NO: 31483 - DNA, 22 bp, Artificial Sequence
  chemically synthesized
cttcaggatgatagggatcatg

SEQ ID NO: 31484 - DNA, 22 bp, Artificial Sequence
  chemically synthesized
caggatgatagggatcatggta

SEQ ID NO: 31485 - DNA, 22 bp, Artificial Sequence
  chemically synthesized
aggatgatagggatcatggtaa

SEQ ID NO: 31486 - DNA, 22 bp, Artificial Sequence
  chemically synthesized
catgagcatgagcccactgtca

SEQ ID NO: 31487 - DNA, 22 bp, Artificial Sequence
  chemically synthesized
tcacacttctttagccataaag

SEQ ID NO: 31488 - DNA, 22 bp, Artificial Sequence
  chemically synthesized
ctttagccataaagtgagtggc

SEQ ID NO: 31489 - DNA, 22 bp, Artificial Sequence
  chemically synthesized
tttagccataaagtgagtggct

SEQ ID NO: 31490 - DNA, 22 bp, Artificial Sequence
  chemically synthesized
tagccataaagtgagtggcttg

SEQ ID NO: 31491 - DNA, 22 bp, Artificial Sequence
  chemically synthesized
agccataaagtgagtggcttgg

SEQ ID NO: 31492 - DNA, 22 bp, Artificial Sequence
  chemically synthesized
gccataaagtgagtggcttggt

SEQ ID NO: 31493 - DNA, 22 bp, Artificial Sequence
  chemically synthesized
ggtcagaagcaatgctgtgtgg

SEQ ID NO: 31494 - DNA, 22 bp, Artificial Sequence
  chemically synthesized
gtcagaagcaatgctgtgtgga

SEQ ID NO: 31495 - DNA, 22 bp, Artificial Sequence
  chemically synthesized
tgtggaataccatgacagtgga

SEQ ID NO: 31496 - DNA, 22 bp, Artificial Sequence
  chemically synthesized
tgtgattccatggatggtagtc

SEQ ID NO: 31497 - DNA, 22 bp, Artificial Sequence
  chemically synthesized
tgattccatggatggtagtctt

SEQ ID NO: 31498 - DNA, 22 bp, Artificial Sequence
  chemically synthesized
catggatggtagtcttggcata

SEQ ID NO: 31499 - DNA, 22 bp, Artificial Sequence
  chemically synthesized
ggcataagcattgagttcagga

SEQ ID NO: 31500 - DNA, 22 bp, Artificial Sequence
  chemically synthesized
gcataagcattgagttcaggat

SEQ ID NO: 31501 - DNA, 22 bp, Artificial Sequence
  chemically synthesized
agttcaggattgggaaacccat

SEQ ID NO: 31502 - DNA, 22 bp, Artificial Sequence
  chemically synthesized
aggattgggaaacccatatcca

SEQ ID NO: 31503 - DNA, 22 bp, Artificial Sequence
  chemically synthesized
ggaaacccatatccagagtaag

SEQ ID NO: 31504 - DNA, 22 bp, Artificial Sequence
  chemically synthesized
ttccagtgaggacaagcctctg

SEQ ID NO: 31505 - DNA, 22 bp, Artificial Sequence
  chemically synthesized
cagtgaggacaagcctctgccc

SEQ ID NO: 31506 - DNA, 22 bp, Artificial Sequence
  chemically synthesized
tgccctttccatgatggaagag

SEQ ID NO: 31507 - DNA, 22 bp, Artificial Sequence
  chemically synthesized
ccctttccatgatggaagaggt

SEQ ID NO: 31508 - DNA, 22 bp, Artificial Sequence
  chemically synthesized
tccatgatggaagaggtccaat

SEQ ID NO: 31509 - DNA, 22 bp, Artificial Sequence
  chemically synthesized
ccatgatggaagaggtccaata

SEQ ID NO: 31510 - DNA, 22 bp, Artificial Sequence
  chemically synthesized
catgatggaagaggtccaatat

SEQ ID NO: 31511 - DNA, 22 bp, Artificial Sequence
  chemically synthesized
ccaccaggtagctggctgatca

SEQ ID NO: 31512 - DNA, 22 bp, Artificial Sequence
  chemically synthesized
gctgatcaccccgaggaatggt

SEQ ID NO: 31513 - DNA, 22 bp, Artificial Sequence
  chemically synthesized
atcaccccgaggaatggtgcca

SEQ ID NO: 31514 - DNA, 22 bp, Artificial Sequence
  chemically synthesized
agtgttggtctctgatgctggc

SEQ ID NO: 31515 - DNA, 22 bp, Artificial Sequence
  chemically synthesized
gtgttggtctctgatgctggca

SEQ ID NO: 31516 - DNA, 22 bp, Artificial Sequence
  chemically synthesized
gtctctgatgctggcaagcagt

SEQ ID NO: 31517 - DNA, 22 bp, Artificial Sequence
  chemically synthesized
tgatgctggcaagcagtggctg

SEQ ID NO: 31518 - DNA, 22 bp, Artificial Sequence
  chemically synthesized
atgctggcaagcagtggctgtg

SEQ ID NO: 31519 - DNA, 22 bp, Artificial Sequence
  chemically synthesized
gcaagcagtggctgtggccagg

SEQ ID NO: 31520 - DNA, 22 bp, Artificial Sequence
  chemically synthesized
tggccaggtcagctttggtgag

SEQ ID NO: 31521 - DNA, 22 bp, Artificial Sequence
  chemically synthesized
tggtgagtggaagtccatgttg

SEQ ID NO: 31522 - DNA, 22 bp, Artificial Sequence
  chemically synthesized
ggtgagtggaagtccatgttgc

SEQ ID NO: 31523 - DNA, 22 bp, Artificial Sequence
  chemically synthesized
gtgagtggaagtccatgttgct

SEQ ID NO: 31524 - DNA, 22 bp, Artificial Sequence
  chemically synthesized
ctgagcccaagcataacttcca

SEQ ID NO: 31525 - DNA, 22 bp, Artificial Sequence
  chemically synthesized
agcccaagcataacttccatcc

SEQ ID NO: 31526 - DNA, 22 bp, Artificial Sequence
  chemically synthesized
ccatccctgcaactgtggccac

SEQ ID NO: 31527 - DNA, 22 bp, Artificial Sequence
  chemically synthesized
catccctgcaactgtggccact

SEQ ID NO: 31528 - DNA, 22 bp, Artificial Sequence
  chemically synthesized
caactgtggccactttgttcat

SEQ ID NO: 31529 - DNA, 22 bp, Artificial Sequence
  chemically synthesized
tggccactttgttcatgggtcc

SEQ ID NO: 31530 - DNA, 22 bp, Artificial Sequence
  chemically synthesized
tgttcatgggtccattggacga

SEQ ID NO: 31531 - DNA, 22 bp, Artificial Sequence
  chemically synthesized
gttcatgggtccattggacgat

SEQ ID NO: 31532 - DNA, 22 bp, Artificial Sequence
  chemically synthesized
ttcatgggtccattggacgatg

SEQ ID NO: 31533 - DNA, 22 bp, Artificial Sequence
  chemically synthesized
atgggtccattggacgatgaca

SEQ ID NO: 31534 - DNA, 22 bp, Artificial Sequence
  chemically synthesized
gacgatgacatgagtggcctgg

SEQ ID NO: 31535 - DNA, 22 bp, Artificial Sequence
  chemically synthesized
ggaaaaggctgagtggtgtcca

SEQ ID NO: 31536 - DNA, 22 bp, Artificial Sequence
  chemically synthesized
agtggtgtccacagaattgatc

SEQ ID NO: 31537 - DNA, 22 bp, Artificial Sequence
  chemically synthesized
atcatcctatccacttgattat

SEQ ID NO: 31538 - DNA, 22 bp, Artificial Sequence
  chemically synthesized
tccacttgattattaaaatcct

SEQ ID NO: 31539 - DNA, 22 bp, Artificial Sequence
  chemically synthesized
gattattaaaatcctcttctgc

SEQ ID NO: 31540 - DNA, 22 bp, Artificial Sequence
  chemically synthesized
attattaaaatcctcttctgct

SEQ ID NO: 31541 - DNA, 22 bp, Artificial Sequence
  chemically synthesized
ttaaaatcctcttctgctgagg

SEQ ID NO: 31542 - DNA, 22 bp, Artificial Sequence
  chemically synthesized
aaatcctcttctgctgaggtca

SEQ ID NO: 31543 - DNA, 22 bp, Artificial Sequence
  chemically synthesized
ttctgctgaggtcacccattgg

SEQ ID NO: 31544 - DNA, 22 bp, Artificial Sequence
  chemically synthesized
ctgctgaggtcacccattggtg

SEQ ID NO: 31545 - DNA, 22 bp, Artificial Sequence
  chemically synthesized
tgctgaggtcacccattggtga

SEQ ID NO: 31546 - DNA, 22 bp, Artificial Sequence
  chemically synthesized
ctgaggtcacccattggtgagc

SEQ ID NO: 31547 - DNA, 22 bp, Artificial Sequence
  chemically synthesized
aggtcacccattggtgagcact

SEQ ID NO: 31548 - DNA, 22 bp, Artificial Sequence
  chemically synthesized
gtgagcactcacatgggatgaa

SEQ ID NO: 31549 - DNA, 22 bp, Artificial Sequence
  chemically synthesized
acatgggatgaaaatatctttg

SEQ ID NO: 31550 - DNA, 22 bp, Artificial Sequence
  chemically synthesized
tgtagtttttgactaatcatag

SEQ ID NO: 31551 - DNA, 22 bp, Artificial Sequence
  chemically synthesized
gtagtttttgactaatcataga

SEQ ID NO: 31552 - DNA, 22 bp, Artificial Sequence
  chemically synthesized
tagtttttgactaatcatagag

SEQ ID NO: 31553 - DNA, 22 bp, Artificial Sequence
  chemically synthesized
ttgactaatcatagaggtccat

SEQ ID NO: 31554 - DNA, 22 bp, Artificial Sequence
  chemically synthesized
tgactaatcatagaggtccatc

SEQ ID NO: 31555 - DNA, 22 bp, Artificial Sequence
  chemically synthesized
gactaatcatagaggtccatcc

SEQ ID NO: 31556 - DNA, 22 bp, Artificial Sequence
  chemically synthesized
actaatcatagaggtccatcca

SEQ ID NO: 31557 - DNA, 22 bp, Artificial Sequence
  chemically synthesized
atcatagaggtccatccacata

SEQ ID NO: 31558 - DNA, 22 bp, Artificial Sequence
  chemically synthesized
ttccccaaatttctttgtcatc

SEQ ID NO: 31559 - DNA, 22 bp, Artificial Sequence
  chemically synthesized
ccccaaatttctttgtcatcaa

SEQ ID NO: 31560 - DNA, 22 bp, Artificial Sequence
  chemically synthesized
cccaaatttctttgtcatcaat

SEQ ID NO: 31561 - DNA, 22 bp, Artificial Sequence
  chemically synthesized
ctttgtcatcaattttccagtc

SEQ ID NO: 31562 - DNA, 22 bp, Artificial Sequence
  chemically synthesized
tttgtcatcaattttccagtca

SEQ ID NO: 31563 - DNA, 22 bp, Artificial Sequence
  chemically synthesized
tgtcatcaattttccagtcatg

SEQ ID NO: 31564 - DNA, 22 bp, Artificial Sequence
  chemically synthesized
gtcatcaattttccagtcatgc

SEQ ID NO: 31565 - DNA, 22 bp, Artificial Sequence
  chemically synthesized
tcatcaattttccagtcatgct

SEQ ID NO: 31566 - DNA, 22 bp, Artificial Sequence
  chemically synthesized
tccagtcatgctttttccaagt

SEQ ID NO: 31567 - DNA, 22 bp, Artificial Sequence
  chemically synthesized
ccagtcatgctttttccaagtc

SEQ ID NO: 31568 - DNA, 22 bp, Artificial Sequence
  chemically synthesized
cagtcatgctttttccaagtcc

SEQ ID NO: 31569 - DNA, 22 bp, Artificial Sequence
  chemically synthesized
tttccaagtccctgaccatcta

SEQ ID NO: 31570 - DNA, 22 bp, Artificial Sequence
  chemically synthesized
ttccaagtccctgaccatctag

SEQ ID NO: 31571 - DNA, 22 bp, Artificial Sequence
  chemically synthesized
tccaagtccctgaccatctagc

SEQ ID NO: 31572 - DNA, 22 bp, Artificial Sequence
  chemically synthesized
ccaagtccctgaccatctagcc

SEQ ID NO: 31573 - DNA, 22 bp, Artificial Sequence
  chemically synthesized
caagtccctgaccatctagcca

SEQ ID NO: 31574 - DNA, 22 bp, Artificial Sequence
  chemically synthesized
accatctagccaaacctttggc

SEQ ID NO: 31575 - DNA, 22 bp, Artificial Sequence
  chemically synthesized
gccaaacctttggctacagccc

SEQ ID NO: 31576 - DNA, 22 bp, Artificial Sequence
  chemically synthesized
tggctacagcccatgaataagt

SEQ ID NO: 31577 - DNA, 22 bp, Artificial Sequence
  chemically synthesized
ggctacagcccatgaataagta

SEQ ID NO: 31578 - DNA, 22 bp, Artificial Sequence
  chemically synthesized
gctacagcccatgaataagtat

SEQ ID NO: 31579 - DNA, 22 bp, Artificial Sequence
  chemically synthesized
cagcccatgaataagtatataa

SEQ ID NO: 31580 - DNA, 22 bp, Artificial Sequence
  chemically synthesized
gccatttctccttctgtgcaaa

SEQ ID NO: 31581 - DNA, 22 bp, Artificial Sequence
  chemically synthesized
ctccttctgtgcaaagtgcaca

SEQ ID NO: 31582 - DNA, 22 bp, Artificial Sequence
  chemically synthesized
tccttctgtgcaaagtgcacaa

SEQ ID NO: 31583 - DNA, 22 bp, Artificial Sequence
  chemically synthesized
cttctgtgcaaagtgcacaacc

SEQ ID NO: 31584 - DNA, 22 bp, Artificial Sequence
  chemically synthesized
ctgtgcaaagtgcacaaccagg

SEQ ID NO: 31585 - DNA, 22 bp, Artificial Sequence
  chemically synthesized
tgtgcaaagtgcacaaccaggc

SEQ ID NO: 31586 - DNA, 22 bp, Artificial Sequence
  chemically synthesized
tgcaaagtgcacaaccaggcac

SEQ ID NO: 31587 - DNA, 22 bp, Artificial Sequence
  chemically synthesized
ctcaaagttctgccaactagga

SEQ ID NO: 31588 - DNA, 22 bp, Artificial Sequence
  chemically synthesized
aaagttctgccaactaggaaga

SEQ ID NO: 31589 - DNA, 22 bp, Artificial Sequence
  chemically synthesized
tgccaactaggaagatttccct

SEQ ID NO: 31590 - DNA, 22 bp, Artificial Sequence
  chemically synthesized
ccaactaggaagatttcccttc

SEQ ID NO: 31591 - DNA, 22 bp, Artificial Sequence
  chemically synthesized
ggaagatttcccttcaccgttg

SEQ ID NO: 31592 - DNA, 22 bp, Artificial Sequence
  chemically synthesized
cccttcaccgttgtccttcagg

SEQ ID NO: 31593 - DNA, 22 bp, Artificial Sequence
  chemically synthesized
ccttcaccgttgtccttcaggg

SEQ ID NO: 31594 - DNA, 22 bp, Artificial Sequence
  chemically synthesized
caccgttgtccttcagggatgt

SEQ ID NO: 31595 - DNA, 22 bp, Artificial Sequence
  chemically synthesized
accgttgtccttcagggatgtc

SEQ ID NO: 31596 - DNA, 22 bp, Artificial Sequence
  chemically synthesized
tccttcagggatgtcctagaaa

SEQ ID NO: 31597 - DNA, 22 bp, Artificial Sequence
  chemically synthesized
cagggatgtcctagaaaggggc

SEQ ID NO: 31598 - DNA, 22 bp, Artificial Sequence
  chemically synthesized
agggatgtcctagaaaggggct

SEQ ID NO: 31599 - DNA, 22 bp, Artificial Sequence
  chemically synthesized
gaaaggggctgtagtgctgcgg

SEQ ID NO: 31600 - DNA, 22 bp, Artificial Sequence
  chemically synthesized
tagtgctgcggctgtccacttt

SEQ ID NO: 31601 - DNA, 22 bp, Artificial Sequence
  chemically synthesized
cggctgtccacttttgggtggt

SEQ ID NO: 31602 - DNA, 22 bp, Artificial Sequence
  chemically synthesized
tccacttttgggtggtgcctgc

SEQ ID NO: 31603 - DNA, 22 bp, Artificial Sequence
  chemically synthesized
ttgggtggtgcctgcatatcgt

SEQ ID NO: 31604 - DNA, 22 bp, Artificial Sequence
  chemically synthesized
tgggtggtgcctgcatatcgtg

SEQ ID NO: 31605 - DNA, 22 bp, Artificial Sequence
  chemically synthesized
gggtggtgcctgcatatcgtgc

SEQ ID NO: 31606 - DNA, 22 bp, Artificial Sequence
  chemically synthesized
ggtggtgcctgcatatcgtgca

SEQ ID NO: 31607 - DNA, 22 bp, Artificial Sequence
  chemically synthesized
catatcgtgcagaactatctgt

SEQ ID NO: 31608 - DNA, 22 bp, Artificial Sequence
  chemically synthesized
tctgtgaaccaggacctagtct

SEQ ID NO: 31609 - DNA, 22 bp, Artificial Sequence
  chemically synthesized
tgaaccaggacctagtcttctc

SEQ ID NO: 31610 - DNA, 22 bp, Artificial Sequence
  chemically synthesized
gtcttctcttcctctgtcagct

SEQ ID NO: 31611 - DNA, 22 bp, Artificial Sequence
  chemically synthesized
ctcttcctctgtcagctgatca

SEQ ID NO: 31612 - DNA, 22 bp, Artificial Sequence
  chemically synthesized
tcttcctctgtcagctgatcat

SEQ ID NO: 31613 - DNA, 22 bp, Artificial Sequence
  chemically synthesized
ttcctctgtcagctgatcatag

SEQ ID NO: 31614 - DNA, 22 bp, Artificial Sequence
  chemically synthesized
cctctgtcagctgatcataggg

SEQ ID NO: 31615 - DNA, 22 bp, Artificial Sequence
  chemically synthesized
ctctgtcagctgatcataggga

SEQ ID NO: 31616 - DNA, 22 bp, Artificial Sequence
  chemically synthesized
tgtcagctgatcatagggaact

SEQ ID NO: 31617 - DNA, 22 bp, Artificial Sequence
  chemically synthesized
tcagctgatcatagggaactcc

SEQ ID NO: 31618 - DNA, 22 bp, Artificial Sequence
  chemically synthesized
atcatagggaactccccatgag

SEQ ID NO: 31619 - DNA, 22 bp, Artificial Sequence
  chemically synthesized
cccatgagaccatcggtgcagt

SEQ ID NO: 31620 - DNA, 22 bp, Artificial Sequence
  chemically synthesized
agggagagaaagcagtgtgtca

SEQ ID NO: 31621 - DNA, 22 bp, Artificial Sequence
  chemically synthesized
gagcccctttctcatgtaactt

SEQ ID NO: 31622 - DNA, 22 bp, Artificial Sequence
  chemically synthesized
agcccctttctcatgtaactta

SEQ ID NO: 31623 - DNA, 22 bp, Artificial Sequence
  chemically synthesized
tctcatgtaacttactagtgcc

SEQ ID NO: 31624 - DNA, 22 bp, Artificial Sequence
  chemically synthesized
ctcatgtaacttactagtgcct

SEQ ID NO: 31625 - DNA, 22 bp, Artificial Sequence
  chemically synthesized
tcatgtaacttactagtgcctt

SEQ ID NO: 31626 - DNA, 22 bp, Artificial Sequence
  chemically synthesized
atgtaacttactagtgccttca

SEQ ID NO: 31627 - DNA, 22 bp, Artificial Sequence
  chemically synthesized
actagtgccttcaggatctgct

SEQ ID NO: 31628 - DNA, 22 bp, Artificial Sequence
  chemically synthesized
ctagtgccttcaggatctgctc

SEQ ID NO: 31629 - DNA, 22 bp, Artificial Sequence
  chemically synthesized
gtgccttcaggatctgctcaag

SEQ ID NO: 31630 - DNA, 22 bp, Artificial Sequence
  chemically synthesized
caggatctgctcaagcccaatc

SEQ ID NO: 31631 - DNA, 22 bp, Artificial Sequence
  chemically synthesized
aggatctgctcaagcccaatcg

SEQ ID NO: 31632 - DNA, 22 bp, Artificial Sequence
  chemically synthesized
ctcaagcccaatcgcatatata

SEQ ID NO: 31633 - DNA, 22 bp, Artificial Sequence
  chemically synthesized
aagcccaatcgcatatatacca

SEQ ID NO: 31634 - DNA, 22 bp, Artificial Sequence
  chemically synthesized
ccatttgctgatgcaatgctgc

SEQ ID NO: 31635 - DNA, 22 bp, Artificial Sequence
  chemically synthesized
catttgctgatgcaatgctgct

SEQ ID NO: 31636 - DNA, 22 bp, Artificial Sequence
  chemically synthesized
gctgatgcaatgctgctgtgca

SEQ ID NO: 31637 - DNA, 22 bp, Artificial Sequence
  chemically synthesized
ctgatgcaatgctgctgtgcac

SEQ ID NO: 31638 - DNA, 22 bp, Artificial Sequence
  chemically synthesized
atgcaatgctgctgtgcacagc

SEQ ID NO: 31639 - DNA, 22 bp, Artificial Sequence
  chemically synthesized
ctgtgcacagcccactttatgg

SEQ ID NO: 31640 - DNA, 22 bp, Artificial Sequence
  chemically synthesized
tgcacagcccactttatggcta

SEQ ID NO: 31641 - DNA, 22 bp, Artificial Sequence
  chemically synthesized
tatggctagatggatcagaaag

SEQ ID NO: 31642 - DNA, 22 bp, Artificial Sequence
  chemically synthesized
atggctagatggatcagaaagc

SEQ ID NO: 31643 - DNA, 22 bp, Artificial Sequence
  chemically synthesized
tggctagatggatcagaaagca

SEQ ID NO: 31644 - DNA, 22 bp, Artificial Sequence
  chemically synthesized
gatggatcagaaagcacccagt

SEQ ID NO: 31645 - DNA, 22 bp, Artificial Sequence
  chemically synthesized
atgataggcagttcaggtcaca

SEQ ID NO: 31646 - DNA, 22 bp, Artificial Sequence
  chemically synthesized
aggtcacatggtgacttgatga

SEQ ID NO: 31647 - DNA, 22 bp, Artificial Sequence
  chemically synthesized
gatgactcatagtcaaatattt

SEQ ID NO: 31648 - DNA, 22 bp, Artificial Sequence
  chemically synthesized
atgactcatagtcaaatatttc

SEQ ID NO: 31649 - DNA, 22 bp, Artificial Sequence
  chemically synthesized
atagtcaaatatttcgtttcca

SEQ ID NO: 31650 - DNA, 22 bp, Artificial Sequence
  chemically synthesized
cgtttccaccaaagcccagtaa

SEQ ID NO: 31651 - DNA, 22 bp, Artificial Sequence
  chemically synthesized
gtttccaccaaagcccagtaac

SEQ ID NO: 31652 - DNA, 22 bp, Artificial Sequence
  chemically synthesized
ccaccaaagcccagtaacaggc

SEQ ID NO: 31653 - DNA, 22 bp, Artificial Sequence
  chemically synthesized
caccaaagcccagtaacaggcc

SEQ ID NO: 31654 - DNA, 22 bp, Artificial Sequence
  chemically synthesized
tctccctaaaagagagtagtta

SEQ ID NO: 31655 - DNA, 22 bp, Artificial Sequence
  chemically synthesized
ctccctaaaagagagtagttat

SEQ ID NO: 31656 - DNA, 22 bp, Artificial Sequence
  chemically synthesized
tccctaaaagagagtagttatc

SEQ ID NO: 31657 - DNA, 22 bp, Artificial Sequence
  chemically synthesized
cctaaaagagagtagttatctg

SEQ ID NO: 31658 - DNA, 22 bp, Artificial Sequence
  chemically synthesized
aaagagagtagttatctgcaga

SEQ ID NO: 31659 - DNA, 22 bp, Artificial Sequence
  chemically synthesized
tctgcagaagatggcagggcct

SEQ ID NO: 31660 - DNA, 22 bp, Artificial Sequence
  chemically synthesized
cagaagatggcagggccttgct

SEQ ID NO: 31661 - DNA, 22 bp, Artificial Sequence
  chemically synthesized
gctccaaaatcctagaggcctc

SEQ ID NO: 31662 - DNA, 22 bp, Artificial Sequence
  chemically synthesized
ctccaaaatcctagaggcctcc

SEQ ID NO: 31663 - DNA, 22 bp, Artificial Sequence
  chemically synthesized
caaaatcctagaggcctccgct

SEQ ID NO: 31664 - DNA, 22 bp, Artificial Sequence
  chemically synthesized
gaggcctccgctgtgattcagc

SEQ ID NO: 31665 - DNA, 22 bp, Artificial Sequence
  chemically synthesized
cgctgtgattcagcctgccaaa

SEQ ID NO: 31666 - DNA, 22 bp, Artificial Sequence
  chemically synthesized
tgattcagcctgccaaatgctc

SEQ ID NO: 31667 - DNA, 22 bp, Artificial Sequence
  chemically synthesized
agcctgccaaatgctccaaaca

SEQ ID NO: 31668 - DNA, 22 bp, Artificial Sequence
  chemically synthesized
ccaaatgctccaaacagcatcc

SEQ ID NO: 31669 - DNA, 22 bp, Artificial Sequence
  chemically synthesized
caaacagcatccctatctggca

SEQ ID NO: 31670 - DNA, 22 bp, Artificial Sequence
  chemically synthesized
tctggcactgacacctcaagca

SEQ ID NO: 31671 - DNA, 22 bp, Artificial Sequence
  chemically synthesized
gcactgacacctcaagcatcat

SEQ ID NO: 31672 - DNA, 22 bp, Artificial Sequence
  chemically synthesized
acacctcaagcatcattggatc

SEQ ID NO: 31673 - DNA, 22 bp, Artificial Sequence
  chemically synthesized
aagcatcattggatctgctagg

SEQ ID NO: 31674 - DNA, 22 bp, Artificial Sequence
  chemically synthesized
gatctgctaggtcatatggccc

SEQ ID NO: 31675 - DNA, 22 bp, Artificial Sequence
  chemically synthesized
ctaggtcatatggcccaagtgg

SEQ ID NO: 31676 - DNA, 22 bp, Artificial Sequence
  chemically synthesized
ggtcatatggcccaagtggcat

SEQ ID NO: 31677 - DNA, 22 bp, Artificial Sequence
  chemically synthesized
gcacagcagcctggacctgtgg

SEQ ID NO: 31678 - DNA, 22 bp, Artificial Sequence
  chemically synthesized
cacagcagcctggacctgtggc

SEQ ID NO: 31679 - DNA, 22 bp, Artificial Sequence
  chemically synthesized
gacctgtggcagagccttctgt

SEQ ID NO: 31680 - DNA, 22 bp, Artificial Sequence
  chemically synthesized
tggcagagccttctgttctgga

SEQ ID NO: 31681 - DNA, 22 bp, Artificial Sequence
  chemically synthesized
ctgttctggactccactcaaaa

SEQ ID NO: 31682 - DNA, 22 bp, Artificial Sequence
  chemically synthesized
tgttctggactccactcaaaac

SEQ ID NO: 31683 - DNA, 22 bp, Artificial Sequence
  chemically synthesized
ttctggactccactcaaaactg

SEQ ID NO: 31684 - DNA, 22 bp, Artificial Sequence
  chemically synthesized
tggactccactcaaaactggca

SEQ ID NO: 31685 - DNA, 22 bp, Artificial Sequence
  chemically synthesized
gactccactcaaaactggcagc

SEQ ID NO: 31686 - DNA, 22 bp, Artificial Sequence
  chemically synthesized
cactcaaaactggcagcctttt

SEQ ID NO: 31687 - DNA, 22 bp, Artificial Sequence
  chemically synthesized
aaaactggcagccttttggatc

SEQ ID NO: 31688 - DNA, 22 bp, Artificial Sequence
  chemically synthesized
gcagccttttggatcactcgat

SEQ ID NO: 31689 - DNA, 22 bp, Artificial Sequence
  chemically synthesized
ttggatcactcgataaatgggc

SEQ ID NO: 31690 - DNA, 22 bp, Artificial Sequence
  chemically synthesized
tggatcactcgataaatgggcc

SEQ ID NO: 31691 - DNA, 22 bp, Artificial Sequence
  chemically synthesized
ggatcactcgataaatgggcca

SEQ ID NO: 31692 - DNA, 22 bp, Artificial Sequence
  chemically synthesized
gatcactcgataaatgggccag

SEQ ID NO: 31693 - DNA, 22 bp, Artificial Sequence
  chemically synthesized
gataaatgggccagagtaacac

SEQ ID NO: 31694 - DNA, 22 bp, Artificial Sequence
  chemically synthesized
cctccaaaatccaaataggccc

SEQ ID NO: 31695 - DNA, 22 bp, Artificial Sequence
  chemically synthesized
caaaatccaaataggcccacta

SEQ ID NO: 31696 - DNA, 22 bp, Artificial Sequence
  chemically synthesized
ggcgttgtgcctatttcttggt

SEQ ID NO: 31697 - DNA, 22 bp, Artificial Sequence
  chemically synthesized
tgcctatttcttggttgtaaga

SEQ ID NO: 31698 - DNA, 22 bp, Artificial Sequence
  chemically synthesized
tttcttggttgtaagagtggcc

SEQ ID NO: 31699 - DNA, 22 bp, Artificial Sequence
  chemically synthesized
cttggttgtaagagtggccaaa

SEQ ID NO: 31700 - DNA, 22 bp, Artificial Sequence
  chemically synthesized
ttggttgtaagagtggccaaat

SEQ ID NO: 31701 - DNA, 22 bp, Artificial Sequence
  chemically synthesized
ggttgtaagagtggccaaatgc

SEQ ID NO: 31702 - DNA, 22 bp, Artificial Sequence
  chemically synthesized
gttgtaagagtggccaaatgca

SEQ ID NO: 31703 - DNA, 22 bp, Artificial Sequence
  chemically synthesized
taagagtggccaaatgcagcaa

SEQ ID NO: 31704 - DNA, 22 bp, Artificial Sequence
  chemically synthesized
tccttcactttagaaggaatat

SEQ ID NO: 31705 - DNA, 22 bp, Artificial Sequence
  chemically synthesized
cactttagaaggaatatctcaa

SEQ ID NO: 31706 - DNA, 22 bp, Artificial Sequence
  chemically synthesized
actttagaaggaatatctcaaa

SEQ ID NO: 31707 - DNA, 22 bp, Artificial Sequence
  chemically synthesized
tagaaggaatatctcaaagagc

SEQ ID NO: 31708 - DNA, 22 bp, Artificial Sequence
  chemically synthesized
agaaggaatatctcaaagagcc

SEQ ID NO: 31709 - DNA, 22 bp, Artificial Sequence
  chemically synthesized
gaaggaatatctcaaagagccc

SEQ ID NO: 31710 - DNA, 22 bp, Artificial Sequence
  chemically synthesized
aaagagccccaaaccattggac

SEQ ID NO: 31711 - DNA, 22 bp, Artificial Sequence
  chemically synthesized
gacccctataaattttactgag

SEQ ID NO: 31712 - DNA, 22 bp, Artificial Sequence
  chemically synthesized
taaattttactgaggtagaagg

SEQ ID NO: 31713 - DNA, 22 bp, Artificial Sequence
  chemically synthesized
tactgaggtagaaggtccctga

SEQ ID NO: 31714 - DNA, 22 bp, Artificial Sequence
  chemically synthesized
actgaggtagaaggtccctgaa

SEQ ID NO: 31715 - DNA, 22 bp, Artificial Sequence
  chemically synthesized
ctgaggtagaaggtccctgaat

SEQ ID NO: 31716 - DNA, 22 bp, Artificial Sequence
  chemically synthesized
aggtagaaggtccctgaattta

SEQ ID NO: 31717 - DNA, 22 bp, Artificial Sequence
  chemically synthesized
aatttaatcagatttatttccc

SEQ ID NO: 31718 - DNA, 22 bp, Artificial Sequence
  chemically synthesized
aatcagatttatttcccatcct

SEQ ID NO: 31719 - DNA, 22 bp, Artificial Sequence
  chemically synthesized
atcagatttatttcccatcctc

SEQ ID NO: 31720 - DNA, 22 bp, Artificial Sequence
  chemically synthesized
atttcccatcctctgtcccaca

SEQ ID NO: 31721 - DNA, 22 bp, Artificial Sequence
  chemically synthesized
tttcccatcctctgtcccacaa

SEQ ID NO: 31722 - DNA, 22 bp, Artificial Sequence
  chemically synthesized
cccatcctctgtcccacaaatg

SEQ ID NO: 31723 - DNA, 22 bp, Artificial Sequence
  chemically synthesized
ccatcctctgtcccacaaatgt

SEQ ID NO: 31724 - DNA, 22 bp, Artificial Sequence
  chemically synthesized
tgtcccacaaatgtctcatcaa

SEQ ID NO: 31725 - DNA, 22 bp, Artificial Sequence
  chemically synthesized
tcccacaaatgtctcatcaata

SEQ ID NO: 31726 - DNA, 22 bp, Artificial Sequence
  chemically synthesized
atcaataaatccagtgtgtttg

SEQ ID NO: 31727 - DNA, 22 bp, Artificial Sequence
  chemically synthesized
gctacttcttgctcactagttc

SEQ ID NO: 31728 - DNA, 22 bp, Artificial Sequence
  chemically synthesized
ctacttcttgctcactagttcc

SEQ ID NO: 31729 - DNA, 22 bp, Artificial Sequence
  chemically synthesized
cttcttgctcactagttccagt

SEQ ID NO: 31730 - DNA, 22 bp, Artificial Sequence
  chemically synthesized
cttgctcactagttccagtcag

SEQ ID NO: 31731 - DNA, 22 bp, Artificial Sequence
  chemically synthesized
ttgctcactagttccagtcagc

SEQ ID NO: 31732 - DNA, 22 bp, Artificial Sequence
  chemically synthesized
gctcactagttccagtcagcat

SEQ ID NO: 31733 - DNA, 22 bp, Artificial Sequence
  chemically synthesized
ctcactagttccagtcagcatg

SEQ ID NO: 31734 - DNA, 22 bp, Artificial Sequence
  chemically synthesized
actagttccagtcagcatgtca

SEQ ID NO: 31735 - DNA, 22 bp, Artificial Sequence
  chemically synthesized
gttccagtcagcatgtcatcaa

SEQ ID NO: 31736 - DNA, 22 bp, Artificial Sequence
  chemically synthesized
cagtcagcatgtcatcaatgta

SEQ ID NO: 31737 - DNA, 22 bp, Artificial Sequence
  chemically synthesized
tgatatcttgtggaagtgaaag

SEQ ID NO: 31738 - DNA, 22 bp, Artificial Sequence
  chemically synthesized
gtggaagtgaaaggtgagcaag

SEQ ID NO: 31739 - DNA, 22 bp, Artificial Sequence
  chemically synthesized
tggaagtgaaaggtgagcaagt

SEQ ID NO: 31740 - DNA, 22 bp, Artificial Sequence
  chemically synthesized
tctccaaataagattatggcac

SEQ ID NO: 31741 - DNA, 22 bp, Artificial Sequence
  chemically synthesized
tccaaataagattatggcacaa

SEQ ID NO: 31742 - DNA, 22 bp, Artificial Sequence
  chemically synthesized
caaataagattatggcacaaag

SEQ ID NO: 31743 - DNA, 22 bp, Artificial Sequence
  chemically synthesized
tggcacaaagctggagagttga

SEQ ID NO: 31744 - DNA, 22 bp, Artificial Sequence
  chemically synthesized
gagagttgatatactcctgagt

SEQ ID NO: 31745 - DNA, 22 bp, Artificial Sequence
  chemically synthesized
atatactcctgagttcatcatt

SEQ ID NO: 31746 - DNA, 22 bp, Artificial Sequence
  chemically synthesized
ctgagttcatcattttctttca

SEQ ID NO: 31747 - DNA, 22 bp, Artificial Sequence
  chemically synthesized
agttcatcattttctttcatca

SEQ ID NO: 31748 - DNA, 22 bp, Artificial Sequence
  chemically synthesized
atcattttctttcatcactttg

SEQ ID NO: 31749 - DNA, 22 bp, Artificial Sequence
  chemically synthesized
tctttcatcactttgtccagcg

SEQ ID NO: 31750 - DNA, 22 bp, Artificial Sequence
  chemically synthesized
ctttcatcactttgtccagcga

SEQ ID NO: 31751 - DNA, 22 bp, Artificial Sequence
  chemically synthesized
tttcatcactttgtccagcgaa

SEQ ID NO: 31752 - DNA, 22 bp, Artificial Sequence
  chemically synthesized
tcatcactttgtccagcgaact

SEQ ID NO: 31753 - DNA, 22 bp, Artificial Sequence
  chemically synthesized
catcactttgtccagcgaactt

SEQ ID NO: 31754 - DNA, 22 bp, Artificial Sequence
  chemically synthesized
atcactttgtccagcgaactta

SEQ ID NO: 31755 - DNA, 22 bp, Artificial Sequence
  chemically synthesized
tgtccagcgaacttacaagcaa

SEQ ID NO: 31756 - DNA, 22 bp, Artificial Sequence
  chemically synthesized
gtccagcgaacttacaagcaac

SEQ ID NO: 31757 - DNA, 22 bp, Artificial Sequence
  chemically synthesized
tccagcgaacttacaagcaacc

SEQ ID NO: 31758 - DNA, 22 bp, Artificial Sequence
  chemically synthesized
acaagcaaccaaccaacttcac

SEQ ID NO: 31759 - DNA, 22 bp, Artificial Sequence
  chemically synthesized
caagcaaccaaccaacttcact

SEQ ID NO: 31760 - DNA, 22 bp, Artificial Sequence
  chemically synthesized
cactatgttccttgattctcca

SEQ ID NO: 31761 - DNA, 22 bp, Artificial Sequence
  chemically synthesized
actatgttccttgattctccac

SEQ ID NO: 31762 - DNA, 22 bp, Artificial Sequence
  chemically synthesized
tgttccttgattctccacatat

SEQ ID NO: 31763 - DNA, 22 bp, Artificial Sequence
  chemically synthesized
cttgattctccacatatagtca

SEQ ID NO: 31764 - DNA, 22 bp, Artificial Sequence
  chemically synthesized
gattctccacatatagtcaaaa

SEQ ID NO: 31765 - DNA, 22 bp, Artificial Sequence
  chemically synthesized
attctccacatatagtcaaaag

SEQ ID NO: 31766 - DNA, 22 bp, Artificial Sequence
  chemically synthesized
tccacatatagtcaaaagtatt

SEQ ID NO: 31767 - DNA, 22 bp, Artificial Sequence
  chemically synthesized
cacatatagtcaaaagtattat

SEQ ID NO: 31768 - DNA, 22 bp, Artificial Sequence
  chemically synthesized
tgtatacagtagctaaattcct

SEQ ID NO: 31769 - DNA, 22 bp, Artificial Sequence
  chemically synthesized
aattccttgcctctcacaagcg

SEQ ID NO: 31770 - DNA, 22 bp, Artificial Sequence
  chemically synthesized
cttgcctctcacaagcgttgaa

SEQ ID NO: 31771 - DNA, 22 bp, Artificial Sequence
  chemically synthesized
gcctctcacaagcgttgaatca

SEQ ID NO: 31772 - DNA, 22 bp, Artificial Sequence
  chemically synthesized
cctctcacaagcgttgaatcaa

SEQ ID NO: 31773 - DNA, 22 bp, Artificial Sequence
  chemically synthesized
tcacaagcgttgaatcaagagt

SEQ ID NO: 31774 - DNA, 22 bp, Artificial Sequence
  chemically synthesized
acaagcgttgaatcaagagtgt

SEQ ID NO: 31775 - DNA, 22 bp, Artificial Sequence
  chemically synthesized
aatcaagagtgtcaaatgcatt

SEQ ID NO: 31776 - DNA, 22 bp, Artificial Sequence
  chemically synthesized
attttgcataactctctaaaca

SEQ ID NO: 31777 - DNA, 22 bp, Artificial Sequence
  chemically synthesized
ttttgcataactctctaaacaa

SEQ ID NO: 31778 - DNA, 22 bp, Artificial Sequence
  chemically synthesized
tgcataactctctaaacaattg

SEQ ID NO: 31779 - DNA, 22 bp, Artificial Sequence
  chemically synthesized
gcataactctctaaacaattga

SEQ ID NO: 31780 - DNA, 22 bp, Artificial Sequence
  chemically synthesized
cataactctctaaacaattgat

SEQ ID NO: 31781 - DNA, 22 bp, Artificial Sequence
  chemically synthesized
tctaaacaattgatgccaagga

SEQ ID NO: 31782 - DNA, 22 bp, Artificial Sequence
  chemically synthesized
taaacaattgatgccaaggatt

SEQ ID NO: 31783 - DNA, 22 bp, Artificial Sequence
  chemically synthesized
aacaattgatgccaaggattat

SEQ ID NO: 31784 - DNA, 22 bp, Artificial Sequence
  chemically synthesized
atgccaaggattatcagtgttc

SEQ ID NO: 31785 - DNA, 22 bp, Artificial Sequence
  chemically synthesized
tcagtgttctccataccattag

SEQ ID NO: 31786 - DNA, 22 bp, Artificial Sequence
  chemically synthesized
tccataccattagaagaagagt

SEQ ID NO: 31787 - DNA, 22 bp, Artificial Sequence
  chemically synthesized
cataccattagaagaagagtcc

SEQ ID NO: 31788 - DNA, 22 bp, Artificial Sequence
  chemically synthesized
gaagaagagtccttagcatatt

SEQ ID NO: 31789 - DNA, 22 bp, Artificial Sequence
  chemically synthesized
agcatatttgggtctaatcata

SEQ ID NO: 31790 - DNA, 22 bp, Artificial Sequence
  chemically synthesized
gcatatttgggtctaatcatat

SEQ ID NO: 31791 - DNA, 22 bp, Artificial Sequence
  chemically synthesized
gggtctaatcatattaagcagc

SEQ ID NO: 31792 - DNA, 22 bp, Artificial Sequence
  chemically synthesized
ggtctaatcatattaagcagcc

SEQ ID NO: 31793 - DNA, 22 bp, Artificial Sequence
  chemically synthesized
atcatattaagcagccaactcc

SEQ ID NO: 31794 - DNA, 22 bp, Artificial Sequence
  chemically synthesized
agcagccaactccagaaacccc

SEQ ID NO: 31795 - DNA, 22 bp, Artificial Sequence
  chemically synthesized
cagaaaccccaaaaccaatgaa

SEQ ID NO: 31796 - DNA, 22 bp, Artificial Sequence
  chemically synthesized
catccttaatattctgttcctc

SEQ ID NO: 31797 - DNA, 22 bp, Artificial Sequence
  chemically synthesized
aatattctgttcctctagaacc

SEQ ID NO: 31798 - DNA, 22 bp, Artificial Sequence
  chemically synthesized
atattctgttcctctagaacca

SEQ ID NO: 31799 - DNA, 22 bp, Artificial Sequence
  chemically synthesized
tgttcctctagaaccactcctg

SEQ ID NO: 31800 - DNA, 22 bp, Artificial Sequence
  chemically synthesized
ttcctctagaaccactcctggt

SEQ ID NO: 31801 - DNA, 22 bp, Artificial Sequence
  chemically synthesized
ctctagaaccactcctggtacc

SEQ ID NO: 31802 - DNA, 22 bp, Artificial Sequence
  chemically synthesized
tagaaccactcctggtaccaaa

SEQ ID NO: 31803 - DNA, 22 bp, Artificial Sequence
  chemically synthesized
gaaccactcctggtaccaaaat

SEQ ID NO: 31804 - DNA, 22 bp, Artificial Sequence
  chemically synthesized
ctggtaccaaaatctgtattag

SEQ ID NO: 31805 - DNA, 22 bp, Artificial Sequence
  chemically synthesized
gtaccaaaatctgtattagggt

SEQ ID NO: 31806 - DNA, 22 bp, Artificial Sequence
  chemically synthesized
tattagggttctacagagaaac

SEQ ID NO: 31807 - DNA, 22 bp, Artificial Sequence
  chemically synthesized
gggttctacagagaaacagaat

SEQ ID NO: 31808 - DNA, 22 bp, Artificial Sequence
  chemically synthesized
tacagagaaacagaattaatag

SEQ ID NO: 31809 - DNA, 22 bp, Artificial Sequence
  chemically synthesized
cagagaaacagaattaatagga

SEQ ID NO: 31810 - DNA, 22 bp, Artificial Sequence
  chemically synthesized
ataggagatatatatctatatc

SEQ ID NO: 31811 - DNA, 22 bp, Artificial Sequence
  chemically synthesized
tatctatatctatatctatatc

SEQ ID NO: 31812 - DNA, 22 bp, Artificial Sequence
  chemically synthesized
tatctatatctatatctatatc

SEQ ID NO: 31813 - DNA, 22 bp, Artificial Sequence
  chemically synthesized
tatctatatctatatctatatc

SEQ ID NO: 31814 - DNA, 22 bp, Artificial Sequence
  chemically synthesized
tatctatatctatatctatctc

SEQ ID NO: 31815 - DNA, 22 bp, Artificial Sequence
  chemically synthesized
tatctatatctatctctatatc

SEQ ID NO: 31816 - DNA, 22 bp, Artificial Sequence
  chemically synthesized
tatctatctctatatctatctc

SEQ ID NO: 31817 - DNA, 22 bp, Artificial Sequence
  chemically synthesized
tctctatatctatctctatatc

SEQ ID NO: 31818 - DNA, 22 bp, Artificial Sequence
  chemically synthesized
tatatctatctctatatctata

SEQ ID NO: 31819 - DNA, 22 bp, Artificial Sequence
  chemically synthesized
tatctatctctatatctatatc

SEQ ID NO: 31820 - DNA, 22 bp, Artificial Sequence
  chemically synthesized
tctctatatctatatctatatg

SEQ ID NO: 31821 - DNA, 22 bp, Artificial Sequence
  chemically synthesized
tatatctatatctatatgagag

SEQ ID NO: 31822 - DNA, 22 bp, Artificial Sequence
  chemically synthesized
tatctatatctatatgagagtt

SEQ ID NO: 31823 - DNA, 22 bp, Artificial Sequence
  chemically synthesized
tatctatatgagagtttattat

SEQ ID NO: 31824 - DNA, 22 bp, Artificial Sequence
  chemically synthesized
tatgagagtttattatgtagta

SEQ ID NO: 31825 - DNA, 22 bp, Artificial Sequence
  chemically synthesized
attatgtagtattgactcacat

SEQ ID NO: 31826 - DNA, 22 bp, Artificial Sequence
  chemically synthesized
ttatgtagtattgactcacatg

SEQ ID NO: 31827 - DNA, 22 bp, Artificial Sequence
  chemically synthesized
tgtagtattgactcacatgttc

SEQ ID NO: 31828 - DNA, 22 bp, Artificial Sequence
  chemically synthesized
actcacatgttcacaaggtccc

SEQ ID NO: 31829 - DNA, 22 bp, Artificial Sequence
  chemically synthesized
acatgttcacaaggtcccaaaa

SEQ ID NO: 31830 - DNA, 22 bp, Artificial Sequence
  chemically synthesized
acaaggtcccaaaacaggccat

SEQ ID NO: 31831 - DNA, 22 bp, Artificial Sequence
  chemically synthesized
ccagctgaggaacaaggaagct

SEQ ID NO: 31832 - DNA, 22 bp, Artificial Sequence
  chemically synthesized
aggaacaaggaagctagtcgga

SEQ ID NO: 31833 - DNA, 22 bp, Artificial Sequence
  chemically synthesized
gtcggagtcccaaagctgaaga

SEQ ID NO: 31834 - DNA, 22 bp, Artificial Sequence
  chemically synthesized
aagaacctggagttcaatgttc

SEQ ID NO: 31835 - DNA, 22 bp, Artificial Sequence
  chemically synthesized
gagttcaatgttccagggcagg

SEQ ID NO: 31836 - DNA, 22 bp, Artificial Sequence
  chemically synthesized
aatgttccagggcaggaagaat

SEQ ID NO: 31837 - DNA, 22 bp, Artificial Sequence
  chemically synthesized
cagggcaggaagaatccagcat

SEQ ID NO: 31838 - DNA, 22 bp, Artificial Sequence
  chemically synthesized
ggatgccaagccaatctagcct

SEQ ID NO: 31839 - DNA, 22 bp, Artificial Sequence
  chemically synthesized
gccttttcacatttttctgcct

SEQ ID NO: 31840 - DNA, 22 bp, Artificial Sequence
  chemically synthesized
ttcacatttttctgcctgcttt

SEQ ID NO: 31841 - DNA, 22 bp, Artificial Sequence
  chemically synthesized
tcacatttttctgcctgcttta

SEQ ID NO: 31842 - DNA, 22 bp, Artificial Sequence
  chemically synthesized
cacatttttctgcctgctttat

SEQ ID NO: 31843 - DNA, 22 bp, Artificial Sequence
  chemically synthesized
acatttttctgcctgctttata

SEQ ID NO: 31844 - DNA, 22 bp, Artificial Sequence
  chemically synthesized
ttctgcctgctttatatcctgg

SEQ ID NO: 31845 - DNA, 22 bp, Artificial Sequence
  chemically synthesized
tctgcctgctttatatcctggc

SEQ ID NO: 31846 - DNA, 22 bp, Artificial Sequence
  chemically synthesized
ctgcctgctttatatcctggct

SEQ ID NO: 31847 - DNA, 22 bp, Artificial Sequence
  chemically synthesized
tgcctgctttatatcctggctg

SEQ ID NO: 31848 - DNA, 22 bp, Artificial Sequence
  chemically synthesized
cctgctttatatcctggctgtg

SEQ ID NO: 31849 - DNA, 22 bp, Artificial Sequence
  chemically synthesized
ctttatatcctggctgtgctgg

SEQ ID NO: 31850 - DNA, 22 bp, Artificial Sequence
  chemically synthesized
tatatcctggctgtgctggcaa

SEQ ID NO: 31851 - DNA, 22 bp, Artificial Sequence
  chemically synthesized
atatcctggctgtgctggcaac

SEQ ID NO: 31852 - DNA, 22 bp, Artificial Sequence
  chemically synthesized
tatcctggctgtgctggcaact

SEQ ID NO: 31853 - DNA, 22 bp, Artificial Sequence
  chemically synthesized
gctgtgctggcaactgattaga

SEQ ID NO: 31854 - DNA, 22 bp, Artificial Sequence
  chemically synthesized
tgctggcaactgattagatggt

SEQ ID NO: 31855 - DNA, 22 bp, Artificial Sequence
  chemically synthesized
gcaactgattagatggtgccca

SEQ ID NO: 31856 - DNA, 22 bp, Artificial Sequence
  chemically synthesized
attagatggtgcccacccagat

SEQ ID NO: 31857 - DNA, 22 bp, Artificial Sequence
  chemically synthesized
gatggtgcccacccagattaag

SEQ ID NO: 31858 - DNA, 22 bp, Artificial Sequence
  chemically synthesized
agggtgggtctgccttccccag

SEQ ID NO: 31859 - DNA, 22 bp, Artificial Sequence
  chemically synthesized
ccttccccagcccactgactga

SEQ ID NO: 31860 - DNA, 22 bp, Artificial Sequence
  chemically synthesized
ccccagcccactgactgaaata

SEQ ID NO: 31861 - DNA, 22 bp, Artificial Sequence
  chemically synthesized
cccagcccactgactgaaatat

SEQ ID NO: 31862 - DNA, 22 bp, Artificial Sequence
  chemically synthesized
actgaaatattaatctcctttg

SEQ ID NO: 31863 - DNA, 22 bp, Artificial Sequence
  chemically synthesized
aaatattaatctcctttggtaa

SEQ ID NO: 31864 - DNA, 22 bp, Artificial Sequence
  chemically synthesized
atctcctttggtaacaccctca

SEQ ID NO: 31865 - DNA, 22 bp, Artificial Sequence
  chemically synthesized
ctttggtaacaccctcacagac

SEQ ID NO: 31866 - DNA, 22 bp, Artificial Sequence
  chemically synthesized
tggtaacaccctcacagacaca

SEQ ID NO: 31867 - DNA, 22 bp, Artificial Sequence
  chemically synthesized
ggtaacaccctcacagacacac

SEQ ID NO: 31868 - DNA, 22 bp, Artificial Sequence
  chemically synthesized
gtaacaccctcacagacacacc

SEQ ID NO: 31869 - DNA, 22 bp, Artificial Sequence
  chemically synthesized
acagacacacccaagatcatta

SEQ ID NO: 31870 - DNA, 22 bp, Artificial Sequence
  chemically synthesized
ctttgcatccttcagtccaatc

SEQ ID NO: 31871 - DNA, 22 bp, Artificial Sequence
  chemically synthesized
tgcatccttcagtccaatcaag

SEQ ID NO: 31872 - DNA, 22 bp, Artificial Sequence
  chemically synthesized
gcatccttcagtccaatcaagt

SEQ ID NO: 31873 - DNA, 22 bp, Artificial Sequence
  chemically synthesized
catccttcagtccaatcaagtt

SEQ ID NO: 31874 - DNA, 22 bp, Artificial Sequence
  chemically synthesized
cagtccaatcaagttgacactc

SEQ ID NO: 31875 - DNA, 22 bp, Artificial Sequence
  chemically synthesized
agtccaatcaagttgacactca

SEQ ID NO: 31876 - DNA, 22 bp, Artificial Sequence
  chemically synthesized
acactcagtattaaccatcaca

SEQ ID NO: 31877 - DNA, 22 bp, Artificial Sequence
  chemically synthesized
agtattaaccatcacagtcact

SEQ ID NO: 31878 - DNA, 22 bp, Artificial Sequence
  chemically synthesized
accatcacagtcactttctaat

SEQ ID NO: 31879 - DNA, 22 bp, Artificial Sequence
  chemically synthesized
tctaatgaggttggtttttttg

SEQ ID NO: 31880 - DNA, 22 bp, Artificial Sequence
  chemically synthesized
ctaatgaggttggtttttttgt

SEQ ID NO: 31881 - DNA, 22 bp, Artificial Sequence
  chemically synthesized
taatgaggttggtttttttgtt

SEQ ID NO: 31882 - DNA, 22 bp, Artificial Sequence
  chemically synthesized
atgaggttggtttttttgttgt

SEQ ID NO: 31883 - DNA, 22 bp, Artificial Sequence
  chemically synthesized
gtttttttgttgttgagttcct

SEQ ID NO: 31884 - DNA, 22 bp, Artificial Sequence
  chemically synthesized
ttttgttgttgagttccttgta

SEQ ID NO: 31885 - DNA, 22 bp, Artificial Sequence
  chemically synthesized
tttgttgttgagttccttgtag

SEQ ID NO: 31886 - DNA, 22 bp, Artificial Sequence
  chemically synthesized
ttgttgttgagttccttgtaga

SEQ ID NO: 31887 - DNA, 22 bp, Artificial Sequence
  chemically synthesized
tgttgttgagttccttgtagat

SEQ ID NO: 31888 - DNA, 22 bp, Artificial Sequence
  chemically synthesized
gttgttgagttccttgtagatt

SEQ ID NO: 31889 - DNA, 22 bp, Artificial Sequence
  chemically synthesized
ttgttgagttccttgtagattc

SEQ ID NO: 31890 - DNA, 22 bp, Artificial Sequence
  chemically synthesized
ttgagttccttgtagattctgt

SEQ ID NO: 31891 - DNA, 22 bp, Artificial Sequence
  chemically synthesized
agttccttgtagattctgtata

SEQ ID NO: 31892 - DNA, 22 bp, Artificial Sequence
  chemically synthesized
cttgtagattctgtatattagc

SEQ ID NO: 31893 - DNA, 22 bp, Artificial Sequence
  chemically synthesized
gtagattctgtatattagcctt

SEQ ID NO: 31894 - DNA, 22 bp, Artificial Sequence
  chemically synthesized
tagattctgtatattagccttt

SEQ ID NO: 31895 - DNA, 22 bp, Artificial Sequence
  chemically synthesized
tgtatattagccttttgttgca

SEQ ID NO: 31896 - DNA, 22 bp, Artificial Sequence
  chemically synthesized
tatattagccttttgttgcatt

SEQ ID NO: 31897 - DNA, 22 bp, Artificial Sequence
  chemically synthesized
gccttttgttgcattcatagtt

SEQ ID NO: 31898 - DNA, 22 bp, Artificial Sequence
  chemically synthesized
ttgttgcattcatagtttgcaa

SEQ ID NO: 31899 - DNA, 22 bp, Artificial Sequence
  chemically synthesized
tgttgcattcatagtttgcaat

SEQ ID NO: 31900 - DNA, 22 bp, Artificial Sequence
  chemically synthesized
gttgcattcatagtttgcaatt

SEQ ID NO: 31901 - DNA, 22 bp, Artificial Sequence
  chemically synthesized
ttgcattcatagtttgcaattt

SEQ ID NO: 31902 - DNA, 22 bp, Artificial Sequence
  chemically synthesized
cattcatagtttgcaatttttt

SEQ ID NO: 31903 - DNA, 22 bp, Artificial Sequence
  chemically synthesized
atagtttgcaatttttttttct

SEQ ID NO: 31904 - DNA, 22 bp, Artificial Sequence
  chemically synthesized
gcaatttttttttctcattctg

SEQ ID NO: 31905 - DNA, 22 bp, Artificial Sequence
  chemically synthesized
caatttttttttctcattctgt

SEQ ID NO: 31906 - DNA, 22 bp, Artificial Sequence
  chemically synthesized
ttttttctcattctgtaggtta

SEQ ID NO: 31907 - DNA, 22 bp, Artificial Sequence
  chemically synthesized
tttttctcattctgtaggttat

SEQ ID NO: 31908 - DNA, 22 bp, Artificial Sequence
  chemically synthesized
ttttctcattctgtaggttatc

SEQ ID NO: 31909 - DNA, 22 bp, Artificial Sequence
  chemically synthesized
tttctcattctgtaggttatcc

SEQ ID NO: 31910 - DNA, 22 bp, Artificial Sequence
  chemically synthesized
ttctcattctgtaggttatccg

SEQ ID NO: 31911 - DNA, 22 bp, Artificial Sequence
  chemically synthesized
tctcattctgtaggttatccgt

SEQ ID NO: 31912 - DNA, 22 bp, Artificial Sequence
  chemically synthesized
ctcattctgtaggttatccgtt

SEQ ID NO: 31913 - DNA, 22 bp, Artificial Sequence
  chemically synthesized
tcattctgtaggttatccgttt

SEQ ID NO: 31914 - DNA, 22 bp, Artificial Sequence
  chemically synthesized
attctgtaggttatccgtttac

SEQ ID NO: 31915 - DNA, 22 bp, Artificial Sequence
  chemically synthesized
tgtaggttatccgtttactctg

SEQ ID NO: 31916 - DNA, 22 bp, Artificial Sequence
  chemically synthesized
taggttatccgtttactctgtt

SEQ ID NO: 31917 - DNA, 22 bp, Artificial Sequence
  chemically synthesized
tccgtttactctgttgattcgg

SEQ ID NO: 31918 - DNA, 22 bp, Artificial Sequence
  chemically synthesized
actctgttgattcggtcttttg

SEQ ID NO: 31919 - DNA, 22 bp, Artificial Sequence
  chemically synthesized
ctctgttgattcggtcttttgc

SEQ ID NO: 31920 - DNA, 22 bp, Artificial Sequence
  chemically synthesized
tgttgattcggtcttttgcggt

SEQ ID NO: 31921 - DNA, 22 bp, Artificial Sequence
  chemically synthesized
ttgattcggtcttttgcggtgc

SEQ ID NO: 31922 - DNA, 22 bp, Artificial Sequence
  chemically synthesized
attcggtcttttgcggtgcaga

SEQ ID NO: 31923 - DNA, 22 bp, Artificial Sequence
  chemically synthesized
ggtcttttgcggtgcagaagca

SEQ ID NO: 31924 - DNA, 22 bp, Artificial Sequence
  chemically synthesized
ttgcggtgcagaagcattttag

SEQ ID NO: 31925 - DNA, 22 bp, Artificial Sequence
  chemically synthesized
tgcggtgcagaagcattttagt

SEQ ID NO: 31926 - DNA, 22 bp, Artificial Sequence
  chemically synthesized
gcggtgcagaagcattttagtt

SEQ ID NO: 31927 - DNA, 22 bp, Artificial Sequence
  chemically synthesized
cggtgcagaagcattttagttt

SEQ ID NO: 31928 - DNA, 22 bp, Artificial Sequence
  chemically synthesized
tagtttaattaagtcccatttg

SEQ ID NO: 31929 - DNA, 22 bp, Artificial Sequence
  chemically synthesized
agtttaattaagtcccatttgt

SEQ ID NO: 31930 - DNA, 22 bp, Artificial Sequence
  chemically synthesized
gtttaattaagtcccatttgtc

SEQ ID NO: 31931 - DNA, 22 bp, Artificial Sequence
  chemically synthesized
aattaagtcccatttgtctgtt

SEQ ID NO: 31932 - DNA, 22 bp, Artificial Sequence
  chemically synthesized
attaagtcccatttgtctgttt

SEQ ID NO: 31933 - DNA, 22 bp, Artificial Sequence
  chemically synthesized
agtcccatttgtctgtttttgt

SEQ ID NO: 31934 - DNA, 22 bp, Artificial Sequence
  chemically synthesized
gtctgtttttgtttttgttgtg

SEQ ID NO: 31935 - DNA, 22 bp, Artificial Sequence
  chemically synthesized
tctgtttttgtttttgttgtgt

SEQ ID NO: 31936 - DNA, 22 bp, Artificial Sequence
  chemically synthesized
tttttgtttttgttgtgtttag

SEQ ID NO: 31937 - DNA, 22 bp, Artificial Sequence
  chemically synthesized
ttgtttttgttgtgtttagttt

SEQ ID NO: 31938 - DNA, 22 bp, Artificial Sequence
  chemically synthesized
tgtttttgttgtgtttagtttt

SEQ ID NO: 31939 - DNA, 22 bp, Artificial Sequence
  chemically synthesized
gtttttgttgtgtttagttttg

SEQ ID NO: 31940 - DNA, 22 bp, Artificial Sequence
  chemically synthesized
tttttgttgtgtttagttttga

SEQ ID NO: 31941 - DNA, 22 bp, Artificial Sequence
  chemically synthesized
ttgttgtgtttagttttgagga

SEQ ID NO: 31942 - DNA, 22 bp, Artificial Sequence
  chemically synthesized
tgttgtgtttagttttgaggac

SEQ ID NO: 31943 - DNA, 22 bp, Artificial Sequence
  chemically synthesized
gttgtgtttagttttgaggact

SEQ ID NO: 31944 - DNA, 22 bp, Artificial Sequence
  chemically synthesized
ttgtgtttagttttgaggactt

SEQ ID NO: 31945 - DNA, 22 bp, Artificial Sequence
  chemically synthesized
tgtttagttttgaggacttggt

SEQ ID NO: 31946 - DNA, 22 bp, Artificial Sequence
  chemically synthesized
agttttgaggacttggtcataa

SEQ ID NO: 31947 - DNA, 22 bp, Artificial Sequence
  chemically synthesized
gttttgaggacttggtcataaa

SEQ ID NO: 31948 - DNA, 22 bp, Artificial Sequence
  chemically synthesized
tgaggacttggtcataaattct

SEQ ID NO: 31949 - DNA, 22 bp, Artificial Sequence
  chemically synthesized
gaggacttggtcataaattctt

SEQ ID NO: 31950 - DNA, 22 bp, Artificial Sequence
  chemically synthesized
aggacttggtcataaattcttt

SEQ ID NO: 31951 - DNA, 22 bp, Artificial Sequence
  chemically synthesized
ggtcataaattctttgcctagg

SEQ ID NO: 31952 - DNA, 22 bp, Artificial Sequence
  chemically synthesized
gtcataaattctttgcctaggc

SEQ ID NO: 31953 - DNA, 22 bp, Artificial Sequence
  chemically synthesized
tttgcctaggccacatctaatt

SEQ ID NO: 31954 - DNA, 22 bp, Artificial Sequence
  chemically synthesized
tgcctaggccacatctaatttt

SEQ ID NO: 31955 - DNA, 22 bp, Artificial Sequence
  chemically synthesized
gcctaggccacatctaattttt

SEQ ID NO: 31956 - DNA, 22 bp, Artificial Sequence
  chemically synthesized
cctaggccacatctaattttta

SEQ ID NO: 31957 - DNA, 22 bp, Artificial Sequence
  chemically synthesized
ggccacatctaatttttaatcc

SEQ ID NO: 31958 - DNA, 22 bp, Artificial Sequence
  chemically synthesized
atttttaatcctcttttagagc

SEQ ID NO: 31959 - DNA, 22 bp, Artificial Sequence
  chemically synthesized
ttaatcctcttttagagcctgt

SEQ ID NO: 31960 - DNA, 22 bp, Artificial Sequence
  chemically synthesized
taatcctcttttagagcctgtc

SEQ ID NO: 31961 - DNA, 22 bp, Artificial Sequence
  chemically synthesized
aatcctcttttagagcctgtct

SEQ ID NO: 31962 - DNA, 22 bp, Artificial Sequence
  chemically synthesized
atcctcttttagagcctgtctt

SEQ ID NO: 31963 - DNA, 22 bp, Artificial Sequence
  chemically synthesized
ttttagagcctgtctttccctc

SEQ ID NO: 31964 - DNA, 22 bp, Artificial Sequence
  chemically synthesized
ttagagcctgtctttccctcca

SEQ ID NO: 31965 - DNA, 22 bp, Artificial Sequence
  chemically synthesized
tagagcctgtctttccctccaa

SEQ ID NO: 31966 - DNA, 22 bp, Artificial Sequence
  chemically synthesized
agagcctgtctttccctccaaa

SEQ ID NO: 31967 - DNA, 22 bp, Artificial Sequence
  chemically synthesized
gagcctgtctttccctccaaac

SEQ ID NO: 31968 - DNA, 22 bp, Artificial Sequence
  chemically synthesized
tctttccctccaaactaaatat

SEQ ID NO: 31969 - DNA, 22 bp, Artificial Sequence
  chemically synthesized
tccctccaaactaaatattatt

SEQ ID NO: 31970 - DNA, 22 bp, Artificial Sequence
  chemically synthesized
ccctccaaactaaatattattt

SEQ ID NO: 31971 - DNA, 22 bp, Artificial Sequence
  chemically synthesized
cctccaaactaaatattatttt

SEQ ID NO: 31972 - DNA, 22 bp, Artificial Sequence
  chemically synthesized
caaactaaatattattttaccc

SEQ ID NO: 31973 - DNA, 22 bp, Artificial Sequence
  chemically synthesized
aatattattttacccccatttg

SEQ ID NO: 31974 - DNA, 22 bp, Artificial Sequence
  chemically synthesized
ttttacccccatttgacacatg

SEQ ID NO: 31975 - DNA, 22 bp, Artificial Sequence
  chemically synthesized
tacccccatttgacacatgagc

SEQ ID NO: 31976 - DNA, 22 bp, Artificial Sequence
  chemically synthesized
acccccatttgacacatgagct

SEQ ID NO: 31977 - DNA, 22 bp, Artificial Sequence
  chemically synthesized
cccccatttgacacatgagcta

SEQ ID NO: 31978 - DNA, 22 bp, Artificial Sequence
  chemically synthesized
gacacatgagctaattgagcct

SEQ ID NO: 31979 - DNA, 22 bp, Artificial Sequence
  chemically synthesized
acacatgagctaattgagcctt

SEQ ID NO: 31980 - DNA, 22 bp, Artificial Sequence
  chemically synthesized
attgagccttctgtctgttaag

SEQ ID NO: 31981 - DNA, 22 bp, Artificial Sequence
  chemically synthesized
agccttctgtctgttaagtaag

SEQ ID NO: 31982 - DNA, 22 bp, Artificial Sequence
  chemically synthesized
ctgtctgttaagtaagttgact

SEQ ID NO: 31983 - DNA, 22 bp, Artificial Sequence
  chemically synthesized
tgtctgttaagtaagttgacta

SEQ ID NO: 31984 - DNA, 22 bp, Artificial Sequence
  chemically synthesized
tctgttaagtaagttgactagt

SEQ ID NO: 31985 - DNA, 22 bp, Artificial Sequence
  chemically synthesized
ttaagtaagttgactagttcag

SEQ ID NO: 31986 - DNA, 22 bp, Artificial Sequence
  chemically synthesized
agtaagttgactagttcagtgt

SEQ ID NO: 31987 - DNA, 22 bp, Artificial Sequence
  chemically synthesized
actagttcagtgtaagttgttt

SEQ ID NO: 31988 - DNA, 22 bp, Artificial Sequence
  chemically synthesized
gttcagtgtaagttgtttctaa

SEQ ID NO: 31989 - DNA, 22 bp, Artificial Sequence
  chemically synthesized
agtgtaagttgtttctaatttt

SEQ ID NO: 31990 - DNA, 22 bp, Artificial Sequence
  chemically synthesized
tttctaattttttgccatcata

SEQ ID NO: 31991 - DNA, 22 bp, Artificial Sequence
  chemically synthesized
ctaattttttgccatcataatg

SEQ ID NO: 31992 - DNA, 22 bp, Artificial Sequence
  chemically synthesized
taattttttgccatcataatgc

SEQ ID NO: 31993 - DNA, 22 bp, Artificial Sequence
  chemically synthesized
attttttgccatcataatgctt

SEQ ID NO: 31994 - DNA, 22 bp, Artificial Sequence
  chemically synthesized
tttgccatcataatgctttagt

SEQ ID NO: 31995 - DNA, 22 bp, Artificial Sequence
  chemically synthesized
ttgccatcataatgctttagta

SEQ ID NO: 31996 - DNA, 22 bp, Artificial Sequence
  chemically synthesized
tgccatcataatgctttagtaa

SEQ ID NO: 31997 - DNA, 22 bp, Artificial Sequence
  chemically synthesized
gccatcataatgctttagtaaa

SEQ ID NO: 31998 - DNA, 22 bp, Artificial Sequence
  chemically synthesized
ccatcataatgctttagtaaac

SEQ ID NO: 31999 - DNA, 22 bp, Artificial Sequence
  chemically synthesized
tagtaaacatccttttcatact

SEQ ID NO: 32000 - DNA, 22 bp, Artificial Sequence
  chemically synthesized
agtaaacatccttttcatactc

SEQ ID NO: 32001 - DNA, 22 bp, Artificial Sequence
  chemically synthesized
gtaaacatccttttcatactct

SEQ ID NO: 32002 - DNA, 22 bp, Artificial Sequence
  chemically synthesized
ttcatactctccttaattttcc

SEQ ID NO: 32003 - DNA, 22 bp, Artificial Sequence
  chemically synthesized
tcatactctccttaattttccc

SEQ ID NO: 32004 - DNA, 22 bp, Artificial Sequence
  chemically synthesized
catactctccttaattttcccc

SEQ ID NO: 32005 - DNA, 22 bp, Artificial Sequence
  chemically synthesized
atactctccttaattttccccc

SEQ ID NO: 32006 - DNA, 22 bp, Artificial Sequence
  chemically synthesized
tccttaattttcccccaggatg

SEQ ID NO: 32007 - DNA, 22 bp, Artificial Sequence
  chemically synthesized
cttaattttcccccaggatggt

SEQ ID NO: 32008 - DNA, 22 bp, Artificial Sequence
  chemically synthesized
aattttcccccaggatggtttt

SEQ ID NO: 32009 - DNA, 22 bp, Artificial Sequence
  chemically synthesized
attttcccccaggatggttttc

SEQ ID NO: 32010 - DNA, 22 bp, Artificial Sequence
  chemically synthesized
tcccccaggatggttttctaga

SEQ ID NO: 32011 - DNA, 22 bp, Artificial Sequence
  chemically synthesized
cccccaggatggttttctagat

SEQ ID NO: 32012 - DNA, 22 bp, Artificial Sequence
  chemically synthesized
ccccaggatggttttctagatg

SEQ ID NO: 32013 - DNA, 22 bp, Artificial Sequence
  chemically synthesized
tctagatgtggacttgctggat

SEQ ID NO: 32014 - DNA, 22 bp, Artificial Sequence
  chemically synthesized
ctagatgtggacttgctggatc

SEQ ID NO: 32015 - DNA, 22 bp, Artificial Sequence
  chemically synthesized
tagatgtggacttgctggatcc

SEQ ID NO: 32016 - DNA, 22 bp, Artificial Sequence
  chemically synthesized
gatgtggacttgctggatccaa

SEQ ID NO: 32017 - DNA, 22 bp, Artificial Sequence
  chemically synthesized
gctggatccaaagtgtgcatat

SEQ ID NO: 32018 - DNA, 22 bp, Artificial Sequence
  chemically synthesized
ctggatccaaagtgtgcatatt

SEQ ID NO: 32019 - DNA, 22 bp, Artificial Sequence
  chemically synthesized
gatccaaagtgtgcatattttc

SEQ ID NO: 32020 - DNA, 22 bp, Artificial Sequence
  chemically synthesized
tccaaatgtatccatatattgt

SEQ ID NO: 32021 - DNA, 22 bp, Artificial Sequence
  chemically synthesized
ccaaatgtatccatatattgtg

SEQ ID NO: 32022 - DNA, 22 bp, Artificial Sequence
  chemically synthesized
caaatgtatccatatattgtgg

SEQ ID NO: 32023 - DNA, 22 bp, Artificial Sequence
  chemically synthesized
tggctttgtgttttaatagagg

SEQ ID NO: 32024 - DNA, 22 bp, Artificial Sequence
  chemically synthesized
tgtgttttaatagaggtagcag

SEQ ID NO: 32025 - DNA, 22 bp, Artificial Sequence
  chemically synthesized
gtgttttaatagaggtagcagc

SEQ ID NO: 32026 - DNA, 22 bp, Artificial Sequence
  chemically synthesized
tgttttaatagaggtagcagca

SEQ ID NO: 32027 - DNA, 22 bp, Artificial Sequence
  chemically synthesized
taatagaggtagcagcaatatt

SEQ ID NO: 32028 - DNA, 22 bp, Artificial Sequence
  chemically synthesized
aatagaggtagcagcaatatta

SEQ ID NO: 32029 - DNA, 22 bp, Artificial Sequence
  chemically synthesized
atagaggtagcagcaatattag

SEQ ID NO: 32030 - DNA, 22 bp, Artificial Sequence
  chemically synthesized
gaggagagaattaaggaacgat

SEQ ID NO: 32031 - DNA, 22 bp, Artificial Sequence
  chemically synthesized
aggaacgattctagtgtagcag

SEQ ID NO: 32032 - DNA, 22 bp, Artificial Sequence
  chemically synthesized
tagtgtagcaggacaagctgca

SEQ ID NO: 32033 - DNA, 22 bp, Artificial Sequence
  chemically synthesized
gtgtagcaggacaagctgcata

SEQ ID NO: 32034 - DNA, 22 bp, Artificial Sequence
  chemically synthesized
catacaaaacccctcagacacc

SEQ ID NO: 32035 - DNA, 22 bp, Artificial Sequence
  chemically synthesized
agacaccgagttaaagaaggaa

SEQ ID NO: 32036 - DNA, 22 bp, Artificial Sequence
  chemically synthesized
aagaaggaagggctttattcgg

SEQ ID NO: 32037 - DNA, 22 bp, Artificial Sequence
  chemically synthesized
tattcggctgggagcttgggca

SEQ ID NO: 32038 - DNA, 22 bp, Artificial Sequence
  chemically synthesized
attcggctgggagcttgggcaa

SEQ ID NO: 32039 - DNA, 22 bp, Artificial Sequence
  chemically synthesized
ttcggctgggagcttgggcaag

SEQ ID NO: 32040 - DNA, 22 bp, Artificial Sequence
  chemically synthesized
ggctgggagcttgggcaagact

SEQ ID NO: 32041 - DNA, 22 bp, Artificial Sequence
  chemically synthesized
ggagcttgggcaagactcacat

SEQ ID NO: 32042 - DNA, 22 bp, Artificial Sequence
  chemically synthesized
gggcaagactcacatctccaac

SEQ ID NO: 32043 - DNA, 22 bp, Artificial Sequence
  chemically synthesized
ggcaagactcacatctccaaca

SEQ ID NO: 32044 - DNA, 22 bp, Artificial Sequence
  chemically synthesized
acatctccaacaaccaagctct

SEQ ID NO: 32045 - DNA, 22 bp, Artificial Sequence
  chemically synthesized
caacaaccaagctctcagagtg

SEQ ID NO: 32046 - DNA, 22 bp, Artificial Sequence
  chemically synthesized
tcagagtgagcaattcctgtcc

SEQ ID NO: 32047 - DNA, 22 bp, Artificial Sequence
  chemically synthesized
agagtgagcaattcctgtccct

SEQ ID NO: 32048 - DNA, 22 bp, Artificial Sequence
  chemically synthesized
ctgtcccttttaagggcttaca

SEQ ID NO: 32049 - DNA, 22 bp, Artificial Sequence
  chemically synthesized
tcccttttaagggcttacaact

SEQ ID NO: 32050 - DNA, 22 bp, Artificial Sequence
  chemically synthesized
ttaagggcttacaactctaagg

SEQ ID NO: 32051 - DNA, 22 bp, Artificial Sequence
  chemically synthesized
taagggcttacaactctaaggg

SEQ ID NO: 32052 - DNA, 22 bp, Artificial Sequence
  chemically synthesized
aagggcttacaactctaagggg

SEQ ID NO: 32053 - DNA, 22 bp, Artificial Sequence
  chemically synthesized
agggcttacaactctaaggggg

SEQ ID NO: 32054 - DNA, 22 bp, Artificial Sequence
  chemically synthesized
acaactctaagggggtacatga

SEQ ID NO: 32055 - DNA, 22 bp, Artificial Sequence
  chemically synthesized
caactctaagggggtacatgac

SEQ ID NO: 32056 - DNA, 22 bp, Artificial Sequence
  chemically synthesized
taagggggtacatgactggggg

SEQ ID NO: 32057 - DNA, 22 bp, Artificial Sequence
  chemically synthesized
agggggtacatgactgggggct

SEQ ID NO: 32058 - DNA, 22 bp, Artificial Sequence
  chemically synthesized
ggggctgcatgcactggtcatc

SEQ ID NO: 32059 - DNA, 22 bp, Artificial Sequence
  chemically synthesized
catgcactggtcatcagaatgg

SEQ ID NO: 32060 - DNA, 22 bp, Artificial Sequence
  chemically synthesized
gtcatcagaatggaacagaaca

SEQ ID NO: 32061 - DNA, 22 bp, Artificial Sequence
  chemically synthesized
tcacactgcttttccatacagt

SEQ ID NO: 32062 - DNA, 22 bp, Artificial Sequence
  chemically synthesized
cacactgcttttccatacagtg

SEQ ID NO: 32063 - DNA, 22 bp, Artificial Sequence
  chemically synthesized
acactgcttttccatacagtgt

SEQ ID NO: 32064 - DNA, 22 bp, Artificial Sequence
  chemically synthesized
cttttccatacagtgtctggaa

SEQ ID NO: 32065 - DNA, 22 bp, Artificial Sequence
  chemically synthesized
ttccatacagtgtctggaatct

SEQ ID NO: 32066 - DNA, 22 bp, Artificial Sequence
  chemically synthesized
tccatacagtgtctggaatcta

SEQ ID NO: 32067 - DNA, 22 bp, Artificial Sequence
  chemically synthesized
ccatacagtgtctggaatctat

SEQ ID NO: 32068 - DNA, 22 bp, Artificial Sequence
  chemically synthesized
catacagtgtctggaatctata

SEQ ID NO: 32069 - DNA, 22 bp, Artificial Sequence
  chemically synthesized
gaatctatagataacataactg

SEQ ID NO: 32070 - DNA, 22 bp, Artificial Sequence
  chemically synthesized
tagataacataactggccaggt

SEQ ID NO: 32071 - DNA, 22 bp, Artificial Sequence
  chemically synthesized
gccaggtcaggggtctatcttt

SEQ ID NO: 32072 - DNA, 22 bp, Artificial Sequence
  chemically synthesized
tctttaaccaggcccaggatgt

SEQ ID NO: 32073 - DNA, 22 bp, Artificial Sequence
  chemically synthesized
taaccaggcccaggatgtggtc

SEQ ID NO: 32074 - DNA, 22 bp, Artificial Sequence
  chemically synthesized
aaccaggcccaggatgtggtct

SEQ ID NO: 32075 - DNA, 22 bp, Artificial Sequence
  chemically synthesized
accaggcccaggatgtggtctc

SEQ ID NO: 32076 - DNA, 22 bp, Artificial Sequence
  chemically synthesized
aggctgtttgcctgtggatttc

SEQ ID NO: 32077 - DNA, 22 bp, Artificial Sequence
  chemically synthesized
tttgcctgtggatttcatttct

SEQ ID NO: 32078 - DNA, 22 bp, Artificial Sequence
  chemically synthesized
gcctgtggatttcatttctgcc

SEQ ID NO: 32079 - DNA, 22 bp, Artificial Sequence
  chemically synthesized
cctgtggatttcatttctgcct

SEQ ID NO: 32080 - DNA, 22 bp, Artificial Sequence
  chemically synthesized
tggatttcatttctgcctttta

SEQ ID NO: 32081 - DNA, 22 bp, Artificial Sequence
  chemically synthesized
catttctgccttttagttttta

SEQ ID NO: 32082 - DNA, 22 bp, Artificial Sequence
  chemically synthesized
atttctgccttttagtttttac

SEQ ID NO: 32083 - DNA, 22 bp, Artificial Sequence
  chemically synthesized
ctgccttttagtttttacttct

SEQ ID NO: 32084 - DNA, 22 bp, Artificial Sequence
  chemically synthesized
tgccttttagtttttacttctt

SEQ ID NO: 32085 - DNA, 22 bp, Artificial Sequence
  chemically synthesized
ccttttagtttttacttcttct

SEQ ID NO: 32086 - DNA, 22 bp, Artificial Sequence
  chemically synthesized
ttagtttttacttcttctttct

SEQ ID NO: 32087 - DNA, 22 bp, Artificial Sequence
  chemically synthesized
tagtttttacttcttctttctt

SEQ ID NO: 32088 - DNA, 22 bp, Artificial Sequence
  chemically synthesized
agtttttacttcttctttcttt

SEQ ID NO: 32089 - DNA, 22 bp, Artificial Sequence
  chemically synthesized
gtttttacttcttctttctttg

SEQ ID NO: 32090 - DNA, 22 bp, Artificial Sequence
  chemically synthesized
ttacttcttctttctttggagg

SEQ ID NO: 32091 - DNA, 22 bp, Artificial Sequence
  chemically synthesized
tacttcttctttctttggaggc

SEQ ID NO: 32092 - DNA, 22 bp, Artificial Sequence
  chemically synthesized
acttcttctttctttggaggca

SEQ ID NO: 32093 - DNA, 22 bp, Artificial Sequence
  chemically synthesized
cttcttctttctttggaggcag

SEQ ID NO: 32094 - DNA, 22 bp, Artificial Sequence
  chemically synthesized
cttctttctttggaggcagaaa

SEQ ID NO: 32095 - DNA, 22 bp, Artificial Sequence
  chemically synthesized
ttctttctttggaggcagaaat

SEQ ID NO: 32096 - DNA, 22 bp, Artificial Sequence
  chemically synthesized
ctttctttggaggcagaaattg

SEQ ID NO: 32097 - DNA, 22 bp, Artificial Sequence
  chemically synthesized
tttctttggaggcagaaattgg

SEQ ID NO: 32098 - DNA, 22 bp, Artificial Sequence
  chemically synthesized
tctttggaggcagaaattgggc

SEQ ID NO: 32099 - DNA, 22 bp, Artificial Sequence
  chemically synthesized
ctttggaggcagaaattgggca

SEQ ID NO: 32100 - DNA, 22 bp, Artificial Sequence
  chemically synthesized
tttggaggcagaaattgggcat

SEQ ID NO: 32101 - DNA, 22 bp, Artificial Sequence
  chemically synthesized
tggaggcagaaattgggcataa

SEQ ID NO: 32102 - DNA, 22 bp, Artificial Sequence
  chemically synthesized
ggaggcagaaattgggcataaa

SEQ ID NO: 32103 - DNA, 22 bp, Artificial Sequence
  chemically synthesized
gaggcagaaattgggcataaaa

SEQ ID NO: 32104 - DNA, 22 bp, Artificial Sequence
  chemically synthesized
ggcataaaacaatatgaagggt

SEQ ID NO: 32105 - DNA, 22 bp, Artificial Sequence
  chemically synthesized
ctcccttactaggaagagagaa

SEQ ID NO: 32106 - DNA, 22 bp, Artificial Sequence
  chemically synthesized
ccttactaggaagagagaaata

SEQ ID NO: 32107 - DNA, 22 bp, Artificial Sequence
  chemically synthesized
actaggaagagagaaataccat

SEQ ID NO: 32108 - DNA, 22 bp, Artificial Sequence
  chemically synthesized
ctaggaagagagaaataccatg

SEQ ID NO: 32109 - DNA, 22 bp, Artificial Sequence
  chemically synthesized
ggaagagagaaataccatgtga

SEQ ID NO: 32110 - DNA, 22 bp, Artificial Sequence
  chemically synthesized
gtgttattggatttgacatcgg

SEQ ID NO: 32111 - DNA, 22 bp, Artificial Sequence
  chemically synthesized
tgttattggatttgacatcggg

SEQ ID NO: 32112 - DNA, 22 bp, Artificial Sequence
  chemically synthesized
ttggatttgacatcggggttgg

SEQ ID NO: 32113 - DNA, 22 bp, Artificial Sequence
  chemically synthesized
gatttgacatcggggttggacc

SEQ ID NO: 32114 - DNA, 22 bp, Artificial Sequence
  chemically synthesized
gacatcggggttggaccaagca

SEQ ID NO: 32115 - DNA, 22 bp, Artificial Sequence
  chemically synthesized
acatcggggttggaccaagcat

SEQ ID NO: 32116 - DNA, 22 bp, Artificial Sequence
  chemically synthesized
gaccaagcatcttctatgaaca

SEQ ID NO: 32117 - DNA, 22 bp, Artificial Sequence
  chemically synthesized
ctatgaacatctataagcacgt

SEQ ID NO: 32118 - DNA, 22 bp, Artificial Sequence
  chemically synthesized
tatgaacatctataagcacgtt

SEQ ID NO: 32119 - DNA, 22 bp, Artificial Sequence
  chemically synthesized
tgaacatctataagcacgttct

SEQ ID NO: 32120 - DNA, 22 bp, Artificial Sequence
  chemically synthesized
taagcacgttctccttatcaaa

SEQ ID NO: 32121 - DNA, 22 bp, Artificial Sequence
  chemically synthesized
tccttatcaaaaggtactttgc

SEQ ID NO: 32122 - DNA, 22 bp, Artificial Sequence
  chemically synthesized
cttatcaaaaggtactttgctt

SEQ ID NO: 32123 - DNA, 22 bp, Artificial Sequence
  chemically synthesized
atcaaaaggtactttgcttggt

SEQ ID NO: 32124 - DNA, 22 bp, Artificial Sequence
  chemically synthesized
tcaaaaggtactttgcttggtg

SEQ ID NO: 32125 - DNA, 22 bp, Artificial Sequence
  chemically synthesized
tgcttggtgctttaaaagataa

SEQ ID NO: 32126 - DNA, 22 bp, Artificial Sequence
  chemically synthesized
gcttggtgctttaaaagataaa

SEQ ID NO: 32127 - DNA, 22 bp, Artificial Sequence
  chemically synthesized
cttggtgctttaaaagataaat

SEQ ID NO: 32128 - DNA, 22 bp, Artificial Sequence
  chemically synthesized
ggtgctttaaaagataaatgac

SEQ ID NO: 32129 - DNA, 22 bp, Artificial Sequence
  chemically synthesized
gtgctttaaaagataaatgact

SEQ ID NO: 32130 - DNA, 22 bp, Artificial Sequence
  chemically synthesized
taaaagataaatgactatgtag

SEQ ID NO: 32131 - DNA, 22 bp, Artificial Sequence
  chemically synthesized
aaaagataaatgactatgtagc

SEQ ID NO: 32132 - DNA, 22 bp, Artificial Sequence
  chemically synthesized
aaagataaatgactatgtagct

SEQ ID NO: 32133 - DNA, 22 bp, Artificial Sequence
  chemically synthesized
tgtagcttaggagatttcttca

SEQ ID NO: 32134 - DNA, 22 bp, Artificial Sequence
  chemically synthesized
aggagatttcttcataattgaa

SEQ ID NO: 32135 - DNA, 22 bp, Artificial Sequence
  chemically synthesized
ggagatttcttcataattgaaa

SEQ ID NO: 32136 - DNA, 22 bp, Artificial Sequence
  chemically synthesized
cttcataattgaaaaccacagc

SEQ ID NO: 32137 - DNA, 22 bp, Artificial Sequence
  chemically synthesized
ttcataattgaaaaccacagca

SEQ ID NO: 32138 - DNA, 22 bp, Artificial Sequence
  chemically synthesized
cataattgaaaaccacagcagc

SEQ ID NO: 32139 - DNA, 22 bp, Artificial Sequence
  chemically synthesized
ataattgaaaaccacagcagct

SEQ ID NO: 32140 - DNA, 22 bp, Artificial Sequence
  chemically synthesized
aaaaccacagcagctgttattt

SEQ ID NO: 32141 - DNA, 22 bp, Artificial Sequence
  chemically synthesized
ttatttgaacatacctgagccc

SEQ ID NO: 32142 - DNA, 22 bp, Artificial Sequence
  chemically synthesized
tttgaacatacctgagcccctt

SEQ ID NO: 32143 - DNA, 22 bp, Artificial Sequence
  chemically synthesized
gaacatacctgagccccttctg

SEQ ID NO: 32144 - DNA, 22 bp, Artificial Sequence
  chemically synthesized
aacatacctgagccccttctgg

SEQ ID NO: 32145 - DNA, 22 bp, Artificial Sequence
  chemically synthesized
agccccttctggaccactgtag

SEQ ID NO: 32146 - DNA, 22 bp, Artificial Sequence
  chemically synthesized
ctggaccactgtaggagaagga

SEQ ID NO: 32147 - DNA, 22 bp, Artificial Sequence
  chemically synthesized
tggaccactgtaggagaaggag

SEQ ID NO: 32148 - DNA, 22 bp, Artificial Sequence
  chemically synthesized
gaccactgtaggagaaggagga

SEQ ID NO: 32149 - DNA, 22 bp, Artificial Sequence
  chemically synthesized
taggagaaggaggaagagaggt

SEQ ID NO: 32150 - DNA, 22 bp, Artificial Sequence
  chemically synthesized
ctgctgctgagggcatgtatga

SEQ ID NO: 32151 - DNA, 22 bp, Artificial Sequence
  chemically synthesized
tgctgctgagggcatgtatgat

SEQ ID NO: 32152 - DNA, 22 bp, Artificial Sequence
  chemically synthesized
ctgctgagggcatgtatgatga

SEQ ID NO: 32153 - DNA, 22 bp, Artificial Sequence
  chemically synthesized
ctgagggcatgtatgatgacaa

SEQ ID NO: 32154 - DNA, 22 bp, Artificial Sequence
  chemically synthesized
agggcatgtatgatgacaatgg

SEQ ID NO: 32155 - DNA, 22 bp, Artificial Sequence
  chemically synthesized
gtcctaactttgacactacaaa

SEQ ID NO: 32156 - DNA, 22 bp, Artificial Sequence
  chemically synthesized
tcctaactttgacactacaaag

SEQ ID NO: 32157 - DNA, 22 bp, Artificial Sequence
  chemically synthesized
actttgacactacaaagtgact

SEQ ID NO: 32158 - DNA, 22 bp, Artificial Sequence
  chemically synthesized
tgacactacaaagtgactggag

SEQ ID NO: 32159 - DNA, 22 bp, Artificial Sequence
  chemically synthesized
gacactacaaagtgactggagc

SEQ ID NO: 32160 - DNA, 22 bp, Artificial Sequence
  chemically synthesized
acactacaaagtgactggagct

SEQ ID NO: 32161 - DNA, 22 bp, Artificial Sequence
  chemically synthesized
caaagtgactggagctttaggc

SEQ ID NO: 32162 - DNA, 22 bp, Artificial Sequence
  chemically synthesized
gagctttaggcaagtagttact

SEQ ID NO: 32163 - DNA, 22 bp, Artificial Sequence
  chemically synthesized
taggcaagtagttactccaatt

SEQ ID NO: 32164 - DNA, 22 bp, Artificial Sequence
  chemically synthesized
aggcaagtagttactccaattg

SEQ ID NO: 32165 - DNA, 22 bp, Artificial Sequence
  chemically synthesized
ggcaagtagttactccaattgt

SEQ ID NO: 32166 - DNA, 22 bp, Artificial Sequence
  chemically synthesized
ctccaattgtcttttcagactc

SEQ ID NO: 32167 - DNA, 22 bp, Artificial Sequence
  chemically synthesized
caattgtcttttcagactcttt

SEQ ID NO: 32168 - DNA, 22 bp, Artificial Sequence
  chemically synthesized
tcttttcagactctttcttttt

SEQ ID NO: 32169 - DNA, 22 bp, Artificial Sequence
  chemically synthesized
ttcagactctttctttttgagg

SEQ ID NO: 32170 - DNA, 22 bp, Artificial Sequence
  chemically synthesized
tcagactctttctttttgaggt

SEQ ID NO: 32171 - DNA, 22 bp, Artificial Sequence
  chemically synthesized
cagactctttctttttgaggta

SEQ ID NO: 32172 - DNA, 22 bp, Artificial Sequence
  chemically synthesized
agactctttctttttgaggtat

SEQ ID NO: 32173 - DNA, 22 bp, Artificial Sequence
  chemically synthesized
tttctttttgaggtatttgacc

SEQ ID NO: 32174 - DNA, 22 bp, Artificial Sequence
  chemically synthesized
tctttttgaggtatttgacctc

SEQ ID NO: 32175 - DNA, 22 bp, Artificial Sequence
  chemically synthesized
ctttttgaggtatttgacctct

SEQ ID NO: 32176 - DNA, 22 bp, Artificial Sequence
  chemically synthesized
tttttgaggtatttgacctctt

SEQ ID NO: 32177 - DNA, 22 bp, Artificial Sequence
  chemically synthesized
tttgaggtatttgacctctttg

SEQ ID NO: 32178 - DNA, 22 bp, Artificial Sequence
  chemically synthesized
ttgaggtatttgacctctttgc

SEQ ID NO: 32179 - DNA, 22 bp, Artificial Sequence
  chemically synthesized
tgaggtatttgacctctttgcg

SEQ ID NO: 32180 - DNA, 22 bp, Artificial Sequence
  chemically synthesized
gaggtatttgacctctttgcgg

SEQ ID NO: 32181 - DNA, 22 bp, Artificial Sequence
  chemically synthesized
aggtatttgacctctttgcggc

SEQ ID NO: 32182 - DNA, 22 bp, Artificial Sequence
  chemically synthesized
gacctctttgcggcatcagcct

SEQ ID NO: 32183 - DNA, 22 bp, Artificial Sequence
  chemically synthesized
acctctttgcggcatcagcctg

SEQ ID NO: 32184 - DNA, 22 bp, Artificial Sequence
  chemically synthesized
tttgcggcatcagcctgctgct

SEQ ID NO: 32185 - DNA, 22 bp, Artificial Sequence
  chemically synthesized
tgcggcatcagcctgctgctat

SEQ ID NO: 32186 - DNA, 22 bp, Artificial Sequence
  chemically synthesized
gcggcatcagcctgctgctatt

SEQ ID NO: 32187 - DNA, 22 bp, Artificial Sequence
  chemically synthesized
cggcatcagcctgctgctattt

SEQ ID NO: 32188 - DNA, 22 bp, Artificial Sequence
  chemically synthesized
ctgctatttcacatgcacctag

SEQ ID NO: 32189 - DNA, 22 bp, Artificial Sequence
  chemically synthesized
ctatttcacatgcacctagaag

SEQ ID NO: 32190 - DNA, 22 bp, Artificial Sequence
  chemically synthesized
tttcacatgcacctagaaggga

SEQ ID NO: 32191 - DNA, 22 bp, Artificial Sequence
  chemically synthesized
cacatgcacctagaagggactt

SEQ ID NO: 32192 - DNA, 22 bp, Artificial Sequence
  chemically synthesized
acatgcacctagaagggacttt

SEQ ID NO: 32193 - DNA, 22 bp, Artificial Sequence
  chemically synthesized
gaagggactttaaaacatgcac

SEQ ID NO: 32194 - DNA, 22 bp, Artificial Sequence
  chemically synthesized
taaaacatgcacagaattgaac

SEQ ID NO: 32195 - DNA, 22 bp, Artificial Sequence
  chemically synthesized
aaaacatgcacagaattgaaca

SEQ ID NO: 32196 - DNA, 22 bp, Artificial Sequence
  chemically synthesized
aaacatgcacagaattgaacaa

SEQ ID NO: 32197 - DNA, 22 bp, Artificial Sequence
  chemically synthesized
aacaaagcagtaaccattcgtt

SEQ ID NO: 32198 - DNA, 22 bp, Artificial Sequence
  chemically synthesized
gttggtgtcccttaacaatatg

SEQ ID NO: 32199 - DNA, 22 bp, Artificial Sequence
  chemically synthesized
gtgtcccttaacaatatgtcaa

SEQ ID NO: 32200 - DNA, 22 bp, Artificial Sequence
  chemically synthesized
aacaatatgtcaaatactatta

SEQ ID NO: 32201 - DNA, 22 bp, Artificial Sequence
  chemically synthesized
acaatatgtcaaatactattat

SEQ ID NO: 32202 - DNA, 22 bp, Artificial Sequence
  chemically synthesized
ttatttttgaaaggtaaataaa

SEQ ID NO: 32203 - DNA, 22 bp, Artificial Sequence
  chemically synthesized
tttttgaaaggtaaataaatcc

SEQ ID NO: 32204 - DNA, 22 bp, Artificial Sequence
  chemically synthesized
ttgaaaggtaaataaatccttg

SEQ ID NO: 32205 - DNA, 22 bp, Artificial Sequence
  chemically synthesized
tgaaaggtaaataaatccttgg

SEQ ID NO: 32206 - DNA, 22 bp, Artificial Sequence
  chemically synthesized
gaaaggtaaataaatccttggg

SEQ ID NO: 32207 - DNA, 22 bp, Artificial Sequence
  chemically synthesized
aaaggtaaataaatccttgggc

SEQ ID NO: 32208 - DNA, 22 bp, Artificial Sequence
  chemically synthesized
gggcttagtggatcctaaatgc

SEQ ID NO: 32209 - DNA, 22 bp, Artificial Sequence
  chemically synthesized
ggcttagtggatcctaaatgct

SEQ ID NO: 32210 - DNA, 22 bp, Artificial Sequence
  chemically synthesized
agtggatcctaaatgctaattt

SEQ ID NO: 32211 - DNA, 22 bp, Artificial Sequence
  chemically synthesized
gtggatcctaaatgctaattta

SEQ ID NO: 32212 - DNA, 22 bp, Artificial Sequence
  chemically synthesized
aatgctaatttaaaaatctgaa

SEQ ID NO: 32213 - DNA, 22 bp, Artificial Sequence
  chemically synthesized
atttaaaaatctgaactcattt

SEQ ID NO: 32214 - DNA, 22 bp, Artificial Sequence
  chemically synthesized
aaaaatctgaactcatttccat

SEQ ID NO: 32215 - DNA, 22 bp, Artificial Sequence
  chemically synthesized
aaaatctgaactcatttccatc

SEQ ID NO: 32216 - DNA, 22 bp, Artificial Sequence
  chemically synthesized
aactcatttccatcccttatta

SEQ ID NO: 32217 - DNA, 22 bp, Artificial Sequence
  chemically synthesized
atttccatcccttattacttta

SEQ ID NO: 32218 - DNA, 22 bp, Artificial Sequence
  chemically synthesized
ccatcccttattactttaaaca

SEQ ID NO: 32219 - DNA, 22 bp, Artificial Sequence
  chemically synthesized
catcccttattactttaaacaa

SEQ ID NO: 32220 - DNA, 22 bp, Artificial Sequence
  chemically synthesized
attactttaaacaaattgctaa

SEQ ID NO: 32221 - DNA, 22 bp, Artificial Sequence
  chemically synthesized
ttactttaaacaaattgctaac

SEQ ID NO: 32222 - DNA, 22 bp, Artificial Sequence
  chemically synthesized
ctttaaacaaattgctaacctg

SEQ ID NO: 32223 - DNA, 22 bp, Artificial Sequence
  chemically synthesized
taaacaaattgctaacctgaat

SEQ ID NO: 32224 - DNA, 22 bp, Artificial Sequence
  chemically synthesized
aaacaaattgctaacctgaatg

SEQ ID NO: 32225 - DNA, 22 bp, Artificial Sequence
  chemically synthesized
aacaaattgctaacctgaatga

SEQ ID NO: 32226 - DNA, 22 bp, Artificial Sequence
  chemically synthesized
ctaacctgaatgataatagaaa

SEQ ID NO: 32227 - DNA, 22 bp, Artificial Sequence
  chemically synthesized
acctgaatgataatagaaactt

SEQ ID NO: 32228 - DNA, 22 bp, Artificial Sequence
  chemically synthesized
aatgataatagaaacttttttc

SEQ ID NO: 32229 - DNA, 22 bp, Artificial Sequence
  chemically synthesized
ttttccttttaacagttggagg

SEQ ID NO: 32230 - DNA, 22 bp, Artificial Sequence
  chemically synthesized
tttccttttaacagttggaggc

SEQ ID NO: 32231 - DNA, 22 bp, Artificial Sequence
  chemically synthesized
ttccttttaacagttggaggca

SEQ ID NO: 32232 - DNA, 22 bp, Artificial Sequence
  chemically synthesized
tccttttaacagttggaggcat

SEQ ID NO: 32233 - DNA, 22 bp, Artificial Sequence
  chemically synthesized
ccttttaacagttggaggcatc

SEQ ID NO: 32234 - DNA, 22 bp, Artificial Sequence
  chemically synthesized
cttttaacagttggaggcatct

SEQ ID NO: 32235 - DNA, 22 bp, Artificial Sequence
  chemically synthesized
ttaacagttggaggcatctata

SEQ ID NO: 32236 - DNA, 22 bp, Artificial Sequence
  chemically synthesized
taacagttggaggcatctatac

SEQ ID NO: 32237 - DNA, 22 bp, Artificial Sequence
  chemically synthesized
aacagttggaggcatctatact

SEQ ID NO: 32238 - DNA, 22 bp, Artificial Sequence
  chemically synthesized
acagttggaggcatctatactg

SEQ ID NO: 32239 - DNA, 22 bp, Artificial Sequence
  chemically synthesized
gaggcatctatactgtgattca

SEQ ID NO: 32240 - DNA, 22 bp, Artificial Sequence
  chemically synthesized
tactgtgattcagacaaaggcc

SEQ ID NO: 32241 - DNA, 22 bp, Artificial Sequence
  chemically synthesized
tgattcagacaaaggccaaaac

SEQ ID NO: 32242 - DNA, 22 bp, Artificial Sequence
  chemically synthesized
agacaaaggccaaaacaacagc

SEQ ID NO: 32243 - DNA, 22 bp, Artificial Sequence
  chemically synthesized
ttttctgataggtccatatttt

SEQ ID NO: 32244 - DNA, 22 bp, Artificial Sequence
  chemically synthesized
tctgataggtccatattttgag

SEQ ID NO: 32245 - DNA, 22 bp, Artificial Sequence
  chemically synthesized
ctgataggtccatattttgagc

SEQ ID NO: 32246 - DNA, 22 bp, Artificial Sequence
  chemically synthesized
tgataggtccatattttgagca

SEQ ID NO: 32247 - DNA, 22 bp, Artificial Sequence
  chemically synthesized
ataggtccatattttgagcata

SEQ ID NO: 32248 - DNA, 22 bp, Artificial Sequence
  chemically synthesized
tgagcataatatgaagactcag

SEQ ID NO: 32249 - DNA, 22 bp, Artificial Sequence
  chemically synthesized
gagcataatatgaagactcagg

SEQ ID NO: 32250 - DNA, 22 bp, Artificial Sequence
  chemically synthesized
agcataatatgaagactcaggt

SEQ ID NO: 32251 - DNA, 22 bp, Artificial Sequence
  chemically synthesized
aggtggaacagtgtgaacctgt

SEQ ID NO: 32252 - DNA, 22 bp, Artificial Sequence
  chemically synthesized
taaatgatgctgtcagaagagc

SEQ ID NO: 32253 - DNA, 22 bp, Artificial Sequence
  chemically synthesized
tcagaagagcagtggacgcaat

SEQ ID NO: 32254 - DNA, 20 bp, Artificial Sequence
  chemically synthesized
tgtccttctggcagggaacc

SEQ ID NO: 32255 - DNA, 20 bp, Artificial Sequence
  chemically synthesized
gtccttctggcagggaacct

SEQ ID NO: 32256 - DNA, 20 bp, Artificial Sequence
  chemically synthesized
cttctggcagggaacctggg

SEQ ID NO: 32257 - DNA, 20 bp, Artificial Sequence
  chemically synthesized
tggcagggaacctgggcagc

SEQ ID NO: 32258 - DNA, 20 bp, Artificial Sequence
  chemically synthesized
ggcagggaacctgggcagcg

SEQ ID NO: 32259 - DNA, 20 bp, Artificial Sequence
  chemically synthesized
tgggcagcgaggatcctctg

SEQ ID NO: 32260 - DNA, 20 bp, Artificial Sequence
  chemically synthesized
agaacactcattcccaaatc

SEQ ID NO: 32261 - DNA, 20 bp, Artificial Sequence
  chemically synthesized
ccaaatccagaaatgtactg

SEQ ID NO: 32262 - DNA, 20 bp, Artificial Sequence
  chemically synthesized
caaatccagaaatgtactgt

SEQ ID NO: 32263 - DNA, 20 bp, Artificial Sequence
  chemically synthesized
gaaatgtactgtaggtgaca

SEQ ID NO: 32264 - DNA, 20 bp, Artificial Sequence
  chemically synthesized
aaagacacaaatgccaccat

SEQ ID NO: 32265 - DNA, 20 bp, Artificial Sequence
  chemically synthesized
gacacaaatgccaccattag

SEQ ID NO: 32266 - DNA, 20 bp, Artificial Sequence
  chemically synthesized
acacaaatgccaccattagc

SEQ ID NO: 32267 - DNA, 20 bp, Artificial Sequence
  chemically synthesized
gccaccattagcaggattta

SEQ ID NO: 32268 - DNA, 20 bp, Artificial Sequence
  chemically synthesized
caccattagcaggatttaaa

SEQ ID NO: 32269 - DNA, 20 bp, Artificial Sequence
  chemically synthesized
gcaggatttaaagagcattt

SEQ ID NO: 32270 - DNA, 20 bp, Artificial Sequence
  chemically synthesized
taaagagcatttcagaaaat

SEQ ID NO: 32271 - DNA, 20 bp, Artificial Sequence
  chemically synthesized
agagcatttcagaaaattgg

SEQ ID NO: 32272 - DNA, 20 bp, Artificial Sequence
  chemically synthesized
cagaaaattggcagtttact

SEQ ID NO: 32273 - DNA, 20 bp, Artificial Sequence
  chemically synthesized
agaaaattggcagtttacta

SEQ ID NO: 32274 - DNA, 20 bp, Artificial Sequence
  chemically synthesized
aattggcagtttactaaggt

SEQ ID NO: 32275 - DNA, 20 bp, Artificial Sequence
  chemically synthesized
ctaaggtaagaatttctata

SEQ ID NO: 32276 - DNA, 20 bp, Artificial Sequence
  chemically synthesized
gtcttgacatatgaatcatt

SEQ ID NO: 32277 - DNA, 20 bp, Artificial Sequence
  chemically synthesized
tcttgacatatgaatcattt

SEQ ID NO: 32278 - DNA, 20 bp, Artificial Sequence
  chemically synthesized
cttgacatatgaatcattta

SEQ ID NO: 32279 - DNA, 20 bp, Artificial Sequence
  chemically synthesized
gacatatgaatcatttaggg

SEQ ID NO: 32280 - DNA, 20 bp, Artificial Sequence
  chemically synthesized
atcatttagggaagacaata

SEQ ID NO: 32281 - DNA, 20 bp, Artificial Sequence
  chemically synthesized
tatggtttctgtgaatttta

SEQ ID NO: 32282 - DNA, 20 bp, Artificial Sequence
  chemically synthesized
tttaaagacttctaattaat

SEQ ID NO: 32283 - DNA, 20 bp, Artificial Sequence
  chemically synthesized
aaagacttctaattaatcag

SEQ ID NO: 32284 - DNA, 20 bp, Artificial Sequence
  chemically synthesized
agacttctaattaatcagaa

SEQ ID NO: 32285 - DNA, 20 bp, Artificial Sequence
  chemically synthesized
ctaattaatcagaagagtgc

SEQ ID NO: 32286 - DNA, 20 bp, Artificial Sequence
  chemically synthesized
gaagagtgctggatattgca

SEQ ID NO: 32287 - DNA, 20 bp, Artificial Sequence
  chemically synthesized
tgcatagacttctccaccct

SEQ ID NO: 32288 - DNA, 20 bp, Artificial Sequence
  chemically synthesized
tctccacccttagctgtact

SEQ ID NO: 32289 - DNA, 20 bp, Artificial Sequence
  chemically synthesized
agctgtacttagctgatttg

SEQ ID NO: 32290 - DNA, 20 bp, Artificial Sequence
  chemically synthesized
gctgtacttagctgatttgt

SEQ ID NO: 32291 - DNA, 20 bp, Artificial Sequence
  chemically synthesized
actgtaacctccctgaactt

SEQ ID NO: 32292 - DNA, 20 bp, Artificial Sequence
  chemically synthesized
tccatttccctttcaaactc

SEQ ID NO: 32293 - DNA, 20 bp, Artificial Sequence
  chemically synthesized
ccatttccctttcaaactct

SEQ ID NO: 32294 - DNA, 20 bp, Artificial Sequence
  chemically synthesized
tttcaaactctgggaaaaaa

SEQ ID NO: 32295 - DNA, 20 bp, Artificial Sequence
  chemically synthesized
actctgggaaaaaaaagaaa

SEQ ID NO: 32296 - DNA, 20 bp, Artificial Sequence
  chemically synthesized
aaaaagaaaaagcatctatg

SEQ ID NO: 32297 - DNA, 20 bp, Artificial Sequence
  chemically synthesized
aaagaaaaagcatctatgaa

SEQ ID NO: 32298 - DNA, 20 bp, Artificial Sequence
  chemically synthesized
aagaaaaagcatctatgaag

SEQ ID NO: 32299 - DNA, 20 bp, Artificial Sequence
  chemically synthesized
agcatctatgaagaggtgtg

SEQ ID NO: 32300 - DNA, 20 bp, Artificial Sequence
  chemically synthesized
gcatctatgaagaggtgtgt

SEQ ID NO: 32301 - DNA, 20 bp, Artificial Sequence
  chemically synthesized
gtgtgtgggtccaaccctga

SEQ ID NO: 32302 - DNA, 20 bp, Artificial Sequence
  chemically synthesized
cagcaaaaccctctccaaac

SEQ ID NO: 32303 - DNA, 20 bp, Artificial Sequence
  chemically synthesized
tctccaaactagccttgctg

SEQ ID NO: 32304 - DNA, 20 bp, Artificial Sequence
  chemically synthesized
ctccaaactagccttgctgt

SEQ ID NO: 32305 - DNA, 20 bp, Artificial Sequence
  chemically synthesized
caaactagccttgctgtagg

SEQ ID NO: 32306 - DNA, 20 bp, Artificial Sequence
  chemically synthesized
actagccttgctgtaggcag

SEQ ID NO: 32307 - DNA, 20 bp, Artificial Sequence
  chemically synthesized
tctgctatctgcctcatcta

SEQ ID NO: 32308 - DNA, 20 bp, Artificial Sequence
  chemically synthesized
tgtgcgaatgcatgaaaata

SEQ ID NO: 32309 - DNA, 20 bp, Artificial Sequence
  chemically synthesized
atgcatgaaaataaagttta

SEQ ID NO: 32310 - DNA, 20 bp, Artificial Sequence
  chemically synthesized
gaaaataaagtttaaagata

SEQ ID NO: 32311 - DNA, 20 bp, Artificial Sequence
  chemically synthesized
aaaataaagtttaaagatat

SEQ ID NO: 32312 - DNA, 20 bp, Artificial Sequence
  chemically synthesized
ataaagtttaaagatatggg

SEQ ID NO: 32313 - DNA, 20 bp, Artificial Sequence
  chemically synthesized
ttaaagatatgggtggcctt

SEQ ID NO: 32314 - DNA, 20 bp, Artificial Sequence
  chemically synthesized
taaagatatgggtggccttc

SEQ ID NO: 32315 - DNA, 20 bp, Artificial Sequence
  chemically synthesized
aagatatgggtggccttcag

SEQ ID NO: 32316 - DNA, 20 bp, Artificial Sequence
  chemically synthesized
gtggccttcaggagacacgc

SEQ ID NO: 32317 - DNA, 20 bp, Artificial Sequence
  chemically synthesized
cttcaggagacacgccagcc

SEQ ID NO: 32318 - DNA, 20 bp, Artificial Sequence
  chemically synthesized
atcttttcacaatgacacaa

SEQ ID NO: 32319 - DNA, 20 bp, Artificial Sequence
  chemically synthesized
ccatctcttcactttacacc

SEQ ID NO: 32320 - DNA, 20 bp, Artificial Sequence
  chemically synthesized
atctcttcactttacaccca

SEQ ID NO: 32321 - DNA, 20 bp, Artificial Sequence
  chemically synthesized
tctcttcactttacacccag

SEQ ID NO: 32322 - DNA, 20 bp, Artificial Sequence
  chemically synthesized
ttacacccagaggaaaaaaa

SEQ ID NO: 32323 - DNA, 20 bp, Artificial Sequence
  chemically synthesized
ccagaggaaaaaaaaagtta

SEQ ID NO: 32324 - DNA, 20 bp, Artificial Sequence
  chemically synthesized
cagaggaaaaaaaaagttaa

SEQ ID NO: 32325 - DNA, 20 bp, Artificial Sequence
  chemically synthesized
agaggaaaaaaaaagttaaa

SEQ ID NO: 32326 - DNA, 20 bp, Artificial Sequence
  chemically synthesized
aagttaaagggtttctcaac

SEQ ID NO: 32327 - DNA, 20 bp, Artificial Sequence
  chemically synthesized
agttaaagggtttctcaacc

SEQ ID NO: 32328 - DNA, 20 bp, Artificial Sequence
  chemically synthesized
aaagggtttctcaaccaggt

SEQ ID NO: 32329 - DNA, 20 bp, Artificial Sequence
  chemically synthesized
tttctcaaccaggtaagtca

SEQ ID NO: 32330 - DNA, 20 bp, Artificial Sequence
  chemically synthesized
tctcaaccaggtaagtcatg

SEQ ID NO: 32331 - DNA, 20 bp, Artificial Sequence
  chemically synthesized
tcaaccaggtaagtcatgga

SEQ ID NO: 32332 - DNA, 20 bp, Artificial Sequence
  chemically synthesized
gcaacactcaacacacttgt

SEQ ID NO: 32333 - DNA, 20 bp, Artificial Sequence
  chemically synthesized
gtgagttcttgtgcactgtc

SEQ ID NO: 32334 - DNA, 20 bp, Artificial Sequence
  chemically synthesized
gcactgtctggcttttttgc

SEQ ID NO: 32335 - DNA, 20 bp, Artificial Sequence
  chemically synthesized
tggcttttttgctagcctat

SEQ ID NO: 32336 - DNA, 20 bp, Artificial Sequence
  chemically synthesized
gctagcctataagctgcatg

SEQ ID NO: 32337 - DNA, 20 bp, Artificial Sequence
  chemically synthesized
ctagcctataagctgcatga

SEQ ID NO: 32338 - DNA, 20 bp, Artificial Sequence
  chemically synthesized
ctataagctgcatgaaggct

SEQ ID NO: 32339 - DNA, 20 bp, Artificial Sequence
  chemically synthesized
ctgcatgaaggctgagacta

SEQ ID NO: 32340 - DNA, 20 bp, Artificial Sequence
  chemically synthesized
catgaaggctgagactatgg

SEQ ID NO: 32341 - DNA, 20 bp, Artificial Sequence
  chemically synthesized
ggctgagactatggcagtct

SEQ ID NO: 32342 - DNA, 20 bp, Artificial Sequence
  chemically synthesized
actatggcagtcttggctca

SEQ ID NO: 32343 - DNA, 20 bp, Artificial Sequence
  chemically synthesized
atggcagtcttggctcatag

SEQ ID NO: 32344 - DNA, 20 bp, Artificial Sequence
  chemically synthesized
tggcagtcttggctcataga

SEQ ID NO: 32345 - DNA, 20 bp, Artificial Sequence
  chemically synthesized
cttggctcatagaaggtaat

SEQ ID NO: 32346 - DNA, 20 bp, Artificial Sequence
  chemically synthesized
ggctcatagaaggtaatcag

SEQ ID NO: 32347 - DNA, 20 bp, Artificial Sequence
  chemically synthesized
ttgattgaatttttccctta

SEQ ID NO: 32348 - DNA, 20 bp, Artificial Sequence
  chemically synthesized
cttaaagccaattctaatgt

SEQ ID NO: 32349 - DNA, 20 bp, Artificial Sequence
  chemically synthesized
tgtatgtgtgctgctgtaaa

SEQ ID NO: 32350 - DNA, 20 bp, Artificial Sequence
  chemically synthesized
gtatgtgtgctgctgtaaat

SEQ ID NO: 32351 - DNA, 20 bp, Artificial Sequence
  chemically synthesized
tatgtgtgctgctgtaaata

SEQ ID NO: 32352 - DNA, 20 bp, Artificial Sequence
  chemically synthesized
tgtgctgctgtaaatagggt

SEQ ID NO: 32353 - DNA, 20 bp, Artificial Sequence
  chemically synthesized
acttaaataccaattgattt

SEQ ID NO: 32354 - DNA, 20 bp, Artificial Sequence
  chemically synthesized
aataccaattgattttagcc

SEQ ID NO: 32355 - DNA, 20 bp, Artificial Sequence
  chemically synthesized
ataccaattgattttagccc

SEQ ID NO: 32356 - DNA, 20 bp, Artificial Sequence
  chemically synthesized
agcccaggataatgaaaatg

SEQ ID NO: 32357 - DNA, 20 bp, Artificial Sequence
  chemically synthesized
aatgaaaatgcagtcttgct

SEQ ID NO: 32358 - DNA, 20 bp, Artificial Sequence
  chemically synthesized
aaaatgcagtcttgctcagc

SEQ ID NO: 32359 - DNA, 20 bp, Artificial Sequence
  chemically synthesized
gaaatgtaaccatctgaaca

SEQ ID NO: 32360 - DNA, 20 bp, Artificial Sequence
  chemically synthesized
ccatctgaacacagctcctt

SEQ ID NO: 32361 - DNA, 20 bp, Artificial Sequence
  chemically synthesized
atctgaacacagctccttaa

SEQ ID NO: 32362 - DNA, 20 bp, Artificial Sequence
  chemically synthesized
cacagctccttaagagatat

SEQ ID NO: 32363 - DNA, 20 bp, Artificial Sequence
  chemically synthesized
agctccttaagagatataag

SEQ ID NO: 32364 - DNA, 20 bp, Artificial Sequence
  chemically synthesized
gctccttaagagatataaga

SEQ ID NO: 32365 - DNA, 20 bp, Artificial Sequence
  chemically synthesized
ctccttaagagatataagaa

SEQ ID NO: 32366 - DNA, 20 bp, Artificial Sequence
  chemically synthesized
cttaagagatataagaaggg

SEQ ID NO: 32367 - DNA, 20 bp, Artificial Sequence
  chemically synthesized
aagagatataagaagggtgg

SEQ ID NO: 32368 - DNA, 20 bp, Artificial Sequence
  chemically synthesized
agatataagaagggtggaag

SEQ ID NO: 32369 - DNA, 20 bp, Artificial Sequence
  chemically synthesized
gatataagaagggtggaagt

SEQ ID NO: 32370 - DNA, 20 bp, Artificial Sequence
  chemically synthesized
aagaagggtggaagtgggtg

SEQ ID NO: 32371 - DNA, 20 bp, Artificial Sequence
  chemically synthesized
agaagggtggaagtgggtga

SEQ ID NO: 32372 - DNA, 20 bp, Artificial Sequence
  chemically synthesized
gaagggtggaagtgggtgaa

SEQ ID NO: 32373 - DNA, 20 bp, Artificial Sequence
  chemically synthesized
gggtggaagtgggtgaaggg

SEQ ID NO: 32374 - DNA, 20 bp, Artificial Sequence
  chemically synthesized
ggtggaagtgggtgaagggt

SEQ ID NO: 32375 - DNA, 20 bp, Artificial Sequence
  chemically synthesized
tgggtgaagggtaggccctc

SEQ ID NO: 32376 - DNA, 20 bp, Artificial Sequence
  chemically synthesized
ggtgaagggtaggccctcca

SEQ ID NO: 32377 - DNA, 20 bp, Artificial Sequence
  chemically synthesized
ggtaggccctccagagttct

SEQ ID NO: 32378 - DNA, 20 bp, Artificial Sequence
  chemically synthesized
tccagagttctcagttgttg

SEQ ID NO: 32379 - DNA, 20 bp, Artificial Sequence
  chemically synthesized
ccagagttctcagttgttgc

SEQ ID NO: 32380 - DNA, 20 bp, Artificial Sequence
  chemically synthesized
gagttctcagttgttgcggg

SEQ ID NO: 32381 - DNA, 20 bp, Artificial Sequence
  chemically synthesized
ctcagttgttgcgggaagtc

SEQ ID NO: 32382 - DNA, 20 bp, Artificial Sequence
  chemically synthesized
tcagttgttgcgggaagtct

SEQ ID NO: 32383 - DNA, 20 bp, Artificial Sequence
  chemically synthesized
gggaagtctgggactccaaa

SEQ ID NO: 32384 - DNA, 20 bp, Artificial Sequence
  chemically synthesized
gaagtctgggactccaaacg

SEQ ID NO: 32385 - DNA, 20 bp, Artificial Sequence
  chemically synthesized
aagtctgggactccaaacgg

SEQ ID NO: 32386 - DNA, 20 bp, Artificial Sequence
  chemically synthesized
agtctgggactccaaacgga

SEQ ID NO: 32387 - DNA, 20 bp, Artificial Sequence
  chemically synthesized
gggactccaaacggagggat

SEQ ID NO: 32388 - DNA, 20 bp, Artificial Sequence
  chemically synthesized
ccaaacggagggatcagctg

SEQ ID NO: 32389 - DNA, 20 bp, Artificial Sequence
  chemically synthesized
ggagggatcagctgaagcca

SEQ ID NO: 32390 - DNA, 20 bp, Artificial Sequence
  chemically synthesized
gggatcagctgaagccatgg

SEQ ID NO: 32391 - DNA, 20 bp, Artificial Sequence
  chemically synthesized
atcagctgaagccatggcag

SEQ ID NO: 32392 - DNA, 20 bp, Artificial Sequence
  chemically synthesized
gaagccatggcagaagttcg

SEQ ID NO: 32393 - DNA, 20 bp, Artificial Sequence
  chemically synthesized
gcagaagttcgtggattgtg

SEQ ID NO: 32394 - DNA, 20 bp, Artificial Sequence
  chemically synthesized
cgtggattgtgaagatttca

SEQ ID NO: 32395 - DNA, 20 bp, Artificial Sequence
  chemically synthesized
aagatttcatggacatttat

SEQ ID NO: 32396 - DNA, 20 bp, Artificial Sequence
  chemically synthesized
atctctaaacataaattgta

SEQ ID NO: 32397 - DNA, 20 bp, Artificial Sequence
  chemically synthesized
cataaattgtaaagatttca

SEQ ID NO: 32398 - DNA, 20 bp, Artificial Sequence
  chemically synthesized
atggacacttatcacttccc

SEQ ID NO: 32399 - DNA, 20 bp, Artificial Sequence
  chemically synthesized
ctttaatctcttaatcctgt

SEQ ID NO: 32400 - DNA, 20 bp, Artificial Sequence
  chemically synthesized
atctcttaatcctgtcagct

SEQ ID NO: 32401 - DNA, 20 bp, Artificial Sequence
  chemically synthesized
tctcttaatcctgtcagctg

SEQ ID NO: 32402 - DNA, 20 bp, Artificial Sequence
  chemically synthesized
tcttaatcctgtcagctgag

SEQ ID NO: 32403 - DNA, 20 bp, Artificial Sequence
  chemically synthesized
cttaatcctgtcagctgagg

SEQ ID NO: 32404 - DNA, 20 bp, Artificial Sequence
  chemically synthesized
gaggaggatgtatattgcct

SEQ ID NO: 32405 - DNA, 20 bp, Artificial Sequence
  chemically synthesized
aggaggatgtatattgcctc

SEQ ID NO: 32406 - DNA, 20 bp, Artificial Sequence
  chemically synthesized
cattaactgcacaaattgta

SEQ ID NO: 32407 - DNA, 20 bp, Artificial Sequence
  chemically synthesized
attgtacagcatgtgtgttt

SEQ ID NO: 32408 - DNA, 20 bp, Artificial Sequence
  chemically synthesized
tgtttgagcaacatgaaatg

SEQ ID NO: 32409 - DNA, 20 bp, Artificial Sequence
  chemically synthesized
aaatgtggacaccttgaaaa

SEQ ID NO: 32410 - DNA, 20 bp, Artificial Sequence
  chemically synthesized
tggacaccttgaaaaaagaa

SEQ ID NO: 32411 - DNA, 20 bp, Artificial Sequence
  chemically synthesized
ggacaccttgaaaaaagaac

SEQ ID NO: 32412 - DNA, 20 bp, Artificial Sequence
  chemically synthesized
ttgaaaaaagaacaggataa

SEQ ID NO: 32413 - DNA, 20 bp, Artificial Sequence
  chemically synthesized
acaggataacagcaattgtt

SEQ ID NO: 32414 - DNA, 20 bp, Artificial Sequence
  chemically synthesized
caggataacagcaattgttc

SEQ ID NO: 32415 - DNA, 20 bp, Artificial Sequence
  chemically synthesized
aggataacagcaattgttca

SEQ ID NO: 32416 - DNA, 20 bp, Artificial Sequence
  chemically synthesized
acagcaattgttcagggaat

SEQ ID NO: 32417 - DNA, 20 bp, Artificial Sequence
  chemically synthesized
agcaattgttcagggaataa

SEQ ID NO: 32418 - DNA, 20 bp, Artificial Sequence
  chemically synthesized
caattgttcagggaataaga

SEQ ID NO: 32419 - DNA, 20 bp, Artificial Sequence
  chemically synthesized
taaccttaaactctgactgc

SEQ ID NO: 32420 - DNA, 20 bp, Artificial Sequence
  chemically synthesized
cttaaactctgactgctggt

SEQ ID NO: 32421 - DNA, 20 bp, Artificial Sequence
  chemically synthesized
aactctgactgctggtgagc

SEQ ID NO: 32422 - DNA, 20 bp, Artificial Sequence
  chemically synthesized
actctgactgctggtgagcc

SEQ ID NO: 32423 - DNA, 20 bp, Artificial Sequence
  chemically synthesized
ctgactgctggtgagccagg

SEQ ID NO: 32424 - DNA, 20 bp, Artificial Sequence
  chemically synthesized
tgctggtgagccaggcagaa

SEQ ID NO: 32425 - DNA, 20 bp, Artificial Sequence
  chemically synthesized
ctggtgagccaggcagaaca

SEQ ID NO: 32426 - DNA, 20 bp, Artificial Sequence
  chemically synthesized
ccatatttctcttctttcaa

SEQ ID NO: 32427 - DNA, 20 bp, Artificial Sequence
  chemically synthesized
tctcttctttcaaaagcaaa

SEQ ID NO: 32428 - DNA, 20 bp, Artificial Sequence
  chemically synthesized
ctcttctttcaaaagcaaat

SEQ ID NO: 32429 - DNA, 20 bp, Artificial Sequence
  chemically synthesized
cttctttcaaaagcaaatgg

SEQ ID NO: 32430 - DNA, 20 bp, Artificial Sequence
  chemically synthesized
tatcgctgaattctttttct

SEQ ID NO: 32431 - DNA, 20 bp, Artificial Sequence
  chemically synthesized
ctgaattctttttctcagca

SEQ ID NO: 32432 - DNA, 20 bp, Artificial Sequence
  chemically synthesized
tctcagcatggaacatccct

SEQ ID NO: 32433 - DNA, 20 bp, Artificial Sequence
  chemically synthesized
agcatggaacatccctgaga

SEQ ID NO: 32434 - DNA, 20 bp, Artificial Sequence
  chemically synthesized
catggaacatccctgagaaa

SEQ ID NO: 32435 - DNA, 20 bp, Artificial Sequence
  chemically synthesized
atccctgagaaagagaatac

SEQ ID NO: 32436 - DNA, 20 bp, Artificial Sequence
  chemically synthesized
ctgagaaagagaatacgagc

SEQ ID NO: 32437 - DNA, 20 bp, Artificial Sequence
  chemically synthesized
tgagaaagagaatacgagcc

SEQ ID NO: 32438 - DNA, 20 bp, Artificial Sequence
  chemically synthesized
agaaagagaatacgagccag

SEQ ID NO: 32439 - DNA, 20 bp, Artificial Sequence
  chemically synthesized
gaaagagaatacgagccagg

SEQ ID NO: 32440 - DNA, 20 bp, Artificial Sequence
  chemically synthesized
agaatacgagccaggaggta

SEQ ID NO: 32441 - DNA, 20 bp, Artificial Sequence
  chemically synthesized
gaatacgagccaggaggtat

SEQ ID NO: 32442 - DNA, 20 bp, Artificial Sequence
  chemically synthesized
aggaggtataggcttataaa

SEQ ID NO: 32443 - DNA, 20 bp, Artificial Sequence
  chemically synthesized
gcttataaacagcccccctc

SEQ ID NO: 32444 - DNA, 20 bp, Artificial Sequence
  chemically synthesized
cttataaacagcccccctcc

SEQ ID NO: 32445 - DNA, 20 bp, Artificial Sequence
  chemically synthesized
ccaggtgcgcctgtctctta

SEQ ID NO: 32446 - DNA, 20 bp, Artificial Sequence
  chemically synthesized
tgcgcctgtctcttatggtc

SEQ ID NO: 32447 - DNA, 20 bp, Artificial Sequence
  chemically synthesized
gtctcttatggtcgagactg

SEQ ID NO: 32448 - DNA, 20 bp, Artificial Sequence
  chemically synthesized
tctcttatggtcgagactgc

SEQ ID NO: 32449 - DNA, 20 bp, Artificial Sequence
  chemically synthesized
ctcttatggtcgagactgca

SEQ ID NO: 32450 - DNA, 20 bp, Artificial Sequence
  chemically synthesized
tcttatggtcgagactgcag

SEQ ID NO: 32451 - DNA, 20 bp, Artificial Sequence
  chemically synthesized
tcgagactgcaggggtgaaa

SEQ ID NO: 32452 - DNA, 20 bp, Artificial Sequence
  chemically synthesized
tgcaggggtgaaatagaccc

SEQ ID NO: 32453 - DNA, 20 bp, Artificial Sequence
  chemically synthesized
aaatagaccccagtctccca

SEQ ID NO: 32454 - DNA, 20 bp, Artificial Sequence
  chemically synthesized
ccagtctcccacagcgctcc

SEQ ID NO: 32455 - DNA, 20 bp, Artificial Sequence
  chemically synthesized
cagtctcccacagcgctccc

SEQ ID NO: 32456 - DNA, 20 bp, Artificial Sequence
  chemically synthesized
cacagcgctcccaggcttat

SEQ ID NO: 32457 - DNA, 20 bp, Artificial Sequence
  chemically synthesized
acagcgctcccaggcttatt

SEQ ID NO: 32458 - DNA, 20 bp, Artificial Sequence
  chemically synthesized
gcgctcccaggcttattagg

SEQ ID NO: 32459 - DNA, 20 bp, Artificial Sequence
  chemically synthesized
gctcccaggcttattaggaa

SEQ ID NO: 32460 - DNA, 20 bp, Artificial Sequence
  chemically synthesized
ctcccaggcttattaggaag

SEQ ID NO: 32461 - DNA, 20 bp, Artificial Sequence
  chemically synthesized
aattcccgcctaataaattt

SEQ ID NO: 32462 - DNA, 20 bp, Artificial Sequence
  chemically synthesized
cccgcctaataaattttggt

SEQ ID NO: 32463 - DNA, 20 bp, Artificial Sequence
  chemically synthesized
ctaataaattttggtcagac

SEQ ID NO: 32464 - DNA, 20 bp, Artificial Sequence
  chemically synthesized
taaaaaccctgtctcctgat

SEQ ID NO: 32465 - DNA, 20 bp, Artificial Sequence
  chemically synthesized
taagatgttatcaatgacaa

SEQ ID NO: 32466 - DNA, 20 bp, Artificial Sequence
  chemically synthesized
aatggtgcccgaaacttcat

SEQ ID NO: 32467 - DNA, 20 bp, Artificial Sequence
  chemically synthesized
tagcaattttaatttcgcct

SEQ ID NO: 32468 - DNA, 20 bp, Artificial Sequence
  chemically synthesized
ttaatttcgcctcggtcctg

SEQ ID NO: 32469 - DNA, 20 bp, Artificial Sequence
  chemically synthesized
tgatattctattaccttgta

SEQ ID NO: 32470 - DNA, 20 bp, Artificial Sequence
  chemically synthesized
aatccctaatacaaacttgc

SEQ ID NO: 32471 - DNA, 20 bp, Artificial Sequence
  chemically synthesized
tacaaacttgctggtttttg

SEQ ID NO: 32472 - DNA, 20 bp, Artificial Sequence
  chemically synthesized
ttgctggtttttgtggcttg

SEQ ID NO: 32473 - DNA, 20 bp, Artificial Sequence
  chemically synthesized
tgctggtttttgtggcttgt

SEQ ID NO: 32474 - DNA, 20 bp, Artificial Sequence
  chemically synthesized
gctggtttttgtggcttgtg

SEQ ID NO: 32475 - DNA, 20 bp, Artificial Sequence
  chemically synthesized
ttgtggcttgtggggcatca

SEQ ID NO: 32476 - DNA, 20 bp, Artificial Sequence
  chemically synthesized
ccgaaatgtgatgcctcccc

SEQ ID NO: 32477 - DNA, 20 bp, Artificial Sequence
  chemically synthesized
tgatgcctcccccggatgcc

SEQ ID NO: 32478 - DNA, 20 bp, Artificial Sequence
  chemically synthesized
actctgtccctttatttcta

SEQ ID NO: 32479 - DNA, 20 bp, Artificial Sequence
  chemically synthesized
tgtccctttatttctaaagt

SEQ ID NO: 32480 - DNA, 20 bp, Artificial Sequence
  chemically synthesized
ttctaaagttggccgacgct

SEQ ID NO: 32481 - DNA, 20 bp, Artificial Sequence
  chemically synthesized
tctaaagttggccgacgctt

SEQ ID NO: 32482 - DNA, 20 bp, Artificial Sequence
  chemically synthesized
ctaaagttggccgacgctta

SEQ ID NO: 32483 - DNA, 20 bp, Artificial Sequence
  chemically synthesized
tggccgacgcttagggaaaa

SEQ ID NO: 32484 - DNA, 20 bp, Artificial Sequence
  chemically synthesized
gacgcttagggaaaatagaa

SEQ ID NO: 32485 - DNA, 20 bp, Artificial Sequence
  chemically synthesized
aaaagaacctacgtgaatat

SEQ ID NO: 32486 - DNA, 20 bp, Artificial Sequence
  chemically synthesized
aaagaacctacgtgaatatt

SEQ ID NO: 32487 - DNA, 20 bp, Artificial Sequence
  chemically synthesized
aagaacctacgtgaatattg

SEQ ID NO: 32488 - DNA, 20 bp, Artificial Sequence
  chemically synthesized
aacctacgtgaatattgggg

SEQ ID NO: 32489 - DNA, 20 bp, Artificial Sequence
  chemically synthesized
acctacgtgaatattggggc

SEQ ID NO: 32490 - DNA, 20 bp, Artificial Sequence
  chemically synthesized
ggggcaggttccctgatact

SEQ ID NO: 32491 - DNA, 20 bp, Artificial Sequence
  chemically synthesized
gcaggttccctgatactcag

SEQ ID NO: 32492 - DNA, 20 bp, Artificial Sequence
  chemically synthesized
ttccctgatactcagtggcg

SEQ ID NO: 32493 - DNA, 20 bp, Artificial Sequence
  chemically synthesized
ccctgatactcagtggcgtg

SEQ ID NO: 32494 - DNA, 20 bp, Artificial Sequence
  chemically synthesized
cagtggcgtggagatgtaac

SEQ ID NO: 32495 - DNA, 20 bp, Artificial Sequence
  chemically synthesized
gcgtggagatgtaacaagcc

SEQ ID NO: 32496 - DNA, 20 bp, Artificial Sequence
  chemically synthesized
tgtaacaagcctggatgtgt

SEQ ID NO: 32497 - DNA, 20 bp, Artificial Sequence
  chemically synthesized
ctggatgtgtgagtgatgat

SEQ ID NO: 32498 - DNA, 20 bp, Artificial Sequence
  chemically synthesized
tggatgtgtgagtgatgatc

SEQ ID NO: 32499 - DNA, 20 bp, Artificial Sequence
  chemically synthesized
agtgatgatcaggccaacaa

SEQ ID NO: 32500 - DNA, 20 bp, Artificial Sequence
  chemically synthesized
ggccaacaacagtctgtatt

SEQ ID NO: 32501 - DNA, 20 bp, Artificial Sequence
  chemically synthesized
caacaacagtctgtatttgg

SEQ ID NO: 32502 - DNA, 20 bp, Artificial Sequence
  chemically synthesized
tctgtatttggaagaaatat

SEQ ID NO: 32503 - DNA, 20 bp, Artificial Sequence
  chemically synthesized
cagatgtgaatgttatgacc

SEQ ID NO: 32504 - DNA, 20 bp, Artificial Sequence
  chemically synthesized
agatgtgaatgttatgacct

SEQ ID NO: 32505 - DNA, 20 bp, Artificial Sequence
  chemically synthesized
tgtgaatgttatgacctagg

SEQ ID NO: 32506 - DNA, 20 bp, Artificial Sequence
  chemically synthesized
tgttatgacctaggaagcaa

SEQ ID NO: 32507 - DNA, 20 bp, Artificial Sequence
  chemically synthesized
tatgacctaggaagcaatgg

SEQ ID NO: 32508 - DNA, 20 bp, Artificial Sequence
  chemically synthesized
aaaattattctttttgcctt

SEQ ID NO: 32509 - DNA, 20 bp, Artificial Sequence
  chemically synthesized
ttgtcaacacaaaaaatact

SEQ ID NO: 32510 - DNA, 20 bp, Artificial Sequence
  chemically synthesized
gttgtatactgatttgttaa

SEQ ID NO: 32511 - DNA, 20 bp, Artificial Sequence
  chemically synthesized
gtatactgatttgttaaaag

SEQ ID NO: 32512 - DNA, 20 bp, Artificial Sequence
  chemically synthesized
tactgatttgttaaaagcag

SEQ ID NO: 32513 - DNA, 20 bp, Artificial Sequence
  chemically synthesized
ttgttaaaagcagcagcatg

SEQ ID NO: 32514 - DNA, 20 bp, Artificial Sequence
  chemically synthesized
taaaagcagcagcatgcagt

SEQ ID NO: 32515 - DNA, 20 bp, Artificial Sequence
  chemically synthesized
aaaagcagcagcatgcagtt

SEQ ID NO: 32516 - DNA, 20 bp, Artificial Sequence
  chemically synthesized
tgcagttaggatgatatctt

SEQ ID NO: 32517 - DNA, 20 bp, Artificial Sequence
  chemically synthesized
gcagttaggatgatatcttt

SEQ ID NO: 32518 - DNA, 20 bp, Artificial Sequence
  chemically synthesized
cagttaggatgatatctttg

SEQ ID NO: 32519 - DNA, 20 bp, Artificial Sequence
  chemically synthesized
ggatgatatctttggggaaa

SEQ ID NO: 32520 - DNA, 20 bp, Artificial Sequence
  chemically synthesized
tgatatctttggggaaatgg

SEQ ID NO: 32521 - DNA, 20 bp, Artificial Sequence
  chemically synthesized
atatctttggggaaatggca

SEQ ID NO: 32522 - DNA, 20 bp, Artificial Sequence
  chemically synthesized
aaccccatgctcaccatcaa

SEQ ID NO: 32523 - DNA, 20 bp, Artificial Sequence
  chemically synthesized
accccatgctcaccatcaac

SEQ ID NO: 32524 - DNA, 20 bp, Artificial Sequence
  chemically synthesized
ccatcaacgggattgaattt

SEQ ID NO: 32525 - DNA, 20 bp, Artificial Sequence
  chemically synthesized
gggattgaatttgagctgct

SEQ ID NO: 32526 - DNA, 20 bp, Artificial Sequence
  chemically synthesized
gaatttgagctgctgagaat

SEQ ID NO: 32527 - DNA, 20 bp, Artificial Sequence
  chemically synthesized
ttatcttcaattctgtgaaa

SEQ ID NO: 32528 - DNA, 20 bp, Artificial Sequence
  chemically synthesized
aattctgtgaaatggaattt

SEQ ID NO: 32529 - DNA, 20 bp, Artificial Sequence
  chemically synthesized
tgtgaaatggaattttagac

SEQ ID NO: 32530 - DNA, 20 bp, Artificial Sequence
  chemically synthesized
tttagaccagcctgtgactg

SEQ ID NO: 32531 - DNA, 20 bp, Artificial Sequence
  chemically synthesized
cagcctgtgactgaagccac

SEQ ID NO: 32532 - DNA, 20 bp, Artificial Sequence
  chemically synthesized
agcctgtgactgaagccact

SEQ ID NO: 32533 - DNA, 20 bp, Artificial Sequence
  chemically synthesized
actgaagccactgggcatta

SEQ ID NO: 32534 - DNA, 20 bp, Artificial Sequence
  chemically synthesized
gccgcattgtttctctctgc

SEQ ID NO: 32535 - DNA, 20 bp, Artificial Sequence
  chemically synthesized
cgcattgtttctctctgcaa

SEQ ID NO: 32536 - DNA, 20 bp, Artificial Sequence
  chemically synthesized
cattgtttctctctgcaaga

SEQ ID NO: 32537 - DNA, 20 bp, Artificial Sequence
  chemically synthesized
attgtttctctctgcaagag

SEQ ID NO: 32538 - DNA, 20 bp, Artificial Sequence
  chemically synthesized
gtttctctctgcaagagagg

SEQ ID NO: 32539 - DNA, 20 bp, Artificial Sequence
  chemically synthesized
tttctctctgcaagagagga

SEQ ID NO: 32540 - DNA, 20 bp, Artificial Sequence
  chemically synthesized
ctctctgcaagagaggaagg

SEQ ID NO: 32541 - DNA, 20 bp, Artificial Sequence
  chemically synthesized
tctctgcaagagaggaagga

SEQ ID NO: 32542 - DNA, 20 bp, Artificial Sequence
  chemically synthesized
tgcaagagaggaaggaaggc

SEQ ID NO: 32543 - DNA, 20 bp, Artificial Sequence
  chemically synthesized
caagagaggaaggaaggctg

SEQ ID NO: 32544 - DNA, 20 bp, Artificial Sequence
  chemically synthesized
gaggaaggaaggctggagta

SEQ ID NO: 32545 - DNA, 20 bp, Artificial Sequence
  chemically synthesized
aggaaggctggagtacagct

SEQ ID NO: 32546 - DNA, 20 bp, Artificial Sequence
  chemically synthesized
tggagtacagctgagctttc

SEQ ID NO: 32547 - DNA, 20 bp, Artificial Sequence
  chemically synthesized
agtacagctgagctttctgg

SEQ ID NO: 32548 - DNA, 20 bp, Artificial Sequence
  chemically synthesized
gtacagctgagctttctggc

SEQ ID NO: 32549 - DNA, 20 bp, Artificial Sequence
  chemically synthesized
ctgagctttctggcaggcac

SEQ ID NO: 32550 - DNA, 20 bp, Artificial Sequence
  chemically synthesized
agctttctggcaggcactgg

SEQ ID NO: 32551 - DNA, 20 bp, Artificial Sequence
  chemically synthesized
ctttctggcaggcactggtg

SEQ ID NO: 32552 - DNA, 20 bp, Artificial Sequence
  chemically synthesized
ccttccccattctttgtaac

SEQ ID NO: 32553 - DNA, 20 bp, Artificial Sequence
  chemically synthesized
tccccattctttgtaactgg

SEQ ID NO: 32554 - DNA, 20 bp, Artificial Sequence
  chemically synthesized
ttctttgtaactggtggcct

SEQ ID NO: 32555 - DNA, 20 bp, Artificial Sequence
  chemically synthesized
tttgtaactggtggccttag

SEQ ID NO: 32556 - DNA, 20 bp, Artificial Sequence
  chemically synthesized
tgtaactggtggccttagaa

SEQ ID NO: 32557 - DNA, 20 bp, Artificial Sequence
  chemically synthesized
gtaactggtggccttagaag

SEQ ID NO: 32558 - DNA, 20 bp, Artificial Sequence
  chemically synthesized
taactggtggccttagaaga

SEQ ID NO: 32559 - DNA, 20 bp, Artificial Sequence
  chemically synthesized
ggtggccttagaagagggtt

SEQ ID NO: 32560 - DNA, 20 bp, Artificial Sequence
  chemically synthesized
gtggccttagaagagggttc

SEQ ID NO: 32561 - DNA, 20 bp, Artificial Sequence
  chemically synthesized
tggccttagaagagggttca

SEQ ID NO: 32562 - DNA, 20 bp, Artificial Sequence
  chemically synthesized
agggttcagggttatgtgtt

SEQ ID NO: 32563 - DNA, 20 bp, Artificial Sequence
  chemically synthesized
gggttatgtgtttggaacac

SEQ ID NO: 32564 - DNA, 20 bp, Artificial Sequence
  chemically synthesized
tatgtgtttggaacacgagt

SEQ ID NO: 32565 - DNA, 20 bp, Artificial Sequence
  chemically synthesized
ggaacacgagttagtataaa

SEQ ID NO: 32566 - DNA, 20 bp, Artificial Sequence
  chemically synthesized
agttagtataaatggttctg

SEQ ID NO: 32567 - DNA, 20 bp, Artificial Sequence
  chemically synthesized
tggttctgaagcacttgatt

SEQ ID NO: 32568 - DNA, 20 bp, Artificial Sequence
  chemically synthesized
tcagactgtgctttaaaaaa

SEQ ID NO: 32569 - DNA, 20 bp, Artificial Sequence
  chemically synthesized
cagactgtgctttaaaaaat

SEQ ID NO: 32570 - DNA, 20 bp, Artificial Sequence
  chemically synthesized
ctgtgctttaaaaaatagga

SEQ ID NO: 32571 - DNA, 20 bp, Artificial Sequence
  chemically synthesized
gctttaaaaaataggaaaga

SEQ ID NO: 32572 - DNA, 20 bp, Artificial Sequence
  chemically synthesized
ttaaaaaataggaaagaaag

SEQ ID NO: 32573 - DNA, 20 bp, Artificial Sequence
  chemically synthesized
aaaataggaaagaaagtaga

SEQ ID NO: 32574 - DNA, 20 bp, Artificial Sequence
  chemically synthesized
aggaaagaaagtagaaagaa

SEQ ID NO: 32575 - DNA, 20 bp, Artificial Sequence
  chemically synthesized
aaagtagaaagaacagctga

SEQ ID NO: 32576 - DNA, 20 bp, Artificial Sequence
  chemically synthesized
agaaagaacagctgatggtt

SEQ ID NO: 32577 - DNA, 20 bp, Artificial Sequence
  chemically synthesized
aagaacagctgatggtttgg

SEQ ID NO: 32578 - DNA, 20 bp, Artificial Sequence
  chemically synthesized
agaacagctgatggtttgga

SEQ ID NO: 32579 - DNA, 20 bp, Artificial Sequence
  chemically synthesized
gaacagctgatggtttggaa

SEQ ID NO: 32580 - DNA, 20 bp, Artificial Sequence
  chemically synthesized
acagctgatggtttggaagg

SEQ ID NO: 32581 - DNA, 20 bp, Artificial Sequence
  chemically synthesized
tggtttggaagggagccacc

SEQ ID NO: 32582 - DNA, 20 bp, Artificial Sequence
  chemically synthesized
gaagggagccaccaagcacc

SEQ ID NO: 32583 - DNA, 20 bp, Artificial Sequence
  chemically synthesized
agggagccaccaagcaccaa

SEQ ID NO: 32584 - DNA, 20 bp, Artificial Sequence
  chemically synthesized
gggagccaccaagcaccaag

SEQ ID NO: 32585 - DNA, 20 bp, Artificial Sequence
  chemically synthesized
caccaagcaccaagaggtgt

SEQ ID NO: 32586 - DNA, 20 bp, Artificial Sequence
  chemically synthesized
ctgaatccgtttctcaatct

SEQ ID NO: 32587 - DNA, 20 bp, Artificial Sequence
  chemically synthesized
ccgtttctcaatcttagctg

SEQ ID NO: 32588 - DNA, 20 bp, Artificial Sequence
  chemically synthesized
cgtttctcaatcttagctgc

SEQ ID NO: 32589 - DNA, 20 bp, Artificial Sequence
  chemically synthesized
gtttctcaatcttagctgca

SEQ ID NO: 32590 - DNA, 20 bp, Artificial Sequence
  chemically synthesized
caatcttagctgcagggcat

SEQ ID NO: 32591 - DNA, 20 bp, Artificial Sequence
  chemically synthesized
tagctgcagggcattggcta

SEQ ID NO: 32592 - DNA, 20 bp, Artificial Sequence
  chemically synthesized
gctgcagggcattggctaaa

SEQ ID NO: 32593 - DNA, 20 bp, Artificial Sequence
  chemically synthesized
ctgcagggcattggctaaag

SEQ ID NO: 32594 - DNA, 20 bp, Artificial Sequence
  chemically synthesized
cagggcattggctaaagagg

SEQ ID NO: 32595 - DNA, 20 bp, Artificial Sequence
  chemically synthesized
agggcattggctaaagagga

SEQ ID NO: 32596 - DNA, 20 bp, Artificial Sequence
  chemically synthesized
agaggaaggtgaaaactgct

SEQ ID NO: 32597 - DNA, 20 bp, Artificial Sequence
  chemically synthesized
tgagtcactatcaaatcaat

SEQ ID NO: 32598 - DNA, 20 bp, Artificial Sequence
  chemically synthesized
attggtttttctaatcccct

SEQ ID NO: 32599 - DNA, 20 bp, Artificial Sequence
  chemically synthesized
tggtttttctaatcccctga

SEQ ID NO: 32600 - DNA, 20 bp, Artificial Sequence
  chemically synthesized
ttctaatcccctgagagaaa

SEQ ID NO: 32601 - DNA, 20 bp, Artificial Sequence
  chemically synthesized
atcccctgagagaaaaagta

SEQ ID NO: 32602 - DNA, 20 bp, Artificial Sequence
  chemically synthesized
cccctgagagaaaaagtaca

SEQ ID NO: 32603 - DNA, 20 bp, Artificial Sequence
  chemically synthesized
aaaaagtacagagtttattg

SEQ ID NO: 32604 - DNA, 20 bp, Artificial Sequence
  chemically synthesized
ttaaaatgccatgcccctca

SEQ ID NO: 32605 - DNA, 20 bp, Artificial Sequence
  chemically synthesized
tgccatgcccctcacggcca

SEQ ID NO: 32606 - DNA, 20 bp, Artificial Sequence
  chemically synthesized
gccatgcccctcacggccaa

SEQ ID NO: 32607 - DNA, 20 bp, Artificial Sequence
  chemically synthesized
cggccaaaggcatctgaatt

SEQ ID NO: 32608 - DNA, 20 bp, Artificial Sequence
  chemically synthesized
ggccaaaggcatctgaatta

SEQ ID NO: 32609 - DNA, 20 bp, Artificial Sequence
  chemically synthesized
caaaggcatctgaattaagg

SEQ ID NO: 32610 - DNA, 20 bp, Artificial Sequence
  chemically synthesized
aggcatctgaattaaggaag

SEQ ID NO: 32611 - DNA, 20 bp, Artificial Sequence
  chemically synthesized
aattaaggaagcagtattca

SEQ ID NO: 32612 - DNA, 20 bp, Artificial Sequence
  chemically synthesized
gtattcacagctgctttctc

SEQ ID NO: 32613 - DNA, 20 bp, Artificial Sequence
  chemically synthesized
agctgctttctccagacatt

SEQ ID NO: 32614 - DNA, 20 bp, Artificial Sequence
  chemically synthesized
tttctccagacattgagctc

SEQ ID NO: 32615 - DNA, 20 bp, Artificial Sequence
  chemically synthesized
ttctccagacattgagctca

SEQ ID NO: 32616 - DNA, 20 bp, Artificial Sequence
  chemically synthesized
ccagacattgagctcaagga

SEQ ID NO: 32617 - DNA, 20 bp, Artificial Sequence
  chemically synthesized
aatctgaactctgcttttat

SEQ ID NO: 32618 - DNA, 20 bp, Artificial Sequence
  chemically synthesized
tttatcagctgcgaaaatcc

SEQ ID NO: 32619 - DNA, 20 bp, Artificial Sequence
  chemically synthesized
aaaatccaagcattcatttc

SEQ ID NO: 32620 - DNA, 20 bp, Artificial Sequence
  chemically synthesized
tccaagcattcatttccagc

SEQ ID NO: 32621 - DNA, 20 bp, Artificial Sequence
  chemically synthesized
gcattcatttccagctggtt

SEQ ID NO: 32622 - DNA, 20 bp, Artificial Sequence
  chemically synthesized
ctggttcagtgcctatgtaa

SEQ ID NO: 32623 - DNA, 20 bp, Artificial Sequence
  chemically synthesized
agtatactgtgtacaaaaat

SEQ ID NO: 32624 - DNA, 20 bp, Artificial Sequence
  chemically synthesized
tgtacaaaaataagattaaa

SEQ ID NO: 32625 - DNA, 20 bp, Artificial Sequence
  chemically synthesized
aagattaaaaagctaacatt

SEQ ID NO: 32626 - DNA, 20 bp, Artificial Sequence
  chemically synthesized
ttaaaaagctaacattaagc

SEQ ID NO: 32627 - DNA, 20 bp, Artificial Sequence
  chemically synthesized
gtgtgtttgtatgttttcta

SEQ ID NO: 32628 - DNA, 20 bp, Artificial Sequence
  chemically synthesized
tttgtatgttttctacagtt

SEQ ID NO: 32629 - DNA, 20 bp, Artificial Sequence
  chemically synthesized
ttctgaataatttgatccga

SEQ ID NO: 32630 - DNA, 20 bp, Artificial Sequence
  chemically synthesized
atatgatttcatttcttttc

SEQ ID NO: 32631 - DNA, 20 bp, Artificial Sequence
  chemically synthesized
atgatttcatttcttttcga

SEQ ID NO: 32632 - DNA, 20 bp, Artificial Sequence
  chemically synthesized
tatgcatactttctaaatgc

SEQ ID NO: 32633 - DNA, 20 bp, Artificial Sequence
  chemically synthesized
aaatgcaagaataaattcct

SEQ ID NO: 32634 - DNA, 20 bp, Artificial Sequence
  chemically synthesized
tcctgagctccatgtgactt

SEQ ID NO: 32635 - DNA, 20 bp, Artificial Sequence
  chemically synthesized
ccatgtgacttcagtaccat

SEQ ID NO: 32636 - DNA, 20 bp, Artificial Sequence
  chemically synthesized
cttcagtaccatcagctctt

SEQ ID NO: 32637 - DNA, 20 bp, Artificial Sequence
  chemically synthesized
cagtaccatcagctctttgg

SEQ ID NO: 32638 - DNA, 20 bp, Artificial Sequence
  chemically synthesized
tcagctctttggcagcttat

SEQ ID NO: 32639 - DNA, 20 bp, Artificial Sequence
  chemically synthesized
tttggcagcttatgagtata

SEQ ID NO: 32640 - DNA, 20 bp, Artificial Sequence
  chemically synthesized
acagctttttaattctcacc

SEQ ID NO: 32641 - DNA, 20 bp, Artificial Sequence
  chemically synthesized
tttaattctcacctggtccc

SEQ ID NO: 32642 - DNA, 20 bp, Artificial Sequence
  chemically synthesized
ttaattctcacctggtcccc

SEQ ID NO: 32643 - DNA, 20 bp, Artificial Sequence
  chemically synthesized
ctcacctggtccccaggata

SEQ ID NO: 32644 - DNA, 20 bp, Artificial Sequence
  chemically synthesized
ccaggatatggtttacttgt

SEQ ID NO: 32645 - DNA, 20 bp, Artificial Sequence
  chemically synthesized
aggatatggtttacttgtca

SEQ ID NO: 32646 - DNA, 20 bp, Artificial Sequence
  chemically synthesized
atatggtttacttgtcagag

SEQ ID NO: 32647 - DNA, 20 bp, Artificial Sequence
  chemically synthesized
acttgtcagagtagttttat

SEQ ID NO: 32648 - DNA, 20 bp, Artificial Sequence
  chemically synthesized
cttgtcagagtagttttatg

SEQ ID NO: 32649 - DNA, 20 bp, Artificial Sequence
  chemically synthesized
ctttctcctgactctgattc

SEQ ID NO: 32650 - DNA, 20 bp, Artificial Sequence
  chemically synthesized
tttctcctgactctgattct

SEQ ID NO: 32651 - DNA, 20 bp, Artificial Sequence
  chemically synthesized
gattctaggtaacacctgat

SEQ ID NO: 32652 - DNA, 20 bp, Artificial Sequence
  chemically synthesized
gtaacacctgatgagatgaa

SEQ ID NO: 32653 - DNA, 20 bp, Artificial Sequence
  chemically synthesized
cacctgatgagatgaacaga

SEQ ID NO: 32654 - DNA, 20 bp, Artificial Sequence
  chemically synthesized
tgcacctcacttcctcttac

SEQ ID NO: 32655 - DNA, 20 bp, Artificial Sequence
  chemically synthesized
gcacctcacttcctcttact

SEQ ID NO: 32656 - DNA, 20 bp, Artificial Sequence
  chemically synthesized
acttcctcttactgggcatg

SEQ ID NO: 32657 - DNA, 20 bp, Artificial Sequence
  chemically synthesized
cttcctcttactgggcatga

SEQ ID NO: 32658 - DNA, 20 bp, Artificial Sequence
  chemically synthesized
ctcttactgggcatgaagga

SEQ ID NO: 32659 - DNA, 20 bp, Artificial Sequence
  chemically synthesized
cttactgggcatgaaggaaa

SEQ ID NO: 32660 - DNA, 20 bp, Artificial Sequence
  chemically synthesized
tactgggcatgaaggaaaga

SEQ ID NO: 32661 - DNA, 20 bp, Artificial Sequence
  chemically synthesized
ctgggcatgaaggaaagaga

SEQ ID NO: 32662 - DNA, 20 bp, Artificial Sequence
  chemically synthesized
ggcatgaaggaaagagagag

SEQ ID NO: 32663 - DNA, 20 bp, Artificial Sequence
  chemically synthesized
tgaaggaaagagagagaagt

SEQ ID NO: 32664 - DNA, 20 bp, Artificial Sequence
  chemically synthesized
gaaggaaagagagagaagtc

SEQ ID NO: 32665 - DNA, 20 bp, Artificial Sequence
  chemically synthesized
aaggaaagagagagaagtca

SEQ ID NO: 32666 - DNA, 20 bp, Artificial Sequence
  chemically synthesized
gaaagagagagaagtcaggg

SEQ ID NO: 32667 - DNA, 20 bp, Artificial Sequence
  chemically synthesized
aagagagagaagtcagggta

SEQ ID NO: 32668 - DNA, 20 bp, Artificial Sequence
  chemically synthesized
tgctacattttttttttctg

SEQ ID NO: 32669 - DNA, 20 bp, Artificial Sequence
  chemically synthesized
attttttttttctgtggaaa

SEQ ID NO: 32670 - DNA, 20 bp, Artificial Sequence
  chemically synthesized
tttttttttctgtggaaaaa

SEQ ID NO: 32671 - DNA, 20 bp, Artificial Sequence
  chemically synthesized
atatttctaattaaccttga

SEQ ID NO: 32672 - DNA, 20 bp, Artificial Sequence
  chemically synthesized
tatttctaattaaccttgat

SEQ ID NO: 32673 - DNA, 20 bp, Artificial Sequence
  chemically synthesized
aattaaccttgatgggaaca

SEQ ID NO: 32674 - DNA, 20 bp, Artificial Sequence
  chemically synthesized
cttgatgggaacatagaaca

SEQ ID NO: 32675 - DNA, 20 bp, Artificial Sequence
  chemically synthesized
aacatagaacatagattgta

SEQ ID NO: 32676 - DNA, 20 bp, Artificial Sequence
  chemically synthesized
acatagaacatagattgtaa

SEQ ID NO: 32677 - DNA, 20 bp, Artificial Sequence
  chemically synthesized
catagaacatagattgtaaa

SEQ ID NO: 32678 - DNA, 20 bp, Artificial Sequence
  chemically synthesized
agggaacttgcacattatcg

SEQ ID NO: 32679 - DNA, 20 bp, Artificial Sequence
  chemically synthesized
gaacttgcacattatcgcag

SEQ ID NO: 32680 - DNA, 20 bp, Artificial Sequence
  chemically synthesized
aacttgcacattatcgcagt

SEQ ID NO: 32681 - DNA, 20 bp, Artificial Sequence
  chemically synthesized
tatcgcagtaggctgaataa

SEQ ID NO: 32682 - DNA, 20 bp, Artificial Sequence
  chemically synthesized
gtaggctgaataatggctaa

SEQ ID NO: 32683 - DNA, 20 bp, Artificial Sequence
  chemically synthesized
tggctaatggctcactctga

SEQ ID NO: 32684 - DNA, 20 bp, Artificial Sequence
  chemically synthesized
ctcactctgaaagatatgta

SEQ ID NO: 32685 - DNA, 20 bp, Artificial Sequence
  chemically synthesized
gcttaacccctgaaacctgt

SEQ ID NO: 32686 - DNA, 20 bp, Artificial Sequence
  chemically synthesized
cctgtgagtattatcttttc

SEQ ID NO: 32687 - DNA, 20 bp, Artificial Sequence
  chemically synthesized
tattatcttttctagccaaa

SEQ ID NO: 32688 - DNA, 20 bp, Artificial Sequence
  chemically synthesized
agacttttgcatatataatt

SEQ ID NO: 32689 - DNA, 20 bp, Artificial Sequence
  chemically synthesized
gacttttgcatatataatta

SEQ ID NO: 32690 - DNA, 20 bp, Artificial Sequence
  chemically synthesized
gcatatataattaaggatct

SEQ ID NO: 32691 - DNA, 20 bp, Artificial Sequence
  chemically synthesized
catatataattaaggatctt

SEQ ID NO: 32692 - DNA, 20 bp, Artificial Sequence
  chemically synthesized
tataattaaggatcttggga

SEQ ID NO: 32693 - DNA, 20 bp, Artificial Sequence
  chemically synthesized
ataattaaggatcttgggat

SEQ ID NO: 32694 - DNA, 20 bp, Artificial Sequence
  chemically synthesized
taattaaggatcttgggatg

SEQ ID NO: 32695 - DNA, 20 bp, Artificial Sequence
  chemically synthesized
attaaggatcttgggatggg

SEQ ID NO: 32696 - DNA, 20 bp, Artificial Sequence
  chemically synthesized
ggggagatatcctaattatt

SEQ ID NO: 32697 - DNA, 20 bp, Artificial Sequence
  chemically synthesized
gggagatatcctaattattt

SEQ ID NO: 32698 - DNA, 20 bp, Artificial Sequence
  chemically synthesized
tgtatcctaaatgtaatcac

SEQ ID NO: 32699 - DNA, 20 bp, Artificial Sequence
  chemically synthesized
gtaatcacaagtgtcattat

SEQ ID NO: 32700 - DNA, 20 bp, Artificial Sequence
  chemically synthesized
aatcacaagtgtcattataa

SEQ ID NO: 32701 - DNA, 20 bp, Artificial Sequence
  chemically synthesized
atcacaagtgtcattataag

SEQ ID NO: 32702 - DNA, 20 bp, Artificial Sequence
  chemically synthesized
tcacaagtgtcattataaga

SEQ ID NO: 32703 - DNA, 20 bp, Artificial Sequence
  chemically synthesized
acaagtgtcattataagagg

SEQ ID NO: 32704 - DNA, 20 bp, Artificial Sequence
  chemically synthesized
caagtgtcattataagaggg

SEQ ID NO: 32705 - DNA, 20 bp, Artificial Sequence
  chemically synthesized
gtcattataagagggaggca

SEQ ID NO: 32706 - DNA, 20 bp, Artificial Sequence
  chemically synthesized
tcattataagagggaggcaa

SEQ ID NO: 32707 - DNA, 20 bp, Artificial Sequence
  chemically synthesized
cattataagagggaggcaaa

SEQ ID NO: 32708 - DNA, 20 bp, Artificial Sequence
  chemically synthesized
ttataagagggaggcaaagg

SEQ ID NO: 32709 - DNA, 20 bp, Artificial Sequence
  chemically synthesized
caaagggagatttgacttat

SEQ ID NO: 32710 - DNA, 20 bp, Artificial Sequence
  chemically synthesized
aagggagatttgacttataa

SEQ ID NO: 32711 - DNA, 20 bp, Artificial Sequence
  chemically synthesized
agggagatttgacttataag

SEQ ID NO: 32712 - DNA, 20 bp, Artificial Sequence
  chemically synthesized
ggagatttgacttataagag

SEQ ID NO: 32713 - DNA, 20 bp, Artificial Sequence
  chemically synthesized
aaaatgtgacgtgattacaa

SEQ ID NO: 32714 - DNA, 20 bp, Artificial Sequence
  chemically synthesized
atgtgacgtgattacaaaag

SEQ ID NO: 32715 - DNA, 20 bp, Artificial Sequence
  chemically synthesized
gtgacgtgattacaaaagca

SEQ ID NO: 32716 - DNA, 20 bp, Artificial Sequence
  chemically synthesized
agcagagatacatttttttg

SEQ ID NO: 32717 - DNA, 20 bp, Artificial Sequence
  chemically synthesized
gatacatttttttgaagatc

SEQ ID NO: 32718 - DNA, 20 bp, Artificial Sequence
  chemically synthesized
atacatttttttgaagatcg

SEQ ID NO: 32719 - DNA, 20 bp, Artificial Sequence
  chemically synthesized
catttttttgaagatcgagg

SEQ ID NO: 32720 - DNA, 20 bp, Artificial Sequence
  chemically synthesized
tttttttgaagatcgaggaa

SEQ ID NO: 32721 - DNA, 20 bp, Artificial Sequence
  chemically synthesized
ttttttgaagatcgaggaag

SEQ ID NO: 32722 - DNA, 20 bp, Artificial Sequence
  chemically synthesized
cgaggaagaggctacaaacc

SEQ ID NO: 32723 - DNA, 20 bp, Artificial Sequence
  chemically synthesized
gaggaagaggctacaaacca

SEQ ID NO: 32724 - DNA, 20 bp, Artificial Sequence
  chemically synthesized
aggctacaaaccaaggaatg

SEQ ID NO: 32725 - DNA, 20 bp, Artificial Sequence
  chemically synthesized
ggctacaaaccaaggaatgt

SEQ ID NO: 32726 - DNA, 20 bp, Artificial Sequence
  chemically synthesized
tacaaaccaaggaatgtggg

SEQ ID NO: 32727 - DNA, 20 bp, Artificial Sequence
  chemically synthesized
caaggaatgtgggtagcctc

SEQ ID NO: 32728 - DNA, 20 bp, Artificial Sequence
  chemically synthesized
ggaatgtgggtagcctctag

SEQ ID NO: 32729 - DNA, 20 bp, Artificial Sequence
  chemically synthesized
aatgtgggtagcctctagaa

SEQ ID NO: 32730 - DNA, 20 bp, Artificial Sequence
  chemically synthesized
atgtgggtagcctctagaag

SEQ ID NO: 32731 - DNA, 20 bp, Artificial Sequence
  chemically synthesized
gtagcctctagaagaggaaa

SEQ ID NO: 32732 - DNA, 20 bp, Artificial Sequence
  chemically synthesized
agaagaggaaacagaatcca

SEQ ID NO: 32733 - DNA, 20 bp, Artificial Sequence
  chemically synthesized
aggaaacagaatccatggaa

SEQ ID NO: 32734 - DNA, 20 bp, Artificial Sequence
  chemically synthesized
ggaaacagaatccatggaaa

SEQ ID NO: 32735 - DNA, 20 bp, Artificial Sequence
  chemically synthesized
aacagaatccatggaaaagg

SEQ ID NO: 32736 - DNA, 20 bp, Artificial Sequence
  chemically synthesized
acagaatccatggaaaaggc

SEQ ID NO: 32737 - DNA, 20 bp, Artificial Sequence
  chemically synthesized
caggaaaacacaatctctca

SEQ ID NO: 32738 - DNA, 20 bp, Artificial Sequence
  chemically synthesized
ggaaaacacaatctctcata

SEQ ID NO: 32739 - DNA, 20 bp, Artificial Sequence
  chemically synthesized
acaatctctcatagagtctc

SEQ ID NO: 32740 - DNA, 20 bp, Artificial Sequence
  chemically synthesized
atctctcatagagtctccag

SEQ ID NO: 32741 - DNA, 20 bp, Artificial Sequence
  chemically synthesized
catagagtctccagaagaaa

SEQ ID NO: 32742 - DNA, 20 bp, Artificial Sequence
  chemically synthesized
ccacactgacacctcgactt

SEQ ID NO: 32743 - DNA, 20 bp, Artificial Sequence
  chemically synthesized
ctgacacctcgactttagcc

SEQ ID NO: 32744 - DNA, 20 bp, Artificial Sequence
  chemically synthesized
tagcccagtgaaaccgattt

SEQ ID NO: 32745 - DNA, 20 bp, Artificial Sequence
  chemically synthesized
cttctgacctccacaacttc

SEQ ID NO: 32746 - DNA, 20 bp, Artificial Sequence
  chemically synthesized
taatacatttgtgttgtttt

SEQ ID NO: 32747 - DNA, 20 bp, Artificial Sequence
  chemically synthesized
gttttaagccaataaatttg

SEQ ID NO: 32748 - DNA, 20 bp, Artificial Sequence
  chemically synthesized
aaatttgtggtaatttttta

SEQ ID NO: 32749 - DNA, 20 bp, Artificial Sequence
  chemically synthesized
tttgtggtaattttttacag

SEQ ID NO: 32750 - DNA, 20 bp, Artificial Sequence
  chemically synthesized
tggtaattttttacagcagc

SEQ ID NO: 32751 - DNA, 20 bp, Artificial Sequence
  chemically synthesized
gtaattttttacagcagcaa

SEQ ID NO: 32752 - DNA, 20 bp, Artificial Sequence
  chemically synthesized
taattttttacagcagcaag

SEQ ID NO: 32753 - DNA, 20 bp, Artificial Sequence
  chemically synthesized
ttacagcagcaagaggaaat

SEQ ID NO: 32754 - DNA, 20 bp, Artificial Sequence
  chemically synthesized
gcaagaggaaatcagttacg

SEQ ID NO: 32755 - DNA, 20 bp, Artificial Sequence
  chemically synthesized
aggaaatcagttacgtagaa

SEQ ID NO: 32756 - DNA, 20 bp, Artificial Sequence
  chemically synthesized
aaatcagttacgtagaatag

SEQ ID NO: 32757 - DNA, 20 bp, Artificial Sequence
  chemically synthesized
aatcagttacgtagaatagt

SEQ ID NO: 32758 - DNA, 20 bp, Artificial Sequence
  chemically synthesized
agaatagtaggtcctgtctc

SEQ ID NO: 32759 - DNA, 20 bp, Artificial Sequence
  chemically synthesized
tcctgtctctggctaatcat

SEQ ID NO: 32760 - DNA, 20 bp, Artificial Sequence
  chemically synthesized
gctaatcattagaatcactc

SEQ ID NO: 32761 - DNA, 20 bp, Artificial Sequence
  chemically synthesized
aatcattagaatcactccag

SEQ ID NO: 32762 - DNA, 20 bp, Artificial Sequence
  chemically synthesized
ctccagaagcttgttacata

SEQ ID NO: 32763 - DNA, 20 bp, Artificial Sequence
  chemically synthesized
aagcttgttacatacagacc

SEQ ID NO: 32764 - DNA, 20 bp, Artificial Sequence
  chemically synthesized
gcttgttacatacagaccca

SEQ ID NO: 32765 - DNA, 20 bp, Artificial Sequence
  chemically synthesized
gttacatacagacccagagc

SEQ ID NO: 32766 - DNA, 20 bp, Artificial Sequence
  chemically synthesized
agacccagagccagtgaatc

SEQ ID NO: 32767 - DNA, 20 bp, Artificial Sequence
  chemically synthesized
gacccagagccagtgaatca

SEQ ID NO: 32768 - DNA, 20 bp, Artificial Sequence
  chemically synthesized
gagccagtgaatcaaggatt

SEQ ID NO: 32769 - DNA, 20 bp, Artificial Sequence
  chemically synthesized
ccagtgaatcaaggatttgg

SEQ ID NO: 32770 - DNA, 20 bp, Artificial Sequence
  chemically synthesized
gtgaatcaaggatttggtgg

SEQ ID NO: 32771 - DNA, 20 bp, Artificial Sequence
  chemically synthesized
tgaatcaaggatttggtggt

SEQ ID NO: 32772 - DNA, 20 bp, Artificial Sequence
  chemically synthesized
gaatcaaggatttggtggtg

SEQ ID NO: 32773 - DNA, 20 bp, Artificial Sequence
  chemically synthesized
aaggatttggtggtggggcc

SEQ ID NO: 32774 - DNA, 20 bp, Artificial Sequence
  chemically synthesized
ggatttggtggtggggccca

SEQ ID NO: 32775 - DNA, 20 bp, Artificial Sequence
  chemically synthesized
gggcccagagcctgaatatt

SEQ ID NO: 32776 - DNA, 20 bp, Artificial Sequence
  chemically synthesized
ccagagcctgaatattaagc

SEQ ID NO: 32777 - DNA, 20 bp, Artificial Sequence
  chemically synthesized
attaagcaagttcttcgttt

SEQ ID NO: 32778 - DNA, 20 bp, Artificial Sequence
  chemically synthesized
aagttcttcgttttagaaat

SEQ ID NO: 32779 - DNA, 20 bp, Artificial Sequence
  chemically synthesized
agttcttcgttttagaaatg

SEQ ID NO: 32780 - DNA, 20 bp, Artificial Sequence
  chemically synthesized
gttttagaaatgaggaaacc

SEQ ID NO: 32781 - DNA, 20 bp, Artificial Sequence
  chemically synthesized
ttttagaaatgaggaaacca

SEQ ID NO: 32782 - DNA, 20 bp, Artificial Sequence
  chemically synthesized
agaaatgaggaaaccaaggt

SEQ ID NO: 32783 - DNA, 20 bp, Artificial Sequence
  chemically synthesized
gaaatgaggaaaccaaggtt

SEQ ID NO: 32784 - DNA, 20 bp, Artificial Sequence
  chemically synthesized
aatgaggaaaccaaggttgg

SEQ ID NO: 32785 - DNA, 20 bp, Artificial Sequence
  chemically synthesized
gaggaaaccaaggttgggag

SEQ ID NO: 32786 - DNA, 20 bp, Artificial Sequence
  chemically synthesized
aaccaaggttgggagaagct

SEQ ID NO: 32787 - DNA, 20 bp, Artificial Sequence
  chemically synthesized
aagcaacttactcaaataca

SEQ ID NO: 32788 - DNA, 20 bp, Artificial Sequence
  chemically synthesized
agcaacttactcaaatacat

SEQ ID NO: 32789 - DNA, 20 bp, Artificial Sequence
  chemically synthesized
gcaacttactcaaatacata

SEQ ID NO: 32790 - DNA, 20 bp, Artificial Sequence
  chemically synthesized
tcttttgaattttcttaccc

SEQ ID NO: 32791 - DNA, 20 bp, Artificial Sequence
  chemically synthesized
tgtaaatgtgatttcattta

SEQ ID NO: 32792 - DNA, 20 bp, Artificial Sequence
  chemically synthesized
ttgacatattcattaaaatg

SEQ ID NO: 32793 - DNA, 20 bp, Artificial Sequence
  chemically synthesized
tcattaaaatgaagaaataa

SEQ ID NO: 32794 - DNA, 20 bp, Artificial Sequence
  chemically synthesized
aaaatgaagaaataaaagat

SEQ ID NO: 32795 - DNA, 20 bp, Artificial Sequence
  chemically synthesized
aagaaataaaagatgagaaa

SEQ ID NO: 32796 - DNA, 20 bp, Artificial Sequence
  chemically synthesized
attatataatgtttattgat

SEQ ID NO: 32797 - DNA, 20 bp, Artificial Sequence
  chemically synthesized
agaatgaatatgatgcaatc

SEQ ID NO: 32798 - DNA, 20 bp, Artificial Sequence
  chemically synthesized
gcaatctggttttctgtgtt

SEQ ID NO: 32799 - DNA, 20 bp, Artificial Sequence
  chemically synthesized
gtgttcagattcctgacctc

SEQ ID NO: 32800 - DNA, 20 bp, Artificial Sequence
  chemically synthesized
gttcagattcctgacctctg

SEQ ID NO: 32801 - DNA, 20 bp, Artificial Sequence
  chemically synthesized
ggagttaacctttctttgta

SEQ ID NO: 32802 - DNA, 20 bp, Artificial Sequence
  chemically synthesized
taacctttctttgtaaagat

SEQ ID NO: 32803 - DNA, 20 bp, Artificial Sequence
  chemically synthesized
ctttctttgtaaagattaga

SEQ ID NO: 32804 - DNA, 20 bp, Artificial Sequence
  chemically synthesized
tctttgtaaagattagacag

SEQ ID NO: 32805 - DNA, 20 bp, Artificial Sequence
  chemically synthesized
ctttgtaaagattagacagc

SEQ ID NO: 32806 - DNA, 20 bp, Artificial Sequence
  chemically synthesized
tgtaaagattagacagcagg

SEQ ID NO: 32807 - DNA, 20 bp, Artificial Sequence
  chemically synthesized
gtaaagattagacagcaggc

SEQ ID NO: 32808 - DNA, 20 bp, Artificial Sequence
  chemically synthesized
taaagattagacagcaggca

SEQ ID NO: 32809 - DNA, 20 bp, Artificial Sequence
  chemically synthesized
agattagacagcaggcaggg

SEQ ID NO: 32810 - DNA, 20 bp, Artificial Sequence
  chemically synthesized
ggaagaatgcctttgaaact

SEQ ID NO: 32811 - DNA, 20 bp, Artificial Sequence
  chemically synthesized
aagaatgcctttgaaactga

SEQ ID NO: 32812 - DNA, 20 bp, Artificial Sequence
  chemically synthesized
tgcctttgaaactgagagca

SEQ ID NO: 32813 - DNA, 20 bp, Artificial Sequence
  chemically synthesized
ttgaaactgagagcaaagac

SEQ ID NO: 32814 - DNA, 20 bp, Artificial Sequence
  chemically synthesized
tgcaatttacattgatgtcc

SEQ ID NO: 32815 - DNA, 20 bp, Artificial Sequence
  chemically synthesized
gtcctggtgctgtgcataat

SEQ ID NO: 32816 - DNA, 20 bp, Artificial Sequence
  chemically synthesized
aataagttgcttaaacatga

SEQ ID NO: 32817 - DNA, 20 bp, Artificial Sequence
  chemically synthesized
aagttgcttaaacatgacag

SEQ ID NO: 32818 - DNA, 20 bp, Artificial Sequence
  chemically synthesized
agttgcttaaacatgacagc

SEQ ID NO: 32819 - DNA, 20 bp, Artificial Sequence
  chemically synthesized
gcttaaacatgacagcagga

SEQ ID NO: 32820 - DNA, 20 bp, Artificial Sequence
  chemically synthesized
cttaaacatgacagcaggat

SEQ ID NO: 32821 - DNA, 20 bp, Artificial Sequence
  chemically synthesized
acataaaatttatttataaa

SEQ ID NO: 32822 - DNA, 20 bp, Artificial Sequence
  chemically synthesized
aaatttatttataaatggta

SEQ ID NO: 32823 - DNA, 20 bp, Artificial Sequence
  chemically synthesized
acctctgctgaacttcctca

SEQ ID NO: 32824 - DNA, 20 bp, Artificial Sequence
  chemically synthesized
cttcctcatagaatgttcat

SEQ ID NO: 32825 - DNA, 20 bp, Artificial Sequence
  chemically synthesized
agaatgttcatcagaaaaca

SEQ ID NO: 32826 - DNA, 20 bp, Artificial Sequence
  chemically synthesized
ttctatctactctttcttcc

SEQ ID NO: 32827 - DNA, 20 bp, Artificial Sequence
  chemically synthesized
accactgacatcatgaccct

SEQ ID NO: 32828 - DNA, 20 bp, Artificial Sequence
  chemically synthesized
gaccctcagttctattcccc

SEQ ID NO: 32829 - DNA, 20 bp, Artificial Sequence
  chemically synthesized
ctgcccactcccctgaaatc

SEQ ID NO: 32830 - DNA, 20 bp, Artificial Sequence
  chemically synthesized
ccataaatccaaccaccgcc

SEQ ID NO: 32831 - DNA, 20 bp, Artificial Sequence
  chemically synthesized
cataaatccaaccaccgcct

SEQ ID NO: 32832 - DNA, 20 bp, Artificial Sequence
  chemically synthesized
caaccaccgcctgggtatct

SEQ ID NO: 32833 - DNA, 20 bp, Artificial Sequence
  chemically synthesized
accgcctgggtatctcagtt

SEQ ID NO: 32834 - DNA, 20 bp, Artificial Sequence
  chemically synthesized
tccctccatcaactcaaatt

SEQ ID NO: 32835 - DNA, 20 bp, Artificial Sequence
  chemically synthesized
caactcaaatttggctgaca

SEQ ID NO: 32836 - DNA, 20 bp, Artificial Sequence
  chemically synthesized
aaatttggctgacacagttt

SEQ ID NO: 32837 - DNA, 20 bp, Artificial Sequence
  chemically synthesized
gctgacacagttttggattc

SEQ ID NO: 32838 - DNA, 20 bp, Artificial Sequence
  chemically synthesized
tgacacagttttggattcta

SEQ ID NO: 32839 - DNA, 20 bp, Artificial Sequence
  chemically synthesized
gttttggattctagagcatg

SEQ ID NO: 32840 - DNA, 20 bp, Artificial Sequence
  chemically synthesized
ttttggattctagagcatgc

SEQ ID NO: 32841 - DNA, 20 bp, Artificial Sequence
  chemically synthesized
tttgcactcactcttccctc

SEQ ID NO: 32842 - DNA, 20 bp, Artificial Sequence
  chemically synthesized
cccgtccttcctcactttgc

SEQ ID NO: 32843 - DNA, 20 bp, Artificial Sequence
  chemically synthesized
ccagttccaacttctctctg

SEQ ID NO: 32844 - DNA, 20 bp, Artificial Sequence
  chemically synthesized
ccaacttctctctgaagact

SEQ ID NO: 32845 - DNA, 20 bp, Artificial Sequence
  chemically synthesized
ttctctctgaagactcagtt

SEQ ID NO: 32846 - DNA, 20 bp, Artificial Sequence
  chemically synthesized
tctctctgaagactcagttt

SEQ ID NO: 32847 - DNA, 20 bp, Artificial Sequence
  chemically synthesized
ctgaagactcagtttaggta

SEQ ID NO: 32848 - DNA, 20 bp, Artificial Sequence
  chemically synthesized
tgaagactcagtttaggtac

SEQ ID NO: 32849 - DNA, 20 bp, Artificial Sequence
  chemically synthesized
agtttaggtacaggctcctt

SEQ ID NO: 32850 - DNA, 20 bp, Artificial Sequence
  chemically synthesized
gtttaggtacaggctccttt

SEQ ID NO: 32851 - DNA, 20 bp, Artificial Sequence
  chemically synthesized
aatttttttttgactctacc

SEQ ID NO: 32852 - DNA, 20 bp, Artificial Sequence
  chemically synthesized
ttttttgactctacctagcc

SEQ ID NO: 32853 - DNA, 20 bp, Artificial Sequence
  chemically synthesized
gactctacctagcccagact

SEQ ID NO: 32854 - DNA, 20 bp, Artificial Sequence
  chemically synthesized
tcatctacgatattaatctg

SEQ ID NO: 32855 - DNA, 20 bp, Artificial Sequence
  chemically synthesized
taatctgcagtgtcatgcac

SEQ ID NO: 32856 - DNA, 20 bp, Artificial Sequence
  chemically synthesized
acaaaatatttgctgaatga

SEQ ID NO: 32857 - DNA, 20 bp, Artificial Sequence
  chemically synthesized
tatttgctgaatgaaagaat

SEQ ID NO: 32858 - DNA, 20 bp, Artificial Sequence
  chemically synthesized
tttgctgaatgaaagaatga

SEQ ID NO: 32859 - DNA, 20 bp, Artificial Sequence
  chemically synthesized
aaagaatgagagttaacttt

SEQ ID NO: 32860 - DNA, 20 bp, Artificial Sequence
  chemically synthesized
aatgagagttaacttttagt

SEQ ID NO: 32861 - DNA, 20 bp, Artificial Sequence
  chemically synthesized
atgagagttaacttttagtc

SEQ ID NO: 32862 - DNA, 20 bp, Artificial Sequence
  chemically synthesized
ttaacttttagtcaggcata

SEQ ID NO: 32863 - DNA, 20 bp, Artificial Sequence
  chemically synthesized
ggcataaagataaaaaacca

SEQ ID NO: 32864 - DNA, 20 bp, Artificial Sequence
  chemically synthesized
aaaaccaaagtcttttactc

SEQ ID NO: 32865 - DNA, 20 bp, Artificial Sequence
  chemically synthesized
caaagtcttttactccggtg

SEQ ID NO: 32866 - DNA, 20 bp, Artificial Sequence
  chemically synthesized
aagtcttttactccggtgtg

SEQ ID NO: 32867 - DNA, 20 bp, Artificial Sequence
  chemically synthesized
actccggtgtggagtgtttt

SEQ ID NO: 32868 - DNA, 20 bp, Artificial Sequence
  chemically synthesized
ctccggtgtggagtgttttc

SEQ ID NO: 32869 - DNA, 20 bp, Artificial Sequence
  chemically synthesized
ttttcaggattcctaccaat

SEQ ID NO: 32870 - DNA, 20 bp, Artificial Sequence
  chemically synthesized
tttcaggattcctaccaatt

SEQ ID NO: 32871 - DNA, 20 bp, Artificial Sequence
  chemically synthesized
caggattcctaccaattagg

SEQ ID NO: 32872 - DNA, 20 bp, Artificial Sequence
  chemically synthesized
aggattcctaccaattagga

SEQ ID NO: 32873 - DNA, 20 bp, Artificial Sequence
  chemically synthesized
ggtgtttgattcttcaaact

SEQ ID NO: 32874 - DNA, 20 bp, Artificial Sequence
  chemically synthesized
aaacacctccccttaactga

SEQ ID NO: 32875 - DNA, 20 bp, Artificial Sequence
  chemically synthesized
actgatggattcttcaaact

SEQ ID NO: 32876 - DNA, 20 bp, Artificial Sequence
  chemically synthesized
ggattcttcaaactcagcat

SEQ ID NO: 32877 - DNA, 20 bp, Artificial Sequence
  chemically synthesized
tcttcaaactcagcatcagt

SEQ ID NO: 32878 - DNA, 20 bp, Artificial Sequence
  chemically synthesized
ttcaaactcagcatcagtta

SEQ ID NO: 32879 - DNA, 20 bp, Artificial Sequence
  chemically synthesized
tcaaactcagcatcagttag

SEQ ID NO: 32880 - DNA, 20 bp, Artificial Sequence
  chemically synthesized
caaactcagcatcagttaga

SEQ ID NO: 32881 - DNA, 20 bp, Artificial Sequence
  chemically synthesized
cagcatcagttagagggcat

SEQ ID NO: 32882 - DNA, 20 bp, Artificial Sequence
  chemically synthesized
agcatcagttagagggcatt

SEQ ID NO: 32883 - DNA, 20 bp, Artificial Sequence
  chemically synthesized
gcatcagttagagggcatta

SEQ ID NO: 32884 - DNA, 20 bp, Artificial Sequence
  chemically synthesized
cacttctcaaaccctgcatt

SEQ ID NO: 32885 - DNA, 20 bp, Artificial Sequence
  chemically synthesized
acttctcaaaccctgcattc

SEQ ID NO: 32886 - DNA, 20 bp, Artificial Sequence
  chemically synthesized
cttctcaaaccctgcattca

SEQ ID NO: 32887 - DNA, 20 bp, Artificial Sequence
  chemically synthesized
ctcaaaccctgcattcaggg

SEQ ID NO: 32888 - DNA, 20 bp, Artificial Sequence
  chemically synthesized
ttcagggaagatgtctgttg

SEQ ID NO: 32889 - DNA, 20 bp, Artificial Sequence
  chemically synthesized
tcagggaagatgtctgttgt

SEQ ID NO: 32890 - DNA, 20 bp, Artificial Sequence
  chemically synthesized
cagggaagatgtctgttgtg

SEQ ID NO: 32891 - DNA, 20 bp, Artificial Sequence
  chemically synthesized
ggaagatgtctgttgtgggg

SEQ ID NO: 32892 - DNA, 20 bp, Artificial Sequence
  chemically synthesized
atgtctgttgtggggtggtc

SEQ ID NO: 32893 - DNA, 20 bp, Artificial Sequence
  chemically synthesized
gtggggtggtctggcctact

SEQ ID NO: 32894 - DNA, 20 bp, Artificial Sequence
  chemically synthesized
tggtctggcctacttggcct

SEQ ID NO: 32895 - DNA, 20 bp, Artificial Sequence
  chemically synthesized
tggcctacttggcctgagcc

SEQ ID NO: 32896 - DNA, 20 bp, Artificial Sequence
  chemically synthesized
ggcctacttggcctgagcca

SEQ ID NO: 32897 - DNA, 20 bp, Artificial Sequence
  chemically synthesized
cttggcctgagccaaggttc

SEQ ID NO: 32898 - DNA, 20 bp, Artificial Sequence
  chemically synthesized
ttggcctgagccaaggttct

SEQ ID NO: 32899 - DNA, 20 bp, Artificial Sequence
  chemically synthesized
gcctgagccaaggttctggg

SEQ ID NO: 32900 - DNA, 20 bp, Artificial Sequence
  chemically synthesized
aggttctgggcagttctgtt

SEQ ID NO: 32901 - DNA, 20 bp, Artificial Sequence
  chemically synthesized
cagttacacatgcatgcgtt

SEQ ID NO: 32902 - DNA, 20 bp, Artificial Sequence
  chemically synthesized
catgcgttgagcattgattc

SEQ ID NO: 32903 - DNA, 20 bp, Artificial Sequence
  chemically synthesized
gttgagcattgattcaagcc

SEQ ID NO: 32904 - DNA, 20 bp, Artificial Sequence
  chemically synthesized
gcattgattcaagcctggcc

SEQ ID NO: 32905 - DNA, 20 bp, Artificial Sequence
  chemically synthesized
cattgattcaagcctggcct

SEQ ID NO: 32906 - DNA, 20 bp, Artificial Sequence
  chemically synthesized
ttcaagcctggcctgggcac

SEQ ID NO: 32907 - DNA, 20 bp, Artificial Sequence
  chemically synthesized
tcaagcctggcctgggcact

SEQ ID NO: 32908 - DNA, 20 bp, Artificial Sequence
  chemically synthesized
cctggcctgggcactaggca

SEQ ID NO: 32909 - DNA, 20 bp, Artificial Sequence
  chemically synthesized
ctgggcactaggcatggttt

SEQ ID NO: 32910 - DNA, 20 bp, Artificial Sequence
  chemically synthesized
ctaggcatggttttagatat

SEQ ID NO: 32911 - DNA, 20 bp, Artificial Sequence
  chemically synthesized
taggcatggttttagatatt

SEQ ID NO: 32912 - DNA, 20 bp, Artificial Sequence
  chemically synthesized
aggcatggttttagatatta

SEQ ID NO: 32913 - DNA, 20 bp, Artificial Sequence
  chemically synthesized
tattctgttttccttgcctt

SEQ ID NO: 32914 - DNA, 20 bp, Artificial Sequence
  chemically synthesized
ttttccttgccttaagatac

SEQ ID NO: 32915 - DNA, 20 bp, Artificial Sequence
  chemically synthesized
cttgccttaagataccagtc

SEQ ID NO: 32916 - DNA, 20 bp, Artificial Sequence
  chemically synthesized
gccttaagataccagtctag

SEQ ID NO: 32917 - DNA, 20 bp, Artificial Sequence
  chemically synthesized
ccttaagataccagtctagt

SEQ ID NO: 32918 - DNA, 20 bp, Artificial Sequence
  chemically synthesized
ttaagataccagtctagtag

SEQ ID NO: 32919 - DNA, 20 bp, Artificial Sequence
  chemically synthesized
ccagtctagtaggagccact

SEQ ID NO: 32920 - DNA, 20 bp, Artificial Sequence
  chemically synthesized
cagtctagtaggagccacta

SEQ ID NO: 32921 - DNA, 20 bp, Artificial Sequence
  chemically synthesized
agccactaaggccccttttt

SEQ ID NO: 32922 - DNA, 20 bp, Artificial Sequence
  chemically synthesized
ctaaggcccctttttgagcc

SEQ ID NO: 32923 - DNA, 20 bp, Artificial Sequence
  chemically synthesized
aacataccctgcttctaatc

SEQ ID NO: 32924 - DNA, 20 bp, Artificial Sequence
  chemically synthesized
cttctaatcaagtcatctat

SEQ ID NO: 32925 - DNA, 20 bp, Artificial Sequence
  chemically synthesized
ctaatcaagtcatctattgg

SEQ ID NO: 32926 - DNA, 20 bp, Artificial Sequence
  chemically synthesized
tcatctattggcagtgacct

SEQ ID NO: 32927 - DNA, 20 bp, Artificial Sequence
  chemically synthesized
catctattggcagtgacctt

SEQ ID NO: 32928 - DNA, 20 bp, Artificial Sequence
  chemically synthesized
cagtgaccttgggcaaatca

SEQ ID NO: 32929 - DNA, 20 bp, Artificial Sequence
  chemically synthesized
gggcaaatcatagtctctcc

SEQ ID NO: 32930 - DNA, 20 bp, Artificial Sequence
  chemically synthesized
attacttttctaattgaaac

SEQ ID NO: 32931 - DNA, 20 bp, Artificial Sequence
  chemically synthesized
aagaacctctctctataccc

SEQ ID NO: 32932 - DNA, 20 bp, Artificial Sequence
  chemically synthesized
ctataccccagatttatttt

SEQ ID NO: 32933 - DNA, 20 bp, Artificial Sequence
  chemically synthesized
tataccccagatttattttg

SEQ ID NO: 32934 - DNA, 20 bp, Artificial Sequence
  chemically synthesized
agatttattttgaggattat

SEQ ID NO: 32935 - DNA, 20 bp, Artificial Sequence
  chemically synthesized
gaggattatgagttaattca

SEQ ID NO: 32936 - DNA, 20 bp, Artificial Sequence
  chemically synthesized
taattcatagctaaaatgct

SEQ ID NO: 32937 - DNA, 20 bp, Artificial Sequence
  chemically synthesized
ctaaaatgcttagcacctaa

SEQ ID NO: 32938 - DNA, 20 bp, Artificial Sequence
  chemically synthesized
ttcaattgcgtattactaaa

SEQ ID NO: 32939 - DNA, 20 bp, Artificial Sequence
  chemically synthesized
aattgcgtattactaaaaag

SEQ ID NO: 32940 - DNA, 20 bp, Artificial Sequence
  chemically synthesized
attgcgtattactaaaaaga

SEQ ID NO: 32941 - DNA, 20 bp, Artificial Sequence
  chemically synthesized
aaaaagaaggaatgatttcc

SEQ ID NO: 32942 - DNA, 20 bp, Artificial Sequence
  chemically synthesized
aaagaaggaatgatttccta

SEQ ID NO: 32943 - DNA, 20 bp, Artificial Sequence
  chemically synthesized
aagaaggaatgatttcctag

SEQ ID NO: 32944 - DNA, 20 bp, Artificial Sequence
  chemically synthesized
gaaggaatgatttcctagag

SEQ ID NO: 32945 - DNA, 20 bp, Artificial Sequence
  chemically synthesized
aaggaatgatttcctagagg

SEQ ID NO: 32946 - DNA, 20 bp, Artificial Sequence
  chemically synthesized
cctagaggaggtgcttcttc

SEQ ID NO: 32947 - DNA, 20 bp, Artificial Sequence
  chemically synthesized
aggaggtgcttcttctggcc

SEQ ID NO: 32948 - DNA, 20 bp, Artificial Sequence
  chemically synthesized
ggaggtgcttcttctggcca

SEQ ID NO: 32949 - DNA, 20 bp, Artificial Sequence
  chemically synthesized
gaggtgcttcttctggccaa

SEQ ID NO: 32950 - DNA, 20 bp, Artificial Sequence
  chemically synthesized
cttctggccaagggctgatt

SEQ ID NO: 32951 - DNA, 20 bp, Artificial Sequence
  chemically synthesized
tctggccaagggctgattca

SEQ ID NO: 32952 - DNA, 20 bp, Artificial Sequence
  chemically synthesized
cagagccttaattaactaaa

SEQ ID NO: 32953 - DNA, 20 bp, Artificial Sequence
  chemically synthesized
cttaattaactaaatagatc

SEQ ID NO: 32954 - DNA, 20 bp, Artificial Sequence
  chemically synthesized
atagatcaagcatatctaac

SEQ ID NO: 32955 - DNA, 20 bp, Artificial Sequence
  chemically synthesized
aagcatatctaactggtcac

SEQ ID NO: 32956 - DNA, 20 bp, Artificial Sequence
  chemically synthesized
catatctaactggtcaccgg

SEQ ID NO: 32957 - DNA, 20 bp, Artificial Sequence
  chemically synthesized
atctaactggtcaccggaag

SEQ ID NO: 32958 - DNA, 20 bp, Artificial Sequence
  chemically synthesized
ggtcaccggaagtggtccat

SEQ ID NO: 32959 - DNA, 20 bp, Artificial Sequence
  chemically synthesized
gtcaccggaagtggtccatg

SEQ ID NO: 32960 - DNA, 20 bp, Artificial Sequence
  chemically synthesized
ggaagtggtccatgaggctg

SEQ ID NO: 32961 - DNA, 20 bp, Artificial Sequence
  chemically synthesized
ggtccatgaggctgcagcaa

SEQ ID NO: 32962 - DNA, 20 bp, Artificial Sequence
  chemically synthesized
gtccatgaggctgcagcaat

SEQ ID NO: 32963 - DNA, 20 bp, Artificial Sequence
  chemically synthesized
catgaggctgcagcaatggg

SEQ ID NO: 32964 - DNA, 20 bp, Artificial Sequence
  chemically synthesized
atgaggctgcagcaatggga

SEQ ID NO: 32965 - DNA, 20 bp, Artificial Sequence
  chemically synthesized
ctgcagcaatgggaaggtgt

SEQ ID NO: 32966 - DNA, 20 bp, Artificial Sequence
  chemically synthesized
gcagcaatgggaaggtgtca

SEQ ID NO: 32967 - DNA, 20 bp, Artificial Sequence
  chemically synthesized
gcaatgggaaggtgtcagag

SEQ ID NO: 32968 - DNA, 20 bp, Artificial Sequence
  chemically synthesized
caatgggaaggtgtcagagc

SEQ ID NO: 32969 - DNA, 20 bp, Artificial Sequence
  chemically synthesized
aatgggaaggtgtcagagca

SEQ ID NO: 32970 - DNA, 20 bp, Artificial Sequence
  chemically synthesized
atgggaaggtgtcagagcag

SEQ ID NO: 32971 - DNA, 20 bp, Artificial Sequence
  chemically synthesized
gaaggtgtcagagcaggggt

SEQ ID NO: 32972 - DNA, 20 bp, Artificial Sequence
  chemically synthesized
aaggtgtcagagcaggggtt

SEQ ID NO: 32973 - DNA, 20 bp, Artificial Sequence
  chemically synthesized
tcagagcaggggttgggaaa

SEQ ID NO: 32974 - DNA, 20 bp, Artificial Sequence
  chemically synthesized
caggggttgggaaaaagaca

SEQ ID NO: 32975 - DNA, 20 bp, Artificial Sequence
  chemically synthesized
ggggttgggaaaaagacata

SEQ ID NO: 32976 - DNA, 20 bp, Artificial Sequence
  chemically synthesized
ggttgggaaaaagacataga

SEQ ID NO: 32977 - DNA, 20 bp, Artificial Sequence
  chemically synthesized
gagagaaacgtgcatgtccg

SEQ ID NO: 32978 - DNA, 20 bp, Artificial Sequence
  chemically synthesized
agaaacgtgcatgtccgtag

SEQ ID NO: 32979 - DNA, 20 bp, Artificial Sequence
  chemically synthesized
aaacgtgcatgtccgtagtg

SEQ ID NO: 32980 - DNA, 20 bp, Artificial Sequence
  chemically synthesized
aacgtgcatgtccgtagtgg

SEQ ID NO: 32981 - DNA, 20 bp, Artificial Sequence
  chemically synthesized
acgtgcatgtccgtagtgga

SEQ ID NO: 32982 - DNA, 20 bp, Artificial Sequence
  chemically synthesized
cgtgcatgtccgtagtggag

SEQ ID NO: 32983 - DNA, 20 bp, Artificial Sequence
  chemically synthesized
tgcatgtccgtagtggaggg

SEQ ID NO: 32984 - DNA, 20 bp, Artificial Sequence
  chemically synthesized
ccgtagtggaggggagctct

SEQ ID NO: 32985 - DNA, 20 bp, Artificial Sequence
  chemically synthesized
cgtagtggaggggagctctt

SEQ ID NO: 32986 - DNA, 20 bp, Artificial Sequence
  chemically synthesized
gggagctcttaggatgtcta

SEQ ID NO: 32987 - DNA, 20 bp, Artificial Sequence
  chemically synthesized
taggatgtctacagatttcc

SEQ ID NO: 32988 - DNA, 20 bp, Artificial Sequence
  chemically synthesized
gacaataattgaaatgaaca

SEQ ID NO: 32989 - DNA, 20 bp, Artificial Sequence
  chemically synthesized
acaataattgaaatgaacaa

SEQ ID NO: 32990 - DNA, 20 bp, Artificial Sequence
  chemically synthesized
taattgaaatgaacaaaggc

SEQ ID NO: 32991 - DNA, 20 bp, Artificial Sequence
  chemically synthesized
aattgaaatgaacaaaggca

SEQ ID NO: 32992 - DNA, 20 bp, Artificial Sequence
  chemically synthesized
attgaaatgaacaaaggcaa

SEQ ID NO: 32993 - DNA, 20 bp, Artificial Sequence
  chemically synthesized
aaaggcaagggatgaccaat

SEQ ID NO: 32994 - DNA, 20 bp, Artificial Sequence
  chemically synthesized
aggcaagggatgaccaataa

SEQ ID NO: 32995 - DNA, 20 bp, Artificial Sequence
  chemically synthesized
atcacctttcccttgttctt

SEQ ID NO: 32996 - DNA, 20 bp, Artificial Sequence
  chemically synthesized
tttcccttgttcttcagctc

SEQ ID NO: 32997 - DNA, 20 bp, Artificial Sequence
  chemically synthesized
ttcagctccagctgtgccca

SEQ ID NO: 32998 - DNA, 20 bp, Artificial Sequence
  chemically synthesized
agctgtgcccacagacacca

SEQ ID NO: 32999 - DNA, 20 bp, Artificial Sequence
  chemically synthesized
gctgtgcccacagacaccac

SEQ ID NO: 33000 - DNA, 20 bp, Artificial Sequence
  chemically synthesized
ctgtgcccacagacaccaca

SEQ ID NO: 33001 - DNA, 20 bp, Artificial Sequence
  chemically synthesized
tgcccacagacaccacaggg

SEQ ID NO: 33002 - DNA, 20 bp, Artificial Sequence
  chemically synthesized
cacagggaagcctctgaaca

SEQ ID NO: 33003 - DNA, 20 bp, Artificial Sequence
  chemically synthesized
acagggaagcctctgaacac

SEQ ID NO: 33004 - DNA, 20 bp, Artificial Sequence
  chemically synthesized
cagggaagcctctgaacaca

SEQ ID NO: 33005 - DNA, 20 bp, Artificial Sequence
  chemically synthesized
agggaagcctctgaacacag

SEQ ID NO: 33006 - DNA, 20 bp, Artificial Sequence
  chemically synthesized
ctgaacacaggggtttgaac

SEQ ID NO: 33007 - DNA, 20 bp, Artificial Sequence
  chemically synthesized
tgaacacaggggtttgaacc

SEQ ID NO: 33008 - DNA, 20 bp, Artificial Sequence
  chemically synthesized
gaacacaggggtttgaacca

SEQ ID NO: 33009 - DNA, 20 bp, Artificial Sequence
  chemically synthesized
gtttgaaccagggcctctct

SEQ ID NO: 33010 - DNA, 20 bp, Artificial Sequence
  chemically synthesized
tttccaactctgataccctg

SEQ ID NO: 33011 - DNA, 20 bp, Artificial Sequence
  chemically synthesized
ctctgataccctgaagttct

SEQ ID NO: 33012 - DNA, 20 bp, Artificial Sequence
  chemically synthesized
tcagaaacttccataaattt

SEQ ID NO: 33013 - DNA, 20 bp, Artificial Sequence
  chemically synthesized
acttccataaattttggctg

SEQ ID NO: 33014 - DNA, 20 bp, Artificial Sequence
  chemically synthesized
tccataaattttggctgaag

SEQ ID NO: 33015 - DNA, 20 bp, Artificial Sequence
  chemically synthesized
aattttggctgaagaagcca

SEQ ID NO: 33016 - DNA, 20 bp, Artificial Sequence
  chemically synthesized
agaagccatagcaaacttgt

SEQ ID NO: 33017 - DNA, 20 bp, Artificial Sequence
  chemically synthesized
gccatagcaaacttgtcaga

SEQ ID NO: 33018 - DNA, 20 bp, Artificial Sequence
  chemically synthesized
atggtttcttacctttaact

SEQ ID NO: 33019 - DNA, 20 bp, Artificial Sequence
  chemically synthesized
ttttctctctcctctatgtg

SEQ ID NO: 33020 - DNA, 20 bp, Artificial Sequence
  chemically synthesized
tcctctatgtgtggtgactt

SEQ ID NO: 33021 - DNA, 20 bp, Artificial Sequence
  chemically synthesized
cctctatgtgtggtgacttc

SEQ ID NO: 33022 - DNA, 20 bp, Artificial Sequence
  chemically synthesized
tgtggtgacttcaggaaacc

SEQ ID NO: 33023 - DNA, 20 bp, Artificial Sequence
  chemically synthesized
gtggtgacttcaggaaaccc

SEQ ID NO: 33024 - DNA, 20 bp, Artificial Sequence
  chemically synthesized
gacttcaggaaacccaggcc

SEQ ID NO: 33025 - DNA, 20 bp, Artificial Sequence
  chemically synthesized
cttcaggaaacccaggccca

SEQ ID NO: 33026 - DNA, 20 bp, Artificial Sequence
  chemically synthesized
ttcaggaaacccaggcccag

SEQ ID NO: 33027 - DNA, 20 bp, Artificial Sequence
  chemically synthesized
acccaggcccagaggatata

SEQ ID NO: 33028 - DNA, 20 bp, Artificial Sequence
  chemically synthesized
ttctccttcaaaccactctt

SEQ ID NO: 33029 - DNA, 20 bp, Artificial Sequence
  chemically synthesized
aaaccactctttggatattc

SEQ ID NO: 33030 - DNA, 20 bp, Artificial Sequence
  chemically synthesized
actgcttcactgcgcttcac

SEQ ID NO: 33031 - DNA, 20 bp, Artificial Sequence
  chemically synthesized
cttcactgcgcttcactggt

SEQ ID NO: 33032 - DNA, 20 bp, Artificial Sequence
  chemically synthesized
ggtcagtgcgtcactcaaac

SEQ ID NO: 33033 - DNA, 20 bp, Artificial Sequence
  chemically synthesized
gcgtcactcaaactagctga

SEQ ID NO: 33034 - DNA, 20 bp, Artificial Sequence
  chemically synthesized
agaattgtctaactcataca

SEQ ID NO: 33035 - DNA, 20 bp, Artificial Sequence
  chemically synthesized
gaattgtctaactcatacac

SEQ ID NO: 33036 - DNA, 20 bp, Artificial Sequence
  chemically synthesized
aattgtctaactcatacaca

SEQ ID NO: 33037 - DNA, 20 bp, Artificial Sequence
  chemically synthesized
ctaactcatacacagggaca

SEQ ID NO: 33038 - DNA, 20 bp, Artificial Sequence
  chemically synthesized
tcatacacagggacaaagtc

SEQ ID NO: 33039 - DNA, 20 bp, Artificial Sequence
  chemically synthesized
acacagggacaaagtccagc

SEQ ID NO: 33040 - DNA, 20 bp, Artificial Sequence
  chemically synthesized
gtccagcaagcttatttaac

SEQ ID NO: 33041 - DNA, 20 bp, Artificial Sequence
  chemically synthesized
accggttacacaattgcctt

SEQ ID NO: 33042 - DNA, 20 bp, Artificial Sequence
  chemically synthesized
acaattgcctttggttttta

SEQ ID NO: 33043 - DNA, 20 bp, Artificial Sequence
  chemically synthesized
ggtttttacagtttgttcct

SEQ ID NO: 33044 - DNA, 20 bp, Artificial Sequence
  chemically synthesized
agtttgttcctaagtgtttc

SEQ ID NO: 33045 - DNA, 20 bp, Artificial Sequence
  chemically synthesized
tttgttcctaagtgtttcca

SEQ ID NO: 33046 - DNA, 20 bp, Artificial Sequence
  chemically synthesized
ttgttcctaagtgtttccag

SEQ ID NO: 33047 - DNA, 20 bp, Artificial Sequence
  chemically synthesized
cctaagtgtttccagaggct

SEQ ID NO: 33048 - DNA, 20 bp, Artificial Sequence
  chemically synthesized
ggcttggttcctcttcacct

SEQ ID NO: 33049 - DNA, 20 bp, Artificial Sequence
  chemically synthesized
gcttggttcctcttcacctg

SEQ ID NO: 33050 - DNA, 20 bp, Artificial Sequence
  chemically synthesized
tggttcctcttcacctgagg

SEQ ID NO: 33051 - DNA, 20 bp, Artificial Sequence
  chemically synthesized
gttcctcttcacctgaggta

SEQ ID NO: 33052 - DNA, 20 bp, Artificial Sequence
  chemically synthesized
gattgaccaattatttattc

SEQ ID NO: 33053 - DNA, 20 bp, Artificial Sequence
  chemically synthesized
caattatttattccagttaa

SEQ ID NO: 33054 - DNA, 20 bp, Artificial Sequence
  chemically synthesized
ttatttattccagttaaaag

SEQ ID NO: 33055 - DNA, 20 bp, Artificial Sequence
  chemically synthesized
tatttattccagttaaaagt

SEQ ID NO: 33056 - DNA, 20 bp, Artificial Sequence
  chemically synthesized
taaaagtaggcttatttcaa

SEQ ID NO: 33057 - DNA, 20 bp, Artificial Sequence
  chemically synthesized
aaaagtaggcttatttcaaa

SEQ ID NO: 33058 - DNA, 20 bp, Artificial Sequence
  chemically synthesized
agtaggcttatttcaaaagg

SEQ ID NO: 33059 - DNA, 20 bp, Artificial Sequence
  chemically synthesized
taggcttatttcaaaaggca

SEQ ID NO: 33060 - DNA, 20 bp, Artificial Sequence
  chemically synthesized
ttcaaaaggcagagaatttg

SEQ ID NO: 33061 - DNA, 20 bp, Artificial Sequence
  chemically synthesized
ggcagagaatttgaagctat

SEQ ID NO: 33062 - DNA, 20 bp, Artificial Sequence
  chemically synthesized
gcagagaatttgaagctatc

SEQ ID NO: 33063 - DNA, 20 bp, Artificial Sequence
  chemically synthesized
cagagaatttgaagctatcg

SEQ ID NO: 33064 - DNA, 20 bp, Artificial Sequence
  chemically synthesized
gaatttgaagctatcgggga

SEQ ID NO: 33065 - DNA, 20 bp, Artificial Sequence
  chemically synthesized
aatttgaagctatcggggaa

SEQ ID NO: 33066 - DNA, 20 bp, Artificial Sequence
  chemically synthesized
gctatcggggaaaggaactg

SEQ ID NO: 33067 - DNA, 20 bp, Artificial Sequence
  chemically synthesized
atcggggaaaggaactgtgg

SEQ ID NO: 33068 - DNA, 20 bp, Artificial Sequence
  chemically synthesized
gggaaaggaactgtggcaga

SEQ ID NO: 33069 - DNA, 20 bp, Artificial Sequence
  chemically synthesized
cagatagtgcctgctgtgtg

SEQ ID NO: 33070 - DNA, 20 bp, Artificial Sequence
  chemically synthesized
atagtgcctgctgtgtgtgg

SEQ ID NO: 33071 - DNA, 20 bp, Artificial Sequence
  chemically synthesized
agtgcctgctgtgtgtggtg

SEQ ID NO: 33072 - DNA, 20 bp, Artificial Sequence
  chemically synthesized
gtgcctgctgtgtgtggtgg

SEQ ID NO: 33073 - DNA, 20 bp, Artificial Sequence
  chemically synthesized
gtggtggaggattctctgct

SEQ ID NO: 33074 - DNA, 20 bp, Artificial Sequence
  chemically synthesized
ttctctgctcagtcctgact

SEQ ID NO: 33075 - DNA, 20 bp, Artificial Sequence
  chemically synthesized
tctctgctcagtcctgactc

SEQ ID NO: 33076 - DNA, 20 bp, Artificial Sequence
  chemically synthesized
tgctcagtcctgactcaggc

SEQ ID NO: 33077 - DNA, 20 bp, Artificial Sequence
  chemically synthesized
gctcagtcctgactcaggct

SEQ ID NO: 33078 - DNA, 20 bp, Artificial Sequence
  chemically synthesized
cagtcctgactcaggctagg

SEQ ID NO: 33079 - DNA, 20 bp, Artificial Sequence
  chemically synthesized
agtcctgactcaggctagga

SEQ ID NO: 33080 - DNA, 20 bp, Artificial Sequence
  chemically synthesized
tgactcaggctaggaaggaa

SEQ ID NO: 33081 - DNA, 20 bp, Artificial Sequence
  chemically synthesized
gactcaggctaggaaggaac

SEQ ID NO: 33082 - DNA, 20 bp, Artificial Sequence
  chemically synthesized
actcaggctaggaaggaaca

SEQ ID NO: 33083 - DNA, 20 bp, Artificial Sequence
  chemically synthesized
caggctaggaaggaacaggg

SEQ ID NO: 33084 - DNA, 20 bp, Artificial Sequence
  chemically synthesized
ggaaggaacagggcagtgct

SEQ ID NO: 33085 - DNA, 20 bp, Artificial Sequence
  chemically synthesized
cagggcagtgctgagtctcc

SEQ ID NO: 33086 - DNA, 20 bp, Artificial Sequence
  chemically synthesized
gggcagtgctgagtctcctg

SEQ ID NO: 33087 - DNA, 20 bp, Artificial Sequence
  chemically synthesized
agcactgccctgttccttcc

SEQ ID NO: 33088 - DNA, 20 bp, Artificial Sequence
  chemically synthesized
gccctgttccttcctagcct

SEQ ID NO: 33089 - DNA, 20 bp, Artificial Sequence
  chemically synthesized
tgttccttcctagcctgagt

SEQ ID NO: 33090 - DNA, 20 bp, Artificial Sequence
  chemically synthesized
gttccttcctagcctgagtc

SEQ ID NO: 33091 - DNA, 20 bp, Artificial Sequence
  chemically synthesized
tcctagcctgagtcaggact

SEQ ID NO: 33092 - DNA, 20 bp, Artificial Sequence
  chemically synthesized
tagcctgagtcaggactgag

SEQ ID NO: 33093 - DNA, 20 bp, Artificial Sequence
  chemically synthesized
gcctgagtcaggactgagca

SEQ ID NO: 33094 - DNA, 20 bp, Artificial Sequence
  chemically synthesized
agagaatcctccaccacaca

SEQ ID NO: 33095 - DNA, 20 bp, Artificial Sequence
  chemically synthesized
gaatcctccaccacacacag

SEQ ID NO: 33096 - DNA, 20 bp, Artificial Sequence
  chemically synthesized
aatcctccaccacacacagc

SEQ ID NO: 33097 - DNA, 20 bp, Artificial Sequence
  chemically synthesized
acagcaggcactatctgcca

SEQ ID NO: 33098 - DNA, 20 bp, Artificial Sequence
  chemically synthesized
gccacagttcctttccccga

SEQ ID NO: 33099 - DNA, 20 bp, Artificial Sequence
  chemically synthesized
aattctctgccttttgaaat

SEQ ID NO: 33100 - DNA, 20 bp, Artificial Sequence
  chemically synthesized
gaaataagcctacttttaac

SEQ ID NO: 33101 - DNA, 20 bp, Artificial Sequence
  chemically synthesized
ttttaactggaataaataat

SEQ ID NO: 33102 - DNA, 20 bp, Artificial Sequence
  chemically synthesized
taattggtcaatctctacct

SEQ ID NO: 33103 - DNA, 20 bp, Artificial Sequence
  chemically synthesized
aattggtcaatctctacctc

SEQ ID NO: 33104 - DNA, 20 bp, Artificial Sequence
  chemically synthesized
gtcaatctctacctcaggtg

SEQ ID NO: 33105 - DNA, 20 bp, Artificial Sequence
  chemically synthesized
caatctctacctcaggtgaa

SEQ ID NO: 33106 - DNA, 20 bp, Artificial Sequence
  chemically synthesized
aatctctacctcaggtgaag

SEQ ID NO: 33107 - DNA, 20 bp, Artificial Sequence
  chemically synthesized
acctcaggtgaagaggaacc

SEQ ID NO: 33108 - DNA, 20 bp, Artificial Sequence
  chemically synthesized
gtgaagaggaaccaagcctc

SEQ ID NO: 33109 - DNA, 20 bp, Artificial Sequence
  chemically synthesized
accaagcctctggaaacact

SEQ ID NO: 33110 - DNA, 20 bp, Artificial Sequence
  chemically synthesized
ccaagcctctggaaacactt

SEQ ID NO: 33111 - DNA, 20 bp, Artificial Sequence
  chemically synthesized
ggaacaaactgtaaaaacca

SEQ ID NO: 33112 - DNA, 20 bp, Artificial Sequence
  chemically synthesized
gaacaaactgtaaaaaccaa

SEQ ID NO: 33113 - DNA, 20 bp, Artificial Sequence
  chemically synthesized
accaaaggcaattgtgtaac

SEQ ID NO: 33114 - DNA, 20 bp, Artificial Sequence
  chemically synthesized
aattgtgtaaccggttaaat

SEQ ID NO: 33115 - DNA, 20 bp, Artificial Sequence
  chemically synthesized
aaccggttaaataagcttgc

SEQ ID NO: 33116 - DNA, 20 bp, Artificial Sequence
  chemically synthesized
tggactttgtccctgtgtat

SEQ ID NO: 33117 - DNA, 20 bp, Artificial Sequence
  chemically synthesized
ctttgtccctgtgtatgagt

SEQ ID NO: 33118 - DNA, 20 bp, Artificial Sequence
  chemically synthesized
tatgagttagacaattcttt

SEQ ID NO: 33119 - DNA, 20 bp, Artificial Sequence
  chemically synthesized
agttagacaattctttcagc

SEQ ID NO: 33120 - DNA, 20 bp, Artificial Sequence
  chemically synthesized
acaattctttcagctagttt

SEQ ID NO: 33121 - DNA, 20 bp, Artificial Sequence
  chemically synthesized
agtttgagtgacgcactgac

SEQ ID NO: 33122 - DNA, 20 bp, Artificial Sequence
  chemically synthesized
gagtgacgcactgaccagtg

SEQ ID NO: 33123 - DNA, 20 bp, Artificial Sequence
  chemically synthesized
acgcactgaccagtgaagcg

SEQ ID NO: 33124 - DNA, 20 bp, Artificial Sequence
  chemically synthesized
ctgaccagtgaagcgcagtg

SEQ ID NO: 33125 - DNA, 20 bp, Artificial Sequence
  chemically synthesized
accagtgaagcgcagtgaag

SEQ ID NO: 33126 - DNA, 20 bp, Artificial Sequence
  chemically synthesized
agtgaagcgcagtgaagcag

SEQ ID NO: 33127 - DNA, 20 bp, Artificial Sequence
  chemically synthesized
gtgaagcgcagtgaagcagt

SEQ ID NO: 33128 - DNA, 20 bp, Artificial Sequence
  chemically synthesized
cgcagtgaagcagtgggaac

SEQ ID NO: 33129 - DNA, 20 bp, Artificial Sequence
  chemically synthesized
agtgggaaccggaatatcca

SEQ ID NO: 33130 - DNA, 20 bp, Artificial Sequence
  chemically synthesized
tgggaaccggaatatccaaa

SEQ ID NO: 33131 - DNA, 20 bp, Artificial Sequence
  chemically synthesized
gaaccggaatatccaaagag

SEQ ID NO: 33132 - DNA, 20 bp, Artificial Sequence
  chemically synthesized
aatatccaaagagtggtttg

SEQ ID NO: 33133 - DNA, 20 bp, Artificial Sequence
  chemically synthesized
atatccaaagagtggtttga

SEQ ID NO: 33134 - DNA, 20 bp, Artificial Sequence
  chemically synthesized
atccaaagagtggtttgaag

SEQ ID NO: 33135 - DNA, 20 bp, Artificial Sequence
  chemically synthesized
aaagagtggtttgaaggaga

SEQ ID NO: 33136 - DNA, 20 bp, Artificial Sequence
  chemically synthesized
gagtggtttgaaggagaaag

SEQ ID NO: 33137 - DNA, 20 bp, Artificial Sequence
  chemically synthesized
tgaaggagaaagaagcattg

SEQ ID NO: 33138 - DNA, 20 bp, Artificial Sequence
  chemically synthesized
cattgtggctttatatcctc

SEQ ID NO: 33139 - DNA, 20 bp, Artificial Sequence
  chemically synthesized
attgtggctttatatcctct

SEQ ID NO: 33140 - DNA, 20 bp, Artificial Sequence
  chemically synthesized
ggctttatatcctctgggcc

SEQ ID NO: 33141 - DNA, 20 bp, Artificial Sequence
  chemically synthesized
gctttatatcctctgggcct

SEQ ID NO: 33142 - DNA, 20 bp, Artificial Sequence
  chemically synthesized
ctctgggcctgggtttcctg

SEQ ID NO: 33143 - DNA, 20 bp, Artificial Sequence
  chemically synthesized
tttcctgaagtcaccacaca

SEQ ID NO: 33144 - DNA, 20 bp, Artificial Sequence
  chemically synthesized
tcctgaagtcaccacacata

SEQ ID NO: 33145 - DNA, 20 bp, Artificial Sequence
  chemically synthesized
cctgaagtcaccacacatag

SEQ ID NO: 33146 - DNA, 20 bp, Artificial Sequence
  chemically synthesized
tgaagtcaccacacatagag

SEQ ID NO: 33147 - DNA, 20 bp, Artificial Sequence
  chemically synthesized
aagtcaccacacatagagga

SEQ ID NO: 33148 - DNA, 20 bp, Artificial Sequence
  chemically synthesized
gtcaccacacatagaggaga

SEQ ID NO: 33149 - DNA, 20 bp, Artificial Sequence
  chemically synthesized
cacatagaggagagagaaaa

SEQ ID NO: 33150 - DNA, 20 bp, Artificial Sequence
  chemically synthesized
agaggagagagaaaatggct

SEQ ID NO: 33151 - DNA, 20 bp, Artificial Sequence
  chemically synthesized
gagagaaaatggctgagtta

SEQ ID NO: 33152 - DNA, 20 bp, Artificial Sequence
  chemically synthesized
agagaaaatggctgagttaa

SEQ ID NO: 33153 - DNA, 20 bp, Artificial Sequence
  chemically synthesized
aaaatggctgagttaaaggt

SEQ ID NO: 33154 - DNA, 20 bp, Artificial Sequence
  chemically synthesized
aaggtaagaaaccatctgac

SEQ ID NO: 33155 - DNA, 20 bp, Artificial Sequence
  chemically synthesized
accatctgacaagtttgcta

SEQ ID NO: 33156 - DNA, 20 bp, Artificial Sequence
  chemically synthesized
caagtttgctatggcttctt

SEQ ID NO: 33157 - DNA, 20 bp, Artificial Sequence
  chemically synthesized
gcttcttcagccaaaattta

SEQ ID NO: 33158 - DNA, 20 bp, Artificial Sequence
  chemically synthesized
tcttcagccaaaatttatgg

SEQ ID NO: 33159 - DNA, 20 bp, Artificial Sequence
  chemically synthesized
caaaatttatggaagtttct

SEQ ID NO: 33160 - DNA, 20 bp, Artificial Sequence
  chemically synthesized
atggaagtttctgagaactt

SEQ ID NO: 33161 - DNA, 20 bp, Artificial Sequence
  chemically synthesized
tggaagtttctgagaacttc

SEQ ID NO: 33162 - DNA, 20 bp, Artificial Sequence
  chemically synthesized
ggaagtttctgagaacttca

SEQ ID NO: 33163 - DNA, 20 bp, Artificial Sequence
  chemically synthesized
ttctgagaacttcagggtat

SEQ ID NO: 33164 - DNA, 20 bp, Artificial Sequence
  chemically synthesized
ctgagaacttcagggtatca

SEQ ID NO: 33165 - DNA, 20 bp, Artificial Sequence
  chemically synthesized
gaacttcagggtatcagagt

SEQ ID NO: 33166 - DNA, 20 bp, Artificial Sequence
  chemically synthesized
tcagggtatcagagttggaa

SEQ ID NO: 33167 - DNA, 20 bp, Artificial Sequence
  chemically synthesized
tatcagagttggaaaagact

SEQ ID NO: 33168 - DNA, 20 bp, Artificial Sequence
  chemically synthesized
tcagagttggaaaagactta

SEQ ID NO: 33169 - DNA, 20 bp, Artificial Sequence
  chemically synthesized
agagttggaaaagacttaga

SEQ ID NO: 33170 - DNA, 20 bp, Artificial Sequence
  chemically synthesized
gagttggaaaagacttagag

SEQ ID NO: 33171 - DNA, 20 bp, Artificial Sequence
  chemically synthesized
gaaaagacttagagaggccc

SEQ ID NO: 33172 - DNA, 20 bp, Artificial Sequence
  chemically synthesized
ctggttcaaacccctgtgtt

SEQ ID NO: 33173 - DNA, 20 bp, Artificial Sequence
  chemically synthesized
ggttcaaacccctgtgttca

SEQ ID NO: 33174 - DNA, 20 bp, Artificial Sequence
  chemically synthesized
gttcaaacccctgtgttcag

SEQ ID NO: 33175 - DNA, 20 bp, Artificial Sequence
  chemically synthesized
tgtgttcagaggcttccctg

SEQ ID NO: 33176 - DNA, 20 bp, Artificial Sequence
  chemically synthesized
aggcttccctgtggtgtctg

SEQ ID NO: 33177 - DNA, 20 bp, Artificial Sequence
  chemically synthesized
ggcttccctgtggtgtctgt

SEQ ID NO: 33178 - DNA, 20 bp, Artificial Sequence
  chemically synthesized
ccctgtggtgtctgtgggca

SEQ ID NO: 33179 - DNA, 20 bp, Artificial Sequence
  chemically synthesized
gtggtgtctgtgggcacagc

SEQ ID NO: 33180 - DNA, 20 bp, Artificial Sequence
  chemically synthesized
ggtgtctgtgggcacagctg

SEQ ID NO: 33181 - DNA, 20 bp, Artificial Sequence
  chemically synthesized
tgtgggcacagctggagctg

SEQ ID NO: 33182 - DNA, 20 bp, Artificial Sequence
  chemically synthesized
cacagctggagctgaagaac

SEQ ID NO: 33183 - DNA, 20 bp, Artificial Sequence
  chemically synthesized
acagctggagctgaagaaca

SEQ ID NO: 33184 - DNA, 20 bp, Artificial Sequence
  chemically synthesized
cagctggagctgaagaacaa

SEQ ID NO: 33185 - DNA, 20 bp, Artificial Sequence
  chemically synthesized
tggagctgaagaacaaggga

SEQ ID NO: 33186 - DNA, 20 bp, Artificial Sequence
  chemically synthesized
ggagctgaagaacaagggaa

SEQ ID NO: 33187 - DNA, 20 bp, Artificial Sequence
  chemically synthesized
agaacaagggaaaggtgata

SEQ ID NO: 33188 - DNA, 20 bp, Artificial Sequence
  chemically synthesized
gaacaagggaaaggtgataa

SEQ ID NO: 33189 - DNA, 20 bp, Artificial Sequence
  chemically synthesized
aagggaaaggtgataaagga

SEQ ID NO: 33190 - DNA, 20 bp, Artificial Sequence
  chemically synthesized
ggtgataaaggaaagaaatg

SEQ ID NO: 33191 - DNA, 20 bp, Artificial Sequence
  chemically synthesized
gaaagaaatgaagctcttat

SEQ ID NO: 33192 - DNA, 20 bp, Artificial Sequence
  chemically synthesized
gttcatttcaattattgtct

SEQ ID NO: 33193 - DNA, 20 bp, Artificial Sequence
  chemically synthesized
attattgtcttggaaatctg

SEQ ID NO: 33194 - DNA, 20 bp, Artificial Sequence
  chemically synthesized
tggaaatctgtagacatcct

SEQ ID NO: 33195 - DNA, 20 bp, Artificial Sequence
  chemically synthesized
gaaatctgtagacatcctaa

SEQ ID NO: 33196 - DNA, 20 bp, Artificial Sequence
  chemically synthesized
ctaagagctcccctccacta

SEQ ID NO: 33197 - DNA, 20 bp, Artificial Sequence
  chemically synthesized
ctgacaccttcccattgctg

SEQ ID NO: 33198 - DNA, 20 bp, Artificial Sequence
  chemically synthesized
ttcccattgctgcagcctca

SEQ ID NO: 33199 - DNA, 20 bp, Artificial Sequence
  chemically synthesized
gcagcctcatggaccacttc

SEQ ID NO: 33200 - DNA, 20 bp, Artificial Sequence
  chemically synthesized
catggaccacttccggtgac

SEQ ID NO: 33201 - DNA, 20 bp, Artificial Sequence
  chemically synthesized
gaccacttccggtgaccagt

SEQ ID NO: 33202 - DNA, 20 bp, Artificial Sequence
  chemically synthesized
ttagatatgcttgatctatt

SEQ ID NO: 33203 - DNA, 20 bp, Artificial Sequence
  chemically synthesized
cttgatctatttagttaatt

SEQ ID NO: 33204 - DNA, 20 bp, Artificial Sequence
  chemically synthesized
ttgatctatttagttaatta

SEQ ID NO: 33205 - DNA, 20 bp, Artificial Sequence
  chemically synthesized
agttaattaaggctctgaat

SEQ ID NO: 33206 - DNA, 20 bp, Artificial Sequence
  chemically synthesized
taaggctctgaatcagccct

SEQ ID NO: 33207 - DNA, 20 bp, Artificial Sequence
  chemically synthesized
gctctgaatcagcccttggc

SEQ ID NO: 33208 - DNA, 20 bp, Artificial Sequence
  chemically synthesized
ctgaatcagcccttggccag

SEQ ID NO: 33209 - DNA, 20 bp, Artificial Sequence
  chemically synthesized
aatcagcccttggccagaag

SEQ ID NO: 33210 - DNA, 20 bp, Artificial Sequence
  chemically synthesized
gccagaagaagcacctcctc

SEQ ID NO: 33211 - DNA, 20 bp, Artificial Sequence
  chemically synthesized
ccagaagaagcacctcctct

SEQ ID NO: 33212 - DNA, 20 bp, Artificial Sequence
  chemically synthesized
aggaaatcattccttctttt

SEQ ID NO: 33213 - DNA, 20 bp, Artificial Sequence
  chemically synthesized
tttagtaatacgcaattgaa

SEQ ID NO: 33214 - DNA, 20 bp, Artificial Sequence
  chemically synthesized
acgcaattgaaaagtatgtg

SEQ ID NO: 33215 - DNA, 20 bp, Artificial Sequence
  chemically synthesized
cgcaattgaaaagtatgtgt

SEQ ID NO: 33216 - DNA, 20 bp, Artificial Sequence
  chemically synthesized
atgtgtgggttatgtgctgt

SEQ ID NO: 33217 - DNA, 20 bp, Artificial Sequence
  chemically synthesized
tgtgtgggttatgtgctgtt

SEQ ID NO: 33218 - DNA, 20 bp, Artificial Sequence
  chemically synthesized
gttatgtgctgttaggtgct

SEQ ID NO: 33219 - DNA, 20 bp, Artificial Sequence
  chemically synthesized
ctgttaggtgctaagcattt

SEQ ID NO: 33220 - DNA, 20 bp, Artificial Sequence
  chemically synthesized
cataatcctcaaaataaatc

SEQ ID NO: 33221 - DNA, 20 bp, Artificial Sequence
  chemically synthesized
ataatcctcaaaataaatct

SEQ ID NO: 33222 - DNA, 20 bp, Artificial Sequence
  chemically synthesized
taatcctcaaaataaatctg

SEQ ID NO: 33223 - DNA, 20 bp, Artificial Sequence
  chemically synthesized
ctcaaaataaatctggggta

SEQ ID NO: 33224 - DNA, 20 bp, Artificial Sequence
  chemically synthesized
caaaataaatctggggtata

SEQ ID NO: 33225 - DNA, 20 bp, Artificial Sequence
  chemically synthesized
aaataaatctggggtataga

SEQ ID NO: 33226 - DNA, 20 bp, Artificial Sequence
  chemically synthesized
ataaatctggggtatagaga

SEQ ID NO: 33227 - DNA, 20 bp, Artificial Sequence
  chemically synthesized
taaatctggggtatagagag

SEQ ID NO: 33228 - DNA, 20 bp, Artificial Sequence
  chemically synthesized
agagaggttcttgtttcaat

SEQ ID NO: 33229 - DNA, 20 bp, Artificial Sequence
  chemically synthesized
ggttcttgtttcaattagaa

SEQ ID NO: 33230 - DNA, 20 bp, Artificial Sequence
  chemically synthesized
tcaattagaaaagtaatgct

SEQ ID NO: 33231 - DNA, 20 bp, Artificial Sequence
  chemically synthesized
aattagaaaagtaatgcttg

SEQ ID NO: 33232 - DNA, 20 bp, Artificial Sequence
  chemically synthesized
ttagaaaagtaatgcttgga

SEQ ID NO: 33233 - DNA, 20 bp, Artificial Sequence
  chemically synthesized
ggagagactatgatttgccc

SEQ ID NO: 33234 - DNA, 20 bp, Artificial Sequence
  chemically synthesized
gagagactatgatttgccca

SEQ ID NO: 33235 - DNA, 20 bp, Artificial Sequence
  chemically synthesized
ttgcccaaggtcactgccaa

SEQ ID NO: 33236 - DNA, 20 bp, Artificial Sequence
  chemically synthesized
ctgccaatagatgacttgat

SEQ ID NO: 33237 - DNA, 20 bp, Artificial Sequence
  chemically synthesized
ccaatagatgacttgattag

SEQ ID NO: 33238 - DNA, 20 bp, Artificial Sequence
  chemically synthesized
atagatgacttgattagaag

SEQ ID NO: 33239 - DNA, 20 bp, Artificial Sequence
  chemically synthesized
tagatgacttgattagaagc

SEQ ID NO: 33240 - DNA, 20 bp, Artificial Sequence
  chemically synthesized
agatgacttgattagaagca

SEQ ID NO: 33241 - DNA, 20 bp, Artificial Sequence
  chemically synthesized
gcagggtatgtttgaatgcg

SEQ ID NO: 33242 - DNA, 20 bp, Artificial Sequence
  chemically synthesized
gtatgtttgaatgcgaagtc

SEQ ID NO: 33243 - DNA, 20 bp, Artificial Sequence
  chemically synthesized
tatgtttgaatgcgaagtcc

SEQ ID NO: 33244 - DNA, 20 bp, Artificial Sequence
  chemically synthesized
atgcgaagtccaggctcaaa

SEQ ID NO: 33245 - DNA, 20 bp, Artificial Sequence
  chemically synthesized
tgcgaagtccaggctcaaaa

SEQ ID NO: 33246 - DNA, 20 bp, Artificial Sequence
  chemically synthesized
gcgaagtccaggctcaaaaa

SEQ ID NO: 33247 - DNA, 20 bp, Artificial Sequence
  chemically synthesized
cgaagtccaggctcaaaaag

SEQ ID NO: 33248 - DNA, 20 bp, Artificial Sequence
  chemically synthesized
ccaggctcaaaaaggggcct

SEQ ID NO: 33249 - DNA, 20 bp, Artificial Sequence
  chemically synthesized
ggctcaaaaaggggccttag

SEQ ID NO: 33250 - DNA, 20 bp, Artificial Sequence
  chemically synthesized
ggggccttagtggctcctac

SEQ ID NO: 33251 - DNA, 20 bp, Artificial Sequence
  chemically synthesized
cttagtggctcctactagac

SEQ ID NO: 33252 - DNA, 20 bp, Artificial Sequence
  chemically synthesized
tcctactagactggtatctt

SEQ ID NO: 33253 - DNA, 20 bp, Artificial Sequence
  chemically synthesized
cctactagactggtatctta

SEQ ID NO: 33254 - DNA, 20 bp, Artificial Sequence
  chemically synthesized
ctagactggtatcttaaggc

SEQ ID NO: 33255 - DNA, 20 bp, Artificial Sequence
  chemically synthesized
tagactggtatcttaaggca

SEQ ID NO: 33256 - DNA, 20 bp, Artificial Sequence
  chemically synthesized
gtatcttaaggcaaggaaaa

SEQ ID NO: 33257 - DNA, 20 bp, Artificial Sequence
  chemically synthesized
ctaatatctaaaaccatgcc

SEQ ID NO: 33258 - DNA, 20 bp, Artificial Sequence
  chemically synthesized
ctaaaaccatgcctagtgcc

SEQ ID NO: 33259 - DNA, 20 bp, Artificial Sequence
  chemically synthesized
taaaaccatgcctagtgccc

SEQ ID NO: 33260 - DNA, 20 bp, Artificial Sequence
  chemically synthesized
accatgcctagtgcccaggc

SEQ ID NO: 33261 - DNA, 20 bp, Artificial Sequence
  chemically synthesized
ccatgcctagtgcccaggcc

SEQ ID NO: 33262 - DNA, 20 bp, Artificial Sequence
  chemically synthesized
cgcatgcatgtgtaactgaa

SEQ ID NO: 33263 - DNA, 20 bp, Artificial Sequence
  chemically synthesized
tgtaactgaacagaactgcc

SEQ ID NO: 33264 - DNA, 20 bp, Artificial Sequence
  chemically synthesized
aacagaactgcccagaacct

SEQ ID NO: 33265 - DNA, 20 bp, Artificial Sequence
  chemically synthesized
aactgcccagaaccttggct

SEQ ID NO: 33266 - DNA, 20 bp, Artificial Sequence
  chemically synthesized
actgcccagaaccttggctc

SEQ ID NO: 33267 - DNA, 20 bp, Artificial Sequence
  chemically synthesized
ccagaaccttggctcaggcc

SEQ ID NO: 33268 - DNA, 20 bp, Artificial Sequence
  chemically synthesized
gaaccttggctcaggccaag

SEQ ID NO: 33269 - DNA, 20 bp, Artificial Sequence
  chemically synthesized
aaccttggctcaggccaagt

SEQ ID NO: 33270 - DNA, 20 bp, Artificial Sequence
  chemically synthesized
ttggctcaggccaagtaggc

SEQ ID NO: 33271 - DNA, 20 bp, Artificial Sequence
  chemically synthesized
taggccagaccaccccacaa

SEQ ID NO: 33272 - DNA, 20 bp, Artificial Sequence
  chemically synthesized
acagacatcttccctgaatg

SEQ ID NO: 33273 - DNA, 20 bp, Artificial Sequence
  chemically synthesized
cagacatcttccctgaatgc

SEQ ID NO: 33274 - DNA, 20 bp, Artificial Sequence
  chemically synthesized
agacatcttccctgaatgca

SEQ ID NO: 33275 - DNA, 20 bp, Artificial Sequence
  chemically synthesized
cttccctgaatgcagggttt

SEQ ID NO: 33276 - DNA, 20 bp, Artificial Sequence
  chemically synthesized
ccctgaatgcagggtttgag

SEQ ID NO: 33277 - DNA, 20 bp, Artificial Sequence
  chemically synthesized
aatgccctctaactgatgct

SEQ ID NO: 33278 - DNA, 20 bp, Artificial Sequence
  chemically synthesized
tctaactgatgctgagtttg

SEQ ID NO: 33279 - DNA, 20 bp, Artificial Sequence
  chemically synthesized
gctgagtttgaagaatccat

SEQ ID NO: 33280 - DNA, 20 bp, Artificial Sequence
  chemically synthesized
gtttgaagaatccatcagtt

SEQ ID NO: 33281 - DNA, 20 bp, Artificial Sequence
  chemically synthesized
tttgaagaatccatcagtta

SEQ ID NO: 33282 - DNA, 20 bp, Artificial Sequence
  chemically synthesized
ttgaagaatccatcagttaa

SEQ ID NO: 33283 - DNA, 20 bp, Artificial Sequence
  chemically synthesized
tgaagaatccatcagttaag

SEQ ID NO: 33284 - DNA, 20 bp, Artificial Sequence
  chemically synthesized
aagaatccatcagttaaggg

SEQ ID NO: 33285 - DNA, 20 bp, Artificial Sequence
  chemically synthesized
agaatccatcagttaagggg

SEQ ID NO: 33286 - DNA, 20 bp, Artificial Sequence
  chemically synthesized
agttaaggggaggtgtttct

SEQ ID NO: 33287 - DNA, 20 bp, Artificial Sequence
  chemically synthesized
gggaggtgtttctgagtttg

SEQ ID NO: 33288 - DNA, 20 bp, Artificial Sequence
  chemically synthesized
gaatcaaacaccttcctaat

SEQ ID NO: 33289 - DNA, 20 bp, Artificial Sequence
  chemically synthesized
tcaaacaccttcctaattgg

SEQ ID NO: 33290 - DNA, 20 bp, Artificial Sequence
  chemically synthesized
caaacaccttcctaattggt

SEQ ID NO: 33291 - DNA, 20 bp, Artificial Sequence
  chemically synthesized
atcctgaaaacactccacac

SEQ ID NO: 33292 - DNA, 20 bp, Artificial Sequence
  chemically synthesized
cctgaaaacactccacaccg

SEQ ID NO: 33293 - DNA, 20 bp, Artificial Sequence
  chemically synthesized
aacactccacaccggagtaa

SEQ ID NO: 33294 - DNA, 20 bp, Artificial Sequence
  chemically synthesized
cacaccggagtaaaagactt

SEQ ID NO: 33295 - DNA, 20 bp, Artificial Sequence
  chemically synthesized
ttatctttatgcctgactaa

SEQ ID NO: 33296 - DNA, 20 bp, Artificial Sequence
  chemically synthesized
ttaactctcattctttcatt

SEQ ID NO: 33297 - DNA, 20 bp, Artificial Sequence
  chemically synthesized
attcagcaaatattttgtgc

SEQ ID NO: 33298 - DNA, 20 bp, Artificial Sequence
  chemically synthesized
tgtgctagtgcatgacactg

SEQ ID NO: 33299 - DNA, 20 bp, Artificial Sequence
  chemically synthesized
gacactgcagattaatatcg

SEQ ID NO: 33300 - DNA, 20 bp, Artificial Sequence
  chemically synthesized
attaatatcgtagatgaact

SEQ ID NO: 33301 - DNA, 20 bp, Artificial Sequence
  chemically synthesized
tatcgtagatgaactgagtc

SEQ ID NO: 33302 - DNA, 20 bp, Artificial Sequence
  chemically synthesized
atcgtagatgaactgagtct

SEQ ID NO: 33303 - DNA, 20 bp, Artificial Sequence
  chemically synthesized
tagatgaactgagtctgggc

SEQ ID NO: 33304 - DNA, 20 bp, Artificial Sequence
  chemically synthesized
agatgaactgagtctgggct

SEQ ID NO: 33305 - DNA, 20 bp, Artificial Sequence
  chemically synthesized
tgaactgagtctgggctagg

SEQ ID NO: 33306 - DNA, 20 bp, Artificial Sequence
  chemically synthesized
aactgagtctgggctaggta

SEQ ID NO: 33307 - DNA, 20 bp, Artificial Sequence
  chemically synthesized
agtcaaaaaaaaatttccta

SEQ ID NO: 33308 - DNA, 20 bp, Artificial Sequence
  chemically synthesized
gtcaaaaaaaaatttcctaa

SEQ ID NO: 33309 - DNA, 20 bp, Artificial Sequence
  chemically synthesized
caaaaaaaaatttcctaaag

SEQ ID NO: 33310 - DNA, 20 bp, Artificial Sequence
  chemically synthesized
aaggagcctgtacctaaact

SEQ ID NO: 33311 - DNA, 20 bp, Artificial Sequence
  chemically synthesized
ctgtacctaaactgagtctt

SEQ ID NO: 33312 - DNA, 20 bp, Artificial Sequence
  chemically synthesized
gtacctaaactgagtcttca

SEQ ID NO: 33313 - DNA, 20 bp, Artificial Sequence
  chemically synthesized
acctaaactgagtcttcaga

SEQ ID NO: 33314 - DNA, 20 bp, Artificial Sequence
  chemically synthesized
taaactgagtcttcagagag

SEQ ID NO: 33315 - DNA, 20 bp, Artificial Sequence
  chemically synthesized
ctgagtcttcagagagaagt

SEQ ID NO: 33316 - DNA, 20 bp, Artificial Sequence
  chemically synthesized
cttcagagagaagttggaac

SEQ ID NO: 33317 - DNA, 20 bp, Artificial Sequence
  chemically synthesized
gagagaagttggaactggca

SEQ ID NO: 33318 - DNA, 20 bp, Artificial Sequence
  chemically synthesized
gaagttggaactggcaaagt

SEQ ID NO: 33319 - DNA, 20 bp, Artificial Sequence
  chemically synthesized
aagttggaactggcaaagtg

SEQ ID NO: 33320 - DNA, 20 bp, Artificial Sequence
  chemically synthesized
ttggaactggcaaagtgagg

SEQ ID NO: 33321 - DNA, 20 bp, Artificial Sequence
  chemically synthesized
tggaactggcaaagtgagga

SEQ ID NO: 33322 - DNA, 20 bp, Artificial Sequence
  chemically synthesized
actggcaaagtgaggaagga

SEQ ID NO: 33323 - DNA, 20 bp, Artificial Sequence
  chemically synthesized
ctggcaaagtgaggaaggac

SEQ ID NO: 33324 - DNA, 20 bp, Artificial Sequence
  chemically synthesized
tggcaaagtgaggaaggacg

SEQ ID NO: 33325 - DNA, 20 bp, Artificial Sequence
  chemically synthesized
aagtgaggaaggacggggtc

SEQ ID NO: 33326 - DNA, 20 bp, Artificial Sequence
  chemically synthesized
gtgaggaaggacggggtctg

SEQ ID NO: 33327 - DNA, 20 bp, Artificial Sequence
  chemically synthesized
tgaggaaggacggggtctgg

SEQ ID NO: 33328 - DNA, 20 bp, Artificial Sequence
  chemically synthesized
gaggaaggacggggtctgga

SEQ ID NO: 33329 - DNA, 20 bp, Artificial Sequence
  chemically synthesized
gaaggacggggtctggaggg

SEQ ID NO: 33330 - DNA, 20 bp, Artificial Sequence
  chemically synthesized
aggacggggtctggagggaa

SEQ ID NO: 33331 - DNA, 20 bp, Artificial Sequence
  chemically synthesized
cggggtctggagggaagagt

SEQ ID NO: 33332 - DNA, 20 bp, Artificial Sequence
  chemically synthesized
tggagggaagagtgagtgca

SEQ ID NO: 33333 - DNA, 20 bp, Artificial Sequence
  chemically synthesized
ggagggaagagtgagtgcaa

SEQ ID NO: 33334 - DNA, 20 bp, Artificial Sequence
  chemically synthesized
gaagagtgagtgcaaaggca

SEQ ID NO: 33335 - DNA, 20 bp, Artificial Sequence
  chemically synthesized
gtgcaaaggcacagcacata

SEQ ID NO: 33336 - DNA, 20 bp, Artificial Sequence
  chemically synthesized
tacagaatgcctgcatgctc

SEQ ID NO: 33337 - DNA, 20 bp, Artificial Sequence
  chemically synthesized
tctagaatccaaaactgtgt

SEQ ID NO: 33338 - DNA, 20 bp, Artificial Sequence
  chemically synthesized
aaactgtgtcagccaaattt

SEQ ID NO: 33339 - DNA, 20 bp, Artificial Sequence
  chemically synthesized
gtcagccaaatttgagttga

SEQ ID NO: 33340 - DNA, 20 bp, Artificial Sequence
  chemically synthesized
cagccaaatttgagttgatg

SEQ ID NO: 33341 - DNA, 20 bp, Artificial Sequence
  chemically synthesized
agccaaatttgagttgatgg

SEQ ID NO: 33342 - DNA, 20 bp, Artificial Sequence
  chemically synthesized
gccaaatttgagttgatgga

SEQ ID NO: 33343 - DNA, 20 bp, Artificial Sequence
  chemically synthesized
aatttgagttgatggaggga

SEQ ID NO: 33344 - DNA, 20 bp, Artificial Sequence
  chemically synthesized
gatggagggacagccaaact

SEQ ID NO: 33345 - DNA, 20 bp, Artificial Sequence
  chemically synthesized
gacagccaaactgagatacc

SEQ ID NO: 33346 - DNA, 20 bp, Artificial Sequence
  chemically synthesized
acagccaaactgagataccc

SEQ ID NO: 33347 - DNA, 20 bp, Artificial Sequence
  chemically synthesized
gccaaactgagatacccagg

SEQ ID NO: 33348 - DNA, 20 bp, Artificial Sequence
  chemically synthesized
aaactgagatacccaggcgg

SEQ ID NO: 33349 - DNA, 20 bp, Artificial Sequence
  chemically synthesized
tgagatacccaggcggtggt

SEQ ID NO: 33350 - DNA, 20 bp, Artificial Sequence
  chemically synthesized
ccaggcggtggttggattta

SEQ ID NO: 33351 - DNA, 20 bp, Artificial Sequence
  chemically synthesized
ggtggttggatttatggatc

SEQ ID NO: 33352 - DNA, 20 bp, Artificial Sequence
  chemically synthesized
ggatttatggatctggattt

SEQ ID NO: 33353 - DNA, 20 bp, Artificial Sequence
  chemically synthesized
gatttatggatctggatttc

SEQ ID NO: 33354 - DNA, 20 bp, Artificial Sequence
  chemically synthesized
atttatggatctggatttca

SEQ ID NO: 33355 - DNA, 20 bp, Artificial Sequence
  chemically synthesized
tttatggatctggatttcag

SEQ ID NO: 33356 - DNA, 20 bp, Artificial Sequence
  chemically synthesized
tatggatctggatttcaggg

SEQ ID NO: 33357 - DNA, 20 bp, Artificial Sequence
  chemically synthesized
ggatctggatttcaggggag

SEQ ID NO: 33358 - DNA, 20 bp, Artificial Sequence
  chemically synthesized
gatctggatttcaggggagt

SEQ ID NO: 33359 - DNA, 20 bp, Artificial Sequence
  chemically synthesized
ctggatttcaggggagtggg

SEQ ID NO: 33360 - DNA, 20 bp, Artificial Sequence
  chemically synthesized
tggatttcaggggagtgggc

SEQ ID NO: 33361 - DNA, 20 bp, Artificial Sequence
  chemically synthesized
ggatttcaggggagtgggca

SEQ ID NO: 33362 - DNA, 20 bp, Artificial Sequence
  chemically synthesized
ttcaggggagtgggcagggc

SEQ ID NO: 33363 - DNA, 20 bp, Artificial Sequence
  chemically synthesized
tcaggggagtgggcagggct

SEQ ID NO: 33364 - DNA, 20 bp, Artificial Sequence
  chemically synthesized
caggggagtgggcagggcta

SEQ ID NO: 33365 - DNA, 20 bp, Artificial Sequence
  chemically synthesized
aggggagtgggcagggctag

SEQ ID NO: 33366 - DNA, 20 bp, Artificial Sequence
  chemically synthesized
agtgggcagggctaggggaa

SEQ ID NO: 33367 - DNA, 20 bp, Artificial Sequence
  chemically synthesized
agggctaggggaatagaact

SEQ ID NO: 33368 - DNA, 20 bp, Artificial Sequence
  chemically synthesized
gggctaggggaatagaactg

SEQ ID NO: 33369 - DNA, 20 bp, Artificial Sequence
  chemically synthesized
ggctaggggaatagaactga

SEQ ID NO: 33370 - DNA, 20 bp, Artificial Sequence
  chemically synthesized
agaactgagggtcatgatgt

SEQ ID NO: 33371 - DNA, 20 bp, Artificial Sequence
  chemically synthesized
actgagggtcatgatgtcag

SEQ ID NO: 33372 - DNA, 20 bp, Artificial Sequence
  chemically synthesized
gagggtcatgatgtcagtgg

SEQ ID NO: 33373 - DNA, 20 bp, Artificial Sequence
  chemically synthesized
agggtcatgatgtcagtggt

SEQ ID NO: 33374 - DNA, 20 bp, Artificial Sequence
  chemically synthesized
ggtcatgatgtcagtggtag

SEQ ID NO: 33375 - DNA, 20 bp, Artificial Sequence
  chemically synthesized
gatgtcagtggtaggagttg

SEQ ID NO: 33376 - DNA, 20 bp, Artificial Sequence
  chemically synthesized
agtggtaggagttgaagtct

SEQ ID NO: 33377 - DNA, 20 bp, Artificial Sequence
  chemically synthesized
ggtaggagttgaagtcttgg

SEQ ID NO: 33378 - DNA, 20 bp, Artificial Sequence
  chemically synthesized
ggagttgaagtcttggaaga

SEQ ID NO: 33379 - DNA, 20 bp, Artificial Sequence
  chemically synthesized
agttgaagtcttggaagaaa

SEQ ID NO: 33380 - DNA, 20 bp, Artificial Sequence
  chemically synthesized
tgaagtcttggaagaaagag

SEQ ID NO: 33381 - DNA, 20 bp, Artificial Sequence
  chemically synthesized
gtcttggaagaaagagtaga

SEQ ID NO: 33382 - DNA, 20 bp, Artificial Sequence
  chemically synthesized
ttttctgatgaacattctat

SEQ ID NO: 33383 - DNA, 20 bp, Artificial Sequence
  chemically synthesized
tttctgatgaacattctatg

SEQ ID NO: 33384 - DNA, 20 bp, Artificial Sequence
  chemically synthesized
ctgatgaacattctatgagg

SEQ ID NO: 33385 - DNA, 20 bp, Artificial Sequence
  chemically synthesized
gaacattctatgaggaagtt

SEQ ID NO: 33386 - DNA, 20 bp, Artificial Sequence
  chemically synthesized
cattctatgaggaagttcag

SEQ ID NO: 33387 - DNA, 20 bp, Artificial Sequence
  chemically synthesized
ttctatgaggaagttcagca

SEQ ID NO: 33388 - DNA, 20 bp, Artificial Sequence
  chemically synthesized
tctatgaggaagttcagcag

SEQ ID NO: 33389 - DNA, 20 bp, Artificial Sequence
  chemically synthesized
tgaggaagttcagcagaggt

SEQ ID NO: 33390 - DNA, 20 bp, Artificial Sequence
  chemically synthesized
cctatcctgctgtcatgttt

SEQ ID NO: 33391 - DNA, 20 bp, Artificial Sequence
  chemically synthesized
tttaagcaacttattatgca

SEQ ID NO: 33392 - DNA, 20 bp, Artificial Sequence
  chemically synthesized
caacttattatgcacagcac

SEQ ID NO: 33393 - DNA, 20 bp, Artificial Sequence
  chemically synthesized
aacttattatgcacagcacc

SEQ ID NO: 33394 - DNA, 20 bp, Artificial Sequence
  chemically synthesized
catcaatgtaaattgcatgc

SEQ ID NO: 33395 - DNA, 20 bp, Artificial Sequence
  chemically synthesized
tgcatgccagtctttgctct

SEQ ID NO: 33396 - DNA, 20 bp, Artificial Sequence
  chemically synthesized
agtctttgctctcagtttca

SEQ ID NO: 33397 - DNA, 20 bp, Artificial Sequence
  chemically synthesized
gtctttgctctcagtttcaa

SEQ ID NO: 33398 - DNA, 20 bp, Artificial Sequence
  chemically synthesized
cctgctgtctaatctttaca

SEQ ID NO: 33399 - DNA, 20 bp, Artificial Sequence
  chemically synthesized
ctgtctaatctttacaaaga

SEQ ID NO: 33400 - DNA, 20 bp, Artificial Sequence
  chemically synthesized
tgtctaatctttacaaagaa

SEQ ID NO: 33401 - DNA, 20 bp, Artificial Sequence
  chemically synthesized
ttacaaagaaaggttaactc

SEQ ID NO: 33402 - DNA, 20 bp, Artificial Sequence
  chemically synthesized
acaaagaaaggttaactcca

SEQ ID NO: 33403 - DNA, 20 bp, Artificial Sequence
  chemically synthesized
caaagaaaggttaactccag

SEQ ID NO: 33404 - DNA, 20 bp, Artificial Sequence
  chemically synthesized
gaaaggttaactccagaggt

SEQ ID NO: 33405 - DNA, 20 bp, Artificial Sequence
  chemically synthesized
aaaggttaactccagaggtc

SEQ ID NO: 33406 - DNA, 20 bp, Artificial Sequence
  chemically synthesized
agaggtcaggaatctgaaca

SEQ ID NO: 33407 - DNA, 20 bp, Artificial Sequence
  chemically synthesized
ggaatctgaacacagaaaac

SEQ ID NO: 33408 - DNA, 20 bp, Artificial Sequence
  chemically synthesized
ttaatgaatatgtcaacaca

SEQ ID NO: 33409 - DNA, 20 bp, Artificial Sequence
  chemically synthesized
atgaaatcacatttacacaa

SEQ ID NO: 33410 - DNA, 20 bp, Artificial Sequence
  chemically synthesized
catttacacaaaagtacaac

SEQ ID NO: 33411 - DNA, 20 bp, Artificial Sequence
  chemically synthesized
atttacacaaaagtacaact

SEQ ID NO: 33412 - DNA, 20 bp, Artificial Sequence
  chemically synthesized
tttacacaaaagtacaactg

SEQ ID NO: 33413 - DNA, 20 bp, Artificial Sequence
  chemically synthesized
cacaaaagtacaactggggt

SEQ ID NO: 33414 - DNA, 20 bp, Artificial Sequence
  chemically synthesized
actggggtaagaaaattcaa

SEQ ID NO: 33415 - DNA, 20 bp, Artificial Sequence
  chemically synthesized
gtaagaaaattcaaaagata

SEQ ID NO: 33416 - DNA, 20 bp, Artificial Sequence
  chemically synthesized
atgaaataccctatgtattt

SEQ ID NO: 33417 - DNA, 20 bp, Artificial Sequence
  chemically synthesized
aataccctatgtatttgagt

SEQ ID NO: 33418 - DNA, 20 bp, Artificial Sequence
  chemically synthesized
atgtatttgagtaagttgct

SEQ ID NO: 33419 - DNA, 20 bp, Artificial Sequence
  chemically synthesized
tgcttagcttctcccaacct

SEQ ID NO: 33420 - DNA, 20 bp, Artificial Sequence
  chemically synthesized
gtttcctcatttctaaaacg

SEQ ID NO: 33421 - DNA, 20 bp, Artificial Sequence
  chemically synthesized
cgaagaacttgcttaatatt

SEQ ID NO: 33422 - DNA, 20 bp, Artificial Sequence
  chemically synthesized
gaagaacttgcttaatattc

SEQ ID NO: 33423 - DNA, 20 bp, Artificial Sequence
  chemically synthesized
cttgcttaatattcaggctc

SEQ ID NO: 33424 - DNA, 20 bp, Artificial Sequence
  chemically synthesized
ttgcttaatattcaggctct

SEQ ID NO: 33425 - DNA, 20 bp, Artificial Sequence
  chemically synthesized
ccaccaaatccttgattcac

SEQ ID NO: 33426 - DNA, 20 bp, Artificial Sequence
  chemically synthesized
aatccttgattcactggctc

SEQ ID NO: 33427 - DNA, 20 bp, Artificial Sequence
  chemically synthesized
atccttgattcactggctct

SEQ ID NO: 33428 - DNA, 20 bp, Artificial Sequence
  chemically synthesized
gctctgggtctgtatgtaac

SEQ ID NO: 33429 - DNA, 20 bp, Artificial Sequence
  chemically synthesized
gtctgtatgtaacaagcttc

SEQ ID NO: 33430 - DNA, 20 bp, Artificial Sequence
  chemically synthesized
ctgtatgtaacaagcttctg

SEQ ID NO: 33431 - DNA, 20 bp, Artificial Sequence
  chemically synthesized
tctggagtgattctaatgat

SEQ ID NO: 33432 - DNA, 20 bp, Artificial Sequence
  chemically synthesized
gagtgattctaatgattagc

SEQ ID NO: 33433 - DNA, 20 bp, Artificial Sequence
  chemically synthesized
gtgattctaatgattagcca

SEQ ID NO: 33434 - DNA, 20 bp, Artificial Sequence
  chemically synthesized
ttctaatgattagccagaga

SEQ ID NO: 33435 - DNA, 20 bp, Artificial Sequence
  chemically synthesized
tctaatgattagccagagac

SEQ ID NO: 33436 - DNA, 20 bp, Artificial Sequence
  chemically synthesized
aaaaattaccacaaatttat

SEQ ID NO: 33437 - DNA, 20 bp, Artificial Sequence
  chemically synthesized
aacacaaatgtattatcttg

SEQ ID NO: 33438 - DNA, 20 bp, Artificial Sequence
  chemically synthesized
aatgtattatcttgaagttg

SEQ ID NO: 33439 - DNA, 20 bp, Artificial Sequence
  chemically synthesized
tgtattatcttgaagttgtg

SEQ ID NO: 33440 - DNA, 20 bp, Artificial Sequence
  chemically synthesized
gtattatcttgaagttgtgg

SEQ ID NO: 33441 - DNA, 20 bp, Artificial Sequence
  chemically synthesized
tatcttgaagttgtggaggt

SEQ ID NO: 33442 - DNA, 20 bp, Artificial Sequence
  chemically synthesized
cttgaagttgtggaggtcag

SEQ ID NO: 33443 - DNA, 20 bp, Artificial Sequence
  chemically synthesized
ggaggtcagaagtctgaaat

SEQ ID NO: 33444 - DNA, 20 bp, Artificial Sequence
  chemically synthesized
aagtctgaaatcggtttcac

SEQ ID NO: 33445 - DNA, 20 bp, Artificial Sequence
  chemically synthesized
agtctgaaatcggtttcact

SEQ ID NO: 33446 - DNA, 20 bp, Artificial Sequence
  chemically synthesized
aaatcggtttcactgggcta

SEQ ID NO: 33447 - DNA, 20 bp, Artificial Sequence
  chemically synthesized
ggtttcactgggctaaagtc

SEQ ID NO: 33448 - DNA, 20 bp, Artificial Sequence
  chemically synthesized
gtttcactgggctaaagtcg

SEQ ID NO: 33449 - DNA, 20 bp, Artificial Sequence
  chemically synthesized
ctgggctaaagtcgaggtgt

SEQ ID NO: 33450 - DNA, 20 bp, Artificial Sequence
  chemically synthesized
ctaaagtcgaggtgtcagtg

SEQ ID NO: 33451 - DNA, 20 bp, Artificial Sequence
  chemically synthesized
gtcagtgtggctgtttcttc

SEQ ID NO: 33452 - DNA, 20 bp, Artificial Sequence
  chemically synthesized
cagtgtggctgtttcttctg

SEQ ID NO: 33453 - DNA, 20 bp, Artificial Sequence
  chemically synthesized
gtttcttctggagactctat

SEQ ID NO: 33454 - DNA, 20 bp, Artificial Sequence
  chemically synthesized
ttcttctggagactctatga

SEQ ID NO: 33455 - DNA, 20 bp, Artificial Sequence
  chemically synthesized
gtgttttcctgccttttcca

SEQ ID NO: 33456 - DNA, 20 bp, Artificial Sequence
  chemically synthesized
atggattctgtttcctcttc

SEQ ID NO: 33457 - DNA, 20 bp, Artificial Sequence
  chemically synthesized
ggattctgtttcctcttcta

SEQ ID NO: 33458 - DNA, 20 bp, Artificial Sequence
  chemically synthesized
gattctgtttcctcttctag

SEQ ID NO: 33459 - DNA, 20 bp, Artificial Sequence
  chemically synthesized
tagaggctacccacattcct

SEQ ID NO: 33460 - DNA, 20 bp, Artificial Sequence
  chemically synthesized
tacccacattccttggtttg

SEQ ID NO: 33461 - DNA, 20 bp, Artificial Sequence
  chemically synthesized
gtcacattttctcctcttat

SEQ ID NO: 33462 - DNA, 20 bp, Artificial Sequence
  chemically synthesized
atgacacttgtgattacatt

SEQ ID NO: 33463 - DNA, 20 bp, Artificial Sequence
  chemically synthesized
tgacacttgtgattacattt

SEQ ID NO: 33464 - DNA, 20 bp, Artificial Sequence
  chemically synthesized
ttaggatacacccaaataat

SEQ ID NO: 33465 - DNA, 20 bp, Artificial Sequence
  chemically synthesized
taggatacacccaaataatt

SEQ ID NO: 33466 - DNA, 20 bp, Artificial Sequence
  chemically synthesized
ttaggatatctccccatccc

SEQ ID NO: 33467 - DNA, 20 bp, Artificial Sequence
  chemically synthesized
atccttaattatatatgcaa

SEQ ID NO: 33468 - DNA, 20 bp, Artificial Sequence
  chemically synthesized
tatatatgcaaaagtctgtt

SEQ ID NO: 33469 - DNA, 20 bp, Artificial Sequence
  chemically synthesized
tatgcaaaagtctgtttggc

SEQ ID NO: 33470 - DNA, 20 bp, Artificial Sequence
  chemically synthesized
aaaagtctgtttggctagaa

SEQ ID NO: 33471 - DNA, 20 bp, Artificial Sequence
  chemically synthesized
gctagaaaagataatactca

SEQ ID NO: 33472 - DNA, 20 bp, Artificial Sequence
  chemically synthesized
ctagaaaagataatactcac

SEQ ID NO: 33473 - DNA, 20 bp, Artificial Sequence
  chemically synthesized
aagataatactcacaggttt

SEQ ID NO: 33474 - DNA, 20 bp, Artificial Sequence
  chemically synthesized
agataatactcacaggtttc

SEQ ID NO: 33475 - DNA, 20 bp, Artificial Sequence
  chemically synthesized
gataatactcacaggtttca

SEQ ID NO: 33476 - DNA, 20 bp, Artificial Sequence
  chemically synthesized
ataatactcacaggtttcag

SEQ ID NO: 33477 - DNA, 20 bp, Artificial Sequence
  chemically synthesized
actcacaggtttcaggggtt

SEQ ID NO: 33478 - DNA, 20 bp, Artificial Sequence
  chemically synthesized
gttaagccatacatatcttt

SEQ ID NO: 33479 - DNA, 20 bp, Artificial Sequence
  chemically synthesized
taagccatacatatctttca

SEQ ID NO: 33480 - DNA, 20 bp, Artificial Sequence
  chemically synthesized
ccatacatatctttcagagt

SEQ ID NO: 33481 - DNA, 20 bp, Artificial Sequence
  chemically synthesized
tatctttcagagtgagccat

SEQ ID NO: 33482 - DNA, 20 bp, Artificial Sequence
  chemically synthesized
gtgagccattagccattatt

SEQ ID NO: 33483 - DNA, 20 bp, Artificial Sequence
  chemically synthesized
agcctactgcgataatgtgc

SEQ ID NO: 33484 - DNA, 20 bp, Artificial Sequence
  chemically synthesized
ctatgttctatgttcccatc

SEQ ID NO: 33485 - DNA, 20 bp, Artificial Sequence
  chemically synthesized
tatgttctatgttcccatca

SEQ ID NO: 33486 - DNA, 20 bp, Artificial Sequence
  chemically synthesized
atgttcccatcaaggttaat

SEQ ID NO: 33487 - DNA, 20 bp, Artificial Sequence
  chemically synthesized
tcaaggttaattagaaatat

SEQ ID NO: 33488 - DNA, 20 bp, Artificial Sequence
  chemically synthesized
aatattagactctttttcca

SEQ ID NO: 33489 - DNA, 20 bp, Artificial Sequence
  chemically synthesized
ttccacagaaaaaaaaaatg

SEQ ID NO: 33490 - DNA, 20 bp, Artificial Sequence
  chemically synthesized
cacagaaaaaaaaaatgtag

SEQ ID NO: 33491 - DNA, 20 bp, Artificial Sequence
  chemically synthesized
agaaaaaaaaaatgtagcag

SEQ ID NO: 33492 - DNA, 20 bp, Artificial Sequence
  chemically synthesized
ctctctctttccttcatgcc

SEQ ID NO: 33493 - DNA, 20 bp, Artificial Sequence
  chemically synthesized
ctctttccttcatgcccagt

SEQ ID NO: 33494 - DNA, 20 bp, Artificial Sequence
  chemically synthesized
ctttccttcatgcccagtaa

SEQ ID NO: 33495 - DNA, 20 bp, Artificial Sequence
  chemically synthesized
tttccttcatgcccagtaag

SEQ ID NO: 33496 - DNA, 20 bp, Artificial Sequence
  chemically synthesized
ccttcatgcccagtaagagg

SEQ ID NO: 33497 - DNA, 20 bp, Artificial Sequence
  chemically synthesized
catgcccagtaagaggaagt

SEQ ID NO: 33498 - DNA, 20 bp, Artificial Sequence
  chemically synthesized
atgcccagtaagaggaagtg

SEQ ID NO: 33499 - DNA, 20 bp, Artificial Sequence
  chemically synthesized
gcaccatctgttcatctcat

SEQ ID NO: 33500 - DNA, 20 bp, Artificial Sequence
  chemically synthesized
caccatctgttcatctcatc

SEQ ID NO: 33501 - DNA, 20 bp, Artificial Sequence
  chemically synthesized
tcatctcatcaggtgttacc

SEQ ID NO: 33502 - DNA, 20 bp, Artificial Sequence
  chemically synthesized
catcaggtgttacctagaat

SEQ ID NO: 33503 - DNA, 20 bp, Artificial Sequence
  chemically synthesized
tcaggtgttacctagaatca

SEQ ID NO: 33504 - DNA, 20 bp, Artificial Sequence
  chemically synthesized
gtgttacctagaatcagagt

SEQ ID NO: 33505 - DNA, 20 bp, Artificial Sequence
  chemically synthesized
tgttacctagaatcagagtc

SEQ ID NO: 33506 - DNA, 20 bp, Artificial Sequence
  chemically synthesized
ttacctagaatcagagtcag

SEQ ID NO: 33507 - DNA, 20 bp, Artificial Sequence
  chemically synthesized
ctagaatcagagtcaggaga

SEQ ID NO: 33508 - DNA, 20 bp, Artificial Sequence
  chemically synthesized
cctcataaaactactctgac

SEQ ID NO: 33509 - DNA, 20 bp, Artificial Sequence
  chemically synthesized
ctgacaagtaaaccatatcc

SEQ ID NO: 33510 - DNA, 20 bp, Artificial Sequence
  chemically synthesized
tgacaagtaaaccatatcct

SEQ ID NO: 33511 - DNA, 20 bp, Artificial Sequence
  chemically synthesized
gacaagtaaaccatatcctg

SEQ ID NO: 33512 - DNA, 20 bp, Artificial Sequence
  chemically synthesized
gtaaaccatatcctggggac

SEQ ID NO: 33513 - DNA, 20 bp, Artificial Sequence
  chemically synthesized
taaaccatatcctggggacc

SEQ ID NO: 33514 - DNA, 20 bp, Artificial Sequence
  chemically synthesized
ccatatcctggggaccaggt

SEQ ID NO: 33515 - DNA, 20 bp, Artificial Sequence
  chemically synthesized
gggaccaggtgagaattaaa

SEQ ID NO: 33516 - DNA, 20 bp, Artificial Sequence
  chemically synthesized
ttaaaaagctgtatactcat

SEQ ID NO: 33517 - DNA, 20 bp, Artificial Sequence
  chemically synthesized
tgtatactcataagctgcca

SEQ ID NO: 33518 - DNA, 20 bp, Artificial Sequence
  chemically synthesized
tatactcataagctgccaaa

SEQ ID NO: 33519 - DNA, 20 bp, Artificial Sequence
  chemically synthesized
ataagctgccaaagagctga

SEQ ID NO: 33520 - DNA, 20 bp, Artificial Sequence
  chemically synthesized
ccaaagagctgatggtactg

SEQ ID NO: 33521 - DNA, 20 bp, Artificial Sequence
  chemically synthesized
ctgatggtactgaagtcaca

SEQ ID NO: 33522 - DNA, 20 bp, Artificial Sequence
  chemically synthesized
gatggtactgaagtcacatg

SEQ ID NO: 33523 - DNA, 20 bp, Artificial Sequence
  chemically synthesized
tactgaagtcacatggagct

SEQ ID NO: 33524 - DNA, 20 bp, Artificial Sequence
  chemically synthesized
actgaagtcacatggagctc

SEQ ID NO: 33525 - DNA, 20 bp, Artificial Sequence
  chemically synthesized
caggaatttattcttgcatt

SEQ ID NO: 33526 - DNA, 20 bp, Artificial Sequence
  chemically synthesized
aatttattcttgcatttaga

SEQ ID NO: 33527 - DNA, 20 bp, Artificial Sequence
  chemically synthesized
atgcatataattctctcgaa

SEQ ID NO: 33528 - DNA, 20 bp, Artificial Sequence
  chemically synthesized
atgaaatcatatttttctgt

SEQ ID NO: 33529 - DNA, 20 bp, Artificial Sequence
  chemically synthesized
ttctgtcggatcaaattatt

SEQ ID NO: 33530 - DNA, 20 bp, Artificial Sequence
  chemically synthesized
ttattcagaaatccgaactg

SEQ ID NO: 33531 - DNA, 20 bp, Artificial Sequence
  chemically synthesized
caaacacacttgcttaatgt

SEQ ID NO: 33532 - DNA, 20 bp, Artificial Sequence
  chemically synthesized
tttaatcttatttttgtaca

SEQ ID NO: 33533 - DNA, 20 bp, Artificial Sequence
  chemically synthesized
gtacacagtatacttttaca

SEQ ID NO: 33534 - DNA, 20 bp, Artificial Sequence
  chemically synthesized
tacacagtatacttttacat

SEQ ID NO: 33535 - DNA, 20 bp, Artificial Sequence
  chemically synthesized
cttttacataggcactgaac

SEQ ID NO: 33536 - DNA, 20 bp, Artificial Sequence
  chemically synthesized
tacataggcactgaaccagc

SEQ ID NO: 33537 - DNA, 20 bp, Artificial Sequence
  chemically synthesized
accagctggaaatgaatgct

SEQ ID NO: 33538 - DNA, 20 bp, Artificial Sequence
  chemically synthesized
aatgaatgcttggattttcg

SEQ ID NO: 33539 - DNA, 20 bp, Artificial Sequence
  chemically synthesized
tggattttcgcagctgataa

SEQ ID NO: 33540 - DNA, 20 bp, Artificial Sequence
  chemically synthesized
attttcgcagctgataaaag

SEQ ID NO: 33541 - DNA, 20 bp, Artificial Sequence
  chemically synthesized
tttcgcagctgataaaagca

SEQ ID NO: 33542 - DNA, 20 bp, Artificial Sequence
  chemically synthesized
cagctgataaaagcagagtt

SEQ ID NO: 33543 - DNA, 20 bp, Artificial Sequence
  chemically synthesized
agagttcagattctgtcctt

SEQ ID NO: 33544 - DNA, 20 bp, Artificial Sequence
  chemically synthesized
ctgtccttgagctcaatgtc

SEQ ID NO: 33545 - DNA, 20 bp, Artificial Sequence
  chemically synthesized
gtccttgagctcaatgtctg

SEQ ID NO: 33546 - DNA, 20 bp, Artificial Sequence
  chemically synthesized
ttgagctcaatgtctggaga

SEQ ID NO: 33547 - DNA, 20 bp, Artificial Sequence
  chemically synthesized
agctcaatgtctggagaaag

SEQ ID NO: 33548 - DNA, 20 bp, Artificial Sequence
  chemically synthesized
tgaatactgcttccttaatt

SEQ ID NO: 33549 - DNA, 20 bp, Artificial Sequence
  chemically synthesized
ttccttaattcagatgcctt

SEQ ID NO: 33550 - DNA, 20 bp, Artificial Sequence
  chemically synthesized
attcagatgcctttggccgt

SEQ ID NO: 33551 - DNA, 20 bp, Artificial Sequence
  chemically synthesized
ttcagatgcctttggccgtg

SEQ ID NO: 33552 - DNA, 20 bp, Artificial Sequence
  chemically synthesized
tcagatgcctttggccgtga

SEQ ID NO: 33553 - DNA, 20 bp, Artificial Sequence
  chemically synthesized
cagatgcctttggccgtgag

SEQ ID NO: 33554 - DNA, 20 bp, Artificial Sequence
  chemically synthesized
gcctttggccgtgaggggca

SEQ ID NO: 33555 - DNA, 20 bp, Artificial Sequence
  chemically synthesized
gtgaggggcatggcatttta

SEQ ID NO: 33556 - DNA, 20 bp, Artificial Sequence
  chemically synthesized
aaactctgtactttttctct

SEQ ID NO: 33557 - DNA, 20 bp, Artificial Sequence
  chemically synthesized
aactctgtactttttctctc

SEQ ID NO: 33558 - DNA, 20 bp, Artificial Sequence
  chemically synthesized
actctgtactttttctctca

SEQ ID NO: 33559 - DNA, 20 bp, Artificial Sequence
  chemically synthesized
ctctgtactttttctctcag

SEQ ID NO: 33560 - DNA, 20 bp, Artificial Sequence
  chemically synthesized
tactttttctctcaggggat

SEQ ID NO: 33561 - DNA, 20 bp, Artificial Sequence
  chemically synthesized
agaaaaaccaattgatttga

SEQ ID NO: 33562 - DNA, 20 bp, Artificial Sequence
  chemically synthesized
caattgatttgatagtgact

SEQ ID NO: 33563 - DNA, 20 bp, Artificial Sequence
  chemically synthesized
ttgatttgatagtgactcag

SEQ ID NO: 33564 - DNA, 20 bp, Artificial Sequence
  chemically synthesized
gcagttttcaccttcctctt

SEQ ID NO: 33565 - DNA, 20 bp, Artificial Sequence
  chemically synthesized
cctctttagccaatgccctg

SEQ ID NO: 33566 - DNA, 20 bp, Artificial Sequence
  chemically synthesized
ttagccaatgccctgcagct

SEQ ID NO: 33567 - DNA, 20 bp, Artificial Sequence
  chemically synthesized
aatgccctgcagctaagatt

SEQ ID NO: 33568 - DNA, 20 bp, Artificial Sequence
  chemically synthesized
ctgcagctaagattgagaaa

SEQ ID NO: 33569 - DNA, 20 bp, Artificial Sequence
  chemically synthesized
ctaagattgagaaacggatt

SEQ ID NO: 33570 - DNA, 20 bp, Artificial Sequence
  chemically synthesized
gattcagaactcacacctct

SEQ ID NO: 33571 - DNA, 20 bp, Artificial Sequence
  chemically synthesized
aactcacacctcttggtgct

SEQ ID NO: 33572 - DNA, 20 bp, Artificial Sequence
  chemically synthesized
tcacacctcttggtgcttgg

SEQ ID NO: 33573 - DNA, 20 bp, Artificial Sequence
  chemically synthesized
gtggctcccttccaaaccat

SEQ ID NO: 33574 - DNA, 20 bp, Artificial Sequence
  chemically synthesized
actttctttcctatttttta

SEQ ID NO: 33575 - DNA, 20 bp, Artificial Sequence
  chemically synthesized
ctttcctattttttaaagca

SEQ ID NO: 33576 - DNA, 20 bp, Artificial Sequence
  chemically synthesized
tttaaagcacagtctgaatc

SEQ ID NO: 33577 - DNA, 20 bp, Artificial Sequence
  chemically synthesized
acagtctgaatcaagtgctt

SEQ ID NO: 33578 - DNA, 20 bp, Artificial Sequence
  chemically synthesized
ataaccctgaaccctcttct

SEQ ID NO: 33579 - DNA, 20 bp, Artificial Sequence
  chemically synthesized
taaccctgaaccctcttcta

SEQ ID NO: 33580 - DNA, 20 bp, Artificial Sequence
  chemically synthesized
gaaccctcttctaaggccac

SEQ ID NO: 33581 - DNA, 20 bp, Artificial Sequence
  chemically synthesized
ttctaaggccaccagttaca

SEQ ID NO: 33582 - DNA, 20 bp, Artificial Sequence
  chemically synthesized
aggccaccagttacaaagaa

SEQ ID NO: 33583 - DNA, 20 bp, Artificial Sequence
  chemically synthesized
ggccaccagttacaaagaat

SEQ ID NO: 33584 - DNA, 20 bp, Artificial Sequence
  chemically synthesized
gccaccagttacaaagaatg

SEQ ID NO: 33585 - DNA, 20 bp, Artificial Sequence
  chemically synthesized
accagttacaaagaatgggg

SEQ ID NO: 33586 - DNA, 20 bp, Artificial Sequence
  chemically synthesized
ccagttacaaagaatgggga

SEQ ID NO: 33587 - DNA, 20 bp, Artificial Sequence
  chemically synthesized
aaagaatggggaaggttaat

SEQ ID NO: 33588 - DNA, 20 bp, Artificial Sequence
  chemically synthesized
aggttaatgagtaactccac

SEQ ID NO: 33589 - DNA, 20 bp, Artificial Sequence
  chemically synthesized
gtaactccaccagtgcctgc

SEQ ID NO: 33590 - DNA, 20 bp, Artificial Sequence
  chemically synthesized
ctccaccagtgcctgccaga

SEQ ID NO: 33591 - DNA, 20 bp, Artificial Sequence
  chemically synthesized
ccagtgcctgccagaaagct

SEQ ID NO: 33592 - DNA, 20 bp, Artificial Sequence
  chemically synthesized
cagaaagctcagctgtactc

SEQ ID NO: 33593 - DNA, 20 bp, Artificial Sequence
  chemically synthesized
cagccttccttcctctcttg

SEQ ID NO: 33594 - DNA, 20 bp, Artificial Sequence
  chemically synthesized
gccttccttcctctcttgca

SEQ ID NO: 33595 - DNA, 20 bp, Artificial Sequence
  chemically synthesized
cttccttcctctcttgcaga

SEQ ID NO: 33596 - DNA, 20 bp, Artificial Sequence
  chemically synthesized
tcttgcagagagaaacaatg

SEQ ID NO: 33597 - DNA, 20 bp, Artificial Sequence
  chemically synthesized
tgcagagagaaacaatgcgg

SEQ ID NO: 33598 - DNA, 20 bp, Artificial Sequence
  chemically synthesized
aacaatgcggcagttgaaca

SEQ ID NO: 33599 - DNA, 20 bp, Artificial Sequence
  chemically synthesized
tgcggcagttgaacaaagcg

SEQ ID NO: 33600 - DNA, 20 bp, Artificial Sequence
  chemically synthesized
gcggcagttgaacaaagcga

SEQ ID NO: 33601 - DNA, 20 bp, Artificial Sequence
  chemically synthesized
agcgaaggcactgtaatgcc

SEQ ID NO: 33602 - DNA, 20 bp, Artificial Sequence
  chemically synthesized
gaaggcactgtaatgcccag

SEQ ID NO: 33603 - DNA, 20 bp, Artificial Sequence
  chemically synthesized
actgtaatgcccagtggctt

SEQ ID NO: 33604 - DNA, 20 bp, Artificial Sequence
  chemically synthesized
atgcccagtggcttcagtca

SEQ ID NO: 33605 - DNA, 20 bp, Artificial Sequence
  chemically synthesized
tgcccagtggcttcagtcac

SEQ ID NO: 33606 - DNA, 20 bp, Artificial Sequence
  chemically synthesized
cagtggcttcagtcacaggc

SEQ ID NO: 33607 - DNA, 20 bp, Artificial Sequence
  chemically synthesized
tggtctaaaattccatttca

SEQ ID NO: 33608 - DNA, 20 bp, Artificial Sequence
  chemically synthesized
aattccatttcacagaattg

SEQ ID NO: 33609 - DNA, 20 bp, Artificial Sequence
  chemically synthesized
tcacagaattgaagataatt

SEQ ID NO: 33610 - DNA, 20 bp, Artificial Sequence
  chemically synthesized
cacagaattgaagataattt

SEQ ID NO: 33611 - DNA, 20 bp, Artificial Sequence
  chemically synthesized
acagaattgaagataatttg

SEQ ID NO: 33612 - DNA, 20 bp, Artificial Sequence
  chemically synthesized
ttggggttattaccaattct

SEQ ID NO: 33613 - DNA, 20 bp, Artificial Sequence
  chemically synthesized
gggttattaccaattctcag

SEQ ID NO: 33614 - DNA, 20 bp, Artificial Sequence
  chemically synthesized
ctcaaattcaatcccgttga

SEQ ID NO: 33615 - DNA, 20 bp, Artificial Sequence
  chemically synthesized
aattcaatcccgttgatggt

SEQ ID NO: 33616 - DNA, 20 bp, Artificial Sequence
  chemically synthesized
aatcccgttgatggtgagca

SEQ ID NO: 33617 - DNA, 20 bp, Artificial Sequence
  chemically synthesized
atcccgttgatggtgagcat

SEQ ID NO: 33618 - DNA, 20 bp, Artificial Sequence
  chemically synthesized
tcccgttgatggtgagcatg

SEQ ID NO: 33619 - DNA, 20 bp, Artificial Sequence
  chemically synthesized
gtgagcatggggttcatttt

SEQ ID NO: 33620 - DNA, 20 bp, Artificial Sequence
  chemically synthesized
gagcatggggttcattttga

SEQ ID NO: 33621 - DNA, 20 bp, Artificial Sequence
  chemically synthesized
catggggttcattttgagag

SEQ ID NO: 33622 - DNA, 20 bp, Artificial Sequence
  chemically synthesized
tcattttgagagtagaaaat

SEQ ID NO: 33623 - DNA, 20 bp, Artificial Sequence
  chemically synthesized
tgagagtagaaaattggatg

SEQ ID NO: 33624 - DNA, 20 bp, Artificial Sequence
  chemically synthesized
gagtagaaaattggatgcag

SEQ ID NO: 33625 - DNA, 20 bp, Artificial Sequence
  chemically synthesized
gtagaaaattggatgcagtg

SEQ ID NO: 33626 - DNA, 20 bp, Artificial Sequence
  chemically synthesized
aattggatgcagtggagaat

SEQ ID NO: 33627 - DNA, 20 bp, Artificial Sequence
  chemically synthesized
gcagtggagaatcagaatgt

SEQ ID NO: 33628 - DNA, 20 bp, Artificial Sequence
  chemically synthesized
tggagaatcagaatgttgga

SEQ ID NO: 33629 - DNA, 20 bp, Artificial Sequence
  chemically synthesized
tggtctctgccatttcccca

SEQ ID NO: 33630 - DNA, 20 bp, Artificial Sequence
  chemically synthesized
tgctgctgcttttaacaaat

SEQ ID NO: 33631 - DNA, 20 bp, Artificial Sequence
  chemically synthesized
taacaaatcagtatacaact

SEQ ID NO: 33632 - DNA, 20 bp, Artificial Sequence
  chemically synthesized
tttcaaatatacaaaatatt

SEQ ID NO: 33633 - DNA, 20 bp, Artificial Sequence
  chemically synthesized
tatacaaaatattgagtctg

SEQ ID NO: 33634 - DNA, 20 bp, Artificial Sequence
  chemically synthesized
atacaaaatattgagtctga

SEQ ID NO: 33635 - DNA, 20 bp, Artificial Sequence
  chemically synthesized
atattgagtctgaaggcaaa

SEQ ID NO: 33636 - DNA, 20 bp, Artificial Sequence
  chemically synthesized
ttttcacttccattgcttcc

SEQ ID NO: 33637 - DNA, 20 bp, Artificial Sequence
  chemically synthesized
tttcacttccattgcttcct

SEQ ID NO: 33638 - DNA, 20 bp, Artificial Sequence
  chemically synthesized
tctgatatttcttccaaata

SEQ ID NO: 33639 - DNA, 20 bp, Artificial Sequence
  chemically synthesized
ttccaaatacagactgttgt

SEQ ID NO: 33640 - DNA, 20 bp, Artificial Sequence
  chemically synthesized
ctgatcatcactcacacatc

SEQ ID NO: 33641 - DNA, 20 bp, Artificial Sequence
  chemically synthesized
tgatcatcactcacacatcc

SEQ ID NO: 33642 - DNA, 20 bp, Artificial Sequence
  chemically synthesized
tgttacatctccacgccact

SEQ ID NO: 33643 - DNA, 20 bp, Artificial Sequence
  chemically synthesized
atctccacgccactgagtat

SEQ ID NO: 33644 - DNA, 20 bp, Artificial Sequence
  chemically synthesized
tctccacgccactgagtatc

SEQ ID NO: 33645 - DNA, 20 bp, Artificial Sequence
  chemically synthesized
ctccacgccactgagtatca

SEQ ID NO: 33646 - DNA, 20 bp, Artificial Sequence
  chemically synthesized
aacctgccccaatattcacg

SEQ ID NO: 33647 - DNA, 20 bp, Artificial Sequence
  chemically synthesized
acctgccccaatattcacgt

SEQ ID NO: 33648 - DNA, 20 bp, Artificial Sequence
  chemically synthesized
ggttcttttctattttccct

SEQ ID NO: 33649 - DNA, 20 bp, Artificial Sequence
  chemically synthesized
tttctattttccctaagcgt

SEQ ID NO: 33650 - DNA, 20 bp, Artificial Sequence
  chemically synthesized
ccctaagcgtcggccaactt

SEQ ID NO: 33651 - DNA, 20 bp, Artificial Sequence
  chemically synthesized
gtcggccaactttagaaata

SEQ ID NO: 33652 - DNA, 20 bp, Artificial Sequence
  chemically synthesized
tcggccaactttagaaataa

SEQ ID NO: 33653 - DNA, 20 bp, Artificial Sequence
  chemically synthesized
cggccaactttagaaataaa

SEQ ID NO: 33654 - DNA, 20 bp, Artificial Sequence
  chemically synthesized
caactttagaaataaaggga

SEQ ID NO: 33655 - DNA, 20 bp, Artificial Sequence
  chemically synthesized
actttagaaataaagggaca

SEQ ID NO: 33656 - DNA, 20 bp, Artificial Sequence
  chemically synthesized
aataaagggacagagtacaa

SEQ ID NO: 33657 - DNA, 20 bp, Artificial Sequence
  chemically synthesized
taaagggacagagtacaaaa

SEQ ID NO: 33658 - DNA, 20 bp, Artificial Sequence
  chemically synthesized
aagggacagagtacaaaaga

SEQ ID NO: 33659 - DNA, 20 bp, Artificial Sequence
  chemically synthesized
tacaaaagagagaaatttta

SEQ ID NO: 33660 - DNA, 20 bp, Artificial Sequence
  chemically synthesized
aaagagagaaattttaaagc

SEQ ID NO: 33661 - DNA, 20 bp, Artificial Sequence
  chemically synthesized
aagagagaaattttaaagcc

SEQ ID NO: 33662 - DNA, 20 bp, Artificial Sequence
  chemically synthesized
aaattttaaagccgggcatc

SEQ ID NO: 33663 - DNA, 20 bp, Artificial Sequence
  chemically synthesized
aattttaaagccgggcatcc

SEQ ID NO: 33664 - DNA, 20 bp, Artificial Sequence
  chemically synthesized
attttaaagccgggcatccg

SEQ ID NO: 33665 - DNA, 20 bp, Artificial Sequence
  chemically synthesized
ttttaaagccgggcatccgg

SEQ ID NO: 33666 - DNA, 20 bp, Artificial Sequence
  chemically synthesized
ttaaagccgggcatccgggg

SEQ ID NO: 33667 - DNA, 20 bp, Artificial Sequence
  chemically synthesized
taaagccgggcatccggggg

SEQ ID NO: 33668 - DNA, 20 bp, Artificial Sequence
  chemically synthesized
ccgggggaggcatcacattt

SEQ ID NO: 33669 - DNA, 20 bp, Artificial Sequence
  chemically synthesized
ggggaggcatcacatttcgg

SEQ ID NO: 33670 - DNA, 20 bp, Artificial Sequence
  chemically synthesized
gggaggcatcacatttcggt

SEQ ID NO: 33671 - DNA, 20 bp, Artificial Sequence
  chemically synthesized
taggttccgtgatgccccac

SEQ ID NO: 33672 - DNA, 20 bp, Artificial Sequence
  chemically synthesized
gccccacaagccacaaaaac

SEQ ID NO: 33673 - DNA, 20 bp, Artificial Sequence
  chemically synthesized
cacaagccacaaaaaccagc

SEQ ID NO: 33674 - DNA, 20 bp, Artificial Sequence
  chemically synthesized
aaaaaccagcaagtttgtat

SEQ ID NO: 33675 - DNA, 20 bp, Artificial Sequence
  chemically synthesized
aaaaccagcaagtttgtatt

SEQ ID NO: 33676 - DNA, 20 bp, Artificial Sequence
  chemically synthesized
aaaccagcaagtttgtatta

SEQ ID NO: 33677 - DNA, 20 bp, Artificial Sequence
  chemically synthesized
ttgtattagggattttcaaa

SEQ ID NO: 33678 - DNA, 20 bp, Artificial Sequence
  chemically synthesized
tgtattagggattttcaaat

SEQ ID NO: 33679 - DNA, 20 bp, Artificial Sequence
  chemically synthesized
gtattagggattttcaaatg

SEQ ID NO: 33680 - DNA, 20 bp, Artificial Sequence
  chemically synthesized
attagggattttcaaatggg

SEQ ID NO: 33681 - DNA, 20 bp, Artificial Sequence
  chemically synthesized
ttagggattttcaaatgggg

SEQ ID NO: 33682 - DNA, 20 bp, Artificial Sequence
  chemically synthesized
gggattttcaaatggggagg

SEQ ID NO: 33683 - DNA, 20 bp, Artificial Sequence
  chemically synthesized
atggggaggcagtgtgcaaa

SEQ ID NO: 33684 - DNA, 20 bp, Artificial Sequence
  chemically synthesized
tggggaggcagtgtgcaaat

SEQ ID NO: 33685 - DNA, 20 bp, Artificial Sequence
  chemically synthesized
aggcagtgtgcaaataggtg

SEQ ID NO: 33686 - DNA, 20 bp, Artificial Sequence
  chemically synthesized
ggcagtgtgcaaataggtgt

SEQ ID NO: 33687 - DNA, 20 bp, Artificial Sequence
  chemically synthesized
gtgcaaataggtgtgggtca

SEQ ID NO: 33688 - DNA, 20 bp, Artificial Sequence
  chemically synthesized
aggtgtgggtcacagacatc

SEQ ID NO: 33689 - DNA, 20 bp, Artificial Sequence
  chemically synthesized
acagacatcaagtactttac

SEQ ID NO: 33690 - DNA, 20 bp, Artificial Sequence
  chemically synthesized
cagacatcaagtactttaca

SEQ ID NO: 33691 - DNA, 20 bp, Artificial Sequence
  chemically synthesized
tcaagtactttacaaggtaa

SEQ ID NO: 33692 - DNA, 20 bp, Artificial Sequence
  chemically synthesized
acaaggtaatagaatatcac

SEQ ID NO: 33693 - DNA, 20 bp, Artificial Sequence
  chemically synthesized
caaggtaatagaatatcaca

SEQ ID NO: 33694 - DNA, 20 bp, Artificial Sequence
  chemically synthesized
gtaatagaatatcacaaggc

SEQ ID NO: 33695 - DNA, 20 bp, Artificial Sequence
  chemically synthesized
atagaatatcacaaggcaag

SEQ ID NO: 33696 - DNA, 20 bp, Artificial Sequence
  chemically synthesized
agaatatcacaaggcaagtg

SEQ ID NO: 33697 - DNA, 20 bp, Artificial Sequence
  chemically synthesized
gaatatcacaaggcaagtgg

SEQ ID NO: 33698 - DNA, 20 bp, Artificial Sequence
  chemically synthesized
tatcacaaggcaagtggagg

SEQ ID NO: 33699 - DNA, 20 bp, Artificial Sequence
  chemically synthesized
atcacaaggcaagtggaggc

SEQ ID NO: 33700 - DNA, 20 bp, Artificial Sequence
  chemically synthesized
tcacaaggcaagtggaggca

SEQ ID NO: 33701 - DNA, 20 bp, Artificial Sequence
  chemically synthesized
aaggcaagtggaggcagggt

SEQ ID NO: 33702 - DNA, 20 bp, Artificial Sequence
  chemically synthesized
gtggaggcagggtgagatca

SEQ ID NO: 33703 - DNA, 20 bp, Artificial Sequence
  chemically synthesized
tggaggcagggtgagatcac

SEQ ID NO: 33704 - DNA, 20 bp, Artificial Sequence
  chemically synthesized
agggtgagatcacaggacca

SEQ ID NO: 33705 - DNA, 20 bp, Artificial Sequence
  chemically synthesized
gggtgagatcacaggaccac

SEQ ID NO: 33706 - DNA, 20 bp, Artificial Sequence
  chemically synthesized
gatcacaggaccacaggacc

SEQ ID NO: 33707 - DNA, 20 bp, Artificial Sequence
  chemically synthesized
atcacaggaccacaggaccg

SEQ ID NO: 33708 - DNA, 20 bp, Artificial Sequence
  chemically synthesized
cgaaattaaaattgctaatg

SEQ ID NO: 33709 - DNA, 20 bp, Artificial Sequence
  chemically synthesized
taaaattgctaatgaagttt

SEQ ID NO: 33710 - DNA, 20 bp, Artificial Sequence
  chemically synthesized
aaaattgctaatgaagtttc

SEQ ID NO: 33711 - DNA, 20 bp, Artificial Sequence
  chemically synthesized
tgtcattgataacatcttat

SEQ ID NO: 33712 - DNA, 20 bp, Artificial Sequence
  chemically synthesized
gtcattgataacatcttatc

SEQ ID NO: 33713 - DNA, 20 bp, Artificial Sequence
  chemically synthesized
cattgataacatcttatcag

SEQ ID NO: 33714 - DNA, 20 bp, Artificial Sequence
  chemically synthesized
gataacatcttatcaggaga

SEQ ID NO: 33715 - DNA, 20 bp, Artificial Sequence
  chemically synthesized
ataacatcttatcaggagac

SEQ ID NO: 33716 - DNA, 20 bp, Artificial Sequence
  chemically synthesized
taacatcttatcaggagaca

SEQ ID NO: 33717 - DNA, 20 bp, Artificial Sequence
  chemically synthesized
ttatcaggagacagggtttt

SEQ ID NO: 33718 - DNA, 20 bp, Artificial Sequence
  chemically synthesized
tatcaggagacagggttttt

SEQ ID NO: 33719 - DNA, 20 bp, Artificial Sequence
  chemically synthesized
acagggtttttaggatcaac

SEQ ID NO: 33720 - DNA, 20 bp, Artificial Sequence
  chemically synthesized
ctggtctgaccaaaatttat

SEQ ID NO: 33721 - DNA, 20 bp, Artificial Sequence
  chemically synthesized
tggtctgaccaaaatttatt

SEQ ID NO: 33722 - DNA, 20 bp, Artificial Sequence
  chemically synthesized
tctgaccaaaatttattagg

SEQ ID NO: 33723 - DNA, 20 bp, Artificial Sequence
  chemically synthesized
ctgaccaaaatttattaggc

SEQ ID NO: 33724 - DNA, 20 bp, Artificial Sequence
  chemically synthesized
gggaatttcctcttcctaat

SEQ ID NO: 33725 - DNA, 20 bp, Artificial Sequence
  chemically synthesized
tttcctcttcctaataagcc

SEQ ID NO: 33726 - DNA, 20 bp, Artificial Sequence
  chemically synthesized
ttcctcttcctaataagcct

SEQ ID NO: 33727 - DNA, 20 bp, Artificial Sequence
  chemically synthesized
cctcttcctaataagcctgg

SEQ ID NO: 33728 - DNA, 20 bp, Artificial Sequence
  chemically synthesized
taataagcctgggagcgctg

SEQ ID NO: 33729 - DNA, 20 bp, Artificial Sequence
  chemically synthesized
aataagcctgggagcgctgt

SEQ ID NO: 33730 - DNA, 20 bp, Artificial Sequence
  chemically synthesized
taagcctgggagcgctgtgg

SEQ ID NO: 33731 - DNA, 20 bp, Artificial Sequence
  chemically synthesized
ctgggagcgctgtgggagac

SEQ ID NO: 33732 - DNA, 20 bp, Artificial Sequence
  chemically synthesized
tgggagcgctgtgggagact

SEQ ID NO: 33733 - DNA, 20 bp, Artificial Sequence
  chemically synthesized
gggagcgctgtgggagactg

SEQ ID NO: 33734 - DNA, 20 bp, Artificial Sequence
  chemically synthesized
tggggtctatttcacccctg

SEQ ID NO: 33735 - DNA, 20 bp, Artificial Sequence
  chemically synthesized
acccctgcagtctcgaccat

SEQ ID NO: 33736 - DNA, 20 bp, Artificial Sequence
  chemically synthesized
ccctgcagtctcgaccataa

SEQ ID NO: 33737 - DNA, 20 bp, Artificial Sequence
  chemically synthesized
gcagtctcgaccataagaga

SEQ ID NO: 33738 - DNA, 20 bp, Artificial Sequence
  chemically synthesized
cagtctcgaccataagagac

SEQ ID NO: 33739 - DNA, 20 bp, Artificial Sequence
  chemically synthesized
ccataagagacaggcgcacc

SEQ ID NO: 33740 - DNA, 20 bp, Artificial Sequence
  chemically synthesized
ataagagacaggcgcacctg

SEQ ID NO: 33741 - DNA, 20 bp, Artificial Sequence
  chemically synthesized
taagagacaggcgcacctgg

SEQ ID NO: 33742 - DNA, 20 bp, Artificial Sequence
  chemically synthesized
aagagacaggcgcacctgga

SEQ ID NO: 33743 - DNA, 20 bp, Artificial Sequence
  chemically synthesized
agagacaggcgcacctggag

SEQ ID NO: 33744 - DNA, 20 bp, Artificial Sequence
  chemically synthesized
gagacaggcgcacctggagg

SEQ ID NO: 33745 - DNA, 20 bp, Artificial Sequence
  chemically synthesized
agacaggcgcacctggaggg

SEQ ID NO: 33746 - DNA, 20 bp, Artificial Sequence
  chemically synthesized
cctggaggggggctgtttat

SEQ ID NO: 33747 - DNA, 20 bp, Artificial Sequence
  chemically synthesized
gtttataagcctatacctcc

SEQ ID NO: 33748 - DNA, 20 bp, Artificial Sequence
  chemically synthesized
ctggctcgtattctctttct

SEQ ID NO: 33749 - DNA, 20 bp, Artificial Sequence
  chemically synthesized
tggctcgtattctctttctc

SEQ ID NO: 33750 - DNA, 20 bp, Artificial Sequence
  chemically synthesized
ggctcgtattctctttctca

SEQ ID NO: 33751 - DNA, 20 bp, Artificial Sequence
  chemically synthesized
tctcagggatgttccatgct

SEQ ID NO: 33752 - DNA, 20 bp, Artificial Sequence
  chemically synthesized
ggatgttccatgctgagaaa

SEQ ID NO: 33753 - DNA, 20 bp, Artificial Sequence
  chemically synthesized
ccatgctgagaaaaagaatt

SEQ ID NO: 33754 - DNA, 20 bp, Artificial Sequence
  chemically synthesized
tttctcccatttgcttttga

SEQ ID NO: 33755 - DNA, 20 bp, Artificial Sequence
  chemically synthesized
ctcccatttgcttttgaaag

SEQ ID NO: 33756 - DNA, 20 bp, Artificial Sequence
  chemically synthesized
cccatttgcttttgaaagaa

SEQ ID NO: 33757 - DNA, 20 bp, Artificial Sequence
  chemically synthesized
cttttgaaagaagagaaata

SEQ ID NO: 33758 - DNA, 20 bp, Artificial Sequence
  chemically synthesized
aaatatggctctgttctgcc

SEQ ID NO: 33759 - DNA, 20 bp, Artificial Sequence
  chemically synthesized
ctctgttctgcctggctcac

SEQ ID NO: 33760 - DNA, 20 bp, Artificial Sequence
  chemically synthesized
tgttctgcctggctcaccag

SEQ ID NO: 33761 - DNA, 20 bp, Artificial Sequence
  chemically synthesized
ctgcctggctcaccagcagt

SEQ ID NO: 33762 - DNA, 20 bp, Artificial Sequence
  chemically synthesized
gcctggctcaccagcagtca

SEQ ID NO: 33763 - DNA, 20 bp, Artificial Sequence
  chemically synthesized
ctcaccagcagtcagagttt

SEQ ID NO: 33764 - DNA, 20 bp, Artificial Sequence
  chemically synthesized
tcaccagcagtcagagttta

SEQ ID NO: 33765 - DNA, 20 bp, Artificial Sequence
  chemically synthesized
tgttatcctgttcttttttc

SEQ ID NO: 33766 - DNA, 20 bp, Artificial Sequence
  chemically synthesized
gttatcctgttcttttttca

SEQ ID NO: 33767 - DNA, 20 bp, Artificial Sequence
  chemically synthesized
cacatgctgtacaatttgtg

SEQ ID NO: 33768 - DNA, 20 bp, Artificial Sequence
  chemically synthesized
tgcagttaatgcaattatta

SEQ ID NO: 33769 - DNA, 20 bp, Artificial Sequence
  chemically synthesized
gcagttaatgcaattattac

SEQ ID NO: 33770 - DNA, 20 bp, Artificial Sequence
  chemically synthesized
cagttaatgcaattattaca

SEQ ID NO: 33771 - DNA, 20 bp, Artificial Sequence
  chemically synthesized
tgcaattattacagggtcct

SEQ ID NO: 33772 - DNA, 20 bp, Artificial Sequence
  chemically synthesized
gcaattattacagggtcctg

SEQ ID NO: 33773 - DNA, 20 bp, Artificial Sequence
  chemically synthesized
gaggcaatatacatcctcct

SEQ ID NO: 33774 - DNA, 20 bp, Artificial Sequence
  chemically synthesized
tatacatcctcctcagctga

SEQ ID NO: 33775 - DNA, 20 bp, Artificial Sequence
  chemically synthesized
atacatcctcctcagctgac

SEQ ID NO: 33776 - DNA, 20 bp, Artificial Sequence
  chemically synthesized
cctcctcagctgacaggatt

SEQ ID NO: 33777 - DNA, 20 bp, Artificial Sequence
  chemically synthesized
tcctcagctgacaggattaa

SEQ ID NO: 33778 - DNA, 20 bp, Artificial Sequence
  chemically synthesized
ctgacaggattaagagatta

SEQ ID NO: 33779 - DNA, 20 bp, Artificial Sequence
  chemically synthesized
aggattaagagattaaagta

SEQ ID NO: 33780 - DNA, 20 bp, Artificial Sequence
  chemically synthesized
ttaagagattaaagtaaaga

SEQ ID NO: 33781 - DNA, 20 bp, Artificial Sequence
  chemically synthesized
taagagattaaagtaaagac

SEQ ID NO: 33782 - DNA, 20 bp, Artificial Sequence
  chemically synthesized
taaagacaggcataaatcac

SEQ ID NO: 33783 - DNA, 20 bp, Artificial Sequence
  chemically synthesized
aaagacaggcataaatcaca

SEQ ID NO: 33784 - DNA, 20 bp, Artificial Sequence
  chemically synthesized
taaatcacaaggatattgac

SEQ ID NO: 33785 - DNA, 20 bp, Artificial Sequence
  chemically synthesized
aaatcacaaggatattgact

SEQ ID NO: 33786 - DNA, 20 bp, Artificial Sequence
  chemically synthesized
aatcacaaggatattgactg

SEQ ID NO: 33787 - DNA, 20 bp, Artificial Sequence
  chemically synthesized
cacaaggatattgactgggg

SEQ ID NO: 33788 - DNA, 20 bp, Artificial Sequence
  chemically synthesized
atattgactggggaagtgat

SEQ ID NO: 33789 - DNA, 20 bp, Artificial Sequence
  chemically synthesized
aaatctttacaatttatgtt

SEQ ID NO: 33790 - DNA, 20 bp, Artificial Sequence
  chemically synthesized
atctttacaatttatgttta

SEQ ID NO: 33791 - DNA, 20 bp, Artificial Sequence
  chemically synthesized
caatttatgtttagagattg

SEQ ID NO: 33792 - DNA, 20 bp, Artificial Sequence
  chemically synthesized
tatgtttagagattgcagta

SEQ ID NO: 33793 - DNA, 20 bp, Artificial Sequence
  chemically synthesized
tttagagattgcagtaaaga

SEQ ID NO: 33794 - DNA, 20 bp, Artificial Sequence
  chemically synthesized
ttagagattgcagtaaagac

SEQ ID NO: 33795 - DNA, 20 bp, Artificial Sequence
  chemically synthesized
attgcagtaaagacaggcat

SEQ ID NO: 33796 - DNA, 20 bp, Artificial Sequence
  chemically synthesized
acaggcataagaaattacaa

SEQ ID NO: 33797 - DNA, 20 bp, Artificial Sequence
  chemically synthesized
aaattacaaaagtattaatt

SEQ ID NO: 33798 - DNA, 20 bp, Artificial Sequence
  chemically synthesized
aattacaaaagtattaattt

SEQ ID NO: 33799 - DNA, 20 bp, Artificial Sequence
  chemically synthesized
attacaaaagtattaatttg

SEQ ID NO: 33800 - DNA, 20 bp, Artificial Sequence
  chemically synthesized
caatccacgaacttctgcca

SEQ ID NO: 33801 - DNA, 20 bp, Artificial Sequence
  chemically synthesized
acgaacttctgccatggctt

SEQ ID NO: 33802 - DNA, 20 bp, Artificial Sequence
  chemically synthesized
cttcagctgatccctccgtt

SEQ ID NO: 33803 - DNA, 20 bp, Artificial Sequence
  chemically synthesized
tcagctgatccctccgtttg

SEQ ID NO: 33804 - DNA, 20 bp, Artificial Sequence
  chemically synthesized
gatccctccgtttggagtcc

SEQ ID NO: 33805 - DNA, 20 bp, Artificial Sequence
  chemically synthesized
ccagacttcccgcaacaact

SEQ ID NO: 33806 - DNA, 20 bp, Artificial Sequence
  chemically synthesized
cccgcaacaactgagaactc

SEQ ID NO: 33807 - DNA, 20 bp, Artificial Sequence
  chemically synthesized
cgcaacaactgagaactctg

SEQ ID NO: 33808 - DNA, 20 bp, Artificial Sequence
  chemically synthesized
gcaacaactgagaactctgg

SEQ ID NO: 33809 - DNA, 20 bp, Artificial Sequence
  chemically synthesized
caacaactgagaactctgga

SEQ ID NO: 33810 - DNA, 20 bp, Artificial Sequence
  chemically synthesized
ccacccttcttatatctctt

SEQ ID NO: 33811 - DNA, 20 bp, Artificial Sequence
  chemically synthesized
cacccttcttatatctctta

SEQ ID NO: 33812 - DNA, 20 bp, Artificial Sequence
  chemically synthesized
cccttcttatatctcttaag

SEQ ID NO: 33813 - DNA, 20 bp, Artificial Sequence
  chemically synthesized
atctcttaaggagctgtgtt

SEQ ID NO: 33814 - DNA, 20 bp, Artificial Sequence
  chemically synthesized
cttaaggagctgtgttcaga

SEQ ID NO: 33815 - DNA, 20 bp, Artificial Sequence
  chemically synthesized
atggttacatttcgcttgct

SEQ ID NO: 33816 - DNA, 20 bp, Artificial Sequence
  chemically synthesized
ttacatttcgcttgctgagc

SEQ ID NO: 33817 - DNA, 20 bp, Artificial Sequence
  chemically synthesized
agactgcattttcattatcc

SEQ ID NO: 33818 - DNA, 20 bp, Artificial Sequence
  chemically synthesized
gactgcattttcattatcct

SEQ ID NO: 33819 - DNA, 20 bp, Artificial Sequence
  chemically synthesized
tatcctgggctaaaatcaat

SEQ ID NO: 33820 - DNA, 20 bp, Artificial Sequence
  chemically synthesized
gctaaaatcaattggtattt

SEQ ID NO: 33821 - DNA, 20 bp, Artificial Sequence
  chemically synthesized
aaatcaattggtatttaagt

SEQ ID NO: 33822 - DNA, 20 bp, Artificial Sequence
  chemically synthesized
atcaattggtatttaagtta

SEQ ID NO: 33823 - DNA, 20 bp, Artificial Sequence
  chemically synthesized
ggtatttaagttagagcaaa

SEQ ID NO: 33824 - DNA, 20 bp, Artificial Sequence
  chemically synthesized
gtatttaagttagagcaaaa

SEQ ID NO: 33825 - DNA, 20 bp, Artificial Sequence
  chemically synthesized
tatttaagttagagcaaaaa

SEQ ID NO: 33826 - DNA, 20 bp, Artificial Sequence
  chemically synthesized
aagggttctaaccctattta

SEQ ID NO: 33827 - DNA, 20 bp, Artificial Sequence
  chemically synthesized
ggttctaaccctatttacag

SEQ ID NO: 33828 - DNA, 20 bp, Artificial Sequence
  chemically synthesized
cagcacacatacacttacat

SEQ ID NO: 33829 - DNA, 20 bp, Artificial Sequence
  chemically synthesized
acatacacttacattagaat

SEQ ID NO: 33830 - DNA, 20 bp, Artificial Sequence
  chemically synthesized
cttacattagaattggcttt

SEQ ID NO: 33831 - DNA, 20 bp, Artificial Sequence
  chemically synthesized
ttacattagaattggcttta

SEQ ID NO: 33832 - DNA, 20 bp, Artificial Sequence
  chemically synthesized
tacattagaattggctttaa

SEQ ID NO: 33833 - DNA, 20 bp, Artificial Sequence
  chemically synthesized
ttccactgattaccttctat

SEQ ID NO: 33834 - DNA, 20 bp, Artificial Sequence
  chemically synthesized
ctgattaccttctatgagcc

SEQ ID NO: 33835 - DNA, 20 bp, Artificial Sequence
  chemically synthesized
tctatgagccaagactgcca

SEQ ID NO: 33836 - DNA, 20 bp, Artificial Sequence
  chemically synthesized
agccaagactgccatagtct

SEQ ID NO: 33837 - DNA, 20 bp, Artificial Sequence
  chemically synthesized
ccatagtctcagccttcatg

SEQ ID NO: 33838 - DNA, 20 bp, Artificial Sequence
  chemically synthesized
ctcagccttcatgcagctta

SEQ ID NO: 33839 - DNA, 20 bp, Artificial Sequence
  chemically synthesized
tcagccttcatgcagcttat

SEQ ID NO: 33840 - DNA, 20 bp, Artificial Sequence
  chemically synthesized
ccttcatgcagcttataggc

SEQ ID NO: 33841 - DNA, 20 bp, Artificial Sequence
  chemically synthesized
cagcttataggctagcaaaa

SEQ ID NO: 33842 - DNA, 20 bp, Artificial Sequence
  chemically synthesized
ttataggctagcaaaaaagc

SEQ ID NO: 33843 - DNA, 20 bp, Artificial Sequence
  chemically synthesized
aggctagcaaaaaagccaga

SEQ ID NO: 33844 - DNA, 20 bp, Artificial Sequence
  chemically synthesized
aaaaaagccagacagtgcac

SEQ ID NO: 33845 - DNA, 20 bp, Artificial Sequence
  chemically synthesized
gacagtgcacaagaactcac

SEQ ID NO: 33846 - DNA, 20 bp, Artificial Sequence
  chemically synthesized
caagaactcacaagtgtgtt

SEQ ID NO: 33847 - DNA, 20 bp, Artificial Sequence
  chemically synthesized
acaagtgtgttgagtgttgc

SEQ ID NO: 33848 - DNA, 20 bp, Artificial Sequence
  chemically synthesized
aagtgtgttgagtgttgcaa

SEQ ID NO: 33849 - DNA, 20 bp, Artificial Sequence
  chemically synthesized
gtgttgagtgttgcaagagt

SEQ ID NO: 33850 - DNA, 20 bp, Artificial Sequence
  chemically synthesized
agtgttgcaagagtaagttt

SEQ ID NO: 33851 - DNA, 20 bp, Artificial Sequence
  chemically synthesized
gtgttgcaagagtaagtttc

SEQ ID NO: 33852 - DNA, 20 bp, Artificial Sequence
  chemically synthesized
tgttgcaagagtaagtttca

SEQ ID NO: 33853 - DNA, 20 bp, Artificial Sequence
  chemically synthesized
gttgcaagagtaagtttcag

SEQ ID NO: 33854 - DNA, 20 bp, Artificial Sequence
  chemically synthesized
ggggctctccatgacttacc

SEQ ID NO: 33855 - DNA, 20 bp, Artificial Sequence
  chemically synthesized
tctccatgacttacctggtt

SEQ ID NO: 33856 - DNA, 20 bp, Artificial Sequence
  chemically synthesized
ctttaactttttttttcctc

SEQ ID NO: 33857 - DNA, 20 bp, Artificial Sequence
  chemically synthesized
tttaactttttttttcctct

SEQ ID NO: 33858 - DNA, 20 bp, Artificial Sequence
  chemically synthesized
ttttttttcctctgggtgta

SEQ ID NO: 33859 - DNA, 20 bp, Artificial Sequence
  chemically synthesized
tttcctctgggtgtaaagtg

SEQ ID NO: 33860 - DNA, 20 bp, Artificial Sequence
  chemically synthesized
tcctctgggtgtaaagtgaa

SEQ ID NO: 33861 - DNA, 20 bp, Artificial Sequence
  chemically synthesized
ctgggtgtaaagtgaagaga

SEQ ID NO: 33862 - DNA, 20 bp, Artificial Sequence
  chemically synthesized
taaagtgaagagatggcaat

SEQ ID NO: 33863 - DNA, 20 bp, Artificial Sequence
  chemically synthesized
aagtgaagagatggcaatca

SEQ ID NO: 33864 - DNA, 20 bp, Artificial Sequence
  chemically synthesized
tgaagagatggcaatcagag

SEQ ID NO: 33865 - DNA, 20 bp, Artificial Sequence
  chemically synthesized
gaagagatggcaatcagagt

SEQ ID NO: 33866 - DNA, 20 bp, Artificial Sequence
  chemically synthesized
ttccattgtgtcattgtgaa

SEQ ID NO: 33867 - DNA, 20 bp, Artificial Sequence
  chemically synthesized
gtgtcattgtgaaaagatgc

SEQ ID NO: 33868 - DNA, 20 bp, Artificial Sequence
  chemically synthesized
tgtcattgtgaaaagatgct

SEQ ID NO: 33869 - DNA, 20 bp, Artificial Sequence
  chemically synthesized
attgtgaaaagatgctgggc

SEQ ID NO: 33870 - DNA, 20 bp, Artificial Sequence
  chemically synthesized
ctgggctggcgtgtctcctg

SEQ ID NO: 33871 - DNA, 20 bp, Artificial Sequence
  chemically synthesized
tgggctggcgtgtctcctga

SEQ ID NO: 33872 - DNA, 20 bp, Artificial Sequence
  chemically synthesized
ttcatgcattcgcacaaata

SEQ ID NO: 33873 - DNA, 20 bp, Artificial Sequence
  chemically synthesized
acaaatatagatgtgttcca

SEQ ID NO: 33874 - DNA, 20 bp, Artificial Sequence
  chemically synthesized
tatagatgtgttccatagat

SEQ ID NO: 33875 - DNA, 20 bp, Artificial Sequence
  chemically synthesized
atagatgtgttccatagatg

SEQ ID NO: 33876 - DNA, 20 bp, Artificial Sequence
  chemically synthesized
gatgtgttccatagatgagg

SEQ ID NO: 33877 - DNA, 20 bp, Artificial Sequence
  chemically synthesized
tgttccatagatgaggcaga

SEQ ID NO: 33878 - DNA, 20 bp, Artificial Sequence
  chemically synthesized
tccatagatgaggcagatag

SEQ ID NO: 33879 - DNA, 20 bp, Artificial Sequence
  chemically synthesized
catagatgaggcagatagca

SEQ ID NO: 33880 - DNA, 20 bp, Artificial Sequence
  chemically synthesized
atagatgaggcagatagcag

SEQ ID NO: 33881 - DNA, 20 bp, Artificial Sequence
  chemically synthesized
atagcagaggcttctgccta

SEQ ID NO: 33882 - DNA, 20 bp, Artificial Sequence
  chemically synthesized
cagaggcttctgcctacagc

SEQ ID NO: 33883 - DNA, 20 bp, Artificial Sequence
  chemically synthesized
agaggcttctgcctacagca

SEQ ID NO: 33884 - DNA, 20 bp, Artificial Sequence
  chemically synthesized
gcttctgcctacagcaaggc

SEQ ID NO: 33885 - DNA, 20 bp, Artificial Sequence
  chemically synthesized
tgcctacagcaaggctagtt

SEQ ID NO: 33886 - DNA, 20 bp, Artificial Sequence
  chemically synthesized
cctacagcaaggctagtttg

SEQ ID NO: 33887 - DNA, 20 bp, Artificial Sequence
  chemically synthesized
tacagcaaggctagtttgga

SEQ ID NO: 33888 - DNA, 20 bp, Artificial Sequence
  chemically synthesized
acagcaaggctagtttggag

SEQ ID NO: 33889 - DNA, 20 bp, Artificial Sequence
  chemically synthesized
cagcaaggctagtttggaga

SEQ ID NO: 33890 - DNA, 20 bp, Artificial Sequence
  chemically synthesized
tttggagagggttttgctgt

SEQ ID NO: 33891 - DNA, 20 bp, Artificial Sequence
  chemically synthesized
ttggagagggttttgctgtc

SEQ ID NO: 33892 - DNA, 20 bp, Artificial Sequence
  chemically synthesized
tggagagggttttgctgtca

SEQ ID NO: 33893 - DNA, 20 bp, Artificial Sequence
  chemically synthesized
gagggttttgctgtcagggt

SEQ ID NO: 33894 - DNA, 20 bp, Artificial Sequence
  chemically synthesized
tggacccacacacctcttca

SEQ ID NO: 33895 - DNA, 20 bp, Artificial Sequence
  chemically synthesized
atgctttttcttttttttcc

SEQ ID NO: 33896 - DNA, 20 bp, Artificial Sequence
  chemically synthesized
gctttttcttttttttccca

SEQ ID NO: 33897 - DNA, 20 bp, Artificial Sequence
  chemically synthesized
ttttttttcccagagtttga

SEQ ID NO: 33898 - DNA, 20 bp, Artificial Sequence
  chemically synthesized
tttttttcccagagtttgaa

SEQ ID NO: 33899 - DNA, 20 bp, Artificial Sequence
  chemically synthesized
ttttttcccagagtttgaaa

SEQ ID NO: 33900 - DNA, 20 bp, Artificial Sequence
  chemically synthesized
cccagagtttgaaagggaaa

SEQ ID NO: 33901 - DNA, 20 bp, Artificial Sequence
  chemically synthesized
cagagtttgaaagggaaatg

SEQ ID NO: 33902 - DNA, 20 bp, Artificial Sequence
  chemically synthesized
tgaaagggaaatggagtctc

SEQ ID NO: 33903 - DNA, 20 bp, Artificial Sequence
  chemically synthesized
gggaaatggagtctcaagtt

SEQ ID NO: 33904 - DNA, 20 bp, Artificial Sequence
  chemically synthesized
ggaaatggagtctcaagttc

SEQ ID NO: 33905 - DNA, 20 bp, Artificial Sequence
  chemically synthesized
gaaatggagtctcaagttca

SEQ ID NO: 33906 - DNA, 20 bp, Artificial Sequence
  chemically synthesized
aatggagtctcaagttcagg

SEQ ID NO: 33907 - DNA, 20 bp, Artificial Sequence
  chemically synthesized
atggagtctcaagttcaggg

SEQ ID NO: 33908 - DNA, 20 bp, Artificial Sequence
  chemically synthesized
tctcaagttcagggaggtta

SEQ ID NO: 33909 - DNA, 20 bp, Artificial Sequence
  chemically synthesized
agttcagggaggttacagtg

SEQ ID NO: 33910 - DNA, 20 bp, Artificial Sequence
  chemically synthesized
tacagtgtagacccacaaat

SEQ ID NO: 33911 - DNA, 20 bp, Artificial Sequence
  chemically synthesized
tgtagacccacaaatcagct

SEQ ID NO: 33912 - DNA, 20 bp, Artificial Sequence
  chemically synthesized
acccacaaatcagctaagta

SEQ ID NO: 33913 - DNA, 20 bp, Artificial Sequence
  chemically synthesized
caaatcagctaagtacagct

SEQ ID NO: 33914 - DNA, 20 bp, Artificial Sequence
  chemically synthesized
aaatcagctaagtacagcta

SEQ ID NO: 33915 - DNA, 20 bp, Artificial Sequence
  chemically synthesized
aatcagctaagtacagctaa

SEQ ID NO: 33916 - DNA, 20 bp, Artificial Sequence
  chemically synthesized
cagctaagtacagctaaggg

SEQ ID NO: 33917 - DNA, 20 bp, Artificial Sequence
  chemically synthesized
gctaagtacagctaagggtg

SEQ ID NO: 33918 - DNA, 20 bp, Artificial Sequence
  chemically synthesized
aagtacagctaagggtggag

SEQ ID NO: 33919 - DNA, 20 bp, Artificial Sequence
  chemically synthesized
ggagaagtctatgcaatatc

SEQ ID NO: 33920 - DNA, 20 bp, Artificial Sequence
  chemically synthesized
ccagcactcttctgattaat

SEQ ID NO: 33921 - DNA, 20 bp, Artificial Sequence
  chemically synthesized
gcactcttctgattaattag

SEQ ID NO: 33922 - DNA, 20 bp, Artificial Sequence
  chemically synthesized
ttagaagtctttaaaattca

SEQ ID NO: 33923 - DNA, 20 bp, Artificial Sequence
  chemically synthesized
ccctaaatgattcatatgtc

SEQ ID NO: 33924 - DNA, 20 bp, Artificial Sequence
  chemically synthesized
atgattcatatgtcaagaca

SEQ ID NO: 33925 - DNA, 20 bp, Artificial Sequence
  chemically synthesized
tcatatgtcaagacacagta

SEQ ID NO: 33926 - DNA, 20 bp, Artificial Sequence
  chemically synthesized
cacagtaaagatattatatg

SEQ ID NO: 33927 - DNA, 20 bp, Artificial Sequence
  chemically synthesized
tggaacatcatacacaaaca

SEQ ID NO: 33928 - DNA, 20 bp, Artificial Sequence
  chemically synthesized
ggaacatcatacacaaacat

SEQ ID NO: 33929 - DNA, 20 bp, Artificial Sequence
  chemically synthesized
tacacaaacataggtccata

SEQ ID NO: 33930 - DNA, 20 bp, Artificial Sequence
  chemically synthesized
ccatatagaaattcttacct

SEQ ID NO: 33931 - DNA, 20 bp, Artificial Sequence
  chemically synthesized
tgctctttaaatcctgctaa

SEQ ID NO: 33932 - DNA, 20 bp, Artificial Sequence
  chemically synthesized
tctttaaatcctgctaatgg

SEQ ID NO: 33933 - DNA, 20 bp, Artificial Sequence
  chemically synthesized
atttgtgtctttgtcaccta

SEQ ID NO: 33934 - DNA, 20 bp, Artificial Sequence
  chemically synthesized
tgtcacctacagtacatttc

SEQ ID NO: 33935 - DNA, 20 bp, Artificial Sequence
  chemically synthesized
ctacagtacatttctggatt

SEQ ID NO: 33936 - DNA, 20 bp, Artificial Sequence
  chemically synthesized
tacagtacatttctggattt

SEQ ID NO: 33937 - DNA, 20 bp, Artificial Sequence
  chemically synthesized
acatttctggatttgggaat

SEQ ID NO: 33938 - DNA, 20 bp, Artificial Sequence
  chemically synthesized
atttgggaatgagtgttctt

SEQ ID NO: 33939 - DNA, 20 bp, Artificial Sequence
  chemically synthesized
ttgggaatgagtgttcttca

SEQ ID NO: 33940 - DNA, 20 bp, Artificial Sequence
  chemically synthesized
tgggaatgagtgttcttcag

SEQ ID NO: 33941 - DNA, 20 bp, Artificial Sequence
  chemically synthesized
ttcagaggatcctcgctgcc

SEQ ID NO: 33942 - DNA, 20 bp, Artificial Sequence
  chemically synthesized
tcagaggatcctcgctgccc

SEQ ID NO: 33943 - DNA, 20 bp, Artificial Sequence
  chemically synthesized
tcgctgcccaggttccctgc

SEQ ID NO: 33944 - DNA, 20 bp, Artificial Sequence
  chemically synthesized
ctgcccaggttccctgccag

SEQ ID NO: 33945 - DNA, 20 bp, Artificial Sequence
  chemically synthesized
tgcccaggttccctgccaga

SEQ ID NO: 33946 - DNA, 20 bp, Artificial Sequence
  chemically synthesized
caggttccctgccagaagga

SEQ ID NO: 33947 - DNA, 20 bp, Artificial Sequence
  chemically synthesized
tggcagggaacctgggcagc

SEQ ID NO: 33948 - DNA, 20 bp, Artificial Sequence
  chemically synthesized
gacacaaatgccaccattag

SEQ ID NO: 33949 - DNA, 20 bp, Artificial Sequence
  chemically synthesized
aattggcagtttactaaggt

SEQ ID NO: 33950 - DNA, 20 bp, Artificial Sequence
  chemically synthesized
tctttactgtgtcttgacat

SEQ ID NO: 33951 - DNA, 20 bp, Artificial Sequence
  chemically synthesized
gggaagacaatatggtttct

SEQ ID NO: 33952 - DNA, 20 bp, Artificial Sequence
  chemically synthesized
aaagacttctaattaatcag

SEQ ID NO: 33953 - DNA, 20 bp, Artificial Sequence
  chemically synthesized
tctaattaatcagaagagtg

SEQ ID NO: 33954 - DNA, 20 bp, Artificial Sequence
  chemically synthesized
tagctgtacttagctgattt

SEQ ID NO: 33955 - DNA, 20 bp, Artificial Sequence
  chemically synthesized
aagcatctatgaagaggtgt

SEQ ID NO: 33956 - DNA, 20 bp, Artificial Sequence
  chemically synthesized
tggaacacatctatatttgt

SEQ ID NO: 33957 - DNA, 20 bp, Artificial Sequence
  chemically synthesized
tgaaaataaagtttaaagat

SEQ ID NO: 33958 - DNA, 20 bp, Artificial Sequence
  chemically synthesized
ccagaggaaaaaaaaagtta

SEQ ID NO: 33959 - DNA, 20 bp, Artificial Sequence
  chemically synthesized
ttgcaacactcaacacactt

SEQ ID NO: 33960 - DNA, 20 bp, Artificial Sequence
  chemically synthesized
agtggaaatttgtcgattga

SEQ ID NO: 33961 - DNA, 20 bp, Artificial Sequence
  chemically synthesized
tgtatgtgtgctgctgtaaa

SEQ ID NO: 33962 - DNA, 20 bp, Artificial Sequence
  chemically synthesized
aataccaattgattttagcc

SEQ ID NO: 33963 - DNA, 20 bp, Artificial Sequence
  chemically synthesized
agctccttaagagatataag

SEQ ID NO: 33964 - DNA, 20 bp, Artificial Sequence
  chemically synthesized
gagatataagaagggtggaa

SEQ ID NO: 33965 - DNA, 20 bp, Artificial Sequence
  chemically synthesized
aagaagggtggaagtgggtg

SEQ ID NO: 33966 - DNA, 20 bp, Artificial Sequence
  chemically synthesized
tgggtgaagggtaggccctc

SEQ ID NO: 33967 - DNA, 20 bp, Artificial Sequence
  chemically synthesized
aagtctgggactccaaacgg

SEQ ID NO: 33968 - DNA, 20 bp, Artificial Sequence
  chemically synthesized
tgaagccatggcagaagttc

SEQ ID NO: 33969 - DNA, 20 bp, Artificial Sequence
  chemically synthesized
tcttaatcctgtcagctgag

SEQ ID NO: 33970 - DNA, 20 bp, Artificial Sequence
  chemically synthesized
tggacaccttgaaaaaagaa

SEQ ID NO: 33971 - DNA, 20 bp, Artificial Sequence
  chemically synthesized
aggataacagcaattgttca

SEQ ID NO: 33972 - DNA, 20 bp, Artificial Sequence
  chemically synthesized
agcaaatgggagaaatatcg

SEQ ID NO: 33973 - DNA, 20 bp, Artificial Sequence
  chemically synthesized
catggaacatccctgagaaa

SEQ ID NO: 33974 - DNA, 20 bp, Artificial Sequence
  chemically synthesized
tctcttatggtcgagactgc

SEQ ID NO: 33975 - DNA, 20 bp, Artificial Sequence
  chemically synthesized
accgaaatgtgatgcctccc

SEQ ID NO: 33976 - DNA, 20 bp, Artificial Sequence
  chemically synthesized
gaaaatagaaaagaacctac

SEQ ID NO: 33977 - DNA, 20 bp, Artificial Sequence
  chemically synthesized
ggcgtggagatgtaacaagc

SEQ ID NO: 33978 - DNA, 20 bp, Artificial Sequence
  chemically synthesized
gatgtaacaagcctggatgt

SEQ ID NO: 33979 - DNA, 20 bp, Artificial Sequence
  chemically synthesized
atttggaagaaatatcagat

SEQ ID NO: 33980 - DNA, 20 bp, Artificial Sequence
  chemically synthesized
taaaagcagcagcatgcagt

SEQ ID NO: 33981 - DNA, 20 bp, Artificial Sequence
  chemically synthesized
aaccccatgctcaccatcaa

SEQ ID NO: 33982 - DNA, 20 bp, Artificial Sequence
  chemically synthesized
catgctcaccatcaacggga

SEQ ID NO: 33983 - DNA, 20 bp, Artificial Sequence
  chemically synthesized
gggattgaatttgagctgct

SEQ ID NO: 33984 - DNA, 20 bp, Artificial Sequence
  chemically synthesized
ttatcttcaattctgtgaaa

SEQ ID NO: 33985 - DNA, 20 bp, Artificial Sequence
  chemically synthesized
tgcaagagaggaaggaaggc

SEQ ID NO: 33986 - DNA, 20 bp, Artificial Sequence
  chemically synthesized
agctttctggcaggcactgg

SEQ ID NO: 33987 - DNA, 20 bp, Artificial Sequence
  chemically synthesized
tgtaactggtggccttagaa

SEQ ID NO: 33988 - DNA, 20 bp, Artificial Sequence
  chemically synthesized
ggtggccttagaagagggtt

SEQ ID NO: 33989 - DNA, 20 bp, Artificial Sequence
  chemically synthesized
cagggttatgtgtttggaac

SEQ ID NO: 33990 - DNA, 20 bp, Artificial Sequence
  chemically synthesized
gccaccaagcaccaagaggt

SEQ ID NO: 33991 - DNA, 20 bp, Artificial Sequence
  chemically synthesized
agcaccaagaggtgtgagtt

SEQ ID NO: 33992 - DNA, 20 bp, Artificial Sequence
  chemically synthesized
aaagaggaaggtgaaaactg

SEQ ID NO: 33993 - DNA, 20 bp, Artificial Sequence
  chemically synthesized
atcccctgagagaaaaagta

SEQ ID NO: 33994 - DNA, 20 bp, Artificial Sequence
  chemically synthesized
cccctcacggccaaaggcat

SEQ ID NO: 33995 - DNA, 20 bp, Artificial Sequence
  chemically synthesized
ccagacattgagctcaagga

SEQ ID NO: 33996 - DNA, 20 bp, Artificial Sequence
  chemically synthesized
gtttgtatgttttctacagt

SEQ ID NO: 33997 - DNA, 20 bp, Artificial Sequence
  chemically synthesized
gttttctacagttcggattt

SEQ ID NO: 33998 - DNA, 20 bp, Artificial Sequence
  chemically synthesized
atgatttcatttcttttcga

SEQ ID NO: 33999 - DNA, 20 bp, Artificial Sequence
  chemically synthesized
tatgcatactttctaaatgc

SEQ ID NO: 34000 - DNA, 20 bp, Artificial Sequence
  chemically synthesized
catcagctctttggcagctt

SEQ ID NO: 34001 - DNA, 20 bp, Artificial Sequence
  chemically synthesized
tttaattctcacctggtccc

SEQ ID NO: 34002 - DNA, 20 bp, Artificial Sequence
  chemically synthesized
ccaggatatggtttacttgt

SEQ ID NO: 34003 - DNA, 20 bp, Artificial Sequence
  chemically synthesized
tgaaggaaagagagagaagt

SEQ ID NO: 34004 - DNA, 20 bp, Artificial Sequence
  chemically synthesized
attttttttttctgtggaaa

SEQ ID NO: 34005 - DNA, 20 bp, Artificial Sequence
  chemically synthesized
ttgcacattatcgcagtagg

SEQ ID NO: 34006 - DNA, 20 bp, Artificial Sequence
  chemically synthesized
tggcttaacccctgaaacct

SEQ ID NO: 34007 - DNA, 20 bp, Artificial Sequence
  chemically synthesized
agacttttgcatatataatt

SEQ ID NO: 34008 - DNA, 20 bp, Artificial Sequence
  chemically synthesized
gcatatataattaaggatct

SEQ ID NO: 34009 - DNA, 20 bp, Artificial Sequence
  chemically synthesized
tggggagatatcctaattat

SEQ ID NO: 34010 - DNA, 20 bp, Artificial Sequence
  chemically synthesized
gaggaagaggctacaaacca

SEQ ID NO: 34011 - DNA, 20 bp, Artificial Sequence
  chemically synthesized
gaggctacaaaccaaggaat

SEQ ID NO: 34012 - DNA, 20 bp, Artificial Sequence
  chemically synthesized
gtagcctctagaagaggaaa

SEQ ID NO: 34013 - DNA, 20 bp, Artificial Sequence
  chemically synthesized
caggaaaacacaatctctca

SEQ ID NO: 34014 - DNA, 20 bp, Artificial Sequence
  chemically synthesized
gcaagaggaaatcagttacg

SEQ ID NO: 34015 - DNA, 20 bp, Artificial Sequence
  chemically synthesized
tcctgtctctggctaatcat

SEQ ID NO: 34016 - DNA, 20 bp, Artificial Sequence
  chemically synthesized
tacatacagacccagagcca

SEQ ID NO: 34017 - DNA, 20 bp, Artificial Sequence
  chemically synthesized
agacccagagccagtgaatc

SEQ ID NO: 34018 - DNA, 20 bp, Artificial Sequence
  chemically synthesized
ttggtggtggggcccagagc

SEQ ID NO: 34019 - DNA, 20 bp, Artificial Sequence
  chemically synthesized
aagcaacttactcaaataca

SEQ ID NO: 34020 - DNA, 20 bp, Artificial Sequence
  chemically synthesized
taattttattactttatctt

SEQ ID NO: 34021 - DNA, 20 bp, Artificial Sequence
  chemically synthesized
attatataatgtttattgat

SEQ ID NO: 34022 - DNA, 20 bp, Artificial Sequence
  chemically synthesized
tataatgtttattgattaga

SEQ ID NO: 34023 - DNA, 20 bp, Artificial Sequence
  chemically synthesized
gtgttcagattcctgacctc

SEQ ID NO: 34024 - DNA, 20 bp, Artificial Sequence
  chemically synthesized
agattagacagcaggcaggg

SEQ ID NO: 34025 - DNA, 20 bp, Artificial Sequence
  chemically synthesized
aagttgcttaaacatgacag

SEQ ID NO: 34026 - DNA, 20 bp, Artificial Sequence
  chemically synthesized
gcttaaacatgacagcagga

SEQ ID NO: 34027 - DNA, 20 bp, Artificial Sequence
  chemically synthesized
acctctgctgaacttcctca

SEQ ID NO: 34028 - DNA, 20 bp, Artificial Sequence
  chemically synthesized
tccataaatccaaccaccgc

SEQ ID NO: 34029 - DNA, 20 bp, Artificial Sequence
  chemically synthesized
caaatttggctgacacagtt

SEQ ID NO: 34030 - DNA, 20 bp, Artificial Sequence
  chemically synthesized
gcactagcacaaaatatttg

SEQ ID NO: 34031 - DNA, 20 bp, Artificial Sequence
  chemically synthesized
acaaaatatttgctgaatga

SEQ ID NO: 34032 - DNA, 20 bp, Artificial Sequence
  chemically synthesized
tatttgctgaatgaaagaat

SEQ ID NO: 34033 - DNA, 20 bp, Artificial Sequence
  chemically synthesized
caaagtcttttactccggtg

SEQ ID NO: 34034 - DNA, 20 bp, Artificial Sequence
  chemically synthesized
actccggtgtggagtgtttt

SEQ ID NO: 34035 - DNA, 20 bp, Artificial Sequence
  chemically synthesized
gaaacacctccccttaactg

SEQ ID NO: 34036 - DNA, 20 bp, Artificial Sequence
  chemically synthesized
ttcagggaagatgtctgttg

SEQ ID NO: 34037 - DNA, 20 bp, Artificial Sequence
  chemically synthesized
ctataccccagatttatttt

SEQ ID NO: 34038 - DNA, 20 bp, Artificial Sequence
  chemically synthesized
ccagatttattttgaggatt

SEQ ID NO: 34039 - DNA, 20 bp, Artificial Sequence
  chemically synthesized
attgcgtattactaaaaaga

SEQ ID NO: 34040 - DNA, 20 bp, Artificial Sequence
  chemically synthesized
caatgggaaggtgtcagagc

SEQ ID NO: 34041 - DNA, 20 bp, Artificial Sequence
  chemically synthesized
ccgtagtggaggggagctct

SEQ ID NO: 34042 - DNA, 20 bp, Artificial Sequence
  chemically synthesized
aattgaaatgaacaaaggca

SEQ ID NO: 34043 - DNA, 20 bp, Artificial Sequence
  chemically synthesized
acagggaagcctctgaacac

SEQ ID NO: 34044 - DNA, 20 bp, Artificial Sequence
  chemically synthesized
cttcaggaaacccaggccca

SEQ ID NO: 34045 - DNA, 20 bp, Artificial Sequence
  chemically synthesized
tttctccttcaaaccactct

SEQ ID NO: 34046 - DNA, 20 bp, Artificial Sequence
  chemically synthesized
gcgtcactcaaactagctga

SEQ ID NO: 34047 - DNA, 20 bp, Artificial Sequence
  chemically synthesized
taggcttatttcaaaaggca

SEQ ID NO: 34048 - DNA, 20 bp, Artificial Sequence
  chemically synthesized
agtgcctgctgtgtgtggtg

SEQ ID NO: 34049 - DNA, 20 bp, Artificial Sequence
  chemically synthesized
taggaaggaacagggcagtg

SEQ ID NO: 34050 - DNA, 20 bp, Artificial Sequence
  chemically synthesized
ctgccctgttccttcctagc

SEQ ID NO: 34051 - DNA, 20 bp, Artificial Sequence
  chemically synthesized
gcctgagtcaggactgagca

SEQ ID NO: 34052 - DNA, 20 bp, Artificial Sequence
  chemically synthesized
gaaataagcctacttttaac

SEQ ID NO: 34053 - DNA, 20 bp, Artificial Sequence
  chemically synthesized
gctggactttgtccctgtgt

SEQ ID NO: 34054 - DNA, 20 bp, Artificial Sequence
  chemically synthesized
agacaattctttcagctagt

SEQ ID NO: 34055 - DNA, 20 bp, Artificial Sequence
  chemically synthesized
cgcagtgaagcagtgggaac

SEQ ID NO: 34056 - DNA, 20 bp, Artificial Sequence
  chemically synthesized
agtgggaaccggaatatcca

SEQ ID NO: 34057 - DNA, 20 bp, Artificial Sequence
  chemically synthesized
tggctttatatcctctgggc

SEQ ID NO: 34058 - DNA, 20 bp, Artificial Sequence
  chemically synthesized
atagaggagagagaaaatgg

SEQ ID NO: 34059 - DNA, 20 bp, Artificial Sequence
  chemically synthesized
atggaagtttctgagaactt

SEQ ID NO: 34060 - DNA, 20 bp, Artificial Sequence
  chemically synthesized
ttctgagaacttcagggtat

SEQ ID NO: 34061 - DNA, 20 bp, Artificial Sequence
  chemically synthesized
ctatttagttaattaaggct

SEQ ID NO: 34062 - DNA, 20 bp, Artificial Sequence
  chemically synthesized
tacgcaattgaaaagtatgt

SEQ ID NO: 34063 - DNA, 20 bp, Artificial Sequence
  chemically synthesized
aggtgctaagcattttagct

SEQ ID NO: 34064 - DNA, 20 bp, Artificial Sequence
  chemically synthesized
cataatcctcaaaataaatc

SEQ ID NO: 34065 - DNA, 20 bp, Artificial Sequence
  chemically synthesized
atagatgacttgattagaag

SEQ ID NO: 34066 - DNA, 20 bp, Artificial Sequence
  chemically synthesized
tgattagaagcagggtatgt

SEQ ID NO: 34067 - DNA, 20 bp, Artificial Sequence
  chemically synthesized
gtatcttaaggcaaggaaaa

SEQ ID NO: 34068 - DNA, 20 bp, Artificial Sequence
  chemically synthesized
gcctagtgcccaggccaggc

SEQ ID NO: 34069 - DNA, 20 bp, Artificial Sequence
  chemically synthesized
ccccacaacagacatcttcc

SEQ ID NO: 34070 - DNA, 20 bp, Artificial Sequence
  chemically synthesized
acagacatcttccctgaatg

SEQ ID NO: 34071 - DNA, 20 bp, Artificial Sequence
  chemically synthesized
ctaatgccctctaactgatg

SEQ ID NO: 34072 - DNA, 20 bp, Artificial Sequence
  chemically synthesized
tctaactgatgctgagtttg

SEQ ID NO: 34073 - DNA, 20 bp, Artificial Sequence
  chemically synthesized
tcagttaaggggaggtgttt

SEQ ID NO: 34074 - DNA, 20 bp, Artificial Sequence
  chemically synthesized
gggaggtgtttctgagtttg

SEQ ID NO: 34075 - DNA, 20 bp, Artificial Sequence
  chemically synthesized
caaacaccttcctaattggt

SEQ ID NO: 34076 - DNA, 20 bp, Artificial Sequence
  chemically synthesized
atcctgaaaacactccacac

SEQ ID NO: 34077 - DNA, 20 bp, Artificial Sequence
  chemically synthesized
agattaatatcgtagatgaa

SEQ ID NO: 34078 - DNA, 20 bp, Artificial Sequence
  chemically synthesized
tgaactgagtctgggctagg

SEQ ID NO: 34079 - DNA, 20 bp, Artificial Sequence
  chemically synthesized
taaaggagcctgtacctaaa

SEQ ID NO: 34080 - DNA, 20 bp, Artificial Sequence
  chemically synthesized
actggcaaagtgaggaagga

SEQ ID NO: 34081 - DNA, 20 bp, Artificial Sequence
  chemically synthesized
gaaggacggggtctggaggg

SEQ ID NO: 34082 - DNA, 20 bp, Artificial Sequence
  chemically synthesized
gacggggtctggagggaaga

SEQ ID NO: 34083 - DNA, 20 bp, Artificial Sequence
  chemically synthesized
gtgcaaaggcacagcacata

SEQ ID NO: 34084 - DNA, 20 bp, Artificial Sequence
  chemically synthesized
tacagaatgcctgcatgctc

SEQ ID NO: 34085 - DNA, 20 bp, Artificial Sequence
  chemically synthesized
caaaactgtgtcagccaaat

SEQ ID NO: 34086 - DNA, 20 bp, Artificial Sequence
  chemically synthesized
ctgagatacccaggcggtgg

SEQ ID NO: 34087 - DNA, 20 bp, Artificial Sequence
  chemically synthesized
cccaggcggtggttggattt

SEQ ID NO: 34088 - DNA, 20 bp, Artificial Sequence
  chemically synthesized
cggtggttggatttatggat

SEQ ID NO: 34089 - DNA, 20 bp, Artificial Sequence
  chemically synthesized
tttatggatctggatttcag

SEQ ID NO: 34090 - DNA, 20 bp, Artificial Sequence
  chemically synthesized
aggggagtgggcagggctag

SEQ ID NO: 34091 - DNA, 20 bp, Artificial Sequence
  chemically synthesized
agggctaggggaatagaact

SEQ ID NO: 34092 - DNA, 20 bp, Artificial Sequence
  chemically synthesized
agggtcatgatgtcagtggt

SEQ ID NO: 34093 - DNA, 20 bp, Artificial Sequence
  chemically synthesized
ggagttgaagtcttggaaga

SEQ ID NO: 34094 - DNA, 20 bp, Artificial Sequence
  chemically synthesized
aaaggttaactccagaggtc

SEQ ID NO: 34095 - DNA, 20 bp, Artificial Sequence
  chemically synthesized
tcttttatttcttcatttta

SEQ ID NO: 34096 - DNA, 20 bp, Artificial Sequence
  chemically synthesized
catttacacaaaagtacaac

SEQ ID NO: 34097 - DNA, 20 bp, Artificial Sequence
  chemically synthesized
aaatgaaataccctatgtat

SEQ ID NO: 34098 - DNA, 20 bp, Artificial Sequence
  chemically synthesized
aaatccttgattcactggct

SEQ ID NO: 34099 - DNA, 20 bp, Artificial Sequence
  chemically synthesized
gtctgtatgtaacaagcttc

SEQ ID NO: 34100 - DNA, 20 bp, Artificial Sequence
  chemically synthesized
tgtgttttcctgccttttcc

SEQ ID NO: 34101 - DNA, 20 bp, Artificial Sequence
  chemically synthesized
atgacacttgtgattacatt

SEQ ID NO: 34102 - DNA, 20 bp, Artificial Sequence
  chemically synthesized
ttaggatacacccaaataat

SEQ ID NO: 34103 - DNA, 20 bp, Artificial Sequence
  chemically synthesized
agataatactcacaggtttc

SEQ ID NO: 34104 - DNA, 20 bp, Artificial Sequence
  chemically synthesized
gttaagccatacatatcttt

SEQ ID NO: 34105 - DNA, 20 bp, Artificial Sequence
  chemically synthesized
tcatctcatcaggtgttacc

SEQ ID NO: 34106 - DNA, 20 bp, Artificial Sequence
  chemically synthesized
catcaggtgttacctagaat

SEQ ID NO: 34107 - DNA, 20 bp, Artificial Sequence
  chemically synthesized
ccatatcctggggaccaggt

SEQ ID NO: 34108 - DNA, 20 bp, Artificial Sequence
  chemically synthesized
actgaagtcacatggagctc

SEQ ID NO: 34109 - DNA, 20 bp, Artificial Sequence
  chemically synthesized
aatgaaatcatatttttctg

SEQ ID NO: 34110 - DNA, 20 bp, Artificial Sequence
  chemically synthesized
aggcactgaaccagctggaa

SEQ ID NO: 34111 - DNA, 20 bp, Artificial Sequence
  chemically synthesized
aaccagctggaaatgaatgc

SEQ ID NO: 34112 - DNA, 20 bp, Artificial Sequence
  chemically synthesized
attttcgcagctgataaaag

SEQ ID NO: 34113 - DNA, 20 bp, Artificial Sequence
  chemically synthesized
aatgtctggagaaagcagct

SEQ ID NO: 34114 - DNA, 20 bp, Artificial Sequence
  chemically synthesized
actctgtactttttctctca

SEQ ID NO: 34115 - DNA, 20 bp, Artificial Sequence
  chemically synthesized
cctgcagctaagattgagaa

SEQ ID NO: 34116 - DNA, 20 bp, Artificial Sequence
  chemically synthesized
cctattttttaaagcacagt

SEQ ID NO: 34117 - DNA, 20 bp, Artificial Sequence
  chemically synthesized
ttctaaggccaccagttaca

SEQ ID NO: 34118 - DNA, 20 bp, Artificial Sequence
  chemically synthesized
acaaagaatggggaaggtta

SEQ ID NO: 34119 - DNA, 20 bp, Artificial Sequence
  chemically synthesized
tggtctaaaattccatttca

SEQ ID NO: 34120 - DNA, 20 bp, Artificial Sequence
  chemically synthesized
tcacagaattgaagataatt

SEQ ID NO: 34121 - DNA, 20 bp, Artificial Sequence
  chemically synthesized
aatcccgttgatggtgagca

SEQ ID NO: 34122 - DNA, 20 bp, Artificial Sequence
  chemically synthesized
gtgagcatggggttcatttt

SEQ ID NO: 34123 - DNA, 20 bp, Artificial Sequence
  chemically synthesized
ttcattttgagagtagaaaa

SEQ ID NO: 34124 - DNA, 20 bp, Artificial Sequence
  chemically synthesized
gtagaaaattggatgcagtg

SEQ ID NO: 34125 - DNA, 20 bp, Artificial Sequence
  chemically synthesized
aattggatgcagtggagaat

SEQ ID NO: 34126 - DNA, 20 bp, Artificial Sequence
  chemically synthesized
tgcagtggagaatcagaatg

SEQ ID NO: 34127 - DNA, 20 bp, Artificial Sequence
  chemically synthesized
attttcaaatatacaaaata

SEQ ID NO: 34128 - DNA, 20 bp, Artificial Sequence
  chemically synthesized
atattgagtctgaaggcaaa

SEQ ID NO: 34129 - DNA, 20 bp, Artificial Sequence
  chemically synthesized
cttgttacatctccacgcca

SEQ ID NO: 34130 - DNA, 20 bp, Artificial Sequence
  chemically synthesized
caactttagaaataaaggga

SEQ ID NO: 34131 - DNA, 20 bp, Artificial Sequence
  chemically synthesized
aaaaccagcaagtttgtatt

SEQ ID NO: 34132 - DNA, 20 bp, Artificial Sequence
  chemically synthesized
gaggcagtgtgcaaataggt

SEQ ID NO: 34133 - DNA, 20 bp, Artificial Sequence
  chemically synthesized
tcaagtactttacaaggtaa

SEQ ID NO: 34134 - DNA, 20 bp, Artificial Sequence
  chemically synthesized
tatcacaaggcaagtggagg

SEQ ID NO: 34135 - DNA, 20 bp, Artificial Sequence
  chemically synthesized
gataacatcttatcaggaga

SEQ ID NO: 34136 - DNA, 20 bp, Artificial Sequence
  chemically synthesized
ttatcaggagacagggtttt

SEQ ID NO: 34137 - DNA, 20 bp, Artificial Sequence
  chemically synthesized
ctgaccaaaatttattaggc

SEQ ID NO: 34138 - DNA, 20 bp, Artificial Sequence
  chemically synthesized
ctgggagcgctgtgggagac

SEQ ID NO: 34139 - DNA, 20 bp, Artificial Sequence
  chemically synthesized
tggctcgtattctctttctc

SEQ ID NO: 34140 - DNA, 20 bp, Artificial Sequence
  chemically synthesized
ggatgttccatgctgagaaa

SEQ ID NO: 34141 - DNA, 20 bp, Artificial Sequence
  chemically synthesized
ctgcctggctcaccagcagt

SEQ ID NO: 34142 - DNA, 20 bp, Artificial Sequence
  chemically synthesized
tgcagttaatgcaattatta

SEQ ID NO: 34143 - DNA, 20 bp, Artificial Sequence
  chemically synthesized
tatacatcctcctcagctga

SEQ ID NO: 34144 - DNA, 20 bp, Artificial Sequence
  chemically synthesized
taaagacaggcataaatcac

SEQ ID NO: 34145 - DNA, 20 bp, Artificial Sequence
  chemically synthesized
cttcagctgatccctccgtt

SEQ ID NO: 34146 - DNA, 20 bp, Artificial Sequence
  chemically synthesized
ggtatttaagttagagcaaa

SEQ ID NO: 34147 - DNA, 20 bp, Artificial Sequence
  chemically synthesized
cagcacacatacacttacat

SEQ ID NO: 34148 - DNA, 20 bp, Artificial Sequence
  chemically synthesized
cacaagaactcacaagtgtg

SEQ ID NO: 34149 - DNA, 20 bp, Artificial Sequence
  chemically synthesized
acaagtgtgttgagtgttgc

SEQ ID NO: 34150 - DNA, 20 bp, Artificial Sequence
  chemically synthesized
cctttaactttttttttcct

SEQ ID NO: 34151 - DNA, 20 bp, Artificial Sequence
  chemically synthesized
taaagtgaagagatggcaat

SEQ ID NO: 34152 - DNA, 20 bp, Artificial Sequence
  chemically synthesized
tacagcaaggctagtttgga

SEQ ID NO: 34153 - DNA, 20 bp, Artificial Sequence
  chemically synthesized
tttggagagggttttgctgt

SEQ ID NO: 34154 - DNA, 20 bp, Artificial Sequence
  chemically synthesized
atgctttttcttttttttcc

SEQ ID NO: 34155 - DNA, 20 bp, Artificial Sequence
  chemically synthesized
cccagagtttgaaagggaaa

SEQ ID NO: 34156 - DNA, 20 bp, Artificial Sequence
  chemically synthesized
caaatcagctaagtacagct

SEQ ID NO: 34157 - DNA, 20 bp, Artificial Sequence
  chemically synthesized
ttgtcacctacagtacattt

SEQ ID NO: 34158 - DNA, 20 bp, Artificial Sequence
  chemically synthesized
tacagtacatttctggattt

SEQ ID NO: 34159 - DNA, 20 bp, Artificial Sequence
  chemically synthesized
gtacatttctggatttggga

SEQ ID NO: 34160 - DNA, 20 bp, Artificial Sequence
  chemically synthesized
ttgggaatgagtgttcttca

SEQ ID NO: 34161 - DNA, 20 bp, Artificial Sequence
  chemically synthesized
aagaacactcattcccaaat

SEQ ID NO: 34162 - DNA, 20 bp, Artificial Sequence
  chemically synthesized
agcaggatttaaagagcatt

SEQ ID NO: 34163 - DNA, 20 bp, Artificial Sequence
  chemically synthesized
aaattggcagtttactaagg

SEQ ID NO: 34164 - DNA, 20 bp, Artificial Sequence
  chemically synthesized
ctttcaaactctgggaaaaa

SEQ ID NO: 34165 - DNA, 20 bp, Artificial Sequence
  chemically synthesized
tcttctttcaaaagcaaatg

SEQ ID NO: 34166 - DNA, 20 bp, Artificial Sequence
  chemically synthesized
ttctcagcatggaacatccc

SEQ ID NO: 34167 - DNA, 20 bp, Artificial Sequence
  chemically synthesized
gcatggaacatccctgagaa

SEQ ID NO: 34168 - DNA, 20 bp, Artificial Sequence
  chemically synthesized
ttggccgacgcttagggaaa

SEQ ID NO: 34169 - DNA, 20 bp, Artificial Sequence
  chemically synthesized
ccaacaacagtctgtatttg

SEQ ID NO: 34170 - DNA, 20 bp, Artificial Sequence
  chemically synthesized
cgggattgaatttgagctgc

SEQ ID NO: 34171 - DNA, 20 bp, Artificial Sequence
  chemically synthesized
actgtgctttaaaaaatagg

SEQ ID NO: 34172 - DNA, 20 bp, Artificial Sequence
  chemically synthesized
tttaaaaaataggaaagaaa

SEQ ID NO: 34173 - DNA, 20 bp, Artificial Sequence
  chemically synthesized
ttggtttttctaatcccctg

SEQ ID NO: 34174 - DNA, 20 bp, Artificial Sequence
  chemically synthesized
tccagacattgagctcaagg

SEQ ID NO: 34175 - DNA, 20 bp, Artificial Sequence
  chemically synthesized
tttctgaataatttgatccg

SEQ ID NO: 34176 - DNA, 20 bp, Artificial Sequence
  chemically synthesized
tatgatttcatttcttttcg

SEQ ID NO: 34177 - DNA, 20 bp, Artificial Sequence
  chemically synthesized
atatgcatactttctaaatg

SEQ ID NO: 34178 - DNA, 20 bp, Artificial Sequence
  chemically synthesized
gggagatttgacttataaga

SEQ ID NO: 34179 - DNA, 20 bp, Artificial Sequence
  chemically synthesized
ggtagcctctagaagaggaa

SEQ ID NO: 34180 - DNA, 20 bp, Artificial Sequence
  chemically synthesized
aatctctcatagagtctcca

SEQ ID NO: 34181 - DNA, 20 bp, Artificial Sequence
  chemically synthesized
agcaagaggaaatcagttac

SEQ ID NO: 34182 - DNA, 20 bp, Artificial Sequence
  chemically synthesized
gtcctgtctctggctaatca

SEQ ID NO: 34183 - DNA, 20 bp, Artificial Sequence
  chemically synthesized
tattaagcaagttcttcgtt

SEQ ID NO: 34184 - DNA, 20 bp, Artificial Sequence
  chemically synthesized
gttgacatattcattaaaat

SEQ ID NO: 34185 - DNA, 20 bp, Artificial Sequence
  chemically synthesized
taaaatgaagaaataaaaga

SEQ ID NO: 34186 - DNA, 20 bp, Artificial Sequence
  chemically synthesized
aattatataatgtttattga

SEQ ID NO: 34187 - DNA, 20 bp, Artificial Sequence
  chemically synthesized
aagattagacagcaggcagg

SEQ ID NO: 34188 - DNA, 20 bp, Artificial Sequence
  chemically synthesized
aacctctgctgaacttcctc

SEQ ID NO: 34189 - DNA, 20 bp, Artificial Sequence
  chemically synthesized
acttcctcatagaatgttca

SEQ ID NO: 34190 - DNA, 20 bp, Artificial Sequence
  chemically synthesized
cacaaaatatttgctgaatg

SEQ ID NO: 34191 - DNA, 20 bp, Artificial Sequence
  chemically synthesized
aggtgtttgattcttcaaac

SEQ ID NO: 34192 - DNA, 20 bp, Artificial Sequence
  chemically synthesized
gggttgggaaaaagacatag

SEQ ID NO: 34193 - DNA, 20 bp, Artificial Sequence
  chemically synthesized
actctgataccctgaagttc

SEQ ID NO: 34194 - DNA, 20 bp, Artificial Sequence
  chemically synthesized
tgcgtcactcaaactagctg

SEQ ID NO: 34195 - DNA, 20 bp, Artificial Sequence
  chemically synthesized
gtaggcttatttcaaaaggc

SEQ ID NO: 34196 - DNA, 20 bp, Artificial Sequence
  chemically synthesized
agcctgagtcaggactgagc

SEQ ID NO: 34197 - DNA, 20 bp, Artificial Sequence
  chemically synthesized
tatccaaagagtggtttgaa

SEQ ID NO: 34198 - DNA, 20 bp, Artificial Sequence
  chemically synthesized
agtcaccacacatagaggag

SEQ ID NO: 34199 - DNA, 20 bp, Artificial Sequence
  chemically synthesized
gaaaatggctgagttaaagg

SEQ ID NO: 34200 - DNA, 20 bp, Artificial Sequence
  chemically synthesized
caagggaaaggtgataaagg

SEQ ID NO: 34201 - DNA, 20 bp, Artificial Sequence
  chemically synthesized
gagagaggttcttgtttcaa

SEQ ID NO: 34202 - DNA, 20 bp, Artificial Sequence
  chemically synthesized
ggtatcttaaggcaaggaaa

SEQ ID NO: 34203 - DNA, 20 bp, Artificial Sequence
  chemically synthesized
ctctaactgatgctgagttt

SEQ ID NO: 34204 - DNA, 20 bp, Artificial Sequence
  chemically synthesized
ggggaggtgtttctgagttt

SEQ ID NO: 34205 - DNA, 20 bp, Artificial Sequence
  chemically synthesized
agtgcaaaggcacagcacat

SEQ ID NO: 34206 - DNA, 20 bp, Artificial Sequence
  chemically synthesized
atacagaatgcctgcatgct

SEQ ID NO: 34207 - DNA, 20 bp, Artificial Sequence
  chemically synthesized
tggtaggagttgaagtcttg

SEQ ID NO: 34208 - DNA, 20 bp, Artificial Sequence
  chemically synthesized
agtcttggaagaaagagtag

SEQ ID NO: 34209 - DNA, 20 bp, Artificial Sequence
  chemically synthesized
gcctgctgtctaatctttac

SEQ ID NO: 34210 - DNA, 20 bp, Artificial Sequence
  chemically synthesized
cagaggtcaggaatctgaac

SEQ ID NO: 34211 - DNA, 20 bp, Artificial Sequence
  chemically synthesized
acacaaaagtacaactgggg

SEQ ID NO: 34212 - DNA, 20 bp, Artificial Sequence
  chemically synthesized
atatgcaaaagtctgtttgg

SEQ ID NO: 34213 - DNA, 20 bp, Artificial Sequence
  chemically synthesized
tatgttcccatcaaggttaa

SEQ ID NO: 34214 - DNA, 20 bp, Artificial Sequence
  chemically synthesized
aaatattagactctttttcc

SEQ ID NO: 34215 - DNA, 20 bp, Artificial Sequence
  chemically synthesized
ttcatctcatcaggtgttac

SEQ ID NO: 34216 - DNA, 20 bp, Artificial Sequence
  chemically synthesized
gttacctagaatcagagtca

SEQ ID NO: 34217 - DNA, 20 bp, Artificial Sequence
  chemically synthesized
accatatcctggggaccagg

SEQ ID NO: 34218 - DNA, 20 bp, Artificial Sequence
  chemically synthesized
tcaggaatttattcttgcat

SEQ ID NO: 34219 - DNA, 20 bp, Artificial Sequence
  chemically synthesized
tatgcatataattctctcga

SEQ ID NO: 34220 - DNA, 20 bp, Artificial Sequence
  chemically synthesized
tttctgtcggatcaaattat

SEQ ID NO: 34221 - DNA, 20 bp, Artificial Sequence
  chemically synthesized
attattcagaaatccgaact

SEQ ID NO: 34222 - DNA, 20 bp, Artificial Sequence
  chemically synthesized
tgtccttgagctcaatgtct

SEQ ID NO: 34223 - DNA, 20 bp, Artificial Sequence
  chemically synthesized
gtactttttctctcagggga

SEQ ID NO: 34224 - DNA, 20 bp, Artificial Sequence
  chemically synthesized
caatgccctgcagctaagat

SEQ ID NO: 34225 - DNA, 20 bp, Artificial Sequence
  chemically synthesized
cttctaaggccaccagttac

SEQ ID NO: 34226 - DNA, 20 bp, Artificial Sequence
  chemically synthesized
agtaactccaccagtgcctg

SEQ ID NO: 34227 - DNA, 20 bp, Artificial Sequence
  chemically synthesized
ccttccttcctctcttgcag

SEQ ID NO: 34228 - DNA, 20 bp, Artificial Sequence
  chemically synthesized
ctggtctaaaattccatttc

SEQ ID NO: 34229 - DNA, 20 bp, Artificial Sequence
  chemically synthesized
gcatggggttcattttgaga

SEQ ID NO: 34230 - DNA, 20 bp, Artificial Sequence
  chemically synthesized
agtagaaaattggatgcagt

SEQ ID NO: 34231 - DNA, 20 bp, Artificial Sequence
  chemically synthesized
aaattggatgcagtggagaa

SEQ ID NO: 34232 - DNA, 20 bp, Artificial Sequence
  chemically synthesized
aatattgagtctgaaggcaa

SEQ ID NO: 34233 - DNA, 20 bp, Artificial Sequence
  chemically synthesized
tccctaagcgtcggccaact

SEQ ID NO: 34234 - DNA, 20 bp, Artificial Sequence
  chemically synthesized
aaagggacagagtacaaaag

SEQ ID NO: 34235 - DNA, 20 bp, Artificial Sequence
  chemically synthesized
atcaagtactttacaaggta

SEQ ID NO: 34236 - DNA, 20 bp, Artificial Sequence
  chemically synthesized
ttctcagggatgttccatgc

SEQ ID NO: 34237 - DNA, 20 bp, Artificial Sequence
  chemically synthesized
gggatgttccatgctgagaa

SEQ ID NO: 34238 - DNA, 20 bp, Artificial Sequence
  chemically synthesized
tcccatttgcttttgaaaga

SEQ ID NO: 34239 - DNA, 20 bp, Artificial Sequence
  chemically synthesized
gattgcagtaaagacaggca

SEQ ID NO: 34240 - DNA, 20 bp, Artificial Sequence
  chemically synthesized
gcagcacacatacacttaca

SEQ ID NO: 34241 - DNA, 20 bp, Artificial Sequence
  chemically synthesized
ctctccatgacttacctggt

SEQ ID NO: 34242 - DNA, 20 bp, Artificial Sequence
  chemically synthesized
attagaagtctttaaaattc

SEQ ID NO: 34243 - DNA, 20 bp, Artificial Sequence
  chemically synthesized
atacacaaacataggtccat

SEQ ID NO: 34244 - DNA, 20 bp, Artificial Sequence
  chemically synthesized
tgtgggtccaaccctgacag

SEQ ID NO: 34245 - DNA, 20 bp, Artificial Sequence
  chemically synthesized
tggtcagaccagttgatcct

SEQ ID NO: 34246 - DNA, 20 bp, Artificial Sequence
  chemically synthesized
cattggctaaagaggaaggt

SEQ ID NO: 34247 - DNA, 20 bp, Artificial Sequence
  chemically synthesized
agaatccatggaaaaggcag

SEQ ID NO: 34248 - DNA, 20 bp, Artificial Sequence
  chemically synthesized
tcctcatagaatgttcatca

SEQ ID NO: 34249 - DNA, 20 bp, Artificial Sequence
  chemically synthesized
tttagtcaggcataaagata

SEQ ID NO: 34250 - DNA, 20 bp, Artificial Sequence
  chemically synthesized
aacacttaggaacaaactgt

SEQ ID NO: 34251 - DNA, 20 bp, Artificial Sequence
  chemically synthesized
gactggtatcttaaggcaag

SEQ ID NO: 34252 - DNA, 20 bp, Artificial Sequence
  chemically synthesized
cagaatatgtccctaatatc

SEQ ID NO: 34253 - DNA, 20 bp, Artificial Sequence
  chemically synthesized
tcctaattggtaggaatcct

SEQ ID NO: 34254 - DNA, 20 bp, Artificial Sequence
  chemically synthesized
tgcctgcatgctctagaatc

SEQ ID NO: 34255 - DNA, 20 bp, Artificial Sequence
  chemically synthesized
aggtcaggaatctgaacaca

SEQ ID NO: 34256 - DNA, 20 bp, Artificial Sequence
  chemically synthesized
aataaacattatataatttt

SEQ ID NO: 34257 - DNA, 20 bp, Artificial Sequence
  chemically synthesized
aaccttggtttcctcatttc

SEQ ID NO: 34258 - DNA, 20 bp, Artificial Sequence
  chemically synthesized
ttaccacaaatttattggct

SEQ ID NO: 34259 - DNA, 20 bp, Artificial Sequence
  chemically synthesized
agtcaggagaaagcacctca

SEQ ID NO: 34260 - DNA, 20 bp, Artificial Sequence
  chemically synthesized
attcagaaatccgaactgta

SEQ ID NO: 34261 - DNA, 20 bp, Artificial Sequence
  chemically synthesized
tttttctctcaggggattag

SEQ ID NO: 34262 - DNA, 20 bp, Artificial Sequence
  chemically synthesized
cgtgatgccccacaagccac

SEQ ID NO: 34263 - DNA, 20 bp, Artificial Sequence
  chemically synthesized
agacacaaatgccaccatta

SEQ ID NO: 34264 - DNA, 20 bp, Artificial Sequence
  chemically synthesized
aaagagcatttcagaaaatt

SEQ ID NO: 34265 - DNA, 20 bp, Artificial Sequence
  chemically synthesized
gtaagaatttctatatggac

SEQ ID NO: 34266 - DNA, 20 bp, Artificial Sequence
  chemically synthesized
gaatcatttagggaagacaa

SEQ ID NO: 34267 - DNA, 20 bp, Artificial Sequence
  chemically synthesized
ctccacccttagctgtactt

SEQ ID NO: 34268 - DNA, 20 bp, Artificial Sequence
  chemically synthesized
tttgtgcgaatgcatgaaaa

SEQ ID NO: 34269 - DNA, 20 bp, Artificial Sequence
  chemically synthesized
caatgacacaatggaaccta

SEQ ID NO: 34270 - DNA, 20 bp, Artificial Sequence
  chemically synthesized
ccagaggaaaaaaaaagtta

SEQ ID NO: 34271 - DNA, 20 bp, Artificial Sequence
  chemically synthesized
ttgtgagttcttgtgcactg

SEQ ID NO: 34272 - DNA, 20 bp, Artificial Sequence
  chemically synthesized
gaaggtaatcagtggaaatt

SEQ ID NO: 34273 - DNA, 20 bp, Artificial Sequence
  chemically synthesized
gtaatcagtggaaatttgtc

SEQ ID NO: 34274 - DNA, 20 bp, Artificial Sequence
  chemically synthesized
tttgctctaacttaaatacc

SEQ ID NO: 34275 - DNA, 20 bp, Artificial Sequence
  chemically synthesized
ctgaagccatggcagaagtt

SEQ ID NO: 34276 - DNA, 20 bp, Artificial Sequence
  chemically synthesized
tggcagaagttcgtggattg

SEQ ID NO: 34277 - DNA, 20 bp, Artificial Sequence
  chemically synthesized
caatctctaaacataaattg

SEQ ID NO: 34278 - DNA, 20 bp, Artificial Sequence
  chemically synthesized
cacttccccagtcaatatcc

SEQ ID NO: 34279 - DNA, 20 bp, Artificial Sequence
  chemically synthesized
ctgcacaaattgtacagcat

SEQ ID NO: 34280 - DNA, 20 bp, Artificial Sequence
  chemically synthesized
gagaatacgagccaggaggt

SEQ ID NO: 34281 - DNA, 20 bp, Artificial Sequence
  chemically synthesized
cccagtctcccacagcgctc

SEQ ID NO: 34282 - DNA, 20 bp, Artificial Sequence
  chemically synthesized
aaaatccctaatacaaactt

SEQ ID NO: 34283 - DNA, 20 bp, Artificial Sequence
  chemically synthesized
aatacaaacttgctggtttt

SEQ ID NO: 34284 - DNA, 20 bp, Artificial Sequence
  chemically synthesized
tgtgatgcctcccccggatg

SEQ ID NO: 34285 - DNA, 20 bp, Artificial Sequence
  chemically synthesized
cctttatttctaaagttggc

SEQ ID NO: 34286 - DNA, 20 bp, Artificial Sequence
  chemically synthesized
acaaaaaatactaagttgta

SEQ ID NO: 34287 - DNA, 20 bp, Artificial Sequence
  chemically synthesized
atggcagagaccatccaaca

SEQ ID NO: 34288 - DNA, 20 bp, Artificial Sequence
  chemically synthesized
gaaccccatgctcaccatca

SEQ ID NO: 34289 - DNA, 20 bp, Artificial Sequence
  chemically synthesized
gccactgggcattacagtgc

SEQ ID NO: 34290 - DNA, 20 bp, Artificial Sequence
  chemically synthesized
ttcgctttgttcaactgccg

SEQ ID NO: 34291 - DNA, 20 bp, Artificial Sequence
  chemically synthesized
gaaggaaggctggagtacag

SEQ ID NO: 34292 - DNA, 20 bp, Artificial Sequence
  chemically synthesized
ttagaagagggttcagggtt

SEQ ID NO: 34293 - DNA, 20 bp, Artificial Sequence
  chemically synthesized
agtataaatggttctgaagc

SEQ ID NO: 34294 - DNA, 20 bp, Artificial Sequence
  chemically synthesized
tctgaagcacttgattcaga

SEQ ID NO: 34295 - DNA, 20 bp, Artificial Sequence
  chemically synthesized
agaaagtagaaagaacagct

SEQ ID NO: 34296 - DNA, 20 bp, Artificial Sequence
  chemically synthesized
ccaagaggtgtgagttctga

SEQ ID NO: 34297 - DNA, 20 bp, Artificial Sequence
  chemically synthesized
gctgagtcactatcaaatca

SEQ ID NO: 34298 - DNA, 20 bp, Artificial Sequence
  chemically synthesized
atcccctgagagaaaaagta

SEQ ID NO: 34299 - DNA, 20 bp, Artificial Sequence
  chemically synthesized
agaaaaagtacagagtttat

SEQ ID NO: 34300 - DNA, 20 bp, Artificial Sequence
  chemically synthesized
attaaggaagcagtattcac

SEQ ID NO: 34301 - DNA, 20 bp, Artificial Sequence
  chemically synthesized
gctcaaggacagaatctgaa

SEQ ID NO: 34302 - DNA, 20 bp, Artificial Sequence
  chemically synthesized
aaagtatactgtgtacaaaa

SEQ ID NO: 34303 - DNA, 20 bp, Artificial Sequence
  chemically synthesized
aaaaagctaacattaagcaa

SEQ ID NO: 34304 - DNA, 20 bp, Artificial Sequence
  chemically synthesized
aacattaagcaagtgtgttt

SEQ ID NO: 34305 - DNA, 20 bp, Artificial Sequence
  chemically synthesized
tgtttgtatgttttctacag

SEQ ID NO: 34306 - DNA, 20 bp, Artificial Sequence
  chemically synthesized
taatttgatccgacagaaaa

SEQ ID NO: 34307 - DNA, 20 bp, Artificial Sequence
  chemically synthesized
ttcagtaccatcagctcttt

SEQ ID NO: 34308 - DNA, 20 bp, Artificial Sequence
  chemically synthesized
tctttggcagcttatgagta

SEQ ID NO: 34309 - DNA, 20 bp, Artificial Sequence
  chemically synthesized
ttctcacctggtccccagga

SEQ ID NO: 34310 - DNA, 20 bp, Artificial Sequence
  chemically synthesized
ggatatggtttacttgtcag

SEQ ID NO: 34311 - DNA, 20 bp, Artificial Sequence
  chemically synthesized
cttgtcagagtagttttatg

SEQ ID NO: 34312 - DNA, 20 bp, Artificial Sequence
  chemically synthesized
tatgaggtgctttctcctga

SEQ ID NO: 34313 - DNA, 20 bp, Artificial Sequence
  chemically synthesized
accttgatgggaacatagaa

SEQ ID NO: 34314 - DNA, 20 bp, Artificial Sequence
  chemically synthesized
ggctcactctgaaagatatg

SEQ ID NO: 34315 - DNA, 20 bp, Artificial Sequence
  chemically synthesized
cattataagagggaggcaaa

SEQ ID NO: 34316 - DNA, 20 bp, Artificial Sequence
  chemically synthesized
ttataagaggagaaaatgtg

SEQ ID NO: 34317 - DNA, 20 bp, Artificial Sequence
  chemically synthesized
cctcgactttagcccagtga

SEQ ID NO: 34318 - DNA, 20 bp, Artificial Sequence
  chemically synthesized
acttcaagataatacatttg

SEQ ID NO: 34319 - DNA, 20 bp, Artificial Sequence
  chemically synthesized
ctaatcattagaatcactcc

SEQ ID NO: 34320 - DNA, 20 bp, Artificial Sequence
  chemically synthesized
cagacccagagccagtgaat

SEQ ID NO: 34321 - DNA, 20 bp, Artificial Sequence
  chemically synthesized
gcctgaatattaagcaagtt

SEQ ID NO: 34322 - DNA, 20 bp, Artificial Sequence
  chemically synthesized
ccagttgtacttttgtgtaa

SEQ ID NO: 34323 - DNA, 20 bp, Artificial Sequence
  chemically synthesized
tgtgtaaatgtgatttcatt

SEQ ID NO: 34324 - DNA, 20 bp, Artificial Sequence
  chemically synthesized
tgaagaaataaaagatgaga

SEQ ID NO: 34325 - DNA, 20 bp, Artificial Sequence
  chemically synthesized
aaacagttttaaaaattata

SEQ ID NO: 34326 - DNA, 20 bp, Artificial Sequence
  chemically synthesized
tttaaaaattatataatgtt

SEQ ID NO: 34327 - DNA, 20 bp, Artificial Sequence
  chemically synthesized
ttagaatgaatatgatgcaa

SEQ ID NO: 34328 - DNA, 20 bp, Artificial Sequence
  chemically synthesized
atgcaatctggttttctgtg

SEQ ID NO: 34329 - DNA, 20 bp, Artificial Sequence
  chemically synthesized
ctggagttaacctttctttg

SEQ ID NO: 34330 - DNA, 20 bp, Artificial Sequence
  chemically synthesized
tcctggtgctgtgcataata

SEQ ID NO: 34331 - DNA, 20 bp, Artificial Sequence
  chemically synthesized
tgcttaaacatgacagcagg

SEQ ID NO: 34332 - DNA, 20 bp, Artificial Sequence
  chemically synthesized
aatttatttataaatggtaa

SEQ ID NO: 34333 - DNA, 20 bp, Artificial Sequence
  chemically synthesized
atagaatgttcatcagaaaa

SEQ ID NO: 34334 - DNA, 20 bp, Artificial Sequence
  chemically synthesized
tccaaccaccgcctgggtat

SEQ ID NO: 34335 - DNA, 20 bp, Artificial Sequence
  chemically synthesized
atcaactcaaatttggctga

SEQ ID NO: 34336 - DNA, 20 bp, Artificial Sequence
  chemically synthesized
tcaaatttggctgacacagt

SEQ ID NO: 34337 - DNA, 20 bp, Artificial Sequence
  chemically synthesized
ttccaacttctctctgaaga

SEQ ID NO: 34338 - DNA, 20 bp, Artificial Sequence
  chemically synthesized
aagtcttttactccggtgtg

SEQ ID NO: 34339 - DNA, 20 bp, Artificial Sequence
  chemically synthesized
tactccggtgtggagtgttt

SEQ ID NO: 34340 - DNA, 20 bp, Artificial Sequence
  chemically synthesized
aggattcctaccaattagga

SEQ ID NO: 34341 - DNA, 20 bp, Artificial Sequence
  chemically synthesized
ttcctaccaattaggaaggt

SEQ ID NO: 34342 - DNA, 20 bp, Artificial Sequence
  chemically synthesized
agaaacacctccccttaact

SEQ ID NO: 34343 - DNA, 20 bp, Artificial Sequence
  chemically synthesized
ttacacatgcatgcgttgag

SEQ ID NO: 34344 - DNA, 20 bp, Artificial Sequence
  chemically synthesized
agcctggcctgggcactagg

SEQ ID NO: 34345 - DNA, 20 bp, Artificial Sequence
  chemically synthesized
ttttagatattagggacata

SEQ ID NO: 34346 - DNA, 20 bp, Artificial Sequence
  chemically synthesized
ggacttcgcattcaaacata

SEQ ID NO: 34347 - DNA, 20 bp, Artificial Sequence
  chemically synthesized
acaagaacctctctctatac

SEQ ID NO: 34348 - DNA, 20 bp, Artificial Sequence
  chemically synthesized
tctataccccagatttattt

SEQ ID NO: 34349 - DNA, 20 bp, Artificial Sequence
  chemically synthesized
tatgagttaattcatagcta

SEQ ID NO: 34350 - DNA, 20 bp, Artificial Sequence
  chemically synthesized
tgcgtattactaaaaagaag

SEQ ID NO: 34351 - DNA, 20 bp, Artificial Sequence
  chemically synthesized
aaggaatgatttcctagagg

SEQ ID NO: 34352 - DNA, 20 bp, Artificial Sequence
  chemically synthesized
aggtgcttcttctggccaag

SEQ ID NO: 34353 - DNA, 20 bp, Artificial Sequence
  chemically synthesized
aggggagctcttaggatgtc

SEQ ID NO: 34354 - DNA, 20 bp, Artificial Sequence
  chemically synthesized
aaaggcaagggatgaccaat

SEQ ID NO: 34355 - DNA, 20 bp, Artificial Sequence
  chemically synthesized
acagggaagcctctgaacac

SEQ ID NO: 34356 - DNA, 20 bp, Artificial Sequence
  chemically synthesized
aagccatagcaaacttgtca

SEQ ID NO: 34357 - DNA, 20 bp, Artificial Sequence
  chemically synthesized
gcccagaggatataaagcca

SEQ ID NO: 34358 - DNA, 20 bp, Artificial Sequence
  chemically synthesized
tctttggatattccggttcc

SEQ ID NO: 34359 - DNA, 20 bp, Artificial Sequence
  chemically synthesized
ttccggttcccactgcttca

SEQ ID NO: 34360 - DNA, 20 bp, Artificial Sequence
  chemically synthesized
atacacagggacaaagtcca

SEQ ID NO: 34361 - DNA, 20 bp, Artificial Sequence
  chemically synthesized
taaccggttacacaattgcc

SEQ ID NO: 34362 - DNA, 20 bp, Artificial Sequence
  chemically synthesized
acacaattgcctttggtttt

SEQ ID NO: 34363 - DNA, 20 bp, Artificial Sequence
  chemically synthesized
ggtttttacagtttgttcct

SEQ ID NO: 34364 - DNA, 20 bp, Artificial Sequence
  chemically synthesized
gtttgttcctaagtgtttcc

SEQ ID NO: 34365 - DNA, 20 bp, Artificial Sequence
  chemically synthesized
tggttcctcttcacctgagg

SEQ ID NO: 34366 - DNA, 20 bp, Artificial Sequence
  chemically synthesized
attatttattccagttaaaa

SEQ ID NO: 34367 - DNA, 20 bp, Artificial Sequence
  chemically synthesized
tagtgcctgctgtgtgtggt

SEQ ID NO: 34368 - DNA, 20 bp, Artificial Sequence
  chemically synthesized
ctgccacagttcctttcccc

SEQ ID NO: 34369 - DNA, 20 bp, Artificial Sequence
  chemically synthesized
gcaattgtgtaaccggttaa

SEQ ID NO: 34370 - DNA, 20 bp, Artificial Sequence
  chemically synthesized
tgagttagacaattctttca

SEQ ID NO: 34371 - DNA, 20 bp, Artificial Sequence
  chemically synthesized
gggaaccggaatatccaaag

SEQ ID NO: 34372 - DNA, 20 bp, Artificial Sequence
  chemically synthesized
tttgaaggagaaagaagcat

SEQ ID NO: 34373 - DNA, 20 bp, Artificial Sequence
  chemically synthesized
tggctttatatcctctgggc

SEQ ID NO: 34374 - DNA, 20 bp, Artificial Sequence
  chemically synthesized
taaaggtaagaaaccatctg

SEQ ID NO: 34375 - DNA, 20 bp, Artificial Sequence
  chemically synthesized
aaaccatctgacaagtttgc

SEQ ID NO: 34376 - DNA, 20 bp, Artificial Sequence
  chemically synthesized
cttcttcagccaaaatttat

SEQ ID NO: 34377 - DNA, 20 bp, Artificial Sequence
  chemically synthesized
tggttcaaacccctgtgttc

SEQ ID NO: 34378 - DNA, 20 bp, Artificial Sequence
  chemically synthesized
ctcccctccactacggacat

SEQ ID NO: 34379 - DNA, 20 bp, Artificial Sequence
  chemically synthesized
cacttccggtgaccagttag

SEQ ID NO: 34380 - DNA, 20 bp, Artificial Sequence
  chemically synthesized
tctggggtatagagagaggt

SEQ ID NO: 34381 - DNA, 20 bp, Artificial Sequence
  chemically synthesized
tcttgtttcaattagaaaag

SEQ ID NO: 34382 - DNA, 20 bp, Artificial Sequence
  chemically synthesized
aaaagtaatgcttggagaga

SEQ ID NO: 34383 - DNA, 20 bp, Artificial Sequence
  chemically synthesized
aaggtcactgccaatagatg

SEQ ID NO: 34384 - DNA, 20 bp, Artificial Sequence
  chemically synthesized
atgacttgattagaagcagg

SEQ ID NO: 34385 - DNA, 20 bp, Artificial Sequence
  chemically synthesized
aaccatgcctagtgcccagg

SEQ ID NO: 34386 - DNA, 20 bp, Artificial Sequence
  chemically synthesized
acagacatcttccctgaatg

SEQ ID NO: 34387 - DNA, 20 bp, Artificial Sequence
  chemically synthesized
ctaatgccctctaactgatg

SEQ ID NO: 34388 - DNA, 20 bp, Artificial Sequence
  chemically synthesized
agaatccatcagttaagggg

SEQ ID NO: 34389 - DNA, 20 bp, Artificial Sequence
  chemically synthesized
tcagttaaggggaggtgttt

SEQ ID NO: 34390 - DNA, 20 bp, Artificial Sequence
  chemically synthesized
tccacaccggagtaaaagac

SEQ ID NO: 34391 - DNA, 20 bp, Artificial Sequence
  chemically synthesized
tttgtgctagtgcatgacac

SEQ ID NO: 34392 - DNA, 20 bp, Artificial Sequence
  chemically synthesized
actgagatacccaggcggtg

SEQ ID NO: 34393 - DNA, 20 bp, Artificial Sequence
  chemically synthesized
gcggtggttggatttatgga

SEQ ID NO: 34394 - DNA, 20 bp, Artificial Sequence
  chemically synthesized
gaagaaagagtagatagaaa

SEQ ID NO: 34395 - DNA, 20 bp, Artificial Sequence
  chemically synthesized
tgtaaaatcctatcctgctg

SEQ ID NO: 34396 - DNA, 20 bp, Artificial Sequence
  chemically synthesized
attgcatgccagtctttgct

SEQ ID NO: 34397 - DNA, 20 bp, Artificial Sequence
  chemically synthesized
caggaatctgaacacagaaa

SEQ ID NO: 34398 - DNA, 20 bp, Artificial Sequence
  chemically synthesized
aaacattatataatttttaa

SEQ ID NO: 34399 - DNA, 20 bp, Artificial Sequence
  chemically synthesized
ataccctatgtatttgagta

SEQ ID NO: 34400 - DNA, 20 bp, Artificial Sequence
  chemically synthesized
ctatgtatttgagtaagttg

SEQ ID NO: 34401 - DNA, 20 bp, Artificial Sequence
  chemically synthesized
gttgcttagcttctcccaac

SEQ ID NO: 34402 - DNA, 20 bp, Artificial Sequence
  chemically synthesized
cctcatttctaaaacgaaga

SEQ ID NO: 34403 - DNA, 20 bp, Artificial Sequence
  chemically synthesized
tctgggccccaccaccaaat

SEQ ID NO: 34404 - DNA, 20 bp, Artificial Sequence
  chemically synthesized
tggctctgggtctgtatgta

SEQ ID NO: 34405 - DNA, 20 bp, Artificial Sequence
  chemically synthesized
ctgtatgtaacaagcttctg

SEQ ID NO: 34406 - DNA, 20 bp, Artificial Sequence
  chemically synthesized
acaagcttctggagtgattc

SEQ ID NO: 34407 - DNA, 20 bp, Artificial Sequence
  chemically synthesized
caggacctactattctacgt

SEQ ID NO: 34408 - DNA, 20 bp, Artificial Sequence
  chemically synthesized
taaaaaattaccacaaattt

SEQ ID NO: 34409 - DNA, 20 bp, Artificial Sequence
  chemically synthesized
gtggaggtcagaagtctgaa

SEQ ID NO: 34410 - DNA, 20 bp, Artificial Sequence
  chemically synthesized
taaagtcgaggtgtcagtgt

SEQ ID NO: 34411 - DNA, 20 bp, Artificial Sequence
  chemically synthesized
gtttcttctggagactctat

SEQ ID NO: 34412 - DNA, 20 bp, Artificial Sequence
  chemically synthesized
tctggagactctatgagaga

SEQ ID NO: 34413 - DNA, 20 bp, Artificial Sequence
  chemically synthesized
ttgtgttttcctgccttttc

SEQ ID NO: 34414 - DNA, 20 bp, Artificial Sequence
  chemically synthesized
tttcctgccttttccatgga

SEQ ID NO: 34415 - DNA, 20 bp, Artificial Sequence
  chemically synthesized
tctagaggctacccacattc

SEQ ID NO: 34416 - DNA, 20 bp, Artificial Sequence
  chemically synthesized
cgatcttcaaaaaaatgtat

SEQ ID NO: 34417 - DNA, 20 bp, Artificial Sequence
  chemically synthesized
cctccctcttataatgacac

SEQ ID NO: 34418 - DNA, 20 bp, Artificial Sequence
  chemically synthesized
ccttaattatatatgcaaaa

SEQ ID NO: 34419 - DNA, 20 bp, Artificial Sequence
  chemically synthesized
ggctagaaaagataatactc

SEQ ID NO: 34420 - DNA, 20 bp, Artificial Sequence
  chemically synthesized
acagaaaaaaaaaatgtagc

SEQ ID NO: 34421 - DNA, 20 bp, Artificial Sequence
  chemically synthesized
tgtagaaaacatacaaacac

SEQ ID NO: 34422 - DNA, 20 bp, Artificial Sequence
  chemically synthesized
tacaaacacacttgcttaat

SEQ ID NO: 34423 - DNA, 20 bp, Artificial Sequence
  chemically synthesized
gcactgaaccagctggaaat

SEQ ID NO: 34424 - DNA, 20 bp, Artificial Sequence
  chemically synthesized
gaaccagctggaaatgaatg

SEQ ID NO: 34425 - DNA, 20 bp, Artificial Sequence
  chemically synthesized
cgcagctgataaaagcagag

SEQ ID NO: 34426 - DNA, 20 bp, Artificial Sequence
  chemically synthesized
ctggagaaagcagctgtgaa

SEQ ID NO: 34427 - DNA, 20 bp, Artificial Sequence
  chemically synthesized
aactctgtactttttctctc

SEQ ID NO: 34428 - DNA, 20 bp, Artificial Sequence
  chemically synthesized
ctcaggggattagaaaaacc

SEQ ID NO: 34429 - DNA, 20 bp, Artificial Sequence
  chemically synthesized
aattgatttgatagtgactc

SEQ ID NO: 34430 - DNA, 20 bp, Artificial Sequence
  chemically synthesized
ctttagccaatgccctgcag

SEQ ID NO: 34431 - DNA, 20 bp, Artificial Sequence
  chemically synthesized
ccctgcagctaagattgaga

SEQ ID NO: 34432 - DNA, 20 bp, Artificial Sequence
  chemically synthesized
gattcagaactcacacctct

SEQ ID NO: 34433 - DNA, 20 bp, Artificial Sequence
  chemically synthesized
tttaaagcacagtctgaatc

SEQ ID NO: 34434 - DNA, 20 bp, Artificial Sequence
  chemically synthesized
gcgaaggcactgtaatgccc

SEQ ID NO: 34435 - DNA, 20 bp, Artificial Sequence
  chemically synthesized
atatcatcctaactgcatgc

SEQ ID NO: 34436 - DNA, 20 bp, Artificial Sequence
  chemically synthesized
aaagaataatttttcacttc

SEQ ID NO: 34437 - DNA, 20 bp, Artificial Sequence
  chemically synthesized
cctgatcatcactcacacat

SEQ ID NO: 34438 - DNA, 20 bp, Artificial Sequence
  chemically synthesized
cccacaagccacaaaaacca

SEQ ID NO: 34439 - DNA, 20 bp, Artificial Sequence
  chemically synthesized
aaaaaccagcaagtttgtat

SEQ ID NO: 34440 - DNA, 20 bp, Artificial Sequence
  chemically synthesized
ggcgaaattaaaattgctaa

SEQ ID NO: 34441 - DNA, 20 bp, Artificial Sequence
  chemically synthesized
gataacatcttatcaggaga

SEQ ID NO: 34442 - DNA, 20 bp, Artificial Sequence
  chemically synthesized
gacaggcgcacctggagggg

SEQ ID NO: 34443 - DNA, 20 bp, Artificial Sequence
  chemically synthesized
aattcagcgatatttctccc

SEQ ID NO: 34444 - DNA, 20 bp, Artificial Sequence
  chemically synthesized
ctgcctggctcaccagcagt

SEQ ID NO: 34445 - DNA, 20 bp, Artificial Sequence
  chemically synthesized
atatacatcctcctcagctg

SEQ ID NO: 34446 - DNA, 20 bp, Artificial Sequence
  chemically synthesized
cctcctcagctgacaggatt

SEQ ID NO: 34447 - DNA, 20 bp, Artificial Sequence
  chemically synthesized
gtccatgaaatctttacaat

SEQ ID NO: 34448 - DNA, 20 bp, Artificial Sequence
  chemically synthesized
aaatctttacaatttatgtt

SEQ ID NO: 34449 - DNA, 20 bp, Artificial Sequence
  chemically synthesized
cacaatccacgaacttctgc

SEQ ID NO: 34450 - DNA, 20 bp, Artificial Sequence
  chemically synthesized
gccatggcttcagctgatcc

SEQ ID NO: 34451 - DNA, 20 bp, Artificial Sequence
  chemically synthesized
gctgtgttcagatggttaca

SEQ ID NO: 34452 - DNA, 20 bp, Artificial Sequence
  chemically synthesized
acacatacacttacattaga

SEQ ID NO: 34453 - DNA, 20 bp, Artificial Sequence
  chemically synthesized
tcaatcaatcgacaaatttc

SEQ ID NO: 34454 - DNA, 20 bp, Artificial Sequence
  chemically synthesized
tgccatagtctcagccttca

SEQ ID NO: 34455 - DNA, 20 bp, Artificial Sequence
  chemically synthesized
gtgtgttgagtgttgcaaga

SEQ ID NO: 34456 - DNA, 20 bp, Artificial Sequence
  chemically synthesized
ccatagatgaggcagatagc

SEQ ID NO: 34457 - DNA, 20 bp, Artificial Sequence
  chemically synthesized
aggcttctgcctacagcaag

SEQ ID NO: 34458 - DNA, 20 bp, Artificial Sequence
  chemically synthesized
tacagcaaggctagtttgga

SEQ ID NO: 34459 - DNA, 20 bp, Artificial Sequence
  chemically synthesized
ggacccacacacctcttcat

SEQ ID NO: 34460 - DNA, 20 bp, Artificial Sequence
  chemically synthesized
atgctttttcttttttttcc

SEQ ID NO: 34461 - DNA, 20 bp, Artificial Sequence
  chemically synthesized
ctatgcaatatccagcactc

SEQ ID NO: 34462 - DNA, 20 bp, Artificial Sequence
  chemically synthesized
gaaaccatattgtcttccct

SEQ ID NO: 34463 - DNA, 20 bp, Artificial Sequence
  chemically synthesized
tttgtcacctacagtacatt

SEQ ID NO: 34464 - DNA, 22 bp, Artificial Sequence
  chemically synthesized
tccttctggcagggaacctggg

SEQ ID NO: 34465 - DNA, 22 bp, Artificial Sequence
  chemically synthesized
ctggcagggaacctgggcagcg

SEQ ID NO: 34466 - DNA, 22 bp, Artificial Sequence
  chemically synthesized
tggcagggaacctgggcagcga

SEQ ID NO: 34467 - DNA, 22 bp, Artificial Sequence
  chemically synthesized
gcagggaacctgggcagcgagg

SEQ ID NO: 34468 - DNA, 22 bp, Artificial Sequence
  chemically synthesized
ggcagcgaggatcctctgaaga

SEQ ID NO: 34469 - DNA, 22 bp, Artificial Sequence
  chemically synthesized
tgaagaacactcattcccaaat

SEQ ID NO: 34470 - DNA, 22 bp, Artificial Sequence
  chemically synthesized
aagaacactcattcccaaatcc

SEQ ID NO: 34471 - DNA, 22 bp, Artificial Sequence
  chemically synthesized
attcccaaatccagaaatgtac

SEQ ID NO: 34472 - DNA, 22 bp, Artificial Sequence
  chemically synthesized
ccaaatccagaaatgtactgta

SEQ ID NO: 34473 - DNA, 22 bp, Artificial Sequence
  chemically synthesized
taggtgacaaagacacaaatgc

SEQ ID NO: 34474 - DNA, 22 bp, Artificial Sequence
  chemically synthesized
gcaggatttaaagagcatttca

SEQ ID NO: 34475 - DNA, 22 bp, Artificial Sequence
  chemically synthesized
aaagagcatttcagaaaattgg

SEQ ID NO: 34476 - DNA, 22 bp, Artificial Sequence
  chemically synthesized
aagagcatttcagaaaattggc

SEQ ID NO: 34477 - DNA, 22 bp, Artificial Sequence
  chemically synthesized
cagaaaattggcagtttactaa

SEQ ID NO: 34478 - DNA, 22 bp, Artificial Sequence
  chemically synthesized
agaaaattggcagtttactaag

SEQ ID NO: 34479 - DNA, 22 bp, Artificial Sequence
  chemically synthesized
gcagtttactaaggtaagaatt

SEQ ID NO: 34480 - DNA, 22 bp, Artificial Sequence
  chemically synthesized
actaaggtaagaatttctatat

SEQ ID NO: 34481 - DNA, 22 bp, Artificial Sequence
  chemically synthesized
ctaaggtaagaatttctatatg

SEQ ID NO: 34482 - DNA, 22 bp, Artificial Sequence
  chemically synthesized
aggtaagaatttctatatggac

SEQ ID NO: 34483 - DNA, 22 bp, Artificial Sequence
  chemically synthesized
ctatatggacctatgtttgtgt

SEQ ID NO: 34484 - DNA, 22 bp, Artificial Sequence
  chemically synthesized
tatatggacctatgtttgtgta

SEQ ID NO: 34485 - DNA, 22 bp, Artificial Sequence
  chemically synthesized
tatggacctatgtttgtgtatg

SEQ ID NO: 34486 - DNA, 22 bp, Artificial Sequence
  chemically synthesized
tgtttgtgtatgatgttccaca

SEQ ID NO: 34487 - DNA, 22 bp, Artificial Sequence
  chemically synthesized
gtgtatgatgttccacatataa

SEQ ID NO: 34488 - DNA, 22 bp, Artificial Sequence
  chemically synthesized
tgtatgatgttccacatataat

SEQ ID NO: 34489 - DNA, 22 bp, Artificial Sequence
  chemically synthesized
cacatataatatctttactgtg

SEQ ID NO: 34490 - DNA, 22 bp, Artificial Sequence
  chemically synthesized
tactgtgtcttgacatatgaat

SEQ ID NO: 34491 - DNA, 22 bp, Artificial Sequence
  chemically synthesized
actgtgtcttgacatatgaatc

SEQ ID NO: 34492 - DNA, 22 bp, Artificial Sequence
  chemically synthesized
ctgtgtcttgacatatgaatca

SEQ ID NO: 34493 - DNA, 22 bp, Artificial Sequence
  chemically synthesized
tgtcttgacatatgaatcattt

SEQ ID NO: 34494 - DNA, 22 bp, Artificial Sequence
  chemically synthesized
gacatatgaatcatttagggaa

SEQ ID NO: 34495 - DNA, 22 bp, Artificial Sequence
  chemically synthesized
acatatgaatcatttagggaag

SEQ ID NO: 34496 - DNA, 22 bp, Artificial Sequence
  chemically synthesized
agggaagacaatatggtttctg

SEQ ID NO: 34497 - DNA, 22 bp, Artificial Sequence
  chemically synthesized
gggaagacaatatggtttctgt

SEQ ID NO: 34498 - DNA, 22 bp, Artificial Sequence
  chemically synthesized
ctgtgaattttaaagacttcta

SEQ ID NO: 34499 - DNA, 22 bp, Artificial Sequence
  chemically synthesized
tgtgaattttaaagacttctaa

SEQ ID NO: 34500 - DNA, 22 bp, Artificial Sequence
  chemically synthesized
tgaattttaaagacttctaatt

SEQ ID NO: 34501 - DNA, 22 bp, Artificial Sequence
  chemically synthesized
taaagacttctaattaatcaga

SEQ ID NO: 34502 - DNA, 22 bp, Artificial Sequence
  chemically synthesized
aaagacttctaattaatcagaa

SEQ ID NO: 34503 - DNA, 22 bp, Artificial Sequence
  chemically synthesized
aagacttctaattaatcagaag

SEQ ID NO: 34504 - DNA, 22 bp, Artificial Sequence
  chemically synthesized
ctaattaatcagaagagtgctg

SEQ ID NO: 34505 - DNA, 22 bp, Artificial Sequence
  chemically synthesized
taattaatcagaagagtgctgg

SEQ ID NO: 34506 - DNA, 22 bp, Artificial Sequence
  chemically synthesized
attaatcagaagagtgctggat

SEQ ID NO: 34507 - DNA, 22 bp, Artificial Sequence
  chemically synthesized
atcagaagagtgctggatattg

SEQ ID NO: 34508 - DNA, 22 bp, Artificial Sequence
  chemically synthesized
gatattgcatagacttctccac

SEQ ID NO: 34509 - DNA, 22 bp, Artificial Sequence
  chemically synthesized
catagacttctccacccttagc

SEQ ID NO: 34510 - DNA, 22 bp, Artificial Sequence
  chemically synthesized
ctccacccttagctgtacttag

SEQ ID NO: 34511 - DNA, 22 bp, Artificial Sequence
  chemically synthesized
tccacccttagctgtacttagc

SEQ ID NO: 34512 - DNA, 22 bp, Artificial Sequence
  chemically synthesized
cacccttagctgtacttagctg

SEQ ID NO: 34513 - DNA, 22 bp, Artificial Sequence
  chemically synthesized
agctgtacttagctgatttgtg

SEQ ID NO: 34514 - DNA, 22 bp, Artificial Sequence
  chemically synthesized
gctgtacttagctgatttgtgg

SEQ ID NO: 34515 - DNA, 22 bp, Artificial Sequence
  chemically synthesized
tacttagctgatttgtgggtct

SEQ ID NO: 34516 - DNA, 22 bp, Artificial Sequence
  chemically synthesized
agctgatttgtgggtctacact

SEQ ID NO: 34517 - DNA, 22 bp, Artificial Sequence
  chemically synthesized
gctgatttgtgggtctacactg

SEQ ID NO: 34518 - DNA, 22 bp, Artificial Sequence
  chemically synthesized
atttgtgggtctacactgtaac

SEQ ID NO: 34519 - DNA, 22 bp, Artificial Sequence
  chemically synthesized
gtgggtctacactgtaacctcc

SEQ ID NO: 34520 - DNA, 22 bp, Artificial Sequence
  chemically synthesized
tgggtctacactgtaacctccc

SEQ ID NO: 34521 - DNA, 22 bp, Artificial Sequence
  chemically synthesized
cactgtaacctccctgaacttg

SEQ ID NO: 34522 - DNA, 22 bp, Artificial Sequence
  chemically synthesized
taacctccctgaacttgagact

SEQ ID NO: 34523 - DNA, 22 bp, Artificial Sequence
  chemically synthesized
cctgaacttgagactccatttc

SEQ ID NO: 34524 - DNA, 22 bp, Artificial Sequence
  chemically synthesized
aacttgagactccatttccctt

SEQ ID NO: 34525 - DNA, 22 bp, Artificial Sequence
  chemically synthesized
gagactccatttccctttcaaa

SEQ ID NO: 34526 - DNA, 22 bp, Artificial Sequence
  chemically synthesized
agactccatttccctttcaaac

SEQ ID NO: 34527 - DNA, 22 bp, Artificial Sequence
  chemically synthesized
catttccctttcaaactctggg

SEQ ID NO: 34528 - DNA, 22 bp, Artificial Sequence
  chemically synthesized
ccctttcaaactctgggaaaaa

SEQ ID NO: 34529 - DNA, 22 bp, Artificial Sequence
  chemically synthesized
cctttcaaactctgggaaaaaa

SEQ ID NO: 34530 - DNA, 22 bp, Artificial Sequence
  chemically synthesized
tcaaactctgggaaaaaaaaga

SEQ ID NO: 34531 - DNA, 22 bp, Artificial Sequence
  chemically synthesized
caaactctgggaaaaaaaagaa

SEQ ID NO: 34532 - DNA, 22 bp, Artificial Sequence
  chemically synthesized
aaactctgggaaaaaaaagaaa

SEQ ID NO: 34533 - DNA, 22 bp, Artificial Sequence
  chemically synthesized
tgggaaaaaaaagaaaaagcat

SEQ ID NO: 34534 - DNA, 22 bp, Artificial Sequence
  chemically synthesized
ggaaaaaaaagaaaaagcatct

SEQ ID NO: 34535 - DNA, 22 bp, Artificial Sequence
  chemically synthesized
tgaagaggtgtgtgggtccaac

SEQ ID NO: 34536 - DNA, 22 bp, Artificial Sequence
  chemically synthesized
acagcaaaaccctctccaaact

SEQ ID NO: 34537 - DNA, 22 bp, Artificial Sequence
  chemically synthesized
tccaaactagccttgctgtagg

SEQ ID NO: 34538 - DNA, 22 bp, Artificial Sequence
  chemically synthesized
caaactagccttgctgtaggca

SEQ ID NO: 34539 - DNA, 22 bp, Artificial Sequence
  chemically synthesized
gccttgctgtaggcagaagcct

SEQ ID NO: 34540 - DNA, 22 bp, Artificial Sequence
  chemically synthesized
gctgtaggcagaagcctctgct

SEQ ID NO: 34541 - DNA, 22 bp, Artificial Sequence
  chemically synthesized
ctgtaggcagaagcctctgcta

SEQ ID NO: 34542 - DNA, 22 bp, Artificial Sequence
  chemically synthesized
taggcagaagcctctgctatct

SEQ ID NO: 34543 - DNA, 22 bp, Artificial Sequence
  chemically synthesized
tgctatctgcctcatctatgga

SEQ ID NO: 34544 - DNA, 22 bp, Artificial Sequence
  chemically synthesized
ctatctgcctcatctatggaac

SEQ ID NO: 34545 - DNA, 22 bp, Artificial Sequence
  chemically synthesized
tctgcctcatctatggaacaca

SEQ ID NO: 34546 - DNA, 22 bp, Artificial Sequence
  chemically synthesized
cctcatctatggaacacatcta

SEQ ID NO: 34547 - DNA, 22 bp, Artificial Sequence
  chemically synthesized
atctatggaacacatctatatt

SEQ ID NO: 34548 - DNA, 22 bp, Artificial Sequence
  chemically synthesized
tggaacacatctatatttgtgc

SEQ ID NO: 34549 - DNA, 22 bp, Artificial Sequence
  chemically synthesized
tatttgtgcgaatgcatgaaaa

SEQ ID NO: 34550 - DNA, 22 bp, Artificial Sequence
  chemically synthesized
gtgcgaatgcatgaaaataaag

SEQ ID NO: 34551 - DNA, 22 bp, Artificial Sequence
  chemically synthesized
tgcgaatgcatgaaaataaagt

SEQ ID NO: 34552 - DNA, 22 bp, Artificial Sequence
  chemically synthesized
aaagatatgggtggccttcagg

SEQ ID NO: 34553 - DNA, 22 bp, Artificial Sequence
  chemically synthesized
aagatatgggtggccttcagga

SEQ ID NO: 34554 - DNA, 22 bp, Artificial Sequence
  chemically synthesized
caggagacacgccagcccagca

SEQ ID NO: 34555 - DNA, 22 bp, Artificial Sequence
  chemically synthesized
aggagacacgccagcccagcat

SEQ ID NO: 34556 - DNA, 22 bp, Artificial Sequence
  chemically synthesized
ttcacaatgacacaatggaacc

SEQ ID NO: 34557 - DNA, 22 bp, Artificial Sequence
  chemically synthesized
tcacaatgacacaatggaacct

SEQ ID NO: 34558 - DNA, 22 bp, Artificial Sequence
  chemically synthesized
cacaatgacacaatggaaccta

SEQ ID NO: 34559 - DNA, 22 bp, Artificial Sequence
  chemically synthesized
acaatgacacaatggaacctac

SEQ ID NO: 34560 - DNA, 22 bp, Artificial Sequence
  chemically synthesized
ctctgattgccatctcttcact

SEQ ID NO: 34561 - DNA, 22 bp, Artificial Sequence
  chemically synthesized
tgattgccatctcttcacttta

SEQ ID NO: 34562 - DNA, 22 bp, Artificial Sequence
  chemically synthesized
attgccatctcttcactttaca

SEQ ID NO: 34563 - DNA, 22 bp, Artificial Sequence
  chemically synthesized
ccatctcttcactttacaccca

SEQ ID NO: 34564 - DNA, 22 bp, Artificial Sequence
  chemically synthesized
ttcactttacacccagaggaaa

SEQ ID NO: 34565 - DNA, 22 bp, Artificial Sequence
  chemically synthesized
cactttacacccagaggaaaaa

SEQ ID NO: 34566 - DNA, 22 bp, Artificial Sequence
  chemically synthesized
actttacacccagaggaaaaaa

SEQ ID NO: 34567 - DNA, 22 bp, Artificial Sequence
  chemically synthesized
tacacccagaggaaaaaaaaag

SEQ ID NO: 34568 - DNA, 22 bp, Artificial Sequence
  chemically synthesized
acacccagaggaaaaaaaaagt

SEQ ID NO: 34569 - DNA, 22 bp, Artificial Sequence
  chemically synthesized
cacccagaggaaaaaaaaagtt

SEQ ID NO: 34570 - DNA, 22 bp, Artificial Sequence
  chemically synthesized
aagggtttctcaaccaggtaag

SEQ ID NO: 34571 - DNA, 22 bp, Artificial Sequence
  chemically synthesized
ctcaaccaggtaagtcatggag

SEQ ID NO: 34572 - DNA, 22 bp, Artificial Sequence
  chemically synthesized
tcaaccaggtaagtcatggaga

SEQ ID NO: 34573 - DNA, 22 bp, Artificial Sequence
  chemically synthesized
aaccaggtaagtcatggagagc

SEQ ID NO: 34574 - DNA, 22 bp, Artificial Sequence
  chemically synthesized
aaacttactcttgcaacactca

SEQ ID NO: 34575 - DNA, 22 bp, Artificial Sequence
  chemically synthesized
actcttgcaacactcaacacac

SEQ ID NO: 34576 - DNA, 22 bp, Artificial Sequence
  chemically synthesized
ctcttgcaacactcaacacact

SEQ ID NO: 34577 - DNA, 22 bp, Artificial Sequence
  chemically synthesized
ttgcaacactcaacacacttgt

SEQ ID NO: 34578 - DNA, 22 bp, Artificial Sequence
  chemically synthesized
gcaacactcaacacacttgtga

SEQ ID NO: 34579 - DNA, 22 bp, Artificial Sequence
  chemically synthesized
caacactcaacacacttgtgag

SEQ ID NO: 34580 - DNA, 22 bp, Artificial Sequence
  chemically synthesized
aacacacttgtgagttcttgtg

SEQ ID NO: 34581 - DNA, 22 bp, Artificial Sequence
  chemically synthesized
gtgagttcttgtgcactgtctg

SEQ ID NO: 34582 - DNA, 22 bp, Artificial Sequence
  chemically synthesized
tgagttcttgtgcactgtctgg

SEQ ID NO: 34583 - DNA, 22 bp, Artificial Sequence
  chemically synthesized
ttgtgcactgtctggctttttt

SEQ ID NO: 34584 - DNA, 22 bp, Artificial Sequence
  chemically synthesized
gtgcactgtctggcttttttgc

SEQ ID NO: 34585 - DNA, 22 bp, Artificial Sequence
  chemically synthesized
tgcactgtctggcttttttgct

SEQ ID NO: 34586 - DNA, 22 bp, Artificial Sequence
  chemically synthesized
tctggcttttttgctagcctat

SEQ ID NO: 34587 - DNA, 22 bp, Artificial Sequence
  chemically synthesized
gcttttttgctagcctataagc

SEQ ID NO: 34588 - DNA, 22 bp, Artificial Sequence
  chemically synthesized
ttttgctagcctataagctgca

SEQ ID NO: 34589 - DNA, 22 bp, Artificial Sequence
  chemically synthesized
tttgctagcctataagctgcat

SEQ ID NO: 34590 - DNA, 22 bp, Artificial Sequence
  chemically synthesized
ttgctagcctataagctgcatg

SEQ ID NO: 34591 - DNA, 22 bp, Artificial Sequence
  chemically synthesized
tgctagcctataagctgcatga

SEQ ID NO: 34592 - DNA, 22 bp, Artificial Sequence
  chemically synthesized
gctagcctataagctgcatgaa

SEQ ID NO: 34593 - DNA, 22 bp, Artificial Sequence
  chemically synthesized
ctagcctataagctgcatgaag

SEQ ID NO: 34594 - DNA, 22 bp, Artificial Sequence
  chemically synthesized
gcctataagctgcatgaaggct

SEQ ID NO: 34595 - DNA, 22 bp, Artificial Sequence
  chemically synthesized
taagctgcatgaaggctgagac

SEQ ID NO: 34596 - DNA, 22 bp, Artificial Sequence
  chemically synthesized
catgaaggctgagactatggca

SEQ ID NO: 34597 - DNA, 22 bp, Artificial Sequence
  chemically synthesized
agactatggcagtcttggctca

SEQ ID NO: 34598 - DNA, 22 bp, Artificial Sequence
  chemically synthesized
tggcagtcttggctcatagaag

SEQ ID NO: 34599 - DNA, 22 bp, Artificial Sequence
  chemically synthesized
ggctcatagaaggtaatcagtg

SEQ ID NO: 34600 - DNA, 22 bp, Artificial Sequence
  chemically synthesized
gctcatagaaggtaatcagtgg

SEQ ID NO: 34601 - DNA, 22 bp, Artificial Sequence
  chemically synthesized
atagaaggtaatcagtggaaat

SEQ ID NO: 34602 - DNA, 22 bp, Artificial Sequence
  chemically synthesized
gtcgattgattgaatttttccc

SEQ ID NO: 34603 - DNA, 22 bp, Artificial Sequence
  chemically synthesized
tcgattgattgaatttttccct

SEQ ID NO: 34604 - DNA, 22 bp, Artificial Sequence
  chemically synthesized
attgaatttttcccttaaagcc

SEQ ID NO: 34605 - DNA, 22 bp, Artificial Sequence
  chemically synthesized
aatttttcccttaaagccaatt

SEQ ID NO: 34606 - DNA, 22 bp, Artificial Sequence
  chemically synthesized
ttcccttaaagccaattctaat

SEQ ID NO: 34607 - DNA, 22 bp, Artificial Sequence
  chemically synthesized
tcccttaaagccaattctaatg

SEQ ID NO: 34608 - DNA, 22 bp, Artificial Sequence
  chemically synthesized
cccttaaagccaattctaatgt

SEQ ID NO: 34609 - DNA, 22 bp, Artificial Sequence
  chemically synthesized
ccttaaagccaattctaatgta

SEQ ID NO: 34610 - DNA, 22 bp, Artificial Sequence
  chemically synthesized
aaagccaattctaatgtaagtg

SEQ ID NO: 34611 - DNA, 22 bp, Artificial Sequence
  chemically synthesized
aagccaattctaatgtaagtgt

SEQ ID NO: 34612 - DNA, 22 bp, Artificial Sequence
  chemically synthesized
taatgtaagtgtatgtgtgctg

SEQ ID NO: 34613 - DNA, 22 bp, Artificial Sequence
  chemically synthesized
atgtaagtgtatgtgtgctgct

SEQ ID NO: 34614 - DNA, 22 bp, Artificial Sequence
  chemically synthesized
ctgtaaatagggttagaaccct

SEQ ID NO: 34615 - DNA, 22 bp, Artificial Sequence
  chemically synthesized
taaatagggttagaaccctttt

SEQ ID NO: 34616 - DNA, 22 bp, Artificial Sequence
  chemically synthesized
gaaccctttttgctctaactta

SEQ ID NO: 34617 - DNA, 22 bp, Artificial Sequence
  chemically synthesized
tttgctctaacttaaataccaa

SEQ ID NO: 34618 - DNA, 22 bp, Artificial Sequence
  chemically synthesized
ttgctctaacttaaataccaat

SEQ ID NO: 34619 - DNA, 22 bp, Artificial Sequence
  chemically synthesized
tgctctaacttaaataccaatt

SEQ ID NO: 34620 - DNA, 22 bp, Artificial Sequence
  chemically synthesized
gctctaacttaaataccaattg

SEQ ID NO: 34621 - DNA, 22 bp, Artificial Sequence
  chemically synthesized
ctctaacttaaataccaattga

SEQ ID NO: 34622 - DNA, 22 bp, Artificial Sequence
  chemically synthesized
taacttaaataccaattgattt

SEQ ID NO: 34623 - DNA, 22 bp, Artificial Sequence
  chemically synthesized
acttaaataccaattgatttta

SEQ ID NO: 34624 - DNA, 22 bp, Artificial Sequence
  chemically synthesized
aaataccaattgattttagccc

SEQ ID NO: 34625 - DNA, 22 bp, Artificial Sequence
  chemically synthesized
aataccaattgattttagccca

SEQ ID NO: 34626 - DNA, 22 bp, Artificial Sequence
  chemically synthesized
attttagcccaggataatgaaa

SEQ ID NO: 34627 - DNA, 22 bp, Artificial Sequence
  chemically synthesized
tagcccaggataatgaaaatgc

SEQ ID NO: 34628 - DNA, 22 bp, Artificial Sequence
  chemically synthesized
agcccaggataatgaaaatgca

SEQ ID NO: 34629 - DNA, 22 bp, Artificial Sequence
  chemically synthesized
gcccaggataatgaaaatgcag

SEQ ID NO: 34630 - DNA, 22 bp, Artificial Sequence
  chemically synthesized
gctcagcaagcgaaatgtaacc

SEQ ID NO: 34631 - DNA, 22 bp, Artificial Sequence
  chemically synthesized
ctcagcaagcgaaatgtaacca

SEQ ID NO: 34632 - DNA, 22 bp, Artificial Sequence
  chemically synthesized
agcaagcgaaatgtaaccatct

SEQ ID NO: 34633 - DNA, 22 bp, Artificial Sequence
  chemically synthesized
aacacagctccttaagagatat

SEQ ID NO: 34634 - DNA, 22 bp, Artificial Sequence
  chemically synthesized
cttaagagatataagaagggtg

SEQ ID NO: 34635 - DNA, 22 bp, Artificial Sequence
  chemically synthesized
aagagatataagaagggtggaa

SEQ ID NO: 34636 - DNA, 22 bp, Artificial Sequence
  chemically synthesized
agagatataagaagggtggaag

SEQ ID NO: 34637 - DNA, 22 bp, Artificial Sequence
  chemically synthesized
cagagttctcagttgttgcggg

SEQ ID NO: 34638 - DNA, 22 bp, Artificial Sequence
  chemically synthesized
tcagttgttgcgggaagtctgg

SEQ ID NO: 34639 - DNA, 22 bp, Artificial Sequence
  chemically synthesized
agttgttgcgggaagtctggga

SEQ ID NO: 34640 - DNA, 22 bp, Artificial Sequence
  chemically synthesized
ttgcgggaagtctgggactcca

SEQ ID NO: 34641 - DNA, 22 bp, Artificial Sequence
  chemically synthesized
cgggaagtctgggactccaaac

SEQ ID NO: 34642 - DNA, 22 bp, Artificial Sequence
  chemically synthesized
ggactccaaacggagggatcag

SEQ ID NO: 34643 - DNA, 22 bp, Artificial Sequence
  chemically synthesized
caaacggagggatcagctgaag

SEQ ID NO: 34644 - DNA, 22 bp, Artificial Sequence
  chemically synthesized
aagccatggcagaagttcgtgg

SEQ ID NO: 34645 - DNA, 22 bp, Artificial Sequence
  chemically synthesized
gtggattgtgaagatttcatgg

SEQ ID NO: 34646 - DNA, 22 bp, Artificial Sequence
  chemically synthesized
tgaagatttcatggacatttat

SEQ ID NO: 34647 - DNA, 22 bp, Artificial Sequence
  chemically synthesized
catggacatttattagttcccc

SEQ ID NO: 34648 - DNA, 22 bp, Artificial Sequence
  chemically synthesized
atggacatttattagttcccca

SEQ ID NO: 34649 - DNA, 22 bp, Artificial Sequence
  chemically synthesized
attagttccccaaattaatact

SEQ ID NO: 34650 - DNA, 22 bp, Artificial Sequence
  chemically synthesized
ttagttccccaaattaatactt

SEQ ID NO: 34651 - DNA, 22 bp, Artificial Sequence
  chemically synthesized
gttccccaaattaatacttttg

SEQ ID NO: 34652 - DNA, 22 bp, Artificial Sequence
  chemically synthesized
cccaaattaatacttttgtaat

SEQ ID NO: 34653 - DNA, 22 bp, Artificial Sequence
  chemically synthesized
atacttttgtaatttcttatgc

SEQ ID NO: 34654 - DNA, 22 bp, Artificial Sequence
  chemically synthesized
ttgtaatttcttatgcctgtct

SEQ ID NO: 34655 - DNA, 22 bp, Artificial Sequence
  chemically synthesized
tgtaatttcttatgcctgtctt

SEQ ID NO: 34656 - DNA, 22 bp, Artificial Sequence
  chemically synthesized
gtaatttcttatgcctgtcttt

SEQ ID NO: 34657 - DNA, 22 bp, Artificial Sequence
  chemically synthesized
taatttcttatgcctgtcttta

SEQ ID NO: 34658 - DNA, 22 bp, Artificial Sequence
  chemically synthesized
cttatgcctgtctttactgcaa

SEQ ID NO: 34659 - DNA, 22 bp, Artificial Sequence
  chemically synthesized
ttatgcctgtctttactgcaat

SEQ ID NO: 34660 - DNA, 22 bp, Artificial Sequence
  chemically synthesized
atgcctgtctttactgcaatct

SEQ ID NO: 34661 - DNA, 22 bp, Artificial Sequence
  chemically synthesized
tgcctgtctttactgcaatctc

SEQ ID NO: 34662 - DNA, 22 bp, Artificial Sequence
  chemically synthesized
tctttactgcaatctctaaaca

SEQ ID NO: 34663 - DNA, 22 bp, Artificial Sequence
  chemically synthesized
tactgcaatctctaaacataaa

SEQ ID NO: 34664 - DNA, 22 bp, Artificial Sequence
  chemically synthesized
actgcaatctctaaacataaat

SEQ ID NO: 34665 - DNA, 22 bp, Artificial Sequence
  chemically synthesized
ctgcaatctctaaacataaatt

SEQ ID NO: 34666 - DNA, 22 bp, Artificial Sequence
  chemically synthesized
caatctctaaacataaattgta

SEQ ID NO: 34667 - DNA, 22 bp, Artificial Sequence
  chemically synthesized
taaacataaattgtaaagattt

SEQ ID NO: 34668 - DNA, 22 bp, Artificial Sequence
  chemically synthesized
aacataaattgtaaagatttca

SEQ ID NO: 34669 - DNA, 22 bp, Artificial Sequence
  chemically synthesized
taaagatttcatggacacttat

SEQ ID NO: 34670 - DNA, 22 bp, Artificial Sequence
  chemically synthesized
catggacacttatcacttcccc

SEQ ID NO: 34671 - DNA, 22 bp, Artificial Sequence
  chemically synthesized
atggacacttatcacttcccca

SEQ ID NO: 34672 - DNA, 22 bp, Artificial Sequence
  chemically synthesized
atcacttccccagtcaatatcc

SEQ ID NO: 34673 - DNA, 22 bp, Artificial Sequence
  chemically synthesized
tcacttccccagtcaatatcct

SEQ ID NO: 34674 - DNA, 22 bp, Artificial Sequence
  chemically synthesized
ccccagtcaatatccttgtgat

SEQ ID NO: 34675 - DNA, 22 bp, Artificial Sequence
  chemically synthesized
cccagtcaatatccttgtgatt

SEQ ID NO: 34676 - DNA, 22 bp, Artificial Sequence
  chemically synthesized
gtgatttatgcctgtctttact

SEQ ID NO: 34677 - DNA, 22 bp, Artificial Sequence
  chemically synthesized
tgatttatgcctgtctttactt

SEQ ID NO: 34678 - DNA, 22 bp, Artificial Sequence
  chemically synthesized
atgcctgtctttactttaatct

SEQ ID NO: 34679 - DNA, 22 bp, Artificial Sequence
  chemically synthesized
tgcctgtctttactttaatctc

SEQ ID NO: 34680 - DNA, 22 bp, Artificial Sequence
  chemically synthesized
tctttactttaatctcttaatc

SEQ ID NO: 34681 - DNA, 22 bp, Artificial Sequence
  chemically synthesized
tactttaatctcttaatcctgt

SEQ ID NO: 34682 - DNA, 22 bp, Artificial Sequence
  chemically synthesized
actttaatctcttaatcctgtc

SEQ ID NO: 34683 - DNA, 22 bp, Artificial Sequence
  chemically synthesized
ctttaatctcttaatcctgtca

SEQ ID NO: 34684 - DNA, 22 bp, Artificial Sequence
  chemically synthesized
taatctcttaatcctgtcagct

SEQ ID NO: 34685 - DNA, 22 bp, Artificial Sequence
  chemically synthesized
aatctcttaatcctgtcagctg

SEQ ID NO: 34686 - DNA, 22 bp, Artificial Sequence
  chemically synthesized
atctcttaatcctgtcagctga

SEQ ID NO: 34687 - DNA, 22 bp, Artificial Sequence
  chemically synthesized
ttaatcctgtcagctgaggagg

SEQ ID NO: 34688 - DNA, 22 bp, Artificial Sequence
  chemically synthesized
aatcctgtcagctgaggaggat

SEQ ID NO: 34689 - DNA, 22 bp, Artificial Sequence
  chemically synthesized
atcctgtcagctgaggaggatg

SEQ ID NO: 34690 - DNA, 22 bp, Artificial Sequence
  chemically synthesized
tcagctgaggaggatgtatatt

SEQ ID NO: 34691 - DNA, 22 bp, Artificial Sequence
  chemically synthesized
aggaggatgtatattgcctcag

SEQ ID NO: 34692 - DNA, 22 bp, Artificial Sequence
  chemically synthesized
cctcaggaccctgtaataattg

SEQ ID NO: 34693 - DNA, 22 bp, Artificial Sequence
  chemically synthesized
aggaccctgtaataattgcatt

SEQ ID NO: 34694 - DNA, 22 bp, Artificial Sequence
  chemically synthesized
taataattgcattaactgcaca

SEQ ID NO: 34695 - DNA, 22 bp, Artificial Sequence
  chemically synthesized
cattaactgcacaaattgtaca

SEQ ID NO: 34696 - DNA, 22 bp, Artificial Sequence
  chemically synthesized
actgcacaaattgtacagcatg

SEQ ID NO: 34697 - DNA, 22 bp, Artificial Sequence
  chemically synthesized
cacaaattgtacagcatgtgtg

SEQ ID NO: 34698 - DNA, 22 bp, Artificial Sequence
  chemically synthesized
tacagcatgtgtgtttgagcaa

SEQ ID NO: 34699 - DNA, 22 bp, Artificial Sequence
  chemically synthesized
gagcaacatgaaatgtggacac

SEQ ID NO: 34700 - DNA, 22 bp, Artificial Sequence
  chemically synthesized
agcaacatgaaatgtggacacc

SEQ ID NO: 34701 - DNA, 22 bp, Artificial Sequence
  chemically synthesized
gaaaaaagaacaggataacagc

SEQ ID NO: 34702 - DNA, 22 bp, Artificial Sequence
  chemically synthesized
aaaaaagaacaggataacagca

SEQ ID NO: 34703 - DNA, 22 bp, Artificial Sequence
  chemically synthesized
ttcagggaataagagagataac

SEQ ID NO: 34704 - DNA, 22 bp, Artificial Sequence
  chemically synthesized
agggaataagagagataacctt

SEQ ID NO: 34705 - DNA, 22 bp, Artificial Sequence
  chemically synthesized
aaactctgactgctggtgagcc

SEQ ID NO: 34706 - DNA, 22 bp, Artificial Sequence
  chemically synthesized
aactctgactgctggtgagcca

SEQ ID NO: 34707 - DNA, 22 bp, Artificial Sequence
  chemically synthesized
tgactgctggtgagccaggcag

SEQ ID NO: 34708 - DNA, 22 bp, Artificial Sequence
  chemically synthesized
actgctggtgagccaggcagaa

SEQ ID NO: 34709 - DNA, 22 bp, Artificial Sequence
  chemically synthesized
ctggtgagccaggcagaacaga

SEQ ID NO: 34710 - DNA, 22 bp, Artificial Sequence
  chemically synthesized
gtgagccaggcagaacagagcc

SEQ ID NO: 34711 - DNA, 22 bp, Artificial Sequence
  chemically synthesized
ctcttctttcaaaagcaaatgg

SEQ ID NO: 34712 - DNA, 22 bp, Artificial Sequence
  chemically synthesized
tcttctttcaaaagcaaatggg

SEQ ID NO: 34713 - DNA, 22 bp, Artificial Sequence
  chemically synthesized
ttctttcaaaagcaaatgggag

SEQ ID NO: 34714 - DNA, 22 bp, Artificial Sequence
  chemically synthesized
ctttcaaaagcaaatgggagaa

SEQ ID NO: 34715 - DNA, 22 bp, Artificial Sequence
  chemically synthesized
tttcaaaagcaaatgggagaaa

SEQ ID NO: 34716 - DNA, 22 bp, Artificial Sequence
  chemically synthesized
tcaaaagcaaatgggagaaata

SEQ ID NO: 34717 - DNA, 22 bp, Artificial Sequence
  chemically synthesized
caaaagcaaatgggagaaatat

SEQ ID NO: 34718 - DNA, 22 bp, Artificial Sequence
  chemically synthesized
aaaagcaaatgggagaaatatc

SEQ ID NO: 34719 - DNA, 22 bp, Artificial Sequence
  chemically synthesized
aattctttttctcagcatggaa

SEQ ID NO: 34720 - DNA, 22 bp, Artificial Sequence
  chemically synthesized
tttttctcagcatggaacatcc

SEQ ID NO: 34721 - DNA, 22 bp, Artificial Sequence
  chemically synthesized
tttctcagcatggaacatccct

SEQ ID NO: 34722 - DNA, 22 bp, Artificial Sequence
  chemically synthesized
ttctcagcatggaacatccctg

SEQ ID NO: 34723 - DNA, 22 bp, Artificial Sequence
  chemically synthesized
tctcagcatggaacatccctga

SEQ ID NO: 34724 - DNA, 22 bp, Artificial Sequence
  chemically synthesized
ctcagcatggaacatccctgag

SEQ ID NO: 34725 - DNA, 22 bp, Artificial Sequence
  chemically synthesized
tcagcatggaacatccctgaga

SEQ ID NO: 34726 - DNA, 22 bp, Artificial Sequence
  chemically synthesized
agcatggaacatccctgagaaa

SEQ ID NO: 34727 - DNA, 22 bp, Artificial Sequence
  chemically synthesized
agaaagagaatacgagccagga

SEQ ID NO: 34728 - DNA, 22 bp, Artificial Sequence
  chemically synthesized
ataaacagcccccctccaggtg

SEQ ID NO: 34729 - DNA, 22 bp, Artificial Sequence
  chemically synthesized
taaacagcccccctccaggtgc

SEQ ID NO: 34730 - DNA, 22 bp, Artificial Sequence
  chemically synthesized
caggtgcgcctgtctcttatgg

SEQ ID NO: 34731 - DNA, 22 bp, Artificial Sequence
  chemically synthesized
tctcttatggtcgagactgcag

SEQ ID NO: 34732 - DNA, 22 bp, Artificial Sequence
  chemically synthesized
ttatggtcgagactgcaggggt

SEQ ID NO: 34733 - DNA, 22 bp, Artificial Sequence
  chemically synthesized
atggtcgagactgcaggggtga

SEQ ID NO: 34734 - DNA, 22 bp, Artificial Sequence
  chemically synthesized
tggtcgagactgcaggggtgaa

SEQ ID NO: 34735 - DNA, 22 bp, Artificial Sequence
  chemically synthesized
caggggtgaaatagaccccagt

SEQ ID NO: 34736 - DNA, 22 bp, Artificial Sequence
  chemically synthesized
ccacagcgctcccaggcttatt

SEQ ID NO: 34737 - DNA, 22 bp, Artificial Sequence
  chemically synthesized
ccaggcttattaggaagaggaa

SEQ ID NO: 34738 - DNA, 22 bp, Artificial Sequence
  chemically synthesized
attaggaagaggaaattcccgc

SEQ ID NO: 34739 - DNA, 22 bp, Artificial Sequence
  chemically synthesized
ttaggaagaggaaattcccgcc

SEQ ID NO: 34740 - DNA, 22 bp, Artificial Sequence
  chemically synthesized
ggaagaggaaattcccgcctaa

SEQ ID NO: 34741 - DNA, 22 bp, Artificial Sequence
  chemically synthesized
ccgcctaataaattttggtcag

SEQ ID NO: 34742 - DNA, 22 bp, Artificial Sequence
  chemically synthesized
ataaattttggtcagaccagtt

SEQ ID NO: 34743 - DNA, 22 bp, Artificial Sequence
  chemically synthesized
tggtcagaccagttgatcctaa

SEQ ID NO: 34744 - DNA, 22 bp, Artificial Sequence
  chemically synthesized
ggtcagaccagttgatcctaaa

SEQ ID NO: 34745 - DNA, 22 bp, Artificial Sequence
  chemically synthesized
gtcagaccagttgatcctaaaa

SEQ ID NO: 34746 - DNA, 22 bp, Artificial Sequence
  chemically synthesized
atcctaaaaaccctgtctcctg

SEQ ID NO: 34747 - DNA, 22 bp, Artificial Sequence
  chemically synthesized
aaaaccctgtctcctgataaga

SEQ ID NO: 34748 - DNA, 22 bp, Artificial Sequence
  chemically synthesized
tctcctgataagatgttatcaa

SEQ ID NO: 34749 - DNA, 22 bp, Artificial Sequence
  chemically synthesized
ctgataagatgttatcaatgac

SEQ ID NO: 34750 - DNA, 22 bp, Artificial Sequence
  chemically synthesized
ataagatgttatcaatgacaat

SEQ ID NO: 34751 - DNA, 22 bp, Artificial Sequence
  chemically synthesized
tcaatgacaatggtgcccgaaa

SEQ ID NO: 34752 - DNA, 22 bp, Artificial Sequence
  chemically synthesized
cattagcaattttaatttcgcc

SEQ ID NO: 34753 - DNA, 22 bp, Artificial Sequence
  chemically synthesized
attagcaattttaatttcgcct

SEQ ID NO: 34754 - DNA, 22 bp, Artificial Sequence
  chemically synthesized
gcaattttaatttcgcctcggt

SEQ ID NO: 34755 - DNA, 22 bp, Artificial Sequence
  chemically synthesized
taatttcgcctcggtcctgtgg

SEQ ID NO: 34756 - DNA, 22 bp, Artificial Sequence
  chemically synthesized
aatttcgcctcggtcctgtggt

SEQ ID NO: 34757 - DNA, 22 bp, Artificial Sequence
  chemically synthesized
atttcgcctcggtcctgtggtc

SEQ ID NO: 34758 - DNA, 22 bp, Artificial Sequence
  chemically synthesized
cgcctcggtcctgtggtcctgt

SEQ ID NO: 34759 - DNA, 22 bp, Artificial Sequence
  chemically synthesized
gcctcggtcctgtggtcctgtg

SEQ ID NO: 34760 - DNA, 22 bp, Artificial Sequence
  chemically synthesized
ggtcctgtggtcctgtgatctc

SEQ ID NO: 34761 - DNA, 22 bp, Artificial Sequence
  chemically synthesized
tggtcctgtgatctcaccctgc

SEQ ID NO: 34762 - DNA, 22 bp, Artificial Sequence
  chemically synthesized
tgatctcaccctgcctccactt

SEQ ID NO: 34763 - DNA, 22 bp, Artificial Sequence
  chemically synthesized
accctgcctccacttgccttgt

SEQ ID NO: 34764 - DNA, 22 bp, Artificial Sequence
  chemically synthesized
cctccacttgccttgtgatatt

SEQ ID NO: 34765 - DNA, 22 bp, Artificial Sequence
  chemically synthesized
cacttgccttgtgatattctat

SEQ ID NO: 34766 - DNA, 22 bp, Artificial Sequence
  chemically synthesized
gccttgtgatattctattacct

SEQ ID NO: 34767 - DNA, 22 bp, Artificial Sequence
  chemically synthesized
ccttgtgatattctattacctt

SEQ ID NO: 34768 - DNA, 22 bp, Artificial Sequence
  chemically synthesized
gtgatattctattaccttgtaa

SEQ ID NO: 34769 - DNA, 22 bp, Artificial Sequence
  chemically synthesized
tgatattctattaccttgtaaa

SEQ ID NO: 34770 - DNA, 22 bp, Artificial Sequence
  chemically synthesized
tattaccttgtaaagtacttga

SEQ ID NO: 34771 - DNA, 22 bp, Artificial Sequence
  chemically synthesized
ttaccttgtaaagtacttgatg

SEQ ID NO: 34772 - DNA, 22 bp, Artificial Sequence
  chemically synthesized
ccttgtaaagtacttgatgtct

SEQ ID NO: 34773 - DNA, 22 bp, Artificial Sequence
  chemically synthesized
gtaaagtacttgatgtctgtga

SEQ ID NO: 34774 - DNA, 22 bp, Artificial Sequence
  chemically synthesized
taaagtacttgatgtctgtgac

SEQ ID NO: 34775 - DNA, 22 bp, Artificial Sequence
  chemically synthesized
gatgtctgtgacccacacctat

SEQ ID NO: 34776 - DNA, 22 bp, Artificial Sequence
  chemically synthesized
atgtctgtgacccacacctatt

SEQ ID NO: 34777 - DNA, 22 bp, Artificial Sequence
  chemically synthesized
tgacccacacctatttgcacac

SEQ ID NO: 34778 - DNA, 22 bp, Artificial Sequence
  chemically synthesized
tttgcacactgcctccccattt

SEQ ID NO: 34779 - DNA, 22 bp, Artificial Sequence
  chemically synthesized
gcacactgcctccccatttgaa

SEQ ID NO: 34780 - DNA, 22 bp, Artificial Sequence
  chemically synthesized
cacactgcctccccatttgaaa

SEQ ID NO: 34781 - DNA, 22 bp, Artificial Sequence
  chemically synthesized
cctccccatttgaaaatcccta

SEQ ID NO: 34782 - DNA, 22 bp, Artificial Sequence
  chemically synthesized
cccatttgaaaatccctaatac

SEQ ID NO: 34783 - DNA, 22 bp, Artificial Sequence
  chemically synthesized
gaaaatccctaatacaaacttg

SEQ ID NO: 34784 - DNA, 22 bp, Artificial Sequence
  chemically synthesized
aaaatccctaatacaaacttgc

SEQ ID NO: 34785 - DNA, 22 bp, Artificial Sequence
  chemically synthesized
atacaaacttgctggtttttgt

SEQ ID NO: 34786 - DNA, 22 bp, Artificial Sequence
  chemically synthesized
gctggtttttgtggcttgtggg

SEQ ID NO: 34787 - DNA, 22 bp, Artificial Sequence
  chemically synthesized
ctggtttttgtggcttgtgggg

SEQ ID NO: 34788 - DNA, 22 bp, Artificial Sequence
  chemically synthesized
gtttttgtggcttgtggggcat

SEQ ID NO: 34789 - DNA, 22 bp, Artificial Sequence
  chemically synthesized
ttgtggcttgtggggcatcacg

SEQ ID NO: 34790 - DNA, 22 bp, Artificial Sequence
  chemically synthesized
tgtggcttgtggggcatcacgg

SEQ ID NO: 34791 - DNA, 22 bp, Artificial Sequence
  chemically synthesized
gtggcttgtggggcatcacgga

SEQ ID NO: 34792 - DNA, 22 bp, Artificial Sequence
  chemically synthesized
tggcttgtggggcatcacggaa

SEQ ID NO: 34793 - DNA, 22 bp, Artificial Sequence
  chemically synthesized
gtggggcatcacggaacctacc

SEQ ID NO: 34794 - DNA, 22 bp, Artificial Sequence
  chemically synthesized
tggggcatcacggaacctaccg

SEQ ID NO: 34795 - DNA, 22 bp, Artificial Sequence
  chemically synthesized
ccgaaatgtgatgcctcccccg

SEQ ID NO: 34796 - DNA, 22 bp, Artificial Sequence
  chemically synthesized
ccccggatgcccggctttaaaa

SEQ ID NO: 34797 - DNA, 22 bp, Artificial Sequence
  chemically synthesized
taaaatttctctcttttgtact

SEQ ID NO: 34798 - DNA, 22 bp, Artificial Sequence
  chemically synthesized
aaaatttctctcttttgtactc

SEQ ID NO: 34799 - DNA, 22 bp, Artificial Sequence
  chemically synthesized
aaatttctctcttttgtactct

SEQ ID NO: 34800 - DNA, 22 bp, Artificial Sequence
  chemically synthesized
ctctcttttgtactctgtccct

SEQ ID NO: 34801 - DNA, 22 bp, Artificial Sequence
  chemically synthesized
tctcttttgtactctgtccctt

SEQ ID NO: 34802 - DNA, 22 bp, Artificial Sequence
  chemically synthesized
tcttttgtactctgtcccttta

SEQ ID NO: 34803 - DNA, 22 bp, Artificial Sequence
  chemically synthesized
ttttgtactctgtccctttatt

SEQ ID NO: 34804 - DNA, 22 bp, Artificial Sequence
  chemically synthesized
ttgtactctgtccctttatttc

SEQ ID NO: 34805 - DNA, 22 bp, Artificial Sequence
  chemically synthesized
tgtactctgtccctttatttct

SEQ ID NO: 34806 - DNA, 22 bp, Artificial Sequence
  chemically synthesized
gtactctgtccctttatttcta

SEQ ID NO: 34807 - DNA, 22 bp, Artificial Sequence
  chemically synthesized
tactctgtccctttatttctaa

SEQ ID NO: 34808 - DNA, 22 bp, Artificial Sequence
  chemically synthesized
tgtccctttatttctaaagttg

SEQ ID NO: 34809 - DNA, 22 bp, Artificial Sequence
  chemically synthesized
tccctttatttctaaagttggc

SEQ ID NO: 34810 - DNA, 22 bp, Artificial Sequence
  chemically synthesized
tatttctaaagttggccgacgc

SEQ ID NO: 34811 - DNA, 22 bp, Artificial Sequence
  chemically synthesized
atttctaaagttggccgacgct

SEQ ID NO: 34812 - DNA, 22 bp, Artificial Sequence
  chemically synthesized
tttctaaagttggccgacgctt

SEQ ID NO: 34813 - DNA, 22 bp, Artificial Sequence
  chemically synthesized
ctaaagttggccgacgcttagg

SEQ ID NO: 34814 - DNA, 22 bp, Artificial Sequence
  chemically synthesized
taaagttggccgacgcttaggg

SEQ ID NO: 34815 - DNA, 22 bp, Artificial Sequence
  chemically synthesized
aagttggccgacgcttagggaa

SEQ ID NO: 34816 - DNA, 22 bp, Artificial Sequence
  chemically synthesized
gccgacgcttagggaaaataga

SEQ ID NO: 34817 - DNA, 22 bp, Artificial Sequence
  chemically synthesized
agggaaaatagaaaagaaccta

SEQ ID NO: 34818 - DNA, 22 bp, Artificial Sequence
  chemically synthesized
gggaaaatagaaaagaacctac

SEQ ID NO: 34819 - DNA, 22 bp, Artificial Sequence
  chemically synthesized
cgtgaatattggggcaggttcc

SEQ ID NO: 34820 - DNA, 22 bp, Artificial Sequence
  chemically synthesized
gggcaggttccctgatactcag

SEQ ID NO: 34821 - DNA, 22 bp, Artificial Sequence
  chemically synthesized
cctgatactcagtggcgtggag

SEQ ID NO: 34822 - DNA, 22 bp, Artificial Sequence
  chemically synthesized
atactcagtggcgtggagatgt

SEQ ID NO: 34823 - DNA, 22 bp, Artificial Sequence
  chemically synthesized
agtggcgtggagatgtaacaag

SEQ ID NO: 34824 - DNA, 22 bp, Artificial Sequence
  chemically synthesized
gatgtgtgagtgatgatcaggc

SEQ ID NO: 34825 - DNA, 22 bp, Artificial Sequence
  chemically synthesized
tatttggaagaaatatcagatg

SEQ ID NO: 34826 - DNA, 22 bp, Artificial Sequence
  chemically synthesized
ggaagaaatatcagatgtgaat

SEQ ID NO: 34827 - DNA, 22 bp, Artificial Sequence
  chemically synthesized
gaagaaatatcagatgtgaatg

SEQ ID NO: 34828 - DNA, 22 bp, Artificial Sequence
  chemically synthesized
tgacctaggaagcaatggaagt

SEQ ID NO: 34829 - DNA, 22 bp, Artificial Sequence
  chemically synthesized
ggaagcaatggaagtgaaaaat

SEQ ID NO: 34830 - DNA, 22 bp, Artificial Sequence
  chemically synthesized
ttctttttgccttcagactcaa

SEQ ID NO: 34831 - DNA, 22 bp, Artificial Sequence
  chemically synthesized
tttttgccttcagactcaatat

SEQ ID NO: 34832 - DNA, 22 bp, Artificial Sequence
  chemically synthesized
tttgccttcagactcaatattt

SEQ ID NO: 34833 - DNA, 22 bp, Artificial Sequence
  chemically synthesized
ttgccttcagactcaatatttt

SEQ ID NO: 34834 - DNA, 22 bp, Artificial Sequence
  chemically synthesized
tgccttcagactcaatattttg

SEQ ID NO: 34835 - DNA, 22 bp, Artificial Sequence
  chemically synthesized
gccttcagactcaatattttgt

SEQ ID NO: 34836 - DNA, 22 bp, Artificial Sequence
  chemically synthesized
ccttcagactcaatattttgta

SEQ ID NO: 34837 - DNA, 22 bp, Artificial Sequence
  chemically synthesized
cagactcaatattttgtatatt

SEQ ID NO: 34838 - DNA, 22 bp, Artificial Sequence
  chemically synthesized
agactcaatattttgtatattt

SEQ ID NO: 34839 - DNA, 22 bp, Artificial Sequence
  chemically synthesized
aatattttgtatatttgaaaat

SEQ ID NO: 34840 - DNA, 22 bp, Artificial Sequence
  chemically synthesized
tgtatatttgaaaatttgtcaa

SEQ ID NO: 34841 - DNA, 22 bp, Artificial Sequence
  chemically synthesized
gtatatttgaaaatttgtcaac

SEQ ID NO: 34842 - DNA, 22 bp, Artificial Sequence
  chemically synthesized
tatatttgaaaatttgtcaaca

SEQ ID NO: 34843 - DNA, 22 bp, Artificial Sequence
  chemically synthesized
gaaaatttgtcaacacaaaaaa

SEQ ID NO: 34844 - DNA, 22 bp, Artificial Sequence
  chemically synthesized
aaaatttgtcaacacaaaaaat

SEQ ID NO: 34845 - DNA, 22 bp, Artificial Sequence
  chemically synthesized
gtcaacacaaaaaatactaagt

SEQ ID NO: 34846 - DNA, 22 bp, Artificial Sequence
  chemically synthesized
tcaacacaaaaaatactaagtt

SEQ ID NO: 34847 - DNA, 22 bp, Artificial Sequence
  chemically synthesized
agttgtatactgatttgttaaa

SEQ ID NO: 34848 - DNA, 22 bp, Artificial Sequence
  chemically synthesized
tatactgatttgttaaaagcag

SEQ ID NO: 34849 - DNA, 22 bp, Artificial Sequence
  chemically synthesized
atttgttaaaagcagcagcatg

SEQ ID NO: 34850 - DNA, 22 bp, Artificial Sequence
  chemically synthesized
gttaaaagcagcagcatgcagt

SEQ ID NO: 34851 - DNA, 22 bp, Artificial Sequence
  chemically synthesized
ttaaaagcagcagcatgcagtt

SEQ ID NO: 34852 - DNA, 22 bp, Artificial Sequence
  chemically synthesized
aaagcagcagcatgcagttagg

SEQ ID NO: 34853 - DNA, 22 bp, Artificial Sequence
  chemically synthesized
ggatgatatctttggggaaatg

SEQ ID NO: 34854 - DNA, 22 bp, Artificial Sequence
  chemically synthesized
tggggaaatggcagagaccatc

SEQ ID NO: 34855 - DNA, 22 bp, Artificial Sequence
  chemically synthesized
ggggaaatggcagagaccatcc

SEQ ID NO: 34856 - DNA, 22 bp, Artificial Sequence
  chemically synthesized
gggaaatggcagagaccatcca

SEQ ID NO: 34857 - DNA, 22 bp, Artificial Sequence
  chemically synthesized
tgattctccactgcatccaatt

SEQ ID NO: 34858 - DNA, 22 bp, Artificial Sequence
  chemically synthesized
attctccactgcatccaatttt

SEQ ID NO: 34859 - DNA, 22 bp, Artificial Sequence
  chemically synthesized
tccactgcatccaattttctac

SEQ ID NO: 34860 - DNA, 22 bp, Artificial Sequence
  chemically synthesized
cactgcatccaattttctactc

SEQ ID NO: 34861 - DNA, 22 bp, Artificial Sequence
  chemically synthesized
catccaattttctactctcaaa

SEQ ID NO: 34862 - DNA, 22 bp, Artificial Sequence
  chemically synthesized
tctactctcaaaatgaacccca

SEQ ID NO: 34863 - DNA, 22 bp, Artificial Sequence
  chemically synthesized
ctactctcaaaatgaaccccat

SEQ ID NO: 34864 - DNA, 22 bp, Artificial Sequence
  chemically synthesized
tactctcaaaatgaaccccatg

SEQ ID NO: 34865 - DNA, 22 bp, Artificial Sequence
  chemically synthesized
ctctcaaaatgaaccccatgct

SEQ ID NO: 34866 - DNA, 22 bp, Artificial Sequence
  chemically synthesized
tcaaaatgaaccccatgctcac

SEQ ID NO: 34867 - DNA, 22 bp, Artificial Sequence
  chemically synthesized
aaaatgaaccccatgctcacca

SEQ ID NO: 34868 - DNA, 22 bp, Artificial Sequence
  chemically synthesized
accatcaacgggattgaatttg

SEQ ID NO: 34869 - DNA, 22 bp, Artificial Sequence
  chemically synthesized
aatttgagctgctgagaattgg

SEQ ID NO: 34870 - DNA, 22 bp, Artificial Sequence
  chemically synthesized
gagctgctgagaattggtaata

SEQ ID NO: 34871 - DNA, 22 bp, Artificial Sequence
  chemically synthesized
agctgctgagaattggtaataa

SEQ ID NO: 34872 - DNA, 22 bp, Artificial Sequence
  chemically synthesized
ctgagaattggtaataacccca

SEQ ID NO: 34873 - DNA, 22 bp, Artificial Sequence
  chemically synthesized
agaattggtaataaccccaaat

SEQ ID NO: 34874 - DNA, 22 bp, Artificial Sequence
  chemically synthesized
gtaataaccccaaattatcttc

SEQ ID NO: 34875 - DNA, 22 bp, Artificial Sequence
  chemically synthesized
tcttcaattctgtgaaatggaa

SEQ ID NO: 34876 - DNA, 22 bp, Artificial Sequence
  chemically synthesized
caattctgtgaaatggaatttt

SEQ ID NO: 34877 - DNA, 22 bp, Artificial Sequence
  chemically synthesized
aattctgtgaaatggaatttta

SEQ ID NO: 34878 - DNA, 22 bp, Artificial Sequence
  chemically synthesized
tgtgaaatggaattttagacca

SEQ ID NO: 34879 - DNA, 22 bp, Artificial Sequence
  chemically synthesized
tgaaatggaattttagaccagc

SEQ ID NO: 34880 - DNA, 22 bp, Artificial Sequence
  chemically synthesized
tagaccagcctgtgactgaagc

SEQ ID NO: 34881 - DNA, 22 bp, Artificial Sequence
  chemically synthesized
agaccagcctgtgactgaagcc

SEQ ID NO: 34882 - DNA, 22 bp, Artificial Sequence
  chemically synthesized
gaccagcctgtgactgaagcca

SEQ ID NO: 34883 - DNA, 22 bp, Artificial Sequence
  chemically synthesized
tgactgaagccactgggcatta

SEQ ID NO: 34884 - DNA, 22 bp, Artificial Sequence
  chemically synthesized
aagccactgggcattacagtgc

SEQ ID NO: 34885 - DNA, 22 bp, Artificial Sequence
  chemically synthesized
ggcattacagtgccttcgcttt

SEQ ID NO: 34886 - DNA, 22 bp, Artificial Sequence
  chemically synthesized
cagtgccttcgctttgttcaac

SEQ ID NO: 34887 - DNA, 22 bp, Artificial Sequence
  chemically synthesized
cgctttgttcaactgccgcatt

SEQ ID NO: 34888 - DNA, 22 bp, Artificial Sequence
  chemically synthesized
gctttgttcaactgccgcattg

SEQ ID NO: 34889 - DNA, 22 bp, Artificial Sequence
  chemically synthesized
tgttcaactgccgcattgtttc

SEQ ID NO: 34890 - DNA, 22 bp, Artificial Sequence
  chemically synthesized
gttcaactgccgcattgtttct

SEQ ID NO: 34891 - DNA, 22 bp, Artificial Sequence
  chemically synthesized
ttcaactgccgcattgtttctc

SEQ ID NO: 34892 - DNA, 22 bp, Artificial Sequence
  chemically synthesized
aactgccgcattgtttctctct

SEQ ID NO: 34893 - DNA, 22 bp, Artificial Sequence
  chemically synthesized
ccgcattgtttctctctgcaag

SEQ ID NO: 34894 - DNA, 22 bp, Artificial Sequence
  chemically synthesized
tttctctctgcaagagaggaag

SEQ ID NO: 34895 - DNA, 22 bp, Artificial Sequence
  chemically synthesized
ctctctgcaagagaggaaggaa

SEQ ID NO: 34896 - DNA, 22 bp, Artificial Sequence
  chemically synthesized
tctctgcaagagaggaaggaag

SEQ ID NO: 34897 - DNA, 22 bp, Artificial Sequence
  chemically synthesized
tctgcaagagaggaaggaaggc

SEQ ID NO: 34898 - DNA, 22 bp, Artificial Sequence
  chemically synthesized
tgcaagagaggaaggaaggctg

SEQ ID NO: 34899 - DNA, 22 bp, Artificial Sequence
  chemically synthesized
caagagaggaaggaaggctgga

SEQ ID NO: 34900 - DNA, 22 bp, Artificial Sequence
  chemically synthesized
gagtacagctgagctttctggc

SEQ ID NO: 34901 - DNA, 22 bp, Artificial Sequence
  chemically synthesized
agctttctggcaggcactggtg

SEQ ID NO: 34902 - DNA, 22 bp, Artificial Sequence
  chemically synthesized
tctggcaggcactggtggagtt

SEQ ID NO: 34903 - DNA, 22 bp, Artificial Sequence
  chemically synthesized
ctggcaggcactggtggagtta

SEQ ID NO: 34904 - DNA, 22 bp, Artificial Sequence
  chemically synthesized
tggcaggcactggtggagttac

SEQ ID NO: 34905 - DNA, 22 bp, Artificial Sequence
  chemically synthesized
gcaggcactggtggagttactc

SEQ ID NO: 34906 - DNA, 22 bp, Artificial Sequence
  chemically synthesized
gtggagttactcattaaccttc

SEQ ID NO: 34907 - DNA, 22 bp, Artificial Sequence
  chemically synthesized
ctcattaaccttccccattctt

SEQ ID NO: 34908 - DNA, 22 bp, Artificial Sequence
  chemically synthesized
attaaccttccccattctttgt

SEQ ID NO: 34909 - DNA, 22 bp, Artificial Sequence
  chemically synthesized
accttccccattctttgtaact

SEQ ID NO: 34910 - DNA, 22 bp, Artificial Sequence
  chemically synthesized
ccccattctttgtaactggtgg

SEQ ID NO: 34911 - DNA, 22 bp, Artificial Sequence
  chemically synthesized
cccattctttgtaactggtggc

SEQ ID NO: 34912 - DNA, 22 bp, Artificial Sequence
  chemically synthesized
tttgtaactggtggccttagaa

SEQ ID NO: 34913 - DNA, 22 bp, Artificial Sequence
  chemically synthesized
tgtaactggtggccttagaaga

SEQ ID NO: 34914 - DNA, 22 bp, Artificial Sequence
  chemically synthesized
gtaactggtggccttagaagag

SEQ ID NO: 34915 - DNA, 22 bp, Artificial Sequence
  chemically synthesized
taactggtggccttagaagagg

SEQ ID NO: 34916 - DNA, 22 bp, Artificial Sequence
  chemically synthesized
gtggccttagaagagggttcag

SEQ ID NO: 34917 - DNA, 22 bp, Artificial Sequence
  chemically synthesized
agaagagggttcagggttatgt

SEQ ID NO: 34918 - DNA, 22 bp, Artificial Sequence
  chemically synthesized
gaagagggttcagggttatgtg

SEQ ID NO: 34919 - DNA, 22 bp, Artificial Sequence
  chemically synthesized
agggttatgtgtttggaacacg

SEQ ID NO: 34920 - DNA, 22 bp, Artificial Sequence
  chemically synthesized
tgtgtttggaacacgagttagt

SEQ ID NO: 34921 - DNA, 22 bp, Artificial Sequence
  chemically synthesized
ggaacacgagttagtataaatg

SEQ ID NO: 34922 - DNA, 22 bp, Artificial Sequence
  chemically synthesized
gaacacgagttagtataaatgg

SEQ ID NO: 34923 - DNA, 22 bp, Artificial Sequence
  chemically synthesized
gtataaatggttctgaagcact

SEQ ID NO: 34924 - DNA, 22 bp, Artificial Sequence
  chemically synthesized
tgaagcacttgattcagactgt

SEQ ID NO: 34925 - DNA, 22 bp, Artificial Sequence
  chemically synthesized
aagcacttgattcagactgtgc

SEQ ID NO: 34926 - DNA, 22 bp, Artificial Sequence
  chemically synthesized
gattcagactgtgctttaaaaa

SEQ ID NO: 34927 - DNA, 22 bp, Artificial Sequence
  chemically synthesized
attcagactgtgctttaaaaaa

SEQ ID NO: 34928 - DNA, 22 bp, Artificial Sequence
  chemically synthesized
agactgtgctttaaaaaatagg

SEQ ID NO: 34929 - DNA, 22 bp, Artificial Sequence
  chemically synthesized
tgctttaaaaaataggaaagaa

SEQ ID NO: 34930 - DNA, 22 bp, Artificial Sequence
  chemically synthesized
taaaaaataggaaagaaagtag

SEQ ID NO: 34931 - DNA, 22 bp, Artificial Sequence
  chemically synthesized
aaaaaataggaaagaaagtaga

SEQ ID NO: 34932 - DNA, 22 bp, Artificial Sequence
  chemically synthesized
aaaaataggaaagaaagtagaa

SEQ ID NO: 34933 - DNA, 22 bp, Artificial Sequence
  chemically synthesized
atggtttggaagggagccacca

SEQ ID NO: 34934 - DNA, 22 bp, Artificial Sequence
  chemically synthesized
ggaagggagccaccaagcacca

SEQ ID NO: 34935 - DNA, 22 bp, Artificial Sequence
  chemically synthesized
gaagggagccaccaagcaccaa

SEQ ID NO: 34936 - DNA, 22 bp, Artificial Sequence
  chemically synthesized
tgaatccgtttctcaatcttag

SEQ ID NO: 34937 - DNA, 22 bp, Artificial Sequence
  chemically synthesized
aatccgtttctcaatcttagct

SEQ ID NO: 34938 - DNA, 22 bp, Artificial Sequence
  chemically synthesized
ctcaatcttagctgcagggcat

SEQ ID NO: 34939 - DNA, 22 bp, Artificial Sequence
  chemically synthesized
tcaatcttagctgcagggcatt

SEQ ID NO: 34940 - DNA, 22 bp, Artificial Sequence
  chemically synthesized
aatcttagctgcagggcattgg

SEQ ID NO: 34941 - DNA, 22 bp, Artificial Sequence
  chemically synthesized
agctgcagggcattggctaaag

SEQ ID NO: 34942 - DNA, 22 bp, Artificial Sequence
  chemically synthesized
gctgcagggcattggctaaaga

SEQ ID NO: 34943 - DNA, 22 bp, Artificial Sequence
  chemically synthesized
cagggcattggctaaagaggaa

SEQ ID NO: 34944 - DNA, 22 bp, Artificial Sequence
  chemically synthesized
gctaaagaggaaggtgaaaact

SEQ ID NO: 34945 - DNA, 22 bp, Artificial Sequence
  chemically synthesized
aagaggaaggtgaaaactgctg

SEQ ID NO: 34946 - DNA, 22 bp, Artificial Sequence
  chemically synthesized
ctgagtcactatcaaatcaatt

SEQ ID NO: 34947 - DNA, 22 bp, Artificial Sequence
  chemically synthesized
agtcactatcaaatcaattggt

SEQ ID NO: 34948 - DNA, 22 bp, Artificial Sequence
  chemically synthesized
tcaaatcaattggtttttctaa

SEQ ID NO: 34949 - DNA, 22 bp, Artificial Sequence
  chemically synthesized
gtttttctaatcccctgagaga

SEQ ID NO: 34950 - DNA, 22 bp, Artificial Sequence
  chemically synthesized
ttctaatcccctgagagaaaaa

SEQ ID NO: 34951 - DNA, 22 bp, Artificial Sequence
  chemically synthesized
tctaatcccctgagagaaaaag

SEQ ID NO: 34952 - DNA, 22 bp, Artificial Sequence
  chemically synthesized
ctaatcccctgagagaaaaagt

SEQ ID NO: 34953 - DNA, 22 bp, Artificial Sequence
  chemically synthesized
taatcccctgagagaaaaagta

SEQ ID NO: 34954 - DNA, 22 bp, Artificial Sequence
  chemically synthesized
atcccctgagagaaaaagtaca

SEQ ID NO: 34955 - DNA, 22 bp, Artificial Sequence
  chemically synthesized
agagaaaaagtacagagtttat

SEQ ID NO: 34956 - DNA, 22 bp, Artificial Sequence
  chemically synthesized
attgcagctttaaaatgccatg

SEQ ID NO: 34957 - DNA, 22 bp, Artificial Sequence
  chemically synthesized
ttgcagctttaaaatgccatgc

SEQ ID NO: 34958 - DNA, 22 bp, Artificial Sequence
  chemically synthesized
cagctttaaaatgccatgcccc

SEQ ID NO: 34959 - DNA, 22 bp, Artificial Sequence
  chemically synthesized
taaaatgccatgcccctcacgg

SEQ ID NO: 34960 - DNA, 22 bp, Artificial Sequence
  chemically synthesized
aaaatgccatgcccctcacggc

SEQ ID NO: 34961 - DNA, 22 bp, Artificial Sequence
  chemically synthesized
aaatgccatgcccctcacggcc

SEQ ID NO: 34962 - DNA, 22 bp, Artificial Sequence
  chemically synthesized
acggccaaaggcatctgaatta

SEQ ID NO: 34963 - DNA, 22 bp, Artificial Sequence
  chemically synthesized
aattaaggaagcagtattcaca

SEQ ID NO: 34964 - DNA, 22 bp, Artificial Sequence
  chemically synthesized
aggaagcagtattcacagctgc

SEQ ID NO: 34965 - DNA, 22 bp, Artificial Sequence
  chemically synthesized
acagctgctttctccagacatt

SEQ ID NO: 34966 - DNA, 22 bp, Artificial Sequence
  chemically synthesized
ctttctccagacattgagctca

SEQ ID NO: 34967 - DNA, 22 bp, Artificial Sequence
  chemically synthesized
tctccagacattgagctcaagg

SEQ ID NO: 34968 - DNA, 22 bp, Artificial Sequence
  chemically synthesized
ctccagacattgagctcaagga

SEQ ID NO: 34969 - DNA, 22 bp, Artificial Sequence
  chemically synthesized
tccagacattgagctcaaggac

SEQ ID NO: 34970 - DNA, 22 bp, Artificial Sequence
  chemically synthesized
cagacattgagctcaaggacag

SEQ ID NO: 34971 - DNA, 22 bp, Artificial Sequence
  chemically synthesized
agctcaaggacagaatctgaac

SEQ ID NO: 34972 - DNA, 22 bp, Artificial Sequence
  chemically synthesized
aaggacagaatctgaactctgc

SEQ ID NO: 34973 - DNA, 22 bp, Artificial Sequence
  chemically synthesized
aactctgcttttatcagctgcg

SEQ ID NO: 34974 - DNA, 22 bp, Artificial Sequence
  chemically synthesized
tgcttttatcagctgcgaaaat

SEQ ID NO: 34975 - DNA, 22 bp, Artificial Sequence
  chemically synthesized
cttttatcagctgcgaaaatcc

SEQ ID NO: 34976 - DNA, 22 bp, Artificial Sequence
  chemically synthesized
ttatcagctgcgaaaatccaag

SEQ ID NO: 34977 - DNA, 22 bp, Artificial Sequence
  chemically synthesized
tatcagctgcgaaaatccaagc

SEQ ID NO: 34978 - DNA, 22 bp, Artificial Sequence
  chemically synthesized
atcagctgcgaaaatccaagca

SEQ ID NO: 34979 - DNA, 22 bp, Artificial Sequence
  chemically synthesized
tcagctgcgaaaatccaagcat

SEQ ID NO: 34980 - DNA, 22 bp, Artificial Sequence
  chemically synthesized
cgaaaatccaagcattcatttc

SEQ ID NO: 34981 - DNA, 22 bp, Artificial Sequence
  chemically synthesized
atttccagctggttcagtgcct

SEQ ID NO: 34982 - DNA, 22 bp, Artificial Sequence
  chemically synthesized
ccagctggttcagtgcctatgt

SEQ ID NO: 34983 - DNA, 22 bp, Artificial Sequence
  chemically synthesized
cagctggttcagtgcctatgta

SEQ ID NO: 34984 - DNA, 22 bp, Artificial Sequence
  chemically synthesized
gttcagtgcctatgtaaaagta

SEQ ID NO: 34985 - DNA, 22 bp, Artificial Sequence
  chemically synthesized
agtgcctatgtaaaagtatact

SEQ ID NO: 34986 - DNA, 22 bp, Artificial Sequence
  chemically synthesized
tgtaaaagtatactgtgtacaa

SEQ ID NO: 34987 - DNA, 22 bp, Artificial Sequence
  chemically synthesized
tgtacaaaaataagattaaaaa

SEQ ID NO: 34988 - DNA, 22 bp, Artificial Sequence
  chemically synthesized
aaaagctaacattaagcaagtg

SEQ ID NO: 34989 - DNA, 22 bp, Artificial Sequence
  chemically synthesized
acattaagcaagtgtgtttgta

SEQ ID NO: 34990 - DNA, 22 bp, Artificial Sequence
  chemically synthesized
agcaagtgtgtttgtatgtttt

SEQ ID NO: 34991 - DNA, 22 bp, Artificial Sequence
  chemically synthesized
gtatgttttctacagttcggat

SEQ ID NO: 34992 - DNA, 22 bp, Artificial Sequence
  chemically synthesized
tatgttttctacagttcggatt

SEQ ID NO: 34993 - DNA, 22 bp, Artificial Sequence
  chemically synthesized
tctacagttcggatttctgaat

SEQ ID NO: 34994 - DNA, 22 bp, Artificial Sequence
  chemically synthesized
ctacagttcggatttctgaata

SEQ ID NO: 34995 - DNA, 22 bp, Artificial Sequence
  chemically synthesized
tacagttcggatttctgaataa

SEQ ID NO: 34996 - DNA, 22 bp, Artificial Sequence
  chemically synthesized
cagttcggatttctgaataatt

SEQ ID NO: 34997 - DNA, 22 bp, Artificial Sequence
  chemically synthesized
ggatttctgaataatttgatcc

SEQ ID NO: 34998 - DNA, 22 bp, Artificial Sequence
  chemically synthesized
ctgaataatttgatccgacaga

SEQ ID NO: 34999 - DNA, 22 bp, Artificial Sequence
  chemically synthesized
tgaataatttgatccgacagaa

SEQ ID NO: 35000 - DNA, 22 bp, Artificial Sequence
  chemically synthesized
aataatttgatccgacagaaaa

SEQ ID NO: 35001 - DNA, 22 bp, Artificial Sequence
  chemically synthesized
gatccgacagaaaaatatgatt

SEQ ID NO: 35002 - DNA, 22 bp, Artificial Sequence
  chemically synthesized
atccgacagaaaaatatgattt

SEQ ID NO: 35003 - DNA, 22 bp, Artificial Sequence
  chemically synthesized
catttcttttcgagagaattat

SEQ ID NO: 35004 - DNA, 22 bp, Artificial Sequence
  chemically synthesized
atttcttttcgagagaattata

SEQ ID NO: 35005 - DNA, 22 bp, Artificial Sequence
  chemically synthesized
cttttcgagagaattatatgca

SEQ ID NO: 35006 - DNA, 22 bp, Artificial Sequence
  chemically synthesized
ttttcgagagaattatatgcat

SEQ ID NO: 35007 - DNA, 22 bp, Artificial Sequence
  chemically synthesized
ttcgagagaattatatgcatac

SEQ ID NO: 35008 - DNA, 22 bp, Artificial Sequence
  chemically synthesized
tcgagagaattatatgcatact

SEQ ID NO: 35009 - DNA, 22 bp, Artificial Sequence
  chemically synthesized
cgagagaattatatgcatactt

SEQ ID NO: 35010 - DNA, 22 bp, Artificial Sequence
  chemically synthesized
gagagaattatatgcatacttt

SEQ ID NO: 35011 - DNA, 22 bp, Artificial Sequence
  chemically synthesized
tatgcatactttctaaatgcaa

SEQ ID NO: 35012 - DNA, 22 bp, Artificial Sequence
  chemically synthesized
tctaaatgcaagaataaattcc

SEQ ID NO: 35013 - DNA, 22 bp, Artificial Sequence
  chemically synthesized
ctaaatgcaagaataaattcct

SEQ ID NO: 35014 - DNA, 22 bp, Artificial Sequence
  chemically synthesized
taaatgcaagaataaattcctg

SEQ ID NO: 35015 - DNA, 22 bp, Artificial Sequence
  chemically synthesized
aatgcaagaataaattcctgag

SEQ ID NO: 35016 - DNA, 22 bp, Artificial Sequence
  chemically synthesized
ctgagctccatgtgacttcagt

SEQ ID NO: 35017 - DNA, 22 bp, Artificial Sequence
  chemically synthesized
agctccatgtgacttcagtacc

SEQ ID NO: 35018 - DNA, 22 bp, Artificial Sequence
  chemically synthesized
catgtgacttcagtaccatcag

SEQ ID NO: 35019 - DNA, 22 bp, Artificial Sequence
  chemically synthesized
cagtaccatcagctctttggca

SEQ ID NO: 35020 - DNA, 22 bp, Artificial Sequence
  chemically synthesized
agtaccatcagctctttggcag

SEQ ID NO: 35021 - DNA, 22 bp, Artificial Sequence
  chemically synthesized
tttggcagcttatgagtataca

SEQ ID NO: 35022 - DNA, 22 bp, Artificial Sequence
  chemically synthesized
tggcagcttatgagtatacagc

SEQ ID NO: 35023 - DNA, 22 bp, Artificial Sequence
  chemically synthesized
ggcagcttatgagtatacagct

SEQ ID NO: 35024 - DNA, 22 bp, Artificial Sequence
  chemically synthesized
gcagcttatgagtatacagctt

SEQ ID NO: 35025 - DNA, 22 bp, Artificial Sequence
  chemically synthesized
atgagtatacagctttttaatt

SEQ ID NO: 35026 - DNA, 22 bp, Artificial Sequence
  chemically synthesized
tgagtatacagctttttaattc

SEQ ID NO: 35027 - DNA, 22 bp, Artificial Sequence
  chemically synthesized
tttaattctcacctggtcccca

SEQ ID NO: 35028 - DNA, 22 bp, Artificial Sequence
  chemically synthesized
ttaattctcacctggtccccag

SEQ ID NO: 35029 - DNA, 22 bp, Artificial Sequence
  chemically synthesized
taattctcacctggtccccagg

SEQ ID NO: 35030 - DNA, 22 bp, Artificial Sequence
  chemically synthesized
aattctcacctggtccccagga

SEQ ID NO: 35031 - DNA, 22 bp, Artificial Sequence
  chemically synthesized
attctcacctggtccccaggat

SEQ ID NO: 35032 - DNA, 22 bp, Artificial Sequence
  chemically synthesized
tcacctggtccccaggatatgg

SEQ ID NO: 35033 - DNA, 22 bp, Artificial Sequence
  chemically synthesized
acctggtccccaggatatggtt

SEQ ID NO: 35034 - DNA, 22 bp, Artificial Sequence
  chemically synthesized
gtccccaggatatggtttactt

SEQ ID NO: 35035 - DNA, 22 bp, Artificial Sequence
  chemically synthesized
acttgtcagagtagttttatga

SEQ ID NO: 35036 - DNA, 22 bp, Artificial Sequence
  chemically synthesized
cttgtcagagtagttttatgag

SEQ ID NO: 35037 - DNA, 22 bp, Artificial Sequence
  chemically synthesized
gtcagagtagttttatgaggtg

SEQ ID NO: 35038 - DNA, 22 bp, Artificial Sequence
  chemically synthesized
tcagagtagttttatgaggtgc

SEQ ID NO: 35039 - DNA, 22 bp, Artificial Sequence
  chemically synthesized
tatgaggtgctttctcctgact

SEQ ID NO: 35040 - DNA, 22 bp, Artificial Sequence
  chemically synthesized
atgaggtgctttctcctgactc

SEQ ID NO: 35041 - DNA, 22 bp, Artificial Sequence
  chemically synthesized
tgaggtgctttctcctgactct

SEQ ID NO: 35042 - DNA, 22 bp, Artificial Sequence
  chemically synthesized
tctcctgactctgattctaggt

SEQ ID NO: 35043 - DNA, 22 bp, Artificial Sequence
  chemically synthesized
ctcctgactctgattctaggta

SEQ ID NO: 35044 - DNA, 22 bp, Artificial Sequence
  chemically synthesized
tcctgactctgattctaggtaa

SEQ ID NO: 35045 - DNA, 22 bp, Artificial Sequence
  chemically synthesized
ctgactctgattctaggtaaca

SEQ ID NO: 35046 - DNA, 22 bp, Artificial Sequence
  chemically synthesized
actctgattctaggtaacacct

SEQ ID NO: 35047 - DNA, 22 bp, Artificial Sequence
  chemically synthesized
tgattctaggtaacacctgatg

SEQ ID NO: 35048 - DNA, 22 bp, Artificial Sequence
  chemically synthesized
attctaggtaacacctgatgag

SEQ ID NO: 35049 - DNA, 22 bp, Artificial Sequence
  chemically synthesized
taggtaacacctgatgagatga

SEQ ID NO: 35050 - DNA, 22 bp, Artificial Sequence
  chemically synthesized
ggtaacacctgatgagatgaac

SEQ ID NO: 35051 - DNA, 22 bp, Artificial Sequence
  chemically synthesized
atgagatgaacagatggtgcac

SEQ ID NO: 35052 - DNA, 22 bp, Artificial Sequence
  chemically synthesized
acttcctcttactgggcatgaa

SEQ ID NO: 35053 - DNA, 22 bp, Artificial Sequence
  chemically synthesized
cctcttactgggcatgaaggaa

SEQ ID NO: 35054 - DNA, 22 bp, Artificial Sequence
  chemically synthesized
ctcttactgggcatgaaggaaa

SEQ ID NO: 35055 - DNA, 22 bp, Artificial Sequence
  chemically synthesized
ttactgggcatgaaggaaagag

SEQ ID NO: 35056 - DNA, 22 bp, Artificial Sequence
  chemically synthesized
actgggcatgaaggaaagagag

SEQ ID NO: 35057 - DNA, 22 bp, Artificial Sequence
  chemically synthesized
ctgggcatgaaggaaagagaga

SEQ ID NO: 35058 - DNA, 22 bp, Artificial Sequence
  chemically synthesized
ggcatgaaggaaagagagagaa

SEQ ID NO: 35059 - DNA, 22 bp, Artificial Sequence
  chemically synthesized
ctgctacattttttttttctgt

SEQ ID NO: 35060 - DNA, 22 bp, Artificial Sequence
  chemically synthesized
ctacattttttttttctgtgga

SEQ ID NO: 35061 - DNA, 22 bp, Artificial Sequence
  chemically synthesized
cattttttttttctgtggaaaa

SEQ ID NO: 35062 - DNA, 22 bp, Artificial Sequence
  chemically synthesized
tttttttctgtggaaaaagagt

SEQ ID NO: 35063 - DNA, 22 bp, Artificial Sequence
  chemically synthesized
ttttttctgtggaaaaagagtc

SEQ ID NO: 35064 - DNA, 22 bp, Artificial Sequence
  chemically synthesized
tttttctgtggaaaaagagtct

SEQ ID NO: 35065 - DNA, 22 bp, Artificial Sequence
  chemically synthesized
ttttctgtggaaaaagagtcta

SEQ ID NO: 35066 - DNA, 22 bp, Artificial Sequence
  chemically synthesized
tttctgtggaaaaagagtctaa

SEQ ID NO: 35067 - DNA, 22 bp, Artificial Sequence
  chemically synthesized
ttctgtggaaaaagagtctaat

SEQ ID NO: 35068 - DNA, 22 bp, Artificial Sequence
  chemically synthesized
tctgtggaaaaagagtctaata

SEQ ID NO: 35069 - DNA, 22 bp, Artificial Sequence
  chemically synthesized
ctgtggaaaaagagtctaatat

SEQ ID NO: 35070 - DNA, 22 bp, Artificial Sequence
  chemically synthesized
tgtggaaaaagagtctaatatt

SEQ ID NO: 35071 - DNA, 22 bp, Artificial Sequence
  chemically synthesized
tggaaaaagagtctaatatttc

SEQ ID NO: 35072 - DNA, 22 bp, Artificial Sequence
  chemically synthesized
atatttctaattaaccttgatg

SEQ ID NO: 35073 - DNA, 22 bp, Artificial Sequence
  chemically synthesized
ctaattaaccttgatgggaaca

SEQ ID NO: 35074 - DNA, 22 bp, Artificial Sequence
  chemically synthesized
taattaaccttgatgggaacat

SEQ ID NO: 35075 - DNA, 22 bp, Artificial Sequence
  chemically synthesized
attaaccttgatgggaacatag

SEQ ID NO: 35076 - DNA, 22 bp, Artificial Sequence
  chemically synthesized
accttgatgggaacatagaaca

SEQ ID NO: 35077 - DNA, 22 bp, Artificial Sequence
  chemically synthesized
gatgggaacatagaacatagat

SEQ ID NO: 35078 - DNA, 22 bp, Artificial Sequence
  chemically synthesized
atgggaacatagaacatagatt

SEQ ID NO: 35079 - DNA, 22 bp, Artificial Sequence
  chemically synthesized
taaagggaacttgcacattatc

SEQ ID NO: 35080 - DNA, 22 bp, Artificial Sequence
  chemically synthesized
gcacattatcgcagtaggctga

SEQ ID NO: 35081 - DNA, 22 bp, Artificial Sequence
  chemically synthesized
cacattatcgcagtaggctgaa

SEQ ID NO: 35082 - DNA, 22 bp, Artificial Sequence
  chemically synthesized
tcgcagtaggctgaataatggc

SEQ ID NO: 35083 - DNA, 22 bp, Artificial Sequence
  chemically synthesized
aataatggctaatggctcactc

SEQ ID NO: 35084 - DNA, 22 bp, Artificial Sequence
  chemically synthesized
atggctcactctgaaagatatg

SEQ ID NO: 35085 - DNA, 22 bp, Artificial Sequence
  chemically synthesized
actctgaaagatatgtatggct

SEQ ID NO: 35086 - DNA, 22 bp, Artificial Sequence
  chemically synthesized
tgaaagatatgtatggcttaac

SEQ ID NO: 35087 - DNA, 22 bp, Artificial Sequence
  chemically synthesized
aaagatatgtatggcttaaccc

SEQ ID NO: 35088 - DNA, 22 bp, Artificial Sequence
  chemically synthesized
aacccctgaaacctgtgagtat

SEQ ID NO: 35089 - DNA, 22 bp, Artificial Sequence
  chemically synthesized
acccctgaaacctgtgagtatt

SEQ ID NO: 35090 - DNA, 22 bp, Artificial Sequence
  chemically synthesized
aaacctgtgagtattatctttt

SEQ ID NO: 35091 - DNA, 22 bp, Artificial Sequence
  chemically synthesized
tgagtattatcttttctagcca

SEQ ID NO: 35092 - DNA, 22 bp, Artificial Sequence
  chemically synthesized
tcttttctagccaaacagactt

SEQ ID NO: 35093 - DNA, 22 bp, Artificial Sequence
  chemically synthesized
ttctagccaaacagacttttgc

SEQ ID NO: 35094 - DNA, 22 bp, Artificial Sequence
  chemically synthesized
tctagccaaacagacttttgca

SEQ ID NO: 35095 - DNA, 22 bp, Artificial Sequence
  chemically synthesized
ctagccaaacagacttttgcat

SEQ ID NO: 35096 - DNA, 22 bp, Artificial Sequence
  chemically synthesized
tagccaaacagacttttgcata

SEQ ID NO: 35097 - DNA, 22 bp, Artificial Sequence
  chemically synthesized
gccaaacagacttttgcatata

SEQ ID NO: 35098 - DNA, 22 bp, Artificial Sequence
  chemically synthesized
ttgcatatataattaaggatct

SEQ ID NO: 35099 - DNA, 22 bp, Artificial Sequence
  chemically synthesized
tgcatatataattaaggatctt

SEQ ID NO: 35100 - DNA, 22 bp, Artificial Sequence
  chemically synthesized
gcatatataattaaggatcttg

SEQ ID NO: 35101 - DNA, 22 bp, Artificial Sequence
  chemically synthesized
catatataattaaggatcttgg

SEQ ID NO: 35102 - DNA, 22 bp, Artificial Sequence
  chemically synthesized
aggatcttgggatggggagata

SEQ ID NO: 35103 - DNA, 22 bp, Artificial Sequence
  chemically synthesized
gggatggggagatatcctaatt

SEQ ID NO: 35104 - DNA, 22 bp, Artificial Sequence
  chemically synthesized
ggatggggagatatcctaatta

SEQ ID NO: 35105 - DNA, 22 bp, Artificial Sequence
  chemically synthesized
attatttgggtgtatcctaaat

SEQ ID NO: 35106 - DNA, 22 bp, Artificial Sequence
  chemically synthesized
tttgggtgtatcctaaatgtaa

SEQ ID NO: 35107 - DNA, 22 bp, Artificial Sequence
  chemically synthesized
gggtgtatcctaaatgtaatca

SEQ ID NO: 35108 - DNA, 22 bp, Artificial Sequence
  chemically synthesized
ggtgtatcctaaatgtaatcac

SEQ ID NO: 35109 - DNA, 22 bp, Artificial Sequence
  chemically synthesized
aatgtaatcacaagtgtcatta

SEQ ID NO: 35110 - DNA, 22 bp, Artificial Sequence
  chemically synthesized
taagagggaggcaaagggagat

SEQ ID NO: 35111 - DNA, 22 bp, Artificial Sequence
  chemically synthesized
gacttataagaggagaaaatgt

SEQ ID NO: 35112 - DNA, 22 bp, Artificial Sequence
  chemically synthesized
acttataagaggagaaaatgtg

SEQ ID NO: 35113 - DNA, 22 bp, Artificial Sequence
  chemically synthesized
ataagaggagaaaatgtgacgt

SEQ ID NO: 35114 - DNA, 22 bp, Artificial Sequence
  chemically synthesized
taagaggagaaaatgtgacgtg

SEQ ID NO: 35115 - DNA, 22 bp, Artificial Sequence
  chemically synthesized
caaaagcagagatacatttttt

SEQ ID NO: 35116 - DNA, 22 bp, Artificial Sequence
  chemically synthesized
ttttgaagatcgaggaagaggc

SEQ ID NO: 35117 - DNA, 22 bp, Artificial Sequence
  chemically synthesized
tttgaagatcgaggaagaggct

SEQ ID NO: 35118 - DNA, 22 bp, Artificial Sequence
  chemically synthesized
ttgaagatcgaggaagaggcta

SEQ ID NO: 35119 - DNA, 22 bp, Artificial Sequence
  chemically synthesized
tgaagatcgaggaagaggctac

SEQ ID NO: 35120 - DNA, 22 bp, Artificial Sequence
  chemically synthesized
gaagatcgaggaagaggctaca

SEQ ID NO: 35121 - DNA, 22 bp, Artificial Sequence
  chemically synthesized
aagatcgaggaagaggctacaa

SEQ ID NO: 35122 - DNA, 22 bp, Artificial Sequence
  chemically synthesized
caaaccaaggaatgtgggtagc

SEQ ID NO: 35123 - DNA, 22 bp, Artificial Sequence
  chemically synthesized
tagaagaggaaacagaatccat

SEQ ID NO: 35124 - DNA, 22 bp, Artificial Sequence
  chemically synthesized
gaagaggaaacagaatccatgg

SEQ ID NO: 35125 - DNA, 22 bp, Artificial Sequence
  chemically synthesized
tcatagagtctccagaagaaac

SEQ ID NO: 35126 - DNA, 22 bp, Artificial Sequence
  chemically synthesized
atagagtctccagaagaaacag

SEQ ID NO: 35127 - DNA, 22 bp, Artificial Sequence
  chemically synthesized
cagaagaaacagccacactgac

SEQ ID NO: 35128 - DNA, 22 bp, Artificial Sequence
  chemically synthesized
acacctcgactttagcccagtg

SEQ ID NO: 35129 - DNA, 22 bp, Artificial Sequence
  chemically synthesized
gactttagcccagtgaaaccga

SEQ ID NO: 35130 - DNA, 22 bp, Artificial Sequence
  chemically synthesized
tagcccagtgaaaccgatttca

SEQ ID NO: 35131 - DNA, 22 bp, Artificial Sequence
  chemically synthesized
agcccagtgaaaccgatttcag

SEQ ID NO: 35132 - DNA, 22 bp, Artificial Sequence
  chemically synthesized
gcccagtgaaaccgatttcaga

SEQ ID NO: 35133 - DNA, 22 bp, Artificial Sequence
  chemically synthesized
cagacttctgacctccacaact

SEQ ID NO: 35134 - DNA, 22 bp, Artificial Sequence
  chemically synthesized
agacttctgacctccacaactt

SEQ ID NO: 35135 - DNA, 22 bp, Artificial Sequence
  chemically synthesized
ctgacctccacaacttcaagat

SEQ ID NO: 35136 - DNA, 22 bp, Artificial Sequence
  chemically synthesized
tgacctccacaacttcaagata

SEQ ID NO: 35137 - DNA, 22 bp, Artificial Sequence
  chemically synthesized
acctccacaacttcaagataat

SEQ ID NO: 35138 - DNA, 22 bp, Artificial Sequence
  chemically synthesized
cacaacttcaagataatacatt

SEQ ID NO: 35139 - DNA, 22 bp, Artificial Sequence
  chemically synthesized
caagataatacatttgtgttgt

SEQ ID NO: 35140 - DNA, 22 bp, Artificial Sequence
  chemically synthesized
aagataatacatttgtgttgtt

SEQ ID NO: 35141 - DNA, 22 bp, Artificial Sequence
  chemically synthesized
gtgttgttttaagccaataaat

SEQ ID NO: 35142 - DNA, 22 bp, Artificial Sequence
  chemically synthesized
tgttgttttaagccaataaatt

SEQ ID NO: 35143 - DNA, 22 bp, Artificial Sequence
  chemically synthesized
ttttaagccaataaatttgtgg

SEQ ID NO: 35144 - DNA, 22 bp, Artificial Sequence
  chemically synthesized
taagccaataaatttgtggtaa

SEQ ID NO: 35145 - DNA, 22 bp, Artificial Sequence
  chemically synthesized
aagccaataaatttgtggtaat

SEQ ID NO: 35146 - DNA, 22 bp, Artificial Sequence
  chemically synthesized
agccaataaatttgtggtaatt

SEQ ID NO: 35147 - DNA, 22 bp, Artificial Sequence
  chemically synthesized
gtggtaattttttacagcagca

SEQ ID NO: 35148 - DNA, 22 bp, Artificial Sequence
  chemically synthesized
tggtaattttttacagcagcaa

SEQ ID NO: 35149 - DNA, 22 bp, Artificial Sequence
  chemically synthesized
tttacagcagcaagaggaaatc

SEQ ID NO: 35150 - DNA, 22 bp, Artificial Sequence
  chemically synthesized
ttacagcagcaagaggaaatca

SEQ ID NO: 35151 - DNA, 22 bp, Artificial Sequence
  chemically synthesized
tacagcagcaagaggaaatcag

SEQ ID NO: 35152 - DNA, 22 bp, Artificial Sequence
  chemically synthesized
acagcagcaagaggaaatcagt

SEQ ID NO: 35153 - DNA, 22 bp, Artificial Sequence
  chemically synthesized
cagcagcaagaggaaatcagtt

SEQ ID NO: 35154 - DNA, 22 bp, Artificial Sequence
  chemically synthesized
cgtagaatagtaggtcctgtct

SEQ ID NO: 35155 - DNA, 22 bp, Artificial Sequence
  chemically synthesized
tctctggctaatcattagaatc

SEQ ID NO: 35156 - DNA, 22 bp, Artificial Sequence
  chemically synthesized
tggctaatcattagaatcactc

SEQ ID NO: 35157 - DNA, 22 bp, Artificial Sequence
  chemically synthesized
gctaatcattagaatcactcca

SEQ ID NO: 35158 - DNA, 22 bp, Artificial Sequence
  chemically synthesized
atcattagaatcactccagaag

SEQ ID NO: 35159 - DNA, 22 bp, Artificial Sequence
  chemically synthesized
gaatcactccagaagcttgtta

SEQ ID NO: 35160 - DNA, 22 bp, Artificial Sequence
  chemically synthesized
cagaagcttgttacatacagac

SEQ ID NO: 35161 - DNA, 22 bp, Artificial Sequence
  chemically synthesized
gttacatacagacccagagcca

SEQ ID NO: 35162 - DNA, 22 bp, Artificial Sequence
  chemically synthesized
ttacatacagacccagagccag

SEQ ID NO: 35163 - DNA, 22 bp, Artificial Sequence
  chemically synthesized
catacagacccagagccagtga

SEQ ID NO: 35164 - DNA, 22 bp, Artificial Sequence
  chemically synthesized
ggtggtggggcccagagcctga

SEQ ID NO: 35165 - DNA, 22 bp, Artificial Sequence
  chemically synthesized
gtggtggggcccagagcctgaa

SEQ ID NO: 35166 - DNA, 22 bp, Artificial Sequence
  chemically synthesized
aatattaagcaagttcttcgtt

SEQ ID NO: 35167 - DNA, 22 bp, Artificial Sequence
  chemically synthesized
agcaagttcttcgttttagaaa

SEQ ID NO: 35168 - DNA, 22 bp, Artificial Sequence
  chemically synthesized
ttcgttttagaaatgaggaaac

SEQ ID NO: 35169 - DNA, 22 bp, Artificial Sequence
  chemically synthesized
cgttttagaaatgaggaaacca

SEQ ID NO: 35170 - DNA, 22 bp, Artificial Sequence
  chemically synthesized
gttttagaaatgaggaaaccaa

SEQ ID NO: 35171 - DNA, 22 bp, Artificial Sequence
  chemically synthesized
tagaaatgaggaaaccaaggtt

SEQ ID NO: 35172 - DNA, 22 bp, Artificial Sequence
  chemically synthesized
agaaatgaggaaaccaaggttg

SEQ ID NO: 35173 - DNA, 22 bp, Artificial Sequence
  chemically synthesized
gaaatgaggaaaccaaggttgg

SEQ ID NO: 35174 - DNA, 22 bp, Artificial Sequence
  chemically synthesized
ggagaagctaagcaacttactc

SEQ ID NO: 35175 - DNA, 22 bp, Artificial Sequence
  chemically synthesized
agcaacttactcaaatacatag

SEQ ID NO: 35176 - DNA, 22 bp, Artificial Sequence
  chemically synthesized
actcaaatacatagggtatttc

SEQ ID NO: 35177 - DNA, 22 bp, Artificial Sequence
  chemically synthesized
ctcaaatacatagggtatttca

SEQ ID NO: 35178 - DNA, 22 bp, Artificial Sequence
  chemically synthesized
aaatacatagggtatttcattt

SEQ ID NO: 35179 - DNA, 22 bp, Artificial Sequence
  chemically synthesized
cattttaaatttaattttatta

SEQ ID NO: 35180 - DNA, 22 bp, Artificial Sequence
  chemically synthesized
attttaaatttaattttattac

SEQ ID NO: 35181 - DNA, 22 bp, Artificial Sequence
  chemically synthesized
taaatttaattttattacttta

SEQ ID NO: 35182 - DNA, 22 bp, Artificial Sequence
  chemically synthesized
aaatttaattttattactttat

SEQ ID NO: 35183 - DNA, 22 bp, Artificial Sequence
  chemically synthesized
aatttaattttattactttatc

SEQ ID NO: 35184 - DNA, 22 bp, Artificial Sequence
  chemically synthesized
aattttattactttatcttttg

SEQ ID NO: 35185 - DNA, 22 bp, Artificial Sequence
  chemically synthesized
attttattactttatcttttga

SEQ ID NO: 35186 - DNA, 22 bp, Artificial Sequence
  chemically synthesized
tattactttatcttttgaattt

SEQ ID NO: 35187 - DNA, 22 bp, Artificial Sequence
  chemically synthesized
attactttatcttttgaatttt

SEQ ID NO: 35188 - DNA, 22 bp, Artificial Sequence
  chemically synthesized
ttactttatcttttgaattttc

SEQ ID NO: 35189 - DNA, 22 bp, Artificial Sequence
  chemically synthesized
ctttatcttttgaattttctta

SEQ ID NO: 35190 - DNA, 22 bp, Artificial Sequence
  chemically synthesized
tatcttttgaattttcttaccc

SEQ ID NO: 35191 - DNA, 22 bp, Artificial Sequence
  chemically synthesized
atcttttgaattttcttacccc

SEQ ID NO: 35192 - DNA, 22 bp, Artificial Sequence
  chemically synthesized
tcttttgaattttcttacccca

SEQ ID NO: 35193 - DNA, 22 bp, Artificial Sequence
  chemically synthesized
ttgaattttcttaccccagttg

SEQ ID NO: 35194 - DNA, 22 bp, Artificial Sequence
  chemically synthesized
tgaattttcttaccccagttgt

SEQ ID NO: 35195 - DNA, 22 bp, Artificial Sequence
  chemically synthesized
gaattttcttaccccagttgta

SEQ ID NO: 35196 - DNA, 22 bp, Artificial Sequence
  chemically synthesized
aattttcttaccccagttgtac

SEQ ID NO: 35197 - DNA, 22 bp, Artificial Sequence
  chemically synthesized
tcttaccccagttgtacttttg

SEQ ID NO: 35198 - DNA, 22 bp, Artificial Sequence
  chemically synthesized
cttaccccagttgtacttttgt

SEQ ID NO: 35199 - DNA, 22 bp, Artificial Sequence
  chemically synthesized
ttaccccagttgtacttttgtg

SEQ ID NO: 35200 - DNA, 22 bp, Artificial Sequence
  chemically synthesized
accccagttgtacttttgtgta

SEQ ID NO: 35201 - DNA, 22 bp, Artificial Sequence
  chemically synthesized
ccccagttgtacttttgtgtaa

SEQ ID NO: 35202 - DNA, 22 bp, Artificial Sequence
  chemically synthesized
tacttttgtgtaaatgtgattt

SEQ ID NO: 35203 - DNA, 22 bp, Artificial Sequence
  chemically synthesized
ttgtgtaaatgtgatttcattt

SEQ ID NO: 35204 - DNA, 22 bp, Artificial Sequence
  chemically synthesized
tgtgtaaatgtgatttcattta

SEQ ID NO: 35205 - DNA, 22 bp, Artificial Sequence
  chemically synthesized
gtgtaaatgtgatttcatttac

SEQ ID NO: 35206 - DNA, 22 bp, Artificial Sequence
  chemically synthesized
tgtaaatgtgatttcatttacg

SEQ ID NO: 35207 - DNA, 22 bp, Artificial Sequence
  chemically synthesized
catttacggctttgtgttgaca

SEQ ID NO: 35208 - DNA, 22 bp, Artificial Sequence
  chemically synthesized
atttacggctttgtgttgacat

SEQ ID NO: 35209 - DNA, 22 bp, Artificial Sequence
  chemically synthesized
acggctttgtgttgacatattc

SEQ ID NO: 35210 - DNA, 22 bp, Artificial Sequence
  chemically synthesized
cggctttgtgttgacatattca

SEQ ID NO: 35211 - DNA, 22 bp, Artificial Sequence
  chemically synthesized
tgtgttgacatattcattaaaa

SEQ ID NO: 35212 - DNA, 22 bp, Artificial Sequence
  chemically synthesized
gtgttgacatattcattaaaat

SEQ ID NO: 35213 - DNA, 22 bp, Artificial Sequence
  chemically synthesized
tgttgacatattcattaaaatg

SEQ ID NO: 35214 - DNA, 22 bp, Artificial Sequence
  chemically synthesized
acatattcattaaaatgaagaa

SEQ ID NO: 35215 - DNA, 22 bp, Artificial Sequence
  chemically synthesized
attaaaatgaagaaataaaaga

SEQ ID NO: 35216 - DNA, 22 bp, Artificial Sequence
  chemically synthesized
aaatgaagaaataaaagatgag

SEQ ID NO: 35217 - DNA, 22 bp, Artificial Sequence
  chemically synthesized
taaaaattatataatgtttatt

SEQ ID NO: 35218 - DNA, 22 bp, Artificial Sequence
  chemically synthesized
aaaaattatataatgtttattg

SEQ ID NO: 35219 - DNA, 22 bp, Artificial Sequence
  chemically synthesized
aaaattatataatgtttattga

SEQ ID NO: 35220 - DNA, 22 bp, Artificial Sequence
  chemically synthesized
tataatgtttattgattagaat

SEQ ID NO: 35221 - DNA, 22 bp, Artificial Sequence
  chemically synthesized
attgattagaatgaatatgatg

SEQ ID NO: 35222 - DNA, 22 bp, Artificial Sequence
  chemically synthesized
ttgattagaatgaatatgatgc

SEQ ID NO: 35223 - DNA, 22 bp, Artificial Sequence
  chemically synthesized
attagaatgaatatgatgcaat

SEQ ID NO: 35224 - DNA, 22 bp, Artificial Sequence
  chemically synthesized
gaatgaatatgatgcaatctgg

SEQ ID NO: 35225 - DNA, 22 bp, Artificial Sequence
  chemically synthesized
gttttctgtgttcagattcctg

SEQ ID NO: 35226 - DNA, 22 bp, Artificial Sequence
  chemically synthesized
tctgtgttcagattcctgacct

SEQ ID NO: 35227 - DNA, 22 bp, Artificial Sequence
  chemically synthesized
ctgtgttcagattcctgacctc

SEQ ID NO: 35228 - DNA, 22 bp, Artificial Sequence
  chemically synthesized
tgtgttcagattcctgacctct

SEQ ID NO: 35229 - DNA, 22 bp, Artificial Sequence
  chemically synthesized
tgttcagattcctgacctctgg

SEQ ID NO: 35230 - DNA, 22 bp, Artificial Sequence
  chemically synthesized
agattcctgacctctggagtta

SEQ ID NO: 35231 - DNA, 22 bp, Artificial Sequence
  chemically synthesized
ctgacctctggagttaaccttt

SEQ ID NO: 35232 - DNA, 22 bp, Artificial Sequence
  chemically synthesized
acctctggagttaacctttctt

SEQ ID NO: 35233 - DNA, 22 bp, Artificial Sequence
  chemically synthesized
tggagttaacctttctttgtaa

SEQ ID NO: 35234 - DNA, 22 bp, Artificial Sequence
  chemically synthesized
gagttaacctttctttgtaaag

SEQ ID NO: 35235 - DNA, 22 bp, Artificial Sequence
  chemically synthesized
acctttctttgtaaagattaga

SEQ ID NO: 35236 - DNA, 22 bp, Artificial Sequence
  chemically synthesized
tctttgtaaagattagacagca

SEQ ID NO: 35237 - DNA, 22 bp, Artificial Sequence
  chemically synthesized
ctttgtaaagattagacagcag

SEQ ID NO: 35238 - DNA, 22 bp, Artificial Sequence
  chemically synthesized
tttgtaaagattagacagcagg

SEQ ID NO: 35239 - DNA, 22 bp, Artificial Sequence
  chemically synthesized
tgtaaagattagacagcaggca

SEQ ID NO: 35240 - DNA, 22 bp, Artificial Sequence
  chemically synthesized
gtaaagattagacagcaggcag

SEQ ID NO: 35241 - DNA, 22 bp, Artificial Sequence
  chemically synthesized
taaagattagacagcaggcagg

SEQ ID NO: 35242 - DNA, 22 bp, Artificial Sequence
  chemically synthesized
gacagcaggcagggaagaatgc

SEQ ID NO: 35243 - DNA, 22 bp, Artificial Sequence
  chemically synthesized
tgaaactgagagcaaagactgg

SEQ ID NO: 35244 - DNA, 22 bp, Artificial Sequence
  chemically synthesized
gaaactgagagcaaagactggc

SEQ ID NO: 35245 - DNA, 22 bp, Artificial Sequence
  chemically synthesized
aaactgagagcaaagactggca

SEQ ID NO: 35246 - DNA, 22 bp, Artificial Sequence
  chemically synthesized
agagcaaagactggcatgcaat

SEQ ID NO: 35247 - DNA, 22 bp, Artificial Sequence
  chemically synthesized
gcatgcaatttacattgatgtc

SEQ ID NO: 35248 - DNA, 22 bp, Artificial Sequence
  chemically synthesized
acattgatgtcctggtgctgtg

SEQ ID NO: 35249 - DNA, 22 bp, Artificial Sequence
  chemically synthesized
cattgatgtcctggtgctgtgc

SEQ ID NO: 35250 - DNA, 22 bp, Artificial Sequence
  chemically synthesized
atgtcctggtgctgtgcataat

SEQ ID NO: 35251 - DNA, 22 bp, Artificial Sequence
  chemically synthesized
gtgctgtgcataataagttgct

SEQ ID NO: 35252 - DNA, 22 bp, Artificial Sequence
  chemically synthesized
tgcataataagttgcttaaaca

SEQ ID NO: 35253 - DNA, 22 bp, Artificial Sequence
  chemically synthesized
cttaaacatgacagcaggatag

SEQ ID NO: 35254 - DNA, 22 bp, Artificial Sequence
  chemically synthesized
aaacatgacagcaggataggat

SEQ ID NO: 35255 - DNA, 22 bp, Artificial Sequence
  chemically synthesized
aacatgacagcaggataggatt

SEQ ID NO: 35256 - DNA, 22 bp, Artificial Sequence
  chemically synthesized
tacataaaatttatttataaat

SEQ ID NO: 35257 - DNA, 22 bp, Artificial Sequence
  chemically synthesized
acataaaatttatttataaatg

SEQ ID NO: 35258 - DNA, 22 bp, Artificial Sequence
  chemically synthesized
cataaaatttatttataaatgg

SEQ ID NO: 35259 - DNA, 22 bp, Artificial Sequence
  chemically synthesized
atttataaatggtaaagatgtt

SEQ ID NO: 35260 - DNA, 22 bp, Artificial Sequence
  chemically synthesized
tttataaatggtaaagatgttt

SEQ ID NO: 35261 - DNA, 22 bp, Artificial Sequence
  chemically synthesized
ataaatggtaaagatgtttcca

SEQ ID NO: 35262 - DNA, 22 bp, Artificial Sequence
  chemically synthesized
taaatggtaaagatgtttccaa

SEQ ID NO: 35263 - DNA, 22 bp, Artificial Sequence
  chemically synthesized
ccaacctctgctgaacttcctc

SEQ ID NO: 35264 - DNA, 22 bp, Artificial Sequence
  chemically synthesized
caacctctgctgaacttcctca

SEQ ID NO: 35265 - DNA, 22 bp, Artificial Sequence
  chemically synthesized
tgctgaacttcctcatagaatg

SEQ ID NO: 35266 - DNA, 22 bp, Artificial Sequence
  chemically synthesized
ctgaacttcctcatagaatgtt

SEQ ID NO: 35267 - DNA, 22 bp, Artificial Sequence
  chemically synthesized
aacttcctcatagaatgttcat

SEQ ID NO: 35268 - DNA, 22 bp, Artificial Sequence
  chemically synthesized
cctcatagaatgttcatcagaa

SEQ ID NO: 35269 - DNA, 22 bp, Artificial Sequence
  chemically synthesized
ctcatagaatgttcatcagaaa

SEQ ID NO: 35270 - DNA, 22 bp, Artificial Sequence
  chemically synthesized
atagaatgttcatcagaaaaca

SEQ ID NO: 35271 - DNA, 22 bp, Artificial Sequence
  chemically synthesized
atcagaaaacaaagtttctatc

SEQ ID NO: 35272 - DNA, 22 bp, Artificial Sequence
  chemically synthesized
ctatctactctttcttccaaga

SEQ ID NO: 35273 - DNA, 22 bp, Artificial Sequence
  chemically synthesized
tatctactctttcttccaagac

SEQ ID NO: 35274 - DNA, 22 bp, Artificial Sequence
  chemically synthesized
tctactctttcttccaagactt

SEQ ID NO: 35275 - DNA, 22 bp, Artificial Sequence
  chemically synthesized
ctctttcttccaagacttcaac

SEQ ID NO: 35276 - DNA, 22 bp, Artificial Sequence
  chemically synthesized
tttcttccaagacttcaactcc

SEQ ID NO: 35277 - DNA, 22 bp, Artificial Sequence
  chemically synthesized
tcttccaagacttcaactccta

SEQ ID NO: 35278 - DNA, 22 bp, Artificial Sequence
  chemically synthesized
cttccaagacttcaactcctac

SEQ ID NO: 35279 - DNA, 22 bp, Artificial Sequence
  chemically synthesized
ttccaagacttcaactcctacc

SEQ ID NO: 35280 - DNA, 22 bp, Artificial Sequence
  chemically synthesized
ccaagacttcaactcctaccac

SEQ ID NO: 35281 - DNA, 22 bp, Artificial Sequence
  chemically synthesized
caagacttcaactcctaccact

SEQ ID NO: 35282 - DNA, 22 bp, Artificial Sequence
  chemically synthesized
caactcctaccactgacatcat

SEQ ID NO: 35283 - DNA, 22 bp, Artificial Sequence
  chemically synthesized
aactcctaccactgacatcatg

SEQ ID NO: 35284 - DNA, 22 bp, Artificial Sequence
  chemically synthesized
ctaccactgacatcatgaccct

SEQ ID NO: 35285 - DNA, 22 bp, Artificial Sequence
  chemically synthesized
ccactgacatcatgaccctcag

SEQ ID NO: 35286 - DNA, 22 bp, Artificial Sequence
  chemically synthesized
acatcatgaccctcagttctat

SEQ ID NO: 35287 - DNA, 22 bp, Artificial Sequence
  chemically synthesized
agttctattcccctagccctgc

SEQ ID NO: 35288 - DNA, 22 bp, Artificial Sequence
  chemically synthesized
tattcccctagccctgcccact

SEQ ID NO: 35289 - DNA, 22 bp, Artificial Sequence
  chemically synthesized
ttcccctagccctgcccactcc

SEQ ID NO: 35290 - DNA, 22 bp, Artificial Sequence
  chemically synthesized
ccctagccctgcccactcccct

SEQ ID NO: 35291 - DNA, 22 bp, Artificial Sequence
  chemically synthesized
gccctgcccactcccctgaaat

SEQ ID NO: 35292 - DNA, 22 bp, Artificial Sequence
  chemically synthesized
cccactcccctgaaatccagat

SEQ ID NO: 35293 - DNA, 22 bp, Artificial Sequence
  chemically synthesized
ccctgaaatccagatccataaa

SEQ ID NO: 35294 - DNA, 22 bp, Artificial Sequence
  chemically synthesized
aaatccagatccataaatccaa

SEQ ID NO: 35295 - DNA, 22 bp, Artificial Sequence
  chemically synthesized
ggtatctcagtttggctgtccc

SEQ ID NO: 35296 - DNA, 22 bp, Artificial Sequence
  chemically synthesized
agtttggctgtccctccatcaa

SEQ ID NO: 35297 - DNA, 22 bp, Artificial Sequence
  chemically synthesized
ggctgtccctccatcaactcaa

SEQ ID NO: 35298 - DNA, 22 bp, Artificial Sequence
  chemically synthesized
gctgtccctccatcaactcaaa

SEQ ID NO: 35299 - DNA, 22 bp, Artificial Sequence
  chemically synthesized
tccctccatcaactcaaatttg

SEQ ID NO: 35300 - DNA, 22 bp, Artificial Sequence
  chemically synthesized
catcaactcaaatttggctgac

SEQ ID NO: 35301 - DNA, 22 bp, Artificial Sequence
  chemically synthesized
aaatttggctgacacagttttg

SEQ ID NO: 35302 - DNA, 22 bp, Artificial Sequence
  chemically synthesized
ggctgacacagttttggattct

SEQ ID NO: 35303 - DNA, 22 bp, Artificial Sequence
  chemically synthesized
gctgacacagttttggattcta

SEQ ID NO: 35304 - DNA, 22 bp, Artificial Sequence
  chemically synthesized
acacagttttggattctagagc

SEQ ID NO: 35305 - DNA, 22 bp, Artificial Sequence
  chemically synthesized
tggattctagagcatgcaggca

SEQ ID NO: 35306 - DNA, 22 bp, Artificial Sequence
  chemically synthesized
ggattctagagcatgcaggcat

SEQ ID NO: 35307 - DNA, 22 bp, Artificial Sequence
  chemically synthesized
gattctagagcatgcaggcatt

SEQ ID NO: 35308 - DNA, 22 bp, Artificial Sequence
  chemically synthesized
tagagcatgcaggcattctgta

SEQ ID NO: 35309 - DNA, 22 bp, Artificial Sequence
  chemically synthesized
gagcatgcaggcattctgtatg

SEQ ID NO: 35310 - DNA, 22 bp, Artificial Sequence
  chemically synthesized
tgtatgtgctgtgcctttgcac

SEQ ID NO: 35311 - DNA, 22 bp, Artificial Sequence
  chemically synthesized
tatgtgctgtgcctttgcactc

SEQ ID NO: 35312 - DNA, 22 bp, Artificial Sequence
  chemically synthesized
tgcctttgcactcactcttccc

SEQ ID NO: 35313 - DNA, 22 bp, Artificial Sequence
  chemically synthesized
tgcactcactcttccctccaga

SEQ ID NO: 35314 - DNA, 22 bp, Artificial Sequence
  chemically synthesized
gcactcactcttccctccagac

SEQ ID NO: 35315 - DNA, 22 bp, Artificial Sequence
  chemically synthesized
cactcactcttccctccagacc

SEQ ID NO: 35316 - DNA, 22 bp, Artificial Sequence
  chemically synthesized
actcttccctccagaccccgtc

SEQ ID NO: 35317 - DNA, 22 bp, Artificial Sequence
  chemically synthesized
ttccctccagaccccgtccttc

SEQ ID NO: 35318 - DNA, 22 bp, Artificial Sequence
  chemically synthesized
ccctccagaccccgtccttcct

SEQ ID NO: 35319 - DNA, 22 bp, Artificial Sequence
  chemically synthesized
cctccagaccccgtccttcctc

SEQ ID NO: 35320 - DNA, 22 bp, Artificial Sequence
  chemically synthesized
cagaccccgtccttcctcactt

SEQ ID NO: 35321 - DNA, 22 bp, Artificial Sequence
  chemically synthesized
cctcactttgccagttccaact

SEQ ID NO: 35322 - DNA, 22 bp, Artificial Sequence
  chemically synthesized
ctcactttgccagttccaactt

SEQ ID NO: 35323 - DNA, 22 bp, Artificial Sequence
  chemically synthesized
actttgccagttccaacttctc

SEQ ID NO: 35324 - DNA, 22 bp, Artificial Sequence
  chemically synthesized
tgccagttccaacttctctctg

SEQ ID NO: 35325 - DNA, 22 bp, Artificial Sequence
  chemically synthesized
gccagttccaacttctctctga

SEQ ID NO: 35326 - DNA, 22 bp, Artificial Sequence
  chemically synthesized
ccagttccaacttctctctgaa

SEQ ID NO: 35327 - DNA, 22 bp, Artificial Sequence
  chemically synthesized
caacttctctctgaagactcag

SEQ ID NO: 35328 - DNA, 22 bp, Artificial Sequence
  chemically synthesized
ctctctgaagactcagtttagg

SEQ ID NO: 35329 - DNA, 22 bp, Artificial Sequence
  chemically synthesized
tctctgaagactcagtttaggt

SEQ ID NO: 35330 - DNA, 22 bp, Artificial Sequence
  chemically synthesized
tctgaagactcagtttaggtac

SEQ ID NO: 35331 - DNA, 22 bp, Artificial Sequence
  chemically synthesized
tgaagactcagtttaggtacag

SEQ ID NO: 35332 - DNA, 22 bp, Artificial Sequence
  chemically synthesized
aagactcagtttaggtacaggc

SEQ ID NO: 35333 - DNA, 22 bp, Artificial Sequence
  chemically synthesized
agtttaggtacaggctccttta

SEQ ID NO: 35334 - DNA, 22 bp, Artificial Sequence
  chemically synthesized
aggtacaggctcctttaggaaa

SEQ ID NO: 35335 - DNA, 22 bp, Artificial Sequence
  chemically synthesized
ggtacaggctcctttaggaaat

SEQ ID NO: 35336 - DNA, 22 bp, Artificial Sequence
  chemically synthesized
ctttaggaaatttttttttgac

SEQ ID NO: 35337 - DNA, 22 bp, Artificial Sequence
  chemically synthesized
taggaaatttttttttgactct

SEQ ID NO: 35338 - DNA, 22 bp, Artificial Sequence
  chemically synthesized
aggaaatttttttttgactcta

SEQ ID NO: 35339 - DNA, 22 bp, Artificial Sequence
  chemically synthesized
ggaaatttttttttgactctac

SEQ ID NO: 35340 - DNA, 22 bp, Artificial Sequence
  chemically synthesized
ttttttgactctacctagccca

SEQ ID NO: 35341 - DNA, 22 bp, Artificial Sequence
  chemically synthesized
tttttgactctacctagcccag

SEQ ID NO: 35342 - DNA, 22 bp, Artificial Sequence
  chemically synthesized
ttttgactctacctagcccaga

SEQ ID NO: 35343 - DNA, 22 bp, Artificial Sequence
  chemically synthesized
tttgactctacctagcccagac

SEQ ID NO: 35344 - DNA, 22 bp, Artificial Sequence
  chemically synthesized
ttgactctacctagcccagact

SEQ ID NO: 35345 - DNA, 22 bp, Artificial Sequence
  chemically synthesized
tgactctacctagcccagactc

SEQ ID NO: 35346 - DNA, 22 bp, Artificial Sequence
  chemically synthesized
gactctacctagcccagactca

SEQ ID NO: 35347 - DNA, 22 bp, Artificial Sequence
  chemically synthesized
actctacctagcccagactcag

SEQ ID NO: 35348 - DNA, 22 bp, Artificial Sequence
  chemically synthesized
tacctagcccagactcagttca

SEQ ID NO: 35349 - DNA, 22 bp, Artificial Sequence
  chemically synthesized
cctagcccagactcagttcatc

SEQ ID NO: 35350 - DNA, 22 bp, Artificial Sequence
  chemically synthesized
gcccagactcagttcatctacg

SEQ ID NO: 35351 - DNA, 22 bp, Artificial Sequence
  chemically synthesized
agttcatctacgatattaatct

SEQ ID NO: 35352 - DNA, 22 bp, Artificial Sequence
  chemically synthesized
atctacgatattaatctgcagt

SEQ ID NO: 35353 - DNA, 22 bp, Artificial Sequence
  chemically synthesized
cgatattaatctgcagtgtcat

SEQ ID NO: 35354 - DNA, 22 bp, Artificial Sequence
  chemically synthesized
atctgcagtgtcatgcactagc

SEQ ID NO: 35355 - DNA, 22 bp, Artificial Sequence
  chemically synthesized
cagtgtcatgcactagcacaaa

SEQ ID NO: 35356 - DNA, 22 bp, Artificial Sequence
  chemically synthesized
gcacaaaatatttgctgaatga

SEQ ID NO: 35357 - DNA, 22 bp, Artificial Sequence
  chemically synthesized
gctgaatgaaagaatgagagtt

SEQ ID NO: 35358 - DNA, 22 bp, Artificial Sequence
  chemically synthesized
ctgaatgaaagaatgagagtta

SEQ ID NO: 35359 - DNA, 22 bp, Artificial Sequence
  chemically synthesized
aatgaaagaatgagagttaact

SEQ ID NO: 35360 - DNA, 22 bp, Artificial Sequence
  chemically synthesized
acttttagtcaggcataaagat

SEQ ID NO: 35361 - DNA, 22 bp, Artificial Sequence
  chemically synthesized
ttagtcaggcataaagataaaa

SEQ ID NO: 35362 - DNA, 22 bp, Artificial Sequence
  chemically synthesized
tagtcaggcataaagataaaaa

SEQ ID NO: 35363 - DNA, 22 bp, Artificial Sequence
  chemically synthesized
agtcaggcataaagataaaaaa

SEQ ID NO: 35364 - DNA, 22 bp, Artificial Sequence
  chemically synthesized
gtcaggcataaagataaaaaac

SEQ ID NO: 35365 - DNA, 22 bp, Artificial Sequence
  chemically synthesized
ttactccggtgtggagtgtttt

SEQ ID NO: 35366 - DNA, 22 bp, Artificial Sequence
  chemically synthesized
tactccggtgtggagtgttttc

SEQ ID NO: 35367 - DNA, 22 bp, Artificial Sequence
  chemically synthesized
actccggtgtggagtgttttca

SEQ ID NO: 35368 - DNA, 22 bp, Artificial Sequence
  chemically synthesized
ctccggtgtggagtgttttcag

SEQ ID NO: 35369 - DNA, 22 bp, Artificial Sequence
  chemically synthesized
cggtgtggagtgttttcaggat

SEQ ID NO: 35370 - DNA, 22 bp, Artificial Sequence
  chemically synthesized
tcaggattcctaccaattagga

SEQ ID NO: 35371 - DNA, 22 bp, Artificial Sequence
  chemically synthesized
caggattcctaccaattaggaa

SEQ ID NO: 35372 - DNA, 22 bp, Artificial Sequence
  chemically synthesized
aggattcctaccaattaggaag

SEQ ID NO: 35373 - DNA, 22 bp, Artificial Sequence
  chemically synthesized
ctaccaattaggaaggtgtttg

SEQ ID NO: 35374 - DNA, 22 bp, Artificial Sequence
  chemically synthesized
ccaattaggaaggtgtttgatt

SEQ ID NO: 35375 - DNA, 22 bp, Artificial Sequence
  chemically synthesized
ggaaggtgtttgattcttcaaa

SEQ ID NO: 35376 - DNA, 22 bp, Artificial Sequence
  chemically synthesized
gattcttcaaactcagaaacac

SEQ ID NO: 35377 - DNA, 22 bp, Artificial Sequence
  chemically synthesized
attcttcaaactcagaaacacc

SEQ ID NO: 35378 - DNA, 22 bp, Artificial Sequence
  chemically synthesized
ttcaaactcagaaacacctccc

SEQ ID NO: 35379 - DNA, 22 bp, Artificial Sequence
  chemically synthesized
caaactcagaaacacctcccct

SEQ ID NO: 35380 - DNA, 22 bp, Artificial Sequence
  chemically synthesized
aaactcagaaacacctcccctt

SEQ ID NO: 35381 - DNA, 22 bp, Artificial Sequence
  chemically synthesized
agaaacacctccccttaactga

SEQ ID NO: 35382 - DNA, 22 bp, Artificial Sequence
  chemically synthesized
cccttaactgatggattcttca

SEQ ID NO: 35383 - DNA, 22 bp, Artificial Sequence
  chemically synthesized
aactgatggattcttcaaactc

SEQ ID NO: 35384 - DNA, 22 bp, Artificial Sequence
  chemically synthesized
actgatggattcttcaaactca

SEQ ID NO: 35385 - DNA, 22 bp, Artificial Sequence
  chemically synthesized
atggattcttcaaactcagcat

SEQ ID NO: 35386 - DNA, 22 bp, Artificial Sequence
  chemically synthesized
ttcaaactcagcatcagttaga

SEQ ID NO: 35387 - DNA, 22 bp, Artificial Sequence
  chemically synthesized
caaactcagcatcagttagagg

SEQ ID NO: 35388 - DNA, 22 bp, Artificial Sequence
  chemically synthesized
aaactcagcatcagttagaggg

SEQ ID NO: 35389 - DNA, 22 bp, Artificial Sequence
  chemically synthesized
agcatcagttagagggcattag

SEQ ID NO: 35390 - DNA, 22 bp, Artificial Sequence
  chemically synthesized
gagggcattagggcacttctca

SEQ ID NO: 35391 - DNA, 22 bp, Artificial Sequence
  chemically synthesized
gggcacttctcaaaccctgcat

SEQ ID NO: 35392 - DNA, 22 bp, Artificial Sequence
  chemically synthesized
ctcaaaccctgcattcagggaa

SEQ ID NO: 35393 - DNA, 22 bp, Artificial Sequence
  chemically synthesized
tcaaaccctgcattcagggaag

SEQ ID NO: 35394 - DNA, 22 bp, Artificial Sequence
  chemically synthesized
aaaccctgcattcagggaagat

SEQ ID NO: 35395 - DNA, 22 bp, Artificial Sequence
  chemically synthesized
cattcagggaagatgtctgttg

SEQ ID NO: 35396 - DNA, 22 bp, Artificial Sequence
  chemically synthesized
agggaagatgtctgttgtgggg

SEQ ID NO: 35397 - DNA, 22 bp, Artificial Sequence
  chemically synthesized
ttgtggggtggtctggcctact

SEQ ID NO: 35398 - DNA, 22 bp, Artificial Sequence
  chemically synthesized
tggggtggtctggcctacttgg

SEQ ID NO: 35399 - DNA, 22 bp, Artificial Sequence
  chemically synthesized
gcctacttggcctgagccaagg

SEQ ID NO: 35400 - DNA, 22 bp, Artificial Sequence
  chemically synthesized
cttggcctgagccaaggttctg

SEQ ID NO: 35401 - DNA, 22 bp, Artificial Sequence
  chemically synthesized
ggcctgagccaaggttctgggc

SEQ ID NO: 35402 - DNA, 22 bp, Artificial Sequence
  chemically synthesized
gcctgagccaaggttctgggca

SEQ ID NO: 35403 - DNA, 22 bp, Artificial Sequence
  chemically synthesized
agccaaggttctgggcagttct

SEQ ID NO: 35404 - DNA, 22 bp, Artificial Sequence
  chemically synthesized
tgggcagttctgttcagttaca

SEQ ID NO: 35405 - DNA, 22 bp, Artificial Sequence
  chemically synthesized
ggcagttctgttcagttacaca

SEQ ID NO: 35406 - DNA, 22 bp, Artificial Sequence
  chemically synthesized
tgttcagttacacatgcatgcg

SEQ ID NO: 35407 - DNA, 22 bp, Artificial Sequence
  chemically synthesized
ttcagttacacatgcatgcgtt

SEQ ID NO: 35408 - DNA, 22 bp, Artificial Sequence
  chemically synthesized
agttacacatgcatgcgttgag

SEQ ID NO: 35409 - DNA, 22 bp, Artificial Sequence
  chemically synthesized
cacatgcatgcgttgagcattg

SEQ ID NO: 35410 - DNA, 22 bp, Artificial Sequence
  chemically synthesized
agcattgattcaagcctggcct

SEQ ID NO: 35411 - DNA, 22 bp, Artificial Sequence
  chemically synthesized
attcaagcctggcctgggcact

SEQ ID NO: 35412 - DNA, 22 bp, Artificial Sequence
  chemically synthesized
aagcctggcctgggcactaggc

SEQ ID NO: 35413 - DNA, 22 bp, Artificial Sequence
  chemically synthesized
gcctgggcactaggcatggttt

SEQ ID NO: 35414 - DNA, 22 bp, Artificial Sequence
  chemically synthesized
ggcactaggcatggttttagat

SEQ ID NO: 35415 - DNA, 22 bp, Artificial Sequence
  chemically synthesized
ggcatggttttagatattaggg

SEQ ID NO: 35416 - DNA, 22 bp, Artificial Sequence
  chemically synthesized
tagatattagggacatattctg

SEQ ID NO: 35417 - DNA, 22 bp, Artificial Sequence
  chemically synthesized
agatattagggacatattctgt

SEQ ID NO: 35418 - DNA, 22 bp, Artificial Sequence
  chemically synthesized
gatattagggacatattctgtt

SEQ ID NO: 35419 - DNA, 22 bp, Artificial Sequence
  chemically synthesized
gggacatattctgttttccttg

SEQ ID NO: 35420 - DNA, 22 bp, Artificial Sequence
  chemically synthesized
tgttttccttgccttaagatac

SEQ ID NO: 35421 - DNA, 22 bp, Artificial Sequence
  chemically synthesized
ttttccttgccttaagatacca

SEQ ID NO: 35422 - DNA, 22 bp, Artificial Sequence
  chemically synthesized
tccttgccttaagataccagtc

SEQ ID NO: 35423 - DNA, 22 bp, Artificial Sequence
  chemically synthesized
ccttgccttaagataccagtct

SEQ ID NO: 35424 - DNA, 22 bp, Artificial Sequence
  chemically synthesized
cttgccttaagataccagtcta

SEQ ID NO: 35425 - DNA, 22 bp, Artificial Sequence
  chemically synthesized
gccttaagataccagtctagta

SEQ ID NO: 35426 - DNA, 22 bp, Artificial Sequence
  chemically synthesized
ccttaagataccagtctagtag

SEQ ID NO: 35427 - DNA, 22 bp, Artificial Sequence
  chemically synthesized
aagataccagtctagtaggagc

SEQ ID NO: 35428 - DNA, 22 bp, Artificial Sequence
  chemically synthesized
agataccagtctagtaggagcc

SEQ ID NO: 35429 - DNA, 22 bp, Artificial Sequence
  chemically synthesized
gtaggagccactaaggcccctt

SEQ ID NO: 35430 - DNA, 22 bp, Artificial Sequence
  chemically synthesized
aggcccctttttgagcctggac

SEQ ID NO: 35431 - DNA, 22 bp, Artificial Sequence
  chemically synthesized
tttgagcctggacttcgcattc

SEQ ID NO: 35432 - DNA, 22 bp, Artificial Sequence
  chemically synthesized
ttgagcctggacttcgcattca

SEQ ID NO: 35433 - DNA, 22 bp, Artificial Sequence
  chemically synthesized
tgagcctggacttcgcattcaa

SEQ ID NO: 35434 - DNA, 22 bp, Artificial Sequence
  chemically synthesized
gagcctggacttcgcattcaaa

SEQ ID NO: 35435 - DNA, 22 bp, Artificial Sequence
  chemically synthesized
agcctggacttcgcattcaaac

SEQ ID NO: 35436 - DNA, 22 bp, Artificial Sequence
  chemically synthesized
gacttcgcattcaaacataccc

SEQ ID NO: 35437 - DNA, 22 bp, Artificial Sequence
  chemically synthesized
cgcattcaaacataccctgctt

SEQ ID NO: 35438 - DNA, 22 bp, Artificial Sequence
  chemically synthesized
gcattcaaacataccctgcttc

SEQ ID NO: 35439 - DNA, 22 bp, Artificial Sequence
  chemically synthesized
aaacataccctgcttctaatca

SEQ ID NO: 35440 - DNA, 22 bp, Artificial Sequence
  chemically synthesized
cttctaatcaagtcatctattg

SEQ ID NO: 35441 - DNA, 22 bp, Artificial Sequence
  chemically synthesized
ctaatcaagtcatctattggca

SEQ ID NO: 35442 - DNA, 22 bp, Artificial Sequence
  chemically synthesized
taatcaagtcatctattggcag

SEQ ID NO: 35443 - DNA, 22 bp, Artificial Sequence
  chemically synthesized
atcaagtcatctattggcagtg

SEQ ID NO: 35444 - DNA, 22 bp, Artificial Sequence
  chemically synthesized
ttggcagtgaccttgggcaaat

SEQ ID NO: 35445 - DNA, 22 bp, Artificial Sequence
  chemically synthesized
gcagtgaccttgggcaaatcat

SEQ ID NO: 35446 - DNA, 22 bp, Artificial Sequence
  chemically synthesized
gggcaaatcatagtctctccaa

SEQ ID NO: 35447 - DNA, 22 bp, Artificial Sequence
  chemically synthesized
ggcaaatcatagtctctccaag

SEQ ID NO: 35448 - DNA, 22 bp, Artificial Sequence
  chemically synthesized
tccaagcattacttttctaatt

SEQ ID NO: 35449 - DNA, 22 bp, Artificial Sequence
  chemically synthesized
caagcattacttttctaattga

SEQ ID NO: 35450 - DNA, 22 bp, Artificial Sequence
  chemically synthesized
cttttctaattgaaacaagaac

SEQ ID NO: 35451 - DNA, 22 bp, Artificial Sequence
  chemically synthesized
ttctaattgaaacaagaacctc

SEQ ID NO: 35452 - DNA, 22 bp, Artificial Sequence
  chemically synthesized
tctaattgaaacaagaacctct

SEQ ID NO: 35453 - DNA, 22 bp, Artificial Sequence
  chemically synthesized
ctaattgaaacaagaacctctc

SEQ ID NO: 35454 - DNA, 22 bp, Artificial Sequence
  chemically synthesized
taattgaaacaagaacctctct

SEQ ID NO: 35455 - DNA, 22 bp, Artificial Sequence
  chemically synthesized
attgaaacaagaacctctctct

SEQ ID NO: 35456 - DNA, 22 bp, Artificial Sequence
  chemically synthesized
aaacaagaacctctctctatac

SEQ ID NO: 35457 - DNA, 22 bp, Artificial Sequence
  chemically synthesized
tctctataccccagatttattt

SEQ ID NO: 35458 - DNA, 22 bp, Artificial Sequence
  chemically synthesized
tctataccccagatttattttg

SEQ ID NO: 35459 - DNA, 22 bp, Artificial Sequence
  chemically synthesized
tataccccagatttattttgag

SEQ ID NO: 35460 - DNA, 22 bp, Artificial Sequence
  chemically synthesized
taccccagatttattttgagga

SEQ ID NO: 35461 - DNA, 22 bp, Artificial Sequence
  chemically synthesized
attttgaggattatgagttaat

SEQ ID NO: 35462 - DNA, 22 bp, Artificial Sequence
  chemically synthesized
ttttgaggattatgagttaatt

SEQ ID NO: 35463 - DNA, 22 bp, Artificial Sequence
  chemically synthesized
tgaggattatgagttaattcat

SEQ ID NO: 35464 - DNA, 22 bp, Artificial Sequence
  chemically synthesized
gaggattatgagttaattcata

SEQ ID NO: 35465 - DNA, 22 bp, Artificial Sequence
  chemically synthesized
aggattatgagttaattcatag

SEQ ID NO: 35466 - DNA, 22 bp, Artificial Sequence
  chemically synthesized
tgagttaattcatagctaaaat

SEQ ID NO: 35467 - DNA, 22 bp, Artificial Sequence
  chemically synthesized
attcatagctaaaatgcttagc

SEQ ID NO: 35468 - DNA, 22 bp, Artificial Sequence
  chemically synthesized
atagctaaaatgcttagcacct

SEQ ID NO: 35469 - DNA, 22 bp, Artificial Sequence
  chemically synthesized
aaatgcttagcacctaacagca

SEQ ID NO: 35470 - DNA, 22 bp, Artificial Sequence
  chemically synthesized
agcacctaacagcacataaccc

SEQ ID NO: 35471 - DNA, 22 bp, Artificial Sequence
  chemically synthesized
gcacctaacagcacataaccca

SEQ ID NO: 35472 - DNA, 22 bp, Artificial Sequence
  chemically synthesized
acagcacataacccacacatac

SEQ ID NO: 35473 - DNA, 22 bp, Artificial Sequence
  chemically synthesized
ttcaattgcgtattactaaaaa

SEQ ID NO: 35474 - DNA, 22 bp, Artificial Sequence
  chemically synthesized
tcaattgcgtattactaaaaag

SEQ ID NO: 35475 - DNA, 22 bp, Artificial Sequence
  chemically synthesized
caattgcgtattactaaaaaga

SEQ ID NO: 35476 - DNA, 22 bp, Artificial Sequence
  chemically synthesized
aattgcgtattactaaaaagaa

SEQ ID NO: 35477 - DNA, 22 bp, Artificial Sequence
  chemically synthesized
cgtattactaaaaagaaggaat

SEQ ID NO: 35478 - DNA, 22 bp, Artificial Sequence
  chemically synthesized
ctaaaaagaaggaatgatttcc

SEQ ID NO: 35479 - DNA, 22 bp, Artificial Sequence
  chemically synthesized
aaaagaaggaatgatttcctag

SEQ ID NO: 35480 - DNA, 22 bp, Artificial Sequence
  chemically synthesized
cctagaggaggtgcttcttctg

SEQ ID NO: 35481 - DNA, 22 bp, Artificial Sequence
  chemically synthesized
ctagaggaggtgcttcttctgg

SEQ ID NO: 35482 - DNA, 22 bp, Artificial Sequence
  chemically synthesized
gaggaggtgcttcttctggcca

SEQ ID NO: 35483 - DNA, 22 bp, Artificial Sequence
  chemically synthesized
cttctggccaagggctgattca

SEQ ID NO: 35484 - DNA, 22 bp, Artificial Sequence
  chemically synthesized
ttctggccaagggctgattcag

SEQ ID NO: 35485 - DNA, 22 bp, Artificial Sequence
  chemically synthesized
ctggccaagggctgattcagag

SEQ ID NO: 35486 - DNA, 22 bp, Artificial Sequence
  chemically synthesized
tggccaagggctgattcagagc

SEQ ID NO: 35487 - DNA, 22 bp, Artificial Sequence
  chemically synthesized
gccaagggctgattcagagcct

SEQ ID NO: 35488 - DNA, 22 bp, Artificial Sequence
  chemically synthesized
attcagagccttaattaactaa

SEQ ID NO: 35489 - DNA, 22 bp, Artificial Sequence
  chemically synthesized
agagccttaattaactaaatag

SEQ ID NO: 35490 - DNA, 22 bp, Artificial Sequence
  chemically synthesized
aattaactaaatagatcaagca

SEQ ID NO: 35491 - DNA, 22 bp, Artificial Sequence
  chemically synthesized
attaactaaatagatcaagcat

SEQ ID NO: 35492 - DNA, 22 bp, Artificial Sequence
  chemically synthesized
actaaatagatcaagcatatct

SEQ ID NO: 35493 - DNA, 22 bp, Artificial Sequence
  chemically synthesized
aatagatcaagcatatctaact

SEQ ID NO: 35494 - DNA, 22 bp, Artificial Sequence
  chemically synthesized
actggtcaccggaagtggtcca

SEQ ID NO: 35495 - DNA, 22 bp, Artificial Sequence
  chemically synthesized
gtcaccggaagtggtccatgag

SEQ ID NO: 35496 - DNA, 22 bp, Artificial Sequence
  chemically synthesized
cagcaatgggaaggtgtcagag

SEQ ID NO: 35497 - DNA, 22 bp, Artificial Sequence
  chemically synthesized
ggaaaaagacatagagagaaac

SEQ ID NO: 35498 - DNA, 22 bp, Artificial Sequence
  chemically synthesized
ttaggatgtctacagatttcca

SEQ ID NO: 35499 - DNA, 22 bp, Artificial Sequence
  chemically synthesized
aggatgtctacagatttccaag

SEQ ID NO: 35500 - DNA, 22 bp, Artificial Sequence
  chemically synthesized
ggatgtctacagatttccaaga

SEQ ID NO: 35501 - DNA, 22 bp, Artificial Sequence
  chemically synthesized
cagatttccaagacaataattg

SEQ ID NO: 35502 - DNA, 22 bp, Artificial Sequence
  chemically synthesized
ccaagacaataattgaaatgaa

SEQ ID NO: 35503 - DNA, 22 bp, Artificial Sequence
  chemically synthesized
caagacaataattgaaatgaac

SEQ ID NO: 35504 - DNA, 22 bp, Artificial Sequence
  chemically synthesized
aaatgaacaaaggcaagggatg

SEQ ID NO: 35505 - DNA, 22 bp, Artificial Sequence
  chemically synthesized
catttctttcctttatcacctt

SEQ ID NO: 35506 - DNA, 22 bp, Artificial Sequence
  chemically synthesized
atttctttcctttatcaccttt

SEQ ID NO: 35507 - DNA, 22 bp, Artificial Sequence
  chemically synthesized
ctttcctttatcacctttccct

SEQ ID NO: 35508 - DNA, 22 bp, Artificial Sequence
  chemically synthesized
tttcctttatcacctttccctt

SEQ ID NO: 35509 - DNA, 22 bp, Artificial Sequence
  chemically synthesized
tcctttatcacctttcccttgt

SEQ ID NO: 35510 - DNA, 22 bp, Artificial Sequence
  chemically synthesized
cctttatcacctttcccttgtt

SEQ ID NO: 35511 - DNA, 22 bp, Artificial Sequence
  chemically synthesized
ctttatcacctttcccttgttc

SEQ ID NO: 35512 - DNA, 22 bp, Artificial Sequence
  chemically synthesized
tatcacctttcccttgttcttc

SEQ ID NO: 35513 - DNA, 22 bp, Artificial Sequence
  chemically synthesized
atcacctttcccttgttcttca

SEQ ID NO: 35514 - DNA, 22 bp, Artificial Sequence
  chemically synthesized
tcacctttcccttgttcttcag

SEQ ID NO: 35515 - DNA, 22 bp, Artificial Sequence
  chemically synthesized
tcccttgttcttcagctccagc

SEQ ID NO: 35516 - DNA, 22 bp, Artificial Sequence
  chemically synthesized
cccttgttcttcagctccagct

SEQ ID NO: 35517 - DNA, 22 bp, Artificial Sequence
  chemically synthesized
ccttgttcttcagctccagctg

SEQ ID NO: 35518 - DNA, 22 bp, Artificial Sequence
  chemically synthesized
gttcttcagctccagctgtgcc

SEQ ID NO: 35519 - DNA, 22 bp, Artificial Sequence
  chemically synthesized
ttcttcagctccagctgtgccc

SEQ ID NO: 35520 - DNA, 22 bp, Artificial Sequence
  chemically synthesized
ttcagctccagctgtgcccaca

SEQ ID NO: 35521 - DNA, 22 bp, Artificial Sequence
  chemically synthesized
cagctccagctgtgcccacaga

SEQ ID NO: 35522 - DNA, 22 bp, Artificial Sequence
  chemically synthesized
agctccagctgtgcccacagac

SEQ ID NO: 35523 - DNA, 22 bp, Artificial Sequence
  chemically synthesized
cagctgtgcccacagacaccac

SEQ ID NO: 35524 - DNA, 22 bp, Artificial Sequence
  chemically synthesized
tgcccacagacaccacagggaa

SEQ ID NO: 35525 - DNA, 22 bp, Artificial Sequence
  chemically synthesized
tgaacacaggggtttgaaccag

SEQ ID NO: 35526 - DNA, 22 bp, Artificial Sequence
  chemically synthesized
aacacaggggtttgaaccaggg

SEQ ID NO: 35527 - DNA, 22 bp, Artificial Sequence
  chemically synthesized
gaaccagggcctctctaagtct

SEQ ID NO: 35528 - DNA, 22 bp, Artificial Sequence
  chemically synthesized
aaccagggcctctctaagtctt

SEQ ID NO: 35529 - DNA, 22 bp, Artificial Sequence
  chemically synthesized
tctaagtcttttccaactctga

SEQ ID NO: 35530 - DNA, 22 bp, Artificial Sequence
  chemically synthesized
taagtcttttccaactctgata

SEQ ID NO: 35531 - DNA, 22 bp, Artificial Sequence
  chemically synthesized
agtcttttccaactctgatacc

SEQ ID NO: 35532 - DNA, 22 bp, Artificial Sequence
  chemically synthesized
ttccaactctgataccctgaag

SEQ ID NO: 35533 - DNA, 22 bp, Artificial Sequence
  chemically synthesized
tccaactctgataccctgaagt

SEQ ID NO: 35534 - DNA, 22 bp, Artificial Sequence
  chemically synthesized
ccaactctgataccctgaagtt

SEQ ID NO: 35535 - DNA, 22 bp, Artificial Sequence
  chemically synthesized
caactctgataccctgaagttc

SEQ ID NO: 35536 - DNA, 22 bp, Artificial Sequence
  chemically synthesized
tgataccctgaagttctcagaa

SEQ ID NO: 35537 - DNA, 22 bp, Artificial Sequence
  chemically synthesized
ataccctgaagttctcagaaac

SEQ ID NO: 35538 - DNA, 22 bp, Artificial Sequence
  chemically synthesized
aagttctcagaaacttccataa

SEQ ID NO: 35539 - DNA, 22 bp, Artificial Sequence
  chemically synthesized
tcagaaacttccataaattttg

SEQ ID NO: 35540 - DNA, 22 bp, Artificial Sequence
  chemically synthesized
agaaacttccataaattttggc

SEQ ID NO: 35541 - DNA, 22 bp, Artificial Sequence
  chemically synthesized
ccataaattttggctgaagaag

SEQ ID NO: 35542 - DNA, 22 bp, Artificial Sequence
  chemically synthesized
cataaattttggctgaagaagc

SEQ ID NO: 35543 - DNA, 22 bp, Artificial Sequence
  chemically synthesized
tggctgaagaagccatagcaaa

SEQ ID NO: 35544 - DNA, 22 bp, Artificial Sequence
  chemically synthesized
ggctgaagaagccatagcaaac

SEQ ID NO: 35545 - DNA, 22 bp, Artificial Sequence
  chemically synthesized
gctgaagaagccatagcaaact

SEQ ID NO: 35546 - DNA, 22 bp, Artificial Sequence
  chemically synthesized
aagaagccatagcaaacttgtc

SEQ ID NO: 35547 - DNA, 22 bp, Artificial Sequence
  chemically synthesized
gtcagatggtttcttaccttta

SEQ ID NO: 35548 - DNA, 22 bp, Artificial Sequence
  chemically synthesized
tcagatggtttcttacctttaa

SEQ ID NO: 35549 - DNA, 22 bp, Artificial Sequence
  chemically synthesized
cttacctttaactcagccattt

SEQ ID NO: 35550 - DNA, 22 bp, Artificial Sequence
  chemically synthesized
ttacctttaactcagccatttt

SEQ ID NO: 35551 - DNA, 22 bp, Artificial Sequence
  chemically synthesized
acctttaactcagccattttct

SEQ ID NO: 35552 - DNA, 22 bp, Artificial Sequence
  chemically synthesized
cctttaactcagccattttctc

SEQ ID NO: 35553 - DNA, 22 bp, Artificial Sequence
  chemically synthesized
taactcagccattttctctctc

SEQ ID NO: 35554 - DNA, 22 bp, Artificial Sequence
  chemically synthesized
aactcagccattttctctctcc

SEQ ID NO: 35555 - DNA, 22 bp, Artificial Sequence
  chemically synthesized
actcagccattttctctctcct

SEQ ID NO: 35556 - DNA, 22 bp, Artificial Sequence
  chemically synthesized
agccattttctctctcctctat

SEQ ID NO: 35557 - DNA, 22 bp, Artificial Sequence
  chemically synthesized
tctctctcctctatgtgtggtg

SEQ ID NO: 35558 - DNA, 22 bp, Artificial Sequence
  chemically synthesized
ctctctcctctatgtgtggtga

SEQ ID NO: 35559 - DNA, 22 bp, Artificial Sequence
  chemically synthesized
tctctcctctatgtgtggtgac

SEQ ID NO: 35560 - DNA, 22 bp, Artificial Sequence
  chemically synthesized
tctcctctatgtgtggtgactt

SEQ ID NO: 35561 - DNA, 22 bp, Artificial Sequence
  chemically synthesized
tcctctatgtgtggtgacttca

SEQ ID NO: 35562 - DNA, 22 bp, Artificial Sequence
  chemically synthesized
ctctatgtgtggtgacttcagg

SEQ ID NO: 35563 - DNA, 22 bp, Artificial Sequence
  chemically synthesized
tatgtgtggtgacttcaggaaa

SEQ ID NO: 35564 - DNA, 22 bp, Artificial Sequence
  chemically synthesized
tgtgtggtgacttcaggaaacc

SEQ ID NO: 35565 - DNA, 22 bp, Artificial Sequence
  chemically synthesized
caggaaacccaggcccagagga

SEQ ID NO: 35566 - DNA, 22 bp, Artificial Sequence
  chemically synthesized
aggaaacccaggcccagaggat

SEQ ID NO: 35567 - DNA, 22 bp, Artificial Sequence
  chemically synthesized
ctttctccttcaaaccactctt

SEQ ID NO: 35568 - DNA, 22 bp, Artificial Sequence
  chemically synthesized
tttctccttcaaaccactcttt

SEQ ID NO: 35569 - DNA, 22 bp, Artificial Sequence
  chemically synthesized
tctccttcaaaccactctttgg

SEQ ID NO: 35570 - DNA, 22 bp, Artificial Sequence
  chemically synthesized
ctccttcaaaccactctttgga

SEQ ID NO: 35571 - DNA, 22 bp, Artificial Sequence
  chemically synthesized
tccttcaaaccactctttggat

SEQ ID NO: 35572 - DNA, 22 bp, Artificial Sequence
  chemically synthesized
cttcaaaccactctttggatat

SEQ ID NO: 35573 - DNA, 22 bp, Artificial Sequence
  chemically synthesized
caaaccactctttggatattcc

SEQ ID NO: 35574 - DNA, 22 bp, Artificial Sequence
  chemically synthesized
aaaccactctttggatattccg

SEQ ID NO: 35575 - DNA, 22 bp, Artificial Sequence
  chemically synthesized
tttggatattccggttcccact

SEQ ID NO: 35576 - DNA, 22 bp, Artificial Sequence
  chemically synthesized
tggatattccggttcccactgc

SEQ ID NO: 35577 - DNA, 22 bp, Artificial Sequence
  chemically synthesized
ggatattccggttcccactgct

SEQ ID NO: 35578 - DNA, 22 bp, Artificial Sequence
  chemically synthesized
gatattccggttcccactgctt

SEQ ID NO: 35579 - DNA, 22 bp, Artificial Sequence
  chemically synthesized
cggttcccactgcttcactgcg

SEQ ID NO: 35580 - DNA, 22 bp, Artificial Sequence
  chemically synthesized
ccactgcttcactgcgcttcac

SEQ ID NO: 35581 - DNA, 22 bp, Artificial Sequence
  chemically synthesized
cttcactgcgcttcactggtca

SEQ ID NO: 35582 - DNA, 22 bp, Artificial Sequence
  chemically synthesized
cactgcgcttcactggtcagtg

SEQ ID NO: 35583 - DNA, 22 bp, Artificial Sequence
  chemically synthesized
actgcgcttcactggtcagtgc

SEQ ID NO: 35584 - DNA, 22 bp, Artificial Sequence
  chemically synthesized
cgcttcactggtcagtgcgtca

SEQ ID NO: 35585 - DNA, 22 bp, Artificial Sequence
  chemically synthesized
cactggtcagtgcgtcactcaa

SEQ ID NO: 35586 - DNA, 22 bp, Artificial Sequence
  chemically synthesized
actggtcagtgcgtcactcaaa

SEQ ID NO: 35587 - DNA, 22 bp, Artificial Sequence
  chemically synthesized
gtcagtgcgtcactcaaactag

SEQ ID NO: 35588 - DNA, 22 bp, Artificial Sequence
  chemically synthesized
aaactagctgaaagaattgtct

SEQ ID NO: 35589 - DNA, 22 bp, Artificial Sequence
  chemically synthesized
gctgaaagaattgtctaactca

SEQ ID NO: 35590 - DNA, 22 bp, Artificial Sequence
  chemically synthesized
aaagaattgtctaactcataca

SEQ ID NO: 35591 - DNA, 22 bp, Artificial Sequence
  chemically synthesized
tctaactcatacacagggacaa

SEQ ID NO: 35592 - DNA, 22 bp, Artificial Sequence
  chemically synthesized
actcatacacagggacaaagtc

SEQ ID NO: 35593 - DNA, 22 bp, Artificial Sequence
  chemically synthesized
atacacagggacaaagtccagc

SEQ ID NO: 35594 - DNA, 22 bp, Artificial Sequence
  chemically synthesized
atttaaccggttacacaattgc

SEQ ID NO: 35595 - DNA, 22 bp, Artificial Sequence
  chemically synthesized
tttaaccggttacacaattgcc

SEQ ID NO: 35596 - DNA, 22 bp, Artificial Sequence
  chemically synthesized
aaccggttacacaattgccttt

SEQ ID NO: 35597 - DNA, 22 bp, Artificial Sequence
  chemically synthesized
accggttacacaattgcctttg

SEQ ID NO: 35598 - DNA, 22 bp, Artificial Sequence
  chemically synthesized
cacaattgcctttggtttttac

SEQ ID NO: 35599 - DNA, 22 bp, Artificial Sequence
  chemically synthesized
cctttggtttttacagtttgtt

SEQ ID NO: 35600 - DNA, 22 bp, Artificial Sequence
  chemically synthesized
tggtttttacagtttgttccta

SEQ ID NO: 35601 - DNA, 22 bp, Artificial Sequence
  chemically synthesized
ggtttttacagtttgttcctaa

SEQ ID NO: 35602 - DNA, 22 bp, Artificial Sequence
  chemically synthesized
gtttttacagtttgttcctaag

SEQ ID NO: 35603 - DNA, 22 bp, Artificial Sequence
  chemically synthesized
ttacagtttgttcctaagtgtt

SEQ ID NO: 35604 - DNA, 22 bp, Artificial Sequence
  chemically synthesized
tacagtttgttcctaagtgttt

SEQ ID NO: 35605 - DNA, 22 bp, Artificial Sequence
  chemically synthesized
acagtttgttcctaagtgtttc

SEQ ID NO: 35606 - DNA, 22 bp, Artificial Sequence
  chemically synthesized
cagtttgttcctaagtgtttcc

SEQ ID NO: 35607 - DNA, 22 bp, Artificial Sequence
  chemically synthesized
gttcctaagtgtttccagaggc

SEQ ID NO: 35608 - DNA, 22 bp, Artificial Sequence
  chemically synthesized
ttcctaagtgtttccagaggct

SEQ ID NO: 35609 - DNA, 22 bp, Artificial Sequence
  chemically synthesized
ctaagtgtttccagaggcttgg

SEQ ID NO: 35610 - DNA, 22 bp, Artificial Sequence
  chemically synthesized
agtgtttccagaggcttggttc

SEQ ID NO: 35611 - DNA, 22 bp, Artificial Sequence
  chemically synthesized
ccagaggcttggttcctcttca

SEQ ID NO: 35612 - DNA, 22 bp, Artificial Sequence
  chemically synthesized
cagaggcttggttcctcttcac

SEQ ID NO: 35613 - DNA, 22 bp, Artificial Sequence
  chemically synthesized
ggttcctcttcacctgaggtag

SEQ ID NO: 35614 - DNA, 22 bp, Artificial Sequence
  chemically synthesized
gttcctcttcacctgaggtaga

SEQ ID NO: 35615 - DNA, 22 bp, Artificial Sequence
  chemically synthesized
ctcttcacctgaggtagagatt

SEQ ID NO: 35616 - DNA, 22 bp, Artificial Sequence
  chemically synthesized
ttcacctgaggtagagattgac

SEQ ID NO: 35617 - DNA, 22 bp, Artificial Sequence
  chemically synthesized
cacctgaggtagagattgacca

SEQ ID NO: 35618 - DNA, 22 bp, Artificial Sequence
  chemically synthesized
acctgaggtagagattgaccaa

SEQ ID NO: 35619 - DNA, 22 bp, Artificial Sequence
  chemically synthesized
aggtagagattgaccaattatt

SEQ ID NO: 35620 - DNA, 22 bp, Artificial Sequence
  chemically synthesized
accaattatttattccagttaa

SEQ ID NO: 35621 - DNA, 22 bp, Artificial Sequence
  chemically synthesized
tttattccagttaaaagtaggc

SEQ ID NO: 35622 - DNA, 22 bp, Artificial Sequence
  chemically synthesized
attccagttaaaagtaggctta

SEQ ID NO: 35623 - DNA, 22 bp, Artificial Sequence
  chemically synthesized
ttccagttaaaagtaggcttat

SEQ ID NO: 35624 - DNA, 22 bp, Artificial Sequence
  chemically synthesized
cagttaaaagtaggcttatttc

SEQ ID NO: 35625 - DNA, 22 bp, Artificial Sequence
  chemically synthesized
aaagtaggcttatttcaaaagg

SEQ ID NO: 35626 - DNA, 22 bp, Artificial Sequence
  chemically synthesized
atttcaaaaggcagagaatttg

SEQ ID NO: 35627 - DNA, 22 bp, Artificial Sequence
  chemically synthesized
tttcaaaaggcagagaatttga

SEQ ID NO: 35628 - DNA, 22 bp, Artificial Sequence
  chemically synthesized
caaaaggcagagaatttgaagc

SEQ ID NO: 35629 - DNA, 22 bp, Artificial Sequence
  chemically synthesized
aaaaggcagagaatttgaagct

SEQ ID NO: 35630 - DNA, 22 bp, Artificial Sequence
  chemically synthesized
gaagctatcggggaaaggaact

SEQ ID NO: 35631 - DNA, 22 bp, Artificial Sequence
  chemically synthesized
aagctatcggggaaaggaactg

SEQ ID NO: 35632 - DNA, 22 bp, Artificial Sequence
  chemically synthesized
tcggggaaaggaactgtggcag

SEQ ID NO: 35633 - DNA, 22 bp, Artificial Sequence
  chemically synthesized
tggcagatagtgcctgctgtgt

SEQ ID NO: 35634 - DNA, 22 bp, Artificial Sequence
  chemically synthesized
ctgtgtgtggtggaggattctc

SEQ ID NO: 35635 - DNA, 22 bp, Artificial Sequence
  chemically synthesized
tgtgtggtggaggattctctgc

SEQ ID NO: 35636 - DNA, 22 bp, Artificial Sequence
  chemically synthesized
tctgctcagtcctgactcaggc

SEQ ID NO: 35637 - DNA, 22 bp, Artificial Sequence
  chemically synthesized
tgctcagtcctgactcaggcta

SEQ ID NO: 35638 - DNA, 22 bp, Artificial Sequence
  chemically synthesized
ctcagtcctgactcaggctagg

SEQ ID NO: 35639 - DNA, 22 bp, Artificial Sequence
  chemically synthesized
agtcctgactcaggctaggaag

SEQ ID NO: 35640 - DNA, 22 bp, Artificial Sequence
  chemically synthesized
actcaggctaggaaggaacagg

SEQ ID NO: 35641 - DNA, 22 bp, Artificial Sequence
  chemically synthesized
aggctaggaaggaacagggcag

SEQ ID NO: 35642 - DNA, 22 bp, Artificial Sequence
  chemically synthesized
ggaaggaacagggcagtgctga

SEQ ID NO: 35643 - DNA, 22 bp, Artificial Sequence
  chemically synthesized
caggagactcagcactgccctg

SEQ ID NO: 35644 - DNA, 22 bp, Artificial Sequence
  chemically synthesized
agcactgccctgttccttccta

SEQ ID NO: 35645 - DNA, 22 bp, Artificial Sequence
  chemically synthesized
ccctgttccttcctagcctgag

SEQ ID NO: 35646 - DNA, 22 bp, Artificial Sequence
  chemically synthesized
ttccttcctagcctgagtcagg

SEQ ID NO: 35647 - DNA, 22 bp, Artificial Sequence
  chemically synthesized
cttcctagcctgagtcaggact

SEQ ID NO: 35648 - DNA, 22 bp, Artificial Sequence
  chemically synthesized
cctagcctgagtcaggactgag

SEQ ID NO: 35649 - DNA, 22 bp, Artificial Sequence
  chemically synthesized
ctagcctgagtcaggactgagc

SEQ ID NO: 35650 - DNA, 22 bp, Artificial Sequence
  chemically synthesized
gcctgagtcaggactgagcaga

SEQ ID NO: 35651 - DNA, 22 bp, Artificial Sequence
  chemically synthesized
agtcaggactgagcagagaatc

SEQ ID NO: 35652 - DNA, 22 bp, Artificial Sequence
  chemically synthesized
agcagagaatcctccaccacac

SEQ ID NO: 35653 - DNA, 22 bp, Artificial Sequence
  chemically synthesized
caccacacacagcaggcactat

SEQ ID NO: 35654 - DNA, 22 bp, Artificial Sequence
  chemically synthesized
tctgccacagttcctttccccg

SEQ ID NO: 35655 - DNA, 22 bp, Artificial Sequence
  chemically synthesized
ccacagttcctttccccgatag

SEQ ID NO: 35656 - DNA, 22 bp, Artificial Sequence
  chemically synthesized
ctttccccgatagcttcaaatt

SEQ ID NO: 35657 - DNA, 22 bp, Artificial Sequence
  chemically synthesized
tccccgatagcttcaaattctc

SEQ ID NO: 35658 - DNA, 22 bp, Artificial Sequence
  chemically synthesized
ccccgatagcttcaaattctct

SEQ ID NO: 35659 - DNA, 22 bp, Artificial Sequence
  chemically synthesized
cccgatagcttcaaattctctg

SEQ ID NO: 35660 - DNA, 22 bp, Artificial Sequence
  chemically synthesized
caaattctctgccttttgaaat

SEQ ID NO: 35661 - DNA, 22 bp, Artificial Sequence
  chemically synthesized
aaattctctgccttttgaaata

SEQ ID NO: 35662 - DNA, 22 bp, Artificial Sequence
  chemically synthesized
tctgccttttgaaataagccta

SEQ ID NO: 35663 - DNA, 22 bp, Artificial Sequence
  chemically synthesized
tgccttttgaaataagcctact

SEQ ID NO: 35664 - DNA, 22 bp, Artificial Sequence
  chemically synthesized
ccttttgaaataagcctacttt

SEQ ID NO: 35665 - DNA, 22 bp, Artificial Sequence
  chemically synthesized
ttgaaataagcctacttttaac

SEQ ID NO: 35666 - DNA, 22 bp, Artificial Sequence
  chemically synthesized
tgaaataagcctacttttaact

SEQ ID NO: 35667 - DNA, 22 bp, Artificial Sequence
  chemically synthesized
gaaataagcctacttttaactg

SEQ ID NO: 35668 - DNA, 22 bp, Artificial Sequence
  chemically synthesized
aaataagcctacttttaactgg

SEQ ID NO: 35669 - DNA, 22 bp, Artificial Sequence
  chemically synthesized
cttttaactggaataaataatt

SEQ ID NO: 35670 - DNA, 22 bp, Artificial Sequence
  chemically synthesized
ttaactggaataaataattggt

SEQ ID NO: 35671 - DNA, 22 bp, Artificial Sequence
  chemically synthesized
taactggaataaataattggtc

SEQ ID NO: 35672 - DNA, 22 bp, Artificial Sequence
  chemically synthesized
aactggaataaataattggtca

SEQ ID NO: 35673 - DNA, 22 bp, Artificial Sequence
  chemically synthesized
actggaataaataattggtcaa

SEQ ID NO: 35674 - DNA, 22 bp, Artificial Sequence
  chemically synthesized
gaataaataattggtcaatctc

SEQ ID NO: 35675 - DNA, 22 bp, Artificial Sequence
  chemically synthesized
gtcaatctctacctcaggtgaa

SEQ ID NO: 35676 - DNA, 22 bp, Artificial Sequence
  chemically synthesized
tacctcaggtgaagaggaacca

SEQ ID NO: 35677 - DNA, 22 bp, Artificial Sequence
  chemically synthesized
cctcaggtgaagaggaaccaag

SEQ ID NO: 35678 - DNA, 22 bp, Artificial Sequence
  chemically synthesized
aggtgaagaggaaccaagcctc

SEQ ID NO: 35679 - DNA, 22 bp, Artificial Sequence
  chemically synthesized
tggaaacacttaggaacaaact

SEQ ID NO: 35680 - DNA, 22 bp, Artificial Sequence
  chemically synthesized
gaaacacttaggaacaaactgt

SEQ ID NO: 35681 - DNA, 22 bp, Artificial Sequence
  chemically synthesized
aggaacaaactgtaaaaaccaa

SEQ ID NO: 35682 - DNA, 22 bp, Artificial Sequence
  chemically synthesized
ggaacaaactgtaaaaaccaaa

SEQ ID NO: 35683 - DNA, 22 bp, Artificial Sequence
  chemically synthesized
taaaaaccaaaggcaattgtgt

SEQ ID NO: 35684 - DNA, 22 bp, Artificial Sequence
  chemically synthesized
tgtaaccggttaaataagcttg

SEQ ID NO: 35685 - DNA, 22 bp, Artificial Sequence
  chemically synthesized
aataagcttgctggactttgtc

SEQ ID NO: 35686 - DNA, 22 bp, Artificial Sequence
  chemically synthesized
gctggactttgtccctgtgtat

SEQ ID NO: 35687 - DNA, 22 bp, Artificial Sequence
  chemically synthesized
ctggactttgtccctgtgtatg

SEQ ID NO: 35688 - DNA, 22 bp, Artificial Sequence
  chemically synthesized
gactttgtccctgtgtatgagt

SEQ ID NO: 35689 - DNA, 22 bp, Artificial Sequence
  chemically synthesized
tgtccctgtgtatgagttagac

SEQ ID NO: 35690 - DNA, 22 bp, Artificial Sequence
  chemically synthesized
gtccctgtgtatgagttagaca

SEQ ID NO: 35691 - DNA, 22 bp, Artificial Sequence
  chemically synthesized
tccctgtgtatgagttagacaa

SEQ ID NO: 35692 - DNA, 22 bp, Artificial Sequence
  chemically synthesized
tgtatgagttagacaattcttt

SEQ ID NO: 35693 - DNA, 22 bp, Artificial Sequence
  chemically synthesized
gacaattctttcagctagtttg

SEQ ID NO: 35694 - DNA, 22 bp, Artificial Sequence
  chemically synthesized
tttcagctagtttgagtgacgc

SEQ ID NO: 35695 - DNA, 22 bp, Artificial Sequence
  chemically synthesized
tcagctagtttgagtgacgcac

SEQ ID NO: 35696 - DNA, 22 bp, Artificial Sequence
  chemically synthesized
cagctagtttgagtgacgcact

SEQ ID NO: 35697 - DNA, 22 bp, Artificial Sequence
  chemically synthesized
agctagtttgagtgacgcactg

SEQ ID NO: 35698 - DNA, 22 bp, Artificial Sequence
  chemically synthesized
gtttgagtgacgcactgaccag

SEQ ID NO: 35699 - DNA, 22 bp, Artificial Sequence
  chemically synthesized
gagtgacgcactgaccagtgaa

SEQ ID NO: 35700 - DNA, 22 bp, Artificial Sequence
  chemically synthesized
agtgacgcactgaccagtgaag

SEQ ID NO: 35701 - DNA, 22 bp, Artificial Sequence
  chemically synthesized
accagtgaagcgcagtgaagca

SEQ ID NO: 35702 - DNA, 22 bp, Artificial Sequence
  chemically synthesized
gaaggagaaagaagcattgtgg

SEQ ID NO: 35703 - DNA, 22 bp, Artificial Sequence
  chemically synthesized
aaggagaaagaagcattgtggc

SEQ ID NO: 35704 - DNA, 22 bp, Artificial Sequence
  chemically synthesized
tggctttatatcctctgggcct

SEQ ID NO: 35705 - DNA, 22 bp, Artificial Sequence
  chemically synthesized
tatatcctctgggcctgggttt

SEQ ID NO: 35706 - DNA, 22 bp, Artificial Sequence
  chemically synthesized
atatcctctgggcctgggtttc

SEQ ID NO: 35707 - DNA, 22 bp, Artificial Sequence
  chemically synthesized
tatcctctgggcctgggtttcc

SEQ ID NO: 35708 - DNA, 22 bp, Artificial Sequence
  chemically synthesized
tgggcctgggtttcctgaagtc

SEQ ID NO: 35709 - DNA, 22 bp, Artificial Sequence
  chemically synthesized
ggcctgggtttcctgaagtcac

SEQ ID NO: 35710 - DNA, 22 bp, Artificial Sequence
  chemically synthesized
ggtttcctgaagtcaccacaca

SEQ ID NO: 35711 - DNA, 22 bp, Artificial Sequence
  chemically synthesized
cctgaagtcaccacacatagag

SEQ ID NO: 35712 - DNA, 22 bp, Artificial Sequence
  chemically synthesized
ctgaagtcaccacacatagagg

SEQ ID NO: 35713 - DNA, 22 bp, Artificial Sequence
  chemically synthesized
aagtcaccacacatagaggaga

SEQ ID NO: 35714 - DNA, 22 bp, Artificial Sequence
  chemically synthesized
agttaaaggtaagaaaccatct

SEQ ID NO: 35715 - DNA, 22 bp, Artificial Sequence
  chemically synthesized
aaggtaagaaaccatctgacaa

SEQ ID NO: 35716 - DNA, 22 bp, Artificial Sequence
  chemically synthesized
acaagtttgctatggcttcttc

SEQ ID NO: 35717 - DNA, 22 bp, Artificial Sequence
  chemically synthesized
gctatggcttcttcagccaaaa

SEQ ID NO: 35718 - DNA, 22 bp, Artificial Sequence
  chemically synthesized
ctatggcttcttcagccaaaat

SEQ ID NO: 35719 - DNA, 22 bp, Artificial Sequence
  chemically synthesized
tggcttcttcagccaaaattta

SEQ ID NO: 35720 - DNA, 22 bp, Artificial Sequence
  chemically synthesized
cttcagccaaaatttatggaag

SEQ ID NO: 35721 - DNA, 22 bp, Artificial Sequence
  chemically synthesized
ttcagccaaaatttatggaagt

SEQ ID NO: 35722 - DNA, 22 bp, Artificial Sequence
  chemically synthesized
cagccaaaatttatggaagttt

SEQ ID NO: 35723 - DNA, 22 bp, Artificial Sequence
  chemically synthesized
agccaaaatttatggaagtttc

SEQ ID NO: 35724 - DNA, 22 bp, Artificial Sequence
  chemically synthesized
atggaagtttctgagaacttca

SEQ ID NO: 35725 - DNA, 22 bp, Artificial Sequence
  chemically synthesized
tggaagtttctgagaacttcag

SEQ ID NO: 35726 - DNA, 22 bp, Artificial Sequence
  chemically synthesized
ctgagaacttcagggtatcaga

SEQ ID NO: 35727 - DNA, 22 bp, Artificial Sequence
  chemically synthesized
tgagaacttcagggtatcagag

SEQ ID NO: 35728 - DNA, 22 bp, Artificial Sequence
  chemically synthesized
agaacttcagggtatcagagtt

SEQ ID NO: 35729 - DNA, 22 bp, Artificial Sequence
  chemically synthesized
cagggtatcagagttggaaaag

SEQ ID NO: 35730 - DNA, 22 bp, Artificial Sequence
  chemically synthesized
agggtatcagagttggaaaaga

SEQ ID NO: 35731 - DNA, 22 bp, Artificial Sequence
  chemically synthesized
gaaaagacttagagaggccctg

SEQ ID NO: 35732 - DNA, 22 bp, Artificial Sequence
  chemically synthesized
agagaggccctggttcaaaccc

SEQ ID NO: 35733 - DNA, 22 bp, Artificial Sequence
  chemically synthesized
gagaggccctggttcaaacccc

SEQ ID NO: 35734 - DNA, 22 bp, Artificial Sequence
  chemically synthesized
gttcaaacccctgtgttcagag

SEQ ID NO: 35735 - DNA, 22 bp, Artificial Sequence
  chemically synthesized
aaacccctgtgttcagaggctt

SEQ ID NO: 35736 - DNA, 22 bp, Artificial Sequence
  chemically synthesized
tgttcagaggcttccctgtggt

SEQ ID NO: 35737 - DNA, 22 bp, Artificial Sequence
  chemically synthesized
agaggcttccctgtggtgtctg

SEQ ID NO: 35738 - DNA, 22 bp, Artificial Sequence
  chemically synthesized
ccctgtggtgtctgtgggcaca

SEQ ID NO: 35739 - DNA, 22 bp, Artificial Sequence
  chemically synthesized
cctgtggtgtctgtgggcacag

SEQ ID NO: 35740 - DNA, 22 bp, Artificial Sequence
  chemically synthesized
tggtgtctgtgggcacagctgg

SEQ ID NO: 35741 - DNA, 22 bp, Artificial Sequence
  chemically synthesized
tgggcacagctggagctgaaga

SEQ ID NO: 35742 - DNA, 22 bp, Artificial Sequence
  chemically synthesized
gagctgaagaacaagggaaagg

SEQ ID NO: 35743 - DNA, 22 bp, Artificial Sequence
  chemically synthesized
aagaacaagggaaaggtgataa

SEQ ID NO: 35744 - DNA, 22 bp, Artificial Sequence
  chemically synthesized
ttattggtcatcccttgccttt

SEQ ID NO: 35745 - DNA, 22 bp, Artificial Sequence
  chemically synthesized
attggtcatcccttgcctttgt

SEQ ID NO: 35746 - DNA, 22 bp, Artificial Sequence
  chemically synthesized
ttggtcatcccttgcctttgtt

SEQ ID NO: 35747 - DNA, 22 bp, Artificial Sequence
  chemically synthesized
gtcatcccttgcctttgttcat

SEQ ID NO: 35748 - DNA, 22 bp, Artificial Sequence
  chemically synthesized
gcctttgttcatttcaattatt

SEQ ID NO: 35749 - DNA, 22 bp, Artificial Sequence
  chemically synthesized
cctttgttcatttcaattattg

SEQ ID NO: 35750 - DNA, 22 bp, Artificial Sequence
  chemically synthesized
tgttcatttcaattattgtctt

SEQ ID NO: 35751 - DNA, 22 bp, Artificial Sequence
  chemically synthesized
gttcatttcaattattgtcttg

SEQ ID NO: 35752 - DNA, 22 bp, Artificial Sequence
  chemically synthesized
ttcatttcaattattgtcttgg

SEQ ID NO: 35753 - DNA, 22 bp, Artificial Sequence
  chemically synthesized
atttcaattattgtcttggaaa

SEQ ID NO: 35754 - DNA, 22 bp, Artificial Sequence
  chemically synthesized
caattattgtcttggaaatctg

SEQ ID NO: 35755 - DNA, 22 bp, Artificial Sequence
  chemically synthesized
aattattgtcttggaaatctgt

SEQ ID NO: 35756 - DNA, 22 bp, Artificial Sequence
  chemically synthesized
ttgtcttggaaatctgtagaca

SEQ ID NO: 35757 - DNA, 22 bp, Artificial Sequence
  chemically synthesized
tcttggaaatctgtagacatcc

SEQ ID NO: 35758 - DNA, 22 bp, Artificial Sequence
  chemically synthesized
ggaaatctgtagacatcctaag

SEQ ID NO: 35759 - DNA, 22 bp, Artificial Sequence
  chemically synthesized
gaaatctgtagacatcctaaga

SEQ ID NO: 35760 - DNA, 22 bp, Artificial Sequence
  chemically synthesized
tagacatcctaagagctcccct

SEQ ID NO: 35761 - DNA, 22 bp, Artificial Sequence
  chemically synthesized
agagctcccctccactacggac

SEQ ID NO: 35762 - DNA, 22 bp, Artificial Sequence
  chemically synthesized
ccctccactacggacatgcacg

SEQ ID NO: 35763 - DNA, 22 bp, Artificial Sequence
  chemically synthesized
cactacggacatgcacgtttct

SEQ ID NO: 35764 - DNA, 22 bp, Artificial Sequence
  chemically synthesized
cggacatgcacgtttctctcta

SEQ ID NO: 35765 - DNA, 22 bp, Artificial Sequence
  chemically synthesized
ctctctatgtctttttcccaac

SEQ ID NO: 35766 - DNA, 22 bp, Artificial Sequence
  chemically synthesized
tctctatgtctttttcccaacc

SEQ ID NO: 35767 - DNA, 22 bp, Artificial Sequence
  chemically synthesized
tctatgtctttttcccaacccc

SEQ ID NO: 35768 - DNA, 22 bp, Artificial Sequence
  chemically synthesized
tatgtctttttcccaacccctg

SEQ ID NO: 35769 - DNA, 22 bp, Artificial Sequence
  chemically synthesized
tgtctttttcccaacccctgct

SEQ ID NO: 35770 - DNA, 22 bp, Artificial Sequence
  chemically synthesized
tttcccaacccctgctctgaca

SEQ ID NO: 35771 - DNA, 22 bp, Artificial Sequence
  chemically synthesized
ttcccaacccctgctctgacac

SEQ ID NO: 35772 - DNA, 22 bp, Artificial Sequence
  chemically synthesized
tcccaacccctgctctgacacc

SEQ ID NO: 35773 - DNA, 22 bp, Artificial Sequence
  chemically synthesized
cccaacccctgctctgacacct

SEQ ID NO: 35774 - DNA, 22 bp, Artificial Sequence
  chemically synthesized
ccaacccctgctctgacacctt

SEQ ID NO: 35775 - DNA, 22 bp, Artificial Sequence
  chemically synthesized
ctctgacaccttcccattgctg

SEQ ID NO: 35776 - DNA, 22 bp, Artificial Sequence
  chemically synthesized
tgacaccttcccattgctgcag

SEQ ID NO: 35777 - DNA, 22 bp, Artificial Sequence
  chemically synthesized
acaccttcccattgctgcagcc

SEQ ID NO: 35778 - DNA, 22 bp, Artificial Sequence
  chemically synthesized
cccattgctgcagcctcatgga

SEQ ID NO: 35779 - DNA, 22 bp, Artificial Sequence
  chemically synthesized
ccattgctgcagcctcatggac

SEQ ID NO: 35780 - DNA, 22 bp, Artificial Sequence
  chemically synthesized
ctgcagcctcatggaccacttc

SEQ ID NO: 35781 - DNA, 22 bp, Artificial Sequence
  chemically synthesized
cagcctcatggaccacttccgg

SEQ ID NO: 35782 - DNA, 22 bp, Artificial Sequence
  chemically synthesized
atggaccacttccggtgaccag

SEQ ID NO: 35783 - DNA, 22 bp, Artificial Sequence
  chemically synthesized
ccggtgaccagttagatatgct

SEQ ID NO: 35784 - DNA, 22 bp, Artificial Sequence
  chemically synthesized
cggtgaccagttagatatgctt

SEQ ID NO: 35785 - DNA, 22 bp, Artificial Sequence
  chemically synthesized
gatatgcttgatctatttagtt

SEQ ID NO: 35786 - DNA, 22 bp, Artificial Sequence
  chemically synthesized
gatctatttagttaattaaggc

SEQ ID NO: 35787 - DNA, 22 bp, Artificial Sequence
  chemically synthesized
atctatttagttaattaaggct

SEQ ID NO: 35788 - DNA, 22 bp, Artificial Sequence
  chemically synthesized
tttagttaattaaggctctgaa

SEQ ID NO: 35789 - DNA, 22 bp, Artificial Sequence
  chemically synthesized
agttaattaaggctctgaatca

SEQ ID NO: 35790 - DNA, 22 bp, Artificial Sequence
  chemically synthesized
gttaattaaggctctgaatcag

SEQ ID NO: 35791 - DNA, 22 bp, Artificial Sequence
  chemically synthesized
attaaggctctgaatcagccct

SEQ ID NO: 35792 - DNA, 22 bp, Artificial Sequence
  chemically synthesized
aggctctgaatcagcccttggc

SEQ ID NO: 35793 - DNA, 22 bp, Artificial Sequence
  chemically synthesized
tgaatcagcccttggccagaag

SEQ ID NO: 35794 - DNA, 22 bp, Artificial Sequence
  chemically synthesized
aatcagcccttggccagaagaa

SEQ ID NO: 35795 - DNA, 22 bp, Artificial Sequence
  chemically synthesized
ggccagaagaagcacctcctct

SEQ ID NO: 35796 - DNA, 22 bp, Artificial Sequence
  chemically synthesized
gccagaagaagcacctcctcta

SEQ ID NO: 35797 - DNA, 22 bp, Artificial Sequence
  chemically synthesized
ctctaggaaatcattccttctt

SEQ ID NO: 35798 - DNA, 22 bp, Artificial Sequence
  chemically synthesized
taggaaatcattccttcttttt

SEQ ID NO: 35799 - DNA, 22 bp, Artificial Sequence
  chemically synthesized
ggaaatcattccttctttttag

SEQ ID NO: 35800 - DNA, 22 bp, Artificial Sequence
  chemically synthesized
cttctttttagtaatacgcaat

SEQ ID NO: 35801 - DNA, 22 bp, Artificial Sequence
  chemically synthesized
ctttttagtaatacgcaattga

SEQ ID NO: 35802 - DNA, 22 bp, Artificial Sequence
  chemically synthesized
tttttagtaatacgcaattgaa

SEQ ID NO: 35803 - DNA, 22 bp, Artificial Sequence
  chemically synthesized
tttagtaatacgcaattgaaaa

SEQ ID NO: 35804 - DNA, 22 bp, Artificial Sequence
  chemically synthesized
ttagtaatacgcaattgaaaag

SEQ ID NO: 35805 - DNA, 22 bp, Artificial Sequence
  chemically synthesized
tagtaatacgcaattgaaaagt

SEQ ID NO: 35806 - DNA, 22 bp, Artificial Sequence
  chemically synthesized
agtaatacgcaattgaaaagta

SEQ ID NO: 35807 - DNA, 22 bp, Artificial Sequence
  chemically synthesized
gtaatacgcaattgaaaagtat

SEQ ID NO: 35808 - DNA, 22 bp, Artificial Sequence
  chemically synthesized
aaaagtatgtgtgggttatgtg

SEQ ID NO: 35809 - DNA, 22 bp, Artificial Sequence
  chemically synthesized
tgtgctgttaggtgctaagcat

SEQ ID NO: 35810 - DNA, 22 bp, Artificial Sequence
  chemically synthesized
ttaggtgctaagcattttagct

SEQ ID NO: 35811 - DNA, 22 bp, Artificial Sequence
  chemically synthesized
ggtgctaagcattttagctatg

SEQ ID NO: 35812 - DNA, 22 bp, Artificial Sequence
  chemically synthesized
agcattttagctatgaattaac

SEQ ID NO: 35813 - DNA, 22 bp, Artificial Sequence
  chemically synthesized
tagctatgaattaactcataat

SEQ ID NO: 35814 - DNA, 22 bp, Artificial Sequence
  chemically synthesized
agctatgaattaactcataatc

SEQ ID NO: 35815 - DNA, 22 bp, Artificial Sequence
  chemically synthesized
gctatgaattaactcataatcc

SEQ ID NO: 35816 - DNA, 22 bp, Artificial Sequence
  chemically synthesized
tgaattaactcataatcctcaa

SEQ ID NO: 35817 - DNA, 22 bp, Artificial Sequence
  chemically synthesized
actcataatcctcaaaataaat

SEQ ID NO: 35818 - DNA, 22 bp, Artificial Sequence
  chemically synthesized
ataatcctcaaaataaatctgg

SEQ ID NO: 35819 - DNA, 22 bp, Artificial Sequence
  chemically synthesized
aaaataaatctggggtatagag

SEQ ID NO: 35820 - DNA, 22 bp, Artificial Sequence
  chemically synthesized
gggtatagagagaggttcttgt

SEQ ID NO: 35821 - DNA, 22 bp, Artificial Sequence
  chemically synthesized
ttgtttcaattagaaaagtaat

SEQ ID NO: 35822 - DNA, 22 bp, Artificial Sequence
  chemically synthesized
gtttcaattagaaaagtaatgc

SEQ ID NO: 35823 - DNA, 22 bp, Artificial Sequence
  chemically synthesized
tttcaattagaaaagtaatgct

SEQ ID NO: 35824 - DNA, 22 bp, Artificial Sequence
  chemically synthesized
caattagaaaagtaatgcttgg

SEQ ID NO: 35825 - DNA, 22 bp, Artificial Sequence
  chemically synthesized
aattagaaaagtaatgcttgga

SEQ ID NO: 35826 - DNA, 22 bp, Artificial Sequence
  chemically synthesized
gaaaagtaatgcttggagagac

SEQ ID NO: 35827 - DNA, 22 bp, Artificial Sequence
  chemically synthesized
ggagagactatgatttgcccaa

SEQ ID NO: 35828 - DNA, 22 bp, Artificial Sequence
  chemically synthesized
gagagactatgatttgcccaag

SEQ ID NO: 35829 - DNA, 22 bp, Artificial Sequence
  chemically synthesized
tgatttgcccaaggtcactgcc

SEQ ID NO: 35830 - DNA, 22 bp, Artificial Sequence
  chemically synthesized
gcccaaggtcactgccaataga

SEQ ID NO: 35831 - DNA, 22 bp, Artificial Sequence
  chemically synthesized
cccaaggtcactgccaatagat

SEQ ID NO: 35832 - DNA, 22 bp, Artificial Sequence
  chemically synthesized
ccaatagatgacttgattagaa

SEQ ID NO: 35833 - DNA, 22 bp, Artificial Sequence
  chemically synthesized
gattagaagcagggtatgtttg

SEQ ID NO: 35834 - DNA, 22 bp, Artificial Sequence
  chemically synthesized
attagaagcagggtatgtttga

SEQ ID NO: 35835 - DNA, 22 bp, Artificial Sequence
  chemically synthesized
gaagcagggtatgtttgaatgc

SEQ ID NO: 35836 - DNA, 22 bp, Artificial Sequence
  chemically synthesized
gaatgcgaagtccaggctcaaa

SEQ ID NO: 35837 - DNA, 22 bp, Artificial Sequence
  chemically synthesized
aatgcgaagtccaggctcaaaa

SEQ ID NO: 35838 - DNA, 22 bp, Artificial Sequence
  chemically synthesized
aaaaaggggccttagtggctcc

SEQ ID NO: 35839 - DNA, 22 bp, Artificial Sequence
  chemically synthesized
agtggctcctactagactggta

SEQ ID NO: 35840 - DNA, 22 bp, Artificial Sequence
  chemically synthesized
gtggctcctactagactggtat

SEQ ID NO: 35841 - DNA, 22 bp, Artificial Sequence
  chemically synthesized
ctactagactggtatcttaagg

SEQ ID NO: 35842 - DNA, 22 bp, Artificial Sequence
  chemically synthesized
ctagactggtatcttaaggcaa

SEQ ID NO: 35843 - DNA, 22 bp, Artificial Sequence
  chemically synthesized
gactggtatcttaaggcaagga

SEQ ID NO: 35844 - DNA, 22 bp, Artificial Sequence
  chemically synthesized
gtatcttaaggcaaggaaaaca

SEQ ID NO: 35845 - DNA, 22 bp, Artificial Sequence
  chemically synthesized
aaggcaaggaaaacagaatatg

SEQ ID NO: 35846 - DNA, 22 bp, Artificial Sequence
  chemically synthesized
aggcaaggaaaacagaatatgt

SEQ ID NO: 35847 - DNA, 22 bp, Artificial Sequence
  chemically synthesized
atatctaaaaccatgcctagtg

SEQ ID NO: 35848 - DNA, 22 bp, Artificial Sequence
  chemically synthesized
aaaccatgcctagtgcccaggc

SEQ ID NO: 35849 - DNA, 22 bp, Artificial Sequence
  chemically synthesized
gtgcccaggccaggcttgaatc

SEQ ID NO: 35850 - DNA, 22 bp, Artificial Sequence
  chemically synthesized
gaatcaatgctcaacgcatgca

SEQ ID NO: 35851 - DNA, 22 bp, Artificial Sequence
  chemically synthesized
aatcaatgctcaacgcatgcat

SEQ ID NO: 35852 - DNA, 22 bp, Artificial Sequence
  chemically synthesized
aacgcatgcatgtgtaactgaa

SEQ ID NO: 35853 - DNA, 22 bp, Artificial Sequence
  chemically synthesized
aacagaactgcccagaaccttg

SEQ ID NO: 35854 - DNA, 22 bp, Artificial Sequence
  chemically synthesized
cccagaaccttggctcaggcca

SEQ ID NO: 35855 - DNA, 22 bp, Artificial Sequence
  chemically synthesized
ggctcaggccaagtaggccaga

SEQ ID NO: 35856 - DNA, 22 bp, Artificial Sequence
  chemically synthesized
gctcaggccaagtaggccagac

SEQ ID NO: 35857 - DNA, 22 bp, Artificial Sequence
  chemically synthesized
aggccaagtaggccagaccacc

SEQ ID NO: 35858 - DNA, 22 bp, Artificial Sequence
  chemically synthesized
ccctgaatgcagggtttgagaa

SEQ ID NO: 35859 - DNA, 22 bp, Artificial Sequence
  chemically synthesized
cctgaatgcagggtttgagaag

SEQ ID NO: 35860 - DNA, 22 bp, Artificial Sequence
  chemically synthesized
aatgcagggtttgagaagtgcc

SEQ ID NO: 35861 - DNA, 22 bp, Artificial Sequence
  chemically synthesized
gagaagtgccctaatgccctct

SEQ ID NO: 35862 - DNA, 22 bp, Artificial Sequence
  chemically synthesized
agaagtgccctaatgccctcta

SEQ ID NO: 35863 - DNA, 22 bp, Artificial Sequence
  chemically synthesized
atgccctctaactgatgctgag

SEQ ID NO: 35864 - DNA, 22 bp, Artificial Sequence
  chemically synthesized
taactgatgctgagtttgaaga

SEQ ID NO: 35865 - DNA, 22 bp, Artificial Sequence
  chemically synthesized
actgatgctgagtttgaagaat

SEQ ID NO: 35866 - DNA, 22 bp, Artificial Sequence
  chemically synthesized
atgctgagtttgaagaatccat

SEQ ID NO: 35867 - DNA, 22 bp, Artificial Sequence
  chemically synthesized
agtttgaagaatccatcagtta

SEQ ID NO: 35868 - DNA, 22 bp, Artificial Sequence
  chemically synthesized
gaagaatccatcagttaagggg

SEQ ID NO: 35869 - DNA, 22 bp, Artificial Sequence
  chemically synthesized
aagaatccatcagttaagggga

SEQ ID NO: 35870 - DNA, 22 bp, Artificial Sequence
  chemically synthesized
aggggaggtgtttctgagtttg

SEQ ID NO: 35871 - DNA, 22 bp, Artificial Sequence
  chemically synthesized
ctgagtttgaagaatcaaacac

SEQ ID NO: 35872 - DNA, 22 bp, Artificial Sequence
  chemically synthesized
tgagtttgaagaatcaaacacc

SEQ ID NO: 35873 - DNA, 22 bp, Artificial Sequence
  chemically synthesized
agtttgaagaatcaaacacctt

SEQ ID NO: 35874 - DNA, 22 bp, Artificial Sequence
  chemically synthesized
gaagaatcaaacaccttcctaa

SEQ ID NO: 35875 - DNA, 22 bp, Artificial Sequence
  chemically synthesized
aagaatcaaacaccttcctaat

SEQ ID NO: 35876 - DNA, 22 bp, Artificial Sequence
  chemically synthesized
cctaattggtaggaatcctgaa

SEQ ID NO: 35877 - DNA, 22 bp, Artificial Sequence
  chemically synthesized
ctaattggtaggaatcctgaaa

SEQ ID NO: 35878 - DNA, 22 bp, Artificial Sequence
  chemically synthesized
attggtaggaatcctgaaaaca

SEQ ID NO: 35879 - DNA, 22 bp, Artificial Sequence
  chemically synthesized
gtaggaatcctgaaaacactcc

SEQ ID NO: 35880 - DNA, 22 bp, Artificial Sequence
  chemically synthesized
aaaacactccacaccggagtaa

SEQ ID NO: 35881 - DNA, 22 bp, Artificial Sequence
  chemically synthesized
cacaccggagtaaaagactttg

SEQ ID NO: 35882 - DNA, 22 bp, Artificial Sequence
  chemically synthesized
tggttttttatctttatgcctg

SEQ ID NO: 35883 - DNA, 22 bp, Artificial Sequence
  chemically synthesized
ggttttttatctttatgcctga

SEQ ID NO: 35884 - DNA, 22 bp, Artificial Sequence
  chemically synthesized
gttttttatctttatgcctgac

SEQ ID NO: 35885 - DNA, 22 bp, Artificial Sequence
  chemically synthesized
tttatctttatgcctgactaaa

SEQ ID NO: 35886 - DNA, 22 bp, Artificial Sequence
  chemically synthesized
ttatctttatgcctgactaaaa

SEQ ID NO: 35887 - DNA, 22 bp, Artificial Sequence
  chemically synthesized
tatctttatgcctgactaaaag

SEQ ID NO: 35888 - DNA, 22 bp, Artificial Sequence
  chemically synthesized
atctttatgcctgactaaaagt

SEQ ID NO: 35889 - DNA, 22 bp, Artificial Sequence
  chemically synthesized
tctttatgcctgactaaaagtt

SEQ ID NO: 35890 - DNA, 22 bp, Artificial Sequence
  chemically synthesized
tatgcctgactaaaagttaact

SEQ ID NO: 35891 - DNA, 22 bp, Artificial Sequence
  chemically synthesized
atgcctgactaaaagttaactc

SEQ ID NO: 35892 - DNA, 22 bp, Artificial Sequence
  chemically synthesized
tgcctgactaaaagttaactct

SEQ ID NO: 35893 - DNA, 22 bp, Artificial Sequence
  chemically synthesized
actaaaagttaactctcattct

SEQ ID NO: 35894 - DNA, 22 bp, Artificial Sequence
  chemically synthesized
aaagttaactctcattctttca

SEQ ID NO: 35895 - DNA, 22 bp, Artificial Sequence
  chemically synthesized
actctcattctttcattcagca

SEQ ID NO: 35896 - DNA, 22 bp, Artificial Sequence
  chemically synthesized
tcattctttcattcagcaaata

SEQ ID NO: 35897 - DNA, 22 bp, Artificial Sequence
  chemically synthesized
attctttcattcagcaaatatt

SEQ ID NO: 35898 - DNA, 22 bp, Artificial Sequence
  chemically synthesized
tttcattcagcaaatattttgt

SEQ ID NO: 35899 - DNA, 22 bp, Artificial Sequence
  chemically synthesized
tcattcagcaaatattttgtgc

SEQ ID NO: 35900 - DNA, 22 bp, Artificial Sequence
  chemically synthesized
cattcagcaaatattttgtgct

SEQ ID NO: 35901 - DNA, 22 bp, Artificial Sequence
  chemically synthesized
attcagcaaatattttgtgcta

SEQ ID NO: 35902 - DNA, 22 bp, Artificial Sequence
  chemically synthesized
agcaaatattttgtgctagtgc

SEQ ID NO: 35903 - DNA, 22 bp, Artificial Sequence
  chemically synthesized
tgtgctagtgcatgacactgca

SEQ ID NO: 35904 - DNA, 22 bp, Artificial Sequence
  chemically synthesized
gtgctagtgcatgacactgcag

SEQ ID NO: 35905 - DNA, 22 bp, Artificial Sequence
  chemically synthesized
tgctagtgcatgacactgcaga

SEQ ID NO: 35906 - DNA, 22 bp, Artificial Sequence
  chemically synthesized
gtgcatgacactgcagattaat

SEQ ID NO: 35907 - DNA, 22 bp, Artificial Sequence
  chemically synthesized
cagattaatatcgtagatgaac

SEQ ID NO: 35908 - DNA, 22 bp, Artificial Sequence
  chemically synthesized
atatcgtagatgaactgagtct

SEQ ID NO: 35909 - DNA, 22 bp, Artificial Sequence
  chemically synthesized
agtctgggctaggtagagtcaa

SEQ ID NO: 35910 - DNA, 22 bp, Artificial Sequence
  chemically synthesized
ggctaggtagagtcaaaaaaaa

SEQ ID NO: 35911 - DNA, 22 bp, Artificial Sequence
  chemically synthesized
ggtagagtcaaaaaaaaatttc

SEQ ID NO: 35912 - DNA, 22 bp, Artificial Sequence
  chemically synthesized
cctaaaggagcctgtacctaaa

SEQ ID NO: 35913 - DNA, 22 bp, Artificial Sequence
  chemically synthesized
ctaaaggagcctgtacctaaac

SEQ ID NO: 35914 - DNA, 22 bp, Artificial Sequence
  chemically synthesized
aaggagcctgtacctaaactga

SEQ ID NO: 35915 - DNA, 22 bp, Artificial Sequence
  chemically synthesized
tacctaaactgagtcttcagag

SEQ ID NO: 35916 - DNA, 22 bp, Artificial Sequence
  chemically synthesized
aactgagtcttcagagagaagt

SEQ ID NO: 35917 - DNA, 22 bp, Artificial Sequence
  chemically synthesized
agtcttcagagagaagttggaa

SEQ ID NO: 35918 - DNA, 22 bp, Artificial Sequence
  chemically synthesized
cagagagaagttggaactggca

SEQ ID NO: 35919 - DNA, 22 bp, Artificial Sequence
  chemically synthesized
agagagaagttggaactggcaa

SEQ ID NO: 35920 - DNA, 22 bp, Artificial Sequence
  chemically synthesized
gaactggcaaagtgaggaagga

SEQ ID NO: 35921 - DNA, 22 bp, Artificial Sequence
  chemically synthesized
gcaaagtgaggaaggacggggt

SEQ ID NO: 35922 - DNA, 22 bp, Artificial Sequence
  chemically synthesized
gagggaagagtgagtgcaaagg

SEQ ID NO: 35923 - DNA, 22 bp, Artificial Sequence
  chemically synthesized
catgctctagaatccaaaactg

SEQ ID NO: 35924 - DNA, 22 bp, Artificial Sequence
  chemically synthesized
tagaatccaaaactgtgtcagc

SEQ ID NO: 35925 - DNA, 22 bp, Artificial Sequence
  chemically synthesized
gaatccaaaactgtgtcagcca

SEQ ID NO: 35926 - DNA, 22 bp, Artificial Sequence
  chemically synthesized
tgtcagccaaatttgagttgat

SEQ ID NO: 35927 - DNA, 22 bp, Artificial Sequence
  chemically synthesized
gagttgatggagggacagccaa

SEQ ID NO: 35928 - DNA, 22 bp, Artificial Sequence
  chemically synthesized
agttgatggagggacagccaaa

SEQ ID NO: 35929 - DNA, 22 bp, Artificial Sequence
  chemically synthesized
atggagggacagccaaactgag

SEQ ID NO: 35930 - DNA, 22 bp, Artificial Sequence
  chemically synthesized
agatacccaggcggtggttgga

SEQ ID NO: 35931 - DNA, 22 bp, Artificial Sequence
  chemically synthesized
gatttatggatctggatttcag

SEQ ID NO: 35932 - DNA, 22 bp, Artificial Sequence
  chemically synthesized
atggatctggatttcaggggag

SEQ ID NO: 35933 - DNA, 22 bp, Artificial Sequence
  chemically synthesized
tggatctggatttcaggggagt

SEQ ID NO: 35934 - DNA, 22 bp, Artificial Sequence
  chemically synthesized
gatttcaggggagtgggcaggg

SEQ ID NO: 35935 - DNA, 22 bp, Artificial Sequence
  chemically synthesized
caggggagtgggcagggctagg

SEQ ID NO: 35936 - DNA, 22 bp, Artificial Sequence
  chemically synthesized
aggggagtgggcagggctaggg

SEQ ID NO: 35937 - DNA, 22 bp, Artificial Sequence
  chemically synthesized
ggggaatagaactgagggtcat

SEQ ID NO: 35938 - DNA, 22 bp, Artificial Sequence
  chemically synthesized
agggtcatgatgtcagtggtag

SEQ ID NO: 35939 - DNA, 22 bp, Artificial Sequence
  chemically synthesized
aagtcttggaagaaagagtaga

SEQ ID NO: 35940 - DNA, 22 bp, Artificial Sequence
  chemically synthesized
ggaagaaagagtagatagaaac

SEQ ID NO: 35941 - DNA, 22 bp, Artificial Sequence
  chemically synthesized
gaagaaagagtagatagaaact

SEQ ID NO: 35942 - DNA, 22 bp, Artificial Sequence
  chemically synthesized
tgttttctgatgaacattctat

SEQ ID NO: 35943 - DNA, 22 bp, Artificial Sequence
  chemically synthesized
gttttctgatgaacattctatg

SEQ ID NO: 35944 - DNA, 22 bp, Artificial Sequence
  chemically synthesized
ttttctgatgaacattctatga

SEQ ID NO: 35945 - DNA, 22 bp, Artificial Sequence
  chemically synthesized
tctgatgaacattctatgagga

SEQ ID NO: 35946 - DNA, 22 bp, Artificial Sequence
  chemically synthesized
ctgatgaacattctatgaggaa

SEQ ID NO: 35947 - DNA, 22 bp, Artificial Sequence
  chemically synthesized
tgatgaacattctatgaggaag

SEQ ID NO: 35948 - DNA, 22 bp, Artificial Sequence
  chemically synthesized
atgaacattctatgaggaagtt

SEQ ID NO: 35949 - DNA, 22 bp, Artificial Sequence
  chemically synthesized
tatgaggaagttcagcagaggt

SEQ ID NO: 35950 - DNA, 22 bp, Artificial Sequence
  chemically synthesized
tgaggaagttcagcagaggttg

SEQ ID NO: 35951 - DNA, 22 bp, Artificial Sequence
  chemically synthesized
agcagaggttggaaacatcttt

SEQ ID NO: 35952 - DNA, 22 bp, Artificial Sequence
  chemically synthesized
gaaacatctttaccatttataa

SEQ ID NO: 35953 - DNA, 22 bp, Artificial Sequence
  chemically synthesized
taccatttataaataaatttta

SEQ ID NO: 35954 - DNA, 22 bp, Artificial Sequence
  chemically synthesized
accatttataaataaattttat

SEQ ID NO: 35955 - DNA, 22 bp, Artificial Sequence
  chemically synthesized
ccatttataaataaattttatg

SEQ ID NO: 35956 - DNA, 22 bp, Artificial Sequence
  chemically synthesized
ataaataaattttatgtaaaat

SEQ ID NO: 35957 - DNA, 22 bp, Artificial Sequence
  chemically synthesized
taaataaattttatgtaaaatc

SEQ ID NO: 35958 - DNA, 22 bp, Artificial Sequence
  chemically synthesized
tatgtaaaatcctatcctgctg

SEQ ID NO: 35959 - DNA, 22 bp, Artificial Sequence
  chemically synthesized
atgtaaaatcctatcctgctgt

SEQ ID NO: 35960 - DNA, 22 bp, Artificial Sequence
  chemically synthesized
tgtaaaatcctatcctgctgtc

SEQ ID NO: 35961 - DNA, 22 bp, Artificial Sequence
  chemically synthesized
tcctgctgtcatgtttaagcaa

SEQ ID NO: 35962 - DNA, 22 bp, Artificial Sequence
  chemically synthesized
ctgtcatgtttaagcaacttat

SEQ ID NO: 35963 - DNA, 22 bp, Artificial Sequence
  chemically synthesized
tcatgtttaagcaacttattat

SEQ ID NO: 35964 - DNA, 22 bp, Artificial Sequence
  chemically synthesized
aagcaacttattatgcacagca

SEQ ID NO: 35965 - DNA, 22 bp, Artificial Sequence
  chemically synthesized
agcaacttattatgcacagcac

SEQ ID NO: 35966 - DNA, 22 bp, Artificial Sequence
  chemically synthesized
attatgcacagcaccaggacat

SEQ ID NO: 35967 - DNA, 22 bp, Artificial Sequence
  chemically synthesized
ttatgcacagcaccaggacatc

SEQ ID NO: 35968 - DNA, 22 bp, Artificial Sequence
  chemically synthesized
tgcacagcaccaggacatcaat

SEQ ID NO: 35969 - DNA, 22 bp, Artificial Sequence
  chemically synthesized
catgccagtctttgctctcagt

SEQ ID NO: 35970 - DNA, 22 bp, Artificial Sequence
  chemically synthesized
tgctctcagtttcaaaggcatt

SEQ ID NO: 35971 - DNA, 22 bp, Artificial Sequence
  chemically synthesized
gctctcagtttcaaaggcattc

SEQ ID NO: 35972 - DNA, 22 bp, Artificial Sequence
  chemically synthesized
ctctcagtttcaaaggcattct

SEQ ID NO: 35973 - DNA, 22 bp, Artificial Sequence
  chemically synthesized
tcagtttcaaaggcattcttcc

SEQ ID NO: 35974 - DNA, 22 bp, Artificial Sequence
  chemically synthesized
agtttcaaaggcattcttccct

SEQ ID NO: 35975 - DNA, 22 bp, Artificial Sequence
  chemically synthesized
caaaggcattcttccctgcctg

SEQ ID NO: 35976 - DNA, 22 bp, Artificial Sequence
  chemically synthesized
aaaggcattcttccctgcctgc

SEQ ID NO: 35977 - DNA, 22 bp, Artificial Sequence
  chemically synthesized
ttccctgcctgctgtctaatct

SEQ ID NO: 35978 - DNA, 22 bp, Artificial Sequence
  chemically synthesized
ccctgcctgctgtctaatcttt

SEQ ID NO: 35979 - DNA, 22 bp, Artificial Sequence
  chemically synthesized
cctgcctgctgtctaatcttta

SEQ ID NO: 35980 - DNA, 22 bp, Artificial Sequence
  chemically synthesized
cctgctgtctaatctttacaaa

SEQ ID NO: 35981 - DNA, 22 bp, Artificial Sequence
  chemically synthesized
ctgtctaatctttacaaagaaa

SEQ ID NO: 35982 - DNA, 22 bp, Artificial Sequence
  chemically synthesized
tctaatctttacaaagaaaggt

SEQ ID NO: 35983 - DNA, 22 bp, Artificial Sequence
  chemically synthesized
atctttacaaagaaaggttaac

SEQ ID NO: 35984 - DNA, 22 bp, Artificial Sequence
  chemically synthesized
tacaaagaaaggttaactccag

SEQ ID NO: 35985 - DNA, 22 bp, Artificial Sequence
  chemically synthesized
acaaagaaaggttaactccaga

SEQ ID NO: 35986 - DNA, 22 bp, Artificial Sequence
  chemically synthesized
caaagaaaggttaactccagag

SEQ ID NO: 35987 - DNA, 22 bp, Artificial Sequence
  chemically synthesized
actccagaggtcaggaatctga

SEQ ID NO: 35988 - DNA, 22 bp, Artificial Sequence
  chemically synthesized
cagaggtcaggaatctgaacac

SEQ ID NO: 35989 - DNA, 22 bp, Artificial Sequence
  chemically synthesized
aacacagaaaaccagattgcat

SEQ ID NO: 35990 - DNA, 22 bp, Artificial Sequence
  chemically synthesized
catcatattcattctaatcaat

SEQ ID NO: 35991 - DNA, 22 bp, Artificial Sequence
  chemically synthesized
attctaatcaataaacattata

SEQ ID NO: 35992 - DNA, 22 bp, Artificial Sequence
  chemically synthesized
taatcaataaacattatataat

SEQ ID NO: 35993 - DNA, 22 bp, Artificial Sequence
  chemically synthesized
atcaataaacattatataattt

SEQ ID NO: 35994 - DNA, 22 bp, Artificial Sequence
  chemically synthesized
tataatttttaaaactgtttct

SEQ ID NO: 35995 - DNA, 22 bp, Artificial Sequence
  chemically synthesized
ttaaaactgtttctcatctttt

SEQ ID NO: 35996 - DNA, 22 bp, Artificial Sequence
  chemically synthesized
taaaactgtttctcatctttta

SEQ ID NO: 35997 - DNA, 22 bp, Artificial Sequence
  chemically synthesized
aaaactgtttctcatcttttat

SEQ ID NO: 35998 - DNA, 22 bp, Artificial Sequence
  chemically synthesized
aaactgtttctcatcttttatt

SEQ ID NO: 35999 - DNA, 22 bp, Artificial Sequence
  chemically synthesized
tttctcatcttttatttcttca

SEQ ID NO: 36000 - DNA, 22 bp, Artificial Sequence
  chemically synthesized
ctcatcttttatttcttcattt

SEQ ID NO: 36001 - DNA, 22 bp, Artificial Sequence
  chemically synthesized
tcatcttttatttcttcatttt

SEQ ID NO: 36002 - DNA, 22 bp, Artificial Sequence
  chemically synthesized
atcttttatttcttcattttaa

SEQ ID NO: 36003 - DNA, 22 bp, Artificial Sequence
  chemically synthesized
ttatttcttcattttaatgaat

SEQ ID NO: 36004 - DNA, 22 bp, Artificial Sequence
  chemically synthesized
tatttcttcattttaatgaata

SEQ ID NO: 36005 - DNA, 22 bp, Artificial Sequence
  chemically synthesized
atttcttcattttaatgaatat

SEQ ID NO: 36006 - DNA, 22 bp, Artificial Sequence
  chemically synthesized
tttcttcattttaatgaatatg

SEQ ID NO: 36007 - DNA, 22 bp, Artificial Sequence
  chemically synthesized
cttcattttaatgaatatgtca

SEQ ID NO: 36008 - DNA, 22 bp, Artificial Sequence
  chemically synthesized
ttcattttaatgaatatgtcaa

SEQ ID NO: 36009 - DNA, 22 bp, Artificial Sequence
  chemically synthesized
cattttaatgaatatgtcaaca

SEQ ID NO: 36010 - DNA, 22 bp, Artificial Sequence
  chemically synthesized
attttaatgaatatgtcaacac

SEQ ID NO: 36011 - DNA, 22 bp, Artificial Sequence
  chemically synthesized
taatgaatatgtcaacacaaag

SEQ ID NO: 36012 - DNA, 22 bp, Artificial Sequence
  chemically synthesized
aatgaatatgtcaacacaaagc

SEQ ID NO: 36013 - DNA, 22 bp, Artificial Sequence
  chemically synthesized
atgaatatgtcaacacaaagcc

SEQ ID NO: 36014 - DNA, 22 bp, Artificial Sequence
  chemically synthesized
acacaaaagtacaactggggta

SEQ ID NO: 36015 - DNA, 22 bp, Artificial Sequence
  chemically synthesized
cacaaaagtacaactggggtaa

SEQ ID NO: 36016 - DNA, 22 bp, Artificial Sequence
  chemically synthesized
gggtaagaaaattcaaaagata

SEQ ID NO: 36017 - DNA, 22 bp, Artificial Sequence
  chemically synthesized
aaaagataaagtaataaaatta

SEQ ID NO: 36018 - DNA, 22 bp, Artificial Sequence
  chemically synthesized
aatttaaaatgaaataccctat

SEQ ID NO: 36019 - DNA, 22 bp, Artificial Sequence
  chemically synthesized
aaaatgaaataccctatgtatt

SEQ ID NO: 36020 - DNA, 22 bp, Artificial Sequence
  chemically synthesized
aaatgaaataccctatgtattt

SEQ ID NO: 36021 - DNA, 22 bp, Artificial Sequence
  chemically synthesized
tgtatttgagtaagttgcttag

SEQ ID NO: 36022 - DNA, 22 bp, Artificial Sequence
  chemically synthesized
gagtaagttgcttagcttctcc

SEQ ID NO: 36023 - DNA, 22 bp, Artificial Sequence
  chemically synthesized
agtaagttgcttagcttctccc

SEQ ID NO: 36024 - DNA, 22 bp, Artificial Sequence
  chemically synthesized
cttagcttctcccaaccttggt

SEQ ID NO: 36025 - DNA, 22 bp, Artificial Sequence
  chemically synthesized
agcttctcccaaccttggtttc

SEQ ID NO: 36026 - DNA, 22 bp, Artificial Sequence
  chemically synthesized
gcttctcccaaccttggtttcc

SEQ ID NO: 36027 - DNA, 22 bp, Artificial Sequence
  chemically synthesized
ctcccaaccttggtttcctcat

SEQ ID NO: 36028 - DNA, 22 bp, Artificial Sequence
  chemically synthesized
tcccaaccttggtttcctcatt

SEQ ID NO: 36029 - DNA, 22 bp, Artificial Sequence
  chemically synthesized
ccaaccttggtttcctcatttc

SEQ ID NO: 36030 - DNA, 22 bp, Artificial Sequence
  chemically synthesized
ggtttcctcatttctaaaacga

SEQ ID NO: 36031 - DNA, 22 bp, Artificial Sequence
  chemically synthesized
gtttcctcatttctaaaacgaa

SEQ ID NO: 36032 - DNA, 22 bp, Artificial Sequence
  chemically synthesized
cctcatttctaaaacgaagaac

SEQ ID NO: 36033 - DNA, 22 bp, Artificial Sequence
  chemically synthesized
ctcatttctaaaacgaagaact

SEQ ID NO: 36034 - DNA, 22 bp, Artificial Sequence
  chemically synthesized
atttctaaaacgaagaacttgc

SEQ ID NO: 36035 - DNA, 22 bp, Artificial Sequence
  chemically synthesized
ctaaaacgaagaacttgcttaa

SEQ ID NO: 36036 - DNA, 22 bp, Artificial Sequence
  chemically synthesized
taaaacgaagaacttgcttaat

SEQ ID NO: 36037 - DNA, 22 bp, Artificial Sequence
  chemically synthesized
aaacgaagaacttgcttaatat

SEQ ID NO: 36038 - DNA, 22 bp, Artificial Sequence
  chemically synthesized
gcttaatattcaggctctgggc

SEQ ID NO: 36039 - DNA, 22 bp, Artificial Sequence
  chemically synthesized
cttaatattcaggctctgggcc

SEQ ID NO: 36040 - DNA, 22 bp, Artificial Sequence
  chemically synthesized
aatattcaggctctgggcccca

SEQ ID NO: 36041 - DNA, 22 bp, Artificial Sequence
  chemically synthesized
atattcaggctctgggccccac

SEQ ID NO: 36042 - DNA, 22 bp, Artificial Sequence
  chemically synthesized
aggctctgggccccaccaccaa

SEQ ID NO: 36043 - DNA, 22 bp, Artificial Sequence
  chemically synthesized
tgggccccaccaccaaatcctt

SEQ ID NO: 36044 - DNA, 22 bp, Artificial Sequence
  chemically synthesized
ggccccaccaccaaatccttga

SEQ ID NO: 36045 - DNA, 22 bp, Artificial Sequence
  chemically synthesized
gattcactggctctgggtctgt

SEQ ID NO: 36046 - DNA, 22 bp, Artificial Sequence
  chemically synthesized
attcactggctctgggtctgta

SEQ ID NO: 36047 - DNA, 22 bp, Artificial Sequence
  chemically synthesized
actggctctgggtctgtatgta

SEQ ID NO: 36048 - DNA, 22 bp, Artificial Sequence
  chemically synthesized
gctctgggtctgtatgtaacaa

SEQ ID NO: 36049 - DNA, 22 bp, Artificial Sequence
  chemically synthesized
tgggtctgtatgtaacaagctt

SEQ ID NO: 36050 - DNA, 22 bp, Artificial Sequence
  chemically synthesized
ggtctgtatgtaacaagcttct

SEQ ID NO: 36051 - DNA, 22 bp, Artificial Sequence
  chemically synthesized
tatgtaacaagcttctggagtg

SEQ ID NO: 36052 - DNA, 22 bp, Artificial Sequence
  chemically synthesized
ctggagtgattctaatgattag

SEQ ID NO: 36053 - DNA, 22 bp, Artificial Sequence
  chemically synthesized
tggagtgattctaatgattagc

SEQ ID NO: 36054 - DNA, 22 bp, Artificial Sequence
  chemically synthesized
gagtgattctaatgattagcca

SEQ ID NO: 36055 - DNA, 22 bp, Artificial Sequence
  chemically synthesized
taatgattagccagagacagga

SEQ ID NO: 36056 - DNA, 22 bp, Artificial Sequence
  chemically synthesized
atgattagccagagacaggacc

SEQ ID NO: 36057 - DNA, 22 bp, Artificial Sequence
  chemically synthesized
gccagagacaggacctactatt

SEQ ID NO: 36058 - DNA, 22 bp, Artificial Sequence
  chemically synthesized
ctattctacgtaactgatttcc

SEQ ID NO: 36059 - DNA, 22 bp, Artificial Sequence
  chemically synthesized
ttctacgtaactgatttcctct

SEQ ID NO: 36060 - DNA, 22 bp, Artificial Sequence
  chemically synthesized
tacgtaactgatttcctcttgc

SEQ ID NO: 36061 - DNA, 22 bp, Artificial Sequence
  chemically synthesized
cgtaactgatttcctcttgctg

SEQ ID NO: 36062 - DNA, 22 bp, Artificial Sequence
  chemically synthesized
atttcctcttgctgctgtaaaa

SEQ ID NO: 36063 - DNA, 22 bp, Artificial Sequence
  chemically synthesized
cctcttgctgctgtaaaaaatt

SEQ ID NO: 36064 - DNA, 22 bp, Artificial Sequence
  chemically synthesized
ctcttgctgctgtaaaaaatta

SEQ ID NO: 36065 - DNA, 22 bp, Artificial Sequence
  chemically synthesized
ttgctgctgtaaaaaattacca

SEQ ID NO: 36066 - DNA, 22 bp, Artificial Sequence
  chemically synthesized
gctgctgtaaaaaattaccaca

SEQ ID NO: 36067 - DNA, 22 bp, Artificial Sequence
  chemically synthesized
ctgctgtaaaaaattaccacaa

SEQ ID NO: 36068 - DNA, 22 bp, Artificial Sequence
  chemically synthesized
ctgtaaaaaattaccacaaatt

SEQ ID NO: 36069 - DNA, 22 bp, Artificial Sequence
  chemically synthesized
taaaaaattaccacaaatttat

SEQ ID NO: 36070 - DNA, 22 bp, Artificial Sequence
  chemically synthesized
ccacaaatttattggcttaaaa

SEQ ID NO: 36071 - DNA, 22 bp, Artificial Sequence
  chemically synthesized
attggcttaaaacaacacaaat

SEQ ID NO: 36072 - DNA, 22 bp, Artificial Sequence
  chemically synthesized
ttggcttaaaacaacacaaatg

SEQ ID NO: 36073 - DNA, 22 bp, Artificial Sequence
  chemically synthesized
gcttaaaacaacacaaatgtat

SEQ ID NO: 36074 - DNA, 22 bp, Artificial Sequence
  chemically synthesized
aaaacaacacaaatgtattatc

SEQ ID NO: 36075 - DNA, 22 bp, Artificial Sequence
  chemically synthesized
aaacaacacaaatgtattatct

SEQ ID NO: 36076 - DNA, 22 bp, Artificial Sequence
  chemically synthesized
tcttgaagttgtggaggtcaga

SEQ ID NO: 36077 - DNA, 22 bp, Artificial Sequence
  chemically synthesized
gaagttgtggaggtcagaagtc

SEQ ID NO: 36078 - DNA, 22 bp, Artificial Sequence
  chemically synthesized
aagttgtggaggtcagaagtct

SEQ ID NO: 36079 - DNA, 22 bp, Artificial Sequence
  chemically synthesized
tggaggtcagaagtctgaaatc

SEQ ID NO: 36080 - DNA, 22 bp, Artificial Sequence
  chemically synthesized
aaatcggtttcactgggctaaa

SEQ ID NO: 36081 - DNA, 22 bp, Artificial Sequence
  chemically synthesized
cactgggctaaagtcgaggtgt

SEQ ID NO: 36082 - DNA, 22 bp, Artificial Sequence
  chemically synthesized
actgggctaaagtcgaggtgtc

SEQ ID NO: 36083 - DNA, 22 bp, Artificial Sequence
  chemically synthesized
ggctaaagtcgaggtgtcagtg

SEQ ID NO: 36084 - DNA, 22 bp, Artificial Sequence
  chemically synthesized
aagtcgaggtgtcagtgtggct

SEQ ID NO: 36085 - DNA, 22 bp, Artificial Sequence
  chemically synthesized
tttcttctggagactctatgag

SEQ ID NO: 36086 - DNA, 22 bp, Artificial Sequence
  chemically synthesized
cttctggagactctatgagaga

SEQ ID NO: 36087 - DNA, 22 bp, Artificial Sequence
  chemically synthesized
ttctggagactctatgagagat

SEQ ID NO: 36088 - DNA, 22 bp, Artificial Sequence
  chemically synthesized
ctggagactctatgagagattg

SEQ ID NO: 36089 - DNA, 22 bp, Artificial Sequence
  chemically synthesized
tggagactctatgagagattgt

SEQ ID NO: 36090 - DNA, 22 bp, Artificial Sequence
  chemically synthesized
gagactctatgagagattgtgt

SEQ ID NO: 36091 - DNA, 22 bp, Artificial Sequence
  chemically synthesized
tatgagagattgtgttttcctg

SEQ ID NO: 36092 - DNA, 22 bp, Artificial Sequence
  chemically synthesized
tgagagattgtgttttcctgcc

SEQ ID NO: 36093 - DNA, 22 bp, Artificial Sequence
  chemically synthesized
tgttttcctgccttttccatgg

SEQ ID NO: 36094 - DNA, 22 bp, Artificial Sequence
  chemically synthesized
tcctgccttttccatggattct

SEQ ID NO: 36095 - DNA, 22 bp, Artificial Sequence
  chemically synthesized
cctgccttttccatggattctg

SEQ ID NO: 36096 - DNA, 22 bp, Artificial Sequence
  chemically synthesized
ctgccttttccatggattctgt

SEQ ID NO: 36097 - DNA, 22 bp, Artificial Sequence
  chemically synthesized
ccttttccatggattctgtttc

SEQ ID NO: 36098 - DNA, 22 bp, Artificial Sequence
  chemically synthesized
ttccatggattctgtttcctct

SEQ ID NO: 36099 - DNA, 22 bp, Artificial Sequence
  chemically synthesized
tccatggattctgtttcctctt

SEQ ID NO: 36100 - DNA, 22 bp, Artificial Sequence
  chemically synthesized
ccatggattctgtttcctcttc

SEQ ID NO: 36101 - DNA, 22 bp, Artificial Sequence
  chemically synthesized
catggattctgtttcctcttct

SEQ ID NO: 36102 - DNA, 22 bp, Artificial Sequence
  chemically synthesized
tgtttcctcttctagaggctac

SEQ ID NO: 36103 - DNA, 22 bp, Artificial Sequence
  chemically synthesized
tttcctcttctagaggctaccc

SEQ ID NO: 36104 - DNA, 22 bp, Artificial Sequence
  chemically synthesized
cctcttctagaggctacccaca

SEQ ID NO: 36105 - DNA, 22 bp, Artificial Sequence
  chemically synthesized
ctcttctagaggctacccacat

SEQ ID NO: 36106 - DNA, 22 bp, Artificial Sequence
  chemically synthesized
ttctagaggctacccacattcc

SEQ ID NO: 36107 - DNA, 22 bp, Artificial Sequence
  chemically synthesized
ctagaggctacccacattcctt

SEQ ID NO: 36108 - DNA, 22 bp, Artificial Sequence
  chemically synthesized
tagaggctacccacattccttg

SEQ ID NO: 36109 - DNA, 22 bp, Artificial Sequence
  chemically synthesized
gaggctacccacattccttggt

SEQ ID NO: 36110 - DNA, 22 bp, Artificial Sequence
  chemically synthesized
cccacattccttggtttgtagc

SEQ ID NO: 36111 - DNA, 22 bp, Artificial Sequence
  chemically synthesized
cttggtttgtagcctcttcctc

SEQ ID NO: 36112 - DNA, 22 bp, Artificial Sequence
  chemically synthesized
ggtttgtagcctcttcctcgat

SEQ ID NO: 36113 - DNA, 22 bp, Artificial Sequence
  chemically synthesized
gtttgtagcctcttcctcgatc

SEQ ID NO: 36114 - DNA, 22 bp, Artificial Sequence
  chemically synthesized
gtagcctcttcctcgatcttca

SEQ ID NO: 36115 - DNA, 22 bp, Artificial Sequence
  chemically synthesized
tagcctcttcctcgatcttcaa

SEQ ID NO: 36116 - DNA, 22 bp, Artificial Sequence
  chemically synthesized
ttcctcgatcttcaaaaaaatg

SEQ ID NO: 36117 - DNA, 22 bp, Artificial Sequence
  chemically synthesized
cctcgatcttcaaaaaaatgta

SEQ ID NO: 36118 - DNA, 22 bp, Artificial Sequence
  chemically synthesized
ctcgatcttcaaaaaaatgtat

SEQ ID NO: 36119 - DNA, 22 bp, Artificial Sequence
  chemically synthesized
gatcttcaaaaaaatgtatctc

SEQ ID NO: 36120 - DNA, 22 bp, Artificial Sequence
  chemically synthesized
caaaaaaatgtatctctgcttt

SEQ ID NO: 36121 - DNA, 22 bp, Artificial Sequence
  chemically synthesized
aaaaaaatgtatctctgctttt

SEQ ID NO: 36122 - DNA, 22 bp, Artificial Sequence
  chemically synthesized
tgcttttgtaatcacgtcacat

SEQ ID NO: 36123 - DNA, 22 bp, Artificial Sequence
  chemically synthesized
cttttgtaatcacgtcacattt

SEQ ID NO: 36124 - DNA, 22 bp, Artificial Sequence
  chemically synthesized
ttgtaatcacgtcacattttct

SEQ ID NO: 36125 - DNA, 22 bp, Artificial Sequence
  chemically synthesized
tgtaatcacgtcacattttctc

SEQ ID NO: 36126 - DNA, 22 bp, Artificial Sequence
  chemically synthesized
gtaatcacgtcacattttctcc

SEQ ID NO: 36127 - DNA, 22 bp, Artificial Sequence
  chemically synthesized
taatcacgtcacattttctcct

SEQ ID NO: 36128 - DNA, 22 bp, Artificial Sequence
  chemically synthesized
tctcctcttataagtcaaatct

SEQ ID NO: 36129 - DNA, 22 bp, Artificial Sequence
  chemically synthesized
ctcctcttataagtcaaatctc

SEQ ID NO: 36130 - DNA, 22 bp, Artificial Sequence
  chemically synthesized
tcctcttataagtcaaatctcc

SEQ ID NO: 36131 - DNA, 22 bp, Artificial Sequence
  chemically synthesized
ctcttataagtcaaatctccct

SEQ ID NO: 36132 - DNA, 22 bp, Artificial Sequence
  chemically synthesized
ttataagtcaaatctccctttg

SEQ ID NO: 36133 - DNA, 22 bp, Artificial Sequence
  chemically synthesized
ataagtcaaatctccctttgcc

SEQ ID NO: 36134 - DNA, 22 bp, Artificial Sequence
  chemically synthesized
taagtcaaatctccctttgcct

SEQ ID NO: 36135 - DNA, 22 bp, Artificial Sequence
  chemically synthesized
cctttgcctccctcttataatg

SEQ ID NO: 36136 - DNA, 22 bp, Artificial Sequence
  chemically synthesized
tgcctccctcttataatgacac

SEQ ID NO: 36137 - DNA, 22 bp, Artificial Sequence
  chemically synthesized
gcctccctcttataatgacact

SEQ ID NO: 36138 - DNA, 22 bp, Artificial Sequence
  chemically synthesized
cctccctcttataatgacactt

SEQ ID NO: 36139 - DNA, 22 bp, Artificial Sequence
  chemically synthesized
cctcttataatgacacttgtga

SEQ ID NO: 36140 - DNA, 22 bp, Artificial Sequence
  chemically synthesized
ttataatgacacttgtgattac

SEQ ID NO: 36141 - DNA, 22 bp, Artificial Sequence
  chemically synthesized
ataatgacacttgtgattacat

SEQ ID NO: 36142 - DNA, 22 bp, Artificial Sequence
  chemically synthesized
taatgacacttgtgattacatt

SEQ ID NO: 36143 - DNA, 22 bp, Artificial Sequence
  chemically synthesized
gtgattacatttaggatacacc

SEQ ID NO: 36144 - DNA, 22 bp, Artificial Sequence
  chemically synthesized
tgattacatttaggatacaccc

SEQ ID NO: 36145 - DNA, 22 bp, Artificial Sequence
  chemically synthesized
catttaggatacacccaaataa

SEQ ID NO: 36146 - DNA, 22 bp, Artificial Sequence
  chemically synthesized
aggatacacccaaataattagg

SEQ ID NO: 36147 - DNA, 22 bp, Artificial Sequence
  chemically synthesized
ggatacacccaaataattagga

SEQ ID NO: 36148 - DNA, 22 bp, Artificial Sequence
  chemically synthesized
ggatatctccccatcccaagat

SEQ ID NO: 36149 - DNA, 22 bp, Artificial Sequence
  chemically synthesized
cccatcccaagatccttaatta

SEQ ID NO: 36150 - DNA, 22 bp, Artificial Sequence
  chemically synthesized
aattatatatgcaaaagtctgt

SEQ ID NO: 36151 - DNA, 22 bp, Artificial Sequence
  chemically synthesized
attatatatgcaaaagtctgtt

SEQ ID NO: 36152 - DNA, 22 bp, Artificial Sequence
  chemically synthesized
tatatgcaaaagtctgtttggc

SEQ ID NO: 36153 - DNA, 22 bp, Artificial Sequence
  chemically synthesized
tttggctagaaaagataatact

SEQ ID NO: 36154 - DNA, 22 bp, Artificial Sequence
  chemically synthesized
ggctagaaaagataatactcac

SEQ ID NO: 36155 - DNA, 22 bp, Artificial Sequence
  chemically synthesized
gctagaaaagataatactcaca

SEQ ID NO: 36156 - DNA, 22 bp, Artificial Sequence
  chemically synthesized
gaaaagataatactcacaggtt

SEQ ID NO: 36157 - DNA, 22 bp, Artificial Sequence
  chemically synthesized
acaggtttcaggggttaagcca

SEQ ID NO: 36158 - DNA, 22 bp, Artificial Sequence
  chemically synthesized
caggggttaagccatacatatc

SEQ ID NO: 36159 - DNA, 22 bp, Artificial Sequence
  chemically synthesized
aggggttaagccatacatatct

SEQ ID NO: 36160 - DNA, 22 bp, Artificial Sequence
  chemically synthesized
agccatacatatctttcagagt

SEQ ID NO: 36161 - DNA, 22 bp, Artificial Sequence
  chemically synthesized
tcagagtgagccattagccatt

SEQ ID NO: 36162 - DNA, 22 bp, Artificial Sequence
  chemically synthesized
cagagtgagccattagccatta

SEQ ID NO: 36163 - DNA, 22 bp, Artificial Sequence
  chemically synthesized
agagtgagccattagccattat

SEQ ID NO: 36164 - DNA, 22 bp, Artificial Sequence
  chemically synthesized
gccattattcagcctactgcga

SEQ ID NO: 36165 - DNA, 22 bp, Artificial Sequence
  chemically synthesized
ttcagcctactgcgataatgtg

SEQ ID NO: 36166 - DNA, 22 bp, Artificial Sequence
  chemically synthesized
agcctactgcgataatgtgcaa

SEQ ID NO: 36167 - DNA, 22 bp, Artificial Sequence
  chemically synthesized
ctgcgataatgtgcaagttccc

SEQ ID NO: 36168 - DNA, 22 bp, Artificial Sequence
  chemically synthesized
cgataatgtgcaagttcccttt

SEQ ID NO: 36169 - DNA, 22 bp, Artificial Sequence
  chemically synthesized
cctttacaatctatgttctatg

SEQ ID NO: 36170 - DNA, 22 bp, Artificial Sequence
  chemically synthesized
tacaatctatgttctatgttcc

SEQ ID NO: 36171 - DNA, 22 bp, Artificial Sequence
  chemically synthesized
acaatctatgttctatgttccc

SEQ ID NO: 36172 - DNA, 22 bp, Artificial Sequence
  chemically synthesized
caatctatgttctatgttccca

SEQ ID NO: 36173 - DNA, 22 bp, Artificial Sequence
  chemically synthesized
tgttctatgttcccatcaaggt

SEQ ID NO: 36174 - DNA, 22 bp, Artificial Sequence
  chemically synthesized
tatgttcccatcaaggttaatt

SEQ ID NO: 36175 - DNA, 22 bp, Artificial Sequence
  chemically synthesized
tgttcccatcaaggttaattag

SEQ ID NO: 36176 - DNA, 22 bp, Artificial Sequence
  chemically synthesized
ccatcaaggttaattagaaata

SEQ ID NO: 36177 - DNA, 22 bp, Artificial Sequence
  chemically synthesized
attagaaatattagactctttt

SEQ ID NO: 36178 - DNA, 22 bp, Artificial Sequence
  chemically synthesized
gaaatattagactctttttcca

SEQ ID NO: 36179 - DNA, 22 bp, Artificial Sequence
  chemically synthesized
gactctttttccacagaaaaaa

SEQ ID NO: 36180 - DNA, 22 bp, Artificial Sequence
  chemically synthesized
tttttccacagaaaaaaaaaat

SEQ ID NO: 36181 - DNA, 22 bp, Artificial Sequence
  chemically synthesized
tttccacagaaaaaaaaaatgt

SEQ ID NO: 36182 - DNA, 22 bp, Artificial Sequence
  chemically synthesized
ttccacagaaaaaaaaaatgta

SEQ ID NO: 36183 - DNA, 22 bp, Artificial Sequence
  chemically synthesized
tccacagaaaaaaaaaatgtag

SEQ ID NO: 36184 - DNA, 22 bp, Artificial Sequence
  chemically synthesized
ccacagaaaaaaaaaatgtagc

SEQ ID NO: 36185 - DNA, 22 bp, Artificial Sequence
  chemically synthesized
cacagaaaaaaaaaatgtagca

SEQ ID NO: 36186 - DNA, 22 bp, Artificial Sequence
  chemically synthesized
catctctaccctgacttctctc

SEQ ID NO: 36187 - DNA, 22 bp, Artificial Sequence
  chemically synthesized
atctctaccctgacttctctct

SEQ ID NO: 36188 - DNA, 22 bp, Artificial Sequence
  chemically synthesized
taccctgacttctctctctttc

SEQ ID NO: 36189 - DNA, 22 bp, Artificial Sequence
  chemically synthesized
ccctgacttctctctctttcct

SEQ ID NO: 36190 - DNA, 22 bp, Artificial Sequence
  chemically synthesized
acttctctctctttccttcatg

SEQ ID NO: 36191 - DNA, 22 bp, Artificial Sequence
  chemically synthesized
ctctctctttccttcatgccca

SEQ ID NO: 36192 - DNA, 22 bp, Artificial Sequence
  chemically synthesized
tctctctttccttcatgcccag

SEQ ID NO: 36193 - DNA, 22 bp, Artificial Sequence
  chemically synthesized
tctctttccttcatgcccagta

SEQ ID NO: 36194 - DNA, 22 bp, Artificial Sequence
  chemically synthesized
tctttccttcatgcccagtaag

SEQ ID NO: 36195 - DNA, 22 bp, Artificial Sequence
  chemically synthesized
tttccttcatgcccagtaagag

SEQ ID NO: 36196 - DNA, 22 bp, Artificial Sequence
  chemically synthesized
tccttcatgcccagtaagagga

SEQ ID NO: 36197 - DNA, 22 bp, Artificial Sequence
  chemically synthesized
ccttcatgcccagtaagaggaa

SEQ ID NO: 36198 - DNA, 22 bp, Artificial Sequence
  chemically synthesized
cttcatgcccagtaagaggaag

SEQ ID NO: 36199 - DNA, 22 bp, Artificial Sequence
  chemically synthesized
catgcccagtaagaggaagtga

SEQ ID NO: 36200 - DNA, 22 bp, Artificial Sequence
  chemically synthesized
atgcccagtaagaggaagtgag

SEQ ID NO: 36201 - DNA, 22 bp, Artificial Sequence
  chemically synthesized
ttcatctcatcaggtgttacct

SEQ ID NO: 36202 - DNA, 22 bp, Artificial Sequence
  chemically synthesized
atctcatcaggtgttacctaga

SEQ ID NO: 36203 - DNA, 22 bp, Artificial Sequence
  chemically synthesized
atcaggtgttacctagaatcag

SEQ ID NO: 36204 - DNA, 22 bp, Artificial Sequence
  chemically synthesized
cctagaatcagagtcaggagaa

SEQ ID NO: 36205 - DNA, 22 bp, Artificial Sequence
  chemically synthesized
gaatcagagtcaggagaaagca

SEQ ID NO: 36206 - DNA, 22 bp, Artificial Sequence
  chemically synthesized
ataaaactactctgacaagtaa

SEQ ID NO: 36207 - DNA, 22 bp, Artificial Sequence
  chemically synthesized
ctctgacaagtaaaccatatcc

SEQ ID NO: 36208 - DNA, 22 bp, Artificial Sequence
  chemically synthesized
tgacaagtaaaccatatcctgg

SEQ ID NO: 36209 - DNA, 22 bp, Artificial Sequence
  chemically synthesized
acaagtaaaccatatcctgggg

SEQ ID NO: 36210 - DNA, 22 bp, Artificial Sequence
  chemically synthesized
gggaccaggtgagaattaaaaa

SEQ ID NO: 36211 - DNA, 22 bp, Artificial Sequence
  chemically synthesized
aaaagctgtatactcataagct

SEQ ID NO: 36212 - DNA, 22 bp, Artificial Sequence
  chemically synthesized
tatactcataagctgccaaaga

SEQ ID NO: 36213 - DNA, 22 bp, Artificial Sequence
  chemically synthesized
ataagctgccaaagagctgatg

SEQ ID NO: 36214 - DNA, 22 bp, Artificial Sequence
  chemically synthesized
ccaaagagctgatggtactgaa

SEQ ID NO: 36215 - DNA, 22 bp, Artificial Sequence
  chemically synthesized
atggtactgaagtcacatggag

SEQ ID NO: 36216 - DNA, 22 bp, Artificial Sequence
  chemically synthesized
aagtcacatggagctcaggaat

SEQ ID NO: 36217 - DNA, 22 bp, Artificial Sequence
  chemically synthesized
aggaatttattcttgcatttag

SEQ ID NO: 36218 - DNA, 22 bp, Artificial Sequence
  chemically synthesized
attcttgcatttagaaagtatg

SEQ ID NO: 36219 - DNA, 22 bp, Artificial Sequence
  chemically synthesized
ttcttgcatttagaaagtatgc

SEQ ID NO: 36220 - DNA, 22 bp, Artificial Sequence
  chemically synthesized
ttgcatttagaaagtatgcata

SEQ ID NO: 36221 - DNA, 22 bp, Artificial Sequence
  chemically synthesized
gcatttagaaagtatgcatata

SEQ ID NO: 36222 - DNA, 22 bp, Artificial Sequence
  chemically synthesized
catttagaaagtatgcatataa

SEQ ID NO: 36223 - DNA, 22 bp, Artificial Sequence
  chemically synthesized
agaaagtatgcatataattctc

SEQ ID NO: 36224 - DNA, 22 bp, Artificial Sequence
  chemically synthesized
gaaagtatgcatataattctct

SEQ ID NO: 36225 - DNA, 22 bp, Artificial Sequence
  chemically synthesized
tctcgaaaagaaatgaaatcat

SEQ ID NO: 36226 - DNA, 22 bp, Artificial Sequence
  chemically synthesized
tcgaaaagaaatgaaatcatat

SEQ ID NO: 36227 - DNA, 22 bp, Artificial Sequence
  chemically synthesized
gaaaagaaatgaaatcatattt

SEQ ID NO: 36228 - DNA, 22 bp, Artificial Sequence
  chemically synthesized
ttctgtcggatcaaattattca

SEQ ID NO: 36229 - DNA, 22 bp, Artificial Sequence
  chemically synthesized
tctgtcggatcaaattattcag

SEQ ID NO: 36230 - DNA, 22 bp, Artificial Sequence
  chemically synthesized
ctgtcggatcaaattattcaga

SEQ ID NO: 36231 - DNA, 22 bp, Artificial Sequence
  chemically synthesized
tgtcggatcaaattattcagaa

SEQ ID NO: 36232 - DNA, 22 bp, Artificial Sequence
  chemically synthesized
tcggatcaaattattcagaaat

SEQ ID NO: 36233 - DNA, 22 bp, Artificial Sequence
  chemically synthesized
ttcagaaatccgaactgtagaa

SEQ ID NO: 36234 - DNA, 22 bp, Artificial Sequence
  chemically synthesized
agaaatccgaactgtagaaaac

SEQ ID NO: 36235 - DNA, 22 bp, Artificial Sequence
  chemically synthesized
tagaaaacatacaaacacactt

SEQ ID NO: 36236 - DNA, 22 bp, Artificial Sequence
  chemically synthesized
gcttaatgttagctttttaatc

SEQ ID NO: 36237 - DNA, 22 bp, Artificial Sequence
  chemically synthesized
cttaatgttagctttttaatct

SEQ ID NO: 36238 - DNA, 22 bp, Artificial Sequence
  chemically synthesized
aatgttagctttttaatcttat

SEQ ID NO: 36239 - DNA, 22 bp, Artificial Sequence
  chemically synthesized
atgttagctttttaatcttatt

SEQ ID NO: 36240 - DNA, 22 bp, Artificial Sequence
  chemically synthesized
gctttttaatcttatttttgta

SEQ ID NO: 36241 - DNA, 22 bp, Artificial Sequence
  chemically synthesized
tttaatcttatttttgtacaca

SEQ ID NO: 36242 - DNA, 22 bp, Artificial Sequence
  chemically synthesized
ttaatcttatttttgtacacag

SEQ ID NO: 36243 - DNA, 22 bp, Artificial Sequence
  chemically synthesized
taatcttatttttgtacacagt

SEQ ID NO: 36244 - DNA, 22 bp, Artificial Sequence
  chemically synthesized
aatcttatttttgtacacagta

SEQ ID NO: 36245 - DNA, 22 bp, Artificial Sequence
  chemically synthesized
atcttatttttgtacacagtat

SEQ ID NO: 36246 - DNA, 22 bp, Artificial Sequence
  chemically synthesized
atttttgtacacagtatacttt

SEQ ID NO: 36247 - DNA, 22 bp, Artificial Sequence
  chemically synthesized
tttttgtacacagtatactttt

SEQ ID NO: 36248 - DNA, 22 bp, Artificial Sequence
  chemically synthesized
ttgtacacagtatacttttaca

SEQ ID NO: 36249 - DNA, 22 bp, Artificial Sequence
  chemically synthesized
tgtacacagtatacttttacat

SEQ ID NO: 36250 - DNA, 22 bp, Artificial Sequence
  chemically synthesized
gtacacagtatacttttacata

SEQ ID NO: 36251 - DNA, 22 bp, Artificial Sequence
  chemically synthesized
tacacagtatacttttacatag

SEQ ID NO: 36252 - DNA, 22 bp, Artificial Sequence
  chemically synthesized
ttacataggcactgaaccagct

SEQ ID NO: 36253 - DNA, 22 bp, Artificial Sequence
  chemically synthesized
tacataggcactgaaccagctg

SEQ ID NO: 36254 - DNA, 22 bp, Artificial Sequence
  chemically synthesized
acataggcactgaaccagctgg

SEQ ID NO: 36255 - DNA, 22 bp, Artificial Sequence
  chemically synthesized
cataggcactgaaccagctgga

SEQ ID NO: 36256 - DNA, 22 bp, Artificial Sequence
  chemically synthesized
aaccagctggaaatgaatgctt

SEQ ID NO: 36257 - DNA, 22 bp, Artificial Sequence
  chemically synthesized
gaaatgaatgcttggattttcg

SEQ ID NO: 36258 - DNA, 22 bp, Artificial Sequence
  chemically synthesized
ggattttcgcagctgataaaag

SEQ ID NO: 36259 - DNA, 22 bp, Artificial Sequence
  chemically synthesized
gattttcgcagctgataaaagc

SEQ ID NO: 36260 - DNA, 22 bp, Artificial Sequence
  chemically synthesized
tcgcagctgataaaagcagagt

SEQ ID NO: 36261 - DNA, 22 bp, Artificial Sequence
  chemically synthesized
cgcagctgataaaagcagagtt

SEQ ID NO: 36262 - DNA, 22 bp, Artificial Sequence
  chemically synthesized
gcagctgataaaagcagagttc

SEQ ID NO: 36263 - DNA, 22 bp, Artificial Sequence
  chemically synthesized
ataaaagcagagttcagattct

SEQ ID NO: 36264 - DNA, 22 bp, Artificial Sequence
  chemically synthesized
agattctgtccttgagctcaat

SEQ ID NO: 36265 - DNA, 22 bp, Artificial Sequence
  chemically synthesized
tgtccttgagctcaatgtctgg

SEQ ID NO: 36266 - DNA, 22 bp, Artificial Sequence
  chemically synthesized
tccttgagctcaatgtctggag

SEQ ID NO: 36267 - DNA, 22 bp, Artificial Sequence
  chemically synthesized
gagctcaatgtctggagaaagc

SEQ ID NO: 36268 - DNA, 22 bp, Artificial Sequence
  chemically synthesized
agctcaatgtctggagaaagca

SEQ ID NO: 36269 - DNA, 22 bp, Artificial Sequence
  chemically synthesized
aatgtctggagaaagcagctgt

SEQ ID NO: 36270 - DNA, 22 bp, Artificial Sequence
  chemically synthesized
gagaaagcagctgtgaatactg

SEQ ID NO: 36271 - DNA, 22 bp, Artificial Sequence
  chemically synthesized
tgaatactgcttccttaattca

SEQ ID NO: 36272 - DNA, 22 bp, Artificial Sequence
  chemically synthesized
cttccttaattcagatgccttt

SEQ ID NO: 36273 - DNA, 22 bp, Artificial Sequence
  chemically synthesized
ccttaattcagatgcctttggc

SEQ ID NO: 36274 - DNA, 22 bp, Artificial Sequence
  chemically synthesized
cttaattcagatgcctttggcc

SEQ ID NO: 36275 - DNA, 22 bp, Artificial Sequence
  chemically synthesized
aattcagatgcctttggccgtg

SEQ ID NO: 36276 - DNA, 22 bp, Artificial Sequence
  chemically synthesized
attcagatgcctttggccgtga

SEQ ID NO: 36277 - DNA, 22 bp, Artificial Sequence
  chemically synthesized
agatgcctttggccgtgagggg

SEQ ID NO: 36278 - DNA, 22 bp, Artificial Sequence
  chemically synthesized
tggccgtgaggggcatggcatt

SEQ ID NO: 36279 - DNA, 22 bp, Artificial Sequence
  chemically synthesized
ggccgtgaggggcatggcattt

SEQ ID NO: 36280 - DNA, 22 bp, Artificial Sequence
  chemically synthesized
gccgtgaggggcatggcatttt

SEQ ID NO: 36281 - DNA, 22 bp, Artificial Sequence
  chemically synthesized
taaagctgcaataaactctgta

SEQ ID NO: 36282 - DNA, 22 bp, Artificial Sequence
  chemically synthesized
aaagctgcaataaactctgtac

SEQ ID NO: 36283 - DNA, 22 bp, Artificial Sequence
  chemically synthesized
aagctgcaataaactctgtact

SEQ ID NO: 36284 - DNA, 22 bp, Artificial Sequence
  chemically synthesized
caataaactctgtactttttct

SEQ ID NO: 36285 - DNA, 22 bp, Artificial Sequence
  chemically synthesized
tgtactttttctctcaggggat

SEQ ID NO: 36286 - DNA, 22 bp, Artificial Sequence
  chemically synthesized
tactttttctctcaggggatta

SEQ ID NO: 36287 - DNA, 22 bp, Artificial Sequence
  chemically synthesized
tttctctcaggggattagaaaa

SEQ ID NO: 36288 - DNA, 22 bp, Artificial Sequence
  chemically synthesized
ttctctcaggggattagaaaaa

SEQ ID NO: 36289 - DNA, 22 bp, Artificial Sequence
  chemically synthesized
tctctcaggggattagaaaaac

SEQ ID NO: 36290 - DNA, 22 bp, Artificial Sequence
  chemically synthesized
ctctcaggggattagaaaaacc

SEQ ID NO: 36291 - DNA, 22 bp, Artificial Sequence
  chemically synthesized
tctcaggggattagaaaaacca

SEQ ID NO: 36292 - DNA, 22 bp, Artificial Sequence
  chemically synthesized
tcaggggattagaaaaaccaat

SEQ ID NO: 36293 - DNA, 22 bp, Artificial Sequence
  chemically synthesized
aggggattagaaaaaccaattg

SEQ ID NO: 36294 - DNA, 22 bp, Artificial Sequence
  chemically synthesized
gaaaaaccaattgatttgatag

SEQ ID NO: 36295 - DNA, 22 bp, Artificial Sequence
  chemically synthesized
atttgatagtgactcagcagtt

SEQ ID NO: 36296 - DNA, 22 bp, Artificial Sequence
  chemically synthesized
gatagtgactcagcagttttca

SEQ ID NO: 36297 - DNA, 22 bp, Artificial Sequence
  chemically synthesized
atagtgactcagcagttttcac

SEQ ID NO: 36298 - DNA, 22 bp, Artificial Sequence
  chemically synthesized
agcagttttcaccttcctcttt

SEQ ID NO: 36299 - DNA, 22 bp, Artificial Sequence
  chemically synthesized
tcaccttcctctttagccaatg

SEQ ID NO: 36300 - DNA, 22 bp, Artificial Sequence
  chemically synthesized
caccttcctctttagccaatgc

SEQ ID NO: 36301 - DNA, 22 bp, Artificial Sequence
  chemically synthesized
accttcctctttagccaatgcc

SEQ ID NO: 36302 - DNA, 22 bp, Artificial Sequence
  chemically synthesized
cctctttagccaatgccctgca

SEQ ID NO: 36303 - DNA, 22 bp, Artificial Sequence
  chemically synthesized
ctctttagccaatgccctgcag

SEQ ID NO: 36304 - DNA, 22 bp, Artificial Sequence
  chemically synthesized
tttagccaatgccctgcagcta

SEQ ID NO: 36305 - DNA, 22 bp, Artificial Sequence
  chemically synthesized
tagccaatgccctgcagctaag

SEQ ID NO: 36306 - DNA, 22 bp, Artificial Sequence
  chemically synthesized
agccaatgccctgcagctaaga

SEQ ID NO: 36307 - DNA, 22 bp, Artificial Sequence
  chemically synthesized
gccaatgccctgcagctaagat

SEQ ID NO: 36308 - DNA, 22 bp, Artificial Sequence
  chemically synthesized
cagctaagattgagaaacggat

SEQ ID NO: 36309 - DNA, 22 bp, Artificial Sequence
  chemically synthesized
agattgagaaacggattcagaa

SEQ ID NO: 36310 - DNA, 22 bp, Artificial Sequence
  chemically synthesized
agaaacggattcagaactcaca

SEQ ID NO: 36311 - DNA, 22 bp, Artificial Sequence
  chemically synthesized
agaactcacacctcttggtgct

SEQ ID NO: 36312 - DNA, 22 bp, Artificial Sequence
  chemically synthesized
acacctcttggtgcttggtggc

SEQ ID NO: 36313 - DNA, 22 bp, Artificial Sequence
  chemically synthesized
ttggtgcttggtggctcccttc

SEQ ID NO: 36314 - DNA, 22 bp, Artificial Sequence
  chemically synthesized
ggtgcttggtggctcccttcca

SEQ ID NO: 36315 - DNA, 22 bp, Artificial Sequence
  chemically synthesized
gtgcttggtggctcccttccaa

SEQ ID NO: 36316 - DNA, 22 bp, Artificial Sequence
  chemically synthesized
ggtggctcccttccaaaccatc

SEQ ID NO: 36317 - DNA, 22 bp, Artificial Sequence
  chemically synthesized
gtggctcccttccaaaccatca

SEQ ID NO: 36318 - DNA, 22 bp, Artificial Sequence
  chemically synthesized
ccttccaaaccatcagctgttc

SEQ ID NO: 36319 - DNA, 22 bp, Artificial Sequence
  chemically synthesized
ccaaaccatcagctgttctttc

SEQ ID NO: 36320 - DNA, 22 bp, Artificial Sequence
  chemically synthesized
caaaccatcagctgttctttct

SEQ ID NO: 36321 - DNA, 22 bp, Artificial Sequence
  chemically synthesized
ttctttctactttctttcctat

SEQ ID NO: 36322 - DNA, 22 bp, Artificial Sequence
  chemically synthesized
tttctactttctttcctatttt

SEQ ID NO: 36323 - DNA, 22 bp, Artificial Sequence
  chemically synthesized
tctactttctttcctatttttt

SEQ ID NO: 36324 - DNA, 22 bp, Artificial Sequence
  chemically synthesized
ctactttctttcctatttttta

SEQ ID NO: 36325 - DNA, 22 bp, Artificial Sequence
  chemically synthesized
tactttctttcctattttttaa

SEQ ID NO: 36326 - DNA, 22 bp, Artificial Sequence
  chemically synthesized
ctttctttcctattttttaaag

SEQ ID NO: 36327 - DNA, 22 bp, Artificial Sequence
  chemically synthesized
tctttcctattttttaaagcac

SEQ ID NO: 36328 - DNA, 22 bp, Artificial Sequence
  chemically synthesized
ctttcctattttttaaagcaca

SEQ ID NO: 36329 - DNA, 22 bp, Artificial Sequence
  chemically synthesized
tttcctattttttaaagcacag

SEQ ID NO: 36330 - DNA, 22 bp, Artificial Sequence
  chemically synthesized
tcctattttttaaagcacagtc

SEQ ID NO: 36331 - DNA, 22 bp, Artificial Sequence
  chemically synthesized
cctattttttaaagcacagtct

SEQ ID NO: 36332 - DNA, 22 bp, Artificial Sequence
  chemically synthesized
ctattttttaaagcacagtctg

SEQ ID NO: 36333 - DNA, 22 bp, Artificial Sequence
  chemically synthesized
ttttttaaagcacagtctgaat

SEQ ID NO: 36334 - DNA, 22 bp, Artificial Sequence
  chemically synthesized
tttaaagcacagtctgaatcaa

SEQ ID NO: 36335 - DNA, 22 bp, Artificial Sequence
  chemically synthesized
ttaaagcacagtctgaatcaag

SEQ ID NO: 36336 - DNA, 22 bp, Artificial Sequence
  chemically synthesized
taaagcacagtctgaatcaagt

SEQ ID NO: 36337 - DNA, 22 bp, Artificial Sequence
  chemically synthesized
aaagcacagtctgaatcaagtg

SEQ ID NO: 36338 - DNA, 22 bp, Artificial Sequence
  chemically synthesized
aagcacagtctgaatcaagtgc

SEQ ID NO: 36339 - DNA, 22 bp, Artificial Sequence
  chemically synthesized
aatcaagtgcttcagaaccatt

SEQ ID NO: 36340 - DNA, 22 bp, Artificial Sequence
  chemically synthesized
cagaaccatttatactaactcg

SEQ ID NO: 36341 - DNA, 22 bp, Artificial Sequence
  chemically synthesized
agaaccatttatactaactcgt

SEQ ID NO: 36342 - DNA, 22 bp, Artificial Sequence
  chemically synthesized
atactaactcgtgttccaaaca

SEQ ID NO: 36343 - DNA, 22 bp, Artificial Sequence
  chemically synthesized
tactaactcgtgttccaaacac

SEQ ID NO: 36344 - DNA, 22 bp, Artificial Sequence
  chemically synthesized
actcgtgttccaaacacataac

SEQ ID NO: 36345 - DNA, 22 bp, Artificial Sequence
  chemically synthesized
gtgttccaaacacataaccctg

SEQ ID NO: 36346 - DNA, 22 bp, Artificial Sequence
  chemically synthesized
caaacacataaccctgaaccct

SEQ ID NO: 36347 - DNA, 22 bp, Artificial Sequence
  chemically synthesized
aaccctcttctaaggccaccag

SEQ ID NO: 36348 - DNA, 22 bp, Artificial Sequence
  chemically synthesized
ttctaaggccaccagttacaaa

SEQ ID NO: 36349 - DNA, 22 bp, Artificial Sequence
  chemically synthesized
ctaaggccaccagttacaaaga

SEQ ID NO: 36350 - DNA, 22 bp, Artificial Sequence
  chemically synthesized
taaggccaccagttacaaagaa

SEQ ID NO: 36351 - DNA, 22 bp, Artificial Sequence
  chemically synthesized
aggccaccagttacaaagaatg

SEQ ID NO: 36352 - DNA, 22 bp, Artificial Sequence
  chemically synthesized
caaagaatggggaaggttaatg

SEQ ID NO: 36353 - DNA, 22 bp, Artificial Sequence
  chemically synthesized
atgagtaactccaccagtgcct

SEQ ID NO: 36354 - DNA, 22 bp, Artificial Sequence
  chemically synthesized
caccagtgcctgccagaaagct

SEQ ID NO: 36355 - DNA, 22 bp, Artificial Sequence
  chemically synthesized
ccagaaagctcagctgtactcc

SEQ ID NO: 36356 - DNA, 22 bp, Artificial Sequence
  chemically synthesized
agctgtactccagccttccttc

SEQ ID NO: 36357 - DNA, 22 bp, Artificial Sequence
  chemically synthesized
tactccagccttccttcctctc

SEQ ID NO: 36358 - DNA, 22 bp, Artificial Sequence
  chemically synthesized
cagccttccttcctctcttgca

SEQ ID NO: 36359 - DNA, 22 bp, Artificial Sequence
  chemically synthesized
ccttcctctcttgcagagagaa

SEQ ID NO: 36360 - DNA, 22 bp, Artificial Sequence
  chemically synthesized
cttcctctcttgcagagagaaa

SEQ ID NO: 36361 - DNA, 22 bp, Artificial Sequence
  chemically synthesized
cctctcttgcagagagaaacaa

SEQ ID NO: 36362 - DNA, 22 bp, Artificial Sequence
  chemically synthesized
ctctcttgcagagagaaacaat

SEQ ID NO: 36363 - DNA, 22 bp, Artificial Sequence
  chemically synthesized
tcttgcagagagaaacaatgcg

SEQ ID NO: 36364 - DNA, 22 bp, Artificial Sequence
  chemically synthesized
ttgcagagagaaacaatgcggc

SEQ ID NO: 36365 - DNA, 22 bp, Artificial Sequence
  chemically synthesized
gcagagagaaacaatgcggcag

SEQ ID NO: 36366 - DNA, 22 bp, Artificial Sequence
  chemically synthesized
cagagagaaacaatgcggcagt

SEQ ID NO: 36367 - DNA, 22 bp, Artificial Sequence
  chemically synthesized
aacaaagcgaaggcactgtaat

SEQ ID NO: 36368 - DNA, 22 bp, Artificial Sequence
  chemically synthesized
taatgcccagtggcttcagtca

SEQ ID NO: 36369 - DNA, 22 bp, Artificial Sequence
  chemically synthesized
cagtcacaggctggtctaaaat

SEQ ID NO: 36370 - DNA, 22 bp, Artificial Sequence
  chemically synthesized
agtcacaggctggtctaaaatt

SEQ ID NO: 36371 - DNA, 22 bp, Artificial Sequence
  chemically synthesized
gtctaaaattccatttcacaga

SEQ ID NO: 36372 - DNA, 22 bp, Artificial Sequence
  chemically synthesized
aaattccatttcacagaattga

SEQ ID NO: 36373 - DNA, 22 bp, Artificial Sequence
  chemically synthesized
catttcacagaattgaagataa

SEQ ID NO: 36374 - DNA, 22 bp, Artificial Sequence
  chemically synthesized
cacagaattgaagataatttgg

SEQ ID NO: 36375 - DNA, 22 bp, Artificial Sequence
  chemically synthesized
acagaattgaagataatttggg

SEQ ID NO: 36376 - DNA, 22 bp, Artificial Sequence
  chemically synthesized
aagataatttggggttattacc

SEQ ID NO: 36377 - DNA, 22 bp, Artificial Sequence
  chemically synthesized
ggggttattaccaattctcagc

SEQ ID NO: 36378 - DNA, 22 bp, Artificial Sequence
  chemically synthesized
gggttattaccaattctcagca

SEQ ID NO: 36379 - DNA, 22 bp, Artificial Sequence
  chemically synthesized
ttaccaattctcagcagctcaa

SEQ ID NO: 36380 - DNA, 22 bp, Artificial Sequence
  chemically synthesized
ccaattctcagcagctcaaatt

SEQ ID NO: 36381 - DNA, 22 bp, Artificial Sequence
  chemically synthesized
tcagcagctcaaattcaatccc

SEQ ID NO: 36382 - DNA, 22 bp, Artificial Sequence
  chemically synthesized
agcagctcaaattcaatcccgt

SEQ ID NO: 36383 - DNA, 22 bp, Artificial Sequence
  chemically synthesized
aaattcaatcccgttgatggtg

SEQ ID NO: 36384 - DNA, 22 bp, Artificial Sequence
  chemically synthesized
aatcccgttgatggtgagcatg

SEQ ID NO: 36385 - DNA, 22 bp, Artificial Sequence
  chemically synthesized
atggtgagcatggggttcattt

SEQ ID NO: 36386 - DNA, 22 bp, Artificial Sequence
  chemically synthesized
attttgagagtagaaaattgga

SEQ ID NO: 36387 - DNA, 22 bp, Artificial Sequence
  chemically synthesized
tgagagtagaaaattggatgca

SEQ ID NO: 36388 - DNA, 22 bp, Artificial Sequence
  chemically synthesized
gagagtagaaaattggatgcag

SEQ ID NO: 36389 - DNA, 22 bp, Artificial Sequence
  chemically synthesized
agagtagaaaattggatgcagt

SEQ ID NO: 36390 - DNA, 22 bp, Artificial Sequence
  chemically synthesized
gatgcagtggagaatcagaatg

SEQ ID NO: 36391 - DNA, 22 bp, Artificial Sequence
  chemically synthesized
gatggtctctgccatttcccca

SEQ ID NO: 36392 - DNA, 22 bp, Artificial Sequence
  chemically synthesized
tgccatttccccaaagatatca

SEQ ID NO: 36393 - DNA, 22 bp, Artificial Sequence
  chemically synthesized
ccatttccccaaagatatcatc

SEQ ID NO: 36394 - DNA, 22 bp, Artificial Sequence
  chemically synthesized
ccccaaagatatcatcctaact

SEQ ID NO: 36395 - DNA, 22 bp, Artificial Sequence
  chemically synthesized
cccaaagatatcatcctaactg

SEQ ID NO: 36396 - DNA, 22 bp, Artificial Sequence
  chemically synthesized
actgcatgctgctgcttttaac

SEQ ID NO: 36397 - DNA, 22 bp, Artificial Sequence
  chemically synthesized
catgctgctgcttttaacaaat

SEQ ID NO: 36398 - DNA, 22 bp, Artificial Sequence
  chemically synthesized
ctgcttttaacaaatcagtata

SEQ ID NO: 36399 - DNA, 22 bp, Artificial Sequence
  chemically synthesized
cttttaacaaatcagtatacaa

SEQ ID NO: 36400 - DNA, 22 bp, Artificial Sequence
  chemically synthesized
ttaacaaatcagtatacaactt

SEQ ID NO: 36401 - DNA, 22 bp, Artificial Sequence
  chemically synthesized
taacaaatcagtatacaactta

SEQ ID NO: 36402 - DNA, 22 bp, Artificial Sequence
  chemically synthesized
aacaaatcagtatacaacttag

SEQ ID NO: 36403 - DNA, 22 bp, Artificial Sequence
  chemically synthesized
acaaatcagtatacaacttagt

SEQ ID NO: 36404 - DNA, 22 bp, Artificial Sequence
  chemically synthesized
agtattttttgtgttgacaaat

SEQ ID NO: 36405 - DNA, 22 bp, Artificial Sequence
  chemically synthesized
gtattttttgtgttgacaaatt

SEQ ID NO: 36406 - DNA, 22 bp, Artificial Sequence
  chemically synthesized
tttgtgttgacaaattttcaaa

SEQ ID NO: 36407 - DNA, 22 bp, Artificial Sequence
  chemically synthesized
ttgtgttgacaaattttcaaat

SEQ ID NO: 36408 - DNA, 22 bp, Artificial Sequence
  chemically synthesized
tgtgttgacaaattttcaaata

SEQ ID NO: 36409 - DNA, 22 bp, Artificial Sequence
  chemically synthesized
gtgttgacaaattttcaaatat

SEQ ID NO: 36410 - DNA, 22 bp, Artificial Sequence
  chemically synthesized
tgttgacaaattttcaaatata

SEQ ID NO: 36411 - DNA, 22 bp, Artificial Sequence
  chemically synthesized
acaaattttcaaatatacaaaa

SEQ ID NO: 36412 - DNA, 22 bp, Artificial Sequence
  chemically synthesized
tcaaatatacaaaatattgagt

SEQ ID NO: 36413 - DNA, 22 bp, Artificial Sequence
  chemically synthesized
caaatatacaaaatattgagtc

SEQ ID NO: 36414 - DNA, 22 bp, Artificial Sequence
  chemically synthesized
aaatatacaaaatattgagtct

SEQ ID NO: 36415 - DNA, 22 bp, Artificial Sequence
  chemically synthesized
agtctgaaggcaaaaagaataa

SEQ ID NO: 36416 - DNA, 22 bp, Artificial Sequence
  chemically synthesized
aaggcaaaaagaataatttttc

SEQ ID NO: 36417 - DNA, 22 bp, Artificial Sequence
  chemically synthesized
ttcacttccattgcttcctagg

SEQ ID NO: 36418 - DNA, 22 bp, Artificial Sequence
  chemically synthesized
tcacttccattgcttcctaggt

SEQ ID NO: 36419 - DNA, 22 bp, Artificial Sequence
  chemically synthesized
cacttccattgcttcctaggtc

SEQ ID NO: 36420 - DNA, 22 bp, Artificial Sequence
  chemically synthesized
acttccattgcttcctaggtca

SEQ ID NO: 36421 - DNA, 22 bp, Artificial Sequence
  chemically synthesized
ccattgcttcctaggtcataac

SEQ ID NO: 36422 - DNA, 22 bp, Artificial Sequence
  chemically synthesized
cattgcttcctaggtcataaca

SEQ ID NO: 36423 - DNA, 22 bp, Artificial Sequence
  chemically synthesized
cttcctaggtcataacattcac

SEQ ID NO: 36424 - DNA, 22 bp, Artificial Sequence
  chemically synthesized
cctaggtcataacattcacatc

SEQ ID NO: 36425 - DNA, 22 bp, Artificial Sequence
  chemically synthesized
ctaggtcataacattcacatct

SEQ ID NO: 36426 - DNA, 22 bp, Artificial Sequence
  chemically synthesized
ggtcataacattcacatctgat

SEQ ID NO: 36427 - DNA, 22 bp, Artificial Sequence
  chemically synthesized
acatctgatatttcttccaaat

SEQ ID NO: 36428 - DNA, 22 bp, Artificial Sequence
  chemically synthesized
atatttcttccaaatacagact

SEQ ID NO: 36429 - DNA, 22 bp, Artificial Sequence
  chemically synthesized
cttccaaatacagactgttgtt

SEQ ID NO: 36430 - DNA, 22 bp, Artificial Sequence
  chemically synthesized
ttccaaatacagactgttgttg

SEQ ID NO: 36431 - DNA, 22 bp, Artificial Sequence
  chemically synthesized
ccaaatacagactgttgttggc

SEQ ID NO: 36432 - DNA, 22 bp, Artificial Sequence
  chemically synthesized
caaatacagactgttgttggcc

SEQ ID NO: 36433 - DNA, 22 bp, Artificial Sequence
  chemically synthesized
ttgttggcctgatcatcactca

SEQ ID NO: 36434 - DNA, 22 bp, Artificial Sequence
  chemically synthesized
ttggcctgatcatcactcacac

SEQ ID NO: 36435 - DNA, 22 bp, Artificial Sequence
  chemically synthesized
gcctgatcatcactcacacatc

SEQ ID NO: 36436 - DNA, 22 bp, Artificial Sequence
  chemically synthesized
atcatcactcacacatccaggc

SEQ ID NO: 36437 - DNA, 22 bp, Artificial Sequence
  chemically synthesized
acacatccaggcttgttacatc

SEQ ID NO: 36438 - DNA, 22 bp, Artificial Sequence
  chemically synthesized
gttacatctccacgccactgag

SEQ ID NO: 36439 - DNA, 22 bp, Artificial Sequence
  chemically synthesized
ttacatctccacgccactgagt

SEQ ID NO: 36440 - DNA, 22 bp, Artificial Sequence
  chemically synthesized
catctccacgccactgagtatc

SEQ ID NO: 36441 - DNA, 22 bp, Artificial Sequence
  chemically synthesized
cacgccactgagtatcagggaa

SEQ ID NO: 36442 - DNA, 22 bp, Artificial Sequence
  chemically synthesized
agtatcagggaacctgccccaa

SEQ ID NO: 36443 - DNA, 22 bp, Artificial Sequence
  chemically synthesized
ccccaatattcacgtaggttct

SEQ ID NO: 36444 - DNA, 22 bp, Artificial Sequence
  chemically synthesized
acgtaggttcttttctattttc

SEQ ID NO: 36445 - DNA, 22 bp, Artificial Sequence
  chemically synthesized
ttttctattttccctaagcgtc

SEQ ID NO: 36446 - DNA, 22 bp, Artificial Sequence
  chemically synthesized
ttctattttccctaagcgtcgg

SEQ ID NO: 36447 - DNA, 22 bp, Artificial Sequence
  chemically synthesized
tctattttccctaagcgtcggc

SEQ ID NO: 36448 - DNA, 22 bp, Artificial Sequence
  chemically synthesized
ctattttccctaagcgtcggcc

SEQ ID NO: 36449 - DNA, 22 bp, Artificial Sequence
  chemically synthesized
tattttccctaagcgtcggcca

SEQ ID NO: 36450 - DNA, 22 bp, Artificial Sequence
  chemically synthesized
ttttccctaagcgtcggccaac

SEQ ID NO: 36451 - DNA, 22 bp, Artificial Sequence
  chemically synthesized
tccctaagcgtcggccaacttt

SEQ ID NO: 36452 - DNA, 22 bp, Artificial Sequence
  chemically synthesized
ccctaagcgtcggccaacttta

SEQ ID NO: 36453 - DNA, 22 bp, Artificial Sequence
  chemically synthesized
cctaagcgtcggccaactttag

SEQ ID NO: 36454 - DNA, 22 bp, Artificial Sequence
  chemically synthesized
agcgtcggccaactttagaaat

SEQ ID NO: 36455 - DNA, 22 bp, Artificial Sequence
  chemically synthesized
tagaaataaagggacagagtac

SEQ ID NO: 36456 - DNA, 22 bp, Artificial Sequence
  chemically synthesized
agaaataaagggacagagtaca

SEQ ID NO: 36457 - DNA, 22 bp, Artificial Sequence
  chemically synthesized
gaaataaagggacagagtacaa

SEQ ID NO: 36458 - DNA, 22 bp, Artificial Sequence
  chemically synthesized
taaagccgggcatccgggggag

SEQ ID NO: 36459 - DNA, 22 bp, Artificial Sequence
  chemically synthesized
aaagccgggcatccgggggagg

SEQ ID NO: 36460 - DNA, 22 bp, Artificial Sequence
  chemically synthesized
aagccgggcatccgggggaggc

SEQ ID NO: 36461 - DNA, 22 bp, Artificial Sequence
  chemically synthesized
cggtaggttccgtgatgcccca

SEQ ID NO: 36462 - DNA, 22 bp, Artificial Sequence
  chemically synthesized
ggtaggttccgtgatgccccac

SEQ ID NO: 36463 - DNA, 22 bp, Artificial Sequence
  chemically synthesized
cgtgatgccccacaagccacaa

SEQ ID NO: 36464 - DNA, 22 bp, Artificial Sequence
  chemically synthesized
gtattagggattttcaaatggg

SEQ ID NO: 36465 - DNA, 22 bp, Artificial Sequence
  chemically synthesized
tattagggattttcaaatgggg

SEQ ID NO: 36466 - DNA, 22 bp, Artificial Sequence
  chemically synthesized
gggattttcaaatggggaggca

SEQ ID NO: 36467 - DNA, 22 bp, Artificial Sequence
  chemically synthesized
tcaaatggggaggcagtgtgca

SEQ ID NO: 36468 - DNA, 22 bp, Artificial Sequence
  chemically synthesized
caaatggggaggcagtgtgcaa

SEQ ID NO: 36469 - DNA, 22 bp, Artificial Sequence
  chemically synthesized
aaatggggaggcagtgtgcaaa

SEQ ID NO: 36470 - DNA, 22 bp, Artificial Sequence
  chemically synthesized
tacaaggtaatagaatatcaca

SEQ ID NO: 36471 - DNA, 22 bp, Artificial Sequence
  chemically synthesized
acaaggtaatagaatatcacaa

SEQ ID NO: 36472 - DNA, 22 bp, Artificial Sequence
  chemically synthesized
caaggtaatagaatatcacaag

SEQ ID NO: 36473 - DNA, 22 bp, Artificial Sequence
  chemically synthesized
aaattgctaatgaagtttcggg

SEQ ID NO: 36474 - DNA, 22 bp, Artificial Sequence
  chemically synthesized
ctaatgaagtttcgggcaccat

SEQ ID NO: 36475 - DNA, 22 bp, Artificial Sequence
  chemically synthesized
atgaagtttcgggcaccattgt

SEQ ID NO: 36476 - DNA, 22 bp, Artificial Sequence
  chemically synthesized
cgggcaccattgtcattgataa

SEQ ID NO: 36477 - DNA, 22 bp, Artificial Sequence
  chemically synthesized
gggcaccattgtcattgataac

SEQ ID NO: 36478 - DNA, 22 bp, Artificial Sequence
  chemically synthesized
tcattgataacatcttatcagg

SEQ ID NO: 36479 - DNA, 22 bp, Artificial Sequence
  chemically synthesized
ataacatcttatcaggagacag

SEQ ID NO: 36480 - DNA, 22 bp, Artificial Sequence
  chemically synthesized
atcaggagacagggtttttagg

SEQ ID NO: 36481 - DNA, 22 bp, Artificial Sequence
  chemically synthesized
tcaggagacagggtttttagga

SEQ ID NO: 36482 - DNA, 22 bp, Artificial Sequence
  chemically synthesized
ttaggatcaactggtctgacca

SEQ ID NO: 36483 - DNA, 22 bp, Artificial Sequence
  chemically synthesized
taggatcaactggtctgaccaa

SEQ ID NO: 36484 - DNA, 22 bp, Artificial Sequence
  chemically synthesized
aggatcaactggtctgaccaaa

SEQ ID NO: 36485 - DNA, 22 bp, Artificial Sequence
  chemically synthesized
ggatcaactggtctgaccaaaa

SEQ ID NO: 36486 - DNA, 22 bp, Artificial Sequence
  chemically synthesized
gtctgaccaaaatttattaggc

SEQ ID NO: 36487 - DNA, 22 bp, Artificial Sequence
  chemically synthesized
accaaaatttattaggcgggaa

SEQ ID NO: 36488 - DNA, 22 bp, Artificial Sequence
  chemically synthesized
attaggcgggaatttcctcttc

SEQ ID NO: 36489 - DNA, 22 bp, Artificial Sequence
  chemically synthesized
ttaggcgggaatttcctcttcc

SEQ ID NO: 36490 - DNA, 22 bp, Artificial Sequence
  chemically synthesized
ggcgggaatttcctcttcctaa

SEQ ID NO: 36491 - DNA, 22 bp, Artificial Sequence
  chemically synthesized
cctcttcctaataagcctggga

SEQ ID NO: 36492 - DNA, 22 bp, Artificial Sequence
  chemically synthesized
ctcttcctaataagcctgggag

SEQ ID NO: 36493 - DNA, 22 bp, Artificial Sequence
  chemically synthesized
ttcctaataagcctgggagcgc

SEQ ID NO: 36494 - DNA, 22 bp, Artificial Sequence
  chemically synthesized
cctaataagcctgggagcgctg

SEQ ID NO: 36495 - DNA, 22 bp, Artificial Sequence
  chemically synthesized
ctaataagcctgggagcgctgt

SEQ ID NO: 36496 - DNA, 22 bp, Artificial Sequence
  chemically synthesized
ataagcctgggagcgctgtggg

SEQ ID NO: 36497 - DNA, 22 bp, Artificial Sequence
  chemically synthesized
ggagcgctgtgggagactgggg

SEQ ID NO: 36498 - DNA, 22 bp, Artificial Sequence
  chemically synthesized
tgggagactggggtctatttca

SEQ ID NO: 36499 - DNA, 22 bp, Artificial Sequence
  chemically synthesized
gggtctatttcacccctgcagt

SEQ ID NO: 36500 - DNA, 22 bp, Artificial Sequence
  chemically synthesized
tttcacccctgcagtctcgacc

SEQ ID NO: 36501 - DNA, 22 bp, Artificial Sequence
  chemically synthesized
cacccctgcagtctcgaccata

SEQ ID NO: 36502 - DNA, 22 bp, Artificial Sequence
  chemically synthesized
acccctgcagtctcgaccataa

SEQ ID NO: 36503 - DNA, 22 bp, Artificial Sequence
  chemically synthesized
cagtctcgaccataagagacag

SEQ ID NO: 36504 - DNA, 22 bp, Artificial Sequence
  chemically synthesized
gaccataagagacaggcgcacc

SEQ ID NO: 36505 - DNA, 22 bp, Artificial Sequence
  chemically synthesized
gaggggggctgtttataagcct

SEQ ID NO: 36506 - DNA, 22 bp, Artificial Sequence
  chemically synthesized
tttataagcctatacctcctgg

SEQ ID NO: 36507 - DNA, 22 bp, Artificial Sequence
  chemically synthesized
ataagcctatacctcctggctc

SEQ ID NO: 36508 - DNA, 22 bp, Artificial Sequence
  chemically synthesized
taagcctatacctcctggctcg

SEQ ID NO: 36509 - DNA, 22 bp, Artificial Sequence
  chemically synthesized
tacctcctggctcgtattctct

SEQ ID NO: 36510 - DNA, 22 bp, Artificial Sequence
  chemically synthesized
ctggctcgtattctctttctca

SEQ ID NO: 36511 - DNA, 22 bp, Artificial Sequence
  chemically synthesized
gctcgtattctctttctcaggg

SEQ ID NO: 36512 - DNA, 22 bp, Artificial Sequence
  chemically synthesized
gtattctctttctcagggatgt

SEQ ID NO: 36513 - DNA, 22 bp, Artificial Sequence
  chemically synthesized
tctttctcagggatgttccatg

SEQ ID NO: 36514 - DNA, 22 bp, Artificial Sequence
  chemically synthesized
tttctcagggatgttccatgct

SEQ ID NO: 36515 - DNA, 22 bp, Artificial Sequence
  chemically synthesized
tctcagggatgttccatgctga

SEQ ID NO: 36516 - DNA, 22 bp, Artificial Sequence
  chemically synthesized
ctcagggatgttccatgctgag

SEQ ID NO: 36517 - DNA, 22 bp, Artificial Sequence
  chemically synthesized
tcagggatgttccatgctgaga

SEQ ID NO: 36518 - DNA, 22 bp, Artificial Sequence
  chemically synthesized
agggatgttccatgctgagaaa

SEQ ID NO: 36519 - DNA, 22 bp, Artificial Sequence
  chemically synthesized
catgctgagaaaaagaattcag

SEQ ID NO: 36520 - DNA, 22 bp, Artificial Sequence
  chemically synthesized
agaaaaagaattcagcgatatt

SEQ ID NO: 36521 - DNA, 22 bp, Artificial Sequence
  chemically synthesized
agcgatatttctcccatttgct

SEQ ID NO: 36522 - DNA, 22 bp, Artificial Sequence
  chemically synthesized
ctcccatttgcttttgaaagaa

SEQ ID NO: 36523 - DNA, 22 bp, Artificial Sequence
  chemically synthesized
tcccatttgcttttgaaagaag

SEQ ID NO: 36524 - DNA, 22 bp, Artificial Sequence
  chemically synthesized
ccatttgcttttgaaagaagag

SEQ ID NO: 36525 - DNA, 22 bp, Artificial Sequence
  chemically synthesized
gcttttgaaagaagagaaatat

SEQ ID NO: 36526 - DNA, 22 bp, Artificial Sequence
  chemically synthesized
cttttgaaagaagagaaatatg

SEQ ID NO: 36527 - DNA, 22 bp, Artificial Sequence
  chemically synthesized
ttgaaagaagagaaatatggct

SEQ ID NO: 36528 - DNA, 22 bp, Artificial Sequence
  chemically synthesized
tgaaagaagagaaatatggctc

SEQ ID NO: 36529 - DNA, 22 bp, Artificial Sequence
  chemically synthesized
gaaagaagagaaatatggctct

SEQ ID NO: 36530 - DNA, 22 bp, Artificial Sequence
  chemically synthesized
aaagaagagaaatatggctctg

SEQ ID NO: 36531 - DNA, 22 bp, Artificial Sequence
  chemically synthesized
tgttctgcctggctcaccagca

SEQ ID NO: 36532 - DNA, 22 bp, Artificial Sequence
  chemically synthesized
ttctgcctggctcaccagcagt

SEQ ID NO: 36533 - DNA, 22 bp, Artificial Sequence
  chemically synthesized
tgcctggctcaccagcagtcag

SEQ ID NO: 36534 - DNA, 22 bp, Artificial Sequence
  chemically synthesized
cctggctcaccagcagtcagag

SEQ ID NO: 36535 - DNA, 22 bp, Artificial Sequence
  chemically synthesized
gctcaccagcagtcagagttta

SEQ ID NO: 36536 - DNA, 22 bp, Artificial Sequence
  chemically synthesized
accagcagtcagagtttaaggt

SEQ ID NO: 36537 - DNA, 22 bp, Artificial Sequence
  chemically synthesized
aaggttatctctcttattccct

SEQ ID NO: 36538 - DNA, 22 bp, Artificial Sequence
  chemically synthesized
aggttatctctcttattccctg

SEQ ID NO: 36539 - DNA, 22 bp, Artificial Sequence
  chemically synthesized
tctctcttattccctgaacaat

SEQ ID NO: 36540 - DNA, 22 bp, Artificial Sequence
  chemically synthesized
tcttattccctgaacaattgct

SEQ ID NO: 36541 - DNA, 22 bp, Artificial Sequence
  chemically synthesized
ttattccctgaacaattgctgt

SEQ ID NO: 36542 - DNA, 22 bp, Artificial Sequence
  chemically synthesized
attccctgaacaattgctgtta

SEQ ID NO: 36543 - DNA, 22 bp, Artificial Sequence
  chemically synthesized
ttccctgaacaattgctgttat

SEQ ID NO: 36544 - DNA, 22 bp, Artificial Sequence
  chemically synthesized
cctgaacaattgctgttatcct

SEQ ID NO: 36545 - DNA, 22 bp, Artificial Sequence
  chemically synthesized
aacaattgctgttatcctgttc

SEQ ID NO: 36546 - DNA, 22 bp, Artificial Sequence
  chemically synthesized
ctgttatcctgttcttttttca

SEQ ID NO: 36547 - DNA, 22 bp, Artificial Sequence
  chemically synthesized
ttatcctgttcttttttcaagg

SEQ ID NO: 36548 - DNA, 22 bp, Artificial Sequence
  chemically synthesized
tcctgttcttttttcaaggtgt

SEQ ID NO: 36549 - DNA, 22 bp, Artificial Sequence
  chemically synthesized
ttcttttttcaaggtgtccaca

SEQ ID NO: 36550 - DNA, 22 bp, Artificial Sequence
  chemically synthesized
ttttttcaaggtgtccacattt

SEQ ID NO: 36551 - DNA, 22 bp, Artificial Sequence
  chemically synthesized
ttttcaaggtgtccacatttca

SEQ ID NO: 36552 - DNA, 22 bp, Artificial Sequence
  chemically synthesized
tttcaaggtgtccacatttcat

SEQ ID NO: 36553 - DNA, 22 bp, Artificial Sequence
  chemically synthesized
ttcaaggtgtccacatttcatg

SEQ ID NO: 36554 - DNA, 22 bp, Artificial Sequence
  chemically synthesized
tcaaggtgtccacatttcatgt

SEQ ID NO: 36555 - DNA, 22 bp, Artificial Sequence
  chemically synthesized
caaggtgtccacatttcatgtt

SEQ ID NO: 36556 - DNA, 22 bp, Artificial Sequence
  chemically synthesized
aaggtgtccacatttcatgttg

SEQ ID NO: 36557 - DNA, 22 bp, Artificial Sequence
  chemically synthesized
catgttgctcaaacacacatgc

SEQ ID NO: 36558 - DNA, 22 bp, Artificial Sequence
  chemically synthesized
atgttgctcaaacacacatgct

SEQ ID NO: 36559 - DNA, 22 bp, Artificial Sequence
  chemically synthesized
ctcaaacacacatgctgtacaa

SEQ ID NO: 36560 - DNA, 22 bp, Artificial Sequence
  chemically synthesized
aaacacacatgctgtacaattt

SEQ ID NO: 36561 - DNA, 22 bp, Artificial Sequence
  chemically synthesized
tacaatttgtgcagttaatgca

SEQ ID NO: 36562 - DNA, 22 bp, Artificial Sequence
  chemically synthesized
gtgcagttaatgcaattattac

SEQ ID NO: 36563 - DNA, 22 bp, Artificial Sequence
  chemically synthesized
tgcagttaatgcaattattaca

SEQ ID NO: 36564 - DNA, 22 bp, Artificial Sequence
  chemically synthesized
atgcaattattacagggtcctg

SEQ ID NO: 36565 - DNA, 22 bp, Artificial Sequence
  chemically synthesized
ttacagggtcctgaggcaatat

SEQ ID NO: 36566 - DNA, 22 bp, Artificial Sequence
  chemically synthesized
cagggtcctgaggcaatataca

SEQ ID NO: 36567 - DNA, 22 bp, Artificial Sequence
  chemically synthesized
aggcaatatacatcctcctcag

SEQ ID NO: 36568 - DNA, 22 bp, Artificial Sequence
  chemically synthesized
ctcagctgacaggattaagaga

SEQ ID NO: 36569 - DNA, 22 bp, Artificial Sequence
  chemically synthesized
agctgacaggattaagagatta

SEQ ID NO: 36570 - DNA, 22 bp, Artificial Sequence
  chemically synthesized
acaggattaagagattaaagta

SEQ ID NO: 36571 - DNA, 22 bp, Artificial Sequence
  chemically synthesized
agagattaaagtaaagacaggc

SEQ ID NO: 36572 - DNA, 22 bp, Artificial Sequence
  chemically synthesized
aagtaaagacaggcataaatca

SEQ ID NO: 36573 - DNA, 22 bp, Artificial Sequence
  chemically synthesized
actggggaagtgataagtgtcc

SEQ ID NO: 36574 - DNA, 22 bp, Artificial Sequence
  chemically synthesized
gggaagtgataagtgtccatga

SEQ ID NO: 36575 - DNA, 22 bp, Artificial Sequence
  chemically synthesized
tacaatttatgtttagagattg

SEQ ID NO: 36576 - DNA, 22 bp, Artificial Sequence
  chemically synthesized
acaatttatgtttagagattgc

SEQ ID NO: 36577 - DNA, 22 bp, Artificial Sequence
  chemically synthesized
caatttatgtttagagattgca

SEQ ID NO: 36578 - DNA, 22 bp, Artificial Sequence
  chemically synthesized
atgtttagagattgcagtaaag

SEQ ID NO: 36579 - DNA, 22 bp, Artificial Sequence
  chemically synthesized
tgtttagagattgcagtaaaga

SEQ ID NO: 36580 - DNA, 22 bp, Artificial Sequence
  chemically synthesized
agagattgcagtaaagacaggc

SEQ ID NO: 36581 - DNA, 22 bp, Artificial Sequence
  chemically synthesized
gagattgcagtaaagacaggca

SEQ ID NO: 36582 - DNA, 22 bp, Artificial Sequence
  chemically synthesized
cagtaaagacaggcataagaaa

SEQ ID NO: 36583 - DNA, 22 bp, Artificial Sequence
  chemically synthesized
caaaagtattaatttggggaac

SEQ ID NO: 36584 - DNA, 22 bp, Artificial Sequence
  chemically synthesized
atttggggaactaataaatgtc

SEQ ID NO: 36585 - DNA, 22 bp, Artificial Sequence
  chemically synthesized
ggggaactaataaatgtccatg

SEQ ID NO: 36586 - DNA, 22 bp, Artificial Sequence
  chemically synthesized
gggaactaataaatgtccatga

SEQ ID NO: 36587 - DNA, 22 bp, Artificial Sequence
  chemically synthesized
ataaatgtccatgaaatcttca

SEQ ID NO: 36588 - DNA, 22 bp, Artificial Sequence
  chemically synthesized
cacaatccacgaacttctgcca

SEQ ID NO: 36589 - DNA, 22 bp, Artificial Sequence
  chemically synthesized
acaatccacgaacttctgccat

SEQ ID NO: 36590 - DNA, 22 bp, Artificial Sequence
  chemically synthesized
ctgccatggcttcagctgatcc

SEQ ID NO: 36591 - DNA, 22 bp, Artificial Sequence
  chemically synthesized
tgccatggcttcagctgatccc

SEQ ID NO: 36592 - DNA, 22 bp, Artificial Sequence
  chemically synthesized
ccatggcttcagctgatccctc

SEQ ID NO: 36593 - DNA, 22 bp, Artificial Sequence
  chemically synthesized
cagctgatccctccgtttggag

SEQ ID NO: 36594 - DNA, 22 bp, Artificial Sequence
  chemically synthesized
agctgatccctccgtttggagt

SEQ ID NO: 36595 - DNA, 22 bp, Artificial Sequence
  chemically synthesized
atccctccgtttggagtcccag

SEQ ID NO: 36596 - DNA, 22 bp, Artificial Sequence
  chemically synthesized
cgtttggagtcccagacttccc

SEQ ID NO: 36597 - DNA, 22 bp, Artificial Sequence
  chemically synthesized
ggagtcccagacttcccgcaac

SEQ ID NO: 36598 - DNA, 22 bp, Artificial Sequence
  chemically synthesized
gagtcccagacttcccgcaaca

SEQ ID NO: 36599 - DNA, 22 bp, Artificial Sequence
  chemically synthesized
cccgcaacaactgagaactctg

SEQ ID NO: 36600 - DNA, 22 bp, Artificial Sequence
  chemically synthesized
ccgcaacaactgagaactctgg

SEQ ID NO: 36601 - DNA, 22 bp, Artificial Sequence
  chemically synthesized
agaactctggagggcctaccct

SEQ ID NO: 36602 - DNA, 22 bp, Artificial Sequence
  chemically synthesized
tggagggcctacccttcaccca

SEQ ID NO: 36603 - DNA, 22 bp, Artificial Sequence
  chemically synthesized
gagggcctacccttcacccact

SEQ ID NO: 36604 - DNA, 22 bp, Artificial Sequence
  chemically synthesized
cccttcacccacttccaccctt

SEQ ID NO: 36605 - DNA, 22 bp, Artificial Sequence
  chemically synthesized
cacccacttccacccttcttat

SEQ ID NO: 36606 - DNA, 22 bp, Artificial Sequence
  chemically synthesized
acccacttccacccttcttata

SEQ ID NO: 36607 - DNA, 22 bp, Artificial Sequence
  chemically synthesized
ccacccttcttatatctcttaa

SEQ ID NO: 36608 - DNA, 22 bp, Artificial Sequence
  chemically synthesized
cacccttcttatatctcttaag

SEQ ID NO: 36609 - DNA, 22 bp, Artificial Sequence
  chemically synthesized
cttatatctcttaaggagctgt

SEQ ID NO: 36610 - DNA, 22 bp, Artificial Sequence
  chemically synthesized
ttatatctcttaaggagctgtg

SEQ ID NO: 36611 - DNA, 22 bp, Artificial Sequence
  chemically synthesized
atatctcttaaggagctgtgtt

SEQ ID NO: 36612 - DNA, 22 bp, Artificial Sequence
  chemically synthesized
tatctcttaaggagctgtgttc

SEQ ID NO: 36613 - DNA, 22 bp, Artificial Sequence
  chemically synthesized
ttaaggagctgtgttcagatgg

SEQ ID NO: 36614 - DNA, 22 bp, Artificial Sequence
  chemically synthesized
aaggagctgtgttcagatggtt

SEQ ID NO: 36615 - DNA, 22 bp, Artificial Sequence
  chemically synthesized
aggagctgtgttcagatggtta

SEQ ID NO: 36616 - DNA, 22 bp, Artificial Sequence
  chemically synthesized
tgttcagatggttacatttcgc

SEQ ID NO: 36617 - DNA, 22 bp, Artificial Sequence
  chemically synthesized
agatggttacatttcgcttgct

SEQ ID NO: 36618 - DNA, 22 bp, Artificial Sequence
  chemically synthesized
catttcgcttgctgagcaagac

SEQ ID NO: 36619 - DNA, 22 bp, Artificial Sequence
  chemically synthesized
cgcttgctgagcaagactgcat

SEQ ID NO: 36620 - DNA, 22 bp, Artificial Sequence
  chemically synthesized
gcttgctgagcaagactgcatt

SEQ ID NO: 36621 - DNA, 22 bp, Artificial Sequence
  chemically synthesized
gctgagcaagactgcattttca

SEQ ID NO: 36622 - DNA, 22 bp, Artificial Sequence
  chemically synthesized
ctgagcaagactgcattttcat

SEQ ID NO: 36623 - DNA, 22 bp, Artificial Sequence
  chemically synthesized
agcaagactgcattttcattat

SEQ ID NO: 36624 - DNA, 22 bp, Artificial Sequence
  chemically synthesized
cattttcattatcctgggctaa

SEQ ID NO: 36625 - DNA, 22 bp, Artificial Sequence
  chemically synthesized
tcattatcctgggctaaaatca

SEQ ID NO: 36626 - DNA, 22 bp, Artificial Sequence
  chemically synthesized
cattatcctgggctaaaatcaa

SEQ ID NO: 36627 - DNA, 22 bp, Artificial Sequence
  chemically synthesized
attatcctgggctaaaatcaat

SEQ ID NO: 36628 - DNA, 22 bp, Artificial Sequence
  chemically synthesized
tcctgggctaaaatcaattggt

SEQ ID NO: 36629 - DNA, 22 bp, Artificial Sequence
  chemically synthesized
ggctaaaatcaattggtattta

SEQ ID NO: 36630 - DNA, 22 bp, Artificial Sequence
  chemically synthesized
aaatcaattggtatttaagtta

SEQ ID NO: 36631 - DNA, 22 bp, Artificial Sequence
  chemically synthesized
gtatttaagttagagcaaaaag

SEQ ID NO: 36632 - DNA, 22 bp, Artificial Sequence
  chemically synthesized
aagttagagcaaaaagggttct

SEQ ID NO: 36633 - DNA, 22 bp, Artificial Sequence
  chemically synthesized
agttagagcaaaaagggttcta

SEQ ID NO: 36634 - DNA, 22 bp, Artificial Sequence
  chemically synthesized
gagcaaaaagggttctaaccct

SEQ ID NO: 36635 - DNA, 22 bp, Artificial Sequence
  chemically synthesized
taaccctatttacagcagcaca

SEQ ID NO: 36636 - DNA, 22 bp, Artificial Sequence
  chemically synthesized
accctatttacagcagcacaca

SEQ ID NO: 36637 - DNA, 22 bp, Artificial Sequence
  chemically synthesized
tttacagcagcacacatacact

SEQ ID NO: 36638 - DNA, 22 bp, Artificial Sequence
  chemically synthesized
acagcagcacacatacacttac

SEQ ID NO: 36639 - DNA, 22 bp, Artificial Sequence
  chemically synthesized
cagcagcacacatacacttaca

SEQ ID NO: 36640 - DNA, 22 bp, Artificial Sequence
  chemically synthesized
acattagaattggctttaaggg

SEQ ID NO: 36641 - DNA, 22 bp, Artificial Sequence
  chemically synthesized
cattagaattggctttaaggga

SEQ ID NO: 36642 - DNA, 22 bp, Artificial Sequence
  chemically synthesized
gaattggctttaagggaaaaat

SEQ ID NO: 36643 - DNA, 22 bp, Artificial Sequence
  chemically synthesized
gctttaagggaaaaattcaatc

SEQ ID NO: 36644 - DNA, 22 bp, Artificial Sequence
  chemically synthesized
taagggaaaaattcaatcaatc

SEQ ID NO: 36645 - DNA, 22 bp, Artificial Sequence
  chemically synthesized
aagggaaaaattcaatcaatcg

SEQ ID NO: 36646 - DNA, 22 bp, Artificial Sequence
  chemically synthesized
agggaaaaattcaatcaatcga

SEQ ID NO: 36647 - DNA, 22 bp, Artificial Sequence
  chemically synthesized
aatcaatcgacaaatttccact

SEQ ID NO: 36648 - DNA, 22 bp, Artificial Sequence
  chemically synthesized
ccactgattaccttctatgagc

SEQ ID NO: 36649 - DNA, 22 bp, Artificial Sequence
  chemically synthesized
cactgattaccttctatgagcc

SEQ ID NO: 36650 - DNA, 22 bp, Artificial Sequence
  chemically synthesized
attaccttctatgagccaagac

SEQ ID NO: 36651 - DNA, 22 bp, Artificial Sequence
  chemically synthesized
ccttctatgagccaagactgcc

SEQ ID NO: 36652 - DNA, 22 bp, Artificial Sequence
  chemically synthesized
ctatgagccaagactgccatag

SEQ ID NO: 36653 - DNA, 22 bp, Artificial Sequence
  chemically synthesized
tatgagccaagactgccatagt

SEQ ID NO: 36654 - DNA, 22 bp, Artificial Sequence
  chemically synthesized
tgagccaagactgccatagtct

SEQ ID NO: 36655 - DNA, 22 bp, Artificial Sequence
  chemically synthesized
ccatagtctcagccttcatgca

SEQ ID NO: 36656 - DNA, 22 bp, Artificial Sequence
  chemically synthesized
agccttcatgcagcttataggc

SEQ ID NO: 36657 - DNA, 22 bp, Artificial Sequence
  chemically synthesized
catgcagcttataggctagcaa

SEQ ID NO: 36658 - DNA, 22 bp, Artificial Sequence
  chemically synthesized
atgcagcttataggctagcaaa

SEQ ID NO: 36659 - DNA, 22 bp, Artificial Sequence
  chemically synthesized
ataggctagcaaaaaagccaga

SEQ ID NO: 36660 - DNA, 22 bp, Artificial Sequence
  chemically synthesized
taggctagcaaaaaagccagac

SEQ ID NO: 36661 - DNA, 22 bp, Artificial Sequence
  chemically synthesized
gcaaaaaagccagacagtgcac

SEQ ID NO: 36662 - DNA, 22 bp, Artificial Sequence
  chemically synthesized
acaagtgtgttgagtgttgcaa

SEQ ID NO: 36663 - DNA, 22 bp, Artificial Sequence
  chemically synthesized
agtgttgcaagagtaagtttca

SEQ ID NO: 36664 - DNA, 22 bp, Artificial Sequence
  chemically synthesized
caagagtaagtttcaggggctc

SEQ ID NO: 36665 - DNA, 22 bp, Artificial Sequence
  chemically synthesized
caggggctctccatgacttacc

SEQ ID NO: 36666 - DNA, 22 bp, Artificial Sequence
  chemically synthesized
aggggctctccatgacttacct

SEQ ID NO: 36667 - DNA, 22 bp, Artificial Sequence
  chemically synthesized
tccatgacttacctggttgaga

SEQ ID NO: 36668 - DNA, 22 bp, Artificial Sequence
  chemically synthesized
catgacttacctggttgagaaa

SEQ ID NO: 36669 - DNA, 22 bp, Artificial Sequence
  chemically synthesized
acctggttgagaaaccctttaa

SEQ ID NO: 36670 - DNA, 22 bp, Artificial Sequence
  chemically synthesized
cctggttgagaaaccctttaac

SEQ ID NO: 36671 - DNA, 22 bp, Artificial Sequence
  chemically synthesized
gttgagaaaccctttaactttt

SEQ ID NO: 36672 - DNA, 22 bp, Artificial Sequence
  chemically synthesized
agaaaccctttaactttttttt

SEQ ID NO: 36673 - DNA, 22 bp, Artificial Sequence
  chemically synthesized
taactttttttttcctctgggt

SEQ ID NO: 36674 - DNA, 22 bp, Artificial Sequence
  chemically synthesized
aactttttttttcctctgggtg

SEQ ID NO: 36675 - DNA, 22 bp, Artificial Sequence
  chemically synthesized
actttttttttcctctgggtgt

SEQ ID NO: 36676 - DNA, 22 bp, Artificial Sequence
  chemically synthesized
tttttttcctctgggtgtaaag

SEQ ID NO: 36677 - DNA, 22 bp, Artificial Sequence
  chemically synthesized
ttttttcctctgggtgtaaagt

SEQ ID NO: 36678 - DNA, 22 bp, Artificial Sequence
  chemically synthesized
tttttcctctgggtgtaaagtg

SEQ ID NO: 36679 - DNA, 22 bp, Artificial Sequence
  chemically synthesized
ttttcctctgggtgtaaagtga

SEQ ID NO: 36680 - DNA, 22 bp, Artificial Sequence
  chemically synthesized
tttcctctgggtgtaaagtgaa

SEQ ID NO: 36681 - DNA, 22 bp, Artificial Sequence
  chemically synthesized
ttcctctgggtgtaaagtgaag

SEQ ID NO: 36682 - DNA, 22 bp, Artificial Sequence
  chemically synthesized
tcctctgggtgtaaagtgaaga

SEQ ID NO: 36683 - DNA, 22 bp, Artificial Sequence
  chemically synthesized
cctctgggtgtaaagtgaagag

SEQ ID NO: 36684 - DNA, 22 bp, Artificial Sequence
  chemically synthesized
ctctgggtgtaaagtgaagaga

SEQ ID NO: 36685 - DNA, 22 bp, Artificial Sequence
  chemically synthesized
tgggtgtaaagtgaagagatgg

SEQ ID NO: 36686 - DNA, 22 bp, Artificial Sequence
  chemically synthesized
ggtgtaaagtgaagagatggca

SEQ ID NO: 36687 - DNA, 22 bp, Artificial Sequence
  chemically synthesized
cattgtgtcattgtgaaaagat

SEQ ID NO: 36688 - DNA, 22 bp, Artificial Sequence
  chemically synthesized
tgtcattgtgaaaagatgctgg

SEQ ID NO: 36689 - DNA, 22 bp, Artificial Sequence
  chemically synthesized
tgaaaagatgctgggctggcgt

SEQ ID NO: 36690 - DNA, 22 bp, Artificial Sequence
  chemically synthesized
ggctggcgtgtctcctgaaggc

SEQ ID NO: 36691 - DNA, 22 bp, Artificial Sequence
  chemically synthesized
gcgtgtctcctgaaggccaccc

SEQ ID NO: 36692 - DNA, 22 bp, Artificial Sequence
  chemically synthesized
ctgaaggccacccatatcttta

SEQ ID NO: 36693 - DNA, 22 bp, Artificial Sequence
  chemically synthesized
aaggccacccatatctttaaac

SEQ ID NO: 36694 - DNA, 22 bp, Artificial Sequence
  chemically synthesized
taaactttattttcatgcattc

SEQ ID NO: 36695 - DNA, 22 bp, Artificial Sequence
  chemically synthesized
aaactttattttcatgcattcg

SEQ ID NO: 36696 - DNA, 22 bp, Artificial Sequence
  chemically synthesized
aactttattttcatgcattcgc

SEQ ID NO: 36697 - DNA, 22 bp, Artificial Sequence
  chemically synthesized
tattttcatgcattcgcacaaa

SEQ ID NO: 36698 - DNA, 22 bp, Artificial Sequence
  chemically synthesized
attttcatgcattcgcacaaat

SEQ ID NO: 36699 - DNA, 22 bp, Artificial Sequence
  chemically synthesized
ttttcatgcattcgcacaaata

SEQ ID NO: 36700 - DNA, 22 bp, Artificial Sequence
  chemically synthesized
tcatgcattcgcacaaatatag

SEQ ID NO: 36701 - DNA, 22 bp, Artificial Sequence
  chemically synthesized
catgcattcgcacaaatataga

SEQ ID NO: 36702 - DNA, 22 bp, Artificial Sequence
  chemically synthesized
atgcattcgcacaaatatagat

SEQ ID NO: 36703 - DNA, 22 bp, Artificial Sequence
  chemically synthesized
gcacaaatatagatgtgttcca

SEQ ID NO: 36704 - DNA, 22 bp, Artificial Sequence
  chemically synthesized
catagatgaggcagatagcaga

SEQ ID NO: 36705 - DNA, 22 bp, Artificial Sequence
  chemically synthesized
ctgcctacagcaaggctagttt

SEQ ID NO: 36706 - DNA, 22 bp, Artificial Sequence
  chemically synthesized
tgcctacagcaaggctagtttg

SEQ ID NO: 36707 - DNA, 22 bp, Artificial Sequence
  chemically synthesized
cctacagcaaggctagtttgga

SEQ ID NO: 36708 - DNA, 22 bp, Artificial Sequence
  chemically synthesized
cagcaaggctagtttggagagg

SEQ ID NO: 36709 - DNA, 22 bp, Artificial Sequence
  chemically synthesized
gtttggagagggttttgctgtc

SEQ ID NO: 36710 - DNA, 22 bp, Artificial Sequence
  chemically synthesized
ggagagggttttgctgtcaggg

SEQ ID NO: 36711 - DNA, 22 bp, Artificial Sequence
  chemically synthesized
gagagggttttgctgtcagggt

SEQ ID NO: 36712 - DNA, 22 bp, Artificial Sequence
  chemically synthesized
tgctgtcagggttggacccaca

SEQ ID NO: 36713 - DNA, 22 bp, Artificial Sequence
  chemically synthesized
gctgtcagggttggacccacac

SEQ ID NO: 36714 - DNA, 22 bp, Artificial Sequence
  chemically synthesized
ctgtcagggttggacccacaca

SEQ ID NO: 36715 - DNA, 22 bp, Artificial Sequence
  chemically synthesized
tcagggttggacccacacacct

SEQ ID NO: 36716 - DNA, 22 bp, Artificial Sequence
  chemically synthesized
gacccacacacctcttcataga

SEQ ID NO: 36717 - DNA, 22 bp, Artificial Sequence
  chemically synthesized
ttcatagatgctttttcttttt

SEQ ID NO: 36718 - DNA, 22 bp, Artificial Sequence
  chemically synthesized
catagatgctttttcttttttt

SEQ ID NO: 36719 - DNA, 22 bp, Artificial Sequence
  chemically synthesized
atagatgctttttctttttttt

SEQ ID NO: 36720 - DNA, 22 bp, Artificial Sequence
  chemically synthesized
tttcttttttttcccagagttt

SEQ ID NO: 36721 - DNA, 22 bp, Artificial Sequence
  chemically synthesized
ttcttttttttcccagagtttg

SEQ ID NO: 36722 - DNA, 22 bp, Artificial Sequence
  chemically synthesized
tcttttttttcccagagtttga

SEQ ID NO: 36723 - DNA, 22 bp, Artificial Sequence
  chemically synthesized
cttttttttcccagagtttgaa

SEQ ID NO: 36724 - DNA, 22 bp, Artificial Sequence
  chemically synthesized
ttttttttcccagagtttgaaa

SEQ ID NO: 36725 - DNA, 22 bp, Artificial Sequence
  chemically synthesized
ttttttcccagagtttgaaagg

SEQ ID NO: 36726 - DNA, 22 bp, Artificial Sequence
  chemically synthesized
tttttcccagagtttgaaaggg

SEQ ID NO: 36727 - DNA, 22 bp, Artificial Sequence
  chemically synthesized
ttttcccagagtttgaaaggga

SEQ ID NO: 36728 - DNA, 22 bp, Artificial Sequence
  chemically synthesized
tttcccagagtttgaaagggaa

SEQ ID NO: 36729 - DNA, 22 bp, Artificial Sequence
  chemically synthesized
ttcccagagtttgaaagggaaa

SEQ ID NO: 36730 - DNA, 22 bp, Artificial Sequence
  chemically synthesized
tcccagagtttgaaagggaaat

SEQ ID NO: 36731 - DNA, 22 bp, Artificial Sequence
  chemically synthesized
cccagagtttgaaagggaaatg

SEQ ID NO: 36732 - DNA, 22 bp, Artificial Sequence
  chemically synthesized
ccagagtttgaaagggaaatgg

SEQ ID NO: 36733 - DNA, 22 bp, Artificial Sequence
  chemically synthesized
gaaagggaaatggagtctcaag

SEQ ID NO: 36734 - DNA, 22 bp, Artificial Sequence
  chemically synthesized
aaagggaaatggagtctcaagt

SEQ ID NO: 36735 - DNA, 22 bp, Artificial Sequence
  chemically synthesized
aagttcagggaggttacagtgt

SEQ ID NO: 36736 - DNA, 22 bp, Artificial Sequence
  chemically synthesized
agggaggttacagtgtagaccc

SEQ ID NO: 36737 - DNA, 22 bp, Artificial Sequence
  chemically synthesized
cagtgtagacccacaaatcagc

SEQ ID NO: 36738 - DNA, 22 bp, Artificial Sequence
  chemically synthesized
agtacagctaagggtggagaag

SEQ ID NO: 36739 - DNA, 22 bp, Artificial Sequence
  chemically synthesized
agggtggagaagtctatgcaat

SEQ ID NO: 36740 - DNA, 22 bp, Artificial Sequence
  chemically synthesized
tgcaatatccagcactcttctg

SEQ ID NO: 36741 - DNA, 22 bp, Artificial Sequence
  chemically synthesized
ttctgattaattagaagtcttt

SEQ ID NO: 36742 - DNA, 22 bp, Artificial Sequence
  chemically synthesized
ctgattaattagaagtctttaa

SEQ ID NO: 36743 - DNA, 22 bp, Artificial Sequence
  chemically synthesized
tgattaattagaagtctttaaa

SEQ ID NO: 36744 - DNA, 22 bp, Artificial Sequence
  chemically synthesized
attaattagaagtctttaaaat

SEQ ID NO: 36745 - DNA, 22 bp, Artificial Sequence
  chemically synthesized
attagaagtctttaaaattcac

SEQ ID NO: 36746 - DNA, 22 bp, Artificial Sequence
  chemically synthesized
gaagtctttaaaattcacagaa

SEQ ID NO: 36747 - DNA, 22 bp, Artificial Sequence
  chemically synthesized
taaaattcacagaaaccatatt

SEQ ID NO: 36748 - DNA, 22 bp, Artificial Sequence
  chemically synthesized
aaaattcacagaaaccatattg

SEQ ID NO: 36749 - DNA, 22 bp, Artificial Sequence
  chemically synthesized
aaattcacagaaaccatattgt

SEQ ID NO: 36750 - DNA, 22 bp, Artificial Sequence
  chemically synthesized
acagaaaccatattgtcttccc

SEQ ID NO: 36751 - DNA, 22 bp, Artificial Sequence
  chemically synthesized
tcttccctaaatgattcatatg

SEQ ID NO: 36752 - DNA, 22 bp, Artificial Sequence
  chemically synthesized
ccctaaatgattcatatgtcaa

SEQ ID NO: 36753 - DNA, 22 bp, Artificial Sequence
  chemically synthesized
cctaaatgattcatatgtcaag

SEQ ID NO: 36754 - DNA, 22 bp, Artificial Sequence
  chemically synthesized
aatgattcatatgtcaagacac

SEQ ID NO: 36755 - DNA, 22 bp, Artificial Sequence
  chemically synthesized
atatgtcaagacacagtaaaga

SEQ ID NO: 36756 - DNA, 22 bp, Artificial Sequence
  chemically synthesized
tatgtggaacatcatacacaaa

SEQ ID NO: 36757 - DNA, 22 bp, Artificial Sequence
  chemically synthesized
ttaccttagtaaactgccaatt

SEQ ID NO: 36758 - DNA, 22 bp, Artificial Sequence
  chemically synthesized
accttagtaaactgccaatttt

SEQ ID NO: 36759 - DNA, 22 bp, Artificial Sequence
  chemically synthesized
ccttagtaaactgccaattttc

SEQ ID NO: 36760 - DNA, 22 bp, Artificial Sequence
  chemically synthesized
agtaaactgccaattttctgaa

SEQ ID NO: 36761 - DNA, 22 bp, Artificial Sequence
  chemically synthesized
gtaaactgccaattttctgaaa

SEQ ID NO: 36762 - DNA, 22 bp, Artificial Sequence
  chemically synthesized
ccaattttctgaaatgctcttt

SEQ ID NO: 36763 - DNA, 22 bp, Artificial Sequence
  chemically synthesized
tctgaaatgctctttaaatcct

SEQ ID NO: 36764 - DNA, 22 bp, Artificial Sequence
  chemically synthesized
ctgaaatgctctttaaatcctg

SEQ ID NO: 36765 - DNA, 22 bp, Artificial Sequence
  chemically synthesized
tgaaatgctctttaaatcctgc

SEQ ID NO: 36766 - DNA, 22 bp, Artificial Sequence
  chemically synthesized
aaatgctctttaaatcctgcta

SEQ ID NO: 36767 - DNA, 22 bp, Artificial Sequence
  chemically synthesized
tttaaatcctgctaatggtggc

SEQ ID NO: 36768 - DNA, 22 bp, Artificial Sequence
  chemically synthesized
taaatcctgctaatggtggcat

SEQ ID NO: 36769 - DNA, 22 bp, Artificial Sequence
  chemically synthesized
aaatcctgctaatggtggcatt

SEQ ID NO: 36770 - DNA, 22 bp, Artificial Sequence
  chemically synthesized
aatcctgctaatggtggcattt

SEQ ID NO: 36771 - DNA, 22 bp, Artificial Sequence
  chemically synthesized
ctaatggtggcatttgtgtctt

SEQ ID NO: 36772 - DNA, 22 bp, Artificial Sequence
  chemically synthesized
atggtggcatttgtgtctttgt

SEQ ID NO: 36773 - DNA, 22 bp, Artificial Sequence
  chemically synthesized
gtgtctttgtcacctacagtac

SEQ ID NO: 36774 - DNA, 22 bp, Artificial Sequence
  chemically synthesized
tgtctttgtcacctacagtaca

SEQ ID NO: 36775 - DNA, 22 bp, Artificial Sequence
  chemically synthesized
tgtcacctacagtacatttctg

SEQ ID NO: 36776 - DNA, 22 bp, Artificial Sequence
  chemically synthesized
gtcacctacagtacatttctgg

SEQ ID NO: 36777 - DNA, 22 bp, Artificial Sequence
  chemically synthesized
tcacctacagtacatttctgga

SEQ ID NO: 36778 - DNA, 22 bp, Artificial Sequence
  chemically synthesized
cagtacatttctggatttggga

SEQ ID NO: 36779 - DNA, 22 bp, Artificial Sequence
  chemically synthesized
ctggatttgggaatgagtgttc

SEQ ID NO: 36780 - DNA, 22 bp, Artificial Sequence
  chemically synthesized
tggatttgggaatgagtgttct

SEQ ID NO: 36781 - DNA, 22 bp, Artificial Sequence
  chemically synthesized
gatttgggaatgagtgttcttc

SEQ ID NO: 36782 - DNA, 22 bp, Artificial Sequence
  chemically synthesized
gggaatgagtgttcttcagagg

SEQ ID NO: 36783 - DNA, 22 bp, Artificial Sequence
  chemically synthesized
ggaatgagtgttcttcagagga

SEQ ID NO: 36784 - DNA, 22 bp, Artificial Sequence
  chemically synthesized
ttcagaggatcctcgctgccca

SEQ ID NO: 36785 - DNA, 22 bp, Artificial Sequence
  chemically synthesized
cagaggatcctcgctgcccagg

SEQ ID NO: 36786 - DNA, 22 bp, Artificial Sequence
  chemically synthesized
agaggatcctcgctgcccaggt

SEQ ID NO: 36787 - DNA, 22 bp, Artificial Sequence
  chemically synthesized
gctgcccaggttccctgccaga

SEQ ID NO: 36788 - DNA, 22 bp, Artificial Sequence
  chemically synthesized
cccaggttccctgccagaagga

SEQ ID NO: 36789 - DNA, 20 bp, Artificial Sequence
  chemically synthesized
ctccttttgccacaccctca

SEQ ID NO: 36790 - DNA, 20 bp, Artificial Sequence
  chemically synthesized
acaccctcacagacataacc

SEQ ID NO: 36791 - DNA, 20 bp, Artificial Sequence
  chemically synthesized
ttgcatctttcaatccaatc

SEQ ID NO: 36792 - DNA, 20 bp, Artificial Sequence
  chemically synthesized
tttcaatccaatcaagttga

SEQ ID NO: 36793 - DNA, 20 bp, Artificial Sequence
  chemically synthesized
ttgacagtattaaccatcac

SEQ ID NO: 36794 - DNA, 20 bp, Artificial Sequence
  chemically synthesized
tcatacataatcttcaaata

SEQ ID NO: 36795 - DNA, 20 bp, Artificial Sequence
  chemically synthesized
cttcaaataaagacaataat

SEQ ID NO: 36796 - DNA, 20 bp, Artificial Sequence
  chemically synthesized
ttcaaataaagacaataata

SEQ ID NO: 36797 - DNA, 20 bp, Artificial Sequence
  chemically synthesized
tacaactatcctcatacaac

SEQ ID NO: 36798 - DNA, 20 bp, Artificial Sequence
  chemically synthesized
cgcaccaatccccaaaccaa

SEQ ID NO: 36799 - DNA, 20 bp, Artificial Sequence
  chemically synthesized
caaaccaaaagttattacat

SEQ ID NO: 36800 - DNA, 20 bp, Artificial Sequence
  chemically synthesized
aaaccaaaagttattacata

SEQ ID NO: 36801 - DNA, 20 bp, Artificial Sequence
  chemically synthesized
aatgcttaaatgctgatgtg

SEQ ID NO: 36802 - DNA, 20 bp, Artificial Sequence
  chemically synthesized
gatgtgaagtccataaatct

SEQ ID NO: 36803 - DNA, 20 bp, Artificial Sequence
  chemically synthesized
atgtgaagtccataaatcta

SEQ ID NO: 36804 - DNA, 20 bp, Artificial Sequence
  chemically synthesized
aaatctaaggtcacatgata

SEQ ID NO: 36805 - DNA, 20 bp, Artificial Sequence
  chemically synthesized
aatctaaggtcacatgataa

SEQ ID NO: 36806 - DNA, 20 bp, Artificial Sequence
  chemically synthesized
cacatgataaaggaaaaata

SEQ ID NO: 36807 - DNA, 20 bp, Artificial Sequence
  chemically synthesized
acatgataaaggaaaaataa

SEQ ID NO: 36808 - DNA, 20 bp, Artificial Sequence
  chemically synthesized
aaaataaaggaaataaaata

SEQ ID NO: 36809 - DNA, 20 bp, Artificial Sequence
  chemically synthesized
ataaaataaagatattttct

SEQ ID NO: 36810 - DNA, 20 bp, Artificial Sequence
  chemically synthesized
taaagatattttcttagcac

SEQ ID NO: 36811 - DNA, 20 bp, Artificial Sequence
  chemically synthesized
cacaagtgtacacatgcatt

SEQ ID NO: 36812 - DNA, 20 bp, Artificial Sequence
  chemically synthesized
agtgtacacatgcatttaga

SEQ ID NO: 36813 - DNA, 20 bp, Artificial Sequence
  chemically synthesized
gtacacatgcatttagaaag

SEQ ID NO: 36814 - DNA, 20 bp, Artificial Sequence
  chemically synthesized
atgcatttagaaagtggata

SEQ ID NO: 36815 - DNA, 20 bp, Artificial Sequence
  chemically synthesized
agaaagtggatatagtgctg

SEQ ID NO: 36816 - DNA, 20 bp, Artificial Sequence
  chemically synthesized
gtgctgcagctgtccacttt

SEQ ID NO: 36817 - DNA, 20 bp, Artificial Sequence
  chemically synthesized
tgctgcagctgtccactttc

SEQ ID NO: 36818 - DNA, 20 bp, Artificial Sequence
  chemically synthesized
tgcagctgtccactttcggg

SEQ ID NO: 36819 - DNA, 20 bp, Artificial Sequence
  chemically synthesized
ggtggtgcctgcatatcgtg

SEQ ID NO: 36820 - DNA, 20 bp, Artificial Sequence
  chemically synthesized
gtgcagaaccatctatgaac

SEQ ID NO: 36821 - DNA, 20 bp, Artificial Sequence
  chemically synthesized
accatctatgaaccagtcct

SEQ ID NO: 36822 - DNA, 20 bp, Artificial Sequence
  chemically synthesized
cttcctctgtcaactgatca

SEQ ID NO: 36823 - DNA, 20 bp, Artificial Sequence
  chemically synthesized
ttcctctgtcaactgatcat

SEQ ID NO: 36824 - DNA, 20 bp, Artificial Sequence
  chemically synthesized
tcctctgtcaactgatcata

SEQ ID NO: 36825 - DNA, 20 bp, Artificial Sequence
  chemically synthesized
gatcatagggaactccccat

SEQ ID NO: 36826 - DNA, 20 bp, Artificial Sequence
  chemically synthesized
atcatagggaactccccatg

SEQ ID NO: 36827 - DNA, 20 bp, Artificial Sequence
  chemically synthesized
ggaactccccatgaggccat

SEQ ID NO: 36828 - DNA, 20 bp, Artificial Sequence
  chemically synthesized
tccccatgaggccattggtg

SEQ ID NO: 36829 - DNA, 20 bp, Artificial Sequence
  chemically synthesized
ccccatgaggccattggtgc

SEQ ID NO: 36830 - DNA, 20 bp, Artificial Sequence
  chemically synthesized
atgaggccattggtgcaggc

SEQ ID NO: 36831 - DNA, 20 bp, Artificial Sequence
  chemically synthesized
tgaggccattggtgcaggct

SEQ ID NO: 36832 - DNA, 20 bp, Artificial Sequence
  chemically synthesized
gaggccattggtgcaggctg

SEQ ID NO: 36833 - DNA, 20 bp, Artificial Sequence
  chemically synthesized
aggccattggtgcaggctgg

SEQ ID NO: 36834 - DNA, 20 bp, Artificial Sequence
  chemically synthesized
gccattggtgcaggctgggg

SEQ ID NO: 36835 - DNA, 20 bp, Artificial Sequence
  chemically synthesized
ccattggtgcaggctggggg

SEQ ID NO: 36836 - DNA, 20 bp, Artificial Sequence
  chemically synthesized
cattggtgcaggctggggga

SEQ ID NO: 36837 - DNA, 20 bp, Artificial Sequence
  chemically synthesized
tggtgcaggctgggggaggg

SEQ ID NO: 36838 - DNA, 20 bp, Artificial Sequence
  chemically synthesized
ggtgcaggctgggggaggga

SEQ ID NO: 36839 - DNA, 20 bp, Artificial Sequence
  chemically synthesized
gcaggctgggggagggaagg

SEQ ID NO: 36840 - DNA, 20 bp, Artificial Sequence
  chemically synthesized
caggctgggggagggaaggc

SEQ ID NO: 36841 - DNA, 20 bp, Artificial Sequence
  chemically synthesized
aggctgggggagggaaggca

SEQ ID NO: 36842 - DNA, 20 bp, Artificial Sequence
  chemically synthesized
ctgggggagggaaggcaggg

SEQ ID NO: 36843 - DNA, 20 bp, Artificial Sequence
  chemically synthesized
gagggaaggcagggtggcat

SEQ ID NO: 36844 - DNA, 20 bp, Artificial Sequence
  chemically synthesized
ggaaggcagggtggcatgag

SEQ ID NO: 36845 - DNA, 20 bp, Artificial Sequence
  chemically synthesized
aaggcagggtggcatgagtg

SEQ ID NO: 36846 - DNA, 20 bp, Artificial Sequence
  chemically synthesized
ggtggcatgagtggagaaca

SEQ ID NO: 36847 - DNA, 20 bp, Artificial Sequence
  chemically synthesized
gtggcatgagtggagaacat

SEQ ID NO: 36848 - DNA, 20 bp, Artificial Sequence
  chemically synthesized
agtggagaacatgggcattt

SEQ ID NO: 36849 - DNA, 20 bp, Artificial Sequence
  chemically synthesized
atgtaacttacttgtgcctt

SEQ ID NO: 36850 - DNA, 20 bp, Artificial Sequence
  chemically synthesized
tgtaacttacttgtgccttc

SEQ ID NO: 36851 - DNA, 20 bp, Artificial Sequence
  chemically synthesized
tgtgccttcaggacctgctc

SEQ ID NO: 36852 - DNA, 20 bp, Artificial Sequence
  chemically synthesized
cgctgtgctgacccacttca

SEQ ID NO: 36853 - DNA, 20 bp, Artificial Sequence
  chemically synthesized
gtgctgacccacttcatggc

SEQ ID NO: 36854 - DNA, 20 bp, Artificial Sequence
  chemically synthesized
tgacccacttcatggctaga

SEQ ID NO: 36855 - DNA, 20 bp, Artificial Sequence
  chemically synthesized
gacccacttcatggctagat

SEQ ID NO: 36856 - DNA, 20 bp, Artificial Sequence
  chemically synthesized
cacttcatggctagatgggt

SEQ ID NO: 36857 - DNA, 20 bp, Artificial Sequence
  chemically synthesized
tcatggctagatgggtcaga

SEQ ID NO: 36858 - DNA, 20 bp, Artificial Sequence
  chemically synthesized
tagatgggtcagaaagcaac

SEQ ID NO: 36859 - DNA, 20 bp, Artificial Sequence
  chemically synthesized
agaaagcaaccagttcatga

SEQ ID NO: 36860 - DNA, 20 bp, Artificial Sequence
  chemically synthesized
gaaagcaaccagttcatgat

SEQ ID NO: 36861 - DNA, 20 bp, Artificial Sequence
  chemically synthesized
agcaaccagttcatgatagg

SEQ ID NO: 36862 - DNA, 20 bp, Artificial Sequence
  chemically synthesized
gcaaccagttcatgataggc

SEQ ID NO: 36863 - DNA, 20 bp, Artificial Sequence
  chemically synthesized
cagttcatgataggcaggtt

SEQ ID NO: 36864 - DNA, 20 bp, Artificial Sequence
  chemically synthesized
agttcatgataggcaggttc

SEQ ID NO: 36865 - DNA, 20 bp, Artificial Sequence
  chemically synthesized
tcatgataggcaggttcagg

SEQ ID NO: 36866 - DNA, 20 bp, Artificial Sequence
  chemically synthesized
ataggcaggttcaggtagca

SEQ ID NO: 36867 - DNA, 20 bp, Artificial Sequence
  chemically synthesized
catggtgactttatgaccca

SEQ ID NO: 36868 - DNA, 20 bp, Artificial Sequence
  chemically synthesized
atgacccacagtcaaacgtt

SEQ ID NO: 36869 - DNA, 20 bp, Artificial Sequence
  chemically synthesized
caaacgttcagttaccacca

SEQ ID NO: 36870 - DNA, 20 bp, Artificial Sequence
  chemically synthesized
ttaccaccaaagcccaataa

SEQ ID NO: 36871 - DNA, 20 bp, Artificial Sequence
  chemically synthesized
aaagcccaataacagaccaa

SEQ ID NO: 36872 - DNA, 20 bp, Artificial Sequence
  chemically synthesized
gaccaatagctgtctctcaa

SEQ ID NO: 36873 - DNA, 20 bp, Artificial Sequence
  chemically synthesized
accaatagctgtctctcaaa

SEQ ID NO: 36874 - DNA, 20 bp, Artificial Sequence
  chemically synthesized
caatagctgtctctcaaaag

SEQ ID NO: 36875 - DNA, 20 bp, Artificial Sequence
  chemically synthesized
atagctgtctctcaaaagga

SEQ ID NO: 36876 - DNA, 20 bp, Artificial Sequence
  chemically synthesized
gctgtctctcaaaaggagag

SEQ ID NO: 36877 - DNA, 20 bp, Artificial Sequence
  chemically synthesized
aaaaggagagtagttatctg

SEQ ID NO: 36878 - DNA, 20 bp, Artificial Sequence
  chemically synthesized
aggagagtagttatctgcag

SEQ ID NO: 36879 - DNA, 20 bp, Artificial Sequence
  chemically synthesized
agagtagttatctgcagaag

SEQ ID NO: 36880 - DNA, 20 bp, Artificial Sequence
  chemically synthesized
gtagttatctgcagaagtgg

SEQ ID NO: 36881 - DNA, 20 bp, Artificial Sequence
  chemically synthesized
tagttatctgcagaagtggc

SEQ ID NO: 36882 - DNA, 20 bp, Artificial Sequence
  chemically synthesized
agttatctgcagaagtggca

SEQ ID NO: 36883 - DNA, 20 bp, Artificial Sequence
  chemically synthesized
agggccttgctccaaaatcc

SEQ ID NO: 36884 - DNA, 20 bp, Artificial Sequence
  chemically synthesized
ggccttgctccaaaatccta

SEQ ID NO: 36885 - DNA, 20 bp, Artificial Sequence
  chemically synthesized
gccttgctccaaaatcctag

SEQ ID NO: 36886 - DNA, 20 bp, Artificial Sequence
  chemically synthesized
tctccactgtgattcaccta

SEQ ID NO: 36887 - DNA, 20 bp, Artificial Sequence
  chemically synthesized
ctccactgtgattcacctat

SEQ ID NO: 36888 - DNA, 20 bp, Artificial Sequence
  chemically synthesized
tccactgtgattcacctatg

SEQ ID NO: 36889 - DNA, 20 bp, Artificial Sequence
  chemically synthesized
ccactgtgattcacctatgg

SEQ ID NO: 36890 - DNA, 20 bp, Artificial Sequence
  chemically synthesized
tcacctatgggggcctgcca

SEQ ID NO: 36891 - DNA, 20 bp, Artificial Sequence
  chemically synthesized
cacctatgggggcctgccaa

SEQ ID NO: 36892 - DNA, 20 bp, Artificial Sequence
  chemically synthesized
ggcctgccaaaggctccaaa

SEQ ID NO: 36893 - DNA, 20 bp, Artificial Sequence
  chemically synthesized
ctatctgccactgacacctc

SEQ ID NO: 36894 - DNA, 20 bp, Artificial Sequence
  chemically synthesized
actgacacctcaagcaccat

SEQ ID NO: 36895 - DNA, 20 bp, Artificial Sequence
  chemically synthesized
ctcaagcaccattggatctg

SEQ ID NO: 36896 - DNA, 20 bp, Artificial Sequence
  chemically synthesized
tcaagcaccattggatctgc

SEQ ID NO: 36897 - DNA, 20 bp, Artificial Sequence
  chemically synthesized
caagcaccattggatctgcg

SEQ ID NO: 36898 - DNA, 20 bp, Artificial Sequence
  chemically synthesized
attggatctgcggggtcatg

SEQ ID NO: 36899 - DNA, 20 bp, Artificial Sequence
  chemically synthesized
gcggggtcatgtggcccaaa

SEQ ID NO: 36900 - DNA, 20 bp, Artificial Sequence
  chemically synthesized
gggtcatgtggcccaaatgg

SEQ ID NO: 36901 - DNA, 20 bp, Artificial Sequence
  chemically synthesized
gtcatgtggcccaaatggca

SEQ ID NO: 36902 - DNA, 20 bp, Artificial Sequence
  chemically synthesized
atgtggcccaaatggcagag

SEQ ID NO: 36903 - DNA, 20 bp, Artificial Sequence
  chemically synthesized
aaatggcagagcagctttca

SEQ ID NO: 36904 - DNA, 20 bp, Artificial Sequence
  chemically synthesized
tggcagagcagctttcacag

SEQ ID NO: 36905 - DNA, 20 bp, Artificial Sequence
  chemically synthesized
gagcagctttcacagcagcc

SEQ ID NO: 36906 - DNA, 20 bp, Artificial Sequence
  chemically synthesized
acagcagcctggacctgttt

SEQ ID NO: 36907 - DNA, 20 bp, Artificial Sequence
  chemically synthesized
agcagcctggacctgtttca

SEQ ID NO: 36908 - DNA, 20 bp, Artificial Sequence
  chemically synthesized
ttcagagccttcttttgttc

SEQ ID NO: 36909 - DNA, 20 bp, Artificial Sequence
  chemically synthesized
ttctagactgcacttaaatc

SEQ ID NO: 36910 - DNA, 20 bp, Artificial Sequence
  chemically synthesized
tagactgcacttaaatctgg

SEQ ID NO: 36911 - DNA, 20 bp, Artificial Sequence
  chemically synthesized
acttaaatctggcagccttt

SEQ ID NO: 36912 - DNA, 20 bp, Artificial Sequence
  chemically synthesized
cttaaatctggcagcctttc

SEQ ID NO: 36913 - DNA, 20 bp, Artificial Sequence
  chemically synthesized
ctttcaggtcactcgataaa

SEQ ID NO: 36914 - DNA, 20 bp, Artificial Sequence
  chemically synthesized
tttcaggtcactcgataaat

SEQ ID NO: 36915 - DNA, 20 bp, Artificial Sequence
  chemically synthesized
aggtcactcgataaatgggc

SEQ ID NO: 36916 - DNA, 20 bp, Artificial Sequence
  chemically synthesized
gtcactcgataaatgggcca

SEQ ID NO: 36917 - DNA, 20 bp, Artificial Sequence
  chemically synthesized
ccagagtaacacacccaaac

SEQ ID NO: 36918 - DNA, 20 bp, Artificial Sequence
  chemically synthesized
cagagtaacacacccaaacg

SEQ ID NO: 36919 - DNA, 20 bp, Artificial Sequence
  chemically synthesized
tgttgcctccaaaatccaaa

SEQ ID NO: 36920 - DNA, 20 bp, Artificial Sequence
  chemically synthesized
gttgcctccaaaatccaaat

SEQ ID NO: 36921 - DNA, 20 bp, Artificial Sequence
  chemically synthesized
caaaatccaaataggcccac

SEQ ID NO: 36922 - DNA, 20 bp, Artificial Sequence
  chemically synthesized
aaaatccaaataggcccacc

SEQ ID NO: 36923 - DNA, 20 bp, Artificial Sequence
  chemically synthesized
caggcattgtgcctctttct

SEQ ID NO: 36924 - DNA, 20 bp, Artificial Sequence
  chemically synthesized
tgtgcctctttcttggttgt

SEQ ID NO: 36925 - DNA, 20 bp, Artificial Sequence
  chemically synthesized
tgcctctttcttggttgtaa

SEQ ID NO: 36926 - DNA, 20 bp, Artificial Sequence
  chemically synthesized
gcctctttcttggttgtaag

SEQ ID NO: 36927 - DNA, 20 bp, Artificial Sequence
  chemically synthesized
cctctttcttggttgtaaga

SEQ ID NO: 36928 - DNA, 20 bp, Artificial Sequence
  chemically synthesized
ctctttcttggttgtaagag

SEQ ID NO: 36929 - DNA, 20 bp, Artificial Sequence
  chemically synthesized
gttgtaagaggggccaaacg

SEQ ID NO: 36930 - DNA, 20 bp, Artificial Sequence
  chemically synthesized
taagaggggccaaacgcagc

SEQ ID NO: 36931 - DNA, 20 bp, Artificial Sequence
  chemically synthesized
cagcaagttatgcttcacct

SEQ ID NO: 36932 - DNA, 20 bp, Artificial Sequence
  chemically synthesized
caagttatgcttcaccttag

SEQ ID NO: 36933 - DNA, 20 bp, Artificial Sequence
  chemically synthesized
aagttatgcttcaccttaga

SEQ ID NO: 36934 - DNA, 20 bp, Artificial Sequence
  chemically synthesized
ccttagaaggaatatctcca

SEQ ID NO: 36935 - DNA, 20 bp, Artificial Sequence
  chemically synthesized
cttagaaggaatatctccat

SEQ ID NO: 36936 - DNA, 20 bp, Artificial Sequence
  chemically synthesized
ctccataggtctcatgccac

SEQ ID NO: 36937 - DNA, 20 bp, Artificial Sequence
  chemically synthesized
gtctcatgccactggaaccc

SEQ ID NO: 36938 - DNA, 20 bp, Artificial Sequence
  chemically synthesized
ggaaccctagaaattttacc

SEQ ID NO: 36939 - DNA, 20 bp, Artificial Sequence
  chemically synthesized
gaaccctagaaattttaccg

SEQ ID NO: 36940 - DNA, 20 bp, Artificial Sequence
  chemically synthesized
ccctagaaattttaccgagg

SEQ ID NO: 36941 - DNA, 20 bp, Artificial Sequence
  chemically synthesized
agaaattttaccgaggtaga

SEQ ID NO: 36942 - DNA, 20 bp, Artificial Sequence
  chemically synthesized
ggtagaaagtccctaaattt

SEQ ID NO: 36943 - DNA, 20 bp, Artificial Sequence
  chemically synthesized
gaaagtccctaaattttagc

SEQ ID NO: 36944 - DNA, 20 bp, Artificial Sequence
  chemically synthesized
tggatttatttcccatcctc

SEQ ID NO: 36945 - DNA, 20 bp, Artificial Sequence
  chemically synthesized
catacaaatgtctcaccaat

SEQ ID NO: 36946 - DNA, 20 bp, Artificial Sequence
  chemically synthesized
aaatgtctcaccaataagtt

SEQ ID NO: 36947 - DNA, 20 bp, Artificial Sequence
  chemically synthesized
tcataatgtcatgaatgtaa

SEQ ID NO: 36948 - DNA, 20 bp, Artificial Sequence
  chemically synthesized
atgtcatgaatgtaatggac

SEQ ID NO: 36949 - DNA, 20 bp, Artificial Sequence
  chemically synthesized
tggaccagtgttatatctcg

SEQ ID NO: 36950 - DNA, 20 bp, Artificial Sequence
  chemically synthesized
accagtgttatatctcgtgg

SEQ ID NO: 36951 - DNA, 20 bp, Artificial Sequence
  chemically synthesized
ttatatctcgtggaagtgaa

SEQ ID NO: 36952 - DNA, 20 bp, Artificial Sequence
  chemically synthesized
atctcgtggaagtgaaaagc

SEQ ID NO: 36953 - DNA, 20 bp, Artificial Sequence
  chemically synthesized
cgtggaagtgaaaagcgagc

SEQ ID NO: 36954 - DNA, 20 bp, Artificial Sequence
  chemically synthesized
gtggaagtgaaaagcgagca

SEQ ID NO: 36955 - DNA, 20 bp, Artificial Sequence
  chemically synthesized
cgagcaaggtctctccaaat

SEQ ID NO: 36956 - DNA, 20 bp, Artificial Sequence
  chemically synthesized
ccaaataagattatgacaca

SEQ ID NO: 36957 - DNA, 20 bp, Artificial Sequence
  chemically synthesized
ataagattatgacacaaagc

SEQ ID NO: 36958 - DNA, 20 bp, Artificial Sequence
  chemically synthesized
aagattatgacacaaagctg

SEQ ID NO: 36959 - DNA, 20 bp, Artificial Sequence
  chemically synthesized
gattatgacacaaagctgga

SEQ ID NO: 36960 - DNA, 20 bp, Artificial Sequence
  chemically synthesized
tggagagttgatacacccct

SEQ ID NO: 36961 - DNA, 20 bp, Artificial Sequence
  chemically synthesized
ggagagttgatacacccctg

SEQ ID NO: 36962 - DNA, 20 bp, Artificial Sequence
  chemically synthesized
gagttgatacacccctgagg

SEQ ID NO: 36963 - DNA, 20 bp, Artificial Sequence
  chemically synthesized
agttgatacacccctgaggt

SEQ ID NO: 36964 - DNA, 20 bp, Artificial Sequence
  chemically synthesized
gttgatacacccctgaggta

SEQ ID NO: 36965 - DNA, 20 bp, Artificial Sequence
  chemically synthesized
gatacacccctgaggtaggg

SEQ ID NO: 36966 - DNA, 20 bp, Artificial Sequence
  chemically synthesized
acccctgaggtagggtggta

SEQ ID NO: 36967 - DNA, 20 bp, Artificial Sequence
  chemically synthesized
cccctgaggtagggtggtaa

SEQ ID NO: 36968 - DNA, 20 bp, Artificial Sequence
  chemically synthesized
gggtggtaaaggtataatgc

SEQ ID NO: 36969 - DNA, 20 bp, Artificial Sequence
  chemically synthesized
aggtataatgctggccttgt

SEQ ID NO: 36970 - DNA, 20 bp, Artificial Sequence
  chemically synthesized
aatgctggccttgtcagctg

SEQ ID NO: 36971 - DNA, 20 bp, Artificial Sequence
  chemically synthesized
atgctggccttgtcagctga

SEQ ID NO: 36972 - DNA, 20 bp, Artificial Sequence
  chemically synthesized
agctgaaggcaaattgcttc

SEQ ID NO: 36973 - DNA, 20 bp, Artificial Sequence
  chemically synthesized
tgaaggcaaattgcttctgg

SEQ ID NO: 36974 - DNA, 20 bp, Artificial Sequence
  chemically synthesized
gaaggcaaattgcttctggt

SEQ ID NO: 36975 - DNA, 20 bp, Artificial Sequence
  chemically synthesized
attgcttctggtgggtctta

SEQ ID NO: 36976 - DNA, 20 bp, Artificial Sequence
  chemically synthesized
cttctggtgggtcttatgga

SEQ ID NO: 36977 - DNA, 20 bp, Artificial Sequence
  chemically synthesized
ttctggtgggtcttatggac

SEQ ID NO: 36978 - DNA, 20 bp, Artificial Sequence
  chemically synthesized
gtgggtcttatggacaggaa

SEQ ID NO: 36979 - DNA, 20 bp, Artificial Sequence
  chemically synthesized
gggtcttatggacaggaatg

SEQ ID NO: 36980 - DNA, 20 bp, Artificial Sequence
  chemically synthesized
tatggacaggaatggagaaa

SEQ ID NO: 36981 - DNA, 20 bp, Artificial Sequence
  chemically synthesized
tggagaaaaagccacttgcc

SEQ ID NO: 36982 - DNA, 20 bp, Artificial Sequence
  chemically synthesized
aaagccacttgccaagccaa

SEQ ID NO: 36983 - DNA, 20 bp, Artificial Sequence
  chemically synthesized
ccaagccaatggctgcatac

SEQ ID NO: 36984 - DNA, 20 bp, Artificial Sequence
  chemically synthesized
caagccaatggctgcatacc

SEQ ID NO: 36985 - DNA, 20 bp, Artificial Sequence
  chemically synthesized
aatggctgcataccaggcac

SEQ ID NO: 36986 - DNA, 20 bp, Artificial Sequence
  chemically synthesized
atggctgcataccaggcacc

SEQ ID NO: 36987 - DNA, 20 bp, Artificial Sequence
  chemically synthesized
ggctgcataccaggcaccag

SEQ ID NO: 36988 - DNA, 20 bp, Artificial Sequence
  chemically synthesized
ggagatgtgttaatttgctc

SEQ ID NO: 36989 - DNA, 20 bp, Artificial Sequence
  chemically synthesized
tcaagcaacaaaaccacaac

SEQ ID NO: 36990 - DNA, 20 bp, Artificial Sequence
  chemically synthesized
agcaacaaaaccacaactgg

SEQ ID NO: 36991 - DNA, 20 bp, Artificial Sequence
  chemically synthesized
caacaaaaccacaactggta

SEQ ID NO: 36992 - DNA, 20 bp, Artificial Sequence
  chemically synthesized
caaaaccacaactggtagag

SEQ ID NO: 36993 - DNA, 20 bp, Artificial Sequence
  chemically synthesized
actggtagagcagctgcaat

SEQ ID NO: 36994 - DNA, 20 bp, Artificial Sequence
  chemically synthesized
tggtagagcagctgcaattg

SEQ ID NO: 36995 - DNA, 20 bp, Artificial Sequence
  chemically synthesized
ctgcaattggagtcaccact

SEQ ID NO: 36996 - DNA, 20 bp, Artificial Sequence
  chemically synthesized
attggagtcaccacttggtt

SEQ ID NO: 36997 - DNA, 20 bp, Artificial Sequence
  chemically synthesized
ataatccaccatcattttcc

SEQ ID NO: 36998 - DNA, 20 bp, Artificial Sequence
  chemically synthesized
agatccatctgtcctctgca

SEQ ID NO: 36999 - DNA, 20 bp, Artificial Sequence
  chemically synthesized
gatccatctgtcctctgcac

SEQ ID NO: 37000 - DNA, 20 bp, Artificial Sequence
  chemically synthesized
tgtcctctgcacaggtcaaa

SEQ ID NO: 37001 - DNA, 20 bp, Artificial Sequence
  chemically synthesized
gtcctctgcacaggtcaaat

SEQ ID NO: 37002 - DNA, 20 bp, Artificial Sequence
  chemically synthesized
cctctgcacaggtcaaatgg

SEQ ID NO: 37003 - DNA, 20 bp, Artificial Sequence
  chemically synthesized
tctgcacaggtcaaatggga

SEQ ID NO: 37004 - DNA, 20 bp, Artificial Sequence
  chemically synthesized
ggtcaaatgggagagttgaa

SEQ ID NO: 37005 - DNA, 20 bp, Artificial Sequence
  chemically synthesized
gtcaaatgggagagttgaac

SEQ ID NO: 37006 - DNA, 20 bp, Artificial Sequence
  chemically synthesized
tcaaatgggagagttgaaca

SEQ ID NO: 37007 - DNA, 20 bp, Artificial Sequence
  chemically synthesized
gggagagttgaacagggatg

SEQ ID NO: 37008 - DNA, 20 bp, Artificial Sequence
  chemically synthesized
agagttgaacagggatgtgg

SEQ ID NO: 37009 - DNA, 20 bp, Artificial Sequence
  chemically synthesized
gagttgaacagggatgtggt

SEQ ID NO: 37010 - DNA, 20 bp, Artificial Sequence
  chemically synthesized
tcaccacccctgcgtctttc

SEQ ID NO: 37011 - DNA, 20 bp, Artificial Sequence
  chemically synthesized
tgcgtctttcaagtccttga

SEQ ID NO: 37012 - DNA, 20 bp, Artificial Sequence
  chemically synthesized
gatggtgacactaatcactt

SEQ ID NO: 37013 - DNA, 20 bp, Artificial Sequence
  chemically synthesized
actaatcacttcagtccctc

SEQ ID NO: 37014 - DNA, 20 bp, Artificial Sequence
  chemically synthesized
ctaatcacttcagtccctcc

SEQ ID NO: 37015 - DNA, 20 bp, Artificial Sequence
  chemically synthesized
taatcacttcagtccctcca

SEQ ID NO: 37016 - DNA, 20 bp, Artificial Sequence
  chemically synthesized
cacttcagtccctccaggga

SEQ ID NO: 37017 - DNA, 20 bp, Artificial Sequence
  chemically synthesized
acttcagtccctccagggat

SEQ ID NO: 37018 - DNA, 20 bp, Artificial Sequence
  chemically synthesized
ttttgatttttttatttttc

SEQ ID NO: 37019 - DNA, 20 bp, Artificial Sequence
  chemically synthesized
tttgatttttttatttttct

SEQ ID NO: 37020 - DNA, 20 bp, Artificial Sequence
  chemically synthesized
gatttttttatttttctagg

SEQ ID NO: 37021 - DNA, 20 bp, Artificial Sequence
  chemically synthesized
tttttttatttttctaggta

SEQ ID NO: 37022 - DNA, 20 bp, Artificial Sequence
  chemically synthesized
tttatttttctaggtagaga

SEQ ID NO: 37023 - DNA, 20 bp, Artificial Sequence
  chemically synthesized
ctaggtagagacagctctaa

SEQ ID NO: 37024 - DNA, 20 bp, Artificial Sequence
  chemically synthesized
cagctctaatggcttctgtt

SEQ ID NO: 37025 - DNA, 20 bp, Artificial Sequence
  chemically synthesized
tttggcctttcccaccataa

SEQ ID NO: 37026 - DNA, 20 bp, Artificial Sequence
  chemically synthesized
cataatagccctcatcctac

SEQ ID NO: 37027 - DNA, 20 bp, Artificial Sequence
  chemically synthesized
atagccctcatcctaccagt

SEQ ID NO: 37028 - DNA, 20 bp, Artificial Sequence
  chemically synthesized
tagccctcatcctaccagtc

SEQ ID NO: 37029 - DNA, 20 bp, Artificial Sequence
  chemically synthesized
agccctcatcctaccagtca

SEQ ID NO: 37030 - DNA, 20 bp, Artificial Sequence
  chemically synthesized
ccctcatcctaccagtcagg

SEQ ID NO: 37031 - DNA, 20 bp, Artificial Sequence
  chemically synthesized
taccagtcagggagccaatg

SEQ ID NO: 37032 - DNA, 20 bp, Artificial Sequence
  chemically synthesized
agccaatgtggcatttctgc

SEQ ID NO: 37033 - DNA, 20 bp, Artificial Sequence
  chemically synthesized
tggcatttctgccagctaat

SEQ ID NO: 37034 - DNA, 20 bp, Artificial Sequence
  chemically synthesized
tctatacaaattatgcattt

SEQ ID NO: 37035 - DNA, 20 bp, Artificial Sequence
  chemically synthesized
caaattatgcattttggcac

SEQ ID NO: 37036 - DNA, 20 bp, Artificial Sequence
  chemically synthesized
aaattatgcattttggcact

SEQ ID NO: 37037 - DNA, 20 bp, Artificial Sequence
  chemically synthesized
tttggcactgggaaaatgac

SEQ ID NO: 37038 - DNA, 20 bp, Artificial Sequence
  chemically synthesized
tggcactgggaaaatgacca

SEQ ID NO: 37039 - DNA, 20 bp, Artificial Sequence
  chemically synthesized
ggcactgggaaaatgaccag

SEQ ID NO: 37040 - DNA, 20 bp, Artificial Sequence
  chemically synthesized
tgggaaaatgaccagaggat

SEQ ID NO: 37041 - DNA, 20 bp, Artificial Sequence
  chemically synthesized
aaatgaccagaggataagtc

SEQ ID NO: 37042 - DNA, 20 bp, Artificial Sequence
  chemically synthesized
aatgaccagaggataagtcc

SEQ ID NO: 37043 - DNA, 20 bp, Artificial Sequence
  chemically synthesized
atgaccagaggataagtcca

SEQ ID NO: 37044 - DNA, 20 bp, Artificial Sequence
  chemically synthesized
ggataagtccagggacccac

SEQ ID NO: 37045 - DNA, 20 bp, Artificial Sequence
  chemically synthesized
ggacccactggaaccactgt

SEQ ID NO: 37046 - DNA, 20 bp, Artificial Sequence
  chemically synthesized
ccactggaaccactgtaagt

SEQ ID NO: 37047 - DNA, 20 bp, Artificial Sequence
  chemically synthesized
aaccactgtaagtcagaaat

SEQ ID NO: 37048 - DNA, 20 bp, Artificial Sequence
  chemically synthesized
attaattacctaacctccat

SEQ ID NO: 37049 - DNA, 20 bp, Artificial Sequence
  chemically synthesized
ccataagcccctactttaac

SEQ ID NO: 37050 - DNA, 20 bp, Artificial Sequence
  chemically synthesized
cataagcccctactttaact

SEQ ID NO: 37051 - DNA, 20 bp, Artificial Sequence
  chemically synthesized
ataagcccctactttaactg

SEQ ID NO: 37052 - DNA, 20 bp, Artificial Sequence
  chemically synthesized
ggggaaccacaataacgttt

SEQ ID NO: 37053 - DNA, 20 bp, Artificial Sequence
  chemically synthesized
gggaaccacaataacgtttt

SEQ ID NO: 37054 - DNA, 20 bp, Artificial Sequence
  chemically synthesized
caataacgttttgggtaccc

SEQ ID NO: 37055 - DNA, 20 bp, Artificial Sequence
  chemically synthesized
gggtaccctggaatcaacgt

SEQ ID NO: 37056 - DNA, 20 bp, Artificial Sequence
  chemically synthesized
ccctggaatcaacgtcagct

SEQ ID NO: 37057 - DNA, 20 bp, Artificial Sequence
  chemically synthesized
ctggaatcaacgtcagctca

SEQ ID NO: 37058 - DNA, 20 bp, Artificial Sequence
  chemically synthesized
aatcaacgtcagctcagagc

SEQ ID NO: 37059 - DNA, 20 bp, Artificial Sequence
  chemically synthesized
gtcagctcagagccagtgtc

SEQ ID NO: 37060 - DNA, 20 bp, Artificial Sequence
  chemically synthesized
tctcattacttccctttctc

SEQ ID NO: 37061 - DNA, 20 bp, Artificial Sequence
  chemically synthesized
ttccctttctccagtacaca

SEQ ID NO: 37062 - DNA, 20 bp, Artificial Sequence
  chemically synthesized
tccagtacacacagttaccc

SEQ ID NO: 37063 - DNA, 20 bp, Artificial Sequence
  chemically synthesized
acacacagttaccctggtaa

SEQ ID NO: 37064 - DNA, 20 bp, Artificial Sequence
  chemically synthesized
cacacagttaccctggtaaa

SEQ ID NO: 37065 - DNA, 20 bp, Artificial Sequence
  chemically synthesized
cagttaccctggtaaaaggc

SEQ ID NO: 37066 - DNA, 20 bp, Artificial Sequence
  chemically synthesized
gttaccctggtaaaaggcca

SEQ ID NO: 37067 - DNA, 20 bp, Artificial Sequence
  chemically synthesized
ttaccctggtaaaaggccag

SEQ ID NO: 37068 - DNA, 20 bp, Artificial Sequence
  chemically synthesized
taaaaggccagaggtctcct

SEQ ID NO: 37069 - DNA, 20 bp, Artificial Sequence
  chemically synthesized
aaaaggccagaggtctcctt

SEQ ID NO: 37070 - DNA, 20 bp, Artificial Sequence
  chemically synthesized
aaaggccagaggtctcctta

SEQ ID NO: 37071 - DNA, 20 bp, Artificial Sequence
  chemically synthesized
ggccagaggtctccttaggg

SEQ ID NO: 37072 - DNA, 20 bp, Artificial Sequence
  chemically synthesized
gccagaggtctccttaggga

SEQ ID NO: 37073 - DNA, 20 bp, Artificial Sequence
  chemically synthesized
gaggtctccttagggaagga

SEQ ID NO: 37074 - DNA, 20 bp, Artificial Sequence
  chemically synthesized
aggtctccttagggaaggat

SEQ ID NO: 37075 - DNA, 20 bp, Artificial Sequence
  chemically synthesized
gtctccttagggaaggatgg

SEQ ID NO: 37076 - DNA, 20 bp, Artificial Sequence
  chemically synthesized
ccttagggaaggatgggaga

SEQ ID NO: 37077 - DNA, 20 bp, Artificial Sequence
  chemically synthesized
ttagggaaggatgggagaaa

SEQ ID NO: 37078 - DNA, 20 bp, Artificial Sequence
  chemically synthesized
aaggatgggagaaagagtaa

SEQ ID NO: 37079 - DNA, 20 bp, Artificial Sequence
  chemically synthesized
gggagaaagagtaacagcat

SEQ ID NO: 37080 - DNA, 20 bp, Artificial Sequence
  chemically synthesized
agagtaacagcataagttgt

SEQ ID NO: 37081 - DNA, 20 bp, Artificial Sequence
  chemically synthesized
gtaacagcataagttgtcag

SEQ ID NO: 37082 - DNA, 20 bp, Artificial Sequence
  chemically synthesized
agcataagttgtcagtagcc

SEQ ID NO: 37083 - DNA, 20 bp, Artificial Sequence
  chemically synthesized
ataagttgtcagtagcctag

SEQ ID NO: 37084 - DNA, 20 bp, Artificial Sequence
  chemically synthesized
gcctagtggtgtccttcctc

SEQ ID NO: 37085 - DNA, 20 bp, Artificial Sequence
  chemically synthesized
cctagtggtgtccttcctca

SEQ ID NO: 37086 - DNA, 20 bp, Artificial Sequence
  chemically synthesized
ctagtggtgtccttcctcaa

SEQ ID NO: 37087 - DNA, 20 bp, Artificial Sequence
  chemically synthesized
tagtggtgtccttcctcaag

SEQ ID NO: 37088 - DNA, 20 bp, Artificial Sequence
  chemically synthesized
tgtccttcctcaaggggatc

SEQ ID NO: 37089 - DNA, 20 bp, Artificial Sequence
  chemically synthesized
gatccagcctccccttcatt

SEQ ID NO: 37090 - DNA, 20 bp, Artificial Sequence
  chemically synthesized
ccagcctccccttcattcag

SEQ ID NO: 37091 - DNA, 20 bp, Artificial Sequence
  chemically synthesized
cagcctccccttcattcagt

SEQ ID NO: 37092 - DNA, 20 bp, Artificial Sequence
  chemically synthesized
ccccttcattcagtgggttc

SEQ ID NO: 37093 - DNA, 20 bp, Artificial Sequence
  chemically synthesized
agtgggttctggaactgtaa

SEQ ID NO: 37094 - DNA, 20 bp, Artificial Sequence
  chemically synthesized
gtgggttctggaactgtaac

SEQ ID NO: 37095 - DNA, 20 bp, Artificial Sequence
  chemically synthesized
tctggaactgtaacaggttc

SEQ ID NO: 37096 - DNA, 20 bp, Artificial Sequence
  chemically synthesized
aactgtaacaggttcgagtc

SEQ ID NO: 37097 - DNA, 20 bp, Artificial Sequence
  chemically synthesized
ttcgagtctggaaattgatt

SEQ ID NO: 37098 - DNA, 20 bp, Artificial Sequence
  chemically synthesized
tcgagtctggaaattgattg

SEQ ID NO: 37099 - DNA, 20 bp, Artificial Sequence
  chemically synthesized
cgagtctggaaattgattga

SEQ ID NO: 37100 - DNA, 20 bp, Artificial Sequence
  chemically synthesized
gattctctgtttttataatt

SEQ ID NO: 37101 - DNA, 20 bp, Artificial Sequence
  chemically synthesized
tctgtttttataattcagat

SEQ ID NO: 37102 - DNA, 20 bp, Artificial Sequence
  chemically synthesized
ttataattcagattagtctt

SEQ ID NO: 37103 - DNA, 20 bp, Artificial Sequence
  chemically synthesized
agtctttagtccattctacc

SEQ ID NO: 37104 - DNA, 20 bp, Artificial Sequence
  chemically synthesized
ctttagtccattctacctgg

SEQ ID NO: 37105 - DNA, 20 bp, Artificial Sequence
  chemically synthesized
gttttttgtttatataaatc

SEQ ID NO: 37106 - DNA, 20 bp, Artificial Sequence
  chemically synthesized
ttttgtttatataaatcaag

SEQ ID NO: 37107 - DNA, 20 bp, Artificial Sequence
  chemically synthesized
tttgtttatataaatcaagt

SEQ ID NO: 37108 - DNA, 20 bp, Artificial Sequence
  chemically synthesized
atataaatcaagtaggaata

SEQ ID NO: 37109 - DNA, 20 bp, Artificial Sequence
  chemically synthesized
taaatcaagtaggaatacag

SEQ ID NO: 37110 - DNA, 20 bp, Artificial Sequence
  chemically synthesized
aaatcaagtaggaatacagt

SEQ ID NO: 37111 - DNA, 20 bp, Artificial Sequence
  chemically synthesized
tttcccatcaatttcacttc

SEQ ID NO: 37112 - DNA, 20 bp, Artificial Sequence
  chemically synthesized
ttcccatcaatttcacttct

SEQ ID NO: 37113 - DNA, 20 bp, Artificial Sequence
  chemically synthesized
ctaggaacaccatgattaat

SEQ ID NO: 37114 - DNA, 20 bp, Artificial Sequence
  chemically synthesized
catgattaattagccaatgc

SEQ ID NO: 37115 - DNA, 20 bp, Artificial Sequence
  chemically synthesized
tgattaattagccaatgcca

SEQ ID NO: 37116 - DNA, 20 bp, Artificial Sequence
  chemically synthesized
ccaatgccagagctctacat

SEQ ID NO: 37117 - DNA, 20 bp, Artificial Sequence
  chemically synthesized
tgccagagctctacatgagt

SEQ ID NO: 37118 - DNA, 20 bp, Artificial Sequence
  chemically synthesized
catgagtcagactattctga

SEQ ID NO: 37119 - DNA, 20 bp, Artificial Sequence
  chemically synthesized
tttgcctctgctgtctatta

SEQ ID NO: 37120 - DNA, 20 bp, Artificial Sequence
  chemically synthesized
gcctctgctgtctattatgg

SEQ ID NO: 37121 - DNA, 20 bp, Artificial Sequence
  chemically synthesized
tatgcccaccttgcctttga

SEQ ID NO: 37122 - DNA, 20 bp, Artificial Sequence
  chemically synthesized
ccaccttgcctttgatggtt

SEQ ID NO: 37123 - DNA, 20 bp, Artificial Sequence
  chemically synthesized
gatggttcagtgccaacact

SEQ ID NO: 37124 - DNA, 20 bp, Artificial Sequence
  chemically synthesized
acacttggcccctgccacct

SEQ ID NO: 37125 - DNA, 20 bp, Artificial Sequence
  chemically synthesized
cacttggcccctgccacctc

SEQ ID NO: 37126 - DNA, 20 bp, Artificial Sequence
  chemically synthesized
cccattgtatttaaattttg

SEQ ID NO: 37127 - DNA, 20 bp, Artificial Sequence
  chemically synthesized
tgtatttaaattttgtagtt

SEQ ID NO: 37128 - DNA, 20 bp, Artificial Sequence
  chemically synthesized
attttgtagttgagtgactg

SEQ ID NO: 37129 - DNA, 20 bp, Artificial Sequence
  chemically synthesized
gtgactgtggttcctactgt

SEQ ID NO: 37130 - DNA, 20 bp, Artificial Sequence
  chemically synthesized
ctactgttagatctgacata

SEQ ID NO: 37131 - DNA, 20 bp, Artificial Sequence
  chemically synthesized
actgttagatctgacataca

SEQ ID NO: 37132 - DNA, 20 bp, Artificial Sequence
  chemically synthesized
gttagatctgacatacagag

SEQ ID NO: 37133 - DNA, 20 bp, Artificial Sequence
  chemically synthesized
tagatctgacatacagagaa

SEQ ID NO: 37134 - DNA, 20 bp, Artificial Sequence
  chemically synthesized
catacagagaagagcaatta

SEQ ID NO: 37135 - DNA, 20 bp, Artificial Sequence
  chemically synthesized
atacagagaagagcaattac

SEQ ID NO: 37136 - DNA, 20 bp, Artificial Sequence
  chemically synthesized
ttacgggctcttcaaaaata

SEQ ID NO: 37137 - DNA, 20 bp, Artificial Sequence
  chemically synthesized
tacgggctcttcaaaaatac

SEQ ID NO: 37138 - DNA, 20 bp, Artificial Sequence
  chemically synthesized
tctcacaaatctatttcaca

SEQ ID NO: 37139 - DNA, 20 bp, Artificial Sequence
  chemically synthesized
aaatctatttcacaaagctt

SEQ ID NO: 37140 - DNA, 20 bp, Artificial Sequence
  chemically synthesized
tatttcacaaagcttcggcc

SEQ ID NO: 37141 - DNA, 20 bp, Artificial Sequence
  chemically synthesized
atttcacaaagcttcggcca

SEQ ID NO: 37142 - DNA, 20 bp, Artificial Sequence
  chemically synthesized
tttcacaaagcttcggccaa

SEQ ID NO: 37143 - DNA, 20 bp, Artificial Sequence
  chemically synthesized
tcggccaagggtgtatcttc

SEQ ID NO: 37144 - DNA, 20 bp, Artificial Sequence
  chemically synthesized
gtgtatcttctggaccctcc

SEQ ID NO: 37145 - DNA, 20 bp, Artificial Sequence
  chemically synthesized
atcttctggaccctcccagc

SEQ ID NO: 37146 - DNA, 20 bp, Artificial Sequence
  chemically synthesized
tcttctggaccctcccagct

SEQ ID NO: 37147 - DNA, 20 bp, Artificial Sequence
  chemically synthesized
tggaccctcccagctgggat

SEQ ID NO: 37148 - DNA, 20 bp, Artificial Sequence
  chemically synthesized
accctcccagctgggatgag

SEQ ID NO: 37149 - DNA, 20 bp, Artificial Sequence
  chemically synthesized
ccctcccagctgggatgagt

SEQ ID NO: 37150 - DNA, 20 bp, Artificial Sequence
  chemically synthesized
agctgggatgagtaggtcta

SEQ ID NO: 37151 - DNA, 20 bp, Artificial Sequence
  chemically synthesized
tccaccatcctaatctccct

SEQ ID NO: 37152 - DNA, 20 bp, Artificial Sequence
  chemically synthesized
tcctaatctccctaagcctt

SEQ ID NO: 37153 - DNA, 20 bp, Artificial Sequence
  chemically synthesized
cacttcctctacattaaacc

SEQ ID NO: 37154 - DNA, 20 bp, Artificial Sequence
  chemically synthesized
acttcctctacattaaacca

SEQ ID NO: 37155 - DNA, 20 bp, Artificial Sequence
  chemically synthesized
acattaaaccaaggcatttc

SEQ ID NO: 37156 - DNA, 20 bp, Artificial Sequence
  chemically synthesized
catttccagctcactaacat

SEQ ID NO: 37157 - DNA, 20 bp, Artificial Sequence
  chemically synthesized
ccatcttttaatccatattt

SEQ ID NO: 37158 - DNA, 20 bp, Artificial Sequence
  chemically synthesized
aatccatatttcagctaacc

SEQ ID NO: 37159 - DNA, 20 bp, Artificial Sequence
  chemically synthesized
aacttttttttttttttttt

SEQ ID NO: 37160 - DNA, 20 bp, Artificial Sequence
  chemically synthesized
tttttttttttttttggaaa

SEQ ID NO: 37161 - DNA, 20 bp, Artificial Sequence
  chemically synthesized
tttttttttttttggaaatg

SEQ ID NO: 37162 - DNA, 20 bp, Artificial Sequence
  chemically synthesized
atggagtcttgctctgttac

SEQ ID NO: 37163 - DNA, 20 bp, Artificial Sequence
  chemically synthesized
tggagtcttgctctgttacc

SEQ ID NO: 37164 - DNA, 20 bp, Artificial Sequence
  chemically synthesized
gtcttgctctgttaccaggc

SEQ ID NO: 37165 - DNA, 20 bp, Artificial Sequence
  chemically synthesized
tctgttaccaggctggaatg

SEQ ID NO: 37166 - DNA, 20 bp, Artificial Sequence
  chemically synthesized
gttaccaggctggaatgcag

SEQ ID NO: 37167 - DNA, 20 bp, Artificial Sequence
  chemically synthesized
ttaccaggctggaatgcagt

SEQ ID NO: 37168 - DNA, 20 bp, Artificial Sequence
  chemically synthesized
taccaggctggaatgcagtg

SEQ ID NO: 37169 - DNA, 20 bp, Artificial Sequence
  chemically synthesized
ggaatgcagtggggcgatct

SEQ ID NO: 37170 - DNA, 20 bp, Artificial Sequence
  chemically synthesized
tcactgcaatctctgcctca

SEQ ID NO: 37171 - DNA, 20 bp, Artificial Sequence
  chemically synthesized
cactgcaatctctgcctcac

SEQ ID NO: 37172 - DNA, 20 bp, Artificial Sequence
  chemically synthesized
aatctctgcctcacaggttc

SEQ ID NO: 37173 - DNA, 20 bp, Artificial Sequence
  chemically synthesized
ctctgcctcacaggttcaag

SEQ ID NO: 37174 - DNA, 20 bp, Artificial Sequence
  chemically synthesized
ttcaagcagttctcttgcct

SEQ ID NO: 37175 - DNA, 20 bp, Artificial Sequence
  chemically synthesized
ttctcttgcctcagcctccc

SEQ ID NO: 37176 - DNA, 20 bp, Artificial Sequence
  chemically synthesized
tcttgcctcagcctcccaag

SEQ ID NO: 37177 - DNA, 20 bp, Artificial Sequence
  chemically synthesized
cctcagcctcccaagtagat

SEQ ID NO: 37178 - DNA, 20 bp, Artificial Sequence
  chemically synthesized
ctcccaagtagatgagatta

SEQ ID NO: 37179 - DNA, 20 bp, Artificial Sequence
  chemically synthesized
cagttacgcatcaccatgcc

SEQ ID NO: 37180 - DNA, 20 bp, Artificial Sequence
  chemically synthesized
ccagctaatttttgtatttt

SEQ ID NO: 37181 - DNA, 20 bp, Artificial Sequence
  chemically synthesized
gctaatttttgtatttttag

SEQ ID NO: 37182 - DNA, 20 bp, Artificial Sequence
  chemically synthesized
taatttttgtatttttagca

SEQ ID NO: 37183 - DNA, 20 bp, Artificial Sequence
  chemically synthesized
ttttgtatttttagcagaga

SEQ ID NO: 37184 - DNA, 20 bp, Artificial Sequence
  chemically synthesized
tttgtatttttagcagagat

SEQ ID NO: 37185 - DNA, 20 bp, Artificial Sequence
  chemically synthesized
ttgtatttttagcagagatg

SEQ ID NO: 37186 - DNA, 20 bp, Artificial Sequence
  chemically synthesized
gagatggggtttcaccattt

SEQ ID NO: 37187 - DNA, 20 bp, Artificial Sequence
  chemically synthesized
tggggtttcaccattttagc

SEQ ID NO: 37188 - DNA, 20 bp, Artificial Sequence
  chemically synthesized
tctgcccgcccccgcctccc

SEQ ID NO: 37189 - DNA, 20 bp, Artificial Sequence
  chemically synthesized
ctgcccgcccccgcctccca

SEQ ID NO: 37190 - DNA, 20 bp, Artificial Sequence
  chemically synthesized
gcccccgcctcccaaggtgc

SEQ ID NO: 37191 - DNA, 20 bp, Artificial Sequence
  chemically synthesized
cccccgcctcccaaggtgct

SEQ ID NO: 37192 - DNA, 20 bp, Artificial Sequence
  chemically synthesized
ctcccaaggtgctgggatta

SEQ ID NO: 37193 - DNA, 20 bp, Artificial Sequence
  chemically synthesized
tcccaaggtgctgggattac

SEQ ID NO: 37194 - DNA, 20 bp, Artificial Sequence
  chemically synthesized
ggtgctgggattacaggcgt

SEQ ID NO: 37195 - DNA, 20 bp, Artificial Sequence
  chemically synthesized
caggcgtgagccactgctcc

SEQ ID NO: 37196 - DNA, 20 bp, Artificial Sequence
  chemically synthesized
gccactgctcccggccctat

SEQ ID NO: 37197 - DNA, 20 bp, Artificial Sequence
  chemically synthesized
gccctatcagaaccttttct

SEQ ID NO: 37198 - DNA, 20 bp, Artificial Sequence
  chemically synthesized
agaaccttttctaagtcccc

SEQ ID NO: 37199 - DNA, 20 bp, Artificial Sequence
  chemically synthesized
ccgagctgcaacattaaatg

SEQ ID NO: 37200 - DNA, 20 bp, Artificial Sequence
  chemically synthesized
ttaaatgcagaatccctact

SEQ ID NO: 37201 - DNA, 20 bp, Artificial Sequence
  chemically synthesized
aatgcagaatccctacttag

SEQ ID NO: 37202 - DNA, 20 bp, Artificial Sequence
  chemically synthesized
atgcagaatccctacttagt

SEQ ID NO: 37203 - DNA, 20 bp, Artificial Sequence
  chemically synthesized
tgcagaatccctacttagta

SEQ ID NO: 37204 - DNA, 20 bp, Artificial Sequence
  chemically synthesized
tagggccaaaccaataaatt

SEQ ID NO: 37205 - DNA, 20 bp, Artificial Sequence
  chemically synthesized
ccattcccatgcctgttctc

SEQ ID NO: 37206 - DNA, 20 bp, Artificial Sequence
  chemically synthesized
agatttctgccaatataaat

SEQ ID NO: 37207 - DNA, 20 bp, Artificial Sequence
  chemically synthesized
ttctgccaatataaattaga

SEQ ID NO: 37208 - DNA, 20 bp, Artificial Sequence
  chemically synthesized
caatataaattagaaagctt

SEQ ID NO: 37209 - DNA, 20 bp, Artificial Sequence
  chemically synthesized
tataaattagaaagcttaag

SEQ ID NO: 37210 - DNA, 20 bp, Artificial Sequence
  chemically synthesized
gaaagcttaagcagttcttt

SEQ ID NO: 37211 - DNA, 20 bp, Artificial Sequence
  chemically synthesized
aagcttaagcagttctttta

SEQ ID NO: 37212 - DNA, 20 bp, Artificial Sequence
  chemically synthesized
gagtataatgcacctcctca

SEQ ID NO: 37213 - DNA, 20 bp, Artificial Sequence
  chemically synthesized
agtataatgcacctcctcat

SEQ ID NO: 37214 - DNA, 20 bp, Artificial Sequence
  chemically synthesized
cacactctgaacctcacctc

SEQ ID NO: 37215 - DNA, 20 bp, Artificial Sequence
  chemically synthesized
acactctgaacctcacctct

SEQ ID NO: 37216 - DNA, 20 bp, Artificial Sequence
  chemically synthesized
cactctgaacctcacctctg

SEQ ID NO: 37217 - DNA, 20 bp, Artificial Sequence
  chemically synthesized
acctcacctctggggcccgc

SEQ ID NO: 37218 - DNA, 20 bp, Artificial Sequence
  chemically synthesized
cctcacctctggggcccgca

SEQ ID NO: 37219 - DNA, 20 bp, Artificial Sequence
  chemically synthesized
tctggggcccgcaaggaatt

SEQ ID NO: 37220 - DNA, 20 bp, Artificial Sequence
  chemically synthesized
ggcccgcaaggaatttagcc

SEQ ID NO: 37221 - DNA, 20 bp, Artificial Sequence
  chemically synthesized
caaggaatttagcctagtta

SEQ ID NO: 37222 - DNA, 20 bp, Artificial Sequence
  chemically synthesized
aaggaatttagcctagttat

SEQ ID NO: 37223 - DNA, 20 bp, Artificial Sequence
  chemically synthesized
atttagcctagttataggtc

SEQ ID NO: 37224 - DNA, 20 bp, Artificial Sequence
  chemically synthesized
tagcctagttataggtctag

SEQ ID NO: 37225 - DNA, 20 bp, Artificial Sequence
  chemically synthesized
gttataggtctagaagcatt

SEQ ID NO: 37226 - DNA, 20 bp, Artificial Sequence
  chemically synthesized
ttataggtctagaagcattc

SEQ ID NO: 37227 - DNA, 20 bp, Artificial Sequence
  chemically synthesized
tataggtctagaagcattca

SEQ ID NO: 37228 - DNA, 20 bp, Artificial Sequence
  chemically synthesized
ataggtctagaagcattcag

SEQ ID NO: 37229 - DNA, 20 bp, Artificial Sequence
  chemically synthesized
ctagaagcattcaggggcat

SEQ ID NO: 37230 - DNA, 20 bp, Artificial Sequence
  chemically synthesized
tagaagcattcaggggcatt

SEQ ID NO: 37231 - DNA, 20 bp, Artificial Sequence
  chemically synthesized
agaagcattcaggggcatta

SEQ ID NO: 37232 - DNA, 20 bp, Artificial Sequence
  chemically synthesized
gaagcattcaggggcattag

SEQ ID NO: 37233 - DNA, 20 bp, Artificial Sequence
  chemically synthesized
gggcattaggggtgcctctt

SEQ ID NO: 37234 - DNA, 20 bp, Artificial Sequence
  chemically synthesized
ggcattaggggtgcctcttg

SEQ ID NO: 37235 - DNA, 20 bp, Artificial Sequence
  chemically synthesized
cattaggggtgcctcttgag

SEQ ID NO: 37236 - DNA, 20 bp, Artificial Sequence
  chemically synthesized
agaatcaacattatcttgcc

SEQ ID NO: 37237 - DNA, 20 bp, Artificial Sequence
  chemically synthesized
atcaacattatcttgcctgg

SEQ ID NO: 37238 - DNA, 20 bp, Artificial Sequence
  chemically synthesized
atcttgcctggcagctgcct

SEQ ID NO: 37239 - DNA, 20 bp, Artificial Sequence
  chemically synthesized
tcttgcctggcagctgcctc

SEQ ID NO: 37240 - DNA, 20 bp, Artificial Sequence
  chemically synthesized
cttgcctggcagctgcctca

SEQ ID NO: 37241 - DNA, 20 bp, Artificial Sequence
  chemically synthesized
gcctggcagctgcctcaggg

SEQ ID NO: 37242 - DNA, 20 bp, Artificial Sequence
  chemically synthesized
cctggcagctgcctcaggga

SEQ ID NO: 37243 - DNA, 20 bp, Artificial Sequence
  chemically synthesized
aaggccatcactgttgcctc

SEQ ID NO: 37244 - DNA, 20 bp, Artificial Sequence
  chemically synthesized
gccatcactgttgcctcaag

SEQ ID NO: 37245 - DNA, 20 bp, Artificial Sequence
  chemically synthesized
cactgttgcctcaagcagtg

SEQ ID NO: 37246 - DNA, 20 bp, Artificial Sequence
  chemically synthesized
actgttgcctcaagcagtgc

SEQ ID NO: 37247 - DNA, 20 bp, Artificial Sequence
  chemically synthesized
ctgttgcctcaagcagtgca

SEQ ID NO: 37248 - DNA, 20 bp, Artificial Sequence
  chemically synthesized
cagtgcagggtttacatcct

SEQ ID NO: 37249 - DNA, 20 bp, Artificial Sequence
  chemically synthesized
agggtttacatcctcagaca

SEQ ID NO: 37250 - DNA, 20 bp, Artificial Sequence
  chemically synthesized
gggtttacatcctcagacaa

SEQ ID NO: 37251 - DNA, 20 bp, Artificial Sequence
  chemically synthesized
tttacatcctcagacaaagg

SEQ ID NO: 37252 - DNA, 20 bp, Artificial Sequence
  chemically synthesized
catcctcagacaaaggtgga

SEQ ID NO: 37253 - DNA, 20 bp, Artificial Sequence
  chemically synthesized
atcctcagacaaaggtggaa

SEQ ID NO: 37254 - DNA, 20 bp, Artificial Sequence
  chemically synthesized
gacaaaggtggaaaggctaa

SEQ ID NO: 37255 - DNA, 20 bp, Artificial Sequence
  chemically synthesized
aaaggtggaaaggctaatgg

SEQ ID NO: 37256 - DNA, 20 bp, Artificial Sequence
  chemically synthesized
tggaaaggctaatggcagca

SEQ ID NO: 37257 - DNA, 20 bp, Artificial Sequence
  chemically synthesized
ggaaaggctaatggcagcac

SEQ ID NO: 37258 - DNA, 20 bp, Artificial Sequence
  chemically synthesized
aggctaatggcagcacgggt

SEQ ID NO: 37259 - DNA, 20 bp, Artificial Sequence
  chemically synthesized
ggctaatggcagcacgggtc

SEQ ID NO: 37260 - DNA, 20 bp, Artificial Sequence
  chemically synthesized
gctaatggcagcacgggtca

SEQ ID NO: 37261 - DNA, 20 bp, Artificial Sequence
  chemically synthesized
taatggcagcacgggtcagg

SEQ ID NO: 37262 - DNA, 20 bp, Artificial Sequence
  chemically synthesized
aatggcagcacgggtcaggg

SEQ ID NO: 37263 - DNA, 20 bp, Artificial Sequence
  chemically synthesized
atggcagcacgggtcaggga

SEQ ID NO: 37264 - DNA, 20 bp, Artificial Sequence
  chemically synthesized
tggcagcacgggtcagggag

SEQ ID NO: 37265 - DNA, 20 bp, Artificial Sequence
  chemically synthesized
ggaggggatgttaccactac

SEQ ID NO: 37266 - DNA, 20 bp, Artificial Sequence
  chemically synthesized
gaggggatgttaccactact

SEQ ID NO: 37267 - DNA, 20 bp, Artificial Sequence
  chemically synthesized
aggggatgttaccactactg

SEQ ID NO: 37268 - DNA, 20 bp, Artificial Sequence
  chemically synthesized
gatgttaccactactgggga

SEQ ID NO: 37269 - DNA, 20 bp, Artificial Sequence
  chemically synthesized
atgttaccactactggggat

SEQ ID NO: 37270 - DNA, 20 bp, Artificial Sequence
  chemically synthesized
tgttaccactactggggatg

SEQ ID NO: 37271 - DNA, 20 bp, Artificial Sequence
  chemically synthesized
gatggggaaactgtttcttc

SEQ ID NO: 37272 - DNA, 20 bp, Artificial Sequence
  chemically synthesized
aactgtttcttctggcaaaa

SEQ ID NO: 37273 - DNA, 20 bp, Artificial Sequence
  chemically synthesized
ttctggcaaaaaagtttcat

SEQ ID NO: 37274 - DNA, 20 bp, Artificial Sequence
  chemically synthesized
ctggcaaaaaagtttcatca

SEQ ID NO: 37275 - DNA, 20 bp, Artificial Sequence
  chemically synthesized
ttcatcagagttcacaaact

SEQ ID NO: 37276 - DNA, 20 bp, Artificial Sequence
  chemically synthesized
gttcacaaactcagtgtcct

SEQ ID NO: 37277 - DNA, 20 bp, Artificial Sequence
  chemically synthesized
ctcagtgtcctcagcttcat

SEQ ID NO: 37278 - DNA, 20 bp, Artificial Sequence
  chemically synthesized
tcagtgtcctcagcttcatc

SEQ ID NO: 37279 - DNA, 20 bp, Artificial Sequence
  chemically synthesized
cagtgtcctcagcttcatca

SEQ ID NO: 37280 - DNA, 20 bp, Artificial Sequence
  chemically synthesized
ctcccacacatccccactcc

SEQ ID NO: 37281 - DNA, 20 bp, Artificial Sequence
  chemically synthesized
cacatccccactccaagttc

SEQ ID NO: 37282 - DNA, 20 bp, Artificial Sequence
  chemically synthesized
acatccccactccaagttcc

SEQ ID NO: 37283 - DNA, 20 bp, Artificial Sequence
  chemically synthesized
catccccactccaagttcca

SEQ ID NO: 37284 - DNA, 20 bp, Artificial Sequence
  chemically synthesized
tccagggtcccatttttttc

SEQ ID NO: 37285 - DNA, 20 bp, Artificial Sequence
  chemically synthesized
agtcaatgccctcactttaa

SEQ ID NO: 37286 - DNA, 20 bp, Artificial Sequence
  chemically synthesized
tcactttaacagtaaacacc

SEQ ID NO: 37287 - DNA, 20 bp, Artificial Sequence
  chemically synthesized
tttaacagtaaacacctggc

SEQ ID NO: 37288 - DNA, 20 bp, Artificial Sequence
  chemically synthesized
ttaacagtaaacacctggca

SEQ ID NO: 37289 - DNA, 20 bp, Artificial Sequence
  chemically synthesized
tgtgcatgcacctcttgttg

SEQ ID NO: 37290 - DNA, 20 bp, Artificial Sequence
  chemically synthesized
atgcacctcttgttgcagat

SEQ ID NO: 37291 - DNA, 20 bp, Artificial Sequence
  chemically synthesized
atcagctactcgcatgataa

SEQ ID NO: 37292 - DNA, 20 bp, Artificial Sequence
  chemically synthesized
caatttcaactctttctcta

SEQ ID NO: 37293 - DNA, 20 bp, Artificial Sequence
  chemically synthesized
aatttcaactctttctctac

SEQ ID NO: 37294 - DNA, 20 bp, Artificial Sequence
  chemically synthesized
tttcaactctttctctacag

SEQ ID NO: 37295 - DNA, 20 bp, Artificial Sequence
  chemically synthesized
caggagttaaaactctcatt

SEQ ID NO: 37296 - DNA, 20 bp, Artificial Sequence
  chemically synthesized
aggagttaaaactctcattc

SEQ ID NO: 37297 - DNA, 20 bp, Artificial Sequence
  chemically synthesized
ggagttaaaactctcattca

SEQ ID NO: 37298 - DNA, 20 bp, Artificial Sequence
  chemically synthesized
actctcattcagggcaatct

SEQ ID NO: 37299 - DNA, 20 bp, Artificial Sequence
  chemically synthesized
ctcattcagggcaatcttag

SEQ ID NO: 37300 - DNA, 20 bp, Artificial Sequence
  chemically synthesized
gggcaatcttagcagatttg

SEQ ID NO: 37301 - DNA, 20 bp, Artificial Sequence
  chemically synthesized
atcttagcagatttgtggct

SEQ ID NO: 37302 - DNA, 20 bp, Artificial Sequence
  chemically synthesized
tggctcagtatctgcttctg

SEQ ID NO: 37303 - DNA, 20 bp, Artificial Sequence
  chemically synthesized
ggctcagtatctgcttctga

SEQ ID NO: 37304 - DNA, 20 bp, Artificial Sequence
  chemically synthesized
tcagtatctgcttctgaagg

SEQ ID NO: 37305 - DNA, 20 bp, Artificial Sequence
  chemically synthesized
cagtatctgcttctgaaggt

SEQ ID NO: 37306 - DNA, 20 bp, Artificial Sequence
  chemically synthesized
gtatctgcttctgaaggtgg

SEQ ID NO: 37307 - DNA, 20 bp, Artificial Sequence
  chemically synthesized
ctgcttctgaaggtgggaga

SEQ ID NO: 37308 - DNA, 20 bp, Artificial Sequence
  chemically synthesized
aggtgggagacagatcccct

SEQ ID NO: 37309 - DNA, 20 bp, Artificial Sequence
  chemically synthesized
ttttctttcatctctttctc

SEQ ID NO: 37310 - DNA, 20 bp, Artificial Sequence
  chemically synthesized
ttctttcatctctttctcca

SEQ ID NO: 37311 - DNA, 20 bp, Artificial Sequence
  chemically synthesized
atctctttctccagagaact

SEQ ID NO: 37312 - DNA, 20 bp, Artificial Sequence
  chemically synthesized
tctctttctccagagaactt

SEQ ID NO: 37313 - DNA, 20 bp, Artificial Sequence
  chemically synthesized
tctttctccagagaacttag

SEQ ID NO: 37314 - DNA, 20 bp, Artificial Sequence
  chemically synthesized
accaacttcattatgttcct

SEQ ID NO: 37315 - DNA, 20 bp, Artificial Sequence
  chemically synthesized
gttccttggttctccacata

SEQ ID NO: 37316 - DNA, 20 bp, Artificial Sequence
  chemically synthesized
tggttctccacatatagtca

SEQ ID NO: 37317 - DNA, 20 bp, Artificial Sequence
  chemically synthesized
ggttctccacatatagtcaa

SEQ ID NO: 37318 - DNA, 20 bp, Artificial Sequence
  chemically synthesized
atagtcaaaggtattatgta

SEQ ID NO: 37319 - DNA, 20 bp, Artificial Sequence
  chemically synthesized
agtcaaaggtattatgtata

SEQ ID NO: 37320 - DNA, 20 bp, Artificial Sequence
  chemically synthesized
ctaaactccttgcctctcat

SEQ ID NO: 37321 - DNA, 20 bp, Artificial Sequence
  chemically synthesized
gcctctcataagtgatgaat

SEQ ID NO: 37322 - DNA, 20 bp, Artificial Sequence
  chemically synthesized
tctcataagtgatgaatcag

SEQ ID NO: 37323 - DNA, 20 bp, Artificial Sequence
  chemically synthesized
gcataactctctaaacaatt

SEQ ID NO: 37324 - DNA, 20 bp, Artificial Sequence
  chemically synthesized
cataactctctaaacaattc

SEQ ID NO: 37325 - DNA, 20 bp, Artificial Sequence
  chemically synthesized
ctctctaaacaattcaggcc

SEQ ID NO: 37326 - DNA, 20 bp, Artificial Sequence
  chemically synthesized
caattcaggccaagtactat

SEQ ID NO: 37327 - DNA, 20 bp, Artificial Sequence
  chemically synthesized
atcagtgttctccatactat

SEQ ID NO: 37328 - DNA, 20 bp, Artificial Sequence
  chemically synthesized
agtgttctccatactattag

SEQ ID NO: 37329 - DNA, 20 bp, Artificial Sequence
  chemically synthesized
gttctccatactattagaag

SEQ ID NO: 37330 - DNA, 20 bp, Artificial Sequence
  chemically synthesized
tctccatactattagaagta

SEQ ID NO: 37331 - DNA, 20 bp, Artificial Sequence
  chemically synthesized
actattagaagtagagtcct

SEQ ID NO: 37332 - DNA, 20 bp, Artificial Sequence
  chemically synthesized
gtagagtccttagcattttt

SEQ ID NO: 37333 - DNA, 20 bp, Artificial Sequence
  chemically synthesized
tttggtctaatcatattaat

SEQ ID NO: 37334 - DNA, 20 bp, Artificial Sequence
  chemically synthesized
tcatattaatcagccaacac

SEQ ID NO: 37335 - DNA, 20 bp, Artificial Sequence
  chemically synthesized
tattaatcagccaacaccag

SEQ ID NO: 37336 - DNA, 20 bp, Artificial Sequence
  chemically synthesized
agaagtcccaaaaccaatga

SEQ ID NO: 37337 - DNA, 20 bp, Artificial Sequence
  chemically synthesized
tccttaatattctgttcctc

SEQ ID NO: 37338 - DNA, 20 bp, Artificial Sequence
  chemically synthesized
tgttcctcaagaaccacttc

SEQ ID NO: 37339 - DNA, 20 bp, Artificial Sequence
  chemically synthesized
tctggtatgaaaatctgtat

SEQ ID NO: 37340 - DNA, 20 bp, Artificial Sequence
  chemically synthesized
gtatgaaaatctgtattagt

SEQ ID NO: 37341 - DNA, 20 bp, Artificial Sequence
  chemically synthesized
tatgaaaatctgtattagtc

SEQ ID NO: 37342 - DNA, 20 bp, Artificial Sequence
  chemically synthesized
atgaaaatctgtattagtcg

SEQ ID NO: 37343 - DNA, 20 bp, Artificial Sequence
  chemically synthesized
ctgtattagtcggggttctc

SEQ ID NO: 37344 - DNA, 20 bp, Artificial Sequence
  chemically synthesized
gtattagtcggggttctcta

SEQ ID NO: 37345 - DNA, 20 bp, Artificial Sequence
  chemically synthesized
tattagtcggggttctctag

SEQ ID NO: 37346 - DNA, 20 bp, Artificial Sequence
  chemically synthesized
attagtcggggttctctaga

SEQ ID NO: 37347 - DNA, 20 bp, Artificial Sequence
  chemically synthesized
gtcggggttctctagaggga

SEQ ID NO: 37348 - DNA, 20 bp, Artificial Sequence
  chemically synthesized
ctctagagggacagaactaa

SEQ ID NO: 37349 - DNA, 20 bp, Artificial Sequence
  chemically synthesized
tctagagggacagaactaat

SEQ ID NO: 37350 - DNA, 20 bp, Artificial Sequence
  chemically synthesized
tagagggacagaactaatag

SEQ ID NO: 37351 - DNA, 20 bp, Artificial Sequence
  chemically synthesized
gattatatatatatatatat

SEQ ID NO: 37352 - DNA, 20 bp, Artificial Sequence
  chemically synthesized
ttatatatatatatatatga

SEQ ID NO: 37353 - DNA, 20 bp, Artificial Sequence
  chemically synthesized
atatatatatatatatgaga

SEQ ID NO: 37354 - DNA, 20 bp, Artificial Sequence
  chemically synthesized
atatatatatatatgagaga

SEQ ID NO: 37355 - DNA, 20 bp, Artificial Sequence
  chemically synthesized
atatatatatatgagagaga

SEQ ID NO: 37356 - DNA, 20 bp, Artificial Sequence
  chemically synthesized
atatatatatgagagagaga

SEQ ID NO: 37357 - DNA, 20 bp, Artificial Sequence
  chemically synthesized
atatatatgagagagagaga

SEQ ID NO: 37358 - DNA, 20 bp, Artificial Sequence
  chemically synthesized
atatatgagagagagagaga

SEQ ID NO: 37359 - DNA, 20 bp, Artificial Sequence
  chemically synthesized
atatgagagagagagagaga

SEQ ID NO: 37360 - DNA, 20 bp, Artificial Sequence
  chemically synthesized
tatgtatatatgtgtatata

SEQ ID NO: 37361 - DNA, 20 bp, Artificial Sequence
  chemically synthesized
tatatatgtgtatatatagt

SEQ ID NO: 37362 - DNA, 20 bp, Artificial Sequence
  chemically synthesized
agtatacctatatctatcta

SEQ ID NO: 37363 - DNA, 20 bp, Artificial Sequence
  chemically synthesized
cctatatctatctatagata

SEQ ID NO: 37364 - DNA, 20 bp, Artificial Sequence
  chemically synthesized
gatatagatatactcacaca

SEQ ID NO: 37365 - DNA, 20 bp, Artificial Sequence
  chemically synthesized
atatagatatactcacacaa

SEQ ID NO: 37366 - DNA, 20 bp, Artificial Sequence
  chemically synthesized
tatagatatactcacacaaa

SEQ ID NO: 37367 - DNA, 20 bp, Artificial Sequence
  chemically synthesized
atagatatactcacacaaag

SEQ ID NO: 37368 - DNA, 20 bp, Artificial Sequence
  chemically synthesized
agatatactcacacaaaggg

SEQ ID NO: 37369 - DNA, 20 bp, Artificial Sequence
  chemically synthesized
cacacaaaggggagcttatt

SEQ ID NO: 37370 - DNA, 20 bp, Artificial Sequence
  chemically synthesized
acaaaggggagcttattaag

SEQ ID NO: 37371 - DNA, 20 bp, Artificial Sequence
  chemically synthesized
attaagtggtattaactcac

SEQ ID NO: 37372 - DNA, 20 bp, Artificial Sequence
  chemically synthesized
gtattaactcacaagattac

SEQ ID NO: 37373 - DNA, 20 bp, Artificial Sequence
  chemically synthesized
tattaactcacaagattaca

SEQ ID NO: 37374 - DNA, 20 bp, Artificial Sequence
  chemically synthesized
aagattacaaggtcccataa

SEQ ID NO: 37375 - DNA, 20 bp, Artificial Sequence
  chemically synthesized
agattacaaggtcccataat

SEQ ID NO: 37376 - DNA, 20 bp, Artificial Sequence
  chemically synthesized
taataggccacctgcaatct

SEQ ID NO: 37377 - DNA, 20 bp, Artificial Sequence
  chemically synthesized
aataggccacctgcaatctg

SEQ ID NO: 37378 - DNA, 20 bp, Artificial Sequence
  chemically synthesized
taggccacctgcaatctgag

SEQ ID NO: 37379 - DNA, 20 bp, Artificial Sequence
  chemically synthesized
ccacctgcaatctgaggagc

SEQ ID NO: 37380 - DNA, 20 bp, Artificial Sequence
  chemically synthesized
cacctgcaatctgaggagca

SEQ ID NO: 37381 - DNA, 20 bp, Artificial Sequence
  chemically synthesized
ctgcaatctgaggagcaagg

SEQ ID NO: 37382 - DNA, 20 bp, Artificial Sequence
  chemically synthesized
aatctgaggagcaaggaaga

SEQ ID NO: 37383 - DNA, 20 bp, Artificial Sequence
  chemically synthesized
aggagcaaggaagacagtcc

SEQ ID NO: 37384 - DNA, 20 bp, Artificial Sequence
  chemically synthesized
ggaagacagtccaagtccca

SEQ ID NO: 37385 - DNA, 20 bp, Artificial Sequence
  chemically synthesized
cagtccaagtcccacagctg

SEQ ID NO: 37386 - DNA, 20 bp, Artificial Sequence
  chemically synthesized
agtcccacagctgaagaact

SEQ ID NO: 37387 - DNA, 20 bp, Artificial Sequence
  chemically synthesized
tcccacagctgaagaacttg

SEQ ID NO: 37388 - DNA, 20 bp, Artificial Sequence
  chemically synthesized
gaacttggagtccgatgttc

SEQ ID NO: 37389 - DNA, 20 bp, Artificial Sequence
  chemically synthesized
acttggagtccgatgttcaa

SEQ ID NO: 37390 - DNA, 20 bp, Artificial Sequence
  chemically synthesized
tggagtccgatgttcaagag

SEQ ID NO: 37391 - DNA, 20 bp, Artificial Sequence
  chemically synthesized
ggagtccgatgttcaagagc

SEQ ID NO: 37392 - DNA, 20 bp, Artificial Sequence
  chemically synthesized
gtccgatgttcaagagcagg

SEQ ID NO: 37393 - DNA, 20 bp, Artificial Sequence
  chemically synthesized
tccgatgttcaagagcagga

SEQ ID NO: 37394 - DNA, 20 bp, Artificial Sequence
  chemically synthesized
gttcaagagcaggaaggatc

SEQ ID NO: 37395 - DNA, 20 bp, Artificial Sequence
  chemically synthesized
agagcaggaaggatccagca

SEQ ID NO: 37396 - DNA, 20 bp, Artificial Sequence
  chemically synthesized
gagcaggaaggatccagcac

SEQ ID NO: 37397 - DNA, 20 bp, Artificial Sequence
  chemically synthesized
gcaggaaggatccagcacag

SEQ ID NO: 37398 - DNA, 20 bp, Artificial Sequence
  chemically synthesized
gaaggatccagcacaggaga

SEQ ID NO: 37399 - DNA, 20 bp, Artificial Sequence
  chemically synthesized
tccagcacaggagaaagatg

SEQ ID NO: 37400 - DNA, 20 bp, Artificial Sequence
  chemically synthesized
ccagcacaggagaaagatgt

SEQ ID NO: 37401 - DNA, 20 bp, Artificial Sequence
  chemically synthesized
cacaggagaaagatgtaggc

SEQ ID NO: 37402 - DNA, 20 bp, Artificial Sequence
  chemically synthesized
acaggagaaagatgtaggct

SEQ ID NO: 37403 - DNA, 20 bp, Artificial Sequence
  chemically synthesized
aggagaaagatgtaggctgg

SEQ ID NO: 37404 - DNA, 20 bp, Artificial Sequence
  chemically synthesized
ggagaaagatgtaggctggg

SEQ ID NO: 37405 - DNA, 20 bp, Artificial Sequence
  chemically synthesized
aagatgtaggctgggaggct

SEQ ID NO: 37406 - DNA, 20 bp, Artificial Sequence
  chemically synthesized
tgtaggctgggaggctaagc

SEQ ID NO: 37407 - DNA, 20 bp, Artificial Sequence
  chemically synthesized
gctgggaggctaagccagtc

SEQ ID NO: 37408 - DNA, 20 bp, Artificial Sequence
  chemically synthesized
gcctttttacatttttctgc

SEQ ID NO: 37409 - DNA, 20 bp, Artificial Sequence
  chemically synthesized
tttctgccagctttatattc

SEQ ID NO: 37410 - DNA, 20 bp, Artificial Sequence
  chemically synthesized
agctttatattctggctcta

SEQ ID NO: 37411 - DNA, 20 bp, Artificial Sequence
  chemically synthesized
tatattctggctctacagct

SEQ ID NO: 37412 - DNA, 20 bp, Artificial Sequence
  chemically synthesized
atattctggctctacagctt

SEQ ID NO: 37413 - DNA, 20 bp, Artificial Sequence
  chemically synthesized
tattctggctctacagcttg

SEQ ID NO: 37414 - DNA, 20 bp, Artificial Sequence
  chemically synthesized
attctggctctacagcttgg

SEQ ID NO: 37415 - DNA, 20 bp, Artificial Sequence
  chemically synthesized
ctggctctacagcttggggg

SEQ ID NO: 37416 - DNA, 20 bp, Artificial Sequence
  chemically synthesized
gctctacagcttgggggcag

SEQ ID NO: 37417 - DNA, 20 bp, Artificial Sequence
  chemically synthesized
ctctacagcttgggggcagc

SEQ ID NO: 37418 - DNA, 20 bp, Artificial Sequence
  chemically synthesized
tctacagcttgggggcagca

SEQ ID NO: 37419 - DNA, 20 bp, Artificial Sequence
  chemically synthesized
ctacagcttgggggcagcag

SEQ ID NO: 37420 - DNA, 20 bp, Artificial Sequence
  chemically synthesized
cagcttgggggcagcagggg

SEQ ID NO: 37421 - DNA, 20 bp, Artificial Sequence
  chemically synthesized
agcttgggggcagcaggggc

SEQ ID NO: 37422 - DNA, 20 bp, Artificial Sequence
  chemically synthesized
gcttgggggcagcaggggca

SEQ ID NO: 37423 - DNA, 20 bp, Artificial Sequence
  chemically synthesized
cttgggggcagcaggggcag

SEQ ID NO: 37424 - DNA, 20 bp, Artificial Sequence
  chemically synthesized
ggcagcaggggcaggggcct

SEQ ID NO: 37425 - DNA, 20 bp, Artificial Sequence
  chemically synthesized
gcagcaggggcaggggcctc

SEQ ID NO: 37426 - DNA, 20 bp, Artificial Sequence
  chemically synthesized
cagcaggggcaggggcctca

SEQ ID NO: 37427 - DNA, 20 bp, Artificial Sequence
  chemically synthesized
caggggcctcagggtgcttg

SEQ ID NO: 37428 - DNA, 20 bp, Artificial Sequence
  chemically synthesized
aggggcctcagggtgcttgc

SEQ ID NO: 37429 - DNA, 20 bp, Artificial Sequence
  chemically synthesized
ggggcctcagggtgcttgca

SEQ ID NO: 37430 - DNA, 20 bp, Artificial Sequence
  chemically synthesized
tgcttgcagggatgacacac

SEQ ID NO: 37431 - DNA, 20 bp, Artificial Sequence
  chemically synthesized
acacactggcctcttttcca

SEQ ID NO: 37432 - DNA, 20 bp, Artificial Sequence
  chemically synthesized
cacactggcctcttttccat

SEQ ID NO: 37433 - DNA, 20 bp, Artificial Sequence
  chemically synthesized
acactggcctcttttccata

SEQ ID NO: 37434 - DNA, 20 bp, Artificial Sequence
  chemically synthesized
ctggcctcttttccataggg

SEQ ID NO: 37435 - DNA, 20 bp, Artificial Sequence
  chemically synthesized
cctcttttccatagggtggc

SEQ ID NO: 37436 - DNA, 20 bp, Artificial Sequence
  chemically synthesized
ctcttttccatagggtggct

SEQ ID NO: 37437 - DNA, 20 bp, Artificial Sequence
  chemically synthesized
tcttttccatagggtggctg

SEQ ID NO: 37438 - DNA, 20 bp, Artificial Sequence
  chemically synthesized
atagggtggctggggcacac

SEQ ID NO: 37439 - DNA, 20 bp, Artificial Sequence
  chemically synthesized
tagggtggctggggcacact

SEQ ID NO: 37440 - DNA, 20 bp, Artificial Sequence
  chemically synthesized
agggtggctggggcacactg

SEQ ID NO: 37441 - DNA, 20 bp, Artificial Sequence
  chemically synthesized
gctggggcacactggggtgt

SEQ ID NO: 37442 - DNA, 20 bp, Artificial Sequence
  chemically synthesized
ggcacactggggtgtgagta

SEQ ID NO: 37443 - DNA, 20 bp, Artificial Sequence
  chemically synthesized
tggggtgtgagtaaagcact

SEQ ID NO: 37444 - DNA, 20 bp, Artificial Sequence
  chemically synthesized
ggggtgtgagtaaagcactc

SEQ ID NO: 37445 - DNA, 20 bp, Artificial Sequence
  chemically synthesized
caggatcttttttccttccc

SEQ ID NO: 37446 - DNA, 20 bp, Artificial Sequence
  chemically synthesized
cttttttccttccctagtcc

SEQ ID NO: 37447 - DNA, 20 bp, Artificial Sequence
  chemically synthesized
ttccttccctagtccaagta

SEQ ID NO: 37448 - DNA, 20 bp, Artificial Sequence
  chemically synthesized
ttccctagtccaagtacagc

SEQ ID NO: 37449 - DNA, 20 bp, Artificial Sequence
  chemically synthesized
tccctagtccaagtacagca

SEQ ID NO: 37450 - DNA, 20 bp, Artificial Sequence
  chemically synthesized
ccctagtccaagtacagcaa

SEQ ID NO: 37451 - DNA, 20 bp, Artificial Sequence
  chemically synthesized
tagtccaagtacagcaaggg

SEQ ID NO: 37452 - DNA, 20 bp, Artificial Sequence
  chemically synthesized
cagcaagggcagtatgactg

SEQ ID NO: 37453 - DNA, 20 bp, Artificial Sequence
  chemically synthesized
gggcagtatgactgcagtgt

SEQ ID NO: 37454 - DNA, 20 bp, Artificial Sequence
  chemically synthesized
cagtatgactgcagtgttag

SEQ ID NO: 37455 - DNA, 20 bp, Artificial Sequence
  chemically synthesized
tatgactgcagtgttagtgg

SEQ ID NO: 37456 - DNA, 20 bp, Artificial Sequence
  chemically synthesized
gactgcagtgttagtggcag

SEQ ID NO: 37457 - DNA, 20 bp, Artificial Sequence
  chemically synthesized
actgcagtgttagtggcaga

SEQ ID NO: 37458 - DNA, 20 bp, Artificial Sequence
  chemically synthesized
gttagtggcagaaggacttt

SEQ ID NO: 37459 - DNA, 20 bp, Artificial Sequence
  chemically synthesized
gaaggactttcagtcacctc

SEQ ID NO: 37460 - DNA, 20 bp, Artificial Sequence
  chemically synthesized
aaggactttcagtcacctct

SEQ ID NO: 37461 - DNA, 20 bp, Artificial Sequence
  chemically synthesized
ggactttcagtcacctctgg

SEQ ID NO: 37462 - DNA, 20 bp, Artificial Sequence
  chemically synthesized
agcttcaccccacaaaaaca

SEQ ID NO: 37463 - DNA, 20 bp, Artificial Sequence
  chemically synthesized
cttcaccccacaaaaacaca

SEQ ID NO: 37464 - DNA, 20 bp, Artificial Sequence
  chemically synthesized
ccccacaaaaacacagagtg

SEQ ID NO: 37465 - DNA, 20 bp, Artificial Sequence
  chemically synthesized
acaaaaacacagagtgcagc

SEQ ID NO: 37466 - DNA, 20 bp, Artificial Sequence
  chemically synthesized
aaaacacagagtgcagccag

SEQ ID NO: 37467 - DNA, 20 bp, Artificial Sequence
  chemically synthesized
gccagtggaaatgttcaact

SEQ ID NO: 37468 - DNA, 20 bp, Artificial Sequence
  chemically synthesized
ggaaatgttcaactgagttc

SEQ ID NO: 37469 - DNA, 20 bp, Artificial Sequence
  chemically synthesized
gaaatgttcaactgagttcg

SEQ ID NO: 37470 - DNA, 20 bp, Artificial Sequence
  chemically synthesized
agttcgaggtgcctgcactg

SEQ ID NO: 37471 - DNA, 20 bp, Artificial Sequence
  chemically synthesized
gttcgaggtgcctgcactgt

SEQ ID NO: 37472 - DNA, 20 bp, Artificial Sequence
  chemically synthesized
ggtgcctgcactgtgggccc

SEQ ID NO: 37473 - DNA, 20 bp, Artificial Sequence
  chemically synthesized
cctgcactgtgggcccaagc

SEQ ID NO: 37474 - DNA, 20 bp, Artificial Sequence
  chemically synthesized
ctgcactgtgggcccaagcc

SEQ ID NO: 37475 - DNA, 20 bp, Artificial Sequence
  chemically synthesized
gcactgtgggcccaagccag

SEQ ID NO: 37476 - DNA, 20 bp, Artificial Sequence
  chemically synthesized
cccaagccaggagccttgcc

SEQ ID NO: 37477 - DNA, 20 bp, Artificial Sequence
  chemically synthesized
gccaggagccttgcctggtg

SEQ ID NO: 37478 - DNA, 20 bp, Artificial Sequence
  chemically synthesized
caggagccttgcctggtgaa

SEQ ID NO: 37479 - DNA, 20 bp, Artificial Sequence
  chemically synthesized
gagccttgcctggtgaagag

SEQ ID NO: 37480 - DNA, 20 bp, Artificial Sequence
  chemically synthesized
ccttgcctggtgaagagtag

SEQ ID NO: 37481 - DNA, 20 bp, Artificial Sequence
  chemically synthesized
cttgcctggtgaagagtagc

SEQ ID NO: 37482 - DNA, 20 bp, Artificial Sequence
  chemically synthesized
tggtgaagagtagcaggtga

SEQ ID NO: 37483 - DNA, 20 bp, Artificial Sequence
  chemically synthesized
agtagcaggtgaaagctcac

SEQ ID NO: 37484 - DNA, 20 bp, Artificial Sequence
  chemically synthesized
gcaggtgaaagctcacaaga

SEQ ID NO: 37485 - DNA, 20 bp, Artificial Sequence
  chemically synthesized
aggtgaaagctcacaagaaa

SEQ ID NO: 37486 - DNA, 20 bp, Artificial Sequence
  chemically synthesized
agctcacaagaaagagaaac

SEQ ID NO: 37487 - DNA, 20 bp, Artificial Sequence
  chemically synthesized
attctttccctgctgtgtgc

SEQ ID NO: 37488 - DNA, 20 bp, Artificial Sequence
  chemically synthesized
tctttccctgctgtgtgctg

SEQ ID NO: 37489 - DNA, 20 bp, Artificial Sequence
  chemically synthesized
ctttccctgctgtgtgctgg

SEQ ID NO: 37490 - DNA, 20 bp, Artificial Sequence
  chemically synthesized
ctgctgtgtgctggaggtgt

SEQ ID NO: 37491 - DNA, 20 bp, Artificial Sequence
  chemically synthesized
tgctgtgtgctggaggtgtc

SEQ ID NO: 37492 - DNA, 20 bp, Artificial Sequence
  chemically synthesized
gctgtgtgctggaggtgtca

SEQ ID NO: 37493 - DNA, 20 bp, Artificial Sequence
  chemically synthesized
gtgtgctggaggtgtcaggg

SEQ ID NO: 37494 - DNA, 20 bp, Artificial Sequence
  chemically synthesized
tgctggaggtgtcagggaag

SEQ ID NO: 37495 - DNA, 20 bp, Artificial Sequence
  chemically synthesized
ggaggtgtcagggaagtggc

SEQ ID NO: 37496 - DNA, 20 bp, Artificial Sequence
  chemically synthesized
gaggtgtcagggaagtggcc

SEQ ID NO: 37497 - DNA, 20 bp, Artificial Sequence
  chemically synthesized
ggccaggtcccttctttctc

SEQ ID NO: 37498 - DNA, 20 bp, Artificial Sequence
  chemically synthesized
gtcccttctttctcaagccc

SEQ ID NO: 37499 - DNA, 20 bp, Artificial Sequence
  chemically synthesized
tcccttctttctcaagccca

SEQ ID NO: 37500 - DNA, 20 bp, Artificial Sequence
  chemically synthesized
cccttctttctcaagcccaa

SEQ ID NO: 37501 - DNA, 20 bp, Artificial Sequence
  chemically synthesized
ctcaagcccaagggcattaa

SEQ ID NO: 37502 - DNA, 20 bp, Artificial Sequence
  chemically synthesized
aagcccaagggcattaacgg

SEQ ID NO: 37503 - DNA, 20 bp, Artificial Sequence
  chemically synthesized
cattaacggtggtactgctg

SEQ ID NO: 37504 - DNA, 20 bp, Artificial Sequence
  chemically synthesized
tggtactgctgcagctgaaa

SEQ ID NO: 37505 - DNA, 20 bp, Artificial Sequence
  chemically synthesized
tactgctgcagctgaaatgg

SEQ ID NO: 37506 - DNA, 20 bp, Artificial Sequence
  chemically synthesized
ctgctgcagctgaaatggca

SEQ ID NO: 37507 - DNA, 20 bp, Artificial Sequence
  chemically synthesized
tgctgcagctgaaatggcag

SEQ ID NO: 37508 - DNA, 20 bp, Artificial Sequence
  chemically synthesized
gctgcagctgaaatggcaga

SEQ ID NO: 37509 - DNA, 20 bp, Artificial Sequence
  chemically synthesized
ctgcagctgaaatggcagag

SEQ ID NO: 37510 - DNA, 20 bp, Artificial Sequence
  chemically synthesized
ctgaaatggcagaggggctg

SEQ ID NO: 37511 - DNA, 20 bp, Artificial Sequence
  chemically synthesized
tgaaatggcagaggggctgt

SEQ ID NO: 37512 - DNA, 20 bp, Artificial Sequence
  chemically synthesized
aggggctgtgggttgtctct

SEQ ID NO: 37513 - DNA, 20 bp, Artificial Sequence
  chemically synthesized
tgtctcttggatttcctccc

SEQ ID NO: 37514 - DNA, 20 bp, Artificial Sequence
  chemically synthesized
tctcttggatttcctcccca

SEQ ID NO: 37515 - DNA, 20 bp, Artificial Sequence
  chemically synthesized
cttggatttcctccccagag

SEQ ID NO: 37516 - DNA, 20 bp, Artificial Sequence
  chemically synthesized
atttcctccccagagaagca

SEQ ID NO: 37517 - DNA, 20 bp, Artificial Sequence
  chemically synthesized
ttcctccccagagaagcaca

SEQ ID NO: 37518 - DNA, 20 bp, Artificial Sequence
  chemically synthesized
ccaacactgactaaaatgtt

SEQ ID NO: 37519 - DNA, 20 bp, Artificial Sequence
  chemically synthesized
caacactgactaaaatgttc

SEQ ID NO: 37520 - DNA, 20 bp, Artificial Sequence
  chemically synthesized
cactgactaaaatgttcagg

SEQ ID NO: 37521 - DNA, 20 bp, Artificial Sequence
  chemically synthesized
actgactaaaatgttcaggc

SEQ ID NO: 37522 - DNA, 20 bp, Artificial Sequence
  chemically synthesized
ctgactaaaatgttcaggca

SEQ ID NO: 37523 - DNA, 20 bp, Artificial Sequence
  chemically synthesized
ctaaaatgttcaggcagggc

SEQ ID NO: 37524 - DNA, 20 bp, Artificial Sequence
  chemically synthesized
taaaatgttcaggcagggcc

SEQ ID NO: 37525 - DNA, 20 bp, Artificial Sequence
  chemically synthesized
aaaatgttcaggcagggcca

SEQ ID NO: 37526 - DNA, 20 bp, Artificial Sequence
  chemically synthesized
atgttcaggcagggccaggg

SEQ ID NO: 37527 - DNA, 20 bp, Artificial Sequence
  chemically synthesized
cagggtggctgtgctctgcc

SEQ ID NO: 37528 - DNA, 20 bp, Artificial Sequence
  chemically synthesized
gtggctgtgctctgcccagt

SEQ ID NO: 37529 - DNA, 20 bp, Artificial Sequence
  chemically synthesized
tggctgtgctctgcccagtg

SEQ ID NO: 37530 - DNA, 20 bp, Artificial Sequence
  chemically synthesized
gtgctctgcccagtgaggaa

SEQ ID NO: 37531 - DNA, 20 bp, Artificial Sequence
  chemically synthesized
ctctgcccagtgaggaatag

SEQ ID NO: 37532 - DNA, 20 bp, Artificial Sequence
  chemically synthesized
tctgcccagtgaggaatagt

SEQ ID NO: 37533 - DNA, 20 bp, Artificial Sequence
  chemically synthesized
ctgcccagtgaggaatagta

SEQ ID NO: 37534 - DNA, 20 bp, Artificial Sequence
  chemically synthesized
tgcccagtgaggaatagtag

SEQ ID NO: 37535 - DNA, 20 bp, Artificial Sequence
  chemically synthesized
ccagtgaggaatagtagggg

SEQ ID NO: 37536 - DNA, 20 bp, Artificial Sequence
  chemically synthesized
cagtgaggaatagtaggggc

SEQ ID NO: 37537 - DNA, 20 bp, Artificial Sequence
  chemically synthesized
agtgaggaatagtaggggca

SEQ ID NO: 37538 - DNA, 20 bp, Artificial Sequence
  chemically synthesized
ggaatagtaggggcagggac

SEQ ID NO: 37539 - DNA, 20 bp, Artificial Sequence
  chemically synthesized
agtaggggcagggaccagtg

SEQ ID NO: 37540 - DNA, 20 bp, Artificial Sequence
  chemically synthesized
gcagggaccagtgcagaaaa

SEQ ID NO: 37541 - DNA, 20 bp, Artificial Sequence
  chemically synthesized
gaccagtgcagaaaacagtg

SEQ ID NO: 37542 - DNA, 20 bp, Artificial Sequence
  chemically synthesized
cagtgtggccacttttccat

SEQ ID NO: 37543 - DNA, 20 bp, Artificial Sequence
  chemically synthesized
agtgtggccacttttccata

SEQ ID NO: 37544 - DNA, 20 bp, Artificial Sequence
  chemically synthesized
gtggccacttttccataagg

SEQ ID NO: 37545 - DNA, 20 bp, Artificial Sequence
  chemically synthesized
ataaggcagctacactgtgc

SEQ ID NO: 37546 - DNA, 20 bp, Artificial Sequence
  chemically synthesized
aaggcagctacactgtgctg

SEQ ID NO: 37547 - DNA, 20 bp, Artificial Sequence
  chemically synthesized
aggcagctacactgtgctgg

SEQ ID NO: 37548 - DNA, 20 bp, Artificial Sequence
  chemically synthesized
acactgtgctggaggtccgt

SEQ ID NO: 37549 - DNA, 20 bp, Artificial Sequence
  chemically synthesized
actgtgctggaggtccgtga

SEQ ID NO: 37550 - DNA, 20 bp, Artificial Sequence
  chemically synthesized
ggaggtccgtgagagtcctg

SEQ ID NO: 37551 - DNA, 20 bp, Artificial Sequence
  chemically synthesized
gaagctcctcgctccctcct

SEQ ID NO: 37552 - DNA, 20 bp, Artificial Sequence
  chemically synthesized
tgagcccatactttaatctc

SEQ ID NO: 37553 - DNA, 20 bp, Artificial Sequence
  chemically synthesized
agcccatactttaatctcaa

SEQ ID NO: 37554 - DNA, 20 bp, Artificial Sequence
  chemically synthesized
tactttaatctcaagagttt

SEQ ID NO: 37555 - DNA, 20 bp, Artificial Sequence
  chemically synthesized
tctcaagagtttgagataaa

SEQ ID NO: 37556 - DNA, 20 bp, Artificial Sequence
  chemically synthesized
caagagtttgagataaacag

SEQ ID NO: 37557 - DNA, 20 bp, Artificial Sequence
  chemically synthesized
agtttgagataaacagtggt

SEQ ID NO: 37558 - DNA, 20 bp, Artificial Sequence
  chemically synthesized
gtttgagataaacagtggta

SEQ ID NO: 37559 - DNA, 20 bp, Artificial Sequence
  chemically synthesized
tgagataaacagtggtaagg

SEQ ID NO: 37560 - DNA, 20 bp, Artificial Sequence
  chemically synthesized
ataaacagtggtaaggaaga

SEQ ID NO: 37561 - DNA, 20 bp, Artificial Sequence
  chemically synthesized
tggtaaggaagaaagtacaa

SEQ ID NO: 37562 - DNA, 20 bp, Artificial Sequence
  chemically synthesized
ggtaaggaagaaagtacaac

SEQ ID NO: 37563 - DNA, 20 bp, Artificial Sequence
  chemically synthesized
ggaagaaagtacaacgggta

SEQ ID NO: 37564 - DNA, 20 bp, Artificial Sequence
  chemically synthesized
cgggtacggctaatgaaacc

SEQ ID NO: 37565 - DNA, 20 bp, Artificial Sequence
  chemically synthesized
gggtacggctaatgaaaccc

SEQ ID NO: 37566 - DNA, 20 bp, Artificial Sequence
  chemically synthesized
tacggctaatgaaacccagg

SEQ ID NO: 37567 - DNA, 20 bp, Artificial Sequence
  chemically synthesized
ctaatgaaacccaggaagat

SEQ ID NO: 37568 - DNA, 20 bp, Artificial Sequence
  chemically synthesized
caggaagataagtcaatgcg

SEQ ID NO: 37569 - DNA, 20 bp, Artificial Sequence
  chemically synthesized
gaagataagtcaatgcgtag

SEQ ID NO: 37570 - DNA, 20 bp, Artificial Sequence
  chemically synthesized
gtagaagtaattccaaccta

SEQ ID NO: 37571 - DNA, 20 bp, Artificial Sequence
  chemically synthesized
ctttttaaaaatcatattta

SEQ ID NO: 37572 - DNA, 20 bp, Artificial Sequence
  chemically synthesized
ttttaaaaatcatatttata

SEQ ID NO: 37573 - DNA, 20 bp, Artificial Sequence
  chemically synthesized
tttaaaaatcatatttatag

SEQ ID NO: 37574 - DNA, 20 bp, Artificial Sequence
  chemically synthesized
atcatatttatagaggtttg

SEQ ID NO: 37575 - DNA, 20 bp, Artificial Sequence
  chemically synthesized
agaggtttgcagtgatacta

SEQ ID NO: 37576 - DNA, 20 bp, Artificial Sequence
  chemically synthesized
caatattgcaaatcattatt

SEQ ID NO: 37577 - DNA, 20 bp, Artificial Sequence
  chemically synthesized
caaatcattattaagaatac

SEQ ID NO: 37578 - DNA, 20 bp, Artificial Sequence
  chemically synthesized
atcattattaagaatacaag

SEQ ID NO: 37579 - DNA, 20 bp, Artificial Sequence
  chemically synthesized
tttctttaacacctgtgata

SEQ ID NO: 37580 - DNA, 20 bp, Artificial Sequence
  chemically synthesized
ttctttaacacctgtgatac

SEQ ID NO: 37581 - DNA, 20 bp, Artificial Sequence
  chemically synthesized
ttgatatgaattctacgtaa

SEQ ID NO: 37582 - DNA, 20 bp, Artificial Sequence
  chemically synthesized
ttgcttcttgccaccaccca

SEQ ID NO: 37583 - DNA, 20 bp, Artificial Sequence
  chemically synthesized
cttcttgccaccacccaaag

SEQ ID NO: 37584 - DNA, 20 bp, Artificial Sequence
  chemically synthesized
ttcttgccaccacccaaaga

SEQ ID NO: 37585 - DNA, 20 bp, Artificial Sequence
  chemically synthesized
accacccaaagaaggttgta

SEQ ID NO: 37586 - DNA, 20 bp, Artificial Sequence
  chemically synthesized
aaagaaggttgtatagcact

SEQ ID NO: 37587 - DNA, 20 bp, Artificial Sequence
  chemically synthesized
aactgcaaccgtgtatctct

SEQ ID NO: 37588 - DNA, 20 bp, Artificial Sequence
  chemically synthesized
actgcaaccgtgtatctctt

SEQ ID NO: 37589 - DNA, 20 bp, Artificial Sequence
  chemically synthesized
ttgccctcttccctccctat

SEQ ID NO: 37590 - DNA, 20 bp, Artificial Sequence
  chemically synthesized
cctccctatcagcatgtatc

SEQ ID NO: 37591 - DNA, 20 bp, Artificial Sequence
  chemically synthesized
ccctatcagcatgtatctag

SEQ ID NO: 37592 - DNA, 20 bp, Artificial Sequence
  chemically synthesized
gtatctagcagcattctgaa

SEQ ID NO: 37593 - DNA, 20 bp, Artificial Sequence
  chemically synthesized
attctgaaaagttaactgca

SEQ ID NO: 37594 - DNA, 20 bp, Artificial Sequence
  chemically synthesized
tgaaaagttaactgcacagt

SEQ ID NO: 37595 - DNA, 20 bp, Artificial Sequence
  chemically synthesized
actgcacagtgagcgactgc

SEQ ID NO: 37596 - DNA, 20 bp, Artificial Sequence
  chemically synthesized
ctgcacagtgagcgactgct

SEQ ID NO: 37597 - DNA, 20 bp, Artificial Sequence
  chemically synthesized
gagcgactgctgggcatctt

SEQ ID NO: 37598 - DNA, 20 bp, Artificial Sequence
  chemically synthesized
agcgactgctgggcatctta

SEQ ID NO: 37599 - DNA, 20 bp, Artificial Sequence
  chemically synthesized
gcgactgctgggcatcttaa

SEQ ID NO: 37600 - DNA, 20 bp, Artificial Sequence
  chemically synthesized
cgactgctgggcatcttaag

SEQ ID NO: 37601 - DNA, 20 bp, Artificial Sequence
  chemically synthesized
aaggggcattcttttctacc

SEQ ID NO: 37602 - DNA, 20 bp, Artificial Sequence
  chemically synthesized
aggggcattcttttctacct

SEQ ID NO: 37603 - DNA, 20 bp, Artificial Sequence
  chemically synthesized
ccccctcctccactcatgtc

SEQ ID NO: 37604 - DNA, 20 bp, Artificial Sequence
  chemically synthesized
ctccactcatgtctagcatg

SEQ ID NO: 37605 - DNA, 20 bp, Artificial Sequence
  chemically synthesized
tccactcatgtctagcatgc

SEQ ID NO: 37606 - DNA, 20 bp, Artificial Sequence
  chemically synthesized
catgtctagcatgcaggact

SEQ ID NO: 37607 - DNA, 20 bp, Artificial Sequence
  chemically synthesized
atgtctagcatgcaggactt

SEQ ID NO: 37608 - DNA, 20 bp, Artificial Sequence
  chemically synthesized
tgcaggacttgggtaatctc

SEQ ID NO: 37609 - DNA, 20 bp, Artificial Sequence
  chemically synthesized
gcaggacttgggtaatctct

SEQ ID NO: 37610 - DNA, 20 bp, Artificial Sequence
  chemically synthesized
caggacttgggtaatctctg

SEQ ID NO: 37611 - DNA, 20 bp, Artificial Sequence
  chemically synthesized
ttgggtaatctctggggttt

SEQ ID NO: 37612 - DNA, 20 bp, Artificial Sequence
  chemically synthesized
ctctggggtttcagattctc

SEQ ID NO: 37613 - DNA, 20 bp, Artificial Sequence
  chemically synthesized
tctccagacctccattctct

SEQ ID NO: 37614 - DNA, 20 bp, Artificial Sequence
  chemically synthesized
ctccagacctccattctctc

SEQ ID NO: 37615 - DNA, 20 bp, Artificial Sequence
  chemically synthesized
tccagacctccattctctca

SEQ ID NO: 37616 - DNA, 20 bp, Artificial Sequence
  chemically synthesized
ccagacctccattctctcag

SEQ ID NO: 37617 - DNA, 20 bp, Artificial Sequence
  chemically synthesized
ttccacctcctgctcatatc

SEQ ID NO: 37618 - DNA, 20 bp, Artificial Sequence
  chemically synthesized
ctcatatctagctatctgcc

SEQ ID NO: 37619 - DNA, 20 bp, Artificial Sequence
  chemically synthesized
ctaaccataaaatcttaaat

SEQ ID NO: 37620 - DNA, 20 bp, Artificial Sequence
  chemically synthesized
catgtcatgataaaaaaaat

SEQ ID NO: 37621 - DNA, 20 bp, Artificial Sequence
  chemically synthesized
taaaaaaaataagacaccat

SEQ ID NO: 37622 - DNA, 20 bp, Artificial Sequence
  chemically synthesized
aaaaaataagacaccatcag

SEQ ID NO: 37623 - DNA, 20 bp, Artificial Sequence
  chemically synthesized
tcagtggcaactgtgttgcc

SEQ ID NO: 37624 - DNA, 20 bp, Artificial Sequence
  chemically synthesized
ttgatctgctaatccctgtg

SEQ ID NO: 37625 - DNA, 20 bp, Artificial Sequence
  chemically synthesized
ccctgtgtagaaatgaacct

SEQ ID NO: 37626 - DNA, 20 bp, Artificial Sequence
  chemically synthesized
ctgtgtagaaatgaaccttg

SEQ ID NO: 37627 - DNA, 20 bp, Artificial Sequence
  chemically synthesized
tgtgtagaaatgaaccttgg

SEQ ID NO: 37628 - DNA, 20 bp, Artificial Sequence
  chemically synthesized
atttcttacaatatgtgcat

SEQ ID NO: 37629 - DNA, 20 bp, Artificial Sequence
  chemically synthesized
ttgtaacactgtcactttga

SEQ ID NO: 37630 - DNA, 20 bp, Artificial Sequence
  chemically synthesized
ctgtcactttgacagttgat

SEQ ID NO: 37631 - DNA, 20 bp, Artificial Sequence
  chemically synthesized
gttgataagcatcttctgaa

SEQ ID NO: 37632 - DNA, 20 bp, Artificial Sequence
  chemically synthesized
cttctgaatggtccctcctt

SEQ ID NO: 37633 - DNA, 20 bp, Artificial Sequence
  chemically synthesized
tcctttagttacaaaaatgt

SEQ ID NO: 37634 - DNA, 20 bp, Artificial Sequence
  chemically synthesized
gttacaaaaatgttggtgca

SEQ ID NO: 37635 - DNA, 20 bp, Artificial Sequence
  chemically synthesized
tgttggtgcatggatgatgt

SEQ ID NO: 37636 - DNA, 20 bp, Artificial Sequence
  chemically synthesized
gttggtgcatggatgatgtt

SEQ ID NO: 37637 - DNA, 20 bp, Artificial Sequence
  chemically synthesized
tgatgttgggaataaataaa

SEQ ID NO: 37638 - DNA, 20 bp, Artificial Sequence
  chemically synthesized
actaaattatgttctcatct

SEQ ID NO: 37639 - DNA, 20 bp, Artificial Sequence
  chemically synthesized
ctaaattatgttctcatctt

SEQ ID NO: 37640 - DNA, 20 bp, Artificial Sequence
  chemically synthesized
tctcatcttgggcaaaaatt

SEQ ID NO: 37641 - DNA, 20 bp, Artificial Sequence
  chemically synthesized
aaaattaagcaaaaaaaaaa

SEQ ID NO: 37642 - DNA, 20 bp, Artificial Sequence
  chemically synthesized
aattaagcaaaaaaaaaatg

SEQ ID NO: 37643 - DNA, 20 bp, Artificial Sequence
  chemically synthesized
attaagcaaaaaaaaaatgg

SEQ ID NO: 37644 - DNA, 20 bp, Artificial Sequence
  chemically synthesized
aaaaaaaaatggaggatatg

SEQ ID NO: 37645 - DNA, 20 bp, Artificial Sequence
  chemically synthesized
ggatatgaagctcctccaca

SEQ ID NO: 37646 - DNA, 20 bp, Artificial Sequence
  chemically synthesized
tatgaagctcctccacaaag

SEQ ID NO: 37647 - DNA, 20 bp, Artificial Sequence
  chemically synthesized
atgaagctcctccacaaaga

SEQ ID NO: 37648 - DNA, 20 bp, Artificial Sequence
  chemically synthesized
aaagaaggccatttttgtac

SEQ ID NO: 37649 - DNA, 20 bp, Artificial Sequence
  chemically synthesized
aagaaggccatttttgtact

SEQ ID NO: 37650 - DNA, 20 bp, Artificial Sequence
  chemically synthesized
tttttgtactaggcttacta

SEQ ID NO: 37651 - DNA, 20 bp, Artificial Sequence
  chemically synthesized
ctacagtgacacaccactat

SEQ ID NO: 37652 - DNA, 20 bp, Artificial Sequence
  chemically synthesized
agtgacacaccactattagt

SEQ ID NO: 37653 - DNA, 20 bp, Artificial Sequence
  chemically synthesized
gtgacacaccactattagtt

SEQ ID NO: 37654 - DNA, 20 bp, Artificial Sequence
  chemically synthesized
tgacacaccactattagttg

SEQ ID NO: 37655 - DNA, 20 bp, Artificial Sequence
  chemically synthesized
acacaccactattagttggg

SEQ ID NO: 37656 - DNA, 20 bp, Artificial Sequence
  chemically synthesized
actattagttggggagaatt

SEQ ID NO: 37657 - DNA, 20 bp, Artificial Sequence
  chemically synthesized
ggggagaattcagtttttcc

SEQ ID NO: 37658 - DNA, 20 bp, Artificial Sequence
  chemically synthesized
gggagaattcagtttttcca

SEQ ID NO: 37659 - DNA, 20 bp, Artificial Sequence
  chemically synthesized
cagtttttccaaggtgttga

SEQ ID NO: 37660 - DNA, 20 bp, Artificial Sequence
  chemically synthesized
agtttttccaaggtgttgat

SEQ ID NO: 37661 - DNA, 20 bp, Artificial Sequence
  chemically synthesized
ccaaggtgttgataggcatc

SEQ ID NO: 37662 - DNA, 20 bp, Artificial Sequence
  chemically synthesized
gttgataggcatccagattt

SEQ ID NO: 37663 - DNA, 20 bp, Artificial Sequence
  chemically synthesized
tgataggcatccagatttca

SEQ ID NO: 37664 - DNA, 20 bp, Artificial Sequence
  chemically synthesized
gataggcatccagatttcag

SEQ ID NO: 37665 - DNA, 20 bp, Artificial Sequence
  chemically synthesized
tttcagaggaaattgtaaaa

SEQ ID NO: 37666 - DNA, 20 bp, Artificial Sequence
  chemically synthesized
cagaggaaattgtaaaaaag

SEQ ID NO: 37667 - DNA, 20 bp, Artificial Sequence
  chemically synthesized
aattgtaaaaaagcagaacc

SEQ ID NO: 37668 - DNA, 20 bp, Artificial Sequence
  chemically synthesized
attgtaaaaaagcagaacct

SEQ ID NO: 37669 - DNA, 20 bp, Artificial Sequence
  chemically synthesized
actgcccacgatttttcttt

SEQ ID NO: 37670 - DNA, 20 bp, Artificial Sequence
  chemically synthesized
ttttctttgagatcaaatct

SEQ ID NO: 37671 - DNA, 20 bp, Artificial Sequence
  chemically synthesized
tttctttgagatcaaatctg

SEQ ID NO: 37672 - DNA, 20 bp, Artificial Sequence
  chemically synthesized
gaggcaacaaatctgttcaa

SEQ ID NO: 37673 - DNA, 20 bp, Artificial Sequence
  chemically synthesized
ttcaaaagctgctttctgcc

SEQ ID NO: 37674 - DNA, 20 bp, Artificial Sequence
  chemically synthesized
agctgctttctgcctggttg

SEQ ID NO: 37675 - DNA, 20 bp, Artificial Sequence
  chemically synthesized
ctttctgcctggttgtggca

SEQ ID NO: 37676 - DNA, 20 bp, Artificial Sequence
  chemically synthesized
tttctgcctggttgtggcaa

SEQ ID NO: 37677 - DNA, 20 bp, Artificial Sequence
  chemically synthesized
ttctgcctggttgtggcaaa

SEQ ID NO: 37678 - DNA, 20 bp, Artificial Sequence
  chemically synthesized
tgcctggttgtggcaaaggg

SEQ ID NO: 37679 - DNA, 20 bp, Artificial Sequence
  chemically synthesized
ggttgtggcaaagggtggcc

SEQ ID NO: 37680 - DNA, 20 bp, Artificial Sequence
  chemically synthesized
tgtggcaaagggtggccaag

SEQ ID NO: 37681 - DNA, 20 bp, Artificial Sequence
  chemically synthesized
gtggcaaagggtggccaagt

SEQ ID NO: 37682 - DNA, 20 bp, Artificial Sequence
  chemically synthesized
tggcaaagggtggccaagtg

SEQ ID NO: 37683 - DNA, 20 bp, Artificial Sequence
  chemically synthesized
aagggtggccaagtggggct

SEQ ID NO: 37684 - DNA, 20 bp, Artificial Sequence
  chemically synthesized
ctcagctgtgttcccattgc

SEQ ID NO: 37685 - DNA, 20 bp, Artificial Sequence
  chemically synthesized
tcagctgtgttcccattgca

SEQ ID NO: 37686 - DNA, 20 bp, Artificial Sequence
  chemically synthesized
gttcccattgcaaggctact

SEQ ID NO: 37687 - DNA, 20 bp, Artificial Sequence
  chemically synthesized
tactgagcatcccctgtcct

SEQ ID NO: 37688 - DNA, 20 bp, Artificial Sequence
  chemically synthesized
actgagcatcccctgtcctg

SEQ ID NO: 37689 - DNA, 20 bp, Artificial Sequence
  chemically synthesized
tcccctgtcctgaggctcct

SEQ ID NO: 37690 - DNA, 20 bp, Artificial Sequence
  chemically synthesized
cccctgtcctgaggctcctt

SEQ ID NO: 37691 - DNA, 20 bp, Artificial Sequence
  chemically synthesized
ctgaggctccttaggacacc

SEQ ID NO: 37692 - DNA, 20 bp, Artificial Sequence
  chemically synthesized
gctccttaggacacctggct

SEQ ID NO: 37693 - DNA, 20 bp, Artificial Sequence
  chemically synthesized
taggacacctggctgagctt

SEQ ID NO: 37694 - DNA, 20 bp, Artificial Sequence
  chemically synthesized
gacacctggctgagcttcag

SEQ ID NO: 37695 - DNA, 20 bp, Artificial Sequence
  chemically synthesized
agcttcagcagccctcttcc

SEQ ID NO: 37696 - DNA, 20 bp, Artificial Sequence
  chemically synthesized
cagcagccctcttccaagcc

SEQ ID NO: 37697 - DNA, 20 bp, Artificial Sequence
  chemically synthesized
gcagccctcttccaagcctg

SEQ ID NO: 37698 - DNA, 20 bp, Artificial Sequence
  chemically synthesized
tcttccaagcctggagatgc

SEQ ID NO: 37699 - DNA, 20 bp, Artificial Sequence
  chemically synthesized
ggagatgccagctccatctc

SEQ ID NO: 37700 - DNA, 20 bp, Artificial Sequence
  chemically synthesized
tccatctctggcacaaaatg

SEQ ID NO: 37701 - DNA, 20 bp, Artificial Sequence
  chemically synthesized
acaaaatgtagtgattttca

SEQ ID NO: 37702 - DNA, 20 bp, Artificial Sequence
  chemically synthesized
caaaatgtagtgattttcac

SEQ ID NO: 37703 - DNA, 20 bp, Artificial Sequence
  chemically synthesized
aaaatgtagtgattttcaca

SEQ ID NO: 37704 - DNA, 20 bp, Artificial Sequence
  chemically synthesized
tgtagtgattttcacagggt

SEQ ID NO: 37705 - DNA, 20 bp, Artificial Sequence
  chemically synthesized
tagtgattttcacagggtga

SEQ ID NO: 37706 - DNA, 20 bp, Artificial Sequence
  chemically synthesized
agtgattttcacagggtgag

SEQ ID NO: 37707 - DNA, 20 bp, Artificial Sequence
  chemically synthesized
ttcacagggtgagaggccaa

SEQ ID NO: 37708 - DNA, 20 bp, Artificial Sequence
  chemically synthesized
cacagggtgagaggccaaaa

SEQ ID NO: 37709 - DNA, 20 bp, Artificial Sequence
  chemically synthesized
acagggtgagaggccaaaag

SEQ ID NO: 37710 - DNA, 20 bp, Artificial Sequence
  chemically synthesized
caaaagaggctaataaaatg

SEQ ID NO: 37711 - DNA, 20 bp, Artificial Sequence
  chemically synthesized
agaggctaataaaatgaaga

SEQ ID NO: 37712 - DNA, 20 bp, Artificial Sequence
  chemically synthesized
ctaataaaatgaagatagcc

SEQ ID NO: 37713 - DNA, 20 bp, Artificial Sequence
  chemically synthesized
tgaagatagccaagcttcca

SEQ ID NO: 37714 - DNA, 20 bp, Artificial Sequence
  chemically synthesized
agccaagcttccatggaatt

SEQ ID NO: 37715 - DNA, 20 bp, Artificial Sequence
  chemically synthesized
gcttccatggaattaagcaa

SEQ ID NO: 37716 - DNA, 20 bp, Artificial Sequence
  chemically synthesized
cttccatggaattaagcaac

SEQ ID NO: 37717 - DNA, 20 bp, Artificial Sequence
  chemically synthesized
aggacaaccttgaccacttt

SEQ ID NO: 37718 - DNA, 20 bp, Artificial Sequence
  chemically synthesized
ggacaaccttgaccactttg

SEQ ID NO: 37719 - DNA, 20 bp, Artificial Sequence
  chemically synthesized
gacaaccttgaccactttga

SEQ ID NO: 37720 - DNA, 20 bp, Artificial Sequence
  chemically synthesized
acaaccttgaccactttgag

SEQ ID NO: 37721 - DNA, 20 bp, Artificial Sequence
  chemically synthesized
cttgaccactttgaggggtg

SEQ ID NO: 37722 - DNA, 20 bp, Artificial Sequence
  chemically synthesized
gaccactttgaggggtgtgg

SEQ ID NO: 37723 - DNA, 20 bp, Artificial Sequence
  chemically synthesized
accactttgaggggtgtggt

SEQ ID NO: 37724 - DNA, 20 bp, Artificial Sequence
  chemically synthesized
ccactttgaggggtgtggtg

SEQ ID NO: 37725 - DNA, 20 bp, Artificial Sequence
  chemically synthesized
cactttgaggggtgtggtgg

SEQ ID NO: 37726 - DNA, 20 bp, Artificial Sequence
  chemically synthesized
ggtgtggtgggggccacatg

SEQ ID NO: 37727 - DNA, 20 bp, Artificial Sequence
  chemically synthesized
tggtgggggccacatgcaga

SEQ ID NO: 37728 - DNA, 20 bp, Artificial Sequence
  chemically synthesized
gtgggggccacatgcagatg

SEQ ID NO: 37729 - DNA, 20 bp, Artificial Sequence
  chemically synthesized
ggggccacatgcagatggag

SEQ ID NO: 37730 - DNA, 20 bp, Artificial Sequence
  chemically synthesized
gggccacatgcagatggagt

SEQ ID NO: 37731 - DNA, 20 bp, Artificial Sequence
  chemically synthesized
catgcagatggagtgggtta

SEQ ID NO: 37732 - DNA, 20 bp, Artificial Sequence
  chemically synthesized
tgcagatggagtgggttaaa

SEQ ID NO: 37733 - DNA, 20 bp, Artificial Sequence
  chemically synthesized
ggagtgggttaaagagtgac

SEQ ID NO: 37734 - DNA, 20 bp, Artificial Sequence
  chemically synthesized
gtgggttaaagagtgactag

SEQ ID NO: 37735 - DNA, 20 bp, Artificial Sequence
  chemically synthesized
gggttaaagagtgactagaa

SEQ ID NO: 37736 - DNA, 20 bp, Artificial Sequence
  chemically synthesized
ttaaagagtgactagaagag

SEQ ID NO: 37737 - DNA, 20 bp, Artificial Sequence
  chemically synthesized
aagagtgactagaagagcag

SEQ ID NO: 37738 - DNA, 20 bp, Artificial Sequence
  chemically synthesized
agagtgactagaagagcagt

SEQ ID NO: 37739 - DNA, 20 bp, Artificial Sequence
  chemically synthesized
gagtgactagaagagcagtg

SEQ ID NO: 37740 - DNA, 20 bp, Artificial Sequence
  chemically synthesized
agtgactagaagagcagtgg

SEQ ID NO: 37741 - DNA, 20 bp, Artificial Sequence
  chemically synthesized
gactagaagagcagtggggg

SEQ ID NO: 37742 - DNA, 20 bp, Artificial Sequence
  chemically synthesized
tagaagagcagtgggggtgg

SEQ ID NO: 37743 - DNA, 20 bp, Artificial Sequence
  chemically synthesized
aagagcagtgggggtggcag

SEQ ID NO: 37744 - DNA, 20 bp, Artificial Sequence
  chemically synthesized
agagcagtgggggtggcagc

SEQ ID NO: 37745 - DNA, 20 bp, Artificial Sequence
  chemically synthesized
agcagtgggggtggcagcag

SEQ ID NO: 37746 - DNA, 20 bp, Artificial Sequence
  chemically synthesized
cagtgggggtggcagcagga

SEQ ID NO: 37747 - DNA, 20 bp, Artificial Sequence
  chemically synthesized
tgggggtggcagcaggagag

SEQ ID NO: 37748 - DNA, 20 bp, Artificial Sequence
  chemically synthesized
gtggcagcaggagagaagcc

SEQ ID NO: 37749 - DNA, 20 bp, Artificial Sequence
  chemically synthesized
ggagagaagcctggctctga

SEQ ID NO: 37750 - DNA, 20 bp, Artificial Sequence
  chemically synthesized
gagaagcctggctctgaaag

SEQ ID NO: 37751 - DNA, 20 bp, Artificial Sequence
  chemically synthesized
agcctggctctgaaagcagc

SEQ ID NO: 37752 - DNA, 20 bp, Artificial Sequence
  chemically synthesized
tctgaaagcagcgagacttc

SEQ ID NO: 37753 - DNA, 20 bp, Artificial Sequence
  chemically synthesized
ctgaaagcagcgagacttct

SEQ ID NO: 37754 - DNA, 20 bp, Artificial Sequence
  chemically synthesized
tgaaagcagcgagacttcta

SEQ ID NO: 37755 - DNA, 20 bp, Artificial Sequence
  chemically synthesized
agcgagacttctagggaata

SEQ ID NO: 37756 - DNA, 20 bp, Artificial Sequence
  chemically synthesized
gcgagacttctagggaatac

SEQ ID NO: 37757 - DNA, 20 bp, Artificial Sequence
  chemically synthesized
cgagacttctagggaataca

SEQ ID NO: 37758 - DNA, 20 bp, Artificial Sequence
  chemically synthesized
acttctagggaatacagggt

SEQ ID NO: 37759 - DNA, 20 bp, Artificial Sequence
  chemically synthesized
cttctagggaatacagggtc

SEQ ID NO: 37760 - DNA, 20 bp, Artificial Sequence
  chemically synthesized
ttctagggaatacagggtca

SEQ ID NO: 37761 - DNA, 20 bp, Artificial Sequence
  chemically synthesized
tctagggaatacagggtcag

SEQ ID NO: 37762 - DNA, 20 bp, Artificial Sequence
  chemically synthesized
tagggaatacagggtcaggg

SEQ ID NO: 37763 - DNA, 20 bp, Artificial Sequence
  chemically synthesized
agggaatacagggtcagggg

SEQ ID NO: 37764 - DNA, 20 bp, Artificial Sequence
  chemically synthesized
agggtcaggggaggttctga

SEQ ID NO: 37765 - DNA, 20 bp, Artificial Sequence
  chemically synthesized
ttctgaaagatgacacactg

SEQ ID NO: 37766 - DNA, 20 bp, Artificial Sequence
  chemically synthesized
ctgaaagatgacacactgca

SEQ ID NO: 37767 - DNA, 20 bp, Artificial Sequence
  chemically synthesized
tgtgtttgtatgccgatgac

SEQ ID NO: 37768 - DNA, 20 bp, Artificial Sequence
  chemically synthesized
gtatgccgatgacaagtatc

SEQ ID NO: 37769 - DNA, 20 bp, Artificial Sequence
  chemically synthesized
tgccgatgacaagtatccag

SEQ ID NO: 37770 - DNA, 20 bp, Artificial Sequence
  chemically synthesized
gatgacaagtatccagtaga

SEQ ID NO: 37771 - DNA, 20 bp, Artificial Sequence
  chemically synthesized
atgacaagtatccagtagaa

SEQ ID NO: 37772 - DNA, 20 bp, Artificial Sequence
  chemically synthesized
acaagtatccagtagaaagg

SEQ ID NO: 37773 - DNA, 20 bp, Artificial Sequence
  chemically synthesized
ccagtagaaaggcagatgaa

SEQ ID NO: 37774 - DNA, 20 bp, Artificial Sequence
  chemically synthesized
gatgaacagattctcattct

SEQ ID NO: 37775 - DNA, 20 bp, Artificial Sequence
  chemically synthesized
aacagattctcattctcaga

SEQ ID NO: 37776 - DNA, 20 bp, Artificial Sequence
  chemically synthesized
acagattctcattctcagaa

SEQ ID NO: 37777 - DNA, 20 bp, Artificial Sequence
  chemically synthesized
aaggcctgtcctgacctcct

SEQ ID NO: 37778 - DNA, 20 bp, Artificial Sequence
  chemically synthesized
ggcctgtcctgacctcctga

SEQ ID NO: 37779 - DNA, 20 bp, Artificial Sequence
  chemically synthesized
cctgacctcctgagagtaca

SEQ ID NO: 37780 - DNA, 20 bp, Artificial Sequence
  chemically synthesized
cctgagagtacacagaccat

SEQ ID NO: 37781 - DNA, 20 bp, Artificial Sequence
  chemically synthesized
ctgagagtacacagaccatg

SEQ ID NO: 37782 - DNA, 20 bp, Artificial Sequence
  chemically synthesized
tgagagtacacagaccatga

SEQ ID NO: 37783 - DNA, 20 bp, Artificial Sequence
  chemically synthesized
gagtacacagaccatgaggg

SEQ ID NO: 37784 - DNA, 20 bp, Artificial Sequence
  chemically synthesized
agtacacagaccatgagggc

SEQ ID NO: 37785 - DNA, 20 bp, Artificial Sequence
  chemically synthesized
gtacacagaccatgagggca

SEQ ID NO: 37786 - DNA, 20 bp, Artificial Sequence
  chemically synthesized
acagaccatgagggcagggc

SEQ ID NO: 37787 - DNA, 20 bp, Artificial Sequence
  chemically synthesized
cagaccatgagggcagggca

SEQ ID NO: 37788 - DNA, 20 bp, Artificial Sequence
  chemically synthesized
gaccatgagggcagggcaag

SEQ ID NO: 37789 - DNA, 20 bp, Artificial Sequence
  chemically synthesized
accatgagggcagggcaagg

SEQ ID NO: 37790 - DNA, 20 bp, Artificial Sequence
  chemically synthesized
catgagggcagggcaaggag

SEQ ID NO: 37791 - DNA, 20 bp, Artificial Sequence
  chemically synthesized
atgagggcagggcaaggagg

SEQ ID NO: 37792 - DNA, 20 bp, Artificial Sequence
  chemically synthesized
cacgctcactgtttcatgca

SEQ ID NO: 37793 - DNA, 20 bp, Artificial Sequence
  chemically synthesized
actgtttcatgcaaagtcct

SEQ ID NO: 37794 - DNA, 20 bp, Artificial Sequence
  chemically synthesized
tcatgcaaagtccttggcca

SEQ ID NO: 37795 - DNA, 20 bp, Artificial Sequence
  chemically synthesized
caatttaatatgctctatgc

SEQ ID NO: 37796 - DNA, 20 bp, Artificial Sequence
  chemically synthesized
tatgctctatgctggaaaac

SEQ ID NO: 37797 - DNA, 20 bp, Artificial Sequence
  chemically synthesized
tggaaaactggattattgaa

SEQ ID NO: 37798 - DNA, 20 bp, Artificial Sequence
  chemically synthesized
ggaaaactggattattgaac

SEQ ID NO: 37799 - DNA, 20 bp, Artificial Sequence
  chemically synthesized
ctggattattgaacaggcat

SEQ ID NO: 37800 - DNA, 20 bp, Artificial Sequence
  chemically synthesized
tctgaacctaatccactaaa

SEQ ID NO: 37801 - DNA, 20 bp, Artificial Sequence
  chemically synthesized
atccactaaaaagcacttga

SEQ ID NO: 37802 - DNA, 20 bp, Artificial Sequence
  chemically synthesized
agatatatcaaaatatcatt

SEQ ID NO: 37803 - DNA, 20 bp, Artificial Sequence
  chemically synthesized
atcaaaatatcattgagaaa

SEQ ID NO: 37804 - DNA, 20 bp, Artificial Sequence
  chemically synthesized
tcattgagaaatagatattt

SEQ ID NO: 37805 - DNA, 20 bp, Artificial Sequence
  chemically synthesized
cattgagaaatagatatttt

SEQ ID NO: 37806 - DNA, 20 bp, Artificial Sequence
  chemically synthesized
ctcatttgaactctcttttc

SEQ ID NO: 37807 - DNA, 20 bp, Artificial Sequence
  chemically synthesized
tcatttgaactctcttttcc

SEQ ID NO: 37808 - DNA, 20 bp, Artificial Sequence
  chemically synthesized
tttgaactctcttttccagg

SEQ ID NO: 37809 - DNA, 20 bp, Artificial Sequence
  chemically synthesized
tgaactctcttttccaggaa

SEQ ID NO: 37810 - DNA, 20 bp, Artificial Sequence
  chemically synthesized
tttccaggaagagttgtgct

SEQ ID NO: 37811 - DNA, 20 bp, Artificial Sequence
  chemically synthesized
ttccaggaagagttgtgctt

SEQ ID NO: 37812 - DNA, 20 bp, Artificial Sequence
  chemically synthesized
ttgtgcttgggtaaattcta

SEQ ID NO: 37813 - DNA, 20 bp, Artificial Sequence
  chemically synthesized
tgggtaaattctatagctca

SEQ ID NO: 37814 - DNA, 20 bp, Artificial Sequence
  chemically synthesized
aaaacacacaataaattaat

SEQ ID NO: 37815 - DNA, 20 bp, Artificial Sequence
  chemically synthesized
aaacacacaataaattaata

SEQ ID NO: 37816 - DNA, 20 bp, Artificial Sequence
  chemically synthesized
aattaataaggtgcttccta

SEQ ID NO: 37817 - DNA, 20 bp, Artificial Sequence
  chemically synthesized
aataaggtgcttcctacagt

SEQ ID NO: 37818 - DNA, 20 bp, Artificial Sequence
  chemically synthesized
ggtgcttcctacagtgagtt

SEQ ID NO: 37819 - DNA, 20 bp, Artificial Sequence
  chemically synthesized
gagttcagttaaacattttg

SEQ ID NO: 37820 - DNA, 20 bp, Artificial Sequence
  chemically synthesized
gttcagttaaacattttgaa

SEQ ID NO: 37821 - DNA, 20 bp, Artificial Sequence
  chemically synthesized
tgaagagtgtttttgaaatg

SEQ ID NO: 37822 - DNA, 20 bp, Artificial Sequence
  chemically synthesized
agagtgtttttgaaatgtag

SEQ ID NO: 37823 - DNA, 20 bp, Artificial Sequence
  chemically synthesized
agtgtttttgaaatgtagca

SEQ ID NO: 37824 - DNA, 20 bp, Artificial Sequence
  chemically synthesized
gtttttgaaatgtagcagag

SEQ ID NO: 37825 - DNA, 20 bp, Artificial Sequence
  chemically synthesized
tttttgaaatgtagcagagc

SEQ ID NO: 37826 - DNA, 20 bp, Artificial Sequence
  chemically synthesized
ggctacaattgatattcaaa

SEQ ID NO: 37827 - DNA, 20 bp, Artificial Sequence
  chemically synthesized
ctacaattgatattcaaaaa

SEQ ID NO: 37828 - DNA, 20 bp, Artificial Sequence
  chemically synthesized
tacaattgatattcaaaaag

SEQ ID NO: 37829 - DNA, 20 bp, Artificial Sequence
  chemically synthesized
atttatttccccctttaact

SEQ ID NO: 37830 - DNA, 20 bp, Artificial Sequence
  chemically synthesized
tgtcattttattatgcttca

SEQ ID NO: 37831 - DNA, 20 bp, Artificial Sequence
  chemically synthesized
tcattttattatgcttcata

SEQ ID NO: 37832 - DNA, 20 bp, Artificial Sequence
  chemically synthesized
cttcatagagcatcactgct

SEQ ID NO: 37833 - DNA, 20 bp, Artificial Sequence
  chemically synthesized
cactgctgagatcccctccc

SEQ ID NO: 37834 - DNA, 20 bp, Artificial Sequence
  chemically synthesized
ccctccccagctcatgttgc

SEQ ID NO: 37835 - DNA, 20 bp, Artificial Sequence
  chemically synthesized
cctccccagctcatgttgct

SEQ ID NO: 37836 - DNA, 20 bp, Artificial Sequence
  chemically synthesized
tgctaggaaatatcccaaaa

SEQ ID NO: 37837 - DNA, 20 bp, Artificial Sequence
  chemically synthesized
ttgtttctctgattcacctc

SEQ ID NO: 37838 - DNA, 20 bp, Artificial Sequence
  chemically synthesized
tgtttctctgattcacctcc

SEQ ID NO: 37839 - DNA, 20 bp, Artificial Sequence
  chemically synthesized
gtttctctgattcacctcca

SEQ ID NO: 37840 - DNA, 20 bp, Artificial Sequence
  chemically synthesized
attcacctccagggctcata

SEQ ID NO: 37841 - DNA, 20 bp, Artificial Sequence
  chemically synthesized
ctccagggctcatatggcaa

SEQ ID NO: 37842 - DNA, 20 bp, Artificial Sequence
  chemically synthesized
tccagggctcatatggcaat

SEQ ID NO: 37843 - DNA, 20 bp, Artificial Sequence
  chemically synthesized
ccagggctcatatggcaatg

SEQ ID NO: 37844 - DNA, 20 bp, Artificial Sequence
  chemically synthesized
atatggcaatggggatttaa

SEQ ID NO: 37845 - DNA, 20 bp, Artificial Sequence
  chemically synthesized
tatggcaatggggatttaat

SEQ ID NO: 37846 - DNA, 20 bp, Artificial Sequence
  chemically synthesized
atggcaatggggatttaata

SEQ ID NO: 37847 - DNA, 20 bp, Artificial Sequence
  chemically synthesized
atttaatagggtttatttgt

SEQ ID NO: 37848 - DNA, 20 bp, Artificial Sequence
  chemically synthesized
atagggtttatttgttggtg

SEQ ID NO: 37849 - DNA, 20 bp, Artificial Sequence
  chemically synthesized
acattaaacaaatcttttaa

SEQ ID NO: 37850 - DNA, 20 bp, Artificial Sequence
  chemically synthesized
cattaaacaaatcttttaat

SEQ ID NO: 37851 - DNA, 20 bp, Artificial Sequence
  chemically synthesized
ggaaaaatacttttatatta

SEQ ID NO: 37852 - DNA, 20 bp, Artificial Sequence
  chemically synthesized
gaaaaatacttttatattat

SEQ ID NO: 37853 - DNA, 20 bp, Artificial Sequence
  chemically synthesized
tttatattataggcaaaatg

SEQ ID NO: 37854 - DNA, 20 bp, Artificial Sequence
  chemically synthesized
gtagatgtatattgctactg

SEQ ID NO: 37855 - DNA, 20 bp, Artificial Sequence
  chemically synthesized
aagtaaatgtattttattaa

SEQ ID NO: 37856 - DNA, 20 bp, Artificial Sequence
  chemically synthesized
atgtattttattaatggtgt

SEQ ID NO: 37857 - DNA, 20 bp, Artificial Sequence
  chemically synthesized
tgagaatttcttcctcactg

SEQ ID NO: 37858 - DNA, 20 bp, Artificial Sequence
  chemically synthesized
atgcatatttgcatgtgtaa

SEQ ID NO: 37859 - DNA, 20 bp, Artificial Sequence
  chemically synthesized
atttgcatgtgtaaaagact

SEQ ID NO: 37860 - DNA, 20 bp, Artificial Sequence
  chemically synthesized
aagacttagcaatttgtgaa

SEQ ID NO: 37861 - DNA, 20 bp, Artificial Sequence
  chemically synthesized
acttagcaatttgtgaatag

SEQ ID NO: 37862 - DNA, 20 bp, Artificial Sequence
  chemically synthesized
atgtttctccgcttctcact

SEQ ID NO: 37863 - DNA, 20 bp, Artificial Sequence
  chemically synthesized
tctccgcttctcactgagca

SEQ ID NO: 37864 - DNA, 20 bp, Artificial Sequence
  chemically synthesized
ctcactgagcatggctgtaa

SEQ ID NO: 37865 - DNA, 20 bp, Artificial Sequence
  chemically synthesized
aagaaactttttcctctccc

SEQ ID NO: 37866 - DNA, 20 bp, Artificial Sequence
  chemically synthesized
agaaactttttcctctcccc

SEQ ID NO: 37867 - DNA, 20 bp, Artificial Sequence
  chemically synthesized
tttcctctccccgggcattc

SEQ ID NO: 37868 - DNA, 20 bp, Artificial Sequence
  chemically synthesized
ccgggcattccagcacacat

SEQ ID NO: 37869 - DNA, 20 bp, Artificial Sequence
  chemically synthesized
gcattccagcacacattgga

SEQ ID NO: 37870 - DNA, 20 bp, Artificial Sequence
  chemically synthesized
ttggaaagataacacgtcca

SEQ ID NO: 37871 - DNA, 20 bp, Artificial Sequence
  chemically synthesized
aaagataacacgtccacaga

SEQ ID NO: 37872 - DNA, 20 bp, Artificial Sequence
  chemically synthesized
taacacgtccacagaaagcc

SEQ ID NO: 37873 - DNA, 20 bp, Artificial Sequence
  chemically synthesized
cagaaagcctggctttccaa

SEQ ID NO: 37874 - DNA, 20 bp, Artificial Sequence
  chemically synthesized
gaaagcctggctttccaaaa

SEQ ID NO: 37875 - DNA, 20 bp, Artificial Sequence
  chemically synthesized
ggctttccaaaagagcttat

SEQ ID NO: 37876 - DNA, 20 bp, Artificial Sequence
  chemically synthesized
ctttccaaaagagcttatca

SEQ ID NO: 37877 - DNA, 20 bp, Artificial Sequence
  chemically synthesized
ttatcagagaatgtgccccc

SEQ ID NO: 37878 - DNA, 20 bp, Artificial Sequence
  chemically synthesized
tatcagagaatgtgcccccc

SEQ ID NO: 37879 - DNA, 20 bp, Artificial Sequence
  chemically synthesized
taaaacatatgttaatcctg

SEQ ID NO: 37880 - DNA, 20 bp, Artificial Sequence
  chemically synthesized
aacatatgttaatcctgtgg

SEQ ID NO: 37881 - DNA, 20 bp, Artificial Sequence
  chemically synthesized
catatgttaatcctgtggca

SEQ ID NO: 37882 - DNA, 20 bp, Artificial Sequence
  chemically synthesized
atgttaatcctgtggcagag

SEQ ID NO: 37883 - DNA, 20 bp, Artificial Sequence
  chemically synthesized
tgtggcagagaagtttgttc

SEQ ID NO: 37884 - DNA, 20 bp, Artificial Sequence
  chemically synthesized
gagaagtttgttctagcctt

SEQ ID NO: 37885 - DNA, 20 bp, Artificial Sequence
  chemically synthesized
agaagtttgttctagccttt

SEQ ID NO: 37886 - DNA, 20 bp, Artificial Sequence
  chemically synthesized
tttgttctagcctttgggtg

SEQ ID NO: 37887 - DNA, 20 bp, Artificial Sequence
  chemically synthesized
ttgggtgtagcctgctgaat

SEQ ID NO: 37888 - DNA, 20 bp, Artificial Sequence
  chemically synthesized
tagcctgctgaataagttca

SEQ ID NO: 37889 - DNA, 20 bp, Artificial Sequence
  chemically synthesized
gttcacagtgatctacatcc

SEQ ID NO: 37890 - DNA, 20 bp, Artificial Sequence
  chemically synthesized
gatctacatcctagtttcca

SEQ ID NO: 37891 - DNA, 20 bp, Artificial Sequence
  chemically synthesized
atctacatcctagtttccat

SEQ ID NO: 37892 - DNA, 20 bp, Artificial Sequence
  chemically synthesized
ctagtttccatgggctgaaa

SEQ ID NO: 37893 - DNA, 20 bp, Artificial Sequence
  chemically synthesized
ccctgcactccctacacaca

SEQ ID NO: 37894 - DNA, 20 bp, Artificial Sequence
  chemically synthesized
actccctacacacacagaca

SEQ ID NO: 37895 - DNA, 20 bp, Artificial Sequence
  chemically synthesized
ttctttgatattttcttgaa

SEQ ID NO: 37896 - DNA, 20 bp, Artificial Sequence
  chemically synthesized
ttcaaatgtgtttgacttta

SEQ ID NO: 37897 - DNA, 20 bp, Artificial Sequence
  chemically synthesized
tcaacttgtaaaattttatc

SEQ ID NO: 37898 - DNA, 20 bp, Artificial Sequence
  chemically synthesized
aaattttatctggtaattta

SEQ ID NO: 37899 - DNA, 20 bp, Artificial Sequence
  chemically synthesized
taatttatagattaaattgc

SEQ ID NO: 37900 - DNA, 20 bp, Artificial Sequence
  chemically synthesized
agcatctacctccctttcat

SEQ ID NO: 37901 - DNA, 20 bp, Artificial Sequence
  chemically synthesized
ctttcatcagactctccctg

SEQ ID NO: 37902 - DNA, 20 bp, Artificial Sequence
  chemically synthesized
tttcatcagactctccctgc

SEQ ID NO: 37903 - DNA, 20 bp, Artificial Sequence
  chemically synthesized
ttcatcagactctccctgca

SEQ ID NO: 37904 - DNA, 20 bp, Artificial Sequence
  chemically synthesized
tcagactctccctgcagggc

SEQ ID NO: 37905 - DNA, 20 bp, Artificial Sequence
  chemically synthesized
tctaactatgtatgtgcttc

SEQ ID NO: 37906 - DNA, 20 bp, Artificial Sequence
  chemically synthesized
actatgtatgtgcttcaaga

SEQ ID NO: 37907 - DNA, 20 bp, Artificial Sequence
  chemically synthesized
tgcttcaagatggaactcct

SEQ ID NO: 37908 - DNA, 20 bp, Artificial Sequence
  chemically synthesized
agatggaactcctgagttca

SEQ ID NO: 37909 - DNA, 20 bp, Artificial Sequence
  chemically synthesized
gatggaactcctgagttcac

SEQ ID NO: 37910 - DNA, 20 bp, Artificial Sequence
  chemically synthesized
cacaggtgatttataaacca

SEQ ID NO: 37911 - DNA, 20 bp, Artificial Sequence
  chemically synthesized
actacaaaactctcaccctc

SEQ ID NO: 37912 - DNA, 20 bp, Artificial Sequence
  chemically synthesized
tacaaaactctcaccctcca

SEQ ID NO: 37913 - DNA, 20 bp, Artificial Sequence
  chemically synthesized
accctccagagatttgcctc

SEQ ID NO: 37914 - DNA, 20 bp, Artificial Sequence
  chemically synthesized
ccctccagagatttgcctca

SEQ ID NO: 37915 - DNA, 20 bp, Artificial Sequence
  chemically synthesized
cctccagagatttgcctcaa

SEQ ID NO: 37916 - DNA, 20 bp, Artificial Sequence
  chemically synthesized
gggacaacaccctgctcaca

SEQ ID NO: 37917 - DNA, 20 bp, Artificial Sequence
  chemically synthesized
ggacaacaccctgctcacaa

SEQ ID NO: 37918 - DNA, 20 bp, Artificial Sequence
  chemically synthesized
caccctgctcacaaaggcac

SEQ ID NO: 37919 - DNA, 20 bp, Artificial Sequence
  chemically synthesized
cctgctcacaaaggcaccag

SEQ ID NO: 37920 - DNA, 20 bp, Artificial Sequence
  chemically synthesized
ctgctcacaaaggcaccagc

SEQ ID NO: 37921 - DNA, 20 bp, Artificial Sequence
  chemically synthesized
caggcaactgctcaactacc

SEQ ID NO: 37922 - DNA, 20 bp, Artificial Sequence
  chemically synthesized
gcaactgctcaactacctgg

SEQ ID NO: 37923 - DNA, 20 bp, Artificial Sequence
  chemically synthesized
tgctcaactacctggtggat

SEQ ID NO: 37924 - DNA, 20 bp, Artificial Sequence
  chemically synthesized
gctcaactacctggtggata

SEQ ID NO: 37925 - DNA, 20 bp, Artificial Sequence
  chemically synthesized
acctggtggataaggtgccc

SEQ ID NO: 37926 - DNA, 20 bp, Artificial Sequence
  chemically synthesized
ggtggataaggtgcccaagc

SEQ ID NO: 37927 - DNA, 20 bp, Artificial Sequence
  chemically synthesized
ataaggtgcccaagctagca

SEQ ID NO: 37928 - DNA, 20 bp, Artificial Sequence
  chemically synthesized
cctcctctgttgccttttaa

SEQ ID NO: 37929 - DNA, 20 bp, Artificial Sequence
  chemically synthesized
agtgccactttctgctccta

SEQ ID NO: 37930 - DNA, 20 bp, Artificial Sequence
  chemically synthesized
cactttctgctcctaaagtg

SEQ ID NO: 37931 - DNA, 20 bp, Artificial Sequence
  chemically synthesized
tttctgctcctaaagtgaag

SEQ ID NO: 37932 - DNA, 20 bp, Artificial Sequence
  chemically synthesized
gctcctaaagtgaagtagta

SEQ ID NO: 37933 - DNA, 20 bp, Artificial Sequence
  chemically synthesized
cctaaagtgaagtagtacgg

SEQ ID NO: 37934 - DNA, 20 bp, Artificial Sequence
  chemically synthesized
ctaaagtgaagtagtacggc

SEQ ID NO: 37935 - DNA, 20 bp, Artificial Sequence
  chemically synthesized
actgctgcatttcttcccct

SEQ ID NO: 37936 - DNA, 20 bp, Artificial Sequence
  chemically synthesized
ctgcatttcttcccctaagc

SEQ ID NO: 37937 - DNA, 20 bp, Artificial Sequence
  chemically synthesized
ttcttcccctaagctagctt

SEQ ID NO: 37938 - DNA, 20 bp, Artificial Sequence
  chemically synthesized
ttcccctaagctagctttgg

SEQ ID NO: 37939 - DNA, 20 bp, Artificial Sequence
  chemically synthesized
gcaaatcactttctttatac

SEQ ID NO: 37940 - DNA, 20 bp, Artificial Sequence
  chemically synthesized
cagacttctctcttcttaat

SEQ ID NO: 37941 - DNA, 20 bp, Artificial Sequence
  chemically synthesized
tcttcttaattggattctgc

SEQ ID NO: 37942 - DNA, 20 bp, Artificial Sequence
  chemically synthesized
tcttaattggattctgcaag

SEQ ID NO: 37943 - DNA, 20 bp, Artificial Sequence
  chemically synthesized
caaacaattaacctgctctt

SEQ ID NO: 37944 - DNA, 20 bp, Artificial Sequence
  chemically synthesized
aacctgctcttcagttacat

SEQ ID NO: 37945 - DNA, 20 bp, Artificial Sequence
  chemically synthesized
cagttacattggaatgtgtt

SEQ ID NO: 37946 - DNA, 20 bp, Artificial Sequence
  chemically synthesized
agatttattttttcaaatgt

SEQ ID NO: 37947 - DNA, 20 bp, Artificial Sequence
  chemically synthesized
ttttttcaaatgttggaaca

SEQ ID NO: 37948 - DNA, 20 bp, Artificial Sequence
  chemically synthesized
atgttggaacaaagatgaaa

SEQ ID NO: 37949 - DNA, 20 bp, Artificial Sequence
  chemically synthesized
tggaacaaagatgaaaaagt

SEQ ID NO: 37950 - DNA, 20 bp, Artificial Sequence
  chemically synthesized
aacaaagatgaaaaagtgag

SEQ ID NO: 37951 - DNA, 20 bp, Artificial Sequence
  chemically synthesized
caaagatgaaaaagtgagaa

SEQ ID NO: 37952 - DNA, 20 bp, Artificial Sequence
  chemically synthesized
tgaaaaagtgagaagagccc

SEQ ID NO: 37953 - DNA, 20 bp, Artificial Sequence
  chemically synthesized
aagagccctagattttttct

SEQ ID NO: 37954 - DNA, 20 bp, Artificial Sequence
  chemically synthesized
tagattttttcttggaaatc

SEQ ID NO: 37955 - DNA, 20 bp, Artificial Sequence
  chemically synthesized
ttggaaatctggcttaaatc

SEQ ID NO: 37956 - DNA, 20 bp, Artificial Sequence
  chemically synthesized
tggaaatctggcttaaatcc

SEQ ID NO: 37957 - DNA, 20 bp, Artificial Sequence
  chemically synthesized
gtttctttatttccttgatt

SEQ ID NO: 37958 - DNA, 20 bp, Artificial Sequence
  chemically synthesized
tttctttatttccttgattt

SEQ ID NO: 37959 - DNA, 20 bp, Artificial Sequence
  chemically synthesized
atttccttgatttgggaatt

SEQ ID NO: 37960 - DNA, 20 bp, Artificial Sequence
  chemically synthesized
tgatttgggaatttggtcac

SEQ ID NO: 37961 - DNA, 20 bp, Artificial Sequence
  chemically synthesized
acaaataacatgattttcct

SEQ ID NO: 37962 - DNA, 20 bp, Artificial Sequence
  chemically synthesized
taacatgattttcctaagtc

SEQ ID NO: 37963 - DNA, 20 bp, Artificial Sequence
  chemically synthesized
agatttctttgtttataaaa

SEQ ID NO: 37964 - DNA, 20 bp, Artificial Sequence
  chemically synthesized
gatttctttgtttataaaat

SEQ ID NO: 37965 - DNA, 20 bp, Artificial Sequence
  chemically synthesized
atttctttgtttataaaatg

SEQ ID NO: 37966 - DNA, 20 bp, Artificial Sequence
  chemically synthesized
tgctaccctacctataccat

SEQ ID NO: 37967 - DNA, 20 bp, Artificial Sequence
  chemically synthesized
acctataccatgagctaaat

SEQ ID NO: 37968 - DNA, 20 bp, Artificial Sequence
  chemically synthesized
ataccatgagctaaataagc

SEQ ID NO: 37969 - DNA, 20 bp, Artificial Sequence
  chemically synthesized
taaataagctagtatttgta

SEQ ID NO: 37970 - DNA, 20 bp, Artificial Sequence
  chemically synthesized
aaataagctagtatttgtaa

SEQ ID NO: 37971 - DNA, 20 bp, Artificial Sequence
  chemically synthesized
cttacattcacaatcacaca

SEQ ID NO: 37972 - DNA, 20 bp, Artificial Sequence
  chemically synthesized
tgtatgtatgtataaaaatg

SEQ ID NO: 37973 - DNA, 20 bp, Artificial Sequence
  chemically synthesized
gtatgtatgtataaaaatgt

SEQ ID NO: 37974 - DNA, 20 bp, Artificial Sequence
  chemically synthesized
tatgtatgtataaaaatgtg

SEQ ID NO: 37975 - DNA, 20 bp, Artificial Sequence
  chemically synthesized
acccactcaacaaataccct

SEQ ID NO: 37976 - DNA, 20 bp, Artificial Sequence
  chemically synthesized
cattatatgcgtatatcatc

SEQ ID NO: 37977 - DNA, 20 bp, Artificial Sequence
  chemically synthesized
tgcgtatatcatctggcaaa

SEQ ID NO: 37978 - DNA, 20 bp, Artificial Sequence
  chemically synthesized
atggatgtgtataatttctc

SEQ ID NO: 37979 - DNA, 20 bp, Artificial Sequence
  chemically synthesized
tggatgtgtataatttctcc

SEQ ID NO: 37980 - DNA, 20 bp, Artificial Sequence
  chemically synthesized
ggatgtgtataatttctcca

SEQ ID NO: 37981 - DNA, 20 bp, Artificial Sequence
  chemically synthesized
tgtataatttctccagggat

SEQ ID NO: 37982 - DNA, 20 bp, Artificial Sequence
  chemically synthesized
ataatttctccagggataag

SEQ ID NO: 37983 - DNA, 20 bp, Artificial Sequence
  chemically synthesized
aagaagcaaatgtataccga

SEQ ID NO: 37984 - DNA, 20 bp, Artificial Sequence
  chemically synthesized
agcaaatgtataccgatgga

SEQ ID NO: 37985 - DNA, 20 bp, Artificial Sequence
  chemically synthesized
taccgatggaaagccttact

SEQ ID NO: 37986 - DNA, 20 bp, Artificial Sequence
  chemically synthesized
accgatggaaagccttactc

SEQ ID NO: 37987 - DNA, 20 bp, Artificial Sequence
  chemically synthesized
gccttactcaggccataaca

SEQ ID NO: 37988 - DNA, 20 bp, Artificial Sequence
  chemically synthesized
cttactcaggccataacaaa

SEQ ID NO: 37989 - DNA, 20 bp, Artificial Sequence
  chemically synthesized
tactcaggccataacaaaga

SEQ ID NO: 37990 - DNA, 20 bp, Artificial Sequence
  chemically synthesized
ataacaaagagagaaatgct

SEQ ID NO: 37991 - DNA, 20 bp, Artificial Sequence
  chemically synthesized
gctgagtcccactccatgaa

SEQ ID NO: 37992 - DNA, 20 bp, Artificial Sequence
  chemically synthesized
ctgagtcccactccatgaac

SEQ ID NO: 37993 - DNA, 20 bp, Artificial Sequence
  chemically synthesized
tcccactccatgaacaggtc

SEQ ID NO: 37994 - DNA, 20 bp, Artificial Sequence
  chemically synthesized
cccactccatgaacaggtca

SEQ ID NO: 37995 - DNA, 20 bp, Artificial Sequence
  chemically synthesized
caaggaaccaaacatattca

SEQ ID NO: 37996 - DNA, 20 bp, Artificial Sequence
  chemically synthesized
aggaaccaaacatattcaaa

SEQ ID NO: 37997 - DNA, 20 bp, Artificial Sequence
  chemically synthesized
atttcattgtttcaacttgc

SEQ ID NO: 37998 - DNA, 20 bp, Artificial Sequence
  chemically synthesized
cattgtttcaacttgctagt

SEQ ID NO: 37999 - DNA, 20 bp, Artificial Sequence
  chemically synthesized
attgtttcaacttgctagtg

SEQ ID NO: 38000 - DNA, 20 bp, Artificial Sequence
  chemically synthesized
ttgtttcaacttgctagtga

SEQ ID NO: 38001 - DNA, 20 bp, Artificial Sequence
  chemically synthesized
tgtttcaacttgctagtgag

SEQ ID NO: 38002 - DNA, 20 bp, Artificial Sequence
  chemically synthesized
tttcaacttgctagtgaggg

SEQ ID NO: 38003 - DNA, 20 bp, Artificial Sequence
  chemically synthesized
acttgctagtgaggggagca

SEQ ID NO: 38004 - DNA, 20 bp, Artificial Sequence
  chemically synthesized
aggggagcatggcacctgaa

SEQ ID NO: 38005 - DNA, 20 bp, Artificial Sequence
  chemically synthesized
gggagcatggcacctgaaca

SEQ ID NO: 38006 - DNA, 20 bp, Artificial Sequence
  chemically synthesized
tgatataaattaatgaaact

SEQ ID NO: 38007 - DNA, 20 bp, Artificial Sequence
  chemically synthesized
aattaatgaaactgagaacc

SEQ ID NO: 38008 - DNA, 20 bp, Artificial Sequence
  chemically synthesized
atgaaactgagaaccaagcg

SEQ ID NO: 38009 - DNA, 20 bp, Artificial Sequence
  chemically synthesized
gaaactgagaaccaagcgaa

SEQ ID NO: 38010 - DNA, 20 bp, Artificial Sequence
  chemically synthesized
tgagaaccaagcgaagagct

SEQ ID NO: 38011 - DNA, 20 bp, Artificial Sequence
  chemically synthesized
gagcttagccatcctttgca

SEQ ID NO: 38012 - DNA, 20 bp, Artificial Sequence
  chemically synthesized
ttagccatcctttgcatagt

SEQ ID NO: 38013 - DNA, 20 bp, Artificial Sequence
  chemically synthesized
ctttgcatagttagctacaa

SEQ ID NO: 38014 - DNA, 20 bp, Artificial Sequence
  chemically synthesized
tacaatggctatttattttt

SEQ ID NO: 38015 - DNA, 20 bp, Artificial Sequence
  chemically synthesized
atggctatttatttttcagc

SEQ ID NO: 38016 - DNA, 20 bp, Artificial Sequence
  chemically synthesized
tatttatttttcagccagac

SEQ ID NO: 38017 - DNA, 20 bp, Artificial Sequence
  chemically synthesized
cagccagactggccatcatg

SEQ ID NO: 38018 - DNA, 20 bp, Artificial Sequence
  chemically synthesized
agccagactggccatcatgt

SEQ ID NO: 38019 - DNA, 20 bp, Artificial Sequence
  chemically synthesized
atcatgtaggcacactcttt

SEQ ID NO: 38020 - DNA, 20 bp, Artificial Sequence
  chemically synthesized
gtaggcacactcttttagat

SEQ ID NO: 38021 - DNA, 20 bp, Artificial Sequence
  chemically synthesized
ttttttctgcccattcattc

SEQ ID NO: 38022 - DNA, 20 bp, Artificial Sequence
  chemically synthesized
cattcattccagcaccgtga

SEQ ID NO: 38023 - DNA, 20 bp, Artificial Sequence
  chemically synthesized
cagcaccgtgacagtcttca

SEQ ID NO: 38024 - DNA, 20 bp, Artificial Sequence
  chemically synthesized
agcaccgtgacagtcttcac

SEQ ID NO: 38025 - DNA, 20 bp, Artificial Sequence
  chemically synthesized
gcaccgtgacagtcttcacg

SEQ ID NO: 38026 - DNA, 20 bp, Artificial Sequence
  chemically synthesized
gaaattaaacttattttttt

SEQ ID NO: 38027 - DNA, 20 bp, Artificial Sequence
  chemically synthesized
agaatttttcaatcatatac

SEQ ID NO: 38028 - DNA, 20 bp, Artificial Sequence
  chemically synthesized
tcatatacaagattttgaac

SEQ ID NO: 38029 - DNA, 20 bp, Artificial Sequence
  chemically synthesized
catatacaagattttgaact

SEQ ID NO: 38030 - DNA, 20 bp, Artificial Sequence
  chemically synthesized
aattaaatgaattgcacata

SEQ ID NO: 38031 - DNA, 20 bp, Artificial Sequence
  chemically synthesized
atgaattgcacataaagcca

SEQ ID NO: 38032 - DNA, 20 bp, Artificial Sequence
  chemically synthesized
tatgtatttttactacattg

SEQ ID NO: 38033 - DNA, 20 bp, Artificial Sequence
  chemically synthesized
atgtatttttactacattgt

SEQ ID NO: 38034 - DNA, 20 bp, Artificial Sequence
  chemically synthesized
gtatttttactacattgtgg

SEQ ID NO: 38035 - DNA, 20 bp, Artificial Sequence
  chemically synthesized
aactatgtcttacctgattt

SEQ ID NO: 38036 - DNA, 20 bp, Artificial Sequence
  chemically synthesized
ttacctgatttcagaaataa

SEQ ID NO: 38037 - DNA, 20 bp, Artificial Sequence
  chemically synthesized
cctgatttcagaaataaaag

SEQ ID NO: 38038 - DNA, 20 bp, Artificial Sequence
  chemically synthesized
gatttcagaaataaaagaag

SEQ ID NO: 38039 - DNA, 20 bp, Artificial Sequence
  chemically synthesized
ttcagaaataaaagaagtag

SEQ ID NO: 38040 - DNA, 20 bp, Artificial Sequence
  chemically synthesized
cacttccttatgttccattt

SEQ ID NO: 38041 - DNA, 20 bp, Artificial Sequence
  chemically synthesized
acttccttatgttccatttt

SEQ ID NO: 38042 - DNA, 20 bp, Artificial Sequence
  chemically synthesized
cttatgttccattttgggac

SEQ ID NO: 38043 - DNA, 20 bp, Artificial Sequence
  chemically synthesized
tgttccattttgggactggc

SEQ ID NO: 38044 - DNA, 20 bp, Artificial Sequence
  chemically synthesized
tccattttgggactggccag

SEQ ID NO: 38045 - DNA, 20 bp, Artificial Sequence
  chemically synthesized
tgggactggccagcagtgcc

SEQ ID NO: 38046 - DNA, 20 bp, Artificial Sequence
  chemically synthesized
actggccagcagtgcccaga

SEQ ID NO: 38047 - DNA, 20 bp, Artificial Sequence
  chemically synthesized
cagaaagtgtgtcccaatcc

SEQ ID NO: 38048 - DNA, 20 bp, Artificial Sequence
  chemically synthesized
agaaagtgtgtcccaatccc

SEQ ID NO: 38049 - DNA, 20 bp, Artificial Sequence
  chemically synthesized
aggacattgttgacttacat

SEQ ID NO: 38050 - DNA, 20 bp, Artificial Sequence
  chemically synthesized
gacattgttgacttacatga

SEQ ID NO: 38051 - DNA, 20 bp, Artificial Sequence
  chemically synthesized
gagtaaacgcacccacaaac

SEQ ID NO: 38052 - DNA, 20 bp, Artificial Sequence
  chemically synthesized
aaacgcacccacaaaccaga

SEQ ID NO: 38053 - DNA, 20 bp, Artificial Sequence
  chemically synthesized
acaaaccagatagtcaaatt

SEQ ID NO: 38054 - DNA, 20 bp, Artificial Sequence
  chemically synthesized
aattaagttaatgattctct

SEQ ID NO: 38055 - DNA, 20 bp, Artificial Sequence
  chemically synthesized
ttaagttaatgattctctca

SEQ ID NO: 38056 - DNA, 20 bp, Artificial Sequence
  chemically synthesized
ctctcagagacccatgccac

SEQ ID NO: 38057 - DNA, 20 bp, Artificial Sequence
  chemically synthesized
agagacccatgccactggct

SEQ ID NO: 38058 - DNA, 20 bp, Artificial Sequence
  chemically synthesized
gacccatgccactggctcag

SEQ ID NO: 38059 - DNA, 20 bp, Artificial Sequence
  chemically synthesized
acccatgccactggctcagc

SEQ ID NO: 38060 - DNA, 20 bp, Artificial Sequence
  chemically synthesized
cccatgccactggctcagca

SEQ ID NO: 38061 - DNA, 20 bp, Artificial Sequence
  chemically synthesized
ttcaaacattaccttgaata

SEQ ID NO: 38062 - DNA, 20 bp, Artificial Sequence
  chemically synthesized
caaacattaccttgaatata

SEQ ID NO: 38063 - DNA, 20 bp, Artificial Sequence
  chemically synthesized
tagagtcttataaaatattt

SEQ ID NO: 38064 - DNA, 20 bp, Artificial Sequence
  chemically synthesized
gagtcttataaaatatttga

SEQ ID NO: 38065 - DNA, 20 bp, Artificial Sequence
  chemically synthesized
atttgagagtgcaatgtcaa

SEQ ID NO: 38066 - DNA, 20 bp, Artificial Sequence
  chemically synthesized
agtgcaatgtcaatagatgc

SEQ ID NO: 38067 - DNA, 20 bp, Artificial Sequence
  chemically synthesized
gtgcaatgtcaatagatgct

SEQ ID NO: 38068 - DNA, 20 bp, Artificial Sequence
  chemically synthesized
caatgtcaatagatgctggg

SEQ ID NO: 38069 - DNA, 20 bp, Artificial Sequence
  chemically synthesized
tgtcaatagatgctgggaag

SEQ ID NO: 38070 - DNA, 20 bp, Artificial Sequence
  chemically synthesized
tagatgctgggaagtggtga

SEQ ID NO: 38071 - DNA, 20 bp, Artificial Sequence
  chemically synthesized
gtgaaagccatttcccccct

SEQ ID NO: 38072 - DNA, 20 bp, Artificial Sequence
  chemically synthesized
cttactccttccctcacccc

SEQ ID NO: 38073 - DNA, 20 bp, Artificial Sequence
  chemically synthesized
agaccttcatctttcctgat

SEQ ID NO: 38074 - DNA, 20 bp, Artificial Sequence
  chemically synthesized
ttctttcattctctttcttt

SEQ ID NO: 38075 - DNA, 20 bp, Artificial Sequence
  chemically synthesized
tggataaaataaaatcataa

SEQ ID NO: 38076 - DNA, 20 bp, Artificial Sequence
  chemically synthesized
ataaaataaaatcataaaag

SEQ ID NO: 38077 - DNA, 20 bp, Artificial Sequence
  chemically synthesized
taaaagtagctcatatttgc

SEQ ID NO: 38078 - DNA, 20 bp, Artificial Sequence
  chemically synthesized
ttgctggtaacttccatgac

SEQ ID NO: 38079 - DNA, 20 bp, Artificial Sequence
  chemically synthesized
ccatgaccagaccctctgcc

SEQ ID NO: 38080 - DNA, 20 bp, Artificial Sequence
  chemically synthesized
tgccaagtgctgcacatcca

SEQ ID NO: 38081 - DNA, 20 bp, Artificial Sequence
  chemically synthesized
gcacatccatagcctccctc

SEQ ID NO: 38082 - DNA, 20 bp, Artificial Sequence
  chemically synthesized
gcctccctcaagctttccaa

SEQ ID NO: 38083 - DNA, 20 bp, Artificial Sequence
  chemically synthesized
cctccctcaagctttccaac

SEQ ID NO: 38084 - DNA, 20 bp, Artificial Sequence
  chemically synthesized
ccctcaagctttccaacagg

SEQ ID NO: 38085 - DNA, 20 bp, Artificial Sequence
  chemically synthesized
tccaacaggcagtgctgtac

SEQ ID NO: 38086 - DNA, 20 bp, Artificial Sequence
  chemically synthesized
ccaacaggcagtgctgtacg

SEQ ID NO: 38087 - DNA, 20 bp, Artificial Sequence
  chemically synthesized
aacaggcagtgctgtacgag

SEQ ID NO: 38088 - DNA, 20 bp, Artificial Sequence
  chemically synthesized
acaggcagtgctgtacgagg

SEQ ID NO: 38089 - DNA, 20 bp, Artificial Sequence
  chemically synthesized
caggcagtgctgtacgagga

SEQ ID NO: 38090 - DNA, 20 bp, Artificial Sequence
  chemically synthesized
aggcagtgctgtacgaggag

SEQ ID NO: 38091 - DNA, 20 bp, Artificial Sequence
  chemically synthesized
ggcagtgctgtacgaggagg

SEQ ID NO: 38092 - DNA, 20 bp, Artificial Sequence
  chemically synthesized
tgctgtacgaggagggggct

SEQ ID NO: 38093 - DNA, 20 bp, Artificial Sequence
  chemically synthesized
gctgtacgaggagggggctg

SEQ ID NO: 38094 - DNA, 20 bp, Artificial Sequence
  chemically synthesized
gagggggctgaggccttccc

SEQ ID NO: 38095 - DNA, 20 bp, Artificial Sequence
  chemically synthesized
agggggctgaggccttcccg

SEQ ID NO: 38096 - DNA, 20 bp, Artificial Sequence
  chemically synthesized
cccgaggttgtgtcgctacc

SEQ ID NO: 38097 - DNA, 20 bp, Artificial Sequence
  chemically synthesized
ccgaggttgtgtcgctaccc

SEQ ID NO: 38098 - DNA, 20 bp, Artificial Sequence
  chemically synthesized
cgaggttgtgtcgctaccca

SEQ ID NO: 38099 - DNA, 20 bp, Artificial Sequence
  chemically synthesized
gaggttgtgtcgctacccag

SEQ ID NO: 38100 - DNA, 20 bp, Artificial Sequence
  chemically synthesized
tgtgtcgctacccaggggtg

SEQ ID NO: 38101 - DNA, 20 bp, Artificial Sequence
  chemically synthesized
ctacccaggggtgcagctga

SEQ ID NO: 38102 - DNA, 20 bp, Artificial Sequence
  chemically synthesized
gctgatagacacaacccttt

SEQ ID NO: 38103 - DNA, 20 bp, Artificial Sequence
  chemically synthesized
ctgatagacacaaccctttc

SEQ ID NO: 38104 - DNA, 20 bp, Artificial Sequence
  chemically synthesized
gacacaaccctttcaggtct

SEQ ID NO: 38105 - DNA, 20 bp, Artificial Sequence
  chemically synthesized
cctttcaggtcttagtttac

SEQ ID NO: 38106 - DNA, 20 bp, Artificial Sequence
  chemically synthesized
tcaggtcttagtttacgagc

SEQ ID NO: 38107 - DNA, 20 bp, Artificial Sequence
  chemically synthesized
gtcttagtttacgagcaagc

SEQ ID NO: 38108 - DNA, 20 bp, Artificial Sequence
  chemically synthesized
tcttagtttacgagcaagct

SEQ ID NO: 38109 - DNA, 20 bp, Artificial Sequence
  chemically synthesized
ctgtgccgaaatgacaacat

SEQ ID NO: 38110 - DNA, 20 bp, Artificial Sequence
  chemically synthesized
cttcaaaatttatttattcc

SEQ ID NO: 38111 - DNA, 20 bp, Artificial Sequence
  chemically synthesized
gtaattataaattatgttat

SEQ ID NO: 38112 - DNA, 20 bp, Artificial Sequence
  chemically synthesized
ttataagatatcaatccttc

SEQ ID NO: 38113 - DNA, 20 bp, Artificial Sequence
  chemically synthesized
tataagatatcaatccttcc

SEQ ID NO: 38114 - DNA, 20 bp, Artificial Sequence
  chemically synthesized
taagatatcaatccttccag

SEQ ID NO: 38115 - DNA, 20 bp, Artificial Sequence
  chemically synthesized
aagatatcaatccttccagg

SEQ ID NO: 38116 - DNA, 20 bp, Artificial Sequence
  chemically synthesized
agatatcaatccttccagga

SEQ ID NO: 38117 - DNA, 20 bp, Artificial Sequence
  chemically synthesized
gatatcaatccttccaggag

SEQ ID NO: 38118 - DNA, 20 bp, Artificial Sequence
  chemically synthesized
atatcaatccttccaggagg

SEQ ID NO: 38119 - DNA, 20 bp, Artificial Sequence
  chemically synthesized
tcaatccttccaggaggggg

SEQ ID NO: 38120 - DNA, 20 bp, Artificial Sequence
  chemically synthesized
atccttccaggagggggtgg

SEQ ID NO: 38121 - DNA, 20 bp, Artificial Sequence
  chemically synthesized
gtggctcatgcctataatcc

SEQ ID NO: 38122 - DNA, 20 bp, Artificial Sequence
  chemically synthesized
tgcctataatcccagcattt

SEQ ID NO: 38123 - DNA, 20 bp, Artificial Sequence
  chemically synthesized
gcctataatcccagcatttt

SEQ ID NO: 38124 - DNA, 20 bp, Artificial Sequence
  chemically synthesized
ctataatcccagcattttgg

SEQ ID NO: 38125 - DNA, 20 bp, Artificial Sequence
  chemically synthesized
tataatcccagcattttggg

SEQ ID NO: 38126 - DNA, 20 bp, Artificial Sequence
  chemically synthesized
cccagcattttgggaggcca

SEQ ID NO: 38127 - DNA, 20 bp, Artificial Sequence
  chemically synthesized
agcattttgggaggccacgg

SEQ ID NO: 38128 - DNA, 20 bp, Artificial Sequence
  chemically synthesized
ttttgggaggccacggcaga

SEQ ID NO: 38129 - DNA, 20 bp, Artificial Sequence
  chemically synthesized
ccacggcagatggatcacct

SEQ ID NO: 38130 - DNA, 20 bp, Artificial Sequence
  chemically synthesized
cacggcagatggatcacctg

SEQ ID NO: 38131 - DNA, 20 bp, Artificial Sequence
  chemically synthesized
gcagatggatcacctgaggc

SEQ ID NO: 38132 - DNA, 20 bp, Artificial Sequence
  chemically synthesized
cagatggatcacctgaggcc

SEQ ID NO: 38133 - DNA, 20 bp, Artificial Sequence
  chemically synthesized
gatggatcacctgaggccag

SEQ ID NO: 38134 - DNA, 20 bp, Artificial Sequence
  chemically synthesized
tcacctgaggccaggagttt

SEQ ID NO: 38135 - DNA, 20 bp, Artificial Sequence
  chemically synthesized
tgaggccaggagtttgagac

SEQ ID NO: 38136 - DNA, 20 bp, Artificial Sequence
  chemically synthesized
ccaggagtttgagacaagcc

SEQ ID NO: 38137 - DNA, 20 bp, Artificial Sequence
  chemically synthesized
caggagtttgagacaagcct

SEQ ID NO: 38138 - DNA, 20 bp, Artificial Sequence
  chemically synthesized
tctacaaaaaatacaaaaat

SEQ ID NO: 38139 - DNA, 20 bp, Artificial Sequence
  chemically synthesized
caaaaaatacaaaaattagc

SEQ ID NO: 38140 - DNA, 20 bp, Artificial Sequence
  chemically synthesized
aaaaaatacaaaaattagct

SEQ ID NO: 38141 - DNA, 20 bp, Artificial Sequence
  chemically synthesized
atacaaaaattagctgggtg

SEQ ID NO: 38142 - DNA, 20 bp, Artificial Sequence
  chemically synthesized
acaaaaattagctgggtgtg

SEQ ID NO: 38143 - DNA, 20 bp, Artificial Sequence
  chemically synthesized
caaaaattagctgggtgtgg

SEQ ID NO: 38144 - DNA, 20 bp, Artificial Sequence
  chemically synthesized
ctgggtgtggaggcacatgc

SEQ ID NO: 38145 - DNA, 20 bp, Artificial Sequence
  chemically synthesized
gaggcacatgccagtcatcc

SEQ ID NO: 38146 - DNA, 20 bp, Artificial Sequence
  chemically synthesized
tgccagtcatcccagctact

SEQ ID NO: 38147 - DNA, 20 bp, Artificial Sequence
  chemically synthesized
cagtcatcccagctactaag

SEQ ID NO: 38148 - DNA, 20 bp, Artificial Sequence
  chemically synthesized
agtcatcccagctactaagt

SEQ ID NO: 38149 - DNA, 20 bp, Artificial Sequence
  chemically synthesized
tcccagctactaagtaggct

SEQ ID NO: 38150 - DNA, 20 bp, Artificial Sequence
  chemically synthesized
cccagctactaagtaggctg

SEQ ID NO: 38151 - DNA, 20 bp, Artificial Sequence
  chemically synthesized
tactaagtaggctgaggcac

SEQ ID NO: 38152 - DNA, 20 bp, Artificial Sequence
  chemically synthesized
gcactagaattgcttgaaca

SEQ ID NO: 38153 - DNA, 20 bp, Artificial Sequence
  chemically synthesized
cactagaattgcttgaacac

SEQ ID NO: 38154 - DNA, 20 bp, Artificial Sequence
  chemically synthesized
ctagaattgcttgaacacag

SEQ ID NO: 38155 - DNA, 20 bp, Artificial Sequence
  chemically synthesized
aattgcttgaacacaggaga

SEQ ID NO: 38156 - DNA, 20 bp, Artificial Sequence
  chemically synthesized
ttgcttgaacacaggagatg

SEQ ID NO: 38157 - DNA, 20 bp, Artificial Sequence
  chemically synthesized
tgcttgaacacaggagatgg

SEQ ID NO: 38158 - DNA, 20 bp, Artificial Sequence
  chemically synthesized
aacacaggagatggaggttg

SEQ ID NO: 38159 - DNA, 20 bp, Artificial Sequence
  chemically synthesized
caggagatggaggttgcagt

SEQ ID NO: 38160 - DNA, 20 bp, Artificial Sequence
  chemically synthesized
gatggaggttgcagtgagcc

SEQ ID NO: 38161 - DNA, 20 bp, Artificial Sequence
  chemically synthesized
aagaatgtgccactgcactc

SEQ ID NO: 38162 - DNA, 20 bp, Artificial Sequence
  chemically synthesized
tgtgccactgcactccagcc

SEQ ID NO: 38163 - DNA, 20 bp, Artificial Sequence
  chemically synthesized
gtgccactgcactccagcct

SEQ ID NO: 38164 - DNA, 20 bp, Artificial Sequence
  chemically synthesized
ctgcactccagcctgggtga

SEQ ID NO: 38165 - DNA, 20 bp, Artificial Sequence
  chemically synthesized
gcactccagcctgggtgaca

SEQ ID NO: 38166 - DNA, 20 bp, Artificial Sequence
  chemically synthesized
tccagcctgggtgacagagc

SEQ ID NO: 38167 - DNA, 20 bp, Artificial Sequence
  chemically synthesized
gtgacagagcaagaatgtct

SEQ ID NO: 38168 - DNA, 20 bp, Artificial Sequence
  chemically synthesized
tgacagagcaagaatgtctc

SEQ ID NO: 38169 - DNA, 20 bp, Artificial Sequence
  chemically synthesized
agagcaagaatgtctcagga

SEQ ID NO: 38170 - DNA, 20 bp, Artificial Sequence
  chemically synthesized
aatatcaatccttcctattc

SEQ ID NO: 38171 - DNA, 20 bp, Artificial Sequence
  chemically synthesized
atcaatccttcctattctag

SEQ ID NO: 38172 - DNA, 20 bp, Artificial Sequence
  chemically synthesized
ccttcctattctagtagttg

SEQ ID NO: 38173 - DNA, 20 bp, Artificial Sequence
  chemically synthesized
atatttttaaaaataaaaca

SEQ ID NO: 38174 - DNA, 20 bp, Artificial Sequence
  chemically synthesized
tatttttaaaaataaaacat

SEQ ID NO: 38175 - DNA, 20 bp, Artificial Sequence
  chemically synthesized
atttttaaaaataaaacata

SEQ ID NO: 38176 - DNA, 20 bp, Artificial Sequence
  chemically synthesized
taaaaataaaacatagggtc

SEQ ID NO: 38177 - DNA, 20 bp, Artificial Sequence
  chemically synthesized
ataaaacatagggtcgagtg

SEQ ID NO: 38178 - DNA, 20 bp, Artificial Sequence
  chemically synthesized
aaacatagggtcgagtgcgg

SEQ ID NO: 38179 - DNA, 20 bp, Artificial Sequence
  chemically synthesized
gtggctcaactctgtaatcc

SEQ ID NO: 38180 - DNA, 20 bp, Artificial Sequence
  chemically synthesized
actctgtaatcccagcactt

SEQ ID NO: 38181 - DNA, 20 bp, Artificial Sequence
  chemically synthesized
ctctgtaatcccagcacttt

SEQ ID NO: 38182 - DNA, 20 bp, Artificial Sequence
  chemically synthesized
ctgtaatcccagcactttgg

SEQ ID NO: 38183 - DNA, 20 bp, Artificial Sequence
  chemically synthesized
tgtaatcccagcactttggg

SEQ ID NO: 38184 - DNA, 20 bp, Artificial Sequence
  chemically synthesized
tcccagcactttgggaggcc

SEQ ID NO: 38185 - DNA, 20 bp, Artificial Sequence
  chemically synthesized
agcactttgggaggccaaga

SEQ ID NO: 38186 - DNA, 20 bp, Artificial Sequence
  chemically synthesized
gcactttgggaggccaagac

SEQ ID NO: 38187 - DNA, 20 bp, Artificial Sequence
  chemically synthesized
ctttgggaggccaagacagg

SEQ ID NO: 38188 - DNA, 20 bp, Artificial Sequence
  chemically synthesized
ggccaagacaggtggatcac

SEQ ID NO: 38189 - DNA, 20 bp, Artificial Sequence
  chemically synthesized
gccaagacaggtggatcaca

SEQ ID NO: 38190 - DNA, 20 bp, Artificial Sequence
  chemically synthesized
agacaggtggatcacaaggt

SEQ ID NO: 38191 - DNA, 20 bp, Artificial Sequence
  chemically synthesized
gacaggtggatcacaaggtc

SEQ ID NO: 38192 - DNA, 20 bp, Artificial Sequence
  chemically synthesized
caggtggatcacaaggtcag

SEQ ID NO: 38193 - DNA, 20 bp, Artificial Sequence
  chemically synthesized
gatcacaaggtcaggagttt

SEQ ID NO: 38194 - DNA, 20 bp, Artificial Sequence
  chemically synthesized
caaggtcaggagtttgagac

SEQ ID NO: 38195 - DNA, 20 bp, Artificial Sequence
  chemically synthesized
gtcaggagtttgagaccagc

SEQ ID NO: 38196 - DNA, 20 bp, Artificial Sequence
  chemically synthesized
tcaggagtttgagaccagcc

SEQ ID NO: 38197 - DNA, 20 bp, Artificial Sequence
  chemically synthesized
tgagaccagccaggccaatg

SEQ ID NO: 38198 - DNA, 20 bp, Artificial Sequence
  chemically synthesized
tctactaaaaatacaaaaat

SEQ ID NO: 38199 - DNA, 20 bp, Artificial Sequence
  chemically synthesized
ctaaaaatacaaaaattagc

SEQ ID NO: 38200 - DNA, 20 bp, Artificial Sequence
  chemically synthesized
taaaaatacaaaaattagcc

SEQ ID NO: 38201 - DNA, 20 bp, Artificial Sequence
  chemically synthesized
atacaaaaattagccaggcg

SEQ ID NO: 38202 - DNA, 20 bp, Artificial Sequence
  chemically synthesized
caaaaattagccaggcgtgg

SEQ ID NO: 38203 - DNA, 20 bp, Artificial Sequence
  chemically synthesized
aaattagccaggcgtggtgg

SEQ ID NO: 38204 - DNA, 20 bp, Artificial Sequence
  chemically synthesized
aattagccaggcgtggtggt

SEQ ID NO: 38205 - DNA, 20 bp, Artificial Sequence
  chemically synthesized
gtggtgggcacctgtaatcc

SEQ ID NO: 38206 - DNA, 20 bp, Artificial Sequence
  chemically synthesized
gcacctgtaatcccagctac

SEQ ID NO: 38207 - DNA, 20 bp, Artificial Sequence
  chemically synthesized
cacctgtaatcccagctact

SEQ ID NO: 38208 - DNA, 20 bp, Artificial Sequence
  chemically synthesized
acctgtaatcccagctacta

SEQ ID NO: 38209 - DNA, 20 bp, Artificial Sequence
  chemically synthesized
ctgtaatcccagctactagg

SEQ ID NO: 38210 - DNA, 20 bp, Artificial Sequence
  chemically synthesized
tgtaatcccagctactaggg

SEQ ID NO: 38211 - DNA, 20 bp, Artificial Sequence
  chemically synthesized
atcccagctactagggaggc

SEQ ID NO: 38212 - DNA, 20 bp, Artificial Sequence
  chemically synthesized
cccagctactagggaggctg

SEQ ID NO: 38213 - DNA, 20 bp, Artificial Sequence
  chemically synthesized
ctggagtattcacttgaacc

SEQ ID NO: 38214 - DNA, 20 bp, Artificial Sequence
  chemically synthesized
tggagtattcacttgaaccc

SEQ ID NO: 38215 - DNA, 20 bp, Artificial Sequence
  chemically synthesized
gagtattcacttgaacccag

SEQ ID NO: 38216 - DNA, 20 bp, Artificial Sequence
  chemically synthesized
agtattcacttgaacccagg

SEQ ID NO: 38217 - DNA, 20 bp, Artificial Sequence
  chemically synthesized
attcacttgaacccaggagg

SEQ ID NO: 38218 - DNA, 20 bp, Artificial Sequence
  chemically synthesized
cacttgaacccaggaggtgg

SEQ ID NO: 38219 - DNA, 20 bp, Artificial Sequence
  chemically synthesized
aacccaggaggtggaagttg

SEQ ID NO: 38220 - DNA, 20 bp, Artificial Sequence
  chemically synthesized
caggaggtggaagttgcagt

SEQ ID NO: 38221 - DNA, 20 bp, Artificial Sequence
  chemically synthesized
gcagtgagccaaaatcacgt

SEQ ID NO: 38222 - DNA, 20 bp, Artificial Sequence
  chemically synthesized
tcacgtcagtgcacttcaac

SEQ ID NO: 38223 - DNA, 20 bp, Artificial Sequence
  chemically synthesized
cacgtcagtgcacttcaacc

SEQ ID NO: 38224 - DNA, 20 bp, Artificial Sequence
  chemically synthesized
acgtcagtgcacttcaaccg

SEQ ID NO: 38225 - DNA, 20 bp, Artificial Sequence
  chemically synthesized
cagtgcacttcaaccggggt

SEQ ID NO: 38226 - DNA, 20 bp, Artificial Sequence
  chemically synthesized
gtgcacttcaaccggggtga

SEQ ID NO: 38227 - DNA, 20 bp, Artificial Sequence
  chemically synthesized
aataaaataaaataaaataa

SEQ ID NO: 38228 - DNA, 20 bp, Artificial Sequence
  chemically synthesized
aataaaataaaataaaagca

SEQ ID NO: 38229 - DNA, 20 bp, Artificial Sequence
  chemically synthesized
tctttccgcaaatgaattca

SEQ ID NO: 38230 - DNA, 20 bp, Artificial Sequence
  chemically synthesized
cttacattttcgttctcatg

SEQ ID NO: 38231 - DNA, 20 bp, Artificial Sequence
  chemically synthesized
attttcgttctcatgaagta

SEQ ID NO: 38232 - DNA, 20 bp, Artificial Sequence
  chemically synthesized
tcgttctcatgaagtaaagc

SEQ ID NO: 38233 - DNA, 20 bp, Artificial Sequence
  chemically synthesized
gttctcatgaagtaaagcaa

SEQ ID NO: 38234 - DNA, 20 bp, Artificial Sequence
  chemically synthesized
ctcatgaagtaaagcaagag

SEQ ID NO: 38235 - DNA, 20 bp, Artificial Sequence
  chemically synthesized
atgaagtaaagcaagagtgg

SEQ ID NO: 38236 - DNA, 20 bp, Artificial Sequence
  chemically synthesized
aaagcaagagtggtagaatt

SEQ ID NO: 38237 - DNA, 20 bp, Artificial Sequence
  chemically synthesized
gcaagagtggtagaattaag

SEQ ID NO: 38238 - DNA, 20 bp, Artificial Sequence
  chemically synthesized
gagtggtagaattaagtgga

SEQ ID NO: 38239 - DNA, 20 bp, Artificial Sequence
  chemically synthesized
gtggtagaattaagtggaaa

SEQ ID NO: 38240 - DNA, 20 bp, Artificial Sequence
  chemically synthesized
aagtggaaagagtctatctc

SEQ ID NO: 38241 - DNA, 20 bp, Artificial Sequence
  chemically synthesized
gaaagagtctatctctagtg

SEQ ID NO: 38242 - DNA, 20 bp, Artificial Sequence
  chemically synthesized
tatctctagtgtagtcacgt

SEQ ID NO: 38243 - DNA, 20 bp, Artificial Sequence
  chemically synthesized
ctctagtgtagtcacgtcag

SEQ ID NO: 38244 - DNA, 20 bp, Artificial Sequence
  chemically synthesized
gtcacgtcagtggttgtgtc

SEQ ID NO: 38245 - DNA, 20 bp, Artificial Sequence
  chemically synthesized
cgtcagtggttgtgtcaaga

SEQ ID NO: 38246 - DNA, 20 bp, Artificial Sequence
  chemically synthesized
agtggttgtgtcaagatggt

SEQ ID NO: 38247 - DNA, 20 bp, Artificial Sequence
  chemically synthesized
gtggttgtgtcaagatggtt

SEQ ID NO: 38248 - DNA, 20 bp, Artificial Sequence
  chemically synthesized
ggttgtgtcaagatggttag

SEQ ID NO: 38249 - DNA, 20 bp, Artificial Sequence
  chemically synthesized
gttgtgtcaagatggttagg

SEQ ID NO: 38250 - DNA, 20 bp, Artificial Sequence
  chemically synthesized
gaggctcctcccgtttaaaa

SEQ ID NO: 38251 - DNA, 20 bp, Artificial Sequence
  chemically synthesized
tcccgtttaaaacagtatcc

SEQ ID NO: 38252 - DNA, 20 bp, Artificial Sequence
  chemically synthesized
ttaaaacagtatccaagccc

SEQ ID NO: 38253 - DNA, 20 bp, Artificial Sequence
  chemically synthesized
agccccagttgtaaatcaat

SEQ ID NO: 38254 - DNA, 20 bp, Artificial Sequence
  chemically synthesized
gccccagttgtaaatcaatt

SEQ ID NO: 38255 - DNA, 20 bp, Artificial Sequence
  chemically synthesized
ccccagttgtaaatcaattg

SEQ ID NO: 38256 - DNA, 20 bp, Artificial Sequence
  chemically synthesized
ccagttgtaaatcaattggg

SEQ ID NO: 38257 - DNA, 20 bp, Artificial Sequence
  chemically synthesized
gacacgccaactctgatcat

SEQ ID NO: 38258 - DNA, 20 bp, Artificial Sequence
  chemically synthesized
tctgatcatcagcaatatct

SEQ ID NO: 38259 - DNA, 20 bp, Artificial Sequence
  chemically synthesized
catcagcaatatctgagctc

SEQ ID NO: 38260 - DNA, 20 bp, Artificial Sequence
  chemically synthesized
caatatctgagctccagtct

SEQ ID NO: 38261 - DNA, 20 bp, Artificial Sequence
  chemically synthesized
ccagtctcagatattgtgtg

SEQ ID NO: 38262 - DNA, 20 bp, Artificial Sequence
  chemically synthesized
tctcagatattgtgtgcagt

SEQ ID NO: 38263 - DNA, 20 bp, Artificial Sequence
  chemically synthesized
ccctctacctccttccctac

SEQ ID NO: 38264 - DNA, 20 bp, Artificial Sequence
  chemically synthesized
taccagaaaaatcaccactt

SEQ ID NO: 38265 - DNA, 20 bp, Artificial Sequence
  chemically synthesized
aaaatcaccactttagtccc

SEQ ID NO: 38266 - DNA, 20 bp, Artificial Sequence
  chemically synthesized
ccactttagtccctggccac

SEQ ID NO: 38267 - DNA, 20 bp, Artificial Sequence
  chemically synthesized
cactttagtccctggccacc

SEQ ID NO: 38268 - DNA, 20 bp, Artificial Sequence
  chemically synthesized
ccctggccaccgggacaccc

SEQ ID NO: 38269 - DNA, 20 bp, Artificial Sequence
  chemically synthesized
cctggccaccgggacacccc

SEQ ID NO: 38270 - DNA, 20 bp, Artificial Sequence
  chemically synthesized
tggccaccgggacaccccag

SEQ ID NO: 38271 - DNA, 20 bp, Artificial Sequence
  chemically synthesized
ggccaccgggacaccccagg

SEQ ID NO: 38272 - DNA, 20 bp, Artificial Sequence
  chemically synthesized
gccaccgggacaccccagga

SEQ ID NO: 38273 - DNA, 20 bp, Artificial Sequence
  chemically synthesized
ccgggacaccccaggagggt

SEQ ID NO: 38274 - DNA, 20 bp, Artificial Sequence
  chemically synthesized
ggacaccccaggagggtgag

SEQ ID NO: 38275 - DNA, 20 bp, Artificial Sequence
  chemically synthesized
cccaggagggtgagtggtct

SEQ ID NO: 38276 - DNA, 20 bp, Artificial Sequence
  chemically synthesized
ccaggagggtgagtggtctg

SEQ ID NO: 38277 - DNA, 20 bp, Artificial Sequence
  chemically synthesized
ggagggtgagtggtctgagg

SEQ ID NO: 38278 - DNA, 20 bp, Artificial Sequence
  chemically synthesized
tgagtggtctgaggtagtta

SEQ ID NO: 38279 - DNA, 20 bp, Artificial Sequence
  chemically synthesized
tgaggtagttatggcactta

SEQ ID NO: 38280 - DNA, 20 bp, Artificial Sequence
  chemically synthesized
tggctcccttgctgctgatc

SEQ ID NO: 38281 - DNA, 20 bp, Artificial Sequence
  chemically synthesized
ttgctgctgatctggaactc

SEQ ID NO: 38282 - DNA, 20 bp, Artificial Sequence
  chemically synthesized
tgatctggaactcaagcccc

SEQ ID NO: 38283 - DNA, 20 bp, Artificial Sequence
  chemically synthesized
tctggaactcaagccccaag

SEQ ID NO: 38284 - DNA, 20 bp, Artificial Sequence
  chemically synthesized
caagccccaagaagtcccct

SEQ ID NO: 38285 - DNA, 20 bp, Artificial Sequence
  chemically synthesized
ggatgatctgaatatacatt

SEQ ID NO: 38286 - DNA, 20 bp, Artificial Sequence
  chemically synthesized
gatgatctgaatatacattt

SEQ ID NO: 38287 - DNA, 20 bp, Artificial Sequence
  chemically synthesized
atctgaatatacatttggga

SEQ ID NO: 38288 - DNA, 20 bp, Artificial Sequence
  chemically synthesized
atatacatttgggacagatc

SEQ ID NO: 38289 - DNA, 20 bp, Artificial Sequence
  chemically synthesized
tatacatttgggacagatct

SEQ ID NO: 38290 - DNA, 20 bp, Artificial Sequence
  chemically synthesized
atacatttgggacagatcta

SEQ ID NO: 38291 - DNA, 20 bp, Artificial Sequence
  chemically synthesized
acatttgggacagatctagg

SEQ ID NO: 38292 - DNA, 20 bp, Artificial Sequence
  chemically synthesized
gacagatctagggagtttct

SEQ ID NO: 38293 - DNA, 20 bp, Artificial Sequence
  chemically synthesized
gggagtttctgagcaacact

SEQ ID NO: 38294 - DNA, 20 bp, Artificial Sequence
  chemically synthesized
tttctgagcaacacttagac

SEQ ID NO: 38295 - DNA, 20 bp, Artificial Sequence
  chemically synthesized
ttctgagcaacacttagact

SEQ ID NO: 38296 - DNA, 20 bp, Artificial Sequence
  chemically synthesized
tctgagcaacacttagactg

SEQ ID NO: 38297 - DNA, 20 bp, Artificial Sequence
  chemically synthesized
cctacttgaattcgctactt

SEQ ID NO: 38298 - DNA, 20 bp, Artificial Sequence
  chemically synthesized
ctacttgaattcgctacttt

SEQ ID NO: 38299 - DNA, 20 bp, Artificial Sequence
  chemically synthesized
aattcgctactttgggactc

SEQ ID NO: 38300 - DNA, 20 bp, Artificial Sequence
  chemically synthesized
ctactttgggactcaagtct

SEQ ID NO: 38301 - DNA, 20 bp, Artificial Sequence
  chemically synthesized
tactttgggactcaagtcta

SEQ ID NO: 38302 - DNA, 20 bp, Artificial Sequence
  chemically synthesized
actttgggactcaagtctaa

SEQ ID NO: 38303 - DNA, 20 bp, Artificial Sequence
  chemically synthesized
ggactcaagtctaagggact

SEQ ID NO: 38304 - DNA, 20 bp, Artificial Sequence
  chemically synthesized
aagtctaagggactgagact

SEQ ID NO: 38305 - DNA, 20 bp, Artificial Sequence
  chemically synthesized
ctaagggactgagactgaga

SEQ ID NO: 38306 - DNA, 20 bp, Artificial Sequence
  chemically synthesized
taagggactgagactgagac

SEQ ID NO: 38307 - DNA, 20 bp, Artificial Sequence
  chemically synthesized
agggactgagactgagacag

SEQ ID NO: 38308 - DNA, 20 bp, Artificial Sequence
  chemically synthesized
ggactgagactgagacagga

SEQ ID NO: 38309 - DNA, 20 bp, Artificial Sequence
  chemically synthesized
agactgagacaggagagcac

SEQ ID NO: 38310 - DNA, 20 bp, Artificial Sequence
  chemically synthesized
ggagagcacaagactaactt

SEQ ID NO: 38311 - DNA, 20 bp, Artificial Sequence
  chemically synthesized
cttgcaactgtcaatgcctc

SEQ ID NO: 38312 - DNA, 20 bp, Artificial Sequence
  chemically synthesized
aatgcctccagccaaatgcc

SEQ ID NO: 38313 - DNA, 20 bp, Artificial Sequence
  chemically synthesized
ctccagccaaatgcccagca

SEQ ID NO: 38314 - DNA, 20 bp, Artificial Sequence
  chemically synthesized
ccagccaaatgcccagcaca

SEQ ID NO: 38315 - DNA, 20 bp, Artificial Sequence
  chemically synthesized
caaatgcccagcacagagct

SEQ ID NO: 38316 - DNA, 20 bp, Artificial Sequence
  chemically synthesized
atgcccagcacagagctcag

SEQ ID NO: 38317 - DNA, 20 bp, Artificial Sequence
  chemically synthesized
gtggatttgactcttccatt

SEQ ID NO: 38318 - DNA, 20 bp, Artificial Sequence
  chemically synthesized
ctcttccattcagaaactca

SEQ ID NO: 38319 - DNA, 20 bp, Artificial Sequence
  chemically synthesized
gcacacttcattctcaatca

SEQ ID NO: 38320 - DNA, 20 bp, Artificial Sequence
  chemically synthesized
cacacttcattctcaatcac

SEQ ID NO: 38321 - DNA, 20 bp, Artificial Sequence
  chemically synthesized
acacttcattctcaatcaca

SEQ ID NO: 38322 - DNA, 20 bp, Artificial Sequence
  chemically synthesized
acttcattctcaatcacagg

SEQ ID NO: 38323 - DNA, 20 bp, Artificial Sequence
  chemically synthesized
cattctcaatcacagggagc

SEQ ID NO: 38324 - DNA, 20 bp, Artificial Sequence
  chemically synthesized
attctcaatcacagggagct

SEQ ID NO: 38325 - DNA, 20 bp, Artificial Sequence
  chemically synthesized
acagggagctgggcttcctt

SEQ ID NO: 38326 - DNA, 20 bp, Artificial Sequence
  chemically synthesized
ggagctgggcttccttgaga

SEQ ID NO: 38327 - DNA, 20 bp, Artificial Sequence
  chemically synthesized
ctgggcttccttgagaaagc

SEQ ID NO: 38328 - DNA, 20 bp, Artificial Sequence
  chemically synthesized
ccttgagaaagccagcccca

SEQ ID NO: 38329 - DNA, 20 bp, Artificial Sequence
  chemically synthesized
cttgagaaagccagccccaa

SEQ ID NO: 38330 - DNA, 20 bp, Artificial Sequence
  chemically synthesized
caaaggtacctgtgtttaaa

SEQ ID NO: 38331 - DNA, 20 bp, Artificial Sequence
  chemically synthesized
acctgtgtttaaaaagatga

SEQ ID NO: 38332 - DNA, 20 bp, Artificial Sequence
  chemically synthesized
gtttaaaaagatgaaagaaa

SEQ ID NO: 38333 - DNA, 20 bp, Artificial Sequence
  chemically synthesized
tacgtccacaacatgttcac

SEQ ID NO: 38334 - DNA, 20 bp, Artificial Sequence
  chemically synthesized
acgtccacaacatgttcaca

SEQ ID NO: 38335 - DNA, 20 bp, Artificial Sequence
  chemically synthesized
acatgttcacaaggaaactc

SEQ ID NO: 38336 - DNA, 20 bp, Artificial Sequence
  chemically synthesized
tgttcacaaggaaactccag

SEQ ID NO: 38337 - DNA, 20 bp, Artificial Sequence
  chemically synthesized
acaaggaaactccagaagaa

SEQ ID NO: 38338 - DNA, 20 bp, Artificial Sequence
  chemically synthesized
aaggaaactccagaagaaca

SEQ ID NO: 38339 - DNA, 20 bp, Artificial Sequence
  chemically synthesized
gaaactccagaagaacagag

SEQ ID NO: 38340 - DNA, 20 bp, Artificial Sequence
  chemically synthesized
actccagaagaacagagcag

SEQ ID NO: 38341 - DNA, 20 bp, Artificial Sequence
  chemically synthesized
gaagaacagagcagtggtga

SEQ ID NO: 38342 - DNA, 20 bp, Artificial Sequence
  chemically synthesized
tggacctcctgtctgtccgt

SEQ ID NO: 38343 - DNA, 20 bp, Artificial Sequence
  chemically synthesized
ggacctcctgtctgtccgtg

SEQ ID NO: 38344 - DNA, 20 bp, Artificial Sequence
  chemically synthesized
cctgtctgtccgtgaggctg

SEQ ID NO: 38345 - DNA, 20 bp, Artificial Sequence
  chemically synthesized
tccgtgaggctgtagaacac

SEQ ID NO: 38346 - DNA, 20 bp, Artificial Sequence
  chemically synthesized
ccgtgaggctgtagaacaca

SEQ ID NO: 38347 - DNA, 20 bp, Artificial Sequence
  chemically synthesized
tgaggctgtagaacacaagg

SEQ ID NO: 38348 - DNA, 20 bp, Artificial Sequence
  chemically synthesized
aaggcagctcccaatgctgc

SEQ ID NO: 38349 - DNA, 20 bp, Artificial Sequence
  chemically synthesized
ctgccagactctctgaaccc

SEQ ID NO: 38350 - DNA, 20 bp, Artificial Sequence
  chemically synthesized
gccagactctctgaaccctg

SEQ ID NO: 38351 - DNA, 20 bp, Artificial Sequence
  chemically synthesized
cagactctctgaaccctgga

SEQ ID NO: 38352 - DNA, 20 bp, Artificial Sequence
  chemically synthesized
ggagagtgtaaacgtcatat

SEQ ID NO: 38353 - DNA, 20 bp, Artificial Sequence
  chemically synthesized
agagtgtaaacgtcatataa

SEQ ID NO: 38354 - DNA, 20 bp, Artificial Sequence
  chemically synthesized
gagtctatgttccaaaaacc

SEQ ID NO: 38355 - DNA, 20 bp, Artificial Sequence
  chemically synthesized
aaacctggatttaacaatct

SEQ ID NO: 38356 - DNA, 20 bp, Artificial Sequence
  chemically synthesized
taacaatctgagctttgtca

SEQ ID NO: 38357 - DNA, 20 bp, Artificial Sequence
  chemically synthesized
agctttgtcatggtgctttg

SEQ ID NO: 38358 - DNA, 20 bp, Artificial Sequence
  chemically synthesized
ttgtcatggtgctttgcggt

SEQ ID NO: 38359 - DNA, 20 bp, Artificial Sequence
  chemically synthesized
tctttgcttttaaaaccata

SEQ ID NO: 38360 - DNA, 20 bp, Artificial Sequence
  chemically synthesized
taaagaataatgtttaaatg

SEQ ID NO: 38361 - DNA, 20 bp, Artificial Sequence
  chemically synthesized
aagaataatgtttaaatgta

SEQ ID NO: 38362 - DNA, 20 bp, Artificial Sequence
  chemically synthesized
aatgtttaaatgtagagtct

SEQ ID NO: 38363 - DNA, 20 bp, Artificial Sequence
  chemically synthesized
tgctattgtttttatatttt

SEQ ID NO: 38364 - DNA, 20 bp, Artificial Sequence
  chemically synthesized
ttcactcaacattacataat

SEQ ID NO: 38365 - DNA, 20 bp, Artificial Sequence
  chemically synthesized
attacataatgagttttgta

SEQ ID NO: 38366 - DNA, 20 bp, Artificial Sequence
  chemically synthesized
tcttcataactaatatttta

SEQ ID NO: 38367 - DNA, 20 bp, Artificial Sequence
  chemically synthesized
cttcataactaatattttaa

SEQ ID NO: 38368 - DNA, 20 bp, Artificial Sequence
  chemically synthesized
tcataactaatattttaaag

SEQ ID NO: 38369 - DNA, 20 bp, Artificial Sequence
  chemically synthesized
ataactaatattttaaagga

SEQ ID NO: 38370 - DNA, 20 bp, Artificial Sequence
  chemically synthesized
aaggagagctactgattaat

SEQ ID NO: 38371 - DNA, 20 bp, Artificial Sequence
  chemically synthesized
agctactgattaatgagcat

SEQ ID NO: 38372 - DNA, 20 bp, Artificial Sequence
  chemically synthesized
gctactgattaatgagcatg

SEQ ID NO: 38373 - DNA, 20 bp, Artificial Sequence
  chemically synthesized
aatgagcatgaggtttcctt

SEQ ID NO: 38374 - DNA, 20 bp, Artificial Sequence
  chemically synthesized
atgagcatgaggtttccttt

SEQ ID NO: 38375 - DNA, 20 bp, Artificial Sequence
  chemically synthesized
tgagcatgaggtttcctttg

SEQ ID NO: 38376 - DNA, 20 bp, Artificial Sequence
  chemically synthesized
atgaggtttcctttggggat

SEQ ID NO: 38377 - DNA, 20 bp, Artificial Sequence
  chemically synthesized
tgaggtttcctttggggatg

SEQ ID NO: 38378 - DNA, 20 bp, Artificial Sequence
  chemically synthesized
tggggatgaggaaaatattc

SEQ ID NO: 38379 - DNA, 20 bp, Artificial Sequence
  chemically synthesized
atattctggaaatatgatga

SEQ ID NO: 38380 - DNA, 20 bp, Artificial Sequence
  chemically synthesized
tgaatgtactaaatgccact

SEQ ID NO: 38381 - DNA, 20 bp, Artificial Sequence
  chemically synthesized
atgtactaaatgccacttgg

SEQ ID NO: 38382 - DNA, 20 bp, Artificial Sequence
  chemically synthesized
ttggtggtaccctgcaaaaa

SEQ ID NO: 38383 - DNA, 20 bp, Artificial Sequence
  chemically synthesized
ccctgcaaaaatggttaaaa

SEQ ID NO: 38384 - DNA, 20 bp, Artificial Sequence
  chemically synthesized
tacattttattgcaataaaa

SEQ ID NO: 38385 - DNA, 20 bp, Artificial Sequence
  chemically synthesized
tttattgcaataaaaaagaa

SEQ ID NO: 38386 - DNA, 20 bp, Artificial Sequence
  chemically synthesized
aagaatagtcatcatttact

SEQ ID NO: 38387 - DNA, 20 bp, Artificial Sequence
  chemically synthesized
ttactaagcattatcctttc

SEQ ID NO: 38388 - DNA, 20 bp, Artificial Sequence
  chemically synthesized
tactaagcattatcctttcc

SEQ ID NO: 38389 - DNA, 20 bp, Artificial Sequence
  chemically synthesized
gcattatcctttccaggcac

SEQ ID NO: 38390 - DNA, 20 bp, Artificial Sequence
  chemically synthesized
ccaggcacaagcttataatg

SEQ ID NO: 38391 - DNA, 20 bp, Artificial Sequence
  chemically synthesized
atctcacttcatcctcacaa

SEQ ID NO: 38392 - DNA, 20 bp, Artificial Sequence
  chemically synthesized
ctcacaacagtcctatgaaa

SEQ ID NO: 38393 - DNA, 20 bp, Artificial Sequence
  chemically synthesized
tcacaacagtcctatgaaac

SEQ ID NO: 38394 - DNA, 20 bp, Artificial Sequence
  chemically synthesized
caacagtcctatgaaacagg

SEQ ID NO: 38395 - DNA, 20 bp, Artificial Sequence
  chemically synthesized
gttccatcactcctgctcta

SEQ ID NO: 38396 - DNA, 20 bp, Artificial Sequence
  chemically synthesized
atcactcctgctctacagtt

SEQ ID NO: 38397 - DNA, 20 bp, Artificial Sequence
  chemically synthesized
tcactcctgctctacagtta

SEQ ID NO: 38398 - DNA, 20 bp, Artificial Sequence
  chemically synthesized
gctctacagttaaggaaact

SEQ ID NO: 38399 - DNA, 20 bp, Artificial Sequence
  chemically synthesized
ctctacagttaaggaaactg

SEQ ID NO: 38400 - DNA, 20 bp, Artificial Sequence
  chemically synthesized
agttaaggaaactgaggtgt

SEQ ID NO: 38401 - DNA, 20 bp, Artificial Sequence
  chemically synthesized
gttaaggaaactgaggtgta

SEQ ID NO: 38402 - DNA, 20 bp, Artificial Sequence
  chemically synthesized
taaggaaactgaggtgtaag

SEQ ID NO: 38403 - DNA, 20 bp, Artificial Sequence
  chemically synthesized
aaggaaactgaggtgtaagg

SEQ ID NO: 38404 - DNA, 20 bp, Artificial Sequence
  chemically synthesized
tgaggtgtaaggaggttgtc

SEQ ID NO: 38405 - DNA, 20 bp, Artificial Sequence
  chemically synthesized
gaggttgtctagttcaacct

SEQ ID NO: 38406 - DNA, 20 bp, Artificial Sequence
  chemically synthesized
tgtctagttcaacctgagcc

SEQ ID NO: 38407 - DNA, 20 bp, Artificial Sequence
  chemically synthesized
gtctagttcaacctgagcct

SEQ ID NO: 38408 - DNA, 20 bp, Artificial Sequence
  chemically synthesized
tcaacctgagcctgggtctg

SEQ ID NO: 38409 - DNA, 20 bp, Artificial Sequence
  chemically synthesized
aacctgagcctgggtctgcg

SEQ ID NO: 38410 - DNA, 20 bp, Artificial Sequence
  chemically synthesized
tgcttcctccccgtgcgcgt

SEQ ID NO: 38411 - DNA, 20 bp, Artificial Sequence
  chemically synthesized
cctccacatctttgttcata

SEQ ID NO: 38412 - DNA, 20 bp, Artificial Sequence
  chemically synthesized
cttattccttaatattttct

SEQ ID NO: 38413 - DNA, 20 bp, Artificial Sequence
  chemically synthesized
ccttaatattttctgagcct

SEQ ID NO: 38414 - DNA, 20 bp, Artificial Sequence
  chemically synthesized
ctaagttcccataaattata

SEQ ID NO: 38415 - DNA, 20 bp, Artificial Sequence
  chemically synthesized
aacactgccaatttattttc

SEQ ID NO: 38416 - DNA, 20 bp, Artificial Sequence
  chemically synthesized
actgccaatttattttctag

SEQ ID NO: 38417 - DNA, 20 bp, Artificial Sequence
  chemically synthesized
ctgccaatttattttctaga

SEQ ID NO: 38418 - DNA, 20 bp, Artificial Sequence
  chemically synthesized
tattttctagaaggttatga

SEQ ID NO: 38419 - DNA, 20 bp, Artificial Sequence
  chemically synthesized
atgacagtgtaaaatgtcac

SEQ ID NO: 38420 - DNA, 20 bp, Artificial Sequence
  chemically synthesized
tcacttcaccacacttgtat

SEQ ID NO: 38421 - DNA, 20 bp, Artificial Sequence
  chemically synthesized
agtgttcaatttttaaatat

SEQ ID NO: 38422 - DNA, 20 bp, Artificial Sequence
  chemically synthesized
ttaaatattagctaatctaa

SEQ ID NO: 38423 - DNA, 20 bp, Artificial Sequence
  chemically synthesized
taaatattagctaatctaac

SEQ ID NO: 38424 - DNA, 20 bp, Artificial Sequence
  chemically synthesized
tttatacttctttgacaatt

SEQ ID NO: 38425 - DNA, 20 bp, Artificial Sequence
  chemically synthesized
ttatacttctttgacaattt

SEQ ID NO: 38426 - DNA, 20 bp, Artificial Sequence
  chemically synthesized
atacttctttgacaatttgg

SEQ ID NO: 38427 - DNA, 20 bp, Artificial Sequence
  chemically synthesized
acttctttgacaatttggga

SEQ ID NO: 38428 - DNA, 20 bp, Artificial Sequence
  chemically synthesized
tttgacaatttgggagagtg

SEQ ID NO: 38429 - DNA, 20 bp, Artificial Sequence
  chemically synthesized
tgggagagtgaagattctcc

SEQ ID NO: 38430 - DNA, 20 bp, Artificial Sequence
  chemically synthesized
ttttctttgccaaattcaaa

SEQ ID NO: 38431 - DNA, 20 bp, Artificial Sequence
  chemically synthesized
tttgccaaattcaaatagaa

SEQ ID NO: 38432 - DNA, 20 bp, Artificial Sequence
  chemically synthesized
tagaacggttgcaaaattgc

SEQ ID NO: 38433 - DNA, 20 bp, Artificial Sequence
  chemically synthesized
gaacggttgcaaaattgcca

SEQ ID NO: 38434 - DNA, 20 bp, Artificial Sequence
  chemically synthesized
aacggttgcaaaattgccag

SEQ ID NO: 38435 - DNA, 20 bp, Artificial Sequence
  chemically synthesized
cagaggaaatgctgtttttc

SEQ ID NO: 38436 - DNA, 20 bp, Artificial Sequence
  chemically synthesized
ggaaatgctgtttttccaga

SEQ ID NO: 38437 - DNA, 20 bp, Artificial Sequence
  chemically synthesized
tttttccagatggacacacc

SEQ ID NO: 38438 - DNA, 20 bp, Artificial Sequence
  chemically synthesized
ttttccagatggacacaccc

SEQ ID NO: 38439 - DNA, 20 bp, Artificial Sequence
  chemically synthesized
tttccagatggacacaccca

SEQ ID NO: 38440 - DNA, 20 bp, Artificial Sequence
  chemically synthesized
ggacacacccagggatgttt

SEQ ID NO: 38441 - DNA, 20 bp, Artificial Sequence
  chemically synthesized
cagtgttctcacaaataatc

SEQ ID NO: 38442 - DNA, 20 bp, Artificial Sequence
  chemically synthesized
atccagttttctaattttgc

SEQ ID NO: 38443 - DNA, 20 bp, Artificial Sequence
  chemically synthesized
gttttctaattttgcaagcc

SEQ ID NO: 38444 - DNA, 20 bp, Artificial Sequence
  chemically synthesized
tttgcaagcccagctttcat

SEQ ID NO: 38445 - DNA, 20 bp, Artificial Sequence
  chemically synthesized
tgcaaaaatccttgctttgc

SEQ ID NO: 38446 - DNA, 20 bp, Artificial Sequence
  chemically synthesized
aaatccttgctttgcgagca

SEQ ID NO: 38447 - DNA, 20 bp, Artificial Sequence
  chemically synthesized
cttgctttgcgagcatggca

SEQ ID NO: 38448 - DNA, 20 bp, Artificial Sequence
  chemically synthesized
ttgctttgcgagcatggcac

SEQ ID NO: 38449 - DNA, 20 bp, Artificial Sequence
  chemically synthesized
tttgcgagcatggcacaggc

SEQ ID NO: 38450 - DNA, 20 bp, Artificial Sequence
  chemically synthesized
tgcgagcatggcacaggcaa

SEQ ID NO: 38451 - DNA, 20 bp, Artificial Sequence
  chemically synthesized
gcatggcacaggcaagagat

SEQ ID NO: 38452 - DNA, 20 bp, Artificial Sequence
  chemically synthesized
catggcacaggcaagagatg

SEQ ID NO: 38453 - DNA, 20 bp, Artificial Sequence
  chemically synthesized
gcactctctctttcttcccc

SEQ ID NO: 38454 - DNA, 20 bp, Artificial Sequence
  chemically synthesized
actctctctttcttccccca

SEQ ID NO: 38455 - DNA, 20 bp, Artificial Sequence
  chemically synthesized
ccagagcctttgactgcact

SEQ ID NO: 38456 - DNA, 20 bp, Artificial Sequence
  chemically synthesized
tgcacttagatcattgactt

SEQ ID NO: 38457 - DNA, 20 bp, Artificial Sequence
  chemically synthesized
ttagatcattgactttggtt

SEQ ID NO: 38458 - DNA, 20 bp, Artificial Sequence
  chemically synthesized
ttcagaaacctgactgcatc

SEQ ID NO: 38459 - DNA, 20 bp, Artificial Sequence
  chemically synthesized
cagaaacctgactgcatctg

SEQ ID NO: 38460 - DNA, 20 bp, Artificial Sequence
  chemically synthesized
actgcatctggagttgacat

SEQ ID NO: 38461 - DNA, 20 bp, Artificial Sequence
  chemically synthesized
gcatctggagttgacatgag

SEQ ID NO: 38462 - DNA, 20 bp, Artificial Sequence
  chemically synthesized
tggagttgacatgagcagca

SEQ ID NO: 38463 - DNA, 20 bp, Artificial Sequence
  chemically synthesized
agttgacatgagcagcatgg

SEQ ID NO: 38464 - DNA, 20 bp, Artificial Sequence
  chemically synthesized
agcatggaagatgtttgtcc

SEQ ID NO: 38465 - DNA, 20 bp, Artificial Sequence
  chemically synthesized
tttgtcccagcacctcactc

SEQ ID NO: 38466 - DNA, 20 bp, Artificial Sequence
  chemically synthesized
tgtcccagcacctcactcca

SEQ ID NO: 38467 - DNA, 20 bp, Artificial Sequence
  chemically synthesized
gtcccagcacctcactccag

SEQ ID NO: 38468 - DNA, 20 bp, Artificial Sequence
  chemically synthesized
cagcacctcactccagaggc

SEQ ID NO: 38469 - DNA, 20 bp, Artificial Sequence
  chemically synthesized
cctcactccagaggccagct

SEQ ID NO: 38470 - DNA, 20 bp, Artificial Sequence
  chemically synthesized
gaggccagctcagctcaatc

SEQ ID NO: 38471 - DNA, 20 bp, Artificial Sequence
  chemically synthesized
aggccagctcagctcaatct

SEQ ID NO: 38472 - DNA, 20 bp, Artificial Sequence
  chemically synthesized
ccagctcagctcaatctggg

SEQ ID NO: 38473 - DNA, 20 bp, Artificial Sequence
  chemically synthesized
agctcagctcaatctgggca

SEQ ID NO: 38474 - DNA, 20 bp, Artificial Sequence
  chemically synthesized
atctgggcagagctgcatga

SEQ ID NO: 38475 - DNA, 20 bp, Artificial Sequence
  chemically synthesized
tgggcagagctgcatgatgg

SEQ ID NO: 38476 - DNA, 20 bp, Artificial Sequence
  chemically synthesized
gatggaagtttctgactacc

SEQ ID NO: 38477 - DNA, 20 bp, Artificial Sequence
  chemically synthesized
agtttctgactaccaagcat

SEQ ID NO: 38478 - DNA, 20 bp, Artificial Sequence
  chemically synthesized
gtttctgactaccaagcatc

SEQ ID NO: 38479 - DNA, 20 bp, Artificial Sequence
  chemically synthesized
tctgactaccaagcatcggg

SEQ ID NO: 38480 - DNA, 20 bp, Artificial Sequence
  chemically synthesized
tgactaccaagcatcgggca

SEQ ID NO: 38481 - DNA, 20 bp, Artificial Sequence
  chemically synthesized
gactaccaagcatcgggcag

SEQ ID NO: 38482 - DNA, 20 bp, Artificial Sequence
  chemically synthesized
actaccaagcatcgggcaga

SEQ ID NO: 38483 - DNA, 20 bp, Artificial Sequence
  chemically synthesized
cgggcagagggtgcatcacc

SEQ ID NO: 38484 - DNA, 20 bp, Artificial Sequence
  chemically synthesized
ggtgcatcacctggactaca

SEQ ID NO: 38485 - DNA, 20 bp, Artificial Sequence
  chemically synthesized
cctggactacatagttgtgt

SEQ ID NO: 38486 - DNA, 20 bp, Artificial Sequence
  chemically synthesized
ctggactacatagttgtgtg

SEQ ID NO: 38487 - DNA, 20 bp, Artificial Sequence
  chemically synthesized
tggactacatagttgtgtga

SEQ ID NO: 38488 - DNA, 20 bp, Artificial Sequence
  chemically synthesized
gactacatagttgtgtgagg

SEQ ID NO: 38489 - DNA, 20 bp, Artificial Sequence
  chemically synthesized
tgtgagggagcaccgttctc

SEQ ID NO: 38490 - DNA, 20 bp, Artificial Sequence
  chemically synthesized
ttctctagaatctgctattt

SEQ ID NO: 38491 - DNA, 20 bp, Artificial Sequence
  chemically synthesized
ctagaatctgctatttgagc

SEQ ID NO: 38492 - DNA, 20 bp, Artificial Sequence
  chemically synthesized
tagaatctgctatttgagca

SEQ ID NO: 38493 - DNA, 20 bp, Artificial Sequence
  chemically synthesized
caaggcaaacatcctgataa

SEQ ID NO: 38494 - DNA, 20 bp, Artificial Sequence
  chemically synthesized
taatggtgaaaacctaccgc

SEQ ID NO: 38495 - DNA, 20 bp, Artificial Sequence
  chemically synthesized
gaaaacctaccgcaagttgc

SEQ ID NO: 38496 - DNA, 20 bp, Artificial Sequence
  chemically synthesized
aaaacctaccgcaagttgcc

SEQ ID NO: 38497 - DNA, 20 bp, Artificial Sequence
  chemically synthesized
cctaccgcaagttgccagga

SEQ ID NO: 38498 - DNA, 20 bp, Artificial Sequence
  chemically synthesized
agttgccaggaaagttgatg

SEQ ID NO: 38499 - DNA, 20 bp, Artificial Sequence
  chemically synthesized
ggaaagttgatgtggtctgc

SEQ ID NO: 38500 - DNA, 20 bp, Artificial Sequence
  chemically synthesized
aagttgatgtggtctgcgag

SEQ ID NO: 38501 - DNA, 20 bp, Artificial Sequence
  chemically synthesized
agttgatgtggtctgcgagt

SEQ ID NO: 38502 - DNA, 20 bp, Artificial Sequence
  chemically synthesized
tgcgagtaggtgctgccatc

SEQ ID NO: 38503 - DNA, 20 bp, Artificial Sequence
  chemically synthesized
gagtaggtgctgccatccag

SEQ ID NO: 38504 - DNA, 20 bp, Artificial Sequence
  chemically synthesized
ctgccatccagtggccgaca

SEQ ID NO: 38505 - DNA, 20 bp, Artificial Sequence
  chemically synthesized
gccatccagtggccgacata

SEQ ID NO: 38506 - DNA, 20 bp, Artificial Sequence
  chemically synthesized
gacatagagatgtcatctct

SEQ ID NO: 38507 - DNA, 20 bp, Artificial Sequence
  chemically synthesized
acatagagatgtcatctctg

SEQ ID NO: 38508 - DNA, 20 bp, Artificial Sequence
  chemically synthesized
catagagatgtcatctctga

SEQ ID NO: 38509 - DNA, 20 bp, Artificial Sequence
  chemically synthesized
agagatgtcatctctgaggg

SEQ ID NO: 38510 - DNA, 20 bp, Artificial Sequence
  chemically synthesized
gagatgtcatctctgagggc

SEQ ID NO: 38511 - DNA, 20 bp, Artificial Sequence
  chemically synthesized
atgtcatctctgagggcagg

SEQ ID NO: 38512 - DNA, 20 bp, Artificial Sequence
  chemically synthesized
tgtcatctctgagggcaggt

SEQ ID NO: 38513 - DNA, 20 bp, Artificial Sequence
  chemically synthesized
ctctgagggcaggtaggcca

SEQ ID NO: 38514 - DNA, 20 bp, Artificial Sequence
  chemically synthesized
tctgagggcaggtaggccac

SEQ ID NO: 38515 - DNA, 20 bp, Artificial Sequence
  chemically synthesized
gcaggtaggccacaggtgac

SEQ ID NO: 38516 - DNA, 20 bp, Artificial Sequence
  chemically synthesized
aggtaggccacaggtgacaa

SEQ ID NO: 38517 - DNA, 20 bp, Artificial Sequence
  chemically synthesized
ggtaggccacaggtgacaag

SEQ ID NO: 38518 - DNA, 20 bp, Artificial Sequence
  chemically synthesized
cacaggtgacaagaggattg

SEQ ID NO: 38519 - DNA, 20 bp, Artificial Sequence
  chemically synthesized
aggattgaagccctccctga

SEQ ID NO: 38520 - DNA, 20 bp, Artificial Sequence
  chemically synthesized
ggattgaagccctccctgat

SEQ ID NO: 38521 - DNA, 20 bp, Artificial Sequence
  chemically synthesized
gattgaagccctccctgatg

SEQ ID NO: 38522 - DNA, 20 bp, Artificial Sequence
  chemically synthesized
agccctccctgatggggcct

SEQ ID NO: 38523 - DNA, 20 bp, Artificial Sequence
  chemically synthesized
gccctccctgatggggcctt

SEQ ID NO: 38524 - DNA, 20 bp, Artificial Sequence
  chemically synthesized
ccctccctgatggggccttg

SEQ ID NO: 38525 - DNA, 20 bp, Artificial Sequence
  chemically synthesized
ctccctgatggggccttggg

SEQ ID NO: 38526 - DNA, 20 bp, Artificial Sequence
  chemically synthesized
ccctgatggggccttgggga

SEQ ID NO: 38527 - DNA, 20 bp, Artificial Sequence
  chemically synthesized
cctgatggggccttggggag

SEQ ID NO: 38528 - DNA, 20 bp, Artificial Sequence
  chemically synthesized
ctgatggggccttggggaga

SEQ ID NO: 38529 - DNA, 20 bp, Artificial Sequence
  chemically synthesized
atggggccttggggagaggg

SEQ ID NO: 38530 - DNA, 20 bp, Artificial Sequence
  chemically synthesized
gggccttggggagagggcag

SEQ ID NO: 38531 - DNA, 20 bp, Artificial Sequence
  chemically synthesized
ggccttggggagagggcagc

SEQ ID NO: 38532 - DNA, 20 bp, Artificial Sequence
  chemically synthesized
gccttggggagagggcagca

SEQ ID NO: 38533 - DNA, 20 bp, Artificial Sequence
  chemically synthesized
tggggagagggcagcagggt

SEQ ID NO: 38534 - DNA, 20 bp, Artificial Sequence
  chemically synthesized
agagggcagcagggtaagtc

SEQ ID NO: 38535 - DNA, 20 bp, Artificial Sequence
  chemically synthesized
gggcagcagggtaagtccag

SEQ ID NO: 38536 - DNA, 20 bp, Artificial Sequence
  chemically synthesized
cagcagggtaagtccagcgg

SEQ ID NO: 38537 - DNA, 20 bp, Artificial Sequence
  chemically synthesized
agcagggtaagtccagcggc

SEQ ID NO: 38538 - DNA, 20 bp, Artificial Sequence
  chemically synthesized
ggtaagtccagcggcaggat

SEQ ID NO: 38539 - DNA, 20 bp, Artificial Sequence
  chemically synthesized
caggatcagtccattgattg

SEQ ID NO: 38540 - DNA, 20 bp, Artificial Sequence
  chemically synthesized
attgtggatgacgactgacc

SEQ ID NO: 38541 - DNA, 20 bp, Artificial Sequence
  chemically synthesized
actgacctggaaaatcccct

SEQ ID NO: 38542 - DNA, 20 bp, Artificial Sequence
  chemically synthesized
ccaaactctgcatttgatcc

SEQ ID NO: 38543 - DNA, 20 bp, Artificial Sequence
  chemically synthesized
actctgcatttgatccaagt

SEQ ID NO: 38544 - DNA, 20 bp, Artificial Sequence
  chemically synthesized
ctctgcatttgatccaagtc

SEQ ID NO: 38545 - DNA, 20 bp, Artificial Sequence
  chemically synthesized
tctgcatttgatccaagtca

SEQ ID NO: 38546 - DNA, 20 bp, Artificial Sequence
  chemically synthesized
gatccaagtcagggaacacc

SEQ ID NO: 38547 - DNA, 20 bp, Artificial Sequence
  chemically synthesized
agggaacacctggaaacatg

SEQ ID NO: 38548 - DNA, 20 bp, Artificial Sequence
  chemically synthesized
gggaacacctggaaacatga

SEQ ID NO: 38549 - DNA, 20 bp, Artificial Sequence
  chemically synthesized
ggaacacctggaaacatgaa

SEQ ID NO: 38550 - DNA, 20 bp, Artificial Sequence
  chemically synthesized
gaacacctggaaacatgaag

SEQ ID NO: 38551 - DNA, 20 bp, Artificial Sequence
  chemically synthesized
acacctggaaacatgaaggg

SEQ ID NO: 38552 - DNA, 20 bp, Artificial Sequence
  chemically synthesized
acctggaaacatgaagggga

SEQ ID NO: 38553 - DNA, 20 bp, Artificial Sequence
  chemically synthesized
tggaaacatgaaggggagag

SEQ ID NO: 38554 - DNA, 20 bp, Artificial Sequence
  chemically synthesized
ggaaacatgaaggggagagc

SEQ ID NO: 38555 - DNA, 20 bp, Artificial Sequence
  chemically synthesized
gaaaactttgacctccctct

SEQ ID NO: 38556 - DNA, 20 bp, Artificial Sequence
  chemically synthesized
aaactttgacctccctctca

SEQ ID NO: 38557 - DNA, 20 bp, Artificial Sequence
  chemically synthesized
aactttgacctccctctcag

SEQ ID NO: 38558 - DNA, 20 bp, Artificial Sequence
  chemically synthesized
tgacctccctctcagaggct

SEQ ID NO: 38559 - DNA, 20 bp, Artificial Sequence
  chemically synthesized
ctgatgtcattattgacatg

SEQ ID NO: 38560 - DNA, 20 bp, Artificial Sequence
  chemically synthesized
acatgtagaaaattgatgaa

SEQ ID NO: 38561 - DNA, 20 bp, Artificial Sequence
  chemically synthesized
catgtagaaaattgatgaac

SEQ ID NO: 38562 - DNA, 20 bp, Artificial Sequence
  chemically synthesized
gaaaattgatgaacaggcct

SEQ ID NO: 38563 - DNA, 20 bp, Artificial Sequence
  chemically synthesized
caggcctgagttatgttttg

SEQ ID NO: 38564 - DNA, 20 bp, Artificial Sequence
  chemically synthesized
ttatgttttgtggcacctca

SEQ ID NO: 38565 - DNA, 20 bp, Artificial Sequence
  chemically synthesized
ttttgtggcacctcatggtc

SEQ ID NO: 38566 - DNA, 20 bp, Artificial Sequence
  chemically synthesized
gtggcacctcatggtctagt

SEQ ID NO: 38567 - DNA, 20 bp, Artificial Sequence
  chemically synthesized
catggtctagttagtgttct

SEQ ID NO: 38568 - DNA, 20 bp, Artificial Sequence
  chemically synthesized
tgttctgagaatcattttct

SEQ ID NO: 38569 - DNA, 20 bp, Artificial Sequence
  chemically synthesized
tctgagaatcattttctcag

SEQ ID NO: 38570 - DNA, 20 bp, Artificial Sequence
  chemically synthesized
tcattttctcagtggacctg

SEQ ID NO: 38571 - DNA, 20 bp, Artificial Sequence
  chemically synthesized
cattttctcagtggacctgc

SEQ ID NO: 38572 - DNA, 20 bp, Artificial Sequence
  chemically synthesized
ttctcagtggacctgcaggt

SEQ ID NO: 38573 - DNA, 20 bp, Artificial Sequence
  chemically synthesized
agtggacctgcaggtgagac

SEQ ID NO: 38574 - DNA, 20 bp, Artificial Sequence
  chemically synthesized
gtggacctgcaggtgagacc

SEQ ID NO: 38575 - DNA, 20 bp, Artificial Sequence
  chemically synthesized
acctgcaggtgagaccaggc

SEQ ID NO: 38576 - DNA, 20 bp, Artificial Sequence
  chemically synthesized
cctgcaggtgagaccaggcg

SEQ ID NO: 38577 - DNA, 20 bp, Artificial Sequence
  chemically synthesized
gcaggtgagaccaggcgagg

SEQ ID NO: 38578 - DNA, 20 bp, Artificial Sequence
  chemically synthesized
ggtgagaccaggcgaggcag

SEQ ID NO: 38579 - DNA, 20 bp, Artificial Sequence
  chemically synthesized
gaccaggcgaggcagaagcc

SEQ ID NO: 38580 - DNA, 20 bp, Artificial Sequence
  chemically synthesized
caggcgaggcagaagcctag

SEQ ID NO: 38581 - DNA, 20 bp, Artificial Sequence
  chemically synthesized
aggcgaggcagaagcctagt

SEQ ID NO: 38582 - DNA, 20 bp, Artificial Sequence
  chemically synthesized
ggcgaggcagaagcctagtg

SEQ ID NO: 38583 - DNA, 20 bp, Artificial Sequence
  chemically synthesized
gcgaggcagaagcctagtgg

SEQ ID NO: 38584 - DNA, 20 bp, Artificial Sequence
  chemically synthesized
ggcagaagcctagtggggga

SEQ ID NO: 38585 - DNA, 20 bp, Artificial Sequence
  chemically synthesized
agaagcctagtgggggatgg

SEQ ID NO: 38586 - DNA, 20 bp, Artificial Sequence
  chemically synthesized
gcctagtgggggatggtggt

SEQ ID NO: 38587 - DNA, 20 bp, Artificial Sequence
  chemically synthesized
ggatggtggttagaaatgtg

SEQ ID NO: 38588 - DNA, 20 bp, Artificial Sequence
  chemically synthesized
ggtggttagaaatgtgtgga

SEQ ID NO: 38589 - DNA, 20 bp, Artificial Sequence
  chemically synthesized
tagaaatgtgtggatggttg

SEQ ID NO: 38590 - DNA, 20 bp, Artificial Sequence
  chemically synthesized
agaaatgtgtggatggttgt

SEQ ID NO: 38591 - DNA, 20 bp, Artificial Sequence
  chemically synthesized
gaaatgtgtggatggttgtg

SEQ ID NO: 38592 - DNA, 20 bp, Artificial Sequence
  chemically synthesized
atgtgtggatggttgtgggg

SEQ ID NO: 38593 - DNA, 20 bp, Artificial Sequence
  chemically synthesized
tgtggatggttgtggggcag

SEQ ID NO: 38594 - DNA, 20 bp, Artificial Sequence
  chemically synthesized
tggttgtggggcagaagaaa

SEQ ID NO: 38595 - DNA, 20 bp, Artificial Sequence
  chemically synthesized
tgtggggcagaagaaacagc

SEQ ID NO: 38596 - DNA, 20 bp, Artificial Sequence
  chemically synthesized
ggggcagaagaaacagcaag

SEQ ID NO: 38597 - DNA, 20 bp, Artificial Sequence
  chemically synthesized
gggcagaagaaacagcaagt

SEQ ID NO: 38598 - DNA, 20 bp, Artificial Sequence
  chemically synthesized
aagaaacagcaagtaggctc

SEQ ID NO: 38599 - DNA, 20 bp, Artificial Sequence
  chemically synthesized
agaaacagcaagtaggctct

SEQ ID NO: 38600 - DNA, 20 bp, Artificial Sequence
  chemically synthesized
acagcaagtaggctctgggc

SEQ ID NO: 38601 - DNA, 20 bp, Artificial Sequence
  chemically synthesized
gctctgggccagctacaaac

SEQ ID NO: 38602 - DNA, 20 bp, Artificial Sequence
  chemically synthesized
atgatgtctactgatgatga

SEQ ID NO: 38603 - DNA, 20 bp, Artificial Sequence
  chemically synthesized
tctactgatgatgatagtga

SEQ ID NO: 38604 - DNA, 20 bp, Artificial Sequence
  chemically synthesized
actgatgatgatagtgatgg

SEQ ID NO: 38605 - DNA, 20 bp, Artificial Sequence
  chemically synthesized
gatgatgatagtgatggtgg

SEQ ID NO: 38606 - DNA, 20 bp, Artificial Sequence
  chemically synthesized
gatgatagtgatggtggtgg

SEQ ID NO: 38607 - DNA, 20 bp, Artificial Sequence
  chemically synthesized
gatagtgatggtggtggtgg

SEQ ID NO: 38608 - DNA, 20 bp, Artificial Sequence
  chemically synthesized
gatggtggtggtggtggtga

SEQ ID NO: 38609 - DNA, 20 bp, Artificial Sequence
  chemically synthesized
ggtggtggtggtggtgatgg

SEQ ID NO: 38610 - DNA, 20 bp, Artificial Sequence
  chemically synthesized
ggtggtggtggtgatggtgg

SEQ ID NO: 38611 - DNA, 20 bp, Artificial Sequence
  chemically synthesized
ggtggtggtgatggtggtgg

SEQ ID NO: 38612 - DNA, 20 bp, Artificial Sequence
  chemically synthesized
ggtggtggtaataattgtga

SEQ ID NO: 38613 - DNA, 20 bp, Artificial Sequence
  chemically synthesized
ggtggtaataattgtgatgg

SEQ ID NO: 38614 - DNA, 20 bp, Artificial Sequence
  chemically synthesized
ggtaataattgtgatggtgg

SEQ ID NO: 38615 - DNA, 20 bp, Artificial Sequence
  chemically synthesized
tggtggtggaatgatgatga

SEQ ID NO: 38616 - DNA, 20 bp, Artificial Sequence
  chemically synthesized
tggtggaatgatgatgatgg

SEQ ID NO: 38617 - DNA, 20 bp, Artificial Sequence
  chemically synthesized
tggaatgatgatgatggtgg

SEQ ID NO: 38618 - DNA, 20 bp, Artificial Sequence
  chemically synthesized
aatgatgatgatggtggtgg

SEQ ID NO: 38619 - DNA, 20 bp, Artificial Sequence
  chemically synthesized
atgatgatgatggtggtggt

SEQ ID NO: 38620 - DNA, 20 bp, Artificial Sequence
  chemically synthesized
atgatgatggtggtggtggg

SEQ ID NO: 38621 - DNA, 20 bp, Artificial Sequence
  chemically synthesized
gtggtggtgggtagtaatga

SEQ ID NO: 38622 - DNA, 20 bp, Artificial Sequence
  chemically synthesized
gtgggtagtaatgatggtgt

SEQ ID NO: 38623 - DNA, 20 bp, Artificial Sequence
  chemically synthesized
agtaatgatggtgttggtga

SEQ ID NO: 38624 - DNA, 20 bp, Artificial Sequence
  chemically synthesized
aatgatggtgttggtgatgg

SEQ ID NO: 38625 - DNA, 20 bp, Artificial Sequence
  chemically synthesized
gatggtgttggtgatggtgg

SEQ ID NO: 38626 - DNA, 20 bp, Artificial Sequence
  chemically synthesized
ggtgttggtgatggtggtag

SEQ ID NO: 38627 - DNA, 20 bp, Artificial Sequence
  chemically synthesized
ggtgatggtggtagtggtcg

SEQ ID NO: 38628 - DNA, 20 bp, Artificial Sequence
  chemically synthesized
ggtggtagtggtcgtggtga

SEQ ID NO: 38629 - DNA, 20 bp, Artificial Sequence
  chemically synthesized
agtggtcgtggtgatggtga

SEQ ID NO: 38630 - DNA, 20 bp, Artificial Sequence
  chemically synthesized
cgtggtgatggtgatagtga

SEQ ID NO: 38631 - DNA, 20 bp, Artificial Sequence
  chemically synthesized
gatggtgatagtgatagtga

SEQ ID NO: 38632 - DNA, 20 bp, Artificial Sequence
  chemically synthesized
ggtgatagtgatagtgatgg

SEQ ID NO: 38633 - DNA, 20 bp, Artificial Sequence
  chemically synthesized
gatagtgatagtgatggtgg

SEQ ID NO: 38634 - DNA, 20 bp, Artificial Sequence
  chemically synthesized
ggtggtaatgataatgctaa

SEQ ID NO: 38635 - DNA, 20 bp, Artificial Sequence
  chemically synthesized
ggtaatgataatgctaatgg

SEQ ID NO: 38636 - DNA, 20 bp, Artificial Sequence
  chemically synthesized
aatgataatgctaatggtgg

SEQ ID NO: 38637 - DNA, 20 bp, Artificial Sequence
  chemically synthesized
gataatgattatcatgatga

SEQ ID NO: 38638 - DNA, 20 bp, Artificial Sequence
  chemically synthesized
aatgattatcatgatgatag

SEQ ID NO: 38639 - DNA, 20 bp, Artificial Sequence
  chemically synthesized
gattatcatgatgatagcgg

SEQ ID NO: 38640 - DNA, 20 bp, Artificial Sequence
  chemically synthesized
catgatgatagcggtggtga

SEQ ID NO: 38641 - DNA, 20 bp, Artificial Sequence
  chemically synthesized
gatagcggtggtgatggtga

SEQ ID NO: 38642 - DNA, 20 bp, Artificial Sequence
  chemically synthesized
gatggtgatggtgatgataa

SEQ ID NO: 38643 - DNA, 20 bp, Artificial Sequence
  chemically synthesized
gatggtgatgataatggtga

SEQ ID NO: 38644 - DNA, 20 bp, Artificial Sequence
  chemically synthesized
ggtgatgataatggtgatgg

SEQ ID NO: 38645 - DNA, 20 bp, Artificial Sequence
  chemically synthesized
gatgataatggtgatggtgg

SEQ ID NO: 38646 - DNA, 20 bp, Artificial Sequence
  chemically synthesized
tggtggtagaatgatgatga

SEQ ID NO: 38647 - DNA, 20 bp, Artificial Sequence
  chemically synthesized
tagaatgatgatgatggtga

SEQ ID NO: 38648 - DNA, 20 bp, Artificial Sequence
  chemically synthesized
aatgatgatgatggtgatgg

SEQ ID NO: 38649 - DNA, 20 bp, Artificial Sequence
  chemically synthesized
gatgatgatggtgatggtgg

SEQ ID NO: 38650 - DNA, 20 bp, Artificial Sequence
  chemically synthesized
gatgatggtgatggtggtgg

SEQ ID NO: 38651 - DNA, 20 bp, Artificial Sequence
  chemically synthesized
gatggtgatggtggtggtgg

SEQ ID NO: 38652 - DNA, 20 bp, Artificial Sequence
  chemically synthesized
ggtgatggtggtggtggtgg

SEQ ID NO: 38653 - DNA, 20 bp, Artificial Sequence
  chemically synthesized
ggtggtggtagtaatgatga

SEQ ID NO: 38654 - DNA, 20 bp, Artificial Sequence
  chemically synthesized
ggtggtagtaatgatgatgg

SEQ ID NO: 38655 - DNA, 20 bp, Artificial Sequence
  chemically synthesized
ggtagtaatgatgatggtgg

SEQ ID NO: 38656 - DNA, 20 bp, Artificial Sequence
  chemically synthesized
atggtggtggtgatgatgtt

SEQ ID NO: 38657 - DNA, 20 bp, Artificial Sequence
  chemically synthesized
tggtggtggtgatgatgttg

SEQ ID NO: 38658 - DNA, 20 bp, Artificial Sequence
  chemically synthesized
ggtggtggtgatgatgttga

SEQ ID NO: 38659 - DNA, 20 bp, Artificial Sequence
  chemically synthesized
gatgttgagggtgatgataa

SEQ ID NO: 38660 - DNA, 20 bp, Artificial Sequence
  chemically synthesized
gagggtgatgataatagtga

SEQ ID NO: 38661 - DNA, 20 bp, Artificial Sequence
  chemically synthesized
ggtgatgataatagtgacag

SEQ ID NO: 38662 - DNA, 20 bp, Artificial Sequence
  chemically synthesized
gatgataatagtgacagtgg

SEQ ID NO: 38663 - DNA, 20 bp, Artificial Sequence
  chemically synthesized
gataatagtgacagtggtgg

SEQ ID NO: 38664 - DNA, 20 bp, Artificial Sequence
  chemically synthesized
agtggtggtggtaatgataa

SEQ ID NO: 38665 - DNA, 20 bp, Artificial Sequence
  chemically synthesized
ggtggtaatgataatggtga

SEQ ID NO: 38666 - DNA, 20 bp, Artificial Sequence
  chemically synthesized
ggtaatgataatggtgatgg

SEQ ID NO: 38667 - DNA, 20 bp, Artificial Sequence
  chemically synthesized
taatggtgatggtggaatga

SEQ ID NO: 38668 - DNA, 20 bp, Artificial Sequence
  chemically synthesized
tgatggtggaatgatggtga

SEQ ID NO: 38669 - DNA, 20 bp, Artificial Sequence
  chemically synthesized
tggtggaatgatggtgatgg

SEQ ID NO: 38670 - DNA, 20 bp, Artificial Sequence
  chemically synthesized
tggaatgatggtgatggtgg

SEQ ID NO: 38671 - DNA, 20 bp, Artificial Sequence
  chemically synthesized
tgatggtggtggaatgatga

SEQ ID NO: 38672 - DNA, 20 bp, Artificial Sequence
  chemically synthesized
tggtggtggaatgatgatgg

SEQ ID NO: 38673 - DNA, 20 bp, Artificial Sequence
  chemically synthesized
ggaatgatgatggtggtgct

SEQ ID NO: 38674 - DNA, 20 bp, Artificial Sequence
  chemically synthesized
atgatgatggtggtgctgag

SEQ ID NO: 38675 - DNA, 20 bp, Artificial Sequence
  chemically synthesized
gtggtgctgagtagtaatga

SEQ ID NO: 38676 - DNA, 20 bp, Artificial Sequence
  chemically synthesized
ctgagtagtaatgatggtga

SEQ ID NO: 38677 - DNA, 20 bp, Artificial Sequence
  chemically synthesized
agtagtaatgatggtgatgg

SEQ ID NO: 38678 - DNA, 20 bp, Artificial Sequence
  chemically synthesized
agtaatgatggtgatggtgg

SEQ ID NO: 38679 - DNA, 20 bp, Artificial Sequence
  chemically synthesized
aatgatggtgatggtggtgg

SEQ ID NO: 38680 - DNA, 20 bp, Artificial Sequence
  chemically synthesized
ggtgatggtggtggtggctg

SEQ ID NO: 38681 - DNA, 20 bp, Artificial Sequence
  chemically synthesized
ggtggtggctgtggtgatga

SEQ ID NO: 38682 - DNA, 20 bp, Artificial Sequence
  chemically synthesized
ggtggctgtggtgatgatgg

SEQ ID NO: 38683 - DNA, 20 bp, Artificial Sequence
  chemically synthesized
ggctgtggtgatgatggtgg

SEQ ID NO: 38684 - DNA, 20 bp, Artificial Sequence
  chemically synthesized
tgtggtgatgatggtggtgg

SEQ ID NO: 38685 - DNA, 20 bp, Artificial Sequence
  chemically synthesized
ggtgatgatggtggtggtag

SEQ ID NO: 38686 - DNA, 20 bp, Artificial Sequence
  chemically synthesized
gatgatggtggtggtagtgg

SEQ ID NO: 38687 - DNA, 20 bp, Artificial Sequence
  chemically synthesized
ggtagtggtagtaacgatga

SEQ ID NO: 38688 - DNA, 20 bp, Artificial Sequence
  chemically synthesized
agtggtagtaacgatgatgg

SEQ ID NO: 38689 - DNA, 20 bp, Artificial Sequence
  chemically synthesized
ggtagtaacgatgatggtgg

SEQ ID NO: 38690 - DNA, 20 bp, Artificial Sequence
  chemically synthesized
gatgatggtggtggtgatga

SEQ ID NO: 38691 - DNA, 20 bp, Artificial Sequence
  chemically synthesized
ggtggtgatgatagtgatga

SEQ ID NO: 38692 - DNA, 20 bp, Artificial Sequence
  chemically synthesized
gtgatgatggtgatgatgtt

SEQ ID NO: 38693 - DNA, 20 bp, Artificial Sequence
  chemically synthesized
tgatgatggtgatgatgttg

SEQ ID NO: 38694 - DNA, 20 bp, Artificial Sequence
  chemically synthesized
gatgatggtgatgatgttga

SEQ ID NO: 38695 - DNA, 20 bp, Artificial Sequence
  chemically synthesized
gatgttgagggtgatgataa

SEQ ID NO: 38696 - DNA, 20 bp, Artificial Sequence
  chemically synthesized
gagggtgatgataatagtga

SEQ ID NO: 38697 - DNA, 20 bp, Artificial Sequence
  chemically synthesized
ggtgatgataatagtgatag

SEQ ID NO: 38698 - DNA, 20 bp, Artificial Sequence
  chemically synthesized
gatgataatagtgatagcgg

SEQ ID NO: 38699 - DNA, 20 bp, Artificial Sequence
  chemically synthesized
taccaccaccatcatcacca

SEQ ID NO: 38700 - DNA, 20 bp, Artificial Sequence
  chemically synthesized
ccatcaccatcattactact

SEQ ID NO: 38701 - DNA, 20 bp, Artificial Sequence
  chemically synthesized
attatcattaccaccaccat

SEQ ID NO: 38702 - DNA, 20 bp, Artificial Sequence
  chemically synthesized
accaccatcactatcatcat

SEQ ID NO: 38703 - DNA, 20 bp, Artificial Sequence
  chemically synthesized
accatcactatcatcatcag

SEQ ID NO: 38704 - DNA, 20 bp, Artificial Sequence
  chemically synthesized
atcagtagacatcatataac

SEQ ID NO: 38705 - DNA, 20 bp, Artificial Sequence
  chemically synthesized
gacatcatataaccagtttg

SEQ ID NO: 38706 - DNA, 20 bp, Artificial Sequence
  chemically synthesized
tcatataaccagtttgtagc

SEQ ID NO: 38707 - DNA, 20 bp, Artificial Sequence
  chemically synthesized
taaccagtttgtagctggcc

SEQ ID NO: 38708 - DNA, 20 bp, Artificial Sequence
  chemically synthesized
accagtttgtagctggccca

SEQ ID NO: 38709 - DNA, 20 bp, Artificial Sequence
  chemically synthesized
ttctaaccaccatcccccac

SEQ ID NO: 38710 - DNA, 20 bp, Artificial Sequence
  chemically synthesized
tctaaccaccatcccccact

SEQ ID NO: 38711 - DNA, 20 bp, Artificial Sequence
  chemically synthesized
cactaggcttctgcctcgcc

SEQ ID NO: 38712 - DNA, 20 bp, Artificial Sequence
  chemically synthesized
gcctcgcctggtctcacctg

SEQ ID NO: 38713 - DNA, 20 bp, Artificial Sequence
  chemically synthesized
cctcgcctggtctcacctgc

SEQ ID NO: 38714 - DNA, 20 bp, Artificial Sequence
  chemically synthesized
gtctcacctgcaggtccact

SEQ ID NO: 38715 - DNA, 20 bp, Artificial Sequence
  chemically synthesized
tccactgagaaaatgattct

SEQ ID NO: 38716 - DNA, 20 bp, Artificial Sequence
  chemically synthesized
atgattctcagaacactaac

SEQ ID NO: 38717 - DNA, 20 bp, Artificial Sequence
  chemically synthesized
cagaacactaactagaccat

SEQ ID NO: 38718 - DNA, 20 bp, Artificial Sequence
  chemically synthesized
agaacactaactagaccatg

SEQ ID NO: 38719 - DNA, 20 bp, Artificial Sequence
  chemically synthesized
aggtgccacaaaacataact

SEQ ID NO: 38720 - DNA, 20 bp, Artificial Sequence
  chemically synthesized
ggtgccacaaaacataactc

SEQ ID NO: 38721 - DNA, 20 bp, Artificial Sequence
  chemically synthesized
ctacatgtcaataatgacat

SEQ ID NO: 38722 - DNA, 20 bp, Artificial Sequence
  chemically synthesized
tacatgtcaataatgacatc

SEQ ID NO: 38723 - DNA, 20 bp, Artificial Sequence
  chemically synthesized
aataatgacatcaggtcaat

SEQ ID NO: 38724 - DNA, 20 bp, Artificial Sequence
  chemically synthesized
atcaggtcaattggcgttct

SEQ ID NO: 38725 - DNA, 20 bp, Artificial Sequence
  chemically synthesized
aattggcgttctcagcctct

SEQ ID NO: 38726 - DNA, 20 bp, Artificial Sequence
  chemically synthesized
ttggcgttctcagcctctga

SEQ ID NO: 38727 - DNA, 20 bp, Artificial Sequence
  chemically synthesized
tggcgttctcagcctctgag

SEQ ID NO: 38728 - DNA, 20 bp, Artificial Sequence
  chemically synthesized
ggcgttctcagcctctgaga

SEQ ID NO: 38729 - DNA, 20 bp, Artificial Sequence
  chemically synthesized
cgttctcagcctctgagagg

SEQ ID NO: 38730 - DNA, 20 bp, Artificial Sequence
  chemically synthesized
gttctcagcctctgagaggg

SEQ ID NO: 38731 - DNA, 20 bp, Artificial Sequence
  chemically synthesized
agcctctgagagggaggtca

SEQ ID NO: 38732 - DNA, 20 bp, Artificial Sequence
  chemically synthesized
tgctctccccttcatgtttc

SEQ ID NO: 38733 - DNA, 20 bp, Artificial Sequence
  chemically synthesized
gctctccccttcatgtttcc

SEQ ID NO: 38734 - DNA, 20 bp, Artificial Sequence
  chemically synthesized
tttccaggtgttccctgact

SEQ ID NO: 38735 - DNA, 20 bp, Artificial Sequence
  chemically synthesized
tccctgacttggatcaaatg

SEQ ID NO: 38736 - DNA, 20 bp, Artificial Sequence
  chemically synthesized
cctgacttggatcaaatgca

SEQ ID NO: 38737 - DNA, 20 bp, Artificial Sequence
  chemically synthesized
cttggatcaaatgcagagtt

SEQ ID NO: 38738 - DNA, 20 bp, Artificial Sequence
  chemically synthesized
tggatcaaatgcagagtttg

SEQ ID NO: 38739 - DNA, 20 bp, Artificial Sequence
  chemically synthesized
ggatcaaatgcagagtttgg

SEQ ID NO: 38740 - DNA, 20 bp, Artificial Sequence
  chemically synthesized
atgcagagtttggaggtgtt

SEQ ID NO: 38741 - DNA, 20 bp, Artificial Sequence
  chemically synthesized
tgcagagtttggaggtgttg

SEQ ID NO: 38742 - DNA, 20 bp, Artificial Sequence
  chemically synthesized
agtttggaggtgttgaggcc

SEQ ID NO: 38743 - DNA, 20 bp, Artificial Sequence
  chemically synthesized
gtttggaggtgttgaggcca

SEQ ID NO: 38744 - DNA, 20 bp, Artificial Sequence
  chemically synthesized
tttggaggtgttgaggccaa

SEQ ID NO: 38745 - DNA, 20 bp, Artificial Sequence
  chemically synthesized
ttggaggtgttgaggccaag

SEQ ID NO: 38746 - DNA, 20 bp, Artificial Sequence
  chemically synthesized
ttgaggccaaggggattttc

SEQ ID NO: 38747 - DNA, 20 bp, Artificial Sequence
  chemically synthesized
tgaggccaaggggattttcc

SEQ ID NO: 38748 - DNA, 20 bp, Artificial Sequence
  chemically synthesized
gccaaggggattttccaggt

SEQ ID NO: 38749 - DNA, 20 bp, Artificial Sequence
  chemically synthesized
cagtcgtcatccacaatcaa

SEQ ID NO: 38750 - DNA, 20 bp, Artificial Sequence
  chemically synthesized
caatggactgatcctgccgc

SEQ ID NO: 38751 - DNA, 20 bp, Artificial Sequence
  chemically synthesized
taccctgctgccctctcccc

SEQ ID NO: 38752 - DNA, 20 bp, Artificial Sequence
  chemically synthesized
accctgctgccctctcccca

SEQ ID NO: 38753 - DNA, 20 bp, Artificial Sequence
  chemically synthesized
ccctctccccaaggccccat

SEQ ID NO: 38754 - DNA, 20 bp, Artificial Sequence
  chemically synthesized
cctctccccaaggccccatc

SEQ ID NO: 38755 - DNA, 20 bp, Artificial Sequence
  chemically synthesized
ctctccccaaggccccatca

SEQ ID NO: 38756 - DNA, 20 bp, Artificial Sequence
  chemically synthesized
ctccccaaggccccatcagg

SEQ ID NO: 38757 - DNA, 20 bp, Artificial Sequence
  chemically synthesized
tccccaaggccccatcaggg

SEQ ID NO: 38758 - DNA, 20 bp, Artificial Sequence
  chemically synthesized
ccccaaggccccatcaggga

SEQ ID NO: 38759 - DNA, 20 bp, Artificial Sequence
  chemically synthesized
ttcaatcctcttgtcacctg

SEQ ID NO: 38760 - DNA, 20 bp, Artificial Sequence
  chemically synthesized
acctgtggcctacctgccct

SEQ ID NO: 38761 - DNA, 20 bp, Artificial Sequence
  chemically synthesized
ctgtggcctacctgccctca

SEQ ID NO: 38762 - DNA, 20 bp, Artificial Sequence
  chemically synthesized
cagagatgacatctctatgt

SEQ ID NO: 38763 - DNA, 20 bp, Artificial Sequence
  chemically synthesized
gacatctctatgtcggccac

SEQ ID NO: 38764 - DNA, 20 bp, Artificial Sequence
  chemically synthesized
tctctatgtcggccactgga

SEQ ID NO: 38765 - DNA, 20 bp, Artificial Sequence
  chemically synthesized
ctatgtcggccactggatgg

SEQ ID NO: 38766 - DNA, 20 bp, Artificial Sequence
  chemically synthesized
tggatggcagcacctactcg

SEQ ID NO: 38767 - DNA, 20 bp, Artificial Sequence
  chemically synthesized
gcagaccacatcaactttcc

SEQ ID NO: 38768 - DNA, 20 bp, Artificial Sequence
  chemically synthesized
tcaactttcctggcaacttg

SEQ ID NO: 38769 - DNA, 20 bp, Artificial Sequence
  chemically synthesized
actttcctggcaacttgcgg

SEQ ID NO: 38770 - DNA, 20 bp, Artificial Sequence
  chemically synthesized
ctttcctggcaacttgcggt

SEQ ID NO: 38771 - DNA, 20 bp, Artificial Sequence
  chemically synthesized
cggtaggttttcaccattat

SEQ ID NO: 38772 - DNA, 20 bp, Artificial Sequence
  chemically synthesized
ggtaggttttcaccattatc

SEQ ID NO: 38773 - DNA, 20 bp, Artificial Sequence
  chemically synthesized
ggatgtttgccttgctcaaa

SEQ ID NO: 38774 - DNA, 20 bp, Artificial Sequence
  chemically synthesized
tgtttgccttgctcaaatag

SEQ ID NO: 38775 - DNA, 20 bp, Artificial Sequence
  chemically synthesized
cttgctcaaatagcagattc

SEQ ID NO: 38776 - DNA, 20 bp, Artificial Sequence
  chemically synthesized
tgctcaaatagcagattcta

SEQ ID NO: 38777 - DNA, 20 bp, Artificial Sequence
  chemically synthesized
aaatagcagattctagagaa

SEQ ID NO: 38778 - DNA, 20 bp, Artificial Sequence
  chemically synthesized
tgctccctcacacaactatg

SEQ ID NO: 38779 - DNA, 20 bp, Artificial Sequence
  chemically synthesized
cctcacacaactatgtagtc

SEQ ID NO: 38780 - DNA, 20 bp, Artificial Sequence
  chemically synthesized
ctcacacaactatgtagtcc

SEQ ID NO: 38781 - DNA, 20 bp, Artificial Sequence
  chemically synthesized
tgcaccctctgcccgatgct

SEQ ID NO: 38782 - DNA, 20 bp, Artificial Sequence
  chemically synthesized
accctctgcccgatgcttgg

SEQ ID NO: 38783 - DNA, 20 bp, Artificial Sequence
  chemically synthesized
tctgcccgatgcttggtagt

SEQ ID NO: 38784 - DNA, 20 bp, Artificial Sequence
  chemically synthesized
agtcagaaacttccatcatg

SEQ ID NO: 38785 - DNA, 20 bp, Artificial Sequence
  chemically synthesized
ttccatcatgcagctctgcc

SEQ ID NO: 38786 - DNA, 20 bp, Artificial Sequence
  chemically synthesized
catgcagctctgcccagatt

SEQ ID NO: 38787 - DNA, 20 bp, Artificial Sequence
  chemically synthesized
agctctgcccagattgagct

SEQ ID NO: 38788 - DNA, 20 bp, Artificial Sequence
  chemically synthesized
ctgcccagattgagctgagc

SEQ ID NO: 38789 - DNA, 20 bp, Artificial Sequence
  chemically synthesized
gattgagctgagctggcctc

SEQ ID NO: 38790 - DNA, 20 bp, Artificial Sequence
  chemically synthesized
ttgagctgagctggcctctg

SEQ ID NO: 38791 - DNA, 20 bp, Artificial Sequence
  chemically synthesized
gctgagctggcctctggagt

SEQ ID NO: 38792 - DNA, 20 bp, Artificial Sequence
  chemically synthesized
ctgagctggcctctggagtg

SEQ ID NO: 38793 - DNA, 20 bp, Artificial Sequence
  chemically synthesized
tggcctctggagtgaggtgc

SEQ ID NO: 38794 - DNA, 20 bp, Artificial Sequence
  chemically synthesized
ggcctctggagtgaggtgct

SEQ ID NO: 38795 - DNA, 20 bp, Artificial Sequence
  chemically synthesized
catgctgctcatgtcaactc

SEQ ID NO: 38796 - DNA, 20 bp, Artificial Sequence
  chemically synthesized
gctcatgtcaactccagatg

SEQ ID NO: 38797 - DNA, 20 bp, Artificial Sequence
  chemically synthesized
atgtcaactccagatgcagt

SEQ ID NO: 38798 - DNA, 20 bp, Artificial Sequence
  chemically synthesized
tgtcaactccagatgcagtc

SEQ ID NO: 38799 - DNA, 20 bp, Artificial Sequence
  chemically synthesized
gcagtcaggtttctgaacca

SEQ ID NO: 38800 - DNA, 20 bp, Artificial Sequence
  chemically synthesized
tgaaccaaagtcaatgatct

SEQ ID NO: 38801 - DNA, 20 bp, Artificial Sequence
  chemically synthesized
caaagtcaatgatctaagtg

SEQ ID NO: 38802 - DNA, 20 bp, Artificial Sequence
  chemically synthesized
caatgatctaagtgcagtca

SEQ ID NO: 38803 - DNA, 20 bp, Artificial Sequence
  chemically synthesized
aatgatctaagtgcagtcaa

SEQ ID NO: 38804 - DNA, 20 bp, Artificial Sequence
  chemically synthesized
ctaagtgcagtcaaaggctc

SEQ ID NO: 38805 - DNA, 20 bp, Artificial Sequence
  chemically synthesized
taagtgcagtcaaaggctct

SEQ ID NO: 38806 - DNA, 20 bp, Artificial Sequence
  chemically synthesized
aagtgcagtcaaaggctctg

SEQ ID NO: 38807 - DNA, 20 bp, Artificial Sequence
  chemically synthesized
agtgcagtcaaaggctctgg

SEQ ID NO: 38808 - DNA, 20 bp, Artificial Sequence
  chemically synthesized
gcagtcaaaggctctggggg

SEQ ID NO: 38809 - DNA, 20 bp, Artificial Sequence
  chemically synthesized
tcaaaggctctgggggaaga

SEQ ID NO: 38810 - DNA, 20 bp, Artificial Sequence
  chemically synthesized
aaaggctctgggggaagaaa

SEQ ID NO: 38811 - DNA, 20 bp, Artificial Sequence
  chemically synthesized
aggctctgggggaagaaaga

SEQ ID NO: 38812 - DNA, 20 bp, Artificial Sequence
  chemically synthesized
gctctgggggaagaaagaga

SEQ ID NO: 38813 - DNA, 20 bp, Artificial Sequence
  chemically synthesized
ttgcctgtgccatgctcgca

SEQ ID NO: 38814 - DNA, 20 bp, Artificial Sequence
  chemically synthesized
ctgtgccatgctcgcaaagc

SEQ ID NO: 38815 - DNA, 20 bp, Artificial Sequence
  chemically synthesized
tgtgccatgctcgcaaagca

SEQ ID NO: 38816 - DNA, 20 bp, Artificial Sequence
  chemically synthesized
tttttgcaaaattctaatga

SEQ ID NO: 38817 - DNA, 20 bp, Artificial Sequence
  chemically synthesized
tgcaaaattctaatgaaagc

SEQ ID NO: 38818 - DNA, 20 bp, Artificial Sequence
  chemically synthesized
gcaaaattctaatgaaagct

SEQ ID NO: 38819 - DNA, 20 bp, Artificial Sequence
  chemically synthesized
gaaagctgggcttgcaaaat

SEQ ID NO: 38820 - DNA, 20 bp, Artificial Sequence
  chemically synthesized
ggcttgcaaaattagaaaac

SEQ ID NO: 38821 - DNA, 20 bp, Artificial Sequence
  chemically synthesized
tagaaaactggattatttgt

SEQ ID NO: 38822 - DNA, 20 bp, Artificial Sequence
  chemically synthesized
tgagaacactgaaacatccc

SEQ ID NO: 38823 - DNA, 20 bp, Artificial Sequence
  chemically synthesized
gagaacactgaaacatccct

SEQ ID NO: 38824 - DNA, 20 bp, Artificial Sequence
  chemically synthesized
catccctgggtgtgtccatc

SEQ ID NO: 38825 - DNA, 20 bp, Artificial Sequence
  chemically synthesized
ggtgtgtccatctggaaaaa

SEQ ID NO: 38826 - DNA, 20 bp, Artificial Sequence
  chemically synthesized
tggaaaaacagcatttcctc

SEQ ID NO: 38827 - DNA, 20 bp, Artificial Sequence
  chemically synthesized
gcaaccgttctatttgaatt

SEQ ID NO: 38828 - DNA, 20 bp, Artificial Sequence
  chemically synthesized
cgttctatttgaatttggca

SEQ ID NO: 38829 - DNA, 20 bp, Artificial Sequence
  chemically synthesized
tgaatttggcaaagaaaata

SEQ ID NO: 38830 - DNA, 20 bp, Artificial Sequence
  chemically synthesized
atttggcaaagaaaataaag

SEQ ID NO: 38831 - DNA, 20 bp, Artificial Sequence
  chemically synthesized
aataaagcagtttttcacaa

SEQ ID NO: 38832 - DNA, 20 bp, Artificial Sequence
  chemically synthesized
cacaaaagaataaacacaac

SEQ ID NO: 38833 - DNA, 20 bp, Artificial Sequence
  chemically synthesized
acaaaagaataaacacaacc

SEQ ID NO: 38834 - DNA, 20 bp, Artificial Sequence
  chemically synthesized
aaaagaataaacacaaccag

SEQ ID NO: 38835 - DNA, 20 bp, Artificial Sequence
  chemically synthesized
ttcactctcccaaattgtca

SEQ ID NO: 38836 - DNA, 20 bp, Artificial Sequence
  chemically synthesized
actctcccaaattgtcaaag

SEQ ID NO: 38837 - DNA, 20 bp, Artificial Sequence
  chemically synthesized
attgtcaaagaagtataaat

SEQ ID NO: 38838 - DNA, 20 bp, Artificial Sequence
  chemically synthesized
gtataaattagaaaatgaat

SEQ ID NO: 38839 - DNA, 20 bp, Artificial Sequence
  chemically synthesized
tataaattagaaaatgaatc

SEQ ID NO: 38840 - DNA, 20 bp, Artificial Sequence
  chemically synthesized
tcaggacaatttcaacctgt

SEQ ID NO: 38841 - DNA, 20 bp, Artificial Sequence
  chemically synthesized
acaatttcaacctgttagat

SEQ ID NO: 38842 - DNA, 20 bp, Artificial Sequence
  chemically synthesized
taaaaattgaacactcatac

SEQ ID NO: 38843 - DNA, 20 bp, Artificial Sequence
  chemically synthesized
attgaacactcatacaagtg

SEQ ID NO: 38844 - DNA, 20 bp, Artificial Sequence
  chemically synthesized
acactcatacaagtgtggtg

SEQ ID NO: 38845 - DNA, 20 bp, Artificial Sequence
  chemically synthesized
gtggtgaagtgattgttttc

SEQ ID NO: 38846 - DNA, 20 bp, Artificial Sequence
  chemically synthesized
tttacactgtcataaccttc

SEQ ID NO: 38847 - DNA, 20 bp, Artificial Sequence
  chemically synthesized
taaccttctagaaaataaat

SEQ ID NO: 38848 - DNA, 20 bp, Artificial Sequence
  chemically synthesized
ccttctagaaaataaattgg

SEQ ID NO: 38849 - DNA, 20 bp, Artificial Sequence
  chemically synthesized
aaataaattggcagtgttat

SEQ ID NO: 38850 - DNA, 20 bp, Artificial Sequence
  chemically synthesized
aataaattggcagtgttatt

SEQ ID NO: 38851 - DNA, 20 bp, Artificial Sequence
  chemically synthesized
taaattggcagtgttattgg

SEQ ID NO: 38852 - DNA, 20 bp, Artificial Sequence
  chemically synthesized
ttggcagtgttattgggaga

SEQ ID NO: 38853 - DNA, 20 bp, Artificial Sequence
  chemically synthesized
aaatatgtctatataattta

SEQ ID NO: 38854 - DNA, 20 bp, Artificial Sequence
  chemically synthesized
aatatgtctatataatttat

SEQ ID NO: 38855 - DNA, 20 bp, Artificial Sequence
  chemically synthesized
ctatataatttatgggaact

SEQ ID NO: 38856 - DNA, 20 bp, Artificial Sequence
  chemically synthesized
tatataatttatgggaactt

SEQ ID NO: 38857 - DNA, 20 bp, Artificial Sequence
  chemically synthesized
aatttatgggaacttaggct

SEQ ID NO: 38858 - DNA, 20 bp, Artificial Sequence
  chemically synthesized
acttaggctcagaaaatatt

SEQ ID NO: 38859 - DNA, 20 bp, Artificial Sequence
  chemically synthesized
cttaggctcagaaaatatta

SEQ ID NO: 38860 - DNA, 20 bp, Artificial Sequence
  chemically synthesized
ctcagaaaatattaaggaat

SEQ ID NO: 38861 - DNA, 20 bp, Artificial Sequence
  chemically synthesized
aagaatgaactttatgaaca

SEQ ID NO: 38862 - DNA, 20 bp, Artificial Sequence
  chemically synthesized
gaactttatgaacaaagatg

SEQ ID NO: 38863 - DNA, 20 bp, Artificial Sequence
  chemically synthesized
actttatgaacaaagatgtg

SEQ ID NO: 38864 - DNA, 20 bp, Artificial Sequence
  chemically synthesized
ctttatgaacaaagatgtgg

SEQ ID NO: 38865 - DNA, 20 bp, Artificial Sequence
  chemically synthesized
tttatgaacaaagatgtgga

SEQ ID NO: 38866 - DNA, 20 bp, Artificial Sequence
  chemically synthesized
tgaacaaagatgtggagggt

SEQ ID NO: 38867 - DNA, 20 bp, Artificial Sequence
  chemically synthesized
acaaagatgtggagggttgg

SEQ ID NO: 38868 - DNA, 20 bp, Artificial Sequence
  chemically synthesized
agatgtggagggttggaagc

SEQ ID NO: 38869 - DNA, 20 bp, Artificial Sequence
  chemically synthesized
atgtggagggttggaagcaa

SEQ ID NO: 38870 - DNA, 20 bp, Artificial Sequence
  chemically synthesized
tgtggagggttggaagcaag

SEQ ID NO: 38871 - DNA, 20 bp, Artificial Sequence
  chemically synthesized
gtggagggttggaagcaaga

SEQ ID NO: 38872 - DNA, 20 bp, Artificial Sequence
  chemically synthesized
tggagggttggaagcaagag

SEQ ID NO: 38873 - DNA, 20 bp, Artificial Sequence
  chemically synthesized
ggagggttggaagcaagagg

SEQ ID NO: 38874 - DNA, 20 bp, Artificial Sequence
  chemically synthesized
gagggttggaagcaagaggg

SEQ ID NO: 38875 - DNA, 20 bp, Artificial Sequence
  chemically synthesized
aagaggggggccaacgcgca

SEQ ID NO: 38876 - DNA, 20 bp, Artificial Sequence
  chemically synthesized
agaggggggccaacgcgcac

SEQ ID NO: 38877 - DNA, 20 bp, Artificial Sequence
  chemically synthesized
gaggggggccaacgcgcacg

SEQ ID NO: 38878 - DNA, 20 bp, Artificial Sequence
  chemically synthesized
ggggggccaacgcgcacggg

SEQ ID NO: 38879 - DNA, 20 bp, Artificial Sequence
  chemically synthesized
gggggccaacgcgcacgggg

SEQ ID NO: 38880 - DNA, 20 bp, Artificial Sequence
  chemically synthesized
ggccaacgcgcacggggagg

SEQ ID NO: 38881 - DNA, 20 bp, Artificial Sequence
  chemically synthesized
gcgcacggggaggaagcatt

SEQ ID NO: 38882 - DNA, 20 bp, Artificial Sequence
  chemically synthesized
cgcacggggaggaagcattt

SEQ ID NO: 38883 - DNA, 20 bp, Artificial Sequence
  chemically synthesized
acggggaggaagcatttggg

SEQ ID NO: 38884 - DNA, 20 bp, Artificial Sequence
  chemically synthesized
gcatttgggcagtgactccg

SEQ ID NO: 38885 - DNA, 20 bp, Artificial Sequence
  chemically synthesized
gggcagtgactccgcagacc

SEQ ID NO: 38886 - DNA, 20 bp, Artificial Sequence
  chemically synthesized
ggcagtgactccgcagaccc

SEQ ID NO: 38887 - DNA, 20 bp, Artificial Sequence
  chemically synthesized
tgactccgcagacccaggct

SEQ ID NO: 38888 - DNA, 20 bp, Artificial Sequence
  chemically synthesized
gactccgcagacccaggctc

SEQ ID NO: 38889 - DNA, 20 bp, Artificial Sequence
  chemically synthesized
gacccaggctcaggttgaac

SEQ ID NO: 38890 - DNA, 20 bp, Artificial Sequence
  chemically synthesized
tagacaacctccttacacct

SEQ ID NO: 38891 - DNA, 20 bp, Artificial Sequence
  chemically synthesized
cacctcagtttccttaactg

SEQ ID NO: 38892 - DNA, 20 bp, Artificial Sequence
  chemically synthesized
cctcagtttccttaactgta

SEQ ID NO: 38893 - DNA, 20 bp, Artificial Sequence
  chemically synthesized
cagtttccttaactgtagag

SEQ ID NO: 38894 - DNA, 20 bp, Artificial Sequence
  chemically synthesized
agtttccttaactgtagagc

SEQ ID NO: 38895 - DNA, 20 bp, Artificial Sequence
  chemically synthesized
tttccttaactgtagagcag

SEQ ID NO: 38896 - DNA, 20 bp, Artificial Sequence
  chemically synthesized
taactgtagagcaggagtga

SEQ ID NO: 38897 - DNA, 20 bp, Artificial Sequence
  chemically synthesized
tgatggaactgcctgtttca

SEQ ID NO: 38898 - DNA, 20 bp, Artificial Sequence
  chemically synthesized
gatggaactgcctgtttcat

SEQ ID NO: 38899 - DNA, 20 bp, Artificial Sequence
  chemically synthesized
ctgtttcataggactgttgt

SEQ ID NO: 38900 - DNA, 20 bp, Artificial Sequence
  chemically synthesized
tgtttcataggactgttgtg

SEQ ID NO: 38901 - DNA, 20 bp, Artificial Sequence
  chemically synthesized
ataggactgttgtgaggatg

SEQ ID NO: 38902 - DNA, 20 bp, Artificial Sequence
  chemically synthesized
gactgttgtgaggatgaagt

SEQ ID NO: 38903 - DNA, 20 bp, Artificial Sequence
  chemically synthesized
agtgagatacaccacattat

SEQ ID NO: 38904 - DNA, 20 bp, Artificial Sequence
  chemically synthesized
ccacattataagcttgtgcc

SEQ ID NO: 38905 - DNA, 20 bp, Artificial Sequence
  chemically synthesized
attataagcttgtgcctgga

SEQ ID NO: 38906 - DNA, 20 bp, Artificial Sequence
  chemically synthesized
ttataagcttgtgcctggaa

SEQ ID NO: 38907 - DNA, 20 bp, Artificial Sequence
  chemically synthesized
tgcctggaaaggataatgct

SEQ ID NO: 38908 - DNA, 20 bp, Artificial Sequence
  chemically synthesized
ttattgcaataaaatgtaca

SEQ ID NO: 38909 - DNA, 20 bp, Artificial Sequence
  chemically synthesized
caataaaatgtacacagcgt

SEQ ID NO: 38910 - DNA, 20 bp, Artificial Sequence
  chemically synthesized
ataaaatgtacacagcgtaa

SEQ ID NO: 38911 - DNA, 20 bp, Artificial Sequence
  chemically synthesized
tactattttaaccatttttg

SEQ ID NO: 38912 - DNA, 20 bp, Artificial Sequence
  chemically synthesized
actattttaaccatttttgc

SEQ ID NO: 38913 - DNA, 20 bp, Artificial Sequence
  chemically synthesized
ctattttaaccatttttgca

SEQ ID NO: 38914 - DNA, 20 bp, Artificial Sequence
  chemically synthesized
catttttgcagggtaccacc

SEQ ID NO: 38915 - DNA, 20 bp, Artificial Sequence
  chemically synthesized
ttttgcagggtaccaccaag

SEQ ID NO: 38916 - DNA, 20 bp, Artificial Sequence
  chemically synthesized
gggtaccaccaagtggcatt

SEQ ID NO: 38917 - DNA, 20 bp, Artificial Sequence
  chemically synthesized
agtggcatttagtacattca

SEQ ID NO: 38918 - DNA, 20 bp, Artificial Sequence
  chemically synthesized
ggcatttagtacattcacag

SEQ ID NO: 38919 - DNA, 20 bp, Artificial Sequence
  chemically synthesized
tgcaaccatcatcatatttc

SEQ ID NO: 38920 - DNA, 20 bp, Artificial Sequence
  chemically synthesized
gaatattttcctcatcccca

SEQ ID NO: 38921 - DNA, 20 bp, Artificial Sequence
  chemically synthesized
aatattttcctcatccccaa

SEQ ID NO: 38922 - DNA, 20 bp, Artificial Sequence
  chemically synthesized
gaaacctcatgctcattaat

SEQ ID NO: 38923 - DNA, 20 bp, Artificial Sequence
  chemically synthesized
acctcatgctcattaatcag

SEQ ID NO: 38924 - DNA, 20 bp, Artificial Sequence
  chemically synthesized
gtagctctcctttaaaatat

SEQ ID NO: 38925 - DNA, 20 bp, Artificial Sequence
  chemically synthesized
cctttaaaatattagttatg

SEQ ID NO: 38926 - DNA, 20 bp, Artificial Sequence
  chemically synthesized
aatattagttatgaagatca

SEQ ID NO: 38927 - DNA, 20 bp, Artificial Sequence
  chemically synthesized
aaaactcattatgtaatgtt

SEQ ID NO: 38928 - DNA, 20 bp, Artificial Sequence
  chemically synthesized
gtaatgttgagtgaaaaaat

SEQ ID NO: 38929 - DNA, 20 bp, Artificial Sequence
  chemically synthesized
taatgttgagtgaaaaaatc

SEQ ID NO: 38930 - DNA, 20 bp, Artificial Sequence
  chemically synthesized
aatgttgagtgaaaaaatca

SEQ ID NO: 38931 - DNA, 20 bp, Artificial Sequence
  chemically synthesized
attttgtgatatgatgtaat

SEQ ID NO: 38932 - DNA, 20 bp, Artificial Sequence
  chemically synthesized
tgatatgatgtaattagtga

SEQ ID NO: 38933 - DNA, 20 bp, Artificial Sequence
  chemically synthesized
tatgatgtaattagtgaaag

SEQ ID NO: 38934 - DNA, 20 bp, Artificial Sequence
  chemically synthesized
tagtgaaagaagcatacaaa

SEQ ID NO: 38935 - DNA, 20 bp, Artificial Sequence
  chemically synthesized
gtctgaaaatataaaaacaa

SEQ ID NO: 38936 - DNA, 20 bp, Artificial Sequence
  chemically synthesized
acaatagcaattgcatttct

SEQ ID NO: 38937 - DNA, 20 bp, Artificial Sequence
  chemically synthesized
catttaaacattattcttta

SEQ ID NO: 38938 - DNA, 20 bp, Artificial Sequence
  chemically synthesized
attattctttatggttttaa

SEQ ID NO: 38939 - DNA, 20 bp, Artificial Sequence
  chemically synthesized
tctttatggttttaaaagca

SEQ ID NO: 38940 - DNA, 20 bp, Artificial Sequence
  chemically synthesized
tggttttaaaagcaaagaaa

SEQ ID NO: 38941 - DNA, 20 bp, Artificial Sequence
  chemically synthesized
ggttttaaaagcaaagaaaa

SEQ ID NO: 38942 - DNA, 20 bp, Artificial Sequence
  chemically synthesized
taaaagcaaagaaaaaggta

SEQ ID NO: 38943 - DNA, 20 bp, Artificial Sequence
  chemically synthesized
agaaacaacaaccaaccgca

SEQ ID NO: 38944 - DNA, 20 bp, Artificial Sequence
  chemically synthesized
aaccgcaaagcaccatgaca

SEQ ID NO: 38945 - DNA, 20 bp, Artificial Sequence
  chemically synthesized
caaagcaccatgacaaagct

SEQ ID NO: 38946 - DNA, 20 bp, Artificial Sequence
  chemically synthesized
aaagctcagattgttaaatc

SEQ ID NO: 38947 - DNA, 20 bp, Artificial Sequence
  chemically synthesized
aagctcagattgttaaatcc

SEQ ID NO: 38948 - DNA, 20 bp, Artificial Sequence
  chemically synthesized
gattgttaaatccaggtttt

SEQ ID NO: 38949 - DNA, 20 bp, Artificial Sequence
  chemically synthesized
aaatccaggtttttggaaca

SEQ ID NO: 38950 - DNA, 20 bp, Artificial Sequence
  chemically synthesized
tatatgacgtttacactctc

SEQ ID NO: 38951 - DNA, 20 bp, Artificial Sequence
  chemically synthesized
atatgacgtttacactctcc

SEQ ID NO: 38952 - DNA, 20 bp, Artificial Sequence
  chemically synthesized
tatgacgtttacactctcca

SEQ ID NO: 38953 - DNA, 20 bp, Artificial Sequence
  chemically synthesized
cgtttacactctccagggtt

SEQ ID NO: 38954 - DNA, 20 bp, Artificial Sequence
  chemically synthesized
tttacactctccagggttca

SEQ ID NO: 38955 - DNA, 20 bp, Artificial Sequence
  chemically synthesized
tacactctccagggttcaga

SEQ ID NO: 38956 - DNA, 20 bp, Artificial Sequence
  chemically synthesized
tctccagggttcagagagtc

SEQ ID NO: 38957 - DNA, 20 bp, Artificial Sequence
  chemically synthesized
ccagggttcagagagtctgg

SEQ ID NO: 38958 - DNA, 20 bp, Artificial Sequence
  chemically synthesized
ttcagagagtctggcagcat

SEQ ID NO: 38959 - DNA, 20 bp, Artificial Sequence
  chemically synthesized
tcagagagtctggcagcatt

SEQ ID NO: 38960 - DNA, 20 bp, Artificial Sequence
  chemically synthesized
agagagtctggcagcattgg

SEQ ID NO: 38961 - DNA, 20 bp, Artificial Sequence
  chemically synthesized
gggagctgccttgtgttcta

SEQ ID NO: 38962 - DNA, 20 bp, Artificial Sequence
  chemically synthesized
ccttgtgttctacagcctca

SEQ ID NO: 38963 - DNA, 20 bp, Artificial Sequence
  chemically synthesized
gtgttctacagcctcacgga

SEQ ID NO: 38964 - DNA, 20 bp, Artificial Sequence
  chemically synthesized
tctacagcctcacggacaga

SEQ ID NO: 38965 - DNA, 20 bp, Artificial Sequence
  chemically synthesized
ctacagcctcacggacagac

SEQ ID NO: 38966 - DNA, 20 bp, Artificial Sequence
  chemically synthesized
acagcctcacggacagacag

SEQ ID NO: 38967 - DNA, 20 bp, Artificial Sequence
  chemically synthesized
cagcctcacggacagacagg

SEQ ID NO: 38968 - DNA, 20 bp, Artificial Sequence
  chemically synthesized
tcaccactgctctgttcttc

SEQ ID NO: 38969 - DNA, 20 bp, Artificial Sequence
  chemically synthesized
accactgctctgttcttctg

SEQ ID NO: 38970 - DNA, 20 bp, Artificial Sequence
  chemically synthesized
gtttccttgtgaacatgttg

SEQ ID NO: 38971 - DNA, 20 bp, Artificial Sequence
  chemically synthesized
ttgtgaacatgttgtggacg

SEQ ID NO: 38972 - DNA, 20 bp, Artificial Sequence
  chemically synthesized
ttctttcatctttttaaaca

SEQ ID NO: 38973 - DNA, 20 bp, Artificial Sequence
  chemically synthesized
tctttcatctttttaaacac

SEQ ID NO: 38974 - DNA, 20 bp, Artificial Sequence
  chemically synthesized
tttttaaacacaggtacctt

SEQ ID NO: 38975 - DNA, 20 bp, Artificial Sequence
  chemically synthesized
ttttaaacacaggtaccttt

SEQ ID NO: 38976 - DNA, 20 bp, Artificial Sequence
  chemically synthesized
tttaaacacaggtacctttg

SEQ ID NO: 38977 - DNA, 20 bp, Artificial Sequence
  chemically synthesized
aacacaggtacctttggggc

SEQ ID NO: 38978 - DNA, 20 bp, Artificial Sequence
  chemically synthesized
cctttggggctggctttctc

SEQ ID NO: 38979 - DNA, 20 bp, Artificial Sequence
  chemically synthesized
ctttggggctggctttctca

SEQ ID NO: 38980 - DNA, 20 bp, Artificial Sequence
  chemically synthesized
tggggctggctttctcaagg

SEQ ID NO: 38981 - DNA, 20 bp, Artificial Sequence
  chemically synthesized
ctggctttctcaaggaagcc

SEQ ID NO: 38982 - DNA, 20 bp, Artificial Sequence
  chemically synthesized
aagcccagctccctgtgatt

SEQ ID NO: 38983 - DNA, 20 bp, Artificial Sequence
  chemically synthesized
gctccctgtgattgagaatg

SEQ ID NO: 38984 - DNA, 20 bp, Artificial Sequence
  chemically synthesized
atgaagtgtgcaatcgctat

SEQ ID NO: 38985 - DNA, 20 bp, Artificial Sequence
  chemically synthesized
aatcgctatgagtttctgaa

SEQ ID NO: 38986 - DNA, 20 bp, Artificial Sequence
  chemically synthesized
cgctatgagtttctgaatgg

SEQ ID NO: 38987 - DNA, 20 bp, Artificial Sequence
  chemically synthesized
ctatgagtttctgaatggaa

SEQ ID NO: 38988 - DNA, 20 bp, Artificial Sequence
  chemically synthesized
atggaagagtcaaatccact

SEQ ID NO: 38989 - DNA, 20 bp, Artificial Sequence
  chemically synthesized
aaatccactgagctctgtgc

SEQ ID NO: 38990 - DNA, 20 bp, Artificial Sequence
  chemically synthesized
aatccactgagctctgtgct

SEQ ID NO: 38991 - DNA, 20 bp, Artificial Sequence
  chemically synthesized
tgagctctgtgctgggcatt

SEQ ID NO: 38992 - DNA, 20 bp, Artificial Sequence
  chemically synthesized
ctctgtgctgggcatttggc

SEQ ID NO: 38993 - DNA, 20 bp, Artificial Sequence
  chemically synthesized
ctgtgctgggcatttggctg

SEQ ID NO: 38994 - DNA, 20 bp, Artificial Sequence
  chemically synthesized
tgtgctgggcatttggctgg

SEQ ID NO: 38995 - DNA, 20 bp, Artificial Sequence
  chemically synthesized
catttggctggaggcattga

SEQ ID NO: 38996 - DNA, 20 bp, Artificial Sequence
  chemically synthesized
ctggaggcattgacagttgc

SEQ ID NO: 38997 - DNA, 20 bp, Artificial Sequence
  chemically synthesized
tggaggcattgacagttgca

SEQ ID NO: 38998 - DNA, 20 bp, Artificial Sequence
  chemically synthesized
ggcattgacagttgcaaggt

SEQ ID NO: 38999 - DNA, 20 bp, Artificial Sequence
  chemically synthesized
tgacagttgcaaggtaagaa

SEQ ID NO: 39000 - DNA, 20 bp, Artificial Sequence
  chemically synthesized
ttgcaaggtaagaaaagatc

SEQ ID NO: 39001 - DNA, 20 bp, Artificial Sequence
  chemically synthesized
gcaaggtaagaaaagatcaa

SEQ ID NO: 39002 - DNA, 20 bp, Artificial Sequence
  chemically synthesized
aagaaaagatcaagagacca

SEQ ID NO: 39003 - DNA, 20 bp, Artificial Sequence
  chemically synthesized
aaagatcaagagaccaaagt

SEQ ID NO: 39004 - DNA, 20 bp, Artificial Sequence
  chemically synthesized
agtcttgtgctctcctgtct

SEQ ID NO: 39005 - DNA, 20 bp, Artificial Sequence
  chemically synthesized
gtgctctcctgtctcagtct

SEQ ID NO: 39006 - DNA, 20 bp, Artificial Sequence
  chemically synthesized
ctgtctcagtctcagtccct

SEQ ID NO: 39007 - DNA, 20 bp, Artificial Sequence
  chemically synthesized
agtctcagtcccttagactt

SEQ ID NO: 39008 - DNA, 20 bp, Artificial Sequence
  chemically synthesized
tcccttagacttgagtccca

SEQ ID NO: 39009 - DNA, 20 bp, Artificial Sequence
  chemically synthesized
cttagacttgagtcccaaag

SEQ ID NO: 39010 - DNA, 20 bp, Artificial Sequence
  chemically synthesized
agtcccaaagtagcgaattc

SEQ ID NO: 39011 - DNA, 20 bp, Artificial Sequence
  chemically synthesized
cccaaagtagcgaattcaag

SEQ ID NO: 39012 - DNA, 20 bp, Artificial Sequence
  chemically synthesized
ccaaagtagcgaattcaagt

SEQ ID NO: 39013 - DNA, 20 bp, Artificial Sequence
  chemically synthesized
ttcaagtaggatttaatcaa

SEQ ID NO: 39014 - DNA, 20 bp, Artificial Sequence
  chemically synthesized
aagtaggatttaatcaatgg

SEQ ID NO: 39015 - DNA, 20 bp, Artificial Sequence
  chemically synthesized
atttaatcaatggaagaccc

SEQ ID NO: 39016 - DNA, 20 bp, Artificial Sequence
  chemically synthesized
tcaatggaagaccccagtct

SEQ ID NO: 39017 - DNA, 20 bp, Artificial Sequence
  chemically synthesized
accccagtctaagtgttgct

SEQ ID NO: 39018 - DNA, 20 bp, Artificial Sequence
  chemically synthesized
agtgttgctcagaaactccc

SEQ ID NO: 39019 - DNA, 20 bp, Artificial Sequence
  chemically synthesized
atctgtcccaaatgtatatt

SEQ ID NO: 39020 - DNA, 20 bp, Artificial Sequence
  chemically synthesized
aatgtatattcagatcatcc

SEQ ID NO: 39021 - DNA, 20 bp, Artificial Sequence
  chemically synthesized
atgtatattcagatcatcca

SEQ ID NO: 39022 - DNA, 20 bp, Artificial Sequence
  chemically synthesized
tgtatattcagatcatccaa

SEQ ID NO: 39023 - DNA, 20 bp, Artificial Sequence
  chemically synthesized
gtatattcagatcatccaag

SEQ ID NO: 39024 - DNA, 20 bp, Artificial Sequence
  chemically synthesized
gatcatccaaggggacttct

SEQ ID NO: 39025 - DNA, 20 bp, Artificial Sequence
  chemically synthesized
atcatccaaggggacttctt

SEQ ID NO: 39026 - DNA, 20 bp, Artificial Sequence
  chemically synthesized
tcatccaaggggacttcttg

SEQ ID NO: 39027 - DNA, 20 bp, Artificial Sequence
  chemically synthesized
aaggggacttcttggggctt

SEQ ID NO: 39028 - DNA, 20 bp, Artificial Sequence
  chemically synthesized
acttcttggggcttgagttc

SEQ ID NO: 39029 - DNA, 20 bp, Artificial Sequence
  chemically synthesized
ttggggcttgagttccagat

SEQ ID NO: 39030 - DNA, 20 bp, Artificial Sequence
  chemically synthesized
gggcttgagttccagatcag

SEQ ID NO: 39031 - DNA, 20 bp, Artificial Sequence
  chemically synthesized
ttgagttccagatcagcagc

SEQ ID NO: 39032 - DNA, 20 bp, Artificial Sequence
  chemically synthesized
tgagttccagatcagcagca

SEQ ID NO: 39033 - DNA, 20 bp, Artificial Sequence
  chemically synthesized
gagttccagatcagcagcaa

SEQ ID NO: 39034 - DNA, 20 bp, Artificial Sequence
  chemically synthesized
gttccagatcagcagcaagg

SEQ ID NO: 39035 - DNA, 20 bp, Artificial Sequence
  chemically synthesized
atcagcagcaagggagccat

SEQ ID NO: 39036 - DNA, 20 bp, Artificial Sequence
  chemically synthesized
cataagtgccataactacct

SEQ ID NO: 39037 - DNA, 20 bp, Artificial Sequence
  chemically synthesized
cctcagaccactcaccctcc

SEQ ID NO: 39038 - DNA, 20 bp, Artificial Sequence
  chemically synthesized
ctcagaccactcaccctcct

SEQ ID NO: 39039 - DNA, 20 bp, Artificial Sequence
  chemically synthesized
tcagaccactcaccctcctg

SEQ ID NO: 39040 - DNA, 20 bp, Artificial Sequence
  chemically synthesized
ctcaccctcctggggtgtcc

SEQ ID NO: 39041 - DNA, 20 bp, Artificial Sequence
  chemically synthesized
accctcctggggtgtcccgg

SEQ ID NO: 39042 - DNA, 20 bp, Artificial Sequence
  chemically synthesized
tcctggggtgtcccggtggc

SEQ ID NO: 39043 - DNA, 20 bp, Artificial Sequence
  chemically synthesized
cctggggtgtcccggtggcc

SEQ ID NO: 39044 - DNA, 20 bp, Artificial Sequence
  chemically synthesized
ctggggtgtcccggtggcca

SEQ ID NO: 39045 - DNA, 20 bp, Artificial Sequence
  chemically synthesized
gtcccggtggccagggacta

SEQ ID NO: 39046 - DNA, 20 bp, Artificial Sequence
  chemically synthesized
ccggtggccagggactaaag

SEQ ID NO: 39047 - DNA, 20 bp, Artificial Sequence
  chemically synthesized
gactaaagtggtgatttttc

SEQ ID NO: 39048 - DNA, 20 bp, Artificial Sequence
  chemically synthesized
taaagtggtgatttttctgg

SEQ ID NO: 39049 - DNA, 20 bp, Artificial Sequence
  chemically synthesized
aaagtggtgatttttctggt

SEQ ID NO: 39050 - DNA, 20 bp, Artificial Sequence
  chemically synthesized
aagtggtgatttttctggta

SEQ ID NO: 39051 - DNA, 20 bp, Artificial Sequence
  chemically synthesized
tggtgatttttctggtaggg

SEQ ID NO: 39052 - DNA, 20 bp, Artificial Sequence
  chemically synthesized
ggtgatttttctggtaggga

SEQ ID NO: 39053 - DNA, 20 bp, Artificial Sequence
  chemically synthesized
tgatttttctggtagggaag

SEQ ID NO: 39054 - DNA, 20 bp, Artificial Sequence
  chemically synthesized
gatttttctggtagggaagg

SEQ ID NO: 39055 - DNA, 20 bp, Artificial Sequence
  chemically synthesized
ttttctggtagggaaggagg

SEQ ID NO: 39056 - DNA, 20 bp, Artificial Sequence
  chemically synthesized
ttctggtagggaaggaggta

SEQ ID NO: 39057 - DNA, 20 bp, Artificial Sequence
  chemically synthesized
tctggtagggaaggaggtag

SEQ ID NO: 39058 - DNA, 20 bp, Artificial Sequence
  chemically synthesized
ctggtagggaaggaggtaga

SEQ ID NO: 39059 - DNA, 20 bp, Artificial Sequence
  chemically synthesized
agggaaggaggtagagggta

SEQ ID NO: 39060 - DNA, 20 bp, Artificial Sequence
  chemically synthesized
gggaaggaggtagagggtac

SEQ ID NO: 39061 - DNA, 20 bp, Artificial Sequence
  chemically synthesized
aggaggtagagggtacagga

SEQ ID NO: 39062 - DNA, 20 bp, Artificial Sequence
  chemically synthesized
gaggtagagggtacaggaca

SEQ ID NO: 39063 - DNA, 20 bp, Artificial Sequence
  chemically synthesized
actaactgcacacaatatct

SEQ ID NO: 39064 - DNA, 20 bp, Artificial Sequence
  chemically synthesized
ctgcacacaatatctgagac

SEQ ID NO: 39065 - DNA, 20 bp, Artificial Sequence
  chemically synthesized
gcacacaatatctgagactg

SEQ ID NO: 39066 - DNA, 20 bp, Artificial Sequence
  chemically synthesized
caatatctgagactggagct

SEQ ID NO: 39067 - DNA, 20 bp, Artificial Sequence
  chemically synthesized
gctcagatattgctgatgat

SEQ ID NO: 39068 - DNA, 20 bp, Artificial Sequence
  chemically synthesized
tcagatattgctgatgatca

SEQ ID NO: 39069 - DNA, 20 bp, Artificial Sequence
  chemically synthesized
atattgctgatgatcagagt

SEQ ID NO: 39070 - DNA, 20 bp, Artificial Sequence
  chemically synthesized
ctccccaattgatttacaac

SEQ ID NO: 39071 - DNA, 20 bp, Artificial Sequence
  chemically synthesized
tccccaattgatttacaact

SEQ ID NO: 39072 - DNA, 20 bp, Artificial Sequence
  chemically synthesized
ccccaattgatttacaactg

SEQ ID NO: 39073 - DNA, 20 bp, Artificial Sequence
  chemically synthesized
attgatttacaactggggct

SEQ ID NO: 39074 - DNA, 20 bp, Artificial Sequence
  chemically synthesized
ggcttggatactgttttaaa

SEQ ID NO: 39075 - DNA, 20 bp, Artificial Sequence
  chemically synthesized
gcttggatactgttttaaac

SEQ ID NO: 39076 - DNA, 20 bp, Artificial Sequence
  chemically synthesized
ttggatactgttttaaacgg

SEQ ID NO: 39077 - DNA, 20 bp, Artificial Sequence
  chemically synthesized
tggatactgttttaaacggg

SEQ ID NO: 39078 - DNA, 20 bp, Artificial Sequence
  chemically synthesized
gatactgttttaaacgggag

SEQ ID NO: 39079 - DNA, 20 bp, Artificial Sequence
  chemically synthesized
aaccactgacgtgactacac

SEQ ID NO: 39080 - DNA, 20 bp, Artificial Sequence
  chemically synthesized
ccactgacgtgactacacta

SEQ ID NO: 39081 - DNA, 20 bp, Artificial Sequence
  chemically synthesized
tgacgtgactacactagaga

SEQ ID NO: 39082 - DNA, 20 bp, Artificial Sequence
  chemically synthesized
ccactcttgctttacttcat

SEQ ID NO: 39083 - DNA, 20 bp, Artificial Sequence
  chemically synthesized
cttcatgagaacgaaaatgt

SEQ ID NO: 39084 - DNA, 20 bp, Artificial Sequence
  chemically synthesized
ttgcaccatgaattcatttg

SEQ ID NO: 39085 - DNA, 20 bp, Artificial Sequence
  chemically synthesized
accatgaattcatttgcgga

SEQ ID NO: 39086 - DNA, 20 bp, Artificial Sequence
  chemically synthesized
ttattttattttattttatt

SEQ ID NO: 39087 - DNA, 20 bp, Artificial Sequence
  chemically synthesized
ttttattgagactctcaccc

SEQ ID NO: 39088 - DNA, 20 bp, Artificial Sequence
  chemically synthesized
tgagactctcaccccggttg

SEQ ID NO: 39089 - DNA, 20 bp, Artificial Sequence
  chemically synthesized
gaagtgcactgacgtgattt

SEQ ID NO: 39090 - DNA, 20 bp, Artificial Sequence
  chemically synthesized
tcactgcaacttccacctcc

SEQ ID NO: 39091 - DNA, 20 bp, Artificial Sequence
  chemically synthesized
cactgcaacttccacctcct

SEQ ID NO: 39092 - DNA, 20 bp, Artificial Sequence
  chemically synthesized
aacttccacctcctgggttc

SEQ ID NO: 39093 - DNA, 20 bp, Artificial Sequence
  chemically synthesized
ctgggttcaagtgaatactc

SEQ ID NO: 39094 - DNA, 20 bp, Artificial Sequence
  chemically synthesized
agtgaatactccagcctccc

SEQ ID NO: 39095 - DNA, 20 bp, Artificial Sequence
  chemically synthesized
gaatactccagcctccctag

SEQ ID NO: 39096 - DNA, 20 bp, Artificial Sequence
  chemically synthesized
actccagcctccctagtagc

SEQ ID NO: 39097 - DNA, 20 bp, Artificial Sequence
  chemically synthesized
ctccagcctccctagtagct

SEQ ID NO: 39098 - DNA, 20 bp, Artificial Sequence
  chemically synthesized
ctccctagtagctgggatta

SEQ ID NO: 39099 - DNA, 20 bp, Artificial Sequence
  chemically synthesized
tccctagtagctgggattac

SEQ ID NO: 39100 - DNA, 20 bp, Artificial Sequence
  chemically synthesized
caggtgcccaccaccacgcc

SEQ ID NO: 39101 - DNA, 20 bp, Artificial Sequence
  chemically synthesized
ctggctaatttttgtatttt

SEQ ID NO: 39102 - DNA, 20 bp, Artificial Sequence
  chemically synthesized
gctaatttttgtatttttag

SEQ ID NO: 39103 - DNA, 20 bp, Artificial Sequence
  chemically synthesized
taatttttgtatttttagta

SEQ ID NO: 39104 - DNA, 20 bp, Artificial Sequence
  chemically synthesized
ttttgtatttttagtagaga

SEQ ID NO: 39105 - DNA, 20 bp, Artificial Sequence
  chemically synthesized
tttgtatttttagtagagat

SEQ ID NO: 39106 - DNA, 20 bp, Artificial Sequence
  chemically synthesized
ttgtatttttagtagagatg

SEQ ID NO: 39107 - DNA, 20 bp, Artificial Sequence
  chemically synthesized
gagatggggtttcaccacat

SEQ ID NO: 39108 - DNA, 20 bp, Artificial Sequence
  chemically synthesized
ggggtttcaccacattggcc

SEQ ID NO: 39109 - DNA, 20 bp, Artificial Sequence
  chemically synthesized
tttcaccacattggcctggc

SEQ ID NO: 39110 - DNA, 20 bp, Artificial Sequence
  chemically synthesized
accttgtgatccacctgtct

SEQ ID NO: 39111 - DNA, 20 bp, Artificial Sequence
  chemically synthesized
ccacctgtcttggcctccca

SEQ ID NO: 39112 - DNA, 20 bp, Artificial Sequence
  chemically synthesized
gtcttggcctcccaaagtgc

SEQ ID NO: 39113 - DNA, 20 bp, Artificial Sequence
  chemically synthesized
tcttggcctcccaaagtgct

SEQ ID NO: 39114 - DNA, 20 bp, Artificial Sequence
  chemically synthesized
ctcccaaagtgctgggatta

SEQ ID NO: 39115 - DNA, 20 bp, Artificial Sequence
  chemically synthesized
cccaaagtgctgggattaca

SEQ ID NO: 39116 - DNA, 20 bp, Artificial Sequence
  chemically synthesized
agtgctgggattacagagtt

SEQ ID NO: 39117 - DNA, 20 bp, Artificial Sequence
  chemically synthesized
aaatatttatttatttattt

SEQ ID NO: 39118 - DNA, 20 bp, Artificial Sequence
  chemically synthesized
tttatttaagccacaactac

SEQ ID NO: 39119 - DNA, 20 bp, Artificial Sequence
  chemically synthesized
ttaagccacaactactagaa

SEQ ID NO: 39120 - DNA, 20 bp, Artificial Sequence
  chemically synthesized
taagccacaactactagaat

SEQ ID NO: 39121 - DNA, 20 bp, Artificial Sequence
  chemically synthesized
gccacaactactagaatagg

SEQ ID NO: 39122 - DNA, 20 bp, Artificial Sequence
  chemically synthesized
ccacaactactagaatagga

SEQ ID NO: 39123 - DNA, 20 bp, Artificial Sequence
  chemically synthesized
gatattttattaattttatt

SEQ ID NO: 39124 - DNA, 20 bp, Artificial Sequence
  chemically synthesized
attatttttttttctttcct

SEQ ID NO: 39125 - DNA, 20 bp, Artificial Sequence
  chemically synthesized
gacattcttgctctgtcacc

SEQ ID NO: 39126 - DNA, 20 bp, Artificial Sequence
  chemically synthesized
acattcttgctctgtcaccc

SEQ ID NO: 39127 - DNA, 20 bp, Artificial Sequence
  chemically synthesized
tcttgctctgtcacccaggc

SEQ ID NO: 39128 - DNA, 20 bp, Artificial Sequence
  chemically synthesized
ttgctctgtcacccaggctg

SEQ ID NO: 39129 - DNA, 20 bp, Artificial Sequence
  chemically synthesized
ctgtcacccaggctggagtg

SEQ ID NO: 39130 - DNA, 20 bp, Artificial Sequence
  chemically synthesized
tcacccaggctggagtgcag

SEQ ID NO: 39131 - DNA, 20 bp, Artificial Sequence
  chemically synthesized
ggagtgcagtggcacattct

SEQ ID NO: 39132 - DNA, 20 bp, Artificial Sequence
  chemically synthesized
aacctccatctcctgtgttc

SEQ ID NO: 39133 - DNA, 20 bp, Artificial Sequence
  chemically synthesized
ctcctgtgttcaagcaattc

SEQ ID NO: 39134 - DNA, 20 bp, Artificial Sequence
  chemically synthesized
ttcaagcaattctagtgcct

SEQ ID NO: 39135 - DNA, 20 bp, Artificial Sequence
  chemically synthesized
ttctagtgcctcagcctact

SEQ ID NO: 39136 - DNA, 20 bp, Artificial Sequence
  chemically synthesized
tagtgcctcagcctacttag

SEQ ID NO: 39137 - DNA, 20 bp, Artificial Sequence
  chemically synthesized
gcctcagcctacttagtagc

SEQ ID NO: 39138 - DNA, 20 bp, Artificial Sequence
  chemically synthesized
cctcagcctacttagtagct

SEQ ID NO: 39139 - DNA, 20 bp, Artificial Sequence
  chemically synthesized
tacttagtagctgggatgac

SEQ ID NO: 39140 - DNA, 20 bp, Artificial Sequence
  chemically synthesized
ctggcatgtgcctccacacc

SEQ ID NO: 39141 - DNA, 20 bp, Artificial Sequence
  chemically synthesized
gctaatttttgtattttttg

SEQ ID NO: 39142 - DNA, 20 bp, Artificial Sequence
  chemically synthesized
taatttttgtattttttgta

SEQ ID NO: 39143 - DNA, 20 bp, Artificial Sequence
  chemically synthesized
ttttgtattttttgtagaga

SEQ ID NO: 39144 - DNA, 20 bp, Artificial Sequence
  chemically synthesized
tttgtattttttgtagagac

SEQ ID NO: 39145 - DNA, 20 bp, Artificial Sequence
  chemically synthesized
ttgtattttttgtagagaca

SEQ ID NO: 39146 - DNA, 20 bp, Artificial Sequence
  chemically synthesized
tttttgtagagacagggttt

SEQ ID NO: 39147 - DNA, 20 bp, Artificial Sequence
  chemically synthesized
cagggttttggcatgttgcc

SEQ ID NO: 39148 - DNA, 20 bp, Artificial Sequence
  chemically synthesized
agggttttggcatgttgccc

SEQ ID NO: 39149 - DNA, 20 bp, Artificial Sequence
  chemically synthesized
ccaggcttgtctcaaactcc

SEQ ID NO: 39150 - DNA, 20 bp, Artificial Sequence
  chemically synthesized
ttgtctcaaactcctggcct

SEQ ID NO: 39151 - DNA, 20 bp, Artificial Sequence
  chemically synthesized
tgtctcaaactcctggcctc

SEQ ID NO: 39152 - DNA, 20 bp, Artificial Sequence
  chemically synthesized
ctcaggtgatccatctgccg

SEQ ID NO: 39153 - DNA, 20 bp, Artificial Sequence
  chemically synthesized
gccgtggcctcccaaaatgc

SEQ ID NO: 39154 - DNA, 20 bp, Artificial Sequence
  chemically synthesized
ccgtggcctcccaaaatgct

SEQ ID NO: 39155 - DNA, 20 bp, Artificial Sequence
  chemically synthesized
ctcccaaaatgctgggatta

SEQ ID NO: 39156 - DNA, 20 bp, Artificial Sequence
  chemically synthesized
tcccaaaatgctgggattat

SEQ ID NO: 39157 - DNA, 20 bp, Artificial Sequence
  chemically synthesized
aatgctgggattataggcat

SEQ ID NO: 39158 - DNA, 20 bp, Artificial Sequence
  chemically synthesized
catgagccaccaccccctcc

SEQ ID NO: 39159 - DNA, 20 bp, Artificial Sequence
  chemically synthesized
gagccaccaccccctcctgg

SEQ ID NO: 39160 - DNA, 20 bp, Artificial Sequence
  chemically synthesized
agccaccaccccctcctgga

SEQ ID NO: 39161 - DNA, 20 bp, Artificial Sequence
  chemically synthesized
tataacataatttataatta

SEQ ID NO: 39162 - DNA, 20 bp, Artificial Sequence
  chemically synthesized
tataattacagaaaacatgt

SEQ ID NO: 39163 - DNA, 20 bp, Artificial Sequence
  chemically synthesized
cagaaaacatgtgagttcac

SEQ ID NO: 39164 - DNA, 20 bp, Artificial Sequence
  chemically synthesized
agaaaacatgtgagttcact

SEQ ID NO: 39165 - DNA, 20 bp, Artificial Sequence
  chemically synthesized
ctaggaataaataaattttg

SEQ ID NO: 39166 - DNA, 20 bp, Artificial Sequence
  chemically synthesized
ataaattttgaagataataa

SEQ ID NO: 39167 - DNA, 20 bp, Artificial Sequence
  chemically synthesized
tttcacttatgttgtcattt

SEQ ID NO: 39168 - DNA, 20 bp, Artificial Sequence
  chemically synthesized
cttatgttgtcatttcggca

SEQ ID NO: 39169 - DNA, 20 bp, Artificial Sequence
  chemically synthesized
gttgtcatttcggcacagtt

SEQ ID NO: 39170 - DNA, 20 bp, Artificial Sequence
  chemically synthesized
catttcggcacagtttggta

SEQ ID NO: 39171 - DNA, 20 bp, Artificial Sequence
  chemically synthesized
atttcggcacagtttggtat

SEQ ID NO: 39172 - DNA, 20 bp, Artificial Sequence
  chemically synthesized
gcacagtttggtataggatg

SEQ ID NO: 39173 - DNA, 20 bp, Artificial Sequence
  chemically synthesized
acagtttggtataggatgtg

SEQ ID NO: 39174 - DNA, 20 bp, Artificial Sequence
  chemically synthesized
gagatgttaacatttatacc

SEQ ID NO: 39175 - DNA, 20 bp, Artificial Sequence
  chemically synthesized
acctagcttgctcgtaaact

SEQ ID NO: 39176 - DNA, 20 bp, Artificial Sequence
  chemically synthesized
gctcgtaaactaagacctga

SEQ ID NO: 39177 - DNA, 20 bp, Artificial Sequence
  chemically synthesized
ctcgtaaactaagacctgaa

SEQ ID NO: 39178 - DNA, 20 bp, Artificial Sequence
  chemically synthesized
tcgtaaactaagacctgaaa

SEQ ID NO: 39179 - DNA, 20 bp, Artificial Sequence
  chemically synthesized
cctgaaagggttgtgtctat

SEQ ID NO: 39180 - DNA, 20 bp, Artificial Sequence
  chemically synthesized
gtgtctatcagctgcacccc

SEQ ID NO: 39181 - DNA, 20 bp, Artificial Sequence
  chemically synthesized
tgtctatcagctgcacccct

SEQ ID NO: 39182 - DNA, 20 bp, Artificial Sequence
  chemically synthesized
ctatcagctgcacccctggg

SEQ ID NO: 39183 - DNA, 20 bp, Artificial Sequence
  chemically synthesized
cctgggtagcgacacaacct

SEQ ID NO: 39184 - DNA, 20 bp, Artificial Sequence
  chemically synthesized
ctgggtagcgacacaacctc

SEQ ID NO: 39185 - DNA, 20 bp, Artificial Sequence
  chemically synthesized
ggtagcgacacaacctcggg

SEQ ID NO: 39186 - DNA, 20 bp, Artificial Sequence
  chemically synthesized
gtagcgacacaacctcggga

SEQ ID NO: 39187 - DNA, 20 bp, Artificial Sequence
  chemically synthesized
acacaacctcgggaaggcct

SEQ ID NO: 39188 - DNA, 20 bp, Artificial Sequence
  chemically synthesized
gcctcagccccctcctcgta

SEQ ID NO: 39189 - DNA, 20 bp, Artificial Sequence
  chemically synthesized
cctcgtacagcactgcctgt

SEQ ID NO: 39190 - DNA, 20 bp, Artificial Sequence
  chemically synthesized
gtacagcactgcctgttgga

SEQ ID NO: 39191 - DNA, 20 bp, Artificial Sequence
  chemically synthesized
cactgcctgttggaaagctt

SEQ ID NO: 39192 - DNA, 20 bp, Artificial Sequence
  chemically synthesized
actgcctgttggaaagcttg

SEQ ID NO: 39193 - DNA, 20 bp, Artificial Sequence
  chemically synthesized
ctgcctgttggaaagcttga

SEQ ID NO: 39194 - DNA, 20 bp, Artificial Sequence
  chemically synthesized
gcctgttggaaagcttgagg

SEQ ID NO: 39195 - DNA, 20 bp, Artificial Sequence
  chemically synthesized
cctgttggaaagcttgaggg

SEQ ID NO: 39196 - DNA, 20 bp, Artificial Sequence
  chemically synthesized
ggaaagcttgagggaggcta

SEQ ID NO: 39197 - DNA, 20 bp, Artificial Sequence
  chemically synthesized
tgagggaggctatggatgtg

SEQ ID NO: 39198 - DNA, 20 bp, Artificial Sequence
  chemically synthesized
ggctatggatgtgcagcact

SEQ ID NO: 39199 - DNA, 20 bp, Artificial Sequence
  chemically synthesized
tatggatgtgcagcacttgg

SEQ ID NO: 39200 - DNA, 20 bp, Artificial Sequence
  chemically synthesized
tggatgtgcagcacttggca

SEQ ID NO: 39201 - DNA, 20 bp, Artificial Sequence
  chemically synthesized
ggatgtgcagcacttggcag

SEQ ID NO: 39202 - DNA, 20 bp, Artificial Sequence
  chemically synthesized
gatgtgcagcacttggcaga

SEQ ID NO: 39203 - DNA, 20 bp, Artificial Sequence
  chemically synthesized
gcagcacttggcagagggtc

SEQ ID NO: 39204 - DNA, 20 bp, Artificial Sequence
  chemically synthesized
cttggcagagggtctggtca

SEQ ID NO: 39205 - DNA, 20 bp, Artificial Sequence
  chemically synthesized
ggcagagggtctggtcatgg

SEQ ID NO: 39206 - DNA, 20 bp, Artificial Sequence
  chemically synthesized
ggtctggtcatggaagttac

SEQ ID NO: 39207 - DNA, 20 bp, Artificial Sequence
  chemically synthesized
tggaagttaccagcaaatat

SEQ ID NO: 39208 - DNA, 20 bp, Artificial Sequence
  chemically synthesized
tatgattttattttatccaa

SEQ ID NO: 39209 - DNA, 20 bp, Artificial Sequence
  chemically synthesized
attttattttatccaaaaga

SEQ ID NO: 39210 - DNA, 20 bp, Artificial Sequence
  chemically synthesized
tttattttatccaaaagaaa

SEQ ID NO: 39211 - DNA, 20 bp, Artificial Sequence
  chemically synthesized
atccaaaagaaagagaatga

SEQ ID NO: 39212 - DNA, 20 bp, Artificial Sequence
  chemically synthesized
caaaagaaagagaatgaaag

SEQ ID NO: 39213 - DNA, 20 bp, Artificial Sequence
  chemically synthesized
aaagaaagagaatgaaagaa

SEQ ID NO: 39214 - DNA, 20 bp, Artificial Sequence
  chemically synthesized
aagaaagagaatgaaagaag

SEQ ID NO: 39215 - DNA, 20 bp, Artificial Sequence
  chemically synthesized
agaaagagaatgaaagaaga

SEQ ID NO: 39216 - DNA, 20 bp, Artificial Sequence
  chemically synthesized
gaaagagaatgaaagaagag

SEQ ID NO: 39217 - DNA, 20 bp, Artificial Sequence
  chemically synthesized
aagagaatgaaagaagaggg

SEQ ID NO: 39218 - DNA, 20 bp, Artificial Sequence
  chemically synthesized
agagaatgaaagaagagggg

SEQ ID NO: 39219 - DNA, 20 bp, Artificial Sequence
  chemically synthesized
gaaagaagaggggaggaaac

SEQ ID NO: 39220 - DNA, 20 bp, Artificial Sequence
  chemically synthesized
ggggaggaaacaagactaat

SEQ ID NO: 39221 - DNA, 20 bp, Artificial Sequence
  chemically synthesized
gggaggaaacaagactaatc

SEQ ID NO: 39222 - DNA, 20 bp, Artificial Sequence
  chemically synthesized
ggaaacaagactaatcagga

SEQ ID NO: 39223 - DNA, 20 bp, Artificial Sequence
  chemically synthesized
aagactaatcaggaaagatg

SEQ ID NO: 39224 - DNA, 20 bp, Artificial Sequence
  chemically synthesized
agactaatcaggaaagatga

SEQ ID NO: 39225 - DNA, 20 bp, Artificial Sequence
  chemically synthesized
aatcaggaaagatgaaggtc

SEQ ID NO: 39226 - DNA, 20 bp, Artificial Sequence
  chemically synthesized
atcaggaaagatgaaggtct

SEQ ID NO: 39227 - DNA, 20 bp, Artificial Sequence
  chemically synthesized
tcaggaaagatgaaggtcta

SEQ ID NO: 39228 - DNA, 20 bp, Artificial Sequence
  chemically synthesized
caggaaagatgaaggtctag

SEQ ID NO: 39229 - DNA, 20 bp, Artificial Sequence
  chemically synthesized
aaagatgaaggtctaggggt

SEQ ID NO: 39230 - DNA, 20 bp, Artificial Sequence
  chemically synthesized
aagatgaaggtctaggggtg

SEQ ID NO: 39231 - DNA, 20 bp, Artificial Sequence
  chemically synthesized
agatgaaggtctaggggtga

SEQ ID NO: 39232 - DNA, 20 bp, Artificial Sequence
  chemically synthesized
tgaaggtctaggggtgaggg

SEQ ID NO: 39233 - DNA, 20 bp, Artificial Sequence
  chemically synthesized
gaaggtctaggggtgaggga

SEQ ID NO: 39234 - DNA, 20 bp, Artificial Sequence
  chemically synthesized
aggtctaggggtgagggaag

SEQ ID NO: 39235 - DNA, 20 bp, Artificial Sequence
  chemically synthesized
ctaggggtgagggaaggagt

SEQ ID NO: 39236 - DNA, 20 bp, Artificial Sequence
  chemically synthesized
taggggtgagggaaggagta

SEQ ID NO: 39237 - DNA, 20 bp, Artificial Sequence
  chemically synthesized
ggggtgagggaaggagtaag

SEQ ID NO: 39238 - DNA, 20 bp, Artificial Sequence
  chemically synthesized
ggaaggagtaaggagacata

SEQ ID NO: 39239 - DNA, 20 bp, Artificial Sequence
  chemically synthesized
gaaggagtaaggagacataa

SEQ ID NO: 39240 - DNA, 20 bp, Artificial Sequence
  chemically synthesized
aaggagacataaaggcaatg

SEQ ID NO: 39241 - DNA, 20 bp, Artificial Sequence
  chemically synthesized
ggagacataaaggcaatgtg

SEQ ID NO: 39242 - DNA, 20 bp, Artificial Sequence
  chemically synthesized
gacataaaggcaatgtggag

SEQ ID NO: 39243 - DNA, 20 bp, Artificial Sequence
  chemically synthesized
aaaggcaatgtggagcagct

SEQ ID NO: 39244 - DNA, 20 bp, Artificial Sequence
  chemically synthesized
aaggcaatgtggagcagctg

SEQ ID NO: 39245 - DNA, 20 bp, Artificial Sequence
  chemically synthesized
aggcaatgtggagcagctga

SEQ ID NO: 39246 - DNA, 20 bp, Artificial Sequence
  chemically synthesized
ggcaatgtggagcagctgag

SEQ ID NO: 39247 - DNA, 20 bp, Artificial Sequence
  chemically synthesized
gcaatgtggagcagctgagg

SEQ ID NO: 39248 - DNA, 20 bp, Artificial Sequence
  chemically synthesized
caatgtggagcagctgaggg

SEQ ID NO: 39249 - DNA, 20 bp, Artificial Sequence
  chemically synthesized
ggagcagctgaggggggaaa

SEQ ID NO: 39250 - DNA, 20 bp, Artificial Sequence
  chemically synthesized
aaatggctttcaccacttcc

SEQ ID NO: 39251 - DNA, 20 bp, Artificial Sequence
  chemically synthesized
tgcactctcaaatattttat

SEQ ID NO: 39252 - DNA, 20 bp, Artificial Sequence
  chemically synthesized
ttttataagactctatattc

SEQ ID NO: 39253 - DNA, 20 bp, Artificial Sequence
  chemically synthesized
tttataagactctatattca

SEQ ID NO: 39254 - DNA, 20 bp, Artificial Sequence
  chemically synthesized
ggtaatgtttgaaccctgct

SEQ ID NO: 39255 - DNA, 20 bp, Artificial Sequence
  chemically synthesized
atgtttgaaccctgctgagc

SEQ ID NO: 39256 - DNA, 20 bp, Artificial Sequence
  chemically synthesized
tttgaaccctgctgagccag

SEQ ID NO: 39257 - DNA, 20 bp, Artificial Sequence
  chemically synthesized
accctgctgagccagtggca

SEQ ID NO: 39258 - DNA, 20 bp, Artificial Sequence
  chemically synthesized
ccctgctgagccagtggcat

SEQ ID NO: 39259 - DNA, 20 bp, Artificial Sequence
  chemically synthesized
agccagtggcatgggtctct

SEQ ID NO: 39260 - DNA, 20 bp, Artificial Sequence
  chemically synthesized
ccagtggcatgggtctctga

SEQ ID NO: 39261 - DNA, 20 bp, Artificial Sequence
  chemically synthesized
attaacttaatttgactatc

SEQ ID NO: 39262 - DNA, 20 bp, Artificial Sequence
  chemically synthesized
taatttgactatctggtttg

SEQ ID NO: 39263 - DNA, 20 bp, Artificial Sequence
  chemically synthesized
aatttgactatctggtttgt

SEQ ID NO: 39264 - DNA, 20 bp, Artificial Sequence
  chemically synthesized
gggtgcgtttactctcatgt

SEQ ID NO: 39265 - DNA, 20 bp, Artificial Sequence
  chemically synthesized
catgtaagtcaacaatgtcc

SEQ ID NO: 39266 - DNA, 20 bp, Artificial Sequence
  chemically synthesized
atgtaagtcaacaatgtcct

SEQ ID NO: 39267 - DNA, 20 bp, Artificial Sequence
  chemically synthesized
agtcaacaatgtcctgggat

SEQ ID NO: 39268 - DNA, 20 bp, Artificial Sequence
  chemically synthesized
gtcaacaatgtcctgggatt

SEQ ID NO: 39269 - DNA, 20 bp, Artificial Sequence
  chemically synthesized
tgggattgggacacactttc

SEQ ID NO: 39270 - DNA, 20 bp, Artificial Sequence
  chemically synthesized
gggattgggacacactttct

SEQ ID NO: 39271 - DNA, 20 bp, Artificial Sequence
  chemically synthesized
acacactttctgggcactgc

SEQ ID NO: 39272 - DNA, 20 bp, Artificial Sequence
  chemically synthesized
actttctgggcactgctggc

SEQ ID NO: 39273 - DNA, 20 bp, Artificial Sequence
  chemically synthesized
actgctggccagtcccaaaa

SEQ ID NO: 39274 - DNA, 20 bp, Artificial Sequence
  chemically synthesized
ccagtcccaaaatggaacat

SEQ ID NO: 39275 - DNA, 20 bp, Artificial Sequence
  chemically synthesized
cagtcccaaaatggaacata

SEQ ID NO: 39276 - DNA, 20 bp, Artificial Sequence
  chemically synthesized
tcccaaaatggaacataagg

SEQ ID NO: 39277 - DNA, 20 bp, Artificial Sequence
  chemically synthesized
caaaatggaacataaggaag

SEQ ID NO: 39278 - DNA, 20 bp, Artificial Sequence
  chemically synthesized
acttcttttatttctgaaat

SEQ ID NO: 39279 - DNA, 20 bp, Artificial Sequence
  chemically synthesized
cttcttttatttctgaaatc

SEQ ID NO: 39280 - DNA, 20 bp, Artificial Sequence
  chemically synthesized
ttttatttctgaaatcaggt

SEQ ID NO: 39281 - DNA, 20 bp, Artificial Sequence
  chemically synthesized
ttctgaaatcaggtaagaca

SEQ ID NO: 39282 - DNA, 20 bp, Artificial Sequence
  chemically synthesized
acatagtttttttaaattat

SEQ ID NO: 39283 - DNA, 20 bp, Artificial Sequence
  chemically synthesized
ttattttttctcccacaatg

SEQ ID NO: 39284 - DNA, 20 bp, Artificial Sequence
  chemically synthesized
tagtaaaaatacatatgcca

SEQ ID NO: 39285 - DNA, 20 bp, Artificial Sequence
  chemically synthesized
tttttgattcatgaaattcc

SEQ ID NO: 39286 - DNA, 20 bp, Artificial Sequence
  chemically synthesized
tgaaaaattcttaaaaaaat

SEQ ID NO: 39287 - DNA, 20 bp, Artificial Sequence
  chemically synthesized
ataagtttaatttccccgtg

SEQ ID NO: 39288 - DNA, 20 bp, Artificial Sequence
  chemically synthesized
tttccccgtgaagactgtca

SEQ ID NO: 39289 - DNA, 20 bp, Artificial Sequence
  chemically synthesized
cgtgaagactgtcacggtgc

SEQ ID NO: 39290 - DNA, 20 bp, Artificial Sequence
  chemically synthesized
tgtcacggtgctggaatgaa

SEQ ID NO: 39291 - DNA, 20 bp, Artificial Sequence
  chemically synthesized
gtcacggtgctggaatgaat

SEQ ID NO: 39292 - DNA, 20 bp, Artificial Sequence
  chemically synthesized
acggtgctggaatgaatggg

SEQ ID NO: 39293 - DNA, 20 bp, Artificial Sequence
  chemically synthesized
tgaatgggcagaaaaaataa

SEQ ID NO: 39294 - DNA, 20 bp, Artificial Sequence
  chemically synthesized
ggttgatttttctaatctaa

SEQ ID NO: 39295 - DNA, 20 bp, Artificial Sequence
  chemically synthesized
ttgatttttctaatctaaaa

SEQ ID NO: 39296 - DNA, 20 bp, Artificial Sequence
  chemically synthesized
aaaagagtgtgcctacatga

SEQ ID NO: 39297 - DNA, 20 bp, Artificial Sequence
  chemically synthesized
gagtgtgcctacatgatggc

SEQ ID NO: 39298 - DNA, 20 bp, Artificial Sequence
  chemically synthesized
tgcctacatgatggccagtc

SEQ ID NO: 39299 - DNA, 20 bp, Artificial Sequence
  chemically synthesized
cagtctggctgaaaaataaa

SEQ ID NO: 39300 - DNA, 20 bp, Artificial Sequence
  chemically synthesized
tgaaaaataaatagccattg

SEQ ID NO: 39301 - DNA, 20 bp, Artificial Sequence
  chemically synthesized
ccattgtagctaactatgca

SEQ ID NO: 39302 - DNA, 20 bp, Artificial Sequence
  chemically synthesized
cattgtagctaactatgcaa

SEQ ID NO: 39303 - DNA, 20 bp, Artificial Sequence
  chemically synthesized
gtagctaactatgcaaagga

SEQ ID NO: 39304 - DNA, 20 bp, Artificial Sequence
  chemically synthesized
taactatgcaaaggatggct

SEQ ID NO: 39305 - DNA, 20 bp, Artificial Sequence
  chemically synthesized
ggatggctaagctcttcgct

SEQ ID NO: 39306 - DNA, 20 bp, Artificial Sequence
  chemically synthesized
taagctcttcgcttggttct

SEQ ID NO: 39307 - DNA, 20 bp, Artificial Sequence
  chemically synthesized
taatttatatcatctctgtt

SEQ ID NO: 39308 - DNA, 20 bp, Artificial Sequence
  chemically synthesized
aatttatatcatctctgttc

SEQ ID NO: 39309 - DNA, 20 bp, Artificial Sequence
  chemically synthesized
aggtgccatgctcccctcac

SEQ ID NO: 39310 - DNA, 20 bp, Artificial Sequence
  chemically synthesized
gccatgctcccctcactagc

SEQ ID NO: 39311 - DNA, 20 bp, Artificial Sequence
  chemically synthesized
aataactctttgaatatgtt

SEQ ID NO: 39312 - DNA, 20 bp, Artificial Sequence
  chemically synthesized
ttggttccttgacctgttca

SEQ ID NO: 39313 - DNA, 20 bp, Artificial Sequence
  chemically synthesized
ggttccttgacctgttcatg

SEQ ID NO: 39314 - DNA, 20 bp, Artificial Sequence
  chemically synthesized
tccttgacctgttcatggag

SEQ ID NO: 39315 - DNA, 20 bp, Artificial Sequence
  chemically synthesized
ccttgacctgttcatggagt

SEQ ID NO: 39316 - DNA, 20 bp, Artificial Sequence
  chemically synthesized
cctgttcatggagtgggact

SEQ ID NO: 39317 - DNA, 20 bp, Artificial Sequence
  chemically synthesized
cagcatttctctctttgtta

SEQ ID NO: 39318 - DNA, 20 bp, Artificial Sequence
  chemically synthesized
ttctctctttgttatggcct

SEQ ID NO: 39319 - DNA, 20 bp, Artificial Sequence
  chemically synthesized
ctctttgttatggcctgagt

SEQ ID NO: 39320 - DNA, 20 bp, Artificial Sequence
  chemically synthesized
tctttgttatggcctgagta

SEQ ID NO: 39321 - DNA, 20 bp, Artificial Sequence
  chemically synthesized
gcctgagtaaggctttccat

SEQ ID NO: 39322 - DNA, 20 bp, Artificial Sequence
  chemically synthesized
atacatttgcttcttatccc

SEQ ID NO: 39323 - DNA, 20 bp, Artificial Sequence
  chemically synthesized
acatttgcttcttatccctg

SEQ ID NO: 39324 - DNA, 20 bp, Artificial Sequence
  chemically synthesized
aattatacacatccatttgc

SEQ ID NO: 39325 - DNA, 20 bp, Artificial Sequence
  chemically synthesized
ataatgattcaacaaatact

SEQ ID NO: 39326 - DNA, 20 bp, Artificial Sequence
  chemically synthesized
taatgattcaacaaatactc

SEQ ID NO: 39327 - DNA, 20 bp, Artificial Sequence
  chemically synthesized
aatgattcaacaaatactca

SEQ ID NO: 39328 - DNA, 20 bp, Artificial Sequence
  chemically synthesized
aaatactcagggtatttgtt

SEQ ID NO: 39329 - DNA, 20 bp, Artificial Sequence
  chemically synthesized
tactcagggtatttgttgag

SEQ ID NO: 39330 - DNA, 20 bp, Artificial Sequence
  chemically synthesized
actcagggtatttgttgagt

SEQ ID NO: 39331 - DNA, 20 bp, Artificial Sequence
  chemically synthesized
agggtatttgttgagtgggt

SEQ ID NO: 39332 - DNA, 20 bp, Artificial Sequence
  chemically synthesized
gggtatttgttgagtgggtt

SEQ ID NO: 39333 - DNA, 20 bp, Artificial Sequence
  chemically synthesized
ccgtgtgtgattgtgaatgt

SEQ ID NO: 39334 - DNA, 20 bp, Artificial Sequence
  chemically synthesized
tgtgtgtcctttacaaatac

SEQ ID NO: 39335 - DNA, 20 bp, Artificial Sequence
  chemically synthesized
tttacaaatactagcttatt

SEQ ID NO: 39336 - DNA, 20 bp, Artificial Sequence
  chemically synthesized
atactagcttatttagctca

SEQ ID NO: 39337 - DNA, 20 bp, Artificial Sequence
  chemically synthesized
agcttatttagctcatggta

SEQ ID NO: 39338 - DNA, 20 bp, Artificial Sequence
  chemically synthesized
gcttatttagctcatggtat

SEQ ID NO: 39339 - DNA, 20 bp, Artificial Sequence
  chemically synthesized
tatttagctcatggtatagg

SEQ ID NO: 39340 - DNA, 20 bp, Artificial Sequence
  chemically synthesized
atttagctcatggtataggt

SEQ ID NO: 39341 - DNA, 20 bp, Artificial Sequence
  chemically synthesized
tttagctcatggtataggta

SEQ ID NO: 39342 - DNA, 20 bp, Artificial Sequence
  chemically synthesized
agctcatggtataggtaggg

SEQ ID NO: 39343 - DNA, 20 bp, Artificial Sequence
  chemically synthesized
atggtataggtagggtagca

SEQ ID NO: 39344 - DNA, 20 bp, Artificial Sequence
  chemically synthesized
tcatccccattttataaaca

SEQ ID NO: 39345 - DNA, 20 bp, Artificial Sequence
  chemically synthesized
attttataaacaaagaaatc

SEQ ID NO: 39346 - DNA, 20 bp, Artificial Sequence
  chemically synthesized
taaacaaagaaatctagact

SEQ ID NO: 39347 - DNA, 20 bp, Artificial Sequence
  chemically synthesized
aaacaaagaaatctagactt

SEQ ID NO: 39348 - DNA, 20 bp, Artificial Sequence
  chemically synthesized
cgtgaccaaattcccaaatc

SEQ ID NO: 39349 - DNA, 20 bp, Artificial Sequence
  chemically synthesized
gtgaccaaattcccaaatca

SEQ ID NO: 39350 - DNA, 20 bp, Artificial Sequence
  chemically synthesized
attcccaaatcaaggaaata

SEQ ID NO: 39351 - DNA, 20 bp, Artificial Sequence
  chemically synthesized
atcaaggaaataaagaaacc

SEQ ID NO: 39352 - DNA, 20 bp, Artificial Sequence
  chemically synthesized
aaataaagaaacctggattt

SEQ ID NO: 39353 - DNA, 20 bp, Artificial Sequence
  chemically synthesized
aaagaaacctggatttaagc

SEQ ID NO: 39354 - DNA, 20 bp, Artificial Sequence
  chemically synthesized
tggatttaagccagatttcc

SEQ ID NO: 39355 - DNA, 20 bp, Artificial Sequence
  chemically synthesized
cagatttccaagaaaaaatc

SEQ ID NO: 39356 - DNA, 20 bp, Artificial Sequence
  chemically synthesized
agatttccaagaaaaaatct

SEQ ID NO: 39357 - DNA, 20 bp, Artificial Sequence
  chemically synthesized
gatttccaagaaaaaatcta

SEQ ID NO: 39358 - DNA, 20 bp, Artificial Sequence
  chemically synthesized
aacacattccaatgtaactg

SEQ ID NO: 39359 - DNA, 20 bp, Artificial Sequence
  chemically synthesized
cacattccaatgtaactgaa

SEQ ID NO: 39360 - DNA, 20 bp, Artificial Sequence
  chemically synthesized
attccaatgtaactgaagag

SEQ ID NO: 39361 - DNA, 20 bp, Artificial Sequence
  chemically synthesized
ttccaatgtaactgaagagc

SEQ ID NO: 39362 - DNA, 20 bp, Artificial Sequence
  chemically synthesized
ggttaattgtttgccacttg

SEQ ID NO: 39363 - DNA, 20 bp, Artificial Sequence
  chemically synthesized
gccacttgcagaatccaatt

SEQ ID NO: 39364 - DNA, 20 bp, Artificial Sequence
  chemically synthesized
acttgcagaatccaattaag

SEQ ID NO: 39365 - DNA, 20 bp, Artificial Sequence
  chemically synthesized
ttgcagaatccaattaagaa

SEQ ID NO: 39366 - DNA, 20 bp, Artificial Sequence
  chemically synthesized
gcagaatccaattaagaaga

SEQ ID NO: 39367 - DNA, 20 bp, Artificial Sequence
  chemically synthesized
gaatccaattaagaagagag

SEQ ID NO: 39368 - DNA, 20 bp, Artificial Sequence
  chemically synthesized
caattaagaagagagaagtc

SEQ ID NO: 39369 - DNA, 20 bp, Artificial Sequence
  chemically synthesized
gaagagagaagtctggtata

SEQ ID NO: 39370 - DNA, 20 bp, Artificial Sequence
  chemically synthesized
agagaagtctggtataaaga

SEQ ID NO: 39371 - DNA, 20 bp, Artificial Sequence
  chemically synthesized
aagaaagtgatttgcttcca

SEQ ID NO: 39372 - DNA, 20 bp, Artificial Sequence
  chemically synthesized
aagtgatttgcttccaaagc

SEQ ID NO: 39373 - DNA, 20 bp, Artificial Sequence
  chemically synthesized
atttgcttccaaagctagct

SEQ ID NO: 39374 - DNA, 20 bp, Artificial Sequence
  chemically synthesized
tttgcttccaaagctagctt

SEQ ID NO: 39375 - DNA, 20 bp, Artificial Sequence
  chemically synthesized
ttgcttccaaagctagctta

SEQ ID NO: 39376 - DNA, 20 bp, Artificial Sequence
  chemically synthesized
tgcttccaaagctagcttag

SEQ ID NO: 39377 - DNA, 20 bp, Artificial Sequence
  chemically synthesized
ttccaaagctagcttagggg

SEQ ID NO: 39378 - DNA, 20 bp, Artificial Sequence
  chemically synthesized
ctagcttaggggaagaaatg

SEQ ID NO: 39379 - DNA, 20 bp, Artificial Sequence
  chemically synthesized
gcttaggggaagaaatgcag

SEQ ID NO: 39380 - DNA, 20 bp, Artificial Sequence
  chemically synthesized
cctgccgtactacttcactt

SEQ ID NO: 39381 - DNA, 20 bp, Artificial Sequence
  chemically synthesized
ctgccgtactacttcacttt

SEQ ID NO: 39382 - DNA, 20 bp, Artificial Sequence
  chemically synthesized
gccgtactacttcactttag

SEQ ID NO: 39383 - DNA, 20 bp, Artificial Sequence
  chemically synthesized
gtactacttcactttaggag

SEQ ID NO: 39384 - DNA, 20 bp, Artificial Sequence
  chemically synthesized
tacttcactttaggagcaga

SEQ ID NO: 39385 - DNA, 20 bp, Artificial Sequence
  chemically synthesized
ttcactttaggagcagaaag

SEQ ID NO: 39386 - DNA, 20 bp, Artificial Sequence
  chemically synthesized
gcagaaagtggcacttttaa

SEQ ID NO: 39387 - DNA, 20 bp, Artificial Sequence
  chemically synthesized
cagaaagtggcacttttaaa

SEQ ID NO: 39388 - DNA, 20 bp, Artificial Sequence
  chemically synthesized
gtggcacttttaaaaggcaa

SEQ ID NO: 39389 - DNA, 20 bp, Artificial Sequence
  chemically synthesized
ggcacttttaaaaggcaaca

SEQ ID NO: 39390 - DNA, 20 bp, Artificial Sequence
  chemically synthesized
gcacttttaaaaggcaacag

SEQ ID NO: 39391 - DNA, 20 bp, Artificial Sequence
  chemically synthesized
acttttaaaaggcaacagag

SEQ ID NO: 39392 - DNA, 20 bp, Artificial Sequence
  chemically synthesized
cttttaaaaggcaacagagg

SEQ ID NO: 39393 - DNA, 20 bp, Artificial Sequence
  chemically synthesized
taaaaggcaacagaggaggc

SEQ ID NO: 39394 - DNA, 20 bp, Artificial Sequence
  chemically synthesized
aggcaacagaggaggcgagc

SEQ ID NO: 39395 - DNA, 20 bp, Artificial Sequence
  chemically synthesized
ggcaacagaggaggcgagca

SEQ ID NO: 39396 - DNA, 20 bp, Artificial Sequence
  chemically synthesized
agaggaggcgagcaaggatt

SEQ ID NO: 39397 - DNA, 20 bp, Artificial Sequence
  chemically synthesized
gaggaggcgagcaaggattc

SEQ ID NO: 39398 - DNA, 20 bp, Artificial Sequence
  chemically synthesized
aggaggcgagcaaggattca

SEQ ID NO: 39399 - DNA, 20 bp, Artificial Sequence
  chemically synthesized
ggaggcgagcaaggattcag

SEQ ID NO: 39400 - DNA, 20 bp, Artificial Sequence
  chemically synthesized
aaggattcaggggtccatgc

SEQ ID NO: 39401 - DNA, 20 bp, Artificial Sequence
  chemically synthesized
ttcaggggtccatgctagct

SEQ ID NO: 39402 - DNA, 20 bp, Artificial Sequence
  chemically synthesized
tcaggggtccatgctagctt

SEQ ID NO: 39403 - DNA, 20 bp, Artificial Sequence
  chemically synthesized
agcttgggcaccttatccac

SEQ ID NO: 39404 - DNA, 20 bp, Artificial Sequence
  chemically synthesized
gcttgggcaccttatccacc

SEQ ID NO: 39405 - DNA, 20 bp, Artificial Sequence
  chemically synthesized
tgggcaccttatccaccagg

SEQ ID NO: 39406 - DNA, 20 bp, Artificial Sequence
  chemically synthesized
accttatccaccaggtagtt

SEQ ID NO: 39407 - DNA, 20 bp, Artificial Sequence
  chemically synthesized
ttatccaccaggtagttgag

SEQ ID NO: 39408 - DNA, 20 bp, Artificial Sequence
  chemically synthesized
gtagttgagcagttgcctgc

SEQ ID NO: 39409 - DNA, 20 bp, Artificial Sequence
  chemically synthesized
ttgcctgctggtgcctttgt

SEQ ID NO: 39410 - DNA, 20 bp, Artificial Sequence
  chemically synthesized
cctgctggtgcctttgtgag

SEQ ID NO: 39411 - DNA, 20 bp, Artificial Sequence
  chemically synthesized
ctgctggtgcctttgtgagc

SEQ ID NO: 39412 - DNA, 20 bp, Artificial Sequence
  chemically synthesized
tgctggtgcctttgtgagca

SEQ ID NO: 39413 - DNA, 20 bp, Artificial Sequence
  chemically synthesized
tgagcagggtgttgtccctt

SEQ ID NO: 39414 - DNA, 20 bp, Artificial Sequence
  chemically synthesized
gagcagggtgttgtcccttg

SEQ ID NO: 39415 - DNA, 20 bp, Artificial Sequence
  chemically synthesized
tgtcccttgaggcaaatctc

SEQ ID NO: 39416 - DNA, 20 bp, Artificial Sequence
  chemically synthesized
tcccttgaggcaaatctctg

SEQ ID NO: 39417 - DNA, 20 bp, Artificial Sequence
  chemically synthesized
cccttgaggcaaatctctgg

SEQ ID NO: 39418 - DNA, 20 bp, Artificial Sequence
  chemically synthesized
ccttgaggcaaatctctgga

SEQ ID NO: 39419 - DNA, 20 bp, Artificial Sequence
  chemically synthesized
gaggcaaatctctggagggt

SEQ ID NO: 39420 - DNA, 20 bp, Artificial Sequence
  chemically synthesized
ggcaaatctctggagggtga

SEQ ID NO: 39421 - DNA, 20 bp, Artificial Sequence
  chemically synthesized
tctggagggtgagagttttg

SEQ ID NO: 39422 - DNA, 20 bp, Artificial Sequence
  chemically synthesized
ggagggtgagagttttgtag

SEQ ID NO: 39423 - DNA, 20 bp, Artificial Sequence
  chemically synthesized
gagggtgagagttttgtagt

SEQ ID NO: 39424 - DNA, 20 bp, Artificial Sequence
  chemically synthesized
gttttgtagtgggcatgctt

SEQ ID NO: 39425 - DNA, 20 bp, Artificial Sequence
  chemically synthesized
ttataaatcacctgtgaact

SEQ ID NO: 39426 - DNA, 20 bp, Artificial Sequence
  chemically synthesized
tataaatcacctgtgaactc

SEQ ID NO: 39427 - DNA, 20 bp, Artificial Sequence
  chemically synthesized
taaatcacctgtgaactcag

SEQ ID NO: 39428 - DNA, 20 bp, Artificial Sequence
  chemically synthesized
aactcaggagttccatcttg

SEQ ID NO: 39429 - DNA, 20 bp, Artificial Sequence
  chemically synthesized
tccatcttgaagcacataca

SEQ ID NO: 39430 - DNA, 20 bp, Artificial Sequence
  chemically synthesized
tcttgaagcacatacatagt

SEQ ID NO: 39431 - DNA, 20 bp, Artificial Sequence
  chemically synthesized
agttagatgaacttgccctg

SEQ ID NO: 39432 - DNA, 20 bp, Artificial Sequence
  chemically synthesized
gttagatgaacttgccctgc

SEQ ID NO: 39433 - DNA, 20 bp, Artificial Sequence
  chemically synthesized
ttagatgaacttgccctgca

SEQ ID NO: 39434 - DNA, 20 bp, Artificial Sequence
  chemically synthesized
agatgaacttgccctgcagg

SEQ ID NO: 39435 - DNA, 20 bp, Artificial Sequence
  chemically synthesized
atgaacttgccctgcaggga

SEQ ID NO: 39436 - DNA, 20 bp, Artificial Sequence
  chemically synthesized
ctgcagggagagtctgatga

SEQ ID NO: 39437 - DNA, 20 bp, Artificial Sequence
  chemically synthesized
tgcagggagagtctgatgaa

SEQ ID NO: 39438 - DNA, 20 bp, Artificial Sequence
  chemically synthesized
gcagggagagtctgatgaaa

SEQ ID NO: 39439 - DNA, 20 bp, Artificial Sequence
  chemically synthesized
agggagagtctgatgaaagg

SEQ ID NO: 39440 - DNA, 20 bp, Artificial Sequence
  chemically synthesized
gggagagtctgatgaaaggg

SEQ ID NO: 39441 - DNA, 20 bp, Artificial Sequence
  chemically synthesized
agagtctgatgaaagggagg

SEQ ID NO: 39442 - DNA, 20 bp, Artificial Sequence
  chemically synthesized
caatttaatctataaattac

SEQ ID NO: 39443 - DNA, 20 bp, Artificial Sequence
  chemically synthesized
attaccagataaaattttac

SEQ ID NO: 39444 - DNA, 20 bp, Artificial Sequence
  chemically synthesized
aattttacaagttgacttta

SEQ ID NO: 39445 - DNA, 20 bp, Artificial Sequence
  chemically synthesized
aagtcaaacacatttgaatt

SEQ ID NO: 39446 - DNA, 20 bp, Artificial Sequence
  chemically synthesized
tcaaacacatttgaatttag

SEQ ID NO: 39447 - DNA, 20 bp, Artificial Sequence
  chemically synthesized
aacacatttgaatttagtgg

SEQ ID NO: 39448 - DNA, 20 bp, Artificial Sequence
  chemically synthesized
gaatttagtggaagccattc

SEQ ID NO: 39449 - DNA, 20 bp, Artificial Sequence
  chemically synthesized
agccattcaagaaaatatca

SEQ ID NO: 39450 - DNA, 20 bp, Artificial Sequence
  chemically synthesized
agaaaatatcaaagaaaata

SEQ ID NO: 39451 - DNA, 20 bp, Artificial Sequence
  chemically synthesized
aaaatatcaaagaaaataca

SEQ ID NO: 39452 - DNA, 20 bp, Artificial Sequence
  chemically synthesized
atatcaaagaaaatacagag

SEQ ID NO: 39453 - DNA, 20 bp, Artificial Sequence
  chemically synthesized
tatcaaagaaaatacagagc

SEQ ID NO: 39454 - DNA, 20 bp, Artificial Sequence
  chemically synthesized
tcaaagaaaatacagagcag

SEQ ID NO: 39455 - DNA, 20 bp, Artificial Sequence
  chemically synthesized
aagaaaatacagagcaggag

SEQ ID NO: 39456 - DNA, 20 bp, Artificial Sequence
  chemically synthesized
atacagagcaggagaagatt

SEQ ID NO: 39457 - DNA, 20 bp, Artificial Sequence
  chemically synthesized
gagcaggagaagattaagca

SEQ ID NO: 39458 - DNA, 20 bp, Artificial Sequence
  chemically synthesized
gcaggagaagattaagcaaa

SEQ ID NO: 39459 - DNA, 20 bp, Artificial Sequence
  chemically synthesized
agattaagcaaagagttttt

SEQ ID NO: 39460 - DNA, 20 bp, Artificial Sequence
  chemically synthesized
gattaagcaaagagtttttt

SEQ ID NO: 39461 - DNA, 20 bp, Artificial Sequence
  chemically synthesized
attaagcaaagagttttttg

SEQ ID NO: 39462 - DNA, 20 bp, Artificial Sequence
  chemically synthesized
aaagagttttttggggaaat

SEQ ID NO: 39463 - DNA, 20 bp, Artificial Sequence
  chemically synthesized
ggtgtctatgtctgtgtgtg

SEQ ID NO: 39464 - DNA, 20 bp, Artificial Sequence
  chemically synthesized
gtgtctatgtctgtgtgtgt

SEQ ID NO: 39465 - DNA, 20 bp, Artificial Sequence
  chemically synthesized
tgtctatgtctgtgtgtgta

SEQ ID NO: 39466 - DNA, 20 bp, Artificial Sequence
  chemically synthesized
tctatgtctgtgtgtgtagg

SEQ ID NO: 39467 - DNA, 20 bp, Artificial Sequence
  chemically synthesized
gtctgtgtgtgtagggagtg

SEQ ID NO: 39468 - DNA, 20 bp, Artificial Sequence
  chemically synthesized
tctgtgtgtgtagggagtgc

SEQ ID NO: 39469 - DNA, 20 bp, Artificial Sequence
  chemically synthesized
ctgtgtgtgtagggagtgca

SEQ ID NO: 39470 - DNA, 20 bp, Artificial Sequence
  chemically synthesized
tgtgtgtgtagggagtgcag

SEQ ID NO: 39471 - DNA, 20 bp, Artificial Sequence
  chemically synthesized
gggatatgaatattctattt

SEQ ID NO: 39472 - DNA, 20 bp, Artificial Sequence
  chemically synthesized
gaatattctatttcagccca

SEQ ID NO: 39473 - DNA, 20 bp, Artificial Sequence
  chemically synthesized
ctatttcagcccatggaaac

SEQ ID NO: 39474 - DNA, 20 bp, Artificial Sequence
  chemically synthesized
tatttcagcccatggaaact

SEQ ID NO: 39475 - DNA, 20 bp, Artificial Sequence
  chemically synthesized
agcccatggaaactaggatg

SEQ ID NO: 39476 - DNA, 20 bp, Artificial Sequence
  chemically synthesized
tagatcactgtgaacttatt

SEQ ID NO: 39477 - DNA, 20 bp, Artificial Sequence
  chemically synthesized
atcactgtgaacttattcag

SEQ ID NO: 39478 - DNA, 20 bp, Artificial Sequence
  chemically synthesized
tcactgtgaacttattcagc

SEQ ID NO: 39479 - DNA, 20 bp, Artificial Sequence
  chemically synthesized
tattcagcaggctacaccca

SEQ ID NO: 39480 - DNA, 20 bp, Artificial Sequence
  chemically synthesized
attcagcaggctacacccaa

SEQ ID NO: 39481 - DNA, 20 bp, Artificial Sequence
  chemically synthesized
agcaggctacacccaaaggc

SEQ ID NO: 39482 - DNA, 20 bp, Artificial Sequence
  chemically synthesized
tagaacaaacttctctgcca

SEQ ID NO: 39483 - DNA, 20 bp, Artificial Sequence
  chemically synthesized
agaacaaacttctctgccac

SEQ ID NO: 39484 - DNA, 20 bp, Artificial Sequence
  chemically synthesized
aacatatgttttaatcgacc

SEQ ID NO: 39485 - DNA, 20 bp, Artificial Sequence
  chemically synthesized
acatatgttttaatcgacct

SEQ ID NO: 39486 - DNA, 20 bp, Artificial Sequence
  chemically synthesized
catatgttttaatcgacctg

SEQ ID NO: 39487 - DNA, 20 bp, Artificial Sequence
  chemically synthesized
atatgttttaatcgacctgg

SEQ ID NO: 39488 - DNA, 20 bp, Artificial Sequence
  chemically synthesized
tatgttttaatcgacctggg

SEQ ID NO: 39489 - DNA, 20 bp, Artificial Sequence
  chemically synthesized
tggggggcacattctctgat

SEQ ID NO: 39490 - DNA, 20 bp, Artificial Sequence
  chemically synthesized
cattctctgataagctcttt

SEQ ID NO: 39491 - DNA, 20 bp, Artificial Sequence
  chemically synthesized
ctctgataagctcttttgga

SEQ ID NO: 39492 - DNA, 20 bp, Artificial Sequence
  chemically synthesized
gataagctcttttggaaagc

SEQ ID NO: 39493 - DNA, 20 bp, Artificial Sequence
  chemically synthesized
ataagctcttttggaaagcc

SEQ ID NO: 39494 - DNA, 20 bp, Artificial Sequence
  chemically synthesized
ttggaaagccaggctttctg

SEQ ID NO: 39495 - DNA, 20 bp, Artificial Sequence
  chemically synthesized
gttatctttccaatgtgtgc

SEQ ID NO: 39496 - DNA, 20 bp, Artificial Sequence
  chemically synthesized
ccaatgtgtgctggaatgcc

SEQ ID NO: 39497 - DNA, 20 bp, Artificial Sequence
  chemically synthesized
caatgtgtgctggaatgccc

SEQ ID NO: 39498 - DNA, 20 bp, Artificial Sequence
  chemically synthesized
aatgtgtgctggaatgcccg

SEQ ID NO: 39499 - DNA, 20 bp, Artificial Sequence
  chemically synthesized
tgtgtgctggaatgcccggg

SEQ ID NO: 39500 - DNA, 20 bp, Artificial Sequence
  chemically synthesized
tgtgctggaatgcccgggga

SEQ ID NO: 39501 - DNA, 20 bp, Artificial Sequence
  chemically synthesized
gtgctggaatgcccggggag

SEQ ID NO: 39502 - DNA, 20 bp, Artificial Sequence
  chemically synthesized
gaatgcccggggagaggaaa

SEQ ID NO: 39503 - DNA, 20 bp, Artificial Sequence
  chemically synthesized
agaggaaaaagtttctttta

SEQ ID NO: 39504 - DNA, 20 bp, Artificial Sequence
  chemically synthesized
gtttcttttacagccatgct

SEQ ID NO: 39505 - DNA, 20 bp, Artificial Sequence
  chemically synthesized
cttttacagccatgctcagt

SEQ ID NO: 39506 - DNA, 20 bp, Artificial Sequence
  chemically synthesized
ttacagccatgctcagtgag

SEQ ID NO: 39507 - DNA, 20 bp, Artificial Sequence
  chemically synthesized
cagccatgctcagtgagaag

SEQ ID NO: 39508 - DNA, 20 bp, Artificial Sequence
  chemically synthesized
gccatgctcagtgagaagcg

SEQ ID NO: 39509 - DNA, 20 bp, Artificial Sequence
  chemically synthesized
tcttctattcacaaattgct

SEQ ID NO: 39510 - DNA, 20 bp, Artificial Sequence
  chemically synthesized
gcatacacattcacacacca

SEQ ID NO: 39511 - DNA, 20 bp, Artificial Sequence
  chemically synthesized
acacattcacacaccacagt

SEQ ID NO: 39512 - DNA, 20 bp, Artificial Sequence
  chemically synthesized
cacattcacacaccacagtg

SEQ ID NO: 39513 - DNA, 20 bp, Artificial Sequence
  chemically synthesized
attcacacaccacagtgagg

SEQ ID NO: 39514 - DNA, 20 bp, Artificial Sequence
  chemically synthesized
ttaataaaatacatttactt

SEQ ID NO: 39515 - DNA, 20 bp, Artificial Sequence
  chemically synthesized
ataaaatacatttacttcag

SEQ ID NO: 39516 - DNA, 20 bp, Artificial Sequence
  chemically synthesized
acattttgcctataatataa

SEQ ID NO: 39517 - DNA, 20 bp, Artificial Sequence
  chemically synthesized
aaaagtatttttcctattaa

SEQ ID NO: 39518 - DNA, 20 bp, Artificial Sequence
  chemically synthesized
ttaaatccccattgccatat

SEQ ID NO: 39519 - DNA, 20 bp, Artificial Sequence
  chemically synthesized
ccccattgccatatgagccc

SEQ ID NO: 39520 - DNA, 20 bp, Artificial Sequence
  chemically synthesized
ccattgccatatgagccctg

SEQ ID NO: 39521 - DNA, 20 bp, Artificial Sequence
  chemically synthesized
cattgccatatgagccctgg

SEQ ID NO: 39522 - DNA, 20 bp, Artificial Sequence
  chemically synthesized
tatgagccctggaggtgaat

SEQ ID NO: 39523 - DNA, 20 bp, Artificial Sequence
  chemically synthesized
tgagccctggaggtgaatca

SEQ ID NO: 39524 - DNA, 20 bp, Artificial Sequence
  chemically synthesized
gaggtgaatcagagaaacaa

SEQ ID NO: 39525 - DNA, 20 bp, Artificial Sequence
  chemically synthesized
aggtgaatcagagaaacaaa

SEQ ID NO: 39526 - DNA, 20 bp, Artificial Sequence
  chemically synthesized
tcagagaaacaaaaggattg

SEQ ID NO: 39527 - DNA, 20 bp, Artificial Sequence
  chemically synthesized
aaggattgtggaaaaatcat

SEQ ID NO: 39528 - DNA, 20 bp, Artificial Sequence
  chemically synthesized
aggattgtggaaaaatcatc

SEQ ID NO: 39529 - DNA, 20 bp, Artificial Sequence
  chemically synthesized
aaaaatcatcaggttaaaaa

SEQ ID NO: 39530 - DNA, 20 bp, Artificial Sequence
  chemically synthesized
aagaaaaattgattctgttt

SEQ ID NO: 39531 - DNA, 20 bp, Artificial Sequence
  chemically synthesized
agaaaaattgattctgtttt

SEQ ID NO: 39532 - DNA, 20 bp, Artificial Sequence
  chemically synthesized
ttctgttttgggatatttcc

SEQ ID NO: 39533 - DNA, 20 bp, Artificial Sequence
  chemically synthesized
gggatatttcctagcaacat

SEQ ID NO: 39534 - DNA, 20 bp, Artificial Sequence
  chemically synthesized
tatttcctagcaacatgagc

SEQ ID NO: 39535 - DNA, 20 bp, Artificial Sequence
  chemically synthesized
atttcctagcaacatgagct

SEQ ID NO: 39536 - DNA, 20 bp, Artificial Sequence
  chemically synthesized
tttcctagcaacatgagctg

SEQ ID NO: 39537 - DNA, 20 bp, Artificial Sequence
  chemically synthesized
tcctagcaacatgagctggg

SEQ ID NO: 39538 - DNA, 20 bp, Artificial Sequence
  chemically synthesized
cctagcaacatgagctgggg

SEQ ID NO: 39539 - DNA, 20 bp, Artificial Sequence
  chemically synthesized
ctagcaacatgagctgggga

SEQ ID NO: 39540 - DNA, 20 bp, Artificial Sequence
  chemically synthesized
tagcaacatgagctggggag

SEQ ID NO: 39541 - DNA, 20 bp, Artificial Sequence
  chemically synthesized
atgagctggggaggggatct

SEQ ID NO: 39542 - DNA, 20 bp, Artificial Sequence
  chemically synthesized
agctggggaggggatctcag

SEQ ID NO: 39543 - DNA, 20 bp, Artificial Sequence
  chemically synthesized
ctcagcagtgatgctctatg

SEQ ID NO: 39544 - DNA, 20 bp, Artificial Sequence
  chemically synthesized
tgaagcataataaaatgaca

SEQ ID NO: 39545 - DNA, 20 bp, Artificial Sequence
  chemically synthesized
ataataaaatgacacagtta

SEQ ID NO: 39546 - DNA, 20 bp, Artificial Sequence
  chemically synthesized
taataaaatgacacagttac

SEQ ID NO: 39547 - DNA, 20 bp, Artificial Sequence
  chemically synthesized
tgacacagttacaggtaact

SEQ ID NO: 39548 - DNA, 20 bp, Artificial Sequence
  chemically synthesized
agttacaggtaacttagtta

SEQ ID NO: 39549 - DNA, 20 bp, Artificial Sequence
  chemically synthesized
gttacaggtaacttagttaa

SEQ ID NO: 39550 - DNA, 20 bp, Artificial Sequence
  chemically synthesized
ttacaggtaacttagttaaa

SEQ ID NO: 39551 - DNA, 20 bp, Artificial Sequence
  chemically synthesized
tacaggtaacttagttaaag

SEQ ID NO: 39552 - DNA, 20 bp, Artificial Sequence
  chemically synthesized
acaggtaacttagttaaagg

SEQ ID NO: 39553 - DNA, 20 bp, Artificial Sequence
  chemically synthesized
tagttaaagggggaaataaa

SEQ ID NO: 39554 - DNA, 20 bp, Artificial Sequence
  chemically synthesized
ttaaagggggaaataaatgg

SEQ ID NO: 39555 - DNA, 20 bp, Artificial Sequence
  chemically synthesized
ctctttttgaatatcaattg

SEQ ID NO: 39556 - DNA, 20 bp, Artificial Sequence
  chemically synthesized
atgtttaactgaactcactg

SEQ ID NO: 39557 - DNA, 20 bp, Artificial Sequence
  chemically synthesized
tgtttaactgaactcactgt

SEQ ID NO: 39558 - DNA, 20 bp, Artificial Sequence
  chemically synthesized
ttaactgaactcactgtagg

SEQ ID NO: 39559 - DNA, 20 bp, Artificial Sequence
  chemically synthesized
ttaatttattgtgtgttttg

SEQ ID NO: 39560 - DNA, 20 bp, Artificial Sequence
  chemically synthesized
gtgttttgaagtcacactgt

SEQ ID NO: 39561 - DNA, 20 bp, Artificial Sequence
  chemically synthesized
tgaagtcacactgtgagcta

SEQ ID NO: 39562 - DNA, 20 bp, Artificial Sequence
  chemically synthesized
gtgagctatagaatttaccc

SEQ ID NO: 39563 - DNA, 20 bp, Artificial Sequence
  chemically synthesized
tacccaagcacaactcttcc

SEQ ID NO: 39564 - DNA, 20 bp, Artificial Sequence
  chemically synthesized
aagcacaactcttcctggaa

SEQ ID NO: 39565 - DNA, 20 bp, Artificial Sequence
  chemically synthesized
gcacaactcttcctggaaaa

SEQ ID NO: 39566 - DNA, 20 bp, Artificial Sequence
  chemically synthesized
acaactcttcctggaaaaga

SEQ ID NO: 39567 - DNA, 20 bp, Artificial Sequence
  chemically synthesized
ctggaaaagagagttcaaat

SEQ ID NO: 39568 - DNA, 20 bp, Artificial Sequence
  chemically synthesized
aagagagttcaaatgagaaa

SEQ ID NO: 39569 - DNA, 20 bp, Artificial Sequence
  chemically synthesized
agttcaaatgagaaacagtg

SEQ ID NO: 39570 - DNA, 20 bp, Artificial Sequence
  chemically synthesized
gttcaaatgagaaacagtgc

SEQ ID NO: 39571 - DNA, 20 bp, Artificial Sequence
  chemically synthesized
ttcaaatgagaaacagtgcg

SEQ ID NO: 39572 - DNA, 20 bp, Artificial Sequence
  chemically synthesized
atgagaaacagtgcggggtg

SEQ ID NO: 39573 - DNA, 20 bp, Artificial Sequence
  chemically synthesized
aacagtgcggggtgaagaca

SEQ ID NO: 39574 - DNA, 20 bp, Artificial Sequence
  chemically synthesized
gcggggtgaagacatggata

SEQ ID NO: 39575 - DNA, 20 bp, Artificial Sequence
  chemically synthesized
cggggtgaagacatggatat

SEQ ID NO: 39576 - DNA, 20 bp, Artificial Sequence
  chemically synthesized
gatattttgatatatctatc

SEQ ID NO: 39577 - DNA, 20 bp, Artificial Sequence
  chemically synthesized
tatatctatcaagtgctttt

SEQ ID NO: 39578 - DNA, 20 bp, Artificial Sequence
  chemically synthesized
atctatcaagtgctttttag

SEQ ID NO: 39579 - DNA, 20 bp, Artificial Sequence
  chemically synthesized
tcaagtgctttttagtggat

SEQ ID NO: 39580 - DNA, 20 bp, Artificial Sequence
  chemically synthesized
caagtgctttttagtggatt

SEQ ID NO: 39581 - DNA, 20 bp, Artificial Sequence
  chemically synthesized
gctttttagtggattaggtt

SEQ ID NO: 39582 - DNA, 20 bp, Artificial Sequence
  chemically synthesized
ggattaggttcagaatgcat

SEQ ID NO: 39583 - DNA, 20 bp, Artificial Sequence
  chemically synthesized
ccaatgcctgttcaataatc

SEQ ID NO: 39584 - DNA, 20 bp, Artificial Sequence
  chemically synthesized
tgttcaataatccagttttc

SEQ ID NO: 39585 - DNA, 20 bp, Artificial Sequence
  chemically synthesized
aataatccagttttccagca

SEQ ID NO: 39586 - DNA, 20 bp, Artificial Sequence
  chemically synthesized
taatccagttttccagcata

SEQ ID NO: 39587 - DNA, 20 bp, Artificial Sequence
  chemically synthesized
agcatagagcatattaaatt

SEQ ID NO: 39588 - DNA, 20 bp, Artificial Sequence
  chemically synthesized
gcatagagcatattaaattg

SEQ ID NO: 39589 - DNA, 20 bp, Artificial Sequence
  chemically synthesized
tagagcatattaaattgagg

SEQ ID NO: 39590 - DNA, 20 bp, Artificial Sequence
  chemically synthesized
agagcatattaaattgagga

SEQ ID NO: 39591 - DNA, 20 bp, Artificial Sequence
  chemically synthesized
tattaaattgaggaaggaca

SEQ ID NO: 39592 - DNA, 20 bp, Artificial Sequence
  chemically synthesized
attgaggaaggacaaagtca

SEQ ID NO: 39593 - DNA, 20 bp, Artificial Sequence
  chemically synthesized
tgaggaaggacaaagtcaca

SEQ ID NO: 39594 - DNA, 20 bp, Artificial Sequence
  chemically synthesized
gaggaaggacaaagtcacag

SEQ ID NO: 39595 - DNA, 20 bp, Artificial Sequence
  chemically synthesized
gaaggacaaagtcacagagg

SEQ ID NO: 39596 - DNA, 20 bp, Artificial Sequence
  chemically synthesized
aaggacaaagtcacagaggt

SEQ ID NO: 39597 - DNA, 20 bp, Artificial Sequence
  chemically synthesized
aggacaaagtcacagaggtg

SEQ ID NO: 39598 - DNA, 20 bp, Artificial Sequence
  chemically synthesized
gacaaagtcacagaggtggg

SEQ ID NO: 39599 - DNA, 20 bp, Artificial Sequence
  chemically synthesized
aaagtcacagaggtggggag

SEQ ID NO: 39600 - DNA, 20 bp, Artificial Sequence
  chemically synthesized
aagtcacagaggtggggagc

SEQ ID NO: 39601 - DNA, 20 bp, Artificial Sequence
  chemically synthesized
tcacagaggtggggagcagg

SEQ ID NO: 39602 - DNA, 20 bp, Artificial Sequence
  chemically synthesized
ggtggggagcaggtggactg

SEQ ID NO: 39603 - DNA, 20 bp, Artificial Sequence
  chemically synthesized
ggagcaggtggactgtggcc

SEQ ID NO: 39604 - DNA, 20 bp, Artificial Sequence
  chemically synthesized
gagcaggtggactgtggcca

SEQ ID NO: 39605 - DNA, 20 bp, Artificial Sequence
  chemically synthesized
gccaaggactttgcatgaaa

SEQ ID NO: 39606 - DNA, 20 bp, Artificial Sequence
  chemically synthesized
aggactttgcatgaaacagt

SEQ ID NO: 39607 - DNA, 20 bp, Artificial Sequence
  chemically synthesized
tcctccttgccctgccctca

SEQ ID NO: 39608 - DNA, 20 bp, Artificial Sequence
  chemically synthesized
cctcatggtctgtgtactct

SEQ ID NO: 39609 - DNA, 20 bp, Artificial Sequence
  chemically synthesized
ctcatggtctgtgtactctc

SEQ ID NO: 39610 - DNA, 20 bp, Artificial Sequence
  chemically synthesized
catggtctgtgtactctcag

SEQ ID NO: 39611 - DNA, 20 bp, Artificial Sequence
  chemically synthesized
atggtctgtgtactctcagg

SEQ ID NO: 39612 - DNA, 20 bp, Artificial Sequence
  chemically synthesized
tctgtgtactctcaggaggt

SEQ ID NO: 39613 - DNA, 20 bp, Artificial Sequence
  chemically synthesized
ctgtgtactctcaggaggtc

SEQ ID NO: 39614 - DNA, 20 bp, Artificial Sequence
  chemically synthesized
gtactctcaggaggtcagga

SEQ ID NO: 39615 - DNA, 20 bp, Artificial Sequence
  chemically synthesized
tactctcaggaggtcaggac

SEQ ID NO: 39616 - DNA, 20 bp, Artificial Sequence
  chemically synthesized
aggtcaggacaggcctttct

SEQ ID NO: 39617 - DNA, 20 bp, Artificial Sequence
  chemically synthesized
ggacaggcctttctgagaat

SEQ ID NO: 39618 - DNA, 20 bp, Artificial Sequence
  chemically synthesized
ctgttcatctgcctttctac

SEQ ID NO: 39619 - DNA, 20 bp, Artificial Sequence
  chemically synthesized
ttctactggatacttgtcat

SEQ ID NO: 39620 - DNA, 20 bp, Artificial Sequence
  chemically synthesized
atacaaacacatgttctctg

SEQ ID NO: 39621 - DNA, 20 bp, Artificial Sequence
  chemically synthesized
ctctgcagtgtgtcatcttt

SEQ ID NO: 39622 - DNA, 20 bp, Artificial Sequence
  chemically synthesized
tcccctgaccctgtattccc

SEQ ID NO: 39623 - DNA, 20 bp, Artificial Sequence
  chemically synthesized
cctgaccctgtattccctag

SEQ ID NO: 39624 - DNA, 20 bp, Artificial Sequence
  chemically synthesized
cctagaagtctcgctgcttt

SEQ ID NO: 39625 - DNA, 20 bp, Artificial Sequence
  chemically synthesized
tagaagtctcgctgctttca

SEQ ID NO: 39626 - DNA, 20 bp, Artificial Sequence
  chemically synthesized
agtctcgctgctttcagagc

SEQ ID NO: 39627 - DNA, 20 bp, Artificial Sequence
  chemically synthesized
gtctcgctgctttcagagcc

SEQ ID NO: 39628 - DNA, 20 bp, Artificial Sequence
  chemically synthesized
tgccacccccactgctcttc

SEQ ID NO: 39629 - DNA, 20 bp, Artificial Sequence
  chemically synthesized
taacccactccatctgcatg

SEQ ID NO: 39630 - DNA, 20 bp, Artificial Sequence
  chemically synthesized
ggcccccaccacacccctca

SEQ ID NO: 39631 - DNA, 20 bp, Artificial Sequence
  chemically synthesized
ccccaccacacccctcaaag

SEQ ID NO: 39632 - DNA, 20 bp, Artificial Sequence
  chemically synthesized
ccacacccctcaaagtggtc

SEQ ID NO: 39633 - DNA, 20 bp, Artificial Sequence
  chemically synthesized
cacacccctcaaagtggtca

SEQ ID NO: 39634 - DNA, 20 bp, Artificial Sequence
  chemically synthesized
tgtcctgttgcttaattcca

SEQ ID NO: 39635 - DNA, 20 bp, Artificial Sequence
  chemically synthesized
cctgttgcttaattccatgg

SEQ ID NO: 39636 - DNA, 20 bp, Artificial Sequence
  chemically synthesized
tgcttaattccatggaagct

SEQ ID NO: 39637 - DNA, 20 bp, Artificial Sequence
  chemically synthesized
cttggctatcttcattttat

SEQ ID NO: 39638 - DNA, 20 bp, Artificial Sequence
  chemically synthesized
ttcattttattagcctcttt

SEQ ID NO: 39639 - DNA, 20 bp, Artificial Sequence
  chemically synthesized
aaaatcactacattttgtgc

SEQ ID NO: 39640 - DNA, 20 bp, Artificial Sequence
  chemically synthesized
aatcactacattttgtgcca

SEQ ID NO: 39641 - DNA, 20 bp, Artificial Sequence
  chemically synthesized
actacattttgtgccagaga

SEQ ID NO: 39642 - DNA, 20 bp, Artificial Sequence
  chemically synthesized
tacattttgtgccagagatg

SEQ ID NO: 39643 - DNA, 20 bp, Artificial Sequence
  chemically synthesized
ttttgtgccagagatggagc

SEQ ID NO: 39644 - DNA, 20 bp, Artificial Sequence
  chemically synthesized
agagatggagctggcatctc

SEQ ID NO: 39645 - DNA, 20 bp, Artificial Sequence
  chemically synthesized
gagatggagctggcatctcc

SEQ ID NO: 39646 - DNA, 20 bp, Artificial Sequence
  chemically synthesized
ggagctggcatctccaggct

SEQ ID NO: 39647 - DNA, 20 bp, Artificial Sequence
  chemically synthesized
gctggcatctccaggcttgg

SEQ ID NO: 39648 - DNA, 20 bp, Artificial Sequence
  chemically synthesized
tggcatctccaggcttggaa

SEQ ID NO: 39649 - DNA, 20 bp, Artificial Sequence
  chemically synthesized
ggcatctccaggcttggaag

SEQ ID NO: 39650 - DNA, 20 bp, Artificial Sequence
  chemically synthesized
gcatctccaggcttggaaga

SEQ ID NO: 39651 - DNA, 20 bp, Artificial Sequence
  chemically synthesized
ggcttggaagagggctgctg

SEQ ID NO: 39652 - DNA, 20 bp, Artificial Sequence
  chemically synthesized
ggaagagggctgctgaagct

SEQ ID NO: 39653 - DNA, 20 bp, Artificial Sequence
  chemically synthesized
gagggctgctgaagctcagc

SEQ ID NO: 39654 - DNA, 20 bp, Artificial Sequence
  chemically synthesized
agggctgctgaagctcagcc

SEQ ID NO: 39655 - DNA, 20 bp, Artificial Sequence
  chemically synthesized
gaagctcagccaggtgtcct

SEQ ID NO: 39656 - DNA, 20 bp, Artificial Sequence
  chemically synthesized
aagctcagccaggtgtccta

SEQ ID NO: 39657 - DNA, 20 bp, Artificial Sequence
  chemically synthesized
gctcagccaggtgtcctaag

SEQ ID NO: 39658 - DNA, 20 bp, Artificial Sequence
  chemically synthesized
ccaggtgtcctaaggagcct

SEQ ID NO: 39659 - DNA, 20 bp, Artificial Sequence
  chemically synthesized
caggtgtcctaaggagcctc

SEQ ID NO: 39660 - DNA, 20 bp, Artificial Sequence
  chemically synthesized
tgtcctaaggagcctcagga

SEQ ID NO: 39661 - DNA, 20 bp, Artificial Sequence
  chemically synthesized
gtcctaaggagcctcaggac

SEQ ID NO: 39662 - DNA, 20 bp, Artificial Sequence
  chemically synthesized
tcctaaggagcctcaggaca

SEQ ID NO: 39663 - DNA, 20 bp, Artificial Sequence
  chemically synthesized
cctaaggagcctcaggacag

SEQ ID NO: 39664 - DNA, 20 bp, Artificial Sequence
  chemically synthesized
gcctcaggacaggggatgct

SEQ ID NO: 39665 - DNA, 20 bp, Artificial Sequence
  chemically synthesized
tcaggacaggggatgctcag

SEQ ID NO: 39666 - DNA, 20 bp, Artificial Sequence
  chemically synthesized
gatgctcagtagccttgcaa

SEQ ID NO: 39667 - DNA, 20 bp, Artificial Sequence
  chemically synthesized
atgctcagtagccttgcaat

SEQ ID NO: 39668 - DNA, 20 bp, Artificial Sequence
  chemically synthesized
gtagccttgcaatgggaaca

SEQ ID NO: 39669 - DNA, 20 bp, Artificial Sequence
  chemically synthesized
cttgcaatgggaacacagct

SEQ ID NO: 39670 - DNA, 20 bp, Artificial Sequence
  chemically synthesized
gaacacagctgagccccact

SEQ ID NO: 39671 - DNA, 20 bp, Artificial Sequence
  chemically synthesized
tggccaccctttgccacaac

SEQ ID NO: 39672 - DNA, 20 bp, Artificial Sequence
  chemically synthesized
ggccaccctttgccacaacc

SEQ ID NO: 39673 - DNA, 20 bp, Artificial Sequence
  chemically synthesized
caccctttgccacaaccagg

SEQ ID NO: 39674 - DNA, 20 bp, Artificial Sequence
  chemically synthesized
ctttgccacaaccaggcaga

SEQ ID NO: 39675 - DNA, 20 bp, Artificial Sequence
  chemically synthesized
tgccacaaccaggcagaaag

SEQ ID NO: 39676 - DNA, 20 bp, Artificial Sequence
  chemically synthesized
ggcagaaagcagcttttgaa

SEQ ID NO: 39677 - DNA, 20 bp, Artificial Sequence
  chemically synthesized
tttgaacagatttgttgcct

SEQ ID NO: 39678 - DNA, 20 bp, Artificial Sequence
  chemically synthesized
ttgcctcagatttgatctca

SEQ ID NO: 39679 - DNA, 20 bp, Artificial Sequence
  chemically synthesized
ttgatctcaaagaaaaatcg

SEQ ID NO: 39680 - DNA, 20 bp, Artificial Sequence
  chemically synthesized
tgatctcaaagaaaaatcgt

SEQ ID NO: 39681 - DNA, 20 bp, Artificial Sequence
  chemically synthesized
tctcaaagaaaaatcgtggg

SEQ ID NO: 39682 - DNA, 20 bp, Artificial Sequence
  chemically synthesized
agaaaaatcgtgggcagtat

SEQ ID NO: 39683 - DNA, 20 bp, Artificial Sequence
  chemically synthesized
atcgtgggcagtattggtcc

SEQ ID NO: 39684 - DNA, 20 bp, Artificial Sequence
  chemically synthesized
tcgtgggcagtattggtccc

SEQ ID NO: 39685 - DNA, 20 bp, Artificial Sequence
  chemically synthesized
ttacaatttcctctgaaatc

SEQ ID NO: 39686 - DNA, 20 bp, Artificial Sequence
  chemically synthesized
ctggatgcctatcaacacct

SEQ ID NO: 39687 - DNA, 20 bp, Artificial Sequence
  chemically synthesized
actgaattctccccaactaa

SEQ ID NO: 39688 - DNA, 20 bp, Artificial Sequence
  chemically synthesized
gaattctccccaactaatag

SEQ ID NO: 39689 - DNA, 20 bp, Artificial Sequence
  chemically synthesized
ctaatagtggtgtgtcactg

SEQ ID NO: 39690 - DNA, 20 bp, Artificial Sequence
  chemically synthesized
tagtggtgtgtcactgtagt

SEQ ID NO: 39691 - DNA, 20 bp, Artificial Sequence
  chemically synthesized
gtgtgtcactgtagtaagcc

SEQ ID NO: 39692 - DNA, 20 bp, Artificial Sequence
  chemically synthesized
tagtaagcctagtacaaaaa

SEQ ID NO: 39693 - DNA, 20 bp, Artificial Sequence
  chemically synthesized
tacaaaaatggccttctttg

SEQ ID NO: 39694 - DNA, 20 bp, Artificial Sequence
  chemically synthesized
caaaaatggccttctttgtg

SEQ ID NO: 39695 - DNA, 20 bp, Artificial Sequence
  chemically synthesized
aaaaatggccttctttgtgg

SEQ ID NO: 39696 - DNA, 20 bp, Artificial Sequence
  chemically synthesized
aaatggccttctttgtggag

SEQ ID NO: 39697 - DNA, 20 bp, Artificial Sequence
  chemically synthesized
tttttgcttaatttttgccc

SEQ ID NO: 39698 - DNA, 20 bp, Artificial Sequence
  chemically synthesized
gcttaatttttgcccaagat

SEQ ID NO: 39699 - DNA, 20 bp, Artificial Sequence
  chemically synthesized
cccaagatgagaacataatt

SEQ ID NO: 39700 - DNA, 20 bp, Artificial Sequence
  chemically synthesized
caccaacatttttgtaacta

SEQ ID NO: 39701 - DNA, 20 bp, Artificial Sequence
  chemically synthesized
accaacatttttgtaactaa

SEQ ID NO: 39702 - DNA, 20 bp, Artificial Sequence
  chemically synthesized
caacatttttgtaactaaag

SEQ ID NO: 39703 - DNA, 20 bp, Artificial Sequence
  chemically synthesized
aacatttttgtaactaaagg

SEQ ID NO: 39704 - DNA, 20 bp, Artificial Sequence
  chemically synthesized
acatttttgtaactaaagga

SEQ ID NO: 39705 - DNA, 20 bp, Artificial Sequence
  chemically synthesized
taactaaaggagggaccatt

SEQ ID NO: 39706 - DNA, 20 bp, Artificial Sequence
  chemically synthesized
ctaaaggagggaccattcag

SEQ ID NO: 39707 - DNA, 20 bp, Artificial Sequence
  chemically synthesized
aagatgcttatcaactgtca

SEQ ID NO: 39708 - DNA, 20 bp, Artificial Sequence
  chemically synthesized
cttatcaactgtcaaagtga

SEQ ID NO: 39709 - DNA, 20 bp, Artificial Sequence
  chemically synthesized
acaaccaatgcacatattgt

SEQ ID NO: 39710 - DNA, 20 bp, Artificial Sequence
  chemically synthesized
tattgtaagaaatcaaacaa

SEQ ID NO: 39711 - DNA, 20 bp, Artificial Sequence
  chemically synthesized
gaaatcaaacaatggcctcc

SEQ ID NO: 39712 - DNA, 20 bp, Artificial Sequence
  chemically synthesized
aaatcaaacaatggcctcca

SEQ ID NO: 39713 - DNA, 20 bp, Artificial Sequence
  chemically synthesized
ctccaaggttcatttctaca

SEQ ID NO: 39714 - DNA, 20 bp, Artificial Sequence
  chemically synthesized
tccaaggttcatttctacac

SEQ ID NO: 39715 - DNA, 20 bp, Artificial Sequence
  chemically synthesized
ccaaggttcatttctacaca

SEQ ID NO: 39716 - DNA, 20 bp, Artificial Sequence
  chemically synthesized
gttcatttctacacagggat

SEQ ID NO: 39717 - DNA, 20 bp, Artificial Sequence
  chemically synthesized
catttctacacagggattag

SEQ ID NO: 39718 - DNA, 20 bp, Artificial Sequence
  chemically synthesized
tagcagatcaacatcaatct

SEQ ID NO: 39719 - DNA, 20 bp, Artificial Sequence
  chemically synthesized
caacatcaatcttggcaaca

SEQ ID NO: 39720 - DNA, 20 bp, Artificial Sequence
  chemically synthesized
ggcaacacagttgccactga

SEQ ID NO: 39721 - DNA, 20 bp, Artificial Sequence
  chemically synthesized
ttattttttttatcatgaca

SEQ ID NO: 39722 - DNA, 20 bp, Artificial Sequence
  chemically synthesized
tttatcatgacatggcaatc

SEQ ID NO: 39723 - DNA, 20 bp, Artificial Sequence
  chemically synthesized
tatcatgacatggcaatcaa

SEQ ID NO: 39724 - DNA, 20 bp, Artificial Sequence
  chemically synthesized
aacatgatttattcttattt

SEQ ID NO: 39725 - DNA, 20 bp, Artificial Sequence
  chemically synthesized
tattcttatttaagatttta

SEQ ID NO: 39726 - DNA, 20 bp, Artificial Sequence
  chemically synthesized
cttatttaagattttatggt

SEQ ID NO: 39727 - DNA, 20 bp, Artificial Sequence
  chemically synthesized
ttaagattttatggttagac

SEQ ID NO: 39728 - DNA, 20 bp, Artificial Sequence
  chemically synthesized
taagattttatggttagact

SEQ ID NO: 39729 - DNA, 20 bp, Artificial Sequence
  chemically synthesized
gattttatggttagactagg

SEQ ID NO: 39730 - DNA, 20 bp, Artificial Sequence
  chemically synthesized
ttatggttagactaggcaga

SEQ ID NO: 39731 - DNA, 20 bp, Artificial Sequence
  chemically synthesized
ggttagactaggcagatagc

SEQ ID NO: 39732 - DNA, 20 bp, Artificial Sequence
  chemically synthesized
ctaggcagatagctagatat

SEQ ID NO: 39733 - DNA, 20 bp, Artificial Sequence
  chemically synthesized
ggcagatagctagatatgag

SEQ ID NO: 39734 - DNA, 20 bp, Artificial Sequence
  chemically synthesized
gcagatagctagatatgagc

SEQ ID NO: 39735 - DNA, 20 bp, Artificial Sequence
  chemically synthesized
agatagctagatatgagcag

SEQ ID NO: 39736 - DNA, 20 bp, Artificial Sequence
  chemically synthesized
gatagctagatatgagcagg

SEQ ID NO: 39737 - DNA, 20 bp, Artificial Sequence
  chemically synthesized
agctagatatgagcaggagg

SEQ ID NO: 39738 - DNA, 20 bp, Artificial Sequence
  chemically synthesized
tagatatgagcaggaggtgg

SEQ ID NO: 39739 - DNA, 20 bp, Artificial Sequence
  chemically synthesized
agcaggaggtggaagcccct

SEQ ID NO: 39740 - DNA, 20 bp, Artificial Sequence
  chemically synthesized
caggaggtggaagcccctga

SEQ ID NO: 39741 - DNA, 20 bp, Artificial Sequence
  chemically synthesized
ggtggaagcccctgagagaa

SEQ ID NO: 39742 - DNA, 20 bp, Artificial Sequence
  chemically synthesized
tggaagcccctgagagaatg

SEQ ID NO: 39743 - DNA, 20 bp, Artificial Sequence
  chemically synthesized
ggaagcccctgagagaatgg

SEQ ID NO: 39744 - DNA, 20 bp, Artificial Sequence
  chemically synthesized
cccctgagagaatggaggtc

SEQ ID NO: 39745 - DNA, 20 bp, Artificial Sequence
  chemically synthesized
cctgagagaatggaggtctg

SEQ ID NO: 39746 - DNA, 20 bp, Artificial Sequence
  chemically synthesized
gtctggagaatctgaaaccc

SEQ ID NO: 39747 - DNA, 20 bp, Artificial Sequence
  chemically synthesized
ctggagaatctgaaacccca

SEQ ID NO: 39748 - DNA, 20 bp, Artificial Sequence
  chemically synthesized
tgaaaccccagagattaccc

SEQ ID NO: 39749 - DNA, 20 bp, Artificial Sequence
  chemically synthesized
attacccaagtcctgcatgc

SEQ ID NO: 39750 - DNA, 20 bp, Artificial Sequence
  chemically synthesized
aagtcctgcatgctagacat

SEQ ID NO: 39751 - DNA, 20 bp, Artificial Sequence
  chemically synthesized
tcctgcatgctagacatgag

SEQ ID NO: 39752 - DNA, 20 bp, Artificial Sequence
  chemically synthesized
ctgcatgctagacatgagtg

SEQ ID NO: 39753 - DNA, 20 bp, Artificial Sequence
  chemically synthesized
tgcatgctagacatgagtgg

SEQ ID NO: 39754 - DNA, 20 bp, Artificial Sequence
  chemically synthesized
catgctagacatgagtggag

SEQ ID NO: 39755 - DNA, 20 bp, Artificial Sequence
  chemically synthesized
atgctagacatgagtggagg

SEQ ID NO: 39756 - DNA, 20 bp, Artificial Sequence
  chemically synthesized
tgctagacatgagtggagga

SEQ ID NO: 39757 - DNA, 20 bp, Artificial Sequence
  chemically synthesized
gctagacatgagtggaggag

SEQ ID NO: 39758 - DNA, 20 bp, Artificial Sequence
  chemically synthesized
ctagacatgagtggaggagg

SEQ ID NO: 39759 - DNA, 20 bp, Artificial Sequence
  chemically synthesized
agtggaggagggggaatacc

SEQ ID NO: 39760 - DNA, 20 bp, Artificial Sequence
  chemically synthesized
gtggaggagggggaatacct

SEQ ID NO: 39761 - DNA, 20 bp, Artificial Sequence
  chemically synthesized
gaggagggggaatacctagg

SEQ ID NO: 39762 - DNA, 20 bp, Artificial Sequence
  chemically synthesized
gggggaatacctaggtagaa

SEQ ID NO: 39763 - DNA, 20 bp, Artificial Sequence
  chemically synthesized
ggtagaaaagaatgcccctt

SEQ ID NO: 39764 - DNA, 20 bp, Artificial Sequence
  chemically synthesized
agaatgccccttaagatgcc

SEQ ID NO: 39765 - DNA, 20 bp, Artificial Sequence
  chemically synthesized
atgccccttaagatgcccag

SEQ ID NO: 39766 - DNA, 20 bp, Artificial Sequence
  chemically synthesized
cccagcagtcgctcactgtg

SEQ ID NO: 39767 - DNA, 20 bp, Artificial Sequence
  chemically synthesized
tcactgtgcagttaactttt

SEQ ID NO: 39768 - DNA, 20 bp, Artificial Sequence
  chemically synthesized
ttaacttttcagaatgctgc

SEQ ID NO: 39769 - DNA, 20 bp, Artificial Sequence
  chemically synthesized
tgctgctagatacatgctga

SEQ ID NO: 39770 - DNA, 20 bp, Artificial Sequence
  chemically synthesized
gctgctagatacatgctgat

SEQ ID NO: 39771 - DNA, 20 bp, Artificial Sequence
  chemically synthesized
ctgctagatacatgctgata

SEQ ID NO: 39772 - DNA, 20 bp, Artificial Sequence
  chemically synthesized
gctagatacatgctgatagg

SEQ ID NO: 39773 - DNA, 20 bp, Artificial Sequence
  chemically synthesized
ctagatacatgctgataggg

SEQ ID NO: 39774 - DNA, 20 bp, Artificial Sequence
  chemically synthesized
tagatacatgctgataggga

SEQ ID NO: 39775 - DNA, 20 bp, Artificial Sequence
  chemically synthesized
atacatgctgatagggaggg

SEQ ID NO: 39776 - DNA, 20 bp, Artificial Sequence
  chemically synthesized
acatgctgatagggagggaa

SEQ ID NO: 39777 - DNA, 20 bp, Artificial Sequence
  chemically synthesized
catgctgatagggagggaag

SEQ ID NO: 39778 - DNA, 20 bp, Artificial Sequence
  chemically synthesized
atgctgatagggagggaaga

SEQ ID NO: 39779 - DNA, 20 bp, Artificial Sequence
  chemically synthesized
gatagggagggaagagggca

SEQ ID NO: 39780 - DNA, 20 bp, Artificial Sequence
  chemically synthesized
atagggagggaagagggcaa

SEQ ID NO: 39781 - DNA, 20 bp, Artificial Sequence
  chemically synthesized
agggagggaagagggcaaag

SEQ ID NO: 39782 - DNA, 20 bp, Artificial Sequence
  chemically synthesized
agggcaaaggagaaattcct

SEQ ID NO: 39783 - DNA, 20 bp, Artificial Sequence
  chemically synthesized
ggcaaaggagaaattcctaa

SEQ ID NO: 39784 - DNA, 20 bp, Artificial Sequence
  chemically synthesized
agaaattcctaagagataca

SEQ ID NO: 39785 - DNA, 20 bp, Artificial Sequence
  chemically synthesized
tcctaagagatacacggttg

SEQ ID NO: 39786 - DNA, 20 bp, Artificial Sequence
  chemically synthesized
aagagatacacggttgcagt

SEQ ID NO: 39787 - DNA, 20 bp, Artificial Sequence
  chemically synthesized
gttgcagttagtatacatct

SEQ ID NO: 39788 - DNA, 20 bp, Artificial Sequence
  chemically synthesized
gagtgctatacaaccttctt

SEQ ID NO: 39789 - DNA, 20 bp, Artificial Sequence
  chemically synthesized
agtgctatacaaccttcttt

SEQ ID NO: 39790 - DNA, 20 bp, Artificial Sequence
  chemically synthesized
gctatacaaccttctttggg

SEQ ID NO: 39791 - DNA, 20 bp, Artificial Sequence
  chemically synthesized
atacaaccttctttgggtgg

SEQ ID NO: 39792 - DNA, 20 bp, Artificial Sequence
  chemically synthesized
aaccttctttgggtggtggc

SEQ ID NO: 39793 - DNA, 20 bp, Artificial Sequence
  chemically synthesized
cttctttgggtggtggcaag

SEQ ID NO: 39794 - DNA, 20 bp, Artificial Sequence
  chemically synthesized
ggtggtggcaagaagcaatg

SEQ ID NO: 39795 - DNA, 20 bp, Artificial Sequence
  chemically synthesized
gaagcaatgcagccattacg

SEQ ID NO: 39796 - DNA, 20 bp, Artificial Sequence
  chemically synthesized
catatcaaacacctgtatca

SEQ ID NO: 39797 - DNA, 20 bp, Artificial Sequence
  chemically synthesized
atatcaaacacctgtatcac

SEQ ID NO: 39798 - DNA, 20 bp, Artificial Sequence
  chemically synthesized
cacctgtatcacaggtgtta

SEQ ID NO: 39799 - DNA, 20 bp, Artificial Sequence
  chemically synthesized
atcacaggtgttaaagaaac

SEQ ID NO: 39800 - DNA, 20 bp, Artificial Sequence
  chemically synthesized
atgatttgcaatattgtctt

SEQ ID NO: 39801 - DNA, 20 bp, Artificial Sequence
  chemically synthesized
ctataaatatgatttttaaa

SEQ ID NO: 39802 - DNA, 20 bp, Artificial Sequence
  chemically synthesized
atttttaaaaagtatttctt

SEQ ID NO: 39803 - DNA, 20 bp, Artificial Sequence
  chemically synthesized
tttttaaaaagtatttcttt

SEQ ID NO: 39804 - DNA, 20 bp, Artificial Sequence
  chemically synthesized
taaaaagtatttctttaggt

SEQ ID NO: 39805 - DNA, 20 bp, Artificial Sequence
  chemically synthesized
tacgcattgacttatcttcc

SEQ ID NO: 39806 - DNA, 20 bp, Artificial Sequence
  chemically synthesized
acgcattgacttatcttcct

SEQ ID NO: 39807 - DNA, 20 bp, Artificial Sequence
  chemically synthesized
cttatcttcctgggtttcat

SEQ ID NO: 39808 - DNA, 20 bp, Artificial Sequence
  chemically synthesized
actgtttatctcaaactctt

SEQ ID NO: 39809 - DNA, 20 bp, Artificial Sequence
  chemically synthesized
atctcaaactcttgagatta

SEQ ID NO: 39810 - DNA, 20 bp, Artificial Sequence
  chemically synthesized
aaactcttgagattaaagta

SEQ ID NO: 39811 - DNA, 20 bp, Artificial Sequence
  chemically synthesized
aactcttgagattaaagtat

SEQ ID NO: 39812 - DNA, 20 bp, Artificial Sequence
  chemically synthesized
ttgagattaaagtatgggct

SEQ ID NO: 39813 - DNA, 20 bp, Artificial Sequence
  chemically synthesized
tgagattaaagtatgggctc

SEQ ID NO: 39814 - DNA, 20 bp, Artificial Sequence
  chemically synthesized
agattaaagtatgggctcag

SEQ ID NO: 39815 - DNA, 20 bp, Artificial Sequence
  chemically synthesized
gattaaagtatgggctcagg

SEQ ID NO: 39816 - DNA, 20 bp, Artificial Sequence
  chemically synthesized
attaaagtatgggctcagga

SEQ ID NO: 39817 - DNA, 20 bp, Artificial Sequence
  chemically synthesized
taaagtatgggctcaggagg

SEQ ID NO: 39818 - DNA, 20 bp, Artificial Sequence
  chemically synthesized
gtatgggctcaggagggagc

SEQ ID NO: 39819 - DNA, 20 bp, Artificial Sequence
  chemically synthesized
tatgggctcaggagggagcg

SEQ ID NO: 39820 - DNA, 20 bp, Artificial Sequence
  chemically synthesized
tgggctcaggagggagcgag

SEQ ID NO: 39821 - DNA, 20 bp, Artificial Sequence
  chemically synthesized
caggagggagcgaggagctt

SEQ ID NO: 39822 - DNA, 20 bp, Artificial Sequence
  chemically synthesized
aggagggagcgaggagcttc

SEQ ID NO: 39823 - DNA, 20 bp, Artificial Sequence
  chemically synthesized
gaggagcttcaggactctca

SEQ ID NO: 39824 - DNA, 20 bp, Artificial Sequence
  chemically synthesized
tcaggactctcacggacctc

SEQ ID NO: 39825 - DNA, 20 bp, Artificial Sequence
  chemically synthesized
actctcacggacctccagca

SEQ ID NO: 39826 - DNA, 20 bp, Artificial Sequence
  chemically synthesized
cacggacctccagcacagtg

SEQ ID NO: 39827 - DNA, 20 bp, Artificial Sequence
  chemically synthesized
agcacagtgtagctgcctta

SEQ ID NO: 39828 - DNA, 20 bp, Artificial Sequence
  chemically synthesized
agtgtagctgccttatggaa

SEQ ID NO: 39829 - DNA, 20 bp, Artificial Sequence
  chemically synthesized
gtagctgccttatggaaaag

SEQ ID NO: 39830 - DNA, 20 bp, Artificial Sequence
  chemically synthesized
ggccacactgttttctgcac

SEQ ID NO: 39831 - DNA, 20 bp, Artificial Sequence
  chemically synthesized
ctgcccctactattcctcac

SEQ ID NO: 39832 - DNA, 20 bp, Artificial Sequence
  chemically synthesized
tgcccctactattcctcact

SEQ ID NO: 39833 - DNA, 20 bp, Artificial Sequence
  chemically synthesized
ccctactattcctcactggg

SEQ ID NO: 39834 - DNA, 20 bp, Artificial Sequence
  chemically synthesized
ctactattcctcactgggca

SEQ ID NO: 39835 - DNA, 20 bp, Artificial Sequence
  chemically synthesized
attcctcactgggcagagca

SEQ ID NO: 39836 - DNA, 20 bp, Artificial Sequence
  chemically synthesized
tgggcagagcacagccaccc

SEQ ID NO: 39837 - DNA, 20 bp, Artificial Sequence
  chemically synthesized
ctggccctgcctgaacattt

SEQ ID NO: 39838 - DNA, 20 bp, Artificial Sequence
  chemically synthesized
ccctgcctgaacattttagt

SEQ ID NO: 39839 - DNA, 20 bp, Artificial Sequence
  chemically synthesized
ctgaacattttagtcagtgt

SEQ ID NO: 39840 - DNA, 20 bp, Artificial Sequence
  chemically synthesized
gtgttggctctgtgcttctc

SEQ ID NO: 39841 - DNA, 20 bp, Artificial Sequence
  chemically synthesized
tgttggctctgtgcttctct

SEQ ID NO: 39842 - DNA, 20 bp, Artificial Sequence
  chemically synthesized
gttggctctgtgcttctctg

SEQ ID NO: 39843 - DNA, 20 bp, Artificial Sequence
  chemically synthesized
tggctctgtgcttctctggg

SEQ ID NO: 39844 - DNA, 20 bp, Artificial Sequence
  chemically synthesized
ggctctgtgcttctctgggg

SEQ ID NO: 39845 - DNA, 20 bp, Artificial Sequence
  chemically synthesized
cttctctggggaggaaatcc

SEQ ID NO: 39846 - DNA, 20 bp, Artificial Sequence
  chemically synthesized
tctctggggaggaaatccaa

SEQ ID NO: 39847 - DNA, 20 bp, Artificial Sequence
  chemically synthesized
gaaatccaagagacaaccca

SEQ ID NO: 39848 - DNA, 20 bp, Artificial Sequence
  chemically synthesized
ccacagcccctctgccattt

SEQ ID NO: 39849 - DNA, 20 bp, Artificial Sequence
  chemically synthesized
cccctctgccatttcagctg

SEQ ID NO: 39850 - DNA, 20 bp, Artificial Sequence
  chemically synthesized
ctctgccatttcagctgcag

SEQ ID NO: 39851 - DNA, 20 bp, Artificial Sequence
  chemically synthesized
agtaccaccgttaatgccct

SEQ ID NO: 39852 - DNA, 20 bp, Artificial Sequence
  chemically synthesized
gtaccaccgttaatgccctt

SEQ ID NO: 39853 - DNA, 20 bp, Artificial Sequence
  chemically synthesized
ccgttaatgcccttgggctt

SEQ ID NO: 39854 - DNA, 20 bp, Artificial Sequence
  chemically synthesized
taatgcccttgggcttgaga

SEQ ID NO: 39855 - DNA, 20 bp, Artificial Sequence
  chemically synthesized
tgcccttgggcttgagaaag

SEQ ID NO: 39856 - DNA, 20 bp, Artificial Sequence
  chemically synthesized
gcccttgggcttgagaaaga

SEQ ID NO: 39857 - DNA, 20 bp, Artificial Sequence
  chemically synthesized
cccttgggcttgagaaagaa

SEQ ID NO: 39858 - DNA, 20 bp, Artificial Sequence
  chemically synthesized
ggcttgagaaagaagggacc

SEQ ID NO: 39859 - DNA, 20 bp, Artificial Sequence
  chemically synthesized
ggccacttccctgacacctc

SEQ ID NO: 39860 - DNA, 20 bp, Artificial Sequence
  chemically synthesized
tccctgacacctccagcaca

SEQ ID NO: 39861 - DNA, 20 bp, Artificial Sequence
  chemically synthesized
ctgacacctccagcacacag

SEQ ID NO: 39862 - DNA, 20 bp, Artificial Sequence
  chemically synthesized
tgacacctccagcacacagc

SEQ ID NO: 39863 - DNA, 20 bp, Artificial Sequence
  chemically synthesized
gacacctccagcacacagca

SEQ ID NO: 39864 - DNA, 20 bp, Artificial Sequence
  chemically synthesized
cctccagcacacagcaggga

SEQ ID NO: 39865 - DNA, 20 bp, Artificial Sequence
  chemically synthesized
acacagcagggaaagaattc

SEQ ID NO: 39866 - DNA, 20 bp, Artificial Sequence
  chemically synthesized
ttccagtttctctttcttgt

SEQ ID NO: 39867 - DNA, 20 bp, Artificial Sequence
  chemically synthesized
tttcacctgctactcttcac

SEQ ID NO: 39868 - DNA, 20 bp, Artificial Sequence
  chemically synthesized
ttcacctgctactcttcacc

SEQ ID NO: 39869 - DNA, 20 bp, Artificial Sequence
  chemically synthesized
cctgctactcttcaccaggc

SEQ ID NO: 39870 - DNA, 20 bp, Artificial Sequence
  chemically synthesized
ctgctactcttcaccaggca

SEQ ID NO: 39871 - DNA, 20 bp, Artificial Sequence
  chemically synthesized
tcttcaccaggcaaggctcc

SEQ ID NO: 39872 - DNA, 20 bp, Artificial Sequence
  chemically synthesized
accaggcaaggctcctggct

SEQ ID NO: 39873 - DNA, 20 bp, Artificial Sequence
  chemically synthesized
ccaggcaaggctcctggctt

SEQ ID NO: 39874 - DNA, 20 bp, Artificial Sequence
  chemically synthesized
aggctcctggcttgggccca

SEQ ID NO: 39875 - DNA, 20 bp, Artificial Sequence
  chemically synthesized
cctggcttgggcccacagtg

SEQ ID NO: 39876 - DNA, 20 bp, Artificial Sequence
  chemically synthesized
ctggcttgggcccacagtgc

SEQ ID NO: 39877 - DNA, 20 bp, Artificial Sequence
  chemically synthesized
cagtgcaggcacctcgaact

SEQ ID NO: 39878 - DNA, 20 bp, Artificial Sequence
  chemically synthesized
actcagttgaacatttccac

SEQ ID NO: 39879 - DNA, 20 bp, Artificial Sequence
  chemically synthesized
ggctgcactctgtgtttttg

SEQ ID NO: 39880 - DNA, 20 bp, Artificial Sequence
  chemically synthesized
gctgcactctgtgtttttgt

SEQ ID NO: 39881 - DNA, 20 bp, Artificial Sequence
  chemically synthesized
ctgcactctgtgtttttgtg

SEQ ID NO: 39882 - DNA, 20 bp, Artificial Sequence
  chemically synthesized
ctctgtgtttttgtggggtg

SEQ ID NO: 39883 - DNA, 20 bp, Artificial Sequence
  chemically synthesized
tttttgtggggtgaagctcc

SEQ ID NO: 39884 - DNA, 20 bp, Artificial Sequence
  chemically synthesized
tttgtggggtgaagctccca

SEQ ID NO: 39885 - DNA, 20 bp, Artificial Sequence
  chemically synthesized
ttgtggggtgaagctcccag

SEQ ID NO: 39886 - DNA, 20 bp, Artificial Sequence
  chemically synthesized
aagctcccagaggtgactga

SEQ ID NO: 39887 - DNA, 20 bp, Artificial Sequence
  chemically synthesized
tccttctgccactaacactg

SEQ ID NO: 39888 - DNA, 20 bp, Artificial Sequence
  chemically synthesized
catactgcccttgctgtact

SEQ ID NO: 39889 - DNA, 20 bp, Artificial Sequence
  chemically synthesized
tgcccttgctgtacttggac

SEQ ID NO: 39890 - DNA, 20 bp, Artificial Sequence
  chemically synthesized
gcccttgctgtacttggact

SEQ ID NO: 39891 - DNA, 20 bp, Artificial Sequence
  chemically synthesized
cccttgctgtacttggacta

SEQ ID NO: 39892 - DNA, 20 bp, Artificial Sequence
  chemically synthesized
ttgctgtacttggactaggg

SEQ ID NO: 39893 - DNA, 20 bp, Artificial Sequence
  chemically synthesized
tgctgtacttggactaggga

SEQ ID NO: 39894 - DNA, 20 bp, Artificial Sequence
  chemically synthesized
cttggactagggaaggaaaa

SEQ ID NO: 39895 - DNA, 20 bp, Artificial Sequence
  chemically synthesized
agggaaggaaaaaagatcct

SEQ ID NO: 39896 - DNA, 20 bp, Artificial Sequence
  chemically synthesized
tgagtgctttactcacaccc

SEQ ID NO: 39897 - DNA, 20 bp, Artificial Sequence
  chemically synthesized
actcacaccccagtgtgccc

SEQ ID NO: 39898 - DNA, 20 bp, Artificial Sequence
  chemically synthesized
agtgtgccccagccacccta

SEQ ID NO: 39899 - DNA, 20 bp, Artificial Sequence
  chemically synthesized
gccccagccaccctatggaa

SEQ ID NO: 39900 - DNA, 20 bp, Artificial Sequence
  chemically synthesized
cccagccaccctatggaaaa

SEQ ID NO: 39901 - DNA, 20 bp, Artificial Sequence
  chemically synthesized
ccagccaccctatggaaaag

SEQ ID NO: 39902 - DNA, 20 bp, Artificial Sequence
  chemically synthesized
ccaccctatggaaaagaggc

SEQ ID NO: 39903 - DNA, 20 bp, Artificial Sequence
  chemically synthesized
ggccagtgtgtcatccctgc

SEQ ID NO: 39904 - DNA, 20 bp, Artificial Sequence
  chemically synthesized
gtcatccctgcaagcaccct

SEQ ID NO: 39905 - DNA, 20 bp, Artificial Sequence
  chemically synthesized
tcatccctgcaagcaccctg

SEQ ID NO: 39906 - DNA, 20 bp, Artificial Sequence
  chemically synthesized
cccctgcccctgctgccccc

SEQ ID NO: 39907 - DNA, 20 bp, Artificial Sequence
  chemically synthesized
cccctgctgcccccaagctg

SEQ ID NO: 39908 - DNA, 20 bp, Artificial Sequence
  chemically synthesized
cctgctgcccccaagctgta

SEQ ID NO: 39909 - DNA, 20 bp, Artificial Sequence
  chemically synthesized
ctgcccccaagctgtagagc

SEQ ID NO: 39910 - DNA, 20 bp, Artificial Sequence
  chemically synthesized
agctgtagagccagaatata

SEQ ID NO: 39911 - DNA, 20 bp, Artificial Sequence
  chemically synthesized
gtagagccagaatataaagc

SEQ ID NO: 39912 - DNA, 20 bp, Artificial Sequence
  chemically synthesized
gagccagaatataaagctgg

SEQ ID NO: 39913 - DNA, 20 bp, Artificial Sequence
  chemically synthesized
agctggcagaaaaatgtaaa

SEQ ID NO: 39914 - DNA, 20 bp, Artificial Sequence
  chemically synthesized
gctggcagaaaaatgtaaaa

SEQ ID NO: 39915 - DNA, 20 bp, Artificial Sequence
  chemically synthesized
gcagaaaaatgtaaaaaggc

SEQ ID NO: 39916 - DNA, 20 bp, Artificial Sequence
  chemically synthesized
aaaatgtaaaaaggctagac

SEQ ID NO: 39917 - DNA, 20 bp, Artificial Sequence
  chemically synthesized
gtaaaaaggctagactggct

SEQ ID NO: 39918 - DNA, 20 bp, Artificial Sequence
  chemically synthesized
gctagactggcttagcctcc

SEQ ID NO: 39919 - DNA, 20 bp, Artificial Sequence
  chemically synthesized
cctacatctttctcctgtgc

SEQ ID NO: 39920 - DNA, 20 bp, Artificial Sequence
  chemically synthesized
tccttcctgctcttgaacat

SEQ ID NO: 39921 - DNA, 20 bp, Artificial Sequence
  chemically synthesized
gctcttgaacatcggactcc

SEQ ID NO: 39922 - DNA, 20 bp, Artificial Sequence
  chemically synthesized
acatcggactccaagttctt

SEQ ID NO: 39923 - DNA, 20 bp, Artificial Sequence
  chemically synthesized
gactccaagttcttcagctg

SEQ ID NO: 39924 - DNA, 20 bp, Artificial Sequence
  chemically synthesized
actccaagttcttcagctgt

SEQ ID NO: 39925 - DNA, 20 bp, Artificial Sequence
  chemically synthesized
agttcttcagctgtgggact

SEQ ID NO: 39926 - DNA, 20 bp, Artificial Sequence
  chemically synthesized
ggactgtcttccttgctcct

SEQ ID NO: 39927 - DNA, 20 bp, Artificial Sequence
  chemically synthesized
cttccttgctcctcagattg

SEQ ID NO: 39928 - DNA, 20 bp, Artificial Sequence
  chemically synthesized
ttccttgctcctcagattgc

SEQ ID NO: 39929 - DNA, 20 bp, Artificial Sequence
  chemically synthesized
cttgctcctcagattgcagg

SEQ ID NO: 39930 - DNA, 20 bp, Artificial Sequence
  chemically synthesized
agattgcaggtggcctatta

SEQ ID NO: 39931 - DNA, 20 bp, Artificial Sequence
  chemically synthesized
gattgcaggtggcctattat

SEQ ID NO: 39932 - DNA, 20 bp, Artificial Sequence
  chemically synthesized
atgggaccttgtaatcttgt

SEQ ID NO: 39933 - DNA, 20 bp, Artificial Sequence
  chemically synthesized
gtgagttaataccacttaat

SEQ ID NO: 39934 - DNA, 20 bp, Artificial Sequence
  chemically synthesized
taataagctcccctttgtgt

SEQ ID NO: 39935 - DNA, 20 bp, Artificial Sequence
  chemically synthesized
tgtgagtatatctatatcta

SEQ ID NO: 39936 - DNA, 20 bp, Artificial Sequence
  chemically synthesized
agtatatctatatctataga

SEQ ID NO: 39937 - DNA, 20 bp, Artificial Sequence
  chemically synthesized
tctatatctatagatagata

SEQ ID NO: 39938 - DNA, 20 bp, Artificial Sequence
  chemically synthesized
ctatatctatagatagatat

SEQ ID NO: 39939 - DNA, 20 bp, Artificial Sequence
  chemically synthesized
atatatatataatctcctat

SEQ ID NO: 39940 - DNA, 20 bp, Artificial Sequence
  chemically synthesized
tcctattagttctgtccctc

SEQ ID NO: 39941 - DNA, 20 bp, Artificial Sequence
  chemically synthesized
ctattagttctgtccctcta

SEQ ID NO: 39942 - DNA, 20 bp, Artificial Sequence
  chemically synthesized
ctagagaaccccgactaata

SEQ ID NO: 39943 - DNA, 20 bp, Artificial Sequence
  chemically synthesized
actaatacagattttcatac

SEQ ID NO: 39944 - DNA, 20 bp, Artificial Sequence
  chemically synthesized
aatacagattttcataccag

SEQ ID NO: 39945 - DNA, 20 bp, Artificial Sequence
  chemically synthesized
acagattttcataccagaag

SEQ ID NO: 39946 - DNA, 20 bp, Artificial Sequence
  chemically synthesized
tcataccagaagtggttctt

SEQ ID NO: 39947 - DNA, 20 bp, Artificial Sequence
  chemically synthesized
cataccagaagtggttcttg

SEQ ID NO: 39948 - DNA, 20 bp, Artificial Sequence
  chemically synthesized
cagaagtggttcttgaggaa

SEQ ID NO: 39949 - DNA, 20 bp, Artificial Sequence
  chemically synthesized
ttcttgaggaacagaatatt

SEQ ID NO: 39950 - DNA, 20 bp, Artificial Sequence
  chemically synthesized
tcttgaggaacagaatatta

SEQ ID NO: 39951 - DNA, 20 bp, Artificial Sequence
  chemically synthesized
gaggaacagaatattaagga

SEQ ID NO: 39952 - DNA, 20 bp, Artificial Sequence
  chemically synthesized
taaggatggaattctttcat

SEQ ID NO: 39953 - DNA, 20 bp, Artificial Sequence
  chemically synthesized
tggaattctttcattggttt

SEQ ID NO: 39954 - DNA, 20 bp, Artificial Sequence
  chemically synthesized
ggaattctttcattggtttt

SEQ ID NO: 39955 - DNA, 20 bp, Artificial Sequence
  chemically synthesized
ttcattggttttgggacttc

SEQ ID NO: 39956 - DNA, 20 bp, Artificial Sequence
  chemically synthesized
ggttttgggacttctggtgt

SEQ ID NO: 39957 - DNA, 20 bp, Artificial Sequence
  chemically synthesized
tgttggctgattaatatgat

SEQ ID NO: 39958 - DNA, 20 bp, Artificial Sequence
  chemically synthesized
tgattagaccaaaaaatgct

SEQ ID NO: 39959 - DNA, 20 bp, Artificial Sequence
  chemically synthesized
gattagaccaaaaaatgcta

SEQ ID NO: 39960 - DNA, 20 bp, Artificial Sequence
  chemically synthesized
gctaaggactctacttctaa

SEQ ID NO: 39961 - DNA, 20 bp, Artificial Sequence
  chemically synthesized
ggactctacttctaatagta

SEQ ID NO: 39962 - DNA, 20 bp, Artificial Sequence
  chemically synthesized
actctacttctaatagtatg

SEQ ID NO: 39963 - DNA, 20 bp, Artificial Sequence
  chemically synthesized
aatagtatggagaacactga

SEQ ID NO: 39964 - DNA, 20 bp, Artificial Sequence
  chemically synthesized
tggagaacactgatagtact

SEQ ID NO: 39965 - DNA, 20 bp, Artificial Sequence
  chemically synthesized
agtacttggcctgaattgtt

SEQ ID NO: 39966 - DNA, 20 bp, Artificial Sequence
  chemically synthesized
tacttggcctgaattgttta

SEQ ID NO: 39967 - DNA, 20 bp, Artificial Sequence
  chemically synthesized
cttggcctgaattgtttaga

SEQ ID NO: 39968 - DNA, 20 bp, Artificial Sequence
  chemically synthesized
actactgattcatcacttat

SEQ ID NO: 39969 - DNA, 20 bp, Artificial Sequence
  chemically synthesized
tactgattcatcacttatga

SEQ ID NO: 39970 - DNA, 20 bp, Artificial Sequence
  chemically synthesized
actgattcatcacttatgag

SEQ ID NO: 39971 - DNA, 20 bp, Artificial Sequence
  chemically synthesized
attcatcacttatgagaggc

SEQ ID NO: 39972 - DNA, 20 bp, Artificial Sequence
  chemically synthesized
ttcatcacttatgagaggca

SEQ ID NO: 39973 - DNA, 20 bp, Artificial Sequence
  chemically synthesized
catcacttatgagaggcaag

SEQ ID NO: 39974 - DNA, 20 bp, Artificial Sequence
  chemically synthesized
cttatgagaggcaaggagtt

SEQ ID NO: 39975 - DNA, 20 bp, Artificial Sequence
  chemically synthesized
ataatacctttgactatatg

SEQ ID NO: 39976 - DNA, 20 bp, Artificial Sequence
  chemically synthesized
aatacctttgactatatgtg

SEQ ID NO: 39977 - DNA, 20 bp, Artificial Sequence
  chemically synthesized
ttgactatatgtggagaacc

SEQ ID NO: 39978 - DNA, 20 bp, Artificial Sequence
  chemically synthesized
tgactatatgtggagaacca

SEQ ID NO: 39979 - DNA, 20 bp, Artificial Sequence
  chemically synthesized
gagaaccaaggaacataatg

SEQ ID NO: 39980 - DNA, 20 bp, Artificial Sequence
  chemically synthesized
accaaggaacataatgaagt

SEQ ID NO: 39981 - DNA, 20 bp, Artificial Sequence
  chemically synthesized
gaagttggttgattgctcct

SEQ ID NO: 39982 - DNA, 20 bp, Artificial Sequence
  chemically synthesized
ttgattgctcctaagttctc

SEQ ID NO: 39983 - DNA, 20 bp, Artificial Sequence
  chemically synthesized
gattgctcctaagttctctg

SEQ ID NO: 39984 - DNA, 20 bp, Artificial Sequence
  chemically synthesized
gctcctaagttctctggaga

SEQ ID NO: 39985 - DNA, 20 bp, Artificial Sequence
  chemically synthesized
tcctaagttctctggagaaa

SEQ ID NO: 39986 - DNA, 20 bp, Artificial Sequence
  chemically synthesized
ttctctggagaaagagatga

SEQ ID NO: 39987 - DNA, 20 bp, Artificial Sequence
  chemically synthesized
atgaaagaaaatgatgatct

SEQ ID NO: 39988 - DNA, 20 bp, Artificial Sequence
  chemically synthesized
tgaaagaaaatgatgatctc

SEQ ID NO: 39989 - DNA, 20 bp, Artificial Sequence
  chemically synthesized
gaaagaaaatgatgatctca

SEQ ID NO: 39990 - DNA, 20 bp, Artificial Sequence
  chemically synthesized
aaagaaaatgatgatctcag

SEQ ID NO: 39991 - DNA, 20 bp, Artificial Sequence
  chemically synthesized
ggggatctgtctcccacctt

SEQ ID NO: 39992 - DNA, 20 bp, Artificial Sequence
  chemically synthesized
gatctgtctcccaccttcag

SEQ ID NO: 39993 - DNA, 20 bp, Artificial Sequence
  chemically synthesized
ctgtctcccaccttcagaag

SEQ ID NO: 39994 - DNA, 20 bp, Artificial Sequence
  chemically synthesized
caccttcagaagcagatact

SEQ ID NO: 39995 - DNA, 20 bp, Artificial Sequence
  chemically synthesized
tactgagccacaaatctgct

SEQ ID NO: 39996 - DNA, 20 bp, Artificial Sequence
  chemically synthesized
ctgctaagattgccctgaat

SEQ ID NO: 39997 - DNA, 20 bp, Artificial Sequence
  chemically synthesized
gctaagattgccctgaatga

SEQ ID NO: 39998 - DNA, 20 bp, Artificial Sequence
  chemically synthesized
aatgagagttttaactcctg

SEQ ID NO: 39999 - DNA, 20 bp, Artificial Sequence
  chemically synthesized
tgagagttttaactcctgta

SEQ ID NO: 40000 - DNA, 20 bp, Artificial Sequence
  chemically synthesized
agttttaactcctgtagaga

SEQ ID NO: 40001 - DNA, 20 bp, Artificial Sequence
  chemically synthesized
ttttaactcctgtagagaaa

SEQ ID NO: 40002 - DNA, 20 bp, Artificial Sequence
  chemically synthesized
gagttgaaattgtgaaaaaa

SEQ ID NO: 40003 - DNA, 20 bp, Artificial Sequence
  chemically synthesized
gttgaaattgtgaaaaaaca

SEQ ID NO: 40004 - DNA, 20 bp, Artificial Sequence
  chemically synthesized
aattgtgaaaaaacagagac

SEQ ID NO: 40005 - DNA, 20 bp, Artificial Sequence
  chemically synthesized
gagacaagctgttatcatgc

SEQ ID NO: 40006 - DNA, 20 bp, Artificial Sequence
  chemically synthesized
acaagctgttatcatgcgag

SEQ ID NO: 40007 - DNA, 20 bp, Artificial Sequence
  chemically synthesized
gcgagtagctgatctgcaac

SEQ ID NO: 40008 - DNA, 20 bp, Artificial Sequence
  chemically synthesized
gagtagctgatctgcaacaa

SEQ ID NO: 40009 - DNA, 20 bp, Artificial Sequence
  chemically synthesized
agtagctgatctgcaacaag

SEQ ID NO: 40010 - DNA, 20 bp, Artificial Sequence
  chemically synthesized
tgcaacaagaggtgcatgca

SEQ ID NO: 40011 - DNA, 20 bp, Artificial Sequence
  chemically synthesized
aggtgcatgcacagccttgc

SEQ ID NO: 40012 - DNA, 20 bp, Artificial Sequence
  chemically synthesized
ggtgcatgcacagccttgcc

SEQ ID NO: 40013 - DNA, 20 bp, Artificial Sequence
  chemically synthesized
ttgccaggtgtttactgtta

SEQ ID NO: 40014 - DNA, 20 bp, Artificial Sequence
  chemically synthesized
caggtgtttactgttaaagt

SEQ ID NO: 40015 - DNA, 20 bp, Artificial Sequence
  chemically synthesized
aggtgtttactgttaaagtg

SEQ ID NO: 40016 - DNA, 20 bp, Artificial Sequence
  chemically synthesized
ggtgtttactgttaaagtga

SEQ ID NO: 40017 - DNA, 20 bp, Artificial Sequence
  chemically synthesized
gttaaagtgagggcattgac

SEQ ID NO: 40018 - DNA, 20 bp, Artificial Sequence
  chemically synthesized
gggcattgactggaaaaaaa

SEQ ID NO: 40019 - DNA, 20 bp, Artificial Sequence
  chemically synthesized
ggcattgactggaaaaaaat

SEQ ID NO: 40020 - DNA, 20 bp, Artificial Sequence
  chemically synthesized
actggaaaaaaatgggaccc

SEQ ID NO: 40021 - DNA, 20 bp, Artificial Sequence
  chemically synthesized
aaaaatgggaccctggaact

SEQ ID NO: 40022 - DNA, 20 bp, Artificial Sequence
  chemically synthesized
aaatgggaccctggaacttg

SEQ ID NO: 40023 - DNA, 20 bp, Artificial Sequence
  chemically synthesized
tgggaccctggaacttggag

SEQ ID NO: 40024 - DNA, 20 bp, Artificial Sequence
  chemically synthesized
gggaccctggaacttggagt

SEQ ID NO: 40025 - DNA, 20 bp, Artificial Sequence
  chemically synthesized
ggaccctggaacttggagtg

SEQ ID NO: 40026 - DNA, 20 bp, Artificial Sequence
  chemically synthesized
gaacttggagtggggatgtg

SEQ ID NO: 40027 - DNA, 20 bp, Artificial Sequence
  chemically synthesized
aacttggagtggggatgtgt

SEQ ID NO: 40028 - DNA, 20 bp, Artificial Sequence
  chemically synthesized
cttggagtggggatgtgtgg

SEQ ID NO: 40029 - DNA, 20 bp, Artificial Sequence
  chemically synthesized
tgtgtgggagaaccctgatg

SEQ ID NO: 40030 - DNA, 20 bp, Artificial Sequence
  chemically synthesized
gggagaaccctgatgaagct

SEQ ID NO: 40031 - DNA, 20 bp, Artificial Sequence
  chemically synthesized
ggagaaccctgatgaagctg

SEQ ID NO: 40032 - DNA, 20 bp, Artificial Sequence
  chemically synthesized
ctgatgaagctgaggacact

SEQ ID NO: 40033 - DNA, 20 bp, Artificial Sequence
  chemically synthesized
ctctgatgaaacttttttgc

SEQ ID NO: 40034 - DNA, 20 bp, Artificial Sequence
  chemically synthesized
tgatgaaacttttttgccag

SEQ ID NO: 40035 - DNA, 20 bp, Artificial Sequence
  chemically synthesized
aacttttttgccagaagaaa

SEQ ID NO: 40036 - DNA, 20 bp, Artificial Sequence
  chemically synthesized
agaaacagtttccccatccc

SEQ ID NO: 40037 - DNA, 20 bp, Artificial Sequence
  chemically synthesized
aacagtttccccatccccag

SEQ ID NO: 40038 - DNA, 20 bp, Artificial Sequence
  chemically synthesized
agtttccccatccccagtag

SEQ ID NO: 40039 - DNA, 20 bp, Artificial Sequence
  chemically synthesized
tccctgacccgtgctgccat

SEQ ID NO: 40040 - DNA, 20 bp, Artificial Sequence
  chemically synthesized
tagcctttccacctttgtct

SEQ ID NO: 40041 - DNA, 20 bp, Artificial Sequence
  chemically synthesized
agcctttccacctttgtctg

SEQ ID NO: 40042 - DNA, 20 bp, Artificial Sequence
  chemically synthesized
atgtaaaccctgcactgctt

SEQ ID NO: 40043 - DNA, 20 bp, Artificial Sequence
  chemically synthesized
tgtaaaccctgcactgcttg

SEQ ID NO: 40044 - DNA, 20 bp, Artificial Sequence
  chemically synthesized
ccctgcactgcttgaggcaa

SEQ ID NO: 40045 - DNA, 20 bp, Artificial Sequence
  chemically synthesized
actgcttgaggcaacagtga

SEQ ID NO: 40046 - DNA, 20 bp, Artificial Sequence
  chemically synthesized
caacagtgatggccttccct

SEQ ID NO: 40047 - DNA, 20 bp, Artificial Sequence
  chemically synthesized
aacagtgatggccttccctg

SEQ ID NO: 40048 - DNA, 20 bp, Artificial Sequence
  chemically synthesized
agtgatggccttccctgagg

SEQ ID NO: 40049 - DNA, 20 bp, Artificial Sequence
  chemically synthesized
gccttccctgaggcagctgc

SEQ ID NO: 40050 - DNA, 20 bp, Artificial Sequence
  chemically synthesized
ccttccctgaggcagctgcc

SEQ ID NO: 40051 - DNA, 20 bp, Artificial Sequence
  chemically synthesized
ccctgaggcagctgccaggc

SEQ ID NO: 40052 - DNA, 20 bp, Artificial Sequence
  chemically synthesized
agataatgttgattctcctc

SEQ ID NO: 40053 - DNA, 20 bp, Artificial Sequence
  chemically synthesized
ataatgttgattctcctcaa

SEQ ID NO: 40054 - DNA, 20 bp, Artificial Sequence
  chemically synthesized
taatgttgattctcctcaag

SEQ ID NO: 40055 - DNA, 20 bp, Artificial Sequence
  chemically synthesized
ctaatgcccctgaatgcttc

SEQ ID NO: 40056 - DNA, 20 bp, Artificial Sequence
  chemically synthesized
aatgcttctagacctataac

SEQ ID NO: 40057 - DNA, 20 bp, Artificial Sequence
  chemically synthesized
atgcttctagacctataact

SEQ ID NO: 40058 - DNA, 20 bp, Artificial Sequence
  chemically synthesized
taactaggctaaattccttg

SEQ ID NO: 40059 - DNA, 20 bp, Artificial Sequence
  chemically synthesized
aactaggctaaattccttgc

SEQ ID NO: 40060 - DNA, 20 bp, Artificial Sequence
  chemically synthesized
gctaaattccttgcgggccc

SEQ ID NO: 40061 - DNA, 20 bp, Artificial Sequence
  chemically synthesized
taaattccttgcgggcccca

SEQ ID NO: 40062 - DNA, 20 bp, Artificial Sequence
  chemically synthesized
aaattccttgcgggccccag

SEQ ID NO: 40063 - DNA, 20 bp, Artificial Sequence
  chemically synthesized
tccttgcgggccccagaggt

SEQ ID NO: 40064 - DNA, 20 bp, Artificial Sequence
  chemically synthesized
ccttgcgggccccagaggtg

SEQ ID NO: 40065 - DNA, 20 bp, Artificial Sequence
  chemically synthesized
cgggccccagaggtgaggtt

SEQ ID NO: 40066 - DNA, 20 bp, Artificial Sequence
  chemically synthesized
ggccccagaggtgaggttca

SEQ ID NO: 40067 - DNA, 20 bp, Artificial Sequence
  chemically synthesized
aggttcagagtgtgacccat

SEQ ID NO: 40068 - DNA, 20 bp, Artificial Sequence
  chemically synthesized
ggttcagagtgtgacccatg

SEQ ID NO: 40069 - DNA, 20 bp, Artificial Sequence
  chemically synthesized
ttcagagtgtgacccatgag

SEQ ID NO: 40070 - DNA, 20 bp, Artificial Sequence
  chemically synthesized
tcagagtgtgacccatgagg

SEQ ID NO: 40071 - DNA, 20 bp, Artificial Sequence
  chemically synthesized
ggaggtgcattatactctaa

SEQ ID NO: 40072 - DNA, 20 bp, Artificial Sequence
  chemically synthesized
atactctaaaagaactgctt

SEQ ID NO: 40073 - DNA, 20 bp, Artificial Sequence
  chemically synthesized
ttaagctttctaatttatat

SEQ ID NO: 40074 - DNA, 20 bp, Artificial Sequence
  chemically synthesized
agctttctaatttatattgg

SEQ ID NO: 40075 - DNA, 20 bp, Artificial Sequence
  chemically synthesized
aatttatattggcagaaatc

SEQ ID NO: 40076 - DNA, 20 bp, Artificial Sequence
  chemically synthesized
tttatattggcagaaatctg

SEQ ID NO: 40077 - DNA, 20 bp, Artificial Sequence
  chemically synthesized
attggcagaaatctggagaa

SEQ ID NO: 40078 - DNA, 20 bp, Artificial Sequence
  chemically synthesized
ttggcagaaatctggagaac

SEQ ID NO: 40079 - DNA, 20 bp, Artificial Sequence
  chemically synthesized
agaaatctggagaacaggca

SEQ ID NO: 40080 - DNA, 20 bp, Artificial Sequence
  chemically synthesized
gaaatctggagaacaggcat

SEQ ID NO: 40081 - DNA, 20 bp, Artificial Sequence
  chemically synthesized
ctggagaacaggcatgggaa

SEQ ID NO: 40082 - DNA, 20 bp, Artificial Sequence
  chemically synthesized
caggcatgggaatggatatt

SEQ ID NO: 40083 - DNA, 20 bp, Artificial Sequence
  chemically synthesized
aggcatgggaatggatatta

SEQ ID NO: 40084 - DNA, 20 bp, Artificial Sequence
  chemically synthesized
ggcatgggaatggatattaa

SEQ ID NO: 40085 - DNA, 20 bp, Artificial Sequence
  chemically synthesized
tgggaatggatattaagggt

SEQ ID NO: 40086 - DNA, 20 bp, Artificial Sequence
  chemically synthesized
gggaatggatattaagggta

SEQ ID NO: 40087 - DNA, 20 bp, Artificial Sequence
  chemically synthesized
ggaatggatattaagggtaa

SEQ ID NO: 40088 - DNA, 20 bp, Artificial Sequence
  chemically synthesized
atattaagggtaagggataa

SEQ ID NO: 40089 - DNA, 20 bp, Artificial Sequence
  chemically synthesized
ttaagggtaagggataatgg

SEQ ID NO: 40090 - DNA, 20 bp, Artificial Sequence
  chemically synthesized
agggtaagggataatggtgg

SEQ ID NO: 40091 - DNA, 20 bp, Artificial Sequence
  chemically synthesized
gggtaagggataatggtgga

SEQ ID NO: 40092 - DNA, 20 bp, Artificial Sequence
  chemically synthesized
ggtaagggataatggtggaa

SEQ ID NO: 40093 - DNA, 20 bp, Artificial Sequence
  chemically synthesized
ggataatggtggaagggaca

SEQ ID NO: 40094 - DNA, 20 bp, Artificial Sequence
  chemically synthesized
ataatggtggaagggacata

SEQ ID NO: 40095 - DNA, 20 bp, Artificial Sequence
  chemically synthesized
tggtggaagggacatagagt

SEQ ID NO: 40096 - DNA, 20 bp, Artificial Sequence
  chemically synthesized
aagggacatagagttggatc

SEQ ID NO: 40097 - DNA, 20 bp, Artificial Sequence
  chemically synthesized
ttggatcaagctgaatttat

SEQ ID NO: 40098 - DNA, 20 bp, Artificial Sequence
  chemically synthesized
tcaagctgaatttattggtt

SEQ ID NO: 40099 - DNA, 20 bp, Artificial Sequence
  chemically synthesized
tttattggtttggccctact

SEQ ID NO: 40100 - DNA, 20 bp, Artificial Sequence
  chemically synthesized
attggtttggccctactaag

SEQ ID NO: 40101 - DNA, 20 bp, Artificial Sequence
  chemically synthesized
ttggtttggccctactaagt

SEQ ID NO: 40102 - DNA, 20 bp, Artificial Sequence
  chemically synthesized
tggtttggccctactaagta

SEQ ID NO: 40103 - DNA, 20 bp, Artificial Sequence
  chemically synthesized
ggattctgcatttaatgttg

SEQ ID NO: 40104 - DNA, 20 bp, Artificial Sequence
  chemically synthesized
ctgcatttaatgttgcagct

SEQ ID NO: 40105 - DNA, 20 bp, Artificial Sequence
  chemically synthesized
tgcatttaatgttgcagctc

SEQ ID NO: 40106 - DNA, 20 bp, Artificial Sequence
  chemically synthesized
gcatttaatgttgcagctcg

SEQ ID NO: 40107 - DNA, 20 bp, Artificial Sequence
  chemically synthesized
aatgttgcagctcggggact

SEQ ID NO: 40108 - DNA, 20 bp, Artificial Sequence
  chemically synthesized
tgcagctcggggacttagaa

SEQ ID NO: 40109 - DNA, 20 bp, Artificial Sequence
  chemically synthesized
gcagctcggggacttagaaa

SEQ ID NO: 40110 - DNA, 20 bp, Artificial Sequence
  chemically synthesized
ggacttagaaaaggttctga

SEQ ID NO: 40111 - DNA, 20 bp, Artificial Sequence
  chemically synthesized
gacttagaaaaggttctgat

SEQ ID NO: 40112 - DNA, 20 bp, Artificial Sequence
  chemically synthesized
acttagaaaaggttctgata

SEQ ID NO: 40113 - DNA, 20 bp, Artificial Sequence
  chemically synthesized
agaaaaggttctgatagggc

SEQ ID NO: 40114 - DNA, 20 bp, Artificial Sequence
  chemically synthesized
gaaaaggttctgatagggcc

SEQ ID NO: 40115 - DNA, 20 bp, Artificial Sequence
  chemically synthesized
aaaggttctgatagggccgg

SEQ ID NO: 40116 - DNA, 20 bp, Artificial Sequence
  chemically synthesized
ggttctgatagggccgggag

SEQ ID NO: 40117 - DNA, 20 bp, Artificial Sequence
  chemically synthesized
tctgatagggccgggagcag

SEQ ID NO: 40118 - DNA, 20 bp, Artificial Sequence
  chemically synthesized
gtggctcacgcctgtaatcc

SEQ ID NO: 40119 - DNA, 20 bp, Artificial Sequence
  chemically synthesized
cgcctgtaatcccagcacct

SEQ ID NO: 40120 - DNA, 20 bp, Artificial Sequence
  chemically synthesized
gcctgtaatcccagcacctt

SEQ ID NO: 40121 - DNA, 20 bp, Artificial Sequence
  chemically synthesized
ctgtaatcccagcaccttgg

SEQ ID NO: 40122 - DNA, 20 bp, Artificial Sequence
  chemically synthesized
tgtaatcccagcaccttggg

SEQ ID NO: 40123 - DNA, 20 bp, Artificial Sequence
  chemically synthesized
aatcccagcaccttgggagg

SEQ ID NO: 40124 - DNA, 20 bp, Artificial Sequence
  chemically synthesized
atcccagcaccttgggaggc

SEQ ID NO: 40125 - DNA, 20 bp, Artificial Sequence
  chemically synthesized
tcccagcaccttgggaggcg

SEQ ID NO: 40126 - DNA, 20 bp, Artificial Sequence
  chemically synthesized
cccagcaccttgggaggcgg

SEQ ID NO: 40127 - DNA, 20 bp, Artificial Sequence
  chemically synthesized
agcaccttgggaggcggggg

SEQ ID NO: 40128 - DNA, 20 bp, Artificial Sequence
  chemically synthesized
gcaccttgggaggcgggggc

SEQ ID NO: 40129 - DNA, 20 bp, Artificial Sequence
  chemically synthesized
ccttgggaggcgggggcggg

SEQ ID NO: 40130 - DNA, 20 bp, Artificial Sequence
  chemically synthesized
ggcgggggcgggcagatcac

SEQ ID NO: 40131 - DNA, 20 bp, Artificial Sequence
  chemically synthesized
gggcgggcagatcacgagat

SEQ ID NO: 40132 - DNA, 20 bp, Artificial Sequence
  chemically synthesized
ggcgggcagatcacgagatc

SEQ ID NO: 40133 - DNA, 20 bp, Artificial Sequence
  chemically synthesized
cgggcagatcacgagatcag

SEQ ID NO: 40134 - DNA, 20 bp, Artificial Sequence
  chemically synthesized
gatcacgagatcaggagatt

SEQ ID NO: 40135 - DNA, 20 bp, Artificial Sequence
  chemically synthesized
tcaggagattgagacaattc

SEQ ID NO: 40136 - DNA, 20 bp, Artificial Sequence
  chemically synthesized
tgagacaattctggctaaaa

SEQ ID NO: 40137 - DNA, 20 bp, Artificial Sequence
  chemically synthesized
tctgctaaaaatacaaaaat

SEQ ID NO: 40138 - DNA, 20 bp, Artificial Sequence
  chemically synthesized
ctaaaaatacaaaaattagc

SEQ ID NO: 40139 - DNA, 20 bp, Artificial Sequence
  chemically synthesized
taaaaatacaaaaattagct

SEQ ID NO: 40140 - DNA, 20 bp, Artificial Sequence
  chemically synthesized
atacaaaaattagctgggca

SEQ ID NO: 40141 - DNA, 20 bp, Artificial Sequence
  chemically synthesized
taactgtaatctcatctact

SEQ ID NO: 40142 - DNA, 20 bp, Artificial Sequence
  chemically synthesized
aactgtaatctcatctactt

SEQ ID NO: 40143 - DNA, 20 bp, Artificial Sequence
  chemically synthesized
ctgtaatctcatctacttgg

SEQ ID NO: 40144 - DNA, 20 bp, Artificial Sequence
  chemically synthesized
tgtaatctcatctacttggg

SEQ ID NO: 40145 - DNA, 20 bp, Artificial Sequence
  chemically synthesized
tctcatctacttgggaggct

SEQ ID NO: 40146 - DNA, 20 bp, Artificial Sequence
  chemically synthesized
ctcatctacttgggaggctg

SEQ ID NO: 40147 - DNA, 20 bp, Artificial Sequence
  chemically synthesized
tctacttgggaggctgaggc

SEQ ID NO: 40148 - DNA, 20 bp, Artificial Sequence
  chemically synthesized
tacttgggaggctgaggcaa

SEQ ID NO: 40149 - DNA, 20 bp, Artificial Sequence
  chemically synthesized
agagaactgcttgaacctgt

SEQ ID NO: 40150 - DNA, 20 bp, Artificial Sequence
  chemically synthesized
gagaactgcttgaacctgtg

SEQ ID NO: 40151 - DNA, 20 bp, Artificial Sequence
  chemically synthesized
aactgcttgaacctgtgagg

SEQ ID NO: 40152 - DNA, 20 bp, Artificial Sequence
  chemically synthesized
ctgcttgaacctgtgaggca

SEQ ID NO: 40153 - DNA, 20 bp, Artificial Sequence
  chemically synthesized
aacctgtgaggcagagattg

SEQ ID NO: 40154 - DNA, 20 bp, Artificial Sequence
  chemically synthesized
tgtgaggcagagattgcagt

SEQ ID NO: 40155 - DNA, 20 bp, Artificial Sequence
  chemically synthesized
ggcagagattgcagtgagcc

SEQ ID NO: 40156 - DNA, 20 bp, Artificial Sequence
  chemically synthesized
aagatcgccccactgcattc

SEQ ID NO: 40157 - DNA, 20 bp, Artificial Sequence
  chemically synthesized
cgccccactgcattccagcc

SEQ ID NO: 40158 - DNA, 20 bp, Artificial Sequence
  chemically synthesized
actgcattccagcctggtaa

SEQ ID NO: 40159 - DNA, 20 bp, Artificial Sequence
  chemically synthesized
tgcattccagcctggtaaca

SEQ ID NO: 40160 - DNA, 20 bp, Artificial Sequence
  chemically synthesized
ttccagcctggtaacagagc

SEQ ID NO: 40161 - DNA, 20 bp, Artificial Sequence
  chemically synthesized
ttccaaaaaaaaaaaaaaaa

SEQ ID NO: 40162 - DNA, 20 bp, Artificial Sequence
  chemically synthesized
aaaaaaaaaaaaagttataa

SEQ ID NO: 40163 - DNA, 20 bp, Artificial Sequence
  chemically synthesized
gttataatagtttatttgct

SEQ ID NO: 40164 - DNA, 20 bp, Artificial Sequence
  chemically synthesized
taatagtttatttgcttggt

SEQ ID NO: 40165 - DNA, 20 bp, Artificial Sequence
  chemically synthesized
ttgcttggttagctgaaata

SEQ ID NO: 40166 - DNA, 20 bp, Artificial Sequence
  chemically synthesized
ttagctgaaatatggattaa

SEQ ID NO: 40167 - DNA, 20 bp, Artificial Sequence
  chemically synthesized
ctgaaatatggattaaaaga

SEQ ID NO: 40168 - DNA, 20 bp, Artificial Sequence
  chemically synthesized
attaaaagatggtccaatgt

SEQ ID NO: 40169 - DNA, 20 bp, Artificial Sequence
  chemically synthesized
aaagatggtccaatgttagt

SEQ ID NO: 40170 - DNA, 20 bp, Artificial Sequence
  chemically synthesized
atggtccaatgttagtgagc

SEQ ID NO: 40171 - DNA, 20 bp, Artificial Sequence
  chemically synthesized
ttagtgagctggaaatgcct

SEQ ID NO: 40172 - DNA, 20 bp, Artificial Sequence
  chemically synthesized
ggaaatgccttggtttaatg

SEQ ID NO: 40173 - DNA, 20 bp, Artificial Sequence
  chemically synthesized
aaatgccttggtttaatgta

SEQ ID NO: 40174 - DNA, 20 bp, Artificial Sequence
  chemically synthesized
aatgccttggtttaatgtag

SEQ ID NO: 40175 - DNA, 20 bp, Artificial Sequence
  chemically synthesized
gccttggtttaatgtagagg

SEQ ID NO: 40176 - DNA, 20 bp, Artificial Sequence
  chemically synthesized
aatgtagaggaagtgatcca

SEQ ID NO: 40177 - DNA, 20 bp, Artificial Sequence
  chemically synthesized
atgtagaggaagtgatccaa

SEQ ID NO: 40178 - DNA, 20 bp, Artificial Sequence
  chemically synthesized
gaggaagtgatccaaaggct

SEQ ID NO: 40179 - DNA, 20 bp, Artificial Sequence
  chemically synthesized
aggaagtgatccaaaggctt

SEQ ID NO: 40180 - DNA, 20 bp, Artificial Sequence
  chemically synthesized
ggaagtgatccaaaggctta

SEQ ID NO: 40181 - DNA, 20 bp, Artificial Sequence
  chemically synthesized
aagtgatccaaaggcttagg

SEQ ID NO: 40182 - DNA, 20 bp, Artificial Sequence
  chemically synthesized
atccaaaggcttagggagat

SEQ ID NO: 40183 - DNA, 20 bp, Artificial Sequence
  chemically synthesized
tccaaaggcttagggagatt

SEQ ID NO: 40184 - DNA, 20 bp, Artificial Sequence
  chemically synthesized
aaggcttagggagattagga

SEQ ID NO: 40185 - DNA, 20 bp, Artificial Sequence
  chemically synthesized
gcttagggagattaggatgg

SEQ ID NO: 40186 - DNA, 20 bp, Artificial Sequence
  chemically synthesized
ttagggagattaggatggtg

SEQ ID NO: 40187 - DNA, 20 bp, Artificial Sequence
  chemically synthesized
gggagattaggatggtggag

SEQ ID NO: 40188 - DNA, 20 bp, Artificial Sequence
  chemically synthesized
attaggatggtggagtggat

SEQ ID NO: 40189 - DNA, 20 bp, Artificial Sequence
  chemically synthesized
gtggagtggattagtcactt

SEQ ID NO: 40190 - DNA, 20 bp, Artificial Sequence
  chemically synthesized
cactttagacctactcatcc

SEQ ID NO: 40191 - DNA, 20 bp, Artificial Sequence
  chemically synthesized
ttagacctactcatcccagc

SEQ ID NO: 40192 - DNA, 20 bp, Artificial Sequence
  chemically synthesized
tagacctactcatcccagct

SEQ ID NO: 40193 - DNA, 20 bp, Artificial Sequence
  chemically synthesized
gacctactcatcccagctgg

SEQ ID NO: 40194 - DNA, 20 bp, Artificial Sequence
  chemically synthesized
acctactcatcccagctggg

SEQ ID NO: 40195 - DNA, 20 bp, Artificial Sequence
  chemically synthesized
cctactcatcccagctggga

SEQ ID NO: 40196 - DNA, 20 bp, Artificial Sequence
  chemically synthesized
tcatcccagctgggagggtc

SEQ ID NO: 40197 - DNA, 20 bp, Artificial Sequence
  chemically synthesized
tcccagctgggagggtccag

SEQ ID NO: 40198 - DNA, 20 bp, Artificial Sequence
  chemically synthesized
gggtccagaagatacaccct

SEQ ID NO: 40199 - DNA, 20 bp, Artificial Sequence
  chemically synthesized
agaagatacacccttggccg

SEQ ID NO: 40200 - DNA, 20 bp, Artificial Sequence
  chemically synthesized
ttggccgaagctttgtgaaa

SEQ ID NO: 40201 - DNA, 20 bp, Artificial Sequence
  chemically synthesized
gctttgtgaaatagatttgt

SEQ ID NO: 40202 - DNA, 20 bp, Artificial Sequence
  chemically synthesized
tttgtgaaatagatttgtga

SEQ ID NO: 40203 - DNA, 20 bp, Artificial Sequence
  chemically synthesized
gtgaaatagatttgtgagag

SEQ ID NO: 40204 - DNA, 20 bp, Artificial Sequence
  chemically synthesized
gagcagcacctgtatttttg

SEQ ID NO: 40205 - DNA, 20 bp, Artificial Sequence
  chemically synthesized
gcagcacctgtatttttgaa

SEQ ID NO: 40206 - DNA, 20 bp, Artificial Sequence
  chemically synthesized
aattgctcttctctgtatgt

SEQ ID NO: 40207 - DNA, 20 bp, Artificial Sequence
  chemically synthesized
tctctgtatgtcagatctaa

SEQ ID NO: 40208 - DNA, 20 bp, Artificial Sequence
  chemically synthesized
ctgtatgtcagatctaacag

SEQ ID NO: 40209 - DNA, 20 bp, Artificial Sequence
  chemically synthesized
tgtatgtcagatctaacagt

SEQ ID NO: 40210 - DNA, 20 bp, Artificial Sequence
  chemically synthesized
agatctaacagtaggaacca

SEQ ID NO: 40211 - DNA, 20 bp, Artificial Sequence
  chemically synthesized
actacaaaatttaaatacaa

SEQ ID NO: 40212 - DNA, 20 bp, Artificial Sequence
  chemically synthesized
ctacaaaatttaaatacaat

SEQ ID NO: 40213 - DNA, 20 bp, Artificial Sequence
  chemically synthesized
ttaaatacaatgggaataat

SEQ ID NO: 40214 - DNA, 20 bp, Artificial Sequence
  chemically synthesized
aatgggaataattggatcct

SEQ ID NO: 40215 - DNA, 20 bp, Artificial Sequence
  chemically synthesized
atgggaataattggatcctg

SEQ ID NO: 40216 - DNA, 20 bp, Artificial Sequence
  chemically synthesized
ggaataattggatcctgagg

SEQ ID NO: 40217 - DNA, 20 bp, Artificial Sequence
  chemically synthesized
ataattggatcctgaggtgg

SEQ ID NO: 40218 - DNA, 20 bp, Artificial Sequence
  chemically synthesized
taattggatcctgaggtggc

SEQ ID NO: 40219 - DNA, 20 bp, Artificial Sequence
  chemically synthesized
aattggatcctgaggtggca

SEQ ID NO: 40220 - DNA, 20 bp, Artificial Sequence
  chemically synthesized
attggatcctgaggtggcag

SEQ ID NO: 40221 - DNA, 20 bp, Artificial Sequence
  chemically synthesized
atcctgaggtggcaggggcc

SEQ ID NO: 40222 - DNA, 20 bp, Artificial Sequence
  chemically synthesized
aggtggcaggggccaagtgt

SEQ ID NO: 40223 - DNA, 20 bp, Artificial Sequence
  chemically synthesized
gtgttggcactgaaccatca

SEQ ID NO: 40224 - DNA, 20 bp, Artificial Sequence
  chemically synthesized
tgttggcactgaaccatcaa

SEQ ID NO: 40225 - DNA, 20 bp, Artificial Sequence
  chemically synthesized
ggcactgaaccatcaaaggc

SEQ ID NO: 40226 - DNA, 20 bp, Artificial Sequence
  chemically synthesized
gcactgaaccatcaaaggca

SEQ ID NO: 40227 - DNA, 20 bp, Artificial Sequence
  chemically synthesized
ctgaaccatcaaaggcaagg

SEQ ID NO: 40228 - DNA, 20 bp, Artificial Sequence
  chemically synthesized
tgaaccatcaaaggcaaggt

SEQ ID NO: 40229 - DNA, 20 bp, Artificial Sequence
  chemically synthesized
ggtgggcataactaccataa

SEQ ID NO: 40230 - DNA, 20 bp, Artificial Sequence
  chemically synthesized
ggcataactaccataataga

SEQ ID NO: 40231 - DNA, 20 bp, Artificial Sequence
  chemically synthesized
ataactaccataatagacag

SEQ ID NO: 40232 - DNA, 20 bp, Artificial Sequence
  chemically synthesized
aactaccataatagacagca

SEQ ID NO: 40233 - DNA, 20 bp, Artificial Sequence
  chemically synthesized
actaccataatagacagcag

SEQ ID NO: 40234 - DNA, 20 bp, Artificial Sequence
  chemically synthesized
cataatagacagcagaggca

SEQ ID NO: 40235 - DNA, 20 bp, Artificial Sequence
  chemically synthesized
aatagacagcagaggcaaag

SEQ ID NO: 40236 - DNA, 20 bp, Artificial Sequence
  chemically synthesized
agcagaggcaaagcagccat

SEQ ID NO: 40237 - DNA, 20 bp, Artificial Sequence
  chemically synthesized
aggcaaagcagccatcagaa

SEQ ID NO: 40238 - DNA, 20 bp, Artificial Sequence
  chemically synthesized
tcagaatagtctgactcatg

SEQ ID NO: 40239 - DNA, 20 bp, Artificial Sequence
  chemically synthesized
agaatagtctgactcatgta

SEQ ID NO: 40240 - DNA, 20 bp, Artificial Sequence
  chemically synthesized
gtctgactcatgtagagctc

SEQ ID NO: 40241 - DNA, 20 bp, Artificial Sequence
  chemically synthesized
ctcatgtagagctctggcat

SEQ ID NO: 40242 - DNA, 20 bp, Artificial Sequence
  chemically synthesized
tggcattggctaattaatca

SEQ ID NO: 40243 - DNA, 20 bp, Artificial Sequence
  chemically synthesized
ctaattaatcatggtgttcc

SEQ ID NO: 40244 - DNA, 20 bp, Artificial Sequence
  chemically synthesized
attaatcatggtgttcctag

SEQ ID NO: 40245 - DNA, 20 bp, Artificial Sequence
  chemically synthesized
gttcctagaagtgaaattga

SEQ ID NO: 40246 - DNA, 20 bp, Artificial Sequence
  chemically synthesized
ttcctagaagtgaaattgat

SEQ ID NO: 40247 - DNA, 20 bp, Artificial Sequence
  chemically synthesized
ttatataaacaaaaaactgc

SEQ ID NO: 40248 - DNA, 20 bp, Artificial Sequence
  chemically synthesized
tatataaacaaaaaactgcc

SEQ ID NO: 40249 - DNA, 20 bp, Artificial Sequence
  chemically synthesized
ataaacaaaaaactgccagg

SEQ ID NO: 40250 - DNA, 20 bp, Artificial Sequence
  chemically synthesized
caaaaaactgccaggtagaa

SEQ ID NO: 40251 - DNA, 20 bp, Artificial Sequence
  chemically synthesized
ctgccaggtagaatggacta

SEQ ID NO: 40252 - DNA, 20 bp, Artificial Sequence
  chemically synthesized
actaatctgaattataaaaa

SEQ ID NO: 40253 - DNA, 20 bp, Artificial Sequence
  chemically synthesized
taatctgaattataaaaaca

SEQ ID NO: 40254 - DNA, 20 bp, Artificial Sequence
  chemically synthesized
attataaaaacagagaatca

SEQ ID NO: 40255 - DNA, 20 bp, Artificial Sequence
  chemically synthesized
ttataaaaacagagaatcat

SEQ ID NO: 40256 - DNA, 20 bp, Artificial Sequence
  chemically synthesized
atgggccctcaatcaatttc

SEQ ID NO: 40257 - DNA, 20 bp, Artificial Sequence
  chemically synthesized
ttccagactcgaacctgtta

SEQ ID NO: 40258 - DNA, 20 bp, Artificial Sequence
  chemically synthesized
actcgaacctgttacagttc

SEQ ID NO: 40259 - DNA, 20 bp, Artificial Sequence
  chemically synthesized
gttccagaacccactgaatg

SEQ ID NO: 40260 - DNA, 20 bp, Artificial Sequence
  chemically synthesized
ttccagaacccactgaatga

SEQ ID NO: 40261 - DNA, 20 bp, Artificial Sequence
  chemically synthesized
tccagaacccactgaatgaa

SEQ ID NO: 40262 - DNA, 20 bp, Artificial Sequence
  chemically synthesized
ccagaacccactgaatgaag

SEQ ID NO: 40263 - DNA, 20 bp, Artificial Sequence
  chemically synthesized
agaacccactgaatgaaggg

SEQ ID NO: 40264 - DNA, 20 bp, Artificial Sequence
  chemically synthesized
gaacccactgaatgaagggg

SEQ ID NO: 40265 - DNA, 20 bp, Artificial Sequence
  chemically synthesized
ccactgaatgaaggggaggc

SEQ ID NO: 40266 - DNA, 20 bp, Artificial Sequence
  chemically synthesized
aggggaggctggatcccctt

SEQ ID NO: 40267 - DNA, 20 bp, Artificial Sequence
  chemically synthesized
ggggaggctggatccccttg

SEQ ID NO: 40268 - DNA, 20 bp, Artificial Sequence
  chemically synthesized
gaggctggatccccttgagg

SEQ ID NO: 40269 - DNA, 20 bp, Artificial Sequence
  chemically synthesized
aggctggatccccttgagga

SEQ ID NO: 40270 - DNA, 20 bp, Artificial Sequence
  chemically synthesized
cccttgaggaaggacaccac

SEQ ID NO: 40271 - DNA, 20 bp, Artificial Sequence
  chemically synthesized
ccttgaggaaggacaccact

SEQ ID NO: 40272 - DNA, 20 bp, Artificial Sequence
  chemically synthesized
tctttctcccatccttccct

SEQ ID NO: 40273 - DNA, 20 bp, Artificial Sequence
  chemically synthesized
ctttctcccatccttcccta

SEQ ID NO: 40274 - DNA, 20 bp, Artificial Sequence
  chemically synthesized
ttctcccatccttccctaag

SEQ ID NO: 40275 - DNA, 20 bp, Artificial Sequence
  chemically synthesized
tccttccctaaggagacctc

SEQ ID NO: 40276 - DNA, 20 bp, Artificial Sequence
  chemically synthesized
ggagacctctggccttttac

SEQ ID NO: 40277 - DNA, 20 bp, Artificial Sequence
  chemically synthesized
gagacctctggccttttacc

SEQ ID NO: 40278 - DNA, 20 bp, Artificial Sequence
  chemically synthesized
agacctctggccttttacca

SEQ ID NO: 40279 - DNA, 20 bp, Artificial Sequence
  chemically synthesized
accagggtaactgtgtgtac

SEQ ID NO: 40280 - DNA, 20 bp, Artificial Sequence
  chemically synthesized
cagggtaactgtgtgtactg

SEQ ID NO: 40281 - DNA, 20 bp, Artificial Sequence
  chemically synthesized
gtaactgtgtgtactggaga

SEQ ID NO: 40282 - DNA, 20 bp, Artificial Sequence
  chemically synthesized
taactgtgtgtactggagaa

SEQ ID NO: 40283 - DNA, 20 bp, Artificial Sequence
  chemically synthesized
aactgtgtgtactggagaaa

SEQ ID NO: 40284 - DNA, 20 bp, Artificial Sequence
  chemically synthesized
tgtgtgtactggagaaaggg

SEQ ID NO: 40285 - DNA, 20 bp, Artificial Sequence
  chemically synthesized
actggagaaagggaagtaat

SEQ ID NO: 40286 - DNA, 20 bp, Artificial Sequence
  chemically synthesized
agggaagtaatgagacattt

SEQ ID NO: 40287 - DNA, 20 bp, Artificial Sequence
  chemically synthesized
aagtaatgagacatttcaga

SEQ ID NO: 40288 - DNA, 20 bp, Artificial Sequence
  chemically synthesized
tgagacatttcagaaagtac

SEQ ID NO: 40289 - DNA, 20 bp, Artificial Sequence
  chemically synthesized
tttcagaaagtactggacac

SEQ ID NO: 40290 - DNA, 20 bp, Artificial Sequence
  chemically synthesized
aagtactggacactggctct

SEQ ID NO: 40291 - DNA, 20 bp, Artificial Sequence
  chemically synthesized
ctctgagctgacgttgattc

SEQ ID NO: 40292 - DNA, 20 bp, Artificial Sequence
  chemically synthesized
tctgagctgacgttgattcc

SEQ ID NO: 40293 - DNA, 20 bp, Artificial Sequence
  chemically synthesized
ctgagctgacgttgattcca

SEQ ID NO: 40294 - DNA, 20 bp, Artificial Sequence
  chemically synthesized
gggtacccaaaacgttattg

SEQ ID NO: 40295 - DNA, 20 bp, Artificial Sequence
  chemically synthesized
aaaacgttattgtggttccc

SEQ ID NO: 40296 - DNA, 20 bp, Artificial Sequence
  chemically synthesized
ttattgtggttccccagtta

SEQ ID NO: 40297 - DNA, 20 bp, Artificial Sequence
  chemically synthesized
ttgtggttccccagttaaag

SEQ ID NO: 40298 - DNA, 20 bp, Artificial Sequence
  chemically synthesized
tgtggttccccagttaaagt

SEQ ID NO: 40299 - DNA, 20 bp, Artificial Sequence
  chemically synthesized
gtggttccccagttaaagta

SEQ ID NO: 40300 - DNA, 20 bp, Artificial Sequence
  chemically synthesized
tggttccccagttaaagtag

SEQ ID NO: 40301 - DNA, 20 bp, Artificial Sequence
  chemically synthesized
ccagttaaagtaggggctta

SEQ ID NO: 40302 - DNA, 20 bp, Artificial Sequence
  chemically synthesized
agttaaagtaggggcttatg

SEQ ID NO: 40303 - DNA, 20 bp, Artificial Sequence
  chemically synthesized
gttaaagtaggggcttatgg

SEQ ID NO: 40304 - DNA, 20 bp, Artificial Sequence
  chemically synthesized
aagtaggggcttatggaggt

SEQ ID NO: 40305 - DNA, 20 bp, Artificial Sequence
  chemically synthesized
agtaggggcttatggaggtt

SEQ ID NO: 40306 - DNA, 20 bp, Artificial Sequence
  chemically synthesized
tatggaggttaggtaattaa

SEQ ID NO: 40307 - DNA, 20 bp, Artificial Sequence
  chemically synthesized
tggaggttaggtaattaatg

SEQ ID NO: 40308 - DNA, 20 bp, Artificial Sequence
  chemically synthesized
ttaggtaattaatggagttt

SEQ ID NO: 40309 - DNA, 20 bp, Artificial Sequence
  chemically synthesized
tttagctcatttctgactta

SEQ ID NO: 40310 - DNA, 20 bp, Artificial Sequence
  chemically synthesized
agctcatttctgacttacag

SEQ ID NO: 40311 - DNA, 20 bp, Artificial Sequence
  chemically synthesized
tttctgacttacagtggttc

SEQ ID NO: 40312 - DNA, 20 bp, Artificial Sequence
  chemically synthesized
ctgacttacagtggttccag

SEQ ID NO: 40313 - DNA, 20 bp, Artificial Sequence
  chemically synthesized
tgacttacagtggttccagt

SEQ ID NO: 40314 - DNA, 20 bp, Artificial Sequence
  chemically synthesized
cagtggttccagtgggtccc

SEQ ID NO: 40315 - DNA, 20 bp, Artificial Sequence
  chemically synthesized
gggtccctggacttatcctc

SEQ ID NO: 40316 - DNA, 20 bp, Artificial Sequence
  chemically synthesized
ttatcctctggtcattttcc

SEQ ID NO: 40317 - DNA, 20 bp, Artificial Sequence
  chemically synthesized
gccaaaatgcataatttgta

SEQ ID NO: 40318 - DNA, 20 bp, Artificial Sequence
  chemically synthesized
atttgtatagacatacttat

SEQ ID NO: 40319 - DNA, 20 bp, Artificial Sequence
  chemically synthesized
gtatagacatacttattagc

SEQ ID NO: 40320 - DNA, 20 bp, Artificial Sequence
  chemically synthesized
tagacatacttattagctgg

SEQ ID NO: 40321 - DNA, 20 bp, Artificial Sequence
  chemically synthesized
agctggcagaaatgccacat

SEQ ID NO: 40322 - DNA, 20 bp, Artificial Sequence
  chemically synthesized
tgccacattggctccctgac

SEQ ID NO: 40323 - DNA, 20 bp, Artificial Sequence
  chemically synthesized
cacattggctccctgactgg

SEQ ID NO: 40324 - DNA, 20 bp, Artificial Sequence
  chemically synthesized
acattggctccctgactggt

SEQ ID NO: 40325 - DNA, 20 bp, Artificial Sequence
  chemically synthesized
ggctccctgactggtaggat

SEQ ID NO: 40326 - DNA, 20 bp, Artificial Sequence
  chemically synthesized
gctccctgactggtaggatg

SEQ ID NO: 40327 - DNA, 20 bp, Artificial Sequence
  chemically synthesized
ctccctgactggtaggatga

SEQ ID NO: 40328 - DNA, 20 bp, Artificial Sequence
  chemically synthesized
tggtaggatgagggctatta

SEQ ID NO: 40329 - DNA, 20 bp, Artificial Sequence
  chemically synthesized
taggatgagggctattatgg

SEQ ID NO: 40330 - DNA, 20 bp, Artificial Sequence
  chemically synthesized
aggatgagggctattatggt

SEQ ID NO: 40331 - DNA, 20 bp, Artificial Sequence
  chemically synthesized
tgagggctattatggtggga

SEQ ID NO: 40332 - DNA, 20 bp, Artificial Sequence
  chemically synthesized
gagggctattatggtgggaa

SEQ ID NO: 40333 - DNA, 20 bp, Artificial Sequence
  chemically synthesized
ttatggtgggaaaggccaaa

SEQ ID NO: 40334 - DNA, 20 bp, Artificial Sequence
  chemically synthesized
tggtgggaaaggccaaacag

SEQ ID NO: 40335 - DNA, 20 bp, Artificial Sequence
  chemically synthesized
aaaggccaaacagaagccat

SEQ ID NO: 40336 - DNA, 20 bp, Artificial Sequence
  chemically synthesized
aggccaaacagaagccatta

SEQ ID NO: 40337 - DNA, 20 bp, Artificial Sequence
  chemically synthesized
ccattagagctgtctctacc

SEQ ID NO: 40338 - DNA, 20 bp, Artificial Sequence
  chemically synthesized
caaaaacaatatcccatccc

SEQ ID NO: 40339 - DNA, 20 bp, Artificial Sequence
  chemically synthesized
aaaacaatatcccatccctg

SEQ ID NO: 40340 - DNA, 20 bp, Artificial Sequence
  chemically synthesized
aaacaatatcccatccctgg

SEQ ID NO: 40341 - DNA, 20 bp, Artificial Sequence
  chemically synthesized
aacaatatcccatccctgga

SEQ ID NO: 40342 - DNA, 20 bp, Artificial Sequence
  chemically synthesized
tcccatccctggagggactg

SEQ ID NO: 40343 - DNA, 20 bp, Artificial Sequence
  chemically synthesized
cctggagggactgaagtgat

SEQ ID NO: 40344 - DNA, 20 bp, Artificial Sequence
  chemically synthesized
aagtgattagtgtcaccatc

SEQ ID NO: 40345 - DNA, 20 bp, Artificial Sequence
  chemically synthesized
agtgattagtgtcaccatca

SEQ ID NO: 40346 - DNA, 20 bp, Artificial Sequence
  chemically synthesized
tgtcaccatcaaggacttga

SEQ ID NO: 40347 - DNA, 20 bp, Artificial Sequence
  chemically synthesized
catcaaggacttgaaagacg

SEQ ID NO: 40348 - DNA, 20 bp, Artificial Sequence
  chemically synthesized
atcaaggacttgaaagacgc

SEQ ID NO: 40349 - DNA, 20 bp, Artificial Sequence
  chemically synthesized
tcaaggacttgaaagacgca

SEQ ID NO: 40350 - DNA, 20 bp, Artificial Sequence
  chemically synthesized
caaggacttgaaagacgcag

SEQ ID NO: 40351 - DNA, 20 bp, Artificial Sequence
  chemically synthesized
ggacttgaaagacgcagggg

SEQ ID NO: 40352 - DNA, 20 bp, Artificial Sequence
  chemically synthesized
actctcccatttgacctgtg

SEQ ID NO: 40353 - DNA, 20 bp, Artificial Sequence
  chemically synthesized
tctcccatttgacctgtgca

SEQ ID NO: 40354 - DNA, 20 bp, Artificial Sequence
  chemically synthesized
ctcccatttgacctgtgcag

SEQ ID NO: 40355 - DNA, 20 bp, Artificial Sequence
  chemically synthesized
catttgacctgtgcagagga

SEQ ID NO: 40356 - DNA, 20 bp, Artificial Sequence
  chemically synthesized
tgacctgtgcagaggacaga

SEQ ID NO: 40357 - DNA, 20 bp, Artificial Sequence
  chemically synthesized
tgcagaggacagatggatct

SEQ ID NO: 40358 - DNA, 20 bp, Artificial Sequence
  chemically synthesized
agatggatcttggaaaatga

SEQ ID NO: 40359 - DNA, 20 bp, Artificial Sequence
  chemically synthesized
tggatcttggaaaatgatgg

SEQ ID NO: 40360 - DNA, 20 bp, Artificial Sequence
  chemically synthesized
aaatgatggtggattatttt

SEQ ID NO: 40361 - DNA, 20 bp, Artificial Sequence
  chemically synthesized
ggattattttaagcttaacc

SEQ ID NO: 40362 - DNA, 20 bp, Artificial Sequence
  chemically synthesized
ttattttaagcttaaccaag

SEQ ID NO: 40363 - DNA, 20 bp, Artificial Sequence
  chemically synthesized
ccaagtggtgactccaattg

SEQ ID NO: 40364 - DNA, 20 bp, Artificial Sequence
  chemically synthesized
tccaattgcagctgctctac

SEQ ID NO: 40365 - DNA, 20 bp, Artificial Sequence
  chemically synthesized
tgcagctgctctaccagttg

SEQ ID NO: 40366 - DNA, 20 bp, Artificial Sequence
  chemically synthesized
cagttgtggttttgttgctt

SEQ ID NO: 40367 - DNA, 20 bp, Artificial Sequence
  chemically synthesized
gagcaaattaacacatctcc

SEQ ID NO: 40368 - DNA, 20 bp, Artificial Sequence
  chemically synthesized
ttaacacatctcctggtgcc

SEQ ID NO: 40369 - DNA, 20 bp, Artificial Sequence
  chemically synthesized
atctcctggtgcctggtatg

SEQ ID NO: 40370 - DNA, 20 bp, Artificial Sequence
  chemically synthesized
ggtgcctggtatgcagccat

SEQ ID NO: 40371 - DNA, 20 bp, Artificial Sequence
  chemically synthesized
ctggtatgcagccattggct

SEQ ID NO: 40372 - DNA, 20 bp, Artificial Sequence
  chemically synthesized
tatgcagccattggcttggc

SEQ ID NO: 40373 - DNA, 20 bp, Artificial Sequence
  chemically synthesized
gcagccattggcttggcaag

SEQ ID NO: 40374 - DNA, 20 bp, Artificial Sequence
  chemically synthesized
ttttctccattcctgtccat

SEQ ID NO: 40375 - DNA, 20 bp, Artificial Sequence
  chemically synthesized
ttcctgtccataagacccac

SEQ ID NO: 40376 - DNA, 20 bp, Artificial Sequence
  chemically synthesized
ctgtccataagacccaccag

SEQ ID NO: 40377 - DNA, 20 bp, Artificial Sequence
  chemically synthesized
caccagaagcaatttgcctt

SEQ ID NO: 40378 - DNA, 20 bp, Artificial Sequence
  chemically synthesized
gcaatttgccttcagctgac

SEQ ID NO: 40379 - DNA, 20 bp, Artificial Sequence
  chemically synthesized
caatttgccttcagctgaca

SEQ ID NO: 40380 - DNA, 20 bp, Artificial Sequence
  chemically synthesized
ttgccttcagctgacaaggc

SEQ ID NO: 40381 - DNA, 20 bp, Artificial Sequence
  chemically synthesized
atacctttaccaccctacct

SEQ ID NO: 40382 - DNA, 20 bp, Artificial Sequence
  chemically synthesized
tacctttaccaccctacctc

SEQ ID NO: 40383 - DNA, 20 bp, Artificial Sequence
  chemically synthesized
acctttaccaccctacctca

SEQ ID NO: 40384 - DNA, 20 bp, Artificial Sequence
  chemically synthesized
cctttaccaccctacctcag

SEQ ID NO: 40385 - DNA, 20 bp, Artificial Sequence
  chemically synthesized
tcaggggtgtatcaactctc

SEQ ID NO: 40386 - DNA, 20 bp, Artificial Sequence
  chemically synthesized
ctttgtgtcataatcttatt

SEQ ID NO: 40387 - DNA, 20 bp, Artificial Sequence
  chemically synthesized
ttgtgtcataatcttatttg

SEQ ID NO: 40388 - DNA, 20 bp, Artificial Sequence
  chemically synthesized
gtgtcataatcttatttgga

SEQ ID NO: 40389 - DNA, 20 bp, Artificial Sequence
  chemically synthesized
tgctcgcttttcacttccac

SEQ ID NO: 40390 - DNA, 20 bp, Artificial Sequence
  chemically synthesized
acttccacgagatataacac

SEQ ID NO: 40391 - DNA, 20 bp, Artificial Sequence
  chemically synthesized
attcatgacattatgatgat

SEQ ID NO: 40392 - DNA, 20 bp, Artificial Sequence
  chemically synthesized
gacattatgatgattggata

SEQ ID NO: 40393 - DNA, 20 bp, Artificial Sequence
  chemically synthesized
ttatgatgattggatacagt

SEQ ID NO: 40394 - DNA, 20 bp, Artificial Sequence
  chemically synthesized
gatgattggatacagtgagc

SEQ ID NO: 40395 - DNA, 20 bp, Artificial Sequence
  chemically synthesized
gattggatacagtgagcaag

SEQ ID NO: 40396 - DNA, 20 bp, Artificial Sequence
  chemically synthesized
tggatacagtgagcaagaag

SEQ ID NO: 40397 - DNA, 20 bp, Artificial Sequence
  chemically synthesized
agcaaacacactgaacttat

SEQ ID NO: 40398 - DNA, 20 bp, Artificial Sequence
  chemically synthesized
aacacactgaacttattggt

SEQ ID NO: 40399 - DNA, 20 bp, Artificial Sequence
  chemically synthesized
ttggtgagacatttgtatgc

SEQ ID NO: 40400 - DNA, 20 bp, Artificial Sequence
  chemically synthesized
ggtgagacatttgtatgcca

SEQ ID NO: 40401 - DNA, 20 bp, Artificial Sequence
  chemically synthesized
gtgagacatttgtatgccag

SEQ ID NO: 40402 - DNA, 20 bp, Artificial Sequence
  chemically synthesized
gacatttgtatgccagagga

SEQ ID NO: 40403 - DNA, 20 bp, Artificial Sequence
  chemically synthesized
acatttgtatgccagaggat

SEQ ID NO: 40404 - DNA, 20 bp, Artificial Sequence
  chemically synthesized
cagaggatgggaaataaatc

SEQ ID NO: 40405 - DNA, 20 bp, Artificial Sequence
  chemically synthesized
aaataaatccagctaaaatt

SEQ ID NO: 40406 - DNA, 20 bp, Artificial Sequence
  chemically synthesized
aataaatccagctaaaattt

SEQ ID NO: 40407 - DNA, 20 bp, Artificial Sequence
  chemically synthesized
ataaatccagctaaaattta

SEQ ID NO: 40408 - DNA, 20 bp, Artificial Sequence
  chemically synthesized
aatttagggactttctacct

SEQ ID NO: 40409 - DNA, 20 bp, Artificial Sequence
  chemically synthesized
ttctacctcggtaaaatttc

SEQ ID NO: 40410 - DNA, 20 bp, Artificial Sequence
  chemically synthesized
tctacctcggtaaaatttct

SEQ ID NO: 40411 - DNA, 20 bp, Artificial Sequence
  chemically synthesized
ctacctcggtaaaatttcta

SEQ ID NO: 40412 - DNA, 20 bp, Artificial Sequence
  chemically synthesized
cggtaaaatttctagggttc

SEQ ID NO: 40413 - DNA, 20 bp, Artificial Sequence
  chemically synthesized
taaaatttctagggttccag

SEQ ID NO: 40414 - DNA, 20 bp, Artificial Sequence
  chemically synthesized
ttctagggttccagtggcat

SEQ ID NO: 40415 - DNA, 20 bp, Artificial Sequence
  chemically synthesized
ttccagtggcatgagaccta

SEQ ID NO: 40416 - DNA, 20 bp, Artificial Sequence
  chemically synthesized
ccagtggcatgagacctatg

SEQ ID NO: 40417 - DNA, 20 bp, Artificial Sequence
  chemically synthesized
cctatggagatattccttct

SEQ ID NO: 40418 - DNA, 20 bp, Artificial Sequence
  chemically synthesized
ctatggagatattccttcta

SEQ ID NO: 40419 - DNA, 20 bp, Artificial Sequence
  chemically synthesized
gagatattccttctaaggtg

SEQ ID NO: 40420 - DNA, 20 bp, Artificial Sequence
  chemically synthesized
gaagcataacttgctgcgtt

SEQ ID NO: 40421 - DNA, 20 bp, Artificial Sequence
  chemically synthesized
gtttggcccctcttacaacc

SEQ ID NO: 40422 - DNA, 20 bp, Artificial Sequence
  chemically synthesized
ggcccctcttacaaccaaga

SEQ ID NO: 40423 - DNA, 20 bp, Artificial Sequence
  chemically synthesized
cccctcttacaaccaagaaa

SEQ ID NO: 40424 - DNA, 20 bp, Artificial Sequence
  chemically synthesized
ccctcttacaaccaagaaag

SEQ ID NO: 40425 - DNA, 20 bp, Artificial Sequence
  chemically synthesized
caagaaagaggcacaatgcc

SEQ ID NO: 40426 - DNA, 20 bp, Artificial Sequence
  chemically synthesized
gaaagaggcacaatgcctgg

SEQ ID NO: 40427 - DNA, 20 bp, Artificial Sequence
  chemically synthesized
aaagaggcacaatgcctggt

SEQ ID NO: 40428 - DNA, 20 bp, Artificial Sequence
  chemically synthesized
caatgcctggtgggcctatt

SEQ ID NO: 40429 - DNA, 20 bp, Artificial Sequence
  chemically synthesized
tggtgggcctatttggattt

SEQ ID NO: 40430 - DNA, 20 bp, Artificial Sequence
  chemically synthesized
gtgggcctatttggattttg

SEQ ID NO: 40431 - DNA, 20 bp, Artificial Sequence
  chemically synthesized
tgggcctatttggattttgg

SEQ ID NO: 40432 - DNA, 20 bp, Artificial Sequence
  chemically synthesized
gaggcaacacattcctcgtt

SEQ ID NO: 40433 - DNA, 20 bp, Artificial Sequence
  chemically synthesized
aggcaacacattcctcgttt

SEQ ID NO: 40434 - DNA, 20 bp, Artificial Sequence
  chemically synthesized
ctcgtttgggtgtgttactc

SEQ ID NO: 40435 - DNA, 20 bp, Artificial Sequence
  chemically synthesized
gttactctggcccatttatc

SEQ ID NO: 40436 - DNA, 20 bp, Artificial Sequence
  chemically synthesized
ccatttatcgagtgacctga

SEQ ID NO: 40437 - DNA, 20 bp, Artificial Sequence
  chemically synthesized
catttatcgagtgacctgaa

SEQ ID NO: 40438 - DNA, 20 bp, Artificial Sequence
  chemically synthesized
cgagtgacctgaaaggctgc

SEQ ID NO: 40439 - DNA, 20 bp, Artificial Sequence
  chemically synthesized
cctgaaaggctgccagattt

SEQ ID NO: 40440 - DNA, 20 bp, Artificial Sequence
  chemically synthesized
aaggctgccagatttaagtg

SEQ ID NO: 40441 - DNA, 20 bp, Artificial Sequence
  chemically synthesized
tgccagatttaagtgcagtc

SEQ ID NO: 40442 - DNA, 20 bp, Artificial Sequence
  chemically synthesized
ttaagtgcagtctagaacaa

SEQ ID NO: 40443 - DNA, 20 bp, Artificial Sequence
  chemically synthesized
agtgcagtctagaacaaaag

SEQ ID NO: 40444 - DNA, 20 bp, Artificial Sequence
  chemically synthesized
gtgcagtctagaacaaaaga

SEQ ID NO: 40445 - DNA, 20 bp, Artificial Sequence
  chemically synthesized
aacaaaagaaggctctgaaa

SEQ ID NO: 40446 - DNA, 20 bp, Artificial Sequence
  chemically synthesized
acaaaagaaggctctgaaac

SEQ ID NO: 40447 - DNA, 20 bp, Artificial Sequence
  chemically synthesized
agaaggctctgaaacaggtc

SEQ ID NO: 40448 - DNA, 20 bp, Artificial Sequence
  chemically synthesized
gaaggctctgaaacaggtcc

SEQ ID NO: 40449 - DNA, 20 bp, Artificial Sequence
  chemically synthesized
acaggtccaggctgctgtga

SEQ ID NO: 40450 - DNA, 20 bp, Artificial Sequence
  chemically synthesized
gtgaaagctgctctgccatt

SEQ ID NO: 40451 - DNA, 20 bp, Artificial Sequence
  chemically synthesized
tgaaagctgctctgccattt

SEQ ID NO: 40452 - DNA, 20 bp, Artificial Sequence
  chemically synthesized
atttgggccacatgaccccg

SEQ ID NO: 40453 - DNA, 20 bp, Artificial Sequence
  chemically synthesized
acatgaccccgcagatccaa

SEQ ID NO: 40454 - DNA, 20 bp, Artificial Sequence
  chemically synthesized
ccgcagatccaatggtgctt

SEQ ID NO: 40455 - DNA, 20 bp, Artificial Sequence
  chemically synthesized
cgcagatccaatggtgcttg

SEQ ID NO: 40456 - DNA, 20 bp, Artificial Sequence
  chemically synthesized
tccaatggtgcttgaggtgt

SEQ ID NO: 40457 - DNA, 20 bp, Artificial Sequence
  chemically synthesized
aatggtgcttgaggtgtcag

SEQ ID NO: 40458 - DNA, 20 bp, Artificial Sequence
  chemically synthesized
ggtgcttgaggtgtcagtgg

SEQ ID NO: 40459 - DNA, 20 bp, Artificial Sequence
  chemically synthesized
cttgaggtgtcagtggcaga

SEQ ID NO: 40460 - DNA, 20 bp, Artificial Sequence
  chemically synthesized
ttgaggtgtcagtggcagat

SEQ ID NO: 40461 - DNA, 20 bp, Artificial Sequence
  chemically synthesized
tgaggtgtcagtggcagata

SEQ ID NO: 40462 - DNA, 20 bp, Artificial Sequence
  chemically synthesized
tggcagatagggatgctgtt

SEQ ID NO: 40463 - DNA, 20 bp, Artificial Sequence
  chemically synthesized
gcagatagggatgctgtttg

SEQ ID NO: 40464 - DNA, 20 bp, Artificial Sequence
  chemically synthesized
gggatgctgtttggagcctt

SEQ ID NO: 40465 - DNA, 20 bp, Artificial Sequence
  chemically synthesized
atgctgtttggagcctttgg

SEQ ID NO: 40466 - DNA, 20 bp, Artificial Sequence
  chemically synthesized
tgctgtttggagcctttggc

SEQ ID NO: 40467 - DNA, 20 bp, Artificial Sequence
  chemically synthesized
gagcctttggcaggccccca

SEQ ID NO: 40468 - DNA, 20 bp, Artificial Sequence
  chemically synthesized
agcctttggcaggcccccat

SEQ ID NO: 40469 - DNA, 20 bp, Artificial Sequence
  chemically synthesized
aggcccccataggtgaatca

SEQ ID NO: 40470 - DNA, 20 bp, Artificial Sequence
  chemically synthesized
cccccataggtgaatcacag

SEQ ID NO: 40471 - DNA, 20 bp, Artificial Sequence
  chemically synthesized
cccataggtgaatcacagtg

SEQ ID NO: 40472 - DNA, 20 bp, Artificial Sequence
  chemically synthesized
tgaatcacagtggagacctc

SEQ ID NO: 40473 - DNA, 20 bp, Artificial Sequence
  chemically synthesized
gaatcacagtggagacctct

SEQ ID NO: 40474 - DNA, 20 bp, Artificial Sequence
  chemically synthesized
agtggagacctctaggattt

SEQ ID NO: 40475 - DNA, 20 bp, Artificial Sequence
  chemically synthesized
tggagacctctaggattttg

SEQ ID NO: 40476 - DNA, 20 bp, Artificial Sequence
  chemically synthesized
gacctctaggattttggagc

SEQ ID NO: 40477 - DNA, 20 bp, Artificial Sequence
  chemically synthesized
acctctaggattttggagca

SEQ ID NO: 40478 - DNA, 20 bp, Artificial Sequence
  chemically synthesized
gcaaggccctgccacttctg

SEQ ID NO: 40479 - DNA, 20 bp, Artificial Sequence
  chemically synthesized
cagataactactctcctttt

SEQ ID NO: 40480 - DNA, 20 bp, Artificial Sequence
  chemically synthesized
gataactactctccttttga

SEQ ID NO: 40481 - DNA, 20 bp, Artificial Sequence
  chemically synthesized
actactctccttttgagaga

SEQ ID NO: 40482 - DNA, 20 bp, Artificial Sequence
  chemically synthesized
tccttttgagagacagctat

SEQ ID NO: 40483 - DNA, 20 bp, Artificial Sequence
  chemically synthesized
gacagctattggtctgttat

SEQ ID NO: 40484 - DNA, 20 bp, Artificial Sequence
  chemically synthesized
acagctattggtctgttatt

SEQ ID NO: 40485 - DNA, 20 bp, Artificial Sequence
  chemically synthesized
attggtctgttattgggctt

SEQ ID NO: 40486 - DNA, 20 bp, Artificial Sequence
  chemically synthesized
ggtctgttattgggctttgg

SEQ ID NO: 40487 - DNA, 20 bp, Artificial Sequence
  chemically synthesized
ggtaactgaacgtttgactg

SEQ ID NO: 40488 - DNA, 20 bp, Artificial Sequence
  chemically synthesized
gtaactgaacgtttgactgt

SEQ ID NO: 40489 - DNA, 20 bp, Artificial Sequence
  chemically synthesized
acgtttgactgtgggtcata

SEQ ID NO: 40490 - DNA, 20 bp, Artificial Sequence
  chemically synthesized
tgaacctgcctatcatgaac

SEQ ID NO: 40491 - DNA, 20 bp, Artificial Sequence
  chemically synthesized
tggttgctttctgacccatc

SEQ ID NO: 40492 - DNA, 20 bp, Artificial Sequence
  chemically synthesized
ttctgacccatctagccatg

SEQ ID NO: 40493 - DNA, 20 bp, Artificial Sequence
  chemically synthesized
tgacccatctagccatgaag

SEQ ID NO: 40494 - DNA, 20 bp, Artificial Sequence
  chemically synthesized
gacccatctagccatgaagt

SEQ ID NO: 40495 - DNA, 20 bp, Artificial Sequence
  chemically synthesized
catctagccatgaagtgggt

SEQ ID NO: 40496 - DNA, 20 bp, Artificial Sequence
  chemically synthesized
agccatgaagtgggtcagca

SEQ ID NO: 40497 - DNA, 20 bp, Artificial Sequence
  chemically synthesized
catgaagtgggtcagcacag

SEQ ID NO: 40498 - DNA, 20 bp, Artificial Sequence
  chemically synthesized
ggcatttcatcatcaaattg

SEQ ID NO: 40499 - DNA, 20 bp, Artificial Sequence
  chemically synthesized
atttcatcatcaaattgaag

SEQ ID NO: 40500 - DNA, 20 bp, Artificial Sequence
  chemically synthesized
tgaagtggtgtgtatgtgat

SEQ ID NO: 40501 - DNA, 20 bp, Artificial Sequence
  chemically synthesized
gaagtggtgtgtatgtgatc

SEQ ID NO: 40502 - DNA, 20 bp, Artificial Sequence
  chemically synthesized
gtgtgtatgtgatcgggctt

SEQ ID NO: 40503 - DNA, 20 bp, Artificial Sequence
  chemically synthesized
tgtatgtgatcgggcttgag

SEQ ID NO: 40504 - DNA, 20 bp, Artificial Sequence
  chemically synthesized
gtatgtgatcgggcttgagc

SEQ ID NO: 40505 - DNA, 20 bp, Artificial Sequence
  chemically synthesized
tcgggcttgagcaggtcctg

SEQ ID NO: 40506 - DNA, 20 bp, Artificial Sequence
  chemically synthesized
cgggcttgagcaggtcctga

SEQ ID NO: 40507 - DNA, 20 bp, Artificial Sequence
  chemically synthesized
tgagcaggtcctgaaggcac

SEQ ID NO: 40508 - DNA, 20 bp, Artificial Sequence
  chemically synthesized
caggtcctgaaggcacaagt

SEQ ID NO: 40509 - DNA, 20 bp, Artificial Sequence
  chemically synthesized
aaggcacaagtaagttacat

SEQ ID NO: 40510 - DNA, 20 bp, Artificial Sequence
  chemically synthesized
aggcacaagtaagttacata

SEQ ID NO: 40511 - DNA, 20 bp, Artificial Sequence
  chemically synthesized
cacaagtaagttacataagg

SEQ ID NO: 40512 - DNA, 20 bp, Artificial Sequence
  chemically synthesized
aagtaagttacataaggaag

SEQ ID NO: 40513 - DNA, 20 bp, Artificial Sequence
  chemically synthesized
ccaccctgccttccctcccc

SEQ ID NO: 40514 - DNA, 20 bp, Artificial Sequence
  chemically synthesized
cctcccccagcctgcaccaa

SEQ ID NO: 40515 - DNA, 20 bp, Artificial Sequence
  chemically synthesized
agcctgcaccaatggcctca

SEQ ID NO: 40516 - DNA, 20 bp, Artificial Sequence
  chemically synthesized
gcctgcaccaatggcctcat

SEQ ID NO: 40517 - DNA, 20 bp, Artificial Sequence
  chemically synthesized
cctgcaccaatggcctcatg

SEQ ID NO: 40518 - DNA, 20 bp, Artificial Sequence
  chemically synthesized
tgcaccaatggcctcatggg

SEQ ID NO: 40519 - DNA, 20 bp, Artificial Sequence
  chemically synthesized
catggggagttccctatgat

SEQ ID NO: 40520 - DNA, 20 bp, Artificial Sequence
  chemically synthesized
agttccctatgatcagttga

SEQ ID NO: 40521 - DNA, 20 bp, Artificial Sequence
  chemically synthesized
ttccctatgatcagttgaca

SEQ ID NO: 40522 - DNA, 20 bp, Artificial Sequence
  chemically synthesized
tccctatgatcagttgacag

SEQ ID NO: 40523 - DNA, 20 bp, Artificial Sequence
  chemically synthesized
ctatgatcagttgacagagg

SEQ ID NO: 40524 - DNA, 20 bp, Artificial Sequence
  chemically synthesized
tatgatcagttgacagagga

SEQ ID NO: 40525 - DNA, 20 bp, Artificial Sequence
  chemically synthesized
atgatcagttgacagaggaa

SEQ ID NO: 40526 - DNA, 20 bp, Artificial Sequence
  chemically synthesized
atcagttgacagaggaaggg

SEQ ID NO: 40527 - DNA, 20 bp, Artificial Sequence
  chemically synthesized
tgacagaggaagggaagact

SEQ ID NO: 40528 - DNA, 20 bp, Artificial Sequence
  chemically synthesized
gacagaggaagggaagacta

SEQ ID NO: 40529 - DNA, 20 bp, Artificial Sequence
  chemically synthesized
aggaagggaagactaaggac

SEQ ID NO: 40530 - DNA, 20 bp, Artificial Sequence
  chemically synthesized
gaagactaaggactggttca

SEQ ID NO: 40531 - DNA, 20 bp, Artificial Sequence
  chemically synthesized
actaaggactggttcataga

SEQ ID NO: 40532 - DNA, 20 bp, Artificial Sequence
  chemically synthesized
agatggttctgcacgatatg

SEQ ID NO: 40533 - DNA, 20 bp, Artificial Sequence
  chemically synthesized
gatggttctgcacgatatgc

SEQ ID NO: 40534 - DNA, 20 bp, Artificial Sequence
  chemically synthesized
gatatgcaggcaccacccga

SEQ ID NO: 40535 - DNA, 20 bp, Artificial Sequence
  chemically synthesized
atgcaggcaccacccgaaag

SEQ ID NO: 40536 - DNA, 20 bp, Artificial Sequence
  chemically synthesized
aggcaccacccgaaagtgga

SEQ ID NO: 40537 - DNA, 20 bp, Artificial Sequence
  chemically synthesized
cacccgaaagtggacagctg

SEQ ID NO: 40538 - DNA, 20 bp, Artificial Sequence
  chemically synthesized
tgcatgtgtacacttgtgct

SEQ ID NO: 40539 - DNA, 20 bp, Artificial Sequence
  chemically synthesized
tttcctttatcatgtgacct

SEQ ID NO: 40540 - DNA, 20 bp, Artificial Sequence
  chemically synthesized
atcatgtgaccttagattta

SEQ ID NO: 40541 - DNA, 20 bp, Artificial Sequence
  chemically synthesized
tagatttatggacttcacat

SEQ ID NO: 40542 - DNA, 20 bp, Artificial Sequence
  chemically synthesized
tggacttcacatcagcattt

SEQ ID NO: 40543 - DNA, 20 bp, Artificial Sequence
  chemically synthesized
acatcagcatttaagcattt

SEQ ID NO: 40544 - DNA, 20 bp, Artificial Sequence
  chemically synthesized
catttaagtgttgttcatat

SEQ ID NO: 40545 - DNA, 20 bp, Artificial Sequence
  chemically synthesized
taaccttatgtaataacttt

SEQ ID NO: 40546 - DNA, 20 bp, Artificial Sequence
  chemically synthesized
ttatgtaataacttttggtt

SEQ ID NO: 40547 - DNA, 20 bp, Artificial Sequence
  chemically synthesized
tatgtaataacttttggttt

SEQ ID NO: 40548 - DNA, 20 bp, Artificial Sequence
  chemically synthesized
atgtaataacttttggtttg

SEQ ID NO: 40549 - DNA, 20 bp, Artificial Sequence
  chemically synthesized
ataacttttggtttggggat

SEQ ID NO: 40550 - DNA, 20 bp, Artificial Sequence
  chemically synthesized
tttggggattggtgcgtttc

SEQ ID NO: 40551 - DNA, 20 bp, Artificial Sequence
  chemically synthesized
tggtgcgtttctggttgtat

SEQ ID NO: 40552 - DNA, 20 bp, Artificial Sequence
  chemically synthesized
ggtgcgtttctggttgtatg

SEQ ID NO: 40553 - DNA, 20 bp, Artificial Sequence
  chemically synthesized
cgtttctggttgtatgagga

SEQ ID NO: 40554 - DNA, 20 bp, Artificial Sequence
  chemically synthesized
tgaggatagttgtattatat

SEQ ID NO: 40555 - DNA, 20 bp, Artificial Sequence
  chemically synthesized
gaggatagttgtattatatt

SEQ ID NO: 40556 - DNA, 20 bp, Artificial Sequence
  chemically synthesized
cttattattgtctttatttg

SEQ ID NO: 40557 - DNA, 20 bp, Artificial Sequence
  chemically synthesized
ttgaagattatgtatgattt

SEQ ID NO: 40558 - DNA, 20 bp, Artificial Sequence
  chemically synthesized
tgaagattatgtatgatttc

SEQ ID NO: 40559 - DNA, 20 bp, Artificial Sequence
  chemically synthesized
atgatttcaggatgtgtgta

SEQ ID NO: 40560 - DNA, 20 bp, Artificial Sequence
  chemically synthesized
tgatttcaggatgtgtgtat

SEQ ID NO: 40561 - DNA, 20 bp, Artificial Sequence
  chemically synthesized
caggatgtgtgtatgggttc

SEQ ID NO: 40562 - DNA, 20 bp, Artificial Sequence
  chemically synthesized
gtgtatgggttcaagttgac

SEQ ID NO: 40563 - DNA, 20 bp, Artificial Sequence
  chemically synthesized
tgtatgggttcaagttgaca

SEQ ID NO: 40564 - DNA, 20 bp, Artificial Sequence
  chemically synthesized
tatgggttcaagttgacaag

SEQ ID NO: 40565 - DNA, 20 bp, Artificial Sequence
  chemically synthesized
ggttcaagttgacaaggagt

SEQ ID NO: 40566 - DNA, 20 bp, Artificial Sequence
  chemically synthesized
acaaggagttggacttgtga

SEQ ID NO: 40567 - DNA, 20 bp, Artificial Sequence
  chemically synthesized
gttaatactgtcaacttgat

SEQ ID NO: 40568 - DNA, 20 bp, Artificial Sequence
  chemically synthesized
tgtcaacttgattggattga

SEQ ID NO: 40569 - DNA, 20 bp, Artificial Sequence
  chemically synthesized
tgattggattgaaagatgca

SEQ ID NO: 40570 - DNA, 20 bp, Artificial Sequence
  chemically synthesized
aagatgcaaagtattaatct

SEQ ID NO: 40571 - DNA, 20 bp, Artificial Sequence
  chemically synthesized
ttaatctcggttatgtctgt

SEQ ID NO: 40572 - DNA, 20 bp, Artificial Sequence
  chemically synthesized
taatctcggttatgtctgtg

SEQ ID NO: 40573 - DNA, 20 bp, Artificial Sequence
  chemically synthesized
aatctcggttatgtctgtga

SEQ ID NO: 40574 - DNA, 20 bp, Artificial Sequence
  chemically synthesized
cggttatgtctgtgagggtg

SEQ ID NO: 40575 - DNA, 20 bp, Artificial Sequence
  chemically synthesized
tgtctgtgagggtgtggcaa

SEQ ID NO: 40576 - DNA, 20 bp, Artificial Sequence
  chemically synthesized
gtctgtgagggtgtggcaaa

SEQ ID NO: 40577 - DNA, 20 bp, Artificial Sequence
  chemically synthesized
ctgtgagggtgtggcaaaag

SEQ ID NO: 40578 - DNA, 20 bp, Artificial Sequence
  chemically synthesized
gcaaaaggagattaacattt

SEQ ID NO: 40579 - DNA, 20 bp, Artificial Sequence
  chemically synthesized
aaggagattaacatttgagt

SEQ ID NO: 40580 - DNA, 20 bp, Artificial Sequence
  chemically synthesized
gagattaacatttgagtcag

SEQ ID NO: 40581 - DNA, 20 bp, Artificial Sequence
  chemically synthesized
agattaacatttgagtcagt

SEQ ID NO: 40582 - DNA, 20 bp, Artificial Sequence
  chemically synthesized
taacatttgagtcagtgggc

SEQ ID NO: 40583 - DNA, 20 bp, Artificial Sequence
  chemically synthesized
aacatttgagtcagtgggct

SEQ ID NO: 40584 - DNA, 20 bp, Artificial Sequence
  chemically synthesized
tgtacacatgcatttagaaa

SEQ ID NO: 40585 - DNA, 20 bp, Artificial Sequence
  chemically synthesized
agtgctgcagctgtccactt

SEQ ID NO: 40586 - DNA, 20 bp, Artificial Sequence
  chemically synthesized
gcaggctgggggagggaagg

SEQ ID NO: 40587 - DNA, 20 bp, Artificial Sequence
  chemically synthesized
gggagggaaggcagggtggc

SEQ ID NO: 40588 - DNA, 20 bp, Artificial Sequence
  chemically synthesized
ctgacccacttcatggctag

SEQ ID NO: 40589 - DNA, 20 bp, Artificial Sequence
  chemically synthesized
caatagctgtctctcaaaag

SEQ ID NO: 40590 - DNA, 20 bp, Artificial Sequence
  chemically synthesized
cactgacacctcaagcacca

SEQ ID NO: 40591 - DNA, 20 bp, Artificial Sequence
  chemically synthesized
ctcaagcaccattggatctg

SEQ ID NO: 40592 - DNA, 20 bp, Artificial Sequence
  chemically synthesized
aggtcactcgataaatgggc

SEQ ID NO: 40593 - DNA, 20 bp, Artificial Sequence
  chemically synthesized
cagagtaacacacccaaacg

SEQ ID NO: 40594 - DNA, 20 bp, Artificial Sequence
  chemically synthesized
aagttatgcttcaccttaga

SEQ ID NO: 40595 - DNA, 20 bp, Artificial Sequence
  chemically synthesized
agaaagtccctaaattttag

SEQ ID NO: 40596 - DNA, 20 bp, Artificial Sequence
  chemically synthesized
tatccaatcatcataatgtc

SEQ ID NO: 40597 - DNA, 20 bp, Artificial Sequence
  chemically synthesized
aagattatgacacaaagctg

SEQ ID NO: 40598 - DNA, 20 bp, Artificial Sequence
  chemically synthesized
gagttgatacacccctgagg

SEQ ID NO: 40599 - DNA, 20 bp, Artificial Sequence
  chemically synthesized
ctgaaggcaaattgcttctg

SEQ ID NO: 40600 - DNA, 20 bp, Artificial Sequence
  chemically synthesized
ttctggtgggtcttatggac

SEQ ID NO: 40601 - DNA, 20 bp, Artificial Sequence
  chemically synthesized
actggtagagcagctgcaat

SEQ ID NO: 40602 - DNA, 20 bp, Artificial Sequence
  chemically synthesized
cctctgcacaggtcaaatgg

SEQ ID NO: 40603 - DNA, 20 bp, Artificial Sequence
  chemically synthesized
gtcaaatgggagagttgaac

SEQ ID NO: 40604 - DNA, 20 bp, Artificial Sequence
  chemically synthesized
gagttgaacagggatgtggt

SEQ ID NO: 40605 - DNA, 20 bp, Artificial Sequence
  chemically synthesized
ctaatcacttcagtccctcc

SEQ ID NO: 40606 - DNA, 20 bp, Artificial Sequence
  chemically synthesized
cacttcagtccctccaggga

SEQ ID NO: 40607 - DNA, 20 bp, Artificial Sequence
  chemically synthesized
tggcactgggaaaatgacca

SEQ ID NO: 40608 - DNA, 20 bp, Artificial Sequence
  chemically synthesized
tggggaaccacaataacgtt

SEQ ID NO: 40609 - DNA, 20 bp, Artificial Sequence
  chemically synthesized
caataacgttttgggtaccc

SEQ ID NO: 40610 - DNA, 20 bp, Artificial Sequence
  chemically synthesized
ggccagaggtctccttaggg

SEQ ID NO: 40611 - DNA, 20 bp, Artificial Sequence
  chemically synthesized
ccttagggaaggatgggaga

SEQ ID NO: 40612 - DNA, 20 bp, Artificial Sequence
  chemically synthesized
ctagtggtgtccttcctcaa

SEQ ID NO: 40613 - DNA, 20 bp, Artificial Sequence
  chemically synthesized
tccagcctccccttcattca

SEQ ID NO: 40614 - DNA, 20 bp, Artificial Sequence
  chemically synthesized
gttctggaactgtaacaggt

SEQ ID NO: 40615 - DNA, 20 bp, Artificial Sequence
  chemically synthesized
tttgtttatataaatcaagt

SEQ ID NO: 40616 - DNA, 20 bp, Artificial Sequence
  chemically synthesized
agccaatgccagagctctac

SEQ ID NO: 40617 - DNA, 20 bp, Artificial Sequence
  chemically synthesized
acacttggcccctgccacct

SEQ ID NO: 40618 - DNA, 20 bp, Artificial Sequence
  chemically synthesized
attgtatttaaattttgtag

SEQ ID NO: 40619 - DNA, 20 bp, Artificial Sequence
  chemically synthesized
tatttcacaaagcttcggcc

SEQ ID NO: 40620 - DNA, 20 bp, Artificial Sequence
  chemically synthesized
atcttctggaccctcccagc

SEQ ID NO: 40621 - DNA, 20 bp, Artificial Sequence
  chemically synthesized
tctggaccctcccagctggg

SEQ ID NO: 40622 - DNA, 20 bp, Artificial Sequence
  chemically synthesized
atcctaatctccctaagcct

SEQ ID NO: 40623 - DNA, 20 bp, Artificial Sequence
  chemically synthesized
tttttttttttttttggaaa

SEQ ID NO: 40624 - DNA, 20 bp, Artificial Sequence
  chemically synthesized
gtcttgctctgttaccaggc

SEQ ID NO: 40625 - DNA, 20 bp, Artificial Sequence
  chemically synthesized
ttttgtatttttagcagaga

SEQ ID NO: 40626 - DNA, 20 bp, Artificial Sequence
  chemically synthesized
tggggtttcaccattttagc

SEQ ID NO: 40627 - DNA, 20 bp, Artificial Sequence
  chemically synthesized
gcccccgcctcccaaggtgc

SEQ ID NO: 40628 - DNA, 20 bp, Artificial Sequence
  chemically synthesized
ccgagctgcaacattaaatg

SEQ ID NO: 40629 - DNA, 20 bp, Artificial Sequence
  chemically synthesized
gaaagcttaagcagttcttt

SEQ ID NO: 40630 - DNA, 20 bp, Artificial Sequence
  chemically synthesized
agagtataatgcacctcctc

SEQ ID NO: 40631 - DNA, 20 bp, Artificial Sequence
  chemically synthesized
cctcacctctggggcccgca

SEQ ID NO: 40632 - DNA, 20 bp, Artificial Sequence
  chemically synthesized
tagaagcattcaggggcatt

SEQ ID NO: 40633 - DNA, 20 bp, Artificial Sequence
  chemically synthesized
cattaggggtgcctcttgag

SEQ ID NO: 40634 - DNA, 20 bp, Artificial Sequence
  chemically synthesized
cactgttgcctcaagcagtg

SEQ ID NO: 40635 - DNA, 20 bp, Artificial Sequence
  chemically synthesized
gtggaaaggctaatggcagc

SEQ ID NO: 40636 - DNA, 20 bp, Artificial Sequence
  chemically synthesized
atggcagcacgggtcaggga

SEQ ID NO: 40637 - DNA, 20 bp, Artificial Sequence
  chemically synthesized
gaggggatgttaccactact

SEQ ID NO: 40638 - DNA, 20 bp, Artificial Sequence
  chemically synthesized
ttctggcaaaaaagtttcat

SEQ ID NO: 40639 - DNA, 20 bp, Artificial Sequence
  chemically synthesized
ctcagtgtcctcagcttcat

SEQ ID NO: 40640 - DNA, 20 bp, Artificial Sequence
  chemically synthesized
cacatccccactccaagttc

SEQ ID NO: 40641 - DNA, 20 bp, Artificial Sequence
  chemically synthesized
aatttcaactctttctctac

SEQ ID NO: 40642 - DNA, 20 bp, Artificial Sequence
  chemically synthesized
atagtcaaaggtattatgta

SEQ ID NO: 40643 - DNA, 20 bp, Artificial Sequence
  chemically synthesized
ctccttgcctctcataagtg

SEQ ID NO: 40644 - DNA, 20 bp, Artificial Sequence
  chemically synthesized
gttctccatactattagaag

SEQ ID NO: 40645 - DNA, 20 bp, Artificial Sequence
  chemically synthesized
agaagtcccaaaaccaatga

SEQ ID NO: 40646 - DNA, 20 bp, Artificial Sequence
  chemically synthesized
gtatgaaaatctgtattagt

SEQ ID NO: 40647 - DNA, 20 bp, Artificial Sequence
  chemically synthesized
atatatgagagagagagaga

SEQ ID NO: 40648 - DNA, 20 bp, Artificial Sequence
  chemically synthesized
tgtatatatgtgtatatata

SEQ ID NO: 40649 - DNA, 20 bp, Artificial Sequence
  chemically synthesized
agtcccacagctgaagaact

SEQ ID NO: 40650 - DNA, 20 bp, Artificial Sequence
  chemically synthesized
gtccgatgttcaagagcagg

SEQ ID NO: 40651 - DNA, 20 bp, Artificial Sequence
  chemically synthesized
ggcagcaggggcaggggcct

SEQ ID NO: 40652 - DNA, 20 bp, Artificial Sequence
  chemically synthesized
aggggcctcagggtgcttgc

SEQ ID NO: 40653 - DNA, 20 bp, Artificial Sequence
  chemically synthesized
acacactggcctcttttcca

SEQ ID NO: 40654 - DNA, 20 bp, Artificial Sequence
  chemically synthesized
atagggtggctggggcacac

SEQ ID NO: 40655 - DNA, 20 bp, Artificial Sequence
  chemically synthesized
tggctggggcacactggggt

SEQ ID NO: 40656 - DNA, 20 bp, Artificial Sequence
  chemically synthesized
tggggtgtgagtaaagcact

SEQ ID NO: 40657 - DNA, 20 bp, Artificial Sequence
  chemically synthesized
agcttcaccccacaaaaaca

SEQ ID NO: 40658 - DNA, 20 bp, Artificial Sequence
  chemically synthesized
cagccagtggaaatgttcaa

SEQ ID NO: 40659 - DNA, 20 bp, Artificial Sequence
  chemically synthesized
gccaggagccttgcctggtg

SEQ ID NO: 40660 - DNA, 20 bp, Artificial Sequence
  chemically synthesized
agctcacaagaaagagaaac

SEQ ID NO: 40661 - DNA, 20 bp, Artificial Sequence
  chemically synthesized
gctgaaatggcagaggggct

SEQ ID NO: 40662 - DNA, 20 bp, Artificial Sequence
  chemically synthesized
gaggggctgtgggttgtctc

SEQ ID NO: 40663 - DNA, 20 bp, Artificial Sequence
  chemically synthesized
ctaaaatgttcaggcagggc

SEQ ID NO: 40664 - DNA, 20 bp, Artificial Sequence
  chemically synthesized
tggctgtgctctgcccagtg

SEQ ID NO: 40665 - DNA, 20 bp, Artificial Sequence
  chemically synthesized
acactgtgctggaggtccgt

SEQ ID NO: 40666 - DNA, 20 bp, Artificial Sequence
  chemically synthesized
tgagcccatactttaatctc

SEQ ID NO: 40667 - DNA, 20 bp, Artificial Sequence
  chemically synthesized
gtggtaaggaagaaagtaca

SEQ ID NO: 40668 - DNA, 20 bp, Artificial Sequence
  chemically synthesized
caatattgcaaatcattatt

SEQ ID NO: 40669 - DNA, 20 bp, Artificial Sequence
  chemically synthesized
ctgtgatacaggtgtttgat

SEQ ID NO: 40670 - DNA, 20 bp, Artificial Sequence
  chemically synthesized
actgcaaccgtgtatctctt

SEQ ID NO: 40671 - DNA, 20 bp, Artificial Sequence
  chemically synthesized
tcatgtctagcatgcaggac

SEQ ID NO: 40672 - DNA, 20 bp, Artificial Sequence
  chemically synthesized
tgcaggacttgggtaatctc

SEQ ID NO: 40673 - DNA, 20 bp, Artificial Sequence
  chemically synthesized
ctaaccataaaatcttaaat

SEQ ID NO: 40674 - DNA, 20 bp, Artificial Sequence
  chemically synthesized
tgacagttgataagcatctt

SEQ ID NO: 40675 - DNA, 20 bp, Artificial Sequence
  chemically synthesized
agttacaaaaatgttggtgc

SEQ ID NO: 40676 - DNA, 20 bp, Artificial Sequence
  chemically synthesized
gttggtgcatggatgatgtt

SEQ ID NO: 40677 - DNA, 20 bp, Artificial Sequence
  chemically synthesized
aattaagcaaaaaaaaaatg

SEQ ID NO: 40678 - DNA, 20 bp, Artificial Sequence
  chemically synthesized
acacaccactattagttggg

SEQ ID NO: 40679 - DNA, 20 bp, Artificial Sequence
  chemically synthesized
ctttctgcctggttgtggca

SEQ ID NO: 40680 - DNA, 20 bp, Artificial Sequence
  chemically synthesized
acaaaatgtagtgattttca

SEQ ID NO: 40681 - DNA, 20 bp, Artificial Sequence
  chemically synthesized
tgaagatagccaagcttcca

SEQ ID NO: 40682 - DNA, 20 bp, Artificial Sequence
  chemically synthesized
ggacaaccttgaccactttg

SEQ ID NO: 40683 - DNA, 20 bp, Artificial Sequence
  chemically synthesized
tggtgggggccacatgcaga

SEQ ID NO: 40684 - DNA, 20 bp, Artificial Sequence
  chemically synthesized
gggggccacatgcagatgga

SEQ ID NO: 40685 - DNA, 20 bp, Artificial Sequence
  chemically synthesized
catgcagatggagtgggtta

SEQ ID NO: 40686 - DNA, 20 bp, Artificial Sequence
  chemically synthesized
agagtgactagaagagcagt

SEQ ID NO: 40687 - DNA, 20 bp, Artificial Sequence
  chemically synthesized
tgaaagcagcgagacttcta

SEQ ID NO: 40688 - DNA, 20 bp, Artificial Sequence
  chemically synthesized
agcgagacttctagggaata

SEQ ID NO: 40689 - DNA, 20 bp, Artificial Sequence
  chemically synthesized
aaggcctgtcctgacctcct

SEQ ID NO: 40690 - DNA, 20 bp, Artificial Sequence
  chemically synthesized
catgagggcagggcaaggag

SEQ ID NO: 40691 - DNA, 20 bp, Artificial Sequence
  chemically synthesized
atatgctctatgctggaaaa

SEQ ID NO: 40692 - DNA, 20 bp, Artificial Sequence
  chemically synthesized
tttgaactctcttttccagg

SEQ ID NO: 40693 - DNA, 20 bp, Artificial Sequence
  chemically synthesized
ttttccaggaagagttgtgc

SEQ ID NO: 40694 - DNA, 20 bp, Artificial Sequence
  chemically synthesized
ttaataaggtgcttcctaca

SEQ ID NO: 40695 - DNA, 20 bp, Artificial Sequence
  chemically synthesized
gagttcagttaaacattttg

SEQ ID NO: 40696 - DNA, 20 bp, Artificial Sequence
  chemically synthesized
tgctaggaaatatcccaaaa

SEQ ID NO: 40697 - DNA, 20 bp, Artificial Sequence
  chemically synthesized
tccagggctcatatggcaat

SEQ ID NO: 40698 - DNA, 20 bp, Artificial Sequence
  chemically synthesized
atatggcaatggggatttaa

SEQ ID NO: 40699 - DNA, 20 bp, Artificial Sequence
  chemically synthesized
atgtattttattaatggtgt

SEQ ID NO: 40700 - DNA, 20 bp, Artificial Sequence
  chemically synthesized
tttcttcctcactgtggtgt

SEQ ID NO: 40701 - DNA, 20 bp, Artificial Sequence
  chemically synthesized
tgtaaaagacttagcaattt

SEQ ID NO: 40702 - DNA, 20 bp, Artificial Sequence
  chemically synthesized
ctttccaaaagagcttatca

SEQ ID NO: 40703 - DNA, 20 bp, Artificial Sequence
  chemically synthesized
agagaagtttgttctagcct

SEQ ID NO: 40704 - DNA, 20 bp, Artificial Sequence
  chemically synthesized
tagcctttgggtgtagcctg

SEQ ID NO: 40705 - DNA, 20 bp, Artificial Sequence
  chemically synthesized
ctagtttccatgggctgaaa

SEQ ID NO: 40706 - DNA, 20 bp, Artificial Sequence
  chemically synthesized
gtattttctttgatattttc

SEQ ID NO: 40707 - DNA, 20 bp, Artificial Sequence
  chemically synthesized
tgtgcttcaagatggaactc

SEQ ID NO: 40708 - DNA, 20 bp, Artificial Sequence
  chemically synthesized
ggcaactgctcaactacctg

SEQ ID NO: 40709 - DNA, 20 bp, Artificial Sequence
  chemically synthesized
gcccaagctagcatggaccc

SEQ ID NO: 40710 - DNA, 20 bp, Artificial Sequence
  chemically synthesized
ccagacttctctcttcttaa

SEQ ID NO: 40711 - DNA, 20 bp, Artificial Sequence
  chemically synthesized
aacctgctcttcagttacat

SEQ ID NO: 40712 - DNA, 20 bp, Artificial Sequence
  chemically synthesized
tttctttatttccttgattt

SEQ ID NO: 40713 - DNA, 20 bp, Artificial Sequence
  chemically synthesized
gatttctttgtttataaaat

SEQ ID NO: 40714 - DNA, 20 bp, Artificial Sequence
  chemically synthesized
taacccactcaacaaatacc

SEQ ID NO: 40715 - DNA, 20 bp, Artificial Sequence
  chemically synthesized
acaaataccctgagtatttg

SEQ ID NO: 40716 - DNA, 20 bp, Artificial Sequence
  chemically synthesized
atgcgtatatcatctggcaa

SEQ ID NO: 40717 - DNA, 20 bp, Artificial Sequence
  chemically synthesized
tggatgtgtataatttctcc

SEQ ID NO: 40718 - DNA, 20 bp, Artificial Sequence
  chemically synthesized
ccataacaaagagagaaatg

SEQ ID NO: 40719 - DNA, 20 bp, Artificial Sequence
  chemically synthesized
caaggaaccaaacatattca

SEQ ID NO: 40720 - DNA, 20 bp, Artificial Sequence
  chemically synthesized
gaaattaaacttattttttt

SEQ ID NO: 40721 - DNA, 20 bp, Artificial Sequence
  chemically synthesized
catatacaagattttgaact

SEQ ID NO: 40722 - DNA, 20 bp, Artificial Sequence
  chemically synthesized
gattttgaactgggaatttc

SEQ ID NO: 40723 - DNA, 20 bp, Artificial Sequence
  chemically synthesized
tttcatgaatcaaaaattaa

SEQ ID NO: 40724 - DNA, 20 bp, Artificial Sequence
  chemically synthesized
aggacattgttgacttacat

SEQ ID NO: 40725 - DNA, 20 bp, Artificial Sequence
  chemically synthesized
gacccatgccactggctcag

SEQ ID NO: 40726 - DNA, 20 bp, Artificial Sequence
  chemically synthesized
agcagggttcaaacattacc

SEQ ID NO: 40727 - DNA, 20 bp, Artificial Sequence
  chemically synthesized
ttcaaacattaccttgaata

SEQ ID NO: 40728 - DNA, 20 bp, Artificial Sequence
  chemically synthesized
tagagtcttataaaatattt

SEQ ID NO: 40729 - DNA, 20 bp, Artificial Sequence
  chemically synthesized
cttctttcattctctttctt

SEQ ID NO: 40730 - DNA, 20 bp, Artificial Sequence
  chemically synthesized
ccgaggttgtgtcgctaccc

SEQ ID NO: 40731 - DNA, 20 bp, Artificial Sequence
  chemically synthesized
agatatcaatccttccagga

SEQ ID NO: 40732 - DNA, 20 bp, Artificial Sequence
  chemically synthesized
attttgggaggccacggcag

SEQ ID NO: 40733 - DNA, 20 bp, Artificial Sequence
  chemically synthesized
cagatggatcacctgaggcc

SEQ ID NO: 40734 - DNA, 20 bp, Artificial Sequence
  chemically synthesized
acaaaaaatacaaaaattag

SEQ ID NO: 40735 - DNA, 20 bp, Artificial Sequence
  chemically synthesized
tactaagtaggctgaggcac

SEQ ID NO: 40736 - DNA, 20 bp, Artificial Sequence
  chemically synthesized
gatggaggttgcagtgagcc

SEQ ID NO: 40737 - DNA, 20 bp, Artificial Sequence
  chemically synthesized
atgtgccactgcactccagc

SEQ ID NO: 40738 - DNA, 20 bp, Artificial Sequence
  chemically synthesized
tccagcctgggtgacagagc

SEQ ID NO: 40739 - DNA, 20 bp, Artificial Sequence
  chemically synthesized
atatttttaaaaataaaaca

SEQ ID NO: 40740 - DNA, 20 bp, Artificial Sequence
  chemically synthesized
tttaaaaataaaacataggg

SEQ ID NO: 40741 - DNA, 20 bp, Artificial Sequence
  chemically synthesized
actttgggaggccaagacag

SEQ ID NO: 40742 - DNA, 20 bp, Artificial Sequence
  chemically synthesized
gacaggtggatcacaaggtc

SEQ ID NO: 40743 - DNA, 20 bp, Artificial Sequence
  chemically synthesized
atcccagctactagggaggc

SEQ ID NO: 40744 - DNA, 20 bp, Artificial Sequence
  chemically synthesized
tcacgtcagtgcacttcaac

SEQ ID NO: 40745 - DNA, 20 bp, Artificial Sequence
  chemically synthesized
cagtgcacttcaaccggggt

SEQ ID NO: 40746 - DNA, 20 bp, Artificial Sequence
  chemically synthesized
tagtatcaatctttccgcaa

SEQ ID NO: 40747 - DNA, 20 bp, Artificial Sequence
  chemically synthesized
tcgttctcatgaagtaaagc

SEQ ID NO: 40748 - DNA, 20 bp, Artificial Sequence
  chemically synthesized
atgaagtaaagcaagagtgg

SEQ ID NO: 40749 - DNA, 20 bp, Artificial Sequence
  chemically synthesized
gagtggtagaattaagtgga

SEQ ID NO: 40750 - DNA, 20 bp, Artificial Sequence
  chemically synthesized
tggccaccgggacaccccag

SEQ ID NO: 40751 - DNA, 20 bp, Artificial Sequence
  chemically synthesized
caccgggacaccccaggagg

SEQ ID NO: 40752 - DNA, 20 bp, Artificial Sequence
  chemically synthesized
tcaagccccaagaagtcccc

SEQ ID NO: 40753 - DNA, 20 bp, Artificial Sequence
  chemically synthesized
aagaagtccccttggatgat

SEQ ID NO: 40754 - DNA, 20 bp, Artificial Sequence
  chemically synthesized
atacatttgggacagatcta

SEQ ID NO: 40755 - DNA, 20 bp, Artificial Sequence
  chemically synthesized
tttctgagcaacacttagac

SEQ ID NO: 40756 - DNA, 20 bp, Artificial Sequence
  chemically synthesized
ttccattgattaaatcctac

SEQ ID NO: 40757 - DNA, 20 bp, Artificial Sequence
  chemically synthesized
aatgcccagcacagagctca

SEQ ID NO: 40758 - DNA, 20 bp, Artificial Sequence
  chemically synthesized
gccagactctctgaaccctg

SEQ ID NO: 40759 - DNA, 20 bp, Artificial Sequence
  chemically synthesized
ggagagtgtaaacgtcatat

SEQ ID NO: 40760 - DNA, 20 bp, Artificial Sequence
  chemically synthesized
agagtctatgttccaaaaac

SEQ ID NO: 40761 - DNA, 20 bp, Artificial Sequence
  chemically synthesized
tctttgcttttaaaaccata

SEQ ID NO: 40762 - DNA, 20 bp, Artificial Sequence
  chemically synthesized
taaagaataatgtttaaatg

SEQ ID NO: 40763 - DNA, 20 bp, Artificial Sequence
  chemically synthesized
ttttcactcaacattacata

SEQ ID NO: 40764 - DNA, 20 bp, Artificial Sequence
  chemically synthesized
atgagcatgaggtttccttt

SEQ ID NO: 40765 - DNA, 20 bp, Artificial Sequence
  chemically synthesized
gatgatggttgcacaccact

SEQ ID NO: 40766 - DNA, 20 bp, Artificial Sequence
  chemically synthesized
tacattttattgcaataaaa

SEQ ID NO: 40767 - DNA, 20 bp, Artificial Sequence
  chemically synthesized
ttgtctagttcaacctgagc

SEQ ID NO: 40768 - DNA, 20 bp, Artificial Sequence
  chemically synthesized
tcaacctgagcctgggtctg

SEQ ID NO: 40769 - DNA, 20 bp, Artificial Sequence
  chemically synthesized
aatcacttcaccacacttgt

SEQ ID NO: 40770 - DNA, 20 bp, Artificial Sequence
  chemically synthesized
atacttctttgacaatttgg

SEQ ID NO: 40771 - DNA, 20 bp, Artificial Sequence
  chemically synthesized
ttttccagatggacacaccc

SEQ ID NO: 40772 - DNA, 20 bp, Artificial Sequence
  chemically synthesized
tttgcaagcccagctttcat

SEQ ID NO: 40773 - DNA, 20 bp, Artificial Sequence
  chemically synthesized
ttcagaaacctgactgcatc

SEQ ID NO: 40774 - DNA, 20 bp, Artificial Sequence
  chemically synthesized
tgactaccaagcatcgggca

SEQ ID NO: 40775 - DNA, 20 bp, Artificial Sequence
  chemically synthesized
tgtgagggagcaccgttctc

SEQ ID NO: 40776 - DNA, 20 bp, Artificial Sequence
  chemically synthesized
caggaaagttgatgtggtct

SEQ ID NO: 40777 - DNA, 20 bp, Artificial Sequence
  chemically synthesized
aggtaggccacaggtgacaa

SEQ ID NO: 40778 - DNA, 20 bp, Artificial Sequence
  chemically synthesized
gggccttggggagagggcag

SEQ ID NO: 40779 - DNA, 20 bp, Artificial Sequence
  chemically synthesized
cagcagggtaagtccagcgg

SEQ ID NO: 40780 - DNA, 20 bp, Artificial Sequence
  chemically synthesized
gcaggatcagtccattgatt

SEQ ID NO: 40781 - DNA, 20 bp, Artificial Sequence
  chemically synthesized
tagaaaattgatgaacaggc

SEQ ID NO: 40782 - DNA, 20 bp, Artificial Sequence
  chemically synthesized
catggtctagttagtgttct

SEQ ID NO: 40783 - DNA, 20 bp, Artificial Sequence
  chemically synthesized
ggcgaggcagaagcctagtg

SEQ ID NO: 40784 - DNA, 20 bp, Artificial Sequence
  chemically synthesized
gggatggtggttagaaatgt

SEQ ID NO: 40785 - DNA, 20 bp, Artificial Sequence
  chemically synthesized
ggtaataattgtgatggtgg

SEQ ID NO: 40786 - DNA, 20 bp, Artificial Sequence
  chemically synthesized
gaatgatgatgatggtggtg

SEQ ID NO: 40787 - DNA, 20 bp, Artificial Sequence
  chemically synthesized
gatgataatggtgatggtgg

SEQ ID NO: 40788 - DNA, 20 bp, Artificial Sequence
  chemically synthesized
atggtggtggtgatgatgtt

SEQ ID NO: 40789 - DNA, 20 bp, Artificial Sequence
  chemically synthesized
ggtaatgataatggtgatgg

SEQ ID NO: 40790 - DNA, 20 bp, Artificial Sequence
  chemically synthesized
tggaatgatggtgatggtgg

SEQ ID NO: 40791 - DNA, 20 bp, Artificial Sequence
  chemically synthesized
gtggaatgatgatggtggtg

SEQ ID NO: 40792 - DNA, 20 bp, Artificial Sequence
  chemically synthesized
gtgatgatggtgatgatgtt

SEQ ID NO: 40793 - DNA, 20 bp, Artificial Sequence
  chemically synthesized
gtttccaggtgttccctgac

SEQ ID NO: 40794 - DNA, 20 bp, Artificial Sequence
  chemically synthesized
tccctgacttggatcaaatg

SEQ ID NO: 40795 - DNA, 20 bp, Artificial Sequence
  chemically synthesized
tttggaggtgttgaggccaa

SEQ ID NO: 40796 - DNA, 20 bp, Artificial Sequence
  chemically synthesized
tgacatctctatgtcggcca

SEQ ID NO: 40797 - DNA, 20 bp, Artificial Sequence
  chemically synthesized
cggtaggttttcaccattat

SEQ ID NO: 40798 - DNA, 20 bp, Artificial Sequence
  chemically synthesized
gattgagctgagctggcctc

SEQ ID NO: 40799 - DNA, 20 bp, Artificial Sequence
  chemically synthesized
aggctctgggggaagaaaga

SEQ ID NO: 40800 - DNA, 20 bp, Artificial Sequence
  chemically synthesized
ctgtgccatgctcgcaaagc

SEQ ID NO: 40801 - DNA, 20 bp, Artificial Sequence
  chemically synthesized
gggcttgcaaaattagaaaa

SEQ ID NO: 40802 - DNA, 20 bp, Artificial Sequence
  chemically synthesized
gtgagaacactgaaacatcc

SEQ ID NO: 40803 - DNA, 20 bp, Artificial Sequence
  chemically synthesized
caattttgcaaccgttctat

SEQ ID NO: 40804 - DNA, 20 bp, Artificial Sequence
  chemically synthesized
aataaagcagtttttcacaa

SEQ ID NO: 40805 - DNA, 20 bp, Artificial Sequence
  chemically synthesized
aaaagaataaacacaaccag

SEQ ID NO: 40806 - DNA, 20 bp, Artificial Sequence
  chemically synthesized
aaagaagtataaattagaaa

SEQ ID NO: 40807 - DNA, 20 bp, Artificial Sequence
  chemically synthesized
cttaggctcagaaaatatta

SEQ ID NO: 40808 - DNA, 20 bp, Artificial Sequence
  chemically synthesized
ctcagaaaatattaaggaat

SEQ ID NO: 40809 - DNA, 20 bp, Artificial Sequence
  chemically synthesized
actttatgaacaaagatgtg

SEQ ID NO: 40810 - DNA, 20 bp, Artificial Sequence
  chemically synthesized
agtttccttaactgtagagc

SEQ ID NO: 40811 - DNA, 20 bp, Artificial Sequence
  chemically synthesized
ctgtttcataggactgttgt

SEQ ID NO: 40812 - DNA, 20 bp, Artificial Sequence
  chemically synthesized
attataagcttgtgcctgga

SEQ ID NO: 40813 - DNA, 20 bp, Artificial Sequence
  chemically synthesized
caataaaatgtacacagcgt

SEQ ID NO: 40814 - DNA, 20 bp, Artificial Sequence
  chemically synthesized
tactattttaaccatttttg

SEQ ID NO: 40815 - DNA, 20 bp, Artificial Sequence
  chemically synthesized
tgcaaccatcatcatatttc

SEQ ID NO: 40816 - DNA, 20 bp, Artificial Sequence
  chemically synthesized
acaaaactcattatgtaatg

SEQ ID NO: 40817 - DNA, 20 bp, Artificial Sequence
  chemically synthesized
gtaatgttgagtgaaaaaat

SEQ ID NO: 40818 - DNA, 20 bp, Artificial Sequence
  chemically synthesized
tatatgacgtttacactctc

SEQ ID NO: 40819 - DNA, 20 bp, Artificial Sequence
  chemically synthesized
tttacactctccagggttca

SEQ ID NO: 40820 - DNA, 20 bp, Artificial Sequence
  chemically synthesized
tcaccactgctctgttcttc

SEQ ID NO: 40821 - DNA, 20 bp, Artificial Sequence
  chemically synthesized
aagcccagctccctgtgatt

SEQ ID NO: 40822 - DNA, 20 bp, Artificial Sequence
  chemically synthesized
gaatgaagtgtgcaatcgct

SEQ ID NO: 40823 - DNA, 20 bp, Artificial Sequence
  chemically synthesized
tgtgcaatcgctatgagttt

SEQ ID NO: 40824 - DNA, 20 bp, Artificial Sequence
  chemically synthesized
cgctatgagtttctgaatgg

SEQ ID NO: 40825 - DNA, 20 bp, Artificial Sequence
  chemically synthesized
tcagtctcagtcccttagac

SEQ ID NO: 40826 - DNA, 20 bp, Artificial Sequence
  chemically synthesized
tagacttgagtcccaaagta

SEQ ID NO: 40827 - DNA, 20 bp, Artificial Sequence
  chemically synthesized
cccaaagtagcgaattcaag

SEQ ID NO: 40828 - DNA, 20 bp, Artificial Sequence
  chemically synthesized
ccaaggggacttcttggggc

SEQ ID NO: 40829 - DNA, 20 bp, Artificial Sequence
  chemically synthesized
cctcagaccactcaccctcc

SEQ ID NO: 40830 - DNA, 20 bp, Artificial Sequence
  chemically synthesized
ttctggtagggaaggaggta

SEQ ID NO: 40831 - DNA, 20 bp, Artificial Sequence
  chemically synthesized
gctcagatattgctgatgat

SEQ ID NO: 40832 - DNA, 20 bp, Artificial Sequence
  chemically synthesized
aattgatttacaactggggc

SEQ ID NO: 40833 - DNA, 20 bp, Artificial Sequence
  chemically synthesized
cgaaaatgtaagattgcacc

SEQ ID NO: 40834 - DNA, 20 bp, Artificial Sequence
  chemically synthesized
ctcactgcaacttccacctc

SEQ ID NO: 40835 - DNA, 20 bp, Artificial Sequence
  chemically synthesized
cttccacctcctgggttcaa

SEQ ID NO: 40836 - DNA, 20 bp, Artificial Sequence
  chemically synthesized
actccagcctccctagtagc

SEQ ID NO: 40837 - DNA, 20 bp, Artificial Sequence
  chemically synthesized
ttttgtatttttagtagaga

SEQ ID NO: 40838 - DNA, 20 bp, Artificial Sequence
  chemically synthesized
gtcttggcctcccaaagtgc

SEQ ID NO: 40839 - DNA, 20 bp, Artificial Sequence
  chemically synthesized
ctcccaaagtgctgggatta

SEQ ID NO: 40840 - DNA, 20 bp, Artificial Sequence
  chemically synthesized
tttatttaagccacaactac

SEQ ID NO: 40841 - DNA, 20 bp, Artificial Sequence
  chemically synthesized
gccacaactactagaatagg

SEQ ID NO: 40842 - DNA, 20 bp, Artificial Sequence
  chemically synthesized
tcttgctctgtcacccaggc

SEQ ID NO: 40843 - DNA, 20 bp, Artificial Sequence
  chemically synthesized
gcctcagcctacttagtagc

SEQ ID NO: 40844 - DNA, 20 bp, Artificial Sequence
  chemically synthesized
ttttgtattttttgtagaga

SEQ ID NO: 40845 - DNA, 20 bp, Artificial Sequence
  chemically synthesized
gccgtggcctcccaaaatgc

SEQ ID NO: 40846 - DNA, 20 bp, Artificial Sequence
  chemically synthesized
gagccaccaccccctcctgg

SEQ ID NO: 40847 - DNA, 20 bp, Artificial Sequence
  chemically synthesized
tttataattacagaaaacat

SEQ ID NO: 40848 - DNA, 20 bp, Artificial Sequence
  chemically synthesized
agaaaacatgtgagttcact

SEQ ID NO: 40849 - DNA, 20 bp, Artificial Sequence
  chemically synthesized
catttcggcacagtttggta

SEQ ID NO: 40850 - DNA, 20 bp, Artificial Sequence
  chemically synthesized
gctcgtaaactaagacctga

SEQ ID NO: 40851 - DNA, 20 bp, Artificial Sequence
  chemically synthesized
tgtgtctatcagctgcaccc

SEQ ID NO: 40852 - DNA, 20 bp, Artificial Sequence
  chemically synthesized
tggaaagcttgagggaggct

SEQ ID NO: 40853 - DNA, 20 bp, Artificial Sequence
  chemically synthesized
tggatgtgcagcacttggca

SEQ ID NO: 40854 - DNA, 20 bp, Artificial Sequence
  chemically synthesized
tttattttatccaaaagaaa

SEQ ID NO: 40855 - DNA, 20 bp, Artificial Sequence
  chemically synthesized
atcaggaaagatgaaggtct

SEQ ID NO: 40856 - DNA, 20 bp, Artificial Sequence
  chemically synthesized
gaaggtctaggggtgaggga

SEQ ID NO: 40857 - DNA, 20 bp, Artificial Sequence
  chemically synthesized
aaccctgctgagccagtggc

SEQ ID NO: 40858 - DNA, 20 bp, Artificial Sequence
  chemically synthesized
ccagtggcatgggtctctga

SEQ ID NO: 40859 - DNA, 20 bp, Artificial Sequence
  chemically synthesized
ttaatttgactatctggttt

SEQ ID NO: 40860 - DNA, 20 bp, Artificial Sequence
  chemically synthesized
catgtaagtcaacaatgtcc

SEQ ID NO: 40861 - DNA, 20 bp, Artificial Sequence
  chemically synthesized
acatagtttttttaaattat

SEQ ID NO: 40862 - DNA, 20 bp, Artificial Sequence
  chemically synthesized
cgtgaagactgtcacggtgc

SEQ ID NO: 40863 - DNA, 20 bp, Artificial Sequence
  chemically synthesized
aagactgtcacggtgctgga

SEQ ID NO: 40864 - DNA, 20 bp, Artificial Sequence
  chemically synthesized
ggttgatttttctaatctaa

SEQ ID NO: 40865 - DNA, 20 bp, Artificial Sequence
  chemically synthesized
ccattgtagctaactatgca

SEQ ID NO: 40866 - DNA, 20 bp, Artificial Sequence
  chemically synthesized
tgaaacaatgaaataactct

SEQ ID NO: 40867 - DNA, 20 bp, Artificial Sequence
  chemically synthesized
ttggttccttgacctgttca

SEQ ID NO: 40868 - DNA, 20 bp, Artificial Sequence
  chemically synthesized
atttctctctttgttatggc

SEQ ID NO: 40869 - DNA, 20 bp, Artificial Sequence
  chemically synthesized
ataatgattcaacaaatact

SEQ ID NO: 40870 - DNA, 20 bp, Artificial Sequence
  chemically synthesized
acaaatactcagggtatttg

SEQ ID NO: 40871 - DNA, 20 bp, Artificial Sequence
  chemically synthesized
atactcagggtatttgttga

SEQ ID NO: 40872 - DNA, 20 bp, Artificial Sequence
  chemically synthesized
catacacaccgtgtgtgatt

SEQ ID NO: 40873 - DNA, 20 bp, Artificial Sequence
  chemically synthesized
tatttagctcatggtatagg

SEQ ID NO: 40874 - DNA, 20 bp, Artificial Sequence
  chemically synthesized
aatcaaggaaataaagaaac

SEQ ID NO: 40875 - DNA, 20 bp, Artificial Sequence
  chemically synthesized
ggttaattgtttgccacttg

SEQ ID NO: 40876 - DNA, 20 bp, Artificial Sequence
  chemically synthesized
aggcaacagaggaggcgagc

SEQ ID NO: 40877 - DNA, 20 bp, Artificial Sequence
  chemically synthesized
gaggaggcgagcaaggattc

SEQ ID NO: 40878 - DNA, 20 bp, Artificial Sequence
  chemically synthesized
cctgctggtgcctttgtgag

SEQ ID NO: 40879 - DNA, 20 bp, Artificial Sequence
  chemically synthesized
tcccttgaggcaaatctctg

SEQ ID NO: 40880 - DNA, 20 bp, Artificial Sequence
  chemically synthesized
gaggcaaatctctggagggt

SEQ ID NO: 40881 - DNA, 20 bp, Artificial Sequence
  chemically synthesized
tataaatcacctgtgaactc

SEQ ID NO: 40882 - DNA, 20 bp, Artificial Sequence
  chemically synthesized
agatgaacttgccctgcagg

SEQ ID NO: 40883 - DNA, 20 bp, Artificial Sequence
  chemically synthesized
gactttaaagtcaaacacat

SEQ ID NO: 40884 - DNA, 20 bp, Artificial Sequence
  chemically synthesized
gagcaggagaagattaagca

SEQ ID NO: 40885 - DNA, 20 bp, Artificial Sequence
  chemically synthesized
tgtctatgtctgtgtgtgta

SEQ ID NO: 40886 - DNA, 20 bp, Artificial Sequence
  chemically synthesized
ctgtgtgtgtagggagtgca

SEQ ID NO: 40887 - DNA, 20 bp, Artificial Sequence
  chemically synthesized
gtgtagggagtgcaggggat

SEQ ID NO: 40888 - DNA, 20 bp, Artificial Sequence
  chemically synthesized
ctatttcagcccatggaaac

SEQ ID NO: 40889 - DNA, 20 bp, Artificial Sequence
  chemically synthesized
tagaacaaacttctctgcca

SEQ ID NO: 40890 - DNA, 20 bp, Artificial Sequence
  chemically synthesized
gttatctttccaatgtgtgc

SEQ ID NO: 40891 - DNA, 20 bp, Artificial Sequence
  chemically synthesized
ttgccatatgagccctggag

SEQ ID NO: 40892 - DNA, 20 bp, Artificial Sequence
  chemically synthesized
gaggtgaatcagagaaacaa

SEQ ID NO: 40893 - DNA, 20 bp, Artificial Sequence
  chemically synthesized
aagaaaaattgattctgttt

SEQ ID NO: 40894 - DNA, 20 bp, Artificial Sequence
  chemically synthesized
ctagcaacatgagctgggga

SEQ ID NO: 40895 - DNA, 20 bp, Artificial Sequence
  chemically synthesized
taaatggaagtttcctcttt

SEQ ID NO: 40896 - DNA, 20 bp, Artificial Sequence
  chemically synthesized
tgaagtcacactgtgagcta

SEQ ID NO: 40897 - DNA, 20 bp, Artificial Sequence
  chemically synthesized
gcacaactcttcctggaaaa

SEQ ID NO: 40898 - DNA, 20 bp, Artificial Sequence
  chemically synthesized
agttcaaatgagaaacagtg

SEQ ID NO: 40899 - DNA, 20 bp, Artificial Sequence
  chemically synthesized
aaacagtgcggggtgaagac

SEQ ID NO: 40900 - DNA, 20 bp, Artificial Sequence
  chemically synthesized
tatctatcaagtgcttttta

SEQ ID NO: 40901 - DNA, 20 bp, Artificial Sequence
  chemically synthesized
gctttttagtggattaggtt

SEQ ID NO: 40902 - DNA, 20 bp, Artificial Sequence
  chemically synthesized
aggtcaggacaggcctttct

SEQ ID NO: 40903 - DNA, 20 bp, Artificial Sequence
  chemically synthesized
ggacaggcctttctgagaat

SEQ ID NO: 40904 - DNA, 20 bp, Artificial Sequence
  chemically synthesized
tctgttcatctgcctttcta

SEQ ID NO: 40905 - DNA, 20 bp, Artificial Sequence
  chemically synthesized
tcctaaggagcctcaggaca

SEQ ID NO: 40906 - DNA, 20 bp, Artificial Sequence
  chemically synthesized
tttacaatttcctctgaaat

SEQ ID NO: 40907 - DNA, 20 bp, Artificial Sequence
  chemically synthesized
ctatcaacaccttggaaaaa

SEQ ID NO: 40908 - DNA, 20 bp, Artificial Sequence
  chemically synthesized
tccaaggttcatttctacac

SEQ ID NO: 40909 - DNA, 20 bp, Artificial Sequence
  chemically synthesized
caggaggtggaagcccctga

SEQ ID NO: 40910 - DNA, 20 bp, Artificial Sequence
  chemically synthesized
cctgagagaatggaggtctg

SEQ ID NO: 40911 - DNA, 20 bp, Artificial Sequence
  chemically synthesized
ccaagtcctgcatgctagac

SEQ ID NO: 40912 - DNA, 20 bp, Artificial Sequence
  chemically synthesized
ctagacatgagtggaggagg

SEQ ID NO: 40913 - DNA, 20 bp, Artificial Sequence
  chemically synthesized
gggggaatacctaggtagaa

SEQ ID NO: 40914 - DNA, 20 bp, Artificial Sequence
  chemically synthesized
tcactgtgcagttaactttt

SEQ ID NO: 40915 - DNA, 20 bp, Artificial Sequence
  chemically synthesized
cggttgcagttagtatacat

SEQ ID NO: 40916 - DNA, 20 bp, Artificial Sequence
  chemically synthesized
tgagtgctatacaaccttct

SEQ ID NO: 40917 - DNA, 20 bp, Artificial Sequence
  chemically synthesized
gaagcaatgcagccattacg

SEQ ID NO: 40918 - DNA, 20 bp, Artificial Sequence
  chemically synthesized
taaaaagtatttctttaggt

SEQ ID NO: 40919 - DNA, 20 bp, Artificial Sequence
  chemically synthesized
ctacgcattgacttatcttc

SEQ ID NO: 40920 - DNA, 20 bp, Artificial Sequence
  chemically synthesized
cctccagcacacagcaggga

SEQ ID NO: 40921 - DNA, 20 bp, Artificial Sequence
  chemically synthesized
ggctgcactctgtgtttttg

SEQ ID NO: 40922 - DNA, 20 bp, Artificial Sequence
  chemically synthesized
ctagggaaggaaaaaagatc

SEQ ID NO: 40923 - DNA, 20 bp, Artificial Sequence
  chemically synthesized
ctgcccccaagctgtagagc

SEQ ID NO: 40924 - DNA, 20 bp, Artificial Sequence
  chemically synthesized
gcctacatctttctcctgtg

SEQ ID NO: 40925 - DNA, 20 bp, Artificial Sequence
  chemically synthesized
ttatgggaccttgtaatctt

SEQ ID NO: 40926 - DNA, 20 bp, Artificial Sequence
  chemically synthesized
cttaataagctcccctttgt

SEQ ID NO: 40927 - DNA, 20 bp, Artificial Sequence
  chemically synthesized
cagaagtggttcttgaggaa

SEQ ID NO: 40928 - DNA, 20 bp, Artificial Sequence
  chemically synthesized
ttcttgaggaacagaatatt

SEQ ID NO: 40929 - DNA, 20 bp, Artificial Sequence
  chemically synthesized
gaggaacagaatattaagga

SEQ ID NO: 40930 - DNA, 20 bp, Artificial Sequence
  chemically synthesized
gaacactgatagtacttggc

SEQ ID NO: 40931 - DNA, 20 bp, Artificial Sequence
  chemically synthesized
tacttggcctgaattgttta

SEQ ID NO: 40932 - DNA, 20 bp, Artificial Sequence
  chemically synthesized
ttcatcacttatgagaggca

SEQ ID NO: 40933 - DNA, 20 bp, Artificial Sequence
  chemically synthesized
gaaagaaaatgatgatctca

SEQ ID NO: 40934 - DNA, 20 bp, Artificial Sequence
  chemically synthesized
acaaatctgctaagattgcc

SEQ ID NO: 40935 - DNA, 20 bp, Artificial Sequence
  chemically synthesized
ctgctaagattgccctgaat

SEQ ID NO: 40936 - DNA, 20 bp, Artificial Sequence
  chemically synthesized
agttttaactcctgtagaga

SEQ ID NO: 40937 - DNA, 20 bp, Artificial Sequence
  chemically synthesized
cagagacaagctgttatcat

SEQ ID NO: 40938 - DNA, 20 bp, Artificial Sequence
  chemically synthesized
aaaaatgggaccctggaact

SEQ ID NO: 40939 - DNA, 20 bp, Artificial Sequence
  chemically synthesized
gggaccctggaacttggagt

SEQ ID NO: 40940 - DNA, 20 bp, Artificial Sequence
  chemically synthesized
ccctgatgaagctgaggaca

SEQ ID NO: 40941 - DNA, 20 bp, Artificial Sequence
  chemically synthesized
tagcctttccacctttgtct

SEQ ID NO: 40942 - DNA, 20 bp, Artificial Sequence
  chemically synthesized
aagaggcacccctaatgccc

SEQ ID NO: 40943 - DNA, 20 bp, Artificial Sequence
  chemically synthesized
cgggccccagaggtgaggtt

SEQ ID NO: 40944 - DNA, 20 bp, Artificial Sequence
  chemically synthesized
gaaatctggagaacaggcat

SEQ ID NO: 40945 - DNA, 20 bp, Artificial Sequence
  chemically synthesized
tctggagaacaggcatggga

SEQ ID NO: 40946 - DNA, 20 bp, Artificial Sequence
  chemically synthesized
caggcatgggaatggatatt

SEQ ID NO: 40947 - DNA, 20 bp, Artificial Sequence
  chemically synthesized
gggaatggatattaagggta

SEQ ID NO: 40948 - DNA, 20 bp, Artificial Sequence
  chemically synthesized
ggataatggtggaagggaca

SEQ ID NO: 40949 - DNA, 20 bp, Artificial Sequence
  chemically synthesized
atggtggaagggacatagag

SEQ ID NO: 40950 - DNA, 20 bp, Artificial Sequence
  chemically synthesized
ggacatagagttggatcaag

SEQ ID NO: 40951 - DNA, 20 bp, Artificial Sequence
  chemically synthesized
ttggtttggccctactaagt

SEQ ID NO: 40952 - DNA, 20 bp, Artificial Sequence
  chemically synthesized
tttgcttggttagctgaaat

SEQ ID NO: 40953 - DNA, 20 bp, Artificial Sequence
  chemically synthesized
atccaaaggcttagggagat

SEQ ID NO: 40954 - DNA, 20 bp, Artificial Sequence
  chemically synthesized
gcttagggagattaggatgg

SEQ ID NO: 40955 - DNA, 20 bp, Artificial Sequence
  chemically synthesized
agggagattaggatggtgga

SEQ ID NO: 40956 - DNA, 20 bp, Artificial Sequence
  chemically synthesized
gacctactcatcccagctgg

SEQ ID NO: 40957 - DNA, 20 bp, Artificial Sequence
  chemically synthesized
ctacaaaatttaaatacaat

SEQ ID NO: 40958 - DNA, 20 bp, Artificial Sequence
  chemically synthesized
tttaaatacaatgggaataa

SEQ ID NO: 40959 - DNA, 20 bp, Artificial Sequence
  chemically synthesized
agcagaggcaaagcagccat

SEQ ID NO: 40960 - DNA, 20 bp, Artificial Sequence
  chemically synthesized
ataaacaaaaaactgccagg

SEQ ID NO: 40961 - DNA, 20 bp, Artificial Sequence
  chemically synthesized
agaatggactaaagactaat

SEQ ID NO: 40962 - DNA, 20 bp, Artificial Sequence
  chemically synthesized
taatctgaattataaaaaca

SEQ ID NO: 40963 - DNA, 20 bp, Artificial Sequence
  chemically synthesized
tgttacagttccagaaccca

SEQ ID NO: 40964 - DNA, 20 bp, Artificial Sequence
  chemically synthesized
cccactgaatgaaggggagg

SEQ ID NO: 40965 - DNA, 20 bp, Artificial Sequence
  chemically synthesized
ggagacctctggccttttac

SEQ ID NO: 40966 - DNA, 20 bp, Artificial Sequence
  chemically synthesized
ctctgagctgacgttgattc

SEQ ID NO: 40967 - DNA, 20 bp, Artificial Sequence
  chemically synthesized
tatggaggttaggtaattaa

SEQ ID NO: 40968 - DNA, 20 bp, Artificial Sequence
  chemically synthesized
tctgacttacagtggttcca

SEQ ID NO: 40969 - DNA, 20 bp, Artificial Sequence
  chemically synthesized
cacattggctccctgactgg

SEQ ID NO: 40970 - DNA, 20 bp, Artificial Sequence
  chemically synthesized
atcaaggacttgaaagacgc

SEQ ID NO: 40971 - DNA, 20 bp, Artificial Sequence
  chemically synthesized
ttgacctgtgcagaggacag

SEQ ID NO: 40972 - DNA, 20 bp, Artificial Sequence
  chemically synthesized
atggatcttggaaaatgatg

SEQ ID NO: 40973 - DNA, 20 bp, Artificial Sequence
  chemically synthesized
tacctttaccaccctacctc

SEQ ID NO: 40974 - DNA, 20 bp, Artificial Sequence
  chemically synthesized
cattcatgacattatgatga

SEQ ID NO: 40975 - DNA, 20 bp, Artificial Sequence
  chemically synthesized
ggtgagacatttgtatgcca

SEQ ID NO: 40976 - DNA, 20 bp, Artificial Sequence
  chemically synthesized
ttctacctcggtaaaatttc

SEQ ID NO: 40977 - DNA, 20 bp, Artificial Sequence
  chemically synthesized
acaatgcctggtgggcctat

SEQ ID NO: 40978 - DNA, 20 bp, Artificial Sequence
  chemically synthesized
ggaggcaacacattcctcgt

SEQ ID NO: 40979 - DNA, 20 bp, Artificial Sequence
  chemically synthesized
gtgttactctggcccattta

SEQ ID NO: 40980 - DNA, 20 bp, Artificial Sequence
  chemically synthesized
ttgaggtgtcagtggcagat

SEQ ID NO: 40981 - DNA, 20 bp, Artificial Sequence
  chemically synthesized
cctttggcaggcccccatag

SEQ ID NO: 40982 - DNA, 20 bp, Artificial Sequence
  chemically synthesized
tgaatcacagtggagacctc

SEQ ID NO: 40983 - DNA, 20 bp, Artificial Sequence
  chemically synthesized
tggtaactgaacgtttgact

SEQ ID NO: 40984 - DNA, 20 bp, Artificial Sequence
  chemically synthesized
ctgacccatctagccatgaa

SEQ ID NO: 40985 - DNA, 20 bp, Artificial Sequence
  chemically synthesized
cctgcaccaatggcctcatg

SEQ ID NO: 40986 - DNA, 20 bp, Artificial Sequence
  chemically synthesized
tatgtaataacttttggttt

SEQ ID NO: 40987 - DNA, 20 bp, Artificial Sequence
  chemically synthesized
tggtgcgtttctggttgtat

SEQ ID NO: 40988 - DNA, 20 bp, Artificial Sequence
  chemically synthesized
ttgaagattatgtatgattt

SEQ ID NO: 40989 - DNA, 20 bp, Artificial Sequence
  chemically synthesized
tatgatttcaggatgtgtgt

SEQ ID NO: 40990 - DNA, 20 bp, Artificial Sequence
  chemically synthesized
tgtatgggttcaagttgaca

SEQ ID NO: 40991 - DNA, 20 bp, Artificial Sequence
  chemically synthesized
ggttaatactgtcaacttga

SEQ ID NO: 40992 - DNA, 20 bp, Artificial Sequence
  chemically synthesized
ttaatctcggttatgtctgt

SEQ ID NO: 40993 - DNA, 20 bp, Artificial Sequence
  chemically synthesized
tggcaaaaggagattaacat

SEQ ID NO: 40994 - DNA, 20 bp, Artificial Sequence
  chemically synthesized
atacaactatcctcatacaa

SEQ ID NO: 40995 - DNA, 20 bp, Artificial Sequence
  chemically synthesized
gcacaagtgtacacatgcat

SEQ ID NO: 40996 - DNA, 20 bp, Artificial Sequence
  chemically synthesized
ccacttcatggctagatggg

SEQ ID NO: 40997 - DNA, 20 bp, Artificial Sequence
  chemically synthesized
ggtctcatgccactggaacc

SEQ ID NO: 40998 - DNA, 20 bp, Artificial Sequence
  chemically synthesized
accctagaaattttaccgag

SEQ ID NO: 40999 - DNA, 20 bp, Artificial Sequence
  chemically synthesized
tgggtcttatggacaggaat

SEQ ID NO: 41000 - DNA, 20 bp, Artificial Sequence
  chemically synthesized
cccactggaaccactgtaag

SEQ ID NO: 41001 - DNA, 20 bp, Artificial Sequence
  chemically synthesized
ggtctccttagggaaggatg

SEQ ID NO: 41002 - DNA, 20 bp, Artificial Sequence
  chemically synthesized
atggggtttcaccattttag

SEQ ID NO: 41003 - DNA, 20 bp, Artificial Sequence
  chemically synthesized
cccgagctgcaacattaaat

SEQ ID NO: 41004 - DNA, 20 bp, Artificial Sequence
  chemically synthesized
cagatttctgccaatataaa

SEQ ID NO: 41005 - DNA, 20 bp, Artificial Sequence
  chemically synthesized
gcattaggggtgcctcttga

SEQ ID NO: 41006 - DNA, 20 bp, Artificial Sequence
  chemically synthesized
cagaagtcccaaaaccaatg

SEQ ID NO: 41007 - DNA, 20 bp, Artificial Sequence
  chemically synthesized
agcaggaaggatccagcaca

SEQ ID NO: 41008 - DNA, 20 bp, Artificial Sequence
  chemically synthesized
gagtagcaggtgaaagctca

SEQ ID NO: 41009 - DNA, 20 bp, Artificial Sequence
  chemically synthesized
caggtgaaagctcacaagaa

SEQ ID NO: 41010 - DNA, 20 bp, Artificial Sequence
  chemically synthesized
tagtaggggcagggaccagt

SEQ ID NO: 41011 - DNA, 20 bp, Artificial Sequence
  chemically synthesized
ttgagataaacagtggtaag

SEQ ID NO: 41012 - DNA, 20 bp, Artificial Sequence
  chemically synthesized
cgtagaagtaattccaacct

SEQ ID NO: 41013 - DNA, 20 bp, Artificial Sequence
  chemically synthesized
acaatattgcaaatcattat

SEQ ID NO: 41014 - DNA, 20 bp, Artificial Sequence
  chemically synthesized
tctaaccataaaatcttaaa

SEQ ID NO: 41015 - DNA, 20 bp, Artificial Sequence
  chemically synthesized
gttgatctgctaatccctgt

SEQ ID NO: 41016 - DNA, 20 bp, Artificial Sequence
  chemically synthesized
gacacaccactattagttgg

SEQ ID NO: 41017 - DNA, 20 bp, Artificial Sequence
  chemically synthesized
atgccgatgacaagtatcca

SEQ ID NO: 41018 - DNA, 20 bp, Artificial Sequence
  chemically synthesized
agatgaacagattctcattc

SEQ ID NO: 41019 - DNA, 20 bp, Artificial Sequence
  chemically synthesized
tagatatatcaaaatatcat

SEQ ID NO: 41020 - DNA, 20 bp, Artificial Sequence
  chemically synthesized
ttgctaggaaatatcccaaa

SEQ ID NO: 41021 - DNA, 20 bp, Artificial Sequence
  chemically synthesized
aatagggtttatttgttggt

SEQ ID NO: 41022 - DNA, 20 bp, Artificial Sequence
  chemically synthesized
aatgtattttattaatggtg

SEQ ID NO: 41023 - DNA, 20 bp, Artificial Sequence
  chemically synthesized
tctcactgagcatggctgta

SEQ ID NO: 41024 - DNA, 20 bp, Artificial Sequence
  chemically synthesized
attggaaagataacacgtcc

SEQ ID NO: 41025 - DNA, 20 bp, Artificial Sequence
  chemically synthesized
gctttccaaaagagcttatc

SEQ ID NO: 41026 - DNA, 20 bp, Artificial Sequence
  chemically synthesized
cctagtttccatgggctgaa

SEQ ID NO: 41027 - DNA, 20 bp, Artificial Sequence
  chemically synthesized
ttactcaggccataacaaag

SEQ ID NO: 41028 - DNA, 20 bp, Artificial Sequence
  chemically synthesized
tgtaggcacactcttttaga

SEQ ID NO: 41029 - DNA, 20 bp, Artificial Sequence
  chemically synthesized
ggaaattaaacttatttttt

SEQ ID NO: 41030 - DNA, 20 bp, Artificial Sequence
  chemically synthesized
tgtatttttactacattgtg

SEQ ID NO: 41031 - DNA, 20 bp, Artificial Sequence
  chemically synthesized
aaactatgtcttacctgatt

SEQ ID NO: 41032 - DNA, 20 bp, Artificial Sequence
  chemically synthesized
ttgggactggccagcagtgc

SEQ ID NO: 41033 - DNA, 20 bp, Artificial Sequence
  chemically synthesized
ctactaagtaggctgaggca

SEQ ID NO: 41034 - DNA, 20 bp, Artificial Sequence
  chemically synthesized
agatggaggttgcagtgagc

SEQ ID NO: 41035 - DNA, 20 bp, Artificial Sequence
  chemically synthesized
ctccagcctgggtgacagag

SEQ ID NO: 41036 - DNA, 20 bp, Artificial Sequence
  chemically synthesized
cagagcaagaatgtctcagg

SEQ ID NO: 41037 - DNA, 20 bp, Artificial Sequence
  chemically synthesized
catgaagtaaagcaagagtg

SEQ ID NO: 41038 - DNA, 20 bp, Artificial Sequence
  chemically synthesized
accctctacctccttcccta

SEQ ID NO: 41039 - DNA, 20 bp, Artificial Sequence
  chemically synthesized
agtggatttgactcttccat

SEQ ID NO: 41040 - DNA, 20 bp, Artificial Sequence
  chemically synthesized
cacagggagctgggcttcct

SEQ ID NO: 41041 - DNA, 20 bp, Artificial Sequence
  chemically synthesized
tacctgtgtttaaaaagatg

SEQ ID NO: 41042 - DNA, 20 bp, Artificial Sequence
  chemically synthesized
ttctttgcttttaaaaccat

SEQ ID NO: 41043 - DNA, 20 bp, Artificial Sequence
  chemically synthesized
taatgtttaaatgtagagtc

SEQ ID NO: 41044 - DNA, 20 bp, Artificial Sequence
  chemically synthesized
gtacattttattgcaataaa

SEQ ID NO: 41045 - DNA, 20 bp, Artificial Sequence
  chemically synthesized
tatgacagtgtaaaatgtca

SEQ ID NO: 41046 - DNA, 20 bp, Artificial Sequence
  chemically synthesized
ttttgcaagcccagctttca

SEQ ID NO: 41047 - DNA, 20 bp, Artificial Sequence
  chemically synthesized
cttagatcattgactttggt

SEQ ID NO: 41048 - DNA, 20 bp, Artificial Sequence
  chemically synthesized
gtgtgagggagcaccgttct

SEQ ID NO: 41049 - DNA, 20 bp, Artificial Sequence
  chemically synthesized
cctgatgtcattattgacat

SEQ ID NO: 41050 - DNA, 20 bp, Artificial Sequence
  chemically synthesized
tcatggtctagttagtgttc

SEQ ID NO: 41051 - DNA, 20 bp, Artificial Sequence
  chemically synthesized
agcctagtgggggatggtgg

SEQ ID NO: 41052 - DNA, 20 bp, Artificial Sequence
  chemically synthesized
gtgtggatggttgtggggca

SEQ ID NO: 41053 - DNA, 20 bp, Artificial Sequence
  chemically synthesized
tgatgataatggtgatggtg

SEQ ID NO: 41054 - DNA, 20 bp, Artificial Sequence
  chemically synthesized
ggtctcacctgcaggtccac

SEQ ID NO: 41055 - DNA, 20 bp, Artificial Sequence
  chemically synthesized
ctctgcccgatgcttggtag

SEQ ID NO: 41056 - DNA, 20 bp, Artificial Sequence
  chemically synthesized
tgcagtcaaaggctctgggg

SEQ ID NO: 41057 - DNA, 20 bp, Artificial Sequence
  chemically synthesized
tgaaagctgggcttgcaaaa

SEQ ID NO: 41058 - DNA, 20 bp, Artificial Sequence
  chemically synthesized
ccgttctatttgaatttggc

SEQ ID NO: 41059 - DNA, 20 bp, Artificial Sequence
  chemically synthesized
aaataaagcagtttttcaca

SEQ ID NO: 41060 - DNA, 20 bp, Artificial Sequence
  chemically synthesized
caaaagaataaacacaacca

SEQ ID NO: 41061 - DNA, 20 bp, Artificial Sequence
  chemically synthesized
aattgtcaaagaagtataaa

SEQ ID NO: 41062 - DNA, 20 bp, Artificial Sequence
  chemically synthesized
ttttacactgtcataacctt

SEQ ID NO: 41063 - DNA, 20 bp, Artificial Sequence
  chemically synthesized
attggcagtgttattgggag

SEQ ID NO: 41064 - DNA, 20 bp, Artificial Sequence
  chemically synthesized
taatttatgggaacttaggc

SEQ ID NO: 41065 - DNA, 20 bp, Artificial Sequence
  chemically synthesized
gctcagaaaatattaaggaa

SEQ ID NO: 41066 - DNA, 20 bp, Artificial Sequence
  chemically synthesized
gtgcaaccatcatcatattt

SEQ ID NO: 41067 - DNA, 20 bp, Artificial Sequence
  chemically synthesized
ttctttatggttttaaaagc

SEQ ID NO: 41068 - DNA, 20 bp, Artificial Sequence
  chemically synthesized
ttaaaagcaaagaaaaaggt

SEQ ID NO: 41069 - DNA, 20 bp, Artificial Sequence
  chemically synthesized
gaagcccagctccctgtgat

SEQ ID NO: 41070 - DNA, 20 bp, Artificial Sequence
  chemically synthesized
aggcattgacagttgcaagg

SEQ ID NO: 41071 - DNA, 20 bp, Artificial Sequence
  chemically synthesized
gaccccagtctaagtgttgc

SEQ ID NO: 41072 - DNA, 20 bp, Artificial Sequence
  chemically synthesized
atttatttaagccacaacta

SEQ ID NO: 41073 - DNA, 20 bp, Artificial Sequence
  chemically synthesized
ttataacataatttataatt

SEQ ID NO: 41074 - DNA, 20 bp, Artificial Sequence
  chemically synthesized
ttatgattttattttatcca

SEQ ID NO: 41075 - DNA, 20 bp, Artificial Sequence
  chemically synthesized
ttttattttatccaaaagaa

SEQ ID NO: 41076 - DNA, 20 bp, Artificial Sequence
  chemically synthesized
gccagtggcatgggtctctg

SEQ ID NO: 41077 - DNA, 20 bp, Artificial Sequence
  chemically synthesized
gacatagtttttttaaatta

SEQ ID NO: 41078 - DNA, 20 bp, Artificial Sequence
  chemically synthesized
cacggtgctggaatgaatgg

SEQ ID NO: 41079 - DNA, 20 bp, Artificial Sequence
  chemically synthesized
tacatttgcttcttatccct

SEQ ID NO: 41080 - DNA, 20 bp, Artificial Sequence
  chemically synthesized
gtcatccccattttataaac

SEQ ID NO: 41081 - DNA, 20 bp, Artificial Sequence
  chemically synthesized
aattcccaaatcaaggaaat

SEQ ID NO: 41082 - DNA, 20 bp, Artificial Sequence
  chemically synthesized
ctggatttaagccagatttc

SEQ ID NO: 41083 - DNA, 20 bp, Artificial Sequence
  chemically synthesized
aggttaattgtttgccactt

SEQ ID NO: 41084 - DNA, 20 bp, Artificial Sequence
  chemically synthesized
agaagagagaagtctggtat

SEQ ID NO: 41085 - DNA, 20 bp, Artificial Sequence
  chemically synthesized
cttccaaagctagcttaggg

SEQ ID NO: 41086 - DNA, 20 bp, Artificial Sequence
  chemically synthesized
cgtactacttcactttagga

SEQ ID NO: 41087 - DNA, 20 bp, Artificial Sequence
  chemically synthesized
tgaatttagtggaagccatt

SEQ ID NO: 41088 - DNA, 20 bp, Artificial Sequence
  chemically synthesized
aagccattcaagaaaatatc

SEQ ID NO: 41089 - DNA, 20 bp, Artificial Sequence
  chemically synthesized
agccatgctcagtgagaagc

SEQ ID NO: 41090 - DNA, 20 bp, Artificial Sequence
  chemically synthesized
cattcacacaccacagtgag

SEQ ID NO: 41091 - DNA, 20 bp, Artificial Sequence
  chemically synthesized
atgagccctggaggtgaatc

SEQ ID NO: 41092 - DNA, 20 bp, Artificial Sequence
  chemically synthesized
gaaaaatcatcaggttaaaa

SEQ ID NO: 41093 - DNA, 20 bp, Artificial Sequence
  chemically synthesized
ttgaagtcacactgtgagct

SEQ ID NO: 41094 - DNA, 20 bp, Artificial Sequence
  chemically synthesized
cctggaaaagagagttcaaa

SEQ ID NO: 41095 - DNA, 20 bp, Artificial Sequence
  chemically synthesized
tgctttttagtggattaggt

SEQ ID NO: 41096 - DNA, 20 bp, Artificial Sequence
  chemically synthesized
gaggtcaggacaggcctttc

SEQ ID NO: 41097 - DNA, 20 bp, Artificial Sequence
  chemically synthesized
aggacaggcctttctgagaa

SEQ ID NO: 41098 - DNA, 20 bp, Artificial Sequence
  chemically synthesized
ccaccctttgccacaaccag

SEQ ID NO: 41099 - DNA, 20 bp, Artificial Sequence
  chemically synthesized
gttgcctcagatttgatctc

SEQ ID NO: 41100 - DNA, 20 bp, Artificial Sequence
  chemically synthesized
tacaaccaatgcacatattg

SEQ ID NO: 41101 - DNA, 20 bp, Artificial Sequence
  chemically synthesized
gcaggaggtggaagcccctg

SEQ ID NO: 41102 - DNA, 20 bp, Artificial Sequence
  chemically synthesized
ccctgagagaatggaggtct

SEQ ID NO: 41103 - DNA, 20 bp, Artificial Sequence
  chemically synthesized
ggaggagggggaatacctag

SEQ ID NO: 41104 - DNA, 20 bp, Artificial Sequence
  chemically synthesized
agggggaatacctaggtaga

SEQ ID NO: 41105 - DNA, 20 bp, Artificial Sequence
  chemically synthesized
ctcactgtgcagttaacttt

SEQ ID NO: 41106 - DNA, 20 bp, Artificial Sequence
  chemically synthesized
tagggagggaagagggcaaa

SEQ ID NO: 41107 - DNA, 20 bp, Artificial Sequence
  chemically synthesized
agaagcaatgcagccattac

SEQ ID NO: 41108 - DNA, 20 bp, Artificial Sequence
  chemically synthesized
acacctgtatcacaggtgtt

SEQ ID NO: 41109 - DNA, 20 bp, Artificial Sequence
  chemically synthesized
tatcacaggtgttaaagaaa

SEQ ID NO: 41110 - DNA, 20 bp, Artificial Sequence
  chemically synthesized
accgttaatgcccttgggct

SEQ ID NO: 41111 - DNA, 20 bp, Artificial Sequence
  chemically synthesized
acctccagcacacagcaggg

SEQ ID NO: 41112 - DNA, 20 bp, Artificial Sequence
  chemically synthesized
gctgcccccaagctgtagag

SEQ ID NO: 41113 - DNA, 20 bp, Artificial Sequence
  chemically synthesized
agagccagaatataaagctg

SEQ ID NO: 41114 - DNA, 20 bp, Artificial Sequence
  chemically synthesized
ccagaagtggttcttgagga

SEQ ID NO: 41115 - DNA, 20 bp, Artificial Sequence
  chemically synthesized
tgattgctcctaagttctct

SEQ ID NO: 41116 - DNA, 20 bp, Artificial Sequence
  chemically synthesized
gttctctggagaaagagatg

SEQ ID NO: 41117 - DNA, 20 bp, Artificial Sequence
  chemically synthesized
atgagagttttaactcctgt

SEQ ID NO: 41118 - DNA, 20 bp, Artificial Sequence
  chemically synthesized
ctgatgaaacttttttgcca

SEQ ID NO: 41119 - DNA, 20 bp, Artificial Sequence
  chemically synthesized
aagctttctaatttatattg

SEQ ID NO: 41120 - DNA, 20 bp, Artificial Sequence
  chemically synthesized
taatgttgcagctcggggac

SEQ ID NO: 41121 - DNA, 20 bp, Artificial Sequence
  chemically synthesized
cagcagaggcaaagcagcca

SEQ ID NO: 41122 - DNA, 20 bp, Artificial Sequence
  chemically synthesized
tataaacaaaaaactgccag

SEQ ID NO: 41123 - DNA, 20 bp, Artificial Sequence
  chemically synthesized
ctaatctgaattataaaaac

SEQ ID NO: 41124 - DNA, 20 bp, Artificial Sequence
  chemically synthesized
ccagggtaactgtgtgtact

SEQ ID NO: 41125 - DNA, 20 bp, Artificial Sequence
  chemically synthesized
aagggaagtaatgagacatt

SEQ ID NO: 41126 - DNA, 20 bp, Artificial Sequence
  chemically synthesized
atagacatacttattagctg

SEQ ID NO: 41127 - DNA, 20 bp, Artificial Sequence
  chemically synthesized
gccattagagctgtctctac

SEQ ID NO: 41128 - DNA, 20 bp, Artificial Sequence
  chemically synthesized
cgtttggcccctcttacaac

SEQ ID NO: 41129 - DNA, 20 bp, Artificial Sequence
  chemically synthesized
atgcatgtgtacacttgtgc

SEQ ID NO: 41130 - DNA, 20 bp, Artificial Sequence
  chemically synthesized
gtgttaatttgctcaagcaa

SEQ ID NO: 41131 - DNA, 20 bp, Artificial Sequence
  chemically synthesized
actgtaagtcagaaatgagc

SEQ ID NO: 41132 - DNA, 20 bp, Artificial Sequence
  chemically synthesized
aactctttctctacaggagt

SEQ ID NO: 41133 - DNA, 20 bp, Artificial Sequence
  chemically synthesized
tcagccaacaccagaagtcc

SEQ ID NO: 41134 - DNA, 20 bp, Artificial Sequence
  chemically synthesized
ctctgggagcttcaccccac

SEQ ID NO: 41135 - DNA, 20 bp, Artificial Sequence
  chemically synthesized
taggggcagggaccagtgca

SEQ ID NO: 41136 - DNA, 20 bp, Artificial Sequence
  chemically synthesized
atttaatatgctctatgctg

SEQ ID NO: 41137 - DNA, 20 bp, Artificial Sequence
  chemically synthesized
tatagctcacagtgtgactt

SEQ ID NO: 41138 - DNA, 20 bp, Artificial Sequence
  chemically synthesized
catgttgctaggaaatatcc

SEQ ID NO: 41139 - DNA, 20 bp, Artificial Sequence
  chemically synthesized
aatgtgccccccaggtcgat

SEQ ID NO: 41140 - DNA, 20 bp, Artificial Sequence
  chemically synthesized
catagacaccaatttcccca

SEQ ID NO: 41141 - DNA, 20 bp, Artificial Sequence
  chemically synthesized
aaaccaaagcatgcccacta

SEQ ID NO: 41142 - DNA, 20 bp, Artificial Sequence
  chemically synthesized
aaataattcttataatttaa

SEQ ID NO: 41143 - DNA, 20 bp, Artificial Sequence
  chemically synthesized
gacaagcctgggcaacatgc

SEQ ID NO: 41144 - DNA, 20 bp, Artificial Sequence
  chemically synthesized
taaataaatatttttaaaaa

SEQ ID NO: 41145 - DNA, 20 bp, Artificial Sequence
  chemically synthesized
gttaggaggctcctcccgtt

SEQ ID NO: 41146 - DNA, 20 bp, Artificial Sequence
  chemically synthesized
catataagagtctatgttcc

SEQ ID NO: 41147 - DNA, 20 bp, Artificial Sequence
  chemically synthesized
tttacctttttctttgcttt

SEQ ID NO: 41148 - DNA, 20 bp, Artificial Sequence
  chemically synthesized
gacagtgtaaaatgtcacta

SEQ ID NO: 41149 - DNA, 20 bp, Artificial Sequence
  chemically synthesized
gttgtgtttattcttttgtg

SEQ ID NO: 41150 - DNA, 20 bp, Artificial Sequence
  chemically synthesized
gcaaacatcctgataatggt

SEQ ID NO: 41151 - DNA, 20 bp, Artificial Sequence
  chemically synthesized
aaacatgaaggggagagcag

SEQ ID NO: 41152 - DNA, 20 bp, Artificial Sequence
  chemically synthesized
aactagaccatgaggtgcca

SEQ ID NO: 41153 - DNA, 20 bp, Artificial Sequence
  chemically synthesized
aagctgggcttgcaaaatta

SEQ ID NO: 41154 - DNA, 20 bp, Artificial Sequence
  chemically synthesized
ccctgggtgtgtccatctgg

SEQ ID NO: 41155 - DNA, 20 bp, Artificial Sequence
  chemically synthesized
atgaagatcatagcactata

SEQ ID NO: 41156 - DNA, 20 bp, Artificial Sequence
  chemically synthesized
tacaaaaagtctgaaaatat

SEQ ID NO: 41157 - DNA, 20 bp, Artificial Sequence
  chemically synthesized
taacataatttataattaca

SEQ ID NO: 41158 - DNA, 20 bp, Artificial Sequence
  chemically synthesized
agcctgctctgctacatttc

SEQ ID NO: 41159 - DNA, 20 bp, Artificial Sequence
  chemically synthesized
gatgcctatcaacaccttgg

SEQ ID NO: 41160 - DNA, 20 bp, Artificial Sequence
  chemically synthesized
agaaagagttgaaattgtga

SEQ ID NO: 41161 - DNA, 20 bp, Artificial Sequence
  chemically synthesized
ctacttgatttatataaaca

SEQ ID NO: 41162 - DNA, 20 bp, Artificial Sequence
  chemically synthesized
taaagactaatctgaattat

SEQ ID NO: 41163 - DNA, 20 bp, Artificial Sequence
  chemically synthesized
gacgttgattccagggtacc

SEQ ID NO: 41164 - DNA, 20 bp, Artificial Sequence
  chemically synthesized
cctagaaaaataaaaaaatc

SEQ ID NO: 41165 - DNA, 20 bp, Artificial Sequence
  chemically synthesized
ccacaccctcacagacataa

SEQ ID NO: 41166 - DNA, 20 bp, Artificial Sequence
  chemically synthesized
tgctgatatgaacaacactt

SEQ ID NO: 41167 - DNA, 20 bp, Artificial Sequence
  chemically synthesized
caaaatcctagaggtctcca

SEQ ID NO: 41168 - DNA, 20 bp, Artificial Sequence
  chemically synthesized
tcatgtggcccaaatggcag

SEQ ID NO: 41169 - DNA, 20 bp, Artificial Sequence
  chemically synthesized
cagctttcacagcagcctgg

SEQ ID NO: 41170 - DNA, 20 bp, Artificial Sequence
  chemically synthesized
gaggggccaaacgcagcaag

SEQ ID NO: 41171 - DNA, 20 bp, Artificial Sequence
  chemically synthesized
tagaaagtccctaaatttta

SEQ ID NO: 41172 - DNA, 20 bp, Artificial Sequence
  chemically synthesized
atgtctcaccaataagttca

SEQ ID NO: 41173 - DNA, 20 bp, Artificial Sequence
  chemically synthesized
agcgagcaaggtctctccaa

SEQ ID NO: 41174 - DNA, 20 bp, Artificial Sequence
  chemically synthesized
ggccttgtcagctgaaggca

SEQ ID NO: 41175 - DNA, 20 bp, Artificial Sequence
  chemically synthesized
caattggagtcaccacttgg

SEQ ID NO: 41176 - DNA, 20 bp, Artificial Sequence
  chemically synthesized
cagtccctccagggatggga

SEQ ID NO: 41177 - DNA, 20 bp, Artificial Sequence
  chemically synthesized
ctccagggatgggatattgt

SEQ ID NO: 41178 - DNA, 20 bp, Artificial Sequence
  chemically synthesized
ttctaggtagagacagctct

SEQ ID NO: 41179 - DNA, 20 bp, Artificial Sequence
  chemically synthesized
gtagagacagctctaatggc

SEQ ID NO: 41180 - DNA, 20 bp, Artificial Sequence
  chemically synthesized
ctttaactggggaaccacaa

SEQ ID NO: 41181 - DNA, 20 bp, Artificial Sequence
  chemically synthesized
gtaacaggttcgagtctgga

SEQ ID NO: 41182 - DNA, 20 bp, Artificial Sequence
  chemically synthesized
tctggaaattgattgagggc

SEQ ID NO: 41183 - DNA, 20 bp, Artificial Sequence
  chemically synthesized
ttgattgagggcccatgatt

SEQ ID NO: 41184 - DNA, 20 bp, Artificial Sequence
  chemically synthesized
atgattctctgtttttataa

SEQ ID NO: 41185 - DNA, 20 bp, Artificial Sequence
  chemically synthesized
gtctttagtccattctacct

SEQ ID NO: 41186 - DNA, 20 bp, Artificial Sequence
  chemically synthesized
gtccattctacctggcagtt

SEQ ID NO: 41187 - DNA, 20 bp, Artificial Sequence
  chemically synthesized
ataaatcaagtaggaataca

SEQ ID NO: 41188 - DNA, 20 bp, Artificial Sequence
  chemically synthesized
caatttcacttctaggaaca

SEQ ID NO: 41189 - DNA, 20 bp, Artificial Sequence
  chemically synthesized
atgagtcagactattctgat

SEQ ID NO: 41190 - DNA, 20 bp, Artificial Sequence
  chemically synthesized
gctctcacaaatctatttca

SEQ ID NO: 41191 - DNA, 20 bp, Artificial Sequence
  chemically synthesized
tgcctcagcctcccaagtag

SEQ ID NO: 41192 - DNA, 20 bp, Artificial Sequence
  chemically synthesized
ttttgtatttttagcagaga

SEQ ID NO: 41193 - DNA, 20 bp, Artificial Sequence
  chemically synthesized
cgcccccgcctcccaaggtg

SEQ ID NO: 41194 - DNA, 20 bp, Artificial Sequence
  chemically synthesized
agtagggccaaaccaataaa

SEQ ID NO: 41195 - DNA, 20 bp, Artificial Sequence
  chemically synthesized
atccattcccatgcctgttc

SEQ ID NO: 41196 - DNA, 20 bp, Artificial Sequence
  chemically synthesized
atttctgccaatataaatta

SEQ ID NO: 41197 - DNA, 20 bp, Artificial Sequence
  chemically synthesized
cactgttgcctcaagcagtg

SEQ ID NO: 41198 - DNA, 20 bp, Artificial Sequence
  chemically synthesized
accactactggggatgggga

SEQ ID NO: 41199 - DNA, 20 bp, Artificial Sequence
  chemically synthesized
gaaactgtttcttctggcaa

SEQ ID NO: 41200 - DNA, 20 bp, Artificial Sequence
  chemically synthesized
gagttcacaaactcagtgtc

SEQ ID NO: 41201 - DNA, 20 bp, Artificial Sequence
  chemically synthesized
agatcagctactcgcatgat

SEQ ID NO: 41202 - DNA, 20 bp, Artificial Sequence
  chemically synthesized
ctcgcatgataacagcttgt

SEQ ID NO: 41203 - DNA, 20 bp, Artificial Sequence
  chemically synthesized
ctctcattcagggcaatctt

SEQ ID NO: 41204 - DNA, 20 bp, Artificial Sequence
  chemically synthesized
tagcagatttgtggctcagt

SEQ ID NO: 41205 - DNA, 20 bp, Artificial Sequence
  chemically synthesized
tctagagggacagaactaat

SEQ ID NO: 41206 - DNA, 20 bp, Artificial Sequence
  chemically synthesized
atagatatactcacacaaag

SEQ ID NO: 41207 - DNA, 20 bp, Artificial Sequence
  chemically synthesized
ttattaagtggtattaactc

SEQ ID NO: 41208 - DNA, 20 bp, Artificial Sequence
  chemically synthesized
tagcctttttacatttttct

SEQ ID NO: 41209 - DNA, 20 bp, Artificial Sequence
  chemically synthesized
ccagctttatattctggctc

SEQ ID NO: 41210 - DNA, 20 bp, Artificial Sequence
  chemically synthesized
cagcaggggcaggggcctca

SEQ ID NO: 41211 - DNA, 20 bp, Artificial Sequence
  chemically synthesized
aaggactttcagtcacctct

SEQ ID NO: 41212 - DNA, 20 bp, Artificial Sequence
  chemically synthesized
agaggggctgtgggttgtct

SEQ ID NO: 41213 - DNA, 20 bp, Artificial Sequence
  chemically synthesized
tgagcccatactttaatctc

SEQ ID NO: 41214 - DNA, 20 bp, Artificial Sequence
  chemically synthesized
tttttaaaaatcatatttat

SEQ ID NO: 41215 - DNA, 20 bp, Artificial Sequence
  chemically synthesized
tattaagaatacaagaagta

SEQ ID NO: 41216 - DNA, 20 bp, Artificial Sequence
  chemically synthesized
aatacaagaagtacaatgtt

SEQ ID NO: 41217 - DNA, 20 bp, Artificial Sequence
  chemically synthesized
ttctttaacacctgtgatac

SEQ ID NO: 41218 - DNA, 20 bp, Artificial Sequence
  chemically synthesized
tgaattctacgtaatggctg

SEQ ID NO: 41219 - DNA, 20 bp, Artificial Sequence
  chemically synthesized
tgcaggacttgggtaatctc

SEQ ID NO: 41220 - DNA, 20 bp, Artificial Sequence
  chemically synthesized
acttgggtaatctctggggt

SEQ ID NO: 41221 - DNA, 20 bp, Artificial Sequence
  chemically synthesized
ctccagacctccattctctc

SEQ ID NO: 41222 - DNA, 20 bp, Artificial Sequence
  chemically synthesized
aaatcttaaataagaataaa

SEQ ID NO: 41223 - DNA, 20 bp, Artificial Sequence
  chemically synthesized
taagaataaatcatgtttgc

SEQ ID NO: 41224 - DNA, 20 bp, Artificial Sequence
  chemically synthesized
catcagtggcaactgtgttg

SEQ ID NO: 41225 - DNA, 20 bp, Artificial Sequence
  chemically synthesized
tagaaatgaaccttggaggc

SEQ ID NO: 41226 - DNA, 20 bp, Artificial Sequence
  chemically synthesized
aatgaaccttggaggccatt

SEQ ID NO: 41227 - DNA, 20 bp, Artificial Sequence
  chemically synthesized
caaagaaggccatttttgta

SEQ ID NO: 41228 - DNA, 20 bp, Artificial Sequence
  chemically synthesized
ccactattagttggggagaa

SEQ ID NO: 41229 - DNA, 20 bp, Artificial Sequence
  chemically synthesized
ttccaaggtgttgataggca

SEQ ID NO: 41230 - DNA, 20 bp, Artificial Sequence
  chemically synthesized
gaacctgggaccaatactgc

SEQ ID NO: 41231 - DNA, 20 bp, Artificial Sequence
  chemically synthesized
aggcaacaaatctgttcaaa

SEQ ID NO: 41232 - DNA, 20 bp, Artificial Sequence
  chemically synthesized
aggctccttaggacacctgg

SEQ ID NO: 41233 - DNA, 20 bp, Artificial Sequence
  chemically synthesized
tccatctctggcacaaaatg

SEQ ID NO: 41234 - DNA, 20 bp, Artificial Sequence
  chemically synthesized
ggctaataaaatgaagatag

SEQ ID NO: 41235 - DNA, 20 bp, Artificial Sequence
  chemically synthesized
gatgacacactgcagagaac

SEQ ID NO: 41236 - DNA, 20 bp, Artificial Sequence
  chemically synthesized
atccagtagaaaggcagatg

SEQ ID NO: 41237 - DNA, 20 bp, Artificial Sequence
  chemically synthesized
caaggaggaggatgcacgct

SEQ ID NO: 41238 - DNA, 20 bp, Artificial Sequence
  chemically synthesized
aatatgctctatgctggaaa

SEQ ID NO: 41239 - DNA, 20 bp, Artificial Sequence
  chemically synthesized
atatccatgtcttcaccccg

SEQ ID NO: 41240 - DNA, 20 bp, Artificial Sequence
  chemically synthesized
actctcttttccaggaagag

SEQ ID NO: 41241 - DNA, 20 bp, Artificial Sequence
  chemically synthesized
aaacacacaataaattaata

SEQ ID NO: 41242 - DNA, 20 bp, Artificial Sequence
  chemically synthesized
gttcagttaaacattttgaa

SEQ ID NO: 41243 - DNA, 20 bp, Artificial Sequence
  chemically synthesized
cctgtaactgtgtcatttta

SEQ ID NO: 41244 - DNA, 20 bp, Artificial Sequence
  chemically synthesized
caatttttctttttttaacc

SEQ ID NO: 41245 - DNA, 20 bp, Artificial Sequence
  chemically synthesized
tgatgatttttccacaatcc

SEQ ID NO: 41246 - DNA, 20 bp, Artificial Sequence
  chemically synthesized
tttccacaatccttttgttt

SEQ ID NO: 41247 - DNA, 20 bp, Artificial Sequence
  chemically synthesized
ctccagggctcatatggcaa

SEQ ID NO: 41248 - DNA, 20 bp, Artificial Sequence
  chemically synthesized
atatggcaatggggatttaa

SEQ ID NO: 41249 - DNA, 20 bp, Artificial Sequence
  chemically synthesized
cttagcaatttgtgaataga

SEQ ID NO: 41250 - DNA, 20 bp, Artificial Sequence
  chemically synthesized
tttgtgaatagaagatgttt

SEQ ID NO: 41251 - DNA, 20 bp, Artificial Sequence
  chemically synthesized
gataacacgtccacagaaag

SEQ ID NO: 41252 - DNA, 20 bp, Artificial Sequence
  chemically synthesized
cagaaagcctggctttccaa

SEQ ID NO: 41253 - DNA, 20 bp, Artificial Sequence
  chemically synthesized
atcagagaatgtgcccccca

SEQ ID NO: 41254 - DNA, 20 bp, Artificial Sequence
  chemically synthesized
atatgttaatcctgtggcag

SEQ ID NO: 41255 - DNA, 20 bp, Artificial Sequence
  chemically synthesized
aagttcacagtgatctacat

SEQ ID NO: 41256 - DNA, 20 bp, Artificial Sequence
  chemically synthesized
accaatttccccaaaaaact

SEQ ID NO: 41257 - DNA, 20 bp, Artificial Sequence
  chemically synthesized
ttttctttgatattttcttg

SEQ ID NO: 41258 - DNA, 20 bp, Artificial Sequence
  chemically synthesized
atggcttccactaaattcaa

SEQ ID NO: 41259 - DNA, 20 bp, Artificial Sequence
  chemically synthesized
taaaattttatctggtaatt

SEQ ID NO: 41260 - DNA, 20 bp, Artificial Sequence
  chemically synthesized
gcaagttcatctaactatgt

SEQ ID NO: 41261 - DNA, 20 bp, Artificial Sequence
  chemically synthesized
gatggaactcctgagttcac

SEQ ID NO: 41262 - DNA, 20 bp, Artificial Sequence
  chemically synthesized
actacaaaactctcaccctc

SEQ ID NO: 41263 - DNA, 20 bp, Artificial Sequence
  chemically synthesized
tgctgcatttcttcccctaa

SEQ ID NO: 41264 - DNA, 20 bp, Artificial Sequence
  chemically synthesized
accagacttctctcttctta

SEQ ID NO: 41265 - DNA, 20 bp, Artificial Sequence
  chemically synthesized
tgctcttcagttacattgga

SEQ ID NO: 41266 - DNA, 20 bp, Artificial Sequence
  chemically synthesized
ttcagttacattggaatgtg

SEQ ID NO: 41267 - DNA, 20 bp, Artificial Sequence
  chemically synthesized
gatgaaaaagtgagaagagc

SEQ ID NO: 41268 - DNA, 20 bp, Artificial Sequence
  chemically synthesized
cctagattttttcttggaaa

SEQ ID NO: 41269 - DNA, 20 bp, Artificial Sequence
  chemically synthesized
cttggaaatctggcttaaat

SEQ ID NO: 41270 - DNA, 20 bp, Artificial Sequence
  chemically synthesized
aaatccaggtttctttattt

SEQ ID NO: 41271 - DNA, 20 bp, Artificial Sequence
  chemically synthesized
atttggtcacgagacaaata

SEQ ID NO: 41272 - DNA, 20 bp, Artificial Sequence
  chemically synthesized
aataacatgattttcctaag

SEQ ID NO: 41273 - DNA, 20 bp, Artificial Sequence
  chemically synthesized
attttcctaagtctagattt

SEQ ID NO: 41274 - DNA, 20 bp, Artificial Sequence
  chemically synthesized
acatattcaaagagttattt

SEQ ID NO: 41275 - DNA, 20 bp, Artificial Sequence
  chemically synthesized
atgaaactgagaaccaagcg

SEQ ID NO: 41276 - DNA, 20 bp, Artificial Sequence
  chemically synthesized
ccatcatgtaggcacactct

SEQ ID NO: 41277 - DNA, 20 bp, Artificial Sequence
  chemically synthesized
taagaatttttcaatcatat

SEQ ID NO: 41278 - DNA, 20 bp, Artificial Sequence
  chemically synthesized
atttaaaaaaactatgtctt

SEQ ID NO: 41279 - DNA, 20 bp, Artificial Sequence
  chemically synthesized
accagatagtcaaattaagt

SEQ ID NO: 41280 - DNA, 20 bp, Artificial Sequence
  chemically synthesized
cacccctagaccttcatctt

SEQ ID NO: 41281 - DNA, 20 bp, Artificial Sequence
  chemically synthesized
ccttcatctttcctgattag

SEQ ID NO: 41282 - DNA, 20 bp, Artificial Sequence
  chemically synthesized
ctgcacatccatagcctccc

SEQ ID NO: 41283 - DNA, 20 bp, Artificial Sequence
  chemically synthesized
tagacacaaccctttcaggt

SEQ ID NO: 41284 - DNA, 20 bp, Artificial Sequence
  chemically synthesized
tatttattcctagtgaactc

SEQ ID NO: 41285 - DNA, 20 bp, Artificial Sequence
  chemically synthesized
cagatggatcacctgaggcc

SEQ ID NO: 41286 - DNA, 20 bp, Artificial Sequence
  chemically synthesized
taagtaggctgaggcactag

SEQ ID NO: 41287 - DNA, 20 bp, Artificial Sequence
  chemically synthesized
atccttcctattctagtagt

SEQ ID NO: 41288 - DNA, 20 bp, Artificial Sequence
  chemically synthesized
gacaggtggatcacaaggtc

SEQ ID NO: 41289 - DNA, 20 bp, Artificial Sequence
  chemically synthesized
caagatggttaggaggctcc

SEQ ID NO: 41290 - DNA, 20 bp, Artificial Sequence
  chemically synthesized
atacatttgggacagatcta

SEQ ID NO: 41291 - DNA, 20 bp, Artificial Sequence
  chemically synthesized
acacttagactggggtcttc

SEQ ID NO: 41292 - DNA, 20 bp, Artificial Sequence
  chemically synthesized
aaatgcccagcacagagctc

SEQ ID NO: 41293 - DNA, 20 bp, Artificial Sequence
  chemically synthesized
ctcttccattcagaaactca

SEQ ID NO: 41294 - DNA, 20 bp, Artificial Sequence
  chemically synthesized
tcattctcaatcacagggag

SEQ ID NO: 41295 - DNA, 20 bp, Artificial Sequence
  chemically synthesized
aaagccagccccaaaggtac

SEQ ID NO: 41296 - DNA, 20 bp, Artificial Sequence
  chemically synthesized
aagagtctatgttccaaaaa

SEQ ID NO: 41297 - DNA, 20 bp, Artificial Sequence
  chemically synthesized
aaaaacctggatttaacaat

SEQ ID NO: 41298 - DNA, 20 bp, Artificial Sequence
  chemically synthesized
taacaatctgagctttgtca

SEQ ID NO: 41299 - DNA, 20 bp, Artificial Sequence
  chemically synthesized
catggtgctttgcggttggt

SEQ ID NO: 41300 - DNA, 20 bp, Artificial Sequence
  chemically synthesized
tgttgtttctttaccttttt

SEQ ID NO: 41301 - DNA, 20 bp, Artificial Sequence
  chemically synthesized
gcttttaaaaccataaagaa

SEQ ID NO: 41302 - DNA, 20 bp, Artificial Sequence
  chemically synthesized
agtctgagaaatgcaattgc

SEQ ID NO: 41303 - DNA, 20 bp, Artificial Sequence
  chemically synthesized
tttatattttcagacttttt

SEQ ID NO: 41304 - DNA, 20 bp, Artificial Sequence
  chemically synthesized
tcatatcacaaaatttcaca

SEQ ID NO: 41305 - DNA, 20 bp, Artificial Sequence
  chemically synthesized
ttttcactcaacattacata

SEQ ID NO: 41306 - DNA, 20 bp, Artificial Sequence
  chemically synthesized
ctaatattttaaaggagagc

SEQ ID NO: 41307 - DNA, 20 bp, Artificial Sequence
  chemically synthesized
gagctactgattaatgagca

SEQ ID NO: 41308 - DNA, 20 bp, Artificial Sequence
  chemically synthesized
aagcattatcctttccaggc

SEQ ID NO: 41309 - DNA, 20 bp, Artificial Sequence
  chemically synthesized
ggtctgcggagtcactgccc

SEQ ID NO: 41310 - DNA, 20 bp, Artificial Sequence
  chemically synthesized
cccgtgcgcgttggcccccc

SEQ ID NO: 41311 - DNA, 20 bp, Artificial Sequence
  chemically synthesized
aatctaacaggttgaaattg

SEQ ID NO: 41312 - DNA, 20 bp, Artificial Sequence
  chemically synthesized
tctttgacaatttgggagag

SEQ ID NO: 41313 - DNA, 20 bp, Artificial Sequence
  chemically synthesized
gagagtgaagattctcctgg

SEQ ID NO: 41314 - DNA, 20 bp, Artificial Sequence
  chemically synthesized
gtgtttattcttttgtgaaa

SEQ ID NO: 41315 - DNA, 20 bp, Artificial Sequence
  chemically synthesized
tgcaaaattgccagaggaaa

SEQ ID NO: 41316 - DNA, 20 bp, Artificial Sequence
  chemically synthesized
ttccagatggacacacccag

SEQ ID NO: 41317 - DNA, 20 bp, Artificial Sequence
  chemically synthesized
ttcagtgttctcacaaataa

SEQ ID NO: 41318 - DNA, 20 bp, Artificial Sequence
  chemically synthesized
cagttttctaattttgcaag

SEQ ID NO: 41319 - DNA, 20 bp, Artificial Sequence
  chemically synthesized
cattagaattttgcaaaaat

SEQ ID NO: 41320 - DNA, 20 bp, Artificial Sequence
  chemically synthesized
gttgacatgagcagcatgga

SEQ ID NO: 41321 - DNA, 20 bp, Artificial Sequence
  chemically synthesized
tctgggcagagctgcatgat

SEQ ID NO: 41322 - DNA, 20 bp, Artificial Sequence
  chemically synthesized
caggtaggccacaggtgaca

SEQ ID NO: 41323 - DNA, 20 bp, Artificial Sequence
  chemically synthesized
gtccagcggcaggatcagtc

SEQ ID NO: 41324 - DNA, 20 bp, Artificial Sequence
  chemically synthesized
aattgatgaacaggcctgag

SEQ ID NO: 41325 - DNA, 20 bp, Artificial Sequence
  chemically synthesized
gctaatggtggtggtaatga

SEQ ID NO: 41326 - DNA, 20 bp, Artificial Sequence
  chemically synthesized
tcatcagtagacatcatata

SEQ ID NO: 41327 - DNA, 20 bp, Artificial Sequence
  chemically synthesized
tagctggcccagagcctact

SEQ ID NO: 41328 - DNA, 20 bp, Artificial Sequence
  chemically synthesized
tttctaaccaccatccccca

SEQ ID NO: 41329 - DNA, 20 bp, Artificial Sequence
  chemically synthesized
cacctgcaggtccactgaga

SEQ ID NO: 41330 - DNA, 20 bp, Artificial Sequence
  chemically synthesized
tcagcctctgagagggaggt

SEQ ID NO: 41331 - DNA, 20 bp, Artificial Sequence
  chemically synthesized
aagttttcctgctctcccct

SEQ ID NO: 41332 - DNA, 20 bp, Artificial Sequence
  chemically synthesized
tccctgacttggatcaaatg

SEQ ID NO: 41333 - DNA, 20 bp, Artificial Sequence
  chemically synthesized
gtttggaggtgttgaggcca

SEQ ID NO: 41334 - DNA, 20 bp, Artificial Sequence
  chemically synthesized
ctccccaaggccccatcagg

SEQ ID NO: 41335 - DNA, 20 bp, Artificial Sequence
  chemically synthesized
aactttcctggcaacttgcg

SEQ ID NO: 41336 - DNA, 20 bp, Artificial Sequence
  chemically synthesized
gtaggttttcaccattatca

SEQ ID NO: 41337 - DNA, 20 bp, Artificial Sequence
  chemically synthesized
gatgtttgccttgctcaaat

SEQ ID NO: 41338 - DNA, 20 bp, Artificial Sequence
  chemically synthesized
caggtgatgcaccctctgcc

SEQ ID NO: 41339 - DNA, 20 bp, Artificial Sequence
  chemically synthesized
acttccatcatgcagctctg

SEQ ID NO: 41340 - DNA, 20 bp, Artificial Sequence
  chemically synthesized
catgtcaactccagatgcag

SEQ ID NO: 41341 - DNA, 20 bp, Artificial Sequence
  chemically synthesized
cctgtgccatgctcgcaaag

SEQ ID NO: 41342 - DNA, 20 bp, Artificial Sequence
  chemically synthesized
ttgcaaaattctaatgaaag

SEQ ID NO: 41343 - DNA, 20 bp, Artificial Sequence
  chemically synthesized
tgggcttgcaaaattagaaa

SEQ ID NO: 41344 - DNA, 20 bp, Artificial Sequence
  chemically synthesized
gaatttggcaaagaaaataa

SEQ ID NO: 41345 - DNA, 20 bp, Artificial Sequence
  chemically synthesized
aatcaggacaatttcaacct

SEQ ID NO: 41346 - DNA, 20 bp, Artificial Sequence
  chemically synthesized
acactcatacaagtgtggtg

SEQ ID NO: 41347 - DNA, 20 bp, Artificial Sequence
  chemically synthesized
tcatacaagtgtggtgaagt

SEQ ID NO: 41348 - DNA, 20 bp, Artificial Sequence
  chemically synthesized
actagacaacctccttacac

SEQ ID NO: 41349 - DNA, 20 bp, Artificial Sequence
  chemically synthesized
agagcaggagtgatggaact

SEQ ID NO: 41350 - DNA, 20 bp, Artificial Sequence
  chemically synthesized
gaagtgagatacaccacatt

SEQ ID NO: 41351 - DNA, 20 bp, Artificial Sequence
  chemically synthesized
aagcttgtgcctggaaagga

SEQ ID NO: 41352 - DNA, 20 bp, Artificial Sequence
  chemically synthesized
tacatttaaacattattctt

SEQ ID NO: 41353 - DNA, 20 bp, Artificial Sequence
  chemically synthesized
cgcaaagcaccatgacaaag

SEQ ID NO: 41354 - DNA, 20 bp, Artificial Sequence
  chemically synthesized
caaagctcagattgttaaat

SEQ ID NO: 41355 - DNA, 20 bp, Artificial Sequence
  chemically synthesized
ttggaacatagactcttata

SEQ ID NO: 41356 - DNA, 20 bp, Artificial Sequence
  chemically synthesized
tcaccactgctctgttcttc

SEQ ID NO: 41357 - DNA, 20 bp, Artificial Sequence
  chemically synthesized
taaacacaggtacctttggg

SEQ ID NO: 41358 - DNA, 20 bp, Artificial Sequence
  chemically synthesized
tctcaaggaagcccagctcc

SEQ ID NO: 41359 - DNA, 20 bp, Artificial Sequence
  chemically synthesized
gaatgaagtgtgcaatcgct

SEQ ID NO: 41360 - DNA, 20 bp, Artificial Sequence
  chemically synthesized
tcccaaagtagcgaattcaa

SEQ ID NO: 41361 - DNA, 20 bp, Artificial Sequence
  chemically synthesized
gatcatccaaggggacttct

SEQ ID NO: 41362 - DNA, 20 bp, Artificial Sequence
  chemically synthesized
ccggtggccagggactaaag

SEQ ID NO: 41363 - DNA, 20 bp, Artificial Sequence
  chemically synthesized
cagagttggcgtgtctcccc

SEQ ID NO: 41364 - DNA, 20 bp, Artificial Sequence
  chemically synthesized
ctccccaattgatttacaac

SEQ ID NO: 41365 - DNA, 20 bp, Artificial Sequence
  chemically synthesized
atttacaactggggcttgga

SEQ ID NO: 41366 - DNA, 20 bp, Artificial Sequence
  chemically synthesized
tttccacttaattctaccac

SEQ ID NO: 41367 - DNA, 20 bp, Artificial Sequence
  chemically synthesized
tacttcatgagaacgaaaat

SEQ ID NO: 41368 - DNA, 20 bp, Artificial Sequence
  chemically synthesized
gcaccatgaattcatttgcg

SEQ ID NO: 41369 - DNA, 20 bp, Artificial Sequence
  chemically synthesized
catttgcggaaagattgata

SEQ ID NO: 41370 - DNA, 20 bp, Artificial Sequence
  chemically synthesized
accccggttgaagtgcactg

SEQ ID NO: 41371 - DNA, 20 bp, Artificial Sequence
  chemically synthesized
tactccagcctccctagtag

SEQ ID NO: 41372 - DNA, 20 bp, Artificial Sequence
  chemically synthesized
ttttgtatttttagtagaga

SEQ ID NO: 41373 - DNA, 20 bp, Artificial Sequence
  chemically synthesized
tgtcttggcctcccaaagtg

SEQ ID NO: 41374 - DNA, 20 bp, Artificial Sequence
  chemically synthesized
ttgagccaccgcactcgacc

SEQ ID NO: 41375 - DNA, 20 bp, Artificial Sequence
  chemically synthesized
agccacaactactagaatag

SEQ ID NO: 41376 - DNA, 20 bp, Artificial Sequence
  chemically synthesized
ttttgtattttttgtagaga

SEQ ID NO: 41377 - DNA, 20 bp, Artificial Sequence
  chemically synthesized
acagggttttggcatgttgc

SEQ ID NO: 41378 - DNA, 20 bp, Artificial Sequence
  chemically synthesized
tgccgtggcctcccaaaatg

SEQ ID NO: 41379 - DNA, 20 bp, Artificial Sequence
  chemically synthesized
tgagccaccaccccctcctg

SEQ ID NO: 41380 - DNA, 20 bp, Artificial Sequence
  chemically synthesized
aaataaattttgaagataat

SEQ ID NO: 41381 - DNA, 20 bp, Artificial Sequence
  chemically synthesized
cacttatgttgtcatttcgg

SEQ ID NO: 41382 - DNA, 20 bp, Artificial Sequence
  chemically synthesized
tggagatgttaacatttata

SEQ ID NO: 41383 - DNA, 20 bp, Artificial Sequence
  chemically synthesized
tcgtacagcactgcctgttg

SEQ ID NO: 41384 - DNA, 20 bp, Artificial Sequence
  chemically synthesized
ccagcaaatatgagctactt

SEQ ID NO: 41385 - DNA, 20 bp, Artificial Sequence
  chemically synthesized
gtggagcagctgagggggga

SEQ ID NO: 41386 - DNA, 20 bp, Artificial Sequence
  chemically synthesized
ataagactctatattcaagg

SEQ ID NO: 41387 - DNA, 20 bp, Artificial Sequence
  chemically synthesized
tcattaacttaatttgacta

SEQ ID NO: 41388 - DNA, 20 bp, Artificial Sequence
  chemically synthesized
tttgactatctggtttgtgg

SEQ ID NO: 41389 - DNA, 20 bp, Artificial Sequence
  chemically synthesized
tcatgtaagtcaacaatgtc

SEQ ID NO: 41390 - DNA, 20 bp, Artificial Sequence
  chemically synthesized
atttctgaaatcaggtaaga

SEQ ID NO: 41391 - DNA, 20 bp, Artificial Sequence
  chemically synthesized
tgtagtaaaaatacatatgc

SEQ ID NO: 41392 - DNA, 20 bp, Artificial Sequence
  chemically synthesized
ttatgtgcaattcatttaat

SEQ ID NO: 41393 - DNA, 20 bp, Artificial Sequence
  chemically synthesized
ttcccagttcaaaatcttgt

SEQ ID NO: 41394 - DNA, 20 bp, Artificial Sequence
  chemically synthesized
attgaaaaattcttaaaaaa

SEQ ID NO: 41395 - DNA, 20 bp, Artificial Sequence
  chemically synthesized
gaatgggcagaaaaaataat

SEQ ID NO: 41396 - DNA, 20 bp, Artificial Sequence
  chemically synthesized
atgcaaaggatggctaagct

SEQ ID NO: 41397 - DNA, 20 bp, Artificial Sequence
  chemically synthesized
gctaagctcttcgcttggtt

SEQ ID NO: 41398 - DNA, 20 bp, Artificial Sequence
  chemically synthesized
acaatgaaataactctttga

SEQ ID NO: 41399 - DNA, 20 bp, Artificial Sequence
  chemically synthesized
tctctttgttatggcctgag

SEQ ID NO: 41400 - DNA, 20 bp, Artificial Sequence
  chemically synthesized
aaggctttccatcggtatac

SEQ ID NO: 41401 - DNA, 20 bp, Artificial Sequence
  chemically synthesized
tgccagatgatatacgcata

SEQ ID NO: 41402 - DNA, 20 bp, Artificial Sequence
  chemically synthesized
catacacacatacacaccgt

SEQ ID NO: 41403 - DNA, 20 bp, Artificial Sequence
  chemically synthesized
agtgtgtgtcctttacaaat

SEQ ID NO: 41404 - DNA, 20 bp, Artificial Sequence
  chemically synthesized
aaatcaaggaaataaagaaa

SEQ ID NO: 41405 - DNA, 20 bp, Artificial Sequence
  chemically synthesized
ataaagaaacctggatttaa

SEQ ID NO: 41406 - DNA, 20 bp, Artificial Sequence
  chemically synthesized
atgtaactgaagagcaggtt

SEQ ID NO: 41407 - DNA, 20 bp, Artificial Sequence
  chemically synthesized
agagaagtctggtataaaga

SEQ ID NO: 41408 - DNA, 20 bp, Artificial Sequence
  chemically synthesized
agtctggtataaagaaagtg

SEQ ID NO: 41409 - DNA, 20 bp, Artificial Sequence
  chemically synthesized
gaaagtgatttgcttccaaa

SEQ ID NO: 41410 - DNA, 20 bp, Artificial Sequence
  chemically synthesized
aaggcaacagaggaggcgag

SEQ ID NO: 41411 - DNA, 20 bp, Artificial Sequence
  chemically synthesized
gcaaggattcaggggtccat

SEQ ID NO: 41412 - DNA, 20 bp, Artificial Sequence
  chemically synthesized
gaggcaaatctctggagggt

SEQ ID NO: 41413 - DNA, 20 bp, Artificial Sequence
  chemically synthesized
gggtgagagttttgtagtgg

SEQ ID NO: 41414 - DNA, 20 bp, Artificial Sequence
  chemically synthesized
gagttttgtagtgggcatgc

SEQ ID NO: 41415 - DNA, 20 bp, Artificial Sequence
  chemically synthesized
gagtctgatgaaagggaggt

SEQ ID NO: 41416 - DNA, 20 bp, Artificial Sequence
  chemically synthesized
caaagaaaatacagagcagg

SEQ ID NO: 41417 - DNA, 20 bp, Artificial Sequence
  chemically synthesized
gagcaggagaagattaagca

SEQ ID NO: 41418 - DNA, 20 bp, Artificial Sequence
  chemically synthesized
ctagaacaaacttctctgcc

SEQ ID NO: 41419 - DNA, 20 bp, Artificial Sequence
  chemically synthesized
ttctctgccacaggattaac

SEQ ID NO: 41420 - DNA, 20 bp, Artificial Sequence
  chemically synthesized
tgataagctcttttggaaag

SEQ ID NO: 41421 - DNA, 20 bp, Artificial Sequence
  chemically synthesized
tggaatgcccggggagagga

SEQ ID NO: 41422 - DNA, 20 bp, Artificial Sequence
  chemically synthesized
ataaaagtatttttcctatt

SEQ ID NO: 41423 - DNA, 20 bp, Artificial Sequence
  chemically synthesized
agtatttttcctattaaaag

SEQ ID NO: 41424 - DNA, 20 bp, Artificial Sequence
  chemically synthesized
ttcctattaaaagatttgtt

SEQ ID NO: 41425 - DNA, 20 bp, Artificial Sequence
  chemically synthesized
ggaggtgaatcagagaaaca

SEQ ID NO: 41426 - DNA, 20 bp, Artificial Sequence
  chemically synthesized
catcaggttaaaaaaagaaa

SEQ ID NO: 41427 - DNA, 20 bp, Artificial Sequence
  chemically synthesized
gttaaaaaaagaaaaattga

SEQ ID NO: 41428 - DNA, 20 bp, Artificial Sequence
  chemically synthesized
agttaaagggggaaataaat

SEQ ID NO: 41429 - DNA, 20 bp, Artificial Sequence
  chemically synthesized
catttcaaaaacactcttca

SEQ ID NO: 41430 - DNA, 20 bp, Artificial Sequence
  chemically synthesized
aagcaccttattaatttatt

SEQ ID NO: 41431 - DNA, 20 bp, Artificial Sequence
  chemically synthesized
gatattttgatatatctatc

SEQ ID NO: 41432 - DNA, 20 bp, Artificial Sequence
  chemically synthesized
atatctatcaagtgcttttt

SEQ ID NO: 41433 - DNA, 20 bp, Artificial Sequence
  chemically synthesized
agccaatgcctgttcaataa

SEQ ID NO: 41434 - DNA, 20 bp, Artificial Sequence
  chemically synthesized
cctgtattccctagaagtct

SEQ ID NO: 41435 - DNA, 20 bp, Artificial Sequence
  chemically synthesized
aagtctcgctgctttcagag

SEQ ID NO: 41436 - DNA, 20 bp, Artificial Sequence
  chemically synthesized
caaagtggtcaaggttgtcc

SEQ ID NO: 41437 - DNA, 20 bp, Artificial Sequence
  chemically synthesized
gtcctgttgcttaattccat

SEQ ID NO: 41438 - DNA, 20 bp, Artificial Sequence
  chemically synthesized
cagagatggagctggcatct

SEQ ID NO: 41439 - DNA, 20 bp, Artificial Sequence
  chemically synthesized
tttgccacaaccaggcagaa

SEQ ID NO: 41440 - DNA, 20 bp, Artificial Sequence
  chemically synthesized
caggcagaaagcagcttttg

SEQ ID NO: 41441 - DNA, 20 bp, Artificial Sequence
  chemically synthesized
cttttgaacagatttgttgc

SEQ ID NO: 41442 - DNA, 20 bp, Artificial Sequence
  chemically synthesized
tgggcagtattggtcccagg

SEQ ID NO: 41443 - DNA, 20 bp, Artificial Sequence
  chemically synthesized
aaaaatggccttctttgtgg

SEQ ID NO: 41444 - DNA, 20 bp, Artificial Sequence
  chemically synthesized
cttcatatcctccatttttt

SEQ ID NO: 41445 - DNA, 20 bp, Artificial Sequence
  chemically synthesized
taaaggagggaccattcaga

SEQ ID NO: 41446 - DNA, 20 bp, Artificial Sequence
  chemically synthesized
ctccaaggttcatttctaca

SEQ ID NO: 41447 - DNA, 20 bp, Artificial Sequence
  chemically synthesized
gacatggcaatcaagagcaa

SEQ ID NO: 41448 - DNA, 20 bp, Artificial Sequence
  chemically synthesized
caaacatgatttattcttat

SEQ ID NO: 41449 - DNA, 20 bp, Artificial Sequence
  chemically synthesized
gtctggagaatctgaaaccc

SEQ ID NO: 41450 - DNA, 20 bp, Artificial Sequence
  chemically synthesized
tgtacttcttgtattcttaa

SEQ ID NO: 41451 - DNA, 20 bp, Artificial Sequence
  chemically synthesized
atcactgcaaacctctataa

SEQ ID NO: 41452 - DNA, 20 bp, Artificial Sequence
  chemically synthesized
ctacgcattgacttatcttc

SEQ ID NO: 41453 - DNA, 20 bp, Artificial Sequence
  chemically synthesized
cgttgtactttcttccttac

SEQ ID NO: 41454 - DNA, 20 bp, Artificial Sequence
  chemically synthesized
ccactgtttatctcaaactc

SEQ ID NO: 41455 - DNA, 20 bp, Artificial Sequence
  chemically synthesized
tatgggctcaggagggagcg

SEQ ID NO: 41456 - DNA, 20 bp, Artificial Sequence
  chemically synthesized
gccttatggaaaagtggcca

SEQ ID NO: 41457 - DNA, 20 bp, Artificial Sequence
  chemically synthesized
cattttagtcagtgttggct

SEQ ID NO: 41458 - DNA, 20 bp, Artificial Sequence
  chemically synthesized
cagtaccaccgttaatgccc

SEQ ID NO: 41459 - DNA, 20 bp, Artificial Sequence
  chemically synthesized
gcacacagcagggaaagaat

SEQ ID NO: 41460 - DNA, 20 bp, Artificial Sequence
  chemically synthesized
aattccagtttctctttctt

SEQ ID NO: 41461 - DNA, 20 bp, Artificial Sequence
  chemically synthesized
actcttcaccaggcaaggct

SEQ ID NO: 41462 - DNA, 20 bp, Artificial Sequence
  chemically synthesized
acatttccactggctgcact

SEQ ID NO: 41463 - DNA, 20 bp, Artificial Sequence
  chemically synthesized
agggaaggaaaaaagatcct

SEQ ID NO: 41464 - DNA, 20 bp, Artificial Sequence
  chemically synthesized
gaaaaatgtaaaaaggctag

SEQ ID NO: 41465 - DNA, 20 bp, Artificial Sequence
  chemically synthesized
ttggactgtcttccttgctc

SEQ ID NO: 41466 - DNA, 20 bp, Artificial Sequence
  chemically synthesized
ctctagagaaccccgactaa

SEQ ID NO: 41467 - DNA, 20 bp, Artificial Sequence
  chemically synthesized
attaaggatggaattctttc

SEQ ID NO: 41468 - DNA, 20 bp, Artificial Sequence
  chemically synthesized
gttttgggacttctggtgtt

SEQ ID NO: 41469 - DNA, 20 bp, Artificial Sequence
  chemically synthesized
cttctggtgttggctgatta

SEQ ID NO: 41470 - DNA, 20 bp, Artificial Sequence
  chemically synthesized
cactgatagtacttggcctg

SEQ ID NO: 41471 - DNA, 20 bp, Artificial Sequence
  chemically synthesized
aaaataaatgcatttgacac

SEQ ID NO: 41472 - DNA, 20 bp, Artificial Sequence
  chemically synthesized
ttcatcacttatgagaggca

SEQ ID NO: 41473 - DNA, 20 bp, Artificial Sequence
  chemically synthesized
ccaaggaacataatgaagtt

SEQ ID NO: 41474 - DNA, 20 bp, Artificial Sequence
  chemically synthesized
gatactgagccacaaatctg

SEQ ID NO: 41475 - DNA, 20 bp, Artificial Sequence
  chemically synthesized
ctgctaagattgccctgaat

SEQ ID NO: 41476 - DNA, 20 bp, Artificial Sequence
  chemically synthesized
ggtgcatgcacagccttgcc

SEQ ID NO: 41477 - DNA, 20 bp, Artificial Sequence
  chemically synthesized
ccctgatgaagctgaggaca

SEQ ID NO: 41478 - DNA, 20 bp, Artificial Sequence
  chemically synthesized
gaaacttttttgccagaaga

SEQ ID NO: 41479 - DNA, 20 bp, Artificial Sequence
  chemically synthesized
gtctgaggatgtaaaccctg

SEQ ID NO: 41480 - DNA, 20 bp, Artificial Sequence
  chemically synthesized
gcagctgccaggcaagataa

SEQ ID NO: 41481 - DNA, 20 bp, Artificial Sequence
  chemically synthesized
gaggcacccctaatgcccct

SEQ ID NO: 41482 - DNA, 20 bp, Artificial Sequence
  chemically synthesized
ggtgcattatactctaaaag

SEQ ID NO: 41483 - DNA, 20 bp, Artificial Sequence
  chemically synthesized
ttatactctaaaagaactgc

SEQ ID NO: 41484 - DNA, 20 bp, Artificial Sequence
  chemically synthesized
agttggatcaagctgaattt

SEQ ID NO: 41485 - DNA, 20 bp, Artificial Sequence
  chemically synthesized
attggtttggccctactaag

SEQ ID NO: 41486 - DNA, 20 bp, Artificial Sequence
  chemically synthesized
ggcgggcagatcacgagatc

SEQ ID NO: 41487 - DNA, 20 bp, Artificial Sequence
  chemically synthesized
ttgggaggctgaggcaagag

SEQ ID NO: 41488 - DNA, 20 bp, Artificial Sequence
  chemically synthesized
aactgcttgaacctgtgagg

SEQ ID NO: 41489 - DNA, 20 bp, Artificial Sequence
  chemically synthesized
aaaaaaaaaaaaaaagttat

SEQ ID NO: 41490 - DNA, 20 bp, Artificial Sequence
  chemically synthesized
aaaaaaagttataatagttt

SEQ ID NO: 41491 - DNA, 20 bp, Artificial Sequence
  chemically synthesized
atttgcttggttagctgaaa

SEQ ID NO: 41492 - DNA, 20 bp, Artificial Sequence
  chemically synthesized
tgttagtgagctggaaatgc

SEQ ID NO: 41493 - DNA, 20 bp, Artificial Sequence
  chemically synthesized
taatgtagaggaagtgatcc

SEQ ID NO: 41494 - DNA, 20 bp, Artificial Sequence
  chemically synthesized
ggaagtgatccaaaggctta

SEQ ID NO: 41495 - DNA, 20 bp, Artificial Sequence
  chemically synthesized
tagggagattaggatggtgg

SEQ ID NO: 41496 - DNA, 20 bp, Artificial Sequence
  chemically synthesized
ccagaagatacacccttggc

SEQ ID NO: 41497 - DNA, 20 bp, Artificial Sequence
  chemically synthesized
ccttggccgaagctttgtga

SEQ ID NO: 41498 - DNA, 20 bp, Artificial Sequence
  chemically synthesized
gggaaacctactgtattcct

SEQ ID NO: 41499 - DNA, 20 bp, Artificial Sequence
  chemically synthesized
ggacactggctctgagctga

SEQ ID NO: 41500 - DNA, 20 bp, Artificial Sequence
  chemically synthesized
tgtggttccccagttaaagt

SEQ ID NO: 41501 - DNA, 20 bp, Artificial Sequence
  chemically synthesized
tatggaggttaggtaattaa

SEQ ID NO: 41502 - DNA, 20 bp, Artificial Sequence
  chemically synthesized
tcccatccctggagggactg

SEQ ID NO: 41503 - DNA, 20 bp, Artificial Sequence
  chemically synthesized
ggacttgaaagacgcagggg

SEQ ID NO: 41504 - DNA, 20 bp, Artificial Sequence
  chemically synthesized
gatggatcttggaaaatgat

SEQ ID NO: 41505 - DNA, 20 bp, Artificial Sequence
  chemically synthesized
gaaaatgatggtggattatt

SEQ ID NO: 41506 - DNA, 20 bp, Artificial Sequence
  chemically synthesized
attgcagctgctctaccagt

SEQ ID NO: 41507 - DNA, 20 bp, Artificial Sequence
  chemically synthesized
tgctctaccagttgtggttt

SEQ ID NO: 41508 - DNA, 20 bp, Artificial Sequence
  chemically synthesized
ctggtgcctggtatgcagcc

SEQ ID NO: 41509 - DNA, 20 bp, Artificial Sequence
  chemically synthesized
atgcagccattggcttggca

SEQ ID NO: 41510 - DNA, 20 bp, Artificial Sequence
  chemically synthesized
cctcaggggtgtatcaactc

SEQ ID NO: 41511 - DNA, 20 bp, Artificial Sequence
  chemically synthesized
atcttatttggagagacctt

SEQ ID NO: 41512 - DNA, 20 bp, Artificial Sequence
  chemically synthesized
ccattacattcatgacatta

SEQ ID NO: 41513 - DNA, 20 bp, Artificial Sequence
  chemically synthesized
ctaaggtgaagcataacttg

SEQ ID NO: 41514 - DNA, 20 bp, Artificial Sequence
  chemically synthesized
cacaatgcctggtgggccta

SEQ ID NO: 41515 - DNA, 20 bp, Artificial Sequence
  chemically synthesized
gattttggaggcaacacatt

SEQ ID NO: 41516 - DNA, 20 bp, Artificial Sequence
  chemically synthesized
atcgagtgacctgaaaggct

SEQ ID NO: 41517 - DNA, 20 bp, Artificial Sequence
  chemically synthesized
acatgaccccgcagatccaa

SEQ ID NO: 41518 - DNA, 20 bp, Artificial Sequence
  chemically synthesized
gtgtcagtggcagataggga

SEQ ID NO: 41519 - DNA, 20 bp, Artificial Sequence
  chemically synthesized
gtgaatcacagtggagacct

SEQ ID NO: 41520 - DNA, 20 bp, Artificial Sequence
  chemically synthesized
agacagctattggtctgtta

SEQ ID NO: 41521 - DNA, 20 bp, Artificial Sequence
  chemically synthesized
attgggctttggtggtaact

SEQ ID NO: 41522 - DNA, 20 bp, Artificial Sequence
  chemically synthesized
gaacctgcctatcatgaact

SEQ ID NO: 41523 - DNA, 20 bp, Artificial Sequence
  chemically synthesized
ttgaagtggtgtgtatgtga

SEQ ID NO: 41524 - DNA, 20 bp, Artificial Sequence
  chemically synthesized
tttttcctttatcatgtgac

SEQ ID NO: 41525 - DNA, 20 bp, Artificial Sequence
  chemically synthesized
gttaaccttatgtaataact

SEQ ID NO: 41526 - DNA, 20 bp, Artificial Sequence
  chemically synthesized
ttatgtaataacttttggtt

SEQ ID NO: 41527 - DNA, 20 bp, Artificial Sequence
  chemically synthesized
aacttttggtttggggattg

SEQ ID NO: 41528 - DNA, 20 bp, Artificial Sequence
  chemically synthesized
accttattattgtctttatt

SEQ ID NO: 41529 - DNA, 20 bp, Artificial Sequence
  chemically synthesized
tgtctttatttgaagattat

SEQ ID NO: 41530 - DNA, 20 bp, Artificial Sequence
  chemically synthesized
tgtgatggttaatactgtca

SEQ ID NO: 41531 - DNA, 20 bp, Artificial Sequence
  chemically synthesized
tggttaatactgtcaacttg

SEQ ID NO: 41532 - DNA, 20 bp, Artificial Sequence
  chemically synthesized
gtctgtgagggtgtggcaaa

SEQ ID NO: 41533 - DNA, 22 bp, Artificial Sequence
  chemically synthesized
ccagcccactgactcaaatgtt

SEQ ID NO: 41534 - DNA, 22 bp, Artificial Sequence
  chemically synthesized
actcaaatgttaatctcctttt

SEQ ID NO: 41535 - DNA, 22 bp, Artificial Sequence
  chemically synthesized
aaatgttaatctccttttgcca

SEQ ID NO: 41536 - DNA, 22 bp, Artificial Sequence
  chemically synthesized
atctccttttgccacaccctca

SEQ ID NO: 41537 - DNA, 22 bp, Artificial Sequence
  chemically synthesized
cttttgccacaccctcacagac

SEQ ID NO: 41538 - DNA, 22 bp, Artificial Sequence
  chemically synthesized
ttgccacaccctcacagacata

SEQ ID NO: 41539 - DNA, 22 bp, Artificial Sequence
  chemically synthesized
tgccacaccctcacagacataa

SEQ ID NO: 41540 - DNA, 22 bp, Artificial Sequence
  chemically synthesized
gccacaccctcacagacataac

SEQ ID NO: 41541 - DNA, 22 bp, Artificial Sequence
  chemically synthesized
ccacaccctcacagacataacc

SEQ ID NO: 41542 - DNA, 22 bp, Artificial Sequence
  chemically synthesized
acagacataaccgagattaata

SEQ ID NO: 41543 - DNA, 22 bp, Artificial Sequence
  chemically synthesized
atactttgcatctttcaatcca

SEQ ID NO: 41544 - DNA, 22 bp, Artificial Sequence
  chemically synthesized
tgcatctttcaatccaatcaag

SEQ ID NO: 41545 - DNA, 22 bp, Artificial Sequence
  chemically synthesized
gcatctttcaatccaatcaagt

SEQ ID NO: 41546 - DNA, 22 bp, Artificial Sequence
  chemically synthesized
catctttcaatccaatcaagtt

SEQ ID NO: 41547 - DNA, 22 bp, Artificial Sequence
  chemically synthesized
tcaatccaatcaagttgacagt

SEQ ID NO: 41548 - DNA, 22 bp, Artificial Sequence
  chemically synthesized
caatccaatcaagttgacagta

SEQ ID NO: 41549 - DNA, 22 bp, Artificial Sequence
  chemically synthesized
aatccaatcaagttgacagtat

SEQ ID NO: 41550 - DNA, 22 bp, Artificial Sequence
  chemically synthesized
acagtattaaccatcacaagtc

SEQ ID NO: 41551 - DNA, 22 bp, Artificial Sequence
  chemically synthesized
accatcacaagtccaactcctt

SEQ ID NO: 41552 - DNA, 22 bp, Artificial Sequence
  chemically synthesized
cttgtcaacttgaacccataca

SEQ ID NO: 41553 - DNA, 22 bp, Artificial Sequence
  chemically synthesized
gtcaacttgaacccatacacac

SEQ ID NO: 41554 - DNA, 22 bp, Artificial Sequence
  chemically synthesized
tcaacttgaacccatacacaca

SEQ ID NO: 41555 - DNA, 22 bp, Artificial Sequence
  chemically synthesized
gaacccatacacacatcctgaa

SEQ ID NO: 41556 - DNA, 22 bp, Artificial Sequence
  chemically synthesized
aacccatacacacatcctgaaa

SEQ ID NO: 41557 - DNA, 22 bp, Artificial Sequence
  chemically synthesized
aaatcatacataatcttcaaat

SEQ ID NO: 41558 - DNA, 22 bp, Artificial Sequence
  chemically synthesized
caaataaagacaataataaggt

SEQ ID NO: 41559 - DNA, 22 bp, Artificial Sequence
  chemically synthesized
aaataaagacaataataaggtc

SEQ ID NO: 41560 - DNA, 22 bp, Artificial Sequence
  chemically synthesized
tgcctaatataatacaactatc

SEQ ID NO: 41561 - DNA, 22 bp, Artificial Sequence
  chemically synthesized
atataatacaactatcctcata

SEQ ID NO: 41562 - DNA, 22 bp, Artificial Sequence
  chemically synthesized
tcctcatacaaccagaaacgca

SEQ ID NO: 41563 - DNA, 22 bp, Artificial Sequence
  chemically synthesized
atacaaccagaaacgcaccaat

SEQ ID NO: 41564 - DNA, 22 bp, Artificial Sequence
  chemically synthesized
ttacataaggttaacaatattt

SEQ ID NO: 41565 - DNA, 22 bp, Artificial Sequence
  chemically synthesized
cataaggttaacaatatttaaa

SEQ ID NO: 41566 - DNA, 22 bp, Artificial Sequence
  chemically synthesized
acaatatttaaatgctgatatg

SEQ ID NO: 41567 - DNA, 22 bp, Artificial Sequence
  chemically synthesized
aaatgctgatatgaacaacact

SEQ ID NO: 41568 - DNA, 22 bp, Artificial Sequence
  chemically synthesized
aatgctgatatgaacaacactt

SEQ ID NO: 41569 - DNA, 22 bp, Artificial Sequence
  chemically synthesized
atatgaacaacacttaaatgct

SEQ ID NO: 41570 - DNA, 22 bp, Artificial Sequence
  chemically synthesized
aaatgcttaaatgctgatgtga

SEQ ID NO: 41571 - DNA, 22 bp, Artificial Sequence
  chemically synthesized
aatgcttaaatgctgatgtgaa

SEQ ID NO: 41572 - DNA, 22 bp, Artificial Sequence
  chemically synthesized
aaatgctgatgtgaagtccata

SEQ ID NO: 41573 - DNA, 22 bp, Artificial Sequence
  chemically synthesized
aatgctgatgtgaagtccataa

SEQ ID NO: 41574 - DNA, 22 bp, Artificial Sequence
  chemically synthesized
atgtgaagtccataaatctaag

SEQ ID NO: 41575 - DNA, 22 bp, Artificial Sequence
  chemically synthesized
aggtcacatgataaaggaaaaa

SEQ ID NO: 41576 - DNA, 22 bp, Artificial Sequence
  chemically synthesized
tcttagcacaagtgtacacatg

SEQ ID NO: 41577 - DNA, 22 bp, Artificial Sequence
  chemically synthesized
cttagcacaagtgtacacatgc

SEQ ID NO: 41578 - DNA, 22 bp, Artificial Sequence
  chemically synthesized
ttagcacaagtgtacacatgca

SEQ ID NO: 41579 - DNA, 22 bp, Artificial Sequence
  chemically synthesized
agcacaagtgtacacatgcatt

SEQ ID NO: 41580 - DNA, 22 bp, Artificial Sequence
  chemically synthesized
gcacaagtgtacacatgcattt

SEQ ID NO: 41581 - DNA, 22 bp, Artificial Sequence
  chemically synthesized
agaaagtggatatagtgctgca

SEQ ID NO: 41582 - DNA, 22 bp, Artificial Sequence
  chemically synthesized
gaaagtggatatagtgctgcag

SEQ ID NO: 41583 - DNA, 22 bp, Artificial Sequence
  chemically synthesized
cagctgtccactttcgggtggt

SEQ ID NO: 41584 - DNA, 22 bp, Artificial Sequence
  chemically synthesized
tccactttcgggtggtgcctgc

SEQ ID NO: 41585 - DNA, 22 bp, Artificial Sequence
  chemically synthesized
tcgggtggtgcctgcatatcgt

SEQ ID NO: 41586 - DNA, 22 bp, Artificial Sequence
  chemically synthesized
cgggtggtgcctgcatatcgtg

SEQ ID NO: 41587 - DNA, 22 bp, Artificial Sequence
  chemically synthesized
gggtggtgcctgcatatcgtgc

SEQ ID NO: 41588 - DNA, 22 bp, Artificial Sequence
  chemically synthesized
catatcgtgcagaaccatctat

SEQ ID NO: 41589 - DNA, 22 bp, Artificial Sequence
  chemically synthesized
tgaaccagtccttagtcttccc

SEQ ID NO: 41590 - DNA, 22 bp, Artificial Sequence
  chemically synthesized
agtcttcccttcctctgtcaac

SEQ ID NO: 41591 - DNA, 22 bp, Artificial Sequence
  chemically synthesized
gtcttcccttcctctgtcaact

SEQ ID NO: 41592 - DNA, 22 bp, Artificial Sequence
  chemically synthesized
cccttcctctgtcaactgatca

SEQ ID NO: 41593 - DNA, 22 bp, Artificial Sequence
  chemically synthesized
ccttcctctgtcaactgatcat

SEQ ID NO: 41594 - DNA, 22 bp, Artificial Sequence
  chemically synthesized
cctctgtcaactgatcataggg

SEQ ID NO: 41595 - DNA, 22 bp, Artificial Sequence
  chemically synthesized
ctctgtcaactgatcataggga

SEQ ID NO: 41596 - DNA, 22 bp, Artificial Sequence
  chemically synthesized
tgtcaactgatcatagggaact

SEQ ID NO: 41597 - DNA, 22 bp, Artificial Sequence
  chemically synthesized
tcaactgatcatagggaactcc

SEQ ID NO: 41598 - DNA, 22 bp, Artificial Sequence
  chemically synthesized
atcatagggaactccccatgag

SEQ ID NO: 41599 - DNA, 22 bp, Artificial Sequence
  chemically synthesized
cccatgaggccattggtgcagg

SEQ ID NO: 41600 - DNA, 22 bp, Artificial Sequence
  chemically synthesized
gtgcaggctgggggagggaagg

SEQ ID NO: 41601 - DNA, 22 bp, Artificial Sequence
  chemically synthesized
ggggagggaaggcagggtggca

SEQ ID NO: 41602 - DNA, 22 bp, Artificial Sequence
  chemically synthesized
gagccacttccttatgtaactt

SEQ ID NO: 41603 - DNA, 22 bp, Artificial Sequence
  chemically synthesized
agccacttccttatgtaactta

SEQ ID NO: 41604 - DNA, 22 bp, Artificial Sequence
  chemically synthesized
ccttatgtaacttacttgtgcc

SEQ ID NO: 41605 - DNA, 22 bp, Artificial Sequence
  chemically synthesized
cttatgtaacttacttgtgcct

SEQ ID NO: 41606 - DNA, 22 bp, Artificial Sequence
  chemically synthesized
atgtaacttacttgtgccttca

SEQ ID NO: 41607 - DNA, 22 bp, Artificial Sequence
  chemically synthesized
tgtaacttacttgtgccttcag

SEQ ID NO: 41608 - DNA, 22 bp, Artificial Sequence
  chemically synthesized
acttgtgccttcaggacctgct

SEQ ID NO: 41609 - DNA, 22 bp, Artificial Sequence
  chemically synthesized
cttgtgccttcaggacctgctc

SEQ ID NO: 41610 - DNA, 22 bp, Artificial Sequence
  chemically synthesized
gtgccttcaggacctgctcaag

SEQ ID NO: 41611 - DNA, 22 bp, Artificial Sequence
  chemically synthesized
tgccttcaggacctgctcaagc

SEQ ID NO: 41612 - DNA, 22 bp, Artificial Sequence
  chemically synthesized
caggacctgctcaagcccgatc

SEQ ID NO: 41613 - DNA, 22 bp, Artificial Sequence
  chemically synthesized
aggacctgctcaagcccgatca

SEQ ID NO: 41614 - DNA, 22 bp, Artificial Sequence
  chemically synthesized
ctcaagcccgatcacatacaca

SEQ ID NO: 41615 - DNA, 22 bp, Artificial Sequence
  chemically synthesized
aagcccgatcacatacacacca

SEQ ID NO: 41616 - DNA, 22 bp, Artificial Sequence
  chemically synthesized
caatttgatgatgaaatgccgc

SEQ ID NO: 41617 - DNA, 22 bp, Artificial Sequence
  chemically synthesized
aatttgatgatgaaatgccgct

SEQ ID NO: 41618 - DNA, 22 bp, Artificial Sequence
  chemically synthesized
gatgatgaaatgccgctgtgct

SEQ ID NO: 41619 - DNA, 22 bp, Artificial Sequence
  chemically synthesized
atgatgaaatgccgctgtgctg

SEQ ID NO: 41620 - DNA, 22 bp, Artificial Sequence
  chemically synthesized
tgctgacccacttcatggctag

SEQ ID NO: 41621 - DNA, 22 bp, Artificial Sequence
  chemically synthesized
acccacttcatggctagatggg

SEQ ID NO: 41622 - DNA, 22 bp, Artificial Sequence
  chemically synthesized
catggctagatgggtcagaaag

SEQ ID NO: 41623 - DNA, 22 bp, Artificial Sequence
  chemically synthesized
atggctagatgggtcagaaagc

SEQ ID NO: 41624 - DNA, 22 bp, Artificial Sequence
  chemically synthesized
gatgggtcagaaagcaaccagt

SEQ ID NO: 41625 - DNA, 22 bp, Artificial Sequence
  chemically synthesized
atgataggcaggttcaggtagc

SEQ ID NO: 41626 - DNA, 22 bp, Artificial Sequence
  chemically synthesized
aggtagcatggtgactttatga

SEQ ID NO: 41627 - DNA, 22 bp, Artificial Sequence
  chemically synthesized
tatgacccacagtcaaacgttc

SEQ ID NO: 41628 - DNA, 22 bp, Artificial Sequence
  chemically synthesized
atgacccacagtcaaacgttca

SEQ ID NO: 41629 - DNA, 22 bp, Artificial Sequence
  chemically synthesized
tgacccacagtcaaacgttcag

SEQ ID NO: 41630 - DNA, 22 bp, Artificial Sequence
  chemically synthesized
agttaccaccaaagcccaataa

SEQ ID NO: 41631 - DNA, 22 bp, Artificial Sequence
  chemically synthesized
ccaccaaagcccaataacagac

SEQ ID NO: 41632 - DNA, 22 bp, Artificial Sequence
  chemically synthesized
tctctcaaaaggagagtagtta

SEQ ID NO: 41633 - DNA, 22 bp, Artificial Sequence
  chemically synthesized
tcaaaaggagagtagttatctg

SEQ ID NO: 41634 - DNA, 22 bp, Artificial Sequence
  chemically synthesized
aaaaggagagtagttatctgca

SEQ ID NO: 41635 - DNA, 22 bp, Artificial Sequence
  chemically synthesized
tctgcagaagtggcagggcctt

SEQ ID NO: 41636 - DNA, 22 bp, Artificial Sequence
  chemically synthesized
cagaagtggcagggccttgctc

SEQ ID NO: 41637 - DNA, 22 bp, Artificial Sequence
  chemically synthesized
gctccaaaatcctagaggtctc

SEQ ID NO: 41638 - DNA, 22 bp, Artificial Sequence
  chemically synthesized
ctccaaaatcctagaggtctcc

SEQ ID NO: 41639 - DNA, 22 bp, Artificial Sequence
  chemically synthesized
caaaatcctagaggtctccact

SEQ ID NO: 41640 - DNA, 22 bp, Artificial Sequence
  chemically synthesized
gaggtctccactgtgattcacc

SEQ ID NO: 41641 - DNA, 22 bp, Artificial Sequence
  chemically synthesized
cactgtgattcacctatggggg

SEQ ID NO: 41642 - DNA, 22 bp, Artificial Sequence
  chemically synthesized
tgattcacctatgggggcctgc

SEQ ID NO: 41643 - DNA, 22 bp, Artificial Sequence
  chemically synthesized
acctatgggggcctgccaaagg

SEQ ID NO: 41644 - DNA, 22 bp, Artificial Sequence
  chemically synthesized
tgggggcctgccaaaggctcca

SEQ ID NO: 41645 - DNA, 22 bp, Artificial Sequence
  chemically synthesized
ccaaaggctccaaacagcatcc

SEQ ID NO: 41646 - DNA, 22 bp, Artificial Sequence
  chemically synthesized
caaacagcatccctatctgcca

SEQ ID NO: 41647 - DNA, 22 bp, Artificial Sequence
  chemically synthesized
tctgccactgacacctcaagca

SEQ ID NO: 41648 - DNA, 22 bp, Artificial Sequence
  chemically synthesized
ccactgacacctcaagcaccat

SEQ ID NO: 41649 - DNA, 22 bp, Artificial Sequence
  chemically synthesized
acacctcaagcaccattggatc

SEQ ID NO: 41650 - DNA, 22 bp, Artificial Sequence
  chemically synthesized
aagcaccattggatctgcgggg

SEQ ID NO: 41651 - DNA, 22 bp, Artificial Sequence
  chemically synthesized
gatctgcggggtcatgtggccc

SEQ ID NO: 41652 - DNA, 22 bp, Artificial Sequence
  chemically synthesized
cggggtcatgtggcccaaatgg

SEQ ID NO: 41653 - DNA, 22 bp, Artificial Sequence
  chemically synthesized
tcacagcagcctggacctgttt

SEQ ID NO: 41654 - DNA, 22 bp, Artificial Sequence
  chemically synthesized
cacagcagcctggacctgtttc

SEQ ID NO: 41655 - DNA, 22 bp, Artificial Sequence
  chemically synthesized
acagcagcctggacctgtttca

SEQ ID NO: 41656 - DNA, 22 bp, Artificial Sequence
  chemically synthesized
gacctgtttcagagccttcttt

SEQ ID NO: 41657 - DNA, 22 bp, Artificial Sequence
  chemically synthesized
tttcagagccttcttttgttct

SEQ ID NO: 41658 - DNA, 22 bp, Artificial Sequence
  chemically synthesized
cagagccttcttttgttctaga

SEQ ID NO: 41659 - DNA, 22 bp, Artificial Sequence
  chemically synthesized
agagccttcttttgttctagac

SEQ ID NO: 41660 - DNA, 22 bp, Artificial Sequence
  chemically synthesized
cttttgttctagactgcactta

SEQ ID NO: 41661 - DNA, 22 bp, Artificial Sequence
  chemically synthesized
ttttgttctagactgcacttaa

SEQ ID NO: 41662 - DNA, 22 bp, Artificial Sequence
  chemically synthesized
ttgttctagactgcacttaaat

SEQ ID NO: 41663 - DNA, 22 bp, Artificial Sequence
  chemically synthesized
tgttctagactgcacttaaatc

SEQ ID NO: 41664 - DNA, 22 bp, Artificial Sequence
  chemically synthesized
gttctagactgcacttaaatct

SEQ ID NO: 41665 - DNA, 22 bp, Artificial Sequence
  chemically synthesized
ttctagactgcacttaaatctg

SEQ ID NO: 41666 - DNA, 22 bp, Artificial Sequence
  chemically synthesized
tagactgcacttaaatctggca

SEQ ID NO: 41667 - DNA, 22 bp, Artificial Sequence
  chemically synthesized
gactgcacttaaatctggcagc

SEQ ID NO: 41668 - DNA, 22 bp, Artificial Sequence
  chemically synthesized
cacttaaatctggcagcctttc

SEQ ID NO: 41669 - DNA, 22 bp, Artificial Sequence
  chemically synthesized
aaatctggcagcctttcaggtc

SEQ ID NO: 41670 - DNA, 22 bp, Artificial Sequence
  chemically synthesized
aatctggcagcctttcaggtca

SEQ ID NO: 41671 - DNA, 22 bp, Artificial Sequence
  chemically synthesized
gcagcctttcaggtcactcgat

SEQ ID NO: 41672 - DNA, 22 bp, Artificial Sequence
  chemically synthesized
tcaggtcactcgataaatgggc

SEQ ID NO: 41673 - DNA, 22 bp, Artificial Sequence
  chemically synthesized
caggtcactcgataaatgggcc

SEQ ID NO: 41674 - DNA, 22 bp, Artificial Sequence
  chemically synthesized
aggtcactcgataaatgggcca

SEQ ID NO: 41675 - DNA, 22 bp, Artificial Sequence
  chemically synthesized
gataaatgggccagagtaacac

SEQ ID NO: 41676 - DNA, 22 bp, Artificial Sequence
  chemically synthesized
cctccaaaatccaaataggccc

SEQ ID NO: 41677 - DNA, 22 bp, Artificial Sequence
  chemically synthesized
caaaatccaaataggcccacca

SEQ ID NO: 41678 - DNA, 22 bp, Artificial Sequence
  chemically synthesized
tgcctctttcttggttgtaaga

SEQ ID NO: 41679 - DNA, 22 bp, Artificial Sequence
  chemically synthesized
tttcttggttgtaagaggggcc

SEQ ID NO: 41680 - DNA, 22 bp, Artificial Sequence
  chemically synthesized
tcttggttgtaagaggggccaa

SEQ ID NO: 41681 - DNA, 22 bp, Artificial Sequence
  chemically synthesized
cttggttgtaagaggggccaaa

SEQ ID NO: 41682 - DNA, 22 bp, Artificial Sequence
  chemically synthesized
ttggttgtaagaggggccaaac

SEQ ID NO: 41683 - DNA, 22 bp, Artificial Sequence
  chemically synthesized
ggttgtaagaggggccaaacgc

SEQ ID NO: 41684 - DNA, 22 bp, Artificial Sequence
  chemically synthesized
gttgtaagaggggccaaacgca

SEQ ID NO: 41685 - DNA, 22 bp, Artificial Sequence
  chemically synthesized
taagaggggccaaacgcagcaa

SEQ ID NO: 41686 - DNA, 22 bp, Artificial Sequence
  chemically synthesized
tgcttcaccttagaaggaatat

SEQ ID NO: 41687 - DNA, 22 bp, Artificial Sequence
  chemically synthesized
caccttagaaggaatatctcca

SEQ ID NO: 41688 - DNA, 22 bp, Artificial Sequence
  chemically synthesized
accttagaaggaatatctccat

SEQ ID NO: 41689 - DNA, 22 bp, Artificial Sequence
  chemically synthesized
agaaggaatatctccataggtc

SEQ ID NO: 41690 - DNA, 22 bp, Artificial Sequence
  chemically synthesized
gaaggaatatctccataggtct

SEQ ID NO: 41691 - DNA, 22 bp, Artificial Sequence
  chemically synthesized
cataggtctcatgccactggaa

SEQ ID NO: 41692 - DNA, 22 bp, Artificial Sequence
  chemically synthesized
atgccactggaaccctagaaat

SEQ ID NO: 41693 - DNA, 22 bp, Artificial Sequence
  chemically synthesized
gaaccctagaaattttaccgag

SEQ ID NO: 41694 - DNA, 22 bp, Artificial Sequence
  chemically synthesized
gaaattttaccgaggtagaaag

SEQ ID NO: 41695 - DNA, 22 bp, Artificial Sequence
  chemically synthesized
taccgaggtagaaagtccctaa

SEQ ID NO: 41696 - DNA, 22 bp, Artificial Sequence
  chemically synthesized
accgaggtagaaagtccctaaa

SEQ ID NO: 41697 - DNA, 22 bp, Artificial Sequence
  chemically synthesized
ccgaggtagaaagtccctaaat

SEQ ID NO: 41698 - DNA, 22 bp, Artificial Sequence
  chemically synthesized
aattttagctggatttatttcc

SEQ ID NO: 41699 - DNA, 22 bp, Artificial Sequence
  chemically synthesized
tagctggatttatttcccatcc

SEQ ID NO: 41700 - DNA, 22 bp, Artificial Sequence
  chemically synthesized
agctggatttatttcccatcct

SEQ ID NO: 41701 - DNA, 22 bp, Artificial Sequence
  chemically synthesized
gctggatttatttcccatcctc

SEQ ID NO: 41702 - DNA, 22 bp, Artificial Sequence
  chemically synthesized
gatttatttcccatcctctggc

SEQ ID NO: 41703 - DNA, 22 bp, Artificial Sequence
  chemically synthesized
atttcccatcctctggcataca

SEQ ID NO: 41704 - DNA, 22 bp, Artificial Sequence
  chemically synthesized
tttcccatcctctggcatacaa

SEQ ID NO: 41705 - DNA, 22 bp, Artificial Sequence
  chemically synthesized
cccatcctctggcatacaaatg

SEQ ID NO: 41706 - DNA, 22 bp, Artificial Sequence
  chemically synthesized
ccatcctctggcatacaaatgt

SEQ ID NO: 41707 - DNA, 22 bp, Artificial Sequence
  chemically synthesized
tggcatacaaatgtctcaccaa

SEQ ID NO: 41708 - DNA, 22 bp, Artificial Sequence
  chemically synthesized
gcatacaaatgtctcaccaata

SEQ ID NO: 41709 - DNA, 22 bp, Artificial Sequence
  chemically synthesized
accaataagttcagtgtgtttg

SEQ ID NO: 41710 - DNA, 22 bp, Artificial Sequence
  chemically synthesized
agtgtgtttgctacttcttgct

SEQ ID NO: 41711 - DNA, 22 bp, Artificial Sequence
  chemically synthesized
gctacttcttgctcactgtatc

SEQ ID NO: 41712 - DNA, 22 bp, Artificial Sequence
  chemically synthesized
ctacttcttgctcactgtatcc

SEQ ID NO: 41713 - DNA, 22 bp, Artificial Sequence
  chemically synthesized
cttcttgctcactgtatccaat

SEQ ID NO: 41714 - DNA, 22 bp, Artificial Sequence
  chemically synthesized
cttgctcactgtatccaatcat

SEQ ID NO: 41715 - DNA, 22 bp, Artificial Sequence
  chemically synthesized
ttgctcactgtatccaatcatc

SEQ ID NO: 41716 - DNA, 22 bp, Artificial Sequence
  chemically synthesized
gctcactgtatccaatcatcat

SEQ ID NO: 41717 - DNA, 22 bp, Artificial Sequence
  chemically synthesized
ctcactgtatccaatcatcata

SEQ ID NO: 41718 - DNA, 22 bp, Artificial Sequence
  chemically synthesized
actgtatccaatcatcataatg

SEQ ID NO: 41719 - DNA, 22 bp, Artificial Sequence
  chemically synthesized
tatccaatcatcataatgtcat

SEQ ID NO: 41720 - DNA, 22 bp, Artificial Sequence
  chemically synthesized
tatctcgtggaagtgaaaagcg

SEQ ID NO: 41721 - DNA, 22 bp, Artificial Sequence
  chemically synthesized
gtggaagtgaaaagcgagcaag

SEQ ID NO: 41722 - DNA, 22 bp, Artificial Sequence
  chemically synthesized
tccaaataagattatgacacaa

SEQ ID NO: 41723 - DNA, 22 bp, Artificial Sequence
  chemically synthesized
caaataagattatgacacaaag

SEQ ID NO: 41724 - DNA, 22 bp, Artificial Sequence
  chemically synthesized
tgacacaaagctggagagttga

SEQ ID NO: 41725 - DNA, 22 bp, Artificial Sequence
  chemically synthesized
gagagttgatacacccctgagg

SEQ ID NO: 41726 - DNA, 22 bp, Artificial Sequence
  chemically synthesized
atacacccctgaggtagggtgg

SEQ ID NO: 41727 - DNA, 22 bp, Artificial Sequence
  chemically synthesized
aggtagggtggtaaaggtataa

SEQ ID NO: 41728 - DNA, 22 bp, Artificial Sequence
  chemically synthesized
gccttgtcagctgaaggcaaat

SEQ ID NO: 41729 - DNA, 22 bp, Artificial Sequence
  chemically synthesized
gtcagctgaaggcaaattgctt

SEQ ID NO: 41730 - DNA, 22 bp, Artificial Sequence
  chemically synthesized
tcagctgaaggcaaattgcttc

SEQ ID NO: 41731 - DNA, 22 bp, Artificial Sequence
  chemically synthesized
aaggcaaattgcttctggtggg

SEQ ID NO: 41732 - DNA, 22 bp, Artificial Sequence
  chemically synthesized
cttctggtgggtcttatggaca

SEQ ID NO: 41733 - DNA, 22 bp, Artificial Sequence
  chemically synthesized
ctggtgggtcttatggacagga

SEQ ID NO: 41734 - DNA, 22 bp, Artificial Sequence
  chemically synthesized
tggtgggtcttatggacaggaa

SEQ ID NO: 41735 - DNA, 22 bp, Artificial Sequence
  chemically synthesized
gtgggtcttatggacaggaatg

SEQ ID NO: 41736 - DNA, 22 bp, Artificial Sequence
  chemically synthesized
atggacaggaatggagaaaaag

SEQ ID NO: 41737 - DNA, 22 bp, Artificial Sequence
  chemically synthesized
tggacaggaatggagaaaaagc

SEQ ID NO: 41738 - DNA, 22 bp, Artificial Sequence
  chemically synthesized
gccaagccaatggctgcatacc

SEQ ID NO: 41739 - DNA, 22 bp, Artificial Sequence
  chemically synthesized
ccaagccaatggctgcatacca

SEQ ID NO: 41740 - DNA, 22 bp, Artificial Sequence
  chemically synthesized
cataccaggcaccaggagatgt

SEQ ID NO: 41741 - DNA, 22 bp, Artificial Sequence
  chemically synthesized
atttgctcaagcaacaaaacca

SEQ ID NO: 41742 - DNA, 22 bp, Artificial Sequence
  chemically synthesized
gctcaagcaacaaaaccacaac

SEQ ID NO: 41743 - DNA, 22 bp, Artificial Sequence
  chemically synthesized
ctcaagcaacaaaaccacaact

SEQ ID NO: 41744 - DNA, 22 bp, Artificial Sequence
  chemically synthesized
aagcaacaaaaccacaactggt

SEQ ID NO: 41745 - DNA, 22 bp, Artificial Sequence
  chemically synthesized
gtagagcagctgcaattggagt

SEQ ID NO: 41746 - DNA, 22 bp, Artificial Sequence
  chemically synthesized
caattggagtcaccacttggtt

SEQ ID NO: 41747 - DNA, 22 bp, Artificial Sequence
  chemically synthesized
gagtcaccacttggttaagctt

SEQ ID NO: 41748 - DNA, 22 bp, Artificial Sequence
  chemically synthesized
ggttaagcttaaaataatccac

SEQ ID NO: 41749 - DNA, 22 bp, Artificial Sequence
  chemically synthesized
gttaagcttaaaataatccacc

SEQ ID NO: 41750 - DNA, 22 bp, Artificial Sequence
  chemically synthesized
agcttaaaataatccaccatca

SEQ ID NO: 41751 - DNA, 22 bp, Artificial Sequence
  chemically synthesized
aaaataatccaccatcattttc

SEQ ID NO: 41752 - DNA, 22 bp, Artificial Sequence
  chemically synthesized
aaataatccaccatcattttcc

SEQ ID NO: 41753 - DNA, 22 bp, Artificial Sequence
  chemically synthesized
tccaagatccatctgtcctctg

SEQ ID NO: 41754 - DNA, 22 bp, Artificial Sequence
  chemically synthesized
ccaagatccatctgtcctctgc

SEQ ID NO: 41755 - DNA, 22 bp, Artificial Sequence
  chemically synthesized
caagatccatctgtcctctgca

SEQ ID NO: 41756 - DNA, 22 bp, Artificial Sequence
  chemically synthesized
tcctctgcacaggtcaaatggg

SEQ ID NO: 41757 - DNA, 22 bp, Artificial Sequence
  chemically synthesized
tgcacaggtcaaatgggagagt

SEQ ID NO: 41758 - DNA, 22 bp, Artificial Sequence
  chemically synthesized
cacaggtcaaatgggagagttg

SEQ ID NO: 41759 - DNA, 22 bp, Artificial Sequence
  chemically synthesized
aacagggatgtggtgggaatca

SEQ ID NO: 41760 - DNA, 22 bp, Artificial Sequence
  chemically synthesized
cgtctttcaagtccttgatggt

SEQ ID NO: 41761 - DNA, 22 bp, Artificial Sequence
  chemically synthesized
tcaagtccttgatggtgacact

SEQ ID NO: 41762 - DNA, 22 bp, Artificial Sequence
  chemically synthesized
caagtccttgatggtgacacta

SEQ ID NO: 41763 - DNA, 22 bp, Artificial Sequence
  chemically synthesized
aagtccttgatggtgacactaa

SEQ ID NO: 41764 - DNA, 22 bp, Artificial Sequence
  chemically synthesized
gatggtgacactaatcacttca

SEQ ID NO: 41765 - DNA, 22 bp, Artificial Sequence
  chemically synthesized
atggtgacactaatcacttcag

SEQ ID NO: 41766 - DNA, 22 bp, Artificial Sequence
  chemically synthesized
atcacttcagtccctccaggga

SEQ ID NO: 41767 - DNA, 22 bp, Artificial Sequence
  chemically synthesized
cagtccctccagggatgggata

SEQ ID NO: 41768 - DNA, 22 bp, Artificial Sequence
  chemically synthesized
agtccctccagggatgggatat

SEQ ID NO: 41769 - DNA, 22 bp, Artificial Sequence
  chemically synthesized
cagggatgggatattgtttttg

SEQ ID NO: 41770 - DNA, 22 bp, Artificial Sequence
  chemically synthesized
tttttgatttttttatttttct

SEQ ID NO: 41771 - DNA, 22 bp, Artificial Sequence
  chemically synthesized
ttgatttttttatttttctagg

SEQ ID NO: 41772 - DNA, 22 bp, Artificial Sequence
  chemically synthesized
tgatttttttatttttctaggt

SEQ ID NO: 41773 - DNA, 22 bp, Artificial Sequence
  chemically synthesized
gatttttttatttttctaggta

SEQ ID NO: 41774 - DNA, 22 bp, Artificial Sequence
  chemically synthesized
atttttttatttttctaggtag

SEQ ID NO: 41775 - DNA, 22 bp, Artificial Sequence
  chemically synthesized
ttttatttttctaggtagagac

SEQ ID NO: 41776 - DNA, 22 bp, Artificial Sequence
  chemically synthesized
tttatttttctaggtagagaca

SEQ ID NO: 41777 - DNA, 22 bp, Artificial Sequence
  chemically synthesized
ttatttttctaggtagagacag

SEQ ID NO: 41778 - DNA, 22 bp, Artificial Sequence
  chemically synthesized
tatttttctaggtagagacagc

SEQ ID NO: 41779 - DNA, 22 bp, Artificial Sequence
  chemically synthesized
atttttctaggtagagacagct

SEQ ID NO: 41780 - DNA, 22 bp, Artificial Sequence
  chemically synthesized
tttttctaggtagagacagctc

SEQ ID NO: 41781 - DNA, 22 bp, Artificial Sequence
  chemically synthesized
ttctaggtagagacagctctaa

SEQ ID NO: 41782 - DNA, 22 bp, Artificial Sequence
  chemically synthesized
tctaggtagagacagctctaat

SEQ ID NO: 41783 - DNA, 22 bp, Artificial Sequence
  chemically synthesized
ctaggtagagacagctctaatg

SEQ ID NO: 41784 - DNA, 22 bp, Artificial Sequence
  chemically synthesized
taggtagagacagctctaatgg

SEQ ID NO: 41785 - DNA, 22 bp, Artificial Sequence
  chemically synthesized
ggtagagacagctctaatggct

SEQ ID NO: 41786 - DNA, 22 bp, Artificial Sequence
  chemically synthesized
taatggcttctgtttggccttt

SEQ ID NO: 41787 - DNA, 22 bp, Artificial Sequence
  chemically synthesized
atggcttctgtttggcctttcc

SEQ ID NO: 41788 - DNA, 22 bp, Artificial Sequence
  chemically synthesized
ctgtttggcctttcccaccata

SEQ ID NO: 41789 - DNA, 22 bp, Artificial Sequence
  chemically synthesized
tgtttggcctttcccaccataa

SEQ ID NO: 41790 - DNA, 22 bp, Artificial Sequence
  chemically synthesized
tttggcctttcccaccataata

SEQ ID NO: 41791 - DNA, 22 bp, Artificial Sequence
  chemically synthesized
ggcctttcccaccataatagcc

SEQ ID NO: 41792 - DNA, 22 bp, Artificial Sequence
  chemically synthesized
gcctttcccaccataatagccc

SEQ ID NO: 41793 - DNA, 22 bp, Artificial Sequence
  chemically synthesized
tcccaccataatagccctcatc

SEQ ID NO: 41794 - DNA, 22 bp, Artificial Sequence
  chemically synthesized
cccaccataatagccctcatcc

SEQ ID NO: 41795 - DNA, 22 bp, Artificial Sequence
  chemically synthesized
ccaccataatagccctcatcct

SEQ ID NO: 41796 - DNA, 22 bp, Artificial Sequence
  chemically synthesized
atcctaccagtcagggagccaa

SEQ ID NO: 41797 - DNA, 22 bp, Artificial Sequence
  chemically synthesized
ccagtcagggagccaatgtggc

SEQ ID NO: 41798 - DNA, 22 bp, Artificial Sequence
  chemically synthesized
ctgccagctaataagtatgtct

SEQ ID NO: 41799 - DNA, 22 bp, Artificial Sequence
  chemically synthesized
tgccagctaataagtatgtcta

SEQ ID NO: 41800 - DNA, 22 bp, Artificial Sequence
  chemically synthesized
ccagctaataagtatgtctata

SEQ ID NO: 41801 - DNA, 22 bp, Artificial Sequence
  chemically synthesized
ataagtatgtctatacaaatta

SEQ ID NO: 41802 - DNA, 22 bp, Artificial Sequence
  chemically synthesized
tacaaattatgcattttggcac

SEQ ID NO: 41803 - DNA, 22 bp, Artificial Sequence
  chemically synthesized
tgcattttggcactgggaaaat

SEQ ID NO: 41804 - DNA, 22 bp, Artificial Sequence
  chemically synthesized
tggcactgggaaaatgaccaga

SEQ ID NO: 41805 - DNA, 22 bp, Artificial Sequence
  chemically synthesized
ggcactgggaaaatgaccagag

SEQ ID NO: 41806 - DNA, 22 bp, Artificial Sequence
  chemically synthesized
gcactgggaaaatgaccagagg

SEQ ID NO: 41807 - DNA, 22 bp, Artificial Sequence
  chemically synthesized
ggaaaatgaccagaggataagt

SEQ ID NO: 41808 - DNA, 22 bp, Artificial Sequence
  chemically synthesized
gaaccactgtaagtcagaaatg

SEQ ID NO: 41809 - DNA, 22 bp, Artificial Sequence
  chemically synthesized
taagtcagaaatgagctaaaac

SEQ ID NO: 41810 - DNA, 22 bp, Artificial Sequence
  chemically synthesized
aaactccattaattacctaacc

SEQ ID NO: 41811 - DNA, 22 bp, Artificial Sequence
  chemically synthesized
cattaattacctaacctccata

SEQ ID NO: 41812 - DNA, 22 bp, Artificial Sequence
  chemically synthesized
attacctaacctccataagccc

SEQ ID NO: 41813 - DNA, 22 bp, Artificial Sequence
  chemically synthesized
cctaacctccataagcccctac

SEQ ID NO: 41814 - DNA, 22 bp, Artificial Sequence
  chemically synthesized
acctccataagcccctacttta

SEQ ID NO: 41815 - DNA, 22 bp, Artificial Sequence
  chemically synthesized
cataagcccctactttaactgg

SEQ ID NO: 41816 - DNA, 22 bp, Artificial Sequence
  chemically synthesized
ctttaactggggaaccacaata

SEQ ID NO: 41817 - DNA, 22 bp, Artificial Sequence
  chemically synthesized
taactggggaaccacaataacg

SEQ ID NO: 41818 - DNA, 22 bp, Artificial Sequence
  chemically synthesized
aactggggaaccacaataacgt

SEQ ID NO: 41819 - DNA, 22 bp, Artificial Sequence
  chemically synthesized
actggggaaccacaataacgtt

SEQ ID NO: 41820 - DNA, 22 bp, Artificial Sequence
  chemically synthesized
gggaaccacaataacgttttgg

SEQ ID NO: 41821 - DNA, 22 bp, Artificial Sequence
  chemically synthesized
tgggtaccctggaatcaacgtc

SEQ ID NO: 41822 - DNA, 22 bp, Artificial Sequence
  chemically synthesized
gggtaccctggaatcaacgtca

SEQ ID NO: 41823 - DNA, 22 bp, Artificial Sequence
  chemically synthesized
ggtaccctggaatcaacgtcag

SEQ ID NO: 41824 - DNA, 22 bp, Artificial Sequence
  chemically synthesized
gaatcaacgtcagctcagagcc

SEQ ID NO: 41825 - DNA, 22 bp, Artificial Sequence
  chemically synthesized
agagccagtgtccagtactttc

SEQ ID NO: 41826 - DNA, 22 bp, Artificial Sequence
  chemically synthesized
tctgaaatgtctcattacttcc

SEQ ID NO: 41827 - DNA, 22 bp, Artificial Sequence
  chemically synthesized
ctgaaatgtctcattacttccc

SEQ ID NO: 41828 - DNA, 22 bp, Artificial Sequence
  chemically synthesized
tgaaatgtctcattacttccct

SEQ ID NO: 41829 - DNA, 22 bp, Artificial Sequence
  chemically synthesized
aaatgtctcattacttcccttt

SEQ ID NO: 41830 - DNA, 22 bp, Artificial Sequence
  chemically synthesized
attacttccctttctccagtac

SEQ ID NO: 41831 - DNA, 22 bp, Artificial Sequence
  chemically synthesized
cttccctttctccagtacacac

SEQ ID NO: 41832 - DNA, 22 bp, Artificial Sequence
  chemically synthesized
ccctttctccagtacacacagt

SEQ ID NO: 41833 - DNA, 22 bp, Artificial Sequence
  chemically synthesized
cctttctccagtacacacagtt

SEQ ID NO: 41834 - DNA, 22 bp, Artificial Sequence
  chemically synthesized
tctccagtacacacagttaccc

SEQ ID NO: 41835 - DNA, 22 bp, Artificial Sequence
  chemically synthesized
ctccagtacacacagttaccct

SEQ ID NO: 41836 - DNA, 22 bp, Artificial Sequence
  chemically synthesized
tccagtacacacagttaccctg

SEQ ID NO: 41837 - DNA, 22 bp, Artificial Sequence
  chemically synthesized
cagtacacacagttaccctggt

SEQ ID NO: 41838 - DNA, 22 bp, Artificial Sequence
  chemically synthesized
ccctggtaaaaggccagaggtc

SEQ ID NO: 41839 - DNA, 22 bp, Artificial Sequence
  chemically synthesized
gtaaaaggccagaggtctcctt

SEQ ID NO: 41840 - DNA, 22 bp, Artificial Sequence
  chemically synthesized
cttagggaaggatgggagaaag

SEQ ID NO: 41841 - DNA, 22 bp, Artificial Sequence
  chemically synthesized
agggaaggatgggagaaagagt

SEQ ID NO: 41842 - DNA, 22 bp, Artificial Sequence
  chemically synthesized
gggaaggatgggagaaagagta

SEQ ID NO: 41843 - DNA, 22 bp, Artificial Sequence
  chemically synthesized
tcagtagcctagtggtgtcctt

SEQ ID NO: 41844 - DNA, 22 bp, Artificial Sequence
  chemically synthesized
gtggtgtccttcctcaagggga

SEQ ID NO: 41845 - DNA, 22 bp, Artificial Sequence
  chemically synthesized
cctcaaggggatccagcctccc

SEQ ID NO: 41846 - DNA, 22 bp, Artificial Sequence
  chemically synthesized
ctcaaggggatccagcctcccc

SEQ ID NO: 41847 - DNA, 22 bp, Artificial Sequence
  chemically synthesized
aaggggatccagcctccccttc

SEQ ID NO: 41848 - DNA, 22 bp, Artificial Sequence
  chemically synthesized
cccttcattcagtgggttctgg

SEQ ID NO: 41849 - DNA, 22 bp, Artificial Sequence
  chemically synthesized
cattcagtgggttctggaactg

SEQ ID NO: 41850 - DNA, 22 bp, Artificial Sequence
  chemically synthesized
attcagtgggttctggaactgt

SEQ ID NO: 41851 - DNA, 22 bp, Artificial Sequence
  chemically synthesized
agtgggttctggaactgtaaca

SEQ ID NO: 41852 - DNA, 22 bp, Artificial Sequence
  chemically synthesized
tggaactgtaacaggttcgagt

SEQ ID NO: 41853 - DNA, 22 bp, Artificial Sequence
  chemically synthesized
gaactgtaacaggttcgagtct

SEQ ID NO: 41854 - DNA, 22 bp, Artificial Sequence
  chemically synthesized
taacaggttcgagtctggaaat

SEQ ID NO: 41855 - DNA, 22 bp, Artificial Sequence
  chemically synthesized
gagtctggaaattgattgaggg

SEQ ID NO: 41856 - DNA, 22 bp, Artificial Sequence
  chemically synthesized
gaaattgattgagggcccatga

SEQ ID NO: 41857 - DNA, 22 bp, Artificial Sequence
  chemically synthesized
attgagggcccatgattctctg

SEQ ID NO: 41858 - DNA, 22 bp, Artificial Sequence
  chemically synthesized
agggcccatgattctctgtttt

SEQ ID NO: 41859 - DNA, 22 bp, Artificial Sequence
  chemically synthesized
tctgtttttataattcagatta

SEQ ID NO: 41860 - DNA, 22 bp, Artificial Sequence
  chemically synthesized
tgtttttataattcagattagt

SEQ ID NO: 41861 - DNA, 22 bp, Artificial Sequence
  chemically synthesized
tttttataattcagattagtct

SEQ ID NO: 41862 - DNA, 22 bp, Artificial Sequence
  chemically synthesized
ttataattcagattagtcttta

SEQ ID NO: 41863 - DNA, 22 bp, Artificial Sequence
  chemically synthesized
tataattcagattagtctttag

SEQ ID NO: 41864 - DNA, 22 bp, Artificial Sequence
  chemically synthesized
ataattcagattagtctttagt

SEQ ID NO: 41865 - DNA, 22 bp, Artificial Sequence
  chemically synthesized
taattcagattagtctttagtc

SEQ ID NO: 41866 - DNA, 22 bp, Artificial Sequence
  chemically synthesized
agattagtctttagtccattct

SEQ ID NO: 41867 - DNA, 22 bp, Artificial Sequence
  chemically synthesized
gtctttagtccattctacctgg

SEQ ID NO: 41868 - DNA, 22 bp, Artificial Sequence
  chemically synthesized
tagtccattctacctggcagtt

SEQ ID NO: 41869 - DNA, 22 bp, Artificial Sequence
  chemically synthesized
agtccattctacctggcagttt

SEQ ID NO: 41870 - DNA, 22 bp, Artificial Sequence
  chemically synthesized
gtccattctacctggcagtttt

SEQ ID NO: 41871 - DNA, 22 bp, Artificial Sequence
  chemically synthesized
tacctggcagttttttgtttat

SEQ ID NO: 41872 - DNA, 22 bp, Artificial Sequence
  chemically synthesized
cctggcagttttttgtttatat

SEQ ID NO: 41873 - DNA, 22 bp, Artificial Sequence
  chemically synthesized
gcagttttttgtttatataaat

SEQ ID NO: 41874 - DNA, 22 bp, Artificial Sequence
  chemically synthesized
tttgtttatataaatcaagtag

SEQ ID NO: 41875 - DNA, 22 bp, Artificial Sequence
  chemically synthesized
ttgtttatataaatcaagtagg

SEQ ID NO: 41876 - DNA, 22 bp, Artificial Sequence
  chemically synthesized
tgtttatataaatcaagtagga

SEQ ID NO: 41877 - DNA, 22 bp, Artificial Sequence
  chemically synthesized
gtttatataaatcaagtaggaa

SEQ ID NO: 41878 - DNA, 22 bp, Artificial Sequence
  chemically synthesized
tttatataaatcaagtaggaat

SEQ ID NO: 41879 - DNA, 22 bp, Artificial Sequence
  chemically synthesized
atataaatcaagtaggaataca

SEQ ID NO: 41880 - DNA, 22 bp, Artificial Sequence
  chemically synthesized
tataaatcaagtaggaatacag

SEQ ID NO: 41881 - DNA, 22 bp, Artificial Sequence
  chemically synthesized
cccatcaatttcacttctagga

SEQ ID NO: 41882 - DNA, 22 bp, Artificial Sequence
  chemically synthesized
ccatcaatttcacttctaggaa

SEQ ID NO: 41883 - DNA, 22 bp, Artificial Sequence
  chemically synthesized
cacttctaggaacaccatgatt

SEQ ID NO: 41884 - DNA, 22 bp, Artificial Sequence
  chemically synthesized
acttctaggaacaccatgatta

SEQ ID NO: 41885 - DNA, 22 bp, Artificial Sequence
  chemically synthesized
ctaggaacaccatgattaatta

SEQ ID NO: 41886 - DNA, 22 bp, Artificial Sequence
  chemically synthesized
taggaacaccatgattaattag

SEQ ID NO: 41887 - DNA, 22 bp, Artificial Sequence
  chemically synthesized
ggaacaccatgattaattagcc

SEQ ID NO: 41888 - DNA, 22 bp, Artificial Sequence
  chemically synthesized
attagccaatgccagagctcta

SEQ ID NO: 41889 - DNA, 22 bp, Artificial Sequence
  chemically synthesized
gccaatgccagagctctacatg

SEQ ID NO: 41890 - DNA, 22 bp, Artificial Sequence
  chemically synthesized
tacatgagtcagactattctga

SEQ ID NO: 41891 - DNA, 22 bp, Artificial Sequence
  chemically synthesized
catgagtcagactattctgatg

SEQ ID NO: 41892 - DNA, 22 bp, Artificial Sequence
  chemically synthesized
ttctgatggctgctttgcctct

SEQ ID NO: 41893 - DNA, 22 bp, Artificial Sequence
  chemically synthesized
tgatggctgctttgcctctgct

SEQ ID NO: 41894 - DNA, 22 bp, Artificial Sequence
  chemically synthesized
atggctgctttgcctctgctgt

SEQ ID NO: 41895 - DNA, 22 bp, Artificial Sequence
  chemically synthesized
ctttgcctctgctgtctattat

SEQ ID NO: 41896 - DNA, 22 bp, Artificial Sequence
  chemically synthesized
tgcctctgctgtctattatggt

SEQ ID NO: 41897 - DNA, 22 bp, Artificial Sequence
  chemically synthesized
gcctctgctgtctattatggta

SEQ ID NO: 41898 - DNA, 22 bp, Artificial Sequence
  chemically synthesized
cctctgctgtctattatggtag

SEQ ID NO: 41899 - DNA, 22 bp, Artificial Sequence
  chemically synthesized
tgctgtctattatggtagttat

SEQ ID NO: 41900 - DNA, 22 bp, Artificial Sequence
  chemically synthesized
ctgtctattatggtagttatgc

SEQ ID NO: 41901 - DNA, 22 bp, Artificial Sequence
  chemically synthesized
tctattatggtagttatgccca

SEQ ID NO: 41902 - DNA, 22 bp, Artificial Sequence
  chemically synthesized
ttatggtagttatgcccacctt

SEQ ID NO: 41903 - DNA, 22 bp, Artificial Sequence
  chemically synthesized
tggtagttatgcccaccttgcc

SEQ ID NO: 41904 - DNA, 22 bp, Artificial Sequence
  chemically synthesized
tgcccaccttgcctttgatggt

SEQ ID NO: 41905 - DNA, 22 bp, Artificial Sequence
  chemically synthesized
gcctttgatggttcagtgccaa

SEQ ID NO: 41906 - DNA, 22 bp, Artificial Sequence
  chemically synthesized
cctttgatggttcagtgccaac

SEQ ID NO: 41907 - DNA, 22 bp, Artificial Sequence
  chemically synthesized
tgatggttcagtgccaacactt

SEQ ID NO: 41908 - DNA, 22 bp, Artificial Sequence
  chemically synthesized
gatggttcagtgccaacacttg

SEQ ID NO: 41909 - DNA, 22 bp, Artificial Sequence
  chemically synthesized
atggttcagtgccaacacttgg

SEQ ID NO: 41910 - DNA, 22 bp, Artificial Sequence
  chemically synthesized
agtgccaacacttggcccctgc

SEQ ID NO: 41911 - DNA, 22 bp, Artificial Sequence
  chemically synthesized
ggcccctgccacctcaggatcc

SEQ ID NO: 41912 - DNA, 22 bp, Artificial Sequence
  chemically synthesized
gcccctgccacctcaggatcca

SEQ ID NO: 41913 - DNA, 22 bp, Artificial Sequence
  chemically synthesized
ccacctcaggatccaattattc

SEQ ID NO: 41914 - DNA, 22 bp, Artificial Sequence
  chemically synthesized
aggatccaattattcccattgt

SEQ ID NO: 41915 - DNA, 22 bp, Artificial Sequence
  chemically synthesized
ttcccattgtatttaaattttg

SEQ ID NO: 41916 - DNA, 22 bp, Artificial Sequence
  chemically synthesized
ccattgtatttaaattttgtag

SEQ ID NO: 41917 - DNA, 22 bp, Artificial Sequence
  chemically synthesized
tatttaaattttgtagttgagt

SEQ ID NO: 41918 - DNA, 22 bp, Artificial Sequence
  chemically synthesized
aaattttgtagttgagtgactg

SEQ ID NO: 41919 - DNA, 22 bp, Artificial Sequence
  chemically synthesized
aattttgtagttgagtgactgt

SEQ ID NO: 41920 - DNA, 22 bp, Artificial Sequence
  chemically synthesized
tgtagttgagtgactgtggttc

SEQ ID NO: 41921 - DNA, 22 bp, Artificial Sequence
  chemically synthesized
gtagttgagtgactgtggttcc

SEQ ID NO: 41922 - DNA, 22 bp, Artificial Sequence
  chemically synthesized
tagttgagtgactgtggttcct

SEQ ID NO: 41923 - DNA, 22 bp, Artificial Sequence
  chemically synthesized
agtgactgtggttcctactgtt

SEQ ID NO: 41924 - DNA, 22 bp, Artificial Sequence
  chemically synthesized
tggttcctactgttagatctga

SEQ ID NO: 41925 - DNA, 22 bp, Artificial Sequence
  chemically synthesized
ctactgttagatctgacataca

SEQ ID NO: 41926 - DNA, 22 bp, Artificial Sequence
  chemically synthesized
ctgttagatctgacatacagag

SEQ ID NO: 41927 - DNA, 22 bp, Artificial Sequence
  chemically synthesized
ttagatctgacatacagagaag

SEQ ID NO: 41928 - DNA, 22 bp, Artificial Sequence
  chemically synthesized
gatctgacatacagagaagagc

SEQ ID NO: 41929 - DNA, 22 bp, Artificial Sequence
  chemically synthesized
acatacagagaagagcaattac

SEQ ID NO: 41930 - DNA, 22 bp, Artificial Sequence
  chemically synthesized
cgggctcttcaaaaatacaggt

SEQ ID NO: 41931 - DNA, 22 bp, Artificial Sequence
  chemically synthesized
ttcaaaaatacaggtgctgctc

SEQ ID NO: 41932 - DNA, 22 bp, Artificial Sequence
  chemically synthesized
caaaaatacaggtgctgctctc

SEQ ID NO: 41933 - DNA, 22 bp, Artificial Sequence
  chemically synthesized
aaaaatacaggtgctgctctca

SEQ ID NO: 41934 - DNA, 22 bp, Artificial Sequence
  chemically synthesized
ctctcacaaatctatttcacaa

SEQ ID NO: 41935 - DNA, 22 bp, Artificial Sequence
  chemically synthesized
tcacaaatctatttcacaaagc

SEQ ID NO: 41936 - DNA, 22 bp, Artificial Sequence
  chemically synthesized
acaaatctatttcacaaagctt

SEQ ID NO: 41937 - DNA, 22 bp, Artificial Sequence
  chemically synthesized
tttcacaaagcttcggccaagg

SEQ ID NO: 41938 - DNA, 22 bp, Artificial Sequence
  chemically synthesized
cacaaagcttcggccaagggtg

SEQ ID NO: 41939 - DNA, 22 bp, Artificial Sequence
  chemically synthesized
acaaagcttcggccaagggtgt

SEQ ID NO: 41940 - DNA, 22 bp, Artificial Sequence
  chemically synthesized
cggccaagggtgtatcttctgg

SEQ ID NO: 41941 - DNA, 22 bp, Artificial Sequence
  chemically synthesized
ggccaagggtgtatcttctgga

SEQ ID NO: 41942 - DNA, 22 bp, Artificial Sequence
  chemically synthesized
ctggaccctcccagctgggatg

SEQ ID NO: 41943 - DNA, 22 bp, Artificial Sequence
  chemically synthesized
tggaccctcccagctgggatga

SEQ ID NO: 41944 - DNA, 22 bp, Artificial Sequence
  chemically synthesized
gaccctcccagctgggatgagt

SEQ ID NO: 41945 - DNA, 22 bp, Artificial Sequence
  chemically synthesized
ccagctgggatgagtaggtcta

SEQ ID NO: 41946 - DNA, 22 bp, Artificial Sequence
  chemically synthesized
ggatgagtaggtctaaagtgac

SEQ ID NO: 41947 - DNA, 22 bp, Artificial Sequence
  chemically synthesized
aagtgactaatccactccacca

SEQ ID NO: 41948 - DNA, 22 bp, Artificial Sequence
  chemically synthesized
atccactccaccatcctaatct

SEQ ID NO: 41949 - DNA, 22 bp, Artificial Sequence
  chemically synthesized
caccatcctaatctccctaagc

SEQ ID NO: 41950 - DNA, 22 bp, Artificial Sequence
  chemically synthesized
atctccctaagcctttggatca

SEQ ID NO: 41951 - DNA, 22 bp, Artificial Sequence
  chemically synthesized
cctaagcctttggatcacttcc

SEQ ID NO: 41952 - DNA, 22 bp, Artificial Sequence
  chemically synthesized
agcctttggatcacttcctcta

SEQ ID NO: 41953 - DNA, 22 bp, Artificial Sequence
  chemically synthesized
tggatcacttcctctacattaa

SEQ ID NO: 41954 - DNA, 22 bp, Artificial Sequence
  chemically synthesized
ggatcacttcctctacattaaa

SEQ ID NO: 41955 - DNA, 22 bp, Artificial Sequence
  chemically synthesized
gatcacttcctctacattaaac

SEQ ID NO: 41956 - DNA, 22 bp, Artificial Sequence
  chemically synthesized
cctctacattaaaccaaggcat

SEQ ID NO: 41957 - DNA, 22 bp, Artificial Sequence
  chemically synthesized
ctctacattaaaccaaggcatt

SEQ ID NO: 41958 - DNA, 22 bp, Artificial Sequence
  chemically synthesized
tacattaaaccaaggcatttcc

SEQ ID NO: 41959 - DNA, 22 bp, Artificial Sequence
  chemically synthesized
cattaaaccaaggcatttccag

SEQ ID NO: 41960 - DNA, 22 bp, Artificial Sequence
  chemically synthesized
aaccaaggcatttccagctcac

SEQ ID NO: 41961 - DNA, 22 bp, Artificial Sequence
  chemically synthesized
ccagctcactaacattggacca

SEQ ID NO: 41962 - DNA, 22 bp, Artificial Sequence
  chemically synthesized
cagctcactaacattggaccat

SEQ ID NO: 41963 - DNA, 22 bp, Artificial Sequence
  chemically synthesized
actaacattggaccatctttta

SEQ ID NO: 41964 - DNA, 22 bp, Artificial Sequence
  chemically synthesized
acattggaccatcttttaatcc

SEQ ID NO: 41965 - DNA, 22 bp, Artificial Sequence
  chemically synthesized
gaccatcttttaatccatattt

SEQ ID NO: 41966 - DNA, 22 bp, Artificial Sequence
  chemically synthesized
ttaatccatatttcagctaacc

SEQ ID NO: 41967 - DNA, 22 bp, Artificial Sequence
  chemically synthesized
taatccatatttcagctaacca

SEQ ID NO: 41968 - DNA, 22 bp, Artificial Sequence
  chemically synthesized
aatccatatttcagctaaccaa

SEQ ID NO: 41969 - DNA, 22 bp, Artificial Sequence
  chemically synthesized
atccatatttcagctaaccaag

SEQ ID NO: 41970 - DNA, 22 bp, Artificial Sequence
  chemically synthesized
cagctaaccaagcaaataaact

SEQ ID NO: 41971 - DNA, 22 bp, Artificial Sequence
  chemically synthesized
agctaaccaagcaaataaacta

SEQ ID NO: 41972 - DNA, 22 bp, Artificial Sequence
  chemically synthesized
accaagcaaataaactattata

SEQ ID NO: 41973 - DNA, 22 bp, Artificial Sequence
  chemically synthesized
ttataacttttttttttttttt

SEQ ID NO: 41974 - DNA, 22 bp, Artificial Sequence
  chemically synthesized
taactttttttttttttttttt

SEQ ID NO: 41975 - DNA, 22 bp, Artificial Sequence
  chemically synthesized
ttttttttttttttttggaaat

SEQ ID NO: 41976 - DNA, 22 bp, Artificial Sequence
  chemically synthesized
tttttttttttttttggaaatg

SEQ ID NO: 41977 - DNA, 22 bp, Artificial Sequence
  chemically synthesized
ttttttttttttttggaaatgg

SEQ ID NO: 41978 - DNA, 22 bp, Artificial Sequence
  chemically synthesized
tttttttttttttggaaatgga

SEQ ID NO: 41979 - DNA, 22 bp, Artificial Sequence
  chemically synthesized
ttttttttttttggaaatggag

SEQ ID NO: 41980 - DNA, 22 bp, Artificial Sequence
  chemically synthesized
tttttttttttggaaatggagt

SEQ ID NO: 41981 - DNA, 22 bp, Artificial Sequence
  chemically synthesized
ttttttttttggaaatggagtc

SEQ ID NO: 41982 - DNA, 22 bp, Artificial Sequence
  chemically synthesized
tttttttttggaaatggagtct

SEQ ID NO: 41983 - DNA, 22 bp, Artificial Sequence
  chemically synthesized
ttttttttggaaatggagtctt

SEQ ID NO: 41984 - DNA, 22 bp, Artificial Sequence
  chemically synthesized
tttttttggaaatggagtcttg

SEQ ID NO: 41985 - DNA, 22 bp, Artificial Sequence
  chemically synthesized
ttttttggaaatggagtcttgc

SEQ ID NO: 41986 - DNA, 22 bp, Artificial Sequence
  chemically synthesized
tttttggaaatggagtcttgct

SEQ ID NO: 41987 - DNA, 22 bp, Artificial Sequence
  chemically synthesized
ttttggaaatggagtcttgctc

SEQ ID NO: 41988 - DNA, 22 bp, Artificial Sequence
  chemically synthesized
tttggaaatggagtcttgctct

SEQ ID NO: 41989 - DNA, 22 bp, Artificial Sequence
  chemically synthesized
ttggaaatggagtcttgctctg

SEQ ID NO: 41990 - DNA, 22 bp, Artificial Sequence
  chemically synthesized
tggaaatggagtcttgctctgt

SEQ ID NO: 41991 - DNA, 22 bp, Artificial Sequence
  chemically synthesized
ggaaatggagtcttgctctgtt

SEQ ID NO: 41992 - DNA, 22 bp, Artificial Sequence
  chemically synthesized
gaaatggagtcttgctctgtta

SEQ ID NO: 41993 - DNA, 22 bp, Artificial Sequence
  chemically synthesized
gctctgttaccaggctggaatg

SEQ ID NO: 41994 - DNA, 22 bp, Artificial Sequence
  chemically synthesized
ctctgttaccaggctggaatgc

SEQ ID NO: 41995 - DNA, 22 bp, Artificial Sequence
  chemically synthesized
tgttaccaggctggaatgcagt

SEQ ID NO: 41996 - DNA, 22 bp, Artificial Sequence
  chemically synthesized
ttaccaggctggaatgcagtgg

SEQ ID NO: 41997 - DNA, 22 bp, Artificial Sequence
  chemically synthesized
ccaggctggaatgcagtggggc

SEQ ID NO: 41998 - DNA, 22 bp, Artificial Sequence
  chemically synthesized
gaatgcagtggggcgatcttgg

SEQ ID NO: 41999 - DNA, 22 bp, Artificial Sequence
  chemically synthesized
ggctcactgcaatctctgcctc

SEQ ID NO: 42000 - DNA, 22 bp, Artificial Sequence
  chemically synthesized
gctcactgcaatctctgcctca

SEQ ID NO: 42001 - DNA, 22 bp, Artificial Sequence
  chemically synthesized
actgcaatctctgcctcacagg

SEQ ID NO: 42002 - DNA, 22 bp, Artificial Sequence
  chemically synthesized
caatctctgcctcacaggttca

SEQ ID NO: 42003 - DNA, 22 bp, Artificial Sequence
  chemically synthesized
tgcctcacaggttcaagcagtt

SEQ ID NO: 42004 - DNA, 22 bp, Artificial Sequence
  chemically synthesized
cctcacaggttcaagcagttct

SEQ ID NO: 42005 - DNA, 22 bp, Artificial Sequence
  chemically synthesized
acaggttcaagcagttctcttg

SEQ ID NO: 42006 - DNA, 22 bp, Artificial Sequence
  chemically synthesized
aagcagttctcttgcctcagcc

SEQ ID NO: 42007 - DNA, 22 bp, Artificial Sequence
  chemically synthesized
tcttgcctcagcctcccaagta

SEQ ID NO: 42008 - DNA, 22 bp, Artificial Sequence
  chemically synthesized
ttgcctcagcctcccaagtaga

SEQ ID NO: 42009 - DNA, 22 bp, Artificial Sequence
  chemically synthesized
gcctcagcctcccaagtagatg

SEQ ID NO: 42010 - DNA, 22 bp, Artificial Sequence
  chemically synthesized
cctcagcctcccaagtagatga

SEQ ID NO: 42011 - DNA, 22 bp, Artificial Sequence
  chemically synthesized
agcctcccaagtagatgagatt

SEQ ID NO: 42012 - DNA, 22 bp, Artificial Sequence
  chemically synthesized
ccaagtagatgagattacagtt

SEQ ID NO: 42013 - DNA, 22 bp, Artificial Sequence
  chemically synthesized
cagttacgcatcaccatgccca

SEQ ID NO: 42014 - DNA, 22 bp, Artificial Sequence
  chemically synthesized
cgcatcaccatgcccagctaat

SEQ ID NO: 42015 - DNA, 22 bp, Artificial Sequence
  chemically synthesized
atttttgtatttttagcagaga

SEQ ID NO: 42016 - DNA, 22 bp, Artificial Sequence
  chemically synthesized
ttgtatttttagcagagatggg

SEQ ID NO: 42017 - DNA, 22 bp, Artificial Sequence
  chemically synthesized
tgtatttttagcagagatgggg

SEQ ID NO: 42018 - DNA, 22 bp, Artificial Sequence
  chemically synthesized
gtatttttagcagagatggggt

SEQ ID NO: 42019 - DNA, 22 bp, Artificial Sequence
  chemically synthesized
tatttttagcagagatggggtt

SEQ ID NO: 42020 - DNA, 22 bp, Artificial Sequence
  chemically synthesized
ttagcagagatggggtttcacc

SEQ ID NO: 42021 - DNA, 22 bp, Artificial Sequence
  chemically synthesized
tagcagagatggggtttcacca

SEQ ID NO: 42022 - DNA, 22 bp, Artificial Sequence
  chemically synthesized
agcagagatggggtttcaccat

SEQ ID NO: 42023 - DNA, 22 bp, Artificial Sequence
  chemically synthesized
gcagagatggggtttcaccatt

SEQ ID NO: 42024 - DNA, 22 bp, Artificial Sequence
  chemically synthesized
caccattttagccagaattgtc

SEQ ID NO: 42025 - DNA, 22 bp, Artificial Sequence
  chemically synthesized
accattttagccagaattgtct

SEQ ID NO: 42026 - DNA, 22 bp, Artificial Sequence
  chemically synthesized
tagccagaattgtctcaatctc

SEQ ID NO: 42027 - DNA, 22 bp, Artificial Sequence
  chemically synthesized
agccagaattgtctcaatctcc

SEQ ID NO: 42028 - DNA, 22 bp, Artificial Sequence
  chemically synthesized
gccagaattgtctcaatctcct

SEQ ID NO: 42029 - DNA, 22 bp, Artificial Sequence
  chemically synthesized
tctcaatctcctgatctcgtga

SEQ ID NO: 42030 - DNA, 22 bp, Artificial Sequence
  chemically synthesized
aatctcctgatctcgtgatctg

SEQ ID NO: 42031 - DNA, 22 bp, Artificial Sequence
  chemically synthesized
ctgatctcgtgatctgcccgcc

SEQ ID NO: 42032 - DNA, 22 bp, Artificial Sequence
  chemically synthesized
atctcgtgatctgcccgccccc

SEQ ID NO: 42033 - DNA, 22 bp, Artificial Sequence
  chemically synthesized
gtgatctgcccgcccccgcctc

SEQ ID NO: 42034 - DNA, 22 bp, Artificial Sequence
  chemically synthesized
cccgcccccgcctcccaaggtg

SEQ ID NO: 42035 - DNA, 22 bp, Artificial Sequence
  chemically synthesized
ccaaggtgctgggattacaggc

SEQ ID NO: 42036 - DNA, 22 bp, Artificial Sequence
  chemically synthesized
ggattacaggcgtgagccactg

SEQ ID NO: 42037 - DNA, 22 bp, Artificial Sequence
  chemically synthesized
caggcgtgagccactgctcccg

SEQ ID NO: 42038 - DNA, 22 bp, Artificial Sequence
  chemically synthesized
ctcccggccctatcagaacctt

SEQ ID NO: 42039 - DNA, 22 bp, Artificial Sequence
  chemically synthesized
ccggccctatcagaaccttttc

SEQ ID NO: 42040 - DNA, 22 bp, Artificial Sequence
  chemically synthesized
tcagaaccttttctaagtcccc

SEQ ID NO: 42041 - DNA, 22 bp, Artificial Sequence
  chemically synthesized
ttctaagtccccgagctgcaac

SEQ ID NO: 42042 - DNA, 22 bp, Artificial Sequence
  chemically synthesized
tctaagtccccgagctgcaaca

SEQ ID NO: 42043 - DNA, 22 bp, Artificial Sequence
  chemically synthesized
ctaagtccccgagctgcaacat

SEQ ID NO: 42044 - DNA, 22 bp, Artificial Sequence
  chemically synthesized
taagtccccgagctgcaacatt

SEQ ID NO: 42045 - DNA, 22 bp, Artificial Sequence
  chemically synthesized
agtccccgagctgcaacattaa

SEQ ID NO: 42046 - DNA, 22 bp, Artificial Sequence
  chemically synthesized
caacattaaatgcagaatccct

SEQ ID NO: 42047 - DNA, 22 bp, Artificial Sequence
  chemically synthesized
aatgcagaatccctacttagta

SEQ ID NO: 42048 - DNA, 22 bp, Artificial Sequence
  chemically synthesized
cttagtagggccaaaccaataa

SEQ ID NO: 42049 - DNA, 22 bp, Artificial Sequence
  chemically synthesized
agtagggccaaaccaataaatt

SEQ ID NO: 42050 - DNA, 22 bp, Artificial Sequence
  chemically synthesized
gtagggccaaaccaataaattc

SEQ ID NO: 42051 - DNA, 22 bp, Artificial Sequence
  chemically synthesized
agcttgatccaactctatgtcc

SEQ ID NO: 42052 - DNA, 22 bp, Artificial Sequence
  chemically synthesized
gatccaactctatgtcccttcc

SEQ ID NO: 42053 - DNA, 22 bp, Artificial Sequence
  chemically synthesized
atccaactctatgtcccttcca

SEQ ID NO: 42054 - DNA, 22 bp, Artificial Sequence
  chemically synthesized
tatgtcccttccaccattatcc

SEQ ID NO: 42055 - DNA, 22 bp, Artificial Sequence
  chemically synthesized
tgtcccttccaccattatccct

SEQ ID NO: 42056 - DNA, 22 bp, Artificial Sequence
  chemically synthesized
ccaccattatcccttaccctta

SEQ ID NO: 42057 - DNA, 22 bp, Artificial Sequence
  chemically synthesized
caccattatcccttacccttaa

SEQ ID NO: 42058 - DNA, 22 bp, Artificial Sequence
  chemically synthesized
tcccttacccttaatatccatt

SEQ ID NO: 42059 - DNA, 22 bp, Artificial Sequence
  chemically synthesized
acccttaatatccattcccatg

SEQ ID NO: 42060 - DNA, 22 bp, Artificial Sequence
  chemically synthesized
cccttaatatccattcccatgc

SEQ ID NO: 42061 - DNA, 22 bp, Artificial Sequence
  chemically synthesized
aatatccattcccatgcctgtt

SEQ ID NO: 42062 - DNA, 22 bp, Artificial Sequence
  chemically synthesized
atatccattcccatgcctgttc

SEQ ID NO: 42063 - DNA, 22 bp, Artificial Sequence
  chemically synthesized
ccatgcctgttctccagatttc

SEQ ID NO: 42064 - DNA, 22 bp, Artificial Sequence
  chemically synthesized
ttctccagatttctgccaatat

SEQ ID NO: 42065 - DNA, 22 bp, Artificial Sequence
  chemically synthesized
tccagatttctgccaatataaa

SEQ ID NO: 42066 - DNA, 22 bp, Artificial Sequence
  chemically synthesized
cagatttctgccaatataaatt

SEQ ID NO: 42067 - DNA, 22 bp, Artificial Sequence
  chemically synthesized
ctgccaatataaattagaaagc

SEQ ID NO: 42068 - DNA, 22 bp, Artificial Sequence
  chemically synthesized
tgccaatataaattagaaagct

SEQ ID NO: 42069 - DNA, 22 bp, Artificial Sequence
  chemically synthesized
ccaatataaattagaaagctta

SEQ ID NO: 42070 - DNA, 22 bp, Artificial Sequence
  chemically synthesized
gaaagcttaagcagttctttta

SEQ ID NO: 42071 - DNA, 22 bp, Artificial Sequence
  chemically synthesized
aagcagttcttttagagtataa

SEQ ID NO: 42072 - DNA, 22 bp, Artificial Sequence
  chemically synthesized
agcagttcttttagagtataat

SEQ ID NO: 42073 - DNA, 22 bp, Artificial Sequence
  chemically synthesized
ttttagagtataatgcacctcc

SEQ ID NO: 42074 - DNA, 22 bp, Artificial Sequence
  chemically synthesized
ttagagtataatgcacctcctc

SEQ ID NO: 42075 - DNA, 22 bp, Artificial Sequence
  chemically synthesized
tagagtataatgcacctcctca

SEQ ID NO: 42076 - DNA, 22 bp, Artificial Sequence
  chemically synthesized
agagtataatgcacctcctcat

SEQ ID NO: 42077 - DNA, 22 bp, Artificial Sequence
  chemically synthesized
gagtataatgcacctcctcatg

SEQ ID NO: 42078 - DNA, 22 bp, Artificial Sequence
  chemically synthesized
ctcatgggtcacactctgaacc

SEQ ID NO: 42079 - DNA, 22 bp, Artificial Sequence
  chemically synthesized
atgggtcacactctgaacctca

SEQ ID NO: 42080 - DNA, 22 bp, Artificial Sequence
  chemically synthesized
tgaacctcacctctggggcccg

SEQ ID NO: 42081 - DNA, 22 bp, Artificial Sequence
  chemically synthesized
aacctcacctctggggcccgca

SEQ ID NO: 42082 - DNA, 22 bp, Artificial Sequence
  chemically synthesized
acctctggggcccgcaaggaat

SEQ ID NO: 42083 - DNA, 22 bp, Artificial Sequence
  chemically synthesized
tggggcccgcaaggaatttagc

SEQ ID NO: 42084 - DNA, 22 bp, Artificial Sequence
  chemically synthesized
gggcccgcaaggaatttagcct

SEQ ID NO: 42085 - DNA, 22 bp, Artificial Sequence
  chemically synthesized
agcctagttataggtctagaag

SEQ ID NO: 42086 - DNA, 22 bp, Artificial Sequence
  chemically synthesized
gcctagttataggtctagaagc

SEQ ID NO: 42087 - DNA, 22 bp, Artificial Sequence
  chemically synthesized
gttataggtctagaagcattca

SEQ ID NO: 42088 - DNA, 22 bp, Artificial Sequence
  chemically synthesized
taggtctagaagcattcagggg

SEQ ID NO: 42089 - DNA, 22 bp, Artificial Sequence
  chemically synthesized
gaagcattcaggggcattaggg

SEQ ID NO: 42090 - DNA, 22 bp, Artificial Sequence
  chemically synthesized
aggggcattaggggtgcctctt

SEQ ID NO: 42091 - DNA, 22 bp, Artificial Sequence
  chemically synthesized
ggggtgcctcttgaggagaatc

SEQ ID NO: 42092 - DNA, 22 bp, Artificial Sequence
  chemically synthesized
ttgaggagaatcaacattatct

SEQ ID NO: 42093 - DNA, 22 bp, Artificial Sequence
  chemically synthesized
gaggagaatcaacattatcttg

SEQ ID NO: 42094 - DNA, 22 bp, Artificial Sequence
  chemically synthesized
aggagaatcaacattatcttgc

SEQ ID NO: 42095 - DNA, 22 bp, Artificial Sequence
  chemically synthesized
tcttgcctggcagctgcctcag

SEQ ID NO: 42096 - DNA, 22 bp, Artificial Sequence
  chemically synthesized
gcctggcagctgcctcagggaa

SEQ ID NO: 42097 - DNA, 22 bp, Artificial Sequence
  chemically synthesized
cctggcagctgcctcagggaag

SEQ ID NO: 42098 - DNA, 22 bp, Artificial Sequence
  chemically synthesized
gcagctgcctcagggaaggcca

SEQ ID NO: 42099 - DNA, 22 bp, Artificial Sequence
  chemically synthesized
cctcagggaaggccatcactgt

SEQ ID NO: 42100 - DNA, 22 bp, Artificial Sequence
  chemically synthesized
agggaaggccatcactgttgcc

SEQ ID NO: 42101 - DNA, 22 bp, Artificial Sequence
  chemically synthesized
ttgcctcaagcagtgcagggtt

SEQ ID NO: 42102 - DNA, 22 bp, Artificial Sequence
  chemically synthesized
cctcaagcagtgcagggtttac

SEQ ID NO: 42103 - DNA, 22 bp, Artificial Sequence
  chemically synthesized
aagcagtgcagggtttacatcc

SEQ ID NO: 42104 - DNA, 22 bp, Artificial Sequence
  chemically synthesized
acatcctcagacaaaggtggaa

SEQ ID NO: 42105 - DNA, 22 bp, Artificial Sequence
  chemically synthesized
catcctcagacaaaggtggaaa

SEQ ID NO: 42106 - DNA, 22 bp, Artificial Sequence
  chemically synthesized
agacaaaggtggaaaggctaat

SEQ ID NO: 42107 - DNA, 22 bp, Artificial Sequence
  chemically synthesized
atggcagcacgggtcagggagg

SEQ ID NO: 42108 - DNA, 22 bp, Artificial Sequence
  chemically synthesized
ccactactggggatggggaaac

SEQ ID NO: 42109 - DNA, 22 bp, Artificial Sequence
  chemically synthesized
ctggggatggggaaactgtttc

SEQ ID NO: 42110 - DNA, 22 bp, Artificial Sequence
  chemically synthesized
gggatggggaaactgtttcttc

SEQ ID NO: 42111 - DNA, 22 bp, Artificial Sequence
  chemically synthesized
tttcttctggcaaaaaagtttc

SEQ ID NO: 42112 - DNA, 22 bp, Artificial Sequence
  chemically synthesized
cttctggcaaaaaagtttcatc

SEQ ID NO: 42113 - DNA, 22 bp, Artificial Sequence
  chemically synthesized
ttctggcaaaaaagtttcatca

SEQ ID NO: 42114 - DNA, 22 bp, Artificial Sequence
  chemically synthesized
ctggcaaaaaagtttcatcaga

SEQ ID NO: 42115 - DNA, 22 bp, Artificial Sequence
  chemically synthesized
tggcaaaaaagtttcatcagag

SEQ ID NO: 42116 - DNA, 22 bp, Artificial Sequence
  chemically synthesized
gcaaaaaagtttcatcagagtt

SEQ ID NO: 42117 - DNA, 22 bp, Artificial Sequence
  chemically synthesized
catcagagttcacaaactcagt

SEQ ID NO: 42118 - DNA, 22 bp, Artificial Sequence
  chemically synthesized
atcagagttcacaaactcagtg

SEQ ID NO: 42119 - DNA, 22 bp, Artificial Sequence
  chemically synthesized
acaaactcagtgtcctcagctt

SEQ ID NO: 42120 - DNA, 22 bp, Artificial Sequence
  chemically synthesized
agtgtcctcagcttcatcaggg

SEQ ID NO: 42121 - DNA, 22 bp, Artificial Sequence
  chemically synthesized
agcttcatcagggttctcccac

SEQ ID NO: 42122 - DNA, 22 bp, Artificial Sequence
  chemically synthesized
catcagggttctcccacacatc

SEQ ID NO: 42123 - DNA, 22 bp, Artificial Sequence
  chemically synthesized
atcagggttctcccacacatcc

SEQ ID NO: 42124 - DNA, 22 bp, Artificial Sequence
  chemically synthesized
tcccacacatccccactccaag

SEQ ID NO: 42125 - DNA, 22 bp, Artificial Sequence
  chemically synthesized
ccacacatccccactccaagtt

SEQ ID NO: 42126 - DNA, 22 bp, Artificial Sequence
  chemically synthesized
caagttccagggtcccattttt

SEQ ID NO: 42127 - DNA, 22 bp, Artificial Sequence
  chemically synthesized
cagggtcccatttttttccagt

SEQ ID NO: 42128 - DNA, 22 bp, Artificial Sequence
  chemically synthesized
ttttccagtcaatgccctcact

SEQ ID NO: 42129 - DNA, 22 bp, Artificial Sequence
  chemically synthesized
tttccagtcaatgccctcactt

SEQ ID NO: 42130 - DNA, 22 bp, Artificial Sequence
  chemically synthesized
ttccagtcaatgccctcacttt

SEQ ID NO: 42131 - DNA, 22 bp, Artificial Sequence
  chemically synthesized
tccagtcaatgccctcacttta

SEQ ID NO: 42132 - DNA, 22 bp, Artificial Sequence
  chemically synthesized
ccagtcaatgccctcactttaa

SEQ ID NO: 42133 - DNA, 22 bp, Artificial Sequence
  chemically synthesized
cagtcaatgccctcactttaac

SEQ ID NO: 42134 - DNA, 22 bp, Artificial Sequence
  chemically synthesized
actttaacagtaaacacctggc

SEQ ID NO: 42135 - DNA, 22 bp, Artificial Sequence
  chemically synthesized
taacagtaaacacctggcaagg

SEQ ID NO: 42136 - DNA, 22 bp, Artificial Sequence
  chemically synthesized
aacagtaaacacctggcaaggc

SEQ ID NO: 42137 - DNA, 22 bp, Artificial Sequence
  chemically synthesized
acagtaaacacctggcaaggct

SEQ ID NO: 42138 - DNA, 22 bp, Artificial Sequence
  chemically synthesized
gcaaggctgtgcatgcacctct

SEQ ID NO: 42139 - DNA, 22 bp, Artificial Sequence
  chemically synthesized
tgcatgcacctcttgttgcaga

SEQ ID NO: 42140 - DNA, 22 bp, Artificial Sequence
  chemically synthesized
ttgttgcagatcagctactcgc

SEQ ID NO: 42141 - DNA, 22 bp, Artificial Sequence
  chemically synthesized
gttgcagatcagctactcgcat

SEQ ID NO: 42142 - DNA, 22 bp, Artificial Sequence
  chemically synthesized
ttgcagatcagctactcgcatg

SEQ ID NO: 42143 - DNA, 22 bp, Artificial Sequence
  chemically synthesized
cagatcagctactcgcatgata

SEQ ID NO: 42144 - DNA, 22 bp, Artificial Sequence
  chemically synthesized
ctcgcatgataacagcttgtct

SEQ ID NO: 42145 - DNA, 22 bp, Artificial Sequence
  chemically synthesized
gcatgataacagcttgtctctg

SEQ ID NO: 42146 - DNA, 22 bp, Artificial Sequence
  chemically synthesized
gtctctgttttttcacaatttc

SEQ ID NO: 42147 - DNA, 22 bp, Artificial Sequence
  chemically synthesized
tctctgttttttcacaatttca

SEQ ID NO: 42148 - DNA, 22 bp, Artificial Sequence
  chemically synthesized
tgttttttcacaatttcaactc

SEQ ID NO: 42149 - DNA, 22 bp, Artificial Sequence
  chemically synthesized
ttttttcacaatttcaactctt

SEQ ID NO: 42150 - DNA, 22 bp, Artificial Sequence
  chemically synthesized
tttcacaatttcaactctttct

SEQ ID NO: 42151 - DNA, 22 bp, Artificial Sequence
  chemically synthesized
ttcacaatttcaactctttctc

SEQ ID NO: 42152 - DNA, 22 bp, Artificial Sequence
  chemically synthesized
tcacaatttcaactctttctct

SEQ ID NO: 42153 - DNA, 22 bp, Artificial Sequence
  chemically synthesized
cacaatttcaactctttctcta

SEQ ID NO: 42154 - DNA, 22 bp, Artificial Sequence
  chemically synthesized
acaatttcaactctttctctac

SEQ ID NO: 42155 - DNA, 22 bp, Artificial Sequence
  chemically synthesized
caactctttctctacaggagtt

SEQ ID NO: 42156 - DNA, 22 bp, Artificial Sequence
  chemically synthesized
aactctttctctacaggagtta

SEQ ID NO: 42157 - DNA, 22 bp, Artificial Sequence
  chemically synthesized
tttctctacaggagttaaaact

SEQ ID NO: 42158 - DNA, 22 bp, Artificial Sequence
  chemically synthesized
tctctacaggagttaaaactct

SEQ ID NO: 42159 - DNA, 22 bp, Artificial Sequence
  chemically synthesized
ctctacaggagttaaaactctc

SEQ ID NO: 42160 - DNA, 22 bp, Artificial Sequence
  chemically synthesized
tctacaggagttaaaactctca

SEQ ID NO: 42161 - DNA, 22 bp, Artificial Sequence
  chemically synthesized
tacaggagttaaaactctcatt

SEQ ID NO: 42162 - DNA, 22 bp, Artificial Sequence
  chemically synthesized
caggagttaaaactctcattca

SEQ ID NO: 42163 - DNA, 22 bp, Artificial Sequence
  chemically synthesized
aaactctcattcagggcaatct

SEQ ID NO: 42164 - DNA, 22 bp, Artificial Sequence
  chemically synthesized
tcattcagggcaatcttagcag

SEQ ID NO: 42165 - DNA, 22 bp, Artificial Sequence
  chemically synthesized
attcagggcaatcttagcagat

SEQ ID NO: 42166 - DNA, 22 bp, Artificial Sequence
  chemically synthesized
agggcaatcttagcagatttgt

SEQ ID NO: 42167 - DNA, 22 bp, Artificial Sequence
  chemically synthesized
agcagatttgtggctcagtatc

SEQ ID NO: 42168 - DNA, 22 bp, Artificial Sequence
  chemically synthesized
gcagatttgtggctcagtatct

SEQ ID NO: 42169 - DNA, 22 bp, Artificial Sequence
  chemically synthesized
gtggctcagtatctgcttctga

SEQ ID NO: 42170 - DNA, 22 bp, Artificial Sequence
  chemically synthesized
tggctcagtatctgcttctgaa

SEQ ID NO: 42171 - DNA, 22 bp, Artificial Sequence
  chemically synthesized
agtatctgcttctgaaggtggg

SEQ ID NO: 42172 - DNA, 22 bp, Artificial Sequence
  chemically synthesized
cttctgaaggtgggagacagat

SEQ ID NO: 42173 - DNA, 22 bp, Artificial Sequence
  chemically synthesized
ctgaaggtgggagacagatccc

SEQ ID NO: 42174 - DNA, 22 bp, Artificial Sequence
  chemically synthesized
tgaaggtgggagacagatcccc

SEQ ID NO: 42175 - DNA, 22 bp, Artificial Sequence
  chemically synthesized
aaggtgggagacagatcccctg

SEQ ID NO: 42176 - DNA, 22 bp, Artificial Sequence
  chemically synthesized
agatcatcattttctttcatct

SEQ ID NO: 42177 - DNA, 22 bp, Artificial Sequence
  chemically synthesized
tctttcatctctttctccagag

SEQ ID NO: 42178 - DNA, 22 bp, Artificial Sequence
  chemically synthesized
ctttcatctctttctccagaga

SEQ ID NO: 42179 - DNA, 22 bp, Artificial Sequence
  chemically synthesized
tttcatctctttctccagagaa

SEQ ID NO: 42180 - DNA, 22 bp, Artificial Sequence
  chemically synthesized
tcatctctttctccagagaact

SEQ ID NO: 42181 - DNA, 22 bp, Artificial Sequence
  chemically synthesized
catctctttctccagagaactt

SEQ ID NO: 42182 - DNA, 22 bp, Artificial Sequence
  chemically synthesized
atctctttctccagagaactta

SEQ ID NO: 42183 - DNA, 22 bp, Artificial Sequence
  chemically synthesized
tttctccagagaacttaggagc

SEQ ID NO: 42184 - DNA, 22 bp, Artificial Sequence
  chemically synthesized
tctccagagaacttaggagcaa

SEQ ID NO: 42185 - DNA, 22 bp, Artificial Sequence
  chemically synthesized
ctccagagaacttaggagcaat

SEQ ID NO: 42186 - DNA, 22 bp, Artificial Sequence
  chemically synthesized
tccagagaacttaggagcaatc

SEQ ID NO: 42187 - DNA, 22 bp, Artificial Sequence
  chemically synthesized
cagagaacttaggagcaatcaa

SEQ ID NO: 42188 - DNA, 22 bp, Artificial Sequence
  chemically synthesized
aggagcaatcaaccaacttcat

SEQ ID NO: 42189 - DNA, 22 bp, Artificial Sequence
  chemically synthesized
ggagcaatcaaccaacttcatt

SEQ ID NO: 42190 - DNA, 22 bp, Artificial Sequence
  chemically synthesized
cattatgttccttggttctcca

SEQ ID NO: 42191 - DNA, 22 bp, Artificial Sequence
  chemically synthesized
attatgttccttggttctccac

SEQ ID NO: 42192 - DNA, 22 bp, Artificial Sequence
  chemically synthesized
tgttccttggttctccacatat

SEQ ID NO: 42193 - DNA, 22 bp, Artificial Sequence
  chemically synthesized
cttggttctccacatatagtca

SEQ ID NO: 42194 - DNA, 22 bp, Artificial Sequence
  chemically synthesized
ggttctccacatatagtcaaag

SEQ ID NO: 42195 - DNA, 22 bp, Artificial Sequence
  chemically synthesized
gttctccacatatagtcaaagg

SEQ ID NO: 42196 - DNA, 22 bp, Artificial Sequence
  chemically synthesized
tccacatatagtcaaaggtatt

SEQ ID NO: 42197 - DNA, 22 bp, Artificial Sequence
  chemically synthesized
cacatatagtcaaaggtattat

SEQ ID NO: 42198 - DNA, 22 bp, Artificial Sequence
  chemically synthesized
tgtatagagtcactaaactcct

SEQ ID NO: 42199 - DNA, 22 bp, Artificial Sequence
  chemically synthesized
aactccttgcctctcataagtg

SEQ ID NO: 42200 - DNA, 22 bp, Artificial Sequence
  chemically synthesized
cttgcctctcataagtgatgaa

SEQ ID NO: 42201 - DNA, 22 bp, Artificial Sequence
  chemically synthesized
gcctctcataagtgatgaatca

SEQ ID NO: 42202 - DNA, 22 bp, Artificial Sequence
  chemically synthesized
cctctcataagtgatgaatcag

SEQ ID NO: 42203 - DNA, 22 bp, Artificial Sequence
  chemically synthesized
tcataagtgatgaatcagtagt

SEQ ID NO: 42204 - DNA, 22 bp, Artificial Sequence
  chemically synthesized
ataagtgatgaatcagtagtgt

SEQ ID NO: 42205 - DNA, 22 bp, Artificial Sequence
  chemically synthesized
attttgcataactctctaaaca

SEQ ID NO: 42206 - DNA, 22 bp, Artificial Sequence
  chemically synthesized
ttttgcataactctctaaacaa

SEQ ID NO: 42207 - DNA, 22 bp, Artificial Sequence
  chemically synthesized
tgcataactctctaaacaattc

SEQ ID NO: 42208 - DNA, 22 bp, Artificial Sequence
  chemically synthesized
gcataactctctaaacaattca

SEQ ID NO: 42209 - DNA, 22 bp, Artificial Sequence
  chemically synthesized
cataactctctaaacaattcag

SEQ ID NO: 42210 - DNA, 22 bp, Artificial Sequence
  chemically synthesized
tctaaacaattcaggccaagta

SEQ ID NO: 42211 - DNA, 22 bp, Artificial Sequence
  chemically synthesized
taaacaattcaggccaagtact

SEQ ID NO: 42212 - DNA, 22 bp, Artificial Sequence
  chemically synthesized
aacaattcaggccaagtactat

SEQ ID NO: 42213 - DNA, 22 bp, Artificial Sequence
  chemically synthesized
aggccaagtactatcagtgttc

SEQ ID NO: 42214 - DNA, 22 bp, Artificial Sequence
  chemically synthesized
tcagtgttctccatactattag

SEQ ID NO: 42215 - DNA, 22 bp, Artificial Sequence
  chemically synthesized
tccatactattagaagtagagt

SEQ ID NO: 42216 - DNA, 22 bp, Artificial Sequence
  chemically synthesized
catactattagaagtagagtcc

SEQ ID NO: 42217 - DNA, 22 bp, Artificial Sequence
  chemically synthesized
ttagaagtagagtccttagcat

SEQ ID NO: 42218 - DNA, 22 bp, Artificial Sequence
  chemically synthesized
gaagtagagtccttagcatttt

SEQ ID NO: 42219 - DNA, 22 bp, Artificial Sequence
  chemically synthesized
agcattttttggtctaatcata

SEQ ID NO: 42220 - DNA, 22 bp, Artificial Sequence
  chemically synthesized
gcattttttggtctaatcatat

SEQ ID NO: 42221 - DNA, 22 bp, Artificial Sequence
  chemically synthesized
tttggtctaatcatattaatca

SEQ ID NO: 42222 - DNA, 22 bp, Artificial Sequence
  chemically synthesized
ttggtctaatcatattaatcag

SEQ ID NO: 42223 - DNA, 22 bp, Artificial Sequence
  chemically synthesized
tggtctaatcatattaatcagc

SEQ ID NO: 42224 - DNA, 22 bp, Artificial Sequence
  chemically synthesized
ggtctaatcatattaatcagcc

SEQ ID NO: 42225 - DNA, 22 bp, Artificial Sequence
  chemically synthesized
gtctaatcatattaatcagcca

SEQ ID NO: 42226 - DNA, 22 bp, Artificial Sequence
  chemically synthesized
atcatattaatcagccaacacc

SEQ ID NO: 42227 - DNA, 22 bp, Artificial Sequence
  chemically synthesized
atcagccaacaccagaagtccc

SEQ ID NO: 42228 - DNA, 22 bp, Artificial Sequence
  chemically synthesized
catccttaatattctgttcctc

SEQ ID NO: 42229 - DNA, 22 bp, Artificial Sequence
  chemically synthesized
aatattctgttcctcaagaacc

SEQ ID NO: 42230 - DNA, 22 bp, Artificial Sequence
  chemically synthesized
atattctgttcctcaagaacca

SEQ ID NO: 42231 - DNA, 22 bp, Artificial Sequence
  chemically synthesized
tgttcctcaagaaccacttctg

SEQ ID NO: 42232 - DNA, 22 bp, Artificial Sequence
  chemically synthesized
ttcctcaagaaccacttctggt

SEQ ID NO: 42233 - DNA, 22 bp, Artificial Sequence
  chemically synthesized
ctcaagaaccacttctggtatg

SEQ ID NO: 42234 - DNA, 22 bp, Artificial Sequence
  chemically synthesized
aagaaccacttctggtatgaaa

SEQ ID NO: 42235 - DNA, 22 bp, Artificial Sequence
  chemically synthesized
ctggtatgaaaatctgtattag

SEQ ID NO: 42236 - DNA, 22 bp, Artificial Sequence
  chemically synthesized
tggtatgaaaatctgtattagt

SEQ ID NO: 42237 - DNA, 22 bp, Artificial Sequence
  chemically synthesized
gtatgaaaatctgtattagtcg

SEQ ID NO: 42238 - DNA, 22 bp, Artificial Sequence
  chemically synthesized
tattagtcggggttctctagag

SEQ ID NO: 42239 - DNA, 22 bp, Artificial Sequence
  chemically synthesized
gtcggggttctctagagggaca

SEQ ID NO: 42240 - DNA, 22 bp, Artificial Sequence
  chemically synthesized
tctagagggacagaactaatag

SEQ ID NO: 42241 - DNA, 22 bp, Artificial Sequence
  chemically synthesized
tagagggacagaactaatagga

SEQ ID NO: 42242 - DNA, 22 bp, Artificial Sequence
  chemically synthesized
gagggacagaactaataggaga

SEQ ID NO: 42243 - DNA, 22 bp, Artificial Sequence
  chemically synthesized
ataggagattatatatatatat

SEQ ID NO: 42244 - DNA, 22 bp, Artificial Sequence
  chemically synthesized
tatatatatatatatgagagag

SEQ ID NO: 42245 - DNA, 22 bp, Artificial Sequence
  chemically synthesized
tatctatctatagatatagata

SEQ ID NO: 42246 - DNA, 22 bp, Artificial Sequence
  chemically synthesized
tctatagatatagatatactca

SEQ ID NO: 42247 - DNA, 22 bp, Artificial Sequence
  chemically synthesized
tagatatagatatactcacaca

SEQ ID NO: 42248 - DNA, 22 bp, Artificial Sequence
  chemically synthesized
acacaaaggggagcttattaag

SEQ ID NO: 42249 - DNA, 22 bp, Artificial Sequence
  chemically synthesized
attaagtggtattaactcacaa

SEQ ID NO: 42250 - DNA, 22 bp, Artificial Sequence
  chemically synthesized
ttaagtggtattaactcacaag

SEQ ID NO: 42251 - DNA, 22 bp, Artificial Sequence
  chemically synthesized
agtggtattaactcacaagatt

SEQ ID NO: 42252 - DNA, 22 bp, Artificial Sequence
  chemically synthesized
actcacaagattacaaggtccc

SEQ ID NO: 42253 - DNA, 22 bp, Artificial Sequence
  chemically synthesized
acaagattacaaggtcccataa

SEQ ID NO: 42254 - DNA, 22 bp, Artificial Sequence
  chemically synthesized
caaggtcccataataggccacc

SEQ ID NO: 42255 - DNA, 22 bp, Artificial Sequence
  chemically synthesized
caatctgaggagcaaggaagac

SEQ ID NO: 42256 - DNA, 22 bp, Artificial Sequence
  chemically synthesized
aggagcaaggaagacagtccaa

SEQ ID NO: 42257 - DNA, 22 bp, Artificial Sequence
  chemically synthesized
aagaacttggagtccgatgttc

SEQ ID NO: 42258 - DNA, 22 bp, Artificial Sequence
  chemically synthesized
ggagtccgatgttcaagagcag

SEQ ID NO: 42259 - DNA, 22 bp, Artificial Sequence
  chemically synthesized
gagtccgatgttcaagagcagg

SEQ ID NO: 42260 - DNA, 22 bp, Artificial Sequence
  chemically synthesized
aagagcaggaaggatccagcac

SEQ ID NO: 42261 - DNA, 22 bp, Artificial Sequence
  chemically synthesized
ggaggctaagccagtctagcct

SEQ ID NO: 42262 - DNA, 22 bp, Artificial Sequence
  chemically synthesized
agccagtctagcctttttacat

SEQ ID NO: 42263 - DNA, 22 bp, Artificial Sequence
  chemically synthesized
gcctttttacatttttctgcca

SEQ ID NO: 42264 - DNA, 22 bp, Artificial Sequence
  chemically synthesized
tttacatttttctgccagcttt

SEQ ID NO: 42265 - DNA, 22 bp, Artificial Sequence
  chemically synthesized
ttacatttttctgccagcttta

SEQ ID NO: 42266 - DNA, 22 bp, Artificial Sequence
  chemically synthesized
tacatttttctgccagctttat

SEQ ID NO: 42267 - DNA, 22 bp, Artificial Sequence
  chemically synthesized
acatttttctgccagctttata

SEQ ID NO: 42268 - DNA, 22 bp, Artificial Sequence
  chemically synthesized
catttttctgccagctttatat

SEQ ID NO: 42269 - DNA, 22 bp, Artificial Sequence
  chemically synthesized
ttctgccagctttatattctgg

SEQ ID NO: 42270 - DNA, 22 bp, Artificial Sequence
  chemically synthesized
tctgccagctttatattctggc

SEQ ID NO: 42271 - DNA, 22 bp, Artificial Sequence
  chemically synthesized
ctgccagctttatattctggct

SEQ ID NO: 42272 - DNA, 22 bp, Artificial Sequence
  chemically synthesized
tgccagctttatattctggctc

SEQ ID NO: 42273 - DNA, 22 bp, Artificial Sequence
  chemically synthesized
ccagctttatattctggctcta

SEQ ID NO: 42274 - DNA, 22 bp, Artificial Sequence
  chemically synthesized
tatattctggctctacagcttg

SEQ ID NO: 42275 - DNA, 22 bp, Artificial Sequence
  chemically synthesized
atattctggctctacagcttgg

SEQ ID NO: 42276 - DNA, 22 bp, Artificial Sequence
  chemically synthesized
tattctggctctacagcttggg

SEQ ID NO: 42277 - DNA, 22 bp, Artificial Sequence
  chemically synthesized
tggctctacagcttgggggcag

SEQ ID NO: 42278 - DNA, 22 bp, Artificial Sequence
  chemically synthesized
gctctacagcttgggggcagca

SEQ ID NO: 42279 - DNA, 22 bp, Artificial Sequence
  chemically synthesized
tacagcttgggggcagcagggg

SEQ ID NO: 42280 - DNA, 22 bp, Artificial Sequence
  chemically synthesized
cagcttgggggcagcaggggca

SEQ ID NO: 42281 - DNA, 22 bp, Artificial Sequence
  chemically synthesized
gggggcagcaggggcaggggcc

SEQ ID NO: 42282 - DNA, 22 bp, Artificial Sequence
  chemically synthesized
ggggcagcaggggcaggggcct

SEQ ID NO: 42283 - DNA, 22 bp, Artificial Sequence
  chemically synthesized
agggtgcttgcagggatgacac

SEQ ID NO: 42284 - DNA, 22 bp, Artificial Sequence
  chemically synthesized
gcagggatgacacactggcctc

SEQ ID NO: 42285 - DNA, 22 bp, Artificial Sequence
  chemically synthesized
cagggatgacacactggcctct

SEQ ID NO: 42286 - DNA, 22 bp, Artificial Sequence
  chemically synthesized
gcctcttttccatagggtggct

SEQ ID NO: 42287 - DNA, 22 bp, Artificial Sequence
  chemically synthesized
ttttccatagggtggctggggc

SEQ ID NO: 42288 - DNA, 22 bp, Artificial Sequence
  chemically synthesized
ttccatagggtggctggggcac

SEQ ID NO: 42289 - DNA, 22 bp, Artificial Sequence
  chemically synthesized
tccatagggtggctggggcaca

SEQ ID NO: 42290 - DNA, 22 bp, Artificial Sequence
  chemically synthesized
ccatagggtggctggggcacac

SEQ ID NO: 42291 - DNA, 22 bp, Artificial Sequence
  chemically synthesized
catagggtggctggggcacact

SEQ ID NO: 42292 - DNA, 22 bp, Artificial Sequence
  chemically synthesized
gggcacactggggtgtgagtaa

SEQ ID NO: 42293 - DNA, 22 bp, Artificial Sequence
  chemically synthesized
gggtgtgagtaaagcactcagg

SEQ ID NO: 42294 - DNA, 22 bp, Artificial Sequence
  chemically synthesized
aggatcttttttccttccctag

SEQ ID NO: 42295 - DNA, 22 bp, Artificial Sequence
  chemically synthesized
ttttccttccctagtccaagta

SEQ ID NO: 42296 - DNA, 22 bp, Artificial Sequence
  chemically synthesized
tttccttccctagtccaagtac

SEQ ID NO: 42297 - DNA, 22 bp, Artificial Sequence
  chemically synthesized
ttccttccctagtccaagtaca

SEQ ID NO: 42298 - DNA, 22 bp, Artificial Sequence
  chemically synthesized
tccttccctagtccaagtacag

SEQ ID NO: 42299 - DNA, 22 bp, Artificial Sequence
  chemically synthesized
ccttccctagtccaagtacagc

SEQ ID NO: 42300 - DNA, 22 bp, Artificial Sequence
  chemically synthesized
cttccctagtccaagtacagca

SEQ ID NO: 42301 - DNA, 22 bp, Artificial Sequence
  chemically synthesized
ccctagtccaagtacagcaagg

SEQ ID NO: 42302 - DNA, 22 bp, Artificial Sequence
  chemically synthesized
cctagtccaagtacagcaaggg

SEQ ID NO: 42303 - DNA, 22 bp, Artificial Sequence
  chemically synthesized
gtccaagtacagcaagggcagt

SEQ ID NO: 42304 - DNA, 22 bp, Artificial Sequence
  chemically synthesized
cagtgttagtggcagaaggact

SEQ ID NO: 42305 - DNA, 22 bp, Artificial Sequence
  chemically synthesized
gtggcagaaggactttcagtca

SEQ ID NO: 42306 - DNA, 22 bp, Artificial Sequence
  chemically synthesized
tcagtcacctctgggagcttca

SEQ ID NO: 42307 - DNA, 22 bp, Artificial Sequence
  chemically synthesized
cagtcacctctgggagcttcac

SEQ ID NO: 42308 - DNA, 22 bp, Artificial Sequence
  chemically synthesized
agtcacctctgggagcttcacc

SEQ ID NO: 42309 - DNA, 22 bp, Artificial Sequence
  chemically synthesized
tgggagcttcaccccacaaaaa

SEQ ID NO: 42310 - DNA, 22 bp, Artificial Sequence
  chemically synthesized
ggagcttcaccccacaaaaaca

SEQ ID NO: 42311 - DNA, 22 bp, Artificial Sequence
  chemically synthesized
caccccacaaaaacacagagtg

SEQ ID NO: 42312 - DNA, 22 bp, Artificial Sequence
  chemically synthesized
accccacaaaaacacagagtgc

SEQ ID NO: 42313 - DNA, 22 bp, Artificial Sequence
  chemically synthesized
aactgagttcgaggtgcctgca

SEQ ID NO: 42314 - DNA, 22 bp, Artificial Sequence
  chemically synthesized
agttcgaggtgcctgcactgtg

SEQ ID NO: 42315 - DNA, 22 bp, Artificial Sequence
  chemically synthesized
gaggtgcctgcactgtgggccc

SEQ ID NO: 42316 - DNA, 22 bp, Artificial Sequence
  chemically synthesized
cactgtgggcccaagccaggag

SEQ ID NO: 42317 - DNA, 22 bp, Artificial Sequence
  chemically synthesized
tgggcccaagccaggagccttg

SEQ ID NO: 42318 - DNA, 22 bp, Artificial Sequence
  chemically synthesized
gcctggtgaagagtagcaggtg

SEQ ID NO: 42319 - DNA, 22 bp, Artificial Sequence
  chemically synthesized
cctggtgaagagtagcaggtga

SEQ ID NO: 42320 - DNA, 22 bp, Artificial Sequence
  chemically synthesized
gtgaagagtagcaggtgaaagc

SEQ ID NO: 42321 - DNA, 22 bp, Artificial Sequence
  chemically synthesized
acaagaaagagaaactggaatt

SEQ ID NO: 42322 - DNA, 22 bp, Artificial Sequence
  chemically synthesized
gaattctttccctgctgtgtgc

SEQ ID NO: 42323 - DNA, 22 bp, Artificial Sequence
  chemically synthesized
tttccctgctgtgtgctggagg

SEQ ID NO: 42324 - DNA, 22 bp, Artificial Sequence
  chemically synthesized
tccctgctgtgtgctggaggtg

SEQ ID NO: 42325 - DNA, 22 bp, Artificial Sequence
  chemically synthesized
ccctgctgtgtgctggaggtgt

SEQ ID NO: 42326 - DNA, 22 bp, Artificial Sequence
  chemically synthesized
cctgctgtgtgctggaggtgtc

SEQ ID NO: 42327 - DNA, 22 bp, Artificial Sequence
  chemically synthesized
ctgtgtgctggaggtgtcaggg

SEQ ID NO: 42328 - DNA, 22 bp, Artificial Sequence
  chemically synthesized
tgtgctggaggtgtcagggaag

SEQ ID NO: 42329 - DNA, 22 bp, Artificial Sequence
  chemically synthesized
gaggtgtcagggaagtggccag

SEQ ID NO: 42330 - DNA, 22 bp, Artificial Sequence
  chemically synthesized
ctttctcaagcccaagggcatt

SEQ ID NO: 42331 - DNA, 22 bp, Artificial Sequence
  chemically synthesized
tttctcaagcccaagggcatta

SEQ ID NO: 42332 - DNA, 22 bp, Artificial Sequence
  chemically synthesized
tctcaagcccaagggcattaac

SEQ ID NO: 42333 - DNA, 22 bp, Artificial Sequence
  chemically synthesized
ctcaagcccaagggcattaacg

SEQ ID NO: 42334 - DNA, 22 bp, Artificial Sequence
  chemically synthesized
tcaagcccaagggcattaacgg

SEQ ID NO: 42335 - DNA, 22 bp, Artificial Sequence
  chemically synthesized
aagcccaagggcattaacggtg

SEQ ID NO: 42336 - DNA, 22 bp, Artificial Sequence
  chemically synthesized
acggtggtactgctgcagctga

SEQ ID NO: 42337 - DNA, 22 bp, Artificial Sequence
  chemically synthesized
ctgcagctgaaatggcagaggg

SEQ ID NO: 42338 - DNA, 22 bp, Artificial Sequence
  chemically synthesized
cagctgaaatggcagaggggct

SEQ ID NO: 42339 - DNA, 22 bp, Artificial Sequence
  chemically synthesized
aaatggcagaggggctgtgggt

SEQ ID NO: 42340 - DNA, 22 bp, Artificial Sequence
  chemically synthesized
tgggttgtctcttggatttcct

SEQ ID NO: 42341 - DNA, 22 bp, Artificial Sequence
  chemically synthesized
tctcttggatttcctccccaga

SEQ ID NO: 42342 - DNA, 22 bp, Artificial Sequence
  chemically synthesized
ttggatttcctccccagagaag

SEQ ID NO: 42343 - DNA, 22 bp, Artificial Sequence
  chemically synthesized
ggatttcctccccagagaagca

SEQ ID NO: 42344 - DNA, 22 bp, Artificial Sequence
  chemically synthesized
gatttcctccccagagaagcac

SEQ ID NO: 42345 - DNA, 22 bp, Artificial Sequence
  chemically synthesized
cctccccagagaagcacagagc

SEQ ID NO: 42346 - DNA, 22 bp, Artificial Sequence
  chemically synthesized
ctccccagagaagcacagagcc

SEQ ID NO: 42347 - DNA, 22 bp, Artificial Sequence
  chemically synthesized
cccagagaagcacagagccaac

SEQ ID NO: 42348 - DNA, 22 bp, Artificial Sequence
  chemically synthesized
actaaaatgttcaggcagggcc

SEQ ID NO: 42349 - DNA, 22 bp, Artificial Sequence
  chemically synthesized
aaatgttcaggcagggccaggg

SEQ ID NO: 42350 - DNA, 22 bp, Artificial Sequence
  chemically synthesized
aggcagggccagggtggctgtg

SEQ ID NO: 42351 - DNA, 22 bp, Artificial Sequence
  chemically synthesized
tgctctgcccagtgaggaatag

SEQ ID NO: 42352 - DNA, 22 bp, Artificial Sequence
  chemically synthesized
tgcccagtgaggaatagtaggg

SEQ ID NO: 42353 - DNA, 22 bp, Artificial Sequence
  chemically synthesized
cccagtgaggaatagtaggggc

SEQ ID NO: 42354 - DNA, 22 bp, Artificial Sequence
  chemically synthesized
ttccataaggcagctacactgt

SEQ ID NO: 42355 - DNA, 22 bp, Artificial Sequence
  chemically synthesized
tccataaggcagctacactgtg

SEQ ID NO: 42356 - DNA, 22 bp, Artificial Sequence
  chemically synthesized
ccataaggcagctacactgtgc

SEQ ID NO: 42357 - DNA, 22 bp, Artificial Sequence
  chemically synthesized
cataaggcagctacactgtgct

SEQ ID NO: 42358 - DNA, 22 bp, Artificial Sequence
  chemically synthesized
cactgtgctggaggtccgtgag

SEQ ID NO: 42359 - DNA, 22 bp, Artificial Sequence
  chemically synthesized
tgctggaggtccgtgagagtcc

SEQ ID NO: 42360 - DNA, 22 bp, Artificial Sequence
  chemically synthesized
gaggtccgtgagagtcctgaag

SEQ ID NO: 42361 - DNA, 22 bp, Artificial Sequence
  chemically synthesized
aagctcctcgctccctcctgag

SEQ ID NO: 42362 - DNA, 22 bp, Artificial Sequence
  chemically synthesized
ctcgctccctcctgagcccata

SEQ ID NO: 42363 - DNA, 22 bp, Artificial Sequence
  chemically synthesized
gctccctcctgagcccatactt

SEQ ID NO: 42364 - DNA, 22 bp, Artificial Sequence
  chemically synthesized
cctcctgagcccatactttaat

SEQ ID NO: 42365 - DNA, 22 bp, Artificial Sequence
  chemically synthesized
ctgagcccatactttaatctca

SEQ ID NO: 42366 - DNA, 22 bp, Artificial Sequence
  chemically synthesized
agcccatactttaatctcaaga

SEQ ID NO: 42367 - DNA, 22 bp, Artificial Sequence
  chemically synthesized
taatctcaagagtttgagataa

SEQ ID NO: 42368 - DNA, 22 bp, Artificial Sequence
  chemically synthesized
aatctcaagagtttgagataaa

SEQ ID NO: 42369 - DNA, 22 bp, Artificial Sequence
  chemically synthesized
atctcaagagtttgagataaac

SEQ ID NO: 42370 - DNA, 22 bp, Artificial Sequence
  chemically synthesized
aagagtttgagataaacagtgg

SEQ ID NO: 42371 - DNA, 22 bp, Artificial Sequence
  chemically synthesized
gagataaacagtggtaaggaag

SEQ ID NO: 42372 - DNA, 22 bp, Artificial Sequence
  chemically synthesized
agataaacagtggtaaggaaga

SEQ ID NO: 42373 - DNA, 22 bp, Artificial Sequence
  chemically synthesized
atgaaacccaggaagataagtc

SEQ ID NO: 42374 - DNA, 22 bp, Artificial Sequence
  chemically synthesized
caacctaaagaaatacttttta

SEQ ID NO: 42375 - DNA, 22 bp, Artificial Sequence
  chemically synthesized
aagaaatactttttaaaaatca

SEQ ID NO: 42376 - DNA, 22 bp, Artificial Sequence
  chemically synthesized
tttaaaaatcatatttatagag

SEQ ID NO: 42377 - DNA, 22 bp, Artificial Sequence
  chemically synthesized
ttaaaaatcatatttatagagg

SEQ ID NO: 42378 - DNA, 22 bp, Artificial Sequence
  chemically synthesized
taaaaatcatatttatagaggt

SEQ ID NO: 42379 - DNA, 22 bp, Artificial Sequence
  chemically synthesized
aaaaatcatatttatagaggtt

SEQ ID NO: 42380 - DNA, 22 bp, Artificial Sequence
  chemically synthesized
aaaatcatatttatagaggttt

SEQ ID NO: 42381 - DNA, 22 bp, Artificial Sequence
  chemically synthesized
atagaggtttgcagtgatacta

SEQ ID NO: 42382 - DNA, 22 bp, Artificial Sequence
  chemically synthesized
tagaggtttgcagtgatactaa

SEQ ID NO: 42383 - DNA, 22 bp, Artificial Sequence
  chemically synthesized
gcagtgatactaaagacaatat

SEQ ID NO: 42384 - DNA, 22 bp, Artificial Sequence
  chemically synthesized
cagtgatactaaagacaatatt

SEQ ID NO: 42385 - DNA, 22 bp, Artificial Sequence
  chemically synthesized
aagacaatattgcaaatcatta

SEQ ID NO: 42386 - DNA, 22 bp, Artificial Sequence
  chemically synthesized
caaatcattattaagaatacaa

SEQ ID NO: 42387 - DNA, 22 bp, Artificial Sequence
  chemically synthesized
ttaagaatacaagaagtacaat

SEQ ID NO: 42388 - DNA, 22 bp, Artificial Sequence
  chemically synthesized
agaatacaagaagtacaatgtt

SEQ ID NO: 42389 - DNA, 22 bp, Artificial Sequence
  chemically synthesized
cttgtttctttaacacctgtga

SEQ ID NO: 42390 - DNA, 22 bp, Artificial Sequence
  chemically synthesized
ttgtttctttaacacctgtgat

SEQ ID NO: 42391 - DNA, 22 bp, Artificial Sequence
  chemically synthesized
gtttctttaacacctgtgatac

SEQ ID NO: 42392 - DNA, 22 bp, Artificial Sequence
  chemically synthesized
tttctttaacacctgtgataca

SEQ ID NO: 42393 - DNA, 22 bp, Artificial Sequence
  chemically synthesized
ctttaacacctgtgatacaggt

SEQ ID NO: 42394 - DNA, 22 bp, Artificial Sequence
  chemically synthesized
tttaacacctgtgatacaggtg

SEQ ID NO: 42395 - DNA, 22 bp, Artificial Sequence
  chemically synthesized
taacacctgtgatacaggtgtt

SEQ ID NO: 42396 - DNA, 22 bp, Artificial Sequence
  chemically synthesized
aacacctgtgatacaggtgttt

SEQ ID NO: 42397 - DNA, 22 bp, Artificial Sequence
  chemically synthesized
acacctgtgatacaggtgtttg

SEQ ID NO: 42398 - DNA, 22 bp, Artificial Sequence
  chemically synthesized
tgatacaggtgtttgatatgaa

SEQ ID NO: 42399 - DNA, 22 bp, Artificial Sequence
  chemically synthesized
gatatgaattctacgtaatggc

SEQ ID NO: 42400 - DNA, 22 bp, Artificial Sequence
  chemically synthesized
atatgaattctacgtaatggct

SEQ ID NO: 42401 - DNA, 22 bp, Artificial Sequence
  chemically synthesized
tacgtaatggctgcattgcttc

SEQ ID NO: 42402 - DNA, 22 bp, Artificial Sequence
  chemically synthesized
cgtaatggctgcattgcttctt

SEQ ID NO: 42403 - DNA, 22 bp, Artificial Sequence
  chemically synthesized
cattgcttcttgccaccaccca

SEQ ID NO: 42404 - DNA, 22 bp, Artificial Sequence
  chemically synthesized
cttcttgccaccacccaaagaa

SEQ ID NO: 42405 - DNA, 22 bp, Artificial Sequence
  chemically synthesized
cttgccaccacccaaagaaggt

SEQ ID NO: 42406 - DNA, 22 bp, Artificial Sequence
  chemically synthesized
ttgccaccacccaaagaaggtt

SEQ ID NO: 42407 - DNA, 22 bp, Artificial Sequence
  chemically synthesized
gccaccacccaaagaaggttgt

SEQ ID NO: 42408 - DNA, 22 bp, Artificial Sequence
  chemically synthesized
ccaccacccaaagaaggttgta

SEQ ID NO: 42409 - DNA, 22 bp, Artificial Sequence
  chemically synthesized
tatagcactcagatgtatacta

SEQ ID NO: 42410 - DNA, 22 bp, Artificial Sequence
  chemically synthesized
agatgtatactaactgcaaccg

SEQ ID NO: 42411 - DNA, 22 bp, Artificial Sequence
  chemically synthesized
actgcaaccgtgtatctcttag

SEQ ID NO: 42412 - DNA, 22 bp, Artificial Sequence
  chemically synthesized
caaccgtgtatctcttaggaat

SEQ ID NO: 42413 - DNA, 22 bp, Artificial Sequence
  chemically synthesized
ttaggaatttctcctttgccct

SEQ ID NO: 42414 - DNA, 22 bp, Artificial Sequence
  chemically synthesized
aggaatttctcctttgccctct

SEQ ID NO: 42415 - DNA, 22 bp, Artificial Sequence
  chemically synthesized
ggaatttctcctttgccctctt

SEQ ID NO: 42416 - DNA, 22 bp, Artificial Sequence
  chemically synthesized
ctcctttgccctcttccctccc

SEQ ID NO: 42417 - DNA, 22 bp, Artificial Sequence
  chemically synthesized
tcctttgccctcttccctccct

SEQ ID NO: 42418 - DNA, 22 bp, Artificial Sequence
  chemically synthesized
ctttgccctcttccctccctat

SEQ ID NO: 42419 - DNA, 22 bp, Artificial Sequence
  chemically synthesized
tgccctcttccctccctatcag

SEQ ID NO: 42420 - DNA, 22 bp, Artificial Sequence
  chemically synthesized
gccctcttccctccctatcagc

SEQ ID NO: 42421 - DNA, 22 bp, Artificial Sequence
  chemically synthesized
ccctcttccctccctatcagca

SEQ ID NO: 42422 - DNA, 22 bp, Artificial Sequence
  chemically synthesized
ttccctccctatcagcatgtat

SEQ ID NO: 42423 - DNA, 22 bp, Artificial Sequence
  chemically synthesized
ccctccctatcagcatgtatct

SEQ ID NO: 42424 - DNA, 22 bp, Artificial Sequence
  chemically synthesized
cctccctatcagcatgtatcta

SEQ ID NO: 42425 - DNA, 22 bp, Artificial Sequence
  chemically synthesized
cctatcagcatgtatctagcag

SEQ ID NO: 42426 - DNA, 22 bp, Artificial Sequence
  chemically synthesized
tcagcatgtatctagcagcatt

SEQ ID NO: 42427 - DNA, 22 bp, Artificial Sequence
  chemically synthesized
gcagcattctgaaaagttaact

SEQ ID NO: 42428 - DNA, 22 bp, Artificial Sequence
  chemically synthesized
tgaaaagttaactgcacagtga

SEQ ID NO: 42429 - DNA, 22 bp, Artificial Sequence
  chemically synthesized
aaaagttaactgcacagtgagc

SEQ ID NO: 42430 - DNA, 22 bp, Artificial Sequence
  chemically synthesized
actgcacagtgagcgactgctg

SEQ ID NO: 42431 - DNA, 22 bp, Artificial Sequence
  chemically synthesized
cacagtgagcgactgctgggca

SEQ ID NO: 42432 - DNA, 22 bp, Artificial Sequence
  chemically synthesized
ctgggcatcttaaggggcattc

SEQ ID NO: 42433 - DNA, 22 bp, Artificial Sequence
  chemically synthesized
ggcatcttaaggggcattcttt

SEQ ID NO: 42434 - DNA, 22 bp, Artificial Sequence
  chemically synthesized
aaggggcattcttttctaccta

SEQ ID NO: 42435 - DNA, 22 bp, Artificial Sequence
  chemically synthesized
aggggcattcttttctacctag

SEQ ID NO: 42436 - DNA, 22 bp, Artificial Sequence
  chemically synthesized
ttttctacctaggtattccccc

SEQ ID NO: 42437 - DNA, 22 bp, Artificial Sequence
  chemically synthesized
ttctacctaggtattccccctc

SEQ ID NO: 42438 - DNA, 22 bp, Artificial Sequence
  chemically synthesized
tctacctaggtattccccctcc

SEQ ID NO: 42439 - DNA, 22 bp, Artificial Sequence
  chemically synthesized
ctacctaggtattccccctcct

SEQ ID NO: 42440 - DNA, 22 bp, Artificial Sequence
  chemically synthesized
tacctaggtattccccctcctc

SEQ ID NO: 42441 - DNA, 22 bp, Artificial Sequence
  chemically synthesized
cctaggtattccccctcctcca

SEQ ID NO: 42442 - DNA, 22 bp, Artificial Sequence
  chemically synthesized
ggtattccccctcctccactca

SEQ ID NO: 42443 - DNA, 22 bp, Artificial Sequence
  chemically synthesized
cccctcctccactcatgtctag

SEQ ID NO: 42444 - DNA, 22 bp, Artificial Sequence
  chemically synthesized
ctccactcatgtctagcatgca

SEQ ID NO: 42445 - DNA, 22 bp, Artificial Sequence
  chemically synthesized
cactcatgtctagcatgcagga

SEQ ID NO: 42446 - DNA, 22 bp, Artificial Sequence
  chemically synthesized
atgtctagcatgcaggacttgg

SEQ ID NO: 42447 - DNA, 22 bp, Artificial Sequence
  chemically synthesized
gcatgcaggacttgggtaatct

SEQ ID NO: 42448 - DNA, 22 bp, Artificial Sequence
  chemically synthesized
gggtaatctctggggtttcaga

SEQ ID NO: 42449 - DNA, 22 bp, Artificial Sequence
  chemically synthesized
ggtaatctctggggtttcagat

SEQ ID NO: 42450 - DNA, 22 bp, Artificial Sequence
  chemically synthesized
tggggtttcagattctccagac

SEQ ID NO: 42451 - DNA, 22 bp, Artificial Sequence
  chemically synthesized
gggtttcagattctccagacct

SEQ ID NO: 42452 - DNA, 22 bp, Artificial Sequence
  chemically synthesized
cagattctccagacctccattc

SEQ ID NO: 42453 - DNA, 22 bp, Artificial Sequence
  chemically synthesized
agattctccagacctccattct

SEQ ID NO: 42454 - DNA, 22 bp, Artificial Sequence
  chemically synthesized
tccagacctccattctctcagg

SEQ ID NO: 42455 - DNA, 22 bp, Artificial Sequence
  chemically synthesized
cagacctccattctctcagggg

SEQ ID NO: 42456 - DNA, 22 bp, Artificial Sequence
  chemically synthesized
cattctctcaggggcttccacc

SEQ ID NO: 42457 - DNA, 22 bp, Artificial Sequence
  chemically synthesized
tctcaggggcttccacctcctg

SEQ ID NO: 42458 - DNA, 22 bp, Artificial Sequence
  chemically synthesized
tcaggggcttccacctcctgct

SEQ ID NO: 42459 - DNA, 22 bp, Artificial Sequence
  chemically synthesized
aggggcttccacctcctgctca

SEQ ID NO: 42460 - DNA, 22 bp, Artificial Sequence
  chemically synthesized
ccacctcctgctcatatctagc

SEQ ID NO: 42461 - DNA, 22 bp, Artificial Sequence
  chemically synthesized
cacctcctgctcatatctagct

SEQ ID NO: 42462 - DNA, 22 bp, Artificial Sequence
  chemically synthesized
ctgctcatatctagctatctgc

SEQ ID NO: 42463 - DNA, 22 bp, Artificial Sequence
  chemically synthesized
ctcatatctagctatctgccta

SEQ ID NO: 42464 - DNA, 22 bp, Artificial Sequence
  chemically synthesized
atatctagctatctgcctagtc

SEQ ID NO: 42465 - DNA, 22 bp, Artificial Sequence
  chemically synthesized
gctatctgcctagtctaaccat

SEQ ID NO: 42466 - DNA, 22 bp, Artificial Sequence
  chemically synthesized
tctgcctagtctaaccataaaa

SEQ ID NO: 42467 - DNA, 22 bp, Artificial Sequence
  chemically synthesized
cctagtctaaccataaaatctt

SEQ ID NO: 42468 - DNA, 22 bp, Artificial Sequence
  chemically synthesized
gtctaaccataaaatcttaaat

SEQ ID NO: 42469 - DNA, 22 bp, Artificial Sequence
  chemically synthesized
accataaaatcttaaataagaa

SEQ ID NO: 42470 - DNA, 22 bp, Artificial Sequence
  chemically synthesized
aaataagaataaatcatgtttg

SEQ ID NO: 42471 - DNA, 22 bp, Artificial Sequence
  chemically synthesized
aataagaataaatcatgtttgc

SEQ ID NO: 42472 - DNA, 22 bp, Artificial Sequence
  chemically synthesized
gctcttgattgccatgtcatga

SEQ ID NO: 42473 - DNA, 22 bp, Artificial Sequence
  chemically synthesized
ctcttgattgccatgtcatgat

SEQ ID NO: 42474 - DNA, 22 bp, Artificial Sequence
  chemically synthesized
ttgattgccatgtcatgataaa

SEQ ID NO: 42475 - DNA, 22 bp, Artificial Sequence
  chemically synthesized
gattgccatgtcatgataaaaa

SEQ ID NO: 42476 - DNA, 22 bp, Artificial Sequence
  chemically synthesized
attgccatgtcatgataaaaaa

SEQ ID NO: 42477 - DNA, 22 bp, Artificial Sequence
  chemically synthesized
ccatgtcatgataaaaaaaata

SEQ ID NO: 42478 - DNA, 22 bp, Artificial Sequence
  chemically synthesized
tgttgccaagattgatgttgat

SEQ ID NO: 42479 - DNA, 22 bp, Artificial Sequence
  chemically synthesized
ccaagattgatgttgatctgct

SEQ ID NO: 42480 - DNA, 22 bp, Artificial Sequence
  chemically synthesized
atgttgatctgctaatccctgt

SEQ ID NO: 42481 - DNA, 22 bp, Artificial Sequence
  chemically synthesized
atctgctaatccctgtgtagaa

SEQ ID NO: 42482 - DNA, 22 bp, Artificial Sequence
  chemically synthesized
ctaatccctgtgtagaaatgaa

SEQ ID NO: 42483 - DNA, 22 bp, Artificial Sequence
  chemically synthesized
atccctgtgtagaaatgaacct

SEQ ID NO: 42484 - DNA, 22 bp, Artificial Sequence
  chemically synthesized
tgtagaaatgaaccttggaggc

SEQ ID NO: 42485 - DNA, 22 bp, Artificial Sequence
  chemically synthesized
ggaggccattgtttgatttctt

SEQ ID NO: 42486 - DNA, 22 bp, Artificial Sequence
  chemically synthesized
gaggccattgtttgatttctta

SEQ ID NO: 42487 - DNA, 22 bp, Artificial Sequence
  chemically synthesized
tttgatttcttacaatatgtgc

SEQ ID NO: 42488 - DNA, 22 bp, Artificial Sequence
  chemically synthesized
gatttcttacaatatgtgcatt

SEQ ID NO: 42489 - DNA, 22 bp, Artificial Sequence
  chemically synthesized
atttcttacaatatgtgcattg

SEQ ID NO: 42490 - DNA, 22 bp, Artificial Sequence
  chemically synthesized
cttacaatatgtgcattggttg

SEQ ID NO: 42491 - DNA, 22 bp, Artificial Sequence
  chemically synthesized
ttacaatatgtgcattggttgt

SEQ ID NO: 42492 - DNA, 22 bp, Artificial Sequence
  chemically synthesized
acaatatgtgcattggttgtaa

SEQ ID NO: 42493 - DNA, 22 bp, Artificial Sequence
  chemically synthesized
caatatgtgcattggttgtaac

SEQ ID NO: 42494 - DNA, 22 bp, Artificial Sequence
  chemically synthesized
gttgtaacactgtcactttgac

SEQ ID NO: 42495 - DNA, 22 bp, Artificial Sequence
  chemically synthesized
taacactgtcactttgacagtt

SEQ ID NO: 42496 - DNA, 22 bp, Artificial Sequence
  chemically synthesized
tcactttgacagttgataagca

SEQ ID NO: 42497 - DNA, 22 bp, Artificial Sequence
  chemically synthesized
tgacagttgataagcatcttct

SEQ ID NO: 42498 - DNA, 22 bp, Artificial Sequence
  chemically synthesized
gacagttgataagcatcttctg

SEQ ID NO: 42499 - DNA, 22 bp, Artificial Sequence
  chemically synthesized
acagttgataagcatcttctga

SEQ ID NO: 42500 - DNA, 22 bp, Artificial Sequence
  chemically synthesized
ataagcatcttctgaatggtcc

SEQ ID NO: 42501 - DNA, 22 bp, Artificial Sequence
  chemically synthesized
ctgaatggtccctcctttagtt

SEQ ID NO: 42502 - DNA, 22 bp, Artificial Sequence
  chemically synthesized
tgaatggtccctcctttagtta

SEQ ID NO: 42503 - DNA, 22 bp, Artificial Sequence
  chemically synthesized
aatggtccctcctttagttaca

SEQ ID NO: 42504 - DNA, 22 bp, Artificial Sequence
  chemically synthesized
ctttagttacaaaaatgttggt

SEQ ID NO: 42505 - DNA, 22 bp, Artificial Sequence
  chemically synthesized
tagttacaaaaatgttggtgca

SEQ ID NO: 42506 - DNA, 22 bp, Artificial Sequence
  chemically synthesized
agttacaaaaatgttggtgcat

SEQ ID NO: 42507 - DNA, 22 bp, Artificial Sequence
  chemically synthesized
gttacaaaaatgttggtgcatg

SEQ ID NO: 42508 - DNA, 22 bp, Artificial Sequence
  chemically synthesized
caaaaatgttggtgcatggatg

SEQ ID NO: 42509 - DNA, 22 bp, Artificial Sequence
  chemically synthesized
gtgcatggatgatgttgggaat

SEQ ID NO: 42510 - DNA, 22 bp, Artificial Sequence
  chemically synthesized
ggaataaataaaaagtgaacta

SEQ ID NO: 42511 - DNA, 22 bp, Artificial Sequence
  chemically synthesized
aattatgttctcatcttgggca

SEQ ID NO: 42512 - DNA, 22 bp, Artificial Sequence
  chemically synthesized
tgttctcatcttgggcaaaaat

SEQ ID NO: 42513 - DNA, 22 bp, Artificial Sequence
  chemically synthesized
tcatcttgggcaaaaattaagc

SEQ ID NO: 42514 - DNA, 22 bp, Artificial Sequence
  chemically synthesized
atcttgggcaaaaattaagcaa

SEQ ID NO: 42515 - DNA, 22 bp, Artificial Sequence
  chemically synthesized
gggcaaaaattaagcaaaaaaa

SEQ ID NO: 42516 - DNA, 22 bp, Artificial Sequence
  chemically synthesized
ggcaaaaattaagcaaaaaaaa

SEQ ID NO: 42517 - DNA, 22 bp, Artificial Sequence
  chemically synthesized
agcaaaaaaaaaatggaggata

SEQ ID NO: 42518 - DNA, 22 bp, Artificial Sequence
  chemically synthesized
ctccacaaagaaggccattttt

SEQ ID NO: 42519 - DNA, 22 bp, Artificial Sequence
  chemically synthesized
cacaaagaaggccatttttgta

SEQ ID NO: 42520 - DNA, 22 bp, Artificial Sequence
  chemically synthesized
ttgtactaggcttactacagtg

SEQ ID NO: 42521 - DNA, 22 bp, Artificial Sequence
  chemically synthesized
tgtactaggcttactacagtga

SEQ ID NO: 42522 - DNA, 22 bp, Artificial Sequence
  chemically synthesized
gtactaggcttactacagtgac

SEQ ID NO: 42523 - DNA, 22 bp, Artificial Sequence
  chemically synthesized
tactaggcttactacagtgaca

SEQ ID NO: 42524 - DNA, 22 bp, Artificial Sequence
  chemically synthesized
ggcttactacagtgacacacca

SEQ ID NO: 42525 - DNA, 22 bp, Artificial Sequence
  chemically synthesized
actacagtgacacaccactatt

SEQ ID NO: 42526 - DNA, 22 bp, Artificial Sequence
  chemically synthesized
ctacagtgacacaccactatta

SEQ ID NO: 42527 - DNA, 22 bp, Artificial Sequence
  chemically synthesized
cagtgacacaccactattagtt

SEQ ID NO: 42528 - DNA, 22 bp, Artificial Sequence
  chemically synthesized
ttagttggggagaattcagttt

SEQ ID NO: 42529 - DNA, 22 bp, Artificial Sequence
  chemically synthesized
gttggggagaattcagtttttc

SEQ ID NO: 42530 - DNA, 22 bp, Artificial Sequence
  chemically synthesized
gggagaattcagtttttccaag

SEQ ID NO: 42531 - DNA, 22 bp, Artificial Sequence
  chemically synthesized
agtttttccaaggtgttgatag

SEQ ID NO: 42532 - DNA, 22 bp, Artificial Sequence
  chemically synthesized
ttccaaggtgttgataggcatc

SEQ ID NO: 42533 - DNA, 22 bp, Artificial Sequence
  chemically synthesized
tccaaggtgttgataggcatcc

SEQ ID NO: 42534 - DNA, 22 bp, Artificial Sequence
  chemically synthesized
ccaaggtgttgataggcatcca

SEQ ID NO: 42535 - DNA, 22 bp, Artificial Sequence
  chemically synthesized
caaggtgttgataggcatccag

SEQ ID NO: 42536 - DNA, 22 bp, Artificial Sequence
  chemically synthesized
ataggcatccagatttcagagg

SEQ ID NO: 42537 - DNA, 22 bp, Artificial Sequence
  chemically synthesized
cagaggaaattgtaaaaaagca

SEQ ID NO: 42538 - DNA, 22 bp, Artificial Sequence
  chemically synthesized
agaggaaattgtaaaaaagcag

SEQ ID NO: 42539 - DNA, 22 bp, Artificial Sequence
  chemically synthesized
taaaaaagcagaacctgggacc

SEQ ID NO: 42540 - DNA, 22 bp, Artificial Sequence
  chemically synthesized
ggaccaatactgcccacgattt

SEQ ID NO: 42541 - DNA, 22 bp, Artificial Sequence
  chemically synthesized
cccacgatttttctttgagatc

SEQ ID NO: 42542 - DNA, 22 bp, Artificial Sequence
  chemically synthesized
ttctttgagatcaaatctgagg

SEQ ID NO: 42543 - DNA, 22 bp, Artificial Sequence
  chemically synthesized
tctttgagatcaaatctgaggc

SEQ ID NO: 42544 - DNA, 22 bp, Artificial Sequence
  chemically synthesized
ctttgagatcaaatctgaggca

SEQ ID NO: 42545 - DNA, 22 bp, Artificial Sequence
  chemically synthesized
tttgagatcaaatctgaggcaa

SEQ ID NO: 42546 - DNA, 22 bp, Artificial Sequence
  chemically synthesized
tgagatcaaatctgaggcaaca

SEQ ID NO: 42547 - DNA, 22 bp, Artificial Sequence
  chemically synthesized
gagatcaaatctgaggcaacaa

SEQ ID NO: 42548 - DNA, 22 bp, Artificial Sequence
  chemically synthesized
agatcaaatctgaggcaacaaa

SEQ ID NO: 42549 - DNA, 22 bp, Artificial Sequence
  chemically synthesized
aggcaacaaatctgttcaaaag

SEQ ID NO: 42550 - DNA, 22 bp, Artificial Sequence
  chemically synthesized
ttcaaaagctgctttctgcctg

SEQ ID NO: 42551 - DNA, 22 bp, Artificial Sequence
  chemically synthesized
aaaagctgctttctgcctggtt

SEQ ID NO: 42552 - DNA, 22 bp, Artificial Sequence
  chemically synthesized
ctttctgcctggttgtggcaaa

SEQ ID NO: 42553 - DNA, 22 bp, Artificial Sequence
  chemically synthesized
tctgcctggttgtggcaaaggg

SEQ ID NO: 42554 - DNA, 22 bp, Artificial Sequence
  chemically synthesized
ctgcctggttgtggcaaagggt

SEQ ID NO: 42555 - DNA, 22 bp, Artificial Sequence
  chemically synthesized
tgcctggttgtggcaaagggtg

SEQ ID NO: 42556 - DNA, 22 bp, Artificial Sequence
  chemically synthesized
cctggttgtggcaaagggtggc

SEQ ID NO: 42557 - DNA, 22 bp, Artificial Sequence
  chemically synthesized
gttgtggcaaagggtggccaag

SEQ ID NO: 42558 - DNA, 22 bp, Artificial Sequence
  chemically synthesized
tggcaaagggtggccaagtggg

SEQ ID NO: 42559 - DNA, 22 bp, Artificial Sequence
  chemically synthesized
agctgtgttcccattgcaaggc

SEQ ID NO: 42560 - DNA, 22 bp, Artificial Sequence
  chemically synthesized
tgttcccattgcaaggctactg

SEQ ID NO: 42561 - DNA, 22 bp, Artificial Sequence
  chemically synthesized
ccattgcaaggctactgagcat

SEQ ID NO: 42562 - DNA, 22 bp, Artificial Sequence
  chemically synthesized
caaggctactgagcatcccctg

SEQ ID NO: 42563 - DNA, 22 bp, Artificial Sequence
  chemically synthesized
ctgagcatcccctgtcctgagg

SEQ ID NO: 42564 - DNA, 22 bp, Artificial Sequence
  chemically synthesized
agcatcccctgtcctgaggctc

SEQ ID NO: 42565 - DNA, 22 bp, Artificial Sequence
  chemically synthesized
tcctgaggctccttaggacacc

SEQ ID NO: 42566 - DNA, 22 bp, Artificial Sequence
  chemically synthesized
aggctccttaggacacctggct

SEQ ID NO: 42567 - DNA, 22 bp, Artificial Sequence
  chemically synthesized
cttaggacacctggctgagctt

SEQ ID NO: 42568 - DNA, 22 bp, Artificial Sequence
  chemically synthesized
aggacacctggctgagcttcag

SEQ ID NO: 42569 - DNA, 22 bp, Artificial Sequence
  chemically synthesized
ggacacctggctgagcttcagc

SEQ ID NO: 42570 - DNA, 22 bp, Artificial Sequence
  chemically synthesized
gctgagcttcagcagccctctt

SEQ ID NO: 42571 - DNA, 22 bp, Artificial Sequence
  chemically synthesized
agcttcagcagccctcttccaa

SEQ ID NO: 42572 - DNA, 22 bp, Artificial Sequence
  chemically synthesized
cagcagccctcttccaagcctg

SEQ ID NO: 42573 - DNA, 22 bp, Artificial Sequence
  chemically synthesized
agcagccctcttccaagcctgg

SEQ ID NO: 42574 - DNA, 22 bp, Artificial Sequence
  chemically synthesized
ttccaagcctggagatgccagc

SEQ ID NO: 42575 - DNA, 22 bp, Artificial Sequence
  chemically synthesized
ccaagcctggagatgccagctc

SEQ ID NO: 42576 - DNA, 22 bp, Artificial Sequence
  chemically synthesized
caagcctggagatgccagctcc

SEQ ID NO: 42577 - DNA, 22 bp, Artificial Sequence
  chemically synthesized
gagatgccagctccatctctgg

SEQ ID NO: 42578 - DNA, 22 bp, Artificial Sequence
  chemically synthesized
catctctggcacaaaatgtagt

SEQ ID NO: 42579 - DNA, 22 bp, Artificial Sequence
  chemically synthesized
tggcacaaaatgtagtgatttt

SEQ ID NO: 42580 - DNA, 22 bp, Artificial Sequence
  chemically synthesized
gcacaaaatgtagtgattttca

SEQ ID NO: 42581 - DNA, 22 bp, Artificial Sequence
  chemically synthesized
tcacagggtgagaggccaaaag

SEQ ID NO: 42582 - DNA, 22 bp, Artificial Sequence
  chemically synthesized
cacagggtgagaggccaaaaga

SEQ ID NO: 42583 - DNA, 22 bp, Artificial Sequence
  chemically synthesized
acagggtgagaggccaaaagag

SEQ ID NO: 42584 - DNA, 22 bp, Artificial Sequence
  chemically synthesized
ataaaatgaagatagccaagct

SEQ ID NO: 42585 - DNA, 22 bp, Artificial Sequence
  chemically synthesized
ccatggaattaagcaacaggac

SEQ ID NO: 42586 - DNA, 22 bp, Artificial Sequence
  chemically synthesized
catggaattaagcaacaggaca

SEQ ID NO: 42587 - DNA, 22 bp, Artificial Sequence
  chemically synthesized
agcaacaggacaaccttgacca

SEQ ID NO: 42588 - DNA, 22 bp, Artificial Sequence
  chemically synthesized
gaccactttgaggggtgtggtg

SEQ ID NO: 42589 - DNA, 22 bp, Artificial Sequence
  chemically synthesized
accactttgaggggtgtggtgg

SEQ ID NO: 42590 - DNA, 22 bp, Artificial Sequence
  chemically synthesized
tgaggggtgtggtgggggccac

SEQ ID NO: 42591 - DNA, 22 bp, Artificial Sequence
  chemically synthesized
gaggggtgtggtgggggccaca

SEQ ID NO: 42592 - DNA, 22 bp, Artificial Sequence
  chemically synthesized
aggggtgtggtgggggccacat

SEQ ID NO: 42593 - DNA, 22 bp, Artificial Sequence
  chemically synthesized
aagagtgactagaagagcagtg

SEQ ID NO: 42594 - DNA, 22 bp, Artificial Sequence
  chemically synthesized
gaagagcagtgggggtggcagc

SEQ ID NO: 42595 - DNA, 22 bp, Artificial Sequence
  chemically synthesized
gctctgaaagcagcgagacttc

SEQ ID NO: 42596 - DNA, 22 bp, Artificial Sequence
  chemically synthesized
tgaaagcagcgagacttctagg

SEQ ID NO: 42597 - DNA, 22 bp, Artificial Sequence
  chemically synthesized
aaagcagcgagacttctaggga

SEQ ID NO: 42598 - DNA, 22 bp, Artificial Sequence
  chemically synthesized
ctagggaatacagggtcagggg

SEQ ID NO: 42599 - DNA, 22 bp, Artificial Sequence
  chemically synthesized
tagggaatacagggtcagggga

SEQ ID NO: 42600 - DNA, 22 bp, Artificial Sequence
  chemically synthesized
gggaatacagggtcaggggagg

SEQ ID NO: 42601 - DNA, 22 bp, Artificial Sequence
  chemically synthesized
tgaaagatgacacactgcagag

SEQ ID NO: 42602 - DNA, 22 bp, Artificial Sequence
  chemically synthesized
aaagatgacacactgcagagaa

SEQ ID NO: 42603 - DNA, 22 bp, Artificial Sequence
  chemically synthesized
cagagaacatgtgtttgtatgc

SEQ ID NO: 42604 - DNA, 22 bp, Artificial Sequence
  chemically synthesized
gtatgccgatgacaagtatcca

SEQ ID NO: 42605 - DNA, 22 bp, Artificial Sequence
  chemically synthesized
tatgccgatgacaagtatccag

SEQ ID NO: 42606 - DNA, 22 bp, Artificial Sequence
  chemically synthesized
tcattctcagaaaggcctgtcc

SEQ ID NO: 42607 - DNA, 22 bp, Artificial Sequence
  chemically synthesized
attctcagaaaggcctgtcctg

SEQ ID NO: 42608 - DNA, 22 bp, Artificial Sequence
  chemically synthesized
tcagaaaggcctgtcctgacct

SEQ ID NO: 42609 - DNA, 22 bp, Artificial Sequence
  chemically synthesized
agaaaggcctgtcctgacctcc

SEQ ID NO: 42610 - DNA, 22 bp, Artificial Sequence
  chemically synthesized
tcctgacctcctgagagtacac

SEQ ID NO: 42611 - DNA, 22 bp, Artificial Sequence
  chemically synthesized
acctcctgagagtacacagacc

SEQ ID NO: 42612 - DNA, 22 bp, Artificial Sequence
  chemically synthesized
ctgagagtacacagaccatgag

SEQ ID NO: 42613 - DNA, 22 bp, Artificial Sequence
  chemically synthesized
agagtacacagaccatgagggc

SEQ ID NO: 42614 - DNA, 22 bp, Artificial Sequence
  chemically synthesized
actgtttcatgcaaagtccttg

SEQ ID NO: 42615 - DNA, 22 bp, Artificial Sequence
  chemically synthesized
tttcatgcaaagtccttggcca

SEQ ID NO: 42616 - DNA, 22 bp, Artificial Sequence
  chemically synthesized
catgcaaagtccttggccacag

SEQ ID NO: 42617 - DNA, 22 bp, Artificial Sequence
  chemically synthesized
atgcaaagtccttggccacagt

SEQ ID NO: 42618 - DNA, 22 bp, Artificial Sequence
  chemically synthesized
ggccacagtccacctgctcccc

SEQ ID NO: 42619 - DNA, 22 bp, Artificial Sequence
  chemically synthesized
gccacagtccacctgctcccca

SEQ ID NO: 42620 - DNA, 22 bp, Artificial Sequence
  chemically synthesized
ctccccacctctgtgactttgt

SEQ ID NO: 42621 - DNA, 22 bp, Artificial Sequence
  chemically synthesized
cccacctctgtgactttgtcct

SEQ ID NO: 42622 - DNA, 22 bp, Artificial Sequence
  chemically synthesized
tgtgactttgtccttcctcaat

SEQ ID NO: 42623 - DNA, 22 bp, Artificial Sequence
  chemically synthesized
tgactttgtccttcctcaattt

SEQ ID NO: 42624 - DNA, 22 bp, Artificial Sequence
  chemically synthesized
tgtccttcctcaatttaatatg

SEQ ID NO: 42625 - DNA, 22 bp, Artificial Sequence
  chemically synthesized
gtccttcctcaatttaatatgc

SEQ ID NO: 42626 - DNA, 22 bp, Artificial Sequence
  chemically synthesized
tccttcctcaatttaatatgct

SEQ ID NO: 42627 - DNA, 22 bp, Artificial Sequence
  chemically synthesized
cctcaatttaatatgctctatg

SEQ ID NO: 42628 - DNA, 22 bp, Artificial Sequence
  chemically synthesized
ctcaatttaatatgctctatgc

SEQ ID NO: 42629 - DNA, 22 bp, Artificial Sequence
  chemically synthesized
aatttaatatgctctatgctgg

SEQ ID NO: 42630 - DNA, 22 bp, Artificial Sequence
  chemically synthesized
aatatgctctatgctggaaaac

SEQ ID NO: 42631 - DNA, 22 bp, Artificial Sequence
  chemically synthesized
atatgctctatgctggaaaact

SEQ ID NO: 42632 - DNA, 22 bp, Artificial Sequence
  chemically synthesized
tatgctggaaaactggattatt

SEQ ID NO: 42633 - DNA, 22 bp, Artificial Sequence
  chemically synthesized
tgctggaaaactggattattga

SEQ ID NO: 42634 - DNA, 22 bp, Artificial Sequence
  chemically synthesized
gaaaactggattattgaacagg

SEQ ID NO: 42635 - DNA, 22 bp, Artificial Sequence
  chemically synthesized
gattattgaacaggcattggct

SEQ ID NO: 42636 - DNA, 22 bp, Artificial Sequence
  chemically synthesized
ttgaacaggcattggctgatgc

SEQ ID NO: 42637 - DNA, 22 bp, Artificial Sequence
  chemically synthesized
aacaggcattggctgatgcatt

SEQ ID NO: 42638 - DNA, 22 bp, Artificial Sequence
  chemically synthesized
gctgatgcattctgaacctaat

SEQ ID NO: 42639 - DNA, 22 bp, Artificial Sequence
  chemically synthesized
atgcattctgaacctaatccac

SEQ ID NO: 42640 - DNA, 22 bp, Artificial Sequence
  chemically synthesized
tgaacctaatccactaaaaagc

SEQ ID NO: 42641 - DNA, 22 bp, Artificial Sequence
  chemically synthesized
aacctaatccactaaaaagcac

SEQ ID NO: 42642 - DNA, 22 bp, Artificial Sequence
  chemically synthesized
atccactaaaaagcacttgata

SEQ ID NO: 42643 - DNA, 22 bp, Artificial Sequence
  chemically synthesized
aaaagcacttgatagatatatc

SEQ ID NO: 42644 - DNA, 22 bp, Artificial Sequence
  chemically synthesized
gatagatatatcaaaatatcat

SEQ ID NO: 42645 - DNA, 22 bp, Artificial Sequence
  chemically synthesized
atagatatatcaaaatatcatt

SEQ ID NO: 42646 - DNA, 22 bp, Artificial Sequence
  chemically synthesized
agaaatagatattttaggccca

SEQ ID NO: 42647 - DNA, 22 bp, Artificial Sequence
  chemically synthesized
taggcccatatccatgtcttca

SEQ ID NO: 42648 - DNA, 22 bp, Artificial Sequence
  chemically synthesized
aggcccatatccatgtcttcac

SEQ ID NO: 42649 - DNA, 22 bp, Artificial Sequence
  chemically synthesized
ggcccatatccatgtcttcacc

SEQ ID NO: 42650 - DNA, 22 bp, Artificial Sequence
  chemically synthesized
caccccgcactgtttctcattt

SEQ ID NO: 42651 - DNA, 22 bp, Artificial Sequence
  chemically synthesized
accccgcactgtttctcatttg

SEQ ID NO: 42652 - DNA, 22 bp, Artificial Sequence
  chemically synthesized
tttctcatttgaactctctttt

SEQ ID NO: 42653 - DNA, 22 bp, Artificial Sequence
  chemically synthesized
ctcatttgaactctcttttcca

SEQ ID NO: 42654 - DNA, 22 bp, Artificial Sequence
  chemically synthesized
tcatttgaactctcttttccag

SEQ ID NO: 42655 - DNA, 22 bp, Artificial Sequence
  chemically synthesized
atttgaactctcttttccagga

SEQ ID NO: 42656 - DNA, 22 bp, Artificial Sequence
  chemically synthesized
gaactctcttttccaggaagag

SEQ ID NO: 42657 - DNA, 22 bp, Artificial Sequence
  chemically synthesized
aactctcttttccaggaagagt

SEQ ID NO: 42658 - DNA, 22 bp, Artificial Sequence
  chemically synthesized
tcttttccaggaagagttgtgc

SEQ ID NO: 42659 - DNA, 22 bp, Artificial Sequence
  chemically synthesized
ttttccaggaagagttgtgctt

SEQ ID NO: 42660 - DNA, 22 bp, Artificial Sequence
  chemically synthesized
ttccaggaagagttgtgcttgg

SEQ ID NO: 42661 - DNA, 22 bp, Artificial Sequence
  chemically synthesized
tccaggaagagttgtgcttggg

SEQ ID NO: 42662 - DNA, 22 bp, Artificial Sequence
  chemically synthesized
ccaggaagagttgtgcttgggt

SEQ ID NO: 42663 - DNA, 22 bp, Artificial Sequence
  chemically synthesized
caggaagagttgtgcttgggta

SEQ ID NO: 42664 - DNA, 22 bp, Artificial Sequence
  chemically synthesized
tgcttgggtaaattctatagct

SEQ ID NO: 42665 - DNA, 22 bp, Artificial Sequence
  chemically synthesized
gggtaaattctatagctcacag

SEQ ID NO: 42666 - DNA, 22 bp, Artificial Sequence
  chemically synthesized
ggtaaattctatagctcacagt

SEQ ID NO: 42667 - DNA, 22 bp, Artificial Sequence
  chemically synthesized
tatagctcacagtgtgacttca

SEQ ID NO: 42668 - DNA, 22 bp, Artificial Sequence
  chemically synthesized
tagctcacagtgtgacttcaaa

SEQ ID NO: 42669 - DNA, 22 bp, Artificial Sequence
  chemically synthesized
acagtgtgacttcaaaacacac

SEQ ID NO: 42670 - DNA, 22 bp, Artificial Sequence
  chemically synthesized
caaaacacacaataaattaata

SEQ ID NO: 42671 - DNA, 22 bp, Artificial Sequence
  chemically synthesized
aaaacacacaataaattaataa

SEQ ID NO: 42672 - DNA, 22 bp, Artificial Sequence
  chemically synthesized
ataaggtgcttcctacagtgag

SEQ ID NO: 42673 - DNA, 22 bp, Artificial Sequence
  chemically synthesized
cctacagtgagttcagttaaac

SEQ ID NO: 42674 - DNA, 22 bp, Artificial Sequence
  chemically synthesized
ctacagtgagttcagttaaaca

SEQ ID NO: 42675 - DNA, 22 bp, Artificial Sequence
  chemically synthesized
cagtgagttcagttaaacattt

SEQ ID NO: 42676 - DNA, 22 bp, Artificial Sequence
  chemically synthesized
agttaaacattttgaagagtgt

SEQ ID NO: 42677 - DNA, 22 bp, Artificial Sequence
  chemically synthesized
aacattttgaagagtgtttttg

SEQ ID NO: 42678 - DNA, 22 bp, Artificial Sequence
  chemically synthesized
tgaagagtgtttttgaaatgta

SEQ ID NO: 42679 - DNA, 22 bp, Artificial Sequence
  chemically synthesized
gaagagtgtttttgaaatgtag

SEQ ID NO: 42680 - DNA, 22 bp, Artificial Sequence
  chemically synthesized
aagagtgtttttgaaatgtagc

SEQ ID NO: 42681 - DNA, 22 bp, Artificial Sequence
  chemically synthesized
ttgaaatgtagcagagcaggct

SEQ ID NO: 42682 - DNA, 22 bp, Artificial Sequence
  chemically synthesized
tgaaatgtagcagagcaggcta

SEQ ID NO: 42683 - DNA, 22 bp, Artificial Sequence
  chemically synthesized
gaaatgtagcagagcaggctac

SEQ ID NO: 42684 - DNA, 22 bp, Artificial Sequence
  chemically synthesized
aaatgtagcagagcaggctaca

SEQ ID NO: 42685 - DNA, 22 bp, Artificial Sequence
  chemically synthesized
caattgatattcaaaaagagga

SEQ ID NO: 42686 - DNA, 22 bp, Artificial Sequence
  chemically synthesized
atattcaaaaagaggaaacttc

SEQ ID NO: 42687 - DNA, 22 bp, Artificial Sequence
  chemically synthesized
aaaaagaggaaacttccattta

SEQ ID NO: 42688 - DNA, 22 bp, Artificial Sequence
  chemically synthesized
ccatttatttccccctttaact

SEQ ID NO: 42689 - DNA, 22 bp, Artificial Sequence
  chemically synthesized
catttatttccccctttaacta

SEQ ID NO: 42690 - DNA, 22 bp, Artificial Sequence
  chemically synthesized
atttccccctttaactaagtta

SEQ ID NO: 42691 - DNA, 22 bp, Artificial Sequence
  chemically synthesized
tttccccctttaactaagttac

SEQ ID NO: 42692 - DNA, 22 bp, Artificial Sequence
  chemically synthesized
ccccctttaactaagttacctg

SEQ ID NO: 42693 - DNA, 22 bp, Artificial Sequence
  chemically synthesized
cccctttaactaagttacctgt

SEQ ID NO: 42694 - DNA, 22 bp, Artificial Sequence
  chemically synthesized
taactaagttacctgtaactgt

SEQ ID NO: 42695 - DNA, 22 bp, Artificial Sequence
  chemically synthesized
aactaagttacctgtaactgtg

SEQ ID NO: 42696 - DNA, 22 bp, Artificial Sequence
  chemically synthesized
actaagttacctgtaactgtgt

SEQ ID NO: 42697 - DNA, 22 bp, Artificial Sequence
  chemically synthesized
agttacctgtaactgtgtcatt

SEQ ID NO: 42698 - DNA, 22 bp, Artificial Sequence
  chemically synthesized
cctgtaactgtgtcattttatt

SEQ ID NO: 42699 - DNA, 22 bp, Artificial Sequence
  chemically synthesized
taactgtgtcattttattatgc

SEQ ID NO: 42700 - DNA, 22 bp, Artificial Sequence
  chemically synthesized
tgtcattttattatgcttcata

SEQ ID NO: 42701 - DNA, 22 bp, Artificial Sequence
  chemically synthesized
tattatgcttcatagagcatca

SEQ ID NO: 42702 - DNA, 22 bp, Artificial Sequence
  chemically synthesized
attatgcttcatagagcatcac

SEQ ID NO: 42703 - DNA, 22 bp, Artificial Sequence
  chemically synthesized
ttatgcttcatagagcatcact

SEQ ID NO: 42704 - DNA, 22 bp, Artificial Sequence
  chemically synthesized
tgcttcatagagcatcactgct

SEQ ID NO: 42705 - DNA, 22 bp, Artificial Sequence
  chemically synthesized
catagagcatcactgctgagat

SEQ ID NO: 42706 - DNA, 22 bp, Artificial Sequence
  chemically synthesized
atagagcatcactgctgagatc

SEQ ID NO: 42707 - DNA, 22 bp, Artificial Sequence
  chemically synthesized
ctgagatcccctccccagctca

SEQ ID NO: 42708 - DNA, 22 bp, Artificial Sequence
  chemically synthesized
agatcccctccccagctcatgt

SEQ ID NO: 42709 - DNA, 22 bp, Artificial Sequence
  chemically synthesized
cccagctcatgttgctaggaaa

SEQ ID NO: 42710 - DNA, 22 bp, Artificial Sequence
  chemically synthesized
atgttgctaggaaatatcccaa

SEQ ID NO: 42711 - DNA, 22 bp, Artificial Sequence
  chemically synthesized
ctaggaaatatcccaaaacaga

SEQ ID NO: 42712 - DNA, 22 bp, Artificial Sequence
  chemically synthesized
ggaaatatcccaaaacagaatc

SEQ ID NO: 42713 - DNA, 22 bp, Artificial Sequence
  chemically synthesized
ttctttttttaacctgatgatt

SEQ ID NO: 42714 - DNA, 22 bp, Artificial Sequence
  chemically synthesized
tctttttttaacctgatgattt

SEQ ID NO: 42715 - DNA, 22 bp, Artificial Sequence
  chemically synthesized
ctttttttaacctgatgatttt

SEQ ID NO: 42716 - DNA, 22 bp, Artificial Sequence
  chemically synthesized
tttttttaacctgatgattttt

SEQ ID NO: 42717 - DNA, 22 bp, Artificial Sequence
  chemically synthesized
tttttaacctgatgatttttcc

SEQ ID NO: 42718 - DNA, 22 bp, Artificial Sequence
  chemically synthesized
ttttaacctgatgatttttcca

SEQ ID NO: 42719 - DNA, 22 bp, Artificial Sequence
  chemically synthesized
tttaacctgatgatttttccac

SEQ ID NO: 42720 - DNA, 22 bp, Artificial Sequence
  chemically synthesized
ttaacctgatgatttttccaca

SEQ ID NO: 42721 - DNA, 22 bp, Artificial Sequence
  chemically synthesized
taacctgatgatttttccacaa

SEQ ID NO: 42722 - DNA, 22 bp, Artificial Sequence
  chemically synthesized
aacctgatgatttttccacaat

SEQ ID NO: 42723 - DNA, 22 bp, Artificial Sequence
  chemically synthesized
acctgatgatttttccacaatc

SEQ ID NO: 42724 - DNA, 22 bp, Artificial Sequence
  chemically synthesized
atgatttttccacaatcctttt

SEQ ID NO: 42725 - DNA, 22 bp, Artificial Sequence
  chemically synthesized
ttccacaatccttttgtttctc

SEQ ID NO: 42726 - DNA, 22 bp, Artificial Sequence
  chemically synthesized
tccacaatccttttgtttctct

SEQ ID NO: 42727 - DNA, 22 bp, Artificial Sequence
  chemically synthesized
ccacaatccttttgtttctctg

SEQ ID NO: 42728 - DNA, 22 bp, Artificial Sequence
  chemically synthesized
cacaatccttttgtttctctga

SEQ ID NO: 42729 - DNA, 22 bp, Artificial Sequence
  chemically synthesized
ttgtttctctgattcacctcca

SEQ ID NO: 42730 - DNA, 22 bp, Artificial Sequence
  chemically synthesized
tgtttctctgattcacctccag

SEQ ID NO: 42731 - DNA, 22 bp, Artificial Sequence
  chemically synthesized
gtttctctgattcacctccagg

SEQ ID NO: 42732 - DNA, 22 bp, Artificial Sequence
  chemically synthesized
tttctctgattcacctccaggg

SEQ ID NO: 42733 - DNA, 22 bp, Artificial Sequence
  chemically synthesized
ctctgattcacctccagggctc

SEQ ID NO: 42734 - DNA, 22 bp, Artificial Sequence
  chemically synthesized
tctgattcacctccagggctca

SEQ ID NO: 42735 - DNA, 22 bp, Artificial Sequence
  chemically synthesized
tgattcacctccagggctcata

SEQ ID NO: 42736 - DNA, 22 bp, Artificial Sequence
  chemically synthesized
attcacctccagggctcatatg

SEQ ID NO: 42737 - DNA, 22 bp, Artificial Sequence
  chemically synthesized
acctccagggctcatatggcaa

SEQ ID NO: 42738 - DNA, 22 bp, Artificial Sequence
  chemically synthesized
cagggctcatatggcaatgggg

SEQ ID NO: 42739 - DNA, 22 bp, Artificial Sequence
  chemically synthesized
atatggcaatggggatttaata

SEQ ID NO: 42740 - DNA, 22 bp, Artificial Sequence
  chemically synthesized
aatagggtttatttgttggtga

SEQ ID NO: 42741 - DNA, 22 bp, Artificial Sequence
  chemically synthesized
atagggtttatttgttggtgaa

SEQ ID NO: 42742 - DNA, 22 bp, Artificial Sequence
  chemically synthesized
atttgttggtgaagaaacatta

SEQ ID NO: 42743 - DNA, 22 bp, Artificial Sequence
  chemically synthesized
tttgttggtgaagaaacattaa

SEQ ID NO: 42744 - DNA, 22 bp, Artificial Sequence
  chemically synthesized
gttggtgaagaaacattaaaca

SEQ ID NO: 42745 - DNA, 22 bp, Artificial Sequence
  chemically synthesized
ttggtgaagaaacattaaacaa

SEQ ID NO: 42746 - DNA, 22 bp, Artificial Sequence
  chemically synthesized
gtgaagaaacattaaacaaatc

SEQ ID NO: 42747 - DNA, 22 bp, Artificial Sequence
  chemically synthesized
aacaaatcttttaataggaaaa

SEQ ID NO: 42748 - DNA, 22 bp, Artificial Sequence
  chemically synthesized
ttaataggaaaaatacttttat

SEQ ID NO: 42749 - DNA, 22 bp, Artificial Sequence
  chemically synthesized
taataggaaaaatacttttata

SEQ ID NO: 42750 - DNA, 22 bp, Artificial Sequence
  chemically synthesized
aataggaaaaatacttttatat

SEQ ID NO: 42751 - DNA, 22 bp, Artificial Sequence
  chemically synthesized
ataggaaaaatacttttatatt

SEQ ID NO: 42752 - DNA, 22 bp, Artificial Sequence
  chemically synthesized
ttatattataggcaaaatgtag

SEQ ID NO: 42753 - DNA, 22 bp, Artificial Sequence
  chemically synthesized
tatattataggcaaaatgtaga

SEQ ID NO: 42754 - DNA, 22 bp, Artificial Sequence
  chemically synthesized
atattataggcaaaatgtagat

SEQ ID NO: 42755 - DNA, 22 bp, Artificial Sequence
  chemically synthesized
tattataggcaaaatgtagatg

SEQ ID NO: 42756 - DNA, 22 bp, Artificial Sequence
  chemically synthesized
taggcaaaatgtagatgtatat

SEQ ID NO: 42757 - DNA, 22 bp, Artificial Sequence
  chemically synthesized
ctactgaagtaaatgtatttta

SEQ ID NO: 42758 - DNA, 22 bp, Artificial Sequence
  chemically synthesized
ctgaagtaaatgtattttatta

SEQ ID NO: 42759 - DNA, 22 bp, Artificial Sequence
  chemically synthesized
aagtaaatgtattttattaatg

SEQ ID NO: 42760 - DNA, 22 bp, Artificial Sequence
  chemically synthesized
tattaatggtgtgagaatttct

SEQ ID NO: 42761 - DNA, 22 bp, Artificial Sequence
  chemically synthesized
attaatggtgtgagaatttctt

SEQ ID NO: 42762 - DNA, 22 bp, Artificial Sequence
  chemically synthesized
ttaatggtgtgagaatttcttc

SEQ ID NO: 42763 - DNA, 22 bp, Artificial Sequence
  chemically synthesized
atggtgtgagaatttcttcctc

SEQ ID NO: 42764 - DNA, 22 bp, Artificial Sequence
  chemically synthesized
cttcctcactgtggtgtgtgaa

SEQ ID NO: 42765 - DNA, 22 bp, Artificial Sequence
  chemically synthesized
ttcctcactgtggtgtgtgaat

SEQ ID NO: 42766 - DNA, 22 bp, Artificial Sequence
  chemically synthesized
cctcactgtggtgtgtgaatgt

SEQ ID NO: 42767 - DNA, 22 bp, Artificial Sequence
  chemically synthesized
ctcactgtggtgtgtgaatgtg

SEQ ID NO: 42768 - DNA, 22 bp, Artificial Sequence
  chemically synthesized
actgtggtgtgtgaatgtgtat

SEQ ID NO: 42769 - DNA, 22 bp, Artificial Sequence
  chemically synthesized
tggtgtgtgaatgtgtatgcat

SEQ ID NO: 42770 - DNA, 22 bp, Artificial Sequence
  chemically synthesized
gcatgtgtaaaagacttagcaa

SEQ ID NO: 42771 - DNA, 22 bp, Artificial Sequence
  chemically synthesized
catgtgtaaaagacttagcaat

SEQ ID NO: 42772 - DNA, 22 bp, Artificial Sequence
  chemically synthesized
agcaatttgtgaatagaagatg

SEQ ID NO: 42773 - DNA, 22 bp, Artificial Sequence
  chemically synthesized
gcaatttgtgaatagaagatgt

SEQ ID NO: 42774 - DNA, 22 bp, Artificial Sequence
  chemically synthesized
gtgaatagaagatgtttctccg

SEQ ID NO: 42775 - DNA, 22 bp, Artificial Sequence
  chemically synthesized
tgaatagaagatgtttctccgc

SEQ ID NO: 42776 - DNA, 22 bp, Artificial Sequence
  chemically synthesized
ctccgcttctcactgagcatgg

SEQ ID NO: 42777 - DNA, 22 bp, Artificial Sequence
  chemically synthesized
tccgcttctcactgagcatggc

SEQ ID NO: 42778 - DNA, 22 bp, Artificial Sequence
  chemically synthesized
cgcttctcactgagcatggctg

SEQ ID NO: 42779 - DNA, 22 bp, Artificial Sequence
  chemically synthesized
ctcactgagcatggctgtaaaa

SEQ ID NO: 42780 - DNA, 22 bp, Artificial Sequence
  chemically synthesized
tcactgagcatggctgtaaaag

SEQ ID NO: 42781 - DNA, 22 bp, Artificial Sequence
  chemically synthesized
actgagcatggctgtaaaagaa

SEQ ID NO: 42782 - DNA, 22 bp, Artificial Sequence
  chemically synthesized
agcatggctgtaaaagaaactt

SEQ ID NO: 42783 - DNA, 22 bp, Artificial Sequence
  chemically synthesized
taaaagaaactttttcctctcc

SEQ ID NO: 42784 - DNA, 22 bp, Artificial Sequence
  chemically synthesized
tttcctctccccgggcattcca

SEQ ID NO: 42785 - DNA, 22 bp, Artificial Sequence
  chemically synthesized
ttcctctccccgggcattccag

SEQ ID NO: 42786 - DNA, 22 bp, Artificial Sequence
  chemically synthesized
tcctctccccgggcattccagc

SEQ ID NO: 42787 - DNA, 22 bp, Artificial Sequence
  chemically synthesized
cctctccccgggcattccagca

SEQ ID NO: 42788 - DNA, 22 bp, Artificial Sequence
  chemically synthesized
ctctccccgggcattccagcac

SEQ ID NO: 42789 - DNA, 22 bp, Artificial Sequence
  chemically synthesized
tccccgggcattccagcacaca

SEQ ID NO: 42790 - DNA, 22 bp, Artificial Sequence
  chemically synthesized
cccgggcattccagcacacatt

SEQ ID NO: 42791 - DNA, 22 bp, Artificial Sequence
  chemically synthesized
cagcacacattggaaagataac

SEQ ID NO: 42792 - DNA, 22 bp, Artificial Sequence
  chemically synthesized
gaaagataacacgtccacagaa

SEQ ID NO: 42793 - DNA, 22 bp, Artificial Sequence
  chemically synthesized
gctttccaaaagagcttatcag

SEQ ID NO: 42794 - DNA, 22 bp, Artificial Sequence
  chemically synthesized
tccaaaagagcttatcagagaa

SEQ ID NO: 42795 - DNA, 22 bp, Artificial Sequence
  chemically synthesized
ccaaaagagcttatcagagaat

SEQ ID NO: 42796 - DNA, 22 bp, Artificial Sequence
  chemically synthesized
caaaagagcttatcagagaatg

SEQ ID NO: 42797 - DNA, 22 bp, Artificial Sequence
  chemically synthesized
atcagagaatgtgccccccagg

SEQ ID NO: 42798 - DNA, 22 bp, Artificial Sequence
  chemically synthesized
tcagagaatgtgccccccaggt

SEQ ID NO: 42799 - DNA, 22 bp, Artificial Sequence
  chemically synthesized
aaacatatgttaatcctgtggc

SEQ ID NO: 42800 - DNA, 22 bp, Artificial Sequence
  chemically synthesized
atcctgtggcagagaagtttgt

SEQ ID NO: 42801 - DNA, 22 bp, Artificial Sequence
  chemically synthesized
tggcagagaagtttgttctagc

SEQ ID NO: 42802 - DNA, 22 bp, Artificial Sequence
  chemically synthesized
gttctagcctttgggtgtagcc

SEQ ID NO: 42803 - DNA, 22 bp, Artificial Sequence
  chemically synthesized
ttctagcctttgggtgtagcct

SEQ ID NO: 42804 - DNA, 22 bp, Artificial Sequence
  chemically synthesized
tagcctttgggtgtagcctgct

SEQ ID NO: 42805 - DNA, 22 bp, Artificial Sequence
  chemically synthesized
gcctttgggtgtagcctgctga

SEQ ID NO: 42806 - DNA, 22 bp, Artificial Sequence
  chemically synthesized
tgggtgtagcctgctgaataag

SEQ ID NO: 42807 - DNA, 22 bp, Artificial Sequence
  chemically synthesized
gggtgtagcctgctgaataagt

SEQ ID NO: 42808 - DNA, 22 bp, Artificial Sequence
  chemically synthesized
ggtgtagcctgctgaataagtt

SEQ ID NO: 42809 - DNA, 22 bp, Artificial Sequence
  chemically synthesized
ctgaataagttcacagtgatct

SEQ ID NO: 42810 - DNA, 22 bp, Artificial Sequence
  chemically synthesized
aataagttcacagtgatctaca

SEQ ID NO: 42811 - DNA, 22 bp, Artificial Sequence
  chemically synthesized
acagtgatctacatcctagttt

SEQ ID NO: 42812 - DNA, 22 bp, Artificial Sequence
  chemically synthesized
catcctagtttccatgggctga

SEQ ID NO: 42813 - DNA, 22 bp, Artificial Sequence
  chemically synthesized
gtttccatgggctgaaatagaa

SEQ ID NO: 42814 - DNA, 22 bp, Artificial Sequence
  chemically synthesized
ccatgggctgaaatagaatatt

SEQ ID NO: 42815 - DNA, 22 bp, Artificial Sequence
  chemically synthesized
catgggctgaaatagaatattc

SEQ ID NO: 42816 - DNA, 22 bp, Artificial Sequence
  chemically synthesized
aaatagaatattcatatcccct

SEQ ID NO: 42817 - DNA, 22 bp, Artificial Sequence
  chemically synthesized
atatcccctgcactccctacac

SEQ ID NO: 42818 - DNA, 22 bp, Artificial Sequence
  chemically synthesized
cactccctacacacacagacat

SEQ ID NO: 42819 - DNA, 22 bp, Artificial Sequence
  chemically synthesized
cctacacacacagacatagaca

SEQ ID NO: 42820 - DNA, 22 bp, Artificial Sequence
  chemically synthesized
cacacacagacatagacaccaa

SEQ ID NO: 42821 - DNA, 22 bp, Artificial Sequence
  chemically synthesized
ccccaaaaaactctttgcttaa

SEQ ID NO: 42822 - DNA, 22 bp, Artificial Sequence
  chemically synthesized
cccaaaaaactctttgcttaat

SEQ ID NO: 42823 - DNA, 22 bp, Artificial Sequence
  chemically synthesized
tttgcttaatcttctcctgctc

SEQ ID NO: 42824 - DNA, 22 bp, Artificial Sequence
  chemically synthesized
tgcttaatcttctcctgctctg

SEQ ID NO: 42825 - DNA, 22 bp, Artificial Sequence
  chemically synthesized
gcttaatcttctcctgctctgt

SEQ ID NO: 42826 - DNA, 22 bp, Artificial Sequence
  chemically synthesized
cttaatcttctcctgctctgta

SEQ ID NO: 42827 - DNA, 22 bp, Artificial Sequence
  chemically synthesized
aatcttctcctgctctgtattt

SEQ ID NO: 42828 - DNA, 22 bp, Artificial Sequence
  chemically synthesized
atcttctcctgctctgtatttt

SEQ ID NO: 42829 - DNA, 22 bp, Artificial Sequence
  chemically synthesized
ctcctgctctgtattttctttg

SEQ ID NO: 42830 - DNA, 22 bp, Artificial Sequence
  chemically synthesized
tcctgctctgtattttctttga

SEQ ID NO: 42831 - DNA, 22 bp, Artificial Sequence
  chemically synthesized
ctgctctgtattttctttgata

SEQ ID NO: 42832 - DNA, 22 bp, Artificial Sequence
  chemically synthesized
ctctgtattttctttgatattt

SEQ ID NO: 42833 - DNA, 22 bp, Artificial Sequence
  chemically synthesized
tgtattttctttgatattttct

SEQ ID NO: 42834 - DNA, 22 bp, Artificial Sequence
  chemically synthesized
tattttctttgatattttcttg

SEQ ID NO: 42835 - DNA, 22 bp, Artificial Sequence
  chemically synthesized
tctttgatattttcttgaatgg

SEQ ID NO: 42836 - DNA, 22 bp, Artificial Sequence
  chemically synthesized
ctttgatattttcttgaatggc

SEQ ID NO: 42837 - DNA, 22 bp, Artificial Sequence
  chemically synthesized
tttgatattttcttgaatggct

SEQ ID NO: 42838 - DNA, 22 bp, Artificial Sequence
  chemically synthesized
tgatattttcttgaatggcttc

SEQ ID NO: 42839 - DNA, 22 bp, Artificial Sequence
  chemically synthesized
gatattttcttgaatggcttcc

SEQ ID NO: 42840 - DNA, 22 bp, Artificial Sequence
  chemically synthesized
atattttcttgaatggcttcca

SEQ ID NO: 42841 - DNA, 22 bp, Artificial Sequence
  chemically synthesized
tcttgaatggcttccactaaat

SEQ ID NO: 42842 - DNA, 22 bp, Artificial Sequence
  chemically synthesized
cttgaatggcttccactaaatt

SEQ ID NO: 42843 - DNA, 22 bp, Artificial Sequence
  chemically synthesized
ttgaatggcttccactaaattc

SEQ ID NO: 42844 - DNA, 22 bp, Artificial Sequence
  chemically synthesized
gaatggcttccactaaattcaa

SEQ ID NO: 42845 - DNA, 22 bp, Artificial Sequence
  chemically synthesized
aatggcttccactaaattcaaa

SEQ ID NO: 42846 - DNA, 22 bp, Artificial Sequence
  chemically synthesized
ccactaaattcaaatgtgtttg

SEQ ID NO: 42847 - DNA, 22 bp, Artificial Sequence
  chemically synthesized
cactaaattcaaatgtgtttga

SEQ ID NO: 42848 - DNA, 22 bp, Artificial Sequence
  chemically synthesized
aattcaaatgtgtttgacttta

SEQ ID NO: 42849 - DNA, 22 bp, Artificial Sequence
  chemically synthesized
aaatgtgtttgactttaaagtc

SEQ ID NO: 42850 - DNA, 22 bp, Artificial Sequence
  chemically synthesized
gactttaaagtcaacttgtaaa

SEQ ID NO: 42851 - DNA, 22 bp, Artificial Sequence
  chemically synthesized
actttaaagtcaacttgtaaaa

SEQ ID NO: 42852 - DNA, 22 bp, Artificial Sequence
  chemically synthesized
taaagtcaacttgtaaaatttt

SEQ ID NO: 42853 - DNA, 22 bp, Artificial Sequence
  chemically synthesized
aaagtcaacttgtaaaatttta

SEQ ID NO: 42854 - DNA, 22 bp, Artificial Sequence
  chemically synthesized
aagtcaacttgtaaaattttat

SEQ ID NO: 42855 - DNA, 22 bp, Artificial Sequence
  chemically synthesized
gtaaaattttatctggtaattt

SEQ ID NO: 42856 - DNA, 22 bp, Artificial Sequence
  chemically synthesized
taaaattttatctggtaattta

SEQ ID NO: 42857 - DNA, 22 bp, Artificial Sequence
  chemically synthesized
tatctggtaatttatagattaa

SEQ ID NO: 42858 - DNA, 22 bp, Artificial Sequence
  chemically synthesized
atctggtaatttatagattaaa

SEQ ID NO: 42859 - DNA, 22 bp, Artificial Sequence
  chemically synthesized
tctggtaatttatagattaaat

SEQ ID NO: 42860 - DNA, 22 bp, Artificial Sequence
  chemically synthesized
gtaatttatagattaaattgca

SEQ ID NO: 42861 - DNA, 22 bp, Artificial Sequence
  chemically synthesized
atagattaaattgcaagcatct

SEQ ID NO: 42862 - DNA, 22 bp, Artificial Sequence
  chemically synthesized
tagattaaattgcaagcatcta

SEQ ID NO: 42863 - DNA, 22 bp, Artificial Sequence
  chemically synthesized
aattgcaagcatctacctccct

SEQ ID NO: 42864 - DNA, 22 bp, Artificial Sequence
  chemically synthesized
caagcatctacctccctttcat

SEQ ID NO: 42865 - DNA, 22 bp, Artificial Sequence
  chemically synthesized
cctccctttcatcagactctcc

SEQ ID NO: 42866 - DNA, 22 bp, Artificial Sequence
  chemically synthesized
cctttcatcagactctccctgc

SEQ ID NO: 42867 - DNA, 22 bp, Artificial Sequence
  chemically synthesized
tcatcagactctccctgcaggg

SEQ ID NO: 42868 - DNA, 22 bp, Artificial Sequence
  chemically synthesized
catcagactctccctgcagggc

SEQ ID NO: 42869 - DNA, 22 bp, Artificial Sequence
  chemically synthesized
atcagactctccctgcagggca

SEQ ID NO: 42870 - DNA, 22 bp, Artificial Sequence
  chemically synthesized
tccctgcagggcaagttcatct

SEQ ID NO: 42871 - DNA, 22 bp, Artificial Sequence
  chemically synthesized
cctgcagggcaagttcatctaa

SEQ ID NO: 42872 - DNA, 22 bp, Artificial Sequence
  chemically synthesized
cagggcaagttcatctaactat

SEQ ID NO: 42873 - DNA, 22 bp, Artificial Sequence
  chemically synthesized
atctaactatgtatgtgcttca

SEQ ID NO: 42874 - DNA, 22 bp, Artificial Sequence
  chemically synthesized
actatgtatgtgcttcaagatg

SEQ ID NO: 42875 - DNA, 22 bp, Artificial Sequence
  chemically synthesized
tgtatgtgcttcaagatggaac

SEQ ID NO: 42876 - DNA, 22 bp, Artificial Sequence
  chemically synthesized
caagatggaactcctgagttca

SEQ ID NO: 42877 - DNA, 22 bp, Artificial Sequence
  chemically synthesized
aagatggaactcctgagttcac

SEQ ID NO: 42878 - DNA, 22 bp, Artificial Sequence
  chemically synthesized
ctgagttcacaggtgatttata

SEQ ID NO: 42879 - DNA, 22 bp, Artificial Sequence
  chemically synthesized
agttcacaggtgatttataaac

SEQ ID NO: 42880 - DNA, 22 bp, Artificial Sequence
  chemically synthesized
acaggtgatttataaaccaaag

SEQ ID NO: 42881 - DNA, 22 bp, Artificial Sequence
  chemically synthesized
ataaaccaaagcatgcccacta

SEQ ID NO: 42882 - DNA, 22 bp, Artificial Sequence
  chemically synthesized
taaaccaaagcatgcccactac

SEQ ID NO: 42883 - DNA, 22 bp, Artificial Sequence
  chemically synthesized
caaaactctcaccctccagaga

SEQ ID NO: 42884 - DNA, 22 bp, Artificial Sequence
  chemically synthesized
tcaccctccagagatttgcctc

SEQ ID NO: 42885 - DNA, 22 bp, Artificial Sequence
  chemically synthesized
accctccagagatttgcctcaa

SEQ ID NO: 42886 - DNA, 22 bp, Artificial Sequence
  chemically synthesized
cagagatttgcctcaagggaca

SEQ ID NO: 42887 - DNA, 22 bp, Artificial Sequence
  chemically synthesized
gcctcaagggacaacaccctgc

SEQ ID NO: 42888 - DNA, 22 bp, Artificial Sequence
  chemically synthesized
cctcaagggacaacaccctgct

SEQ ID NO: 42889 - DNA, 22 bp, Artificial Sequence
  chemically synthesized
aagggacaacaccctgctcaca

SEQ ID NO: 42890 - DNA, 22 bp, Artificial Sequence
  chemically synthesized
ctcacaaaggcaccagcaggca

SEQ ID NO: 42891 - DNA, 22 bp, Artificial Sequence
  chemically synthesized
acaaaggcaccagcaggcaact

SEQ ID NO: 42892 - DNA, 22 bp, Artificial Sequence
  chemically synthesized
ctcaactacctggtggataagg

SEQ ID NO: 42893 - DNA, 22 bp, Artificial Sequence
  chemically synthesized
aactacctggtggataaggtgc

SEQ ID NO: 42894 - DNA, 22 bp, Artificial Sequence
  chemically synthesized
cctggtggataaggtgcccaag

SEQ ID NO: 42895 - DNA, 22 bp, Artificial Sequence
  chemically synthesized
gtggataaggtgcccaagctag

SEQ ID NO: 42896 - DNA, 22 bp, Artificial Sequence
  chemically synthesized
gcatggacccctgaatccttgc

SEQ ID NO: 42897 - DNA, 22 bp, Artificial Sequence
  chemically synthesized
aatccttgctcgcctcctctgt

SEQ ID NO: 42898 - DNA, 22 bp, Artificial Sequence
  chemically synthesized
gctcgcctcctctgttgccttt

SEQ ID NO: 42899 - DNA, 22 bp, Artificial Sequence
  chemically synthesized
ctcgcctcctctgttgcctttt

SEQ ID NO: 42900 - DNA, 22 bp, Artificial Sequence
  chemically synthesized
gcctcctctgttgccttttaaa

SEQ ID NO: 42901 - DNA, 22 bp, Artificial Sequence
  chemically synthesized
ctctgttgccttttaaaagtgc

SEQ ID NO: 42902 - DNA, 22 bp, Artificial Sequence
  chemically synthesized
tgttgccttttaaaagtgccac

SEQ ID NO: 42903 - DNA, 22 bp, Artificial Sequence
  chemically synthesized
ttgccttttaaaagtgccactt

SEQ ID NO: 42904 - DNA, 22 bp, Artificial Sequence
  chemically synthesized
ccttttaaaagtgccactttct

SEQ ID NO: 42905 - DNA, 22 bp, Artificial Sequence
  chemically synthesized
ttaaaagtgccactttctgctc

SEQ ID NO: 42906 - DNA, 22 bp, Artificial Sequence
  chemically synthesized
taaaagtgccactttctgctcc

SEQ ID NO: 42907 - DNA, 22 bp, Artificial Sequence
  chemically synthesized
aaaagtgccactttctgctcct

SEQ ID NO: 42908 - DNA, 22 bp, Artificial Sequence
  chemically synthesized
aaagtgccactttctgctccta

SEQ ID NO: 42909 - DNA, 22 bp, Artificial Sequence
  chemically synthesized
tctgctcctaaagtgaagtagt

SEQ ID NO: 42910 - DNA, 22 bp, Artificial Sequence
  chemically synthesized
ctgctcctaaagtgaagtagta

SEQ ID NO: 42911 - DNA, 22 bp, Artificial Sequence
  chemically synthesized
tgctcctaaagtgaagtagtac

SEQ ID NO: 42912 - DNA, 22 bp, Artificial Sequence
  chemically synthesized
ctcctaaagtgaagtagtacgg

SEQ ID NO: 42913 - DNA, 22 bp, Artificial Sequence
  chemically synthesized
ctaaagtgaagtagtacggcag

SEQ ID NO: 42914 - DNA, 22 bp, Artificial Sequence
  chemically synthesized
aagtgaagtagtacggcaggac

SEQ ID NO: 42915 - DNA, 22 bp, Artificial Sequence
  chemically synthesized
ctgcatttcttcccctaagcta

SEQ ID NO: 42916 - DNA, 22 bp, Artificial Sequence
  chemically synthesized
catttcttcccctaagctagct

SEQ ID NO: 42917 - DNA, 22 bp, Artificial Sequence
  chemically synthesized
cttcccctaagctagctttgga

SEQ ID NO: 42918 - DNA, 22 bp, Artificial Sequence
  chemically synthesized
ttcccctaagctagctttggaa

SEQ ID NO: 42919 - DNA, 22 bp, Artificial Sequence
  chemically synthesized
cccctaagctagctttggaagc

SEQ ID NO: 42920 - DNA, 22 bp, Artificial Sequence
  chemically synthesized
ccctaagctagctttggaagca

SEQ ID NO: 42921 - DNA, 22 bp, Artificial Sequence
  chemically synthesized
agctagctttggaagcaaatca

SEQ ID NO: 42922 - DNA, 22 bp, Artificial Sequence
  chemically synthesized
gctttggaagcaaatcactttc

SEQ ID NO: 42923 - DNA, 22 bp, Artificial Sequence
  chemically synthesized
tggaagcaaatcactttcttta

SEQ ID NO: 42924 - DNA, 22 bp, Artificial Sequence
  chemically synthesized
ggaagcaaatcactttctttat

SEQ ID NO: 42925 - DNA, 22 bp, Artificial Sequence
  chemically synthesized
gaagcaaatcactttctttata

SEQ ID NO: 42926 - DNA, 22 bp, Artificial Sequence
  chemically synthesized
tctttataccagacttctctct

SEQ ID NO: 42927 - DNA, 22 bp, Artificial Sequence
  chemically synthesized
ctttataccagacttctctctt

SEQ ID NO: 42928 - DNA, 22 bp, Artificial Sequence
  chemically synthesized
tttataccagacttctctcttc

SEQ ID NO: 42929 - DNA, 22 bp, Artificial Sequence
  chemically synthesized
tataccagacttctctcttctt

SEQ ID NO: 42930 - DNA, 22 bp, Artificial Sequence
  chemically synthesized
ataccagacttctctcttctta

SEQ ID NO: 42931 - DNA, 22 bp, Artificial Sequence
  chemically synthesized
taccagacttctctcttcttaa

SEQ ID NO: 42932 - DNA, 22 bp, Artificial Sequence
  chemically synthesized
ctctcttcttaattggattctg

SEQ ID NO: 42933 - DNA, 22 bp, Artificial Sequence
  chemically synthesized
tctcttcttaattggattctgc

SEQ ID NO: 42934 - DNA, 22 bp, Artificial Sequence
  chemically synthesized
tcttcttaattggattctgcaa

SEQ ID NO: 42935 - DNA, 22 bp, Artificial Sequence
  chemically synthesized
ttcttaattggattctgcaagt

SEQ ID NO: 42936 - DNA, 22 bp, Artificial Sequence
  chemically synthesized
cttaattggattctgcaagtgg

SEQ ID NO: 42937 - DNA, 22 bp, Artificial Sequence
  chemically synthesized
ttaattggattctgcaagtggc

SEQ ID NO: 42938 - DNA, 22 bp, Artificial Sequence
  chemically synthesized
aattggattctgcaagtggcaa

SEQ ID NO: 42939 - DNA, 22 bp, Artificial Sequence
  chemically synthesized
attggattctgcaagtggcaaa

SEQ ID NO: 42940 - DNA, 22 bp, Artificial Sequence
  chemically synthesized
gattctgcaagtggcaaacaat

SEQ ID NO: 42941 - DNA, 22 bp, Artificial Sequence
  chemically synthesized
tgcaagtggcaaacaattaacc

SEQ ID NO: 42942 - DNA, 22 bp, Artificial Sequence
  chemically synthesized
caagtggcaaacaattaacctg

SEQ ID NO: 42943 - DNA, 22 bp, Artificial Sequence
  chemically synthesized
acctgctcttcagttacattgg

SEQ ID NO: 42944 - DNA, 22 bp, Artificial Sequence
  chemically synthesized
ctcttcagttacattggaatgt

SEQ ID NO: 42945 - DNA, 22 bp, Artificial Sequence
  chemically synthesized
ttcagttacattggaatgtgtt

SEQ ID NO: 42946 - DNA, 22 bp, Artificial Sequence
  chemically synthesized
cagttacattggaatgtgttta

SEQ ID NO: 42947 - DNA, 22 bp, Artificial Sequence
  chemically synthesized
agttacattggaatgtgtttag

SEQ ID NO: 42948 - DNA, 22 bp, Artificial Sequence
  chemically synthesized
cattggaatgtgtttagattta

SEQ ID NO: 42949 - DNA, 22 bp, Artificial Sequence
  chemically synthesized
gaatgtgtttagatttattttt

SEQ ID NO: 42950 - DNA, 22 bp, Artificial Sequence
  chemically synthesized
agatttattttttcaaatgttg

SEQ ID NO: 42951 - DNA, 22 bp, Artificial Sequence
  chemically synthesized
gatttattttttcaaatgttgg

SEQ ID NO: 42952 - DNA, 22 bp, Artificial Sequence
  chemically synthesized
attttttcaaatgttggaacaa

SEQ ID NO: 42953 - DNA, 22 bp, Artificial Sequence
  chemically synthesized
ttttttcaaatgttggaacaaa

SEQ ID NO: 42954 - DNA, 22 bp, Artificial Sequence
  chemically synthesized
tttcaaatgttggaacaaagat

SEQ ID NO: 42955 - DNA, 22 bp, Artificial Sequence
  chemically synthesized
ttcaaatgttggaacaaagatg

SEQ ID NO: 42956 - DNA, 22 bp, Artificial Sequence
  chemically synthesized
tcaaatgttggaacaaagatga

SEQ ID NO: 42957 - DNA, 22 bp, Artificial Sequence
  chemically synthesized
caaatgttggaacaaagatgaa

SEQ ID NO: 42958 - DNA, 22 bp, Artificial Sequence
  chemically synthesized
aaatgttggaacaaagatgaaa

SEQ ID NO: 42959 - DNA, 22 bp, Artificial Sequence
  chemically synthesized
gaacaaagatgaaaaagtgaga

SEQ ID NO: 42960 - DNA, 22 bp, Artificial Sequence
  chemically synthesized
gattttttcttggaaatctggc

SEQ ID NO: 42961 - DNA, 22 bp, Artificial Sequence
  chemically synthesized
tttcttggaaatctggcttaaa

SEQ ID NO: 42962 - DNA, 22 bp, Artificial Sequence
  chemically synthesized
ttcttggaaatctggcttaaat

SEQ ID NO: 42963 - DNA, 22 bp, Artificial Sequence
  chemically synthesized
tcttggaaatctggcttaaatc

SEQ ID NO: 42964 - DNA, 22 bp, Artificial Sequence
  chemically synthesized
cttggaaatctggcttaaatcc

SEQ ID NO: 42965 - DNA, 22 bp, Artificial Sequence
  chemically synthesized
ttggaaatctggcttaaatcca

SEQ ID NO: 42966 - DNA, 22 bp, Artificial Sequence
  chemically synthesized
ggaaatctggcttaaatccagg

SEQ ID NO: 42967 - DNA, 22 bp, Artificial Sequence
  chemically synthesized
gaaatctggcttaaatccaggt

SEQ ID NO: 42968 - DNA, 22 bp, Artificial Sequence
  chemically synthesized
gcttaaatccaggtttctttat

SEQ ID NO: 42969 - DNA, 22 bp, Artificial Sequence
  chemically synthesized
aaatccaggtttctttatttcc

SEQ ID NO: 42970 - DNA, 22 bp, Artificial Sequence
  chemically synthesized
aatccaggtttctttatttcct

SEQ ID NO: 42971 - DNA, 22 bp, Artificial Sequence
  chemically synthesized
ctttatttccttgatttgggaa

SEQ ID NO: 42972 - DNA, 22 bp, Artificial Sequence
  chemically synthesized
tttatttccttgatttgggaat

SEQ ID NO: 42973 - DNA, 22 bp, Artificial Sequence
  chemically synthesized
tatttccttgatttgggaattt

SEQ ID NO: 42974 - DNA, 22 bp, Artificial Sequence
  chemically synthesized
atttccttgatttgggaatttg

SEQ ID NO: 42975 - DNA, 22 bp, Artificial Sequence
  chemically synthesized
tttccttgatttgggaatttgg

SEQ ID NO: 42976 - DNA, 22 bp, Artificial Sequence
  chemically synthesized
ccttgatttgggaatttggtca

SEQ ID NO: 42977 - DNA, 22 bp, Artificial Sequence
  chemically synthesized
cttgatttgggaatttggtcac

SEQ ID NO: 42978 - DNA, 22 bp, Artificial Sequence
  chemically synthesized
gatttgggaatttggtcacgag

SEQ ID NO: 42979 - DNA, 22 bp, Artificial Sequence
  chemically synthesized
atttgggaatttggtcacgaga

SEQ ID NO: 42980 - DNA, 22 bp, Artificial Sequence
  chemically synthesized
gggaatttggtcacgagacaaa

SEQ ID NO: 42981 - DNA, 22 bp, Artificial Sequence
  chemically synthesized
ggaatttggtcacgagacaaat

SEQ ID NO: 42982 - DNA, 22 bp, Artificial Sequence
  chemically synthesized
ggtcacgagacaaataacatga

SEQ ID NO: 42983 - DNA, 22 bp, Artificial Sequence
  chemically synthesized
gtcacgagacaaataacatgat

SEQ ID NO: 42984 - DNA, 22 bp, Artificial Sequence
  chemically synthesized
tcctaagtctagatttctttgt

SEQ ID NO: 42985 - DNA, 22 bp, Artificial Sequence
  chemically synthesized
cctaagtctagatttctttgtt

SEQ ID NO: 42986 - DNA, 22 bp, Artificial Sequence
  chemically synthesized
ctaagtctagatttctttgttt

SEQ ID NO: 42987 - DNA, 22 bp, Artificial Sequence
  chemically synthesized
agtctagatttctttgtttata

SEQ ID NO: 42988 - DNA, 22 bp, Artificial Sequence
  chemically synthesized
gatttctttgtttataaaatgg

SEQ ID NO: 42989 - DNA, 22 bp, Artificial Sequence
  chemically synthesized
ctttgtttataaaatggggatg

SEQ ID NO: 42990 - DNA, 22 bp, Artificial Sequence
  chemically synthesized
tttgtttataaaatggggatga

SEQ ID NO: 42991 - DNA, 22 bp, Artificial Sequence
  chemically synthesized
tgtttataaaatggggatgact

SEQ ID NO: 42992 - DNA, 22 bp, Artificial Sequence
  chemically synthesized
gtttataaaatggggatgacta

SEQ ID NO: 42993 - DNA, 22 bp, Artificial Sequence
  chemically synthesized
tttataaaatggggatgactat

SEQ ID NO: 42994 - DNA, 22 bp, Artificial Sequence
  chemically synthesized
ataaaatggggatgactatgct

SEQ ID NO: 42995 - DNA, 22 bp, Artificial Sequence
  chemically synthesized
taaaatggggatgactatgcta

SEQ ID NO: 42996 - DNA, 22 bp, Artificial Sequence
  chemically synthesized
tgctaccctacctataccatga

SEQ ID NO: 42997 - DNA, 22 bp, Artificial Sequence
  chemically synthesized
ccctacctataccatgagctaa

SEQ ID NO: 42998 - DNA, 22 bp, Artificial Sequence
  chemically synthesized
cctataccatgagctaaataag

SEQ ID NO: 42999 - DNA, 22 bp, Artificial Sequence
  chemically synthesized
taccatgagctaaataagctag

SEQ ID NO: 43000 - DNA, 22 bp, Artificial Sequence
  chemically synthesized
aataagctagtatttgtaaagg

SEQ ID NO: 43001 - DNA, 22 bp, Artificial Sequence
  chemically synthesized
gtatttgtaaaggacacacact

SEQ ID NO: 43002 - DNA, 22 bp, Artificial Sequence
  chemically synthesized
gtaaaggacacacacttacatt

SEQ ID NO: 43003 - DNA, 22 bp, Artificial Sequence
  chemically synthesized
taaaggacacacacttacattc

SEQ ID NO: 43004 - DNA, 22 bp, Artificial Sequence
  chemically synthesized
acattcacaatcacacacggtg

SEQ ID NO: 43005 - DNA, 22 bp, Artificial Sequence
  chemically synthesized
cattcacaatcacacacggtgt

SEQ ID NO: 43006 - DNA, 22 bp, Artificial Sequence
  chemically synthesized
acaatcacacacggtgtgtatg

SEQ ID NO: 43007 - DNA, 22 bp, Artificial Sequence
  chemically synthesized
acccactcaacaaataccctga

SEQ ID NO: 43008 - DNA, 22 bp, Artificial Sequence
  chemically synthesized
aacaaataccctgagtatttgt

SEQ ID NO: 43009 - DNA, 22 bp, Artificial Sequence
  chemically synthesized
agtatttgttgaatcattatat

SEQ ID NO: 43010 - DNA, 22 bp, Artificial Sequence
  chemically synthesized
gttgaatcattatatgcgtata

SEQ ID NO: 43011 - DNA, 22 bp, Artificial Sequence
  chemically synthesized
ttgaatcattatatgcgtatat

SEQ ID NO: 43012 - DNA, 22 bp, Artificial Sequence
  chemically synthesized
aatcattatatgcgtatatcat

SEQ ID NO: 43013 - DNA, 22 bp, Artificial Sequence
  chemically synthesized
tatgcgtatatcatctggcaaa

SEQ ID NO: 43014 - DNA, 22 bp, Artificial Sequence
  chemically synthesized
gcaaatggatgtgtataatttc

SEQ ID NO: 43015 - DNA, 22 bp, Artificial Sequence
  chemically synthesized
ctccagggataagaagcaaatg

SEQ ID NO: 43016 - DNA, 22 bp, Artificial Sequence
  chemically synthesized
tccagggataagaagcaaatgt

SEQ ID NO: 43017 - DNA, 22 bp, Artificial Sequence
  chemically synthesized
cagggataagaagcaaatgtat

SEQ ID NO: 43018 - DNA, 22 bp, Artificial Sequence
  chemically synthesized
actcaggccataacaaagagag

SEQ ID NO: 43019 - DNA, 22 bp, Artificial Sequence
  chemically synthesized
ctcaggccataacaaagagaga

SEQ ID NO: 43020 - DNA, 22 bp, Artificial Sequence
  chemically synthesized
aggccataacaaagagagaaat

SEQ ID NO: 43021 - DNA, 22 bp, Artificial Sequence
  chemically synthesized
agtcccactccatgaacaggtc

SEQ ID NO: 43022 - DNA, 22 bp, Artificial Sequence
  chemically synthesized
catgaacaggtcaaggaaccaa

SEQ ID NO: 43023 - DNA, 22 bp, Artificial Sequence
  chemically synthesized
aaagagttatttcattgtttca

SEQ ID NO: 43024 - DNA, 22 bp, Artificial Sequence
  chemically synthesized
tttcattgtttcaacttgctag

SEQ ID NO: 43025 - DNA, 22 bp, Artificial Sequence
  chemically synthesized
cattgtttcaacttgctagtga

SEQ ID NO: 43026 - DNA, 22 bp, Artificial Sequence
  chemically synthesized
attgtttcaacttgctagtgag

SEQ ID NO: 43027 - DNA, 22 bp, Artificial Sequence
  chemically synthesized
tttcaacttgctagtgagggga

SEQ ID NO: 43028 - DNA, 22 bp, Artificial Sequence
  chemically synthesized
caacttgctagtgaggggagca

SEQ ID NO: 43029 - DNA, 22 bp, Artificial Sequence
  chemically synthesized
aacttgctagtgaggggagcat

SEQ ID NO: 43030 - DNA, 22 bp, Artificial Sequence
  chemically synthesized
gctagtgaggggagcatggcac

SEQ ID NO: 43031 - DNA, 22 bp, Artificial Sequence
  chemically synthesized
ctagtgaggggagcatggcacc

SEQ ID NO: 43032 - DNA, 22 bp, Artificial Sequence
  chemically synthesized
gtgaggggagcatggcacctga

SEQ ID NO: 43033 - DNA, 22 bp, Artificial Sequence
  chemically synthesized
aacagagatgatataaattaat

SEQ ID NO: 43034 - DNA, 22 bp, Artificial Sequence
  chemically synthesized
atgaaactgagaaccaagcgaa

SEQ ID NO: 43035 - DNA, 22 bp, Artificial Sequence
  chemically synthesized
agaaccaagcgaagagcttagc

SEQ ID NO: 43036 - DNA, 22 bp, Artificial Sequence
  chemically synthesized
agccatcctttgcatagttagc

SEQ ID NO: 43037 - DNA, 22 bp, Artificial Sequence
  chemically synthesized
gccatcctttgcatagttagct

SEQ ID NO: 43038 - DNA, 22 bp, Artificial Sequence
  chemically synthesized
tgcatagttagctacaatggct

SEQ ID NO: 43039 - DNA, 22 bp, Artificial Sequence
  chemically synthesized
gcatagttagctacaatggcta

SEQ ID NO: 43040 - DNA, 22 bp, Artificial Sequence
  chemically synthesized
catagttagctacaatggctat

SEQ ID NO: 43041 - DNA, 22 bp, Artificial Sequence
  chemically synthesized
gctacaatggctatttattttt

SEQ ID NO: 43042 - DNA, 22 bp, Artificial Sequence
  chemically synthesized
caatggctatttatttttcagc

SEQ ID NO: 43043 - DNA, 22 bp, Artificial Sequence
  chemically synthesized
tttatttttcagccagactggc

SEQ ID NO: 43044 - DNA, 22 bp, Artificial Sequence
  chemically synthesized
atttttcagccagactggccat

SEQ ID NO: 43045 - DNA, 22 bp, Artificial Sequence
  chemically synthesized
tttttcagccagactggccatc

SEQ ID NO: 43046 - DNA, 22 bp, Artificial Sequence
  chemically synthesized
ttcagccagactggccatcatg

SEQ ID NO: 43047 - DNA, 22 bp, Artificial Sequence
  chemically synthesized
tcagccagactggccatcatgt

SEQ ID NO: 43048 - DNA, 22 bp, Artificial Sequence
  chemically synthesized
cagccagactggccatcatgta

SEQ ID NO: 43049 - DNA, 22 bp, Artificial Sequence
  chemically synthesized
agccagactggccatcatgtag

SEQ ID NO: 43050 - DNA, 22 bp, Artificial Sequence
  chemically synthesized
gccatcatgtaggcacactctt

SEQ ID NO: 43051 - DNA, 22 bp, Artificial Sequence
  chemically synthesized
ttttagattagaaaaatcaacc

SEQ ID NO: 43052 - DNA, 22 bp, Artificial Sequence
  chemically synthesized
ttagattagaaaaatcaaccat

SEQ ID NO: 43053 - DNA, 22 bp, Artificial Sequence
  chemically synthesized
tagattagaaaaatcaaccatt

SEQ ID NO: 43054 - DNA, 22 bp, Artificial Sequence
  chemically synthesized
agattagaaaaatcaaccatta

SEQ ID NO: 43055 - DNA, 22 bp, Artificial Sequence
  chemically synthesized
gattagaaaaatcaaccattat

SEQ ID NO: 43056 - DNA, 22 bp, Artificial Sequence
  chemically synthesized
gaaaaatcaaccattatttttt

SEQ ID NO: 43057 - DNA, 22 bp, Artificial Sequence
  chemically synthesized
ttttttctgcccattcattcca

SEQ ID NO: 43058 - DNA, 22 bp, Artificial Sequence
  chemically synthesized
tttctgcccattcattccagca

SEQ ID NO: 43059 - DNA, 22 bp, Artificial Sequence
  chemically synthesized
ttctgcccattcattccagcac

SEQ ID NO: 43060 - DNA, 22 bp, Artificial Sequence
  chemically synthesized
tctgcccattcattccagcacc

SEQ ID NO: 43061 - DNA, 22 bp, Artificial Sequence
  chemically synthesized
ctgcccattcattccagcaccg

SEQ ID NO: 43062 - DNA, 22 bp, Artificial Sequence
  chemically synthesized
tgcccattcattccagcaccgt

SEQ ID NO: 43063 - DNA, 22 bp, Artificial Sequence
  chemically synthesized
cccattcattccagcaccgtga

SEQ ID NO: 43064 - DNA, 22 bp, Artificial Sequence
  chemically synthesized
attccagcaccgtgacagtctt

SEQ ID NO: 43065 - DNA, 22 bp, Artificial Sequence
  chemically synthesized
cagcaccgtgacagtcttcacg

SEQ ID NO: 43066 - DNA, 22 bp, Artificial Sequence
  chemically synthesized
cacggggaaattaaacttattt

SEQ ID NO: 43067 - DNA, 22 bp, Artificial Sequence
  chemically synthesized
acggggaaattaaacttatttt

SEQ ID NO: 43068 - DNA, 22 bp, Artificial Sequence
  chemically synthesized
aacttatttttttaagaatttt

SEQ ID NO: 43069 - DNA, 22 bp, Artificial Sequence
  chemically synthesized
atttttttaagaatttttcaat

SEQ ID NO: 43070 - DNA, 22 bp, Artificial Sequence
  chemically synthesized
tttttttaagaatttttcaatc

SEQ ID NO: 43071 - DNA, 22 bp, Artificial Sequence
  chemically synthesized
ttttaagaatttttcaatcata

SEQ ID NO: 43072 - DNA, 22 bp, Artificial Sequence
  chemically synthesized
tttaagaatttttcaatcatat

SEQ ID NO: 43073 - DNA, 22 bp, Artificial Sequence
  chemically synthesized
ttaagaatttttcaatcatata

SEQ ID NO: 43074 - DNA, 22 bp, Artificial Sequence
  chemically synthesized
taagaatttttcaatcatatac

SEQ ID NO: 43075 - DNA, 22 bp, Artificial Sequence
  chemically synthesized
aagaatttttcaatcatataca

SEQ ID NO: 43076 - DNA, 22 bp, Artificial Sequence
  chemically synthesized
agaatttttcaatcatatacaa

SEQ ID NO: 43077 - DNA, 22 bp, Artificial Sequence
  chemically synthesized
ttcaatcatatacaagattttg

SEQ ID NO: 43078 - DNA, 22 bp, Artificial Sequence
  chemically synthesized
tcaatcatatacaagattttga

SEQ ID NO: 43079 - DNA, 22 bp, Artificial Sequence
  chemically synthesized
caatcatatacaagattttgaa

SEQ ID NO: 43080 - DNA, 22 bp, Artificial Sequence
  chemically synthesized
aatcatatacaagattttgaac

SEQ ID NO: 43081 - DNA, 22 bp, Artificial Sequence
  chemically synthesized
tgaactgggaatttcatgaatc

SEQ ID NO: 43082 - DNA, 22 bp, Artificial Sequence
  chemically synthesized
gaactgggaatttcatgaatca

SEQ ID NO: 43083 - DNA, 22 bp, Artificial Sequence
  chemically synthesized
aactgggaatttcatgaatcaa

SEQ ID NO: 43084 - DNA, 22 bp, Artificial Sequence
  chemically synthesized
ggaatttcatgaatcaaaaatt

SEQ ID NO: 43085 - DNA, 22 bp, Artificial Sequence
  chemically synthesized
catgaatcaaaaattaaatgaa

SEQ ID NO: 43086 - DNA, 22 bp, Artificial Sequence
  chemically synthesized
atgaatcaaaaattaaatgaat

SEQ ID NO: 43087 - DNA, 22 bp, Artificial Sequence
  chemically synthesized
aatgaattgcacataaagccat

SEQ ID NO: 43088 - DNA, 22 bp, Artificial Sequence
  chemically synthesized
cacataaagccatggcatatgt

SEQ ID NO: 43089 - DNA, 22 bp, Artificial Sequence
  chemically synthesized
ttactacattgtgggagaaaaa

SEQ ID NO: 43090 - DNA, 22 bp, Artificial Sequence
  chemically synthesized
tactacattgtgggagaaaaaa

SEQ ID NO: 43091 - DNA, 22 bp, Artificial Sequence
  chemically synthesized
actacattgtgggagaaaaaat

SEQ ID NO: 43092 - DNA, 22 bp, Artificial Sequence
  chemically synthesized
ctacattgtgggagaaaaaata

SEQ ID NO: 43093 - DNA, 22 bp, Artificial Sequence
  chemically synthesized
cattgtgggagaaaaaataatt

SEQ ID NO: 43094 - DNA, 22 bp, Artificial Sequence
  chemically synthesized
tgggagaaaaaataattcttat

SEQ ID NO: 43095 - DNA, 22 bp, Artificial Sequence
  chemically synthesized
ttataatttaaaaaaactatgt

SEQ ID NO: 43096 - DNA, 22 bp, Artificial Sequence
  chemically synthesized
ataatttaaaaaaactatgtct

SEQ ID NO: 43097 - DNA, 22 bp, Artificial Sequence
  chemically synthesized
taatttaaaaaaactatgtctt

SEQ ID NO: 43098 - DNA, 22 bp, Artificial Sequence
  chemically synthesized
aaaaaaactatgtcttacctga

SEQ ID NO: 43099 - DNA, 22 bp, Artificial Sequence
  chemically synthesized
aaaaaactatgtcttacctgat

SEQ ID NO: 43100 - DNA, 22 bp, Artificial Sequence
  chemically synthesized
tgtcttacctgatttcagaaat

SEQ ID NO: 43101 - DNA, 22 bp, Artificial Sequence
  chemically synthesized
acctgatttcagaaataaaaga

SEQ ID NO: 43102 - DNA, 22 bp, Artificial Sequence
  chemically synthesized
cctgatttcagaaataaaagaa

SEQ ID NO: 43103 - DNA, 22 bp, Artificial Sequence
  chemically synthesized
atttcagaaataaaagaagtag

SEQ ID NO: 43104 - DNA, 22 bp, Artificial Sequence
  chemically synthesized
cagaaataaaagaagtagaaga

SEQ ID NO: 43105 - DNA, 22 bp, Artificial Sequence
  chemically synthesized
agaaataaaagaagtagaagaa

SEQ ID NO: 43106 - DNA, 22 bp, Artificial Sequence
  chemically synthesized
ccttatgttccattttgggact

SEQ ID NO: 43107 - DNA, 22 bp, Artificial Sequence
  chemically synthesized
cttatgttccattttgggactg

SEQ ID NO: 43108 - DNA, 22 bp, Artificial Sequence
  chemically synthesized
atgttccattttgggactggcc

SEQ ID NO: 43109 - DNA, 22 bp, Artificial Sequence
  chemically synthesized
tgttccattttgggactggcca

SEQ ID NO: 43110 - DNA, 22 bp, Artificial Sequence
  chemically synthesized
cattttgggactggccagcagt

SEQ ID NO: 43111 - DNA, 22 bp, Artificial Sequence
  chemically synthesized
tgggactggccagcagtgccca

SEQ ID NO: 43112 - DNA, 22 bp, Artificial Sequence
  chemically synthesized
gggactggccagcagtgcccag

SEQ ID NO: 43113 - DNA, 22 bp, Artificial Sequence
  chemically synthesized
ggactggccagcagtgcccaga

SEQ ID NO: 43114 - DNA, 22 bp, Artificial Sequence
  chemically synthesized
gccagcagtgcccagaaagtgt

SEQ ID NO: 43115 - DNA, 22 bp, Artificial Sequence
  chemically synthesized
ttgacttacatgagagtaaacg

SEQ ID NO: 43116 - DNA, 22 bp, Artificial Sequence
  chemically synthesized
acttacatgagagtaaacgcac

SEQ ID NO: 43117 - DNA, 22 bp, Artificial Sequence
  chemically synthesized
acatgagagtaaacgcacccac

SEQ ID NO: 43118 - DNA, 22 bp, Artificial Sequence
  chemically synthesized
catgagagtaaacgcacccaca

SEQ ID NO: 43119 - DNA, 22 bp, Artificial Sequence
  chemically synthesized
agttaatgattctctcagagac

SEQ ID NO: 43120 - DNA, 22 bp, Artificial Sequence
  chemically synthesized
atgattctctcagagacccatg

SEQ ID NO: 43121 - DNA, 22 bp, Artificial Sequence
  chemically synthesized
tctcagagacccatgccactgg

SEQ ID NO: 43122 - DNA, 22 bp, Artificial Sequence
  chemically synthesized
tcagagacccatgccactggct

SEQ ID NO: 43123 - DNA, 22 bp, Artificial Sequence
  chemically synthesized
agagacccatgccactggctca

SEQ ID NO: 43124 - DNA, 22 bp, Artificial Sequence
  chemically synthesized
gctcagcagggttcaaacatta

SEQ ID NO: 43125 - DNA, 22 bp, Artificial Sequence
  chemically synthesized
agcagggttcaaacattacctt

SEQ ID NO: 43126 - DNA, 22 bp, Artificial Sequence
  chemically synthesized
aaacattaccttgaatatagag

SEQ ID NO: 43127 - DNA, 22 bp, Artificial Sequence
  chemically synthesized
ccttgaatatagagtcttataa

SEQ ID NO: 43128 - DNA, 22 bp, Artificial Sequence
  chemically synthesized
gaatatagagtcttataaaata

SEQ ID NO: 43129 - DNA, 22 bp, Artificial Sequence
  chemically synthesized
aatatagagtcttataaaatat

SEQ ID NO: 43130 - DNA, 22 bp, Artificial Sequence
  chemically synthesized
ataaaatatttgagagtgcaat

SEQ ID NO: 43131 - DNA, 22 bp, Artificial Sequence
  chemically synthesized
taaaatatttgagagtgcaatg

SEQ ID NO: 43132 - DNA, 22 bp, Artificial Sequence
  chemically synthesized
gagagtgcaatgtcaatagatg

SEQ ID NO: 43133 - DNA, 22 bp, Artificial Sequence
  chemically synthesized
agagtgcaatgtcaatagatgc

SEQ ID NO: 43134 - DNA, 22 bp, Artificial Sequence
  chemically synthesized
ggaagtggtgaaagccatttcc

SEQ ID NO: 43135 - DNA, 22 bp, Artificial Sequence
  chemically synthesized
cccccctcagctgctccacatt

SEQ ID NO: 43136 - DNA, 22 bp, Artificial Sequence
  chemically synthesized
ccccctcagctgctccacattg

SEQ ID NO: 43137 - DNA, 22 bp, Artificial Sequence
  chemically synthesized
agctgctccacattgcctttat

SEQ ID NO: 43138 - DNA, 22 bp, Artificial Sequence
  chemically synthesized
ctccacattgcctttatgtctc

SEQ ID NO: 43139 - DNA, 22 bp, Artificial Sequence
  chemically synthesized
cacattgcctttatgtctcctt

SEQ ID NO: 43140 - DNA, 22 bp, Artificial Sequence
  chemically synthesized
cctttatgtctccttactcctt

SEQ ID NO: 43141 - DNA, 22 bp, Artificial Sequence
  chemically synthesized
tatgtctccttactccttccct

SEQ ID NO: 43142 - DNA, 22 bp, Artificial Sequence
  chemically synthesized
atgtctccttactccttccctc

SEQ ID NO: 43143 - DNA, 22 bp, Artificial Sequence
  chemically synthesized
tgtctccttactccttccctca

SEQ ID NO: 43144 - DNA, 22 bp, Artificial Sequence
  chemically synthesized
cttactccttccctcaccccta

SEQ ID NO: 43145 - DNA, 22 bp, Artificial Sequence
  chemically synthesized
actccttccctcacccctagac

SEQ ID NO: 43146 - DNA, 22 bp, Artificial Sequence
  chemically synthesized
ctccttccctcacccctagacc

SEQ ID NO: 43147 - DNA, 22 bp, Artificial Sequence
  chemically synthesized
cttccctcacccctagaccttc

SEQ ID NO: 43148 - DNA, 22 bp, Artificial Sequence
  chemically synthesized
ccctcacccctagaccttcatc

SEQ ID NO: 43149 - DNA, 22 bp, Artificial Sequence
  chemically synthesized
cctcacccctagaccttcatct

SEQ ID NO: 43150 - DNA, 22 bp, Artificial Sequence
  chemically synthesized
acccctagaccttcatctttcc

SEQ ID NO: 43151 - DNA, 22 bp, Artificial Sequence
  chemically synthesized
gaccttcatctttcctgattag

SEQ ID NO: 43152 - DNA, 22 bp, Artificial Sequence
  chemically synthesized
catctttcctgattagtcttgt

SEQ ID NO: 43153 - DNA, 22 bp, Artificial Sequence
  chemically synthesized
atctttcctgattagtcttgtt

SEQ ID NO: 43154 - DNA, 22 bp, Artificial Sequence
  chemically synthesized
tcctgattagtcttgtttcctc

SEQ ID NO: 43155 - DNA, 22 bp, Artificial Sequence
  chemically synthesized
cctgattagtcttgtttcctcc

SEQ ID NO: 43156 - DNA, 22 bp, Artificial Sequence
  chemically synthesized
ctgattagtcttgtttcctccc

SEQ ID NO: 43157 - DNA, 22 bp, Artificial Sequence
  chemically synthesized
attagtcttgtttcctcccctc

SEQ ID NO: 43158 - DNA, 22 bp, Artificial Sequence
  chemically synthesized
gtcttgtttcctcccctcttct

SEQ ID NO: 43159 - DNA, 22 bp, Artificial Sequence
  chemically synthesized
gtttcctcccctcttctttcat

SEQ ID NO: 43160 - DNA, 22 bp, Artificial Sequence
  chemically synthesized
tttcctcccctcttctttcatt

SEQ ID NO: 43161 - DNA, 22 bp, Artificial Sequence
  chemically synthesized
cctcccctcttctttcattctc

SEQ ID NO: 43162 - DNA, 22 bp, Artificial Sequence
  chemically synthesized
ctcccctcttctttcattctct

SEQ ID NO: 43163 - DNA, 22 bp, Artificial Sequence
  chemically synthesized
ccctcttctttcattctctttc

SEQ ID NO: 43164 - DNA, 22 bp, Artificial Sequence
  chemically synthesized
ttctttcattctctttcttttg

SEQ ID NO: 43165 - DNA, 22 bp, Artificial Sequence
  chemically synthesized
ctttcattctctttcttttgga

SEQ ID NO: 43166 - DNA, 22 bp, Artificial Sequence
  chemically synthesized
tttcattctctttcttttggat

SEQ ID NO: 43167 - DNA, 22 bp, Artificial Sequence
  chemically synthesized
tcattctctttcttttggataa

SEQ ID NO: 43168 - DNA, 22 bp, Artificial Sequence
  chemically synthesized
cattctctttcttttggataaa

SEQ ID NO: 43169 - DNA, 22 bp, Artificial Sequence
  chemically synthesized
attctctttcttttggataaaa

SEQ ID NO: 43170 - DNA, 22 bp, Artificial Sequence
  chemically synthesized
tctttcttttggataaaataaa

SEQ ID NO: 43171 - DNA, 22 bp, Artificial Sequence
  chemically synthesized
tttcttttggataaaataaaat

SEQ ID NO: 43172 - DNA, 22 bp, Artificial Sequence
  chemically synthesized
tcttttggataaaataaaatca

SEQ ID NO: 43173 - DNA, 22 bp, Artificial Sequence
  chemically synthesized
cttttggataaaataaaatcat

SEQ ID NO: 43174 - DNA, 22 bp, Artificial Sequence
  chemically synthesized
ttttggataaaataaaatcata

SEQ ID NO: 43175 - DNA, 22 bp, Artificial Sequence
  chemically synthesized
ttggataaaataaaatcataaa

SEQ ID NO: 43176 - DNA, 22 bp, Artificial Sequence
  chemically synthesized
tggataaaataaaatcataaaa

SEQ ID NO: 43177 - DNA, 22 bp, Artificial Sequence
  chemically synthesized
ggataaaataaaatcataaaag

SEQ ID NO: 43178 - DNA, 22 bp, Artificial Sequence
  chemically synthesized
gataaaataaaatcataaaagt

SEQ ID NO: 43179 - DNA, 22 bp, Artificial Sequence
  chemically synthesized
atatttgctggtaacttccatg

SEQ ID NO: 43180 - DNA, 22 bp, Artificial Sequence
  chemically synthesized
gctggtaacttccatgaccaga

SEQ ID NO: 43181 - DNA, 22 bp, Artificial Sequence
  chemically synthesized
ctggtaacttccatgaccagac

SEQ ID NO: 43182 - DNA, 22 bp, Artificial Sequence
  chemically synthesized
gtaacttccatgaccagaccct

SEQ ID NO: 43183 - DNA, 22 bp, Artificial Sequence
  chemically synthesized
ccatgaccagaccctctgccaa

SEQ ID NO: 43184 - DNA, 22 bp, Artificial Sequence
  chemically synthesized
catgaccagaccctctgccaag

SEQ ID NO: 43185 - DNA, 22 bp, Artificial Sequence
  chemically synthesized
tgccaagtgctgcacatccata

SEQ ID NO: 43186 - DNA, 22 bp, Artificial Sequence
  chemically synthesized
ccaagtgctgcacatccatagc

SEQ ID NO: 43187 - DNA, 22 bp, Artificial Sequence
  chemically synthesized
cacatccatagcctccctcaag

SEQ ID NO: 43188 - DNA, 22 bp, Artificial Sequence
  chemically synthesized
cctcaagctttccaacaggcag

SEQ ID NO: 43189 - DNA, 22 bp, Artificial Sequence
  chemically synthesized
aagctttccaacaggcagtgct

SEQ ID NO: 43190 - DNA, 22 bp, Artificial Sequence
  chemically synthesized
tccaacaggcagtgctgtacga

SEQ ID NO: 43191 - DNA, 22 bp, Artificial Sequence
  chemically synthesized
ccaacaggcagtgctgtacgag

SEQ ID NO: 43192 - DNA, 22 bp, Artificial Sequence
  chemically synthesized
caacaggcagtgctgtacgagg

SEQ ID NO: 43193 - DNA, 22 bp, Artificial Sequence
  chemically synthesized
tacgaggagggggctgaggcct

SEQ ID NO: 43194 - DNA, 22 bp, Artificial Sequence
  chemically synthesized
aggccttcccgaggttgtgtcg

SEQ ID NO: 43195 - DNA, 22 bp, Artificial Sequence
  chemically synthesized
cccgaggttgtgtcgctaccca

SEQ ID NO: 43196 - DNA, 22 bp, Artificial Sequence
  chemically synthesized
ccgaggttgtgtcgctacccag

SEQ ID NO: 43197 - DNA, 22 bp, Artificial Sequence
  chemically synthesized
tgtcgctacccaggggtgcagc

SEQ ID NO: 43198 - DNA, 22 bp, Artificial Sequence
  chemically synthesized
cccaggggtgcagctgatagac

SEQ ID NO: 43199 - DNA, 22 bp, Artificial Sequence
  chemically synthesized
atagacacaaccctttcaggtc

SEQ ID NO: 43200 - DNA, 22 bp, Artificial Sequence
  chemically synthesized
tcaggtcttagtttacgagcaa

SEQ ID NO: 43201 - DNA, 22 bp, Artificial Sequence
  chemically synthesized
caggtcttagtttacgagcaag

SEQ ID NO: 43202 - DNA, 22 bp, Artificial Sequence
  chemically synthesized
aggtcttagtttacgagcaagc

SEQ ID NO: 43203 - DNA, 22 bp, Artificial Sequence
  chemically synthesized
agtttacgagcaagctaggtat

SEQ ID NO: 43204 - DNA, 22 bp, Artificial Sequence
  chemically synthesized
gtttacgagcaagctaggtata

SEQ ID NO: 43205 - DNA, 22 bp, Artificial Sequence
  chemically synthesized
acgagcaagctaggtataaatg

SEQ ID NO: 43206 - DNA, 22 bp, Artificial Sequence
  chemically synthesized
cgagcaagctaggtataaatgt

SEQ ID NO: 43207 - DNA, 22 bp, Artificial Sequence
  chemically synthesized
ggtataaatgttaacatctcca

SEQ ID NO: 43208 - DNA, 22 bp, Artificial Sequence
  chemically synthesized
acatctccacatcctataccaa

SEQ ID NO: 43209 - DNA, 22 bp, Artificial Sequence
  chemically synthesized
cacatcctataccaaactgtgc

SEQ ID NO: 43210 - DNA, 22 bp, Artificial Sequence
  chemically synthesized
taccaaactgtgccgaaatgac

SEQ ID NO: 43211 - DNA, 22 bp, Artificial Sequence
  chemically synthesized
tgccgaaatgacaacataagtg

SEQ ID NO: 43212 - DNA, 22 bp, Artificial Sequence
  chemically synthesized
ttattatcttcaaaatttattt

SEQ ID NO: 43213 - DNA, 22 bp, Artificial Sequence
  chemically synthesized
tattatcttcaaaatttattta

SEQ ID NO: 43214 - DNA, 22 bp, Artificial Sequence
  chemically synthesized
attatcttcaaaatttatttat

SEQ ID NO: 43215 - DNA, 22 bp, Artificial Sequence
  chemically synthesized
ttatcttcaaaatttatttatt

SEQ ID NO: 43216 - DNA, 22 bp, Artificial Sequence
  chemically synthesized
tcttcaaaatttatttattcct

SEQ ID NO: 43217 - DNA, 22 bp, Artificial Sequence
  chemically synthesized
caaaatttatttattcctagtg

SEQ ID NO: 43218 - DNA, 22 bp, Artificial Sequence
  chemically synthesized
aaaatttatttattcctagtga

SEQ ID NO: 43219 - DNA, 22 bp, Artificial Sequence
  chemically synthesized
atttattcctagtgaactcaca

SEQ ID NO: 43220 - DNA, 22 bp, Artificial Sequence
  chemically synthesized
tttattcctagtgaactcacat

SEQ ID NO: 43221 - DNA, 22 bp, Artificial Sequence
  chemically synthesized
attcctagtgaactcacatgtt

SEQ ID NO: 43222 - DNA, 22 bp, Artificial Sequence
  chemically synthesized
ttcctagtgaactcacatgttt

SEQ ID NO: 43223 - DNA, 22 bp, Artificial Sequence
  chemically synthesized
ctagtgaactcacatgttttct

SEQ ID NO: 43224 - DNA, 22 bp, Artificial Sequence
  chemically synthesized
gtgaactcacatgttttctgta

SEQ ID NO: 43225 - DNA, 22 bp, Artificial Sequence
  chemically synthesized
acatgttttctgtaattataaa

SEQ ID NO: 43226 - DNA, 22 bp, Artificial Sequence
  chemically synthesized
tctgtaattataaattatgtta

SEQ ID NO: 43227 - DNA, 22 bp, Artificial Sequence
  chemically synthesized
ctgtaattataaattatgttat

SEQ ID NO: 43228 - DNA, 22 bp, Artificial Sequence
  chemically synthesized
tgtaattataaattatgttata

SEQ ID NO: 43229 - DNA, 22 bp, Artificial Sequence
  chemically synthesized
taattataaattatgttataag

SEQ ID NO: 43230 - DNA, 22 bp, Artificial Sequence
  chemically synthesized
taaattatgttataagatatca

SEQ ID NO: 43231 - DNA, 22 bp, Artificial Sequence
  chemically synthesized
tgttataagatatcaatccttc

SEQ ID NO: 43232 - DNA, 22 bp, Artificial Sequence
  chemically synthesized
taagatatcaatccttccagga

SEQ ID NO: 43233 - DNA, 22 bp, Artificial Sequence
  chemically synthesized
ccaggagggggtggtggctcat

SEQ ID NO: 43234 - DNA, 22 bp, Artificial Sequence
  chemically synthesized
caggagggggtggtggctcatg

SEQ ID NO: 43235 - DNA, 22 bp, Artificial Sequence
  chemically synthesized
atgcctataatcccagcatttt

SEQ ID NO: 43236 - DNA, 22 bp, Artificial Sequence
  chemically synthesized
taatcccagcattttgggaggc

SEQ ID NO: 43237 - DNA, 22 bp, Artificial Sequence
  chemically synthesized
tgggaggccacggcagatggat

SEQ ID NO: 43238 - DNA, 22 bp, Artificial Sequence
  chemically synthesized
gggaggccacggcagatggatc

SEQ ID NO: 43239 - DNA, 22 bp, Artificial Sequence
  chemically synthesized
ggaggccacggcagatggatca

SEQ ID NO: 43240 - DNA, 22 bp, Artificial Sequence
  chemically synthesized
aggccaggagtttgagacaagc

SEQ ID NO: 43241 - DNA, 22 bp, Artificial Sequence
  chemically synthesized
gagacaagcctgggcaacatgc

SEQ ID NO: 43242 - DNA, 22 bp, Artificial Sequence
  chemically synthesized
agacaagcctgggcaacatgcc

SEQ ID NO: 43243 - DNA, 22 bp, Artificial Sequence
  chemically synthesized
ggcaacatgccaaaaccctgtc

SEQ ID NO: 43244 - DNA, 22 bp, Artificial Sequence
  chemically synthesized
tctctacaaaaaatacaaaaat

SEQ ID NO: 43245 - DNA, 22 bp, Artificial Sequence
  chemically synthesized
tacaaaaaatacaaaaattagc

SEQ ID NO: 43246 - DNA, 22 bp, Artificial Sequence
  chemically synthesized
caaaaaatacaaaaattagctg

SEQ ID NO: 43247 - DNA, 22 bp, Artificial Sequence
  chemically synthesized
gctgggtgtggaggcacatgcc

SEQ ID NO: 43248 - DNA, 22 bp, Artificial Sequence
  chemically synthesized
ggtgtggaggcacatgccagtc

SEQ ID NO: 43249 - DNA, 22 bp, Artificial Sequence
  chemically synthesized
ctaagtaggctgaggcactaga

SEQ ID NO: 43250 - DNA, 22 bp, Artificial Sequence
  chemically synthesized
agtaggctgaggcactagaatt

SEQ ID NO: 43251 - DNA, 22 bp, Artificial Sequence
  chemically synthesized
aggcactagaattgcttgaaca

SEQ ID NO: 43252 - DNA, 22 bp, Artificial Sequence
  chemically synthesized
gaattgcttgaacacaggagat

SEQ ID NO: 43253 - DNA, 22 bp, Artificial Sequence
  chemically synthesized
cttgaacacaggagatggaggt

SEQ ID NO: 43254 - DNA, 22 bp, Artificial Sequence
  chemically synthesized
gaacacaggagatggaggttgc

SEQ ID NO: 43255 - DNA, 22 bp, Artificial Sequence
  chemically synthesized
aacacaggagatggaggttgca

SEQ ID NO: 43256 - DNA, 22 bp, Artificial Sequence
  chemically synthesized
cagtgagccaagaatgtgccac

SEQ ID NO: 43257 - DNA, 22 bp, Artificial Sequence
  chemically synthesized
cactccagcctgggtgacagag

SEQ ID NO: 43258 - DNA, 22 bp, Artificial Sequence
  chemically synthesized
cagcctgggtgacagagcaaga

SEQ ID NO: 43259 - DNA, 22 bp, Artificial Sequence
  chemically synthesized
ggtgacagagcaagaatgtctc

SEQ ID NO: 43260 - DNA, 22 bp, Artificial Sequence
  chemically synthesized
aggaaagaaaaaaaaataataa

SEQ ID NO: 43261 - DNA, 22 bp, Artificial Sequence
  chemically synthesized
ataaaatatcaatccttcctat

SEQ ID NO: 43262 - DNA, 22 bp, Artificial Sequence
  chemically synthesized
cctattctagtagttgtggctt

SEQ ID NO: 43263 - DNA, 22 bp, Artificial Sequence
  chemically synthesized
ctattctagtagttgtggctta

SEQ ID NO: 43264 - DNA, 22 bp, Artificial Sequence
  chemically synthesized
ttctagtagttgtggcttaaat

SEQ ID NO: 43265 - DNA, 22 bp, Artificial Sequence
  chemically synthesized
tagtagttgtggcttaaataaa

SEQ ID NO: 43266 - DNA, 22 bp, Artificial Sequence
  chemically synthesized
gtagttgtggcttaaataaata

SEQ ID NO: 43267 - DNA, 22 bp, Artificial Sequence
  chemically synthesized
tggcttaaataaataaataaat

SEQ ID NO: 43268 - DNA, 22 bp, Artificial Sequence
  chemically synthesized
aaataaataaataaatattttt

SEQ ID NO: 43269 - DNA, 22 bp, Artificial Sequence
  chemically synthesized
aataaataaataaatattttta

SEQ ID NO: 43270 - DNA, 22 bp, Artificial Sequence
  chemically synthesized
ttaaaaataaaacatagggtcg

SEQ ID NO: 43271 - DNA, 22 bp, Artificial Sequence
  chemically synthesized
taaaaataaaacatagggtcga

SEQ ID NO: 43272 - DNA, 22 bp, Artificial Sequence
  chemically synthesized
aaaaataaaacatagggtcgag

SEQ ID NO: 43273 - DNA, 22 bp, Artificial Sequence
  chemically synthesized
aaaataaaacatagggtcgagt

SEQ ID NO: 43274 - DNA, 22 bp, Artificial Sequence
  chemically synthesized
aactctgtaatcccagcacttt

SEQ ID NO: 43275 - DNA, 22 bp, Artificial Sequence
  chemically synthesized
tgtaatcccagcactttgggag

SEQ ID NO: 43276 - DNA, 22 bp, Artificial Sequence
  chemically synthesized
taatcccagcactttgggaggc

SEQ ID NO: 43277 - DNA, 22 bp, Artificial Sequence
  chemically synthesized
tgggaggccaagacaggtggat

SEQ ID NO: 43278 - DNA, 22 bp, Artificial Sequence
  chemically synthesized
gggaggccaagacaggtggatc

SEQ ID NO: 43279 - DNA, 22 bp, Artificial Sequence
  chemically synthesized
ggaggccaagacaggtggatca

SEQ ID NO: 43280 - DNA, 22 bp, Artificial Sequence
  chemically synthesized
gagaccagccaggccaatgtgg

SEQ ID NO: 43281 - DNA, 22 bp, Artificial Sequence
  chemically synthesized
agaccagccaggccaatgtggt

SEQ ID NO: 43282 - DNA, 22 bp, Artificial Sequence
  chemically synthesized
tactaaaaatacaaaaattagc

SEQ ID NO: 43283 - DNA, 22 bp, Artificial Sequence
  chemically synthesized
ctaaaaatacaaaaattagcca

SEQ ID NO: 43284 - DNA, 22 bp, Artificial Sequence
  chemically synthesized
aaaatacaaaaattagccaggc

SEQ ID NO: 43285 - DNA, 22 bp, Artificial Sequence
  chemically synthesized
gccaggcgtggtggtgggcacc

SEQ ID NO: 43286 - DNA, 22 bp, Artificial Sequence
  chemically synthesized
taatcccagctactagggaggc

SEQ ID NO: 43287 - DNA, 22 bp, Artificial Sequence
  chemically synthesized
ctagggaggctggagtattcac

SEQ ID NO: 43288 - DNA, 22 bp, Artificial Sequence
  chemically synthesized
gggaggctggagtattcacttg

SEQ ID NO: 43289 - DNA, 22 bp, Artificial Sequence
  chemically synthesized
gagtattcacttgaacccagga

SEQ ID NO: 43290 - DNA, 22 bp, Artificial Sequence
  chemically synthesized
acttgaacccaggaggtggaag

SEQ ID NO: 43291 - DNA, 22 bp, Artificial Sequence
  chemically synthesized
gaacccaggaggtggaagttgc

SEQ ID NO: 43292 - DNA, 22 bp, Artificial Sequence
  chemically synthesized
aacccaggaggtggaagttgca

SEQ ID NO: 43293 - DNA, 22 bp, Artificial Sequence
  chemically synthesized
cagtgagccaaaatcacgtcag

SEQ ID NO: 43294 - DNA, 22 bp, Artificial Sequence
  chemically synthesized
caaccggggtgagagtctcaat

SEQ ID NO: 43295 - DNA, 22 bp, Artificial Sequence
  chemically synthesized
aaccggggtgagagtctcaata

SEQ ID NO: 43296 - DNA, 22 bp, Artificial Sequence
  chemically synthesized
aataaaataaaataaaataaaa

SEQ ID NO: 43297 - DNA, 22 bp, Artificial Sequence
  chemically synthesized
tccgcaaatgaattcatggtgc

SEQ ID NO: 43298 - DNA, 22 bp, Artificial Sequence
  chemically synthesized
ccgcaaatgaattcatggtgca

SEQ ID NO: 43299 - DNA, 22 bp, Artificial Sequence
  chemically synthesized
cgcaaatgaattcatggtgcaa

SEQ ID NO: 43300 - DNA, 22 bp, Artificial Sequence
  chemically synthesized
atggtgcaatcttacattttcg

SEQ ID NO: 43301 - DNA, 22 bp, Artificial Sequence
  chemically synthesized
acattttcgttctcatgaagta

SEQ ID NO: 43302 - DNA, 22 bp, Artificial Sequence
  chemically synthesized
cattttcgttctcatgaagtaa

SEQ ID NO: 43303 - DNA, 22 bp, Artificial Sequence
  chemically synthesized
tcgttctcatgaagtaaagcaa

SEQ ID NO: 43304 - DNA, 22 bp, Artificial Sequence
  chemically synthesized
cgttctcatgaagtaaagcaag

SEQ ID NO: 43305 - DNA, 22 bp, Artificial Sequence
  chemically synthesized
gttctcatgaagtaaagcaaga

SEQ ID NO: 43306 - DNA, 22 bp, Artificial Sequence
  chemically synthesized
tcatgaagtaaagcaagagtgg

SEQ ID NO: 43307 - DNA, 22 bp, Artificial Sequence
  chemically synthesized
atgaagtaaagcaagagtggta

SEQ ID NO: 43308 - DNA, 22 bp, Artificial Sequence
  chemically synthesized
agtggaaagagtctatctctag

SEQ ID NO: 43309 - DNA, 22 bp, Artificial Sequence
  chemically synthesized
tctctagtgtagtcacgtcagt

SEQ ID NO: 43310 - DNA, 22 bp, Artificial Sequence
  chemically synthesized
tagtgtagtcacgtcagtggtt

SEQ ID NO: 43311 - DNA, 22 bp, Artificial Sequence
  chemically synthesized
gtgtagtcacgtcagtggttgt

SEQ ID NO: 43312 - DNA, 22 bp, Artificial Sequence
  chemically synthesized
tgtcaagatggttaggaggctc

SEQ ID NO: 43313 - DNA, 22 bp, Artificial Sequence
  chemically synthesized
ggaggctcctcccgtttaaaac

SEQ ID NO: 43314 - DNA, 22 bp, Artificial Sequence
  chemically synthesized
ctcccgtttaaaacagtatcca

SEQ ID NO: 43315 - DNA, 22 bp, Artificial Sequence
  chemically synthesized
ccgtttaaaacagtatccaagc

SEQ ID NO: 43316 - DNA, 22 bp, Artificial Sequence
  chemically synthesized
aaaacagtatccaagccccagt

SEQ ID NO: 43317 - DNA, 22 bp, Artificial Sequence
  chemically synthesized
aaacagtatccaagccccagtt

SEQ ID NO: 43318 - DNA, 22 bp, Artificial Sequence
  chemically synthesized
taaatcaattggggagacacgc

SEQ ID NO: 43319 - DNA, 22 bp, Artificial Sequence
  chemically synthesized
gggagacacgccaactctgatc

SEQ ID NO: 43320 - DNA, 22 bp, Artificial Sequence
  chemically synthesized
tgatcatcagcaatatctgagc

SEQ ID NO: 43321 - DNA, 22 bp, Artificial Sequence
  chemically synthesized
atcatcagcaatatctgagctc

SEQ ID NO: 43322 - DNA, 22 bp, Artificial Sequence
  chemically synthesized
agctccagtctcagatattgtg

SEQ ID NO: 43323 - DNA, 22 bp, Artificial Sequence
  chemically synthesized
cagtctcagatattgtgtgcag

SEQ ID NO: 43324 - DNA, 22 bp, Artificial Sequence
  chemically synthesized
agatattgtgtgcagttagtct

SEQ ID NO: 43325 - DNA, 22 bp, Artificial Sequence
  chemically synthesized
tgtgcagttagtctctgtcctg

SEQ ID NO: 43326 - DNA, 22 bp, Artificial Sequence
  chemically synthesized
gtctctgtcctgtaccctctac

SEQ ID NO: 43327 - DNA, 22 bp, Artificial Sequence
  chemically synthesized
tgtcctgtaccctctacctcct

SEQ ID NO: 43328 - DNA, 22 bp, Artificial Sequence
  chemically synthesized
tcctgtaccctctacctccttc

SEQ ID NO: 43329 - DNA, 22 bp, Artificial Sequence
  chemically synthesized
taccctctacctccttccctac

SEQ ID NO: 43330 - DNA, 22 bp, Artificial Sequence
  chemically synthesized
tacctccttccctaccagaaaa

SEQ ID NO: 43331 - DNA, 22 bp, Artificial Sequence
  chemically synthesized
cctccttccctaccagaaaaat

SEQ ID NO: 43332 - DNA, 22 bp, Artificial Sequence
  chemically synthesized
cttccctaccagaaaaatcacc

SEQ ID NO: 43333 - DNA, 22 bp, Artificial Sequence
  chemically synthesized
ccctaccagaaaaatcaccact

SEQ ID NO: 43334 - DNA, 22 bp, Artificial Sequence
  chemically synthesized
cctaccagaaaaatcaccactt

SEQ ID NO: 43335 - DNA, 22 bp, Artificial Sequence
  chemically synthesized
ccagaaaaatcaccactttagt

SEQ ID NO: 43336 - DNA, 22 bp, Artificial Sequence
  chemically synthesized
tagtccctggccaccgggacac

SEQ ID NO: 43337 - DNA, 22 bp, Artificial Sequence
  chemically synthesized
agtccctggccaccgggacacc

SEQ ID NO: 43338 - DNA, 22 bp, Artificial Sequence
  chemically synthesized
gtccctggccaccgggacaccc

SEQ ID NO: 43339 - DNA, 22 bp, Artificial Sequence
  chemically synthesized
gccaccgggacaccccaggagg

SEQ ID NO: 43340 - DNA, 22 bp, Artificial Sequence
  chemically synthesized
aggtagttatggcacttatggc

SEQ ID NO: 43341 - DNA, 22 bp, Artificial Sequence
  chemically synthesized
tggcacttatggctcccttgct

SEQ ID NO: 43342 - DNA, 22 bp, Artificial Sequence
  chemically synthesized
atggctcccttgctgctgatct

SEQ ID NO: 43343 - DNA, 22 bp, Artificial Sequence
  chemically synthesized
tggctcccttgctgctgatctg

SEQ ID NO: 43344 - DNA, 22 bp, Artificial Sequence
  chemically synthesized
ccttgctgctgatctggaactc

SEQ ID NO: 43345 - DNA, 22 bp, Artificial Sequence
  chemically synthesized
gctgctgatctggaactcaagc

SEQ ID NO: 43346 - DNA, 22 bp, Artificial Sequence
  chemically synthesized
ctgctgatctggaactcaagcc

SEQ ID NO: 43347 - DNA, 22 bp, Artificial Sequence
  chemically synthesized
ctgatctggaactcaagcccca

SEQ ID NO: 43348 - DNA, 22 bp, Artificial Sequence
  chemically synthesized
atctggaactcaagccccaaga

SEQ ID NO: 43349 - DNA, 22 bp, Artificial Sequence
  chemically synthesized
gaactcaagccccaagaagtcc

SEQ ID NO: 43350 - DNA, 22 bp, Artificial Sequence
  chemically synthesized
aagccccaagaagtccccttgg

SEQ ID NO: 43351 - DNA, 22 bp, Artificial Sequence
  chemically synthesized
ggatgatctgaatatacatttg

SEQ ID NO: 43352 - DNA, 22 bp, Artificial Sequence
  chemically synthesized
gatgatctgaatatacatttgg

SEQ ID NO: 43353 - DNA, 22 bp, Artificial Sequence
  chemically synthesized
aatatacatttgggacagatct

SEQ ID NO: 43354 - DNA, 22 bp, Artificial Sequence
  chemically synthesized
gggacagatctagggagtttct

SEQ ID NO: 43355 - DNA, 22 bp, Artificial Sequence
  chemically synthesized
ggacagatctagggagtttctg

SEQ ID NO: 43356 - DNA, 22 bp, Artificial Sequence
  chemically synthesized
gggagtttctgagcaacactta

SEQ ID NO: 43357 - DNA, 22 bp, Artificial Sequence
  chemically synthesized
ctgagcaacacttagactgggg

SEQ ID NO: 43358 - DNA, 22 bp, Artificial Sequence
  chemically synthesized
tgagcaacacttagactggggt

SEQ ID NO: 43359 - DNA, 22 bp, Artificial Sequence
  chemically synthesized
agcaacacttagactggggtct

SEQ ID NO: 43360 - DNA, 22 bp, Artificial Sequence
  chemically synthesized
agactggggtcttccattgatt

SEQ ID NO: 43361 - DNA, 22 bp, Artificial Sequence
  chemically synthesized
gactggggtcttccattgatta

SEQ ID NO: 43362 - DNA, 22 bp, Artificial Sequence
  chemically synthesized
gggtcttccattgattaaatcc

SEQ ID NO: 43363 - DNA, 22 bp, Artificial Sequence
  chemically synthesized
ccattgattaaatcctacttga

SEQ ID NO: 43364 - DNA, 22 bp, Artificial Sequence
  chemically synthesized
cattgattaaatcctacttgaa

SEQ ID NO: 43365 - DNA, 22 bp, Artificial Sequence
  chemically synthesized
attaaatcctacttgaattcgc

SEQ ID NO: 43366 - DNA, 22 bp, Artificial Sequence
  chemically synthesized
aatcctacttgaattcgctact

SEQ ID NO: 43367 - DNA, 22 bp, Artificial Sequence
  chemically synthesized
cttgaattcgctactttgggac

SEQ ID NO: 43368 - DNA, 22 bp, Artificial Sequence
  chemically synthesized
gaattcgctactttgggactca

SEQ ID NO: 43369 - DNA, 22 bp, Artificial Sequence
  chemically synthesized
aattcgctactttgggactcaa

SEQ ID NO: 43370 - DNA, 22 bp, Artificial Sequence
  chemically synthesized
gctactttgggactcaagtcta

SEQ ID NO: 43371 - DNA, 22 bp, Artificial Sequence
  chemically synthesized
ctttgggactcaagtctaaggg

SEQ ID NO: 43372 - DNA, 22 bp, Artificial Sequence
  chemically synthesized
tgggactcaagtctaagggact

SEQ ID NO: 43373 - DNA, 22 bp, Artificial Sequence
  chemically synthesized
gggactcaagtctaagggactg

SEQ ID NO: 43374 - DNA, 22 bp, Artificial Sequence
  chemically synthesized
ggactcaagtctaagggactga

SEQ ID NO: 43375 - DNA, 22 bp, Artificial Sequence
  chemically synthesized
aagtctaagggactgagactga

SEQ ID NO: 43376 - DNA, 22 bp, Artificial Sequence
  chemically synthesized
agggactgagactgagacagga

SEQ ID NO: 43377 - DNA, 22 bp, Artificial Sequence
  chemically synthesized
agactgagacaggagagcacaa

SEQ ID NO: 43378 - DNA, 22 bp, Artificial Sequence
  chemically synthesized
agacaggagagcacaagactaa

SEQ ID NO: 43379 - DNA, 22 bp, Artificial Sequence
  chemically synthesized
actttggtctcttgatcttttc

SEQ ID NO: 43380 - DNA, 22 bp, Artificial Sequence
  chemically synthesized
tggtctcttgatcttttcttac

SEQ ID NO: 43381 - DNA, 22 bp, Artificial Sequence
  chemically synthesized
ggtctcttgatcttttcttacc

SEQ ID NO: 43382 - DNA, 22 bp, Artificial Sequence
  chemically synthesized
gtctcttgatcttttcttacct

SEQ ID NO: 43383 - DNA, 22 bp, Artificial Sequence
  chemically synthesized
ttgatcttttcttaccttgcaa

SEQ ID NO: 43384 - DNA, 22 bp, Artificial Sequence
  chemically synthesized
gatcttttcttaccttgcaact

SEQ ID NO: 43385 - DNA, 22 bp, Artificial Sequence
  chemically synthesized
atcttttcttaccttgcaactg

SEQ ID NO: 43386 - DNA, 22 bp, Artificial Sequence
  chemically synthesized
ttcttaccttgcaactgtcaat

SEQ ID NO: 43387 - DNA, 22 bp, Artificial Sequence
  chemically synthesized
tcttaccttgcaactgtcaatg

SEQ ID NO: 43388 - DNA, 22 bp, Artificial Sequence
  chemically synthesized
cttaccttgcaactgtcaatgc

SEQ ID NO: 43389 - DNA, 22 bp, Artificial Sequence
  chemically synthesized
ttaccttgcaactgtcaatgcc

SEQ ID NO: 43390 - DNA, 22 bp, Artificial Sequence
  chemically synthesized
accttgcaactgtcaatgcctc

SEQ ID NO: 43391 - DNA, 22 bp, Artificial Sequence
  chemically synthesized
ccttgcaactgtcaatgcctcc

SEQ ID NO: 43392 - DNA, 22 bp, Artificial Sequence
  chemically synthesized
gcaactgtcaatgcctccagcc

SEQ ID NO: 43393 - DNA, 22 bp, Artificial Sequence
  chemically synthesized
caactgtcaatgcctccagcca

SEQ ID NO: 43394 - DNA, 22 bp, Artificial Sequence
  chemically synthesized
tcaatgcctccagccaaatgcc

SEQ ID NO: 43395 - DNA, 22 bp, Artificial Sequence
  chemically synthesized
cagccaaatgcccagcacagag

SEQ ID NO: 43396 - DNA, 22 bp, Artificial Sequence
  chemically synthesized
agtggatttgactcttccattc

SEQ ID NO: 43397 - DNA, 22 bp, Artificial Sequence
  chemically synthesized
gactcttccattcagaaactca

SEQ ID NO: 43398 - DNA, 22 bp, Artificial Sequence
  chemically synthesized
actcttccattcagaaactcat

SEQ ID NO: 43399 - DNA, 22 bp, Artificial Sequence
  chemically synthesized
ttccattcagaaactcatagcg

SEQ ID NO: 43400 - DNA, 22 bp, Artificial Sequence
  chemically synthesized
ccattcagaaactcatagcgat

SEQ ID NO: 43401 - DNA, 22 bp, Artificial Sequence
  chemically synthesized
cattcagaaactcatagcgatt

SEQ ID NO: 43402 - DNA, 22 bp, Artificial Sequence
  chemically synthesized
agaaactcatagcgattgcaca

SEQ ID NO: 43403 - DNA, 22 bp, Artificial Sequence
  chemically synthesized
atagcgattgcacacttcattc

SEQ ID NO: 43404 - DNA, 22 bp, Artificial Sequence
  chemically synthesized
cacacttcattctcaatcacag

SEQ ID NO: 43405 - DNA, 22 bp, Artificial Sequence
  chemically synthesized
cattctcaatcacagggagctg

SEQ ID NO: 43406 - DNA, 22 bp, Artificial Sequence
  chemically synthesized
attctcaatcacagggagctgg

SEQ ID NO: 43407 - DNA, 22 bp, Artificial Sequence
  chemically synthesized
tcaatcacagggagctgggctt

SEQ ID NO: 43408 - DNA, 22 bp, Artificial Sequence
  chemically synthesized
aatcacagggagctgggcttcc

SEQ ID NO: 43409 - DNA, 22 bp, Artificial Sequence
  chemically synthesized
ggcttccttgagaaagccagcc

SEQ ID NO: 43410 - DNA, 22 bp, Artificial Sequence
  chemically synthesized
ccttgagaaagccagccccaaa

SEQ ID NO: 43411 - DNA, 22 bp, Artificial Sequence
  chemically synthesized
cttgagaaagccagccccaaag

SEQ ID NO: 43412 - DNA, 22 bp, Artificial Sequence
  chemically synthesized
gagaaagccagccccaaaggta

SEQ ID NO: 43413 - DNA, 22 bp, Artificial Sequence
  chemically synthesized
agaaagccagccccaaaggtac

SEQ ID NO: 43414 - DNA, 22 bp, Artificial Sequence
  chemically synthesized
tgtttaaaaagatgaaagaaat

SEQ ID NO: 43415 - DNA, 22 bp, Artificial Sequence
  chemically synthesized
aaaaagatgaaagaaatggtaa

SEQ ID NO: 43416 - DNA, 22 bp, Artificial Sequence
  chemically synthesized
aaaagatgaaagaaatggtaac

SEQ ID NO: 43417 - DNA, 22 bp, Artificial Sequence
  chemically synthesized
cgtccacaacatgttcacaagg

SEQ ID NO: 43418 - DNA, 22 bp, Artificial Sequence
  chemically synthesized
acaaggaaactccagaagaaca

SEQ ID NO: 43419 - DNA, 22 bp, Artificial Sequence
  chemically synthesized
cagaagaacagagcagtggtga

SEQ ID NO: 43420 - DNA, 22 bp, Artificial Sequence
  chemically synthesized
ctgtctgtccgtgaggctgtag

SEQ ID NO: 43421 - DNA, 22 bp, Artificial Sequence
  chemically synthesized
tctgtccgtgaggctgtagaac

SEQ ID NO: 43422 - DNA, 22 bp, Artificial Sequence
  chemically synthesized
tccgtgaggctgtagaacacaa

SEQ ID NO: 43423 - DNA, 22 bp, Artificial Sequence
  chemically synthesized
tagaacacaaggcagctcccaa

SEQ ID NO: 43424 - DNA, 22 bp, Artificial Sequence
  chemically synthesized
ccaatgctgccagactctctga

SEQ ID NO: 43425 - DNA, 22 bp, Artificial Sequence
  chemically synthesized
ccagactctctgaaccctggag

SEQ ID NO: 43426 - DNA, 22 bp, Artificial Sequence
  chemically synthesized
tctgaaccctggagagtgtaaa

SEQ ID NO: 43427 - DNA, 22 bp, Artificial Sequence
  chemically synthesized
tgaaccctggagagtgtaaacg

SEQ ID NO: 43428 - DNA, 22 bp, Artificial Sequence
  chemically synthesized
aaccctggagagtgtaaacgtc

SEQ ID NO: 43429 - DNA, 22 bp, Artificial Sequence
  chemically synthesized
gagagtgtaaacgtcatataag

SEQ ID NO: 43430 - DNA, 22 bp, Artificial Sequence
  chemically synthesized
tgttccaaaaacctggatttaa

SEQ ID NO: 43431 - DNA, 22 bp, Artificial Sequence
  chemically synthesized
caaaaacctggatttaacaatc

SEQ ID NO: 43432 - DNA, 22 bp, Artificial Sequence
  chemically synthesized
gatttaacaatctgagctttgt

SEQ ID NO: 43433 - DNA, 22 bp, Artificial Sequence
  chemically synthesized
aacaatctgagctttgtcatgg

SEQ ID NO: 43434 - DNA, 22 bp, Artificial Sequence
  chemically synthesized
acaatctgagctttgtcatggt

SEQ ID NO: 43435 - DNA, 22 bp, Artificial Sequence
  chemically synthesized
agctttgtcatggtgctttgcg

SEQ ID NO: 43436 - DNA, 22 bp, Artificial Sequence
  chemically synthesized
tgtcatggtgctttgcggttgg

SEQ ID NO: 43437 - DNA, 22 bp, Artificial Sequence
  chemically synthesized
gtcatggtgctttgcggttggt

SEQ ID NO: 43438 - DNA, 22 bp, Artificial Sequence
  chemically synthesized
tcatggtgctttgcggttggtt

SEQ ID NO: 43439 - DNA, 22 bp, Artificial Sequence
  chemically synthesized
tgcggttggttgttgtttcttt

SEQ ID NO: 43440 - DNA, 22 bp, Artificial Sequence
  chemically synthesized
gcggttggttgttgtttcttta

SEQ ID NO: 43441 - DNA, 22 bp, Artificial Sequence
  chemically synthesized
cggttggttgttgtttctttac

SEQ ID NO: 43442 - DNA, 22 bp, Artificial Sequence
  chemically synthesized
gttgttgtttctttaccttttt

SEQ ID NO: 43443 - DNA, 22 bp, Artificial Sequence
  chemically synthesized
ttgtttctttacctttttcttt

SEQ ID NO: 43444 - DNA, 22 bp, Artificial Sequence
  chemically synthesized
tttctttacctttttctttgct

SEQ ID NO: 43445 - DNA, 22 bp, Artificial Sequence
  chemically synthesized
ctttacctttttctttgctttt

SEQ ID NO: 43446 - DNA, 22 bp, Artificial Sequence
  chemically synthesized
tttacctttttctttgctttta

SEQ ID NO: 43447 - DNA, 22 bp, Artificial Sequence
  chemically synthesized
tacctttttctttgcttttaaa

SEQ ID NO: 43448 - DNA, 22 bp, Artificial Sequence
  chemically synthesized
acctttttctttgcttttaaaa

SEQ ID NO: 43449 - DNA, 22 bp, Artificial Sequence
  chemically synthesized
cctttttctttgcttttaaaac

SEQ ID NO: 43450 - DNA, 22 bp, Artificial Sequence
  chemically synthesized
tttctttgcttttaaaaccata

SEQ ID NO: 43451 - DNA, 22 bp, Artificial Sequence
  chemically synthesized
ttctttgcttttaaaaccataa

SEQ ID NO: 43452 - DNA, 22 bp, Artificial Sequence
  chemically synthesized
tctttgcttttaaaaccataaa

SEQ ID NO: 43453 - DNA, 22 bp, Artificial Sequence
  chemically synthesized
ctttgcttttaaaaccataaag

SEQ ID NO: 43454 - DNA, 22 bp, Artificial Sequence
  chemically synthesized
tttgcttttaaaaccataaaga

SEQ ID NO: 43455 - DNA, 22 bp, Artificial Sequence
  chemically synthesized
tgcttttaaaaccataaagaat

SEQ ID NO: 43456 - DNA, 22 bp, Artificial Sequence
  chemically synthesized
gcttttaaaaccataaagaata

SEQ ID NO: 43457 - DNA, 22 bp, Artificial Sequence
  chemically synthesized
cttttaaaaccataaagaataa

SEQ ID NO: 43458 - DNA, 22 bp, Artificial Sequence
  chemically synthesized
ttaaaaccataaagaataatgt

SEQ ID NO: 43459 - DNA, 22 bp, Artificial Sequence
  chemically synthesized
taaaaccataaagaataatgtt

SEQ ID NO: 43460 - DNA, 22 bp, Artificial Sequence
  chemically synthesized
aaaaccataaagaataatgttt

SEQ ID NO: 43461 - DNA, 22 bp, Artificial Sequence
  chemically synthesized
aaaccataaagaataatgttta

SEQ ID NO: 43462 - DNA, 22 bp, Artificial Sequence
  chemically synthesized
aaatgtagagtctgagaaatgc

SEQ ID NO: 43463 - DNA, 22 bp, Artificial Sequence
  chemically synthesized
aatgtagagtctgagaaatgca

SEQ ID NO: 43464 - DNA, 22 bp, Artificial Sequence
  chemically synthesized
agaaatgcaattgctattgttt

SEQ ID NO: 43465 - DNA, 22 bp, Artificial Sequence
  chemically synthesized
ctattgtttttatattttcaga

SEQ ID NO: 43466 - DNA, 22 bp, Artificial Sequence
  chemically synthesized
ttgtttttatattttcagactt

SEQ ID NO: 43467 - DNA, 22 bp, Artificial Sequence
  chemically synthesized
tttttatattttcagacttttt

SEQ ID NO: 43468 - DNA, 22 bp, Artificial Sequence
  chemically synthesized
ttatattttcagactttttgta

SEQ ID NO: 43469 - DNA, 22 bp, Artificial Sequence
  chemically synthesized
tatattttcagactttttgtat

SEQ ID NO: 43470 - DNA, 22 bp, Artificial Sequence
  chemically synthesized
atattttcagactttttgtatg

SEQ ID NO: 43471 - DNA, 22 bp, Artificial Sequence
  chemically synthesized
tattttcagactttttgtatgc

SEQ ID NO: 43472 - DNA, 22 bp, Artificial Sequence
  chemically synthesized
tcagactttttgtatgcttctt

SEQ ID NO: 43473 - DNA, 22 bp, Artificial Sequence
  chemically synthesized
cagactttttgtatgcttcttt

SEQ ID NO: 43474 - DNA, 22 bp, Artificial Sequence
  chemically synthesized
agactttttgtatgcttctttc

SEQ ID NO: 43475 - DNA, 22 bp, Artificial Sequence
  chemically synthesized
tttgtatgcttctttcactaat

SEQ ID NO: 43476 - DNA, 22 bp, Artificial Sequence
  chemically synthesized
ttgtatgcttctttcactaatt

SEQ ID NO: 43477 - DNA, 22 bp, Artificial Sequence
  chemically synthesized
tgtatgcttctttcactaatta

SEQ ID NO: 43478 - DNA, 22 bp, Artificial Sequence
  chemically synthesized
gtatgcttctttcactaattac

SEQ ID NO: 43479 - DNA, 22 bp, Artificial Sequence
  chemically synthesized
tatgcttctttcactaattaca

SEQ ID NO: 43480 - DNA, 22 bp, Artificial Sequence
  chemically synthesized
ctttcactaattacatcatatc

SEQ ID NO: 43481 - DNA, 22 bp, Artificial Sequence
  chemically synthesized
tttcactaattacatcatatca

SEQ ID NO: 43482 - DNA, 22 bp, Artificial Sequence
  chemically synthesized
tcactaattacatcatatcaca

SEQ ID NO: 43483 - DNA, 22 bp, Artificial Sequence
  chemically synthesized
cactaattacatcatatcacaa

SEQ ID NO: 43484 - DNA, 22 bp, Artificial Sequence
  chemically synthesized
actaattacatcatatcacaaa

SEQ ID NO: 43485 - DNA, 22 bp, Artificial Sequence
  chemically synthesized
attacatcatatcacaaaattt

SEQ ID NO: 43486 - DNA, 22 bp, Artificial Sequence
  chemically synthesized
catcatatcacaaaatttcaca

SEQ ID NO: 43487 - DNA, 22 bp, Artificial Sequence
  chemically synthesized
cacaccctgattttttcactca

SEQ ID NO: 43488 - DNA, 22 bp, Artificial Sequence
  chemically synthesized
acaccctgattttttcactcaa

SEQ ID NO: 43489 - DNA, 22 bp, Artificial Sequence
  chemically synthesized
attttttcactcaacattacat

SEQ ID NO: 43490 - DNA, 22 bp, Artificial Sequence
  chemically synthesized
tttcactcaacattacataatg

SEQ ID NO: 43491 - DNA, 22 bp, Artificial Sequence
  chemically synthesized
ttcactcaacattacataatga

SEQ ID NO: 43492 - DNA, 22 bp, Artificial Sequence
  chemically synthesized
tcactcaacattacataatgag

SEQ ID NO: 43493 - DNA, 22 bp, Artificial Sequence
  chemically synthesized
cactcaacattacataatgagt

SEQ ID NO: 43494 - DNA, 22 bp, Artificial Sequence
  chemically synthesized
actcaacattacataatgagtt

SEQ ID NO: 43495 - DNA, 22 bp, Artificial Sequence
  chemically synthesized
aacattacataatgagttttgt

SEQ ID NO: 43496 - DNA, 22 bp, Artificial Sequence
  chemically synthesized
cataatgagttttgtatagtgc

SEQ ID NO: 43497 - DNA, 22 bp, Artificial Sequence
  chemically synthesized
tgtatagtgctatgatcttcat

SEQ ID NO: 43498 - DNA, 22 bp, Artificial Sequence
  chemically synthesized
gtatagtgctatgatcttcata

SEQ ID NO: 43499 - DNA, 22 bp, Artificial Sequence
  chemically synthesized
tatagtgctatgatcttcataa

SEQ ID NO: 43500 - DNA, 22 bp, Artificial Sequence
  chemically synthesized
tgatcttcataactaatatttt

SEQ ID NO: 43501 - DNA, 22 bp, Artificial Sequence
  chemically synthesized
cataactaatattttaaaggag

SEQ ID NO: 43502 - DNA, 22 bp, Artificial Sequence
  chemically synthesized
ataactaatattttaaaggaga

SEQ ID NO: 43503 - DNA, 22 bp, Artificial Sequence
  chemically synthesized
atattttaaaggagagctactg

SEQ ID NO: 43504 - DNA, 22 bp, Artificial Sequence
  chemically synthesized
taaaggagagctactgattaat

SEQ ID NO: 43505 - DNA, 22 bp, Artificial Sequence
  chemically synthesized
aaaggagagctactgattaatg

SEQ ID NO: 43506 - DNA, 22 bp, Artificial Sequence
  chemically synthesized
aaggagagctactgattaatga

SEQ ID NO: 43507 - DNA, 22 bp, Artificial Sequence
  chemically synthesized
ctgattaatgagcatgaggttt

SEQ ID NO: 43508 - DNA, 22 bp, Artificial Sequence
  chemically synthesized
attaatgagcatgaggtttcct

SEQ ID NO: 43509 - DNA, 22 bp, Artificial Sequence
  chemically synthesized
atgagcatgaggtttcctttgg

SEQ ID NO: 43510 - DNA, 22 bp, Artificial Sequence
  chemically synthesized
cctttggggatgaggaaaatat

SEQ ID NO: 43511 - DNA, 22 bp, Artificial Sequence
  chemically synthesized
ctttggggatgaggaaaatatt

SEQ ID NO: 43512 - DNA, 22 bp, Artificial Sequence
  chemically synthesized
tggggatgaggaaaatattctg

SEQ ID NO: 43513 - DNA, 22 bp, Artificial Sequence
  chemically synthesized
ggggatgaggaaaatattctgg

SEQ ID NO: 43514 - DNA, 22 bp, Artificial Sequence
  chemically synthesized
gggatgaggaaaatattctgga

SEQ ID NO: 43515 - DNA, 22 bp, Artificial Sequence
  chemically synthesized
tggaaatatgatgatggttgca

SEQ ID NO: 43516 - DNA, 22 bp, Artificial Sequence
  chemically synthesized
gaaatatgatgatggttgcaca

SEQ ID NO: 43517 - DNA, 22 bp, Artificial Sequence
  chemically synthesized
cacaccactgtgaatgtactaa

SEQ ID NO: 43518 - DNA, 22 bp, Artificial Sequence
  chemically synthesized
tgaatgtactaaatgccacttg

SEQ ID NO: 43519 - DNA, 22 bp, Artificial Sequence
  chemically synthesized
aatgccacttggtggtaccctg

SEQ ID NO: 43520 - DNA, 22 bp, Artificial Sequence
  chemically synthesized
ggtggtaccctgcaaaaatggt

SEQ ID NO: 43521 - DNA, 22 bp, Artificial Sequence
  chemically synthesized
gtggtaccctgcaaaaatggtt

SEQ ID NO: 43522 - DNA, 22 bp, Artificial Sequence
  chemically synthesized
caaaaatggttaaaatagtaac

SEQ ID NO: 43523 - DNA, 22 bp, Artificial Sequence
  chemically synthesized
aaatagtaactcttacgctgtg

SEQ ID NO: 43524 - DNA, 22 bp, Artificial Sequence
  chemically synthesized
ttacgctgtgtacattttattg

SEQ ID NO: 43525 - DNA, 22 bp, Artificial Sequence
  chemically synthesized
acgctgtgtacattttattgca

SEQ ID NO: 43526 - DNA, 22 bp, Artificial Sequence
  chemically synthesized
cgctgtgtacattttattgcaa

SEQ ID NO: 43527 - DNA, 22 bp, Artificial Sequence
  chemically synthesized
tgtacattttattgcaataaaa

SEQ ID NO: 43528 - DNA, 22 bp, Artificial Sequence
  chemically synthesized
tattgcaataaaaaagaatagt

SEQ ID NO: 43529 - DNA, 22 bp, Artificial Sequence
  chemically synthesized
attgcaataaaaaagaatagtc

SEQ ID NO: 43530 - DNA, 22 bp, Artificial Sequence
  chemically synthesized
ttgcaataaaaaagaatagtca

SEQ ID NO: 43531 - DNA, 22 bp, Artificial Sequence
  chemically synthesized
caataaaaaagaatagtcatca

SEQ ID NO: 43532 - DNA, 22 bp, Artificial Sequence
  chemically synthesized
actaagcattatcctttccagg

SEQ ID NO: 43533 - DNA, 22 bp, Artificial Sequence
  chemically synthesized
ctaagcattatcctttccaggc

SEQ ID NO: 43534 - DNA, 22 bp, Artificial Sequence
  chemically synthesized
agcattatcctttccaggcaca

SEQ ID NO: 43535 - DNA, 22 bp, Artificial Sequence
  chemically synthesized
tcctttccaggcacaagcttat

SEQ ID NO: 43536 - DNA, 22 bp, Artificial Sequence
  chemically synthesized
tccaggcacaagcttataatgt

SEQ ID NO: 43537 - DNA, 22 bp, Artificial Sequence
  chemically synthesized
ccaggcacaagcttataatgtg

SEQ ID NO: 43538 - DNA, 22 bp, Artificial Sequence
  chemically synthesized
caggcacaagcttataatgtgg

SEQ ID NO: 43539 - DNA, 22 bp, Artificial Sequence
  chemically synthesized
ataatgtggtgtatctcacttc

SEQ ID NO: 43540 - DNA, 22 bp, Artificial Sequence
  chemically synthesized
taatgtggtgtatctcacttca

SEQ ID NO: 43541 - DNA, 22 bp, Artificial Sequence
  chemically synthesized
acttcatcctcacaacagtcct

SEQ ID NO: 43542 - DNA, 22 bp, Artificial Sequence
  chemically synthesized
catcctcacaacagtcctatga

SEQ ID NO: 43543 - DNA, 22 bp, Artificial Sequence
  chemically synthesized
atcctcacaacagtcctatgaa

SEQ ID NO: 43544 - DNA, 22 bp, Artificial Sequence
  chemically synthesized
acaacagtcctatgaaacaggc

SEQ ID NO: 43545 - DNA, 22 bp, Artificial Sequence
  chemically synthesized
tgaaacaggcagttccatcact

SEQ ID NO: 43546 - DNA, 22 bp, Artificial Sequence
  chemically synthesized
catcactcctgctctacagtta

SEQ ID NO: 43547 - DNA, 22 bp, Artificial Sequence
  chemically synthesized
ctgctctacagttaaggaaact

SEQ ID NO: 43548 - DNA, 22 bp, Artificial Sequence
  chemically synthesized
ctctacagttaaggaaactgag

SEQ ID NO: 43549 - DNA, 22 bp, Artificial Sequence
  chemically synthesized
tacagttaaggaaactgaggtg

SEQ ID NO: 43550 - DNA, 22 bp, Artificial Sequence
  chemically synthesized
cagttaaggaaactgaggtgta

SEQ ID NO: 43551 - DNA, 22 bp, Artificial Sequence
  chemically synthesized
aggaaactgaggtgtaaggagg

SEQ ID NO: 43552 - DNA, 22 bp, Artificial Sequence
  chemically synthesized
aggtgtaaggaggttgtctagt

SEQ ID NO: 43553 - DNA, 22 bp, Artificial Sequence
  chemically synthesized
tctagttcaacctgagcctggg

SEQ ID NO: 43554 - DNA, 22 bp, Artificial Sequence
  chemically synthesized
gttcaacctgagcctgggtctg

SEQ ID NO: 43555 - DNA, 22 bp, Artificial Sequence
  chemically synthesized
aacctgagcctgggtctgcgga

SEQ ID NO: 43556 - DNA, 22 bp, Artificial Sequence
  chemically synthesized
agcctgggtctgcggagtcact

SEQ ID NO: 43557 - DNA, 22 bp, Artificial Sequence
  chemically synthesized
ggtctgcggagtcactgcccaa

SEQ ID NO: 43558 - DNA, 22 bp, Artificial Sequence
  chemically synthesized
cggagtcactgcccaaatgctt

SEQ ID NO: 43559 - DNA, 22 bp, Artificial Sequence
  chemically synthesized
cccaaatgcttcctccccgtgc

SEQ ID NO: 43560 - DNA, 22 bp, Artificial Sequence
  chemically synthesized
cctccccgtgcgcgttggcccc

SEQ ID NO: 43561 - DNA, 22 bp, Artificial Sequence
  chemically synthesized
ctccccgtgcgcgttggccccc

SEQ ID NO: 43562 - DNA, 22 bp, Artificial Sequence
  chemically synthesized
cccgtgcgcgttggcccccctc

SEQ ID NO: 43563 - DNA, 22 bp, Artificial Sequence
  chemically synthesized
gcccccctcttgcttccaaccc

SEQ ID NO: 43564 - DNA, 22 bp, Artificial Sequence
  chemically synthesized
ttgcttccaaccctccacatct

SEQ ID NO: 43565 - DNA, 22 bp, Artificial Sequence
  chemically synthesized
gcttccaaccctccacatcttt

SEQ ID NO: 43566 - DNA, 22 bp, Artificial Sequence
  chemically synthesized
cttccaaccctccacatctttg

SEQ ID NO: 43567 - DNA, 22 bp, Artificial Sequence
  chemically synthesized
ccaaccctccacatctttgttc

SEQ ID NO: 43568 - DNA, 22 bp, Artificial Sequence
  chemically synthesized
caaccctccacatctttgttca

SEQ ID NO: 43569 - DNA, 22 bp, Artificial Sequence
  chemically synthesized
cacatctttgttcataaagttc

SEQ ID NO: 43570 - DNA, 22 bp, Artificial Sequence
  chemically synthesized
tgttcataaagttcattcttat

SEQ ID NO: 43571 - DNA, 22 bp, Artificial Sequence
  chemically synthesized
gttcataaagttcattcttatt

SEQ ID NO: 43572 - DNA, 22 bp, Artificial Sequence
  chemically synthesized
ttcataaagttcattcttattc

SEQ ID NO: 43573 - DNA, 22 bp, Artificial Sequence
  chemically synthesized
ataaagttcattcttattcctt

SEQ ID NO: 43574 - DNA, 22 bp, Artificial Sequence
  chemically synthesized
attcttattccttaatattttc

SEQ ID NO: 43575 - DNA, 22 bp, Artificial Sequence
  chemically synthesized
ttattccttaatattttctgag

SEQ ID NO: 43576 - DNA, 22 bp, Artificial Sequence
  chemically synthesized
attccttaatattttctgagcc

SEQ ID NO: 43577 - DNA, 22 bp, Artificial Sequence
  chemically synthesized
ttccttaatattttctgagcct

SEQ ID NO: 43578 - DNA, 22 bp, Artificial Sequence
  chemically synthesized
cttaatattttctgagcctaag

SEQ ID NO: 43579 - DNA, 22 bp, Artificial Sequence
  chemically synthesized
aatattttctgagcctaagttc

SEQ ID NO: 43580 - DNA, 22 bp, Artificial Sequence
  chemically synthesized
atattttctgagcctaagttcc

SEQ ID NO: 43581 - DNA, 22 bp, Artificial Sequence
  chemically synthesized
tctgagcctaagttcccataaa

SEQ ID NO: 43582 - DNA, 22 bp, Artificial Sequence
  chemically synthesized
ctgagcctaagttcccataaat

SEQ ID NO: 43583 - DNA, 22 bp, Artificial Sequence
  chemically synthesized
tgagcctaagttcccataaatt

SEQ ID NO: 43584 - DNA, 22 bp, Artificial Sequence
  chemically synthesized
agcctaagttcccataaattat

SEQ ID NO: 43585 - DNA, 22 bp, Artificial Sequence
  chemically synthesized
agttcccataaattatatagac

SEQ ID NO: 43586 - DNA, 22 bp, Artificial Sequence
  chemically synthesized
ccataaattatatagacatatt

SEQ ID NO: 43587 - DNA, 22 bp, Artificial Sequence
  chemically synthesized
tatagacatatttctgtctccc

SEQ ID NO: 43588 - DNA, 22 bp, Artificial Sequence
  chemically synthesized
ctgtctcccaataacactgcca

SEQ ID NO: 43589 - DNA, 22 bp, Artificial Sequence
  chemically synthesized
tgtctcccaataacactgccaa

SEQ ID NO: 43590 - DNA, 22 bp, Artificial Sequence
  chemically synthesized
tctcccaataacactgccaatt

SEQ ID NO: 43591 - DNA, 22 bp, Artificial Sequence
  chemically synthesized
ccaataacactgccaatttatt

SEQ ID NO: 43592 - DNA, 22 bp, Artificial Sequence
  chemically synthesized
ccaatttattttctagaaggtt

SEQ ID NO: 43593 - DNA, 22 bp, Artificial Sequence
  chemically synthesized
attttctagaaggttatgacag

SEQ ID NO: 43594 - DNA, 22 bp, Artificial Sequence
  chemically synthesized
ttttctagaaggttatgacagt

SEQ ID NO: 43595 - DNA, 22 bp, Artificial Sequence
  chemically synthesized
tctagaaggttatgacagtgta

SEQ ID NO: 43596 - DNA, 22 bp, Artificial Sequence
  chemically synthesized
ctagaaggttatgacagtgtaa

SEQ ID NO: 43597 - DNA, 22 bp, Artificial Sequence
  chemically synthesized
tagaaggttatgacagtgtaaa

SEQ ID NO: 43598 - DNA, 22 bp, Artificial Sequence
  chemically synthesized
gaaggttatgacagtgtaaaat

SEQ ID NO: 43599 - DNA, 22 bp, Artificial Sequence
  chemically synthesized
tgacagtgtaaaatgtcactag

SEQ ID NO: 43600 - DNA, 22 bp, Artificial Sequence
  chemically synthesized
gaaaacaatcacttcaccacac

SEQ ID NO: 43601 - DNA, 22 bp, Artificial Sequence
  chemically synthesized
caccacacttgtatgagtgttc

SEQ ID NO: 43602 - DNA, 22 bp, Artificial Sequence
  chemically synthesized
accacacttgtatgagtgttca

SEQ ID NO: 43603 - DNA, 22 bp, Artificial Sequence
  chemically synthesized
gtatgagtgttcaatttttaaa

SEQ ID NO: 43604 - DNA, 22 bp, Artificial Sequence
  chemically synthesized
tatgagtgttcaatttttaaat

SEQ ID NO: 43605 - DNA, 22 bp, Artificial Sequence
  chemically synthesized
aatttttaaatattagctaatc

SEQ ID NO: 43606 - DNA, 22 bp, Artificial Sequence
  chemically synthesized
ttaaatattagctaatctaaca

SEQ ID NO: 43607 - DNA, 22 bp, Artificial Sequence
  chemically synthesized
taaatattagctaatctaacag

SEQ ID NO: 43608 - DNA, 22 bp, Artificial Sequence
  chemically synthesized
aaatattagctaatctaacagg

SEQ ID NO: 43609 - DNA, 22 bp, Artificial Sequence
  chemically synthesized
aatattagctaatctaacaggt

SEQ ID NO: 43610 - DNA, 22 bp, Artificial Sequence
  chemically synthesized
gctaatctaacaggttgaaatt

SEQ ID NO: 43611 - DNA, 22 bp, Artificial Sequence
  chemically synthesized
atctaacaggttgaaattgtcc

SEQ ID NO: 43612 - DNA, 22 bp, Artificial Sequence
  chemically synthesized
acaggttgaaattgtcctgatt

SEQ ID NO: 43613 - DNA, 22 bp, Artificial Sequence
  chemically synthesized
aaattgtcctgattcattttct

SEQ ID NO: 43614 - DNA, 22 bp, Artificial Sequence
  chemically synthesized
tcctgattcattttctaattta

SEQ ID NO: 43615 - DNA, 22 bp, Artificial Sequence
  chemically synthesized
attcattttctaatttatactt

SEQ ID NO: 43616 - DNA, 22 bp, Artificial Sequence
  chemically synthesized
attttctaatttatacttcttt

SEQ ID NO: 43617 - DNA, 22 bp, Artificial Sequence
  chemically synthesized
tctaatttatacttctttgaca

SEQ ID NO: 43618 - DNA, 22 bp, Artificial Sequence
  chemically synthesized
ctaatttatacttctttgacaa

SEQ ID NO: 43619 - DNA, 22 bp, Artificial Sequence
  chemically synthesized
taatttatacttctttgacaat

SEQ ID NO: 43620 - DNA, 22 bp, Artificial Sequence
  chemically synthesized
atttatacttctttgacaattt

SEQ ID NO: 43621 - DNA, 22 bp, Artificial Sequence
  chemically synthesized
atacttctttgacaatttggga

SEQ ID NO: 43622 - DNA, 22 bp, Artificial Sequence
  chemically synthesized
tacttctttgacaatttgggag

SEQ ID NO: 43623 - DNA, 22 bp, Artificial Sequence
  chemically synthesized
ctttgacaatttgggagagtga

SEQ ID NO: 43624 - DNA, 22 bp, Artificial Sequence
  chemically synthesized
tttgacaatttgggagagtgaa

SEQ ID NO: 43625 - DNA, 22 bp, Artificial Sequence
  chemically synthesized
tgacaatttgggagagtgaaga

SEQ ID NO: 43626 - DNA, 22 bp, Artificial Sequence
  chemically synthesized
gacaatttgggagagtgaagat

SEQ ID NO: 43627 - DNA, 22 bp, Artificial Sequence
  chemically synthesized
acaatttgggagagtgaagatt

SEQ ID NO: 43628 - DNA, 22 bp, Artificial Sequence
  chemically synthesized
gggagagtgaagattctcctgg

SEQ ID NO: 43629 - DNA, 22 bp, Artificial Sequence
  chemically synthesized
ggagagtgaagattctcctggt

SEQ ID NO: 43630 - DNA, 22 bp, Artificial Sequence
  chemically synthesized
tcctggttgtgtttattctttt

SEQ ID NO: 43631 - DNA, 22 bp, Artificial Sequence
  chemically synthesized
ctggttgtgtttattcttttgt

SEQ ID NO: 43632 - DNA, 22 bp, Artificial Sequence
  chemically synthesized
gttgtgtttattcttttgtgaa

SEQ ID NO: 43633 - DNA, 22 bp, Artificial Sequence
  chemically synthesized
tgtttattcttttgtgaaaaac

SEQ ID NO: 43634 - DNA, 22 bp, Artificial Sequence
  chemically synthesized
attcttttgtgaaaaactgctt

SEQ ID NO: 43635 - DNA, 22 bp, Artificial Sequence
  chemically synthesized
ttcttttgtgaaaaactgcttt

SEQ ID NO: 43636 - DNA, 22 bp, Artificial Sequence
  chemically synthesized
ttttgtgaaaaactgctttatt

SEQ ID NO: 43637 - DNA, 22 bp, Artificial Sequence
  chemically synthesized
ttgtgaaaaactgctttatttt

SEQ ID NO: 43638 - DNA, 22 bp, Artificial Sequence
  chemically synthesized
tgtgaaaaactgctttattttc

SEQ ID NO: 43639 - DNA, 22 bp, Artificial Sequence
  chemically synthesized
gtgaaaaactgctttattttct

SEQ ID NO: 43640 - DNA, 22 bp, Artificial Sequence
  chemically synthesized
tgaaaaactgctttattttctt

SEQ ID NO: 43641 - DNA, 22 bp, Artificial Sequence
  chemically synthesized
ctttattttctttgccaaattc

SEQ ID NO: 43642 - DNA, 22 bp, Artificial Sequence
  chemically synthesized
tattttctttgccaaattcaaa

SEQ ID NO: 43643 - DNA, 22 bp, Artificial Sequence
  chemically synthesized
attttctttgccaaattcaaat

SEQ ID NO: 43644 - DNA, 22 bp, Artificial Sequence
  chemically synthesized
ttttctttgccaaattcaaata

SEQ ID NO: 43645 - DNA, 22 bp, Artificial Sequence
  chemically synthesized
tctttgccaaattcaaatagaa

SEQ ID NO: 43646 - DNA, 22 bp, Artificial Sequence
  chemically synthesized
ctttgccaaattcaaatagaac

SEQ ID NO: 43647 - DNA, 22 bp, Artificial Sequence
  chemically synthesized
tttgccaaattcaaatagaacg

SEQ ID NO: 43648 - DNA, 22 bp, Artificial Sequence
  chemically synthesized
tgccaaattcaaatagaacggt

SEQ ID NO: 43649 - DNA, 22 bp, Artificial Sequence
  chemically synthesized
gccaaattcaaatagaacggtt

SEQ ID NO: 43650 - DNA, 22 bp, Artificial Sequence
  chemically synthesized
ccaaattcaaatagaacggttg

SEQ ID NO: 43651 - DNA, 22 bp, Artificial Sequence
  chemically synthesized
aaatagaacggttgcaaaattg

SEQ ID NO: 43652 - DNA, 22 bp, Artificial Sequence
  chemically synthesized
caaaattgccagaggaaatgct

SEQ ID NO: 43653 - DNA, 22 bp, Artificial Sequence
  chemically synthesized
ccagaggaaatgctgtttttcc

SEQ ID NO: 43654 - DNA, 22 bp, Artificial Sequence
  chemically synthesized
tttttccagatggacacaccca

SEQ ID NO: 43655 - DNA, 22 bp, Artificial Sequence
  chemically synthesized
ttccagatggacacacccaggg

SEQ ID NO: 43656 - DNA, 22 bp, Artificial Sequence
  chemically synthesized
tccagatggacacacccaggga

SEQ ID NO: 43657 - DNA, 22 bp, Artificial Sequence
  chemically synthesized
ccagatggacacacccagggat

SEQ ID NO: 43658 - DNA, 22 bp, Artificial Sequence
  chemically synthesized
cagatggacacacccagggatg

SEQ ID NO: 43659 - DNA, 22 bp, Artificial Sequence
  chemically synthesized
cagtgttctcacaaataatcca

SEQ ID NO: 43660 - DNA, 22 bp, Artificial Sequence
  chemically synthesized
agtgttctcacaaataatccag

SEQ ID NO: 43661 - DNA, 22 bp, Artificial Sequence
  chemically synthesized
tcacaaataatccagttttcta

SEQ ID NO: 43662 - DNA, 22 bp, Artificial Sequence
  chemically synthesized
acaaataatccagttttctaat

SEQ ID NO: 43663 - DNA, 22 bp, Artificial Sequence
  chemically synthesized
tctaattttgcaagcccagctt

SEQ ID NO: 43664 - DNA, 22 bp, Artificial Sequence
  chemically synthesized
ctaattttgcaagcccagcttt

SEQ ID NO: 43665 - DNA, 22 bp, Artificial Sequence
  chemically synthesized
taattttgcaagcccagctttc

SEQ ID NO: 43666 - DNA, 22 bp, Artificial Sequence
  chemically synthesized
attttgcaagcccagctttcat

SEQ ID NO: 43667 - DNA, 22 bp, Artificial Sequence
  chemically synthesized
tgcaagcccagctttcattaga

SEQ ID NO: 43668 - DNA, 22 bp, Artificial Sequence
  chemically synthesized
gcaagcccagctttcattagaa

SEQ ID NO: 43669 - DNA, 22 bp, Artificial Sequence
  chemically synthesized
caagcccagctttcattagaat

SEQ ID NO: 43670 - DNA, 22 bp, Artificial Sequence
  chemically synthesized
tcattagaattttgcaaaaatc

SEQ ID NO: 43671 - DNA, 22 bp, Artificial Sequence
  chemically synthesized
cattagaattttgcaaaaatcc

SEQ ID NO: 43672 - DNA, 22 bp, Artificial Sequence
  chemically synthesized
attagaattttgcaaaaatcct

SEQ ID NO: 43673 - DNA, 22 bp, Artificial Sequence
  chemically synthesized
gaattttgcaaaaatccttgct

SEQ ID NO: 43674 - DNA, 22 bp, Artificial Sequence
  chemically synthesized
tgcaaaaatccttgctttgcga

SEQ ID NO: 43675 - DNA, 22 bp, Artificial Sequence
  chemically synthesized
gcaaaaatccttgctttgcgag

SEQ ID NO: 43676 - DNA, 22 bp, Artificial Sequence
  chemically synthesized
caaaaatccttgctttgcgagc

SEQ ID NO: 43677 - DNA, 22 bp, Artificial Sequence
  chemically synthesized
gctttgcgagcatggcacaggc

SEQ ID NO: 43678 - DNA, 22 bp, Artificial Sequence
  chemically synthesized
ctttgcgagcatggcacaggca

SEQ ID NO: 43679 - DNA, 22 bp, Artificial Sequence
  chemically synthesized
tgcgagcatggcacaggcaaga

SEQ ID NO: 43680 - DNA, 22 bp, Artificial Sequence
  chemically synthesized
gcgagcatggcacaggcaagag

SEQ ID NO: 43681 - DNA, 22 bp, Artificial Sequence
  chemically synthesized
cgagcatggcacaggcaagaga

SEQ ID NO: 43682 - DNA, 22 bp, Artificial Sequence
  chemically synthesized
tctctttcttcccccagagcct

SEQ ID NO: 43683 - DNA, 22 bp, Artificial Sequence
  chemically synthesized
tctttcttcccccagagccttt

SEQ ID NO: 43684 - DNA, 22 bp, Artificial Sequence
  chemically synthesized
tttcttcccccagagcctttga

SEQ ID NO: 43685 - DNA, 22 bp, Artificial Sequence
  chemically synthesized
tcttcccccagagcctttgact

SEQ ID NO: 43686 - DNA, 22 bp, Artificial Sequence
  chemically synthesized
cttcccccagagcctttgactg

SEQ ID NO: 43687 - DNA, 22 bp, Artificial Sequence
  chemically synthesized
ttcccccagagcctttgactgc

SEQ ID NO: 43688 - DNA, 22 bp, Artificial Sequence
  chemically synthesized
cccccagagcctttgactgcac

SEQ ID NO: 43689 - DNA, 22 bp, Artificial Sequence
  chemically synthesized
ccccagagcctttgactgcact

SEQ ID NO: 43690 - DNA, 22 bp, Artificial Sequence
  chemically synthesized
tgactgcacttagatcattgac

SEQ ID NO: 43691 - DNA, 22 bp, Artificial Sequence
  chemically synthesized
gactgcacttagatcattgact

SEQ ID NO: 43692 - DNA, 22 bp, Artificial Sequence
  chemically synthesized
actgcacttagatcattgactt

SEQ ID NO: 43693 - DNA, 22 bp, Artificial Sequence
  chemically synthesized
cacttagatcattgactttggt

SEQ ID NO: 43694 - DNA, 22 bp, Artificial Sequence
  chemically synthesized
agatcattgactttggttcaga

SEQ ID NO: 43695 - DNA, 22 bp, Artificial Sequence
  chemically synthesized
gatcattgactttggttcagaa

SEQ ID NO: 43696 - DNA, 22 bp, Artificial Sequence
  chemically synthesized
actttggttcagaaacctgact

SEQ ID NO: 43697 - DNA, 22 bp, Artificial Sequence
  chemically synthesized
tggttcagaaacctgactgcat

SEQ ID NO: 43698 - DNA, 22 bp, Artificial Sequence
  chemically synthesized
ggttcagaaacctgactgcatc

SEQ ID NO: 43699 - DNA, 22 bp, Artificial Sequence
  chemically synthesized
gttcagaaacctgactgcatct

SEQ ID NO: 43700 - DNA, 22 bp, Artificial Sequence
  chemically synthesized
agaaacctgactgcatctggag

SEQ ID NO: 43701 - DNA, 22 bp, Artificial Sequence
  chemically synthesized
actgcatctggagttgacatga

SEQ ID NO: 43702 - DNA, 22 bp, Artificial Sequence
  chemically synthesized
catctggagttgacatgagcag

SEQ ID NO: 43703 - DNA, 22 bp, Artificial Sequence
  chemically synthesized
gagttgacatgagcagcatgga

SEQ ID NO: 43704 - DNA, 22 bp, Artificial Sequence
  chemically synthesized
acatgagcagcatggaagatgt

SEQ ID NO: 43705 - DNA, 22 bp, Artificial Sequence
  chemically synthesized
gtcccagcacctcactccagag

SEQ ID NO: 43706 - DNA, 22 bp, Artificial Sequence
  chemically synthesized
tcccagcacctcactccagagg

SEQ ID NO: 43707 - DNA, 22 bp, Artificial Sequence
  chemically synthesized
actccagaggccagctcagctc

SEQ ID NO: 43708 - DNA, 22 bp, Artificial Sequence
  chemically synthesized
cagaggccagctcagctcaatc

SEQ ID NO: 43709 - DNA, 22 bp, Artificial Sequence
  chemically synthesized
agctcaatctgggcagagctgc

SEQ ID NO: 43710 - DNA, 22 bp, Artificial Sequence
  chemically synthesized
aatctgggcagagctgcatgat

SEQ ID NO: 43711 - DNA, 22 bp, Artificial Sequence
  chemically synthesized
ggcagagctgcatgatggaagt

SEQ ID NO: 43712 - DNA, 22 bp, Artificial Sequence
  chemically synthesized
catgatggaagtttctgactac

SEQ ID NO: 43713 - DNA, 22 bp, Artificial Sequence
  chemically synthesized
ctgactaccaagcatcgggcag

SEQ ID NO: 43714 - DNA, 22 bp, Artificial Sequence
  chemically synthesized
tgactaccaagcatcgggcaga

SEQ ID NO: 43715 - DNA, 22 bp, Artificial Sequence
  chemically synthesized
actaccaagcatcgggcagagg

SEQ ID NO: 43716 - DNA, 22 bp, Artificial Sequence
  chemically synthesized
ccaagcatcgggcagagggtgc

SEQ ID NO: 43717 - DNA, 22 bp, Artificial Sequence
  chemically synthesized
gactacatagttgtgtgaggga

SEQ ID NO: 43718 - DNA, 22 bp, Artificial Sequence
  chemically synthesized
catagttgtgtgagggagcacc

SEQ ID NO: 43719 - DNA, 22 bp, Artificial Sequence
  chemically synthesized
tgtgagggagcaccgttctcta

SEQ ID NO: 43720 - DNA, 22 bp, Artificial Sequence
  chemically synthesized
tctagaatctgctatttgagca

SEQ ID NO: 43721 - DNA, 22 bp, Artificial Sequence
  chemically synthesized
tagaatctgctatttgagcaag

SEQ ID NO: 43722 - DNA, 22 bp, Artificial Sequence
  chemically synthesized
gaatctgctatttgagcaaggc

SEQ ID NO: 43723 - DNA, 22 bp, Artificial Sequence
  chemically synthesized
ctatttgagcaaggcaaacatc

SEQ ID NO: 43724 - DNA, 22 bp, Artificial Sequence
  chemically synthesized
tttgagcaaggcaaacatcctg

SEQ ID NO: 43725 - DNA, 22 bp, Artificial Sequence
  chemically synthesized
gagcaaggcaaacatcctgata

SEQ ID NO: 43726 - DNA, 22 bp, Artificial Sequence
  chemically synthesized
agcaaggcaaacatcctgataa

SEQ ID NO: 43727 - DNA, 22 bp, Artificial Sequence
  chemically synthesized
ataatggtgaaaacctaccgca

SEQ ID NO: 43728 - DNA, 22 bp, Artificial Sequence
  chemically synthesized
ccgcaagttgccaggaaagttg

SEQ ID NO: 43729 - DNA, 22 bp, Artificial Sequence
  chemically synthesized
ccaggaaagttgatgtggtctg

SEQ ID NO: 43730 - DNA, 22 bp, Artificial Sequence
  chemically synthesized
atgtggtctgcgagtaggtgct

SEQ ID NO: 43731 - DNA, 22 bp, Artificial Sequence
  chemically synthesized
cgagtaggtgctgccatccagt

SEQ ID NO: 43732 - DNA, 22 bp, Artificial Sequence
  chemically synthesized
ccatccagtggccgacatagag

SEQ ID NO: 43733 - DNA, 22 bp, Artificial Sequence
  chemically synthesized
tgagggcaggtaggccacaggt

SEQ ID NO: 43734 - DNA, 22 bp, Artificial Sequence
  chemically synthesized
agggcaggtaggccacaggtga

SEQ ID NO: 43735 - DNA, 22 bp, Artificial Sequence
  chemically synthesized
aagccctccctgatggggcctt

SEQ ID NO: 43736 - DNA, 22 bp, Artificial Sequence
  chemically synthesized
cctgatggggccttggggagag

SEQ ID NO: 43737 - DNA, 22 bp, Artificial Sequence
  chemically synthesized
atggggccttggggagagggca

SEQ ID NO: 43738 - DNA, 22 bp, Artificial Sequence
  chemically synthesized
ggggagagggcagcagggtaag

SEQ ID NO: 43739 - DNA, 22 bp, Artificial Sequence
  chemically synthesized
gggagagggcagcagggtaagt

SEQ ID NO: 43740 - DNA, 22 bp, Artificial Sequence
  chemically synthesized
attgtggatgacgactgacctg

SEQ ID NO: 43741 - DNA, 22 bp, Artificial Sequence
  chemically synthesized
tggatgacgactgacctggaaa

SEQ ID NO: 43742 - DNA, 22 bp, Artificial Sequence
  chemically synthesized
acctggaaaatccccttggcct

SEQ ID NO: 43743 - DNA, 22 bp, Artificial Sequence
  chemically synthesized
gaaaatccccttggcctcaaca

SEQ ID NO: 43744 - DNA, 22 bp, Artificial Sequence
  chemically synthesized
ggcctcaacacctccaaactct

SEQ ID NO: 43745 - DNA, 22 bp, Artificial Sequence
  chemically synthesized
gcctcaacacctccaaactctg

SEQ ID NO: 43746 - DNA, 22 bp, Artificial Sequence
  chemically synthesized
aacacctccaaactctgcattt

SEQ ID NO: 43747 - DNA, 22 bp, Artificial Sequence
  chemically synthesized
caaactctgcatttgatccaag

SEQ ID NO: 43748 - DNA, 22 bp, Artificial Sequence
  chemically synthesized
tgcatttgatccaagtcaggga

SEQ ID NO: 43749 - DNA, 22 bp, Artificial Sequence
  chemically synthesized
catttgatccaagtcagggaac

SEQ ID NO: 43750 - DNA, 22 bp, Artificial Sequence
  chemically synthesized
gatccaagtcagggaacacctg

SEQ ID NO: 43751 - DNA, 22 bp, Artificial Sequence
  chemically synthesized
atccaagtcagggaacacctgg

SEQ ID NO: 43752 - DNA, 22 bp, Artificial Sequence
  chemically synthesized
gaaacatgaaggggagagcagg

SEQ ID NO: 43753 - DNA, 22 bp, Artificial Sequence
  chemically synthesized
tgacctccctctcagaggctga

SEQ ID NO: 43754 - DNA, 22 bp, Artificial Sequence
  chemically synthesized
gacctccctctcagaggctgag

SEQ ID NO: 43755 - DNA, 22 bp, Artificial Sequence
  chemically synthesized
acctccctctcagaggctgaga

SEQ ID NO: 43756 - DNA, 22 bp, Artificial Sequence
  chemically synthesized
cctctcagaggctgagaacgcc

SEQ ID NO: 43757 - DNA, 22 bp, Artificial Sequence
  chemically synthesized
tcagaggctgagaacgccaatt

SEQ ID NO: 43758 - DNA, 22 bp, Artificial Sequence
  chemically synthesized
agaggctgagaacgccaattga

SEQ ID NO: 43759 - DNA, 22 bp, Artificial Sequence
  chemically synthesized
agaacgccaattgacctgatgt

SEQ ID NO: 43760 - DNA, 22 bp, Artificial Sequence
  chemically synthesized
acctgatgtcattattgacatg

SEQ ID NO: 43761 - DNA, 22 bp, Artificial Sequence
  chemically synthesized
atgtcattattgacatgtagaa

SEQ ID NO: 43762 - DNA, 22 bp, Artificial Sequence
  chemically synthesized
ttgacatgtagaaaattgatga

SEQ ID NO: 43763 - DNA, 22 bp, Artificial Sequence
  chemically synthesized
acatgtagaaaattgatgaaca

SEQ ID NO: 43764 - DNA, 22 bp, Artificial Sequence
  chemically synthesized
atgaacaggcctgagttatgtt

SEQ ID NO: 43765 - DNA, 22 bp, Artificial Sequence
  chemically synthesized
agttatgttttgtggcacctca

SEQ ID NO: 43766 - DNA, 22 bp, Artificial Sequence
  chemically synthesized
tgttttgtggcacctcatggtc

SEQ ID NO: 43767 - DNA, 22 bp, Artificial Sequence
  chemically synthesized
tgtggcacctcatggtctagtt

SEQ ID NO: 43768 - DNA, 22 bp, Artificial Sequence
  chemically synthesized
gtggcacctcatggtctagtta

SEQ ID NO: 43769 - DNA, 22 bp, Artificial Sequence
  chemically synthesized
tggcacctcatggtctagttag

SEQ ID NO: 43770 - DNA, 22 bp, Artificial Sequence
  chemically synthesized
atggtctagttagtgttctgag

SEQ ID NO: 43771 - DNA, 22 bp, Artificial Sequence
  chemically synthesized
gttagtgttctgagaatcattt

SEQ ID NO: 43772 - DNA, 22 bp, Artificial Sequence
  chemically synthesized
gtgttctgagaatcattttctc

SEQ ID NO: 43773 - DNA, 22 bp, Artificial Sequence
  chemically synthesized
tgagaatcattttctcagtgga

SEQ ID NO: 43774 - DNA, 22 bp, Artificial Sequence
  chemically synthesized
agaatcattttctcagtggacc

SEQ ID NO: 43775 - DNA, 22 bp, Artificial Sequence
  chemically synthesized
tctcagtggacctgcaggtgag

SEQ ID NO: 43776 - DNA, 22 bp, Artificial Sequence
  chemically synthesized
ctcagtggacctgcaggtgaga

SEQ ID NO: 43777 - DNA, 22 bp, Artificial Sequence
  chemically synthesized
tcagtggacctgcaggtgagac

SEQ ID NO: 43778 - DNA, 22 bp, Artificial Sequence
  chemically synthesized
agtggacctgcaggtgagacca

SEQ ID NO: 43779 - DNA, 22 bp, Artificial Sequence
  chemically synthesized
caggtgagaccaggcgaggcag

SEQ ID NO: 43780 - DNA, 22 bp, Artificial Sequence
  chemically synthesized
gtgggggatggtggttagaaat

SEQ ID NO: 43781 - DNA, 22 bp, Artificial Sequence
  chemically synthesized
gaaatgtgtggatggttgtggg

SEQ ID NO: 43782 - DNA, 22 bp, Artificial Sequence
  chemically synthesized
tggggcagaagaaacagcaagt

SEQ ID NO: 43783 - DNA, 22 bp, Artificial Sequence
  chemically synthesized
tgggccagctacaaactggtta

SEQ ID NO: 43784 - DNA, 22 bp, Artificial Sequence
  chemically synthesized
ggccagctacaaactggttata

SEQ ID NO: 43785 - DNA, 22 bp, Artificial Sequence
  chemically synthesized
caaactggttatatgatgtcta

SEQ ID NO: 43786 - DNA, 22 bp, Artificial Sequence
  chemically synthesized
gttatatgatgtctactgatga

SEQ ID NO: 43787 - DNA, 22 bp, Artificial Sequence
  chemically synthesized
tatgatgtctactgatgatgat

SEQ ID NO: 43788 - DNA, 22 bp, Artificial Sequence
  chemically synthesized
ctgatgatgatagtgatggtgg

SEQ ID NO: 43789 - DNA, 22 bp, Artificial Sequence
  chemically synthesized
atgatgatagtgatggtggtgg

SEQ ID NO: 43790 - DNA, 22 bp, Artificial Sequence
  chemically synthesized
tgatggtggtggaatgatgatg

SEQ ID NO: 43791 - DNA, 22 bp, Artificial Sequence
  chemically synthesized
gtgatggtggtagtggtcgtgg

SEQ ID NO: 43792 - DNA, 22 bp, Artificial Sequence
  chemically synthesized
atggtggtggtaatgataatga

SEQ ID NO: 43793 - DNA, 22 bp, Artificial Sequence
  chemically synthesized
tcatgatgatagcggtggtgat

SEQ ID NO: 43794 - DNA, 22 bp, Artificial Sequence
  chemically synthesized
agggtgatgataatagtgacag

SEQ ID NO: 43795 - DNA, 22 bp, Artificial Sequence
  chemically synthesized
agtagtaatgatggtgatggtg

SEQ ID NO: 43796 - DNA, 22 bp, Artificial Sequence
  chemically synthesized
tggtgatgatggtggtggtagt

SEQ ID NO: 43797 - DNA, 22 bp, Artificial Sequence
  chemically synthesized
agggtgatgataatagtgatag

SEQ ID NO: 43798 - DNA, 22 bp, Artificial Sequence
  chemically synthesized
tcactattatcatcaccctcaa

SEQ ID NO: 43799 - DNA, 22 bp, Artificial Sequence
  chemically synthesized
ttatcatcaccctcaacatcat

SEQ ID NO: 43800 - DNA, 22 bp, Artificial Sequence
  chemically synthesized
tcatcaccctcaacatcatcac

SEQ ID NO: 43801 - DNA, 22 bp, Artificial Sequence
  chemically synthesized
aacatcatcaccatcatcacta

SEQ ID NO: 43802 - DNA, 22 bp, Artificial Sequence
  chemically synthesized
tcatcaccaccaccatcatcgt

SEQ ID NO: 43803 - DNA, 22 bp, Artificial Sequence
  chemically synthesized
ctaccactaccaccaccatcat

SEQ ID NO: 43804 - DNA, 22 bp, Artificial Sequence
  chemically synthesized
ccactaccaccaccatcatcac

SEQ ID NO: 43805 - DNA, 22 bp, Artificial Sequence
  chemically synthesized
ccaccaccatcatcaccacagc

SEQ ID NO: 43806 - DNA, 22 bp, Artificial Sequence
  chemically synthesized
ctactcagcaccaccatcatca

SEQ ID NO: 43807 - DNA, 22 bp, Artificial Sequence
  chemically synthesized
ctcagcaccaccatcatcattc

SEQ ID NO: 43808 - DNA, 22 bp, Artificial Sequence
  chemically synthesized
agcaccaccatcatcattccac

SEQ ID NO: 43809 - DNA, 22 bp, Artificial Sequence
  chemically synthesized
caccaccatcaccatcattcca

SEQ ID NO: 43810 - DNA, 22 bp, Artificial Sequence
  chemically synthesized
caccatcaccattatcattacc

SEQ ID NO: 43811 - DNA, 22 bp, Artificial Sequence
  chemically synthesized
tcattaccaccaccactgtcac

SEQ ID NO: 43812 - DNA, 22 bp, Artificial Sequence
  chemically synthesized
ccaccaccactgtcactattat

SEQ ID NO: 43813 - DNA, 22 bp, Artificial Sequence
  chemically synthesized
tcactattatcatcaccctcaa

SEQ ID NO: 43814 - DNA, 22 bp, Artificial Sequence
  chemically synthesized
ttatcatcaccctcaacatcat

SEQ ID NO: 43815 - DNA, 22 bp, Artificial Sequence
  chemically synthesized
tcatcaccctcaacatcatcac

SEQ ID NO: 43816 - DNA, 22 bp, Artificial Sequence
  chemically synthesized
aacatcatcaccaccaccatca

SEQ ID NO: 43817 - DNA, 22 bp, Artificial Sequence
  chemically synthesized
ctaccaccaccaccaccatcac

SEQ ID NO: 43818 - DNA, 22 bp, Artificial Sequence
  chemically synthesized
ccaccaccaccaccatcaccat

SEQ ID NO: 43819 - DNA, 22 bp, Artificial Sequence
  chemically synthesized
taccaccatcaccattatcatc

SEQ ID NO: 43820 - DNA, 22 bp, Artificial Sequence
  chemically synthesized
ccaccatcaccattatcatcac

SEQ ID NO: 43821 - DNA, 22 bp, Artificial Sequence
  chemically synthesized
tcatcaccatcaccatcaccac

SEQ ID NO: 43822 - DNA, 22 bp, Artificial Sequence
  chemically synthesized
tcatcatgataatcattatcat

SEQ ID NO: 43823 - DNA, 22 bp, Artificial Sequence
  chemically synthesized
tcattaccaccaccattagcat

SEQ ID NO: 43824 - DNA, 22 bp, Artificial Sequence
  chemically synthesized
ccaccaccattagcattatcat

SEQ ID NO: 43825 - DNA, 22 bp, Artificial Sequence
  chemically synthesized
gcattatcattaccaccaccat

SEQ ID NO: 43826 - DNA, 22 bp, Artificial Sequence
  chemically synthesized
tcattaccaccaccatcactat

SEQ ID NO: 43827 - DNA, 22 bp, Artificial Sequence
  chemically synthesized
ccaccaccatcactatcactat

SEQ ID NO: 43828 - DNA, 22 bp, Artificial Sequence
  chemically synthesized
tcactatcaccatcaccacgac

SEQ ID NO: 43829 - DNA, 22 bp, Artificial Sequence
  chemically synthesized
tcaccatcaccacgaccactac

SEQ ID NO: 43830 - DNA, 22 bp, Artificial Sequence
  chemically synthesized
ccaccatcaccaacaccatcat

SEQ ID NO: 43831 - DNA, 22 bp, Artificial Sequence
  chemically synthesized
ctacccaccaccaccatcatca

SEQ ID NO: 43832 - DNA, 22 bp, Artificial Sequence
  chemically synthesized
cccaccaccaccatcatcatca

SEQ ID NO: 43833 - DNA, 22 bp, Artificial Sequence
  chemically synthesized
caccaccatcacaattattacc

SEQ ID NO: 43834 - DNA, 22 bp, Artificial Sequence
  chemically synthesized
ttaccaccaccaccatcaccac

SEQ ID NO: 43835 - DNA, 22 bp, Artificial Sequence
  chemically synthesized
ccaccaccaccatcaccaccac

SEQ ID NO: 43836 - DNA, 22 bp, Artificial Sequence
  chemically synthesized
tcatcatcagtagacatcatat

SEQ ID NO: 43837 - DNA, 22 bp, Artificial Sequence
  chemically synthesized
gtagctggcccagagcctactt

SEQ ID NO: 43838 - DNA, 22 bp, Artificial Sequence
  chemically synthesized
tagctggcccagagcctacttg

SEQ ID NO: 43839 - DNA, 22 bp, Artificial Sequence
  chemically synthesized
gcccagagcctacttgctgttt

SEQ ID NO: 43840 - DNA, 22 bp, Artificial Sequence
  chemically synthesized
cttgctgtttcttctgccccac

SEQ ID NO: 43841 - DNA, 22 bp, Artificial Sequence
  chemically synthesized
gctgtttcttctgccccacaac

SEQ ID NO: 43842 - DNA, 22 bp, Artificial Sequence
  chemically synthesized
ctgtttcttctgccccacaacc

SEQ ID NO: 43843 - DNA, 22 bp, Artificial Sequence
  chemically synthesized
tttcttctgccccacaaccatc

SEQ ID NO: 43844 - DNA, 22 bp, Artificial Sequence
  chemically synthesized
cttctgccccacaaccatccac

SEQ ID NO: 43845 - DNA, 22 bp, Artificial Sequence
  chemically synthesized
ttctgccccacaaccatccaca

SEQ ID NO: 43846 - DNA, 22 bp, Artificial Sequence
  chemically synthesized
ctgccccacaaccatccacaca

SEQ ID NO: 43847 - DNA, 22 bp, Artificial Sequence
  chemically synthesized
tgccccacaaccatccacacat

SEQ ID NO: 43848 - DNA, 22 bp, Artificial Sequence
  chemically synthesized
ccccacaaccatccacacattt

SEQ ID NO: 43849 - DNA, 22 bp, Artificial Sequence
  chemically synthesized
ctaaccaccatcccccactagg

SEQ ID NO: 43850 - DNA, 22 bp, Artificial Sequence
  chemically synthesized
taaccaccatcccccactaggc

SEQ ID NO: 43851 - DNA, 22 bp, Artificial Sequence
  chemically synthesized
accaccatcccccactaggctt

SEQ ID NO: 43852 - DNA, 22 bp, Artificial Sequence
  chemically synthesized
ggcttctgcctcgcctggtctc

SEQ ID NO: 43853 - DNA, 22 bp, Artificial Sequence
  chemically synthesized
ctgcctcgcctggtctcacctg

SEQ ID NO: 43854 - DNA, 22 bp, Artificial Sequence
  chemically synthesized
tgcctcgcctggtctcacctgc

SEQ ID NO: 43855 - DNA, 22 bp, Artificial Sequence
  chemically synthesized
cctcgcctggtctcacctgcag

SEQ ID NO: 43856 - DNA, 22 bp, Artificial Sequence
  chemically synthesized
gcctggtctcacctgcaggtcc

SEQ ID NO: 43857 - DNA, 22 bp, Artificial Sequence
  chemically synthesized
gtctcacctgcaggtccactga

SEQ ID NO: 43858 - DNA, 22 bp, Artificial Sequence
  chemically synthesized
acctgcaggtccactgagaaaa

SEQ ID NO: 43859 - DNA, 22 bp, Artificial Sequence
  chemically synthesized
caggtccactgagaaaatgatt

SEQ ID NO: 43860 - DNA, 22 bp, Artificial Sequence
  chemically synthesized
agaaaatgattctcagaacact

SEQ ID NO: 43861 - DNA, 22 bp, Artificial Sequence
  chemically synthesized
tcagaacactaactagaccatg

SEQ ID NO: 43862 - DNA, 22 bp, Artificial Sequence
  chemically synthesized
agaacactaactagaccatgag

SEQ ID NO: 43863 - DNA, 22 bp, Artificial Sequence
  chemically synthesized
actagaccatgaggtgccacaa

SEQ ID NO: 43864 - DNA, 22 bp, Artificial Sequence
  chemically synthesized
gaccatgaggtgccacaaaaca

SEQ ID NO: 43865 - DNA, 22 bp, Artificial Sequence
  chemically synthesized
aggcctgttcatcaattttcta

SEQ ID NO: 43866 - DNA, 22 bp, Artificial Sequence
  chemically synthesized
ttcatcaattttctacatgtca

SEQ ID NO: 43867 - DNA, 22 bp, Artificial Sequence
  chemically synthesized
atcaattttctacatgtcaata

SEQ ID NO: 43868 - DNA, 22 bp, Artificial Sequence
  chemically synthesized
tctacatgtcaataatgacatc

SEQ ID NO: 43869 - DNA, 22 bp, Artificial Sequence
  chemically synthesized
ctacatgtcaataatgacatca

SEQ ID NO: 43870 - DNA, 22 bp, Artificial Sequence
  chemically synthesized
tacatgtcaataatgacatcag

SEQ ID NO: 43871 - DNA, 22 bp, Artificial Sequence
  chemically synthesized
catgtcaataatgacatcaggt

SEQ ID NO: 43872 - DNA, 22 bp, Artificial Sequence
  chemically synthesized
gcgttctcagcctctgagaggg

SEQ ID NO: 43873 - DNA, 22 bp, Artificial Sequence
  chemically synthesized
tcagcctctgagagggaggtca

SEQ ID NO: 43874 - DNA, 22 bp, Artificial Sequence
  chemically synthesized
agcctctgagagggaggtcaaa

SEQ ID NO: 43875 - DNA, 22 bp, Artificial Sequence
  chemically synthesized
tgagagggaggtcaaagttttc

SEQ ID NO: 43876 - DNA, 22 bp, Artificial Sequence
  chemically synthesized
agagggaggtcaaagttttcct

SEQ ID NO: 43877 - DNA, 22 bp, Artificial Sequence
  chemically synthesized
tcctgctctccccttcatgttt

SEQ ID NO: 43878 - DNA, 22 bp, Artificial Sequence
  chemically synthesized
cctgctctccccttcatgtttc

SEQ ID NO: 43879 - DNA, 22 bp, Artificial Sequence
  chemically synthesized
ctgctctccccttcatgtttcc

SEQ ID NO: 43880 - DNA, 22 bp, Artificial Sequence
  chemically synthesized
ctctccccttcatgtttccagg

SEQ ID NO: 43881 - DNA, 22 bp, Artificial Sequence
  chemically synthesized
tccccttcatgtttccaggtgt

SEQ ID NO: 43882 - DNA, 22 bp, Artificial Sequence
  chemically synthesized
cccttcatgtttccaggtgttc

SEQ ID NO: 43883 - DNA, 22 bp, Artificial Sequence
  chemically synthesized
catgtttccaggtgttccctga

SEQ ID NO: 43884 - DNA, 22 bp, Artificial Sequence
  chemically synthesized
atgtttccaggtgttccctgac

SEQ ID NO: 43885 - DNA, 22 bp, Artificial Sequence
  chemically synthesized
ccaggtgttccctgacttggat

SEQ ID NO: 43886 - DNA, 22 bp, Artificial Sequence
  chemically synthesized
caggtgttccctgacttggatc

SEQ ID NO: 43887 - DNA, 22 bp, Artificial Sequence
  chemically synthesized
cctgacttggatcaaatgcaga

SEQ ID NO: 43888 - DNA, 22 bp, Artificial Sequence
  chemically synthesized
acttggatcaaatgcagagttt

SEQ ID NO: 43889 - DNA, 22 bp, Artificial Sequence
  chemically synthesized
ggatcaaatgcagagtttggag

SEQ ID NO: 43890 - DNA, 22 bp, Artificial Sequence
  chemically synthesized
gatcaaatgcagagtttggagg

SEQ ID NO: 43891 - DNA, 22 bp, Artificial Sequence
  chemically synthesized
ggaggtgttgaggccaagggga

SEQ ID NO: 43892 - DNA, 22 bp, Artificial Sequence
  chemically synthesized
gaggtgttgaggccaaggggat

SEQ ID NO: 43893 - DNA, 22 bp, Artificial Sequence
  chemically synthesized
aggccaaggggattttccaggt

SEQ ID NO: 43894 - DNA, 22 bp, Artificial Sequence
  chemically synthesized
tccaggtcagtcgtcatccaca

SEQ ID NO: 43895 - DNA, 22 bp, Artificial Sequence
  chemically synthesized
ccaggtcagtcgtcatccacaa

SEQ ID NO: 43896 - DNA, 22 bp, Artificial Sequence
  chemically synthesized
caggtcagtcgtcatccacaat

SEQ ID NO: 43897 - DNA, 22 bp, Artificial Sequence
  chemically synthesized
atcctgccgctggacttaccct

SEQ ID NO: 43898 - DNA, 22 bp, Artificial Sequence
  chemically synthesized
ccgctggacttaccctgctgcc

SEQ ID NO: 43899 - DNA, 22 bp, Artificial Sequence
  chemically synthesized
gacttaccctgctgccctctcc

SEQ ID NO: 43900 - DNA, 22 bp, Artificial Sequence
  chemically synthesized
accctgctgccctctccccaag

SEQ ID NO: 43901 - DNA, 22 bp, Artificial Sequence
  chemically synthesized
ccctgctgccctctccccaagg

SEQ ID NO: 43902 - DNA, 22 bp, Artificial Sequence
  chemically synthesized
ctgccctctccccaaggcccca

SEQ ID NO: 43903 - DNA, 22 bp, Artificial Sequence
  chemically synthesized
ccctctccccaaggccccatca

SEQ ID NO: 43904 - DNA, 22 bp, Artificial Sequence
  chemically synthesized
tccccaaggccccatcagggag

SEQ ID NO: 43905 - DNA, 22 bp, Artificial Sequence
  chemically synthesized
cccaaggccccatcagggaggg

SEQ ID NO: 43906 - DNA, 22 bp, Artificial Sequence
  chemically synthesized
caatcctcttgtcacctgtggc

SEQ ID NO: 43907 - DNA, 22 bp, Artificial Sequence
  chemically synthesized
aatcctcttgtcacctgtggcc

SEQ ID NO: 43908 - DNA, 22 bp, Artificial Sequence
  chemically synthesized
ttgtcacctgtggcctacctgc

SEQ ID NO: 43909 - DNA, 22 bp, Artificial Sequence
  chemically synthesized
gtcacctgtggcctacctgccc

SEQ ID NO: 43910 - DNA, 22 bp, Artificial Sequence
  chemically synthesized
tcacctgtggcctacctgccct

SEQ ID NO: 43911 - DNA, 22 bp, Artificial Sequence
  chemically synthesized
tggcctacctgccctcagagat

SEQ ID NO: 43912 - DNA, 22 bp, Artificial Sequence
  chemically synthesized
cctgccctcagagatgacatct

SEQ ID NO: 43913 - DNA, 22 bp, Artificial Sequence
  chemically synthesized
ccctcagagatgacatctctat

SEQ ID NO: 43914 - DNA, 22 bp, Artificial Sequence
  chemically synthesized
agagatgacatctctatgtcgg

SEQ ID NO: 43915 - DNA, 22 bp, Artificial Sequence
  chemically synthesized
tatgtcggccactggatggcag

SEQ ID NO: 43916 - DNA, 22 bp, Artificial Sequence
  chemically synthesized
tgtcggccactggatggcagca

SEQ ID NO: 43917 - DNA, 22 bp, Artificial Sequence
  chemically synthesized
gatggcagcacctactcgcaga

SEQ ID NO: 43918 - DNA, 22 bp, Artificial Sequence
  chemically synthesized
ctcgcagaccacatcaactttc

SEQ ID NO: 43919 - DNA, 22 bp, Artificial Sequence
  chemically synthesized
gcagaccacatcaactttcctg

SEQ ID NO: 43920 - DNA, 22 bp, Artificial Sequence
  chemically synthesized
tcctggcaacttgcggtaggtt

SEQ ID NO: 43921 - DNA, 22 bp, Artificial Sequence
  chemically synthesized
cctggcaacttgcggtaggttt

SEQ ID NO: 43922 - DNA, 22 bp, Artificial Sequence
  chemically synthesized
ctggcaacttgcggtaggtttt

SEQ ID NO: 43923 - DNA, 22 bp, Artificial Sequence
  chemically synthesized
gcaacttgcggtaggttttcac

SEQ ID NO: 43924 - DNA, 22 bp, Artificial Sequence
  chemically synthesized
gcggtaggttttcaccattatc

SEQ ID NO: 43925 - DNA, 22 bp, Artificial Sequence
  chemically synthesized
cggtaggttttcaccattatca

SEQ ID NO: 43926 - DNA, 22 bp, Artificial Sequence
  chemically synthesized
tcaccattatcaggatgtttgc

SEQ ID NO: 43927 - DNA, 22 bp, Artificial Sequence
  chemically synthesized
caccattatcaggatgtttgcc

SEQ ID NO: 43928 - DNA, 22 bp, Artificial Sequence
  chemically synthesized
accattatcaggatgtttgcct

SEQ ID NO: 43929 - DNA, 22 bp, Artificial Sequence
  chemically synthesized
tcaggatgtttgccttgctcaa

SEQ ID NO: 43930 - DNA, 22 bp, Artificial Sequence
  chemically synthesized
gccttgctcaaatagcagattc

SEQ ID NO: 43931 - DNA, 22 bp, Artificial Sequence
  chemically synthesized
ccttgctcaaatagcagattct

SEQ ID NO: 43932 - DNA, 22 bp, Artificial Sequence
  chemically synthesized
gctcaaatagcagattctagag

SEQ ID NO: 43933 - DNA, 22 bp, Artificial Sequence
  chemically synthesized
ctcaaatagcagattctagaga

SEQ ID NO: 43934 - DNA, 22 bp, Artificial Sequence
  chemically synthesized
aaatagcagattctagagaacg

SEQ ID NO: 43935 - DNA, 22 bp, Artificial Sequence
  chemically synthesized
tagagaacggtgctccctcaca

SEQ ID NO: 43936 - DNA, 22 bp, Artificial Sequence
  chemically synthesized
gagaacggtgctccctcacaca

SEQ ID NO: 43937 - DNA, 22 bp, Artificial Sequence
  chemically synthesized
cctcacacaactatgtagtcca

SEQ ID NO: 43938 - DNA, 22 bp, Artificial Sequence
  chemically synthesized
acacaactatgtagtccaggtg

SEQ ID NO: 43939 - DNA, 22 bp, Artificial Sequence
  chemically synthesized
tgtagtccaggtgatgcaccct

SEQ ID NO: 43940 - DNA, 22 bp, Artificial Sequence
  chemically synthesized
tgcccgatgcttggtagtcaga

SEQ ID NO: 43941 - DNA, 22 bp, Artificial Sequence
  chemically synthesized
cccgatgcttggtagtcagaaa

SEQ ID NO: 43942 - DNA, 22 bp, Artificial Sequence
  chemically synthesized
ggtagtcagaaacttccatcat

SEQ ID NO: 43943 - DNA, 22 bp, Artificial Sequence
  chemically synthesized
gtagtcagaaacttccatcatg

SEQ ID NO: 43944 - DNA, 22 bp, Artificial Sequence
  chemically synthesized
ccatcatgcagctctgcccaga

SEQ ID NO: 43945 - DNA, 22 bp, Artificial Sequence
  chemically synthesized
catcatgcagctctgcccagat

SEQ ID NO: 43946 - DNA, 22 bp, Artificial Sequence
  chemically synthesized
tgcccagattgagctgagctgg

SEQ ID NO: 43947 - DNA, 22 bp, Artificial Sequence
  chemically synthesized
cccagattgagctgagctggcc

SEQ ID NO: 43948 - DNA, 22 bp, Artificial Sequence
  chemically synthesized
agctgagctggcctctggagtg

SEQ ID NO: 43949 - DNA, 22 bp, Artificial Sequence
  chemically synthesized
agctggcctctggagtgaggtg

SEQ ID NO: 43950 - DNA, 22 bp, Artificial Sequence
  chemically synthesized
gcctctggagtgaggtgctggg

SEQ ID NO: 43951 - DNA, 22 bp, Artificial Sequence
  chemically synthesized
tggagtgaggtgctgggacaaa

SEQ ID NO: 43952 - DNA, 22 bp, Artificial Sequence
  chemically synthesized
gagtgaggtgctgggacaaaca

SEQ ID NO: 43953 - DNA, 22 bp, Artificial Sequence
  chemically synthesized
ggacaaacatcttccatgctgc

SEQ ID NO: 43954 - DNA, 22 bp, Artificial Sequence
  chemically synthesized
ccatgctgctcatgtcaactcc

SEQ ID NO: 43955 - DNA, 22 bp, Artificial Sequence
  chemically synthesized
catgctgctcatgtcaactcca

SEQ ID NO: 43956 - DNA, 22 bp, Artificial Sequence
  chemically synthesized
ctcatgtcaactccagatgcag

SEQ ID NO: 43957 - DNA, 22 bp, Artificial Sequence
  chemically synthesized
atgtcaactccagatgcagtca

SEQ ID NO: 43958 - DNA, 22 bp, Artificial Sequence
  chemically synthesized
cagatgcagtcaggtttctgaa

SEQ ID NO: 43959 - DNA, 22 bp, Artificial Sequence
  chemically synthesized
ctgaaccaaagtcaatgatcta

SEQ ID NO: 43960 - DNA, 22 bp, Artificial Sequence
  chemically synthesized
tgaaccaaagtcaatgatctaa

SEQ ID NO: 43961 - DNA, 22 bp, Artificial Sequence
  chemically synthesized
aaccaaagtcaatgatctaagt

SEQ ID NO: 43962 - DNA, 22 bp, Artificial Sequence
  chemically synthesized
agtgcagtcaaaggctctgggg

SEQ ID NO: 43963 - DNA, 22 bp, Artificial Sequence
  chemically synthesized
tgggggaagaaagagagagtgc

SEQ ID NO: 43964 - DNA, 22 bp, Artificial Sequence
  chemically synthesized
ggggaagaaagagagagtgcct

SEQ ID NO: 43965 - DNA, 22 bp, Artificial Sequence
  chemically synthesized
atctcttgcctgtgccatgctc

SEQ ID NO: 43966 - DNA, 22 bp, Artificial Sequence
  chemically synthesized
ttgcctgtgccatgctcgcaaa

SEQ ID NO: 43967 - DNA, 22 bp, Artificial Sequence
  chemically synthesized
gcctgtgccatgctcgcaaagc

SEQ ID NO: 43968 - DNA, 22 bp, Artificial Sequence
  chemically synthesized
cctgtgccatgctcgcaaagca

SEQ ID NO: 43969 - DNA, 22 bp, Artificial Sequence
  chemically synthesized
tgccatgctcgcaaagcaagga

SEQ ID NO: 43970 - DNA, 22 bp, Artificial Sequence
  chemically synthesized
gcaaagcaaggatttttgcaaa

SEQ ID NO: 43971 - DNA, 22 bp, Artificial Sequence
  chemically synthesized
ttgcaaaattctaatgaaagct

SEQ ID NO: 43972 - DNA, 22 bp, Artificial Sequence
  chemically synthesized
tgcaaaattctaatgaaagctg

SEQ ID NO: 43973 - DNA, 22 bp, Artificial Sequence
  chemically synthesized
gcaaaattctaatgaaagctgg

SEQ ID NO: 43974 - DNA, 22 bp, Artificial Sequence
  chemically synthesized
caaaattctaatgaaagctggg

SEQ ID NO: 43975 - DNA, 22 bp, Artificial Sequence
  chemically synthesized
taatgaaagctgggcttgcaaa

SEQ ID NO: 43976 - DNA, 22 bp, Artificial Sequence
  chemically synthesized
atgaaagctgggcttgcaaaat

SEQ ID NO: 43977 - DNA, 22 bp, Artificial Sequence
  chemically synthesized
ggcttgcaaaattagaaaactg

SEQ ID NO: 43978 - DNA, 22 bp, Artificial Sequence
  chemically synthesized
gcaaaattagaaaactggatta

SEQ ID NO: 43979 - DNA, 22 bp, Artificial Sequence
  chemically synthesized
caaaattagaaaactggattat

SEQ ID NO: 43980 - DNA, 22 bp, Artificial Sequence
  chemically synthesized
gaaaactggattatttgtgaga

SEQ ID NO: 43981 - DNA, 22 bp, Artificial Sequence
  chemically synthesized
gattatttgtgagaacactgaa

SEQ ID NO: 43982 - DNA, 22 bp, Artificial Sequence
  chemically synthesized
tttgtgagaacactgaaacatc

SEQ ID NO: 43983 - DNA, 22 bp, Artificial Sequence
  chemically synthesized
gtgagaacactgaaacatccct

SEQ ID NO: 43984 - DNA, 22 bp, Artificial Sequence
  chemically synthesized
tgagaacactgaaacatccctg

SEQ ID NO: 43985 - DNA, 22 bp, Artificial Sequence
  chemically synthesized
aaacatccctgggtgtgtccat

SEQ ID NO: 43986 - DNA, 22 bp, Artificial Sequence
  chemically synthesized
ggtgtgtccatctggaaaaaca

SEQ ID NO: 43987 - DNA, 22 bp, Artificial Sequence
  chemically synthesized
gaaaaacagcatttcctctggc

SEQ ID NO: 43988 - DNA, 22 bp, Artificial Sequence
  chemically synthesized
cctctggcaattttgcaaccgt

SEQ ID NO: 43989 - DNA, 22 bp, Artificial Sequence
  chemically synthesized
ctctggcaattttgcaaccgtt

SEQ ID NO: 43990 - DNA, 22 bp, Artificial Sequence
  chemically synthesized
tggcaattttgcaaccgttcta

SEQ ID NO: 43991 - DNA, 22 bp, Artificial Sequence
  chemically synthesized
gcaattttgcaaccgttctatt

SEQ ID NO: 43992 - DNA, 22 bp, Artificial Sequence
  chemically synthesized
tgcaaccgttctatttgaattt

SEQ ID NO: 43993 - DNA, 22 bp, Artificial Sequence
  chemically synthesized
gcaaccgttctatttgaatttg

SEQ ID NO: 43994 - DNA, 22 bp, Artificial Sequence
  chemically synthesized
caaccgttctatttgaatttgg

SEQ ID NO: 43995 - DNA, 22 bp, Artificial Sequence
  chemically synthesized
tatttgaatttggcaaagaaaa

SEQ ID NO: 43996 - DNA, 22 bp, Artificial Sequence
  chemically synthesized
tttgaatttggcaaagaaaata

SEQ ID NO: 43997 - DNA, 22 bp, Artificial Sequence
  chemically synthesized
gaatttggcaaagaaaataaag

SEQ ID NO: 43998 - DNA, 22 bp, Artificial Sequence
  chemically synthesized
aatttggcaaagaaaataaagc

SEQ ID NO: 43999 - DNA, 22 bp, Artificial Sequence
  chemically synthesized
ggcaaagaaaataaagcagttt

SEQ ID NO: 44000 - DNA, 22 bp, Artificial Sequence
  chemically synthesized
gcaaagaaaataaagcagtttt

SEQ ID NO: 44001 - DNA, 22 bp, Artificial Sequence
  chemically synthesized
ttcacaaaagaataaacacaac

SEQ ID NO: 44002 - DNA, 22 bp, Artificial Sequence
  chemically synthesized
tcacaaaagaataaacacaacc

SEQ ID NO: 44003 - DNA, 22 bp, Artificial Sequence
  chemically synthesized
cacaaaagaataaacacaacca

SEQ ID NO: 44004 - DNA, 22 bp, Artificial Sequence
  chemically synthesized
acaaaagaataaacacaaccag

SEQ ID NO: 44005 - DNA, 22 bp, Artificial Sequence
  chemically synthesized
cactctcccaaattgtcaaaga

SEQ ID NO: 44006 - DNA, 22 bp, Artificial Sequence
  chemically synthesized
actctcccaaattgtcaaagaa

SEQ ID NO: 44007 - DNA, 22 bp, Artificial Sequence
  chemically synthesized
tcccaaattgtcaaagaagtat

SEQ ID NO: 44008 - DNA, 22 bp, Artificial Sequence
  chemically synthesized
ccaaattgtcaaagaagtataa

SEQ ID NO: 44009 - DNA, 22 bp, Artificial Sequence
  chemically synthesized
tcaaagaagtataaattagaaa

SEQ ID NO: 44010 - DNA, 22 bp, Artificial Sequence
  chemically synthesized
gaaaatgaatcaggacaatttc

SEQ ID NO: 44011 - DNA, 22 bp, Artificial Sequence
  chemically synthesized
caacctgttagattagctaata

SEQ ID NO: 44012 - DNA, 22 bp, Artificial Sequence
  chemically synthesized
aacctgttagattagctaatat

SEQ ID NO: 44013 - DNA, 22 bp, Artificial Sequence
  chemically synthesized
ttagattagctaatatttaaaa

SEQ ID NO: 44014 - DNA, 22 bp, Artificial Sequence
  chemically synthesized
gattagctaatatttaaaaatt

SEQ ID NO: 44015 - DNA, 22 bp, Artificial Sequence
  chemically synthesized
gctaatatttaaaaattgaaca

SEQ ID NO: 44016 - DNA, 22 bp, Artificial Sequence
  chemically synthesized
atatttaaaaattgaacactca

SEQ ID NO: 44017 - DNA, 22 bp, Artificial Sequence
  chemically synthesized
aaaaattgaacactcatacaag

SEQ ID NO: 44018 - DNA, 22 bp, Artificial Sequence
  chemically synthesized
aaaattgaacactcatacaagt

SEQ ID NO: 44019 - DNA, 22 bp, Artificial Sequence
  chemically synthesized
aacactcatacaagtgtggtga

SEQ ID NO: 44020 - DNA, 22 bp, Artificial Sequence
  chemically synthesized
atacaagtgtggtgaagtgatt

SEQ ID NO: 44021 - DNA, 22 bp, Artificial Sequence
  chemically synthesized
ttttctagtgacattttacact

SEQ ID NO: 44022 - DNA, 22 bp, Artificial Sequence
  chemically synthesized
tctagtgacattttacactgtc

SEQ ID NO: 44023 - DNA, 22 bp, Artificial Sequence
  chemically synthesized
ctagtgacattttacactgtca

SEQ ID NO: 44024 - DNA, 22 bp, Artificial Sequence
  chemically synthesized
tagtgacattttacactgtcat

SEQ ID NO: 44025 - DNA, 22 bp, Artificial Sequence
  chemically synthesized
gtgacattttacactgtcataa

SEQ ID NO: 44026 - DNA, 22 bp, Artificial Sequence
  chemically synthesized
tacactgtcataaccttctaga

SEQ ID NO: 44027 - DNA, 22 bp, Artificial Sequence
  chemically synthesized
acactgtcataaccttctagaa

SEQ ID NO: 44028 - DNA, 22 bp, Artificial Sequence
  chemically synthesized
cactgtcataaccttctagaaa

SEQ ID NO: 44029 - DNA, 22 bp, Artificial Sequence
  chemically synthesized
tcataaccttctagaaaataaa

SEQ ID NO: 44030 - DNA, 22 bp, Artificial Sequence
  chemically synthesized
ctagaaaataaattggcagtgt

SEQ ID NO: 44031 - DNA, 22 bp, Artificial Sequence
  chemically synthesized
tagaaaataaattggcagtgtt

SEQ ID NO: 44032 - DNA, 22 bp, Artificial Sequence
  chemically synthesized
gaaaataaattggcagtgttat

SEQ ID NO: 44033 - DNA, 22 bp, Artificial Sequence
  chemically synthesized
gcagtgttattgggagacagaa

SEQ ID NO: 44034 - DNA, 22 bp, Artificial Sequence
  chemically synthesized
ttgggagacagaaatatgtcta

SEQ ID NO: 44035 - DNA, 22 bp, Artificial Sequence
  chemically synthesized
ggagacagaaatatgtctatat

SEQ ID NO: 44036 - DNA, 22 bp, Artificial Sequence
  chemically synthesized
tataatttatgggaacttaggc

SEQ ID NO: 44037 - DNA, 22 bp, Artificial Sequence
  chemically synthesized
atgggaacttaggctcagaaaa

SEQ ID NO: 44038 - DNA, 22 bp, Artificial Sequence
  chemically synthesized
tgggaacttaggctcagaaaat

SEQ ID NO: 44039 - DNA, 22 bp, Artificial Sequence
  chemically synthesized
aggctcagaaaatattaaggaa

SEQ ID NO: 44040 - DNA, 22 bp, Artificial Sequence
  chemically synthesized
ggctcagaaaatattaaggaat

SEQ ID NO: 44041 - DNA, 22 bp, Artificial Sequence
  chemically synthesized
agaaaatattaaggaataagaa

SEQ ID NO: 44042 - DNA, 22 bp, Artificial Sequence
  chemically synthesized
aggaataagaatgaactttatg

SEQ ID NO: 44043 - DNA, 22 bp, Artificial Sequence
  chemically synthesized
tatgaacaaagatgtggagggt

SEQ ID NO: 44044 - DNA, 22 bp, Artificial Sequence
  chemically synthesized
atgaacaaagatgtggagggtt

SEQ ID NO: 44045 - DNA, 22 bp, Artificial Sequence
  chemically synthesized
tgaacaaagatgtggagggttg

SEQ ID NO: 44046 - DNA, 22 bp, Artificial Sequence
  chemically synthesized
gaagcaagaggggggccaacgc

SEQ ID NO: 44047 - DNA, 22 bp, Artificial Sequence
  chemically synthesized
gggcagtgactccgcagaccca

SEQ ID NO: 44048 - DNA, 22 bp, Artificial Sequence
  chemically synthesized
ggcagtgactccgcagacccag

SEQ ID NO: 44049 - DNA, 22 bp, Artificial Sequence
  chemically synthesized
cgcagacccaggctcaggttga

SEQ ID NO: 44050 - DNA, 22 bp, Artificial Sequence
  chemically synthesized
aggttgaactagacaacctcct

SEQ ID NO: 44051 - DNA, 22 bp, Artificial Sequence
  chemically synthesized
aactagacaacctccttacacc

SEQ ID NO: 44052 - DNA, 22 bp, Artificial Sequence
  chemically synthesized
gacaacctccttacacctcagt

SEQ ID NO: 44053 - DNA, 22 bp, Artificial Sequence
  chemically synthesized
cttacacctcagtttccttaac

SEQ ID NO: 44054 - DNA, 22 bp, Artificial Sequence
  chemically synthesized
acacctcagtttccttaactgt

SEQ ID NO: 44055 - DNA, 22 bp, Artificial Sequence
  chemically synthesized
cacctcagtttccttaactgta

SEQ ID NO: 44056 - DNA, 22 bp, Artificial Sequence
  chemically synthesized
agtttccttaactgtagagcag

SEQ ID NO: 44057 - DNA, 22 bp, Artificial Sequence
  chemically synthesized
ccttaactgtagagcaggagtg

SEQ ID NO: 44058 - DNA, 22 bp, Artificial Sequence
  chemically synthesized
cttaactgtagagcaggagtga

SEQ ID NO: 44059 - DNA, 22 bp, Artificial Sequence
  chemically synthesized
aactgtagagcaggagtgatgg

SEQ ID NO: 44060 - DNA, 22 bp, Artificial Sequence
  chemically synthesized
actgtagagcaggagtgatgga

SEQ ID NO: 44061 - DNA, 22 bp, Artificial Sequence
  chemically synthesized
tagagcaggagtgatggaactg

SEQ ID NO: 44062 - DNA, 22 bp, Artificial Sequence
  chemically synthesized
cctgtttcataggactgttgtg

SEQ ID NO: 44063 - DNA, 22 bp, Artificial Sequence
  chemically synthesized
tttcataggactgttgtgagga

SEQ ID NO: 44064 - DNA, 22 bp, Artificial Sequence
  chemically synthesized
cataggactgttgtgaggatga

SEQ ID NO: 44065 - DNA, 22 bp, Artificial Sequence
  chemically synthesized
ataggactgttgtgaggatgaa

SEQ ID NO: 44066 - DNA, 22 bp, Artificial Sequence
  chemically synthesized
ttgtgaggatgaagtgagatac

SEQ ID NO: 44067 - DNA, 22 bp, Artificial Sequence
  chemically synthesized
tgaggatgaagtgagatacacc

SEQ ID NO: 44068 - DNA, 22 bp, Artificial Sequence
  chemically synthesized
taagcttgtgcctggaaaggat

SEQ ID NO: 44069 - DNA, 22 bp, Artificial Sequence
  chemically synthesized
gtgcctggaaaggataatgctt

SEQ ID NO: 44070 - DNA, 22 bp, Artificial Sequence
  chemically synthesized
tgcctggaaaggataatgctta

SEQ ID NO: 44071 - DNA, 22 bp, Artificial Sequence
  chemically synthesized
gaaaggataatgcttagtaaat

SEQ ID NO: 44072 - DNA, 22 bp, Artificial Sequence
  chemically synthesized
agtaaatgatgactattctttt

SEQ ID NO: 44073 - DNA, 22 bp, Artificial Sequence
  chemically synthesized
gtaaatgatgactattcttttt

SEQ ID NO: 44074 - DNA, 22 bp, Artificial Sequence
  chemically synthesized
ttcttttttattgcaataaaat

SEQ ID NO: 44075 - DNA, 22 bp, Artificial Sequence
  chemically synthesized
ttttttattgcaataaaatgta

SEQ ID NO: 44076 - DNA, 22 bp, Artificial Sequence
  chemically synthesized
ttttattgcaataaaatgtaca

SEQ ID NO: 44077 - DNA, 22 bp, Artificial Sequence
  chemically synthesized
tttattgcaataaaatgtacac

SEQ ID NO: 44078 - DNA, 22 bp, Artificial Sequence
  chemically synthesized
ttattgcaataaaatgtacaca

SEQ ID NO: 44079 - DNA, 22 bp, Artificial Sequence
  chemically synthesized
tattgcaataaaatgtacacag

SEQ ID NO: 44080 - DNA, 22 bp, Artificial Sequence
  chemically synthesized
attgcaataaaatgtacacagc

SEQ ID NO: 44081 - DNA, 22 bp, Artificial Sequence
  chemically synthesized
ttgcaataaaatgtacacagcg

SEQ ID NO: 44082 - DNA, 22 bp, Artificial Sequence
  chemically synthesized
caataaaatgtacacagcgtaa

SEQ ID NO: 44083 - DNA, 22 bp, Artificial Sequence
  chemically synthesized
ctattttaaccatttttgcagg

SEQ ID NO: 44084 - DNA, 22 bp, Artificial Sequence
  chemically synthesized
ttttaaccatttttgcagggta

SEQ ID NO: 44085 - DNA, 22 bp, Artificial Sequence
  chemically synthesized
taaccatttttgcagggtacca

SEQ ID NO: 44086 - DNA, 22 bp, Artificial Sequence
  chemically synthesized
aaccatttttgcagggtaccac

SEQ ID NO: 44087 - DNA, 22 bp, Artificial Sequence
  chemically synthesized
accatttttgcagggtaccacc

SEQ ID NO: 44088 - DNA, 22 bp, Artificial Sequence
  chemically synthesized
ttgcagggtaccaccaagtggc

SEQ ID NO: 44089 - DNA, 22 bp, Artificial Sequence
  chemically synthesized
tgcagggtaccaccaagtggca

SEQ ID NO: 44090 - DNA, 22 bp, Artificial Sequence
  chemically synthesized
gcagggtaccaccaagtggcat

SEQ ID NO: 44091 - DNA, 22 bp, Artificial Sequence
  chemically synthesized
cagggtaccaccaagtggcatt

SEQ ID NO: 44092 - DNA, 22 bp, Artificial Sequence
  chemically synthesized
agtacattcacagtggtgtgca

SEQ ID NO: 44093 - DNA, 22 bp, Artificial Sequence
  chemically synthesized
gtacattcacagtggtgtgcaa

SEQ ID NO: 44094 - DNA, 22 bp, Artificial Sequence
  chemically synthesized
acagtggtgtgcaaccatcatc

SEQ ID NO: 44095 - DNA, 22 bp, Artificial Sequence
  chemically synthesized
ccagaatattttcctcatcccc

SEQ ID NO: 44096 - DNA, 22 bp, Artificial Sequence
  chemically synthesized
cagaatattttcctcatcccca

SEQ ID NO: 44097 - DNA, 22 bp, Artificial Sequence
  chemically synthesized
tcctcatccccaaaggaaacct

SEQ ID NO: 44098 - DNA, 22 bp, Artificial Sequence
  chemically synthesized
cctcatccccaaaggaaacctc

SEQ ID NO: 44099 - DNA, 22 bp, Artificial Sequence
  chemically synthesized
ctcatccccaaaggaaacctca

SEQ ID NO: 44100 - DNA, 22 bp, Artificial Sequence
  chemically synthesized
atccccaaaggaaacctcatgc

SEQ ID NO: 44101 - DNA, 22 bp, Artificial Sequence
  chemically synthesized
atgctcattaatcagtagctct

SEQ ID NO: 44102 - DNA, 22 bp, Artificial Sequence
  chemically synthesized
attaatcagtagctctccttta

SEQ ID NO: 44103 - DNA, 22 bp, Artificial Sequence
  chemically synthesized
atcagtagctctcctttaaaat

SEQ ID NO: 44104 - DNA, 22 bp, Artificial Sequence
  chemically synthesized
tcctttaaaatattagttatga

SEQ ID NO: 44105 - DNA, 22 bp, Artificial Sequence
  chemically synthesized
ctttaaaatattagttatgaag

SEQ ID NO: 44106 - DNA, 22 bp, Artificial Sequence
  chemically synthesized
taaaatattagttatgaagatc

SEQ ID NO: 44107 - DNA, 22 bp, Artificial Sequence
  chemically synthesized
aaaatattagttatgaagatca

SEQ ID NO: 44108 - DNA, 22 bp, Artificial Sequence
  chemically synthesized
aaatattagttatgaagatcat

SEQ ID NO: 44109 - DNA, 22 bp, Artificial Sequence
  chemically synthesized
gttatgaagatcatagcactat

SEQ ID NO: 44110 - DNA, 22 bp, Artificial Sequence
  chemically synthesized
tgaagatcatagcactatacaa

SEQ ID NO: 44111 - DNA, 22 bp, Artificial Sequence
  chemically synthesized
tacaaaactcattatgtaatgt

SEQ ID NO: 44112 - DNA, 22 bp, Artificial Sequence
  chemically synthesized
attatgtaatgttgagtgaaaa

SEQ ID NO: 44113 - DNA, 22 bp, Artificial Sequence
  chemically synthesized
tgtaatgttgagtgaaaaaatc

SEQ ID NO: 44114 - DNA, 22 bp, Artificial Sequence
  chemically synthesized
agtgaaaaaatcagggtgtgaa

SEQ ID NO: 44115 - DNA, 22 bp, Artificial Sequence
  chemically synthesized
tgtgatatgatgtaattagtga

SEQ ID NO: 44116 - DNA, 22 bp, Artificial Sequence
  chemically synthesized
gtgatatgatgtaattagtgaa

SEQ ID NO: 44117 - DNA, 22 bp, Artificial Sequence
  chemically synthesized
tgatatgatgtaattagtgaaa

SEQ ID NO: 44118 - DNA, 22 bp, Artificial Sequence
  chemically synthesized
gtgaaagaagcatacaaaaagt

SEQ ID NO: 44119 - DNA, 22 bp, Artificial Sequence
  chemically synthesized
aaaatataaaaacaatagcaat

SEQ ID NO: 44120 - DNA, 22 bp, Artificial Sequence
  chemically synthesized
catttctcagactctacattta

SEQ ID NO: 44121 - DNA, 22 bp, Artificial Sequence
  chemically synthesized
ctcagactctacatttaaacat

SEQ ID NO: 44122 - DNA, 22 bp, Artificial Sequence
  chemically synthesized
tcagactctacatttaaacatt

SEQ ID NO: 44123 - DNA, 22 bp, Artificial Sequence
  chemically synthesized
agactctacatttaaacattat

SEQ ID NO: 44124 - DNA, 22 bp, Artificial Sequence
  chemically synthesized
tacatttaaacattattcttta

SEQ ID NO: 44125 - DNA, 22 bp, Artificial Sequence
  chemically synthesized
catttaaacattattctttatg

SEQ ID NO: 44126 - DNA, 22 bp, Artificial Sequence
  chemically synthesized
aaacattattctttatggtttt

SEQ ID NO: 44127 - DNA, 22 bp, Artificial Sequence
  chemically synthesized
aacattattctttatggtttta

SEQ ID NO: 44128 - DNA, 22 bp, Artificial Sequence
  chemically synthesized
ttctttatggttttaaaagcaa

SEQ ID NO: 44129 - DNA, 22 bp, Artificial Sequence
  chemically synthesized
tttatggttttaaaagcaaaga

SEQ ID NO: 44130 - DNA, 22 bp, Artificial Sequence
  chemically synthesized
tatggttttaaaagcaaagaaa

SEQ ID NO: 44131 - DNA, 22 bp, Artificial Sequence
  chemically synthesized
atggttttaaaagcaaagaaaa

SEQ ID NO: 44132 - DNA, 22 bp, Artificial Sequence
  chemically synthesized
tggttttaaaagcaaagaaaaa

SEQ ID NO: 44133 - DNA, 22 bp, Artificial Sequence
  chemically synthesized
taaaagcaaagaaaaaggtaaa

SEQ ID NO: 44134 - DNA, 22 bp, Artificial Sequence
  chemically synthesized
aaaagcaaagaaaaaggtaaag

SEQ ID NO: 44135 - DNA, 22 bp, Artificial Sequence
  chemically synthesized
aaagcaaagaaaaaggtaaaga

SEQ ID NO: 44136 - DNA, 22 bp, Artificial Sequence
  chemically synthesized
agattgttaaatccaggttttt

SEQ ID NO: 44137 - DNA, 22 bp, Artificial Sequence
  chemically synthesized
ttaaatccaggtttttggaaca

SEQ ID NO: 44138 - DNA, 22 bp, Artificial Sequence
  chemically synthesized
aatccaggtttttggaacatag

SEQ ID NO: 44139 - DNA, 22 bp, Artificial Sequence
  chemically synthesized
ttggaacatagactcttatatg

SEQ ID NO: 44140 - DNA, 22 bp, Artificial Sequence
  chemically synthesized
tggaacatagactcttatatga

SEQ ID NO: 44141 - DNA, 22 bp, Artificial Sequence
  chemically synthesized
ggaacatagactcttatatgac

SEQ ID NO: 44142 - DNA, 22 bp, Artificial Sequence
  chemically synthesized
gaacatagactcttatatgacg

SEQ ID NO: 44143 - DNA, 22 bp, Artificial Sequence
  chemically synthesized
ttatatgacgtttacactctcc

SEQ ID NO: 44144 - DNA, 22 bp, Artificial Sequence
  chemically synthesized
atatgacgtttacactctccag

SEQ ID NO: 44145 - DNA, 22 bp, Artificial Sequence
  chemically synthesized
tatgacgtttacactctccagg

SEQ ID NO: 44146 - DNA, 22 bp, Artificial Sequence
  chemically synthesized
acactctccagggttcagagag

SEQ ID NO: 44147 - DNA, 22 bp, Artificial Sequence
  chemically synthesized
cactctccagggttcagagagt

SEQ ID NO: 44148 - DNA, 22 bp, Artificial Sequence
  chemically synthesized
tccagggttcagagagtctggc

SEQ ID NO: 44149 - DNA, 22 bp, Artificial Sequence
  chemically synthesized
cagggttcagagagtctggcag

SEQ ID NO: 44150 - DNA, 22 bp, Artificial Sequence
  chemically synthesized
agagagtctggcagcattggga

SEQ ID NO: 44151 - DNA, 22 bp, Artificial Sequence
  chemically synthesized
gcagcattgggagctgccttgt

SEQ ID NO: 44152 - DNA, 22 bp, Artificial Sequence
  chemically synthesized
ggagctgccttgtgttctacag

SEQ ID NO: 44153 - DNA, 22 bp, Artificial Sequence
  chemically synthesized
ccttgtgttctacagcctcacg

SEQ ID NO: 44154 - DNA, 22 bp, Artificial Sequence
  chemically synthesized
gtgttctacagcctcacggaca

SEQ ID NO: 44155 - DNA, 22 bp, Artificial Sequence
  chemically synthesized
tgttctacagcctcacggacag

SEQ ID NO: 44156 - DNA, 22 bp, Artificial Sequence
  chemically synthesized
tacagcctcacggacagacagg

SEQ ID NO: 44157 - DNA, 22 bp, Artificial Sequence
  chemically synthesized
cagcctcacggacagacaggag

SEQ ID NO: 44158 - DNA, 22 bp, Artificial Sequence
  chemically synthesized
acggacagacaggaggtccatc

SEQ ID NO: 44159 - DNA, 22 bp, Artificial Sequence
  chemically synthesized
ctctgttcttctggagtttcct

SEQ ID NO: 44160 - DNA, 22 bp, Artificial Sequence
  chemically synthesized
tgttcttctggagtttccttgt

SEQ ID NO: 44161 - DNA, 22 bp, Artificial Sequence
  chemically synthesized
ttcttctggagtttccttgtga

SEQ ID NO: 44162 - DNA, 22 bp, Artificial Sequence
  chemically synthesized
ttctggagtttccttgtgaaca

SEQ ID NO: 44163 - DNA, 22 bp, Artificial Sequence
  chemically synthesized
ctggagtttccttgtgaacatg

SEQ ID NO: 44164 - DNA, 22 bp, Artificial Sequence
  chemically synthesized
tggagtttccttgtgaacatgt

SEQ ID NO: 44165 - DNA, 22 bp, Artificial Sequence
  chemically synthesized
gagtttccttgtgaacatgttg

SEQ ID NO: 44166 - DNA, 22 bp, Artificial Sequence
  chemically synthesized
ccttgtgaacatgttgtggacg

SEQ ID NO: 44167 - DNA, 22 bp, Artificial Sequence
  chemically synthesized
cttgtgaacatgttgtggacgt

SEQ ID NO: 44168 - DNA, 22 bp, Artificial Sequence
  chemically synthesized
gtgaacatgttgtggacgtagt

SEQ ID NO: 44169 - DNA, 22 bp, Artificial Sequence
  chemically synthesized
tgaacatgttgtggacgtagtt

SEQ ID NO: 44170 - DNA, 22 bp, Artificial Sequence
  chemically synthesized
tggacgtagttaccatttcttt

SEQ ID NO: 44171 - DNA, 22 bp, Artificial Sequence
  chemically synthesized
ccatttctttcatctttttaaa

SEQ ID NO: 44172 - DNA, 22 bp, Artificial Sequence
  chemically synthesized
ctttcatctttttaaacacagg

SEQ ID NO: 44173 - DNA, 22 bp, Artificial Sequence
  chemically synthesized
tttcatctttttaaacacaggt

SEQ ID NO: 44174 - DNA, 22 bp, Artificial Sequence
  chemically synthesized
tcatctttttaaacacaggtac

SEQ ID NO: 44175 - DNA, 22 bp, Artificial Sequence
  chemically synthesized
catctttttaaacacaggtacc

SEQ ID NO: 44176 - DNA, 22 bp, Artificial Sequence
  chemically synthesized
atctttttaaacacaggtacct

SEQ ID NO: 44177 - DNA, 22 bp, Artificial Sequence
  chemically synthesized
tttaaacacaggtacctttggg

SEQ ID NO: 44178 - DNA, 22 bp, Artificial Sequence
  chemically synthesized
ttaaacacaggtacctttgggg

SEQ ID NO: 44179 - DNA, 22 bp, Artificial Sequence
  chemically synthesized
taaacacaggtacctttggggc

SEQ ID NO: 44180 - DNA, 22 bp, Artificial Sequence
  chemically synthesized
aaacacaggtacctttggggct

SEQ ID NO: 44181 - DNA, 22 bp, Artificial Sequence
  chemically synthesized
aacacaggtacctttggggctg

SEQ ID NO: 44182 - DNA, 22 bp, Artificial Sequence
  chemically synthesized
tggggctggctttctcaaggaa

SEQ ID NO: 44183 - DNA, 22 bp, Artificial Sequence
  chemically synthesized
ggggctggctttctcaaggaag

SEQ ID NO: 44184 - DNA, 22 bp, Artificial Sequence
  chemically synthesized
gggctggctttctcaaggaagc

SEQ ID NO: 44185 - DNA, 22 bp, Artificial Sequence
  chemically synthesized
gctttctcaaggaagcccagct

SEQ ID NO: 44186 - DNA, 22 bp, Artificial Sequence
  chemically synthesized
tctcaaggaagcccagctccct

SEQ ID NO: 44187 - DNA, 22 bp, Artificial Sequence
  chemically synthesized
ctcaaggaagcccagctccctg

SEQ ID NO: 44188 - DNA, 22 bp, Artificial Sequence
  chemically synthesized
tcaaggaagcccagctccctgt

SEQ ID NO: 44189 - DNA, 22 bp, Artificial Sequence
  chemically synthesized
aaggaagcccagctccctgtga

SEQ ID NO: 44190 - DNA, 22 bp, Artificial Sequence
  chemically synthesized
cctgtgattgagaatgaagtgt

SEQ ID NO: 44191 - DNA, 22 bp, Artificial Sequence
  chemically synthesized
tgattgagaatgaagtgtgcaa

SEQ ID NO: 44192 - DNA, 22 bp, Artificial Sequence
  chemically synthesized
agaatgaagtgtgcaatcgcta

SEQ ID NO: 44193 - DNA, 22 bp, Artificial Sequence
  chemically synthesized
tgagtttctgaatggaagagtc

SEQ ID NO: 44194 - DNA, 22 bp, Artificial Sequence
  chemically synthesized
ctgaatggaagagtcaaatcca

SEQ ID NO: 44195 - DNA, 22 bp, Artificial Sequence
  chemically synthesized
tgaatggaagagtcaaatccac

SEQ ID NO: 44196 - DNA, 22 bp, Artificial Sequence
  chemically synthesized
aatggaagagtcaaatccactg

SEQ ID NO: 44197 - DNA, 22 bp, Artificial Sequence
  chemically synthesized
agctctgtgctgggcatttggc

SEQ ID NO: 44198 - DNA, 22 bp, Artificial Sequence
  chemically synthesized
tgtgctgggcatttggctggag

SEQ ID NO: 44199 - DNA, 22 bp, Artificial Sequence
  chemically synthesized
tgctgggcatttggctggaggc

SEQ ID NO: 44200 - DNA, 22 bp, Artificial Sequence
  chemically synthesized
ggcatttggctggaggcattga

SEQ ID NO: 44201 - DNA, 22 bp, Artificial Sequence
  chemically synthesized
ggctggaggcattgacagttgc

SEQ ID NO: 44202 - DNA, 22 bp, Artificial Sequence
  chemically synthesized
gctggaggcattgacagttgca

SEQ ID NO: 44203 - DNA, 22 bp, Artificial Sequence
  chemically synthesized
gaggcattgacagttgcaaggt

SEQ ID NO: 44204 - DNA, 22 bp, Artificial Sequence
  chemically synthesized
acagttgcaaggtaagaaaaga

SEQ ID NO: 44205 - DNA, 22 bp, Artificial Sequence
  chemically synthesized
caaggtaagaaaagatcaagag

SEQ ID NO: 44206 - DNA, 22 bp, Artificial Sequence
  chemically synthesized
gtcttgtgctctcctgtctcag

SEQ ID NO: 44207 - DNA, 22 bp, Artificial Sequence
  chemically synthesized
gtgctctcctgtctcagtctca

SEQ ID NO: 44208 - DNA, 22 bp, Artificial Sequence
  chemically synthesized
tgctctcctgtctcagtctcag

SEQ ID NO: 44209 - DNA, 22 bp, Artificial Sequence
  chemically synthesized
tcctgtctcagtctcagtccct

SEQ ID NO: 44210 - DNA, 22 bp, Artificial Sequence
  chemically synthesized
ctgtctcagtctcagtccctta

SEQ ID NO: 44211 - DNA, 22 bp, Artificial Sequence
  chemically synthesized
tctcagtctcagtcccttagac

SEQ ID NO: 44212 - DNA, 22 bp, Artificial Sequence
  chemically synthesized
agtctcagtcccttagacttga

SEQ ID NO: 44213 - DNA, 22 bp, Artificial Sequence
  chemically synthesized
agtcccttagacttgagtccca

SEQ ID NO: 44214 - DNA, 22 bp, Artificial Sequence
  chemically synthesized
agacttgagtcccaaagtagcg

SEQ ID NO: 44215 - DNA, 22 bp, Artificial Sequence
  chemically synthesized
gacttgagtcccaaagtagcga

SEQ ID NO: 44216 - DNA, 22 bp, Artificial Sequence
  chemically synthesized
gagtcccaaagtagcgaattca

SEQ ID NO: 44217 - DNA, 22 bp, Artificial Sequence
  chemically synthesized
agtcccaaagtagcgaattcaa

SEQ ID NO: 44218 - DNA, 22 bp, Artificial Sequence
  chemically synthesized
aagtaggatttaatcaatggaa

SEQ ID NO: 44219 - DNA, 22 bp, Artificial Sequence
  chemically synthesized
aatcaatggaagaccccagtct

SEQ ID NO: 44220 - DNA, 22 bp, Artificial Sequence
  chemically synthesized
atcaatggaagaccccagtcta

SEQ ID NO: 44221 - DNA, 22 bp, Artificial Sequence
  chemically synthesized
agtgttgctcagaaactcccta

SEQ ID NO: 44222 - DNA, 22 bp, Artificial Sequence
  chemically synthesized
ctcagaaactccctagatctgt

SEQ ID NO: 44223 - DNA, 22 bp, Artificial Sequence
  chemically synthesized
agaaactccctagatctgtccc

SEQ ID NO: 44224 - DNA, 22 bp, Artificial Sequence
  chemically synthesized
cctagatctgtcccaaatgtat

SEQ ID NO: 44225 - DNA, 22 bp, Artificial Sequence
  chemically synthesized
gatctgtcccaaatgtatattc

SEQ ID NO: 44226 - DNA, 22 bp, Artificial Sequence
  chemically synthesized
tcccaaatgtatattcagatca

SEQ ID NO: 44227 - DNA, 22 bp, Artificial Sequence
  chemically synthesized
agatcatccaaggggacttctt

SEQ ID NO: 44228 - DNA, 22 bp, Artificial Sequence
  chemically synthesized
cttggggcttgagttccagatc

SEQ ID NO: 44229 - DNA, 22 bp, Artificial Sequence
  chemically synthesized
ttggggcttgagttccagatca

SEQ ID NO: 44230 - DNA, 22 bp, Artificial Sequence
  chemically synthesized
ggggcttgagttccagatcagc

SEQ ID NO: 44231 - DNA, 22 bp, Artificial Sequence
  chemically synthesized
gggcttgagttccagatcagca

SEQ ID NO: 44232 - DNA, 22 bp, Artificial Sequence
  chemically synthesized
gagttccagatcagcagcaagg

SEQ ID NO: 44233 - DNA, 22 bp, Artificial Sequence
  chemically synthesized
agttccagatcagcagcaaggg

SEQ ID NO: 44234 - DNA, 22 bp, Artificial Sequence
  chemically synthesized
cagatcagcagcaagggagcca

SEQ ID NO: 44235 - DNA, 22 bp, Artificial Sequence
  chemically synthesized
cctcagaccactcaccctcctg

SEQ ID NO: 44236 - DNA, 22 bp, Artificial Sequence
  chemically synthesized
agaccactcaccctcctggggt

SEQ ID NO: 44237 - DNA, 22 bp, Artificial Sequence
  chemically synthesized
accctcctggggtgtcccggtg

SEQ ID NO: 44238 - DNA, 22 bp, Artificial Sequence
  chemically synthesized
ctggggtgtcccggtggccagg

SEQ ID NO: 44239 - DNA, 22 bp, Artificial Sequence
  chemically synthesized
gggtgtcccggtggccagggac

SEQ ID NO: 44240 - DNA, 22 bp, Artificial Sequence
  chemically synthesized
aagtggtgatttttctggtagg

SEQ ID NO: 44241 - DNA, 22 bp, Artificial Sequence
  chemically synthesized
ttctggtagggaaggaggtaga

SEQ ID NO: 44242 - DNA, 22 bp, Artificial Sequence
  chemically synthesized
tctggtagggaaggaggtagag

SEQ ID NO: 44243 - DNA, 22 bp, Artificial Sequence
  chemically synthesized
ctggtagggaaggaggtagagg

SEQ ID NO: 44244 - DNA, 22 bp, Artificial Sequence
  chemically synthesized
tggtagggaaggaggtagaggg

SEQ ID NO: 44245 - DNA, 22 bp, Artificial Sequence
  chemically synthesized
gtagggaaggaggtagagggta

SEQ ID NO: 44246 - DNA, 22 bp, Artificial Sequence
  chemically synthesized
actgcacacaatatctgagact

SEQ ID NO: 44247 - DNA, 22 bp, Artificial Sequence
  chemically synthesized
cacacaatatctgagactggag

SEQ ID NO: 44248 - DNA, 22 bp, Artificial Sequence
  chemically synthesized
agactggagctcagatattgct

SEQ ID NO: 44249 - DNA, 22 bp, Artificial Sequence
  chemically synthesized
gagctcagatattgctgatgat

SEQ ID NO: 44250 - DNA, 22 bp, Artificial Sequence
  chemically synthesized
agatattgctgatgatcagagt

SEQ ID NO: 44251 - DNA, 22 bp, Artificial Sequence
  chemically synthesized
ctgatgatcagagttggcgtgt

SEQ ID NO: 44252 - DNA, 22 bp, Artificial Sequence
  chemically synthesized
atgatcagagttggcgtgtctc

SEQ ID NO: 44253 - DNA, 22 bp, Artificial Sequence
  chemically synthesized
gcgtgtctccccaattgattta

SEQ ID NO: 44254 - DNA, 22 bp, Artificial Sequence
  chemically synthesized
cccaattgatttacaactgggg

SEQ ID NO: 44255 - DNA, 22 bp, Artificial Sequence
  chemically synthesized
atttacaactggggcttggata

SEQ ID NO: 44256 - DNA, 22 bp, Artificial Sequence
  chemically synthesized
acaactggggcttggatactgt

SEQ ID NO: 44257 - DNA, 22 bp, Artificial Sequence
  chemically synthesized
caactggggcttggatactgtt

SEQ ID NO: 44258 - DNA, 22 bp, Artificial Sequence
  chemically synthesized
gggcttggatactgttttaaac

SEQ ID NO: 44259 - DNA, 22 bp, Artificial Sequence
  chemically synthesized
ggatactgttttaaacgggagg

SEQ ID NO: 44260 - DNA, 22 bp, Artificial Sequence
  chemically synthesized
gatactgttttaaacgggagga

SEQ ID NO: 44261 - DNA, 22 bp, Artificial Sequence
  chemically synthesized
ttttaaacgggaggagcctcct

SEQ ID NO: 44262 - DNA, 22 bp, Artificial Sequence
  chemically synthesized
taaacgggaggagcctcctaac

SEQ ID NO: 44263 - DNA, 22 bp, Artificial Sequence
  chemically synthesized
aaacgggaggagcctcctaacc

SEQ ID NO: 44264 - DNA, 22 bp, Artificial Sequence
  chemically synthesized
aacgggaggagcctcctaacca

SEQ ID NO: 44265 - DNA, 22 bp, Artificial Sequence
  chemically synthesized
ctaaccatcttgacacaaccac

SEQ ID NO: 44266 - DNA, 22 bp, Artificial Sequence
  chemically synthesized
accatcttgacacaaccactga

SEQ ID NO: 44267 - DNA, 22 bp, Artificial Sequence
  chemically synthesized
gacacaaccactgacgtgacta

SEQ ID NO: 44268 - DNA, 22 bp, Artificial Sequence
  chemically synthesized
acacaaccactgacgtgactac

SEQ ID NO: 44269 - DNA, 22 bp, Artificial Sequence
  chemically synthesized
acgtgactacactagagataga

SEQ ID NO: 44270 - DNA, 22 bp, Artificial Sequence
  chemically synthesized
cactagagatagactctttcca

SEQ ID NO: 44271 - DNA, 22 bp, Artificial Sequence
  chemically synthesized
gagatagactctttccacttaa

SEQ ID NO: 44272 - DNA, 22 bp, Artificial Sequence
  chemically synthesized
tttccacttaattctaccactc

SEQ ID NO: 44273 - DNA, 22 bp, Artificial Sequence
  chemically synthesized
tccacttaattctaccactctt

SEQ ID NO: 44274 - DNA, 22 bp, Artificial Sequence
  chemically synthesized
ccacttaattctaccactcttg

SEQ ID NO: 44275 - DNA, 22 bp, Artificial Sequence
  chemically synthesized
cacttaattctaccactcttgc

SEQ ID NO: 44276 - DNA, 22 bp, Artificial Sequence
  chemically synthesized
aattctaccactcttgctttac

SEQ ID NO: 44277 - DNA, 22 bp, Artificial Sequence
  chemically synthesized
attctaccactcttgctttact

SEQ ID NO: 44278 - DNA, 22 bp, Artificial Sequence
  chemically synthesized
taccactcttgctttacttcat

SEQ ID NO: 44279 - DNA, 22 bp, Artificial Sequence
  chemically synthesized
ccactcttgctttacttcatga

SEQ ID NO: 44280 - DNA, 22 bp, Artificial Sequence
  chemically synthesized
ttgctttacttcatgagaacga

SEQ ID NO: 44281 - DNA, 22 bp, Artificial Sequence
  chemically synthesized
gctttacttcatgagaacgaaa

SEQ ID NO: 44282 - DNA, 22 bp, Artificial Sequence
  chemically synthesized
ctttacttcatgagaacgaaaa

SEQ ID NO: 44283 - DNA, 22 bp, Artificial Sequence
  chemically synthesized
tacttcatgagaacgaaaatgt

SEQ ID NO: 44284 - DNA, 22 bp, Artificial Sequence
  chemically synthesized
acttcatgagaacgaaaatgta

SEQ ID NO: 44285 - DNA, 22 bp, Artificial Sequence
  chemically synthesized
cttcatgagaacgaaaatgtaa

SEQ ID NO: 44286 - DNA, 22 bp, Artificial Sequence
  chemically synthesized
catgagaacgaaaatgtaagat

SEQ ID NO: 44287 - DNA, 22 bp, Artificial Sequence
  chemically synthesized
atgagaacgaaaatgtaagatt

SEQ ID NO: 44288 - DNA, 22 bp, Artificial Sequence
  chemically synthesized
caccatgaattcatttgcggaa

SEQ ID NO: 44289 - DNA, 22 bp, Artificial Sequence
  chemically synthesized
atttgcggaaagattgatacta

SEQ ID NO: 44290 - DNA, 22 bp, Artificial Sequence
  chemically synthesized
gcggaaagattgatactatgct

SEQ ID NO: 44291 - DNA, 22 bp, Artificial Sequence
  chemically synthesized
cggaaagattgatactatgctt

SEQ ID NO: 44292 - DNA, 22 bp, Artificial Sequence
  chemically synthesized
atactatgcttttattttattt

SEQ ID NO: 44293 - DNA, 22 bp, Artificial Sequence
  chemically synthesized
tgcttttattttattttatttt

SEQ ID NO: 44294 - DNA, 22 bp, Artificial Sequence
  chemically synthesized
ttattttattttattttatttt

SEQ ID NO: 44295 - DNA, 22 bp, Artificial Sequence
  chemically synthesized
tattttattttattttatttta

SEQ ID NO: 44296 - DNA, 22 bp, Artificial Sequence
  chemically synthesized
attttattttattttattttat

SEQ ID NO: 44297 - DNA, 22 bp, Artificial Sequence
  chemically synthesized
ttttattttattttattttatt

SEQ ID NO: 44298 - DNA, 22 bp, Artificial Sequence
  chemically synthesized
tattttattttattttatttta

SEQ ID NO: 44299 - DNA, 22 bp, Artificial Sequence
  chemically synthesized
attttattttattttattttat

SEQ ID NO: 44300 - DNA, 22 bp, Artificial Sequence
  chemically synthesized
ttttattttattttattttatt

SEQ ID NO: 44301 - DNA, 22 bp, Artificial Sequence
  chemically synthesized
tattttattttattttatttta

SEQ ID NO: 44302 - DNA, 22 bp, Artificial Sequence
  chemically synthesized
attttattttattttattttat

SEQ ID NO: 44303 - DNA, 22 bp, Artificial Sequence
  chemically synthesized
ttttattttattttattttatt

SEQ ID NO: 44304 - DNA, 22 bp, Artificial Sequence
  chemically synthesized
tattttattttattttatttta

SEQ ID NO: 44305 - DNA, 22 bp, Artificial Sequence
  chemically synthesized
attttattttattttattttat

SEQ ID NO: 44306 - DNA, 22 bp, Artificial Sequence
  chemically synthesized
ttttattttattttattttatt

SEQ ID NO: 44307 - DNA, 22 bp, Artificial Sequence
  chemically synthesized
tattttattttattttatttta

SEQ ID NO: 44308 - DNA, 22 bp, Artificial Sequence
  chemically synthesized
attttattttattttattttat

SEQ ID NO: 44309 - DNA, 22 bp, Artificial Sequence
  chemically synthesized
ttttattttattttattttatt

SEQ ID NO: 44310 - DNA, 22 bp, Artificial Sequence
  chemically synthesized
tattttattttattttattgag

SEQ ID NO: 44311 - DNA, 22 bp, Artificial Sequence
  chemically synthesized
attttattttattttattgaga

SEQ ID NO: 44312 - DNA, 22 bp, Artificial Sequence
  chemically synthesized
ttttattttattttattgagac

SEQ ID NO: 44313 - DNA, 22 bp, Artificial Sequence
  chemically synthesized
tattttattttattgagactct

SEQ ID NO: 44314 - DNA, 22 bp, Artificial Sequence
  chemically synthesized
attttattttattgagactctc

SEQ ID NO: 44315 - DNA, 22 bp, Artificial Sequence
  chemically synthesized
ttttattttattgagactctca

SEQ ID NO: 44316 - DNA, 22 bp, Artificial Sequence
  chemically synthesized
tattttattgagactctcaccc

SEQ ID NO: 44317 - DNA, 22 bp, Artificial Sequence
  chemically synthesized
attttattgagactctcacccc

SEQ ID NO: 44318 - DNA, 22 bp, Artificial Sequence
  chemically synthesized
ttttattgagactctcaccccg

SEQ ID NO: 44319 - DNA, 22 bp, Artificial Sequence
  chemically synthesized
tattgagactctcaccccggtt

SEQ ID NO: 44320 - DNA, 22 bp, Artificial Sequence
  chemically synthesized
attgagactctcaccccggttg

SEQ ID NO: 44321 - DNA, 22 bp, Artificial Sequence
  chemically synthesized
ttgagactctcaccccggttga

SEQ ID NO: 44322 - DNA, 22 bp, Artificial Sequence
  chemically synthesized
agactctcaccccggttgaagt

SEQ ID NO: 44323 - DNA, 22 bp, Artificial Sequence
  chemically synthesized
tcaccccggttgaagtgcactg

SEQ ID NO: 44324 - DNA, 22 bp, Artificial Sequence
  chemically synthesized
accccggttgaagtgcactgac

SEQ ID NO: 44325 - DNA, 22 bp, Artificial Sequence
  chemically synthesized
aagtgcactgacgtgattttgg

SEQ ID NO: 44326 - DNA, 22 bp, Artificial Sequence
  chemically synthesized
acgtgattttggctcactgcaa

SEQ ID NO: 44327 - DNA, 22 bp, Artificial Sequence
  chemically synthesized
tggctcactgcaacttccacct

SEQ ID NO: 44328 - DNA, 22 bp, Artificial Sequence
  chemically synthesized
ggctcactgcaacttccacctc

SEQ ID NO: 44329 - DNA, 22 bp, Artificial Sequence
  chemically synthesized
gctcactgcaacttccacctcc

SEQ ID NO: 44330 - DNA, 22 bp, Artificial Sequence
  chemically synthesized
actgcaacttccacctcctggg

SEQ ID NO: 44331 - DNA, 22 bp, Artificial Sequence
  chemically synthesized
caacttccacctcctgggttca

SEQ ID NO: 44332 - DNA, 22 bp, Artificial Sequence
  chemically synthesized
ccacctcctgggttcaagtgaa

SEQ ID NO: 44333 - DNA, 22 bp, Artificial Sequence
  chemically synthesized
cacctcctgggttcaagtgaat

SEQ ID NO: 44334 - DNA, 22 bp, Artificial Sequence
  chemically synthesized
ctgggttcaagtgaatactcca

SEQ ID NO: 44335 - DNA, 22 bp, Artificial Sequence
  chemically synthesized
ggttcaagtgaatactccagcc

SEQ ID NO: 44336 - DNA, 22 bp, Artificial Sequence
  chemically synthesized
aagtgaatactccagcctccct

SEQ ID NO: 44337 - DNA, 22 bp, Artificial Sequence
  chemically synthesized
cagcctccctagtagctgggat

SEQ ID NO: 44338 - DNA, 22 bp, Artificial Sequence
  chemically synthesized
cctagtagctgggattacaggt

SEQ ID NO: 44339 - DNA, 22 bp, Artificial Sequence
  chemically synthesized
gtagctgggattacaggtgccc

SEQ ID NO: 44340 - DNA, 22 bp, Artificial Sequence
  chemically synthesized
ggattacaggtgcccaccacca

SEQ ID NO: 44341 - DNA, 22 bp, Artificial Sequence
  chemically synthesized
caggtgcccaccaccacgcctg

SEQ ID NO: 44342 - DNA, 22 bp, Artificial Sequence
  chemically synthesized
gctaatttttgtatttttagta

SEQ ID NO: 44343 - DNA, 22 bp, Artificial Sequence
  chemically synthesized
atttttgtatttttagtagaga

SEQ ID NO: 44344 - DNA, 22 bp, Artificial Sequence
  chemically synthesized
ttgtatttttagtagagatggg

SEQ ID NO: 44345 - DNA, 22 bp, Artificial Sequence
  chemically synthesized
tgtatttttagtagagatgggg

SEQ ID NO: 44346 - DNA, 22 bp, Artificial Sequence
  chemically synthesized
gtatttttagtagagatggggt

SEQ ID NO: 44347 - DNA, 22 bp, Artificial Sequence
  chemically synthesized
tatttttagtagagatggggtt

SEQ ID NO: 44348 - DNA, 22 bp, Artificial Sequence
  chemically synthesized
ttagtagagatggggtttcacc

SEQ ID NO: 44349 - DNA, 22 bp, Artificial Sequence
  chemically synthesized
tagtagagatggggtttcacca

SEQ ID NO: 44350 - DNA, 22 bp, Artificial Sequence
  chemically synthesized
agtagagatggggtttcaccac

SEQ ID NO: 44351 - DNA, 22 bp, Artificial Sequence
  chemically synthesized
gtagagatggggtttcaccaca

SEQ ID NO: 44352 - DNA, 22 bp, Artificial Sequence
  chemically synthesized
caccacattggcctggctggtc

SEQ ID NO: 44353 - DNA, 22 bp, Artificial Sequence
  chemically synthesized
accacattggcctggctggtct

SEQ ID NO: 44354 - DNA, 22 bp, Artificial Sequence
  chemically synthesized
gcctggctggtctcaaactcct

SEQ ID NO: 44355 - DNA, 22 bp, Artificial Sequence
  chemically synthesized
gctggtctcaaactcctgacct

SEQ ID NO: 44356 - DNA, 22 bp, Artificial Sequence
  chemically synthesized
gtctcaaactcctgaccttgtg

SEQ ID NO: 44357 - DNA, 22 bp, Artificial Sequence
  chemically synthesized
aaactcctgaccttgtgatcca

SEQ ID NO: 44358 - DNA, 22 bp, Artificial Sequence
  chemically synthesized
ctgaccttgtgatccacctgtc

SEQ ID NO: 44359 - DNA, 22 bp, Artificial Sequence
  chemically synthesized
accttgtgatccacctgtcttg

SEQ ID NO: 44360 - DNA, 22 bp, Artificial Sequence
  chemically synthesized
gtgatccacctgtcttggcctc

SEQ ID NO: 44361 - DNA, 22 bp, Artificial Sequence
  chemically synthesized
tgatccacctgtcttggcctcc

SEQ ID NO: 44362 - DNA, 22 bp, Artificial Sequence
  chemically synthesized
tcttggcctcccaaagtgctgg

SEQ ID NO: 44363 - DNA, 22 bp, Artificial Sequence
  chemically synthesized
ggcctcccaaagtgctgggatt

SEQ ID NO: 44364 - DNA, 22 bp, Artificial Sequence
  chemically synthesized
gcctcccaaagtgctgggatta

SEQ ID NO: 44365 - DNA, 22 bp, Artificial Sequence
  chemically synthesized
ccaaagtgctgggattacagag

SEQ ID NO: 44366 - DNA, 22 bp, Artificial Sequence
  chemically synthesized
ggattacagagttgagccaccg

SEQ ID NO: 44367 - DNA, 22 bp, Artificial Sequence
  chemically synthesized
cagagttgagccaccgcactcg

SEQ ID NO: 44368 - DNA, 22 bp, Artificial Sequence
  chemically synthesized
agccaccgcactcgaccctatg

SEQ ID NO: 44369 - DNA, 22 bp, Artificial Sequence
  chemically synthesized
gaccctatgttttatttttaaa

SEQ ID NO: 44370 - DNA, 22 bp, Artificial Sequence
  chemically synthesized
tgttttatttttaaaaatattt

SEQ ID NO: 44371 - DNA, 22 bp, Artificial Sequence
  chemically synthesized
tatttttaaaaatatttattta

SEQ ID NO: 44372 - DNA, 22 bp, Artificial Sequence
  chemically synthesized
atttttaaaaatatttatttat

SEQ ID NO: 44373 - DNA, 22 bp, Artificial Sequence
  chemically synthesized
tttttaaaaatatttatttatt

SEQ ID NO: 44374 - DNA, 22 bp, Artificial Sequence
  chemically synthesized
ttaaaaatatttatttatttat

SEQ ID NO: 44375 - DNA, 22 bp, Artificial Sequence
  chemically synthesized
taaaaatatttatttatttatt

SEQ ID NO: 44376 - DNA, 22 bp, Artificial Sequence
  chemically synthesized
aaaaatatttatttatttattt

SEQ ID NO: 44377 - DNA, 22 bp, Artificial Sequence
  chemically synthesized
aaaatatttatttatttattta

SEQ ID NO: 44378 - DNA, 22 bp, Artificial Sequence
  chemically synthesized
atttatttatttaagccacaac

SEQ ID NO: 44379 - DNA, 22 bp, Artificial Sequence
  chemically synthesized
tttatttatttaagccacaact

SEQ ID NO: 44380 - DNA, 22 bp, Artificial Sequence
  chemically synthesized
atttatttaagccacaactact

SEQ ID NO: 44381 - DNA, 22 bp, Artificial Sequence
  chemically synthesized
tttatttaagccacaactacta

SEQ ID NO: 44382 - DNA, 22 bp, Artificial Sequence
  chemically synthesized
atttaagccacaactactagaa

SEQ ID NO: 44383 - DNA, 22 bp, Artificial Sequence
  chemically synthesized
tttaagccacaactactagaat

SEQ ID NO: 44384 - DNA, 22 bp, Artificial Sequence
  chemically synthesized
aagccacaactactagaatagg

SEQ ID NO: 44385 - DNA, 22 bp, Artificial Sequence
  chemically synthesized
agccacaactactagaatagga

SEQ ID NO: 44386 - DNA, 22 bp, Artificial Sequence
  chemically synthesized
ctagaataggaaggattgatat

SEQ ID NO: 44387 - DNA, 22 bp, Artificial Sequence
  chemically synthesized
gaataggaaggattgatatttt

SEQ ID NO: 44388 - DNA, 22 bp, Artificial Sequence
  chemically synthesized
atattttattaattttatttgg

SEQ ID NO: 44389 - DNA, 22 bp, Artificial Sequence
  chemically synthesized
tattaattttatttggtattta

SEQ ID NO: 44390 - DNA, 22 bp, Artificial Sequence
  chemically synthesized
attaattttatttggtatttat

SEQ ID NO: 44391 - DNA, 22 bp, Artificial Sequence
  chemically synthesized
ttaattttatttggtatttatt

SEQ ID NO: 44392 - DNA, 22 bp, Artificial Sequence
  chemically synthesized
attttatttggtatttattatt

SEQ ID NO: 44393 - DNA, 22 bp, Artificial Sequence
  chemically synthesized
tatttggtatttattatttttt

SEQ ID NO: 44394 - DNA, 22 bp, Artificial Sequence
  chemically synthesized
atttggtatttattattttttt

SEQ ID NO: 44395 - DNA, 22 bp, Artificial Sequence
  chemically synthesized
tttggtatttattatttttttt

SEQ ID NO: 44396 - DNA, 22 bp, Artificial Sequence
  chemically synthesized
ggtatttattatttttttttct

SEQ ID NO: 44397 - DNA, 22 bp, Artificial Sequence
  chemically synthesized
gtatttattatttttttttctt

SEQ ID NO: 44398 - DNA, 22 bp, Artificial Sequence
  chemically synthesized
attatttttttttctttcctga

SEQ ID NO: 44399 - DNA, 22 bp, Artificial Sequence
  chemically synthesized
ttatttttttttctttcctgag

SEQ ID NO: 44400 - DNA, 22 bp, Artificial Sequence
  chemically synthesized
tttttttttctttcctgagaca

SEQ ID NO: 44401 - DNA, 22 bp, Artificial Sequence
  chemically synthesized
ttttttctttcctgagacattc

SEQ ID NO: 44402 - DNA, 22 bp, Artificial Sequence
  chemically synthesized
tttttctttcctgagacattct

SEQ ID NO: 44403 - DNA, 22 bp, Artificial Sequence
  chemically synthesized
ttttctttcctgagacattctt

SEQ ID NO: 44404 - DNA, 22 bp, Artificial Sequence
  chemically synthesized
tttctttcctgagacattcttg

SEQ ID NO: 44405 - DNA, 22 bp, Artificial Sequence
  chemically synthesized
ttctttcctgagacattcttgc

SEQ ID NO: 44406 - DNA, 22 bp, Artificial Sequence
  chemically synthesized
tctttcctgagacattcttgct

SEQ ID NO: 44407 - DNA, 22 bp, Artificial Sequence
  chemically synthesized
ctttcctgagacattcttgctc

SEQ ID NO: 44408 - DNA, 22 bp, Artificial Sequence
  chemically synthesized
tttcctgagacattcttgctct

SEQ ID NO: 44409 - DNA, 22 bp, Artificial Sequence
  chemically synthesized
tcctgagacattcttgctctgt

SEQ ID NO: 44410 - DNA, 22 bp, Artificial Sequence
  chemically synthesized
cctgagacattcttgctctgtc

SEQ ID NO: 44411 - DNA, 22 bp, Artificial Sequence
  chemically synthesized
ctgagacattcttgctctgtca

SEQ ID NO: 44412 - DNA, 22 bp, Artificial Sequence
  chemically synthesized
agacattcttgctctgtcaccc

SEQ ID NO: 44413 - DNA, 22 bp, Artificial Sequence
  chemically synthesized
ttgctctgtcacccaggctgga

SEQ ID NO: 44414 - DNA, 22 bp, Artificial Sequence
  chemically synthesized
gctctgtcacccaggctggagt

SEQ ID NO: 44415 - DNA, 22 bp, Artificial Sequence
  chemically synthesized
ctctgtcacccaggctggagtg

SEQ ID NO: 44416 - DNA, 22 bp, Artificial Sequence
  chemically synthesized
tgtcacccaggctggagtgcag

SEQ ID NO: 44417 - DNA, 22 bp, Artificial Sequence
  chemically synthesized
tcacccaggctggagtgcagtg

SEQ ID NO: 44418 - DNA, 22 bp, Artificial Sequence
  chemically synthesized
gagtgcagtggcacattcttgg

SEQ ID NO: 44419 - DNA, 22 bp, Artificial Sequence
  chemically synthesized
ttggctcactgcaacctccatc

SEQ ID NO: 44420 - DNA, 22 bp, Artificial Sequence
  chemically synthesized
ggctcactgcaacctccatctc

SEQ ID NO: 44421 - DNA, 22 bp, Artificial Sequence
  chemically synthesized
gctcactgcaacctccatctcc

SEQ ID NO: 44422 - DNA, 22 bp, Artificial Sequence
  chemically synthesized
actgcaacctccatctcctgtg

SEQ ID NO: 44423 - DNA, 22 bp, Artificial Sequence
  chemically synthesized
caacctccatctcctgtgttca

SEQ ID NO: 44424 - DNA, 22 bp, Artificial Sequence
  chemically synthesized
catctcctgtgttcaagcaatt

SEQ ID NO: 44425 - DNA, 22 bp, Artificial Sequence
  chemically synthesized
ctgtgttcaagcaattctagtg

SEQ ID NO: 44426 - DNA, 22 bp, Artificial Sequence
  chemically synthesized
tgttcaagcaattctagtgcct

SEQ ID NO: 44427 - DNA, 22 bp, Artificial Sequence
  chemically synthesized
aagcaattctagtgcctcagcc

SEQ ID NO: 44428 - DNA, 22 bp, Artificial Sequence
  chemically synthesized
tagtgcctcagcctacttagta

SEQ ID NO: 44429 - DNA, 22 bp, Artificial Sequence
  chemically synthesized
gtgcctcagcctacttagtagc

SEQ ID NO: 44430 - DNA, 22 bp, Artificial Sequence
  chemically synthesized
agcctacttagtagctgggatg

SEQ ID NO: 44431 - DNA, 22 bp, Artificial Sequence
  chemically synthesized
cttagtagctgggatgactggc

SEQ ID NO: 44432 - DNA, 22 bp, Artificial Sequence
  chemically synthesized
agtagctgggatgactggcatg

SEQ ID NO: 44433 - DNA, 22 bp, Artificial Sequence
  chemically synthesized
gtagctgggatgactggcatgt

SEQ ID NO: 44434 - DNA, 22 bp, Artificial Sequence
  chemically synthesized
ggatgactggcatgtgcctcca

SEQ ID NO: 44435 - DNA, 22 bp, Artificial Sequence
  chemically synthesized
gcatgtgcctccacacccagct

SEQ ID NO: 44436 - DNA, 22 bp, Artificial Sequence
  chemically synthesized
cacacccagctaatttttgtat

SEQ ID NO: 44437 - DNA, 22 bp, Artificial Sequence
  chemically synthesized
atttttgtattttttgtagaga

SEQ ID NO: 44438 - DNA, 22 bp, Artificial Sequence
  chemically synthesized
ttgtattttttgtagagacagg

SEQ ID NO: 44439 - DNA, 22 bp, Artificial Sequence
  chemically synthesized
tgtattttttgtagagacaggg

SEQ ID NO: 44440 - DNA, 22 bp, Artificial Sequence
  chemically synthesized
gtattttttgtagagacagggt

SEQ ID NO: 44441 - DNA, 22 bp, Artificial Sequence
  chemically synthesized
tattttttgtagagacagggtt

SEQ ID NO: 44442 - DNA, 22 bp, Artificial Sequence
  chemically synthesized
tttgtagagacagggttttggc

SEQ ID NO: 44443 - DNA, 22 bp, Artificial Sequence
  chemically synthesized
ttgtagagacagggttttggca

SEQ ID NO: 44444 - DNA, 22 bp, Artificial Sequence
  chemically synthesized
tgtagagacagggttttggcat

SEQ ID NO: 44445 - DNA, 22 bp, Artificial Sequence
  chemically synthesized
gtagagacagggttttggcatg

SEQ ID NO: 44446 - DNA, 22 bp, Artificial Sequence
  chemically synthesized
tagagacagggttttggcatgt

SEQ ID NO: 44447 - DNA, 22 bp, Artificial Sequence
  chemically synthesized
tggcatgttgcccaggcttgtc

SEQ ID NO: 44448 - DNA, 22 bp, Artificial Sequence
  chemically synthesized
ggcatgttgcccaggcttgtct

SEQ ID NO: 44449 - DNA, 22 bp, Artificial Sequence
  chemically synthesized
gcatgttgcccaggcttgtctc

SEQ ID NO: 44450 - DNA, 22 bp, Artificial Sequence
  chemically synthesized
cccaggcttgtctcaaactcct

SEQ ID NO: 44451 - DNA, 22 bp, Artificial Sequence
  chemically synthesized
gtctcaaactcctggcctcagg

SEQ ID NO: 44452 - DNA, 22 bp, Artificial Sequence
  chemically synthesized
tctcaaactcctggcctcaggt

SEQ ID NO: 44453 - DNA, 22 bp, Artificial Sequence
  chemically synthesized
aaactcctggcctcaggtgatc

SEQ ID NO: 44454 - DNA, 22 bp, Artificial Sequence
  chemically synthesized
ctggcctcaggtgatccatctg

SEQ ID NO: 44455 - DNA, 22 bp, Artificial Sequence
  chemically synthesized
gcctcaggtgatccatctgccg

SEQ ID NO: 44456 - DNA, 22 bp, Artificial Sequence
  chemically synthesized
aggtgatccatctgccgtggcc

SEQ ID NO: 44457 - DNA, 22 bp, Artificial Sequence
  chemically synthesized
ccgtggcctcccaaaatgctgg

SEQ ID NO: 44458 - DNA, 22 bp, Artificial Sequence
  chemically synthesized
ccaaaatgctgggattataggc

SEQ ID NO: 44459 - DNA, 22 bp, Artificial Sequence
  chemically synthesized
ggattataggcatgagccacca

SEQ ID NO: 44460 - DNA, 22 bp, Artificial Sequence
  chemically synthesized
taggcatgagccaccaccccct

SEQ ID NO: 44461 - DNA, 22 bp, Artificial Sequence
  chemically synthesized
ctggaaggattgatatcttata

SEQ ID NO: 44462 - DNA, 22 bp, Artificial Sequence
  chemically synthesized
gaaggattgatatcttataaca

SEQ ID NO: 44463 - DNA, 22 bp, Artificial Sequence
  chemically synthesized
atatcttataacataatttata

SEQ ID NO: 44464 - DNA, 22 bp, Artificial Sequence
  chemically synthesized
ataacataatttataattacag

SEQ ID NO: 44465 - DNA, 22 bp, Artificial Sequence
  chemically synthesized
taacataatttataattacaga

SEQ ID NO: 44466 - DNA, 22 bp, Artificial Sequence
  chemically synthesized
ataattacagaaaacatgtgag

SEQ ID NO: 44467 - DNA, 22 bp, Artificial Sequence
  chemically synthesized
taattacagaaaacatgtgagt

SEQ ID NO: 44468 - DNA, 22 bp, Artificial Sequence
  chemically synthesized
cagaaaacatgtgagttcacta

SEQ ID NO: 44469 - DNA, 22 bp, Artificial Sequence
  chemically synthesized
actaggaataaataaattttga

SEQ ID NO: 44470 - DNA, 22 bp, Artificial Sequence
  chemically synthesized
ggaataaataaattttgaagat

SEQ ID NO: 44471 - DNA, 22 bp, Artificial Sequence
  chemically synthesized
tgaagataataaaagattttca

SEQ ID NO: 44472 - DNA, 22 bp, Artificial Sequence
  chemically synthesized
gaagataataaaagattttcac

SEQ ID NO: 44473 - DNA, 22 bp, Artificial Sequence
  chemically synthesized
aagataataaaagattttcact

SEQ ID NO: 44474 - DNA, 22 bp, Artificial Sequence
  chemically synthesized
tcacttatgttgtcatttcggc

SEQ ID NO: 44475 - DNA, 22 bp, Artificial Sequence
  chemically synthesized
cacttatgttgtcatttcggca

SEQ ID NO: 44476 - DNA, 22 bp, Artificial Sequence
  chemically synthesized
acttatgttgtcatttcggcac

SEQ ID NO: 44477 - DNA, 22 bp, Artificial Sequence
  chemically synthesized
atgttgtcatttcggcacagtt

SEQ ID NO: 44478 - DNA, 22 bp, Artificial Sequence
  chemically synthesized
tgttgtcatttcggcacagttt

SEQ ID NO: 44479 - DNA, 22 bp, Artificial Sequence
  chemically synthesized
tcatttcggcacagtttggtat

SEQ ID NO: 44480 - DNA, 22 bp, Artificial Sequence
  chemically synthesized
cggcacagtttggtataggatg

SEQ ID NO: 44481 - DNA, 22 bp, Artificial Sequence
  chemically synthesized
ggcacagtttggtataggatgt

SEQ ID NO: 44482 - DNA, 22 bp, Artificial Sequence
  chemically synthesized
ggtataggatgtggagatgtta

SEQ ID NO: 44483 - DNA, 22 bp, Artificial Sequence
  chemically synthesized
gtataggatgtggagatgttaa

SEQ ID NO: 44484 - DNA, 22 bp, Artificial Sequence
  chemically synthesized
acatttatacctagcttgctcg

SEQ ID NO: 44485 - DNA, 22 bp, Artificial Sequence
  chemically synthesized
atacctagcttgctcgtaaact

SEQ ID NO: 44486 - DNA, 22 bp, Artificial Sequence
  chemically synthesized
tacctagcttgctcgtaaacta

SEQ ID NO: 44487 - DNA, 22 bp, Artificial Sequence
  chemically synthesized
gcttgctcgtaaactaagacct

SEQ ID NO: 44488 - DNA, 22 bp, Artificial Sequence
  chemically synthesized
gctcgtaaactaagacctgaaa

SEQ ID NO: 44489 - DNA, 22 bp, Artificial Sequence
  chemically synthesized
ctcgtaaactaagacctgaaag

SEQ ID NO: 44490 - DNA, 22 bp, Artificial Sequence
  chemically synthesized
gtaaactaagacctgaaagggt

SEQ ID NO: 44491 - DNA, 22 bp, Artificial Sequence
  chemically synthesized
agacctgaaagggttgtgtcta

SEQ ID NO: 44492 - DNA, 22 bp, Artificial Sequence
  chemically synthesized
aaagggttgtgtctatcagctg

SEQ ID NO: 44493 - DNA, 22 bp, Artificial Sequence
  chemically synthesized
tgtctatcagctgcacccctgg

SEQ ID NO: 44494 - DNA, 22 bp, Artificial Sequence
  chemically synthesized
tcagctgcacccctgggtagcg

SEQ ID NO: 44495 - DNA, 22 bp, Artificial Sequence
  chemically synthesized
cacccctgggtagcgacacaac

SEQ ID NO: 44496 - DNA, 22 bp, Artificial Sequence
  chemically synthesized
ggtagcgacacaacctcgggaa

SEQ ID NO: 44497 - DNA, 22 bp, Artificial Sequence
  chemically synthesized
gggaaggcctcagccccctcct

SEQ ID NO: 44498 - DNA, 22 bp, Artificial Sequence
  chemically synthesized
agccccctcctcgtacagcact

SEQ ID NO: 44499 - DNA, 22 bp, Artificial Sequence
  chemically synthesized
ctcgtacagcactgcctgttgg

SEQ ID NO: 44500 - DNA, 22 bp, Artificial Sequence
  chemically synthesized
gtacagcactgcctgttggaaa

SEQ ID NO: 44501 - DNA, 22 bp, Artificial Sequence
  chemically synthesized
cctgttggaaagcttgagggag

SEQ ID NO: 44502 - DNA, 22 bp, Artificial Sequence
  chemically synthesized
ttggaaagcttgagggaggcta

SEQ ID NO: 44503 - DNA, 22 bp, Artificial Sequence
  chemically synthesized
gaaagcttgagggaggctatgg

SEQ ID NO: 44504 - DNA, 22 bp, Artificial Sequence
  chemically synthesized
gagggaggctatggatgtgcag

SEQ ID NO: 44505 - DNA, 22 bp, Artificial Sequence
  chemically synthesized
agggaggctatggatgtgcagc

SEQ ID NO: 44506 - DNA, 22 bp, Artificial Sequence
  chemically synthesized
tggatgtgcagcacttggcaga

SEQ ID NO: 44507 - DNA, 22 bp, Artificial Sequence
  chemically synthesized
ggcagagggtctggtcatggaa

SEQ ID NO: 44508 - DNA, 22 bp, Artificial Sequence
  chemically synthesized
gcagagggtctggtcatggaag

SEQ ID NO: 44509 - DNA, 22 bp, Artificial Sequence
  chemically synthesized
gtcatggaagttaccagcaaat

SEQ ID NO: 44510 - DNA, 22 bp, Artificial Sequence
  chemically synthesized
ccagcaaatatgagctactttt

SEQ ID NO: 44511 - DNA, 22 bp, Artificial Sequence
  chemically synthesized
cttttatgattttattttatcc

SEQ ID NO: 44512 - DNA, 22 bp, Artificial Sequence
  chemically synthesized
ttatgattttattttatccaaa

SEQ ID NO: 44513 - DNA, 22 bp, Artificial Sequence
  chemically synthesized
tatgattttattttatccaaaa

SEQ ID NO: 44514 - DNA, 22 bp, Artificial Sequence
  chemically synthesized
atgattttattttatccaaaag

SEQ ID NO: 44515 - DNA, 22 bp, Artificial Sequence
  chemically synthesized
tgattttattttatccaaaaga

SEQ ID NO: 44516 - DNA, 22 bp, Artificial Sequence
  chemically synthesized
tattttatccaaaagaaagaga

SEQ ID NO: 44517 - DNA, 22 bp, Artificial Sequence
  chemically synthesized
attttatccaaaagaaagagaa

SEQ ID NO: 44518 - DNA, 22 bp, Artificial Sequence
  chemically synthesized
ttttatccaaaagaaagagaat

SEQ ID NO: 44519 - DNA, 22 bp, Artificial Sequence
  chemically synthesized
tatccaaaagaaagagaatgaa

SEQ ID NO: 44520 - DNA, 22 bp, Artificial Sequence
  chemically synthesized
atccaaaagaaagagaatgaaa

SEQ ID NO: 44521 - DNA, 22 bp, Artificial Sequence
  chemically synthesized
tccaaaagaaagagaatgaaag

SEQ ID NO: 44522 - DNA, 22 bp, Artificial Sequence
  chemically synthesized
atcaggaaagatgaaggtctag

SEQ ID NO: 44523 - DNA, 22 bp, Artificial Sequence
  chemically synthesized
ggggtgagggaaggagtaagga

SEQ ID NO: 44524 - DNA, 22 bp, Artificial Sequence
  chemically synthesized
aggggggaaatggctttcacca

SEQ ID NO: 44525 - DNA, 22 bp, Artificial Sequence
  chemically synthesized
tcaccacttcccagcatctatt

SEQ ID NO: 44526 - DNA, 22 bp, Artificial Sequence
  chemically synthesized
caccacttcccagcatctattg

SEQ ID NO: 44527 - DNA, 22 bp, Artificial Sequence
  chemically synthesized
accacttcccagcatctattga

SEQ ID NO: 44528 - DNA, 22 bp, Artificial Sequence
  chemically synthesized
cccagcatctattgacattgca

SEQ ID NO: 44529 - DNA, 22 bp, Artificial Sequence
  chemically synthesized
ccagcatctattgacattgcac

SEQ ID NO: 44530 - DNA, 22 bp, Artificial Sequence
  chemically synthesized
ttgacattgcactctcaaatat

SEQ ID NO: 44531 - DNA, 22 bp, Artificial Sequence
  chemically synthesized
acattgcactctcaaatatttt

SEQ ID NO: 44532 - DNA, 22 bp, Artificial Sequence
  chemically synthesized
cactctcaaatattttataaga

SEQ ID NO: 44533 - DNA, 22 bp, Artificial Sequence
  chemically synthesized
tcaaatattttataagactcta

SEQ ID NO: 44534 - DNA, 22 bp, Artificial Sequence
  chemically synthesized
aaatattttataagactctata

SEQ ID NO: 44535 - DNA, 22 bp, Artificial Sequence
  chemically synthesized
tataagactctatattcaaggt

SEQ ID NO: 44536 - DNA, 22 bp, Artificial Sequence
  chemically synthesized
ataagactctatattcaaggta

SEQ ID NO: 44537 - DNA, 22 bp, Artificial Sequence
  chemically synthesized
taagactctatattcaaggtaa

SEQ ID NO: 44538 - DNA, 22 bp, Artificial Sequence
  chemically synthesized
tatattcaaggtaatgtttgaa

SEQ ID NO: 44539 - DNA, 22 bp, Artificial Sequence
  chemically synthesized
tattcaaggtaatgtttgaacc

SEQ ID NO: 44540 - DNA, 22 bp, Artificial Sequence
  chemically synthesized
aaggtaatgtttgaaccctgct

SEQ ID NO: 44541 - DNA, 22 bp, Artificial Sequence
  chemically synthesized
gaaccctgctgagccagtggca

SEQ ID NO: 44542 - DNA, 22 bp, Artificial Sequence
  chemically synthesized
aaccctgctgagccagtggcat

SEQ ID NO: 44543 - DNA, 22 bp, Artificial Sequence
  chemically synthesized
ctgagccagtggcatgggtctc

SEQ ID NO: 44544 - DNA, 22 bp, Artificial Sequence
  chemically synthesized
agccagtggcatgggtctctga

SEQ ID NO: 44545 - DNA, 22 bp, Artificial Sequence
  chemically synthesized
tgagagaatcattaacttaatt

SEQ ID NO: 44546 - DNA, 22 bp, Artificial Sequence
  chemically synthesized
agagaatcattaacttaatttg

SEQ ID NO: 44547 - DNA, 22 bp, Artificial Sequence
  chemically synthesized
acttaatttgactatctggttt

SEQ ID NO: 44548 - DNA, 22 bp, Artificial Sequence
  chemically synthesized
aatttgactatctggtttgtgg

SEQ ID NO: 44549 - DNA, 22 bp, Artificial Sequence
  chemically synthesized
atttgactatctggtttgtggg

SEQ ID NO: 44550 - DNA, 22 bp, Artificial Sequence
  chemically synthesized
gactatctggtttgtgggtgcg

SEQ ID NO: 44551 - DNA, 22 bp, Artificial Sequence
  chemically synthesized
actatctggtttgtgggtgcgt

SEQ ID NO: 44552 - DNA, 22 bp, Artificial Sequence
  chemically synthesized
tctggtttgtgggtgcgtttac

SEQ ID NO: 44553 - DNA, 22 bp, Artificial Sequence
  chemically synthesized
gtttgtgggtgcgtttactctc

SEQ ID NO: 44554 - DNA, 22 bp, Artificial Sequence
  chemically synthesized
gtgggtgcgtttactctcatgt

SEQ ID NO: 44555 - DNA, 22 bp, Artificial Sequence
  chemically synthesized
tgggtgcgtttactctcatgta

SEQ ID NO: 44556 - DNA, 22 bp, Artificial Sequence
  chemically synthesized
actctcatgtaagtcaacaatg

SEQ ID NO: 44557 - DNA, 22 bp, Artificial Sequence
  chemically synthesized
ctctcatgtaagtcaacaatgt

SEQ ID NO: 44558 - DNA, 22 bp, Artificial Sequence
  chemically synthesized
tcatgtaagtcaacaatgtcct

SEQ ID NO: 44559 - DNA, 22 bp, Artificial Sequence
  chemically synthesized
atgtaagtcaacaatgtcctgg

SEQ ID NO: 44560 - DNA, 22 bp, Artificial Sequence
  chemically synthesized
ggattgggacacactttctggg

SEQ ID NO: 44561 - DNA, 22 bp, Artificial Sequence
  chemically synthesized
ggacacactttctgggcactgc

SEQ ID NO: 44562 - DNA, 22 bp, Artificial Sequence
  chemically synthesized
tctgggcactgctggccagtcc

SEQ ID NO: 44563 - DNA, 22 bp, Artificial Sequence
  chemically synthesized
ctgggcactgctggccagtccc

SEQ ID NO: 44564 - DNA, 22 bp, Artificial Sequence
  chemically synthesized
tgggcactgctggccagtccca

SEQ ID NO: 44565 - DNA, 22 bp, Artificial Sequence
  chemically synthesized
ggcactgctggccagtcccaaa

SEQ ID NO: 44566 - DNA, 22 bp, Artificial Sequence
  chemically synthesized
ctggccagtcccaaaatggaac

SEQ ID NO: 44567 - DNA, 22 bp, Artificial Sequence
  chemically synthesized
gccagtcccaaaatggaacata

SEQ ID NO: 44568 - DNA, 22 bp, Artificial Sequence
  chemically synthesized
ttctacttcttttatttctgaa

SEQ ID NO: 44569 - DNA, 22 bp, Artificial Sequence
  chemically synthesized
ctacttcttttatttctgaaat

SEQ ID NO: 44570 - DNA, 22 bp, Artificial Sequence
  chemically synthesized
tacttcttttatttctgaaatc

SEQ ID NO: 44571 - DNA, 22 bp, Artificial Sequence
  chemically synthesized
cttcttttatttctgaaatcag

SEQ ID NO: 44572 - DNA, 22 bp, Artificial Sequence
  chemically synthesized
cttttatttctgaaatcaggta

SEQ ID NO: 44573 - DNA, 22 bp, Artificial Sequence
  chemically synthesized
ttttatttctgaaatcaggtaa

SEQ ID NO: 44574 - DNA, 22 bp, Artificial Sequence
  chemically synthesized
ttatttctgaaatcaggtaaga

SEQ ID NO: 44575 - DNA, 22 bp, Artificial Sequence
  chemically synthesized
tatttctgaaatcaggtaagac

SEQ ID NO: 44576 - DNA, 22 bp, Artificial Sequence
  chemically synthesized
atttctgaaatcaggtaagaca

SEQ ID NO: 44577 - DNA, 22 bp, Artificial Sequence
  chemically synthesized
tttctgaaatcaggtaagacat

SEQ ID NO: 44578 - DNA, 22 bp, Artificial Sequence
  chemically synthesized
ctgaaatcaggtaagacatagt

SEQ ID NO: 44579 - DNA, 22 bp, Artificial Sequence
  chemically synthesized
tgaaatcaggtaagacatagtt

SEQ ID NO: 44580 - DNA, 22 bp, Artificial Sequence
  chemically synthesized
aaatcaggtaagacatagtttt

SEQ ID NO: 44581 - DNA, 22 bp, Artificial Sequence
  chemically synthesized
ttttaaattataagaattattt

SEQ ID NO: 44582 - DNA, 22 bp, Artificial Sequence
  chemically synthesized
tttaaattataagaattatttt

SEQ ID NO: 44583 - DNA, 22 bp, Artificial Sequence
  chemically synthesized
ttaaattataagaattattttt

SEQ ID NO: 44584 - DNA, 22 bp, Artificial Sequence
  chemically synthesized
taaattataagaattatttttt

SEQ ID NO: 44585 - DNA, 22 bp, Artificial Sequence
  chemically synthesized
aaattataagaattattttttc

SEQ ID NO: 44586 - DNA, 22 bp, Artificial Sequence
  chemically synthesized
aattataagaattattttttct

SEQ ID NO: 44587 - DNA, 22 bp, Artificial Sequence
  chemically synthesized
taagaattattttttctcccac

SEQ ID NO: 44588 - DNA, 22 bp, Artificial Sequence
  chemically synthesized
ttttttctcccacaatgtagta

SEQ ID NO: 44589 - DNA, 22 bp, Artificial Sequence
  chemically synthesized
tttctcccacaatgtagtaaaa

SEQ ID NO: 44590 - DNA, 22 bp, Artificial Sequence
  chemically synthesized
ttctcccacaatgtagtaaaaa

SEQ ID NO: 44591 - DNA, 22 bp, Artificial Sequence
  chemically synthesized
tctcccacaatgtagtaaaaat

SEQ ID NO: 44592 - DNA, 22 bp, Artificial Sequence
  chemically synthesized
ctcccacaatgtagtaaaaata

SEQ ID NO: 44593 - DNA, 22 bp, Artificial Sequence
  chemically synthesized
tcccacaatgtagtaaaaatac

SEQ ID NO: 44594 - DNA, 22 bp, Artificial Sequence
  chemically synthesized
ccacaatgtagtaaaaatacat

SEQ ID NO: 44595 - DNA, 22 bp, Artificial Sequence
  chemically synthesized
tatgtgcaattcatttaatttt

SEQ ID NO: 44596 - DNA, 22 bp, Artificial Sequence
  chemically synthesized
atgtgcaattcatttaattttt

SEQ ID NO: 44597 - DNA, 22 bp, Artificial Sequence
  chemically synthesized
tgtgcaattcatttaatttttg

SEQ ID NO: 44598 - DNA, 22 bp, Artificial Sequence
  chemically synthesized
atttaatttttgattcatgaaa

SEQ ID NO: 44599 - DNA, 22 bp, Artificial Sequence
  chemically synthesized
aatttttgattcatgaaattcc

SEQ ID NO: 44600 - DNA, 22 bp, Artificial Sequence
  chemically synthesized
atttttgattcatgaaattccc

SEQ ID NO: 44601 - DNA, 22 bp, Artificial Sequence
  chemically synthesized
ttgattcatgaaattcccagtt

SEQ ID NO: 44602 - DNA, 22 bp, Artificial Sequence
  chemically synthesized
tgattcatgaaattcccagttc

SEQ ID NO: 44603 - DNA, 22 bp, Artificial Sequence
  chemically synthesized
gattcatgaaattcccagttca

SEQ ID NO: 44604 - DNA, 22 bp, Artificial Sequence
  chemically synthesized
attcatgaaattcccagttcaa

SEQ ID NO: 44605 - DNA, 22 bp, Artificial Sequence
  chemically synthesized
atgaaattcccagttcaaaatc

SEQ ID NO: 44606 - DNA, 22 bp, Artificial Sequence
  chemically synthesized
ccagttcaaaatcttgtatatg

SEQ ID NO: 44607 - DNA, 22 bp, Artificial Sequence
  chemically synthesized
aaaatcttgtatatgattgaaa

SEQ ID NO: 44608 - DNA, 22 bp, Artificial Sequence
  chemically synthesized
gtatatgattgaaaaattctta

SEQ ID NO: 44609 - DNA, 22 bp, Artificial Sequence
  chemically synthesized
tatatgattgaaaaattcttaa

SEQ ID NO: 44610 - DNA, 22 bp, Artificial Sequence
  chemically synthesized
aaaaattcttaaaaaaataagt

SEQ ID NO: 44611 - DNA, 22 bp, Artificial Sequence
  chemically synthesized
ttaaaaaaataagtttaatttc

SEQ ID NO: 44612 - DNA, 22 bp, Artificial Sequence
  chemically synthesized
aaaaaaataagtttaatttccc

SEQ ID NO: 44613 - DNA, 22 bp, Artificial Sequence
  chemically synthesized
aaaaaataagtttaatttcccc

SEQ ID NO: 44614 - DNA, 22 bp, Artificial Sequence
  chemically synthesized
aatttccccgtgaagactgtca

SEQ ID NO: 44615 - DNA, 22 bp, Artificial Sequence
  chemically synthesized
atttccccgtgaagactgtcac

SEQ ID NO: 44616 - DNA, 22 bp, Artificial Sequence
  chemically synthesized
ccccgtgaagactgtcacggtg

SEQ ID NO: 44617 - DNA, 22 bp, Artificial Sequence
  chemically synthesized
cccgtgaagactgtcacggtgc

SEQ ID NO: 44618 - DNA, 22 bp, Artificial Sequence
  chemically synthesized
tcacggtgctggaatgaatggg

SEQ ID NO: 44619 - DNA, 22 bp, Artificial Sequence
  chemically synthesized
gaatgaatgggcagaaaaaata

SEQ ID NO: 44620 - DNA, 22 bp, Artificial Sequence
  chemically synthesized
atttttctaatctaaaagagtg

SEQ ID NO: 44621 - DNA, 22 bp, Artificial Sequence
  chemically synthesized
ttctaatctaaaagagtgtgcc

SEQ ID NO: 44622 - DNA, 22 bp, Artificial Sequence
  chemically synthesized
tctaatctaaaagagtgtgcct

SEQ ID NO: 44623 - DNA, 22 bp, Artificial Sequence
  chemically synthesized
ctaatctaaaagagtgtgccta

SEQ ID NO: 44624 - DNA, 22 bp, Artificial Sequence
  chemically synthesized
taatctaaaagagtgtgcctac

SEQ ID NO: 44625 - DNA, 22 bp, Artificial Sequence
  chemically synthesized
atctaaaagagtgtgcctacat

SEQ ID NO: 44626 - DNA, 22 bp, Artificial Sequence
  chemically synthesized
aaagagtgtgcctacatgatgg

SEQ ID NO: 44627 - DNA, 22 bp, Artificial Sequence
  chemically synthesized
catgatggccagtctggctgaa

SEQ ID NO: 44628 - DNA, 22 bp, Artificial Sequence
  chemically synthesized
gctgaaaaataaatagccattg

SEQ ID NO: 44629 - DNA, 22 bp, Artificial Sequence
  chemically synthesized
aaaaataaatagccattgtagc

SEQ ID NO: 44630 - DNA, 22 bp, Artificial Sequence
  chemically synthesized
tagctaactatgcaaaggatgg

SEQ ID NO: 44631 - DNA, 22 bp, Artificial Sequence
  chemically synthesized
actatgcaaaggatggctaagc

SEQ ID NO: 44632 - DNA, 22 bp, Artificial Sequence
  chemically synthesized
tgcaaaggatggctaagctctt

SEQ ID NO: 44633 - DNA, 22 bp, Artificial Sequence
  chemically synthesized
agctcttcgcttggttctcagt

SEQ ID NO: 44634 - DNA, 22 bp, Artificial Sequence
  chemically synthesized
ttcgcttggttctcagtttcat

SEQ ID NO: 44635 - DNA, 22 bp, Artificial Sequence
  chemically synthesized
cgcttggttctcagtttcatta

SEQ ID NO: 44636 - DNA, 22 bp, Artificial Sequence
  chemically synthesized
gcttggttctcagtttcattaa

SEQ ID NO: 44637 - DNA, 22 bp, Artificial Sequence
  chemically synthesized
ggttctcagtttcattaattta

SEQ ID NO: 44638 - DNA, 22 bp, Artificial Sequence
  chemically synthesized
gttctcagtttcattaatttat

SEQ ID NO: 44639 - DNA, 22 bp, Artificial Sequence
  chemically synthesized
tcagtttcattaatttatatca

SEQ ID NO: 44640 - DNA, 22 bp, Artificial Sequence
  chemically synthesized
agtttcattaatttatatcatc

SEQ ID NO: 44641 - DNA, 22 bp, Artificial Sequence
  chemically synthesized
cattaatttatatcatctctgt

SEQ ID NO: 44642 - DNA, 22 bp, Artificial Sequence
  chemically synthesized
attaatttatatcatctctgtt

SEQ ID NO: 44643 - DNA, 22 bp, Artificial Sequence
  chemically synthesized
atttatatcatctctgttcagg

SEQ ID NO: 44644 - DNA, 22 bp, Artificial Sequence
  chemically synthesized
atatcatctctgttcaggtgcc

SEQ ID NO: 44645 - DNA, 22 bp, Artificial Sequence
  chemically synthesized
tatcatctctgttcaggtgcca

SEQ ID NO: 44646 - DNA, 22 bp, Artificial Sequence
  chemically synthesized
tgttcaggtgccatgctcccct

SEQ ID NO: 44647 - DNA, 22 bp, Artificial Sequence
  chemically synthesized
ttcaggtgccatgctcccctca

SEQ ID NO: 44648 - DNA, 22 bp, Artificial Sequence
  chemically synthesized
aggtgccatgctcccctcacta

SEQ ID NO: 44649 - DNA, 22 bp, Artificial Sequence
  chemically synthesized
ccctcactagcaagttgaaaca

SEQ ID NO: 44650 - DNA, 22 bp, Artificial Sequence
  chemically synthesized
actagcaagttgaaacaatgaa

SEQ ID NO: 44651 - DNA, 22 bp, Artificial Sequence
  chemically synthesized
gcaagttgaaacaatgaaataa

SEQ ID NO: 44652 - DNA, 22 bp, Artificial Sequence
  chemically synthesized
aaacaatgaaataactctttga

SEQ ID NO: 44653 - DNA, 22 bp, Artificial Sequence
  chemically synthesized
tttgaatatgtttggttccttg

SEQ ID NO: 44654 - DNA, 22 bp, Artificial Sequence
  chemically synthesized
tgaatatgtttggttccttgac

SEQ ID NO: 44655 - DNA, 22 bp, Artificial Sequence
  chemically synthesized
gaatatgtttggttccttgacc

SEQ ID NO: 44656 - DNA, 22 bp, Artificial Sequence
  chemically synthesized
aatatgtttggttccttgacct

SEQ ID NO: 44657 - DNA, 22 bp, Artificial Sequence
  chemically synthesized
ggttccttgacctgttcatgga

SEQ ID NO: 44658 - DNA, 22 bp, Artificial Sequence
  chemically synthesized
gttccttgacctgttcatggag

SEQ ID NO: 44659 - DNA, 22 bp, Artificial Sequence
  chemically synthesized
cttgacctgttcatggagtggg

SEQ ID NO: 44660 - DNA, 22 bp, Artificial Sequence
  chemically synthesized
gacctgttcatggagtgggact

SEQ ID NO: 44661 - DNA, 22 bp, Artificial Sequence
  chemically synthesized
acctgttcatggagtgggactc

SEQ ID NO: 44662 - DNA, 22 bp, Artificial Sequence
  chemically synthesized
ttcatggagtgggactcagcat

SEQ ID NO: 44663 - DNA, 22 bp, Artificial Sequence
  chemically synthesized
atggagtgggactcagcatttc

SEQ ID NO: 44664 - DNA, 22 bp, Artificial Sequence
  chemically synthesized
agcatttctctctttgttatgg

SEQ ID NO: 44665 - DNA, 22 bp, Artificial Sequence
  chemically synthesized
ctctctttgttatggcctgagt

SEQ ID NO: 44666 - DNA, 22 bp, Artificial Sequence
  chemically synthesized
tctctttgttatggcctgagta

SEQ ID NO: 44667 - DNA, 22 bp, Artificial Sequence
  chemically synthesized
tctttgttatggcctgagtaag

SEQ ID NO: 44668 - DNA, 22 bp, Artificial Sequence
  chemically synthesized
tttgttatggcctgagtaaggc

SEQ ID NO: 44669 - DNA, 22 bp, Artificial Sequence
  chemically synthesized
tgttatggcctgagtaaggctt

SEQ ID NO: 44670 - DNA, 22 bp, Artificial Sequence
  chemically synthesized
gttatggcctgagtaaggcttt

SEQ ID NO: 44671 - DNA, 22 bp, Artificial Sequence
  chemically synthesized
ttatggcctgagtaaggctttc

SEQ ID NO: 44672 - DNA, 22 bp, Artificial Sequence
  chemically synthesized
tggcctgagtaaggctttccat

SEQ ID NO: 44673 - DNA, 22 bp, Artificial Sequence
  chemically synthesized
agtaaggctttccatcggtata

SEQ ID NO: 44674 - DNA, 22 bp, Artificial Sequence
  chemically synthesized
tccatcggtatacatttgcttc

SEQ ID NO: 44675 - DNA, 22 bp, Artificial Sequence
  chemically synthesized
ccatcggtatacatttgcttct

SEQ ID NO: 44676 - DNA, 22 bp, Artificial Sequence
  chemically synthesized
catcggtatacatttgcttctt

SEQ ID NO: 44677 - DNA, 22 bp, Artificial Sequence
  chemically synthesized
gcttcttatccctggagaaatt

SEQ ID NO: 44678 - DNA, 22 bp, Artificial Sequence
  chemically synthesized
cttcttatccctggagaaatta

SEQ ID NO: 44679 - DNA, 22 bp, Artificial Sequence
  chemically synthesized
cttatccctggagaaattatac

SEQ ID NO: 44680 - DNA, 22 bp, Artificial Sequence
  chemically synthesized
ttatccctggagaaattataca

SEQ ID NO: 44681 - DNA, 22 bp, Artificial Sequence
  chemically synthesized
atccctggagaaattatacaca

SEQ ID NO: 44682 - DNA, 22 bp, Artificial Sequence
  chemically synthesized
tccctggagaaattatacacat

SEQ ID NO: 44683 - DNA, 22 bp, Artificial Sequence
  chemically synthesized
gagaaattatacacatccattt

SEQ ID NO: 44684 - DNA, 22 bp, Artificial Sequence
  chemically synthesized
tacacatccatttgccagatga

SEQ ID NO: 44685 - DNA, 22 bp, Artificial Sequence
  chemically synthesized
gccagatgatatacgcatataa

SEQ ID NO: 44686 - DNA, 22 bp, Artificial Sequence
  chemically synthesized
ccagatgatatacgcatataat

SEQ ID NO: 44687 - DNA, 22 bp, Artificial Sequence
  chemically synthesized
aacaaatactcagggtatttgt

SEQ ID NO: 44688 - DNA, 22 bp, Artificial Sequence
  chemically synthesized
agggtatttgttgagtgggtta

SEQ ID NO: 44689 - DNA, 22 bp, Artificial Sequence
  chemically synthesized
gttgagtgggttaggtccccac

SEQ ID NO: 44690 - DNA, 22 bp, Artificial Sequence
  chemically synthesized
ttgagtgggttaggtccccaca

SEQ ID NO: 44691 - DNA, 22 bp, Artificial Sequence
  chemically synthesized
agtgggttaggtccccacattt

SEQ ID NO: 44692 - DNA, 22 bp, Artificial Sequence
  chemically synthesized
ggtccccacatttttatacata

SEQ ID NO: 44693 - DNA, 22 bp, Artificial Sequence
  chemically synthesized
ttatacatacatacacacatac

SEQ ID NO: 44694 - DNA, 22 bp, Artificial Sequence
  chemically synthesized
tatacatacatacacacataca

SEQ ID NO: 44695 - DNA, 22 bp, Artificial Sequence
  chemically synthesized
atacatacatacacacatacac

SEQ ID NO: 44696 - DNA, 22 bp, Artificial Sequence
  chemically synthesized
tacatacatacacacatacaca

SEQ ID NO: 44697 - DNA, 22 bp, Artificial Sequence
  chemically synthesized
tgaatgtaagtgtgtgtccttt

SEQ ID NO: 44698 - DNA, 22 bp, Artificial Sequence
  chemically synthesized
tacaaatactagcttatttagc

SEQ ID NO: 44699 - DNA, 22 bp, Artificial Sequence
  chemically synthesized
acaaatactagcttatttagct

SEQ ID NO: 44700 - DNA, 22 bp, Artificial Sequence
  chemically synthesized
caaatactagcttatttagctc

SEQ ID NO: 44701 - DNA, 22 bp, Artificial Sequence
  chemically synthesized
gcttatttagctcatggtatag

SEQ ID NO: 44702 - DNA, 22 bp, Artificial Sequence
  chemically synthesized
atttagctcatggtataggtag

SEQ ID NO: 44703 - DNA, 22 bp, Artificial Sequence
  chemically synthesized
tttagctcatggtataggtagg

SEQ ID NO: 44704 - DNA, 22 bp, Artificial Sequence
  chemically synthesized
agctcatggtataggtagggta

SEQ ID NO: 44705 - DNA, 22 bp, Artificial Sequence
  chemically synthesized
gctcatggtataggtagggtag

SEQ ID NO: 44706 - DNA, 22 bp, Artificial Sequence
  chemically synthesized
atggtataggtagggtagcata

SEQ ID NO: 44707 - DNA, 22 bp, Artificial Sequence
  chemically synthesized
tataaacaaagaaatctagact

SEQ ID NO: 44708 - DNA, 22 bp, Artificial Sequence
  chemically synthesized
ataaacaaagaaatctagactt

SEQ ID NO: 44709 - DNA, 22 bp, Artificial Sequence
  chemically synthesized
taaacaaagaaatctagactta

SEQ ID NO: 44710 - DNA, 22 bp, Artificial Sequence
  chemically synthesized
gacttaggaaaatcatgttatt

SEQ ID NO: 44711 - DNA, 22 bp, Artificial Sequence
  chemically synthesized
aggaaaatcatgttatttgtct

SEQ ID NO: 44712 - DNA, 22 bp, Artificial Sequence
  chemically synthesized
ggaaaatcatgttatttgtctc

SEQ ID NO: 44713 - DNA, 22 bp, Artificial Sequence
  chemically synthesized
tttgtctcgtgaccaaattccc

SEQ ID NO: 44714 - DNA, 22 bp, Artificial Sequence
  chemically synthesized
gtctcgtgaccaaattcccaaa

SEQ ID NO: 44715 - DNA, 22 bp, Artificial Sequence
  chemically synthesized
tctcgtgaccaaattcccaaat

SEQ ID NO: 44716 - DNA, 22 bp, Artificial Sequence
  chemically synthesized
gtgaccaaattcccaaatcaag

SEQ ID NO: 44717 - DNA, 22 bp, Artificial Sequence
  chemically synthesized
ccaaatcaaggaaataaagaaa

SEQ ID NO: 44718 - DNA, 22 bp, Artificial Sequence
  chemically synthesized
gatttaagccagatttccaaga

SEQ ID NO: 44719 - DNA, 22 bp, Artificial Sequence
  chemically synthesized
aagccagatttccaagaaaaaa

SEQ ID NO: 44720 - DNA, 22 bp, Artificial Sequence
  chemically synthesized
agccagatttccaagaaaaaat

SEQ ID NO: 44721 - DNA, 22 bp, Artificial Sequence
  chemically synthesized
ccaagaaaaaatctagggctct

SEQ ID NO: 44722 - DNA, 22 bp, Artificial Sequence
  chemically synthesized
caagaaaaaatctagggctctt

SEQ ID NO: 44723 - DNA, 22 bp, Artificial Sequence
  chemically synthesized
gggctcttctcactttttcatc

SEQ ID NO: 44724 - DNA, 22 bp, Artificial Sequence
  chemically synthesized
ttctcactttttcatctttgtt

SEQ ID NO: 44725 - DNA, 22 bp, Artificial Sequence
  chemically synthesized
ctcactttttcatctttgttcc

SEQ ID NO: 44726 - DNA, 22 bp, Artificial Sequence
  chemically synthesized
tcactttttcatctttgttcca

SEQ ID NO: 44727 - DNA, 22 bp, Artificial Sequence
  chemically synthesized
actttttcatctttgttccaac

SEQ ID NO: 44728 - DNA, 22 bp, Artificial Sequence
  chemically synthesized
tttcatctttgttccaacattt

SEQ ID NO: 44729 - DNA, 22 bp, Artificial Sequence
  chemically synthesized
ttcatctttgttccaacatttg

SEQ ID NO: 44730 - DNA, 22 bp, Artificial Sequence
  chemically synthesized
tcatctttgttccaacatttga

SEQ ID NO: 44731 - DNA, 22 bp, Artificial Sequence
  chemically synthesized
catctttgttccaacatttgaa

SEQ ID NO: 44732 - DNA, 22 bp, Artificial Sequence
  chemically synthesized
atctttgttccaacatttgaaa

SEQ ID NO: 44733 - DNA, 22 bp, Artificial Sequence
  chemically synthesized
tgttccaacatttgaaaaaata

SEQ ID NO: 44734 - DNA, 22 bp, Artificial Sequence
  chemically synthesized
gttccaacatttgaaaaaataa

SEQ ID NO: 44735 - DNA, 22 bp, Artificial Sequence
  chemically synthesized
ttccaacatttgaaaaaataaa

SEQ ID NO: 44736 - DNA, 22 bp, Artificial Sequence
  chemically synthesized
caacatttgaaaaaataaatct

SEQ ID NO: 44737 - DNA, 22 bp, Artificial Sequence
  chemically synthesized
gaaaaaataaatctaaacacat

SEQ ID NO: 44738 - DNA, 22 bp, Artificial Sequence
  chemically synthesized
aaaaaataaatctaaacacatt

SEQ ID NO: 44739 - DNA, 22 bp, Artificial Sequence
  chemically synthesized
aacacattccaatgtaactgaa

SEQ ID NO: 44740 - DNA, 22 bp, Artificial Sequence
  chemically synthesized
caatgtaactgaagagcaggtt

SEQ ID NO: 44741 - DNA, 22 bp, Artificial Sequence
  chemically synthesized
aagagcaggttaattgtttgcc

SEQ ID NO: 44742 - DNA, 22 bp, Artificial Sequence
  chemically synthesized
attgtttgccacttgcagaatc

SEQ ID NO: 44743 - DNA, 22 bp, Artificial Sequence
  chemically synthesized
tttgccacttgcagaatccaat

SEQ ID NO: 44744 - DNA, 22 bp, Artificial Sequence
  chemically synthesized
gccacttgcagaatccaattaa

SEQ ID NO: 44745 - DNA, 22 bp, Artificial Sequence
  chemically synthesized
ccacttgcagaatccaattaag

SEQ ID NO: 44746 - DNA, 22 bp, Artificial Sequence
  chemically synthesized
gcagaatccaattaagaagaga

SEQ ID NO: 44747 - DNA, 22 bp, Artificial Sequence
  chemically synthesized
cagaatccaattaagaagagag

SEQ ID NO: 44748 - DNA, 22 bp, Artificial Sequence
  chemically synthesized
agaagagagaagtctggtataa

SEQ ID NO: 44749 - DNA, 22 bp, Artificial Sequence
  chemically synthesized
gtataaagaaagtgatttgctt

SEQ ID NO: 44750 - DNA, 22 bp, Artificial Sequence
  chemically synthesized
gcttccaaagctagcttagggg

SEQ ID NO: 44751 - DNA, 22 bp, Artificial Sequence
  chemically synthesized
cttccaaagctagcttagggga

SEQ ID NO: 44752 - DNA, 22 bp, Artificial Sequence
  chemically synthesized
ccaaagctagcttaggggaaga

SEQ ID NO: 44753 - DNA, 22 bp, Artificial Sequence
  chemically synthesized
caaagctagcttaggggaagaa

SEQ ID NO: 44754 - DNA, 22 bp, Artificial Sequence
  chemically synthesized
gcttaggggaagaaatgcagca

SEQ ID NO: 44755 - DNA, 22 bp, Artificial Sequence
  chemically synthesized
aggggaagaaatgcagcagtcc

SEQ ID NO: 44756 - DNA, 22 bp, Artificial Sequence
  chemically synthesized
ggggaagaaatgcagcagtcct

SEQ ID NO: 44757 - DNA, 22 bp, Artificial Sequence
  chemically synthesized
ccgtactacttcactttaggag

SEQ ID NO: 44758 - DNA, 22 bp, Artificial Sequence
  chemically synthesized
cttcactttaggagcagaaagt

SEQ ID NO: 44759 - DNA, 22 bp, Artificial Sequence
  chemically synthesized
cactttaggagcagaaagtggc

SEQ ID NO: 44760 - DNA, 22 bp, Artificial Sequence
  chemically synthesized
actttaggagcagaaagtggca

SEQ ID NO: 44761 - DNA, 22 bp, Artificial Sequence
  chemically synthesized
taggagcagaaagtggcacttt

SEQ ID NO: 44762 - DNA, 22 bp, Artificial Sequence
  chemically synthesized
aggagcagaaagtggcactttt

SEQ ID NO: 44763 - DNA, 22 bp, Artificial Sequence
  chemically synthesized
ggagcagaaagtggcactttta

SEQ ID NO: 44764 - DNA, 22 bp, Artificial Sequence
  chemically synthesized
ttaaaaggcaacagaggaggcg

SEQ ID NO: 44765 - DNA, 22 bp, Artificial Sequence
  chemically synthesized
taaaaggcaacagaggaggcga

SEQ ID NO: 44766 - DNA, 22 bp, Artificial Sequence
  chemically synthesized
aaaaggcaacagaggaggcgag

SEQ ID NO: 44767 - DNA, 22 bp, Artificial Sequence
  chemically synthesized
aaaggcaacagaggaggcgagc

SEQ ID NO: 44768 - DNA, 22 bp, Artificial Sequence
  chemically synthesized
aggggtccatgctagcttgggc

SEQ ID NO: 44769 - DNA, 22 bp, Artificial Sequence
  chemically synthesized
gcttgggcaccttatccaccag

SEQ ID NO: 44770 - DNA, 22 bp, Artificial Sequence
  chemically synthesized
gggcaccttatccaccaggtag

SEQ ID NO: 44771 - DNA, 22 bp, Artificial Sequence
  chemically synthesized
ggcaccttatccaccaggtagt

SEQ ID NO: 44772 - DNA, 22 bp, Artificial Sequence
  chemically synthesized
atccaccaggtagttgagcagt

SEQ ID NO: 44773 - DNA, 22 bp, Artificial Sequence
  chemically synthesized
tccaccaggtagttgagcagtt

SEQ ID NO: 44774 - DNA, 22 bp, Artificial Sequence
  chemically synthesized
agcagttgcctgctggtgcctt

SEQ ID NO: 44775 - DNA, 22 bp, Artificial Sequence
  chemically synthesized
cctgctggtgcctttgtgagca

SEQ ID NO: 44776 - DNA, 22 bp, Artificial Sequence
  chemically synthesized
ctggtgcctttgtgagcagggt

SEQ ID NO: 44777 - DNA, 22 bp, Artificial Sequence
  chemically synthesized
gtgcctttgtgagcagggtgtt

SEQ ID NO: 44778 - DNA, 22 bp, Artificial Sequence
  chemically synthesized
tgtgagcagggtgttgtccctt

SEQ ID NO: 44779 - DNA, 22 bp, Artificial Sequence
  chemically synthesized
gtgagcagggtgttgtcccttg

SEQ ID NO: 44780 - DNA, 22 bp, Artificial Sequence
  chemically synthesized
tgagcagggtgttgtcccttga

SEQ ID NO: 44781 - DNA, 22 bp, Artificial Sequence
  chemically synthesized
tcccttgaggcaaatctctgga

SEQ ID NO: 44782 - DNA, 22 bp, Artificial Sequence
  chemically synthesized
gaggcaaatctctggagggtga

SEQ ID NO: 44783 - DNA, 22 bp, Artificial Sequence
  chemically synthesized
aggcaaatctctggagggtgag

SEQ ID NO: 44784 - DNA, 22 bp, Artificial Sequence
  chemically synthesized
tggagggtgagagttttgtagt

SEQ ID NO: 44785 - DNA, 22 bp, Artificial Sequence
  chemically synthesized
gagggtgagagttttgtagtgg

SEQ ID NO: 44786 - DNA, 22 bp, Artificial Sequence
  chemically synthesized
tgtagtgggcatgctttggttt

SEQ ID NO: 44787 - DNA, 22 bp, Artificial Sequence
  chemically synthesized
gtagtgggcatgctttggttta

SEQ ID NO: 44788 - DNA, 22 bp, Artificial Sequence
  chemically synthesized
tagtgggcatgctttggtttat

SEQ ID NO: 44789 - DNA, 22 bp, Artificial Sequence
  chemically synthesized
tggtttataaatcacctgtgaa

SEQ ID NO: 44790 - DNA, 22 bp, Artificial Sequence
  chemically synthesized
ggtttataaatcacctgtgaac

SEQ ID NO: 44791 - DNA, 22 bp, Artificial Sequence
  chemically synthesized
gtttataaatcacctgtgaact

SEQ ID NO: 44792 - DNA, 22 bp, Artificial Sequence
  chemically synthesized
ataaatcacctgtgaactcagg

SEQ ID NO: 44793 - DNA, 22 bp, Artificial Sequence
  chemically synthesized
taaatcacctgtgaactcagga

SEQ ID NO: 44794 - DNA, 22 bp, Artificial Sequence
  chemically synthesized
tgaactcaggagttccatcttg

SEQ ID NO: 44795 - DNA, 22 bp, Artificial Sequence
  chemically synthesized
aggagttccatcttgaagcaca

SEQ ID NO: 44796 - DNA, 22 bp, Artificial Sequence
  chemically synthesized
catcttgaagcacatacatagt

SEQ ID NO: 44797 - DNA, 22 bp, Artificial Sequence
  chemically synthesized
gaagcacatacatagttagatg

SEQ ID NO: 44798 - DNA, 22 bp, Artificial Sequence
  chemically synthesized
aagcacatacatagttagatga

SEQ ID NO: 44799 - DNA, 22 bp, Artificial Sequence
  chemically synthesized
gatgaacttgccctgcagggag

SEQ ID NO: 44800 - DNA, 22 bp, Artificial Sequence
  chemically synthesized
gccctgcagggagagtctgatg

SEQ ID NO: 44801 - DNA, 22 bp, Artificial Sequence
  chemically synthesized
ccctgcagggagagtctgatga

SEQ ID NO: 44802 - DNA, 22 bp, Artificial Sequence
  chemically synthesized
cagggagagtctgatgaaaggg

SEQ ID NO: 44803 - DNA, 22 bp, Artificial Sequence
  chemically synthesized
atgaaagggaggtagatgcttg

SEQ ID NO: 44804 - DNA, 22 bp, Artificial Sequence
  chemically synthesized
gcaatttaatctataaattacc

SEQ ID NO: 44805 - DNA, 22 bp, Artificial Sequence
  chemically synthesized
caatttaatctataaattacca

SEQ ID NO: 44806 - DNA, 22 bp, Artificial Sequence
  chemically synthesized
aatctataaattaccagataaa

SEQ ID NO: 44807 - DNA, 22 bp, Artificial Sequence
  chemically synthesized
atctataaattaccagataaaa

SEQ ID NO: 44808 - DNA, 22 bp, Artificial Sequence
  chemically synthesized
taaattaccagataaaatttta

SEQ ID NO: 44809 - DNA, 22 bp, Artificial Sequence
  chemically synthesized
ccagataaaattttacaagttg

SEQ ID NO: 44810 - DNA, 22 bp, Artificial Sequence
  chemically synthesized
tacaagttgactttaaagtcaa

SEQ ID NO: 44811 - DNA, 22 bp, Artificial Sequence
  chemically synthesized
acaagttgactttaaagtcaaa

SEQ ID NO: 44812 - DNA, 22 bp, Artificial Sequence
  chemically synthesized
caagttgactttaaagtcaaac

SEQ ID NO: 44813 - DNA, 22 bp, Artificial Sequence
  chemically synthesized
actttaaagtcaaacacatttg

SEQ ID NO: 44814 - DNA, 22 bp, Artificial Sequence
  chemically synthesized
taaagtcaaacacatttgaatt

SEQ ID NO: 44815 - DNA, 22 bp, Artificial Sequence
  chemically synthesized
aaagtcaaacacatttgaattt

SEQ ID NO: 44816 - DNA, 22 bp, Artificial Sequence
  chemically synthesized
aagtcaaacacatttgaattta

SEQ ID NO: 44817 - DNA, 22 bp, Artificial Sequence
  chemically synthesized
gaatttagtggaagccattcaa

SEQ ID NO: 44818 - DNA, 22 bp, Artificial Sequence
  chemically synthesized
aatttagtggaagccattcaag

SEQ ID NO: 44819 - DNA, 22 bp, Artificial Sequence
  chemically synthesized
agtggaagccattcaagaaaat

SEQ ID NO: 44820 - DNA, 22 bp, Artificial Sequence
  chemically synthesized
gtggaagccattcaagaaaata

SEQ ID NO: 44821 - DNA, 22 bp, Artificial Sequence
  chemically synthesized
aagaaaatatcaaagaaaatac

SEQ ID NO: 44822 - DNA, 22 bp, Artificial Sequence
  chemically synthesized
agcaaagagttttttggggaaa

SEQ ID NO: 44823 - DNA, 22 bp, Artificial Sequence
  chemically synthesized
tttggggaaattggtgtctatg

SEQ ID NO: 44824 - DNA, 22 bp, Artificial Sequence
  chemically synthesized
ttggggaaattggtgtctatgt

SEQ ID NO: 44825 - DNA, 22 bp, Artificial Sequence
  chemically synthesized
tggggaaattggtgtctatgtc

SEQ ID NO: 44826 - DNA, 22 bp, Artificial Sequence
  chemically synthesized
ggggaaattggtgtctatgtct

SEQ ID NO: 44827 - DNA, 22 bp, Artificial Sequence
  chemically synthesized
gggaaattggtgtctatgtctg

SEQ ID NO: 44828 - DNA, 22 bp, Artificial Sequence
  chemically synthesized
gtgtctatgtctgtgtgtgtag

SEQ ID NO: 44829 - DNA, 22 bp, Artificial Sequence
  chemically synthesized
tgtctgtgtgtgtagggagtgc

SEQ ID NO: 44830 - DNA, 22 bp, Artificial Sequence
  chemically synthesized
tgtgtgtagggagtgcagggga

SEQ ID NO: 44831 - DNA, 22 bp, Artificial Sequence
  chemically synthesized
tatttcagcccatggaaactag

SEQ ID NO: 44832 - DNA, 22 bp, Artificial Sequence
  chemically synthesized
tttcagcccatggaaactagga

SEQ ID NO: 44833 - DNA, 22 bp, Artificial Sequence
  chemically synthesized
cagcccatggaaactaggatgt

SEQ ID NO: 44834 - DNA, 22 bp, Artificial Sequence
  chemically synthesized
agcccatggaaactaggatgta

SEQ ID NO: 44835 - DNA, 22 bp, Artificial Sequence
  chemically synthesized
ggatgtagatcactgtgaactt

SEQ ID NO: 44836 - DNA, 22 bp, Artificial Sequence
  chemically synthesized
tgaacttattcagcaggctaca

SEQ ID NO: 44837 - DNA, 22 bp, Artificial Sequence
  chemically synthesized
attcagcaggctacacccaaag

SEQ ID NO: 44838 - DNA, 22 bp, Artificial Sequence
  chemically synthesized
ttcagcaggctacacccaaagg

SEQ ID NO: 44839 - DNA, 22 bp, Artificial Sequence
  chemically synthesized
agcaggctacacccaaaggcta

SEQ ID NO: 44840 - DNA, 22 bp, Artificial Sequence
  chemically synthesized
cacccaaaggctagaacaaact

SEQ ID NO: 44841 - DNA, 22 bp, Artificial Sequence
  chemically synthesized
gaacaaacttctctgccacagg

SEQ ID NO: 44842 - DNA, 22 bp, Artificial Sequence
  chemically synthesized
ctctgccacaggattaacatat

SEQ ID NO: 44843 - DNA, 22 bp, Artificial Sequence
  chemically synthesized
tctgccacaggattaacatatg

SEQ ID NO: 44844 - DNA, 22 bp, Artificial Sequence
  chemically synthesized
tgccacaggattaacatatgtt

SEQ ID NO: 44845 - DNA, 22 bp, Artificial Sequence
  chemically synthesized
ccacaggattaacatatgtttt

SEQ ID NO: 44846 - DNA, 22 bp, Artificial Sequence
  chemically synthesized
acatatgttttaatcgacctgg

SEQ ID NO: 44847 - DNA, 22 bp, Artificial Sequence
  chemically synthesized
taatcgacctggggggcacatt

SEQ ID NO: 44848 - DNA, 22 bp, Artificial Sequence
  chemically synthesized
aatcgacctggggggcacattc

SEQ ID NO: 44849 - DNA, 22 bp, Artificial Sequence
  chemically synthesized
atcgacctggggggcacattct

SEQ ID NO: 44850 - DNA, 22 bp, Artificial Sequence
  chemically synthesized
gggggcacattctctgataagc

SEQ ID NO: 44851 - DNA, 22 bp, Artificial Sequence
  chemically synthesized
tctgataagctcttttggaaag

SEQ ID NO: 44852 - DNA, 22 bp, Artificial Sequence
  chemically synthesized
tgataagctcttttggaaagcc

SEQ ID NO: 44853 - DNA, 22 bp, Artificial Sequence
  chemically synthesized
ataagctcttttggaaagccag

SEQ ID NO: 44854 - DNA, 22 bp, Artificial Sequence
  chemically synthesized
ttttggaaagccaggctttctg

SEQ ID NO: 44855 - DNA, 22 bp, Artificial Sequence
  chemically synthesized
ttggaaagccaggctttctgtg

SEQ ID NO: 44856 - DNA, 22 bp, Artificial Sequence
  chemically synthesized
tggaaagccaggctttctgtgg

SEQ ID NO: 44857 - DNA, 22 bp, Artificial Sequence
  chemically synthesized
ggaaagccaggctttctgtgga

SEQ ID NO: 44858 - DNA, 22 bp, Artificial Sequence
  chemically synthesized
gaaagccaggctttctgtggac

SEQ ID NO: 44859 - DNA, 22 bp, Artificial Sequence
  chemically synthesized
tctgtggacgtgttatctttcc

SEQ ID NO: 44860 - DNA, 22 bp, Artificial Sequence
  chemically synthesized
ctgtggacgtgttatctttcca

SEQ ID NO: 44861 - DNA, 22 bp, Artificial Sequence
  chemically synthesized
tgtggacgtgttatctttccaa

SEQ ID NO: 44862 - DNA, 22 bp, Artificial Sequence
  chemically synthesized
tggacgtgttatctttccaatg

SEQ ID NO: 44863 - DNA, 22 bp, Artificial Sequence
  chemically synthesized
tctttccaatgtgtgctggaat

SEQ ID NO: 44864 - DNA, 22 bp, Artificial Sequence
  chemically synthesized
tccaatgtgtgctggaatgccc

SEQ ID NO: 44865 - DNA, 22 bp, Artificial Sequence
  chemically synthesized
ccaatgtgtgctggaatgcccg

SEQ ID NO: 44866 - DNA, 22 bp, Artificial Sequence
  chemically synthesized
caatgtgtgctggaatgcccgg

SEQ ID NO: 44867 - DNA, 22 bp, Artificial Sequence
  chemically synthesized
gaatgcccggggagaggaaaaa

SEQ ID NO: 44868 - DNA, 22 bp, Artificial Sequence
  chemically synthesized
cttttacagccatgctcagtga

SEQ ID NO: 44869 - DNA, 22 bp, Artificial Sequence
  chemically synthesized
ttttacagccatgctcagtgag

SEQ ID NO: 44870 - DNA, 22 bp, Artificial Sequence
  chemically synthesized
ttacagccatgctcagtgagaa

SEQ ID NO: 44871 - DNA, 22 bp, Artificial Sequence
  chemically synthesized
tacagccatgctcagtgagaag

SEQ ID NO: 44872 - DNA, 22 bp, Artificial Sequence
  chemically synthesized
acagccatgctcagtgagaagc

SEQ ID NO: 44873 - DNA, 22 bp, Artificial Sequence
  chemically synthesized
cagccatgctcagtgagaagcg

SEQ ID NO: 44874 - DNA, 22 bp, Artificial Sequence
  chemically synthesized
agtgagaagcggagaaacatct

SEQ ID NO: 44875 - DNA, 22 bp, Artificial Sequence
  chemically synthesized
ctattcacaaattgctaagtct

SEQ ID NO: 44876 - DNA, 22 bp, Artificial Sequence
  chemically synthesized
tattcacaaattgctaagtctt

SEQ ID NO: 44877 - DNA, 22 bp, Artificial Sequence
  chemically synthesized
ttcacaaattgctaagtctttt

SEQ ID NO: 44878 - DNA, 22 bp, Artificial Sequence
  chemically synthesized
acaaattgctaagtcttttaca

SEQ ID NO: 44879 - DNA, 22 bp, Artificial Sequence
  chemically synthesized
ctaagtcttttacacatgcaaa

SEQ ID NO: 44880 - DNA, 22 bp, Artificial Sequence
  chemically synthesized
agtcttttacacatgcaaatat

SEQ ID NO: 44881 - DNA, 22 bp, Artificial Sequence
  chemically synthesized
ttacacatgcaaatatgcatac

SEQ ID NO: 44882 - DNA, 22 bp, Artificial Sequence
  chemically synthesized
tacacatgcaaatatgcataca

SEQ ID NO: 44883 - DNA, 22 bp, Artificial Sequence
  chemically synthesized
acacatgcaaatatgcatacac

SEQ ID NO: 44884 - DNA, 22 bp, Artificial Sequence
  chemically synthesized
cacatgcaaatatgcatacaca

SEQ ID NO: 44885 - DNA, 22 bp, Artificial Sequence
  chemically synthesized
acacaccacagtgaggaagaaa

SEQ ID NO: 44886 - DNA, 22 bp, Artificial Sequence
  chemically synthesized
tcacaccattaataaaatacat

SEQ ID NO: 44887 - DNA, 22 bp, Artificial Sequence
  chemically synthesized
acaccattaataaaatacattt

SEQ ID NO: 44888 - DNA, 22 bp, Artificial Sequence
  chemically synthesized
ataaaatacatttacttcagta

SEQ ID NO: 44889 - DNA, 22 bp, Artificial Sequence
  chemically synthesized
acttcagtagcaatatacatct

SEQ ID NO: 44890 - DNA, 22 bp, Artificial Sequence
  chemically synthesized
cttcagtagcaatatacatcta

SEQ ID NO: 44891 - DNA, 22 bp, Artificial Sequence
  chemically synthesized
cagtagcaatatacatctacat

SEQ ID NO: 44892 - DNA, 22 bp, Artificial Sequence
  chemically synthesized
agtagcaatatacatctacatt

SEQ ID NO: 44893 - DNA, 22 bp, Artificial Sequence
  chemically synthesized
cattttgcctataatataaaag

SEQ ID NO: 44894 - DNA, 22 bp, Artificial Sequence
  chemically synthesized
tgcctataatataaaagtattt

SEQ ID NO: 44895 - DNA, 22 bp, Artificial Sequence
  chemically synthesized
gcctataatataaaagtatttt

SEQ ID NO: 44896 - DNA, 22 bp, Artificial Sequence
  chemically synthesized
cctataatataaaagtattttt

SEQ ID NO: 44897 - DNA, 22 bp, Artificial Sequence
  chemically synthesized
taatataaaagtatttttccta

SEQ ID NO: 44898 - DNA, 22 bp, Artificial Sequence
  chemically synthesized
ttcctattaaaagatttgttta

SEQ ID NO: 44899 - DNA, 22 bp, Artificial Sequence
  chemically synthesized
tcctattaaaagatttgtttaa

SEQ ID NO: 44900 - DNA, 22 bp, Artificial Sequence
  chemically synthesized
cctattaaaagatttgtttaat

SEQ ID NO: 44901 - DNA, 22 bp, Artificial Sequence
  chemically synthesized
ctattaaaagatttgtttaatg

SEQ ID NO: 44902 - DNA, 22 bp, Artificial Sequence
  chemically synthesized
ttaaaagatttgtttaatgttt

SEQ ID NO: 44903 - DNA, 22 bp, Artificial Sequence
  chemically synthesized
aaagatttgtttaatgtttctt

SEQ ID NO: 44904 - DNA, 22 bp, Artificial Sequence
  chemically synthesized
gtttaatgtttcttcaccaaca

SEQ ID NO: 44905 - DNA, 22 bp, Artificial Sequence
  chemically synthesized
tttaatgtttcttcaccaacaa

SEQ ID NO: 44906 - DNA, 22 bp, Artificial Sequence
  chemically synthesized
aatgtttcttcaccaacaaata

SEQ ID NO: 44907 - DNA, 22 bp, Artificial Sequence
  chemically synthesized
atgtttcttcaccaacaaataa

SEQ ID NO: 44908 - DNA, 22 bp, Artificial Sequence
  chemically synthesized
cttcaccaacaaataaacccta

SEQ ID NO: 44909 - DNA, 22 bp, Artificial Sequence
  chemically synthesized
ttcaccaacaaataaaccctat

SEQ ID NO: 44910 - DNA, 22 bp, Artificial Sequence
  chemically synthesized
caccaacaaataaaccctatta

SEQ ID NO: 44911 - DNA, 22 bp, Artificial Sequence
  chemically synthesized
accaacaaataaaccctattaa

SEQ ID NO: 44912 - DNA, 22 bp, Artificial Sequence
  chemically synthesized
ttaaatccccattgccatatga

SEQ ID NO: 44913 - DNA, 22 bp, Artificial Sequence
  chemically synthesized
aatccccattgccatatgagcc

SEQ ID NO: 44914 - DNA, 22 bp, Artificial Sequence
  chemically synthesized
ccatatgagccctggaggtgaa

SEQ ID NO: 44915 - DNA, 22 bp, Artificial Sequence
  chemically synthesized
gaggtgaatcagagaaacaaaa

SEQ ID NO: 44916 - DNA, 22 bp, Artificial Sequence
  chemically synthesized
tggaaaaatcatcaggttaaaa

SEQ ID NO: 44917 - DNA, 22 bp, Artificial Sequence
  chemically synthesized
aaaaaagaaaaattgattctgt

SEQ ID NO: 44918 - DNA, 22 bp, Artificial Sequence
  chemically synthesized
attctgttttgggatatttcct

SEQ ID NO: 44919 - DNA, 22 bp, Artificial Sequence
  chemically synthesized
tgttttgggatatttcctagca

SEQ ID NO: 44920 - DNA, 22 bp, Artificial Sequence
  chemically synthesized
ttttgggatatttcctagcaac

SEQ ID NO: 44921 - DNA, 22 bp, Artificial Sequence
  chemically synthesized
tgggatatttcctagcaacatg

SEQ ID NO: 44922 - DNA, 22 bp, Artificial Sequence
  chemically synthesized
gggatatttcctagcaacatga

SEQ ID NO: 44923 - DNA, 22 bp, Artificial Sequence
  chemically synthesized
ggatatttcctagcaacatgag

SEQ ID NO: 44924 - DNA, 22 bp, Artificial Sequence
  chemically synthesized
cctagcaacatgagctggggag

SEQ ID NO: 44925 - DNA, 22 bp, Artificial Sequence
  chemically synthesized
ctagcaacatgagctggggagg

SEQ ID NO: 44926 - DNA, 22 bp, Artificial Sequence
  chemically synthesized
gcaacatgagctggggagggga

SEQ ID NO: 44927 - DNA, 22 bp, Artificial Sequence
  chemically synthesized
gggaggggatctcagcagtgat

SEQ ID NO: 44928 - DNA, 22 bp, Artificial Sequence
  chemically synthesized
agcagtgatgctctatgaagca

SEQ ID NO: 44929 - DNA, 22 bp, Artificial Sequence
  chemically synthesized
tatgaagcataataaaatgaca

SEQ ID NO: 44930 - DNA, 22 bp, Artificial Sequence
  chemically synthesized
tgaagcataataaaatgacaca

SEQ ID NO: 44931 - DNA, 22 bp, Artificial Sequence
  chemically synthesized
caggtaacttagttaaaggggg

SEQ ID NO: 44932 - DNA, 22 bp, Artificial Sequence
  chemically synthesized
agttaaagggggaaataaatgg

SEQ ID NO: 44933 - DNA, 22 bp, Artificial Sequence
  chemically synthesized
gttaaagggggaaataaatgga

SEQ ID NO: 44934 - DNA, 22 bp, Artificial Sequence
  chemically synthesized
aagggggaaataaatggaagtt

SEQ ID NO: 44935 - DNA, 22 bp, Artificial Sequence
  chemically synthesized
cctctttttgaatatcaattgt

SEQ ID NO: 44936 - DNA, 22 bp, Artificial Sequence
  chemically synthesized
ctctttttgaatatcaattgta

SEQ ID NO: 44937 - DNA, 22 bp, Artificial Sequence
  chemically synthesized
tttttgaatatcaattgtagcc

SEQ ID NO: 44938 - DNA, 22 bp, Artificial Sequence
  chemically synthesized
tttgaatatcaattgtagcctg

SEQ ID NO: 44939 - DNA, 22 bp, Artificial Sequence
  chemically synthesized
ttgaatatcaattgtagcctgc

SEQ ID NO: 44940 - DNA, 22 bp, Artificial Sequence
  chemically synthesized
tgaatatcaattgtagcctgct

SEQ ID NO: 44941 - DNA, 22 bp, Artificial Sequence
  chemically synthesized
gaatatcaattgtagcctgctc

SEQ ID NO: 44942 - DNA, 22 bp, Artificial Sequence
  chemically synthesized
aatatcaattgtagcctgctct

SEQ ID NO: 44943 - DNA, 22 bp, Artificial Sequence
  chemically synthesized
tagcctgctctgctacatttca

SEQ ID NO: 44944 - DNA, 22 bp, Artificial Sequence
  chemically synthesized
ctctgctacatttcaaaaacac

SEQ ID NO: 44945 - DNA, 22 bp, Artificial Sequence
  chemically synthesized
tgctacatttcaaaaacactct

SEQ ID NO: 44946 - DNA, 22 bp, Artificial Sequence
  chemically synthesized
ctacatttcaaaaacactcttc

SEQ ID NO: 44947 - DNA, 22 bp, Artificial Sequence
  chemically synthesized
catttcaaaaacactcttcaaa

SEQ ID NO: 44948 - DNA, 22 bp, Artificial Sequence
  chemically synthesized
caaaaacactcttcaaaatgtt

SEQ ID NO: 44949 - DNA, 22 bp, Artificial Sequence
  chemically synthesized
aaaaacactcttcaaaatgttt

SEQ ID NO: 44950 - DNA, 22 bp, Artificial Sequence
  chemically synthesized
ttcaaaatgtttaactgaactc

SEQ ID NO: 44951 - DNA, 22 bp, Artificial Sequence
  chemically synthesized
caaaatgtttaactgaactcac

SEQ ID NO: 44952 - DNA, 22 bp, Artificial Sequence
  chemically synthesized
aaaatgtttaactgaactcact

SEQ ID NO: 44953 - DNA, 22 bp, Artificial Sequence
  chemically synthesized
aactgaactcactgtaggaagc

SEQ ID NO: 44954 - DNA, 22 bp, Artificial Sequence
  chemically synthesized
actgaactcactgtaggaagca

SEQ ID NO: 44955 - DNA, 22 bp, Artificial Sequence
  chemically synthesized
aactcactgtaggaagcacctt

SEQ ID NO: 44956 - DNA, 22 bp, Artificial Sequence
  chemically synthesized
actgtaggaagcaccttattaa

SEQ ID NO: 44957 - DNA, 22 bp, Artificial Sequence
  chemically synthesized
taggaagcaccttattaattta

SEQ ID NO: 44958 - DNA, 22 bp, Artificial Sequence
  chemically synthesized
attaatttattgtgtgttttga

SEQ ID NO: 44959 - DNA, 22 bp, Artificial Sequence
  chemically synthesized
ttaatttattgtgtgttttgaa

SEQ ID NO: 44960 - DNA, 22 bp, Artificial Sequence
  chemically synthesized
atttattgtgtgttttgaagtc

SEQ ID NO: 44961 - DNA, 22 bp, Artificial Sequence
  chemically synthesized
attgtgtgttttgaagtcacac

SEQ ID NO: 44962 - DNA, 22 bp, Artificial Sequence
  chemically synthesized
ttgtgtgttttgaagtcacact

SEQ ID NO: 44963 - DNA, 22 bp, Artificial Sequence
  chemically synthesized
tgtgttttgaagtcacactgtg

SEQ ID NO: 44964 - DNA, 22 bp, Artificial Sequence
  chemically synthesized
tgaagtcacactgtgagctata

SEQ ID NO: 44965 - DNA, 22 bp, Artificial Sequence
  chemically synthesized
gaagtcacactgtgagctatag

SEQ ID NO: 44966 - DNA, 22 bp, Artificial Sequence
  chemically synthesized
aagtcacactgtgagctataga

SEQ ID NO: 44967 - DNA, 22 bp, Artificial Sequence
  chemically synthesized
tgagctatagaatttacccaag

SEQ ID NO: 44968 - DNA, 22 bp, Artificial Sequence
  chemically synthesized
tagaatttacccaagcacaact

SEQ ID NO: 44969 - DNA, 22 bp, Artificial Sequence
  chemically synthesized
acccaagcacaactcttcctgg

SEQ ID NO: 44970 - DNA, 22 bp, Artificial Sequence
  chemically synthesized
cccaagcacaactcttcctgga

SEQ ID NO: 44971 - DNA, 22 bp, Artificial Sequence
  chemically synthesized
ttcctggaaaagagagttcaaa

SEQ ID NO: 44972 - DNA, 22 bp, Artificial Sequence
  chemically synthesized
cctggaaaagagagttcaaatg

SEQ ID NO: 44973 - DNA, 22 bp, Artificial Sequence
  chemically synthesized
ctggaaaagagagttcaaatga

SEQ ID NO: 44974 - DNA, 22 bp, Artificial Sequence
  chemically synthesized
gaaaagagagttcaaatgagaa

SEQ ID NO: 44975 - DNA, 22 bp, Artificial Sequence
  chemically synthesized
aaatgagaaacagtgcggggtg

SEQ ID NO: 44976 - DNA, 22 bp, Artificial Sequence
  chemically synthesized
aaatatctatttctcaatgata

SEQ ID NO: 44977 - DNA, 22 bp, Artificial Sequence
  chemically synthesized
tttctcaatgatattttgatat

SEQ ID NO: 44978 - DNA, 22 bp, Artificial Sequence
  chemically synthesized
ctcaatgatattttgatatatc

SEQ ID NO: 44979 - DNA, 22 bp, Artificial Sequence
  chemically synthesized
tcaatgatattttgatatatct

SEQ ID NO: 44980 - DNA, 22 bp, Artificial Sequence
  chemically synthesized
aatgatattttgatatatctat

SEQ ID NO: 44981 - DNA, 22 bp, Artificial Sequence
  chemically synthesized
tgatatatctatcaagtgcttt

SEQ ID NO: 44982 - DNA, 22 bp, Artificial Sequence
  chemically synthesized
gatatatctatcaagtgctttt

SEQ ID NO: 44983 - DNA, 22 bp, Artificial Sequence
  chemically synthesized
atatatctatcaagtgcttttt

SEQ ID NO: 44984 - DNA, 22 bp, Artificial Sequence
  chemically synthesized
tcaagtgctttttagtggatta

SEQ ID NO: 44985 - DNA, 22 bp, Artificial Sequence
  chemically synthesized
tttagtggattaggttcagaat

SEQ ID NO: 44986 - DNA, 22 bp, Artificial Sequence
  chemically synthesized
ttagtggattaggttcagaatg

SEQ ID NO: 44987 - DNA, 22 bp, Artificial Sequence
  chemically synthesized
tagtggattaggttcagaatgc

SEQ ID NO: 44988 - DNA, 22 bp, Artificial Sequence
  chemically synthesized
agtggattaggttcagaatgca

SEQ ID NO: 44989 - DNA, 22 bp, Artificial Sequence
  chemically synthesized
gtggattaggttcagaatgcat

SEQ ID NO: 44990 - DNA, 22 bp, Artificial Sequence
  chemically synthesized
ggttcagaatgcatcagccaat

SEQ ID NO: 44991 - DNA, 22 bp, Artificial Sequence
  chemically synthesized
agaatgcatcagccaatgcctg

SEQ ID NO: 44992 - DNA, 22 bp, Artificial Sequence
  chemically synthesized
ttcaataatccagttttccagc

SEQ ID NO: 44993 - DNA, 22 bp, Artificial Sequence
  chemically synthesized
aataatccagttttccagcata

SEQ ID NO: 44994 - DNA, 22 bp, Artificial Sequence
  chemically synthesized
tccagcatagagcatattaaat

SEQ ID NO: 44995 - DNA, 22 bp, Artificial Sequence
  chemically synthesized
ccagcatagagcatattaaatt

SEQ ID NO: 44996 - DNA, 22 bp, Artificial Sequence
  chemically synthesized
cagcatagagcatattaaattg

SEQ ID NO: 44997 - DNA, 22 bp, Artificial Sequence
  chemically synthesized
aattgaggaaggacaaagtcac

SEQ ID NO: 44998 - DNA, 22 bp, Artificial Sequence
  chemically synthesized
aggaaggacaaagtcacagagg

SEQ ID NO: 44999 - DNA, 22 bp, Artificial Sequence
  chemically synthesized
tggccaaggactttgcatgaaa

SEQ ID NO: 45000 - DNA, 22 bp, Artificial Sequence
  chemically synthesized
tgcatgaaacagtgagcgtgca

SEQ ID NO: 45001 - DNA, 22 bp, Artificial Sequence
  chemically synthesized
gcatgaaacagtgagcgtgcat

SEQ ID NO: 45002 - DNA, 22 bp, Artificial Sequence
  chemically synthesized
catgaaacagtgagcgtgcatc

SEQ ID NO: 45003 - DNA, 22 bp, Artificial Sequence
  chemically synthesized
ctccttgccctgccctcatggt

SEQ ID NO: 45004 - DNA, 22 bp, Artificial Sequence
  chemically synthesized
cttgccctgccctcatggtctg

SEQ ID NO: 45005 - DNA, 22 bp, Artificial Sequence
  chemically synthesized
gccctgccctcatggtctgtgt

SEQ ID NO: 45006 - DNA, 22 bp, Artificial Sequence
  chemically synthesized
ccctgccctcatggtctgtgta

SEQ ID NO: 45007 - DNA, 22 bp, Artificial Sequence
  chemically synthesized
ccctcatggtctgtgtactctc

SEQ ID NO: 45008 - DNA, 22 bp, Artificial Sequence
  chemically synthesized
atggtctgtgtactctcaggag

SEQ ID NO: 45009 - DNA, 22 bp, Artificial Sequence
  chemically synthesized
tgtactctcaggaggtcaggac

SEQ ID NO: 45010 - DNA, 22 bp, Artificial Sequence
  chemically synthesized
tcaggaggtcaggacaggcctt

SEQ ID NO: 45011 - DNA, 22 bp, Artificial Sequence
  chemically synthesized
aggaggtcaggacaggcctttc

SEQ ID NO: 45012 - DNA, 22 bp, Artificial Sequence
  chemically synthesized
tctgagaatgagaatctgttca

SEQ ID NO: 45013 - DNA, 22 bp, Artificial Sequence
  chemically synthesized
ctgagaatgagaatctgttcat

SEQ ID NO: 45014 - DNA, 22 bp, Artificial Sequence
  chemically synthesized
tgagaatgagaatctgttcatc

SEQ ID NO: 45015 - DNA, 22 bp, Artificial Sequence
  chemically synthesized
agaatgagaatctgttcatctg

SEQ ID NO: 45016 - DNA, 22 bp, Artificial Sequence
  chemically synthesized
ttcatctgcctttctactggat

SEQ ID NO: 45017 - DNA, 22 bp, Artificial Sequence
  chemically synthesized
atctgcctttctactggatact

SEQ ID NO: 45018 - DNA, 22 bp, Artificial Sequence
  chemically synthesized
cctttctactggatacttgtca

SEQ ID NO: 45019 - DNA, 22 bp, Artificial Sequence
  chemically synthesized
tctactggatacttgtcatcgg

SEQ ID NO: 45020 - DNA, 22 bp, Artificial Sequence
  chemically synthesized
ctactggatacttgtcatcggc

SEQ ID NO: 45021 - DNA, 22 bp, Artificial Sequence
  chemically synthesized
tactggatacttgtcatcggca

SEQ ID NO: 45022 - DNA, 22 bp, Artificial Sequence
  chemically synthesized
ctggatacttgtcatcggcata

SEQ ID NO: 45023 - DNA, 22 bp, Artificial Sequence
  chemically synthesized
gatacttgtcatcggcatacaa

SEQ ID NO: 45024 - DNA, 22 bp, Artificial Sequence
  chemically synthesized
gtcatcggcatacaaacacatg

SEQ ID NO: 45025 - DNA, 22 bp, Artificial Sequence
  chemically synthesized
tcatcggcatacaaacacatgt

SEQ ID NO: 45026 - DNA, 22 bp, Artificial Sequence
  chemically synthesized
tctgcagtgtgtcatctttcag

SEQ ID NO: 45027 - DNA, 22 bp, Artificial Sequence
  chemically synthesized
tgcagtgtgtcatctttcagaa

SEQ ID NO: 45028 - DNA, 22 bp, Artificial Sequence
  chemically synthesized
cagtgtgtcatctttcagaacc

SEQ ID NO: 45029 - DNA, 22 bp, Artificial Sequence
  chemically synthesized
tcagaacctcccctgaccctgt

SEQ ID NO: 45030 - DNA, 22 bp, Artificial Sequence
  chemically synthesized
cagaacctcccctgaccctgta

SEQ ID NO: 45031 - DNA, 22 bp, Artificial Sequence
  chemically synthesized
agaacctcccctgaccctgtat

SEQ ID NO: 45032 - DNA, 22 bp, Artificial Sequence
  chemically synthesized
ccctgaccctgtattccctaga

SEQ ID NO: 45033 - DNA, 22 bp, Artificial Sequence
  chemically synthesized
accctgtattccctagaagtct

SEQ ID NO: 45034 - DNA, 22 bp, Artificial Sequence
  chemically synthesized
tattccctagaagtctcgctgc

SEQ ID NO: 45035 - DNA, 22 bp, Artificial Sequence
  chemically synthesized
cctagaagtctcgctgctttca

SEQ ID NO: 45036 - DNA, 22 bp, Artificial Sequence
  chemically synthesized
gaagtctcgctgctttcagagc

SEQ ID NO: 45037 - DNA, 22 bp, Artificial Sequence
  chemically synthesized
gctgctttcagagccaggcttc

SEQ ID NO: 45038 - DNA, 22 bp, Artificial Sequence
  chemically synthesized
ctttcagagccaggcttctctc

SEQ ID NO: 45039 - DNA, 22 bp, Artificial Sequence
  chemically synthesized
tcagagccaggcttctctcctg

SEQ ID NO: 45040 - DNA, 22 bp, Artificial Sequence
  chemically synthesized
cagagccaggcttctctcctgc

SEQ ID NO: 45041 - DNA, 22 bp, Artificial Sequence
  chemically synthesized
agagccaggcttctctcctgct

SEQ ID NO: 45042 - DNA, 22 bp, Artificial Sequence
  chemically synthesized
ctctcctgctgccacccccact

SEQ ID NO: 45043 - DNA, 22 bp, Artificial Sequence
  chemically synthesized
tctcctgctgccacccccactg

SEQ ID NO: 45044 - DNA, 22 bp, Artificial Sequence
  chemically synthesized
tcctgctgccacccccactgct

SEQ ID NO: 45045 - DNA, 22 bp, Artificial Sequence
  chemically synthesized
ctgctgccacccccactgctct

SEQ ID NO: 45046 - DNA, 22 bp, Artificial Sequence
  chemically synthesized
ctgccacccccactgctcttct

SEQ ID NO: 45047 - DNA, 22 bp, Artificial Sequence
  chemically synthesized
ccacccccactgctcttctagt

SEQ ID NO: 45048 - DNA, 22 bp, Artificial Sequence
  chemically synthesized
ctcttctagtcactctttaacc

SEQ ID NO: 45049 - DNA, 22 bp, Artificial Sequence
  chemically synthesized
ttctagtcactctttaacccac

SEQ ID NO: 45050 - DNA, 22 bp, Artificial Sequence
  chemically synthesized
ctagtcactctttaacccactc

SEQ ID NO: 45051 - DNA, 22 bp, Artificial Sequence
  chemically synthesized
tagtcactctttaacccactcc

SEQ ID NO: 45052 - DNA, 22 bp, Artificial Sequence
  chemically synthesized
gtcactctttaacccactccat

SEQ ID NO: 45053 - DNA, 22 bp, Artificial Sequence
  chemically synthesized
tttaacccactccatctgcatg

SEQ ID NO: 45054 - DNA, 22 bp, Artificial Sequence
  chemically synthesized
taacccactccatctgcatgtg

SEQ ID NO: 45055 - DNA, 22 bp, Artificial Sequence
  chemically synthesized
aacccactccatctgcatgtgg

SEQ ID NO: 45056 - DNA, 22 bp, Artificial Sequence
  chemically synthesized
acccactccatctgcatgtggc

SEQ ID NO: 45057 - DNA, 22 bp, Artificial Sequence
  chemically synthesized
catctgcatgtggcccccacca

SEQ ID NO: 45058 - DNA, 22 bp, Artificial Sequence
  chemically synthesized
catgtggcccccaccacacccc

SEQ ID NO: 45059 - DNA, 22 bp, Artificial Sequence
  chemically synthesized
aaagtggtcaaggttgtcctgt

SEQ ID NO: 45060 - DNA, 22 bp, Artificial Sequence
  chemically synthesized
tcctgttgcttaattccatgga

SEQ ID NO: 45061 - DNA, 22 bp, Artificial Sequence
  chemically synthesized
ttgcttaattccatggaagctt

SEQ ID NO: 45062 - DNA, 22 bp, Artificial Sequence
  chemically synthesized
cttaattccatggaagcttggc

SEQ ID NO: 45063 - DNA, 22 bp, Artificial Sequence
  chemically synthesized
aattccatggaagcttggctat

SEQ ID NO: 45064 - DNA, 22 bp, Artificial Sequence
  chemically synthesized
attccatggaagcttggctatc

SEQ ID NO: 45065 - DNA, 22 bp, Artificial Sequence
  chemically synthesized
catggaagcttggctatcttca

SEQ ID NO: 45066 - DNA, 22 bp, Artificial Sequence
  chemically synthesized
ggctatcttcattttattagcc

SEQ ID NO: 45067 - DNA, 22 bp, Artificial Sequence
  chemically synthesized
gctatcttcattttattagcct

SEQ ID NO: 45068 - DNA, 22 bp, Artificial Sequence
  chemically synthesized
tcttcattttattagcctcttt

SEQ ID NO: 45069 - DNA, 22 bp, Artificial Sequence
  chemically synthesized
cattttattagcctcttttggc

SEQ ID NO: 45070 - DNA, 22 bp, Artificial Sequence
  chemically synthesized
attttattagcctcttttggcc

SEQ ID NO: 45071 - DNA, 22 bp, Artificial Sequence
  chemically synthesized
tattagcctcttttggcctctc

SEQ ID NO: 45072 - DNA, 22 bp, Artificial Sequence
  chemically synthesized
attagcctcttttggcctctca

SEQ ID NO: 45073 - DNA, 22 bp, Artificial Sequence
  chemically synthesized
ttagcctcttttggcctctcac

SEQ ID NO: 45074 - DNA, 22 bp, Artificial Sequence
  chemically synthesized
gcctcttttggcctctcaccct

SEQ ID NO: 45075 - DNA, 22 bp, Artificial Sequence
  chemically synthesized
ttttggcctctcaccctgtgaa

SEQ ID NO: 45076 - DNA, 22 bp, Artificial Sequence
  chemically synthesized
ttggcctctcaccctgtgaaaa

SEQ ID NO: 45077 - DNA, 22 bp, Artificial Sequence
  chemically synthesized
tggcctctcaccctgtgaaaat

SEQ ID NO: 45078 - DNA, 22 bp, Artificial Sequence
  chemically synthesized
ggcctctcaccctgtgaaaatc

SEQ ID NO: 45079 - DNA, 22 bp, Artificial Sequence
  chemically synthesized
gcctctcaccctgtgaaaatca

SEQ ID NO: 45080 - DNA, 22 bp, Artificial Sequence
  chemically synthesized
tcaccctgtgaaaatcactaca

SEQ ID NO: 45081 - DNA, 22 bp, Artificial Sequence
  chemically synthesized
accctgtgaaaatcactacatt

SEQ ID NO: 45082 - DNA, 22 bp, Artificial Sequence
  chemically synthesized
tgaaaatcactacattttgtgc

SEQ ID NO: 45083 - DNA, 22 bp, Artificial Sequence
  chemically synthesized
cattttgtgccagagatggagc

SEQ ID NO: 45084 - DNA, 22 bp, Artificial Sequence
  chemically synthesized
tgtgccagagatggagctggca

SEQ ID NO: 45085 - DNA, 22 bp, Artificial Sequence
  chemically synthesized
gtgccagagatggagctggcat

SEQ ID NO: 45086 - DNA, 22 bp, Artificial Sequence
  chemically synthesized
tgccagagatggagctggcatc

SEQ ID NO: 45087 - DNA, 22 bp, Artificial Sequence
  chemically synthesized
gcatctccaggcttggaagagg

SEQ ID NO: 45088 - DNA, 22 bp, Artificial Sequence
  chemically synthesized
caggcttggaagagggctgctg

SEQ ID NO: 45089 - DNA, 22 bp, Artificial Sequence
  chemically synthesized
ggaagagggctgctgaagctca

SEQ ID NO: 45090 - DNA, 22 bp, Artificial Sequence
  chemically synthesized
gaagagggctgctgaagctcag

SEQ ID NO: 45091 - DNA, 22 bp, Artificial Sequence
  chemically synthesized
ctgaagctcagccaggtgtcct

SEQ ID NO: 45092 - DNA, 22 bp, Artificial Sequence
  chemically synthesized
aagctcagccaggtgtcctaag

SEQ ID NO: 45093 - DNA, 22 bp, Artificial Sequence
  chemically synthesized
agccaggtgtcctaaggagcct

SEQ ID NO: 45094 - DNA, 22 bp, Artificial Sequence
  chemically synthesized
aggagcctcaggacaggggatg

SEQ ID NO: 45095 - DNA, 22 bp, Artificial Sequence
  chemically synthesized
aggacaggggatgctcagtagc

SEQ ID NO: 45096 - DNA, 22 bp, Artificial Sequence
  chemically synthesized
agtagccttgcaatgggaacac

SEQ ID NO: 45097 - DNA, 22 bp, Artificial Sequence
  chemically synthesized
gcaatgggaacacagctgagcc

SEQ ID NO: 45098 - DNA, 22 bp, Artificial Sequence
  chemically synthesized
caatgggaacacagctgagccc

SEQ ID NO: 45099 - DNA, 22 bp, Artificial Sequence
  chemically synthesized
agccccacttggccaccctttg

SEQ ID NO: 45100 - DNA, 22 bp, Artificial Sequence
  chemically synthesized
ggccaccctttgccacaaccag

SEQ ID NO: 45101 - DNA, 22 bp, Artificial Sequence
  chemically synthesized
gccaccctttgccacaaccagg

SEQ ID NO: 45102 - DNA, 22 bp, Artificial Sequence
  chemically synthesized
tgccacaaccaggcagaaagca

SEQ ID NO: 45103 - DNA, 22 bp, Artificial Sequence
  chemically synthesized
gccacaaccaggcagaaagcag

SEQ ID NO: 45104 - DNA, 22 bp, Artificial Sequence
  chemically synthesized
ccacaaccaggcagaaagcagc

SEQ ID NO: 45105 - DNA, 22 bp, Artificial Sequence
  chemically synthesized
ttgaacagatttgttgcctcag

SEQ ID NO: 45106 - DNA, 22 bp, Artificial Sequence
  chemically synthesized
tgaacagatttgttgcctcaga

SEQ ID NO: 45107 - DNA, 22 bp, Artificial Sequence
  chemically synthesized
gaacagatttgttgcctcagat

SEQ ID NO: 45108 - DNA, 22 bp, Artificial Sequence
  chemically synthesized
aacagatttgttgcctcagatt

SEQ ID NO: 45109 - DNA, 22 bp, Artificial Sequence
  chemically synthesized
gttgcctcagatttgatctcaa

SEQ ID NO: 45110 - DNA, 22 bp, Artificial Sequence
  chemically synthesized
ttgcctcagatttgatctcaaa

SEQ ID NO: 45111 - DNA, 22 bp, Artificial Sequence
  chemically synthesized
cctcagatttgatctcaaagaa

SEQ ID NO: 45112 - DNA, 22 bp, Artificial Sequence
  chemically synthesized
agatttgatctcaaagaaaaat

SEQ ID NO: 45113 - DNA, 22 bp, Artificial Sequence
  chemically synthesized
gatctcaaagaaaaatcgtggg

SEQ ID NO: 45114 - DNA, 22 bp, Artificial Sequence
  chemically synthesized
atctcaaagaaaaatcgtgggc

SEQ ID NO: 45115 - DNA, 22 bp, Artificial Sequence
  chemically synthesized
aaagaaaaatcgtgggcagtat

SEQ ID NO: 45116 - DNA, 22 bp, Artificial Sequence
  chemically synthesized
gtcccaggttctgcttttttac

SEQ ID NO: 45117 - DNA, 22 bp, Artificial Sequence
  chemically synthesized
tgcttttttacaatttcctctg

SEQ ID NO: 45118 - DNA, 22 bp, Artificial Sequence
  chemically synthesized
cttttttacaatttcctctgaa

SEQ ID NO: 45119 - DNA, 22 bp, Artificial Sequence
  chemically synthesized
ttttacaatttcctctgaaatc

SEQ ID NO: 45120 - DNA, 22 bp, Artificial Sequence
  chemically synthesized
tttacaatttcctctgaaatct

SEQ ID NO: 45121 - DNA, 22 bp, Artificial Sequence
  chemically synthesized
ttacaatttcctctgaaatctg

SEQ ID NO: 45122 - DNA, 22 bp, Artificial Sequence
  chemically synthesized
tacaatttcctctgaaatctgg

SEQ ID NO: 45123 - DNA, 22 bp, Artificial Sequence
  chemically synthesized
acaatttcctctgaaatctgga

SEQ ID NO: 45124 - DNA, 22 bp, Artificial Sequence
  chemically synthesized
caatttcctctgaaatctggat

SEQ ID NO: 45125 - DNA, 22 bp, Artificial Sequence
  chemically synthesized
cctctgaaatctggatgcctat

SEQ ID NO: 45126 - DNA, 22 bp, Artificial Sequence
  chemically synthesized
ctctgaaatctggatgcctatc

SEQ ID NO: 45127 - DNA, 22 bp, Artificial Sequence
  chemically synthesized
tgaaatctggatgcctatcaac

SEQ ID NO: 45128 - DNA, 22 bp, Artificial Sequence
  chemically synthesized
aaatctggatgcctatcaacac

SEQ ID NO: 45129 - DNA, 22 bp, Artificial Sequence
  chemically synthesized
gatgcctatcaacaccttggaa

SEQ ID NO: 45130 - DNA, 22 bp, Artificial Sequence
  chemically synthesized
tcaacaccttggaaaaactgaa

SEQ ID NO: 45131 - DNA, 22 bp, Artificial Sequence
  chemically synthesized
ggaaaaactgaattctccccaa

SEQ ID NO: 45132 - DNA, 22 bp, Artificial Sequence
  chemically synthesized
gaaaaactgaattctccccaac

SEQ ID NO: 45133 - DNA, 22 bp, Artificial Sequence
  chemically synthesized
aattctccccaactaatagtgg

SEQ ID NO: 45134 - DNA, 22 bp, Artificial Sequence
  chemically synthesized
tccccaactaatagtggtgtgt

SEQ ID NO: 45135 - DNA, 22 bp, Artificial Sequence
  chemically synthesized
cccaactaatagtggtgtgtca

SEQ ID NO: 45136 - DNA, 22 bp, Artificial Sequence
  chemically synthesized
atagtggtgtgtcactgtagta

SEQ ID NO: 45137 - DNA, 22 bp, Artificial Sequence
  chemically synthesized
tagtaagcctagtacaaaaatg

SEQ ID NO: 45138 - DNA, 22 bp, Artificial Sequence
  chemically synthesized
gtacaaaaatggccttctttgt

SEQ ID NO: 45139 - DNA, 22 bp, Artificial Sequence
  chemically synthesized
ctttgtggaggagcttcatatc

SEQ ID NO: 45140 - DNA, 22 bp, Artificial Sequence
  chemically synthesized
tttgtggaggagcttcatatcc

SEQ ID NO: 45141 - DNA, 22 bp, Artificial Sequence
  chemically synthesized
tgtggaggagcttcatatcctc

SEQ ID NO: 45142 - DNA, 22 bp, Artificial Sequence
  chemically synthesized
gtggaggagcttcatatcctcc

SEQ ID NO: 45143 - DNA, 22 bp, Artificial Sequence
  chemically synthesized
tggaggagcttcatatcctcca

SEQ ID NO: 45144 - DNA, 22 bp, Artificial Sequence
  chemically synthesized
catatcctccattttttttttg

SEQ ID NO: 45145 - DNA, 22 bp, Artificial Sequence
  chemically synthesized
atatcctccattttttttttgc

SEQ ID NO: 45146 - DNA, 22 bp, Artificial Sequence
  chemically synthesized
cattttttttttgcttaatttt

SEQ ID NO: 45147 - DNA, 22 bp, Artificial Sequence
  chemically synthesized
tttttttgcttaatttttgccc

SEQ ID NO: 45148 - DNA, 22 bp, Artificial Sequence
  chemically synthesized
ttttttgcttaatttttgccca

SEQ ID NO: 45149 - DNA, 22 bp, Artificial Sequence
  chemically synthesized
tttttgcttaatttttgcccaa

SEQ ID NO: 45150 - DNA, 22 bp, Artificial Sequence
  chemically synthesized
ttttgcttaatttttgcccaag

SEQ ID NO: 45151 - DNA, 22 bp, Artificial Sequence
  chemically synthesized
tttgcttaatttttgcccaaga

SEQ ID NO: 45152 - DNA, 22 bp, Artificial Sequence
  chemically synthesized
ttgcttaatttttgcccaagat

SEQ ID NO: 45153 - DNA, 22 bp, Artificial Sequence
  chemically synthesized
tgcttaatttttgcccaagatg

SEQ ID NO: 45154 - DNA, 22 bp, Artificial Sequence
  chemically synthesized
gcttaatttttgcccaagatga

SEQ ID NO: 45155 - DNA, 22 bp, Artificial Sequence
  chemically synthesized
cttaatttttgcccaagatgag

SEQ ID NO: 45156 - DNA, 22 bp, Artificial Sequence
  chemically synthesized
aatttttgcccaagatgagaac

SEQ ID NO: 45157 - DNA, 22 bp, Artificial Sequence
  chemically synthesized
atttttgcccaagatgagaaca

SEQ ID NO: 45158 - DNA, 22 bp, Artificial Sequence
  chemically synthesized
ttgcccaagatgagaacataat

SEQ ID NO: 45159 - DNA, 22 bp, Artificial Sequence
  chemically synthesized
tgcccaagatgagaacataatt

SEQ ID NO: 45160 - DNA, 22 bp, Artificial Sequence
  chemically synthesized
gcccaagatgagaacataattt

SEQ ID NO: 45161 - DNA, 22 bp, Artificial Sequence
  chemically synthesized
cccaagatgagaacataattta

SEQ ID NO: 45162 - DNA, 22 bp, Artificial Sequence
  chemically synthesized
agttcactttttatttattccc

SEQ ID NO: 45163 - DNA, 22 bp, Artificial Sequence
  chemically synthesized
gttcactttttatttattccca

SEQ ID NO: 45164 - DNA, 22 bp, Artificial Sequence
  chemically synthesized
actttttatttattcccaacat

SEQ ID NO: 45165 - DNA, 22 bp, Artificial Sequence
  chemically synthesized
tttatttattcccaacatcatc

SEQ ID NO: 45166 - DNA, 22 bp, Artificial Sequence
  chemically synthesized
ttatttattcccaacatcatcc

SEQ ID NO: 45167 - DNA, 22 bp, Artificial Sequence
  chemically synthesized
tatttattcccaacatcatcca

SEQ ID NO: 45168 - DNA, 22 bp, Artificial Sequence
  chemically synthesized
atttattcccaacatcatccat

SEQ ID NO: 45169 - DNA, 22 bp, Artificial Sequence
  chemically synthesized
tttattcccaacatcatccatg

SEQ ID NO: 45170 - DNA, 22 bp, Artificial Sequence
  chemically synthesized
attcccaacatcatccatgcac

SEQ ID NO: 45171 - DNA, 22 bp, Artificial Sequence
  chemically synthesized
ttcccaacatcatccatgcacc

SEQ ID NO: 45172 - DNA, 22 bp, Artificial Sequence
  chemically synthesized
ccaacatcatccatgcaccaac

SEQ ID NO: 45173 - DNA, 22 bp, Artificial Sequence
  chemically synthesized
ttgtaactaaaggagggaccat

SEQ ID NO: 45174 - DNA, 22 bp, Artificial Sequence
  chemically synthesized
tgtaactaaaggagggaccatt

SEQ ID NO: 45175 - DNA, 22 bp, Artificial Sequence
  chemically synthesized
gtaactaaaggagggaccattc

SEQ ID NO: 45176 - DNA, 22 bp, Artificial Sequence
  chemically synthesized
taactaaaggagggaccattca

SEQ ID NO: 45177 - DNA, 22 bp, Artificial Sequence
  chemically synthesized
aaggagggaccattcagaagat

SEQ ID NO: 45178 - DNA, 22 bp, Artificial Sequence
  chemically synthesized
agaagatgcttatcaactgtca

SEQ ID NO: 45179 - DNA, 22 bp, Artificial Sequence
  chemically synthesized
atcaactgtcaaagtgacagtg

SEQ ID NO: 45180 - DNA, 22 bp, Artificial Sequence
  chemically synthesized
tcaactgtcaaagtgacagtgt

SEQ ID NO: 45181 - DNA, 22 bp, Artificial Sequence
  chemically synthesized
tcaaagtgacagtgttacaacc

SEQ ID NO: 45182 - DNA, 22 bp, Artificial Sequence
  chemically synthesized
caaccaatgcacatattgtaag

SEQ ID NO: 45183 - DNA, 22 bp, Artificial Sequence
  chemically synthesized
taagaaatcaaacaatggcctc

SEQ ID NO: 45184 - DNA, 22 bp, Artificial Sequence
  chemically synthesized
caaggttcatttctacacaggg

SEQ ID NO: 45185 - DNA, 22 bp, Artificial Sequence
  chemically synthesized
atttctacacagggattagcag

SEQ ID NO: 45186 - DNA, 22 bp, Artificial Sequence
  chemically synthesized
ctacacagggattagcagatca

SEQ ID NO: 45187 - DNA, 22 bp, Artificial Sequence
  chemically synthesized
tacacagggattagcagatcaa

SEQ ID NO: 45188 - DNA, 22 bp, Artificial Sequence
  chemically synthesized
cacagggattagcagatcaaca

SEQ ID NO: 45189 - DNA, 22 bp, Artificial Sequence
  chemically synthesized
gcagatcaacatcaatcttggc

SEQ ID NO: 45190 - DNA, 22 bp, Artificial Sequence
  chemically synthesized
ggcaacacagttgccactgatg

SEQ ID NO: 45191 - DNA, 22 bp, Artificial Sequence
  chemically synthesized
gcaacacagttgccactgatgg

SEQ ID NO: 45192 - DNA, 22 bp, Artificial Sequence
  chemically synthesized
ccactgatggtgtcttattttt

SEQ ID NO: 45193 - DNA, 22 bp, Artificial Sequence
  chemically synthesized
atggtgtcttattttttttatc

SEQ ID NO: 45194 - DNA, 22 bp, Artificial Sequence
  chemically synthesized
attttttttatcatgacatggc

SEQ ID NO: 45195 - DNA, 22 bp, Artificial Sequence
  chemically synthesized
ttttttttatcatgacatggca

SEQ ID NO: 45196 - DNA, 22 bp, Artificial Sequence
  chemically synthesized
tttttatcatgacatggcaatc

SEQ ID NO: 45197 - DNA, 22 bp, Artificial Sequence
  chemically synthesized
ttttatcatgacatggcaatca

SEQ ID NO: 45198 - DNA, 22 bp, Artificial Sequence
  chemically synthesized
tttatcatgacatggcaatcaa

SEQ ID NO: 45199 - DNA, 22 bp, Artificial Sequence
  chemically synthesized
ttatcatgacatggcaatcaag

SEQ ID NO: 45200 - DNA, 22 bp, Artificial Sequence
  chemically synthesized
tatcatgacatggcaatcaaga

SEQ ID NO: 45201 - DNA, 22 bp, Artificial Sequence
  chemically synthesized
atcatgacatggcaatcaagag

SEQ ID NO: 45202 - DNA, 22 bp, Artificial Sequence
  chemically synthesized
tcatgacatggcaatcaagagc

SEQ ID NO: 45203 - DNA, 22 bp, Artificial Sequence
  chemically synthesized
attcttatttaagattttatgg

SEQ ID NO: 45204 - DNA, 22 bp, Artificial Sequence
  chemically synthesized
ttcttatttaagattttatggt

SEQ ID NO: 45205 - DNA, 22 bp, Artificial Sequence
  chemically synthesized
ttatttaagattttatggttag

SEQ ID NO: 45206 - DNA, 22 bp, Artificial Sequence
  chemically synthesized
atttaagattttatggttagac

SEQ ID NO: 45207 - DNA, 22 bp, Artificial Sequence
  chemically synthesized
tttaagattttatggttagact

SEQ ID NO: 45208 - DNA, 22 bp, Artificial Sequence
  chemically synthesized
aagattttatggttagactagg

SEQ ID NO: 45209 - DNA, 22 bp, Artificial Sequence
  chemically synthesized
agattttatggttagactaggc

SEQ ID NO: 45210 - DNA, 22 bp, Artificial Sequence
  chemically synthesized
tatggttagactaggcagatag

SEQ ID NO: 45211 - DNA, 22 bp, Artificial Sequence
  chemically synthesized
atggttagactaggcagatagc

SEQ ID NO: 45212 - DNA, 22 bp, Artificial Sequence
  chemically synthesized
tggttagactaggcagatagct

SEQ ID NO: 45213 - DNA, 22 bp, Artificial Sequence
  chemically synthesized
gactaggcagatagctagatat

SEQ ID NO: 45214 - DNA, 22 bp, Artificial Sequence
  chemically synthesized
ggcagatagctagatatgagca

SEQ ID NO: 45215 - DNA, 22 bp, Artificial Sequence
  chemically synthesized
gatatgagcaggaggtggaagc

SEQ ID NO: 45216 - DNA, 22 bp, Artificial Sequence
  chemically synthesized
agagaatggaggtctggagaat

SEQ ID NO: 45217 - DNA, 22 bp, Artificial Sequence
  chemically synthesized
gagaatctgaaaccccagagat

SEQ ID NO: 45218 - DNA, 22 bp, Artificial Sequence
  chemically synthesized
aaaccccagagattacccaagt

SEQ ID NO: 45219 - DNA, 22 bp, Artificial Sequence
  chemically synthesized
cccaagtcctgcatgctagaca

SEQ ID NO: 45220 - DNA, 22 bp, Artificial Sequence
  chemically synthesized
catgctagacatgagtggagga

SEQ ID NO: 45221 - DNA, 22 bp, Artificial Sequence
  chemically synthesized
gacatgagtggaggagggggaa

SEQ ID NO: 45222 - DNA, 22 bp, Artificial Sequence
  chemically synthesized
ggtagaaaagaatgccccttaa

SEQ ID NO: 45223 - DNA, 22 bp, Artificial Sequence
  chemically synthesized
aagatgcccagcagtcgctcac

SEQ ID NO: 45224 - DNA, 22 bp, Artificial Sequence
  chemically synthesized
agatgcccagcagtcgctcact

SEQ ID NO: 45225 - DNA, 22 bp, Artificial Sequence
  chemically synthesized
actgtgcagttaacttttcaga

SEQ ID NO: 45226 - DNA, 22 bp, Artificial Sequence
  chemically synthesized
tgcagttaacttttcagaatgc

SEQ ID NO: 45227 - DNA, 22 bp, Artificial Sequence
  chemically synthesized
acttttcagaatgctgctagat

SEQ ID NO: 45228 - DNA, 22 bp, Artificial Sequence
  chemically synthesized
ttcagaatgctgctagatacat

SEQ ID NO: 45229 - DNA, 22 bp, Artificial Sequence
  chemically synthesized
tcagaatgctgctagatacatg

SEQ ID NO: 45230 - DNA, 22 bp, Artificial Sequence
  chemically synthesized
cagaatgctgctagatacatgc

SEQ ID NO: 45231 - DNA, 22 bp, Artificial Sequence
  chemically synthesized
agaatgctgctagatacatgct

SEQ ID NO: 45232 - DNA, 22 bp, Artificial Sequence
  chemically synthesized
ctagatacatgctgatagggag

SEQ ID NO: 45233 - DNA, 22 bp, Artificial Sequence
  chemically synthesized
gatacatgctgatagggaggga

SEQ ID NO: 45234 - DNA, 22 bp, Artificial Sequence
  chemically synthesized
atagggagggaagagggcaaag

SEQ ID NO: 45235 - DNA, 22 bp, Artificial Sequence
  chemically synthesized
ctaagagatacacggttgcagt

SEQ ID NO: 45236 - DNA, 22 bp, Artificial Sequence
  chemically synthesized
agagatacacggttgcagttag

SEQ ID NO: 45237 - DNA, 22 bp, Artificial Sequence
  chemically synthesized
cagttagtatacatctgagtgc

SEQ ID NO: 45238 - DNA, 22 bp, Artificial Sequence
  chemically synthesized
gtatacatctgagtgctataca

SEQ ID NO: 45239 - DNA, 22 bp, Artificial Sequence
  chemically synthesized
agtgctatacaaccttctttgg

SEQ ID NO: 45240 - DNA, 22 bp, Artificial Sequence
  chemically synthesized
tacaaccttctttgggtggtgg

SEQ ID NO: 45241 - DNA, 22 bp, Artificial Sequence
  chemically synthesized
ctttgggtggtggcaagaagca

SEQ ID NO: 45242 - DNA, 22 bp, Artificial Sequence
  chemically synthesized
tttgggtggtggcaagaagcaa

SEQ ID NO: 45243 - DNA, 22 bp, Artificial Sequence
  chemically synthesized
tgggtggtggcaagaagcaatg

SEQ ID NO: 45244 - DNA, 22 bp, Artificial Sequence
  chemically synthesized
gggtggtggcaagaagcaatgc

SEQ ID NO: 45245 - DNA, 22 bp, Artificial Sequence
  chemically synthesized
ggtggtggcaagaagcaatgca

SEQ ID NO: 45246 - DNA, 22 bp, Artificial Sequence
  chemically synthesized
cgtagaattcatatcaaacacc

SEQ ID NO: 45247 - DNA, 22 bp, Artificial Sequence
  chemically synthesized
atatcaaacacctgtatcacag

SEQ ID NO: 45248 - DNA, 22 bp, Artificial Sequence
  chemically synthesized
tatcacaggtgttaaagaaaca

SEQ ID NO: 45249 - DNA, 22 bp, Artificial Sequence
  chemically synthesized
aagaaacaagaaacattgtact

SEQ ID NO: 45250 - DNA, 22 bp, Artificial Sequence
  chemically synthesized
tacttcttgtattcttaataat

SEQ ID NO: 45251 - DNA, 22 bp, Artificial Sequence
  chemically synthesized
cttgtattcttaataatgattt

SEQ ID NO: 45252 - DNA, 22 bp, Artificial Sequence
  chemically synthesized
ttgtattcttaataatgatttg

SEQ ID NO: 45253 - DNA, 22 bp, Artificial Sequence
  chemically synthesized
gtattcttaataatgatttgca

SEQ ID NO: 45254 - DNA, 22 bp, Artificial Sequence
  chemically synthesized
tattcttaataatgatttgcaa

SEQ ID NO: 45255 - DNA, 22 bp, Artificial Sequence
  chemically synthesized
ttaataatgatttgcaatattg

SEQ ID NO: 45256 - DNA, 22 bp, Artificial Sequence
  chemically synthesized
aataatgatttgcaatattgtc

SEQ ID NO: 45257 - DNA, 22 bp, Artificial Sequence
  chemically synthesized
ataatgatttgcaatattgtct

SEQ ID NO: 45258 - DNA, 22 bp, Artificial Sequence
  chemically synthesized
gcaatattgtctttagtatcac

SEQ ID NO: 45259 - DNA, 22 bp, Artificial Sequence
  chemically synthesized
caatattgtctttagtatcact

SEQ ID NO: 45260 - DNA, 22 bp, Artificial Sequence
  chemically synthesized
tctttagtatcactgcaaacct

SEQ ID NO: 45261 - DNA, 22 bp, Artificial Sequence
  chemically synthesized
tagtatcactgcaaacctctat

SEQ ID NO: 45262 - DNA, 22 bp, Artificial Sequence
  chemically synthesized
agtatcactgcaaacctctata

SEQ ID NO: 45263 - DNA, 22 bp, Artificial Sequence
  chemically synthesized
gtatcactgcaaacctctataa

SEQ ID NO: 45264 - DNA, 22 bp, Artificial Sequence
  chemically synthesized
caaacctctataaatatgattt

SEQ ID NO: 45265 - DNA, 22 bp, Artificial Sequence
  chemically synthesized
tataaatatgatttttaaaaag

SEQ ID NO: 45266 - DNA, 22 bp, Artificial Sequence
  chemically synthesized
taaatatgatttttaaaaagta

SEQ ID NO: 45267 - DNA, 22 bp, Artificial Sequence
  chemically synthesized
ttaaaaagtatttctttaggtt

SEQ ID NO: 45268 - DNA, 22 bp, Artificial Sequence
  chemically synthesized
taaaaagtatttctttaggttg

SEQ ID NO: 45269 - DNA, 22 bp, Artificial Sequence
  chemically synthesized
aaaaagtatttctttaggttgg

SEQ ID NO: 45270 - DNA, 22 bp, Artificial Sequence
  chemically synthesized
aaaagtatttctttaggttgga

SEQ ID NO: 45271 - DNA, 22 bp, Artificial Sequence
  chemically synthesized
ctttaggttggaattacttcta

SEQ ID NO: 45272 - DNA, 22 bp, Artificial Sequence
  chemically synthesized
tttaggttggaattacttctac

SEQ ID NO: 45273 - DNA, 22 bp, Artificial Sequence
  chemically synthesized
taggttggaattacttctacgc

SEQ ID NO: 45274 - DNA, 22 bp, Artificial Sequence
  chemically synthesized
aggttggaattacttctacgca

SEQ ID NO: 45275 - DNA, 22 bp, Artificial Sequence
  chemically synthesized
ggttggaattacttctacgcat

SEQ ID NO: 45276 - DNA, 22 bp, Artificial Sequence
  chemically synthesized
gaattacttctacgcattgact

SEQ ID NO: 45277 - DNA, 22 bp, Artificial Sequence
  chemically synthesized
cttctacgcattgacttatctt

SEQ ID NO: 45278 - DNA, 22 bp, Artificial Sequence
  chemically synthesized
ctacgcattgacttatcttcct

SEQ ID NO: 45279 - DNA, 22 bp, Artificial Sequence
  chemically synthesized
tacgcattgacttatcttcctg

SEQ ID NO: 45280 - DNA, 22 bp, Artificial Sequence
  chemically synthesized
cgcattgacttatcttcctggg

SEQ ID NO: 45281 - DNA, 22 bp, Artificial Sequence
  chemically synthesized
acttatcttcctgggtttcatt

SEQ ID NO: 45282 - DNA, 22 bp, Artificial Sequence
  chemically synthesized
atcttcctgggtttcattagcc

SEQ ID NO: 45283 - DNA, 22 bp, Artificial Sequence
  chemically synthesized
tcttcctgggtttcattagccg

SEQ ID NO: 45284 - DNA, 22 bp, Artificial Sequence
  chemically synthesized
cctgggtttcattagccgtacc

SEQ ID NO: 45285 - DNA, 22 bp, Artificial Sequence
  chemically synthesized
ctgggtttcattagccgtaccc

SEQ ID NO: 45286 - DNA, 22 bp, Artificial Sequence
  chemically synthesized
ggtttcattagccgtacccgtt

SEQ ID NO: 45287 - DNA, 22 bp, Artificial Sequence
  chemically synthesized
cattagccgtacccgttgtact

SEQ ID NO: 45288 - DNA, 22 bp, Artificial Sequence
  chemically synthesized
attagccgtacccgttgtactt

SEQ ID NO: 45289 - DNA, 22 bp, Artificial Sequence
  chemically synthesized
gccgtacccgttgtactttctt

SEQ ID NO: 45290 - DNA, 22 bp, Artificial Sequence
  chemically synthesized
tactttcttccttaccactgtt

SEQ ID NO: 45291 - DNA, 22 bp, Artificial Sequence
  chemically synthesized
tcttccttaccactgtttatct

SEQ ID NO: 45292 - DNA, 22 bp, Artificial Sequence
  chemically synthesized
cttccttaccactgtttatctc

SEQ ID NO: 45293 - DNA, 22 bp, Artificial Sequence
  chemically synthesized
ttccttaccactgtttatctca

SEQ ID NO: 45294 - DNA, 22 bp, Artificial Sequence
  chemically synthesized
ccttaccactgtttatctcaaa

SEQ ID NO: 45295 - DNA, 22 bp, Artificial Sequence
  chemically synthesized
cttaccactgtttatctcaaac

SEQ ID NO: 45296 - DNA, 22 bp, Artificial Sequence
  chemically synthesized
accactgtttatctcaaactct

SEQ ID NO: 45297 - DNA, 22 bp, Artificial Sequence
  chemically synthesized
ccactgtttatctcaaactctt

SEQ ID NO: 45298 - DNA, 22 bp, Artificial Sequence
  chemically synthesized
tttatctcaaactcttgagatt

SEQ ID NO: 45299 - DNA, 22 bp, Artificial Sequence
  chemically synthesized
atctcaaactcttgagattaaa

SEQ ID NO: 45300 - DNA, 22 bp, Artificial Sequence
  chemically synthesized
tctcaaactcttgagattaaag

SEQ ID NO: 45301 - DNA, 22 bp, Artificial Sequence
  chemically synthesized
aaactcttgagattaaagtatg

SEQ ID NO: 45302 - DNA, 22 bp, Artificial Sequence
  chemically synthesized
ttgagattaaagtatgggctca

SEQ ID NO: 45303 - DNA, 22 bp, Artificial Sequence
  chemically synthesized
gagattaaagtatgggctcagg

SEQ ID NO: 45304 - DNA, 22 bp, Artificial Sequence
  chemically synthesized
agattaaagtatgggctcagga

SEQ ID NO: 45305 - DNA, 22 bp, Artificial Sequence
  chemically synthesized
aagtatgggctcaggagggagc

SEQ ID NO: 45306 - DNA, 22 bp, Artificial Sequence
  chemically synthesized
aggagggagcgaggagcttcag

SEQ ID NO: 45307 - DNA, 22 bp, Artificial Sequence
  chemically synthesized
caggactctcacggacctccag

SEQ ID NO: 45308 - DNA, 22 bp, Artificial Sequence
  chemically synthesized
aggactctcacggacctccagc

SEQ ID NO: 45309 - DNA, 22 bp, Artificial Sequence
  chemically synthesized
tcacggacctccagcacagtgt

SEQ ID NO: 45310 - DNA, 22 bp, Artificial Sequence
  chemically synthesized
acggacctccagcacagtgtag

SEQ ID NO: 45311 - DNA, 22 bp, Artificial Sequence
  chemically synthesized
cagcacagtgtagctgccttat

SEQ ID NO: 45312 - DNA, 22 bp, Artificial Sequence
  chemically synthesized
ccttatggaaaagtggccacac

SEQ ID NO: 45313 - DNA, 22 bp, Artificial Sequence
  chemically synthesized
atggaaaagtggccacactgtt

SEQ ID NO: 45314 - DNA, 22 bp, Artificial Sequence
  chemically synthesized
tggaaaagtggccacactgttt

SEQ ID NO: 45315 - DNA, 22 bp, Artificial Sequence
  chemically synthesized
ttttctgcactggtccctgccc

SEQ ID NO: 45316 - DNA, 22 bp, Artificial Sequence
  chemically synthesized
tctgcactggtccctgccccta

SEQ ID NO: 45317 - DNA, 22 bp, Artificial Sequence
  chemically synthesized
ctgcactggtccctgcccctac

SEQ ID NO: 45318 - DNA, 22 bp, Artificial Sequence
  chemically synthesized
tgcactggtccctgcccctact

SEQ ID NO: 45319 - DNA, 22 bp, Artificial Sequence
  chemically synthesized
cactggtccctgcccctactat

SEQ ID NO: 45320 - DNA, 22 bp, Artificial Sequence
  chemically synthesized
gtccctgcccctactattcctc

SEQ ID NO: 45321 - DNA, 22 bp, Artificial Sequence
  chemically synthesized
cccctactattcctcactgggc

SEQ ID NO: 45322 - DNA, 22 bp, Artificial Sequence
  chemically synthesized
ctattcctcactgggcagagca

SEQ ID NO: 45323 - DNA, 22 bp, Artificial Sequence
  chemically synthesized
ttcctcactgggcagagcacag

SEQ ID NO: 45324 - DNA, 22 bp, Artificial Sequence
  chemically synthesized
ctcactgggcagagcacagcca

SEQ ID NO: 45325 - DNA, 22 bp, Artificial Sequence
  chemically synthesized
actgggcagagcacagccaccc

SEQ ID NO: 45326 - DNA, 22 bp, Artificial Sequence
  chemically synthesized
ggcagagcacagccaccctggc

SEQ ID NO: 45327 - DNA, 22 bp, Artificial Sequence
  chemically synthesized
gccctgcctgaacattttagtc

SEQ ID NO: 45328 - DNA, 22 bp, Artificial Sequence
  chemically synthesized
cctgaacattttagtcagtgtt

SEQ ID NO: 45329 - DNA, 22 bp, Artificial Sequence
  chemically synthesized
aacattttagtcagtgttggct

SEQ ID NO: 45330 - DNA, 22 bp, Artificial Sequence
  chemically synthesized
tagtcagtgttggctctgtgct

SEQ ID NO: 45331 - DNA, 22 bp, Artificial Sequence
  chemically synthesized
agtcagtgttggctctgtgctt

SEQ ID NO: 45332 - DNA, 22 bp, Artificial Sequence
  chemically synthesized
gtcagtgttggctctgtgcttc

SEQ ID NO: 45333 - DNA, 22 bp, Artificial Sequence
  chemically synthesized
gctctgtgcttctctggggagg

SEQ ID NO: 45334 - DNA, 22 bp, Artificial Sequence
  chemically synthesized
tgtgcttctctggggaggaaat

SEQ ID NO: 45335 - DNA, 22 bp, Artificial Sequence
  chemically synthesized
tgcttctctggggaggaaatcc

SEQ ID NO: 45336 - DNA, 22 bp, Artificial Sequence
  chemically synthesized
ctctggggaggaaatccaagag

SEQ ID NO: 45337 - DNA, 22 bp, Artificial Sequence
  chemically synthesized
tctggggaggaaatccaagaga

SEQ ID NO: 45338 - DNA, 22 bp, Artificial Sequence
  chemically synthesized
tggggaggaaatccaagagaca

SEQ ID NO: 45339 - DNA, 22 bp, Artificial Sequence
  chemically synthesized
gggaggaaatccaagagacaac

SEQ ID NO: 45340 - DNA, 22 bp, Artificial Sequence
  chemically synthesized
tgccatttcagctgcagcagta

SEQ ID NO: 45341 - DNA, 22 bp, Artificial Sequence
  chemically synthesized
ccatttcagctgcagcagtacc

SEQ ID NO: 45342 - DNA, 22 bp, Artificial Sequence
  chemically synthesized
cagctgcagcagtaccaccgtt

SEQ ID NO: 45343 - DNA, 22 bp, Artificial Sequence
  chemically synthesized
agctgcagcagtaccaccgtta

SEQ ID NO: 45344 - DNA, 22 bp, Artificial Sequence
  chemically synthesized
cagcagtaccaccgttaatgcc

SEQ ID NO: 45345 - DNA, 22 bp, Artificial Sequence
  chemically synthesized
atgcccttgggcttgagaaaga

SEQ ID NO: 45346 - DNA, 22 bp, Artificial Sequence
  chemically synthesized
gggcttgagaaagaagggacct

SEQ ID NO: 45347 - DNA, 22 bp, Artificial Sequence
  chemically synthesized
ggcttgagaaagaagggacctg

SEQ ID NO: 45348 - DNA, 22 bp, Artificial Sequence
  chemically synthesized
gagaaagaagggacctggccac

SEQ ID NO: 45349 - DNA, 22 bp, Artificial Sequence
  chemically synthesized
agaaagaagggacctggccact

SEQ ID NO: 45350 - DNA, 22 bp, Artificial Sequence
  chemically synthesized
gccacttccctgacacctccag

SEQ ID NO: 45351 - DNA, 22 bp, Artificial Sequence
  chemically synthesized
ccctgacacctccagcacacag

SEQ ID NO: 45352 - DNA, 22 bp, Artificial Sequence
  chemically synthesized
cctgacacctccagcacacagc

SEQ ID NO: 45353 - DNA, 22 bp, Artificial Sequence
  chemically synthesized
acacctccagcacacagcaggg

SEQ ID NO: 45354 - DNA, 22 bp, Artificial Sequence
  chemically synthesized
cagcacacagcagggaaagaat

SEQ ID NO: 45355 - DNA, 22 bp, Artificial Sequence
  chemically synthesized
cagtttctctttcttgtgagct

SEQ ID NO: 45356 - DNA, 22 bp, Artificial Sequence
  chemically synthesized
ctctttcttgtgagctttcacc

SEQ ID NO: 45357 - DNA, 22 bp, Artificial Sequence
  chemically synthesized
tctttcttgtgagctttcacct

SEQ ID NO: 45358 - DNA, 22 bp, Artificial Sequence
  chemically synthesized
tttcttgtgagctttcacctgc

SEQ ID NO: 45359 - DNA, 22 bp, Artificial Sequence
  chemically synthesized
tcttgtgagctttcacctgcta

SEQ ID NO: 45360 - DNA, 22 bp, Artificial Sequence
  chemically synthesized
cttgtgagctttcacctgctac

SEQ ID NO: 45361 - DNA, 22 bp, Artificial Sequence
  chemically synthesized
ttgtgagctttcacctgctact

SEQ ID NO: 45362 - DNA, 22 bp, Artificial Sequence
  chemically synthesized
gtgagctttcacctgctactct

SEQ ID NO: 45363 - DNA, 22 bp, Artificial Sequence
  chemically synthesized
tgagctttcacctgctactctt

SEQ ID NO: 45364 - DNA, 22 bp, Artificial Sequence
  chemically synthesized
tcacctgctactcttcaccagg

SEQ ID NO: 45365 - DNA, 22 bp, Artificial Sequence
  chemically synthesized
cacctgctactcttcaccaggc

SEQ ID NO: 45366 - DNA, 22 bp, Artificial Sequence
  chemically synthesized
acctgctactcttcaccaggca

SEQ ID NO: 45367 - DNA, 22 bp, Artificial Sequence
  chemically synthesized
ctactcttcaccaggcaaggct

SEQ ID NO: 45368 - DNA, 22 bp, Artificial Sequence
  chemically synthesized
ctcttcaccaggcaaggctcct

SEQ ID NO: 45369 - DNA, 22 bp, Artificial Sequence
  chemically synthesized
ttcaccaggcaaggctcctggc

SEQ ID NO: 45370 - DNA, 22 bp, Artificial Sequence
  chemically synthesized
caccaggcaaggctcctggctt

SEQ ID NO: 45371 - DNA, 22 bp, Artificial Sequence
  chemically synthesized
accaggcaaggctcctggcttg

SEQ ID NO: 45372 - DNA, 22 bp, Artificial Sequence
  chemically synthesized
ctggcttgggcccacagtgcag

SEQ ID NO: 45373 - DNA, 22 bp, Artificial Sequence
  chemically synthesized
gcttgggcccacagtgcaggca

SEQ ID NO: 45374 - DNA, 22 bp, Artificial Sequence
  chemically synthesized
gggcccacagtgcaggcacctc

SEQ ID NO: 45375 - DNA, 22 bp, Artificial Sequence
  chemically synthesized
ggcccacagtgcaggcacctcg

SEQ ID NO: 45376 - DNA, 22 bp, Artificial Sequence
  chemically synthesized
gaactcagttgaacatttccac

SEQ ID NO: 45377 - DNA, 22 bp, Artificial Sequence
  chemically synthesized
agttgaacatttccactggctg

SEQ ID NO: 45378 - DNA, 22 bp, Artificial Sequence
  chemically synthesized
aacatttccactggctgcactc

SEQ ID NO: 45379 - DNA, 22 bp, Artificial Sequence
  chemically synthesized
ccactggctgcactctgtgttt

SEQ ID NO: 45380 - DNA, 22 bp, Artificial Sequence
  chemically synthesized
cactggctgcactctgtgtttt

SEQ ID NO: 45381 - DNA, 22 bp, Artificial Sequence
  chemically synthesized
gctgcactctgtgtttttgtgg

SEQ ID NO: 45382 - DNA, 22 bp, Artificial Sequence
  chemically synthesized
cactctgtgtttttgtggggtg

SEQ ID NO: 45383 - DNA, 22 bp, Artificial Sequence
  chemically synthesized
tgtgtttttgtggggtgaagct

SEQ ID NO: 45384 - DNA, 22 bp, Artificial Sequence
  chemically synthesized
tgtttttgtggggtgaagctcc

SEQ ID NO: 45385 - DNA, 22 bp, Artificial Sequence
  chemically synthesized
ttgtggggtgaagctcccagag

SEQ ID NO: 45386 - DNA, 22 bp, Artificial Sequence
  chemically synthesized
tgtggggtgaagctcccagagg

SEQ ID NO: 45387 - DNA, 22 bp, Artificial Sequence
  chemically synthesized
gtggggtgaagctcccagaggt

SEQ ID NO: 45388 - DNA, 22 bp, Artificial Sequence
  chemically synthesized
tggggtgaagctcccagaggtg

SEQ ID NO: 45389 - DNA, 22 bp, Artificial Sequence
  chemically synthesized
ccagaggtgactgaaagtcctt

SEQ ID NO: 45390 - DNA, 22 bp, Artificial Sequence
  chemically synthesized
aaagtccttctgccactaacac

SEQ ID NO: 45391 - DNA, 22 bp, Artificial Sequence
  chemically synthesized
ctgccactaacactgcagtcat

SEQ ID NO: 45392 - DNA, 22 bp, Artificial Sequence
  chemically synthesized
tgccactaacactgcagtcata

SEQ ID NO: 45393 - DNA, 22 bp, Artificial Sequence
  chemically synthesized
ccactaacactgcagtcatact

SEQ ID NO: 45394 - DNA, 22 bp, Artificial Sequence
  chemically synthesized
acactgcagtcatactgccctt

SEQ ID NO: 45395 - DNA, 22 bp, Artificial Sequence
  chemically synthesized
cagtcatactgcccttgctgta

SEQ ID NO: 45396 - DNA, 22 bp, Artificial Sequence
  chemically synthesized
cccttgctgtacttggactagg

SEQ ID NO: 45397 - DNA, 22 bp, Artificial Sequence
  chemically synthesized
gctgtacttggactagggaagg

SEQ ID NO: 45398 - DNA, 22 bp, Artificial Sequence
  chemically synthesized
ctgtacttggactagggaagga

SEQ ID NO: 45399 - DNA, 22 bp, Artificial Sequence
  chemically synthesized
tacttggactagggaaggaaaa

SEQ ID NO: 45400 - DNA, 22 bp, Artificial Sequence
  chemically synthesized
ggactagggaaggaaaaaagat

SEQ ID NO: 45401 - DNA, 22 bp, Artificial Sequence
  chemically synthesized
gactagggaaggaaaaaagatc

SEQ ID NO: 45402 - DNA, 22 bp, Artificial Sequence
  chemically synthesized
gggaaggaaaaaagatcctgag

SEQ ID NO: 45403 - DNA, 22 bp, Artificial Sequence
  chemically synthesized
agtgctttactcacaccccagt

SEQ ID NO: 45404 - DNA, 22 bp, Artificial Sequence
  chemically synthesized
tactcacaccccagtgtgcccc

SEQ ID NO: 45405 - DNA, 22 bp, Artificial Sequence
  chemically synthesized
actcacaccccagtgtgcccca

SEQ ID NO: 45406 - DNA, 22 bp, Artificial Sequence
  chemically synthesized
ctcacaccccagtgtgccccag

SEQ ID NO: 45407 - DNA, 22 bp, Artificial Sequence
  chemically synthesized
acaccccagtgtgccccagcca

SEQ ID NO: 45408 - DNA, 22 bp, Artificial Sequence
  chemically synthesized
tggaaaagaggccagtgtgtca

SEQ ID NO: 45409 - DNA, 22 bp, Artificial Sequence
  chemically synthesized
caagcaccctgaggcccctgcc

SEQ ID NO: 45410 - DNA, 22 bp, Artificial Sequence
  chemically synthesized
aggcccctgcccctgctgcccc

SEQ ID NO: 45411 - DNA, 22 bp, Artificial Sequence
  chemically synthesized
cccctgctgcccccaagctgta

SEQ ID NO: 45412 - DNA, 22 bp, Artificial Sequence
  chemically synthesized
ctgcccccaagctgtagagcca

SEQ ID NO: 45413 - DNA, 22 bp, Artificial Sequence
  chemically synthesized
cccccaagctgtagagccagaa

SEQ ID NO: 45414 - DNA, 22 bp, Artificial Sequence
  chemically synthesized
tagagccagaatataaagctgg

SEQ ID NO: 45415 - DNA, 22 bp, Artificial Sequence
  chemically synthesized
gcagaaaaatgtaaaaaggcta

SEQ ID NO: 45416 - DNA, 22 bp, Artificial Sequence
  chemically synthesized
gactggcttagcctcccagcct

SEQ ID NO: 45417 - DNA, 22 bp, Artificial Sequence
  chemically synthesized
gcttagcctcccagcctacatc

SEQ ID NO: 45418 - DNA, 22 bp, Artificial Sequence
  chemically synthesized
agcctcccagcctacatctttc

SEQ ID NO: 45419 - DNA, 22 bp, Artificial Sequence
  chemically synthesized
gcctcccagcctacatctttct

SEQ ID NO: 45420 - DNA, 22 bp, Artificial Sequence
  chemically synthesized
ccagcctacatctttctcctgt

SEQ ID NO: 45421 - DNA, 22 bp, Artificial Sequence
  chemically synthesized
catctttctcctgtgctggatc

SEQ ID NO: 45422 - DNA, 22 bp, Artificial Sequence
  chemically synthesized
tctcctgtgctggatccttcct

SEQ ID NO: 45423 - DNA, 22 bp, Artificial Sequence
  chemically synthesized
ctcctgtgctggatccttcctg

SEQ ID NO: 45424 - DNA, 22 bp, Artificial Sequence
  chemically synthesized
tcctgtgctggatccttcctgc

SEQ ID NO: 45425 - DNA, 22 bp, Artificial Sequence
  chemically synthesized
ctgtgctggatccttcctgctc

SEQ ID NO: 45426 - DNA, 22 bp, Artificial Sequence
  chemically synthesized
tgctggatccttcctgctcttg

SEQ ID NO: 45427 - DNA, 22 bp, Artificial Sequence
  chemically synthesized
gatccttcctgctcttgaacat

SEQ ID NO: 45428 - DNA, 22 bp, Artificial Sequence
  chemically synthesized
cctgctcttgaacatcggactc

SEQ ID NO: 45429 - DNA, 22 bp, Artificial Sequence
  chemically synthesized
ctgctcttgaacatcggactcc

SEQ ID NO: 45430 - DNA, 22 bp, Artificial Sequence
  chemically synthesized
ctcttgaacatcggactccaag

SEQ ID NO: 45431 - DNA, 22 bp, Artificial Sequence
  chemically synthesized
ttgaacatcggactccaagttc

SEQ ID NO: 45432 - DNA, 22 bp, Artificial Sequence
  chemically synthesized
gaacatcggactccaagttctt

SEQ ID NO: 45433 - DNA, 22 bp, Artificial Sequence
  chemically synthesized
aacatcggactccaagttcttc

SEQ ID NO: 45434 - DNA, 22 bp, Artificial Sequence
  chemically synthesized
caagttcttcagctgtgggact

SEQ ID NO: 45435 - DNA, 22 bp, Artificial Sequence
  chemically synthesized
ttcagctgtgggacttggactg

SEQ ID NO: 45436 - DNA, 22 bp, Artificial Sequence
  chemically synthesized
cagctgtgggacttggactgtc

SEQ ID NO: 45437 - DNA, 22 bp, Artificial Sequence
  chemically synthesized
agctgtgggacttggactgtct

SEQ ID NO: 45438 - DNA, 22 bp, Artificial Sequence
  chemically synthesized
tgggacttggactgtcttcctt

SEQ ID NO: 45439 - DNA, 22 bp, Artificial Sequence
  chemically synthesized
ggactgtcttccttgctcctca

SEQ ID NO: 45440 - DNA, 22 bp, Artificial Sequence
  chemically synthesized
gactgtcttccttgctcctcag

SEQ ID NO: 45441 - DNA, 22 bp, Artificial Sequence
  chemically synthesized
tcttccttgctcctcagattgc

SEQ ID NO: 45442 - DNA, 22 bp, Artificial Sequence
  chemically synthesized
ccttgctcctcagattgcaggt

SEQ ID NO: 45443 - DNA, 22 bp, Artificial Sequence
  chemically synthesized
cttgctcctcagattgcaggtg

SEQ ID NO: 45444 - DNA, 22 bp, Artificial Sequence
  chemically synthesized
gctcctcagattgcaggtggcc

SEQ ID NO: 45445 - DNA, 22 bp, Artificial Sequence
  chemically synthesized
ctcctcagattgcaggtggcct

SEQ ID NO: 45446 - DNA, 22 bp, Artificial Sequence
  chemically synthesized
ctcagattgcaggtggcctatt

SEQ ID NO: 45447 - DNA, 22 bp, Artificial Sequence
  chemically synthesized
agattgcaggtggcctattatg

SEQ ID NO: 45448 - DNA, 22 bp, Artificial Sequence
  chemically synthesized
caggtggcctattatgggacct

SEQ ID NO: 45449 - DNA, 22 bp, Artificial Sequence
  chemically synthesized
ttatgggaccttgtaatcttgt

SEQ ID NO: 45450 - DNA, 22 bp, Artificial Sequence
  chemically synthesized
tgggaccttgtaatcttgtgag

SEQ ID NO: 45451 - DNA, 22 bp, Artificial Sequence
  chemically synthesized
gtaatcttgtgagttaatacca

SEQ ID NO: 45452 - DNA, 22 bp, Artificial Sequence
  chemically synthesized
taatcttgtgagttaataccac

SEQ ID NO: 45453 - DNA, 22 bp, Artificial Sequence
  chemically synthesized
gtgagttaataccacttaataa

SEQ ID NO: 45454 - DNA, 22 bp, Artificial Sequence
  chemically synthesized
tgagttaataccacttaataag

SEQ ID NO: 45455 - DNA, 22 bp, Artificial Sequence
  chemically synthesized
ataccacttaataagctcccct

SEQ ID NO: 45456 - DNA, 22 bp, Artificial Sequence
  chemically synthesized
aataagctcccctttgtgtgag

SEQ ID NO: 45457 - DNA, 22 bp, Artificial Sequence
  chemically synthesized
ataagctcccctttgtgtgagt

SEQ ID NO: 45458 - DNA, 22 bp, Artificial Sequence
  chemically synthesized
ccctttgtgtgagtatatctat

SEQ ID NO: 45459 - DNA, 22 bp, Artificial Sequence
  chemically synthesized
tgtgtgagtatatctatatcta

SEQ ID NO: 45460 - DNA, 22 bp, Artificial Sequence
  chemically synthesized
gtgtgagtatatctatatctat

SEQ ID NO: 45461 - DNA, 22 bp, Artificial Sequence
  chemically synthesized
tgtgagtatatctatatctata

SEQ ID NO: 45462 - DNA, 22 bp, Artificial Sequence
  chemically synthesized
tatctatagatagatataggta

SEQ ID NO: 45463 - DNA, 22 bp, Artificial Sequence
  chemically synthesized
tagatagatataggtatactca

SEQ ID NO: 45464 - DNA, 22 bp, Artificial Sequence
  chemically synthesized
actatatatacacatatataca

SEQ ID NO: 45465 - DNA, 22 bp, Artificial Sequence
  chemically synthesized
tatatacacatatatacatata

SEQ ID NO: 45466 - DNA, 22 bp, Artificial Sequence
  chemically synthesized
tctctctctctctctcatatat

SEQ ID NO: 45467 - DNA, 22 bp, Artificial Sequence
  chemically synthesized
tctctctctctctcatatatat

SEQ ID NO: 45468 - DNA, 22 bp, Artificial Sequence
  chemically synthesized
tctctctctctcatatatatat

SEQ ID NO: 45469 - DNA, 22 bp, Artificial Sequence
  chemically synthesized
tctctctctcatatatatatat

SEQ ID NO: 45470 - DNA, 22 bp, Artificial Sequence
  chemically synthesized
tctctctcatatatatatatat

SEQ ID NO: 45471 - DNA, 22 bp, Artificial Sequence
  chemically synthesized
tctctcatatatatatatatat

SEQ ID NO: 45472 - DNA, 22 bp, Artificial Sequence
  chemically synthesized
tctcatatatatatatatataa

SEQ ID NO: 45473 - DNA, 22 bp, Artificial Sequence
  chemically synthesized
tcatatatatatatatataatc

SEQ ID NO: 45474 - DNA, 22 bp, Artificial Sequence
  chemically synthesized
atatatatatatatataatctc

SEQ ID NO: 45475 - DNA, 22 bp, Artificial Sequence
  chemically synthesized
ctattagttctgtccctctaga

SEQ ID NO: 45476 - DNA, 22 bp, Artificial Sequence
  chemically synthesized
ttagttctgtccctctagagaa

SEQ ID NO: 45477 - DNA, 22 bp, Artificial Sequence
  chemically synthesized
gttctgtccctctagagaaccc

SEQ ID NO: 45478 - DNA, 22 bp, Artificial Sequence
  chemically synthesized
tgtccctctagagaaccccgac

SEQ ID NO: 45479 - DNA, 22 bp, Artificial Sequence
  chemically synthesized
tccctctagagaaccccgacta

SEQ ID NO: 45480 - DNA, 22 bp, Artificial Sequence
  chemically synthesized
tagagaaccccgactaatacag

SEQ ID NO: 45481 - DNA, 22 bp, Artificial Sequence
  chemically synthesized
gagaaccccgactaatacagat

SEQ ID NO: 45482 - DNA, 22 bp, Artificial Sequence
  chemically synthesized
atacagattttcataccagaag

SEQ ID NO: 45483 - DNA, 22 bp, Artificial Sequence
  chemically synthesized
tcataccagaagtggttcttga

SEQ ID NO: 45484 - DNA, 22 bp, Artificial Sequence
  chemically synthesized
cataccagaagtggttcttgag

SEQ ID NO: 45485 - DNA, 22 bp, Artificial Sequence
  chemically synthesized
ataccagaagtggttcttgagg

SEQ ID NO: 45486 - DNA, 22 bp, Artificial Sequence
  chemically synthesized
ttgaggaacagaatattaagga

SEQ ID NO: 45487 - DNA, 22 bp, Artificial Sequence
  chemically synthesized
gaggaacagaatattaaggatg

SEQ ID NO: 45488 - DNA, 22 bp, Artificial Sequence
  chemically synthesized
aggaacagaatattaaggatgg

SEQ ID NO: 45489 - DNA, 22 bp, Artificial Sequence
  chemically synthesized
aggatggaattctttcattggt

SEQ ID NO: 45490 - DNA, 22 bp, Artificial Sequence
  chemically synthesized
tttcattggttttgggacttct

SEQ ID NO: 45491 - DNA, 22 bp, Artificial Sequence
  chemically synthesized
tcattggttttgggacttctgg

SEQ ID NO: 45492 - DNA, 22 bp, Artificial Sequence
  chemically synthesized
cattggttttgggacttctggt

SEQ ID NO: 45493 - DNA, 22 bp, Artificial Sequence
  chemically synthesized
attggttttgggacttctggtg

SEQ ID NO: 45494 - DNA, 22 bp, Artificial Sequence
  chemically synthesized
gttttgggacttctggtgttgg

SEQ ID NO: 45495 - DNA, 22 bp, Artificial Sequence
  chemically synthesized
tgggacttctggtgttggctga

SEQ ID NO: 45496 - DNA, 22 bp, Artificial Sequence
  chemically synthesized
gggacttctggtgttggctgat

SEQ ID NO: 45497 - DNA, 22 bp, Artificial Sequence
  chemically synthesized
ggacttctggtgttggctgatt

SEQ ID NO: 45498 - DNA, 22 bp, Artificial Sequence
  chemically synthesized
ctggtgttggctgattaatatg

SEQ ID NO: 45499 - DNA, 22 bp, Artificial Sequence
  chemically synthesized
tggtgttggctgattaatatga

SEQ ID NO: 45500 - DNA, 22 bp, Artificial Sequence
  chemically synthesized
gtgttggctgattaatatgatt

SEQ ID NO: 45501 - DNA, 22 bp, Artificial Sequence
  chemically synthesized
gctgattaatatgattagacca

SEQ ID NO: 45502 - DNA, 22 bp, Artificial Sequence
  chemically synthesized
attaatatgattagaccaaaaa

SEQ ID NO: 45503 - DNA, 22 bp, Artificial Sequence
  chemically synthesized
atatgattagaccaaaaaatgc

SEQ ID NO: 45504 - DNA, 22 bp, Artificial Sequence
  chemically synthesized
gaccaaaaaatgctaaggactc

SEQ ID NO: 45505 - DNA, 22 bp, Artificial Sequence
  chemically synthesized
aggactctacttctaatagtat

SEQ ID NO: 45506 - DNA, 22 bp, Artificial Sequence
  chemically synthesized
tacttctaatagtatggagaac

SEQ ID NO: 45507 - DNA, 22 bp, Artificial Sequence
  chemically synthesized
cttctaatagtatggagaacac

SEQ ID NO: 45508 - DNA, 22 bp, Artificial Sequence
  chemically synthesized
ctaatagtatggagaacactga

SEQ ID NO: 45509 - DNA, 22 bp, Artificial Sequence
  chemically synthesized
taatagtatggagaacactgat

SEQ ID NO: 45510 - DNA, 22 bp, Artificial Sequence
  chemically synthesized
atagtatggagaacactgatag

SEQ ID NO: 45511 - DNA, 22 bp, Artificial Sequence
  chemically synthesized
atagtacttggcctgaattgtt

SEQ ID NO: 45512 - DNA, 22 bp, Artificial Sequence
  chemically synthesized
ggcctgaattgtttagagagtt

SEQ ID NO: 45513 - DNA, 22 bp, Artificial Sequence
  chemically synthesized
gcctgaattgtttagagagtta

SEQ ID NO: 45514 - DNA, 22 bp, Artificial Sequence
  chemically synthesized
aattgtttagagagttatgcaa

SEQ ID NO: 45515 - DNA, 22 bp, Artificial Sequence
  chemically synthesized
tttagagagttatgcaaaataa

SEQ ID NO: 45516 - DNA, 22 bp, Artificial Sequence
  chemically synthesized
agagagttatgcaaaataaatg

SEQ ID NO: 45517 - DNA, 22 bp, Artificial Sequence
  chemically synthesized
gagagttatgcaaaataaatgc

SEQ ID NO: 45518 - DNA, 22 bp, Artificial Sequence
  chemically synthesized
tgcaaaataaatgcatttgaca

SEQ ID NO: 45519 - DNA, 22 bp, Artificial Sequence
  chemically synthesized
gacactactgattcatcactta

SEQ ID NO: 45520 - DNA, 22 bp, Artificial Sequence
  chemically synthesized
acactactgattcatcacttat

SEQ ID NO: 45521 - DNA, 22 bp, Artificial Sequence
  chemically synthesized
ctgattcatcacttatgagagg

SEQ ID NO: 45522 - DNA, 22 bp, Artificial Sequence
  chemically synthesized
attcatcacttatgagaggcaa

SEQ ID NO: 45523 - DNA, 22 bp, Artificial Sequence
  chemically synthesized
atcacttatgagaggcaaggag

SEQ ID NO: 45524 - DNA, 22 bp, Artificial Sequence
  chemically synthesized
atgagaggcaaggagtttagtg

SEQ ID NO: 45525 - DNA, 22 bp, Artificial Sequence
  chemically synthesized
tgagaggcaaggagtttagtga

SEQ ID NO: 45526 - DNA, 22 bp, Artificial Sequence
  chemically synthesized
agtgactctatacataatacct

SEQ ID NO: 45527 - DNA, 22 bp, Artificial Sequence
  chemically synthesized
gtgactctatacataatacctt

SEQ ID NO: 45528 - DNA, 22 bp, Artificial Sequence
  chemically synthesized
tatacataatacctttgactat

SEQ ID NO: 45529 - DNA, 22 bp, Artificial Sequence
  chemically synthesized
tacataatacctttgactatat

SEQ ID NO: 45530 - DNA, 22 bp, Artificial Sequence
  chemically synthesized
tgactatatgtggagaaccaag

SEQ ID NO: 45531 - DNA, 22 bp, Artificial Sequence
  chemically synthesized
gactatatgtggagaaccaagg

SEQ ID NO: 45532 - DNA, 22 bp, Artificial Sequence
  chemically synthesized
actatatgtggagaaccaagga

SEQ ID NO: 45533 - DNA, 22 bp, Artificial Sequence
  chemically synthesized
tatgtggagaaccaaggaacat

SEQ ID NO: 45534 - DNA, 22 bp, Artificial Sequence
  chemically synthesized
gttgattgctcctaagttctct

SEQ ID NO: 45535 - DNA, 22 bp, Artificial Sequence
  chemically synthesized
attgctcctaagttctctggag

SEQ ID NO: 45536 - DNA, 22 bp, Artificial Sequence
  chemically synthesized
ctcctaagttctctggagaaag

SEQ ID NO: 45537 - DNA, 22 bp, Artificial Sequence
  chemically synthesized
ctaagttctctggagaaagaga

SEQ ID NO: 45538 - DNA, 22 bp, Artificial Sequence
  chemically synthesized
agttctctggagaaagagatga

SEQ ID NO: 45539 - DNA, 22 bp, Artificial Sequence
  chemically synthesized
tctggagaaagagatgaaagaa

SEQ ID NO: 45540 - DNA, 22 bp, Artificial Sequence
  chemically synthesized
tggagaaagagatgaaagaaaa

SEQ ID NO: 45541 - DNA, 22 bp, Artificial Sequence
  chemically synthesized
gagaaagagatgaaagaaaatg

SEQ ID NO: 45542 - DNA, 22 bp, Artificial Sequence
  chemically synthesized
aggggatctgtctcccaccttc

SEQ ID NO: 45543 - DNA, 22 bp, Artificial Sequence
  chemically synthesized
tctcccaccttcagaagcagat

SEQ ID NO: 45544 - DNA, 22 bp, Artificial Sequence
  chemically synthesized
ccaccttcagaagcagatactg

SEQ ID NO: 45545 - DNA, 22 bp, Artificial Sequence
  chemically synthesized
cagaagcagatactgagccaca

SEQ ID NO: 45546 - DNA, 22 bp, Artificial Sequence
  chemically synthesized
agaagcagatactgagccacaa

SEQ ID NO: 45547 - DNA, 22 bp, Artificial Sequence
  chemically synthesized
agccacaaatctgctaagattg

SEQ ID NO: 45548 - DNA, 22 bp, Artificial Sequence
  chemically synthesized
ctaagattgccctgaatgagag

SEQ ID NO: 45549 - DNA, 22 bp, Artificial Sequence
  chemically synthesized
agattgccctgaatgagagttt

SEQ ID NO: 45550 - DNA, 22 bp, Artificial Sequence
  chemically synthesized
ccctgaatgagagttttaactc

SEQ ID NO: 45551 - DNA, 22 bp, Artificial Sequence
  chemically synthesized
aatgagagttttaactcctgta

SEQ ID NO: 45552 - DNA, 22 bp, Artificial Sequence
  chemically synthesized
taactcctgtagagaaagagtt

SEQ ID NO: 45553 - DNA, 22 bp, Artificial Sequence
  chemically synthesized
aactcctgtagagaaagagttg

SEQ ID NO: 45554 - DNA, 22 bp, Artificial Sequence
  chemically synthesized
actcctgtagagaaagagttga

SEQ ID NO: 45555 - DNA, 22 bp, Artificial Sequence
  chemically synthesized
ctgtagagaaagagttgaaatt

SEQ ID NO: 45556 - DNA, 22 bp, Artificial Sequence
  chemically synthesized
tagagaaagagttgaaattgtg

SEQ ID NO: 45557 - DNA, 22 bp, Artificial Sequence
  chemically synthesized
aaattgtgaaaaaacagagaca

SEQ ID NO: 45558 - DNA, 22 bp, Artificial Sequence
  chemically synthesized
tgaaaaaacagagacaagctgt

SEQ ID NO: 45559 - DNA, 22 bp, Artificial Sequence
  chemically synthesized
ttatcatgcgagtagctgatct

SEQ ID NO: 45560 - DNA, 22 bp, Artificial Sequence
  chemically synthesized
tcatgcgagtagctgatctgca

SEQ ID NO: 45561 - DNA, 22 bp, Artificial Sequence
  chemically synthesized
atctgcaacaagaggtgcatgc

SEQ ID NO: 45562 - DNA, 22 bp, Artificial Sequence
  chemically synthesized
caacaagaggtgcatgcacagc

SEQ ID NO: 45563 - DNA, 22 bp, Artificial Sequence
  chemically synthesized
gccaggtgtttactgttaaagt

SEQ ID NO: 45564 - DNA, 22 bp, Artificial Sequence
  chemically synthesized
ccaggtgtttactgttaaagtg

SEQ ID NO: 45565 - DNA, 22 bp, Artificial Sequence
  chemically synthesized
actgttaaagtgagggcattga

SEQ ID NO: 45566 - DNA, 22 bp, Artificial Sequence
  chemically synthesized
ctgttaaagtgagggcattgac

SEQ ID NO: 45567 - DNA, 22 bp, Artificial Sequence
  chemically synthesized
ttaaagtgagggcattgactgg

SEQ ID NO: 45568 - DNA, 22 bp, Artificial Sequence
  chemically synthesized
aagtgagggcattgactggaaa

SEQ ID NO: 45569 - DNA, 22 bp, Artificial Sequence
  chemically synthesized
actggaaaaaaatgggaccctg

SEQ ID NO: 45570 - DNA, 22 bp, Artificial Sequence
  chemically synthesized
gaaaaaaatgggaccctggaac

SEQ ID NO: 45571 - DNA, 22 bp, Artificial Sequence
  chemically synthesized
gaacttggagtggggatgtgtg

SEQ ID NO: 45572 - DNA, 22 bp, Artificial Sequence
  chemically synthesized
ggagtggggatgtgtgggagaa

SEQ ID NO: 45573 - DNA, 22 bp, Artificial Sequence
  chemically synthesized
gagtggggatgtgtgggagaac

SEQ ID NO: 45574 - DNA, 22 bp, Artificial Sequence
  chemically synthesized
atgaagctgaggacactgagtt

SEQ ID NO: 45575 - DNA, 22 bp, Artificial Sequence
  chemically synthesized
aggacactgagtttgtgaactc

SEQ ID NO: 45576 - DNA, 22 bp, Artificial Sequence
  chemically synthesized
agtttgtgaactctgatgaaac

SEQ ID NO: 45577 - DNA, 22 bp, Artificial Sequence
  chemically synthesized
gtgaactctgatgaaacttttt

SEQ ID NO: 45578 - DNA, 22 bp, Artificial Sequence
  chemically synthesized
tgaactctgatgaaactttttt

SEQ ID NO: 45579 - DNA, 22 bp, Artificial Sequence
  chemically synthesized
tgatgaaacttttttgccagaa

SEQ ID NO: 45580 - DNA, 22 bp, Artificial Sequence
  chemically synthesized
atgaaacttttttgccagaaga

SEQ ID NO: 45581 - DNA, 22 bp, Artificial Sequence
  chemically synthesized
ttttgccagaagaaacagtttc

SEQ ID NO: 45582 - DNA, 22 bp, Artificial Sequence
  chemically synthesized
tttgccagaagaaacagtttcc

SEQ ID NO: 45583 - DNA, 22 bp, Artificial Sequence
  chemically synthesized
ttgccagaagaaacagtttccc

SEQ ID NO: 45584 - DNA, 22 bp, Artificial Sequence
  chemically synthesized
tgccagaagaaacagtttcccc

SEQ ID NO: 45585 - DNA, 22 bp, Artificial Sequence
  chemically synthesized
gccagaagaaacagtttcccca

SEQ ID NO: 45586 - DNA, 22 bp, Artificial Sequence
  chemically synthesized
ccagaagaaacagtttccccat

SEQ ID NO: 45587 - DNA, 22 bp, Artificial Sequence
  chemically synthesized
ccccatccccagtagtggtaac

SEQ ID NO: 45588 - DNA, 22 bp, Artificial Sequence
  chemically synthesized
cccatccccagtagtggtaaca

SEQ ID NO: 45589 - DNA, 22 bp, Artificial Sequence
  chemically synthesized
cctgacccgtgctgccattagc

SEQ ID NO: 45590 - DNA, 22 bp, Artificial Sequence
  chemically synthesized
acccgtgctgccattagccttt

SEQ ID NO: 45591 - DNA, 22 bp, Artificial Sequence
  chemically synthesized
ccattagcctttccacctttgt

SEQ ID NO: 45592 - DNA, 22 bp, Artificial Sequence
  chemically synthesized
gcctttccacctttgtctgagg

SEQ ID NO: 45593 - DNA, 22 bp, Artificial Sequence
  chemically synthesized
tccacctttgtctgaggatgta

SEQ ID NO: 45594 - DNA, 22 bp, Artificial Sequence
  chemically synthesized
ccacctttgtctgaggatgtaa

SEQ ID NO: 45595 - DNA, 22 bp, Artificial Sequence
  chemically synthesized
cacctttgtctgaggatgtaaa

SEQ ID NO: 45596 - DNA, 22 bp, Artificial Sequence
  chemically synthesized
tgtctgaggatgtaaaccctgc

SEQ ID NO: 45597 - DNA, 22 bp, Artificial Sequence
  chemically synthesized
gtctgaggatgtaaaccctgca

SEQ ID NO: 45598 - DNA, 22 bp, Artificial Sequence
  chemically synthesized
tctgaggatgtaaaccctgcac

SEQ ID NO: 45599 - DNA, 22 bp, Artificial Sequence
  chemically synthesized
aggatgtaaaccctgcactgct

SEQ ID NO: 45600 - DNA, 22 bp, Artificial Sequence
  chemically synthesized
cactgcttgaggcaacagtgat

SEQ ID NO: 45601 - DNA, 22 bp, Artificial Sequence
  chemically synthesized
cttgaggcaacagtgatggcct

SEQ ID NO: 45602 - DNA, 22 bp, Artificial Sequence
  chemically synthesized
gaggcaacagtgatggccttcc

SEQ ID NO: 45603 - DNA, 22 bp, Artificial Sequence
  chemically synthesized
aggcaacagtgatggccttccc

SEQ ID NO: 45604 - DNA, 22 bp, Artificial Sequence
  chemically synthesized
ccctgaggcagctgccaggcaa

SEQ ID NO: 45605 - DNA, 22 bp, Artificial Sequence
  chemically synthesized
cctgaggcagctgccaggcaag

SEQ ID NO: 45606 - DNA, 22 bp, Artificial Sequence
  chemically synthesized
aggcagctgccaggcaagataa

SEQ ID NO: 45607 - DNA, 22 bp, Artificial Sequence
  chemically synthesized
ccaggcaagataatgttgattc

SEQ ID NO: 45608 - DNA, 22 bp, Artificial Sequence
  chemically synthesized
attctcctcaagaggcacccct

SEQ ID NO: 45609 - DNA, 22 bp, Artificial Sequence
  chemically synthesized
tcctcaagaggcacccctaatg

SEQ ID NO: 45610 - DNA, 22 bp, Artificial Sequence
  chemically synthesized
ctcaagaggcacccctaatgcc

SEQ ID NO: 45611 - DNA, 22 bp, Artificial Sequence
  chemically synthesized
aagaggcacccctaatgcccct

SEQ ID NO: 45612 - DNA, 22 bp, Artificial Sequence
  chemically synthesized
atgcccctgaatgcttctagac

SEQ ID NO: 45613 - DNA, 22 bp, Artificial Sequence
  chemically synthesized
aatgcttctagacctataacta

SEQ ID NO: 45614 - DNA, 22 bp, Artificial Sequence
  chemically synthesized
ctagacctataactaggctaaa

SEQ ID NO: 45615 - DNA, 22 bp, Artificial Sequence
  chemically synthesized
tagacctataactaggctaaat

SEQ ID NO: 45616 - DNA, 22 bp, Artificial Sequence
  chemically synthesized
gacctataactaggctaaattc

SEQ ID NO: 45617 - DNA, 22 bp, Artificial Sequence
  chemically synthesized
taactaggctaaattccttgcg

SEQ ID NO: 45618 - DNA, 22 bp, Artificial Sequence
  chemically synthesized
ggctaaattccttgcgggcccc

SEQ ID NO: 45619 - DNA, 22 bp, Artificial Sequence
  chemically synthesized
aattccttgcgggccccagagg

SEQ ID NO: 45620 - DNA, 22 bp, Artificial Sequence
  chemically synthesized
cttgcgggccccagaggtgagg

SEQ ID NO: 45621 - DNA, 22 bp, Artificial Sequence
  chemically synthesized
gcgggccccagaggtgaggttc

SEQ ID NO: 45622 - DNA, 22 bp, Artificial Sequence
  chemically synthesized
cgggccccagaggtgaggttca

SEQ ID NO: 45623 - DNA, 22 bp, Artificial Sequence
  chemically synthesized
agagtgtgacccatgaggaggt

SEQ ID NO: 45624 - DNA, 22 bp, Artificial Sequence
  chemically synthesized
tactctaaaagaactgcttaag

SEQ ID NO: 45625 - DNA, 22 bp, Artificial Sequence
  chemically synthesized
taaaagaactgcttaagctttc

SEQ ID NO: 45626 - DNA, 22 bp, Artificial Sequence
  chemically synthesized
aaagaactgcttaagctttcta

SEQ ID NO: 45627 - DNA, 22 bp, Artificial Sequence
  chemically synthesized
cttaagctttctaatttatatt

SEQ ID NO: 45628 - DNA, 22 bp, Artificial Sequence
  chemically synthesized
aagctttctaatttatattggc

SEQ ID NO: 45629 - DNA, 22 bp, Artificial Sequence
  chemically synthesized
agctttctaatttatattggca

SEQ ID NO: 45630 - DNA, 22 bp, Artificial Sequence
  chemically synthesized
tctaatttatattggcagaaat

SEQ ID NO: 45631 - DNA, 22 bp, Artificial Sequence
  chemically synthesized
ctaatttatattggcagaaatc

SEQ ID NO: 45632 - DNA, 22 bp, Artificial Sequence
  chemically synthesized
taatttatattggcagaaatct

SEQ ID NO: 45633 - DNA, 22 bp, Artificial Sequence
  chemically synthesized
atttatattggcagaaatctgg

SEQ ID NO: 45634 - DNA, 22 bp, Artificial Sequence
  chemically synthesized
atattggcagaaatctggagaa

SEQ ID NO: 45635 - DNA, 22 bp, Artificial Sequence
  chemically synthesized
tattggcagaaatctggagaac

SEQ ID NO: 45636 - DNA, 22 bp, Artificial Sequence
  chemically synthesized
gcagaaatctggagaacaggca

SEQ ID NO: 45637 - DNA, 22 bp, Artificial Sequence
  chemically synthesized
gagaacaggcatgggaatggat

SEQ ID NO: 45638 - DNA, 22 bp, Artificial Sequence
  chemically synthesized
agggtaagggataatggtggaa

SEQ ID NO: 45639 - DNA, 22 bp, Artificial Sequence
  chemically synthesized
gatcaagctgaatttattggtt

SEQ ID NO: 45640 - DNA, 22 bp, Artificial Sequence
  chemically synthesized
aatttattggtttggccctact

SEQ ID NO: 45641 - DNA, 22 bp, Artificial Sequence
  chemically synthesized
attggtttggccctactaagta

SEQ ID NO: 45642 - DNA, 22 bp, Artificial Sequence
  chemically synthesized
ttggtttggccctactaagtag

SEQ ID NO: 45643 - DNA, 22 bp, Artificial Sequence
  chemically synthesized
gtttggccctactaagtaggga

SEQ ID NO: 45644 - DNA, 22 bp, Artificial Sequence
  chemically synthesized
ggccctactaagtagggattct

SEQ ID NO: 45645 - DNA, 22 bp, Artificial Sequence
  chemically synthesized
gccctactaagtagggattctg

SEQ ID NO: 45646 - DNA, 22 bp, Artificial Sequence
  chemically synthesized
ctaagtagggattctgcattta

SEQ ID NO: 45647 - DNA, 22 bp, Artificial Sequence
  chemically synthesized
agtagggattctgcatttaatg

SEQ ID NO: 45648 - DNA, 22 bp, Artificial Sequence
  chemically synthesized
tgcatttaatgttgcagctcgg

SEQ ID NO: 45649 - DNA, 22 bp, Artificial Sequence
  chemically synthesized
catttaatgttgcagctcgggg

SEQ ID NO: 45650 - DNA, 22 bp, Artificial Sequence
  chemically synthesized
aatgttgcagctcggggactta

SEQ ID NO: 45651 - DNA, 22 bp, Artificial Sequence
  chemically synthesized
atgttgcagctcggggacttag

SEQ ID NO: 45652 - DNA, 22 bp, Artificial Sequence
  chemically synthesized
cagctcggggacttagaaaagg

SEQ ID NO: 45653 - DNA, 22 bp, Artificial Sequence
  chemically synthesized
ggggacttagaaaaggttctga

SEQ ID NO: 45654 - DNA, 22 bp, Artificial Sequence
  chemically synthesized
agaaaaggttctgatagggccg

SEQ ID NO: 45655 - DNA, 22 bp, Artificial Sequence
  chemically synthesized
gaaaaggttctgatagggccgg

SEQ ID NO: 45656 - DNA, 22 bp, Artificial Sequence
  chemically synthesized
tgatagggccgggagcagtggc

SEQ ID NO: 45657 - DNA, 22 bp, Artificial Sequence
  chemically synthesized
atagggccgggagcagtggctc

SEQ ID NO: 45658 - DNA, 22 bp, Artificial Sequence
  chemically synthesized
acgcctgtaatcccagcacctt

SEQ ID NO: 45659 - DNA, 22 bp, Artificial Sequence
  chemically synthesized
taatcccagcaccttgggaggc

SEQ ID NO: 45660 - DNA, 22 bp, Artificial Sequence
  chemically synthesized
gggaggcgggggcgggcagatc

SEQ ID NO: 45661 - DNA, 22 bp, Artificial Sequence
  chemically synthesized
ggaggcgggggcgggcagatca

SEQ ID NO: 45662 - DNA, 22 bp, Artificial Sequence
  chemically synthesized
agacaattctggctaaaatggt

SEQ ID NO: 45663 - DNA, 22 bp, Artificial Sequence
  chemically synthesized
tggctaaaatggtgaaacccca

SEQ ID NO: 45664 - DNA, 22 bp, Artificial Sequence
  chemically synthesized
gctaaaatggtgaaaccccatc

SEQ ID NO: 45665 - DNA, 22 bp, Artificial Sequence
  chemically synthesized
aaatggtgaaaccccatctctg

SEQ ID NO: 45666 - DNA, 22 bp, Artificial Sequence
  chemically synthesized
tgctaaaaatacaaaaattagc

SEQ ID NO: 45667 - DNA, 22 bp, Artificial Sequence
  chemically synthesized
ctaaaaatacaaaaattagctg

SEQ ID NO: 45668 - DNA, 22 bp, Artificial Sequence
  chemically synthesized
aaaatacaaaaattagctgggc

SEQ ID NO: 45669 - DNA, 22 bp, Artificial Sequence
  chemically synthesized
gctgggcatggtgatgcgtaac

SEQ ID NO: 45670 - DNA, 22 bp, Artificial Sequence
  chemically synthesized
ggcatggtgatgcgtaactgta

SEQ ID NO: 45671 - DNA, 22 bp, Artificial Sequence
  chemically synthesized
taatctcatctacttgggaggc

SEQ ID NO: 45672 - DNA, 22 bp, Artificial Sequence
  chemically synthesized
atctacttgggaggctgaggca

SEQ ID NO: 45673 - DNA, 22 bp, Artificial Sequence
  chemically synthesized
cttgggaggctgaggcaagaga

SEQ ID NO: 45674 - DNA, 22 bp, Artificial Sequence
  chemically synthesized
gggaggctgaggcaagagaact

SEQ ID NO: 45675 - DNA, 22 bp, Artificial Sequence
  chemically synthesized
ggaggctgaggcaagagaactg

SEQ ID NO: 45676 - DNA, 22 bp, Artificial Sequence
  chemically synthesized
aggcaagagaactgcttgaacc

SEQ ID NO: 45677 - DNA, 22 bp, Artificial Sequence
  chemically synthesized
cttgaacctgtgaggcagagat

SEQ ID NO: 45678 - DNA, 22 bp, Artificial Sequence
  chemically synthesized
gaacctgtgaggcagagattgc

SEQ ID NO: 45679 - DNA, 22 bp, Artificial Sequence
  chemically synthesized
aacctgtgaggcagagattgca

SEQ ID NO: 45680 - DNA, 22 bp, Artificial Sequence
  chemically synthesized
tgaggcagagattgcagtgagc

SEQ ID NO: 45681 - DNA, 22 bp, Artificial Sequence
  chemically synthesized
cagtgagccaagatcgccccac

SEQ ID NO: 45682 - DNA, 22 bp, Artificial Sequence
  chemically synthesized
cattccagcctggtaacagagc

SEQ ID NO: 45683 - DNA, 22 bp, Artificial Sequence
  chemically synthesized
cagcctggtaacagagcaagac

SEQ ID NO: 45684 - DNA, 22 bp, Artificial Sequence
  chemically synthesized
gtaacagagcaagactccattt

SEQ ID NO: 45685 - DNA, 22 bp, Artificial Sequence
  chemically synthesized
catttccaaaaaaaaaaaaaaa

SEQ ID NO: 45686 - DNA, 22 bp, Artificial Sequence
  chemically synthesized
ccaaaaaaaaaaaaaaaaaagt

SEQ ID NO: 45687 - DNA, 22 bp, Artificial Sequence
  chemically synthesized
caaaaaaaaaaaaaaaaaagtt

SEQ ID NO: 45688 - DNA, 22 bp, Artificial Sequence
  chemically synthesized
taatagtttatttgcttggtta

SEQ ID NO: 45689 - DNA, 22 bp, Artificial Sequence
  chemically synthesized
atttgcttggttagctgaaata

SEQ ID NO: 45690 - DNA, 22 bp, Artificial Sequence
  chemically synthesized
tttgcttggttagctgaaatat

SEQ ID NO: 45691 - DNA, 22 bp, Artificial Sequence
  chemically synthesized
gcttggttagctgaaatatgga

SEQ ID NO: 45692 - DNA, 22 bp, Artificial Sequence
  chemically synthesized
cttggttagctgaaatatggat

SEQ ID NO: 45693 - DNA, 22 bp, Artificial Sequence
  chemically synthesized
ggttagctgaaatatggattaa

SEQ ID NO: 45694 - DNA, 22 bp, Artificial Sequence
  chemically synthesized
gttagctgaaatatggattaaa

SEQ ID NO: 45695 - DNA, 22 bp, Artificial Sequence
  chemically synthesized
gctgaaatatggattaaaagat

SEQ ID NO: 45696 - DNA, 22 bp, Artificial Sequence
  chemically synthesized
aaatatggattaaaagatggtc

SEQ ID NO: 45697 - DNA, 22 bp, Artificial Sequence
  chemically synthesized
aaagatggtccaatgttagtga

SEQ ID NO: 45698 - DNA, 22 bp, Artificial Sequence
  chemically synthesized
gtgagctggaaatgccttggtt

SEQ ID NO: 45699 - DNA, 22 bp, Artificial Sequence
  chemically synthesized
gaaatgccttggtttaatgtag

SEQ ID NO: 45700 - DNA, 22 bp, Artificial Sequence
  chemically synthesized
ggtttaatgtagaggaagtgat

SEQ ID NO: 45701 - DNA, 22 bp, Artificial Sequence
  chemically synthesized
gtttaatgtagaggaagtgatc

SEQ ID NO: 45702 - DNA, 22 bp, Artificial Sequence
  chemically synthesized
aatgtagaggaagtgatccaaa

SEQ ID NO: 45703 - DNA, 22 bp, Artificial Sequence
  chemically synthesized
atgtagaggaagtgatccaaag

SEQ ID NO: 45704 - DNA, 22 bp, Artificial Sequence
  chemically synthesized
agggagattaggatggtggagt

SEQ ID NO: 45705 - DNA, 22 bp, Artificial Sequence
  chemically synthesized
gggagattaggatggtggagtg

SEQ ID NO: 45706 - DNA, 22 bp, Artificial Sequence
  chemically synthesized
ggatggtggagtggattagtca

SEQ ID NO: 45707 - DNA, 22 bp, Artificial Sequence
  chemically synthesized
gtcactttagacctactcatcc

SEQ ID NO: 45708 - DNA, 22 bp, Artificial Sequence
  chemically synthesized
tagacctactcatcccagctgg

SEQ ID NO: 45709 - DNA, 22 bp, Artificial Sequence
  chemically synthesized
agacctactcatcccagctggg

SEQ ID NO: 45710 - DNA, 22 bp, Artificial Sequence
  chemically synthesized
gacctactcatcccagctggga

SEQ ID NO: 45711 - DNA, 22 bp, Artificial Sequence
  chemically synthesized
ctcatcccagctgggagggtcc

SEQ ID NO: 45712 - DNA, 22 bp, Artificial Sequence
  chemically synthesized
atcccagctgggagggtccaga

SEQ ID NO: 45713 - DNA, 22 bp, Artificial Sequence
  chemically synthesized
ggagggtccagaagatacaccc

SEQ ID NO: 45714 - DNA, 22 bp, Artificial Sequence
  chemically synthesized
ggccgaagctttgtgaaataga

SEQ ID NO: 45715 - DNA, 22 bp, Artificial Sequence
  chemically synthesized
gccgaagctttgtgaaatagat

SEQ ID NO: 45716 - DNA, 22 bp, Artificial Sequence
  chemically synthesized
tgtgaaatagatttgtgagagc

SEQ ID NO: 45717 - DNA, 22 bp, Artificial Sequence
  chemically synthesized
gtgaaatagatttgtgagagca

SEQ ID NO: 45718 - DNA, 22 bp, Artificial Sequence
  chemically synthesized
tgaaatagatttgtgagagcag

SEQ ID NO: 45719 - DNA, 22 bp, Artificial Sequence
  chemically synthesized
gtgagagcagcacctgtatttt

SEQ ID NO: 45720 - DNA, 22 bp, Artificial Sequence
  chemically synthesized
tgagagcagcacctgtattttt

SEQ ID NO: 45721 - DNA, 22 bp, Artificial Sequence
  chemically synthesized
tatttttgaagagcccgtaatt

SEQ ID NO: 45722 - DNA, 22 bp, Artificial Sequence
  chemically synthesized
ttgaagagcccgtaattgctct

SEQ ID NO: 45723 - DNA, 22 bp, Artificial Sequence
  chemically synthesized
tgaagagcccgtaattgctctt

SEQ ID NO: 45724 - DNA, 22 bp, Artificial Sequence
  chemically synthesized
gaagagcccgtaattgctcttc

SEQ ID NO: 45725 - DNA, 22 bp, Artificial Sequence
  chemically synthesized
aagagcccgtaattgctcttct

SEQ ID NO: 45726 - DNA, 22 bp, Artificial Sequence
  chemically synthesized
ctcttctctgtatgtcagatct

SEQ ID NO: 45727 - DNA, 22 bp, Artificial Sequence
  chemically synthesized
ttctctgtatgtcagatctaac

SEQ ID NO: 45728 - DNA, 22 bp, Artificial Sequence
  chemically synthesized
ctctgtatgtcagatctaacag

SEQ ID NO: 45729 - DNA, 22 bp, Artificial Sequence
  chemically synthesized
tctgtatgtcagatctaacagt

SEQ ID NO: 45730 - DNA, 22 bp, Artificial Sequence
  chemically synthesized
tgtatgtcagatctaacagtag

SEQ ID NO: 45731 - DNA, 22 bp, Artificial Sequence
  chemically synthesized
tatgtcagatctaacagtagga

SEQ ID NO: 45732 - DNA, 22 bp, Artificial Sequence
  chemically synthesized
acagtaggaaccacagtcactc

SEQ ID NO: 45733 - DNA, 22 bp, Artificial Sequence
  chemically synthesized
aactacaaaatttaaatacaat

SEQ ID NO: 45734 - DNA, 22 bp, Artificial Sequence
  chemically synthesized
caaaatttaaatacaatgggaa

SEQ ID NO: 45735 - DNA, 22 bp, Artificial Sequence
  chemically synthesized
aaatacaatgggaataattgga

SEQ ID NO: 45736 - DNA, 22 bp, Artificial Sequence
  chemically synthesized
aatacaatgggaataattggat

SEQ ID NO: 45737 - DNA, 22 bp, Artificial Sequence
  chemically synthesized
gatcctgaggtggcaggggcca

SEQ ID NO: 45738 - DNA, 22 bp, Artificial Sequence
  chemically synthesized
aggtggcaggggccaagtgttg

SEQ ID NO: 45739 - DNA, 22 bp, Artificial Sequence
  chemically synthesized
gcactgaaccatcaaaggcaag

SEQ ID NO: 45740 - DNA, 22 bp, Artificial Sequence
  chemically synthesized
aaccatcaaaggcaaggtgggc

SEQ ID NO: 45741 - DNA, 22 bp, Artificial Sequence
  chemically synthesized
ccataatagacagcagaggcaa

SEQ ID NO: 45742 - DNA, 22 bp, Artificial Sequence
  chemically synthesized
actcatgtagagctctggcatt

SEQ ID NO: 45743 - DNA, 22 bp, Artificial Sequence
  chemically synthesized
atgtagagctctggcattggct

SEQ ID NO: 45744 - DNA, 22 bp, Artificial Sequence
  chemically synthesized
tggcattggctaattaatcatg

SEQ ID NO: 45745 - DNA, 22 bp, Artificial Sequence
  chemically synthesized
gcattggctaattaatcatggt

SEQ ID NO: 45746 - DNA, 22 bp, Artificial Sequence
  chemically synthesized
gctaattaatcatggtgttcct

SEQ ID NO: 45747 - DNA, 22 bp, Artificial Sequence
  chemically synthesized
attaatcatggtgttcctagaa

SEQ ID NO: 45748 - DNA, 22 bp, Artificial Sequence
  chemically synthesized
atcatggtgttcctagaagtga

SEQ ID NO: 45749 - DNA, 22 bp, Artificial Sequence
  chemically synthesized
ctagaagtgaaattgatgggaa

SEQ ID NO: 45750 - DNA, 22 bp, Artificial Sequence
  chemically synthesized
gaagtgaaattgatgggaaacc

SEQ ID NO: 45751 - DNA, 22 bp, Artificial Sequence
  chemically synthesized
atgggaaacctactgtattcct

SEQ ID NO: 45752 - DNA, 22 bp, Artificial Sequence
  chemically synthesized
ctgtattcctacttgatttata

SEQ ID NO: 45753 - DNA, 22 bp, Artificial Sequence
  chemically synthesized
tattcctacttgatttatataa

SEQ ID NO: 45754 - DNA, 22 bp, Artificial Sequence
  chemically synthesized
ctacttgatttatataaacaaa

SEQ ID NO: 45755 - DNA, 22 bp, Artificial Sequence
  chemically synthesized
cttgatttatataaacaaaaaa

SEQ ID NO: 45756 - DNA, 22 bp, Artificial Sequence
  chemically synthesized
gatttatataaacaaaaaactg

SEQ ID NO: 45757 - DNA, 22 bp, Artificial Sequence
  chemically synthesized
atttatataaacaaaaaactgc

SEQ ID NO: 45758 - DNA, 22 bp, Artificial Sequence
  chemically synthesized
atataaacaaaaaactgccagg

SEQ ID NO: 45759 - DNA, 22 bp, Artificial Sequence
  chemically synthesized
tataaacaaaaaactgccaggt

SEQ ID NO: 45760 - DNA, 22 bp, Artificial Sequence
  chemically synthesized
ccaggtagaatggactaaagac

SEQ ID NO: 45761 - DNA, 22 bp, Artificial Sequence
  chemically synthesized
aagactaatctgaattataaaa

SEQ ID NO: 45762 - DNA, 22 bp, Artificial Sequence
  chemically synthesized
atctgaattataaaaacagaga

SEQ ID NO: 45763 - DNA, 22 bp, Artificial Sequence
  chemically synthesized
aattataaaaacagagaatcat

SEQ ID NO: 45764 - DNA, 22 bp, Artificial Sequence
  chemically synthesized
taaaaacagagaatcatgggcc

SEQ ID NO: 45765 - DNA, 22 bp, Artificial Sequence
  chemically synthesized
aatcaatttccagactcgaacc

SEQ ID NO: 45766 - DNA, 22 bp, Artificial Sequence
  chemically synthesized
ccagactcgaacctgttacagt

SEQ ID NO: 45767 - DNA, 22 bp, Artificial Sequence
  chemically synthesized
cagactcgaacctgttacagtt

SEQ ID NO: 45768 - DNA, 22 bp, Artificial Sequence
  chemically synthesized
gaacctgttacagttccagaac

SEQ ID NO: 45769 - DNA, 22 bp, Artificial Sequence
  chemically synthesized
ttacagttccagaacccactga

SEQ ID NO: 45770 - DNA, 22 bp, Artificial Sequence
  chemically synthesized
cagttccagaacccactgaatg

SEQ ID NO: 45771 - DNA, 22 bp, Artificial Sequence
  chemically synthesized
cagaacccactgaatgaagggg

SEQ ID NO: 45772 - DNA, 22 bp, Artificial Sequence
  chemically synthesized
aatgaaggggaggctggatccc

SEQ ID NO: 45773 - DNA, 22 bp, Artificial Sequence
  chemically synthesized
gatccccttgaggaaggacacc

SEQ ID NO: 45774 - DNA, 22 bp, Artificial Sequence
  chemically synthesized
gaggaaggacaccactaggcta

SEQ ID NO: 45775 - DNA, 22 bp, Artificial Sequence
  chemically synthesized
aggaaggacaccactaggctac

SEQ ID NO: 45776 - DNA, 22 bp, Artificial Sequence
  chemically synthesized
ggctactgacaacttatgctgt

SEQ ID NO: 45777 - DNA, 22 bp, Artificial Sequence
  chemically synthesized
ctgacaacttatgctgttactc

SEQ ID NO: 45778 - DNA, 22 bp, Artificial Sequence
  chemically synthesized
acaacttatgctgttactcttt

SEQ ID NO: 45779 - DNA, 22 bp, Artificial Sequence
  chemically synthesized
atgctgttactctttctcccat

SEQ ID NO: 45780 - DNA, 22 bp, Artificial Sequence
  chemically synthesized
tgctgttactctttctcccatc

SEQ ID NO: 45781 - DNA, 22 bp, Artificial Sequence
  chemically synthesized
ttactctttctcccatccttcc

SEQ ID NO: 45782 - DNA, 22 bp, Artificial Sequence
  chemically synthesized
ctctttctcccatccttcccta

SEQ ID NO: 45783 - DNA, 22 bp, Artificial Sequence
  chemically synthesized
tttctcccatccttccctaagg

SEQ ID NO: 45784 - DNA, 22 bp, Artificial Sequence
  chemically synthesized
tctcccatccttccctaaggag

SEQ ID NO: 45785 - DNA, 22 bp, Artificial Sequence
  chemically synthesized
ctcccatccttccctaaggaga

SEQ ID NO: 45786 - DNA, 22 bp, Artificial Sequence
  chemically synthesized
tcccatccttccctaaggagac

SEQ ID NO: 45787 - DNA, 22 bp, Artificial Sequence
  chemically synthesized
ccatccttccctaaggagacct

SEQ ID NO: 45788 - DNA, 22 bp, Artificial Sequence
  chemically synthesized
ccctaaggagacctctggcctt

SEQ ID NO: 45789 - DNA, 22 bp, Artificial Sequence
  chemically synthesized
cctaaggagacctctggccttt

SEQ ID NO: 45790 - DNA, 22 bp, Artificial Sequence
  chemically synthesized
aggagacctctggccttttacc

SEQ ID NO: 45791 - DNA, 22 bp, Artificial Sequence
  chemically synthesized
tggccttttaccagggtaactg

SEQ ID NO: 45792 - DNA, 22 bp, Artificial Sequence
  chemically synthesized
gccttttaccagggtaactgtg

SEQ ID NO: 45793 - DNA, 22 bp, Artificial Sequence
  chemically synthesized
ttaccagggtaactgtgtgtac

SEQ ID NO: 45794 - DNA, 22 bp, Artificial Sequence
  chemically synthesized
taccagggtaactgtgtgtact

SEQ ID NO: 45795 - DNA, 22 bp, Artificial Sequence
  chemically synthesized
accagggtaactgtgtgtactg

SEQ ID NO: 45796 - DNA, 22 bp, Artificial Sequence
  chemically synthesized
ccagggtaactgtgtgtactgg

SEQ ID NO: 45797 - DNA, 22 bp, Artificial Sequence
  chemically synthesized
tgtgtactggagaaagggaagt

SEQ ID NO: 45798 - DNA, 22 bp, Artificial Sequence
  chemically synthesized
gagaaagggaagtaatgagaca

SEQ ID NO: 45799 - DNA, 22 bp, Artificial Sequence
  chemically synthesized
cagaaagtactggacactggct

SEQ ID NO: 45800 - DNA, 22 bp, Artificial Sequence
  chemically synthesized
agaaagtactggacactggctc

SEQ ID NO: 45801 - DNA, 22 bp, Artificial Sequence
  chemically synthesized
gacactggctctgagctgacgt

SEQ ID NO: 45802 - DNA, 22 bp, Artificial Sequence
  chemically synthesized
gctctgagctgacgttgattcc

SEQ ID NO: 45803 - DNA, 22 bp, Artificial Sequence
  chemically synthesized
tgagctgacgttgattccaggg

SEQ ID NO: 45804 - DNA, 22 bp, Artificial Sequence
  chemically synthesized
agctgacgttgattccagggta

SEQ ID NO: 45805 - DNA, 22 bp, Artificial Sequence
  chemically synthesized
acgttgattccagggtacccaa

SEQ ID NO: 45806 - DNA, 22 bp, Artificial Sequence
  chemically synthesized
attccagggtacccaaaacgtt

SEQ ID NO: 45807 - DNA, 22 bp, Artificial Sequence
  chemically synthesized
cagggtacccaaaacgttattg

SEQ ID NO: 45808 - DNA, 22 bp, Artificial Sequence
  chemically synthesized
ttgtggttccccagttaaagta

SEQ ID NO: 45809 - DNA, 22 bp, Artificial Sequence
  chemically synthesized
tggttccccagttaaagtaggg

SEQ ID NO: 45810 - DNA, 22 bp, Artificial Sequence
  chemically synthesized
cccagttaaagtaggggcttat

SEQ ID NO: 45811 - DNA, 22 bp, Artificial Sequence
  chemically synthesized
aagtaggggcttatggaggtta

SEQ ID NO: 45812 - DNA, 22 bp, Artificial Sequence
  chemically synthesized
atggaggttaggtaattaatgg

SEQ ID NO: 45813 - DNA, 22 bp, Artificial Sequence
  chemically synthesized
tggaggttaggtaattaatgga

SEQ ID NO: 45814 - DNA, 22 bp, Artificial Sequence
  chemically synthesized
ggtaattaatggagttttagct

SEQ ID NO: 45815 - DNA, 22 bp, Artificial Sequence
  chemically synthesized
atggagttttagctcatttctg

SEQ ID NO: 45816 - DNA, 22 bp, Artificial Sequence
  chemically synthesized
tagctcatttctgacttacagt

SEQ ID NO: 45817 - DNA, 22 bp, Artificial Sequence
  chemically synthesized
agctcatttctgacttacagtg

SEQ ID NO: 45818 - DNA, 22 bp, Artificial Sequence
  chemically synthesized
gctcatttctgacttacagtgg

SEQ ID NO: 45819 - DNA, 22 bp, Artificial Sequence
  chemically synthesized
atttctgacttacagtggttcc

SEQ ID NO: 45820 - DNA, 22 bp, Artificial Sequence
  chemically synthesized
ctgacttacagtggttccagtg

SEQ ID NO: 45821 - DNA, 22 bp, Artificial Sequence
  chemically synthesized
tgacttacagtggttccagtgg

SEQ ID NO: 45822 - DNA, 22 bp, Artificial Sequence
  chemically synthesized
acttacagtggttccagtgggt

SEQ ID NO: 45823 - DNA, 22 bp, Artificial Sequence
  chemically synthesized
acagtggttccagtgggtccct

SEQ ID NO: 45824 - DNA, 22 bp, Artificial Sequence
  chemically synthesized
cagtggttccagtgggtccctg

SEQ ID NO: 45825 - DNA, 22 bp, Artificial Sequence
  chemically synthesized
cagtgggtccctggacttatcc

SEQ ID NO: 45826 - DNA, 22 bp, Artificial Sequence
  chemically synthesized
gacttatcctctggtcattttc

SEQ ID NO: 45827 - DNA, 22 bp, Artificial Sequence
  chemically synthesized
atcctctggtcattttcccagt

SEQ ID NO: 45828 - DNA, 22 bp, Artificial Sequence
  chemically synthesized
tcctctggtcattttcccagtg

SEQ ID NO: 45829 - DNA, 22 bp, Artificial Sequence
  chemically synthesized
tggtcattttcccagtgccaaa

SEQ ID NO: 45830 - DNA, 22 bp, Artificial Sequence
  chemically synthesized
gtcattttcccagtgccaaaat

SEQ ID NO: 45831 - DNA, 22 bp, Artificial Sequence
  chemically synthesized
tcccagtgccaaaatgcataat

SEQ ID NO: 45832 - DNA, 22 bp, Artificial Sequence
  chemically synthesized
cccagtgccaaaatgcataatt

SEQ ID NO: 45833 - DNA, 22 bp, Artificial Sequence
  chemically synthesized
ccagtgccaaaatgcataattt

SEQ ID NO: 45834 - DNA, 22 bp, Artificial Sequence
  chemically synthesized
gtatagacatacttattagctg

SEQ ID NO: 45835 - DNA, 22 bp, Artificial Sequence
  chemically synthesized
tatagacatacttattagctgg

SEQ ID NO: 45836 - DNA, 22 bp, Artificial Sequence
  chemically synthesized
attagctggcagaaatgccaca

SEQ ID NO: 45837 - DNA, 22 bp, Artificial Sequence
  chemically synthesized
ttagctggcagaaatgccacat

SEQ ID NO: 45838 - DNA, 22 bp, Artificial Sequence
  chemically synthesized
gctggcagaaatgccacattgg

SEQ ID NO: 45839 - DNA, 22 bp, Artificial Sequence
  chemically synthesized
gcagaaatgccacattggctcc

SEQ ID NO: 45840 - DNA, 22 bp, Artificial Sequence
  chemically synthesized
gctccctgactggtaggatgag

SEQ ID NO: 45841 - DNA, 22 bp, Artificial Sequence
  chemically synthesized
cctgactggtaggatgagggct

SEQ ID NO: 45842 - DNA, 22 bp, Artificial Sequence
  chemically synthesized
actggtaggatgagggctatta

SEQ ID NO: 45843 - DNA, 22 bp, Artificial Sequence
  chemically synthesized
gtaggatgagggctattatggt

SEQ ID NO: 45844 - DNA, 22 bp, Artificial Sequence
  chemically synthesized
ttatggtgggaaaggccaaaca

SEQ ID NO: 45845 - DNA, 22 bp, Artificial Sequence
  chemically synthesized
tggtgggaaaggccaaacagaa

SEQ ID NO: 45846 - DNA, 22 bp, Artificial Sequence
  chemically synthesized
gagctgtctctacctagaaaaa

SEQ ID NO: 45847 - DNA, 22 bp, Artificial Sequence
  chemically synthesized
tctctacctagaaaaataaaaa

SEQ ID NO: 45848 - DNA, 22 bp, Artificial Sequence
  chemically synthesized
tacctagaaaaataaaaaaatc

SEQ ID NO: 45849 - DNA, 22 bp, Artificial Sequence
  chemically synthesized
cctagaaaaataaaaaaatcaa

SEQ ID NO: 45850 - DNA, 22 bp, Artificial Sequence
  chemically synthesized
gaaaaataaaaaaatcaaaaac

SEQ ID NO: 45851 - DNA, 22 bp, Artificial Sequence
  chemically synthesized
gagggactgaagtgattagtgt

SEQ ID NO: 45852 - DNA, 22 bp, Artificial Sequence
  chemically synthesized
aagtgattagtgtcaccatcaa

SEQ ID NO: 45853 - DNA, 22 bp, Artificial Sequence
  chemically synthesized
gtgtcaccatcaaggacttgaa

SEQ ID NO: 45854 - DNA, 22 bp, Artificial Sequence
  chemically synthesized
gaaagacgcaggggtggtgatt

SEQ ID NO: 45855 - DNA, 22 bp, Artificial Sequence
  chemically synthesized
aaagacgcaggggtggtgattc

SEQ ID NO: 45856 - DNA, 22 bp, Artificial Sequence
  chemically synthesized
ccaccacatccctgttcaactc

SEQ ID NO: 45857 - DNA, 22 bp, Artificial Sequence
  chemically synthesized
ttcaactctcccatttgacctg

SEQ ID NO: 45858 - DNA, 22 bp, Artificial Sequence
  chemically synthesized
aactctcccatttgacctgtgc

SEQ ID NO: 45859 - DNA, 22 bp, Artificial Sequence
  chemically synthesized
tcccatttgacctgtgcagagg

SEQ ID NO: 45860 - DNA, 22 bp, Artificial Sequence
  chemically synthesized
ccatttgacctgtgcagaggac

SEQ ID NO: 45861 - DNA, 22 bp, Artificial Sequence
  chemically synthesized
gacctgtgcagaggacagatgg

SEQ ID NO: 45862 - DNA, 22 bp, Artificial Sequence
  chemically synthesized
acctgtgcagaggacagatgga

SEQ ID NO: 45863 - DNA, 22 bp, Artificial Sequence
  chemically synthesized
tgcagaggacagatggatcttg

SEQ ID NO: 45864 - DNA, 22 bp, Artificial Sequence
  chemically synthesized
ggaaaatgatggtggattattt

SEQ ID NO: 45865 - DNA, 22 bp, Artificial Sequence
  chemically synthesized
gaaaatgatggtggattatttt

SEQ ID NO: 45866 - DNA, 22 bp, Artificial Sequence
  chemically synthesized
ttttaagcttaaccaagtggtg

SEQ ID NO: 45867 - DNA, 22 bp, Artificial Sequence
  chemically synthesized
taagcttaaccaagtggtgact

SEQ ID NO: 45868 - DNA, 22 bp, Artificial Sequence
  chemically synthesized
aagcttaaccaagtggtgactc

SEQ ID NO: 45869 - DNA, 22 bp, Artificial Sequence
  chemically synthesized
agcttaaccaagtggtgactcc

SEQ ID NO: 45870 - DNA, 22 bp, Artificial Sequence
  chemically synthesized
aaccaagtggtgactccaattg

SEQ ID NO: 45871 - DNA, 22 bp, Artificial Sequence
  chemically synthesized
accaagtggtgactccaattgc

SEQ ID NO: 45872 - DNA, 22 bp, Artificial Sequence
  chemically synthesized
caattgcagctgctctaccagt

SEQ ID NO: 45873 - DNA, 22 bp, Artificial Sequence
  chemically synthesized
cagctgctctaccagttgtggt

SEQ ID NO: 45874 - DNA, 22 bp, Artificial Sequence
  chemically synthesized
ctctaccagttgtggttttgtt

SEQ ID NO: 45875 - DNA, 22 bp, Artificial Sequence
  chemically synthesized
taccagttgtggttttgttgct

SEQ ID NO: 45876 - DNA, 22 bp, Artificial Sequence
  chemically synthesized
ccagttgtggttttgttgcttg

SEQ ID NO: 45877 - DNA, 22 bp, Artificial Sequence
  chemically synthesized
tggttttgttgcttgagcaaat

SEQ ID NO: 45878 - DNA, 22 bp, Artificial Sequence
  chemically synthesized
tgttgcttgagcaaattaacac

SEQ ID NO: 45879 - DNA, 22 bp, Artificial Sequence
  chemically synthesized
gttgcttgagcaaattaacaca

SEQ ID NO: 45880 - DNA, 22 bp, Artificial Sequence
  chemically synthesized
ttgcttgagcaaattaacacat

SEQ ID NO: 45881 - DNA, 22 bp, Artificial Sequence
  chemically synthesized
cttgagcaaattaacacatctc

SEQ ID NO: 45882 - DNA, 22 bp, Artificial Sequence
  chemically synthesized
gagcaaattaacacatctcctg

SEQ ID NO: 45883 - DNA, 22 bp, Artificial Sequence
  chemically synthesized
agcaaattaacacatctcctgg

SEQ ID NO: 45884 - DNA, 22 bp, Artificial Sequence
  chemically synthesized
acacatctcctggtgcctggta

SEQ ID NO: 45885 - DNA, 22 bp, Artificial Sequence
  chemically synthesized
ctggtgcctggtatgcagccat

SEQ ID NO: 45886 - DNA, 22 bp, Artificial Sequence
  chemically synthesized
gtgcctggtatgcagccattgg

SEQ ID NO: 45887 - DNA, 22 bp, Artificial Sequence
  chemically synthesized
gtatgcagccattggcttggca

SEQ ID NO: 45888 - DNA, 22 bp, Artificial Sequence
  chemically synthesized
gcttggcaagtggctttttctc

SEQ ID NO: 45889 - DNA, 22 bp, Artificial Sequence
  chemically synthesized
ggcaagtggctttttctccatt

SEQ ID NO: 45890 - DNA, 22 bp, Artificial Sequence
  chemically synthesized
gcaagtggctttttctccattc

SEQ ID NO: 45891 - DNA, 22 bp, Artificial Sequence
  chemically synthesized
tttctccattcctgtccataag

SEQ ID NO: 45892 - DNA, 22 bp, Artificial Sequence
  chemically synthesized
ttctccattcctgtccataaga

SEQ ID NO: 45893 - DNA, 22 bp, Artificial Sequence
  chemically synthesized
tctccattcctgtccataagac

SEQ ID NO: 45894 - DNA, 22 bp, Artificial Sequence
  chemically synthesized
ctccattcctgtccataagacc

SEQ ID NO: 45895 - DNA, 22 bp, Artificial Sequence
  chemically synthesized
tccattcctgtccataagaccc

SEQ ID NO: 45896 - DNA, 22 bp, Artificial Sequence
  chemically synthesized
cattcctgtccataagacccac

SEQ ID NO: 45897 - DNA, 22 bp, Artificial Sequence
  chemically synthesized
ctgtccataagacccaccagaa

SEQ ID NO: 45898 - DNA, 22 bp, Artificial Sequence
  chemically synthesized
tccataagacccaccagaagca

SEQ ID NO: 45899 - DNA, 22 bp, Artificial Sequence
  chemically synthesized
gccttcagctgacaaggccagc

SEQ ID NO: 45900 - DNA, 22 bp, Artificial Sequence
  chemically synthesized
ccttcagctgacaaggccagca

SEQ ID NO: 45901 - DNA, 22 bp, Artificial Sequence
  chemically synthesized
cagctgacaaggccagcattat

SEQ ID NO: 45902 - DNA, 22 bp, Artificial Sequence
  chemically synthesized
agctgacaaggccagcattata

SEQ ID NO: 45903 - DNA, 22 bp, Artificial Sequence
  chemically synthesized
acaaggccagcattataccttt

SEQ ID NO: 45904 - DNA, 22 bp, Artificial Sequence
  chemically synthesized
tacctttaccaccctacctcag

SEQ ID NO: 45905 - DNA, 22 bp, Artificial Sequence
  chemically synthesized
taccaccctacctcaggggtgt

SEQ ID NO: 45906 - DNA, 22 bp, Artificial Sequence
  chemically synthesized
accaccctacctcaggggtgta

SEQ ID NO: 45907 - DNA, 22 bp, Artificial Sequence
  chemically synthesized
ccaccctacctcaggggtgtat

SEQ ID NO: 45908 - DNA, 22 bp, Artificial Sequence
  chemically synthesized
cctcaggggtgtatcaactctc

SEQ ID NO: 45909 - DNA, 22 bp, Artificial Sequence
  chemically synthesized
aggggtgtatcaactctccagc

SEQ ID NO: 45910 - DNA, 22 bp, Artificial Sequence
  chemically synthesized
tccagctttgtgtcataatctt

SEQ ID NO: 45911 - DNA, 22 bp, Artificial Sequence
  chemically synthesized
cagctttgtgtcataatcttat

SEQ ID NO: 45912 - DNA, 22 bp, Artificial Sequence
  chemically synthesized
tgtgtcataatcttatttggag

SEQ ID NO: 45913 - DNA, 22 bp, Artificial Sequence
  chemically synthesized
gtgtcataatcttatttggaga

SEQ ID NO: 45914 - DNA, 22 bp, Artificial Sequence
  chemically synthesized
tgtcataatcttatttggagag

SEQ ID NO: 45915 - DNA, 22 bp, Artificial Sequence
  chemically synthesized
atttggagagaccttgctcgct

SEQ ID NO: 45916 - DNA, 22 bp, Artificial Sequence
  chemically synthesized
tttggagagaccttgctcgctt

SEQ ID NO: 45917 - DNA, 22 bp, Artificial Sequence
  chemically synthesized
ggagagaccttgctcgcttttc

SEQ ID NO: 45918 - DNA, 22 bp, Artificial Sequence
  chemically synthesized
gagagaccttgctcgcttttca

SEQ ID NO: 45919 - DNA, 22 bp, Artificial Sequence
  chemically synthesized
gctcgcttttcacttccacgag

SEQ ID NO: 45920 - DNA, 22 bp, Artificial Sequence
  chemically synthesized
ctcgcttttcacttccacgaga

SEQ ID NO: 45921 - DNA, 22 bp, Artificial Sequence
  chemically synthesized
gcttttcacttccacgagatat

SEQ ID NO: 45922 - DNA, 22 bp, Artificial Sequence
  chemically synthesized
ttcacttccacgagatataaca

SEQ ID NO: 45923 - DNA, 22 bp, Artificial Sequence
  chemically synthesized
tcacttccacgagatataacac

SEQ ID NO: 45924 - DNA, 22 bp, Artificial Sequence
  chemically synthesized
cacttccacgagatataacact

SEQ ID NO: 45925 - DNA, 22 bp, Artificial Sequence
  chemically synthesized
acttccacgagatataacactg

SEQ ID NO: 45926 - DNA, 22 bp, Artificial Sequence
  chemically synthesized
ccacgagatataacactggtcc

SEQ ID NO: 45927 - DNA, 22 bp, Artificial Sequence
  chemically synthesized
cacgagatataacactggtcca

SEQ ID NO: 45928 - DNA, 22 bp, Artificial Sequence
  chemically synthesized
gtccattacattcatgacatta

SEQ ID NO: 45929 - DNA, 22 bp, Artificial Sequence
  chemically synthesized
cattcatgacattatgatgatt

SEQ ID NO: 45930 - DNA, 22 bp, Artificial Sequence
  chemically synthesized
atgacattatgatgattggata

SEQ ID NO: 45931 - DNA, 22 bp, Artificial Sequence
  chemically synthesized
tgatgattggatacagtgagca

SEQ ID NO: 45932 - DNA, 22 bp, Artificial Sequence
  chemically synthesized
gatacagtgagcaagaagtagc

SEQ ID NO: 45933 - DNA, 22 bp, Artificial Sequence
  chemically synthesized
aacttattggtgagacatttgt

SEQ ID NO: 45934 - DNA, 22 bp, Artificial Sequence
  chemically synthesized
attggtgagacatttgtatgcc

SEQ ID NO: 45935 - DNA, 22 bp, Artificial Sequence
  chemically synthesized
ttggtgagacatttgtatgcca

SEQ ID NO: 45936 - DNA, 22 bp, Artificial Sequence
  chemically synthesized
gtgagacatttgtatgccagag

SEQ ID NO: 45937 - DNA, 22 bp, Artificial Sequence
  chemically synthesized
gtatgccagaggatgggaaata

SEQ ID NO: 45938 - DNA, 22 bp, Artificial Sequence
  chemically synthesized
tatgccagaggatgggaaataa

SEQ ID NO: 45939 - DNA, 22 bp, Artificial Sequence
  chemically synthesized
aaatttagggactttctacctc

SEQ ID NO: 45940 - DNA, 22 bp, Artificial Sequence
  chemically synthesized
agggactttctacctcggtaaa

SEQ ID NO: 45941 - DNA, 22 bp, Artificial Sequence
  chemically synthesized
gggactttctacctcggtaaaa

SEQ ID NO: 45942 - DNA, 22 bp, Artificial Sequence
  chemically synthesized
tctacctcggtaaaatttctag

SEQ ID NO: 45943 - DNA, 22 bp, Artificial Sequence
  chemically synthesized
ctacctcggtaaaatttctagg

SEQ ID NO: 45944 - DNA, 22 bp, Artificial Sequence
  chemically synthesized
tacctcggtaaaatttctaggg

SEQ ID NO: 45945 - DNA, 22 bp, Artificial Sequence
  chemically synthesized
cctcggtaaaatttctagggtt

SEQ ID NO: 45946 - DNA, 22 bp, Artificial Sequence
  chemically synthesized
ggtaaaatttctagggttccag

SEQ ID NO: 45947 - DNA, 22 bp, Artificial Sequence
  chemically synthesized
ctagggttccagtggcatgaga

SEQ ID NO: 45948 - DNA, 22 bp, Artificial Sequence
  chemically synthesized
tagggttccagtggcatgagac

SEQ ID NO: 45949 - DNA, 22 bp, Artificial Sequence
  chemically synthesized
gggttccagtggcatgagacct

SEQ ID NO: 45950 - DNA, 22 bp, Artificial Sequence
  chemically synthesized
cagtggcatgagacctatggag

SEQ ID NO: 45951 - DNA, 22 bp, Artificial Sequence
  chemically synthesized
tggagatattccttctaaggtg

SEQ ID NO: 45952 - DNA, 22 bp, Artificial Sequence
  chemically synthesized
cttctaaggtgaagcataactt

SEQ ID NO: 45953 - DNA, 22 bp, Artificial Sequence
  chemically synthesized
ctaaggtgaagcataacttgct

SEQ ID NO: 45954 - DNA, 22 bp, Artificial Sequence
  chemically synthesized
taaggtgaagcataacttgctg

SEQ ID NO: 45955 - DNA, 22 bp, Artificial Sequence
  chemically synthesized
aggtgaagcataacttgctgcg

SEQ ID NO: 45956 - DNA, 22 bp, Artificial Sequence
  chemically synthesized
gctgcgtttggcccctcttaca

SEQ ID NO: 45957 - DNA, 22 bp, Artificial Sequence
  chemically synthesized
ctgcgtttggcccctcttacaa

SEQ ID NO: 45958 - DNA, 22 bp, Artificial Sequence
  chemically synthesized
cgtttggcccctcttacaacca

SEQ ID NO: 45959 - DNA, 22 bp, Artificial Sequence
  chemically synthesized
ggcccctcttacaaccaagaaa

SEQ ID NO: 45960 - DNA, 22 bp, Artificial Sequence
  chemically synthesized
gcccctcttacaaccaagaaag

SEQ ID NO: 45961 - DNA, 22 bp, Artificial Sequence
  chemically synthesized
ttacaaccaagaaagaggcaca

SEQ ID NO: 45962 - DNA, 22 bp, Artificial Sequence
  chemically synthesized
acaaccaagaaagaggcacaat

SEQ ID NO: 45963 - DNA, 22 bp, Artificial Sequence
  chemically synthesized
caaccaagaaagaggcacaatg

SEQ ID NO: 45964 - DNA, 22 bp, Artificial Sequence
  chemically synthesized
gtgggcctatttggattttgga

SEQ ID NO: 45965 - DNA, 22 bp, Artificial Sequence
  chemically synthesized
tttggattttggaggcaacaca

SEQ ID NO: 45966 - DNA, 22 bp, Artificial Sequence
  chemically synthesized
ggattttggaggcaacacattc

SEQ ID NO: 45967 - DNA, 22 bp, Artificial Sequence
  chemically synthesized
gattttggaggcaacacattcc

SEQ ID NO: 45968 - DNA, 22 bp, Artificial Sequence
  chemically synthesized
tggaggcaacacattcctcgtt

SEQ ID NO: 45969 - DNA, 22 bp, Artificial Sequence
  chemically synthesized
ggaggcaacacattcctcgttt

SEQ ID NO: 45970 - DNA, 22 bp, Artificial Sequence
  chemically synthesized
gaggcaacacattcctcgtttg

SEQ ID NO: 45971 - DNA, 22 bp, Artificial Sequence
  chemically synthesized
ctcgtttgggtgtgttactctg

SEQ ID NO: 45972 - DNA, 22 bp, Artificial Sequence
  chemically synthesized
gtttgggtgtgttactctggcc

SEQ ID NO: 45973 - DNA, 22 bp, Artificial Sequence
  chemically synthesized
gggtgtgttactctggcccatt

SEQ ID NO: 45974 - DNA, 22 bp, Artificial Sequence
  chemically synthesized
ggtgtgttactctggcccattt

SEQ ID NO: 45975 - DNA, 22 bp, Artificial Sequence
  chemically synthesized
ctctggcccatttatcgagtga

SEQ ID NO: 45976 - DNA, 22 bp, Artificial Sequence
  chemically synthesized
tggcccatttatcgagtgacct

SEQ ID NO: 45977 - DNA, 22 bp, Artificial Sequence
  chemically synthesized
gcccatttatcgagtgacctga

SEQ ID NO: 45978 - DNA, 22 bp, Artificial Sequence
  chemically synthesized
atcgagtgacctgaaaggctgc

SEQ ID NO: 45979 - DNA, 22 bp, Artificial Sequence
  chemically synthesized
tcgagtgacctgaaaggctgcc

SEQ ID NO: 45980 - DNA, 22 bp, Artificial Sequence
  chemically synthesized
aaaggctgccagatttaagtgc

SEQ ID NO: 45981 - DNA, 22 bp, Artificial Sequence
  chemically synthesized
ccagatttaagtgcagtctaga

SEQ ID NO: 45982 - DNA, 22 bp, Artificial Sequence
  chemically synthesized
aagtgcagtctagaacaaaaga

SEQ ID NO: 45983 - DNA, 22 bp, Artificial Sequence
  chemically synthesized
agtgcagtctagaacaaaagaa

SEQ ID NO: 45984 - DNA, 22 bp, Artificial Sequence
  chemically synthesized
gaacaaaagaaggctctgaaac

SEQ ID NO: 45985 - DNA, 22 bp, Artificial Sequence
  chemically synthesized
tgaaacaggtccaggctgctgt

SEQ ID NO: 45986 - DNA, 22 bp, Artificial Sequence
  chemically synthesized
aaacaggtccaggctgctgtga

SEQ ID NO: 45987 - DNA, 22 bp, Artificial Sequence
  chemically synthesized
ctgtgaaagctgctctgccatt

SEQ ID NO: 45988 - DNA, 22 bp, Artificial Sequence
  chemically synthesized
tgaaagctgctctgccatttgg

SEQ ID NO: 45989 - DNA, 22 bp, Artificial Sequence
  chemically synthesized
ctctgccatttgggccacatga

SEQ ID NO: 45990 - DNA, 22 bp, Artificial Sequence
  chemically synthesized
tgccatttgggccacatgaccc

SEQ ID NO: 45991 - DNA, 22 bp, Artificial Sequence
  chemically synthesized
ccatttgggccacatgaccccg

SEQ ID NO: 45992 - DNA, 22 bp, Artificial Sequence
  chemically synthesized
gggccacatgaccccgcagatc

SEQ ID NO: 45993 - DNA, 22 bp, Artificial Sequence
  chemically synthesized
ggccacatgaccccgcagatcc

SEQ ID NO: 45994 - DNA, 22 bp, Artificial Sequence
  chemically synthesized
gaggtgtcagtggcagataggg

SEQ ID NO: 45995 - DNA, 22 bp, Artificial Sequence
  chemically synthesized
aggtgtcagtggcagataggga

SEQ ID NO: 45996 - DNA, 22 bp, Artificial Sequence
  chemically synthesized
tttggagcctttggcaggcccc

SEQ ID NO: 45997 - DNA, 22 bp, Artificial Sequence
  chemically synthesized
ggagcctttggcaggcccccat

SEQ ID NO: 45998 - DNA, 22 bp, Artificial Sequence
  chemically synthesized
gagcctttggcaggcccccata

SEQ ID NO: 45999 - DNA, 22 bp, Artificial Sequence
  chemically synthesized
tggcaggcccccataggtgaat

SEQ ID NO: 46000 - DNA, 22 bp, Artificial Sequence
  chemically synthesized
ggcaggcccccataggtgaatc

SEQ ID NO: 46001 - DNA, 22 bp, Artificial Sequence
  chemically synthesized
gcaggcccccataggtgaatca

SEQ ID NO: 46002 - DNA, 22 bp, Artificial Sequence
  chemically synthesized
taggattttggagcaaggccct

SEQ ID NO: 46003 - DNA, 22 bp, Artificial Sequence
  chemically synthesized
ggattttggagcaaggccctgc

SEQ ID NO: 46004 - DNA, 22 bp, Artificial Sequence
  chemically synthesized
tggagcaaggccctgccacttc

SEQ ID NO: 46005 - DNA, 22 bp, Artificial Sequence
  chemically synthesized
ggagcaaggccctgccacttct

SEQ ID NO: 46006 - DNA, 22 bp, Artificial Sequence
  chemically synthesized
gagcaaggccctgccacttctg

SEQ ID NO: 46007 - DNA, 22 bp, Artificial Sequence
  chemically synthesized
ccacttctgcagataactactc

SEQ ID NO: 46008 - DNA, 22 bp, Artificial Sequence
  chemically synthesized
ctgcagataactactctccttt

SEQ ID NO: 46009 - DNA, 22 bp, Artificial Sequence
  chemically synthesized
tgcagataactactctcctttt

SEQ ID NO: 46010 - DNA, 22 bp, Artificial Sequence
  chemically synthesized
cagataactactctccttttga

SEQ ID NO: 46011 - DNA, 22 bp, Artificial Sequence
  chemically synthesized
ctctccttttgagagacagcta

SEQ ID NO: 46012 - DNA, 22 bp, Artificial Sequence
  chemically synthesized
tccttttgagagacagctattg

SEQ ID NO: 46013 - DNA, 22 bp, Artificial Sequence
  chemically synthesized
cttttgagagacagctattggt

SEQ ID NO: 46014 - DNA, 22 bp, Artificial Sequence
  chemically synthesized
ttgagagacagctattggtctg

SEQ ID NO: 46015 - DNA, 22 bp, Artificial Sequence
  chemically synthesized
tgagagacagctattggtctgt

SEQ ID NO: 46016 - DNA, 22 bp, Artificial Sequence
  chemically synthesized
gagagacagctattggtctgtt

SEQ ID NO: 46017 - DNA, 22 bp, Artificial Sequence
  chemically synthesized
agagacagctattggtctgtta

SEQ ID NO: 46018 - DNA, 22 bp, Artificial Sequence
  chemically synthesized
ttggtctgttattgggctttgg

SEQ ID NO: 46019 - DNA, 22 bp, Artificial Sequence
  chemically synthesized
gtctgttattgggctttggtgg

SEQ ID NO: 46020 - DNA, 22 bp, Artificial Sequence
  chemically synthesized
ttattgggctttggtggtaact

SEQ ID NO: 46021 - DNA, 22 bp, Artificial Sequence
  chemically synthesized
ttgggctttggtggtaactgaa

SEQ ID NO: 46022 - DNA, 22 bp, Artificial Sequence
  chemically synthesized
ggctttggtggtaactgaacgt

SEQ ID NO: 46023 - DNA, 22 bp, Artificial Sequence
  chemically synthesized
tggtggtaactgaacgtttgac

SEQ ID NO: 46024 - DNA, 22 bp, Artificial Sequence
  chemically synthesized
ggtggtaactgaacgtttgact

SEQ ID NO: 46025 - DNA, 22 bp, Artificial Sequence
  chemically synthesized
gtggtaactgaacgtttgactg

SEQ ID NO: 46026 - DNA, 22 bp, Artificial Sequence
  chemically synthesized
aacgtttgactgtgggtcataa

SEQ ID NO: 46027 - DNA, 22 bp, Artificial Sequence
  chemically synthesized
gactgtgggtcataaagtcacc

SEQ ID NO: 46028 - DNA, 22 bp, Artificial Sequence
  chemically synthesized
actgtgggtcataaagtcacca

SEQ ID NO: 46029 - DNA, 22 bp, Artificial Sequence
  chemically synthesized
tgggtcataaagtcaccatgct

SEQ ID NO: 46030 - DNA, 22 bp, Artificial Sequence
  chemically synthesized
cctgaacctgcctatcatgaac

SEQ ID NO: 46031 - DNA, 22 bp, Artificial Sequence
  chemically synthesized
aacctgcctatcatgaactggt

SEQ ID NO: 46032 - DNA, 22 bp, Artificial Sequence
  chemically synthesized
cctatcatgaactggttgcttt

SEQ ID NO: 46033 - DNA, 22 bp, Artificial Sequence
  chemically synthesized
tcatgaactggttgctttctga

SEQ ID NO: 46034 - DNA, 22 bp, Artificial Sequence
  chemically synthesized
gttgctttctgacccatctagc

SEQ ID NO: 46035 - DNA, 22 bp, Artificial Sequence
  chemically synthesized
ctttctgacccatctagccatg

SEQ ID NO: 46036 - DNA, 22 bp, Artificial Sequence
  chemically synthesized
tctgacccatctagccatgaag

SEQ ID NO: 46037 - DNA, 22 bp, Artificial Sequence
  chemically synthesized
ctgacccatctagccatgaagt

SEQ ID NO: 46038 - DNA, 22 bp, Artificial Sequence
  chemically synthesized
tgacccatctagccatgaagtg

SEQ ID NO: 46039 - DNA, 22 bp, Artificial Sequence
  chemically synthesized
acccatctagccatgaagtggg

SEQ ID NO: 46040 - DNA, 22 bp, Artificial Sequence
  chemically synthesized
gccatgaagtgggtcagcacag

SEQ ID NO: 46041 - DNA, 22 bp, Artificial Sequence
  chemically synthesized
catcatcaaattgaagtggtgt

SEQ ID NO: 46042 - DNA, 22 bp, Artificial Sequence
  chemically synthesized
atcatcaaattgaagtggtgtg

SEQ ID NO: 46043 - DNA, 22 bp, Artificial Sequence
  chemically synthesized
aagtggtgtgtatgtgatcggg

SEQ ID NO: 46044 - DNA, 22 bp, Artificial Sequence
  chemically synthesized
gagcaggtcctgaaggcacaag

SEQ ID NO: 46045 - DNA, 22 bp, Artificial Sequence
  chemically synthesized
agcaggtcctgaaggcacaagt

SEQ ID NO: 46046 - DNA, 22 bp, Artificial Sequence
  chemically synthesized
aaggcacaagtaagttacataa

SEQ ID NO: 46047 - DNA, 22 bp, Artificial Sequence
  chemically synthesized
cataaggaagtggctcaaatgc

SEQ ID NO: 46048 - DNA, 22 bp, Artificial Sequence
  chemically synthesized
aaatgcccatgttctccactca

SEQ ID NO: 46049 - DNA, 22 bp, Artificial Sequence
  chemically synthesized
tccactcatgccaccctgcctt

SEQ ID NO: 46050 - DNA, 22 bp, Artificial Sequence
  chemically synthesized
cactcatgccaccctgccttcc

SEQ ID NO: 46051 - DNA, 22 bp, Artificial Sequence
  chemically synthesized
atgccaccctgccttccctccc

SEQ ID NO: 46052 - DNA, 22 bp, Artificial Sequence
  chemically synthesized
ccttccctcccccagcctgcac

SEQ ID NO: 46053 - DNA, 22 bp, Artificial Sequence
  chemically synthesized
ccctcccccagcctgcaccaat

SEQ ID NO: 46054 - DNA, 22 bp, Artificial Sequence
  chemically synthesized
cctcccccagcctgcaccaatg

SEQ ID NO: 46055 - DNA, 22 bp, Artificial Sequence
  chemically synthesized
ccccagcctgcaccaatggcct

SEQ ID NO: 46056 - DNA, 22 bp, Artificial Sequence
  chemically synthesized
caccaatggcctcatggggagt

SEQ ID NO: 46057 - DNA, 22 bp, Artificial Sequence
  chemically synthesized
atggggagttccctatgatcag

SEQ ID NO: 46058 - DNA, 22 bp, Artificial Sequence
  chemically synthesized
cctatgatcagttgacagagga

SEQ ID NO: 46059 - DNA, 22 bp, Artificial Sequence
  chemically synthesized
tgatcagttgacagaggaaggg

SEQ ID NO: 46060 - DNA, 22 bp, Artificial Sequence
  chemically synthesized
acagaggaagggaagactaagg

SEQ ID NO: 46061 - DNA, 22 bp, Artificial Sequence
  chemically synthesized
aggactggttcatagatggttc

SEQ ID NO: 46062 - DNA, 22 bp, Artificial Sequence
  chemically synthesized
gttcatagatggttctgcacga

SEQ ID NO: 46063 - DNA, 22 bp, Artificial Sequence
  chemically synthesized
atagatggttctgcacgatatg

SEQ ID NO: 46064 - DNA, 22 bp, Artificial Sequence
  chemically synthesized
tgcacgatatgcaggcaccacc

SEQ ID NO: 46065 - DNA, 22 bp, Artificial Sequence
  chemically synthesized
cacgatatgcaggcaccacccg

SEQ ID NO: 46066 - DNA, 22 bp, Artificial Sequence
  chemically synthesized
cagcactatatccactttctaa

SEQ ID NO: 46067 - DNA, 22 bp, Artificial Sequence
  chemically synthesized
tatccactttctaaatgcatgt

SEQ ID NO: 46068 - DNA, 22 bp, Artificial Sequence
  chemically synthesized
tctaaatgcatgtgtacacttg

SEQ ID NO: 46069 - DNA, 22 bp, Artificial Sequence
  chemically synthesized
ctaaatgcatgtgtacacttgt

SEQ ID NO: 46070 - DNA, 22 bp, Artificial Sequence
  chemically synthesized
taaatgcatgtgtacacttgtg

SEQ ID NO: 46071 - DNA, 22 bp, Artificial Sequence
  chemically synthesized
aatgcatgtgtacacttgtgct

SEQ ID NO: 46072 - DNA, 22 bp, Artificial Sequence
  chemically synthesized
gtgctaagaaaatatctttatt

SEQ ID NO: 46073 - DNA, 22 bp, Artificial Sequence
  chemically synthesized
tgctaagaaaatatctttattt

SEQ ID NO: 46074 - DNA, 22 bp, Artificial Sequence
  chemically synthesized
agaaaatatctttattttattt

SEQ ID NO: 46075 - DNA, 22 bp, Artificial Sequence
  chemically synthesized
tattttatttcctttatttttc

SEQ ID NO: 46076 - DNA, 22 bp, Artificial Sequence
  chemically synthesized
attttatttcctttatttttcc

SEQ ID NO: 46077 - DNA, 22 bp, Artificial Sequence
  chemically synthesized
ttttatttcctttatttttcct

SEQ ID NO: 46078 - DNA, 22 bp, Artificial Sequence
  chemically synthesized
tatttcctttatttttccttta

SEQ ID NO: 46079 - DNA, 22 bp, Artificial Sequence
  chemically synthesized
atttcctttatttttcctttat

SEQ ID NO: 46080 - DNA, 22 bp, Artificial Sequence
  chemically synthesized
tttcctttatttttcctttatc

SEQ ID NO: 46081 - DNA, 22 bp, Artificial Sequence
  chemically synthesized
cctttatttttcctttatcatg

SEQ ID NO: 46082 - DNA, 22 bp, Artificial Sequence
  chemically synthesized
ctttatttttcctttatcatgt

SEQ ID NO: 46083 - DNA, 22 bp, Artificial Sequence
  chemically synthesized
tatttttcctttatcatgtgac

SEQ ID NO: 46084 - DNA, 22 bp, Artificial Sequence
  chemically synthesized
atttttcctttatcatgtgacc

SEQ ID NO: 46085 - DNA, 22 bp, Artificial Sequence
  chemically synthesized
tttttcctttatcatgtgacct

SEQ ID NO: 46086 - DNA, 22 bp, Artificial Sequence
  chemically synthesized
ttcctttatcatgtgaccttag

SEQ ID NO: 46087 - DNA, 22 bp, Artificial Sequence
  chemically synthesized
tcctttatcatgtgaccttaga

SEQ ID NO: 46088 - DNA, 22 bp, Artificial Sequence
  chemically synthesized
cctttatcatgtgaccttagat

SEQ ID NO: 46089 - DNA, 22 bp, Artificial Sequence
  chemically synthesized
ctttatcatgtgaccttagatt

SEQ ID NO: 46090 - DNA, 22 bp, Artificial Sequence
  chemically synthesized
tatcatgtgaccttagatttat

SEQ ID NO: 46091 - DNA, 22 bp, Artificial Sequence
  chemically synthesized
atcatgtgaccttagatttatg

SEQ ID NO: 46092 - DNA, 22 bp, Artificial Sequence
  chemically synthesized
tcatgtgaccttagatttatgg

SEQ ID NO: 46093 - DNA, 22 bp, Artificial Sequence
  chemically synthesized
agatttatggacttcacatcag

SEQ ID NO: 46094 - DNA, 22 bp, Artificial Sequence
  chemically synthesized
gatttatggacttcacatcagc

SEQ ID NO: 46095 - DNA, 22 bp, Artificial Sequence
  chemically synthesized
atggacttcacatcagcattta

SEQ ID NO: 46096 - DNA, 22 bp, Artificial Sequence
  chemically synthesized
tggacttcacatcagcatttaa

SEQ ID NO: 46097 - DNA, 22 bp, Artificial Sequence
  chemically synthesized
cacatcagcatttaagcattta

SEQ ID NO: 46098 - DNA, 22 bp, Artificial Sequence
  chemically synthesized
acatcagcatttaagcatttaa

SEQ ID NO: 46099 - DNA, 22 bp, Artificial Sequence
  chemically synthesized
aagcatttaagtgttgttcata

SEQ ID NO: 46100 - DNA, 22 bp, Artificial Sequence
  chemically synthesized
agcatttaagtgttgttcatat

SEQ ID NO: 46101 - DNA, 22 bp, Artificial Sequence
  chemically synthesized
aagtgttgttcatatcagcatt

SEQ ID NO: 46102 - DNA, 22 bp, Artificial Sequence
  chemically synthesized
agtgttgttcatatcagcattt

SEQ ID NO: 46103 - DNA, 22 bp, Artificial Sequence
  chemically synthesized
ttcatatcagcatttaaatatt

SEQ ID NO: 46104 - DNA, 22 bp, Artificial Sequence
  chemically synthesized
atatcagcatttaaatattgtt

SEQ ID NO: 46105 - DNA, 22 bp, Artificial Sequence
  chemically synthesized
aaatattgttaaccttatgtaa

SEQ ID NO: 46106 - DNA, 22 bp, Artificial Sequence
  chemically synthesized
aatattgttaaccttatgtaat

SEQ ID NO: 46107 - DNA, 22 bp, Artificial Sequence
  chemically synthesized
ttaaccttatgtaataactttt

SEQ ID NO: 46108 - DNA, 22 bp, Artificial Sequence
  chemically synthesized
accttatgtaataacttttggt

SEQ ID NO: 46109 - DNA, 22 bp, Artificial Sequence
  chemically synthesized
atgtaataacttttggtttggg

SEQ ID NO: 46110 - DNA, 22 bp, Artificial Sequence
  chemically synthesized
tgtaataacttttggtttgggg

SEQ ID NO: 46111 - DNA, 22 bp, Artificial Sequence
  chemically synthesized
ttggtttggggattggtgcgtt

SEQ ID NO: 46112 - DNA, 22 bp, Artificial Sequence
  chemically synthesized
tggtttggggattggtgcgttt

SEQ ID NO: 46113 - DNA, 22 bp, Artificial Sequence
  chemically synthesized
ggtttggggattggtgcgtttc

SEQ ID NO: 46114 - DNA, 22 bp, Artificial Sequence
  chemically synthesized
gtttggggattggtgcgtttct

SEQ ID NO: 46115 - DNA, 22 bp, Artificial Sequence
  chemically synthesized
ggggattggtgcgtttctggtt

SEQ ID NO: 46116 - DNA, 22 bp, Artificial Sequence
  chemically synthesized
gggattggtgcgtttctggttg

SEQ ID NO: 46117 - DNA, 22 bp, Artificial Sequence
  chemically synthesized
gtgcgtttctggttgtatgagg

SEQ ID NO: 46118 - DNA, 22 bp, Artificial Sequence
  chemically synthesized
ctggttgtatgaggatagttgt

SEQ ID NO: 46119 - DNA, 22 bp, Artificial Sequence
  chemically synthesized
tggttgtatgaggatagttgta

SEQ ID NO: 46120 - DNA, 22 bp, Artificial Sequence
  chemically synthesized
gttgtatgaggatagttgtatt

SEQ ID NO: 46121 - DNA, 22 bp, Artificial Sequence
  chemically synthesized
tatgaggatagttgtattatat

SEQ ID NO: 46122 - DNA, 22 bp, Artificial Sequence
  chemically synthesized
tattatattaggcataattatg

SEQ ID NO: 46123 - DNA, 22 bp, Artificial Sequence
  chemically synthesized
tattaggcataattatgacctt

SEQ ID NO: 46124 - DNA, 22 bp, Artificial Sequence
  chemically synthesized
ggcataattatgaccttattat

SEQ ID NO: 46125 - DNA, 22 bp, Artificial Sequence
  chemically synthesized
tgaccttattattgtctttatt

SEQ ID NO: 46126 - DNA, 22 bp, Artificial Sequence
  chemically synthesized
attattgtctttatttgaagat

SEQ ID NO: 46127 - DNA, 22 bp, Artificial Sequence
  chemically synthesized
ttattgtctttatttgaagatt

SEQ ID NO: 46128 - DNA, 22 bp, Artificial Sequence
  chemically synthesized
ttgtctttatttgaagattatg

SEQ ID NO: 46129 - DNA, 22 bp, Artificial Sequence
  chemically synthesized
tctttatttgaagattatgtat

SEQ ID NO: 46130 - DNA, 22 bp, Artificial Sequence
  chemically synthesized
tatttgaagattatgtatgatt

SEQ ID NO: 46131 - DNA, 22 bp, Artificial Sequence
  chemically synthesized
atttgaagattatgtatgattt

SEQ ID NO: 46132 - DNA, 22 bp, Artificial Sequence
  chemically synthesized
tttgaagattatgtatgatttc

SEQ ID NO: 46133 - DNA, 22 bp, Artificial Sequence
  chemically synthesized
gaagattatgtatgatttcagg

SEQ ID NO: 46134 - DNA, 22 bp, Artificial Sequence
  chemically synthesized
aagattatgtatgatttcagga

SEQ ID NO: 46135 - DNA, 22 bp, Artificial Sequence
  chemically synthesized
tgtatgatttcaggatgtgtgt

SEQ ID NO: 46136 - DNA, 22 bp, Artificial Sequence
  chemically synthesized
caggatgtgtgtatgggttcaa

SEQ ID NO: 46137 - DNA, 22 bp, Artificial Sequence
  chemically synthesized
aggatgtgtgtatgggttcaag

SEQ ID NO: 46138 - DNA, 22 bp, Artificial Sequence
  chemically synthesized
aagttgacaaggagttggactt

SEQ ID NO: 46139 - DNA, 22 bp, Artificial Sequence
  chemically synthesized
acaaggagttggacttgtgatg

SEQ ID NO: 46140 - DNA, 22 bp, Artificial Sequence
  chemically synthesized
gacttgtgatggttaatactgt

SEQ ID NO: 46141 - DNA, 22 bp, Artificial Sequence
  chemically synthesized
gtgatggttaatactgtcaact

SEQ ID NO: 46142 - DNA, 22 bp, Artificial Sequence
  chemically synthesized
tgatggttaatactgtcaactt

SEQ ID NO: 46143 - DNA, 22 bp, Artificial Sequence
  chemically synthesized
atactgtcaacttgattggatt

SEQ ID NO: 46144 - DNA, 22 bp, Artificial Sequence
  chemically synthesized
tcaacttgattggattgaaaga

SEQ ID NO: 46145 - DNA, 22 bp, Artificial Sequence
  chemically synthesized
gattggattgaaagatgcaaag

SEQ ID NO: 46146 - DNA, 22 bp, Artificial Sequence
  chemically synthesized
attggattgaaagatgcaaagt

SEQ ID NO: 46147 - DNA, 22 bp, Artificial Sequence
  chemically synthesized
gattgaaagatgcaaagtatta

SEQ ID NO: 46148 - DNA, 22 bp, Artificial Sequence
  chemically synthesized
aaagatgcaaagtattaatctc

SEQ ID NO: 46149 - DNA, 22 bp, Artificial Sequence
  chemically synthesized
atctcggttatgtctgtgaggg

SEQ ID NO: 46150 - DNA, 22 bp, Artificial Sequence
  chemically synthesized
ggttatgtctgtgagggtgtgg

SEQ ID NO: 46151 - DNA, 22 bp, Artificial Sequence
  chemically synthesized
tgtctgtgagggtgtggcaaaa

SEQ ID NO: 46152 - DNA, 22 bp, Artificial Sequence
  chemically synthesized
tgagggtgtggcaaaaggagat

SEQ ID NO: 46153 - DNA, 22 bp, Artificial Sequence
  chemically synthesized
acatttgagtcagtgggctggg

SEQ ID NO: 46154 - DNA, 20 bp, Artificial Sequence
  chemically synthesized
taacgaccccggtaggtgag

SEQ ID NO: 46155 - DNA, 20 bp, Artificial Sequence
  chemically synthesized
accccggtaggtgagaggcc

SEQ ID NO: 46156 - DNA, 20 bp, Artificial Sequence
  chemically synthesized
ccccggtaggtgagaggcca

SEQ ID NO: 46157 - DNA, 20 bp, Artificial Sequence
  chemically synthesized
ggtgagaggccaaggtccca

SEQ ID NO: 46158 - DNA, 20 bp, Artificial Sequence
  chemically synthesized
gtgagaggccaaggtcccaa

SEQ ID NO: 46159 - DNA, 20 bp, Artificial Sequence
  chemically synthesized
tgagaggccaaggtcccaaa

SEQ ID NO: 46160 - DNA, 20 bp, Artificial Sequence
  chemically synthesized
gagaggccaaggtcccaaag

SEQ ID NO: 46161 - DNA, 20 bp, Artificial Sequence
  chemically synthesized
gaggccaaggtcccaaaggg

SEQ ID NO: 46162 - DNA, 20 bp, Artificial Sequence
  chemically synthesized
gccaaggtcccaaaggggag

SEQ ID NO: 46163 - DNA, 20 bp, Artificial Sequence
  chemically synthesized
aaggtcccaaaggggagcag

SEQ ID NO: 46164 - DNA, 20 bp, Artificial Sequence
  chemically synthesized
aggtcccaaaggggagcagc

SEQ ID NO: 46165 - DNA, 20 bp, Artificial Sequence
  chemically synthesized
ggtcccaaaggggagcagca

SEQ ID NO: 46166 - DNA, 20 bp, Artificial Sequence
  chemically synthesized
ccaaaggggagcagcaggga

SEQ ID NO: 46167 - DNA, 20 bp, Artificial Sequence
  chemically synthesized
aggggagcagcagggaaagt

SEQ ID NO: 46168 - DNA, 20 bp, Artificial Sequence
  chemically synthesized
gctcccatctattcttgctc

SEQ ID NO: 46169 - DNA, 20 bp, Artificial Sequence
  chemically synthesized
ctcccatctattcttgctcc

SEQ ID NO: 46170 - DNA, 20 bp, Artificial Sequence
  chemically synthesized
tcccatctattcttgctcca

SEQ ID NO: 46171 - DNA, 20 bp, Artificial Sequence
  chemically synthesized
cccatctattcttgctccag

SEQ ID NO: 46172 - DNA, 20 bp, Artificial Sequence
  chemically synthesized
catctattcttgctccaggg

SEQ ID NO: 46173 - DNA, 20 bp, Artificial Sequence
  chemically synthesized
atctattcttgctccagggg

SEQ ID NO: 46174 - DNA, 20 bp, Artificial Sequence
  chemically synthesized
ctccaggggaggcctttgat

SEQ ID NO: 46175 - DNA, 20 bp, Artificial Sequence
  chemically synthesized
tccaggggaggcctttgatg

SEQ ID NO: 46176 - DNA, 20 bp, Artificial Sequence
  chemically synthesized
aggggaggcctttgatgagg

SEQ ID NO: 46177 - DNA, 20 bp, Artificial Sequence
  chemically synthesized
tttgatgaggaagctgccaa

SEQ ID NO: 46178 - DNA, 20 bp, Artificial Sequence
  chemically synthesized
tgcaaatacaattccaatta

SEQ ID NO: 46179 - DNA, 20 bp, Artificial Sequence
  chemically synthesized
gcaaatacaattccaattac

SEQ ID NO: 46180 - DNA, 20 bp, Artificial Sequence
  chemically synthesized
acaattccaattacaggcaa

SEQ ID NO: 46181 - DNA, 20 bp, Artificial Sequence
  chemically synthesized
caattccaattacaggcaac

SEQ ID NO: 46182 - DNA, 20 bp, Artificial Sequence
  chemically synthesized
ttccaattacaggcaacagg

SEQ ID NO: 46183 - DNA, 20 bp, Artificial Sequence
  chemically synthesized
tccaattacaggcaacagga

SEQ ID NO: 46184 - DNA, 20 bp, Artificial Sequence
  chemically synthesized
caattacaggcaacaggaag

SEQ ID NO: 46185 - DNA, 20 bp, Artificial Sequence
  chemically synthesized
accacctctgccacctctgt

SEQ ID NO: 46186 - DNA, 20 bp, Artificial Sequence
  chemically synthesized
cacctctgtcagcaaaccat

SEQ ID NO: 46187 - DNA, 20 bp, Artificial Sequence
  chemically synthesized
gctcctactctgtgctgcga

SEQ ID NO: 46188 - DNA, 20 bp, Artificial Sequence
  chemically synthesized
cctactctgtgctgcgatgg

SEQ ID NO: 46189 - DNA, 20 bp, Artificial Sequence
  chemically synthesized
ctactctgtgctgcgatggc

SEQ ID NO: 46190 - DNA, 20 bp, Artificial Sequence
  chemically synthesized
tgctgcgatggcgggctcga

SEQ ID NO: 46191 - DNA, 20 bp, Artificial Sequence
  chemically synthesized
gctgcgatggcgggctcgat

SEQ ID NO: 46192 - DNA, 20 bp, Artificial Sequence
  chemically synthesized
ctgcgatggcgggctcgatg

SEQ ID NO: 46193 - DNA, 20 bp, Artificial Sequence
  chemically synthesized
ataactctgaccttacctca

SEQ ID NO: 46194 - DNA, 20 bp, Artificial Sequence
  chemically synthesized
aactctgaccttacctcatg

SEQ ID NO: 46195 - DNA, 20 bp, Artificial Sequence
  chemically synthesized
tggagtcactgtcaacccac

SEQ ID NO: 46196 - DNA, 20 bp, Artificial Sequence
  chemically synthesized
gttgcactgtctttgtgcac

SEQ ID NO: 46197 - DNA, 20 bp, Artificial Sequence
  chemically synthesized
gtctttgtgcactggctctc

SEQ ID NO: 46198 - DNA, 20 bp, Artificial Sequence
  chemically synthesized
ctttgtgcactggctctctg

SEQ ID NO: 46199 - DNA, 20 bp, Artificial Sequence
  chemically synthesized
gtgcactggctctctggagt

SEQ ID NO: 46200 - DNA, 20 bp, Artificial Sequence
  chemically synthesized
tgcactggctctctggagtg

SEQ ID NO: 46201 - DNA, 20 bp, Artificial Sequence
  chemically synthesized
gagtgaggtctttgcaaaca

SEQ ID NO: 46202 - DNA, 20 bp, Artificial Sequence
  chemically synthesized
tgaggtctttgcaaacaaag

SEQ ID NO: 46203 - DNA, 20 bp, Artificial Sequence
  chemically synthesized
gtctttgcaaacaaagtgga

SEQ ID NO: 46204 - DNA, 20 bp, Artificial Sequence
  chemically synthesized
ctttgcaaacaaagtggaaa

SEQ ID NO: 46205 - DNA, 20 bp, Artificial Sequence
  chemically synthesized
agtggaaagagcatcaactt

SEQ ID NO: 46206 - DNA, 20 bp, Artificial Sequence
  chemically synthesized
agagcatcaactttggactc

SEQ ID NO: 46207 - DNA, 20 bp, Artificial Sequence
  chemically synthesized
caactttggactccagcacc

SEQ ID NO: 46208 - DNA, 20 bp, Artificial Sequence
  chemically synthesized
tggactccagcacctagatt

SEQ ID NO: 46209 - DNA, 20 bp, Artificial Sequence
  chemically synthesized
gactccagcacctagattca

SEQ ID NO: 46210 - DNA, 20 bp, Artificial Sequence
  chemically synthesized
tccagcacctagattcagag

SEQ ID NO: 46211 - DNA, 20 bp, Artificial Sequence
  chemically synthesized
ccagcacctagattcagagc

SEQ ID NO: 46212 - DNA, 20 bp, Artificial Sequence
  chemically synthesized
tcagagcaggccatttcact

SEQ ID NO: 46213 - DNA, 20 bp, Artificial Sequence
  chemically synthesized
ggaatctgctgtgcatctgc

SEQ ID NO: 46214 - DNA, 20 bp, Artificial Sequence
  chemically synthesized
gaatctgctgtgcatctgca

SEQ ID NO: 46215 - DNA, 20 bp, Artificial Sequence
  chemically synthesized
aatctgctgtgcatctgcaa

SEQ ID NO: 46216 - DNA, 20 bp, Artificial Sequence
  chemically synthesized
tctgctgtgcatctgcaagg

SEQ ID NO: 46217 - DNA, 20 bp, Artificial Sequence
  chemically synthesized
ctgctgtgcatctgcaaggg

SEQ ID NO: 46218 - DNA, 20 bp, Artificial Sequence
  chemically synthesized
aattcgcctttgtttcttcc

SEQ ID NO: 46219 - DNA, 20 bp, Artificial Sequence
  chemically synthesized
ttgtttcttcccagtatcga

SEQ ID NO: 46220 - DNA, 20 bp, Artificial Sequence
  chemically synthesized
cccagtatcgacagcccttc

SEQ ID NO: 46221 - DNA, 20 bp, Artificial Sequence
  chemically synthesized
gtatcgacagcccttccaga

SEQ ID NO: 46222 - DNA, 20 bp, Artificial Sequence
  chemically synthesized
atcgacagcccttccagaaa

SEQ ID NO: 46223 - DNA, 20 bp, Artificial Sequence
  chemically synthesized
acagcccttccagaaagagc

SEQ ID NO: 46224 - DNA, 20 bp, Artificial Sequence
  chemically synthesized
tcatgccacatgtacaatct

SEQ ID NO: 46225 - DNA, 20 bp, Artificial Sequence
  chemically synthesized
catgccacatgtacaatctg

SEQ ID NO: 46226 - DNA, 20 bp, Artificial Sequence
  chemically synthesized
ccacatgtacaatctgaggc

SEQ ID NO: 46227 - DNA, 20 bp, Artificial Sequence
  chemically synthesized
cacatgtacaatctgaggcc

SEQ ID NO: 46228 - DNA, 20 bp, Artificial Sequence
  chemically synthesized
catgtacaatctgaggccag

SEQ ID NO: 46229 - DNA, 20 bp, Artificial Sequence
  chemically synthesized
ccccttttcatcctcctgcc

SEQ ID NO: 46230 - DNA, 20 bp, Artificial Sequence
  chemically synthesized
tcctcctgcctggtacacaa

SEQ ID NO: 46231 - DNA, 20 bp, Artificial Sequence
  chemically synthesized
cctcctgcctggtacacaat

SEQ ID NO: 46232 - DNA, 20 bp, Artificial Sequence
  chemically synthesized
ggtacacaataggtgtttac

SEQ ID NO: 46233 - DNA, 20 bp, Artificial Sequence
  chemically synthesized
gtgtttactggatgcttgtc

SEQ ID NO: 46234 - DNA, 20 bp, Artificial Sequence
  chemically synthesized
tccagttgatttcttgaaca

SEQ ID NO: 46235 - DNA, 20 bp, Artificial Sequence
  chemically synthesized
ttcttgaacatggtgtgtaa

SEQ ID NO: 46236 - DNA, 20 bp, Artificial Sequence
  chemically synthesized
tcttgaacatggtgtgtaaa

SEQ ID NO: 46237 - DNA, 20 bp, Artificial Sequence
  chemically synthesized
tctttgcaaattgaatcttc

SEQ ID NO: 46238 - DNA, 20 bp, Artificial Sequence
  chemically synthesized
tgcaaattgaatcttctgga

SEQ ID NO: 46239 - DNA, 20 bp, Artificial Sequence
  chemically synthesized
attgaatcttctggaaagct

SEQ ID NO: 46240 - DNA, 20 bp, Artificial Sequence
  chemically synthesized
agctgagcttgtgcctacca

SEQ ID NO: 46241 - DNA, 20 bp, Artificial Sequence
  chemically synthesized
acttaaaacctgaatctttg

SEQ ID NO: 46242 - DNA, 20 bp, Artificial Sequence
  chemically synthesized
taaatcccttgaaatgcatg

SEQ ID NO: 46243 - DNA, 20 bp, Artificial Sequence
  chemically synthesized
aaatcccttgaaatgcatgt

SEQ ID NO: 46244 - DNA, 20 bp, Artificial Sequence
  chemically synthesized
cccttgaaatgcatgtaggc

SEQ ID NO: 46245 - DNA, 20 bp, Artificial Sequence
  chemically synthesized
gcatgtaggctggacatcaa

SEQ ID NO: 46246 - DNA, 20 bp, Artificial Sequence
  chemically synthesized
gtaggctggacatcaaaagc

SEQ ID NO: 46247 - DNA, 20 bp, Artificial Sequence
  chemically synthesized
caaaagcaagcaatctcttc

SEQ ID NO: 46248 - DNA, 20 bp, Artificial Sequence
  chemically synthesized
aaaagcaagcaatctcttca

SEQ ID NO: 46249 - DNA, 20 bp, Artificial Sequence
  chemically synthesized
aagcaagcaatctcttcaag

SEQ ID NO: 46250 - DNA, 20 bp, Artificial Sequence
  chemically synthesized
caagcaatctcttcaaggag

SEQ ID NO: 46251 - DNA, 20 bp, Artificial Sequence
  chemically synthesized
caatctcttcaaggagcagc

SEQ ID NO: 46252 - DNA, 20 bp, Artificial Sequence
  chemically synthesized
ctcttcaaggagcagctagt

SEQ ID NO: 46253 - DNA, 20 bp, Artificial Sequence
  chemically synthesized
tcaaggagcagctagttggt

SEQ ID NO: 46254 - DNA, 20 bp, Artificial Sequence
  chemically synthesized
caaggagcagctagttggta

SEQ ID NO: 46255 - DNA, 20 bp, Artificial Sequence
  chemically synthesized
gagcagctagttggtaaggt

SEQ ID NO: 46256 - DNA, 20 bp, Artificial Sequence
  chemically synthesized
tagttggtaaggtcagtgtg

SEQ ID NO: 46257 - DNA, 20 bp, Artificial Sequence
  chemically synthesized
agttggtaaggtcagtgtgc

SEQ ID NO: 46258 - DNA, 20 bp, Artificial Sequence
  chemically synthesized
gttggtaaggtcagtgtgca

SEQ ID NO: 46259 - DNA, 20 bp, Artificial Sequence
  chemically synthesized
gtcagtgtgcagggtgcata

SEQ ID NO: 46260 - DNA, 20 bp, Artificial Sequence
  chemically synthesized
tcagtgtgcagggtgcataa

SEQ ID NO: 46261 - DNA, 20 bp, Artificial Sequence
  chemically synthesized
cagtgtgcagggtgcataaa

SEQ ID NO: 46262 - DNA, 20 bp, Artificial Sequence
  chemically synthesized
tgtgcagggtgcataaaggg

SEQ ID NO: 46263 - DNA, 20 bp, Artificial Sequence
  chemically synthesized
tgcagggtgcataaagggca

SEQ ID NO: 46264 - DNA, 20 bp, Artificial Sequence
  chemically synthesized
gcagggtgcataaagggcag

SEQ ID NO: 46265 - DNA, 20 bp, Artificial Sequence
  chemically synthesized
ggtgcataaagggcagaggc

SEQ ID NO: 46266 - DNA, 20 bp, Artificial Sequence
  chemically synthesized
tgcataaagggcagaggccg

SEQ ID NO: 46267 - DNA, 20 bp, Artificial Sequence
  chemically synthesized
gcataaagggcagaggccgg

SEQ ID NO: 46268 - DNA, 20 bp, Artificial Sequence
  chemically synthesized
cataaagggcagaggccgga

SEQ ID NO: 46269 - DNA, 20 bp, Artificial Sequence
  chemically synthesized
ataaagggcagaggccggag

SEQ ID NO: 46270 - DNA, 20 bp, Artificial Sequence
  chemically synthesized
taaagggcagaggccggagg

SEQ ID NO: 46271 - DNA, 20 bp, Artificial Sequence
  chemically synthesized
ggcagaggccggagggggtc

SEQ ID NO: 46272 - DNA, 20 bp, Artificial Sequence
  chemically synthesized
gcagaggccggagggggtcc

SEQ ID NO: 46273 - DNA, 20 bp, Artificial Sequence
  chemically synthesized
ggccggagggggtccaggct

SEQ ID NO: 46274 - DNA, 20 bp, Artificial Sequence
  chemically synthesized
gagggggtccaggctaagtt

SEQ ID NO: 46275 - DNA, 20 bp, Artificial Sequence
  chemically synthesized
ggggtccaggctaagtttag

SEQ ID NO: 46276 - DNA, 20 bp, Artificial Sequence
  chemically synthesized
gggtccaggctaagtttaga

SEQ ID NO: 46277 - DNA, 20 bp, Artificial Sequence
  chemically synthesized
ggctaagtttagaaggctgc

SEQ ID NO: 46278 - DNA, 20 bp, Artificial Sequence
  chemically synthesized
gctaagtttagaaggctgcc

SEQ ID NO: 46279 - DNA, 20 bp, Artificial Sequence
  chemically synthesized
gtttagaaggctgccaggtt

SEQ ID NO: 46280 - DNA, 20 bp, Artificial Sequence
  chemically synthesized
tttagaaggctgccaggtta

SEQ ID NO: 46281 - DNA, 20 bp, Artificial Sequence
  chemically synthesized
gaaggctgccaggttaaggc

SEQ ID NO: 46282 - DNA, 20 bp, Artificial Sequence
  chemically synthesized
ggctgccaggttaaggccag

SEQ ID NO: 46283 - DNA, 20 bp, Artificial Sequence
  chemically synthesized
gccaggttaaggccagtgga

SEQ ID NO: 46284 - DNA, 20 bp, Artificial Sequence
  chemically synthesized
taaggccagtggaaagaatt

SEQ ID NO: 46285 - DNA, 20 bp, Artificial Sequence
  chemically synthesized
ggccagtggaaagaattcgg

SEQ ID NO: 46286 - DNA, 20 bp, Artificial Sequence
  chemically synthesized
gccagtggaaagaattcggt

SEQ ID NO: 46287 - DNA, 20 bp, Artificial Sequence
  chemically synthesized
agtggaaagaattcggtggg

SEQ ID NO: 46288 - DNA, 20 bp, Artificial Sequence
  chemically synthesized
gaaagaattcggtgggcagc

SEQ ID NO: 46289 - DNA, 20 bp, Artificial Sequence
  chemically synthesized
aaagaattcggtgggcagcg

SEQ ID NO: 46290 - DNA, 20 bp, Artificial Sequence
  chemically synthesized
agaattcggtgggcagcgag

SEQ ID NO: 46291 - DNA, 20 bp, Artificial Sequence
  chemically synthesized
ggtgggcagcgaggagtcca

SEQ ID NO: 46292 - DNA, 20 bp, Artificial Sequence
  chemically synthesized
gggcagcgaggagtccacag

SEQ ID NO: 46293 - DNA, 20 bp, Artificial Sequence
  chemically synthesized
ggcagcgaggagtccacagt

SEQ ID NO: 46294 - DNA, 20 bp, Artificial Sequence
  chemically synthesized
agtccacagtaggattgatt

SEQ ID NO: 46295 - DNA, 20 bp, Artificial Sequence
  chemically synthesized
ccacagtaggattgattcag

SEQ ID NO: 46296 - DNA, 20 bp, Artificial Sequence
  chemically synthesized
gattgattcagaagtctcac

SEQ ID NO: 46297 - DNA, 20 bp, Artificial Sequence
  chemically synthesized
gattcagaagtctcactggt

SEQ ID NO: 46298 - DNA, 20 bp, Artificial Sequence
  chemically synthesized
tcagaagtctcactggtcag

SEQ ID NO: 46299 - DNA, 20 bp, Artificial Sequence
  chemically synthesized
cagaagtctcactggtcagc

SEQ ID NO: 46300 - DNA, 20 bp, Artificial Sequence
  chemically synthesized
gaagtctcactggtcagcag

SEQ ID NO: 46301 - DNA, 20 bp, Artificial Sequence
  chemically synthesized
ctcactggtcagcaggagac

SEQ ID NO: 46302 - DNA, 20 bp, Artificial Sequence
  chemically synthesized
tcactggtcagcaggagaca

SEQ ID NO: 46303 - DNA, 20 bp, Artificial Sequence
  chemically synthesized
ctggtcagcaggagacaagg

SEQ ID NO: 46304 - DNA, 20 bp, Artificial Sequence
  chemically synthesized
agcaggagacaaggtggacc

SEQ ID NO: 46305 - DNA, 20 bp, Artificial Sequence
  chemically synthesized
gcaggagacaaggtggaccc

SEQ ID NO: 46306 - DNA, 20 bp, Artificial Sequence
  chemically synthesized
tggacccaggaaacactgaa

SEQ ID NO: 46307 - DNA, 20 bp, Artificial Sequence
  chemically synthesized
ggacccaggaaacactgaaa

SEQ ID NO: 46308 - DNA, 20 bp, Artificial Sequence
  chemically synthesized
cccaggaaacactgaaaagg

SEQ ID NO: 46309 - DNA, 20 bp, Artificial Sequence
  chemically synthesized
ccaggaaacactgaaaaggt

SEQ ID NO: 46310 - DNA, 20 bp, Artificial Sequence
  chemically synthesized
aaacactgaaaaggtgggcc

SEQ ID NO: 46311 - DNA, 20 bp, Artificial Sequence
  chemically synthesized
cactgaaaaggtgggcccgg

SEQ ID NO: 46312 - DNA, 20 bp, Artificial Sequence
  chemically synthesized
aaggtgggcccggcagaact

SEQ ID NO: 46313 - DNA, 20 bp, Artificial Sequence
  chemically synthesized
ggtgggcccggcagaacttg

SEQ ID NO: 46314 - DNA, 20 bp, Artificial Sequence
  chemically synthesized
gcccggcagaacttggagtc

SEQ ID NO: 46315 - DNA, 20 bp, Artificial Sequence
  chemically synthesized
ttggagtctggcatcccacg

SEQ ID NO: 46316 - DNA, 20 bp, Artificial Sequence
  chemically synthesized
tggagtctggcatcccacgc

SEQ ID NO: 46317 - DNA, 20 bp, Artificial Sequence
  chemically synthesized
ggagtctggcatcccacgca

SEQ ID NO: 46318 - DNA, 20 bp, Artificial Sequence
  chemically synthesized
tctggcatcccacgcagggt

SEQ ID NO: 46319 - DNA, 20 bp, Artificial Sequence
  chemically synthesized
tggcatcccacgcagggtga

SEQ ID NO: 46320 - DNA, 20 bp, Artificial Sequence
  chemically synthesized
ggcatcccacgcagggtgag

SEQ ID NO: 46321 - DNA, 20 bp, Artificial Sequence
  chemically synthesized
atcccacgcagggtgagagg

SEQ ID NO: 46322 - DNA, 20 bp, Artificial Sequence
  chemically synthesized
tcccacgcagggtgagaggc

SEQ ID NO: 46323 - DNA, 20 bp, Artificial Sequence
  chemically synthesized
ccacgcagggtgagaggcgg

SEQ ID NO: 46324 - DNA, 20 bp, Artificial Sequence
  chemically synthesized
acgcagggtgagaggcggga

SEQ ID NO: 46325 - DNA, 20 bp, Artificial Sequence
  chemically synthesized
cgcagggtgagaggcgggag

SEQ ID NO: 46326 - DNA, 20 bp, Artificial Sequence
  chemically synthesized
cagggtgagaggcgggagag

SEQ ID NO: 46327 - DNA, 20 bp, Artificial Sequence
  chemically synthesized
agggtgagaggcgggagagg

SEQ ID NO: 46328 - DNA, 20 bp, Artificial Sequence
  chemically synthesized
ggtgagaggcgggagaggag

SEQ ID NO: 46329 - DNA, 20 bp, Artificial Sequence
  chemically synthesized
ggcgggagaggaggagcccc

SEQ ID NO: 46330 - DNA, 20 bp, Artificial Sequence
  chemically synthesized
gcgggagaggaggagcccct

SEQ ID NO: 46331 - DNA, 20 bp, Artificial Sequence
  chemically synthesized
cgggagaggaggagccccta

SEQ ID NO: 46332 - DNA, 20 bp, Artificial Sequence
  chemically synthesized
aggaggagcccctagggcgc

SEQ ID NO: 46333 - DNA, 20 bp, Artificial Sequence
  chemically synthesized
tagggcgccggcctgccttc

SEQ ID NO: 46334 - DNA, 20 bp, Artificial Sequence
  chemically synthesized
cgccggcctgccttccagcc

SEQ ID NO: 46335 - DNA, 20 bp, Artificial Sequence
  chemically synthesized
ggcctgccttccagcccagt

SEQ ID NO: 46336 - DNA, 20 bp, Artificial Sequence
  chemically synthesized
gcctgccttccagcccagtt

SEQ ID NO: 46337 - DNA, 20 bp, Artificial Sequence
  chemically synthesized
cttccagcccagttaggatt

SEQ ID NO: 46338 - DNA, 20 bp, Artificial Sequence
  chemically synthesized
ttccagcccagttaggattt

SEQ ID NO: 46339 - DNA, 20 bp, Artificial Sequence
  chemically synthesized
ccagcccagttaggatttgg

SEQ ID NO: 46340 - DNA, 20 bp, Artificial Sequence
  chemically synthesized
gcgcgtaatctgacgctgtt

SEQ ID NO: 46341 - DNA, 20 bp, Artificial Sequence
  chemically synthesized
cgcgtaatctgacgctgttt

SEQ ID NO: 46342 - DNA, 20 bp, Artificial Sequence
  chemically synthesized
gcgtaatctgacgctgtttg

SEQ ID NO: 46343 - DNA, 20 bp, Artificial Sequence
  chemically synthesized
gtaatctgacgctgtttggg

SEQ ID NO: 46344 - DNA, 20 bp, Artificial Sequence
  chemically synthesized
taatctgacgctgtttgggg

SEQ ID NO: 46345 - DNA, 20 bp, Artificial Sequence
  chemically synthesized
aatctgacgctgtttgggga

SEQ ID NO: 46346 - DNA, 20 bp, Artificial Sequence
  chemically synthesized
tgacgctgtttggggagggc

SEQ ID NO: 46347 - DNA, 20 bp, Artificial Sequence
  chemically synthesized
gacgctgtttggggagggcg

SEQ ID NO: 46348 - DNA, 20 bp, Artificial Sequence
  chemically synthesized
gaggccgaaacctgatcctc

SEQ ID NO: 46349 - DNA, 20 bp, Artificial Sequence
  chemically synthesized
cgaaacctgatcctccagtc

SEQ ID NO: 46350 - DNA, 20 bp, Artificial Sequence
  chemically synthesized
gaaacctgatcctccagtcc

SEQ ID NO: 46351 - DNA, 20 bp, Artificial Sequence
  chemically synthesized
aaacctgatcctccagtccg

SEQ ID NO: 46352 - DNA, 20 bp, Artificial Sequence
  chemically synthesized
aacctgatcctccagtccgg

SEQ ID NO: 46353 - DNA, 20 bp, Artificial Sequence
  chemically synthesized
gggttccgttaatgtttaat

SEQ ID NO: 46354 - DNA, 20 bp, Artificial Sequence
  chemically synthesized
tccgttaatgtttaatcaga

SEQ ID NO: 46355 - DNA, 20 bp, Artificial Sequence
  chemically synthesized
ccgttaatgtttaatcagat

SEQ ID NO: 46356 - DNA, 20 bp, Artificial Sequence
  chemically synthesized
aatcagataggatcgtccga

SEQ ID NO: 46357 - DNA, 20 bp, Artificial Sequence
  chemically synthesized
atcagataggatcgtccgat

SEQ ID NO: 46358 - DNA, 20 bp, Artificial Sequence
  chemically synthesized
tcagataggatcgtccgatg

SEQ ID NO: 46359 - DNA, 20 bp, Artificial Sequence
  chemically synthesized
aggatcgtccgatggggctc

SEQ ID NO: 46360 - DNA, 20 bp, Artificial Sequence
  chemically synthesized
atcgtccgatggggctctgg

SEQ ID NO: 46361 - DNA, 20 bp, Artificial Sequence
  chemically synthesized
gtggcgtgatctgcgcgccc

SEQ ID NO: 46362 - DNA, 20 bp, Artificial Sequence
  chemically synthesized
tggcgtgatctgcgcgcccc

SEQ ID NO: 46363 - DNA, 20 bp, Artificial Sequence
  chemically synthesized
atctgcgcgccccaggcgtc

SEQ ID NO: 46364 - DNA, 20 bp, Artificial Sequence
  chemically synthesized
ggcgtcaagcacccacaccc

SEQ ID NO: 46365 - DNA, 20 bp, Artificial Sequence
  chemically synthesized
gtcaagcacccacaccctag

SEQ ID NO: 46366 - DNA, 20 bp, Artificial Sequence
  chemically synthesized
tcaagcacccacaccctaga

SEQ ID NO: 46367 - DNA, 20 bp, Artificial Sequence
  chemically synthesized
cacaccctagaaggtttccg

SEQ ID NO: 46368 - DNA, 20 bp, Artificial Sequence
  chemically synthesized
aaggtttccgcagcgacgtc

SEQ ID NO: 46369 - DNA, 20 bp, Artificial Sequence
  chemically synthesized
aggtttccgcagcgacgtcg

SEQ ID NO: 46370 - DNA, 20 bp, Artificial Sequence
  chemically synthesized
cagcgacgtcgaggcgctca

SEQ ID NO: 46371 - DNA, 20 bp, Artificial Sequence
  chemically synthesized
cgtcgaggcgctcatggttg

SEQ ID NO: 46372 - DNA, 20 bp, Artificial Sequence
  chemically synthesized
gtcgaggcgctcatggttgc

SEQ ID NO: 46373 - DNA, 20 bp, Artificial Sequence
  chemically synthesized
gaggcgctcatggttgcagg

SEQ ID NO: 46374 - DNA, 20 bp, Artificial Sequence
  chemically synthesized
aggcgctcatggttgcaggc

SEQ ID NO: 46375 - DNA, 20 bp, Artificial Sequence
  chemically synthesized
tgcaggcgggcgccgccgtt

SEQ ID NO: 46376 - DNA, 20 bp, Artificial Sequence
  chemically synthesized
gcgggcgccgccgttcagtt

SEQ ID NO: 46377 - DNA, 20 bp, Artificial Sequence
  chemically synthesized
cgggcgccgccgttcagttc

SEQ ID NO: 46378 - DNA, 20 bp, Artificial Sequence
  chemically synthesized
gggcgccgccgttcagttca

SEQ ID NO: 46379 - DNA, 20 bp, Artificial Sequence
  chemically synthesized
cgccgttcagttcagggtct

SEQ ID NO: 46380 - DNA, 20 bp, Artificial Sequence
  chemically synthesized
ttcagttcagggtctgagcc

SEQ ID NO: 46381 - DNA, 20 bp, Artificial Sequence
  chemically synthesized
cagttcagggtctgagcctg

SEQ ID NO: 46382 - DNA, 20 bp, Artificial Sequence
  chemically synthesized
agttcagggtctgagcctgg

SEQ ID NO: 46383 - DNA, 20 bp, Artificial Sequence
  chemically synthesized
ttcagggtctgagcctggag

SEQ ID NO: 46384 - DNA, 20 bp, Artificial Sequence
  chemically synthesized
gggtctgagcctggaggagt

SEQ ID NO: 46385 - DNA, 20 bp, Artificial Sequence
  chemically synthesized
ctgagcctggaggagtgagc

SEQ ID NO: 46386 - DNA, 20 bp, Artificial Sequence
  chemically synthesized
tgagcctggaggagtgagcc

SEQ ID NO: 46387 - DNA, 20 bp, Artificial Sequence
  chemically synthesized
gcctggaggagtgagccagg

SEQ ID NO: 46388 - DNA, 20 bp, Artificial Sequence
  chemically synthesized
ggaggagtgagccaggcagt

SEQ ID NO: 46389 - DNA, 20 bp, Artificial Sequence
  chemically synthesized
agtgagccaggcagtgagac

SEQ ID NO: 46390 - DNA, 20 bp, Artificial Sequence
  chemically synthesized
gccaggcagtgagactggct

SEQ ID NO: 46391 - DNA, 20 bp, Artificial Sequence
  chemically synthesized
ccaggcagtgagactggctc

SEQ ID NO: 46392 - DNA, 20 bp, Artificial Sequence
  chemically synthesized
ggcagtgagactggctcggg

SEQ ID NO: 46393 - DNA, 20 bp, Artificial Sequence
  chemically synthesized
gcagtgagactggctcgggc

SEQ ID NO: 46394 - DNA, 20 bp, Artificial Sequence
  chemically synthesized
tgagactggctcgggcgggc

SEQ ID NO: 46395 - DNA, 20 bp, Artificial Sequence
  chemically synthesized
gagactggctcgggcgggcc

SEQ ID NO: 46396 - DNA, 20 bp, Artificial Sequence
  chemically synthesized
cgggccgggacgcgtcgttg

SEQ ID NO: 46397 - DNA, 20 bp, Artificial Sequence
  chemically synthesized
gccgggacgcgtcgttgcag

SEQ ID NO: 46398 - DNA, 20 bp, Artificial Sequence
  chemically synthesized
gggacgcgtcgttgcagcag

SEQ ID NO: 46399 - DNA, 20 bp, Artificial Sequence
  chemically synthesized
gtcgttgcagcagcggctcc

SEQ ID NO: 46400 - DNA, 20 bp, Artificial Sequence
  chemically synthesized
cagcagcggctcccagctcc

SEQ ID NO: 46401 - DNA, 20 bp, Artificial Sequence
  chemically synthesized
agcggctcccagctcccagc

SEQ ID NO: 46402 - DNA, 20 bp, Artificial Sequence
  chemically synthesized
gcggctcccagctcccagcc

SEQ ID NO: 46403 - DNA, 20 bp, Artificial Sequence
  chemically synthesized
cgcgccctgctcctgaactt

SEQ ID NO: 46404 - DNA, 20 bp, Artificial Sequence
  chemically synthesized
cctgaacttcagctcctgca

SEQ ID NO: 46405 - DNA, 20 bp, Artificial Sequence
  chemically synthesized
tgcacagtcctccccaccgc

SEQ ID NO: 46406 - DNA, 20 bp, Artificial Sequence
  chemically synthesized
gcacagtcctccccaccgca

SEQ ID NO: 46407 - DNA, 20 bp, Artificial Sequence
  chemically synthesized
tcctccccaccgcaaggctc

SEQ ID NO: 46408 - DNA, 20 bp, Artificial Sequence
  chemically synthesized
cctccccaccgcaaggctca

SEQ ID NO: 46409 - DNA, 20 bp, Artificial Sequence
  chemically synthesized
cgcaaggctcaaggcgccgc

SEQ ID NO: 46410 - DNA, 20 bp, Artificial Sequence
  chemically synthesized
ggctcaaggcgccgccggcg

SEQ ID NO: 46411 - DNA, 20 bp, Artificial Sequence
  chemically synthesized
ccgccggcgtggaccgcgca

SEQ ID NO: 46412 - DNA, 20 bp, Artificial Sequence
  chemically synthesized
cgtggaccgcgcacggcctc

SEQ ID NO: 46413 - DNA, 20 bp, Artificial Sequence
  chemically synthesized
gtggaccgcgcacggcctct

SEQ ID NO: 46414 - DNA, 20 bp, Artificial Sequence
  chemically synthesized
cggcctctaggtctcctcgc

SEQ ID NO: 46415 - DNA, 20 bp, Artificial Sequence
  chemically synthesized
ggcctctaggtctcctcgcc

SEQ ID NO: 46416 - DNA, 20 bp, Artificial Sequence
  chemically synthesized
tctaggtctcctcgccagga

SEQ ID NO: 46417 - DNA, 20 bp, Artificial Sequence
  chemically synthesized
caggacagcaacctctcccc

SEQ ID NO: 46418 - DNA, 20 bp, Artificial Sequence
  chemically synthesized
aacctctcccctggccctca

SEQ ID NO: 46419 - DNA, 20 bp, Artificial Sequence
  chemically synthesized
acctctcccctggccctcat

SEQ ID NO: 46420 - DNA, 20 bp, Artificial Sequence
  chemically synthesized
ctggccctcatgggcaccgt

SEQ ID NO: 46421 - DNA, 20 bp, Artificial Sequence
  chemically synthesized
ctcatgggcaccgtcagctc

SEQ ID NO: 46422 - DNA, 20 bp, Artificial Sequence
  chemically synthesized
tcatgggcaccgtcagctcc

SEQ ID NO: 46423 - DNA, 20 bp, Artificial Sequence
  chemically synthesized
tgggcaccgtcagctccagg

SEQ ID NO: 46424 - DNA, 20 bp, Artificial Sequence
  chemically synthesized
ccgtcagctccaggcggtcc

SEQ ID NO: 46425 - DNA, 20 bp, Artificial Sequence
  chemically synthesized
tcagctccaggcggtcctgg

SEQ ID NO: 46426 - DNA, 20 bp, Artificial Sequence
  chemically synthesized
gctgctgctgctgctgctcc

SEQ ID NO: 46427 - DNA, 20 bp, Artificial Sequence
  chemically synthesized
ctgctgctgctgctgctcct

SEQ ID NO: 46428 - DNA, 20 bp, Artificial Sequence
  chemically synthesized
gctgctgctcctgggtcccg

SEQ ID NO: 46429 - DNA, 20 bp, Artificial Sequence
  chemically synthesized
ctgctgctcctgggtcccgc

SEQ ID NO: 46430 - DNA, 20 bp, Artificial Sequence
  chemically synthesized
gtcccgcgggcgcccgtgcg

SEQ ID NO: 46431 - DNA, 20 bp, Artificial Sequence
  chemically synthesized
tcccgcgggcgcccgtgcgc

SEQ ID NO: 46432 - DNA, 20 bp, Artificial Sequence
  chemically synthesized
ccgcgggcgcccgtgcgcag

SEQ ID NO: 46433 - DNA, 20 bp, Artificial Sequence
  chemically synthesized
cgcgggcgcccgtgcgcagg

SEQ ID NO: 46434 - DNA, 20 bp, Artificial Sequence
  chemically synthesized
gcgcccgtgcgcaggaggac

SEQ ID NO: 46435 - DNA, 20 bp, Artificial Sequence
  chemically synthesized
cgcccgtgcgcaggaggacg

SEQ ID NO: 46436 - DNA, 20 bp, Artificial Sequence
  chemically synthesized
cgtgcgcaggaggacgagga

SEQ ID NO: 46437 - DNA, 20 bp, Artificial Sequence
  chemically synthesized
aggacgaggacggcgactac

SEQ ID NO: 46438 - DNA, 20 bp, Artificial Sequence
  chemically synthesized
ggacgaggacggcgactacg

SEQ ID NO: 46439 - DNA, 20 bp, Artificial Sequence
  chemically synthesized
acgaggacggcgactacgag

SEQ ID NO: 46440 - DNA, 20 bp, Artificial Sequence
  chemically synthesized
ggacggcgactacgaggagc

SEQ ID NO: 46441 - DNA, 20 bp, Artificial Sequence
  chemically synthesized
cgactacgaggagctggtgc

SEQ ID NO: 46442 - DNA, 20 bp, Artificial Sequence
  chemically synthesized
tggtgctagccttgcgttcc

SEQ ID NO: 46443 - DNA, 20 bp, Artificial Sequence
  chemically synthesized
ggtgctagccttgcgttccg

SEQ ID NO: 46444 - DNA, 20 bp, Artificial Sequence
  chemically synthesized
tgctagccttgcgttccgag

SEQ ID NO: 46445 - DNA, 20 bp, Artificial Sequence
  chemically synthesized
gctagccttgcgttccgagg

SEQ ID NO: 46446 - DNA, 20 bp, Artificial Sequence
  chemically synthesized
gccttgcgttccgaggagga

SEQ ID NO: 46447 - DNA, 20 bp, Artificial Sequence
  chemically synthesized
gcgttccgaggaggacggcc

SEQ ID NO: 46448 - DNA, 20 bp, Artificial Sequence
  chemically synthesized
cgaggaggacggcctggccg

SEQ ID NO: 46449 - DNA, 20 bp, Artificial Sequence
  chemically synthesized
acggcctggccgaagcaccc

SEQ ID NO: 46450 - DNA, 20 bp, Artificial Sequence
  chemically synthesized
ctggccgaagcacccgagca

SEQ ID NO: 46451 - DNA, 20 bp, Artificial Sequence
  chemically synthesized
agcacccgagcacggaacca

SEQ ID NO: 46452 - DNA, 20 bp, Artificial Sequence
  chemically synthesized
ccaccttccaccgctgcgcc

SEQ ID NO: 46453 - DNA, 20 bp, Artificial Sequence
  chemically synthesized
caccttccaccgctgcgcca

SEQ ID NO: 46454 - DNA, 20 bp, Artificial Sequence
  chemically synthesized
tccaccgctgcgccaaggtg

SEQ ID NO: 46455 - DNA, 20 bp, Artificial Sequence
  chemically synthesized
ccaccgctgcgccaaggtgc

SEQ ID NO: 46456 - DNA, 20 bp, Artificial Sequence
  chemically synthesized
gctgcgccaaggtgcgggtg

SEQ ID NO: 46457 - DNA, 20 bp, Artificial Sequence
  chemically synthesized
ctgcgccaaggtgcgggtgt

SEQ ID NO: 46458 - DNA, 20 bp, Artificial Sequence
  chemically synthesized
tgcgccaaggtgcgggtgta

SEQ ID NO: 46459 - DNA, 20 bp, Artificial Sequence
  chemically synthesized
ccaaggtgcgggtgtaggga

SEQ ID NO: 46460 - DNA, 20 bp, Artificial Sequence
  chemically synthesized
caaggtgcgggtgtagggat

SEQ ID NO: 46461 - DNA, 20 bp, Artificial Sequence
  chemically synthesized
aggtgcgggtgtagggatgg

SEQ ID NO: 46462 - DNA, 20 bp, Artificial Sequence
  chemically synthesized
ggtgcgggtgtagggatggg

SEQ ID NO: 46463 - DNA, 20 bp, Artificial Sequence
  chemically synthesized
cgggtgtagggatgggaggc

SEQ ID NO: 46464 - DNA, 20 bp, Artificial Sequence
  chemically synthesized
gggtgtagggatgggaggcc

SEQ ID NO: 46465 - DNA, 20 bp, Artificial Sequence
  chemically synthesized
ggtgtagggatgggaggccg

SEQ ID NO: 46466 - DNA, 20 bp, Artificial Sequence
  chemically synthesized
gggaggccggggcgaacccg

SEQ ID NO: 46467 - DNA, 20 bp, Artificial Sequence
  chemically synthesized
ggccggggcgaacccgcagc

SEQ ID NO: 46468 - DNA, 20 bp, Artificial Sequence
  chemically synthesized
gccggggcgaacccgcagcc

SEQ ID NO: 46469 - DNA, 20 bp, Artificial Sequence
  chemically synthesized
gggcgaacccgcagccggga

SEQ ID NO: 46470 - DNA, 20 bp, Artificial Sequence
  chemically synthesized
aacccgcagccgggacggtg

SEQ ID NO: 46471 - DNA, 20 bp, Artificial Sequence
  chemically synthesized
ggtgcggtgctgtttcctct

SEQ ID NO: 46472 - DNA, 20 bp, Artificial Sequence
  chemically synthesized
gtgcggtgctgtttcctctc

SEQ ID NO: 46473 - DNA, 20 bp, Artificial Sequence
  chemically synthesized
tgctgtttcctctcgggcct

SEQ ID NO: 46474 - DNA, 20 bp, Artificial Sequence
  chemically synthesized
gcctcagtttccccccatgt

SEQ ID NO: 46475 - DNA, 20 bp, Artificial Sequence
  chemically synthesized
ctcagtttccccccatgtaa

SEQ ID NO: 46476 - DNA, 20 bp, Artificial Sequence
  chemically synthesized
cagtttccccccatgtaaga

SEQ ID NO: 46477 - DNA, 20 bp, Artificial Sequence
  chemically synthesized
agtttccccccatgtaagag

SEQ ID NO: 46478 - DNA, 20 bp, Artificial Sequence
  chemically synthesized
ttccccccatgtaagagagg

SEQ ID NO: 46479 - DNA, 20 bp, Artificial Sequence
  chemically synthesized
cccccatgtaagagaggaag

SEQ ID NO: 46480 - DNA, 20 bp, Artificial Sequence
  chemically synthesized
cccatgtaagagaggaagtg

SEQ ID NO: 46481 - DNA, 20 bp, Artificial Sequence
  chemically synthesized
gtaagagaggaagtggagtg

SEQ ID NO: 46482 - DNA, 20 bp, Artificial Sequence
  chemically synthesized
taagagaggaagtggagtgc

SEQ ID NO: 46483 - DNA, 20 bp, Artificial Sequence
  chemically synthesized
gaagtggagtgcaggtcgcc

SEQ ID NO: 46484 - DNA, 20 bp, Artificial Sequence
  chemically synthesized
aagtggagtgcaggtcgccg

SEQ ID NO: 46485 - DNA, 20 bp, Artificial Sequence
  chemically synthesized
agtggagtgcaggtcgccga

SEQ ID NO: 46486 - DNA, 20 bp, Artificial Sequence
  chemically synthesized
gtcgccgagggctcttcgct

SEQ ID NO: 46487 - DNA, 20 bp, Artificial Sequence
  chemically synthesized
ctcttcgcttggcacgatct

SEQ ID NO: 46488 - DNA, 20 bp, Artificial Sequence
  chemically synthesized
tcttcgcttggcacgatctt

SEQ ID NO: 46489 - DNA, 20 bp, Artificial Sequence
  chemically synthesized
cttcgcttggcacgatcttg

SEQ ID NO: 46490 - DNA, 20 bp, Artificial Sequence
  chemically synthesized
tggcacgatcttggggactg

SEQ ID NO: 46491 - DNA, 20 bp, Artificial Sequence
  chemically synthesized
ggcacgatcttggggactgc

SEQ ID NO: 46492 - DNA, 20 bp, Artificial Sequence
  chemically synthesized
cgatcttggggactgcaggc

SEQ ID NO: 46493 - DNA, 20 bp, Artificial Sequence
  chemically synthesized
gatcttggggactgcaggca

SEQ ID NO: 46494 - DNA, 20 bp, Artificial Sequence
  chemically synthesized
cttggggactgcaggcaagg

SEQ ID NO: 46495 - DNA, 20 bp, Artificial Sequence
  chemically synthesized
ggggactgcaggcaaggcgg

SEQ ID NO: 46496 - DNA, 20 bp, Artificial Sequence
  chemically synthesized
gggactgcaggcaaggcggc

SEQ ID NO: 46497 - DNA, 20 bp, Artificial Sequence
  chemically synthesized
ggactgcaggcaaggcggcg

SEQ ID NO: 46498 - DNA, 20 bp, Artificial Sequence
  chemically synthesized
gactgcaggcaaggcggcgg

SEQ ID NO: 46499 - DNA, 20 bp, Artificial Sequence
  chemically synthesized
ctgcaggcaaggcggcgggg

SEQ ID NO: 46500 - DNA, 20 bp, Artificial Sequence
  chemically synthesized
tgcaggcaaggcggcggggg

SEQ ID NO: 46501 - DNA, 20 bp, Artificial Sequence
  chemically synthesized
ggcaaggcggcgggggagga

SEQ ID NO: 46502 - DNA, 20 bp, Artificial Sequence
  chemically synthesized
gcaaggcggcgggggaggac

SEQ ID NO: 46503 - DNA, 20 bp, Artificial Sequence
  chemically synthesized
aggcggcgggggaggacggg

SEQ ID NO: 46504 - DNA, 20 bp, Artificial Sequence
  chemically synthesized
cggcgggggaggacgggtag

SEQ ID NO: 46505 - DNA, 20 bp, Artificial Sequence
  chemically synthesized
ggcgggggaggacgggtagt

SEQ ID NO: 46506 - DNA, 20 bp, Artificial Sequence
  chemically synthesized
gcgggggaggacgggtagtg

SEQ ID NO: 46507 - DNA, 20 bp, Artificial Sequence
  chemically synthesized
gggggaggacgggtagtggg

SEQ ID NO: 46508 - DNA, 20 bp, Artificial Sequence
  chemically synthesized
aggacgggtagtggggagca

SEQ ID NO: 46509 - DNA, 20 bp, Artificial Sequence
  chemically synthesized
acgggtagtggggagcacgg

SEQ ID NO: 46510 - DNA, 20 bp, Artificial Sequence
  chemically synthesized
gggtagtggggagcacggtg

SEQ ID NO: 46511 - DNA, 20 bp, Artificial Sequence
  chemically synthesized
gtagtggggagcacggtgga

SEQ ID NO: 46512 - DNA, 20 bp, Artificial Sequence
  chemically synthesized
gtggggagcacggtggagag

SEQ ID NO: 46513 - DNA, 20 bp, Artificial Sequence
  chemically synthesized
tggggagcacggtggagagc

SEQ ID NO: 46514 - DNA, 20 bp, Artificial Sequence
  chemically synthesized
ggggagcacggtggagagcg

SEQ ID NO: 46515 - DNA, 20 bp, Artificial Sequence
  chemically synthesized
agcacggtggagagcgggga

SEQ ID NO: 46516 - DNA, 20 bp, Artificial Sequence
  chemically synthesized
cggtggagagcggggacggc

SEQ ID NO: 46517 - DNA, 20 bp, Artificial Sequence
  chemically synthesized
agcggggacggccggctctt

SEQ ID NO: 46518 - DNA, 20 bp, Artificial Sequence
  chemically synthesized
gcggggacggccggctcttt

SEQ ID NO: 46519 - DNA, 20 bp, Artificial Sequence
  chemically synthesized
cggggacggccggctctttg

SEQ ID NO: 46520 - DNA, 20 bp, Artificial Sequence
  chemically synthesized
ccggctctttggggacttgc

SEQ ID NO: 46521 - DNA, 20 bp, Artificial Sequence
  chemically synthesized
cggctctttggggacttgct

SEQ ID NO: 46522 - DNA, 20 bp, Artificial Sequence
  chemically synthesized
ggctctttggggacttgctg

SEQ ID NO: 46523 - DNA, 20 bp, Artificial Sequence
  chemically synthesized
tggggacttgctggggcgtg

SEQ ID NO: 46524 - DNA, 20 bp, Artificial Sequence
  chemically synthesized
gggcgtgcggctgcgctatt

SEQ ID NO: 46525 - DNA, 20 bp, Artificial Sequence
  chemically synthesized
cgtgcggctgcgctattcag

SEQ ID NO: 46526 - DNA, 20 bp, Artificial Sequence
  chemically synthesized
gtgcggctgcgctattcagt

SEQ ID NO: 46527 - DNA, 20 bp, Artificial Sequence
  chemically synthesized
cggctgcgctattcagtggg

SEQ ID NO: 46528 - DNA, 20 bp, Artificial Sequence
  chemically synthesized
ggctgcgctattcagtggga

SEQ ID NO: 46529 - DNA, 20 bp, Artificial Sequence
  chemically synthesized
ctattcagtgggaaggttcg

SEQ ID NO: 46530 - DNA, 20 bp, Artificial Sequence
  chemically synthesized
tattcagtgggaaggttcgc

SEQ ID NO: 46531 - DNA, 20 bp, Artificial Sequence
  chemically synthesized
attcagtgggaaggttcgcg

SEQ ID NO: 46532 - DNA, 20 bp, Artificial Sequence
  chemically synthesized
agtgggaaggttcgcggggt

SEQ ID NO: 46533 - DNA, 20 bp, Artificial Sequence
  chemically synthesized
gtgggaaggttcgcggggtt

SEQ ID NO: 46534 - DNA, 20 bp, Artificial Sequence
  chemically synthesized
gggaaggttcgcggggttgg

SEQ ID NO: 46535 - DNA, 20 bp, Artificial Sequence
  chemically synthesized
gttcgcggggttgggagacc

SEQ ID NO: 46536 - DNA, 20 bp, Artificial Sequence
  chemically synthesized
tcgcggggttgggagacccg

SEQ ID NO: 46537 - DNA, 20 bp, Artificial Sequence
  chemically synthesized
cgcggggttgggagacccgg

SEQ ID NO: 46538 - DNA, 20 bp, Artificial Sequence
  chemically synthesized
ggttgggagacccggaggcc

SEQ ID NO: 46539 - DNA, 20 bp, Artificial Sequence
  chemically synthesized
gttgggagacccggaggccg

SEQ ID NO: 46540 - DNA, 20 bp, Artificial Sequence
  chemically synthesized
gggagacccggaggccgagg

SEQ ID NO: 46541 - DNA, 20 bp, Artificial Sequence
  chemically synthesized
ggagacccggaggccgagga

SEQ ID NO: 46542 - DNA, 20 bp, Artificial Sequence
  chemically synthesized
gagacccggaggccgaggaa

SEQ ID NO: 46543 - DNA, 20 bp, Artificial Sequence
  chemically synthesized
cccggaggccgaggaagggc

SEQ ID NO: 46544 - DNA, 20 bp, Artificial Sequence
  chemically synthesized
ggaggccgaggaagggcgag

SEQ ID NO: 46545 - DNA, 20 bp, Artificial Sequence
  chemically synthesized
aggccgaggaagggcgagca

SEQ ID NO: 46546 - DNA, 20 bp, Artificial Sequence
  chemically synthesized
aagggcgagcagagcactgc

SEQ ID NO: 46547 - DNA, 20 bp, Artificial Sequence
  chemically synthesized
agggcgagcagagcactgcc

SEQ ID NO: 46548 - DNA, 20 bp, Artificial Sequence
  chemically synthesized
cactgccaggatatcctgcc

SEQ ID NO: 46549 - DNA, 20 bp, Artificial Sequence
  chemically synthesized
gatatcctgcccagatttcc

SEQ ID NO: 46550 - DNA, 20 bp, Artificial Sequence
  chemically synthesized
tcccagtttctgcctcgccg

SEQ ID NO: 46551 - DNA, 20 bp, Artificial Sequence
  chemically synthesized
gtttctgcctcgccgcggca

SEQ ID NO: 46552 - DNA, 20 bp, Artificial Sequence
  chemically synthesized
tttctgcctcgccgcggcac

SEQ ID NO: 46553 - DNA, 20 bp, Artificial Sequence
  chemically synthesized
ctgcctcgccgcggcacagg

SEQ ID NO: 46554 - DNA, 20 bp, Artificial Sequence
  chemically synthesized
tgcctcgccgcggcacaggt

SEQ ID NO: 46555 - DNA, 20 bp, Artificial Sequence
  chemically synthesized
cgccgcggcacaggtgggtg

SEQ ID NO: 46556 - DNA, 20 bp, Artificial Sequence
  chemically synthesized
gccgcggcacaggtgggtga

SEQ ID NO: 46557 - DNA, 20 bp, Artificial Sequence
  chemically synthesized
cgcggcacaggtgggtgaag

SEQ ID NO: 46558 - DNA, 20 bp, Artificial Sequence
  chemically synthesized
tgggtgaaggagtgaatgcc

SEQ ID NO: 46559 - DNA, 20 bp, Artificial Sequence
  chemically synthesized
agtgaatgcctggaacgtac

SEQ ID NO: 46560 - DNA, 20 bp, Artificial Sequence
  chemically synthesized
gtgaatgcctggaacgtact

SEQ ID NO: 46561 - DNA, 20 bp, Artificial Sequence
  chemically synthesized
gaacgtactgggaactgcac

SEQ ID NO: 46562 - DNA, 20 bp, Artificial Sequence
  chemically synthesized
aacgtactgggaactgcacc

SEQ ID NO: 46563 - DNA, 20 bp, Artificial Sequence
  chemically synthesized
actgggaactgcaccaggca

SEQ ID NO: 46564 - DNA, 20 bp, Artificial Sequence
  chemically synthesized
tgggaactgcaccaggcaca

SEQ ID NO: 46565 - DNA, 20 bp, Artificial Sequence
  chemically synthesized
aactgcaccaggcacagaga

SEQ ID NO: 46566 - DNA, 20 bp, Artificial Sequence
  chemically synthesized
tgcaccaggcacagagaaag

SEQ ID NO: 46567 - DNA, 20 bp, Artificial Sequence
  chemically synthesized
gcaccaggcacagagaaagc

SEQ ID NO: 46568 - DNA, 20 bp, Artificial Sequence
  chemically synthesized
agaaagcgggcttgccatta

SEQ ID NO: 46569 - DNA, 20 bp, Artificial Sequence
  chemically synthesized
aagcgggcttgccattatag

SEQ ID NO: 46570 - DNA, 20 bp, Artificial Sequence
  chemically synthesized
agcgggcttgccattatagt

SEQ ID NO: 46571 - DNA, 20 bp, Artificial Sequence
  chemically synthesized
cattatagtgggttccgatt

SEQ ID NO: 46572 - DNA, 20 bp, Artificial Sequence
  chemically synthesized
tagtgggttccgatttggtt

SEQ ID NO: 46573 - DNA, 20 bp, Artificial Sequence
  chemically synthesized
ccgatttggtttggaaaaca

SEQ ID NO: 46574 - DNA, 20 bp, Artificial Sequence
  chemically synthesized
cgatttggtttggaaaacat

SEQ ID NO: 46575 - DNA, 20 bp, Artificial Sequence
  chemically synthesized
tttggtttggaaaacatggg

SEQ ID NO: 46576 - DNA, 20 bp, Artificial Sequence
  chemically synthesized
ggtttggaaaacatgggcag

SEQ ID NO: 46577 - DNA, 20 bp, Artificial Sequence
  chemically synthesized
tttggaaaacatgggcagcg

SEQ ID NO: 46578 - DNA, 20 bp, Artificial Sequence
  chemically synthesized
ttggaaaacatgggcagcgg

SEQ ID NO: 46579 - DNA, 20 bp, Artificial Sequence
  chemically synthesized
tggaaaacatgggcagcgga

SEQ ID NO: 46580 - DNA, 20 bp, Artificial Sequence
  chemically synthesized
aaaacatgggcagcggaggg

SEQ ID NO: 46581 - DNA, 20 bp, Artificial Sequence
  chemically synthesized
aacatgggcagcggagggtg

SEQ ID NO: 46582 - DNA, 20 bp, Artificial Sequence
  chemically synthesized
acatgggcagcggagggtgg

SEQ ID NO: 46583 - DNA, 20 bp, Artificial Sequence
  chemically synthesized
catgggcagcggagggtgga

SEQ ID NO: 46584 - DNA, 20 bp, Artificial Sequence
  chemically synthesized
gcagcggagggtggagggcc

SEQ ID NO: 46585 - DNA, 20 bp, Artificial Sequence
  chemically synthesized
agcggagggtggagggcctg

SEQ ID NO: 46586 - DNA, 20 bp, Artificial Sequence
  chemically synthesized
cggagggtggagggcctgga

SEQ ID NO: 46587 - DNA, 20 bp, Artificial Sequence
  chemically synthesized
agggtggagggcctggagag

SEQ ID NO: 46588 - DNA, 20 bp, Artificial Sequence
  chemically synthesized
gggtggagggcctggagaga

SEQ ID NO: 46589 - DNA, 20 bp, Artificial Sequence
  chemically synthesized
ctggagagaaggccctaccc

SEQ ID NO: 46590 - DNA, 20 bp, Artificial Sequence
  chemically synthesized
agagaaggccctacccgaga

SEQ ID NO: 46591 - DNA, 20 bp, Artificial Sequence
  chemically synthesized
gagaaggccctacccgagac

SEQ ID NO: 46592 - DNA, 20 bp, Artificial Sequence
  chemically synthesized
agaaggccctacccgagaca

SEQ ID NO: 46593 - DNA, 20 bp, Artificial Sequence
  chemically synthesized
gaaggccctacccgagacag

SEQ ID NO: 46594 - DNA, 20 bp, Artificial Sequence
  chemically synthesized
ggccctacccgagacagggg

SEQ ID NO: 46595 - DNA, 20 bp, Artificial Sequence
  chemically synthesized
gccctacccgagacaggggc

SEQ ID NO: 46596 - DNA, 20 bp, Artificial Sequence
  chemically synthesized
ccctacccgagacaggggcg

SEQ ID NO: 46597 - DNA, 20 bp, Artificial Sequence
  chemically synthesized
tacccgagacaggggcgggg

SEQ ID NO: 46598 - DNA, 20 bp, Artificial Sequence
  chemically synthesized
acccgagacaggggcggggt

SEQ ID NO: 46599 - DNA, 20 bp, Artificial Sequence
  chemically synthesized
cgagacaggggcggggtggg

SEQ ID NO: 46600 - DNA, 20 bp, Artificial Sequence
  chemically synthesized
gagacaggggcggggtggga

SEQ ID NO: 46601 - DNA, 20 bp, Artificial Sequence
  chemically synthesized
caggggcggggtgggaagga

SEQ ID NO: 46602 - DNA, 20 bp, Artificial Sequence
  chemically synthesized
gggcggggtgggaaggacgg

SEQ ID NO: 46603 - DNA, 20 bp, Artificial Sequence
  chemically synthesized
gtgggaaggacggcagatgc

SEQ ID NO: 46604 - DNA, 20 bp, Artificial Sequence
  chemically synthesized
tgggaaggacggcagatgct

SEQ ID NO: 46605 - DNA, 20 bp, Artificial Sequence
  chemically synthesized
ggaaggacggcagatgctgg

SEQ ID NO: 46606 - DNA, 20 bp, Artificial Sequence
  chemically synthesized
acggcagatgctgggagcac

SEQ ID NO: 46607 - DNA, 20 bp, Artificial Sequence
  chemically synthesized
cggcagatgctgggagcacg

SEQ ID NO: 46608 - DNA, 20 bp, Artificial Sequence
  chemically synthesized
gaggcaatttctttatgaca

SEQ ID NO: 46609 - DNA, 20 bp, Artificial Sequence
  chemically synthesized
atgacacagaactcatgctc

SEQ ID NO: 46610 - DNA, 20 bp, Artificial Sequence
  chemically synthesized
ctctagtattccatctgttt

SEQ ID NO: 46611 - DNA, 20 bp, Artificial Sequence
  chemically synthesized
tattccatctgtttcagccg

SEQ ID NO: 46612 - DNA, 20 bp, Artificial Sequence
  chemically synthesized
catctgtttcagccgaagaa

SEQ ID NO: 46613 - DNA, 20 bp, Artificial Sequence
  chemically synthesized
tttcagccgaagaaaagaac

SEQ ID NO: 46614 - DNA, 20 bp, Artificial Sequence
  chemically synthesized
ccgaagaaaagaaccagctg

SEQ ID NO: 46615 - DNA, 20 bp, Artificial Sequence
  chemically synthesized
cgaagaaaagaaccagctga

SEQ ID NO: 46616 - DNA, 20 bp, Artificial Sequence
  chemically synthesized
gaagaaaagaaccagctgaa

SEQ ID NO: 46617 - DNA, 20 bp, Artificial Sequence
  chemically synthesized
aagaaaagaaccagctgaag

SEQ ID NO: 46618 - DNA, 20 bp, Artificial Sequence
  chemically synthesized
aaaagaaccagctgaagggg

SEQ ID NO: 46619 - DNA, 20 bp, Artificial Sequence
  chemically synthesized
aaagaaccagctgaaggggc

SEQ ID NO: 46620 - DNA, 20 bp, Artificial Sequence
  chemically synthesized
aagaaccagctgaaggggca

SEQ ID NO: 46621 - DNA, 20 bp, Artificial Sequence
  chemically synthesized
agaaccagctgaaggggcag

SEQ ID NO: 46622 - DNA, 20 bp, Artificial Sequence
  chemically synthesized
aaccagctgaaggggcaggg

SEQ ID NO: 46623 - DNA, 20 bp, Artificial Sequence
  chemically synthesized
cagctgaaggggcaggggag

SEQ ID NO: 46624 - DNA, 20 bp, Artificial Sequence
  chemically synthesized
agctgaaggggcaggggaga

SEQ ID NO: 46625 - DNA, 20 bp, Artificial Sequence
  chemically synthesized
gctgaaggggcaggggagaa

SEQ ID NO: 46626 - DNA, 20 bp, Artificial Sequence
  chemically synthesized
ctgaaggggcaggggagaag

SEQ ID NO: 46627 - DNA, 20 bp, Artificial Sequence
  chemically synthesized
aaggggcaggggagaagggg

SEQ ID NO: 46628 - DNA, 20 bp, Artificial Sequence
  chemically synthesized
ggggcaggggagaaggggcg

SEQ ID NO: 46629 - DNA, 20 bp, Artificial Sequence
  chemically synthesized
gggcaggggagaaggggcgg

SEQ ID NO: 46630 - DNA, 20 bp, Artificial Sequence
  chemically synthesized
gaaggggcggaggtattctc

SEQ ID NO: 46631 - DNA, 20 bp, Artificial Sequence
  chemically synthesized
aaggggcggaggtattctcg

SEQ ID NO: 46632 - DNA, 20 bp, Artificial Sequence
  chemically synthesized
gaggtattctcgaggcccat

SEQ ID NO: 46633 - DNA, 20 bp, Artificial Sequence
  chemically synthesized
cgaggcccattggcgtcctt

SEQ ID NO: 46634 - DNA, 20 bp, Artificial Sequence
  chemically synthesized
gaggcccattggcgtccttt

SEQ ID NO: 46635 - DNA, 20 bp, Artificial Sequence
  chemically synthesized
cattggcgtcctttaggact

SEQ ID NO: 46636 - DNA, 20 bp, Artificial Sequence
  chemically synthesized
attggcgtcctttaggactc

SEQ ID NO: 46637 - DNA, 20 bp, Artificial Sequence
  chemically synthesized
ggcgtcctttaggactcagg

SEQ ID NO: 46638 - DNA, 20 bp, Artificial Sequence
  chemically synthesized
gcgtcctttaggactcaggc

SEQ ID NO: 46639 - DNA, 20 bp, Artificial Sequence
  chemically synthesized
cgtcctttaggactcaggca

SEQ ID NO: 46640 - DNA, 20 bp, Artificial Sequence
  chemically synthesized
cctttaggactcaggcaggg

SEQ ID NO: 46641 - DNA, 20 bp, Artificial Sequence
  chemically synthesized
ctttaggactcaggcaggga

SEQ ID NO: 46642 - DNA, 20 bp, Artificial Sequence
  chemically synthesized
tttaggactcaggcagggaa

SEQ ID NO: 46643 - DNA, 20 bp, Artificial Sequence
  chemically synthesized
ctcaggcagggaagggccct

SEQ ID NO: 46644 - DNA, 20 bp, Artificial Sequence
  chemically synthesized
gggaagggcccttggtgctc

SEQ ID NO: 46645 - DNA, 20 bp, Artificial Sequence
  chemically synthesized
gaagggcccttggtgctctg

SEQ ID NO: 46646 - DNA, 20 bp, Artificial Sequence
  chemically synthesized
ggcccttggtgctctggagc

SEQ ID NO: 46647 - DNA, 20 bp, Artificial Sequence
  chemically synthesized
cccttggtgctctggagccg

SEQ ID NO: 46648 - DNA, 20 bp, Artificial Sequence
  chemically synthesized
ccttggtgctctggagccgg

SEQ ID NO: 46649 - DNA, 20 bp, Artificial Sequence
  chemically synthesized
tggtgctctggagccggagg

SEQ ID NO: 46650 - DNA, 20 bp, Artificial Sequence
  chemically synthesized
ggagccggaggtggtgcgcc

SEQ ID NO: 46651 - DNA, 20 bp, Artificial Sequence
  chemically synthesized
ggaggtggtgcgcctggtac

SEQ ID NO: 46652 - DNA, 20 bp, Artificial Sequence
  chemically synthesized
gaggtggtgcgcctggtact

SEQ ID NO: 46653 - DNA, 20 bp, Artificial Sequence
  chemically synthesized
tgcgcctggtactgggaccc

SEQ ID NO: 46654 - DNA, 20 bp, Artificial Sequence
  chemically synthesized
cgcctggtactgggaccccg

SEQ ID NO: 46655 - DNA, 20 bp, Artificial Sequence
  chemically synthesized
ggtactgggaccccggagct

SEQ ID NO: 46656 - DNA, 20 bp, Artificial Sequence
  chemically synthesized
tgggaccccggagctgagcc

SEQ ID NO: 46657 - DNA, 20 bp, Artificial Sequence
  chemically synthesized
cggagctgagcccggcgcct

SEQ ID NO: 46658 - DNA, 20 bp, Artificial Sequence
  chemically synthesized
gcccggcgcctcagcccacc

SEQ ID NO: 46659 - DNA, 20 bp, Artificial Sequence
  chemically synthesized
ggctgtctgccgaccgtgtg

SEQ ID NO: 46660 - DNA, 20 bp, Artificial Sequence
  chemically synthesized
gctgtctgccgaccgtgtgc

SEQ ID NO: 46661 - DNA, 20 bp, Artificial Sequence
  chemically synthesized
ctgtctgccgaccgtgtgcg

SEQ ID NO: 46662 - DNA, 20 bp, Artificial Sequence
  chemically synthesized
ctgccgaccgtgtgcggggc

SEQ ID NO: 46663 - DNA, 20 bp, Artificial Sequence
  chemically synthesized
agtttgctcaacaactctgc

SEQ ID NO: 46664 - DNA, 20 bp, Artificial Sequence
  chemically synthesized
tcaacaactctgccagcttc

SEQ ID NO: 46665 - DNA, 20 bp, Artificial Sequence
  chemically synthesized
ctctgccagcttctggccct

SEQ ID NO: 46666 - DNA, 20 bp, Artificial Sequence
  chemically synthesized
tctgccagcttctggccctc

SEQ ID NO: 46667 - DNA, 20 bp, Artificial Sequence
  chemically synthesized
agcttctggccctcaggctg

SEQ ID NO: 46668 - DNA, 20 bp, Artificial Sequence
  chemically synthesized
gcttctggccctcaggctgt

SEQ ID NO: 46669 - DNA, 20 bp, Artificial Sequence
  chemically synthesized
tctggccctcaggctgtggg

SEQ ID NO: 46670 - DNA, 20 bp, Artificial Sequence
  chemically synthesized
ggctgtgggaagcttcttcc

SEQ ID NO: 46671 - DNA, 20 bp, Artificial Sequence
  chemically synthesized
gctgtgggaagcttcttccc

SEQ ID NO: 46672 - DNA, 20 bp, Artificial Sequence
  chemically synthesized
ctgtgggaagcttcttcccg

SEQ ID NO: 46673 - DNA, 20 bp, Artificial Sequence
  chemically synthesized
gggaagcttcttcccggggc

SEQ ID NO: 46674 - DNA, 20 bp, Artificial Sequence
  chemically synthesized
tcttcccggggcgagaccac

SEQ ID NO: 46675 - DNA, 20 bp, Artificial Sequence
  chemically synthesized
cgagaccactagctttttct

SEQ ID NO: 46676 - DNA, 20 bp, Artificial Sequence
  chemically synthesized
tagctttttctaagtattac

SEQ ID NO: 46677 - DNA, 20 bp, Artificial Sequence
  chemically synthesized
ttttctaagtattaccagcc

SEQ ID NO: 46678 - DNA, 20 bp, Artificial Sequence
  chemically synthesized
tttctaagtattaccagccc

SEQ ID NO: 46679 - DNA, 20 bp, Artificial Sequence
  chemically synthesized
agtattaccagcccaggact

SEQ ID NO: 46680 - DNA, 20 bp, Artificial Sequence
  chemically synthesized
taccagcccaggacttggct

SEQ ID NO: 46681 - DNA, 20 bp, Artificial Sequence
  chemically synthesized
accagcccaggacttggctg

SEQ ID NO: 46682 - DNA, 20 bp, Artificial Sequence
  chemically synthesized
ggctgaggttctgtgtcccc

SEQ ID NO: 46683 - DNA, 20 bp, Artificial Sequence
  chemically synthesized
aggttctgtgtcccccagct

SEQ ID NO: 46684 - DNA, 20 bp, Artificial Sequence
  chemically synthesized
gttctgtgtcccccagcttg

SEQ ID NO: 46685 - DNA, 20 bp, Artificial Sequence
  chemically synthesized
tgtgtcccccagcttggagt

SEQ ID NO: 46686 - DNA, 20 bp, Artificial Sequence
  chemically synthesized
ccccagcttggagtcagatg

SEQ ID NO: 46687 - DNA, 20 bp, Artificial Sequence
  chemically synthesized
cccagcttggagtcagatgt

SEQ ID NO: 46688 - DNA, 20 bp, Artificial Sequence
  chemically synthesized
ccagcttggagtcagatgtg

SEQ ID NO: 46689 - DNA, 20 bp, Artificial Sequence
  chemically synthesized
tcagatgtggggttgaatct

SEQ ID NO: 46690 - DNA, 20 bp, Artificial Sequence
  chemically synthesized
gaatcttggcttcctctcac

SEQ ID NO: 46691 - DNA, 20 bp, Artificial Sequence
  chemically synthesized
tggcttcctctcactagctg

SEQ ID NO: 46692 - DNA, 20 bp, Artificial Sequence
  chemically synthesized
cactagctgtggtgcttgac

SEQ ID NO: 46693 - DNA, 20 bp, Artificial Sequence
  chemically synthesized
ttgacaagtcacttatcctt

SEQ ID NO: 46694 - DNA, 20 bp, Artificial Sequence
  chemically synthesized
ctccattgcctaatctttaa

SEQ ID NO: 46695 - DNA, 20 bp, Artificial Sequence
  chemically synthesized
tccattgcctaatctttaaa

SEQ ID NO: 46696 - DNA, 20 bp, Artificial Sequence
  chemically synthesized
ccattgcctaatctttaaaa

SEQ ID NO: 46697 - DNA, 20 bp, Artificial Sequence
  chemically synthesized
attgcctaatctttaaaagg

SEQ ID NO: 46698 - DNA, 20 bp, Artificial Sequence
  chemically synthesized
ttgcctaatctttaaaaggg

SEQ ID NO: 46699 - DNA, 20 bp, Artificial Sequence
  chemically synthesized
ggaggtgacaatcgtcccta

SEQ ID NO: 46700 - DNA, 20 bp, Artificial Sequence
  chemically synthesized
tgacaatcgtccctacggct

SEQ ID NO: 46701 - DNA, 20 bp, Artificial Sequence
  chemically synthesized
caatcgtccctacggctcag

SEQ ID NO: 46702 - DNA, 20 bp, Artificial Sequence
  chemically synthesized
tcgtccctacggctcagtgg

SEQ ID NO: 46703 - DNA, 20 bp, Artificial Sequence
  chemically synthesized
tccctacggctcagtggcag

SEQ ID NO: 46704 - DNA, 20 bp, Artificial Sequence
  chemically synthesized
tacggctcagtggcagcaga

SEQ ID NO: 46705 - DNA, 20 bp, Artificial Sequence
  chemically synthesized
acggctcagtggcagcagat

SEQ ID NO: 46706 - DNA, 20 bp, Artificial Sequence
  chemically synthesized
cggctcagtggcagcagatg

SEQ ID NO: 46707 - DNA, 20 bp, Artificial Sequence
  chemically synthesized
gctcagtggcagcagatggg

SEQ ID NO: 46708 - DNA, 20 bp, Artificial Sequence
  chemically synthesized
tggcagcagatggggagatg

SEQ ID NO: 46709 - DNA, 20 bp, Artificial Sequence
  chemically synthesized
ggcagcagatggggagatga

SEQ ID NO: 46710 - DNA, 20 bp, Artificial Sequence
  chemically synthesized
gcagcagatggggagatgaa

SEQ ID NO: 46711 - DNA, 20 bp, Artificial Sequence
  chemically synthesized
cagatggggagatgaaggga

SEQ ID NO: 46712 - DNA, 20 bp, Artificial Sequence
  chemically synthesized
gggaaagttctgttgaccat

SEQ ID NO: 46713 - DNA, 20 bp, Artificial Sequence
  chemically synthesized
catgagtgaacttacaatgc

SEQ ID NO: 46714 - DNA, 20 bp, Artificial Sequence
  chemically synthesized
tgaacttacaatgcaagccc

SEQ ID NO: 46715 - DNA, 20 bp, Artificial Sequence
  chemically synthesized
gaacttacaatgcaagcccc

SEQ ID NO: 46716 - DNA, 20 bp, Artificial Sequence
  chemically synthesized
aacttacaatgcaagccccg

SEQ ID NO: 46717 - DNA, 20 bp, Artificial Sequence
  chemically synthesized
acttacaatgcaagccccgg

SEQ ID NO: 46718 - DNA, 20 bp, Artificial Sequence
  chemically synthesized
cttacaatgcaagccccggg

SEQ ID NO: 46719 - DNA, 20 bp, Artificial Sequence
  chemically synthesized
agccccggggggatcacttg

SEQ ID NO: 46720 - DNA, 20 bp, Artificial Sequence
  chemically synthesized
tgcagttttgtccctgtctg

SEQ ID NO: 46721 - DNA, 20 bp, Artificial Sequence
  chemically synthesized
ctgtctgcagtgtgacctgt

SEQ ID NO: 46722 - DNA, 20 bp, Artificial Sequence
  chemically synthesized
attgtctttgctccaaacca

SEQ ID NO: 46723 - DNA, 20 bp, Artificial Sequence
  chemically synthesized
ttgctccaaaccacagctcc

SEQ ID NO: 46724 - DNA, 20 bp, Artificial Sequence
  chemically synthesized
tgctccaaaccacagctcct

SEQ ID NO: 46725 - DNA, 20 bp, Artificial Sequence
  chemically synthesized
gctccaaaccacagctcctg

SEQ ID NO: 46726 - DNA, 20 bp, Artificial Sequence
  chemically synthesized
ccaaaccacagctcctgggg

SEQ ID NO: 46727 - DNA, 20 bp, Artificial Sequence
  chemically synthesized
aaaccacagctcctggggca

SEQ ID NO: 46728 - DNA, 20 bp, Artificial Sequence
  chemically synthesized
aaccacagctcctggggcag

SEQ ID NO: 46729 - DNA, 20 bp, Artificial Sequence
  chemically synthesized
accacagctcctggggcaga

SEQ ID NO: 46730 - DNA, 20 bp, Artificial Sequence
  chemically synthesized
ccacagctcctggggcagag

SEQ ID NO: 46731 - DNA, 20 bp, Artificial Sequence
  chemically synthesized
ggggaaaattctgccactca

SEQ ID NO: 46732 - DNA, 20 bp, Artificial Sequence
  chemically synthesized
gcctgcccacgcttctgtct

SEQ ID NO: 46733 - DNA, 20 bp, Artificial Sequence
  chemically synthesized
acgcttctgtctgagtgtgc

SEQ ID NO: 46734 - DNA, 20 bp, Artificial Sequence
  chemically synthesized
cgcttctgtctgagtgtgct

SEQ ID NO: 46735 - DNA, 20 bp, Artificial Sequence
  chemically synthesized
ttctgtctgagtgtgctggg

SEQ ID NO: 46736 - DNA, 20 bp, Artificial Sequence
  chemically synthesized
tgtctgagtgtgctgggtgg

SEQ ID NO: 46737 - DNA, 20 bp, Artificial Sequence
  chemically synthesized
gtctgagtgtgctgggtggc

SEQ ID NO: 46738 - DNA, 20 bp, Artificial Sequence
  chemically synthesized
gagtgtgctgggtggcagga

SEQ ID NO: 46739 - DNA, 20 bp, Artificial Sequence
  chemically synthesized
gtgctgggtggcaggatggc

SEQ ID NO: 46740 - DNA, 20 bp, Artificial Sequence
  chemically synthesized
caggatggcaagtccttact

SEQ ID NO: 46741 - DNA, 20 bp, Artificial Sequence
  chemically synthesized
tggcaagtccttactcagct

SEQ ID NO: 46742 - DNA, 20 bp, Artificial Sequence
  chemically synthesized
agtccttactcagctcagta

SEQ ID NO: 46743 - DNA, 20 bp, Artificial Sequence
  chemically synthesized
agccctcttccttgttccct

SEQ ID NO: 46744 - DNA, 20 bp, Artificial Sequence
  chemically synthesized
cctgagcctttgactttctc

SEQ ID NO: 46745 - DNA, 20 bp, Artificial Sequence
  chemically synthesized
ctgagcctttgactttctcg

SEQ ID NO: 46746 - DNA, 20 bp, Artificial Sequence
  chemically synthesized
tgagcctttgactttctcga

SEQ ID NO: 46747 - DNA, 20 bp, Artificial Sequence
  chemically synthesized
gactttctcgagggatgttg

SEQ ID NO: 46748 - DNA, 20 bp, Artificial Sequence
  chemically synthesized
actttctcgagggatgttgt

SEQ ID NO: 46749 - DNA, 20 bp, Artificial Sequence
  chemically synthesized
ctttctcgagggatgttgtg

SEQ ID NO: 46750 - DNA, 20 bp, Artificial Sequence
  chemically synthesized
cgagggatgttgtggggttg

SEQ ID NO: 46751 - DNA, 20 bp, Artificial Sequence
  chemically synthesized
ggatgttgtggggttgtggc

SEQ ID NO: 46752 - DNA, 20 bp, Artificial Sequence
  chemically synthesized
gatgttgtggggttgtggcc

SEQ ID NO: 46753 - DNA, 20 bp, Artificial Sequence
  chemically synthesized
tgtggggttgtggccaggat

SEQ ID NO: 46754 - DNA, 20 bp, Artificial Sequence
  chemically synthesized
gggttgtggccaggataaga

SEQ ID NO: 46755 - DNA, 20 bp, Artificial Sequence
  chemically synthesized
ggttgtggccaggataagaa

SEQ ID NO: 46756 - DNA, 20 bp, Artificial Sequence
  chemically synthesized
gttgtggccaggataagaaa

SEQ ID NO: 46757 - DNA, 20 bp, Artificial Sequence
  chemically synthesized
aggataagaaagggcatttc

SEQ ID NO: 46758 - DNA, 20 bp, Artificial Sequence
  chemically synthesized
ctgctccaaaacaactgttc

SEQ ID NO: 46759 - DNA, 20 bp, Artificial Sequence
  chemically synthesized
caaaacaactgttctggaaa

SEQ ID NO: 46760 - DNA, 20 bp, Artificial Sequence
  chemically synthesized
acaactgttctggaaatagt

SEQ ID NO: 46761 - DNA, 20 bp, Artificial Sequence
  chemically synthesized
aatagtgagtaccccatcct

SEQ ID NO: 46762 - DNA, 20 bp, Artificial Sequence
  chemically synthesized
tagtgagtaccccatcctga

SEQ ID NO: 46763 - DNA, 20 bp, Artificial Sequence
  chemically synthesized
agtgagtaccccatcctgag

SEQ ID NO: 46764 - DNA, 20 bp, Artificial Sequence
  chemically synthesized
agtaccccatcctgagaggt

SEQ ID NO: 46765 - DNA, 20 bp, Artificial Sequence
  chemically synthesized
ccccatcctgagaggtgagt

SEQ ID NO: 46766 - DNA, 20 bp, Artificial Sequence
  chemically synthesized
catcctgagaggtgagtaag

SEQ ID NO: 46767 - DNA, 20 bp, Artificial Sequence
  chemically synthesized
tcctgagaggtgagtaagca

SEQ ID NO: 46768 - DNA, 20 bp, Artificial Sequence
  chemically synthesized
cctgagaggtgagtaagcag

SEQ ID NO: 46769 - DNA, 20 bp, Artificial Sequence
  chemically synthesized
gctgtatgaccacctgaacc

SEQ ID NO: 46770 - DNA, 20 bp, Artificial Sequence
  chemically synthesized
accacctgaaccaagccctt

SEQ ID NO: 46771 - DNA, 20 bp, Artificial Sequence
  chemically synthesized
ccacctgaaccaagcccttg

SEQ ID NO: 46772 - DNA, 20 bp, Artificial Sequence
  chemically synthesized
ccttgaggatgtttcttctc

SEQ ID NO: 46773 - DNA, 20 bp, Artificial Sequence
  chemically synthesized
tgaggatgtttcttctctgg

SEQ ID NO: 46774 - DNA, 20 bp, Artificial Sequence
  chemically synthesized
ggatgtttcttctctggtgg

SEQ ID NO: 46775 - DNA, 20 bp, Artificial Sequence
  chemically synthesized
tttcttctctggtggaagtt

SEQ ID NO: 46776 - DNA, 20 bp, Artificial Sequence
  chemically synthesized
tctctggtggaagtttggaa

SEQ ID NO: 46777 - DNA, 20 bp, Artificial Sequence
  chemically synthesized
ctctggtggaagtttggaac

SEQ ID NO: 46778 - DNA, 20 bp, Artificial Sequence
  chemically synthesized
ctggtggaagtttggaacag

SEQ ID NO: 46779 - DNA, 20 bp, Artificial Sequence
  chemically synthesized
tttggaacaggagcctcctc

SEQ ID NO: 46780 - DNA, 20 bp, Artificial Sequence
  chemically synthesized
tcatttattcattcattcaa

SEQ ID NO: 46781 - DNA, 20 bp, Artificial Sequence
  chemically synthesized
ttcattcaatggttattttg

SEQ ID NO: 46782 - DNA, 20 bp, Artificial Sequence
  chemically synthesized
tcattcaatggttattttgt

SEQ ID NO: 46783 - DNA, 20 bp, Artificial Sequence
  chemically synthesized
tattttgtgggaatcgaatt

SEQ ID NO: 46784 - DNA, 20 bp, Artificial Sequence
  chemically synthesized
tttagaatgaaaatattttt

SEQ ID NO: 46785 - DNA, 20 bp, Artificial Sequence
  chemically synthesized
gaatgaaaatattttttggc

SEQ ID NO: 46786 - DNA, 20 bp, Artificial Sequence
  chemically synthesized
tgaaaatattttttggcaag

SEQ ID NO: 46787 - DNA, 20 bp, Artificial Sequence
  chemically synthesized
ggcaagcagaaaataatttt

SEQ ID NO: 46788 - DNA, 20 bp, Artificial Sequence
  chemically synthesized
ttagaccaatccttttcttt

SEQ ID NO: 46789 - DNA, 20 bp, Artificial Sequence
  chemically synthesized
aatccttttcttttagtcat

SEQ ID NO: 46790 - DNA, 20 bp, Artificial Sequence
  chemically synthesized
tcttttagtcatgagaaact

SEQ ID NO: 46791 - DNA, 20 bp, Artificial Sequence
  chemically synthesized
cttttagtcatgagaaactg

SEQ ID NO: 46792 - DNA, 20 bp, Artificial Sequence
  chemically synthesized
agtcatgagaaactgaggcc

SEQ ID NO: 46793 - DNA, 20 bp, Artificial Sequence
  chemically synthesized
tcatgagaaactgaggccca

SEQ ID NO: 46794 - DNA, 20 bp, Artificial Sequence
  chemically synthesized
atgagaaactgaggcccaga

SEQ ID NO: 46795 - DNA, 20 bp, Artificial Sequence
  chemically synthesized
gagaaactgaggcccagaga

SEQ ID NO: 46796 - DNA, 20 bp, Artificial Sequence
  chemically synthesized
agaaactgaggcccagagag

SEQ ID NO: 46797 - DNA, 20 bp, Artificial Sequence
  chemically synthesized
aaactgaggcccagagagag

SEQ ID NO: 46798 - DNA, 20 bp, Artificial Sequence
  chemically synthesized
aactgaggcccagagagagg

SEQ ID NO: 46799 - DNA, 20 bp, Artificial Sequence
  chemically synthesized
ccagagagaggaggtcaccc

SEQ ID NO: 46800 - DNA, 20 bp, Artificial Sequence
  chemically synthesized
cagagagaggaggtcacccc

SEQ ID NO: 46801 - DNA, 20 bp, Artificial Sequence
  chemically synthesized
ggaggtcaccccaggtgcat

SEQ ID NO: 46802 - DNA, 20 bp, Artificial Sequence
  chemically synthesized
caccccaggtgcattagaac

SEQ ID NO: 46803 - DNA, 20 bp, Artificial Sequence
  chemically synthesized
accccaggtgcattagaact

SEQ ID NO: 46804 - DNA, 20 bp, Artificial Sequence
  chemically synthesized
gtgcattagaactgggtttc

SEQ ID NO: 46805 - DNA, 20 bp, Artificial Sequence
  chemically synthesized
agaactgacactccactgca

SEQ ID NO: 46806 - DNA, 20 bp, Artificial Sequence
  chemically synthesized
aactgacactccactgcaca

SEQ ID NO: 46807 - DNA, 20 bp, Artificial Sequence
  chemically synthesized
caattcattcaatttttatt

SEQ ID NO: 46808 - DNA, 20 bp, Artificial Sequence
  chemically synthesized
ttcattcaatttttatttag

SEQ ID NO: 46809 - DNA, 20 bp, Artificial Sequence
  chemically synthesized
attcaatttttatttagcgg

SEQ ID NO: 46810 - DNA, 20 bp, Artificial Sequence
  chemically synthesized
ttcaatttttatttagcgga

SEQ ID NO: 46811 - DNA, 20 bp, Artificial Sequence
  chemically synthesized
tatttagcggaaggcatttt

SEQ ID NO: 46812 - DNA, 20 bp, Artificial Sequence
  chemically synthesized
tagcggaaggcattttcaga

SEQ ID NO: 46813 - DNA, 20 bp, Artificial Sequence
  chemically synthesized
agcggaaggcattttcagat

SEQ ID NO: 46814 - DNA, 20 bp, Artificial Sequence
  chemically synthesized
cattttcagatgggtctttg

SEQ ID NO: 46815 - DNA, 20 bp, Artificial Sequence
  chemically synthesized
cagatgggtctttgaagcat

SEQ ID NO: 46816 - DNA, 20 bp, Artificial Sequence
  chemically synthesized
atgggtctttgaagcattag

SEQ ID NO: 46817 - DNA, 20 bp, Artificial Sequence
  chemically synthesized
tgggtctttgaagcattagt

SEQ ID NO: 46818 - DNA, 20 bp, Artificial Sequence
  chemically synthesized
ggtctttgaagcattagtag

SEQ ID NO: 46819 - DNA, 20 bp, Artificial Sequence
  chemically synthesized
ttgaagcattagtaggagtt

SEQ ID NO: 46820 - DNA, 20 bp, Artificial Sequence
  chemically synthesized
tagtaggagttcagcgatga

SEQ ID NO: 46821 - DNA, 20 bp, Artificial Sequence
  chemically synthesized
ttcagcgatgatggtgtcat

SEQ ID NO: 46822 - DNA, 20 bp, Artificial Sequence
  chemically synthesized
gtgtcatgagaattttattc

SEQ ID NO: 46823 - DNA, 20 bp, Artificial Sequence
  chemically synthesized
tgtcatgagaattttattct

SEQ ID NO: 46824 - DNA, 20 bp, Artificial Sequence
  chemically synthesized
tgagaattttattctaggat

SEQ ID NO: 46825 - DNA, 20 bp, Artificial Sequence
  chemically synthesized
gagaattttattctaggatt

SEQ ID NO: 46826 - DNA, 20 bp, Artificial Sequence
  chemically synthesized
gaattttattctaggattag

SEQ ID NO: 46827 - DNA, 20 bp, Artificial Sequence
  chemically synthesized
aattttattctaggattagg

SEQ ID NO: 46828 - DNA, 20 bp, Artificial Sequence
  chemically synthesized
attaggaggtaccatgaaca

SEQ ID NO: 46829 - DNA, 20 bp, Artificial Sequence
  chemically synthesized
aggtaccatgaacaaagata

SEQ ID NO: 46830 - DNA, 20 bp, Artificial Sequence
  chemically synthesized
gtaccatgaacaaagataca

SEQ ID NO: 46831 - DNA, 20 bp, Artificial Sequence
  chemically synthesized
catgaacaaagatacagagc

SEQ ID NO: 46832 - DNA, 20 bp, Artificial Sequence
  chemically synthesized
atgaacaaagatacagagct

SEQ ID NO: 46833 - DNA, 20 bp, Artificial Sequence
  chemically synthesized
agatacagagctgggaaaac

SEQ ID NO: 46834 - DNA, 20 bp, Artificial Sequence
  chemically synthesized
atacagagctgggaaaacca

SEQ ID NO: 46835 - DNA, 20 bp, Artificial Sequence
  chemically synthesized
tacagagctgggaaaaccag

SEQ ID NO: 46836 - DNA, 20 bp, Artificial Sequence
  chemically synthesized
agagctgggaaaaccagagg

SEQ ID NO: 46837 - DNA, 20 bp, Artificial Sequence
  chemically synthesized
gctgggaaaaccagaggtgg

SEQ ID NO: 46838 - DNA, 20 bp, Artificial Sequence
  chemically synthesized
gaaaaccagaggtggaagat

SEQ ID NO: 46839 - DNA, 20 bp, Artificial Sequence
  chemically synthesized
aaaaccagaggtggaagata

SEQ ID NO: 46840 - DNA, 20 bp, Artificial Sequence
  chemically synthesized
aaccagaggtggaagataag

SEQ ID NO: 46841 - DNA, 20 bp, Artificial Sequence
  chemically synthesized
agataaggagcacatgtcca

SEQ ID NO: 46842 - DNA, 20 bp, Artificial Sequence
  chemically synthesized
gttctttttctttttttttt

SEQ ID NO: 46843 - DNA, 20 bp, Artificial Sequence
  chemically synthesized
tttttcttttttttttgaga

SEQ ID NO: 46844 - DNA, 20 bp, Artificial Sequence
  chemically synthesized
tttcttttttttttgagatg

SEQ ID NO: 46845 - DNA, 20 bp, Artificial Sequence
  chemically synthesized
ggagtttcgctcttgttgcc

SEQ ID NO: 46846 - DNA, 20 bp, Artificial Sequence
  chemically synthesized
gagtttcgctcttgttgccc

SEQ ID NO: 46847 - DNA, 20 bp, Artificial Sequence
  chemically synthesized
ttcgctcttgttgcccaggc

SEQ ID NO: 46848 - DNA, 20 bp, Artificial Sequence
  chemically synthesized
cgctcttgttgcccaggctg

SEQ ID NO: 46849 - DNA, 20 bp, Artificial Sequence
  chemically synthesized
ttgcccaggctggagtgcaa

SEQ ID NO: 46850 - DNA, 20 bp, Artificial Sequence
  chemically synthesized
caggctggagtgcaatggtg

SEQ ID NO: 46851 - DNA, 20 bp, Artificial Sequence
  chemically synthesized
ggagtgcaatggtgcagtct

SEQ ID NO: 46852 - DNA, 20 bp, Artificial Sequence
  chemically synthesized
tcactgcaacatctgtctcc

SEQ ID NO: 46853 - DNA, 20 bp, Artificial Sequence
  chemically synthesized
cactgcaacatctgtctccc

SEQ ID NO: 46854 - DNA, 20 bp, Artificial Sequence
  chemically synthesized
aacatctgtctcccgggttc

SEQ ID NO: 46855 - DNA, 20 bp, Artificial Sequence
  chemically synthesized
atctgtctcccgggttcaag

SEQ ID NO: 46856 - DNA, 20 bp, Artificial Sequence
  chemically synthesized
ttcaagtggttctcctgcct

SEQ ID NO: 46857 - DNA, 20 bp, Artificial Sequence
  chemically synthesized
ttctcctgcctcagcctccc

SEQ ID NO: 46858 - DNA, 20 bp, Artificial Sequence
  chemically synthesized
tcctgcctcagcctcccaag

SEQ ID NO: 46859 - DNA, 20 bp, Artificial Sequence
  chemically synthesized
gcctcagcctcccaagaagc

SEQ ID NO: 46860 - DNA, 20 bp, Artificial Sequence
  chemically synthesized
cctcagcctcccaagaagct

SEQ ID NO: 46861 - DNA, 20 bp, Artificial Sequence
  chemically synthesized
ctcccaagaagctgggatta

SEQ ID NO: 46862 - DNA, 20 bp, Artificial Sequence
  chemically synthesized
tcccaagaagctgggattac

SEQ ID NO: 46863 - DNA, 20 bp, Artificial Sequence
  chemically synthesized
caggtacctgccaccacgcc

SEQ ID NO: 46864 - DNA, 20 bp, Artificial Sequence
  chemically synthesized
ccggctaatttttgtatttt

SEQ ID NO: 46865 - DNA, 20 bp, Artificial Sequence
  chemically synthesized
gctaatttttgtatttttag

SEQ ID NO: 46866 - DNA, 20 bp, Artificial Sequence
  chemically synthesized
taatttttgtatttttagta

SEQ ID NO: 46867 - DNA, 20 bp, Artificial Sequence
  chemically synthesized
tttttgtatttttagtagag

SEQ ID NO: 46868 - DNA, 20 bp, Artificial Sequence
  chemically synthesized
ttttgtatttttagtagaga

SEQ ID NO: 46869 - DNA, 20 bp, Artificial Sequence
  chemically synthesized
tttgtatttttagtagagaa

SEQ ID NO: 46870 - DNA, 20 bp, Artificial Sequence
  chemically synthesized
ttgtatttttagtagagaag

SEQ ID NO: 46871 - DNA, 20 bp, Artificial Sequence
  chemically synthesized
gagaaggggtttcaccacgt

SEQ ID NO: 46872 - DNA, 20 bp, Artificial Sequence
  chemically synthesized
aggggtttcaccacgttggc

SEQ ID NO: 46873 - DNA, 20 bp, Artificial Sequence
  chemically synthesized
ggggtttcaccacgttggcc

SEQ ID NO: 46874 - DNA, 20 bp, Artificial Sequence
  chemically synthesized
tttcaccacgttggccaggc

SEQ ID NO: 46875 - DNA, 20 bp, Artificial Sequence
  chemically synthesized
tcgcaaactcctgacctcct

SEQ ID NO: 46876 - DNA, 20 bp, Artificial Sequence
  chemically synthesized
caaactcctgacctcctcag

SEQ ID NO: 46877 - DNA, 20 bp, Artificial Sequence
  chemically synthesized
ctgacctcctcagtggatcc

SEQ ID NO: 46878 - DNA, 20 bp, Artificial Sequence
  chemically synthesized
tgacctcctcagtggatccg

SEQ ID NO: 46879 - DNA, 20 bp, Artificial Sequence
  chemically synthesized
acctcctcagtggatccgag

SEQ ID NO: 46880 - DNA, 20 bp, Artificial Sequence
  chemically synthesized
cctcctcagtggatccgagg

SEQ ID NO: 46881 - DNA, 20 bp, Artificial Sequence
  chemically synthesized
aggaggtgatcctcccgcct

SEQ ID NO: 46882 - DNA, 20 bp, Artificial Sequence
  chemically synthesized
cctcccgcctcagcctccca

SEQ ID NO: 46883 - DNA, 20 bp, Artificial Sequence
  chemically synthesized
ctcccaaagtgctcgaatta

SEQ ID NO: 46884 - DNA, 20 bp, Artificial Sequence
  chemically synthesized
tcccaaagtgctcgaattac

SEQ ID NO: 46885 - DNA, 20 bp, Artificial Sequence
  chemically synthesized
agtgctcgaattacaggtgt

SEQ ID NO: 46886 - DNA, 20 bp, Artificial Sequence
  chemically synthesized
caggtgtgagccaccacgcc

SEQ ID NO: 46887 - DNA, 20 bp, Artificial Sequence
  chemically synthesized
gccaccacgcctggcctcca

SEQ ID NO: 46888 - DNA, 20 bp, Artificial Sequence
  chemically synthesized
taaaatgttacgaaaaccaa

SEQ ID NO: 46889 - DNA, 20 bp, Artificial Sequence
  chemically synthesized
tttttttgtgatttatttga

SEQ ID NO: 46890 - DNA, 20 bp, Artificial Sequence
  chemically synthesized
ttttgtgatttatttgatgg

SEQ ID NO: 46891 - DNA, 20 bp, Artificial Sequence
  chemically synthesized
cacctgacgtgaactgacat

SEQ ID NO: 46892 - DNA, 20 bp, Artificial Sequence
  chemically synthesized
acatgagattatttttaatt

SEQ ID NO: 46893 - DNA, 20 bp, Artificial Sequence
  chemically synthesized
tattcatatattttgctgca

SEQ ID NO: 46894 - DNA, 20 bp, Artificial Sequence
  chemically synthesized
atattttgctgcatagatta

SEQ ID NO: 46895 - DNA, 20 bp, Artificial Sequence
  chemically synthesized
gctgcatagattacagtatg

SEQ ID NO: 46896 - DNA, 20 bp, Artificial Sequence
  chemically synthesized
tagattacagtatgcagctc

SEQ ID NO: 46897 - DNA, 20 bp, Artificial Sequence
  chemically synthesized
atgcagctccagattcttcc

SEQ ID NO: 46898 - DNA, 20 bp, Artificial Sequence
  chemically synthesized
cagctccagattcttccaag

SEQ ID NO: 46899 - DNA, 20 bp, Artificial Sequence
  chemically synthesized
tgcctttctaaaatccaaac

SEQ ID NO: 46900 - DNA, 20 bp, Artificial Sequence
  chemically synthesized
ctaaaatccaaacaagttct

SEQ ID NO: 46901 - DNA, 20 bp, Artificial Sequence
  chemically synthesized
taaaatccaaacaagttctg

SEQ ID NO: 46902 - DNA, 20 bp, Artificial Sequence
  chemically synthesized
tctgaggttcaaaaccgttt

SEQ ID NO: 46903 - DNA, 20 bp, Artificial Sequence
  chemically synthesized
ttcaaaaccgttttggccct

SEQ ID NO: 46904 - DNA, 20 bp, Artificial Sequence
  chemically synthesized
tcaaaaccgttttggcccta

SEQ ID NO: 46905 - DNA, 20 bp, Artificial Sequence
  chemically synthesized
ccgttttggccctaaggctt

SEQ ID NO: 46906 - DNA, 20 bp, Artificial Sequence
  chemically synthesized
cgttttggccctaaggcttt

SEQ ID NO: 46907 - DNA, 20 bp, Artificial Sequence
  chemically synthesized
tggccctaaggctttgggta

SEQ ID NO: 46908 - DNA, 20 bp, Artificial Sequence
  chemically synthesized
ggccctaaggctttgggtaa

SEQ ID NO: 46909 - DNA, 20 bp, Artificial Sequence
  chemically synthesized
gccctaaggctttgggtaaa

SEQ ID NO: 46910 - DNA, 20 bp, Artificial Sequence
  chemically synthesized
ccctaaggctttgggtaaag

SEQ ID NO: 46911 - DNA, 20 bp, Artificial Sequence
  chemically synthesized
cctaaggctttgggtaaagg

SEQ ID NO: 46912 - DNA, 20 bp, Artificial Sequence
  chemically synthesized
aaggctttgggtaaaggggg

SEQ ID NO: 46913 - DNA, 20 bp, Artificial Sequence
  chemically synthesized
ggactctgttctactctgac

SEQ ID NO: 46914 - DNA, 20 bp, Artificial Sequence
  chemically synthesized
actctgttctactctgactg

SEQ ID NO: 46915 - DNA, 20 bp, Artificial Sequence
  chemically synthesized
ttctactctgactggagtcc

SEQ ID NO: 46916 - DNA, 20 bp, Artificial Sequence
  chemically synthesized
gagtccaagatgcatatata

SEQ ID NO: 46917 - DNA, 20 bp, Artificial Sequence
  chemically synthesized
gtccaagatgcatatataca

SEQ ID NO: 46918 - DNA, 20 bp, Artificial Sequence
  chemically synthesized
gatgcatatatacagagata

SEQ ID NO: 46919 - DNA, 20 bp, Artificial Sequence
  chemically synthesized
atgcatatatacagagatat

SEQ ID NO: 46920 - DNA, 20 bp, Artificial Sequence
  chemically synthesized
atatacagagatatgggtga

SEQ ID NO: 46921 - DNA, 20 bp, Artificial Sequence
  chemically synthesized
tatacagagatatgggtgat

SEQ ID NO: 46922 - DNA, 20 bp, Artificial Sequence
  chemically synthesized
atacagagatatgggtgatg

SEQ ID NO: 46923 - DNA, 20 bp, Artificial Sequence
  chemically synthesized
gatatgggtgatggggctgc

SEQ ID NO: 46924 - DNA, 20 bp, Artificial Sequence
  chemically synthesized
atatgggtgatggggctgca

SEQ ID NO: 46925 - DNA, 20 bp, Artificial Sequence
  chemically synthesized
tgggtgatggggctgcaagg

SEQ ID NO: 46926 - DNA, 20 bp, Artificial Sequence
  chemically synthesized
gggtgatggggctgcaaggt

SEQ ID NO: 46927 - DNA, 20 bp, Artificial Sequence
  chemically synthesized
atggggctgcaaggtaggtt

SEQ ID NO: 46928 - DNA, 20 bp, Artificial Sequence
  chemically synthesized
tggggctgcaaggtaggttg

SEQ ID NO: 46929 - DNA, 20 bp, Artificial Sequence
  chemically synthesized
ggctgcaaggtaggttgagg

SEQ ID NO: 46930 - DNA, 20 bp, Artificial Sequence
  chemically synthesized
gctgcaaggtaggttgaggt

SEQ ID NO: 46931 - DNA, 20 bp, Artificial Sequence
  chemically synthesized
ctgcaaggtaggttgaggta

SEQ ID NO: 46932 - DNA, 20 bp, Artificial Sequence
  chemically synthesized
tgcaaggtaggttgaggtag

SEQ ID NO: 46933 - DNA, 20 bp, Artificial Sequence
  chemically synthesized
ggtaggttgaggtaggggcc

SEQ ID NO: 46934 - DNA, 20 bp, Artificial Sequence
  chemically synthesized
gtaggttgaggtaggggcca

SEQ ID NO: 46935 - DNA, 20 bp, Artificial Sequence
  chemically synthesized
aggttgaggtaggggccaag

SEQ ID NO: 46936 - DNA, 20 bp, Artificial Sequence
  chemically synthesized
ggttgaggtaggggccaagg

SEQ ID NO: 46937 - DNA, 20 bp, Artificial Sequence
  chemically synthesized
ttgaggtaggggccaaggag

SEQ ID NO: 46938 - DNA, 20 bp, Artificial Sequence
  chemically synthesized
gtaggggccaaggaggagca

SEQ ID NO: 46939 - DNA, 20 bp, Artificial Sequence
  chemically synthesized
aggggccaaggaggagcatg

SEQ ID NO: 46940 - DNA, 20 bp, Artificial Sequence
  chemically synthesized
ccaaggaggagcatggagtt

SEQ ID NO: 46941 - DNA, 20 bp, Artificial Sequence
  chemically synthesized
ggagtttggacttgattcat

SEQ ID NO: 46942 - DNA, 20 bp, Artificial Sequence
  chemically synthesized
gagtttggacttgattcatg

SEQ ID NO: 46943 - DNA, 20 bp, Artificial Sequence
  chemically synthesized
ggacttgattcatgaggctg

SEQ ID NO: 46944 - DNA, 20 bp, Artificial Sequence
  chemically synthesized
gacttgattcatgaggctgt

SEQ ID NO: 46945 - DNA, 20 bp, Artificial Sequence
  chemically synthesized
acttgattcatgaggctgtg

SEQ ID NO: 46946 - DNA, 20 bp, Artificial Sequence
  chemically synthesized
ttgattcatgaggctgtggg

SEQ ID NO: 46947 - DNA, 20 bp, Artificial Sequence
  chemically synthesized
ttcatgaggctgtggggagc

SEQ ID NO: 46948 - DNA, 20 bp, Artificial Sequence
  chemically synthesized
gaggctgtggggagccagtg

SEQ ID NO: 46949 - DNA, 20 bp, Artificial Sequence
  chemically synthesized
aggctgtggggagccagtga

SEQ ID NO: 46950 - DNA, 20 bp, Artificial Sequence
  chemically synthesized
gggagccagtgaaggttctt

SEQ ID NO: 46951 - DNA, 20 bp, Artificial Sequence
  chemically synthesized
agccagtgaaggttcttaag

SEQ ID NO: 46952 - DNA, 20 bp, Artificial Sequence
  chemically synthesized
gccagtgaaggttcttaagc

SEQ ID NO: 46953 - DNA, 20 bp, Artificial Sequence
  chemically synthesized
ttaagcaggtatgtctgcct

SEQ ID NO: 46954 - DNA, 20 bp, Artificial Sequence
  chemically synthesized
aagcaggtatgtctgcctga

SEQ ID NO: 46955 - DNA, 20 bp, Artificial Sequence
  chemically synthesized
caggtatgtctgcctgagag

SEQ ID NO: 46956 - DNA, 20 bp, Artificial Sequence
  chemically synthesized
tatgtctgcctgagagcagt

SEQ ID NO: 46957 - DNA, 20 bp, Artificial Sequence
  chemically synthesized
tgtctgcctgagagcagttg

SEQ ID NO: 46958 - DNA, 20 bp, Artificial Sequence
  chemically synthesized
ctgcctgagagcagttggag

SEQ ID NO: 46959 - DNA, 20 bp, Artificial Sequence
  chemically synthesized
tgagagcagttggagcagac

SEQ ID NO: 46960 - DNA, 20 bp, Artificial Sequence
  chemically synthesized
agagcagttggagcagacaa

SEQ ID NO: 46961 - DNA, 20 bp, Artificial Sequence
  chemically synthesized
aaaaaccaaacaaatcacca

SEQ ID NO: 46962 - DNA, 20 bp, Artificial Sequence
  chemically synthesized
accaaacaaatcaccataga

SEQ ID NO: 46963 - DNA, 20 bp, Artificial Sequence
  chemically synthesized
aaacaaatcaccatagatag

SEQ ID NO: 46964 - DNA, 20 bp, Artificial Sequence
  chemically synthesized
tgtcccctccaaatctcatg

SEQ ID NO: 46965 - DNA, 20 bp, Artificial Sequence
  chemically synthesized
ccaaatctcatgtggaaatt

SEQ ID NO: 46966 - DNA, 20 bp, Artificial Sequence
  chemically synthesized
tcatgtggaaatttggtcct

SEQ ID NO: 46967 - DNA, 20 bp, Artificial Sequence
  chemically synthesized
ggaaatttggtcctcagtgt

SEQ ID NO: 46968 - DNA, 20 bp, Artificial Sequence
  chemically synthesized
aatttggtcctcagtgttgg

SEQ ID NO: 46969 - DNA, 20 bp, Artificial Sequence
  chemically synthesized
ttggtcctcagtgttggaag

SEQ ID NO: 46970 - DNA, 20 bp, Artificial Sequence
  chemically synthesized
tggtcctcagtgttggaagt

SEQ ID NO: 46971 - DNA, 20 bp, Artificial Sequence
  chemically synthesized
ggtcctcagtgttggaagtg

SEQ ID NO: 46972 - DNA, 20 bp, Artificial Sequence
  chemically synthesized
gtgttggaagtggggcctaa

SEQ ID NO: 46973 - DNA, 20 bp, Artificial Sequence
  chemically synthesized
tgttggaagtggggcctaat

SEQ ID NO: 46974 - DNA, 20 bp, Artificial Sequence
  chemically synthesized
ttggaagtggggcctaatgg

SEQ ID NO: 46975 - DNA, 20 bp, Artificial Sequence
  chemically synthesized
tggaagtggggcctaatggg

SEQ ID NO: 46976 - DNA, 20 bp, Artificial Sequence
  chemically synthesized
ggggcctaatgggaggtgtt

SEQ ID NO: 46977 - DNA, 20 bp, Artificial Sequence
  chemically synthesized
gggcctaatgggaggtgttt

SEQ ID NO: 46978 - DNA, 20 bp, Artificial Sequence
  chemically synthesized
aatgggaggtgtttgggtca

SEQ ID NO: 46979 - DNA, 20 bp, Artificial Sequence
  chemically synthesized
atgggaggtgtttgggtcat

SEQ ID NO: 46980 - DNA, 20 bp, Artificial Sequence
  chemically synthesized
tgggaggtgtttgggtcatg

SEQ ID NO: 46981 - DNA, 20 bp, Artificial Sequence
  chemically synthesized
gggaggtgtttgggtcatgg

SEQ ID NO: 46982 - DNA, 20 bp, Artificial Sequence
  chemically synthesized
gaggtgtttgggtcatgggg

SEQ ID NO: 46983 - DNA, 20 bp, Artificial Sequence
  chemically synthesized
aggtgtttgggtcatggggg

SEQ ID NO: 46984 - DNA, 20 bp, Artificial Sequence
  chemically synthesized
tgggggaggaacccctgtga

SEQ ID NO: 46985 - DNA, 20 bp, Artificial Sequence
  chemically synthesized
gggggaggaacccctgtgaa

SEQ ID NO: 46986 - DNA, 20 bp, Artificial Sequence
  chemically synthesized
aggaacccctgtgaaaggct

SEQ ID NO: 46987 - DNA, 20 bp, Artificial Sequence
  chemically synthesized
ggtgccgtccttgtgataat

SEQ ID NO: 46988 - DNA, 20 bp, Artificial Sequence
  chemically synthesized
ccgtccttgtgataatgagt

SEQ ID NO: 46989 - DNA, 20 bp, Artificial Sequence
  chemically synthesized
tcccgctatgatttcccttg

SEQ ID NO: 46990 - DNA, 20 bp, Artificial Sequence
  chemically synthesized
cccgctatgatttcccttga

SEQ ID NO: 46991 - DNA, 20 bp, Artificial Sequence
  chemically synthesized
cttgaaggctgattattaaa

SEQ ID NO: 46992 - DNA, 20 bp, Artificial Sequence
  chemically synthesized
tgaaggctgattattaaaaa

SEQ ID NO: 46993 - DNA, 20 bp, Artificial Sequence
  chemically synthesized
gctgattattaaaaagagct

SEQ ID NO: 46994 - DNA, 20 bp, Artificial Sequence
  chemically synthesized
gtgattgatctctgcacatg

SEQ ID NO: 46995 - DNA, 20 bp, Artificial Sequence
  chemically synthesized
tgattgatctctgcacatgt

SEQ ID NO: 46996 - DNA, 20 bp, Artificial Sequence
  chemically synthesized
tccccttcaccttctgccat

SEQ ID NO: 46997 - DNA, 20 bp, Artificial Sequence
  chemically synthesized
tcaccttctgccatcagtga

SEQ ID NO: 46998 - DNA, 20 bp, Artificial Sequence
  chemically synthesized
ccttctgccatcagtgaaag

SEQ ID NO: 46999 - DNA, 20 bp, Artificial Sequence
  chemically synthesized
gccatcagtgaaagcagctt

SEQ ID NO: 47000 - DNA, 20 bp, Artificial Sequence
  chemically synthesized
ccatcagtgaaagcagctta

SEQ ID NO: 47001 - DNA, 20 bp, Artificial Sequence
  chemically synthesized
aagcagcttaaggccctcac

SEQ ID NO: 47002 - DNA, 20 bp, Artificial Sequence
  chemically synthesized
cagcttaaggccctcaccag

SEQ ID NO: 47003 - DNA, 20 bp, Artificial Sequence
  chemically synthesized
cttaaggccctcaccagaag

SEQ ID NO: 47004 - DNA, 20 bp, Artificial Sequence
  chemically synthesized
ccctcaccagaagcagatgc

SEQ ID NO: 47005 - DNA, 20 bp, Artificial Sequence
  chemically synthesized
gatgctggtgccatgcttcc

SEQ ID NO: 47006 - DNA, 20 bp, Artificial Sequence
  chemically synthesized
tgctggtgccatgcttcctg

SEQ ID NO: 47007 - DNA, 20 bp, Artificial Sequence
  chemically synthesized
ctggtgccatgcttcctgga

SEQ ID NO: 47008 - DNA, 20 bp, Artificial Sequence
  chemically synthesized
catgcttcctggagagcttg

SEQ ID NO: 47009 - DNA, 20 bp, Artificial Sequence
  chemically synthesized
tggagagcttgcagaatcat

SEQ ID NO: 47010 - DNA, 20 bp, Artificial Sequence
  chemically synthesized
ccttgtaaattactcacctt

SEQ ID NO: 47011 - DNA, 20 bp, Artificial Sequence
  chemically synthesized
cttgtaaattactcaccttc

SEQ ID NO: 47012 - DNA, 20 bp, Artificial Sequence
  chemically synthesized
ccttcaggtattcctttata

SEQ ID NO: 47013 - DNA, 20 bp, Artificial Sequence
  chemically synthesized
tcctttatatagcaacacaa

SEQ ID NO: 47014 - DNA, 20 bp, Artificial Sequence
  chemically synthesized
cctttatatagcaacacaaa

SEQ ID NO: 47015 - DNA, 20 bp, Artificial Sequence
  chemically synthesized
tatagcaacacaaaaggact

SEQ ID NO: 47016 - DNA, 20 bp, Artificial Sequence
  chemically synthesized
gcaacacaaaaggactaaga

SEQ ID NO: 47017 - DNA, 20 bp, Artificial Sequence
  chemically synthesized
acacaaaaggactaagacag

SEQ ID NO: 47018 - DNA, 20 bp, Artificial Sequence
  chemically synthesized
cttgacttttctctctcttt

SEQ ID NO: 47019 - DNA, 20 bp, Artificial Sequence
  chemically synthesized
gacttttctctctctttaag

SEQ ID NO: 47020 - DNA, 20 bp, Artificial Sequence
  chemically synthesized
aagtgttgcctttgctcact

SEQ ID NO: 47021 - DNA, 20 bp, Artificial Sequence
  chemically synthesized
atcccttctgcctgcatttg

SEQ ID NO: 47022 - DNA, 20 bp, Artificial Sequence
  chemically synthesized
cccttctgcctgcatttgta

SEQ ID NO: 47023 - DNA, 20 bp, Artificial Sequence
  chemically synthesized
gcctgcatttgtagagcatc

SEQ ID NO: 47024 - DNA, 20 bp, Artificial Sequence
  chemically synthesized
gcatttgtagagcatctgga

SEQ ID NO: 47025 - DNA, 20 bp, Artificial Sequence
  chemically synthesized
catttgtagagcatctggat

SEQ ID NO: 47026 - DNA, 20 bp, Artificial Sequence
  chemically synthesized
tttgtagagcatctggatgg

SEQ ID NO: 47027 - DNA, 20 bp, Artificial Sequence
  chemically synthesized
accgtcactcttgactttcc

SEQ ID NO: 47028 - DNA, 20 bp, Artificial Sequence
  chemically synthesized
gtcactcttgactttcccag

SEQ ID NO: 47029 - DNA, 20 bp, Artificial Sequence
  chemically synthesized
tcactcttgactttcccagc

SEQ ID NO: 47030 - DNA, 20 bp, Artificial Sequence
  chemically synthesized
ttcccagcaggcctatgtca

SEQ ID NO: 47031 - DNA, 20 bp, Artificial Sequence
  chemically synthesized
tcccagcaggcctatgtcat

SEQ ID NO: 47032 - DNA, 20 bp, Artificial Sequence
  chemically synthesized
ggcctatgtcataggtactg

SEQ ID NO: 47033 - DNA, 20 bp, Artificial Sequence
  chemically synthesized
gtactgtggtctctacaata

SEQ ID NO: 47034 - DNA, 20 bp, Artificial Sequence
  chemically synthesized
ctgtggtctctacaatacag

SEQ ID NO: 47035 - DNA, 20 bp, Artificial Sequence
  chemically synthesized
gtggtctctacaatacagca

SEQ ID NO: 47036 - DNA, 20 bp, Artificial Sequence
  chemically synthesized
tggtctctacaatacagcag

SEQ ID NO: 47037 - DNA, 20 bp, Artificial Sequence
  chemically synthesized
acaatacagcagaggtatct

SEQ ID NO: 47038 - DNA, 20 bp, Artificial Sequence
  chemically synthesized
caatacagcagaggtatctg

SEQ ID NO: 47039 - DNA, 20 bp, Artificial Sequence
  chemically synthesized
gcagaggtatctgaggctcc

SEQ ID NO: 47040 - DNA, 20 bp, Artificial Sequence
  chemically synthesized
agaggtatctgaggctccga

SEQ ID NO: 47041 - DNA, 20 bp, Artificial Sequence
  chemically synthesized
gaggtatctgaggctccgag

SEQ ID NO: 47042 - DNA, 20 bp, Artificial Sequence
  chemically synthesized
atctgaggctccgagaggtt

SEQ ID NO: 47043 - DNA, 20 bp, Artificial Sequence
  chemically synthesized
gaggttgagtgacttgctca

SEQ ID NO: 47044 - DNA, 20 bp, Artificial Sequence
  chemically synthesized
cttgctcatggctgcacaac

SEQ ID NO: 47045 - DNA, 20 bp, Artificial Sequence
  chemically synthesized
gctgcacaaccagtaaatat

SEQ ID NO: 47046 - DNA, 20 bp, Artificial Sequence
  chemically synthesized
tgcacaaccagtaaatattg

SEQ ID NO: 47047 - DNA, 20 bp, Artificial Sequence
  chemically synthesized
caaccagtaaatattggagc

SEQ ID NO: 47048 - DNA, 20 bp, Artificial Sequence
  chemically synthesized
taaatattggagctggaatt

SEQ ID NO: 47049 - DNA, 20 bp, Artificial Sequence
  chemically synthesized
aaatattggagctggaattc

SEQ ID NO: 47050 - DNA, 20 bp, Artificial Sequence
  chemically synthesized
ggagctggaattcaggtcca

SEQ ID NO: 47051 - DNA, 20 bp, Artificial Sequence
  chemically synthesized
aattcaggtccacggtttcc

SEQ ID NO: 47052 - DNA, 20 bp, Artificial Sequence
  chemically synthesized
tccacggtttcctggctcca

SEQ ID NO: 47053 - DNA, 20 bp, Artificial Sequence
  chemically synthesized
ttccctcaatttattctgac

SEQ ID NO: 47054 - DNA, 20 bp, Artificial Sequence
  chemically synthesized
tccctcaatttattctgact

SEQ ID NO: 47055 - DNA, 20 bp, Artificial Sequence
  chemically synthesized
ccctcaatttattctgactg

SEQ ID NO: 47056 - DNA, 20 bp, Artificial Sequence
  chemically synthesized
aatttattctgactggggca

SEQ ID NO: 47057 - DNA, 20 bp, Artificial Sequence
  chemically synthesized
atttattctgactggggcat

SEQ ID NO: 47058 - DNA, 20 bp, Artificial Sequence
  chemically synthesized
tttattctgactggggcatg

SEQ ID NO: 47059 - DNA, 20 bp, Artificial Sequence
  chemically synthesized
ttattctgactggggcatgg

SEQ ID NO: 47060 - DNA, 20 bp, Artificial Sequence
  chemically synthesized
attctgactggggcatgggg

SEQ ID NO: 47061 - DNA, 20 bp, Artificial Sequence
  chemically synthesized
ttctgactggggcatggggg

SEQ ID NO: 47062 - DNA, 20 bp, Artificial Sequence
  chemically synthesized
tctgactggggcatggggga

SEQ ID NO: 47063 - DNA, 20 bp, Artificial Sequence
  chemically synthesized
ctgactggggcatgggggag

SEQ ID NO: 47064 - DNA, 20 bp, Artificial Sequence
  chemically synthesized
tgactggggcatgggggagg

SEQ ID NO: 47065 - DNA, 20 bp, Artificial Sequence
  chemically synthesized
ctggggcatgggggaggggg

SEQ ID NO: 47066 - DNA, 20 bp, Artificial Sequence
  chemically synthesized
atgggggagggggtggcctt

SEQ ID NO: 47067 - DNA, 20 bp, Artificial Sequence
  chemically synthesized
tgggggagggggtggccttt

SEQ ID NO: 47068 - DNA, 20 bp, Artificial Sequence
  chemically synthesized
gggagggggtggcctttggg

SEQ ID NO: 47069 - DNA, 20 bp, Artificial Sequence
  chemically synthesized
ggagggggtggcctttgggc

SEQ ID NO: 47070 - DNA, 20 bp, Artificial Sequence
  chemically synthesized
gagggggtggcctttgggca

SEQ ID NO: 47071 - DNA, 20 bp, Artificial Sequence
  chemically synthesized
tggcctttgggcagggccac

SEQ ID NO: 47072 - DNA, 20 bp, Artificial Sequence
  chemically synthesized
ggcctttgggcagggccacc

SEQ ID NO: 47073 - DNA, 20 bp, Artificial Sequence
  chemically synthesized
cctttgggcagggccaccag

SEQ ID NO: 47074 - DNA, 20 bp, Artificial Sequence
  chemically synthesized
gcagggccaccaggagcgac

SEQ ID NO: 47075 - DNA, 20 bp, Artificial Sequence
  chemically synthesized
cagggccaccaggagcgacc

SEQ ID NO: 47076 - DNA, 20 bp, Artificial Sequence
  chemically synthesized
accaggagcgaccaggcccg

SEQ ID NO: 47077 - DNA, 20 bp, Artificial Sequence
  chemically synthesized
caggagcgaccaggcccgta

SEQ ID NO: 47078 - DNA, 20 bp, Artificial Sequence
  chemically synthesized
ggagcgaccaggcccgtaga

SEQ ID NO: 47079 - DNA, 20 bp, Artificial Sequence
  chemically synthesized
cgaccaggcccgtagagagc

SEQ ID NO: 47080 - DNA, 20 bp, Artificial Sequence
  chemically synthesized
gaccaggcccgtagagagct

SEQ ID NO: 47081 - DNA, 20 bp, Artificial Sequence
  chemically synthesized
ggcccgtagagagctgggtg

SEQ ID NO: 47082 - DNA, 20 bp, Artificial Sequence
  chemically synthesized
gcccgtagagagctgggtgc

SEQ ID NO: 47083 - DNA, 20 bp, Artificial Sequence
  chemically synthesized
tagagagctgggtgcaggta

SEQ ID NO: 47084 - DNA, 20 bp, Artificial Sequence
  chemically synthesized
gagagctgggtgcaggtaca

SEQ ID NO: 47085 - DNA, 20 bp, Artificial Sequence
  chemically synthesized
agagctgggtgcaggtacag

SEQ ID NO: 47086 - DNA, 20 bp, Artificial Sequence
  chemically synthesized
acagaggaaaacctgttgtc

SEQ ID NO: 47087 - DNA, 20 bp, Artificial Sequence
  chemically synthesized
ggaaaacctgttgtcgagtg

SEQ ID NO: 47088 - DNA, 20 bp, Artificial Sequence
  chemically synthesized
ctgttgtcgagtgtggcccg

SEQ ID NO: 47089 - DNA, 20 bp, Artificial Sequence
  chemically synthesized
agttcccatttttgcctgaa

SEQ ID NO: 47090 - DNA, 20 bp, Artificial Sequence
  chemically synthesized
tgcctgaatggcacatttga

SEQ ID NO: 47091 - DNA, 20 bp, Artificial Sequence
  chemically synthesized
tataaccatgtgaataataa

SEQ ID NO: 47092 - DNA, 20 bp, Artificial Sequence
  chemically synthesized
accatgtgaataataatagt

SEQ ID NO: 47093 - DNA, 20 bp, Artificial Sequence
  chemically synthesized
taataatagttggcctatat

SEQ ID NO: 47094 - DNA, 20 bp, Artificial Sequence
  chemically synthesized
gagttctttaatttgctttt

SEQ ID NO: 47095 - DNA, 20 bp, Artificial Sequence
  chemically synthesized
tttgctttttggtccgcatt

SEQ ID NO: 47096 - DNA, 20 bp, Artificial Sequence
  chemically synthesized
tctcttttgttgtaatttgt

SEQ ID NO: 47097 - DNA, 20 bp, Artificial Sequence
  chemically synthesized
cttttgttgtaatttgtaag

SEQ ID NO: 47098 - DNA, 20 bp, Artificial Sequence
  chemically synthesized
ttttgttgtaatttgtaagt

SEQ ID NO: 47099 - DNA, 20 bp, Artificial Sequence
  chemically synthesized
tttgttgtaatttgtaagta

SEQ ID NO: 47100 - DNA, 20 bp, Artificial Sequence
  chemically synthesized
ttgttgtaatttgtaagtag

SEQ ID NO: 47101 - DNA, 20 bp, Artificial Sequence
  chemically synthesized
tgtaatttgtaagtaggggt

SEQ ID NO: 47102 - DNA, 20 bp, Artificial Sequence
  chemically synthesized
ttgtaagtaggggtgagata

SEQ ID NO: 47103 - DNA, 20 bp, Artificial Sequence
  chemically synthesized
ggggtgagataaagtacacc

SEQ ID NO: 47104 - DNA, 20 bp, Artificial Sequence
  chemically synthesized
gggtgagataaagtacacct

SEQ ID NO: 47105 - DNA, 20 bp, Artificial Sequence
  chemically synthesized
ggtgagataaagtacaccta

SEQ ID NO: 47106 - DNA, 20 bp, Artificial Sequence
  chemically synthesized
aaagtacacctagggtttgc

SEQ ID NO: 47107 - DNA, 20 bp, Artificial Sequence
  chemically synthesized
aagtacacctagggtttgct

SEQ ID NO: 47108 - DNA, 20 bp, Artificial Sequence
  chemically synthesized
tcatcatgttcctccttgca

SEQ ID NO: 47109 - DNA, 20 bp, Artificial Sequence
  chemically synthesized
catcatgttcctccttgcat

SEQ ID NO: 47110 - DNA, 20 bp, Artificial Sequence
  chemically synthesized
atcatgttcctccttgcatg

SEQ ID NO: 47111 - DNA, 20 bp, Artificial Sequence
  chemically synthesized
tgttcctccttgcatggggc

SEQ ID NO: 47112 - DNA, 20 bp, Artificial Sequence
  chemically synthesized
gttcctccttgcatggggcc

SEQ ID NO: 47113 - DNA, 20 bp, Artificial Sequence
  chemically synthesized
ttgcatggggccaggatccg

SEQ ID NO: 47114 - DNA, 20 bp, Artificial Sequence
  chemically synthesized
gcatggggccaggatccgtg

SEQ ID NO: 47115 - DNA, 20 bp, Artificial Sequence
  chemically synthesized
catggggccaggatccgtgg

SEQ ID NO: 47116 - DNA, 20 bp, Artificial Sequence
  chemically synthesized
caggatccgtggaggttgcc

SEQ ID NO: 47117 - DNA, 20 bp, Artificial Sequence
  chemically synthesized
gaggttgcctggcacctacg

SEQ ID NO: 47118 - DNA, 20 bp, Artificial Sequence
  chemically synthesized
gttgcctggcacctacgtgg

SEQ ID NO: 47119 - DNA, 20 bp, Artificial Sequence
  chemically synthesized
gcacctacgtggtggtgctg

SEQ ID NO: 47120 - DNA, 20 bp, Artificial Sequence
  chemically synthesized
cacctacgtggtggtgctga

SEQ ID NO: 47121 - DNA, 20 bp, Artificial Sequence
  chemically synthesized
cctacgtggtggtgctgaag

SEQ ID NO: 47122 - DNA, 20 bp, Artificial Sequence
  chemically synthesized
ctacgtggtggtgctgaagg

SEQ ID NO: 47123 - DNA, 20 bp, Artificial Sequence
  chemically synthesized
acgtggtggtgctgaaggag

SEQ ID NO: 47124 - DNA, 20 bp, Artificial Sequence
  chemically synthesized
aggaggagacccacctctcg

SEQ ID NO: 47125 - DNA, 20 bp, Artificial Sequence
  chemically synthesized
ggagacccacctctcgcagt

SEQ ID NO: 47126 - DNA, 20 bp, Artificial Sequence
  chemically synthesized
agacccacctctcgcagtca

SEQ ID NO: 47127 - DNA, 20 bp, Artificial Sequence
  chemically synthesized
agcgcactgcccgccgcctg

SEQ ID NO: 47128 - DNA, 20 bp, Artificial Sequence
  chemically synthesized
gcgcactgcccgccgcctgc

SEQ ID NO: 47129 - DNA, 20 bp, Artificial Sequence
  chemically synthesized
ctgcccgccgcctgcaggcc

SEQ ID NO: 47130 - DNA, 20 bp, Artificial Sequence
  chemically synthesized
tgcccgccgcctgcaggccc

SEQ ID NO: 47131 - DNA, 20 bp, Artificial Sequence
  chemically synthesized
tgcaggcccaggctgcccgc

SEQ ID NO: 47132 - DNA, 20 bp, Artificial Sequence
  chemically synthesized
gcaggcccaggctgcccgcc

SEQ ID NO: 47133 - DNA, 20 bp, Artificial Sequence
  chemically synthesized
caggcccaggctgcccgccg

SEQ ID NO: 47134 - DNA, 20 bp, Artificial Sequence
  chemically synthesized
cccgccggggatacctcacc

SEQ ID NO: 47135 - DNA, 20 bp, Artificial Sequence
  chemically synthesized
aagatcctgcatgtcttcca

SEQ ID NO: 47136 - DNA, 20 bp, Artificial Sequence
  chemically synthesized
gtcttccatggccttcttcc

SEQ ID NO: 47137 - DNA, 20 bp, Artificial Sequence
  chemically synthesized
tggccttcttcctggcttcc

SEQ ID NO: 47138 - DNA, 20 bp, Artificial Sequence
  chemically synthesized
ttcttcctggcttcctggtg

SEQ ID NO: 47139 - DNA, 20 bp, Artificial Sequence
  chemically synthesized
cctggcttcctggtgaagat

SEQ ID NO: 47140 - DNA, 20 bp, Artificial Sequence
  chemically synthesized
ggcttcctggtgaagatgag

SEQ ID NO: 47141 - DNA, 20 bp, Artificial Sequence
  chemically synthesized
gaagatgagtggcgacctgc

SEQ ID NO: 47142 - DNA, 20 bp, Artificial Sequence
  chemically synthesized
agatgagtggcgacctgctg

SEQ ID NO: 47143 - DNA, 20 bp, Artificial Sequence
  chemically synthesized
gagtggcgacctgctggagc

SEQ ID NO: 47144 - DNA, 20 bp, Artificial Sequence
  chemically synthesized
ggcgacctgctggagctggt

SEQ ID NO: 47145 - DNA, 20 bp, Artificial Sequence
  chemically synthesized
agctggtgagccaccctttt

SEQ ID NO: 47146 - DNA, 20 bp, Artificial Sequence
  chemically synthesized
gctggtgagccacccttttt

SEQ ID NO: 47147 - DNA, 20 bp, Artificial Sequence
  chemically synthesized
tgagccaccctttttgggaa

SEQ ID NO: 47148 - DNA, 20 bp, Artificial Sequence
  chemically synthesized
ttgggaatggcacttcctga

SEQ ID NO: 47149 - DNA, 20 bp, Artificial Sequence
  chemically synthesized
tgggaatggcacttcctgat

SEQ ID NO: 47150 - DNA, 20 bp, Artificial Sequence
  chemically synthesized
gggaatggcacttcctgata

SEQ ID NO: 47151 - DNA, 20 bp, Artificial Sequence
  chemically synthesized
atggcacttcctgatagggc

SEQ ID NO: 47152 - DNA, 20 bp, Artificial Sequence
  chemically synthesized
tggcacttcctgatagggct

SEQ ID NO: 47153 - DNA, 20 bp, Artificial Sequence
  chemically synthesized
ctgggccactgcatatacac

SEQ ID NO: 47154 - DNA, 20 bp, Artificial Sequence
  chemically synthesized
tgggccactgcatatacact

SEQ ID NO: 47155 - DNA, 20 bp, Artificial Sequence
  chemically synthesized
gggccactgcatatacactg

SEQ ID NO: 47156 - DNA, 20 bp, Artificial Sequence
  chemically synthesized
tatacactggggactgtgct

SEQ ID NO: 47157 - DNA, 20 bp, Artificial Sequence
  chemically synthesized
acactggggactgtgcttag

SEQ ID NO: 47158 - DNA, 20 bp, Artificial Sequence
  chemically synthesized
cactggggactgtgcttagt

SEQ ID NO: 47159 - DNA, 20 bp, Artificial Sequence
  chemically synthesized
gtaggcccattgctgaaaat

SEQ ID NO: 47160 - DNA, 20 bp, Artificial Sequence
  chemically synthesized
ggcccattgctgaaaatcag

SEQ ID NO: 47161 - DNA, 20 bp, Artificial Sequence
  chemically synthesized
gcccattgctgaaaatcaga

SEQ ID NO: 47162 - DNA, 20 bp, Artificial Sequence
  chemically synthesized
cccattgctgaaaatcagaa

SEQ ID NO: 47163 - DNA, 20 bp, Artificial Sequence
  chemically synthesized
ccattgctgaaaatcagaag

SEQ ID NO: 47164 - DNA, 20 bp, Artificial Sequence
  chemically synthesized
tgctgaaaatcagaagggga

SEQ ID NO: 47165 - DNA, 20 bp, Artificial Sequence
  chemically synthesized
gaaaatcagaaggggacagc

SEQ ID NO: 47166 - DNA, 20 bp, Artificial Sequence
  chemically synthesized
ggggacagcaagtatgtatt

SEQ ID NO: 47167 - DNA, 20 bp, Artificial Sequence
  chemically synthesized
agtatgtattgagcacttat

SEQ ID NO: 47168 - DNA, 20 bp, Artificial Sequence
  chemically synthesized
gtatgtattgagcacttatc

SEQ ID NO: 47169 - DNA, 20 bp, Artificial Sequence
  chemically synthesized
ttgagcacttatcgggtacc

SEQ ID NO: 47170 - DNA, 20 bp, Artificial Sequence
  chemically synthesized
cacttatcgggtaccaagca

SEQ ID NO: 47171 - DNA, 20 bp, Artificial Sequence
  chemically synthesized
gtaccaagcacagtaactac

SEQ ID NO: 47172 - DNA, 20 bp, Artificial Sequence
  chemically synthesized
gtaactactggctttctgta

SEQ ID NO: 47173 - DNA, 20 bp, Artificial Sequence
  chemically synthesized
ttctgtatagaattcccttt

SEQ ID NO: 47174 - DNA, 20 bp, Artificial Sequence
  chemically synthesized
tatagaattccctttaagcc

SEQ ID NO: 47175 - DNA, 20 bp, Artificial Sequence
  chemically synthesized
ctttaagcctggccatgccc

SEQ ID NO: 47176 - DNA, 20 bp, Artificial Sequence
  chemically synthesized
taagcctggccatgccccag

SEQ ID NO: 47177 - DNA, 20 bp, Artificial Sequence
  chemically synthesized
gtacgtctatcttcatttga

SEQ ID NO: 47178 - DNA, 20 bp, Artificial Sequence
  chemically synthesized
tctatcttcatttgaaagac

SEQ ID NO: 47179 - DNA, 20 bp, Artificial Sequence
  chemically synthesized
ctatcttcatttgaaagacg

SEQ ID NO: 47180 - DNA, 20 bp, Artificial Sequence
  chemically synthesized
atcttcatttgaaagacgag

SEQ ID NO: 47181 - DNA, 20 bp, Artificial Sequence
  chemically synthesized
tttgaaagacgaggagactg

SEQ ID NO: 47182 - DNA, 20 bp, Artificial Sequence
  chemically synthesized
aagacgaggagactgaagtt

SEQ ID NO: 47183 - DNA, 20 bp, Artificial Sequence
  chemically synthesized
gacgaggagactgaagttca

SEQ ID NO: 47184 - DNA, 20 bp, Artificial Sequence
  chemically synthesized
acgaggagactgaagttcag

SEQ ID NO: 47185 - DNA, 20 bp, Artificial Sequence
  chemically synthesized
cgaggagactgaagttcaga

SEQ ID NO: 47186 - DNA, 20 bp, Artificial Sequence
  chemically synthesized
gaggagactgaagttcagag

SEQ ID NO: 47187 - DNA, 20 bp, Artificial Sequence
  chemically synthesized
gaagttcagaggggaccaca

SEQ ID NO: 47188 - DNA, 20 bp, Artificial Sequence
  chemically synthesized
ttcagaggggaccacacaga

SEQ ID NO: 47189 - DNA, 20 bp, Artificial Sequence
  chemically synthesized
gaggggaccacacagacagc

SEQ ID NO: 47190 - DNA, 20 bp, Artificial Sequence
  chemically synthesized
aggggaccacacagacagct

SEQ ID NO: 47191 - DNA, 20 bp, Artificial Sequence
  chemically synthesized
ggggaccacacagacagcta

SEQ ID NO: 47192 - DNA, 20 bp, Artificial Sequence
  chemically synthesized
gggaccacacagacagctag

SEQ ID NO: 47193 - DNA, 20 bp, Artificial Sequence
  chemically synthesized
accacacagacagctagggg

SEQ ID NO: 47194 - DNA, 20 bp, Artificial Sequence
  chemically synthesized
cacacagacagctaggggta

SEQ ID NO: 47195 - DNA, 20 bp, Artificial Sequence
  chemically synthesized
agacagctaggggtagagcc

SEQ ID NO: 47196 - DNA, 20 bp, Artificial Sequence
  chemically synthesized
agagcctggatcaaacccat

SEQ ID NO: 47197 - DNA, 20 bp, Artificial Sequence
  chemically synthesized
aaacccattggtctgcctgc

SEQ ID NO: 47198 - DNA, 20 bp, Artificial Sequence
  chemically synthesized
gccaatgcatctgctgccta

SEQ ID NO: 47199 - DNA, 20 bp, Artificial Sequence
  chemically synthesized
ctgctgcctacggaaacctg

SEQ ID NO: 47200 - DNA, 20 bp, Artificial Sequence
  chemically synthesized
tgctgcctacggaaacctgt

SEQ ID NO: 47201 - DNA, 20 bp, Artificial Sequence
  chemically synthesized
gctgcctacggaaacctgta

SEQ ID NO: 47202 - DNA, 20 bp, Artificial Sequence
  chemically synthesized
ctacggaaacctgtagggac

SEQ ID NO: 47203 - DNA, 20 bp, Artificial Sequence
  chemically synthesized
tacggaaacctgtagggaca

SEQ ID NO: 47204 - DNA, 20 bp, Artificial Sequence
  chemically synthesized
aacctgtagggacaaggccc

SEQ ID NO: 47205 - DNA, 20 bp, Artificial Sequence
  chemically synthesized
acctgtagggacaaggccct

SEQ ID NO: 47206 - DNA, 20 bp, Artificial Sequence
  chemically synthesized
ggacaaggccctgggatgtt

SEQ ID NO: 47207 - DNA, 20 bp, Artificial Sequence
  chemically synthesized
caaggccctgggatgttcag

SEQ ID NO: 47208 - DNA, 20 bp, Artificial Sequence
  chemically synthesized
aggccctgggatgttcagtg

SEQ ID NO: 47209 - DNA, 20 bp, Artificial Sequence
  chemically synthesized
tgggatgttcagtggagcct

SEQ ID NO: 47210 - DNA, 20 bp, Artificial Sequence
  chemically synthesized
gcctgagtcattttataaaa

SEQ ID NO: 47211 - DNA, 20 bp, Artificial Sequence
  chemically synthesized
tttataaaaaagcatgactc

SEQ ID NO: 47212 - DNA, 20 bp, Artificial Sequence
  chemically synthesized
ttataaaaaagcatgactct

SEQ ID NO: 47213 - DNA, 20 bp, Artificial Sequence
  chemically synthesized
tataaaaaagcatgactcta

SEQ ID NO: 47214 - DNA, 20 bp, Artificial Sequence
  chemically synthesized
tagggtccaaaattcctttg

SEQ ID NO: 47215 - DNA, 20 bp, Artificial Sequence
  chemically synthesized
cctttgaagctgttgctatc

SEQ ID NO: 47216 - DNA, 20 bp, Artificial Sequence
  chemically synthesized
tttgaagctgttgctatcca

SEQ ID NO: 47217 - DNA, 20 bp, Artificial Sequence
  chemically synthesized
agctgttgctatccagagtg

SEQ ID NO: 47218 - DNA, 20 bp, Artificial Sequence
  chemically synthesized
ccagagtgaagtcccttctt

SEQ ID NO: 47219 - DNA, 20 bp, Artificial Sequence
  chemically synthesized
cagagtgaagtcccttcttt

SEQ ID NO: 47220 - DNA, 20 bp, Artificial Sequence
  chemically synthesized
gtgaagtcccttctttagga

SEQ ID NO: 47221 - DNA, 20 bp, Artificial Sequence
  chemically synthesized
tgaagtcccttctttaggac

SEQ ID NO: 47222 - DNA, 20 bp, Artificial Sequence
  chemically synthesized
gaagtcccttctttaggaca

SEQ ID NO: 47223 - DNA, 20 bp, Artificial Sequence
  chemically synthesized
gtcccttctttaggacaggg

SEQ ID NO: 47224 - DNA, 20 bp, Artificial Sequence
  chemically synthesized
agggtggccctcctccctcc

SEQ ID NO: 47225 - DNA, 20 bp, Artificial Sequence
  chemically synthesized
cctcctggatgtcacatctt

SEQ ID NO: 47226 - DNA, 20 bp, Artificial Sequence
  chemically synthesized
cctggatgtcacatcttcgg

SEQ ID NO: 47227 - DNA, 20 bp, Artificial Sequence
  chemically synthesized
tggatgtcacatcttcggtg

SEQ ID NO: 47228 - DNA, 20 bp, Artificial Sequence
  chemically synthesized
ggatgtcacatcttcggtgg

SEQ ID NO: 47229 - DNA, 20 bp, Artificial Sequence
  chemically synthesized
gatgtcacatcttcggtgga

SEQ ID NO: 47230 - DNA, 20 bp, Artificial Sequence
  chemically synthesized
atgtcacatcttcggtggag

SEQ ID NO: 47231 - DNA, 20 bp, Artificial Sequence
  chemically synthesized
tcacatcttcggtggagggg

SEQ ID NO: 47232 - DNA, 20 bp, Artificial Sequence
  chemically synthesized
atcttcggtggaggggcaga

SEQ ID NO: 47233 - DNA, 20 bp, Artificial Sequence
  chemically synthesized
tcttcggtggaggggcagaa

SEQ ID NO: 47234 - DNA, 20 bp, Artificial Sequence
  chemically synthesized
cttcggtggaggggcagaaa

SEQ ID NO: 47235 - DNA, 20 bp, Artificial Sequence
  chemically synthesized
ttcggtggaggggcagaaag

SEQ ID NO: 47236 - DNA, 20 bp, Artificial Sequence
  chemically synthesized
tggaggggcagaaaggggac

SEQ ID NO: 47237 - DNA, 20 bp, Artificial Sequence
  chemically synthesized
ggaggggcagaaaggggact

SEQ ID NO: 47238 - DNA, 20 bp, Artificial Sequence
  chemically synthesized
actgggtattctcctcaccc

SEQ ID NO: 47239 - DNA, 20 bp, Artificial Sequence
  chemically synthesized
tattctcctcaccctggccc

SEQ ID NO: 47240 - DNA, 20 bp, Artificial Sequence
  chemically synthesized
tgtgcttctgcaccaccttc

SEQ ID NO: 47241 - DNA, 20 bp, Artificial Sequence
  chemically synthesized
acaaataaaaacgttttttt

SEQ ID NO: 47242 - DNA, 20 bp, Artificial Sequence
  chemically synthesized
aaacgtttttttaagatttg

SEQ ID NO: 47243 - DNA, 20 bp, Artificial Sequence
  chemically synthesized
ttttttaagatttgaagcac

SEQ ID NO: 47244 - DNA, 20 bp, Artificial Sequence
  chemically synthesized
tttttaagatttgaagcact

SEQ ID NO: 47245 - DNA, 20 bp, Artificial Sequence
  chemically synthesized
ttttaagatttgaagcacta

SEQ ID NO: 47246 - DNA, 20 bp, Artificial Sequence
  chemically synthesized
aagatttgaagcactagggc

SEQ ID NO: 47247 - DNA, 20 bp, Artificial Sequence
  chemically synthesized
agatttgaagcactagggcc

SEQ ID NO: 47248 - DNA, 20 bp, Artificial Sequence
  chemically synthesized
gatttgaagcactagggcca

SEQ ID NO: 47249 - DNA, 20 bp, Artificial Sequence
  chemically synthesized
tgaagcactagggccagggt

SEQ ID NO: 47250 - DNA, 20 bp, Artificial Sequence
  chemically synthesized
gaagcactagggccagggtg

SEQ ID NO: 47251 - DNA, 20 bp, Artificial Sequence
  chemically synthesized
agcactagggccagggtgag

SEQ ID NO: 47252 - DNA, 20 bp, Artificial Sequence
  chemically synthesized
gccagggtgaggagaatacc

SEQ ID NO: 47253 - DNA, 20 bp, Artificial Sequence
  chemically synthesized
ccctttctgcccctccaccg

SEQ ID NO: 47254 - DNA, 20 bp, Artificial Sequence
  chemically synthesized
tccaccgaagatgtgacatc

SEQ ID NO: 47255 - DNA, 20 bp, Artificial Sequence
  chemically synthesized
ccaccgaagatgtgacatcc

SEQ ID NO: 47256 - DNA, 20 bp, Artificial Sequence
  chemically synthesized
accgaagatgtgacatccag

SEQ ID NO: 47257 - DNA, 20 bp, Artificial Sequence
  chemically synthesized
ccgaagatgtgacatccagg

SEQ ID NO: 47258 - DNA, 20 bp, Artificial Sequence
  chemically synthesized
cgaagatgtgacatccagga

SEQ ID NO: 47259 - DNA, 20 bp, Artificial Sequence
  chemically synthesized
aagatgtgacatccaggagg

SEQ ID NO: 47260 - DNA, 20 bp, Artificial Sequence
  chemically synthesized
agatgtgacatccaggaggg

SEQ ID NO: 47261 - DNA, 20 bp, Artificial Sequence
  chemically synthesized
atgtgacatccaggagggag

SEQ ID NO: 47262 - DNA, 20 bp, Artificial Sequence
  chemically synthesized
tgtgacatccaggagggagg

SEQ ID NO: 47263 - DNA, 20 bp, Artificial Sequence
  chemically synthesized
gtgacatccaggagggagga

SEQ ID NO: 47264 - DNA, 20 bp, Artificial Sequence
  chemically synthesized
aggagggccaccctgtccta

SEQ ID NO: 47265 - DNA, 20 bp, Artificial Sequence
  chemically synthesized
agggccaccctgtcctaaag

SEQ ID NO: 47266 - DNA, 20 bp, Artificial Sequence
  chemically synthesized
gggccaccctgtcctaaaga

SEQ ID NO: 47267 - DNA, 20 bp, Artificial Sequence
  chemically synthesized
ggccaccctgtcctaaagaa

SEQ ID NO: 47268 - DNA, 20 bp, Artificial Sequence
  chemically synthesized
ctaaagaagggacttcactc

SEQ ID NO: 47269 - DNA, 20 bp, Artificial Sequence
  chemically synthesized
agaagggacttcactctgga

SEQ ID NO: 47270 - DNA, 20 bp, Artificial Sequence
  chemically synthesized
gacttcactctggatagcaa

SEQ ID NO: 47271 - DNA, 20 bp, Artificial Sequence
  chemically synthesized
tctggatagcaacagcttca

SEQ ID NO: 47272 - DNA, 20 bp, Artificial Sequence
  chemically synthesized
ctggatagcaacagcttcaa

SEQ ID NO: 47273 - DNA, 20 bp, Artificial Sequence
  chemically synthesized
caacagcttcaaaggaattt

SEQ ID NO: 47274 - DNA, 20 bp, Artificial Sequence
  chemically synthesized
ttcaaaggaattttggaccc

SEQ ID NO: 47275 - DNA, 20 bp, Artificial Sequence
  chemically synthesized
caaaggaattttggacccta

SEQ ID NO: 47276 - DNA, 20 bp, Artificial Sequence
  chemically synthesized
tgcttttttataaaatgact

SEQ ID NO: 47277 - DNA, 20 bp, Artificial Sequence
  chemically synthesized
gcttttttataaaatgactc

SEQ ID NO: 47278 - DNA, 20 bp, Artificial Sequence
  chemically synthesized
tcaggctccactgaacatcc

SEQ ID NO: 47279 - DNA, 20 bp, Artificial Sequence
  chemically synthesized
caggctccactgaacatccc

SEQ ID NO: 47280 - DNA, 20 bp, Artificial Sequence
  chemically synthesized
aggctccactgaacatccca

SEQ ID NO: 47281 - DNA, 20 bp, Artificial Sequence
  chemically synthesized
atcccagggccttgtcccta

SEQ ID NO: 47282 - DNA, 20 bp, Artificial Sequence
  chemically synthesized
tcccagggccttgtccctac

SEQ ID NO: 47283 - DNA, 20 bp, Artificial Sequence
  chemically synthesized
cttgtccctacaggtttccg

SEQ ID NO: 47284 - DNA, 20 bp, Artificial Sequence
  chemically synthesized
ttgtccctacaggtttccgt

SEQ ID NO: 47285 - DNA, 20 bp, Artificial Sequence
  chemically synthesized
tccctacaggtttccgtagg

SEQ ID NO: 47286 - DNA, 20 bp, Artificial Sequence
  chemically synthesized
ctacaggtttccgtaggcag

SEQ ID NO: 47287 - DNA, 20 bp, Artificial Sequence
  chemically synthesized
tccgtaggcagcagatgcat

SEQ ID NO: 47288 - DNA, 20 bp, Artificial Sequence
  chemically synthesized
ggcagcagatgcattggcac

SEQ ID NO: 47289 - DNA, 20 bp, Artificial Sequence
  chemically synthesized
cagatgcattggcacaagaa

SEQ ID NO: 47290 - DNA, 20 bp, Artificial Sequence
  chemically synthesized
tgcattggcacaagaatggc

SEQ ID NO: 47291 - DNA, 20 bp, Artificial Sequence
  chemically synthesized
attggcacaagaatggctgg

SEQ ID NO: 47292 - DNA, 20 bp, Artificial Sequence
  chemically synthesized
ttggcacaagaatggctggc

SEQ ID NO: 47293 - DNA, 20 bp, Artificial Sequence
  chemically synthesized
gcacaagaatggctggcagg

SEQ ID NO: 47294 - DNA, 20 bp, Artificial Sequence
  chemically synthesized
atggctggcaggcagaccaa

SEQ ID NO: 47295 - DNA, 20 bp, Artificial Sequence
  chemically synthesized
tggctggcaggcagaccaat

SEQ ID NO: 47296 - DNA, 20 bp, Artificial Sequence
  chemically synthesized
gcagaccaatgggtttgatc

SEQ ID NO: 47297 - DNA, 20 bp, Artificial Sequence
  chemically synthesized
cagaccaatgggtttgatcc

SEQ ID NO: 47298 - DNA, 20 bp, Artificial Sequence
  chemically synthesized
tttgatccaggctctacccc

SEQ ID NO: 47299 - DNA, 20 bp, Artificial Sequence
  chemically synthesized
tctacccctagctgtctgtg

SEQ ID NO: 47300 - DNA, 20 bp, Artificial Sequence
  chemically synthesized
gtgtggtcccctctgaactt

SEQ ID NO: 47301 - DNA, 20 bp, Artificial Sequence
  chemically synthesized
gtctcctcgtctttcaaatg

SEQ ID NO: 47302 - DNA, 20 bp, Artificial Sequence
  chemically synthesized
cctcgtctttcaaatgaaga

SEQ ID NO: 47303 - DNA, 20 bp, Artificial Sequence
  chemically synthesized
aatgaagatagacgtaccac

SEQ ID NO: 47304 - DNA, 20 bp, Artificial Sequence
  chemically synthesized
atgaagatagacgtaccact

SEQ ID NO: 47305 - DNA, 20 bp, Artificial Sequence
  chemically synthesized
tgaagatagacgtaccactg

SEQ ID NO: 47306 - DNA, 20 bp, Artificial Sequence
  chemically synthesized
atagacgtaccactggggca

SEQ ID NO: 47307 - DNA, 20 bp, Artificial Sequence
  chemically synthesized
acgtaccactggggcatggc

SEQ ID NO: 47308 - DNA, 20 bp, Artificial Sequence
  chemically synthesized
cgtaccactggggcatggcc

SEQ ID NO: 47309 - DNA, 20 bp, Artificial Sequence
  chemically synthesized
ctggggcatggccaggctta

SEQ ID NO: 47310 - DNA, 20 bp, Artificial Sequence
  chemically synthesized
tggggcatggccaggcttaa

SEQ ID NO: 47311 - DNA, 20 bp, Artificial Sequence
  chemically synthesized
ggggcatggccaggcttaaa

SEQ ID NO: 47312 - DNA, 20 bp, Artificial Sequence
  chemically synthesized
ggcttaaagggaattctata

SEQ ID NO: 47313 - DNA, 20 bp, Artificial Sequence
  chemically synthesized
taaagggaattctatacaga

SEQ ID NO: 47314 - DNA, 20 bp, Artificial Sequence
  chemically synthesized
gggaattctatacagaaagc

SEQ ID NO: 47315 - DNA, 20 bp, Artificial Sequence
  chemically synthesized
aattctatacagaaagccag

SEQ ID NO: 47316 - DNA, 20 bp, Artificial Sequence
  chemically synthesized
aagccagtagttactgtgct

SEQ ID NO: 47317 - DNA, 20 bp, Artificial Sequence
  chemically synthesized
tactgtgcttggtacccgat

SEQ ID NO: 47318 - DNA, 20 bp, Artificial Sequence
  chemically synthesized
tgctgtccccttctgatttt

SEQ ID NO: 47319 - DNA, 20 bp, Artificial Sequence
  chemically synthesized
ccccttctgattttcagcaa

SEQ ID NO: 47320 - DNA, 20 bp, Artificial Sequence
  chemically synthesized
cccttctgattttcagcaat

SEQ ID NO: 47321 - DNA, 20 bp, Artificial Sequence
  chemically synthesized
ttttcagcaatgggcctact

SEQ ID NO: 47322 - DNA, 20 bp, Artificial Sequence
  chemically synthesized
agcaatgggcctactaagca

SEQ ID NO: 47323 - DNA, 20 bp, Artificial Sequence
  chemically synthesized
ggcctactaagcacagtccc

SEQ ID NO: 47324 - DNA, 20 bp, Artificial Sequence
  chemically synthesized
cacagtccccagtgtatatg

SEQ ID NO: 47325 - DNA, 20 bp, Artificial Sequence
  chemically synthesized
agtccccagtgtatatgcag

SEQ ID NO: 47326 - DNA, 20 bp, Artificial Sequence
  chemically synthesized
ccagtgtatatgcagtggcc

SEQ ID NO: 47327 - DNA, 20 bp, Artificial Sequence
  chemically synthesized
atgcagtggcccagccctat

SEQ ID NO: 47328 - DNA, 20 bp, Artificial Sequence
  chemically synthesized
tgcagtggcccagccctatc

SEQ ID NO: 47329 - DNA, 20 bp, Artificial Sequence
  chemically synthesized
agtggcccagccctatcagg

SEQ ID NO: 47330 - DNA, 20 bp, Artificial Sequence
  chemically synthesized
caggaagtgccattcccaaa

SEQ ID NO: 47331 - DNA, 20 bp, Artificial Sequence
  chemically synthesized
aggaagtgccattcccaaaa

SEQ ID NO: 47332 - DNA, 20 bp, Artificial Sequence
  chemically synthesized
ggaagtgccattcccaaaaa

SEQ ID NO: 47333 - DNA, 20 bp, Artificial Sequence
  chemically synthesized
agtgccattcccaaaaaggg

SEQ ID NO: 47334 - DNA, 20 bp, Artificial Sequence
  chemically synthesized
tcccaaaaagggtggctcac

SEQ ID NO: 47335 - DNA, 20 bp, Artificial Sequence
  chemically synthesized
aaagggtggctcaccagctc

SEQ ID NO: 47336 - DNA, 20 bp, Artificial Sequence
  chemically synthesized
gggtggctcaccagctccag

SEQ ID NO: 47337 - DNA, 20 bp, Artificial Sequence
  chemically synthesized
ggtggctcaccagctccagc

SEQ ID NO: 47338 - DNA, 20 bp, Artificial Sequence
  chemically synthesized
aggtcgccactcatcttcac

SEQ ID NO: 47339 - DNA, 20 bp, Artificial Sequence
  chemically synthesized
ggtcgccactcatcttcacc

SEQ ID NO: 47340 - DNA, 20 bp, Artificial Sequence
  chemically synthesized
cgccactcatcttcaccagg

SEQ ID NO: 47341 - DNA, 20 bp, Artificial Sequence
  chemically synthesized
actcatcttcaccaggaagc

SEQ ID NO: 47342 - DNA, 20 bp, Artificial Sequence
  chemically synthesized
ctcatcttcaccaggaagcc

SEQ ID NO: 47343 - DNA, 20 bp, Artificial Sequence
  chemically synthesized
atcttcaccaggaagccagg

SEQ ID NO: 47344 - DNA, 20 bp, Artificial Sequence
  chemically synthesized
ttcaccaggaagccaggaag

SEQ ID NO: 47345 - DNA, 20 bp, Artificial Sequence
  chemically synthesized
tcaccaggaagccaggaaga

SEQ ID NO: 47346 - DNA, 20 bp, Artificial Sequence
  chemically synthesized
ggaagccaggaagaaggcca

SEQ ID NO: 47347 - DNA, 20 bp, Artificial Sequence
  chemically synthesized
agccaggaagaaggccatgg

SEQ ID NO: 47348 - DNA, 20 bp, Artificial Sequence
  chemically synthesized
agaaggccatggaagacatg

SEQ ID NO: 47349 - DNA, 20 bp, Artificial Sequence
  chemically synthesized
gaaggccatggaagacatgc

SEQ ID NO: 47350 - DNA, 20 bp, Artificial Sequence
  chemically synthesized
atggaagacatgcaggatct

SEQ ID NO: 47351 - DNA, 20 bp, Artificial Sequence
  chemically synthesized
aagacatgcaggatcttggt

SEQ ID NO: 47352 - DNA, 20 bp, Artificial Sequence
  chemically synthesized
agacatgcaggatcttggtg

SEQ ID NO: 47353 - DNA, 20 bp, Artificial Sequence
  chemically synthesized
ggatcttggtgaggtatccc

SEQ ID NO: 47354 - DNA, 20 bp, Artificial Sequence
  chemically synthesized
tcttggtgaggtatccccgg

SEQ ID NO: 47355 - DNA, 20 bp, Artificial Sequence
  chemically synthesized
cttggtgaggtatccccggc

SEQ ID NO: 47356 - DNA, 20 bp, Artificial Sequence
  chemically synthesized
ggtgaggtatccccggcggg

SEQ ID NO: 47357 - DNA, 20 bp, Artificial Sequence
  chemically synthesized
ggtatccccggcgggcagcc

SEQ ID NO: 47358 - DNA, 20 bp, Artificial Sequence
  chemically synthesized
gtatccccggcgggcagcct

SEQ ID NO: 47359 - DNA, 20 bp, Artificial Sequence
  chemically synthesized
cggcgggcagcctgggcctg

SEQ ID NO: 47360 - DNA, 20 bp, Artificial Sequence
  chemically synthesized
ggcgggcagcctgggcctgc

SEQ ID NO: 47361 - DNA, 20 bp, Artificial Sequence
  chemically synthesized
gggcagcctgggcctgcagg

SEQ ID NO: 47362 - DNA, 20 bp, Artificial Sequence
  chemically synthesized
cagcctgggcctgcaggcgg

SEQ ID NO: 47363 - DNA, 20 bp, Artificial Sequence
  chemically synthesized
agcctgggcctgcaggcggc

SEQ ID NO: 47364 - DNA, 20 bp, Artificial Sequence
  chemically synthesized
ctgggcctgcaggcggcggg

SEQ ID NO: 47365 - DNA, 20 bp, Artificial Sequence
  chemically synthesized
gggcagtgcgctctgactgc

SEQ ID NO: 47366 - DNA, 20 bp, Artificial Sequence
  chemically synthesized
gcagtgcgctctgactgcga

SEQ ID NO: 47367 - DNA, 20 bp, Artificial Sequence
  chemically synthesized
cagtgcgctctgactgcgag

SEQ ID NO: 47368 - DNA, 20 bp, Artificial Sequence
  chemically synthesized
tgcgctctgactgcgagagg

SEQ ID NO: 47369 - DNA, 20 bp, Artificial Sequence
  chemically synthesized
gcgctctgactgcgagaggt

SEQ ID NO: 47370 - DNA, 20 bp, Artificial Sequence
  chemically synthesized
gagaggtgggtctcctcctt

SEQ ID NO: 47371 - DNA, 20 bp, Artificial Sequence
  chemically synthesized
cctccttcagcaccaccacg

SEQ ID NO: 47372 - DNA, 20 bp, Artificial Sequence
  chemically synthesized
ctccttcagcaccaccacgt

SEQ ID NO: 47373 - DNA, 20 bp, Artificial Sequence
  chemically synthesized
cagcaccaccacgtaggtgc

SEQ ID NO: 47374 - DNA, 20 bp, Artificial Sequence
  chemically synthesized
agcaccaccacgtaggtgcc

SEQ ID NO: 47375 - DNA, 20 bp, Artificial Sequence
  chemically synthesized
taggtgccaggcaacctcca

SEQ ID NO: 47376 - DNA, 20 bp, Artificial Sequence
  chemically synthesized
caggcaacctccacggatcc

SEQ ID NO: 47377 - DNA, 20 bp, Artificial Sequence
  chemically synthesized
cacggatcctggccccatgc

SEQ ID NO: 47378 - DNA, 20 bp, Artificial Sequence
  chemically synthesized
acggatcctggccccatgca

SEQ ID NO: 47379 - DNA, 20 bp, Artificial Sequence
  chemically synthesized
ggatcctggccccatgcaag

SEQ ID NO: 47380 - DNA, 20 bp, Artificial Sequence
  chemically synthesized
gatcctggccccatgcaagg

SEQ ID NO: 47381 - DNA, 20 bp, Artificial Sequence
  chemically synthesized
caaggaggaacatgatgaca

SEQ ID NO: 47382 - DNA, 20 bp, Artificial Sequence
  chemically synthesized
ggaggaacatgatgacatgg

SEQ ID NO: 47383 - DNA, 20 bp, Artificial Sequence
  chemically synthesized
atgatgacatggaagaaacc

SEQ ID NO: 47384 - DNA, 20 bp, Artificial Sequence
  chemically synthesized
ggaagaaacccagcaaaccc

SEQ ID NO: 47385 - DNA, 20 bp, Artificial Sequence
  chemically synthesized
gaagaaacccagcaaaccct

SEQ ID NO: 47386 - DNA, 20 bp, Artificial Sequence
  chemically synthesized
ctacttacaaattacaacaa

SEQ ID NO: 47387 - DNA, 20 bp, Artificial Sequence
  chemically synthesized
acttacaaattacaacaaaa

SEQ ID NO: 47388 - DNA, 20 bp, Artificial Sequence
  chemically synthesized
ttacaacaaaagagacacaa

SEQ ID NO: 47389 - DNA, 20 bp, Artificial Sequence
  chemically synthesized
acaacaaaagagacacaaca

SEQ ID NO: 47390 - DNA, 20 bp, Artificial Sequence
  chemically synthesized
aaaagagacacaacagagta

SEQ ID NO: 47391 - DNA, 20 bp, Artificial Sequence
  chemically synthesized
agagacacaacagagtatag

SEQ ID NO: 47392 - DNA, 20 bp, Artificial Sequence
  chemically synthesized
acagagtatagtagatgata

SEQ ID NO: 47393 - DNA, 20 bp, Artificial Sequence
  chemically synthesized
gagtatagtagatgataaag

SEQ ID NO: 47394 - DNA, 20 bp, Artificial Sequence
  chemically synthesized
gataaagaagttaccaaatg

SEQ ID NO: 47395 - DNA, 20 bp, Artificial Sequence
  chemically synthesized
gttaccaaatgcggaccaaa

SEQ ID NO: 47396 - DNA, 20 bp, Artificial Sequence
  chemically synthesized
gcggaccaaaaagcaaatta

SEQ ID NO: 47397 - DNA, 20 bp, Artificial Sequence
  chemically synthesized
agcaaattaaagaactcata

SEQ ID NO: 47398 - DNA, 20 bp, Artificial Sequence
  chemically synthesized
gcaaattaaagaactcatat

SEQ ID NO: 47399 - DNA, 20 bp, Artificial Sequence
  chemically synthesized
gccaactattattattcaca

SEQ ID NO: 47400 - DNA, 20 bp, Artificial Sequence
  chemically synthesized
acactttcaaatgtgccatt

SEQ ID NO: 47401 - DNA, 20 bp, Artificial Sequence
  chemically synthesized
cactttcaaatgtgccattc

SEQ ID NO: 47402 - DNA, 20 bp, Artificial Sequence
  chemically synthesized
atgtgccattcaggcaaaaa

SEQ ID NO: 47403 - DNA, 20 bp, Artificial Sequence
  chemically synthesized
tgtgccattcaggcaaaaat

SEQ ID NO: 47404 - DNA, 20 bp, Artificial Sequence
  chemically synthesized
tcaggcaaaaatgggaacta

SEQ ID NO: 47405 - DNA, 20 bp, Artificial Sequence
  chemically synthesized
caggcaaaaatgggaactac

SEQ ID NO: 47406 - DNA, 20 bp, Artificial Sequence
  chemically synthesized
ctacgggccacactcgacaa

SEQ ID NO: 47407 - DNA, 20 bp, Artificial Sequence
  chemically synthesized
tacgggccacactcgacaac

SEQ ID NO: 47408 - DNA, 20 bp, Artificial Sequence
  chemically synthesized
ttttcctctgtacctgcacc

SEQ ID NO: 47409 - DNA, 20 bp, Artificial Sequence
  chemically synthesized
tacctgcacccagctctcta

SEQ ID NO: 47410 - DNA, 20 bp, Artificial Sequence
  chemically synthesized
acctgcacccagctctctac

SEQ ID NO: 47411 - DNA, 20 bp, Artificial Sequence
  chemically synthesized
cacccagctctctacgggcc

SEQ ID NO: 47412 - DNA, 20 bp, Artificial Sequence
  chemically synthesized
tctacgggcctggtcgctcc

SEQ ID NO: 47413 - DNA, 20 bp, Artificial Sequence
  chemically synthesized
acgggcctggtcgctcctgg

SEQ ID NO: 47414 - DNA, 20 bp, Artificial Sequence
  chemically synthesized
gctcctggtggccctgccca

SEQ ID NO: 47415 - DNA, 20 bp, Artificial Sequence
  chemically synthesized
ctcctggtggccctgcccaa

SEQ ID NO: 47416 - DNA, 20 bp, Artificial Sequence
  chemically synthesized
ccaccccctcccccatgccc

SEQ ID NO: 47417 - DNA, 20 bp, Artificial Sequence
  chemically synthesized
cccctcccccatgccccagt

SEQ ID NO: 47418 - DNA, 20 bp, Artificial Sequence
  chemically synthesized
tgccccagtcagaataaatt

SEQ ID NO: 47419 - DNA, 20 bp, Artificial Sequence
  chemically synthesized
gccccagtcagaataaattg

SEQ ID NO: 47420 - DNA, 20 bp, Artificial Sequence
  chemically synthesized
ccccagtcagaataaattga

SEQ ID NO: 47421 - DNA, 20 bp, Artificial Sequence
  chemically synthesized
taaattgagggaaaaaatca

SEQ ID NO: 47422 - DNA, 20 bp, Artificial Sequence
  chemically synthesized
aaattgagggaaaaaatcat

SEQ ID NO: 47423 - DNA, 20 bp, Artificial Sequence
  chemically synthesized
agggaaaaaatcatgggctt

SEQ ID NO: 47424 - DNA, 20 bp, Artificial Sequence
  chemically synthesized
ggaaaaaatcatgggctttg

SEQ ID NO: 47425 - DNA, 20 bp, Artificial Sequence
  chemically synthesized
aaaatcatgggctttggagc

SEQ ID NO: 47426 - DNA, 20 bp, Artificial Sequence
  chemically synthesized
aaatcatgggctttggagcc

SEQ ID NO: 47427 - DNA, 20 bp, Artificial Sequence
  chemically synthesized
gctttggagccaggaaaccg

SEQ ID NO: 47428 - DNA, 20 bp, Artificial Sequence
  chemically synthesized
gaaaccgtggacctgaattc

SEQ ID NO: 47429 - DNA, 20 bp, Artificial Sequence
  chemically synthesized
attccagctccaatatttac

SEQ ID NO: 47430 - DNA, 20 bp, Artificial Sequence
  chemically synthesized
tccaatatttactggttgtg

SEQ ID NO: 47431 - DNA, 20 bp, Artificial Sequence
  chemically synthesized
tttactggttgtgcagccat

SEQ ID NO: 47432 - DNA, 20 bp, Artificial Sequence
  chemically synthesized
ctggttgtgcagccatgagc

SEQ ID NO: 47433 - DNA, 20 bp, Artificial Sequence
  chemically synthesized
gagcaagtcactcaacctct

SEQ ID NO: 47434 - DNA, 20 bp, Artificial Sequence
  chemically synthesized
gcaagtcactcaacctctcg

SEQ ID NO: 47435 - DNA, 20 bp, Artificial Sequence
  chemically synthesized
cactcaacctctcggagcct

SEQ ID NO: 47436 - DNA, 20 bp, Artificial Sequence
  chemically synthesized
cagatacctctgctgtattg

SEQ ID NO: 47437 - DNA, 20 bp, Artificial Sequence
  chemically synthesized
gatacctctgctgtattgta

SEQ ID NO: 47438 - DNA, 20 bp, Artificial Sequence
  chemically synthesized
ctgctgtattgtagagacca

SEQ ID NO: 47439 - DNA, 20 bp, Artificial Sequence
  chemically synthesized
agaccacagtacctatgaca

SEQ ID NO: 47440 - DNA, 20 bp, Artificial Sequence
  chemically synthesized
gaccacagtacctatgacat

SEQ ID NO: 47441 - DNA, 20 bp, Artificial Sequence
  chemically synthesized
tacctatgacataggcctgc

SEQ ID NO: 47442 - DNA, 20 bp, Artificial Sequence
  chemically synthesized
acctatgacataggcctgct

SEQ ID NO: 47443 - DNA, 20 bp, Artificial Sequence
  chemically synthesized
atgacataggcctgctggga

SEQ ID NO: 47444 - DNA, 20 bp, Artificial Sequence
  chemically synthesized
ataggcctgctgggaaagtc

SEQ ID NO: 47445 - DNA, 20 bp, Artificial Sequence
  chemically synthesized
aggcctgctgggaaagtcaa

SEQ ID NO: 47446 - DNA, 20 bp, Artificial Sequence
  chemically synthesized
gctgggaaagtcaagagtga

SEQ ID NO: 47447 - DNA, 20 bp, Artificial Sequence
  chemically synthesized
ggttatataaatctcccatc

SEQ ID NO: 47448 - DNA, 20 bp, Artificial Sequence
  chemically synthesized
atccagatgctctacaaatg

SEQ ID NO: 47449 - DNA, 20 bp, Artificial Sequence
  chemically synthesized
tccagatgctctacaaatgc

SEQ ID NO: 47450 - DNA, 20 bp, Artificial Sequence
  chemically synthesized
agatgctctacaaatgcagg

SEQ ID NO: 47451 - DNA, 20 bp, Artificial Sequence
  chemically synthesized
tgctctacaaatgcaggcag

SEQ ID NO: 47452 - DNA, 20 bp, Artificial Sequence
  chemically synthesized
gctctacaaatgcaggcaga

SEQ ID NO: 47453 - DNA, 20 bp, Artificial Sequence
  chemically synthesized
ctctacaaatgcaggcagaa

SEQ ID NO: 47454 - DNA, 20 bp, Artificial Sequence
  chemically synthesized
tgcaggcagaagggatgact

SEQ ID NO: 47455 - DNA, 20 bp, Artificial Sequence
  chemically synthesized
ggcagaagggatgactaagt

SEQ ID NO: 47456 - DNA, 20 bp, Artificial Sequence
  chemically synthesized
aagggatgactaagtgagca

SEQ ID NO: 47457 - DNA, 20 bp, Artificial Sequence
  chemically synthesized
agggatgactaagtgagcaa

SEQ ID NO: 47458 - DNA, 20 bp, Artificial Sequence
  chemically synthesized
agcaaaggcaacacttctta

SEQ ID NO: 47459 - DNA, 20 bp, Artificial Sequence
  chemically synthesized
caaaggcaacacttcttaaa

SEQ ID NO: 47460 - DNA, 20 bp, Artificial Sequence
  chemically synthesized
aaggcaacacttcttaaaga

SEQ ID NO: 47461 - DNA, 20 bp, Artificial Sequence
  chemically synthesized
ggcaacacttcttaaagaga

SEQ ID NO: 47462 - DNA, 20 bp, Artificial Sequence
  chemically synthesized
cacttcttaaagagagagaa

SEQ ID NO: 47463 - DNA, 20 bp, Artificial Sequence
  chemically synthesized
cttaaagagagagaaaagtc

SEQ ID NO: 47464 - DNA, 20 bp, Artificial Sequence
  chemically synthesized
ttaaagagagagaaaagtca

SEQ ID NO: 47465 - DNA, 20 bp, Artificial Sequence
  chemically synthesized
aaaagtcaaggccactgtct

SEQ ID NO: 47466 - DNA, 20 bp, Artificial Sequence
  chemically synthesized
tccttttgtgttgctatata

SEQ ID NO: 47467 - DNA, 20 bp, Artificial Sequence
  chemically synthesized
ccttttgtgttgctatataa

SEQ ID NO: 47468 - DNA, 20 bp, Artificial Sequence
  chemically synthesized
gctatataaaggaatacctg

SEQ ID NO: 47469 - DNA, 20 bp, Artificial Sequence
  chemically synthesized
ctatataaaggaatacctga

SEQ ID NO: 47470 - DNA, 20 bp, Artificial Sequence
  chemically synthesized
ataaaggaatacctgaaggt

SEQ ID NO: 47471 - DNA, 20 bp, Artificial Sequence
  chemically synthesized
cctgaaggtgagtaatttac

SEQ ID NO: 47472 - DNA, 20 bp, Artificial Sequence
  chemically synthesized
ctgaaggtgagtaatttaca

SEQ ID NO: 47473 - DNA, 20 bp, Artificial Sequence
  chemically synthesized
ggtgagtaatttacaaggaa

SEQ ID NO: 47474 - DNA, 20 bp, Artificial Sequence
  chemically synthesized
gtgagtaatttacaaggaaa

SEQ ID NO: 47475 - DNA, 20 bp, Artificial Sequence
  chemically synthesized
tgagtaatttacaaggaaaa

SEQ ID NO: 47476 - DNA, 20 bp, Artificial Sequence
  chemically synthesized
acaaggaaaagggatttatt

SEQ ID NO: 47477 - DNA, 20 bp, Artificial Sequence
  chemically synthesized
tattcagctcatgattctgc

SEQ ID NO: 47478 - DNA, 20 bp, Artificial Sequence
  chemically synthesized
tcatgattctgcaagctctc

SEQ ID NO: 47479 - DNA, 20 bp, Artificial Sequence
  chemically synthesized
catgattctgcaagctctcc

SEQ ID NO: 47480 - DNA, 20 bp, Artificial Sequence
  chemically synthesized
gattctgcaagctctccagg

SEQ ID NO: 47481 - DNA, 20 bp, Artificial Sequence
  chemically synthesized
tgcaagctctccaggaagca

SEQ ID NO: 47482 - DNA, 20 bp, Artificial Sequence
  chemically synthesized
ctctccaggaagcatggcac

SEQ ID NO: 47483 - DNA, 20 bp, Artificial Sequence
  chemically synthesized
atggcaccagcatctgcttc

SEQ ID NO: 47484 - DNA, 20 bp, Artificial Sequence
  chemically synthesized
caccagcatctgcttctggt

SEQ ID NO: 47485 - DNA, 20 bp, Artificial Sequence
  chemically synthesized
accagcatctgcttctggtg

SEQ ID NO: 47486 - DNA, 20 bp, Artificial Sequence
  chemically synthesized
ccagcatctgcttctggtga

SEQ ID NO: 47487 - DNA, 20 bp, Artificial Sequence
  chemically synthesized
ctgcttctggtgagggcctt

SEQ ID NO: 47488 - DNA, 20 bp, Artificial Sequence
  chemically synthesized
ccttaagctgctttcactga

SEQ ID NO: 47489 - DNA, 20 bp, Artificial Sequence
  chemically synthesized
taagctgctttcactgatgg

SEQ ID NO: 47490 - DNA, 20 bp, Artificial Sequence
  chemically synthesized
gctgctttcactgatggcag

SEQ ID NO: 47491 - DNA, 20 bp, Artificial Sequence
  chemically synthesized
ctgctttcactgatggcaga

SEQ ID NO: 47492 - DNA, 20 bp, Artificial Sequence
  chemically synthesized
ttcactgatggcagaaggtg

SEQ ID NO: 47493 - DNA, 20 bp, Artificial Sequence
  chemically synthesized
tcactgatggcagaaggtga

SEQ ID NO: 47494 - DNA, 20 bp, Artificial Sequence
  chemically synthesized
cactgatggcagaaggtgaa

SEQ ID NO: 47495 - DNA, 20 bp, Artificial Sequence
  chemically synthesized
actgatggcagaaggtgaag

SEQ ID NO: 47496 - DNA, 20 bp, Artificial Sequence
  chemically synthesized
tgatggcagaaggtgaaggg

SEQ ID NO: 47497 - DNA, 20 bp, Artificial Sequence
  chemically synthesized
tgaaggggagcctacatgtg

SEQ ID NO: 47498 - DNA, 20 bp, Artificial Sequence
  chemically synthesized
aaggggagcctacatgtgca

SEQ ID NO: 47499 - DNA, 20 bp, Artificial Sequence
  chemically synthesized
atgtgcagagatcaatcaca

SEQ ID NO: 47500 - DNA, 20 bp, Artificial Sequence
  chemically synthesized
gcagagatcaatcacatggc

SEQ ID NO: 47501 - DNA, 20 bp, Artificial Sequence
  chemically synthesized
agagatcaatcacatggcaa

SEQ ID NO: 47502 - DNA, 20 bp, Artificial Sequence
  chemically synthesized
gatcaatcacatggcaagag

SEQ ID NO: 47503 - DNA, 20 bp, Artificial Sequence
  chemically synthesized
caatcacatggcaagagaag

SEQ ID NO: 47504 - DNA, 20 bp, Artificial Sequence
  chemically synthesized
cacatggcaagagaagaagc

SEQ ID NO: 47505 - DNA, 20 bp, Artificial Sequence
  chemically synthesized
catggcaagagaagaagcaa

SEQ ID NO: 47506 - DNA, 20 bp, Artificial Sequence
  chemically synthesized
tggcaagagaagaagcaaga

SEQ ID NO: 47507 - DNA, 20 bp, Artificial Sequence
  chemically synthesized
caagagaagaagcaagagag

SEQ ID NO: 47508 - DNA, 20 bp, Artificial Sequence
  chemically synthesized
agagaagaagcaagagagaa

SEQ ID NO: 47509 - DNA, 20 bp, Artificial Sequence
  chemically synthesized
agaagaagcaagagagaaga

SEQ ID NO: 47510 - DNA, 20 bp, Artificial Sequence
  chemically synthesized
gaagaagcaagagagaagag

SEQ ID NO: 47511 - DNA, 20 bp, Artificial Sequence
  chemically synthesized
aagaagcaagagagaagaga

SEQ ID NO: 47512 - DNA, 20 bp, Artificial Sequence
  chemically synthesized
gaagcaagagagaagagagg

SEQ ID NO: 47513 - DNA, 20 bp, Artificial Sequence
  chemically synthesized
aagcaagagagaagagaggg

SEQ ID NO: 47514 - DNA, 20 bp, Artificial Sequence
  chemically synthesized
agagaagagagggaggtgcc

SEQ ID NO: 47515 - DNA, 20 bp, Artificial Sequence
  chemically synthesized
gccaagctctttttaataat

SEQ ID NO: 47516 - DNA, 20 bp, Artificial Sequence
  chemically synthesized
ctttttaataatcagccttc

SEQ ID NO: 47517 - DNA, 20 bp, Artificial Sequence
  chemically synthesized
tttttaataatcagccttca

SEQ ID NO: 47518 - DNA, 20 bp, Artificial Sequence
  chemically synthesized
ttttaataatcagccttcaa

SEQ ID NO: 47519 - DNA, 20 bp, Artificial Sequence
  chemically synthesized
tcagccttcaagggaaatca

SEQ ID NO: 47520 - DNA, 20 bp, Artificial Sequence
  chemically synthesized
gccttcaagggaaatcatag

SEQ ID NO: 47521 - DNA, 20 bp, Artificial Sequence
  chemically synthesized
ccttcaagggaaatcatagc

SEQ ID NO: 47522 - DNA, 20 bp, Artificial Sequence
  chemically synthesized
ttcaagggaaatcatagcgg

SEQ ID NO: 47523 - DNA, 20 bp, Artificial Sequence
  chemically synthesized
gagaacttactcattatcac

SEQ ID NO: 47524 - DNA, 20 bp, Artificial Sequence
  chemically synthesized
agaacttactcattatcaca

SEQ ID NO: 47525 - DNA, 20 bp, Artificial Sequence
  chemically synthesized
cttactcattatcacaagga

SEQ ID NO: 47526 - DNA, 20 bp, Artificial Sequence
  chemically synthesized
attatcacaaggacggcacc

SEQ ID NO: 47527 - DNA, 20 bp, Artificial Sequence
  chemically synthesized
ggacggcaccaagcctttca

SEQ ID NO: 47528 - DNA, 20 bp, Artificial Sequence
  chemically synthesized
gacggcaccaagcctttcac

SEQ ID NO: 47529 - DNA, 20 bp, Artificial Sequence
  chemically synthesized
acggcaccaagcctttcaca

SEQ ID NO: 47530 - DNA, 20 bp, Artificial Sequence
  chemically synthesized
cggcaccaagcctttcacag

SEQ ID NO: 47531 - DNA, 20 bp, Artificial Sequence
  chemically synthesized
atgacccaaacacctcccat

SEQ ID NO: 47532 - DNA, 20 bp, Artificial Sequence
  chemically synthesized
tgacccaaacacctcccatt

SEQ ID NO: 47533 - DNA, 20 bp, Artificial Sequence
  chemically synthesized
taggccccacttccaacact

SEQ ID NO: 47534 - DNA, 20 bp, Artificial Sequence
  chemically synthesized
aggccccacttccaacactg

SEQ ID NO: 47535 - DNA, 20 bp, Artificial Sequence
  chemically synthesized
tgaggaccaaatttccacat

SEQ ID NO: 47536 - DNA, 20 bp, Artificial Sequence
  chemically synthesized
ccaaatttccacatgagatt

SEQ ID NO: 47537 - DNA, 20 bp, Artificial Sequence
  chemically synthesized
aaatttccacatgagatttg

SEQ ID NO: 47538 - DNA, 20 bp, Artificial Sequence
  chemically synthesized
aatttccacatgagatttgg

SEQ ID NO: 47539 - DNA, 20 bp, Artificial Sequence
  chemically synthesized
atttccacatgagatttgga

SEQ ID NO: 47540 - DNA, 20 bp, Artificial Sequence
  chemically synthesized
tttccacatgagatttggag

SEQ ID NO: 47541 - DNA, 20 bp, Artificial Sequence
  chemically synthesized
tggaggggacaaacaaatta

SEQ ID NO: 47542 - DNA, 20 bp, Artificial Sequence
  chemically synthesized
aggggacaaacaaattatag

SEQ ID NO: 47543 - DNA, 20 bp, Artificial Sequence
  chemically synthesized
attatagcagccactatcta

SEQ ID NO: 47544 - DNA, 20 bp, Artificial Sequence
  chemically synthesized
actatctatggtgatttgtt

SEQ ID NO: 47545 - DNA, 20 bp, Artificial Sequence
  chemically synthesized
atggtgatttgtttggtttt

SEQ ID NO: 47546 - DNA, 20 bp, Artificial Sequence
  chemically synthesized
ttgtctgctccaactgctct

SEQ ID NO: 47547 - DNA, 20 bp, Artificial Sequence
  chemically synthesized
tgtctgctccaactgctctc

SEQ ID NO: 47548 - DNA, 20 bp, Artificial Sequence
  chemically synthesized
ctgctccaactgctctcagg

SEQ ID NO: 47549 - DNA, 20 bp, Artificial Sequence
  chemically synthesized
tcaggcagacatacctgctt

SEQ ID NO: 47550 - DNA, 20 bp, Artificial Sequence
  chemically synthesized
acctgcttaagaaccttcac

SEQ ID NO: 47551 - DNA, 20 bp, Artificial Sequence
  chemically synthesized
gaaccttcactggctcccca

SEQ ID NO: 47552 - DNA, 20 bp, Artificial Sequence
  chemically synthesized
tccccacagcctcatgaatc

SEQ ID NO: 47553 - DNA, 20 bp, Artificial Sequence
  chemically synthesized
ccaaactccatgctcctcct

SEQ ID NO: 47554 - DNA, 20 bp, Artificial Sequence
  chemically synthesized
ccctacctcaacctaccttg

SEQ ID NO: 47555 - DNA, 20 bp, Artificial Sequence
  chemically synthesized
atctctgtatatatgcatct

SEQ ID NO: 47556 - DNA, 20 bp, Artificial Sequence
  chemically synthesized
tatatatgcatcttggactc

SEQ ID NO: 47557 - DNA, 20 bp, Artificial Sequence
  chemically synthesized
tatgcatcttggactccagt

SEQ ID NO: 47558 - DNA, 20 bp, Artificial Sequence
  chemically synthesized
tgcatcttggactccagtca

SEQ ID NO: 47559 - DNA, 20 bp, Artificial Sequence
  chemically synthesized
atcttggactccagtcagag

SEQ ID NO: 47560 - DNA, 20 bp, Artificial Sequence
  chemically synthesized
ggactccagtcagagtagaa

SEQ ID NO: 47561 - DNA, 20 bp, Artificial Sequence
  chemically synthesized
actccagtcagagtagaaca

SEQ ID NO: 47562 - DNA, 20 bp, Artificial Sequence
  chemically synthesized
gagtccaccccctttaccca

SEQ ID NO: 47563 - DNA, 20 bp, Artificial Sequence
  chemically synthesized
accccctttacccaaagcct

SEQ ID NO: 47564 - DNA, 20 bp, Artificial Sequence
  chemically synthesized
ccccctttacccaaagcctt

SEQ ID NO: 47565 - DNA, 20 bp, Artificial Sequence
  chemically synthesized
cccctttacccaaagcctta

SEQ ID NO: 47566 - DNA, 20 bp, Artificial Sequence
  chemically synthesized
ccaaagccttagggccaaaa

SEQ ID NO: 47567 - DNA, 20 bp, Artificial Sequence
  chemically synthesized
gccaaaacggttttgaacct

SEQ ID NO: 47568 - DNA, 20 bp, Artificial Sequence
  chemically synthesized
tttgaacctcagaacttgtt

SEQ ID NO: 47569 - DNA, 20 bp, Artificial Sequence
  chemically synthesized
ctcagaacttgtttggattt

SEQ ID NO: 47570 - DNA, 20 bp, Artificial Sequence
  chemically synthesized
gaacttgtttggattttaga

SEQ ID NO: 47571 - DNA, 20 bp, Artificial Sequence
  chemically synthesized
aacttgtttggattttagaa

SEQ ID NO: 47572 - DNA, 20 bp, Artificial Sequence
  chemically synthesized
ttgtttggattttagaaagg

SEQ ID NO: 47573 - DNA, 20 bp, Artificial Sequence
  chemically synthesized
ggattttagaaaggcagtaa

SEQ ID NO: 47574 - DNA, 20 bp, Artificial Sequence
  chemically synthesized
gattttagaaaggcagtaat

SEQ ID NO: 47575 - DNA, 20 bp, Artificial Sequence
  chemically synthesized
gaaaggcagtaatgggcaat

SEQ ID NO: 47576 - DNA, 20 bp, Artificial Sequence
  chemically synthesized
aaggcagtaatgggcaatca

SEQ ID NO: 47577 - DNA, 20 bp, Artificial Sequence
  chemically synthesized
atgggcaatcagagtctgct

SEQ ID NO: 47578 - DNA, 20 bp, Artificial Sequence
  chemically synthesized
ggcaatcagagtctgcttgg

SEQ ID NO: 47579 - DNA, 20 bp, Artificial Sequence
  chemically synthesized
agagtctgcttggaagaatc

SEQ ID NO: 47580 - DNA, 20 bp, Artificial Sequence
  chemically synthesized
agtctgcttggaagaatctg

SEQ ID NO: 47581 - DNA, 20 bp, Artificial Sequence
  chemically synthesized
gctgcatactgtaatctatg

SEQ ID NO: 47582 - DNA, 20 bp, Artificial Sequence
  chemically synthesized
aattaaaaataatctcatgt

SEQ ID NO: 47583 - DNA, 20 bp, Artificial Sequence
  chemically synthesized
aatctcatgtcagttcacgt

SEQ ID NO: 47584 - DNA, 20 bp, Artificial Sequence
  chemically synthesized
atctcatgtcagttcacgtc

SEQ ID NO: 47585 - DNA, 20 bp, Artificial Sequence
  chemically synthesized
taaatcacaaaaaaaacttt

SEQ ID NO: 47586 - DNA, 20 bp, Artificial Sequence
  chemically synthesized
tttcgtaacattttacattt

SEQ ID NO: 47587 - DNA, 20 bp, Artificial Sequence
  chemically synthesized
gtaacattttacatttcaga

SEQ ID NO: 47588 - DNA, 20 bp, Artificial Sequence
  chemically synthesized
acattttacatttcagacgg

SEQ ID NO: 47589 - DNA, 20 bp, Artificial Sequence
  chemically synthesized
tacatttcagacggtggata

SEQ ID NO: 47590 - DNA, 20 bp, Artificial Sequence
  chemically synthesized
agacggtggataaagaactg

SEQ ID NO: 47591 - DNA, 20 bp, Artificial Sequence
  chemically synthesized
acggtggataaagaactgtg

SEQ ID NO: 47592 - DNA, 20 bp, Artificial Sequence
  chemically synthesized
cggtggataaagaactgtgg

SEQ ID NO: 47593 - DNA, 20 bp, Artificial Sequence
  chemically synthesized
ggataaagaactgtggaggc

SEQ ID NO: 47594 - DNA, 20 bp, Artificial Sequence
  chemically synthesized
gataaagaactgtggaggcc

SEQ ID NO: 47595 - DNA, 20 bp, Artificial Sequence
  chemically synthesized
agaactgtggaggccaggcg

SEQ ID NO: 47596 - DNA, 20 bp, Artificial Sequence
  chemically synthesized
actgtggaggccaggcgtgg

SEQ ID NO: 47597 - DNA, 20 bp, Artificial Sequence
  chemically synthesized
gtggctcacacctgtaattc

SEQ ID NO: 47598 - DNA, 20 bp, Artificial Sequence
  chemically synthesized
cacctgtaattcgagcactt

SEQ ID NO: 47599 - DNA, 20 bp, Artificial Sequence
  chemically synthesized
acctgtaattcgagcacttt

SEQ ID NO: 47600 - DNA, 20 bp, Artificial Sequence
  chemically synthesized
ctgtaattcgagcactttgg

SEQ ID NO: 47601 - DNA, 20 bp, Artificial Sequence
  chemically synthesized
tgtaattcgagcactttggg

SEQ ID NO: 47602 - DNA, 20 bp, Artificial Sequence
  chemically synthesized
ttcgagcactttgggaggct

SEQ ID NO: 47603 - DNA, 20 bp, Artificial Sequence
  chemically synthesized
tcgagcactttgggaggctg

SEQ ID NO: 47604 - DNA, 20 bp, Artificial Sequence
  chemically synthesized
agcactttgggaggctgagg

SEQ ID NO: 47605 - DNA, 20 bp, Artificial Sequence
  chemically synthesized
gcactttgggaggctgaggc

SEQ ID NO: 47606 - DNA, 20 bp, Artificial Sequence
  chemically synthesized
actttgggaggctgaggcgg

SEQ ID NO: 47607 - DNA, 20 bp, Artificial Sequence
  chemically synthesized
ctttgggaggctgaggcggg

SEQ ID NO: 47608 - DNA, 20 bp, Artificial Sequence
  chemically synthesized
aggcgggaggatcacctcct

SEQ ID NO: 47609 - DNA, 20 bp, Artificial Sequence
  chemically synthesized
atcacctcctcggatccact

SEQ ID NO: 47610 - DNA, 20 bp, Artificial Sequence
  chemically synthesized
tcacctcctcggatccactg

SEQ ID NO: 47611 - DNA, 20 bp, Artificial Sequence
  chemically synthesized
acctcctcggatccactgag

SEQ ID NO: 47612 - DNA, 20 bp, Artificial Sequence
  chemically synthesized
cctcctcggatccactgagg

SEQ ID NO: 47613 - DNA, 20 bp, Artificial Sequence
  chemically synthesized
ctcggatccactgaggaggt

SEQ ID NO: 47614 - DNA, 20 bp, Artificial Sequence
  chemically synthesized
tcggatccactgaggaggtc

SEQ ID NO: 47615 - DNA, 20 bp, Artificial Sequence
  chemically synthesized
ggatccactgaggaggtcag

SEQ ID NO: 47616 - DNA, 20 bp, Artificial Sequence
  chemically synthesized
ggaggtcaggagtttgcgac

SEQ ID NO: 47617 - DNA, 20 bp, Artificial Sequence
  chemically synthesized
tcaggagtttgcgactagcc

SEQ ID NO: 47618 - DNA, 20 bp, Artificial Sequence
  chemically synthesized
tgcgactagcctggccaacg

SEQ ID NO: 47619 - DNA, 20 bp, Artificial Sequence
  chemically synthesized
tctactaaaaatacaaaaat

SEQ ID NO: 47620 - DNA, 20 bp, Artificial Sequence
  chemically synthesized
ctaaaaatacaaaaattagc

SEQ ID NO: 47621 - DNA, 20 bp, Artificial Sequence
  chemically synthesized
taaaaatacaaaaattagcc

SEQ ID NO: 47622 - DNA, 20 bp, Artificial Sequence
  chemically synthesized
atacaaaaattagccgggcg

SEQ ID NO: 47623 - DNA, 20 bp, Artificial Sequence
  chemically synthesized
caaaaattagccgggcgtgg

SEQ ID NO: 47624 - DNA, 20 bp, Artificial Sequence
  chemically synthesized
aaattagccgggcgtggtgg

SEQ ID NO: 47625 - DNA, 20 bp, Artificial Sequence
  chemically synthesized
aattagccgggcgtggtggc

SEQ ID NO: 47626 - DNA, 20 bp, Artificial Sequence
  chemically synthesized
gtggcaggtacctgtaatcc

SEQ ID NO: 47627 - DNA, 20 bp, Artificial Sequence
  chemically synthesized
tacctgtaatcccagcttct

SEQ ID NO: 47628 - DNA, 20 bp, Artificial Sequence
  chemically synthesized
acctgtaatcccagcttctt

SEQ ID NO: 47629 - DNA, 20 bp, Artificial Sequence
  chemically synthesized
ctgtaatcccagcttcttgg

SEQ ID NO: 47630 - DNA, 20 bp, Artificial Sequence
  chemically synthesized
tgtaatcccagcttcttggg

SEQ ID NO: 47631 - DNA, 20 bp, Artificial Sequence
  chemically synthesized
tcccagcttcttgggaggct

SEQ ID NO: 47632 - DNA, 20 bp, Artificial Sequence
  chemically synthesized
cccagcttcttgggaggctg

SEQ ID NO: 47633 - DNA, 20 bp, Artificial Sequence
  chemically synthesized
agcttcttgggaggctgagg

SEQ ID NO: 47634 - DNA, 20 bp, Artificial Sequence
  chemically synthesized
gcttcttgggaggctgaggc

SEQ ID NO: 47635 - DNA, 20 bp, Artificial Sequence
  chemically synthesized
ttcttgggaggctgaggcag

SEQ ID NO: 47636 - DNA, 20 bp, Artificial Sequence
  chemically synthesized
gcaggagaaccacttgaacc

SEQ ID NO: 47637 - DNA, 20 bp, Artificial Sequence
  chemically synthesized
caggagaaccacttgaaccc

SEQ ID NO: 47638 - DNA, 20 bp, Artificial Sequence
  chemically synthesized
ggagaaccacttgaacccgg

SEQ ID NO: 47639 - DNA, 20 bp, Artificial Sequence
  chemically synthesized
aaccacttgaacccgggaga

SEQ ID NO: 47640 - DNA, 20 bp, Artificial Sequence
  chemically synthesized
aacccgggagacagatgttg

SEQ ID NO: 47641 - DNA, 20 bp, Artificial Sequence
  chemically synthesized
cgggagacagatgttgcagt

SEQ ID NO: 47642 - DNA, 20 bp, Artificial Sequence
  chemically synthesized
gacagatgttgcagtgagct

SEQ ID NO: 47643 - DNA, 20 bp, Artificial Sequence
  chemically synthesized
gagactgcaccattgcactc

SEQ ID NO: 47644 - DNA, 20 bp, Artificial Sequence
  chemically synthesized
tgcaccattgcactccagcc

SEQ ID NO: 47645 - DNA, 20 bp, Artificial Sequence
  chemically synthesized
gcaccattgcactccagcct

SEQ ID NO: 47646 - DNA, 20 bp, Artificial Sequence
  chemically synthesized
tgcactccagcctgggcaac

SEQ ID NO: 47647 - DNA, 20 bp, Artificial Sequence
  chemically synthesized
cactccagcctgggcaacaa

SEQ ID NO: 47648 - DNA, 20 bp, Artificial Sequence
  chemically synthesized
aaactccatctcaaaaaaaa

SEQ ID NO: 47649 - DNA, 20 bp, Artificial Sequence
  chemically synthesized
catctcaaaaaaaaaagaaa

SEQ ID NO: 47650 - DNA, 20 bp, Artificial Sequence
  chemically synthesized
aaaaaaaagaaaaagaactg

SEQ ID NO: 47651 - DNA, 20 bp, Artificial Sequence
  chemically synthesized
tgctccttatcttccacctc

SEQ ID NO: 47652 - DNA, 20 bp, Artificial Sequence
  chemically synthesized
tcttccacctctggttttcc

SEQ ID NO: 47653 - DNA, 20 bp, Artificial Sequence
  chemically synthesized
cagctctgtatctttgttca

SEQ ID NO: 47654 - DNA, 20 bp, Artificial Sequence
  chemically synthesized
ttcatggtacctcctaatcc

SEQ ID NO: 47655 - DNA, 20 bp, Artificial Sequence
  chemically synthesized
gaactcctactaatgcttca

SEQ ID NO: 47656 - DNA, 20 bp, Artificial Sequence
  chemically synthesized
taaataaaaattgaatgaat

SEQ ID NO: 47657 - DNA, 20 bp, Artificial Sequence
  chemically synthesized
aaataaaaattgaatgaatt

SEQ ID NO: 47658 - DNA, 20 bp, Artificial Sequence
  chemically synthesized
ataaaaattgaatgaattgg

SEQ ID NO: 47659 - DNA, 20 bp, Artificial Sequence
  chemically synthesized
aaaaattgaatgaattggga

SEQ ID NO: 47660 - DNA, 20 bp, Artificial Sequence
  chemically synthesized
aattgggagagtactctgtg

SEQ ID NO: 47661 - DNA, 20 bp, Artificial Sequence
  chemically synthesized
tgggagagtactctgtgcag

SEQ ID NO: 47662 - DNA, 20 bp, Artificial Sequence
  chemically synthesized
ggagagtactctgtgcagtg

SEQ ID NO: 47663 - DNA, 20 bp, Artificial Sequence
  chemically synthesized
tactctgtgcagtggagtgt

SEQ ID NO: 47664 - DNA, 20 bp, Artificial Sequence
  chemically synthesized
gtgcagtggagtgtcagttc

SEQ ID NO: 47665 - DNA, 20 bp, Artificial Sequence
  chemically synthesized
gagtgtcagttctggaaacc

SEQ ID NO: 47666 - DNA, 20 bp, Artificial Sequence
  chemically synthesized
aaacccagttctaatgcacc

SEQ ID NO: 47667 - DNA, 20 bp, Artificial Sequence
  chemically synthesized
aacccagttctaatgcacct

SEQ ID NO: 47668 - DNA, 20 bp, Artificial Sequence
  chemically synthesized
acccagttctaatgcacctg

SEQ ID NO: 47669 - DNA, 20 bp, Artificial Sequence
  chemically synthesized
ctggggtgacctcctctctc

SEQ ID NO: 47670 - DNA, 20 bp, Artificial Sequence
  chemically synthesized
tggggtgacctcctctctct

SEQ ID NO: 47671 - DNA, 20 bp, Artificial Sequence
  chemically synthesized
gacctcctctctctgggcct

SEQ ID NO: 47672 - DNA, 20 bp, Artificial Sequence
  chemically synthesized
cctcagtttctcatgactaa

SEQ ID NO: 47673 - DNA, 20 bp, Artificial Sequence
  chemically synthesized
gtttctcatgactaaaagaa

SEQ ID NO: 47674 - DNA, 20 bp, Artificial Sequence
  chemically synthesized
tttctcatgactaaaagaaa

SEQ ID NO: 47675 - DNA, 20 bp, Artificial Sequence
  chemically synthesized
catgactaaaagaaaaggat

SEQ ID NO: 47676 - DNA, 20 bp, Artificial Sequence
  chemically synthesized
atgaatgaataaatgaactt

SEQ ID NO: 47677 - DNA, 20 bp, Artificial Sequence
  chemically synthesized
tgaatgaataaatgaacttg

SEQ ID NO: 47678 - DNA, 20 bp, Artificial Sequence
  chemically synthesized
aatgaataaatgaacttgag

SEQ ID NO: 47679 - DNA, 20 bp, Artificial Sequence
  chemically synthesized
atgaataaatgaacttgagg

SEQ ID NO: 47680 - DNA, 20 bp, Artificial Sequence
  chemically synthesized
ctcctgttccaaacttccac

SEQ ID NO: 47681 - DNA, 20 bp, Artificial Sequence
  chemically synthesized
cctgttccaaacttccacca

SEQ ID NO: 47682 - DNA, 20 bp, Artificial Sequence
  chemically synthesized
gttccaaacttccaccagag

SEQ ID NO: 47683 - DNA, 20 bp, Artificial Sequence
  chemically synthesized
accagagaagaaacatcctc

SEQ ID NO: 47684 - DNA, 20 bp, Artificial Sequence
  chemically synthesized
ccagagaagaaacatcctca

SEQ ID NO: 47685 - DNA, 20 bp, Artificial Sequence
  chemically synthesized
cagagaagaaacatcctcaa

SEQ ID NO: 47686 - DNA, 20 bp, Artificial Sequence
  chemically synthesized
aagaaacatcctcaagggct

SEQ ID NO: 47687 - DNA, 20 bp, Artificial Sequence
  chemically synthesized
acatcctcaagggcttggtt

SEQ ID NO: 47688 - DNA, 20 bp, Artificial Sequence
  chemically synthesized
catcctcaagggcttggttc

SEQ ID NO: 47689 - DNA, 20 bp, Artificial Sequence
  chemically synthesized
cctcaagggcttggttcagg

SEQ ID NO: 47690 - DNA, 20 bp, Artificial Sequence
  chemically synthesized
gcttggttcaggtggtcata

SEQ ID NO: 47691 - DNA, 20 bp, Artificial Sequence
  chemically synthesized
gcctctgcttactcacctct

SEQ ID NO: 47692 - DNA, 20 bp, Artificial Sequence
  chemically synthesized
cctctgcttactcacctctc

SEQ ID NO: 47693 - DNA, 20 bp, Artificial Sequence
  chemically synthesized
tgcttactcacctctcagga

SEQ ID NO: 47694 - DNA, 20 bp, Artificial Sequence
  chemically synthesized
gcttactcacctctcaggat

SEQ ID NO: 47695 - DNA, 20 bp, Artificial Sequence
  chemically synthesized
cttactcacctctcaggatg

SEQ ID NO: 47696 - DNA, 20 bp, Artificial Sequence
  chemically synthesized
gatggggtactcactatttc

SEQ ID NO: 47697 - DNA, 20 bp, Artificial Sequence
  chemically synthesized
ggtactcactatttccagaa

SEQ ID NO: 47698 - DNA, 20 bp, Artificial Sequence
  chemically synthesized
tatttccagaacagttgttt

SEQ ID NO: 47699 - DNA, 20 bp, Artificial Sequence
  chemically synthesized
tttccagaacagttgttttg

SEQ ID NO: 47700 - DNA, 20 bp, Artificial Sequence
  chemically synthesized
ccagaacagttgttttggag

SEQ ID NO: 47701 - DNA, 20 bp, Artificial Sequence
  chemically synthesized
gaacagttgttttggagcag

SEQ ID NO: 47702 - DNA, 20 bp, Artificial Sequence
  chemically synthesized
tgaaatgccctttcttatcc

SEQ ID NO: 47703 - DNA, 20 bp, Artificial Sequence
  chemically synthesized
acaaccccacaacatccctc

SEQ ID NO: 47704 - DNA, 20 bp, Artificial Sequence
  chemically synthesized
ccccacaacatccctcgaga

SEQ ID NO: 47705 - DNA, 20 bp, Artificial Sequence
  chemically synthesized
aacatccctcgagaaagtca

SEQ ID NO: 47706 - DNA, 20 bp, Artificial Sequence
  chemically synthesized
acatccctcgagaaagtcaa

SEQ ID NO: 47707 - DNA, 20 bp, Artificial Sequence
  chemically synthesized
cctcgagaaagtcaaaggct

SEQ ID NO: 47708 - DNA, 20 bp, Artificial Sequence
  chemically synthesized
ctcgagaaagtcaaaggctc

SEQ ID NO: 47709 - DNA, 20 bp, Artificial Sequence
  chemically synthesized
tcgagaaagtcaaaggctca

SEQ ID NO: 47710 - DNA, 20 bp, Artificial Sequence
  chemically synthesized
aagtcaaaggctcagggaac

SEQ ID NO: 47711 - DNA, 20 bp, Artificial Sequence
  chemically synthesized
agtcaaaggctcagggaaca

SEQ ID NO: 47712 - DNA, 20 bp, Artificial Sequence
  chemically synthesized
caaaggctcagggaacaagg

SEQ ID NO: 47713 - DNA, 20 bp, Artificial Sequence
  chemically synthesized
aaggctcagggaacaaggaa

SEQ ID NO: 47714 - DNA, 20 bp, Artificial Sequence
  chemically synthesized
aggctcagggaacaaggaag

SEQ ID NO: 47715 - DNA, 20 bp, Artificial Sequence
  chemically synthesized
ggctcagggaacaaggaaga

SEQ ID NO: 47716 - DNA, 20 bp, Artificial Sequence
  chemically synthesized
acaaggaagagggctatact

SEQ ID NO: 47717 - DNA, 20 bp, Artificial Sequence
  chemically synthesized
gaagagggctatactgagct

SEQ ID NO: 47718 - DNA, 20 bp, Artificial Sequence
  chemically synthesized
agggctatactgagctgagt

SEQ ID NO: 47719 - DNA, 20 bp, Artificial Sequence
  chemically synthesized
gggctatactgagctgagta

SEQ ID NO: 47720 - DNA, 20 bp, Artificial Sequence
  chemically synthesized
ggacttgccatcctgccacc

SEQ ID NO: 47721 - DNA, 20 bp, Artificial Sequence
  chemically synthesized
atcctgccacccagcacact

SEQ ID NO: 47722 - DNA, 20 bp, Artificial Sequence
  chemically synthesized
tgccacccagcacactcaga

SEQ ID NO: 47723 - DNA, 20 bp, Artificial Sequence
  chemically synthesized
cacccagcacactcagacag

SEQ ID NO: 47724 - DNA, 20 bp, Artificial Sequence
  chemically synthesized
agcacactcagacagaagcg

SEQ ID NO: 47725 - DNA, 20 bp, Artificial Sequence
  chemically synthesized
gcacactcagacagaagcgt

SEQ ID NO: 47726 - DNA, 20 bp, Artificial Sequence
  chemically synthesized
cactcagacagaagcgtggg

SEQ ID NO: 47727 - DNA, 20 bp, Artificial Sequence
  chemically synthesized
actcagacagaagcgtgggc

SEQ ID NO: 47728 - DNA, 20 bp, Artificial Sequence
  chemically synthesized
cagacagaagcgtgggcagg

SEQ ID NO: 47729 - DNA, 20 bp, Artificial Sequence
  chemically synthesized
aagcgtgggcaggcagctgt

SEQ ID NO: 47730 - DNA, 20 bp, Artificial Sequence
  chemically synthesized
cgtgggcaggcagctgtgag

SEQ ID NO: 47731 - DNA, 20 bp, Artificial Sequence
  chemically synthesized
gggcaggcagctgtgagtgg

SEQ ID NO: 47732 - DNA, 20 bp, Artificial Sequence
  chemically synthesized
cagaattttcccctctgccc

SEQ ID NO: 47733 - DNA, 20 bp, Artificial Sequence
  chemically synthesized
agaattttcccctctgcccc

SEQ ID NO: 47734 - DNA, 20 bp, Artificial Sequence
  chemically synthesized
aattttcccctctgccccag

SEQ ID NO: 47735 - DNA, 20 bp, Artificial Sequence
  chemically synthesized
cccctctgccccaggagctg

SEQ ID NO: 47736 - DNA, 20 bp, Artificial Sequence
  chemically synthesized
ctgccccaggagctgtggtt

SEQ ID NO: 47737 - DNA, 20 bp, Artificial Sequence
  chemically synthesized
gccccaggagctgtggtttg

SEQ ID NO: 47738 - DNA, 20 bp, Artificial Sequence
  chemically synthesized
aggagctgtggtttggagca

SEQ ID NO: 47739 - DNA, 20 bp, Artificial Sequence
  chemically synthesized
agcaaagacaatgtcaccaa

SEQ ID NO: 47740 - DNA, 20 bp, Artificial Sequence
  chemically synthesized
gcaaagacaatgtcaccaac

SEQ ID NO: 47741 - DNA, 20 bp, Artificial Sequence
  chemically synthesized
gtcaccaacaggtcacactg

SEQ ID NO: 47742 - DNA, 20 bp, Artificial Sequence
  chemically synthesized
ccaacaggtcacactgcaga

SEQ ID NO: 47743 - DNA, 20 bp, Artificial Sequence
  chemically synthesized
caacaggtcacactgcagac

SEQ ID NO: 47744 - DNA, 20 bp, Artificial Sequence
  chemically synthesized
aacaggtcacactgcagaca

SEQ ID NO: 47745 - DNA, 20 bp, Artificial Sequence
  chemically synthesized
gcagacagggacaaaactgc

SEQ ID NO: 47746 - DNA, 20 bp, Artificial Sequence
  chemically synthesized
aaaactgcaagtgatccccc

SEQ ID NO: 47747 - DNA, 20 bp, Artificial Sequence
  chemically synthesized
aaactgcaagtgatcccccc

SEQ ID NO: 47748 - DNA, 20 bp, Artificial Sequence
  chemically synthesized
aactgcaagtgatccccccg

SEQ ID NO: 47749 - DNA, 20 bp, Artificial Sequence
  chemically synthesized
ccccccggggcttgcattgt

SEQ ID NO: 47750 - DNA, 20 bp, Artificial Sequence
  chemically synthesized
ttgcattgtaagttcactca

SEQ ID NO: 47751 - DNA, 20 bp, Artificial Sequence
  chemically synthesized
gtaagttcactcatggtcaa

SEQ ID NO: 47752 - DNA, 20 bp, Artificial Sequence
  chemically synthesized
tctccccatctgctgccact

SEQ ID NO: 47753 - DNA, 20 bp, Artificial Sequence
  chemically synthesized
catctgctgccactgagccg

SEQ ID NO: 47754 - DNA, 20 bp, Artificial Sequence
  chemically synthesized
atctgctgccactgagccgt

SEQ ID NO: 47755 - DNA, 20 bp, Artificial Sequence
  chemically synthesized
tctgctgccactgagccgta

SEQ ID NO: 47756 - DNA, 20 bp, Artificial Sequence
  chemically synthesized
cgattgtcacctccctttta

SEQ ID NO: 47757 - DNA, 20 bp, Artificial Sequence
  chemically synthesized
gtcacctcccttttaaagat

SEQ ID NO: 47758 - DNA, 20 bp, Artificial Sequence
  chemically synthesized
tcacctcccttttaaagatt

SEQ ID NO: 47759 - DNA, 20 bp, Artificial Sequence
  chemically synthesized
cccttttaaagattaggcaa

SEQ ID NO: 47760 - DNA, 20 bp, Artificial Sequence
  chemically synthesized
cttttaaagattaggcaatg

SEQ ID NO: 47761 - DNA, 20 bp, Artificial Sequence
  chemically synthesized
ttttaaagattaggcaatgg

SEQ ID NO: 47762 - DNA, 20 bp, Artificial Sequence
  chemically synthesized
agattaggcaatggaggctc

SEQ ID NO: 47763 - DNA, 20 bp, Artificial Sequence
  chemically synthesized
gattaggcaatggaggctca

SEQ ID NO: 47764 - DNA, 20 bp, Artificial Sequence
  chemically synthesized
ggcaatggaggctcaaggat

SEQ ID NO: 47765 - DNA, 20 bp, Artificial Sequence
  chemically synthesized
tcaaggataagtgacttgtc

SEQ ID NO: 47766 - DNA, 20 bp, Artificial Sequence
  chemically synthesized
aagtgacttgtcaagcacca

SEQ ID NO: 47767 - DNA, 20 bp, Artificial Sequence
  chemically synthesized
gacttgtcaagcaccacagc

SEQ ID NO: 47768 - DNA, 20 bp, Artificial Sequence
  chemically synthesized
tgtcaagcaccacagctagt

SEQ ID NO: 47769 - DNA, 20 bp, Artificial Sequence
  chemically synthesized
tcaagcaccacagctagtga

SEQ ID NO: 47770 - DNA, 20 bp, Artificial Sequence
  chemically synthesized
caagcaccacagctagtgag

SEQ ID NO: 47771 - DNA, 20 bp, Artificial Sequence
  chemically synthesized
gcaccacagctagtgagagg

SEQ ID NO: 47772 - DNA, 20 bp, Artificial Sequence
  chemically synthesized
acagctagtgagaggaagcc

SEQ ID NO: 47773 - DNA, 20 bp, Artificial Sequence
  chemically synthesized
tcaaccccacatctgactcc

SEQ ID NO: 47774 - DNA, 20 bp, Artificial Sequence
  chemically synthesized
ccccacatctgactccaagc

SEQ ID NO: 47775 - DNA, 20 bp, Artificial Sequence
  chemically synthesized
cccacatctgactccaagct

SEQ ID NO: 47776 - DNA, 20 bp, Artificial Sequence
  chemically synthesized
ccacatctgactccaagctg

SEQ ID NO: 47777 - DNA, 20 bp, Artificial Sequence
  chemically synthesized
cacatctgactccaagctgg

SEQ ID NO: 47778 - DNA, 20 bp, Artificial Sequence
  chemically synthesized
tgactccaagctgggggaca

SEQ ID NO: 47779 - DNA, 20 bp, Artificial Sequence
  chemically synthesized
agctgggggacacagaacct

SEQ ID NO: 47780 - DNA, 20 bp, Artificial Sequence
  chemically synthesized
ggggacacagaacctcagcc

SEQ ID NO: 47781 - DNA, 20 bp, Artificial Sequence
  chemically synthesized
acagaacctcagccaagtcc

SEQ ID NO: 47782 - DNA, 20 bp, Artificial Sequence
  chemically synthesized
cagaacctcagccaagtcct

SEQ ID NO: 47783 - DNA, 20 bp, Artificial Sequence
  chemically synthesized
acctcagccaagtcctgggc

SEQ ID NO: 47784 - DNA, 20 bp, Artificial Sequence
  chemically synthesized
agtcctgggctggtaatact

SEQ ID NO: 47785 - DNA, 20 bp, Artificial Sequence
  chemically synthesized
gggctggtaatacttagaaa

SEQ ID NO: 47786 - DNA, 20 bp, Artificial Sequence
  chemically synthesized
tggtaatacttagaaaaagc

SEQ ID NO: 47787 - DNA, 20 bp, Artificial Sequence
  chemically synthesized
taatacttagaaaaagctag

SEQ ID NO: 47788 - DNA, 20 bp, Artificial Sequence
  chemically synthesized
aaaagctagtggtctcgccc

SEQ ID NO: 47789 - DNA, 20 bp, Artificial Sequence
  chemically synthesized
aaagctagtggtctcgcccc

SEQ ID NO: 47790 - DNA, 20 bp, Artificial Sequence
  chemically synthesized
gctagtggtctcgccccggg

SEQ ID NO: 47791 - DNA, 20 bp, Artificial Sequence
  chemically synthesized
agtggtctcgccccgggaag

SEQ ID NO: 47792 - DNA, 20 bp, Artificial Sequence
  chemically synthesized
ccccgggaagaagcttccca

SEQ ID NO: 47793 - DNA, 20 bp, Artificial Sequence
  chemically synthesized
gaagaagcttcccacagcct

SEQ ID NO: 47794 - DNA, 20 bp, Artificial Sequence
  chemically synthesized
aagaagcttcccacagcctg

SEQ ID NO: 47795 - DNA, 20 bp, Artificial Sequence
  chemically synthesized
agaagcttcccacagcctga

SEQ ID NO: 47796 - DNA, 20 bp, Artificial Sequence
  chemically synthesized
gcttcccacagcctgagggc

SEQ ID NO: 47797 - DNA, 20 bp, Artificial Sequence
  chemically synthesized
tcccacagcctgagggccag

SEQ ID NO: 47798 - DNA, 20 bp, Artificial Sequence
  chemically synthesized
acagcctgagggccagaagc

SEQ ID NO: 47799 - DNA, 20 bp, Artificial Sequence
  chemically synthesized
gcctgagggccagaagctgg

SEQ ID NO: 47800 - DNA, 20 bp, Artificial Sequence
  chemically synthesized
ctgagggccagaagctggca

SEQ ID NO: 47801 - DNA, 20 bp, Artificial Sequence
  chemically synthesized
cagaagctggcagagttgtt

SEQ ID NO: 47802 - DNA, 20 bp, Artificial Sequence
  chemically synthesized
gagcaaactcgccccgcaca

SEQ ID NO: 47803 - DNA, 20 bp, Artificial Sequence
  chemically synthesized
aaactcgccccgcacacggt

SEQ ID NO: 47804 - DNA, 20 bp, Artificial Sequence
  chemically synthesized
ctcgccccgcacacggtcgg

SEQ ID NO: 47805 - DNA, 20 bp, Artificial Sequence
  chemically synthesized
ccccgcacacggtcggcaga

SEQ ID NO: 47806 - DNA, 20 bp, Artificial Sequence
  chemically synthesized
gcacacggtcggcagacagc

SEQ ID NO: 47807 - DNA, 20 bp, Artificial Sequence
  chemically synthesized
cacacggtcggcagacagcc

SEQ ID NO: 47808 - DNA, 20 bp, Artificial Sequence
  chemically synthesized
acggtcggcagacagccagg

SEQ ID NO: 47809 - DNA, 20 bp, Artificial Sequence
  chemically synthesized
cggtcggcagacagccaggt

SEQ ID NO: 47810 - DNA, 20 bp, Artificial Sequence
  chemically synthesized
ggcagacagccaggtgggct

SEQ ID NO: 47811 - DNA, 20 bp, Artificial Sequence
  chemically synthesized
gcagacagccaggtgggctg

SEQ ID NO: 47812 - DNA, 20 bp, Artificial Sequence
  chemically synthesized
agccaggtgggctgaggcgc

SEQ ID NO: 47813 - DNA, 20 bp, Artificial Sequence
  chemically synthesized
gccaggtgggctgaggcgcc

SEQ ID NO: 47814 - DNA, 20 bp, Artificial Sequence
  chemically synthesized
gtgggctgaggcgccgggct

SEQ ID NO: 47815 - DNA, 20 bp, Artificial Sequence
  chemically synthesized
tgaggcgccgggctcagctc

SEQ ID NO: 47816 - DNA, 20 bp, Artificial Sequence
  chemically synthesized
gaggcgccgggctcagctcc

SEQ ID NO: 47817 - DNA, 20 bp, Artificial Sequence
  chemically synthesized
aggcgccgggctcagctccg

SEQ ID NO: 47818 - DNA, 20 bp, Artificial Sequence
  chemically synthesized
cgggctcagctccggggtcc

SEQ ID NO: 47819 - DNA, 20 bp, Artificial Sequence
  chemically synthesized
cagctccggggtcccagtac

SEQ ID NO: 47820 - DNA, 20 bp, Artificial Sequence
  chemically synthesized
agctccggggtcccagtacc

SEQ ID NO: 47821 - DNA, 20 bp, Artificial Sequence
  chemically synthesized
agtaccaggcgcaccacctc

SEQ ID NO: 47822 - DNA, 20 bp, Artificial Sequence
  chemically synthesized
aggcgcaccacctccggctc

SEQ ID NO: 47823 - DNA, 20 bp, Artificial Sequence
  chemically synthesized
gcgcaccacctccggctcca

SEQ ID NO: 47824 - DNA, 20 bp, Artificial Sequence
  chemically synthesized
acctccggctccagagcacc

SEQ ID NO: 47825 - DNA, 20 bp, Artificial Sequence
  chemically synthesized
cctccggctccagagcacca

SEQ ID NO: 47826 - DNA, 20 bp, Artificial Sequence
  chemically synthesized
ctccggctccagagcaccaa

SEQ ID NO: 47827 - DNA, 20 bp, Artificial Sequence
  chemically synthesized
ccaagggcccttccctgcct

SEQ ID NO: 47828 - DNA, 20 bp, Artificial Sequence
  chemically synthesized
ccttccctgcctgagtccta

SEQ ID NO: 47829 - DNA, 20 bp, Artificial Sequence
  chemically synthesized
cttccctgcctgagtcctaa

SEQ ID NO: 47830 - DNA, 20 bp, Artificial Sequence
  chemically synthesized
tgagtcctaaaggacgccaa

SEQ ID NO: 47831 - DNA, 20 bp, Artificial Sequence
  chemically synthesized
gagtcctaaaggacgccaat

SEQ ID NO: 47832 - DNA, 20 bp, Artificial Sequence
  chemically synthesized
aaaggacgccaatgggcctc

SEQ ID NO: 47833 - DNA, 20 bp, Artificial Sequence
  chemically synthesized
ccccttctcccctgcccctt

SEQ ID NO: 47834 - DNA, 20 bp, Artificial Sequence
  chemically synthesized
ttctcccctgccccttcagc

SEQ ID NO: 47835 - DNA, 20 bp, Artificial Sequence
  chemically synthesized
cttcagctggttcttttctt

SEQ ID NO: 47836 - DNA, 20 bp, Artificial Sequence
  chemically synthesized
gttcttttcttcggctgaaa

SEQ ID NO: 47837 - DNA, 20 bp, Artificial Sequence
  chemically synthesized
ttttcttcggctgaaacaga

SEQ ID NO: 47838 - DNA, 20 bp, Artificial Sequence
  chemically synthesized
ggctgaaacagatggaatac

SEQ ID NO: 47839 - DNA, 20 bp, Artificial Sequence
  chemically synthesized
ctgaaacagatggaatacta

SEQ ID NO: 47840 - DNA, 20 bp, Artificial Sequence
  chemically synthesized
cagatggaatactagagcat

SEQ ID NO: 47841 - DNA, 20 bp, Artificial Sequence
  chemically synthesized
agcatgagttctgtgtcata

SEQ ID NO: 47842 - DNA, 20 bp, Artificial Sequence
  chemically synthesized
aagaaattgcctcgtgctcc

SEQ ID NO: 47843 - DNA, 20 bp, Artificial Sequence
  chemically synthesized
ttcccaccccgcccctgtct

SEQ ID NO: 47844 - DNA, 20 bp, Artificial Sequence
  chemically synthesized
tcccaccccgcccctgtctc

SEQ ID NO: 47845 - DNA, 20 bp, Artificial Sequence
  chemically synthesized
caccccgcccctgtctcggg

SEQ ID NO: 47846 - DNA, 20 bp, Artificial Sequence
  chemically synthesized
accccgcccctgtctcgggt

SEQ ID NO: 47847 - DNA, 20 bp, Artificial Sequence
  chemically synthesized
ccccgcccctgtctcgggta

SEQ ID NO: 47848 - DNA, 20 bp, Artificial Sequence
  chemically synthesized
ctcgggtagggccttctctc

SEQ ID NO: 47849 - DNA, 20 bp, Artificial Sequence
  chemically synthesized
tcgggtagggccttctctcc

SEQ ID NO: 47850 - DNA, 20 bp, Artificial Sequence
  chemically synthesized
ccatgttttccaaaccaaat

SEQ ID NO: 47851 - DNA, 20 bp, Artificial Sequence
  chemically synthesized
caaatcggaacccactataa

SEQ ID NO: 47852 - DNA, 20 bp, Artificial Sequence
  chemically synthesized
tcggaacccactataatggc

SEQ ID NO: 47853 - DNA, 20 bp, Artificial Sequence
  chemically synthesized
aagcccgctttctctgtgcc

SEQ ID NO: 47854 - DNA, 20 bp, Artificial Sequence
  chemically synthesized
cgctttctctgtgcctggtg

SEQ ID NO: 47855 - DNA, 20 bp, Artificial Sequence
  chemically synthesized
tctgtgcctggtgcagttcc

SEQ ID NO: 47856 - DNA, 20 bp, Artificial Sequence
  chemically synthesized
gtgcagttcccagtacgttc

SEQ ID NO: 47857 - DNA, 20 bp, Artificial Sequence
  chemically synthesized
tgcagttcccagtacgttcc

SEQ ID NO: 47858 - DNA, 20 bp, Artificial Sequence
  chemically synthesized
tccttcacccacctgtgccg

SEQ ID NO: 47859 - DNA, 20 bp, Artificial Sequence
  chemically synthesized
tcacccacctgtgccgcggc

SEQ ID NO: 47860 - DNA, 20 bp, Artificial Sequence
  chemically synthesized
cacccacctgtgccgcggcg

SEQ ID NO: 47861 - DNA, 20 bp, Artificial Sequence
  chemically synthesized
ccacctgtgccgcggcgagg

SEQ ID NO: 47862 - DNA, 20 bp, Artificial Sequence
  chemically synthesized
tgccgcggcgaggcagaaac

SEQ ID NO: 47863 - DNA, 20 bp, Artificial Sequence
  chemically synthesized
gccgcggcgaggcagaaact

SEQ ID NO: 47864 - DNA, 20 bp, Artificial Sequence
  chemically synthesized
gaggcagaaactgggaaatc

SEQ ID NO: 47865 - DNA, 20 bp, Artificial Sequence
  chemically synthesized
aggcagaaactgggaaatct

SEQ ID NO: 47866 - DNA, 20 bp, Artificial Sequence
  chemically synthesized
cagaaactgggaaatctggg

SEQ ID NO: 47867 - DNA, 20 bp, Artificial Sequence
  chemically synthesized
agaaactgggaaatctgggc

SEQ ID NO: 47868 - DNA, 20 bp, Artificial Sequence
  chemically synthesized
gaaatctgggcaggatatcc

SEQ ID NO: 47869 - DNA, 20 bp, Artificial Sequence
  chemically synthesized
atctgggcaggatatcctgg

SEQ ID NO: 47870 - DNA, 20 bp, Artificial Sequence
  chemically synthesized
gtgctctgctcgcccttcct

SEQ ID NO: 47871 - DNA, 20 bp, Artificial Sequence
  chemically synthesized
gctcgcccttcctcggcctc

SEQ ID NO: 47872 - DNA, 20 bp, Artificial Sequence
  chemically synthesized
ctcgcccttcctcggcctcc

SEQ ID NO: 47873 - DNA, 20 bp, Artificial Sequence
  chemically synthesized
ccgcgaaccttcccactgaa

SEQ ID NO: 47874 - DNA, 20 bp, Artificial Sequence
  chemically synthesized
aaccttcccactgaatagcg

SEQ ID NO: 47875 - DNA, 20 bp, Artificial Sequence
  chemically synthesized
aatagcgcagccgcacgccc

SEQ ID NO: 47876 - DNA, 20 bp, Artificial Sequence
  chemically synthesized
gcgcagccgcacgccccagc

SEQ ID NO: 47877 - DNA, 20 bp, Artificial Sequence
  chemically synthesized
cacgccccagcaagtcccca

SEQ ID NO: 47878 - DNA, 20 bp, Artificial Sequence
  chemically synthesized
cgccccagcaagtccccaaa

SEQ ID NO: 47879 - DNA, 20 bp, Artificial Sequence
  chemically synthesized
ccagcaagtccccaaagagc

SEQ ID NO: 47880 - DNA, 20 bp, Artificial Sequence
  chemically synthesized
ctcccccgccgccttgcctg

SEQ ID NO: 47881 - DNA, 20 bp, Artificial Sequence
  chemically synthesized
ccgccttgcctgcagtcccc

SEQ ID NO: 47882 - DNA, 20 bp, Artificial Sequence
  chemically synthesized
gcagtccccaagatcgtgcc

SEQ ID NO: 47883 - DNA, 20 bp, Artificial Sequence
  chemically synthesized
ccccaagatcgtgccaagcg

SEQ ID NO: 47884 - DNA, 20 bp, Artificial Sequence
  chemically synthesized
ccaagatcgtgccaagcgaa

SEQ ID NO: 47885 - DNA, 20 bp, Artificial Sequence
  chemically synthesized
cgtgccaagcgaagagccct

SEQ ID NO: 47886 - DNA, 20 bp, Artificial Sequence
  chemically synthesized
actccacttcctctcttaca

SEQ ID NO: 47887 - DNA, 20 bp, Artificial Sequence
  chemically synthesized
ctccacttcctctcttacat

SEQ ID NO: 47888 - DNA, 20 bp, Artificial Sequence
  chemically synthesized
tccacttcctctcttacatg

SEQ ID NO: 47889 - DNA, 20 bp, Artificial Sequence
  chemically synthesized
ccacttcctctcttacatgg

SEQ ID NO: 47890 - DNA, 20 bp, Artificial Sequence
  chemically synthesized
cacttcctctcttacatggg

SEQ ID NO: 47891 - DNA, 20 bp, Artificial Sequence
  chemically synthesized
ctcttacatggggggaaact

SEQ ID NO: 47892 - DNA, 20 bp, Artificial Sequence
  chemically synthesized
tcttacatggggggaaactg

SEQ ID NO: 47893 - DNA, 20 bp, Artificial Sequence
  chemically synthesized
atggggggaaactgaggccc

SEQ ID NO: 47894 - DNA, 20 bp, Artificial Sequence
  chemically synthesized
ggggggaaactgaggcccga

SEQ ID NO: 47895 - DNA, 20 bp, Artificial Sequence
  chemically synthesized
gggggaaactgaggcccgag

SEQ ID NO: 47896 - DNA, 20 bp, Artificial Sequence
  chemically synthesized
aactgaggcccgagaggaaa

SEQ ID NO: 47897 - DNA, 20 bp, Artificial Sequence
  chemically synthesized
gaaacagcaccgcaccgtcc

SEQ ID NO: 47898 - DNA, 20 bp, Artificial Sequence
  chemically synthesized
gcaccgcaccgtcccggctg

SEQ ID NO: 47899 - DNA, 20 bp, Artificial Sequence
  chemically synthesized
caccgcaccgtcccggctgc

SEQ ID NO: 47900 - DNA, 20 bp, Artificial Sequence
  chemically synthesized
tcccggctgcgggttcgccc

SEQ ID NO: 47901 - DNA, 20 bp, Artificial Sequence
  chemically synthesized
ccatccctacacccgcacct

SEQ ID NO: 47902 - DNA, 20 bp, Artificial Sequence
  chemically synthesized
cctacacccgcaccttggcg

SEQ ID NO: 47903 - DNA, 20 bp, Artificial Sequence
  chemically synthesized
acacccgcaccttggcgcag

SEQ ID NO: 47904 - DNA, 20 bp, Artificial Sequence
  chemically synthesized
cccgcaccttggcgcagcgg

SEQ ID NO: 47905 - DNA, 20 bp, Artificial Sequence
  chemically synthesized
gcaccttggcgcagcggtgg

SEQ ID NO: 47906 - DNA, 20 bp, Artificial Sequence
  chemically synthesized
caccttggcgcagcggtgga

SEQ ID NO: 47907 - DNA, 20 bp, Artificial Sequence
  chemically synthesized
cttggcgcagcggtggaagg

SEQ ID NO: 47908 - DNA, 20 bp, Artificial Sequence
  chemically synthesized
gcagcggtggaaggtggctg

SEQ ID NO: 47909 - DNA, 20 bp, Artificial Sequence
  chemically synthesized
ggtggctgtggttccgtgct

SEQ ID NO: 47910 - DNA, 20 bp, Artificial Sequence
  chemically synthesized
gtggctgtggttccgtgctc

SEQ ID NO: 47911 - DNA, 20 bp, Artificial Sequence
  chemically synthesized
ggttccgtgctcgggtgctt

SEQ ID NO: 47912 - DNA, 20 bp, Artificial Sequence
  chemically synthesized
ccgtgctcgggtgcttcggc

SEQ ID NO: 47913 - DNA, 20 bp, Artificial Sequence
  chemically synthesized
cgtgctcgggtgcttcggcc

SEQ ID NO: 47914 - DNA, 20 bp, Artificial Sequence
  chemically synthesized
ttcggccaggccgtcctcct

SEQ ID NO: 47915 - DNA, 20 bp, Artificial Sequence
  chemically synthesized
ggccgtcctcctcggaacgc

SEQ ID NO: 47916 - DNA, 20 bp, Artificial Sequence
  chemically synthesized
gccgtcctcctcggaacgca

SEQ ID NO: 47917 - DNA, 20 bp, Artificial Sequence
  chemically synthesized
tcctcctcggaacgcaaggc

SEQ ID NO: 47918 - DNA, 20 bp, Artificial Sequence
  chemically synthesized
tcggaacgcaaggctagcac

SEQ ID NO: 47919 - DNA, 20 bp, Artificial Sequence
  chemically synthesized
aggctagcaccagctcctcg

SEQ ID NO: 47920 - DNA, 20 bp, Artificial Sequence
  chemically synthesized
cgtcctcgtcctcctgcgca

SEQ ID NO: 47921 - DNA, 20 bp, Artificial Sequence
  chemically synthesized
gtcctcgtcctcctgcgcac

SEQ ID NO: 47922 - DNA, 20 bp, Artificial Sequence
  chemically synthesized
ctcctgcgcacgggcgcccg

SEQ ID NO: 47923 - DNA, 20 bp, Artificial Sequence
  chemically synthesized
tcctgcgcacgggcgcccgc

SEQ ID NO: 47924 - DNA, 20 bp, Artificial Sequence
  chemically synthesized
gcacgggcgcccgcgggacc

SEQ ID NO: 47925 - DNA, 20 bp, Artificial Sequence
  chemically synthesized
cacgggcgcccgcgggaccc

SEQ ID NO: 47926 - DNA, 20 bp, Artificial Sequence
  chemically synthesized
cgggcgcccgcgggacccag

SEQ ID NO: 47927 - DNA, 20 bp, Artificial Sequence
  chemically synthesized
gcgcccgcgggacccaggag

SEQ ID NO: 47928 - DNA, 20 bp, Artificial Sequence
  chemically synthesized
cccgcgggacccaggagcag

SEQ ID NO: 47929 - DNA, 20 bp, Artificial Sequence
  chemically synthesized
gcgggacccaggagcagcag

SEQ ID NO: 47930 - DNA, 20 bp, Artificial Sequence
  chemically synthesized
ggacccaggagcagcagcag

SEQ ID NO: 47931 - DNA, 20 bp, Artificial Sequence
  chemically synthesized
cccaggagcagcagcagcag

SEQ ID NO: 47932 - DNA, 20 bp, Artificial Sequence
  chemically synthesized
aggagcagcagcagcagcag

SEQ ID NO: 47933 - DNA, 20 bp, Artificial Sequence
  chemically synthesized
agcagcagcagcagcagcag

SEQ ID NO: 47934 - DNA, 20 bp, Artificial Sequence
  chemically synthesized
agcagcagcagcagcagcag

SEQ ID NO: 47935 - DNA, 20 bp, Artificial Sequence
  chemically synthesized
agcagcagcagcagcagtgg

SEQ ID NO: 47936 - DNA, 20 bp, Artificial Sequence
  chemically synthesized
agcagcagcagcagtggcag

SEQ ID NO: 47937 - DNA, 20 bp, Artificial Sequence
  chemically synthesized
gcagcagtggcagcggccac

SEQ ID NO: 47938 - DNA, 20 bp, Artificial Sequence
  chemically synthesized
cagcagtggcagcggccacc

SEQ ID NO: 47939 - DNA, 20 bp, Artificial Sequence
  chemically synthesized
cagcggccaccaggaccgcc

SEQ ID NO: 47940 - DNA, 20 bp, Artificial Sequence
  chemically synthesized
gcggccaccaggaccgcctg

SEQ ID NO: 47941 - DNA, 20 bp, Artificial Sequence
  chemically synthesized
ccaggaccgcctggagctga

SEQ ID NO: 47942 - DNA, 20 bp, Artificial Sequence
  chemically synthesized
ctggagctgacggtgcccat

SEQ ID NO: 47943 - DNA, 20 bp, Artificial Sequence
  chemically synthesized
tggagctgacggtgcccatg

SEQ ID NO: 47944 - DNA, 20 bp, Artificial Sequence
  chemically synthesized
ggagctgacggtgcccatga

SEQ ID NO: 47945 - DNA, 20 bp, Artificial Sequence
  chemically synthesized
ctgacggtgcccatgagggc

SEQ ID NO: 47946 - DNA, 20 bp, Artificial Sequence
  chemically synthesized
tgacggtgcccatgagggcc

SEQ ID NO: 47947 - DNA, 20 bp, Artificial Sequence
  chemically synthesized
gacggtgcccatgagggcca

SEQ ID NO: 47948 - DNA, 20 bp, Artificial Sequence
  chemically synthesized
acggtgcccatgagggccag

SEQ ID NO: 47949 - DNA, 20 bp, Artificial Sequence
  chemically synthesized
ggtgcccatgagggccaggg

SEQ ID NO: 47950 - DNA, 20 bp, Artificial Sequence
  chemically synthesized
tgcccatgagggccagggga

SEQ ID NO: 47951 - DNA, 20 bp, Artificial Sequence
  chemically synthesized
gcccatgagggccaggggag

SEQ ID NO: 47952 - DNA, 20 bp, Artificial Sequence
  chemically synthesized
caggggagaggttgctgtcc

SEQ ID NO: 47953 - DNA, 20 bp, Artificial Sequence
  chemically synthesized
ggagaggttgctgtcctggc

SEQ ID NO: 47954 - DNA, 20 bp, Artificial Sequence
  chemically synthesized
gagaggttgctgtcctggcg

SEQ ID NO: 47955 - DNA, 20 bp, Artificial Sequence
  chemically synthesized
gaggttgctgtcctggcgag

SEQ ID NO: 47956 - DNA, 20 bp, Artificial Sequence
  chemically synthesized
gctgtcctggcgaggagacc

SEQ ID NO: 47957 - DNA, 20 bp, Artificial Sequence
  chemically synthesized
tgtcctggcgaggagaccta

SEQ ID NO: 47958 - DNA, 20 bp, Artificial Sequence
  chemically synthesized
gtcctggcgaggagacctag

SEQ ID NO: 47959 - DNA, 20 bp, Artificial Sequence
  chemically synthesized
ggagacctagaggccgtgcg

SEQ ID NO: 47960 - DNA, 20 bp, Artificial Sequence
  chemically synthesized
aggccgtgcgcggtccacgc

SEQ ID NO: 47961 - DNA, 20 bp, Artificial Sequence
  chemically synthesized
ccgtgcgcggtccacgccgg

SEQ ID NO: 47962 - DNA, 20 bp, Artificial Sequence
  chemically synthesized
gtccacgccggcggcgcctt

SEQ ID NO: 47963 - DNA, 20 bp, Artificial Sequence
  chemically synthesized
cggcggcgccttgagccttg

SEQ ID NO: 47964 - DNA, 20 bp, Artificial Sequence
  chemically synthesized
cggcgccttgagccttgcgg

SEQ ID NO: 47965 - DNA, 20 bp, Artificial Sequence
  chemically synthesized
ggcgccttgagccttgcggt

SEQ ID NO: 47966 - DNA, 20 bp, Artificial Sequence
  chemically synthesized
gcgccttgagccttgcggtg

SEQ ID NO: 47967 - DNA, 20 bp, Artificial Sequence
  chemically synthesized
gccttgagccttgcggtggg

SEQ ID NO: 47968 - DNA, 20 bp, Artificial Sequence
  chemically synthesized
ccttgagccttgcggtgggg

SEQ ID NO: 47969 - DNA, 20 bp, Artificial Sequence
  chemically synthesized
ttgcggtggggaggactgtg

SEQ ID NO: 47970 - DNA, 20 bp, Artificial Sequence
  chemically synthesized
tgcggtggggaggactgtgc

SEQ ID NO: 47971 - DNA, 20 bp, Artificial Sequence
  chemically synthesized
cggtggggaggactgtgcag

SEQ ID NO: 47972 - DNA, 20 bp, Artificial Sequence
  chemically synthesized
ggaggactgtgcaggagctg

SEQ ID NO: 47973 - DNA, 20 bp, Artificial Sequence
  chemically synthesized
actgtgcaggagctgaagtt

SEQ ID NO: 47974 - DNA, 20 bp, Artificial Sequence
  chemically synthesized
ctgtgcaggagctgaagttc

SEQ ID NO: 47975 - DNA, 20 bp, Artificial Sequence
  chemically synthesized
gtgcaggagctgaagttcag

SEQ ID NO: 47976 - DNA, 20 bp, Artificial Sequence
  chemically synthesized
caggagctgaagttcaggag

SEQ ID NO: 47977 - DNA, 20 bp, Artificial Sequence
  chemically synthesized
aggagctgaagttcaggagc

SEQ ID NO: 47978 - DNA, 20 bp, Artificial Sequence
  chemically synthesized
ggagctgaagttcaggagca

SEQ ID NO: 47979 - DNA, 20 bp, Artificial Sequence
  chemically synthesized
gttcaggagcagggcgcgtg

SEQ ID NO: 47980 - DNA, 20 bp, Artificial Sequence
  chemically synthesized
ttcaggagcagggcgcgtga

SEQ ID NO: 47981 - DNA, 20 bp, Artificial Sequence
  chemically synthesized
tcaggagcagggcgcgtgaa

SEQ ID NO: 47982 - DNA, 20 bp, Artificial Sequence
  chemically synthesized
caggagcagggcgcgtgaag

SEQ ID NO: 47983 - DNA, 20 bp, Artificial Sequence
  chemically synthesized
agggcgcgtgaaggggcgcg

SEQ ID NO: 47984 - DNA, 20 bp, Artificial Sequence
  chemically synthesized
tgaaggggcgcgcggaatcc

SEQ ID NO: 47985 - DNA, 20 bp, Artificial Sequence
  chemically synthesized
ggggcgcgcggaatcctggc

SEQ ID NO: 47986 - DNA, 20 bp, Artificial Sequence
  chemically synthesized
gggcgcgcggaatcctggct

SEQ ID NO: 47987 - DNA, 20 bp, Artificial Sequence
  chemically synthesized
gcgcgcggaatcctggctgg

SEQ ID NO: 47988 - DNA, 20 bp, Artificial Sequence
  chemically synthesized
gcggaatcctggctgggagc

SEQ ID NO: 47989 - DNA, 20 bp, Artificial Sequence
  chemically synthesized
cggaatcctggctgggagct

SEQ ID NO: 47990 - DNA, 20 bp, Artificial Sequence
  chemically synthesized
gaatcctggctgggagctgg

SEQ ID NO: 47991 - DNA, 20 bp, Artificial Sequence
  chemically synthesized
gctgctgcaacgacgcgtcc

SEQ ID NO: 47992 - DNA, 20 bp, Artificial Sequence
  chemically synthesized
cgacgcgtcccggcccgccc

SEQ ID NO: 47993 - DNA, 20 bp, Artificial Sequence
  chemically synthesized
gcgtcccggcccgcccgagc

SEQ ID NO: 47994 - DNA, 20 bp, Artificial Sequence
  chemically synthesized
cccgagccagtctcactgcc

SEQ ID NO: 47995 - DNA, 20 bp, Artificial Sequence
  chemically synthesized
cactgcctggctcactcctc

SEQ ID NO: 47996 - DNA, 20 bp, Artificial Sequence
  chemically synthesized
actgcctggctcactcctcc

SEQ ID NO: 47997 - DNA, 20 bp, Artificial Sequence
  chemically synthesized
ctggctcactcctccaggct

SEQ ID NO: 47998 - DNA, 20 bp, Artificial Sequence
  chemically synthesized
ggctcagaccctgaactgaa

SEQ ID NO: 47999 - DNA, 20 bp, Artificial Sequence
  chemically synthesized
tcagaccctgaactgaacgg

SEQ ID NO: 48000 - DNA, 20 bp, Artificial Sequence
  chemically synthesized
cggcgcccgcctgcaaccat

SEQ ID NO: 48001 - DNA, 20 bp, Artificial Sequence
  chemically synthesized
tgagcgcctcgacgtcgctg

SEQ ID NO: 48002 - DNA, 20 bp, Artificial Sequence
  chemically synthesized
acgtcgctgcggaaaccttc

SEQ ID NO: 48003 - DNA, 20 bp, Artificial Sequence
  chemically synthesized
cgtcgctgcggaaaccttct

SEQ ID NO: 48004 - DNA, 20 bp, Artificial Sequence
  chemically synthesized
gtcgctgcggaaaccttcta

SEQ ID NO: 48005 - DNA, 20 bp, Artificial Sequence
  chemically synthesized
tgcggaaaccttctagggtg

SEQ ID NO: 48006 - DNA, 20 bp, Artificial Sequence
  chemically synthesized
gcggaaaccttctagggtgt

SEQ ID NO: 48007 - DNA, 20 bp, Artificial Sequence
  chemically synthesized
gggtgtgggtgcttgacgcc

SEQ ID NO: 48008 - DNA, 20 bp, Artificial Sequence
  chemically synthesized
ggtgtgggtgcttgacgcct

SEQ ID NO: 48009 - DNA, 20 bp, Artificial Sequence
  chemically synthesized
gtgtgggtgcttgacgcctg

SEQ ID NO: 48010 - DNA, 20 bp, Artificial Sequence
  chemically synthesized
tgcttgacgcctggggcgcg

SEQ ID NO: 48011 - DNA, 20 bp, Artificial Sequence
  chemically synthesized
gggcgcgcagatcacgccac

SEQ ID NO: 48012 - DNA, 20 bp, Artificial Sequence
  chemically synthesized
gcgcgcagatcacgccacca

SEQ ID NO: 48013 - DNA, 20 bp, Artificial Sequence
  chemically synthesized
tcacgccaccagagccccat

SEQ ID NO: 48014 - DNA, 20 bp, Artificial Sequence
  chemically synthesized
cctatctgattaaacattaa

SEQ ID NO: 48015 - DNA, 20 bp, Artificial Sequence
  chemically synthesized
ttaaacattaacggaacccc

SEQ ID NO: 48016 - DNA, 20 bp, Artificial Sequence
  chemically synthesized
cattaacggaacccccggac

SEQ ID NO: 48017 - DNA, 20 bp, Artificial Sequence
  chemically synthesized
ttaacggaacccccggactg

SEQ ID NO: 48018 - DNA, 20 bp, Artificial Sequence
  chemically synthesized
taacggaacccccggactgg

SEQ ID NO: 48019 - DNA, 20 bp, Artificial Sequence
  chemically synthesized
gaacccccggactggaggat

SEQ ID NO: 48020 - DNA, 20 bp, Artificial Sequence
  chemically synthesized
aacccccggactggaggatc

SEQ ID NO: 48021 - DNA, 20 bp, Artificial Sequence
  chemically synthesized
cggactggaggatcaggttt

SEQ ID NO: 48022 - DNA, 20 bp, Artificial Sequence
  chemically synthesized
tcggcctcgccctccccaaa

SEQ ID NO: 48023 - DNA, 20 bp, Artificial Sequence
  chemically synthesized
tcgccctccccaaacagcgt

SEQ ID NO: 48024 - DNA, 20 bp, Artificial Sequence
  chemically synthesized
aaacagcgtcagattacgcg

SEQ ID NO: 48025 - DNA, 20 bp, Artificial Sequence
  chemically synthesized
acagcgtcagattacgcgca

SEQ ID NO: 48026 - DNA, 20 bp, Artificial Sequence
  chemically synthesized
cagcgtcagattacgcgcag

SEQ ID NO: 48027 - DNA, 20 bp, Artificial Sequence
  chemically synthesized
agcgtcagattacgcgcaga

SEQ ID NO: 48028 - DNA, 20 bp, Artificial Sequence
  chemically synthesized
gtcagattacgcgcagaggg

SEQ ID NO: 48029 - DNA, 20 bp, Artificial Sequence
  chemically synthesized
aaaaactcccaaatcctaac

SEQ ID NO: 48030 - DNA, 20 bp, Artificial Sequence
  chemically synthesized
aaaactcccaaatcctaact

SEQ ID NO: 48031 - DNA, 20 bp, Artificial Sequence
  chemically synthesized
ctcccaaatcctaactgggc

SEQ ID NO: 48032 - DNA, 20 bp, Artificial Sequence
  chemically synthesized
ccaaatcctaactgggctgg

SEQ ID NO: 48033 - DNA, 20 bp, Artificial Sequence
  chemically synthesized
caaatcctaactgggctgga

SEQ ID NO: 48034 - DNA, 20 bp, Artificial Sequence
  chemically synthesized
atcctaactgggctggaagg

SEQ ID NO: 48035 - DNA, 20 bp, Artificial Sequence
  chemically synthesized
tcctaactgggctggaaggc

SEQ ID NO: 48036 - DNA, 20 bp, Artificial Sequence
  chemically synthesized
aactgggctggaaggcaggc

SEQ ID NO: 48037 - DNA, 20 bp, Artificial Sequence
  chemically synthesized
tggaaggcaggccggcgccc

SEQ ID NO: 48038 - DNA, 20 bp, Artificial Sequence
  chemically synthesized
ggaaggcaggccggcgccct

SEQ ID NO: 48039 - DNA, 20 bp, Artificial Sequence
  chemically synthesized
gaaggcaggccggcgcccta

SEQ ID NO: 48040 - DNA, 20 bp, Artificial Sequence
  chemically synthesized
aaggcaggccggcgccctag

SEQ ID NO: 48041 - DNA, 20 bp, Artificial Sequence
  chemically synthesized
ctcccgcctctcaccctgcg

SEQ ID NO: 48042 - DNA, 20 bp, Artificial Sequence
  chemically synthesized
tcccgcctctcaccctgcgt

SEQ ID NO: 48043 - DNA, 20 bp, Artificial Sequence
  chemically synthesized
tctcaccctgcgtgggatgc

SEQ ID NO: 48044 - DNA, 20 bp, Artificial Sequence
  chemically synthesized
tgcgtgggatgccagactcc

SEQ ID NO: 48045 - DNA, 20 bp, Artificial Sequence
  chemically synthesized
tgccagactccaagttctgc

SEQ ID NO: 48046 - DNA, 20 bp, Artificial Sequence
  chemically synthesized
gccagactccaagttctgcc

SEQ ID NO: 48047 - DNA, 20 bp, Artificial Sequence
  chemically synthesized
ttctgccgggcccacctttt

SEQ ID NO: 48048 - DNA, 20 bp, Artificial Sequence
  chemically synthesized
cccaccttttcagtgtttcc

SEQ ID NO: 48049 - DNA, 20 bp, Artificial Sequence
  chemically synthesized
ccaccttttcagtgtttcct

SEQ ID NO: 48050 - DNA, 20 bp, Artificial Sequence
  chemically synthesized
ccaccttgtctcctgctgac

SEQ ID NO: 48051 - DNA, 20 bp, Artificial Sequence
  chemically synthesized
cttgtctcctgctgaccagt

SEQ ID NO: 48052 - DNA, 20 bp, Artificial Sequence
  chemically synthesized
cttctgaatcaatcctactg

SEQ ID NO: 48053 - DNA, 20 bp, Artificial Sequence
  chemically synthesized
gcccaccgaattctttccac

SEQ ID NO: 48054 - DNA, 20 bp, Artificial Sequence
  chemically synthesized
tctttccactggccttaacc

SEQ ID NO: 48055 - DNA, 20 bp, Artificial Sequence
  chemically synthesized
ttccactggccttaacctgg

SEQ ID NO: 48056 - DNA, 20 bp, Artificial Sequence
  chemically synthesized
acctggcagccttctaaact

SEQ ID NO: 48057 - DNA, 20 bp, Artificial Sequence
  chemically synthesized
gcagccttctaaacttagcc

SEQ ID NO: 48058 - DNA, 20 bp, Artificial Sequence
  chemically synthesized
aacttagcctggaccccctc

SEQ ID NO: 48059 - DNA, 20 bp, Artificial Sequence
  chemically synthesized
tgcacactgaccttaccaac

SEQ ID NO: 48060 - DNA, 20 bp, Artificial Sequence
  chemically synthesized
taccaactagctgctccttg

SEQ ID NO: 48061 - DNA, 20 bp, Artificial Sequence
  chemically synthesized
ccaactagctgctccttgaa

SEQ ID NO: 48062 - DNA, 20 bp, Artificial Sequence
  chemically synthesized
gattgcttgcttttgatgtc

SEQ ID NO: 48063 - DNA, 20 bp, Artificial Sequence
  chemically synthesized
gtccagcctacatgcatttc

SEQ ID NO: 48064 - DNA, 20 bp, Artificial Sequence
  chemically synthesized
tccagcctacatgcatttca

SEQ ID NO: 48065 - DNA, 20 bp, Artificial Sequence
  chemically synthesized
ccagcctacatgcatttcaa

SEQ ID NO: 48066 - DNA, 20 bp, Artificial Sequence
  chemically synthesized
ttcaagggatttatactaca

SEQ ID NO: 48067 - DNA, 20 bp, Artificial Sequence
  chemically synthesized
ggatttatactacaaagatt

SEQ ID NO: 48068 - DNA, 20 bp, Artificial Sequence
  chemically synthesized
gatttatactacaaagattc

SEQ ID NO: 48069 - DNA, 20 bp, Artificial Sequence
  chemically synthesized
actacaaagattcaggtttt

SEQ ID NO: 48070 - DNA, 20 bp, Artificial Sequence
  chemically synthesized
attcaggttttaagtttgca

SEQ ID NO: 48071 - DNA, 20 bp, Artificial Sequence
  chemically synthesized
aagtttgcaaagacgtcata

SEQ ID NO: 48072 - DNA, 20 bp, Artificial Sequence
  chemically synthesized
agtttgcaaagacgtcatat

SEQ ID NO: 48073 - DNA, 20 bp, Artificial Sequence
  chemically synthesized
agacgtcatataggtacatt

SEQ ID NO: 48074 - DNA, 20 bp, Artificial Sequence
  chemically synthesized
taggtacattcagaattcta

SEQ ID NO: 48075 - DNA, 20 bp, Artificial Sequence
  chemically synthesized
gtacattcagaattctatgg

SEQ ID NO: 48076 - DNA, 20 bp, Artificial Sequence
  chemically synthesized
tacattcagaattctatggt

SEQ ID NO: 48077 - DNA, 20 bp, Artificial Sequence
  chemically synthesized
cagaattctatggtaggcac

SEQ ID NO: 48078 - DNA, 20 bp, Artificial Sequence
  chemically synthesized
ttctatggtaggcacaagct

SEQ ID NO: 48079 - DNA, 20 bp, Artificial Sequence
  chemically synthesized
taggcacaagctcagctttc

SEQ ID NO: 48080 - DNA, 20 bp, Artificial Sequence
  chemically synthesized
gcacaagctcagctttccag

SEQ ID NO: 48081 - DNA, 20 bp, Artificial Sequence
  chemically synthesized
tccagaagattcaatttgca

SEQ ID NO: 48082 - DNA, 20 bp, Artificial Sequence
  chemically synthesized
tccttttacacaccatgttc

SEQ ID NO: 48083 - DNA, 20 bp, Artificial Sequence
  chemically synthesized
accatgttcaagaaatcaac

SEQ ID NO: 48084 - DNA, 20 bp, Artificial Sequence
  chemically synthesized
gttcaagaaatcaactggac

SEQ ID NO: 48085 - DNA, 20 bp, Artificial Sequence
  chemically synthesized
aaatcaactggacaagcatc

SEQ ID NO: 48086 - DNA, 20 bp, Artificial Sequence
  chemically synthesized
agtaaacacctattgtgtac

SEQ ID NO: 48087 - DNA, 20 bp, Artificial Sequence
  chemically synthesized
gtaaacacctattgtgtacc

SEQ ID NO: 48088 - DNA, 20 bp, Artificial Sequence
  chemically synthesized
aacacctattgtgtaccagg

SEQ ID NO: 48089 - DNA, 20 bp, Artificial Sequence
  chemically synthesized
acacctattgtgtaccaggc

SEQ ID NO: 48090 - DNA, 20 bp, Artificial Sequence
  chemically synthesized
acctattgtgtaccaggcag

SEQ ID NO: 48091 - DNA, 20 bp, Artificial Sequence
  chemically synthesized
cctattgtgtaccaggcagg

SEQ ID NO: 48092 - DNA, 20 bp, Artificial Sequence
  chemically synthesized
gtaccaggcaggaggatgaa

SEQ ID NO: 48093 - DNA, 20 bp, Artificial Sequence
  chemically synthesized
taccaggcaggaggatgaaa

SEQ ID NO: 48094 - DNA, 20 bp, Artificial Sequence
  chemically synthesized
accaggcaggaggatgaaaa

SEQ ID NO: 48095 - DNA, 20 bp, Artificial Sequence
  chemically synthesized
ccaggcaggaggatgaaaag

SEQ ID NO: 48096 - DNA, 20 bp, Artificial Sequence
  chemically synthesized
gcaggaggatgaaaagggga

SEQ ID NO: 48097 - DNA, 20 bp, Artificial Sequence
  chemically synthesized
aggaggatgaaaaggggaaa

SEQ ID NO: 48098 - DNA, 20 bp, Artificial Sequence
  chemically synthesized
gaggatgaaaaggggaaaga

SEQ ID NO: 48099 - DNA, 20 bp, Artificial Sequence
  chemically synthesized
aaaaggggaaagagagctcc

SEQ ID NO: 48100 - DNA, 20 bp, Artificial Sequence
  chemically synthesized
ggaaagagagctcctggcct

SEQ ID NO: 48101 - DNA, 20 bp, Artificial Sequence
  chemically synthesized
ctggcctcagattgtacatg

SEQ ID NO: 48102 - DNA, 20 bp, Artificial Sequence
  chemically synthesized
ttgtacatgtggcatgacat

SEQ ID NO: 48103 - DNA, 20 bp, Artificial Sequence
  chemically synthesized
tgtacatgtggcatgacatg

SEQ ID NO: 48104 - DNA, 20 bp, Artificial Sequence
  chemically synthesized
gacatgaggcttgctctttc

SEQ ID NO: 48105 - DNA, 20 bp, Artificial Sequence
  chemically synthesized
atgaggcttgctctttctgg

SEQ ID NO: 48106 - DNA, 20 bp, Artificial Sequence
  chemically synthesized
tgaggcttgctctttctgga

SEQ ID NO: 48107 - DNA, 20 bp, Artificial Sequence
  chemically synthesized
gaggcttgctctttctggaa

SEQ ID NO: 48108 - DNA, 20 bp, Artificial Sequence
  chemically synthesized
tctggaagggctgtcgatac

SEQ ID NO: 48109 - DNA, 20 bp, Artificial Sequence
  chemically synthesized
ctggaagggctgtcgatact

SEQ ID NO: 48110 - DNA, 20 bp, Artificial Sequence
  chemically synthesized
gaagggctgtcgatactggg

SEQ ID NO: 48111 - DNA, 20 bp, Artificial Sequence
  chemically synthesized
gtcgatactgggaagaaaca

SEQ ID NO: 48112 - DNA, 20 bp, Artificial Sequence
  chemically synthesized
tcgatactgggaagaaacaa

SEQ ID NO: 48113 - DNA, 20 bp, Artificial Sequence
  chemically synthesized
gaatttatgatcctcccttg

SEQ ID NO: 48114 - DNA, 20 bp, Artificial Sequence
  chemically synthesized
gatcctcccttgcagatgca

SEQ ID NO: 48115 - DNA, 20 bp, Artificial Sequence
  chemically synthesized
cctcccttgcagatgcacag

SEQ ID NO: 48116 - DNA, 20 bp, Artificial Sequence
  chemically synthesized
gcagatgcacagcagattcc

SEQ ID NO: 48117 - DNA, 20 bp, Artificial Sequence
  chemically synthesized
acagcagattccgagtgaaa

SEQ ID NO: 48118 - DNA, 20 bp, Artificial Sequence
  chemically synthesized
gaaatggcctgctctgaatc

SEQ ID NO: 48119 - DNA, 20 bp, Artificial Sequence
  chemically synthesized
aaatggcctgctctgaatct

SEQ ID NO: 48120 - DNA, 20 bp, Artificial Sequence
  chemically synthesized
cctgctctgaatctaggtgc

SEQ ID NO: 48121 - DNA, 20 bp, Artificial Sequence
  chemically synthesized
tgctctgaatctaggtgctg

SEQ ID NO: 48122 - DNA, 20 bp, Artificial Sequence
  chemically synthesized
aatctaggtgctggagtcca

SEQ ID NO: 48123 - DNA, 20 bp, Artificial Sequence
  chemically synthesized
ctctttccactttgtttgca

SEQ ID NO: 48124 - DNA, 20 bp, Artificial Sequence
  chemically synthesized
tgtttgcaaagacctcactc

SEQ ID NO: 48125 - DNA, 20 bp, Artificial Sequence
  chemically synthesized
tttgcaaagacctcactcca

SEQ ID NO: 48126 - DNA, 20 bp, Artificial Sequence
  chemically synthesized
tgcaaagacctcactccaga

SEQ ID NO: 48127 - DNA, 20 bp, Artificial Sequence
  chemically synthesized
aagacctcactccagagagc

SEQ ID NO: 48128 - DNA, 20 bp, Artificial Sequence
  chemically synthesized
ctccagagagccagtgcaca

SEQ ID NO: 48129 - DNA, 20 bp, Artificial Sequence
  chemically synthesized
agagagccagtgcacaaaga

SEQ ID NO: 48130 - DNA, 20 bp, Artificial Sequence
  chemically synthesized
gtgcacaaagacagtgcaac

SEQ ID NO: 48131 - DNA, 20 bp, Artificial Sequence
  chemically synthesized
cacaaagacagtgcaaccag

SEQ ID NO: 48132 - DNA, 20 bp, Artificial Sequence
  chemically synthesized
acaaagacagtgcaaccagt

SEQ ID NO: 48133 - DNA, 20 bp, Artificial Sequence
  chemically synthesized
cagtgcaaccagtgggttga

SEQ ID NO: 48134 - DNA, 20 bp, Artificial Sequence
  chemically synthesized
tgggttgacagtgactccat

SEQ ID NO: 48135 - DNA, 20 bp, Artificial Sequence
  chemically synthesized
gggttgacagtgactccatg

SEQ ID NO: 48136 - DNA, 20 bp, Artificial Sequence
  chemically synthesized
tgacagtgactccatgaggt

SEQ ID NO: 48137 - DNA, 20 bp, Artificial Sequence
  chemically synthesized
gacagtgactccatgaggta

SEQ ID NO: 48138 - DNA, 20 bp, Artificial Sequence
  chemically synthesized
gtgactccatgaggtaaggt

SEQ ID NO: 48139 - DNA, 20 bp, Artificial Sequence
  chemically synthesized
gactccatgaggtaaggtca

SEQ ID NO: 48140 - DNA, 20 bp, Artificial Sequence
  chemically synthesized
aggtcagagttatccccatc

SEQ ID NO: 48141 - DNA, 20 bp, Artificial Sequence
  chemically synthesized
ccccatcgagcccgccatcg

SEQ ID NO: 48142 - DNA, 20 bp, Artificial Sequence
  chemically synthesized
tcgagcccgccatcgcagca

SEQ ID NO: 48143 - DNA, 20 bp, Artificial Sequence
  chemically synthesized
gagcccgccatcgcagcaca

SEQ ID NO: 48144 - DNA, 20 bp, Artificial Sequence
  chemically synthesized
cccgccatcgcagcacagag

SEQ ID NO: 48145 - DNA, 20 bp, Artificial Sequence
  chemically synthesized
ccgccatcgcagcacagagt

SEQ ID NO: 48146 - DNA, 20 bp, Artificial Sequence
  chemically synthesized
gccatcgcagcacagagtag

SEQ ID NO: 48147 - DNA, 20 bp, Artificial Sequence
  chemically synthesized
cagcacagagtaggagctca

SEQ ID NO: 48148 - DNA, 20 bp, Artificial Sequence
  chemically synthesized
aggagctcatggtttgctga

SEQ ID NO: 48149 - DNA, 20 bp, Artificial Sequence
  chemically synthesized
gagctcatggtttgctgaca

SEQ ID NO: 48150 - DNA, 20 bp, Artificial Sequence
  chemically synthesized
agctcatggtttgctgacag

SEQ ID NO: 48151 - DNA, 20 bp, Artificial Sequence
  chemically synthesized
tcatggtttgctgacagagg

SEQ ID NO: 48152 - DNA, 20 bp, Artificial Sequence
  chemically synthesized
tggtttgctgacagaggtgg

SEQ ID NO: 48153 - DNA, 20 bp, Artificial Sequence
  chemically synthesized
gtttgctgacagaggtggca

SEQ ID NO: 48154 - DNA, 20 bp, Artificial Sequence
  chemically synthesized
tttgctgacagaggtggcag

SEQ ID NO: 48155 - DNA, 20 bp, Artificial Sequence
  chemically synthesized
gctgacagaggtggcagagg

SEQ ID NO: 48156 - DNA, 20 bp, Artificial Sequence
  chemically synthesized
tccttcctgttgcctgtaat

SEQ ID NO: 48157 - DNA, 20 bp, Artificial Sequence
  chemically synthesized
ttgtatttgcaatgtgcttt

SEQ ID NO: 48158 - DNA, 20 bp, Artificial Sequence
  chemically synthesized
tatttgcaatgtgcttttgg

SEQ ID NO: 48159 - DNA, 20 bp, Artificial Sequence
  chemically synthesized
ttttggcagcttcctcatca

SEQ ID NO: 48160 - DNA, 20 bp, Artificial Sequence
  chemically synthesized
tttggcagcttcctcatcaa

SEQ ID NO: 48161 - DNA, 20 bp, Artificial Sequence
  chemically synthesized
tcctcatcaaaggcctcccc

SEQ ID NO: 48162 - DNA, 20 bp, Artificial Sequence
  chemically synthesized
ctcatcaaaggcctcccctg

SEQ ID NO: 48163 - DNA, 20 bp, Artificial Sequence
  chemically synthesized
tcaaaggcctcccctggagc

SEQ ID NO: 48164 - DNA, 20 bp, Artificial Sequence
  chemically synthesized
ggcctcccctggagcaagaa

SEQ ID NO: 48165 - DNA, 20 bp, Artificial Sequence
  chemically synthesized
tcccctggagcaagaataga

SEQ ID NO: 48166 - DNA, 20 bp, Artificial Sequence
  chemically synthesized
cccctggagcaagaatagat

SEQ ID NO: 48167 - DNA, 20 bp, Artificial Sequence
  chemically synthesized
cctggagcaagaatagatgg

SEQ ID NO: 48168 - DNA, 20 bp, Artificial Sequence
  chemically synthesized
ctttccctgctgctcccctt

SEQ ID NO: 48169 - DNA, 20 bp, Artificial Sequence
  chemically synthesized
tttccctgctgctccccttt

SEQ ID NO: 48170 - DNA, 20 bp, Artificial Sequence
  chemically synthesized
gctgctcccctttgggacct

SEQ ID NO: 48171 - DNA, 20 bp, Artificial Sequence
  chemically synthesized
gaccttggcctctcacctac

SEQ ID NO: 48172 - DNA, 20 bp, Artificial Sequence
  chemically synthesized
accttggcctctcacctacc

SEQ ID NO: 48173 - DNA, 20 bp, Artificial Sequence
  chemically synthesized
ccttggcctctcacctaccg

SEQ ID NO: 48174 - DNA, 20 bp, Artificial Sequence
  chemically synthesized
gctgcgatggcgggctcgat

SEQ ID NO: 48175 - DNA, 20 bp, Artificial Sequence
  chemically synthesized
ataactctgaccttacctca

SEQ ID NO: 48176 - DNA, 20 bp, Artificial Sequence
  chemically synthesized
gtctttgtgcactggctctc

SEQ ID NO: 48177 - DNA, 20 bp, Artificial Sequence
  chemically synthesized
tcagagcaggccatttcact

SEQ ID NO: 48178 - DNA, 20 bp, Artificial Sequence
  chemically synthesized
tctgctgtgcatctgcaagg

SEQ ID NO: 48179 - DNA, 20 bp, Artificial Sequence
  chemically synthesized
tggtacacaataggtgttta

SEQ ID NO: 48180 - DNA, 20 bp, Artificial Sequence
  chemically synthesized
tcttgaacatggtgtgtaaa

SEQ ID NO: 48181 - DNA, 20 bp, Artificial Sequence
  chemically synthesized
gtaaaaggaatctttgcaaa

SEQ ID NO: 48182 - DNA, 20 bp, Artificial Sequence
  chemically synthesized
agctgagcttgtgcctacca

SEQ ID NO: 48183 - DNA, 20 bp, Artificial Sequence
  chemically synthesized
cttgtgcctaccatagaatt

SEQ ID NO: 48184 - DNA, 20 bp, Artificial Sequence
  chemically synthesized
cgtctttgcaaacttaaaac

SEQ ID NO: 48185 - DNA, 20 bp, Artificial Sequence
  chemically synthesized
tagttggtaaggtcagtgtg

SEQ ID NO: 48186 - DNA, 20 bp, Artificial Sequence
  chemically synthesized
cataaagggcagaggccgga

SEQ ID NO: 48187 - DNA, 20 bp, Artificial Sequence
  chemically synthesized
gccaggttaaggccagtgga

SEQ ID NO: 48188 - DNA, 20 bp, Artificial Sequence
  chemically synthesized
aaagaattcggtgggcagcg

SEQ ID NO: 48189 - DNA, 20 bp, Artificial Sequence
  chemically synthesized
gggcagcgaggagtccacag

SEQ ID NO: 48190 - DNA, 20 bp, Artificial Sequence
  chemically synthesized
aaggtgggcccggcagaact

SEQ ID NO: 48191 - DNA, 20 bp, Artificial Sequence
  chemically synthesized
ttggagtctggcatcccacg

SEQ ID NO: 48192 - DNA, 20 bp, Artificial Sequence
  chemically synthesized
ggcctgccttccagcccagt

SEQ ID NO: 48193 - DNA, 20 bp, Artificial Sequence
  chemically synthesized
ttccagcccagttaggattt

SEQ ID NO: 48194 - DNA, 20 bp, Artificial Sequence
  chemically synthesized
gaaacctgatcctccagtcc

SEQ ID NO: 48195 - DNA, 20 bp, Artificial Sequence
  chemically synthesized
tccgttaatgtttaatcaga

SEQ ID NO: 48196 - DNA, 20 bp, Artificial Sequence
  chemically synthesized
gcgggcgccgccgttcagtt

SEQ ID NO: 48197 - DNA, 20 bp, Artificial Sequence
  chemically synthesized
agttcagggtctgagcctgg

SEQ ID NO: 48198 - DNA, 20 bp, Artificial Sequence
  chemically synthesized
agcggctcccagctcccagc

SEQ ID NO: 48199 - DNA, 20 bp, Artificial Sequence
  chemically synthesized
tgctgctgctgctgctgctc

SEQ ID NO: 48200 - DNA, 20 bp, Artificial Sequence
  chemically synthesized
ttccaccgctgcgccaaggt

SEQ ID NO: 48201 - DNA, 20 bp, Artificial Sequence
  chemically synthesized
ctgcgccaaggtgcgggtgt

SEQ ID NO: 48202 - DNA, 20 bp, Artificial Sequence
  chemically synthesized
cccccatgtaagagaggaag

SEQ ID NO: 48203 - DNA, 20 bp, Artificial Sequence
  chemically synthesized
aggcaaggcggcgggggagg

SEQ ID NO: 48204 - DNA, 20 bp, Artificial Sequence
  chemically synthesized
ctattcagtgggaaggttcg

SEQ ID NO: 48205 - DNA, 20 bp, Artificial Sequence
  chemically synthesized
aagggcgagcagagcactgc

SEQ ID NO: 48206 - DNA, 20 bp, Artificial Sequence
  chemically synthesized
tctgcctcgccgcggcacag

SEQ ID NO: 48207 - DNA, 20 bp, Artificial Sequence
  chemically synthesized
gccgcggcacaggtgggtga

SEQ ID NO: 48208 - DNA, 20 bp, Artificial Sequence
  chemically synthesized
cggcacaggtgggtgaagga

SEQ ID NO: 48209 - DNA, 20 bp, Artificial Sequence
  chemically synthesized
aaagcgggcttgccattata

SEQ ID NO: 48210 - DNA, 20 bp, Artificial Sequence
  chemically synthesized
tttggaaaacatgggcagcg

SEQ ID NO: 48211 - DNA, 20 bp, Artificial Sequence
  chemically synthesized
ggccctacccgagacagggg

SEQ ID NO: 48212 - DNA, 20 bp, Artificial Sequence
  chemically synthesized
gtctgccgaccgtgtgcggg

SEQ ID NO: 48213 - DNA, 20 bp, Artificial Sequence
  chemically synthesized
aggttctgtgtcccccagct

SEQ ID NO: 48214 - DNA, 20 bp, Artificial Sequence
  chemically synthesized
ccccagcttggagtcagatg

SEQ ID NO: 48215 - DNA, 20 bp, Artificial Sequence
  chemically synthesized
gcttggagtcagatgtgggg

SEQ ID NO: 48216 - DNA, 20 bp, Artificial Sequence
  chemically synthesized
aagggaaagttctgttgacc

SEQ ID NO: 48217 - DNA, 20 bp, Artificial Sequence
  chemically synthesized
acttacaatgcaagccccgg

SEQ ID NO: 48218 - DNA, 20 bp, Artificial Sequence
  chemically synthesized
ctgcctgcccacgcttctgt

SEQ ID NO: 48219 - DNA, 20 bp, Artificial Sequence
  chemically synthesized
cacgcttctgtctgagtgtg

SEQ ID NO: 48220 - DNA, 20 bp, Artificial Sequence
  chemically synthesized
tgtctgagtgtgctgggtgg

SEQ ID NO: 48221 - DNA, 20 bp, Artificial Sequence
  chemically synthesized
ctgagcctttgactttctcg

SEQ ID NO: 48222 - DNA, 20 bp, Artificial Sequence
  chemically synthesized
gactttctcgagggatgttg

SEQ ID NO: 48223 - DNA, 20 bp, Artificial Sequence
  chemically synthesized
ggatgttgtggggttgtggc

SEQ ID NO: 48224 - DNA, 20 bp, Artificial Sequence
  chemically synthesized
aaacaactgttctggaaata

SEQ ID NO: 48225 - DNA, 20 bp, Artificial Sequence
  chemically synthesized
tgagtaccccatcctgagag

SEQ ID NO: 48226 - DNA, 20 bp, Artificial Sequence
  chemically synthesized
accacctgaaccaagccctt

SEQ ID NO: 48227 - DNA, 20 bp, Artificial Sequence
  chemically synthesized
tcattcaatggttattttgt

SEQ ID NO: 48228 - DNA, 20 bp, Artificial Sequence
  chemically synthesized
caatggttattttgtgggaa

SEQ ID NO: 48229 - DNA, 20 bp, Artificial Sequence
  chemically synthesized
tattttgtgggaatcgaatt

SEQ ID NO: 48230 - DNA, 20 bp, Artificial Sequence
  chemically synthesized
tcaccccaggtgcattagaa

SEQ ID NO: 48231 - DNA, 20 bp, Artificial Sequence
  chemically synthesized
agaactgacactccactgca

SEQ ID NO: 48232 - DNA, 20 bp, Artificial Sequence
  chemically synthesized
ttagcggaaggcattttcag

SEQ ID NO: 48233 - DNA, 20 bp, Artificial Sequence
  chemically synthesized
tgggtctttgaagcattagt

SEQ ID NO: 48234 - DNA, 20 bp, Artificial Sequence
  chemically synthesized
ttcagcgatgatggtgtcat

SEQ ID NO: 48235 - DNA, 20 bp, Artificial Sequence
  chemically synthesized
gtgtcatgagaattttattc

SEQ ID NO: 48236 - DNA, 20 bp, Artificial Sequence
  chemically synthesized
tttttcttttttttttgaga

SEQ ID NO: 48237 - DNA, 20 bp, Artificial Sequence
  chemically synthesized
ttcgctcttgttgcccaggc

SEQ ID NO: 48238 - DNA, 20 bp, Artificial Sequence
  chemically synthesized
ctcactgcaacatctgtctc

SEQ ID NO: 48239 - DNA, 20 bp, Artificial Sequence
  chemically synthesized
gcctcagcctcccaagaagc

SEQ ID NO: 48240 - DNA, 20 bp, Artificial Sequence
  chemically synthesized
ttttgtatttttagtagaga

SEQ ID NO: 48241 - DNA, 20 bp, Artificial Sequence
  chemically synthesized
gcaaactcctgacctcctca

SEQ ID NO: 48242 - DNA, 20 bp, Artificial Sequence
  chemically synthesized
gcctcagcctcccaaagtgc

SEQ ID NO: 48243 - DNA, 20 bp, Artificial Sequence
  chemically synthesized
attatttttaatttagttgt

SEQ ID NO: 48244 - DNA, 20 bp, Artificial Sequence
  chemically synthesized
accgttttggccctaaggct

SEQ ID NO: 48245 - DNA, 20 bp, Artificial Sequence
  chemically synthesized
gccctaaggctttgggtaaa

SEQ ID NO: 48246 - DNA, 20 bp, Artificial Sequence
  chemically synthesized
ggactctgttctactctgac

SEQ ID NO: 48247 - DNA, 20 bp, Artificial Sequence
  chemically synthesized
agatgcatatatacagagat

SEQ ID NO: 48248 - DNA, 20 bp, Artificial Sequence
  chemically synthesized
gtaggggccaaggaggagca

SEQ ID NO: 48249 - DNA, 20 bp, Artificial Sequence
  chemically synthesized
tggggcctaatgggaggtgt

SEQ ID NO: 48250 - DNA, 20 bp, Artificial Sequence
  chemically synthesized
ttggtgccgtccttgtgata

SEQ ID NO: 48251 - DNA, 20 bp, Artificial Sequence
  chemically synthesized
catgcttcctggagagcttg

SEQ ID NO: 48252 - DNA, 20 bp, Artificial Sequence
  chemically synthesized
agagcttgcagaatcatgag

SEQ ID NO: 48253 - DNA, 20 bp, Artificial Sequence
  chemically synthesized
tgcctgcatttgtagagcat

SEQ ID NO: 48254 - DNA, 20 bp, Artificial Sequence
  chemically synthesized
gtatctgaggctccgagagg

SEQ ID NO: 48255 - DNA, 20 bp, Artificial Sequence
  chemically synthesized
caaccagtaaatattggagc

SEQ ID NO: 48256 - DNA, 20 bp, Artificial Sequence
  chemically synthesized
tctgactggggcatggggga

SEQ ID NO: 48257 - DNA, 20 bp, Artificial Sequence
  chemically synthesized
gcgaccaggcccgtagagag

SEQ ID NO: 48258 - DNA, 20 bp, Artificial Sequence
  chemically synthesized
gtacagaggaaaacctgttg

SEQ ID NO: 48259 - DNA, 20 bp, Artificial Sequence
  chemically synthesized
cccgtagttcccatttttgc

SEQ ID NO: 48260 - DNA, 20 bp, Artificial Sequence
  chemically synthesized
tgaaagtgttatataaccat

SEQ ID NO: 48261 - DNA, 20 bp, Artificial Sequence
  chemically synthesized
aataataatagttggcctat

SEQ ID NO: 48262 - DNA, 20 bp, Artificial Sequence
  chemically synthesized
ttttgttgtaatttgtaagt

SEQ ID NO: 48263 - DNA, 20 bp, Artificial Sequence
  chemically synthesized
ggggtgagataaagtacacc

SEQ ID NO: 48264 - DNA, 20 bp, Artificial Sequence
  chemically synthesized
taaagtacacctagggtttg

SEQ ID NO: 48265 - DNA, 20 bp, Artificial Sequence
  chemically synthesized
tgttcctccttgcatggggc

SEQ ID NO: 48266 - DNA, 20 bp, Artificial Sequence
  chemically synthesized
gcaggcccaggctgcccgcc

SEQ ID NO: 48267 - DNA, 20 bp, Artificial Sequence
  chemically synthesized
ttcctggcttcctggtgaag

SEQ ID NO: 48268 - DNA, 20 bp, Artificial Sequence
  chemically synthesized
gctggtgagccacccttttt

SEQ ID NO: 48269 - DNA, 20 bp, Artificial Sequence
  chemically synthesized
aagtatgtattgagcactta

SEQ ID NO: 48270 - DNA, 20 bp, Artificial Sequence
  chemically synthesized
gtaactactggctttctgta

SEQ ID NO: 48271 - DNA, 20 bp, Artificial Sequence
  chemically synthesized
aggggaccacacagacagct

SEQ ID NO: 48272 - DNA, 20 bp, Artificial Sequence
  chemically synthesized
cagacagctaggggtagagc

SEQ ID NO: 48273 - DNA, 20 bp, Artificial Sequence
  chemically synthesized
aacctgtagggacaaggccc

SEQ ID NO: 48274 - DNA, 20 bp, Artificial Sequence
  chemically synthesized
cctgggatgttcagtggagc

SEQ ID NO: 48275 - DNA, 20 bp, Artificial Sequence
  chemically synthesized
tttataaaaaagcatgactc

SEQ ID NO: 48276 - DNA, 20 bp, Artificial Sequence
  chemically synthesized
cctttgaagctgttgctatc

SEQ ID NO: 48277 - DNA, 20 bp, Artificial Sequence
  chemically synthesized
gtgaagtcccttctttagga

SEQ ID NO: 48278 - DNA, 20 bp, Artificial Sequence
  chemically synthesized
cagggtggccctcctccctc

SEQ ID NO: 48279 - DNA, 20 bp, Artificial Sequence
  chemically synthesized
gtggaggggcagaaagggga

SEQ ID NO: 48280 - DNA, 20 bp, Artificial Sequence
  chemically synthesized
aagatttgaagcactagggc

SEQ ID NO: 48281 - DNA, 20 bp, Artificial Sequence
  chemically synthesized
agcactagggccagggtgag

SEQ ID NO: 48282 - DNA, 20 bp, Artificial Sequence
  chemically synthesized
cctaaagaagggacttcact

SEQ ID NO: 48283 - DNA, 20 bp, Artificial Sequence
  chemically synthesized
ctggatagcaacagcttcaa

SEQ ID NO: 48284 - DNA, 20 bp, Artificial Sequence
  chemically synthesized
ttcaaaggaattttggaccc

SEQ ID NO: 48285 - DNA, 20 bp, Artificial Sequence
  chemically synthesized
ggcagcagatgcattggcac

SEQ ID NO: 48286 - DNA, 20 bp, Artificial Sequence
  chemically synthesized
aatggctggcaggcagacca

SEQ ID NO: 48287 - DNA, 20 bp, Artificial Sequence
  chemically synthesized
ggggcatggccaggcttaaa

SEQ ID NO: 48288 - DNA, 20 bp, Artificial Sequence
  chemically synthesized
caggaagtgccattcccaaa

SEQ ID NO: 48289 - DNA, 20 bp, Artificial Sequence
  chemically synthesized
agaaggccatggaagacatg

SEQ ID NO: 48290 - DNA, 20 bp, Artificial Sequence
  chemically synthesized
gtgcgctctgactgcgagag

SEQ ID NO: 48291 - DNA, 20 bp, Artificial Sequence
  chemically synthesized
gtaggtgccaggcaacctcc

SEQ ID NO: 48292 - DNA, 20 bp, Artificial Sequence
  chemically synthesized
ttacaacaaaagagacacaa

SEQ ID NO: 48293 - DNA, 20 bp, Artificial Sequence
  chemically synthesized
cccctcccccatgccccagt

SEQ ID NO: 48294 - DNA, 20 bp, Artificial Sequence
  chemically synthesized
ggagccaggaaaccgtggac

SEQ ID NO: 48295 - DNA, 20 bp, Artificial Sequence
  chemically synthesized
ataggcctgctgggaaagtc

SEQ ID NO: 48296 - DNA, 20 bp, Artificial Sequence
  chemically synthesized
gctctacaaatgcaggcaga

SEQ ID NO: 48297 - DNA, 20 bp, Artificial Sequence
  chemically synthesized
ccttttgtgttgctatataa

SEQ ID NO: 48298 - DNA, 20 bp, Artificial Sequence
  chemically synthesized
atataaaggaatacctgaag

SEQ ID NO: 48299 - DNA, 20 bp, Artificial Sequence
  chemically synthesized
gtgagtaatttacaaggaaa

SEQ ID NO: 48300 - DNA, 20 bp, Artificial Sequence
  chemically synthesized
gacggcaccaagcctttcac

SEQ ID NO: 48301 - DNA, 20 bp, Artificial Sequence
  chemically synthesized
cactggctccccacagcctc

SEQ ID NO: 48302 - DNA, 20 bp, Artificial Sequence
  chemically synthesized
tatgcatcttggactccagt

SEQ ID NO: 48303 - DNA, 20 bp, Artificial Sequence
  chemically synthesized
ggactccagtcagagtagaa

SEQ ID NO: 48304 - DNA, 20 bp, Artificial Sequence
  chemically synthesized
ttttgaacctcagaacttgt

SEQ ID NO: 48305 - DNA, 20 bp, Artificial Sequence
  chemically synthesized
gaaaggcagtaatgggcaat

SEQ ID NO: 48306 - DNA, 20 bp, Artificial Sequence
  chemically synthesized
ggcaatcagagtctgcttgg

SEQ ID NO: 48307 - DNA, 20 bp, Artificial Sequence
  chemically synthesized
taatctatgcagcaaaatat

SEQ ID NO: 48308 - DNA, 20 bp, Artificial Sequence
  chemically synthesized
aacattttacatttcagacg

SEQ ID NO: 48309 - DNA, 20 bp, Artificial Sequence
  chemically synthesized
actttgggaggctgaggcgg

SEQ ID NO: 48310 - DNA, 20 bp, Artificial Sequence
  chemically synthesized
gaggcgggaggatcacctcc

SEQ ID NO: 48311 - DNA, 20 bp, Artificial Sequence
  chemically synthesized
tcggatccactgaggaggtc

SEQ ID NO: 48312 - DNA, 20 bp, Artificial Sequence
  chemically synthesized
ttcatggtacctcctaatcc

SEQ ID NO: 48313 - DNA, 20 bp, Artificial Sequence
  chemically synthesized
tgccttccgctaaataaaaa

SEQ ID NO: 48314 - DNA, 20 bp, Artificial Sequence
  chemically synthesized
ttccgctaaataaaaattga

SEQ ID NO: 48315 - DNA, 20 bp, Artificial Sequence
  chemically synthesized
ataaaaattgaatgaattgg

SEQ ID NO: 48316 - DNA, 20 bp, Artificial Sequence
  chemically synthesized
tgggagagtactctgtgcag

SEQ ID NO: 48317 - DNA, 20 bp, Artificial Sequence
  chemically synthesized
aaacccagttctaatgcacc

SEQ ID NO: 48318 - DNA, 20 bp, Artificial Sequence
  chemically synthesized
gtttctcatgactaaaagaa

SEQ ID NO: 48319 - DNA, 20 bp, Artificial Sequence
  chemically synthesized
cgattcccacaaaataacca

SEQ ID NO: 48320 - DNA, 20 bp, Artificial Sequence
  chemically synthesized
tcccacaaaataaccattga

SEQ ID NO: 48321 - DNA, 20 bp, Artificial Sequence
  chemically synthesized
acaaaataaccattgaatga

SEQ ID NO: 48322 - DNA, 20 bp, Artificial Sequence
  chemically synthesized
gcctctgcttactcacctct

SEQ ID NO: 48323 - DNA, 20 bp, Artificial Sequence
  chemically synthesized
tgcttactcacctctcagga

SEQ ID NO: 48324 - DNA, 20 bp, Artificial Sequence
  chemically synthesized
aggaagagggctatactgag

SEQ ID NO: 48325 - DNA, 20 bp, Artificial Sequence
  chemically synthesized
agaagcgtgggcaggcagct

SEQ ID NO: 48326 - DNA, 20 bp, Artificial Sequence
  chemically synthesized
gggcaggcagctgtgagtgg

SEQ ID NO: 48327 - DNA, 20 bp, Artificial Sequence
  chemically synthesized
agattaggcaatggaggctc

SEQ ID NO: 48328 - DNA, 20 bp, Artificial Sequence
  chemically synthesized
gcctgagggccagaagctgg

SEQ ID NO: 48329 - DNA, 20 bp, Artificial Sequence
  chemically synthesized
tgaggcgccgggctcagctc

SEQ ID NO: 48330 - DNA, 20 bp, Artificial Sequence
  chemically synthesized
caccaagggcccttccctgc

SEQ ID NO: 48331 - DNA, 20 bp, Artificial Sequence
  chemically synthesized
aaaggacgccaatgggcctc

SEQ ID NO: 48332 - DNA, 20 bp, Artificial Sequence
  chemically synthesized
ttttcttcggctgaaacaga

SEQ ID NO: 48333 - DNA, 20 bp, Artificial Sequence
  chemically synthesized
aacagatggaatactagagc

SEQ ID NO: 48334 - DNA, 20 bp, Artificial Sequence
  chemically synthesized
cttcccaccccgcccctgtc

SEQ ID NO: 48335 - DNA, 20 bp, Artificial Sequence
  chemically synthesized
cagaaactgggaaatctggg

SEQ ID NO: 48336 - DNA, 20 bp, Artificial Sequence
  chemically synthesized
tgctcgcccttcctcggcct

SEQ ID NO: 48337 - DNA, 20 bp, Artificial Sequence
  chemically synthesized
caaccccgcgaaccttccca

SEQ ID NO: 48338 - DNA, 20 bp, Artificial Sequence
  chemically synthesized
agcaccgcaccgtcccggct

SEQ ID NO: 48339 - DNA, 20 bp, Artificial Sequence
  chemically synthesized
aggtggctgtggttccgtgc

SEQ ID NO: 48340 - DNA, 20 bp, Artificial Sequence
  chemically synthesized
agggcgcgtgaaggggcgcg

SEQ ID NO: 48341 - DNA, 20 bp, Artificial Sequence
  chemically synthesized
acgtcgctgcggaaaccttc

SEQ ID NO: 48342 - DNA, 20 bp, Artificial Sequence
  chemically synthesized
ctgcggaaaccttctagggt

SEQ ID NO: 48343 - DNA, 20 bp, Artificial Sequence
  chemically synthesized
ttaacggaacccccggactg

SEQ ID NO: 48344 - DNA, 20 bp, Artificial Sequence
  chemically synthesized
ctcccgcctctcaccctgcg

SEQ ID NO: 48345 - DNA, 20 bp, Artificial Sequence
  chemically synthesized
gcccaccttttcagtgtttc

SEQ ID NO: 48346 - DNA, 20 bp, Artificial Sequence
  chemically synthesized
cctgctgaccagtgagactt

SEQ ID NO: 48347 - DNA, 20 bp, Artificial Sequence
  chemically synthesized
tgtggactcctcgctgccca

SEQ ID NO: 48348 - DNA, 20 bp, Artificial Sequence
  chemically synthesized
tccagcctacatgcatttca

SEQ ID NO: 48349 - DNA, 20 bp, Artificial Sequence
  chemically synthesized
agacgtcatataggtacatt

SEQ ID NO: 48350 - DNA, 20 bp, Artificial Sequence
  chemically synthesized
acctattgtgtaccaggcag

SEQ ID NO: 48351 - DNA, 20 bp, Artificial Sequence
  chemically synthesized
gatactgggaagaaacaaag

SEQ ID NO: 48352 - DNA, 20 bp, Artificial Sequence
  chemically synthesized
ttgcagatgcacagcagatt

SEQ ID NO: 48353 - DNA, 20 bp, Artificial Sequence
  chemically synthesized
tccgagtgaaatggcctgct

SEQ ID NO: 48354 - DNA, 20 bp, Artificial Sequence
  chemically synthesized
cctgctctgaatctaggtgc

SEQ ID NO: 48355 - DNA, 20 bp, Artificial Sequence
  chemically synthesized
gcacaaagacagtgcaacca

SEQ ID NO: 48356 - DNA, 20 bp, Artificial Sequence
  chemically synthesized
gtgactccatgaggtaaggt

SEQ ID NO: 48357 - DNA, 20 bp, Artificial Sequence
  chemically synthesized
tcgagcccgccatcgcagca

SEQ ID NO: 48358 - DNA, 20 bp, Artificial Sequence
  chemically synthesized
tccttcctgttgcctgtaat

SEQ ID NO: 48359 - DNA, 20 bp, Artificial Sequence
  chemically synthesized
tcaaaggcctcccctggagc

SEQ ID NO: 48360 - DNA, 20 bp, Artificial Sequence
  chemically synthesized
gaccttggcctctcacctac

SEQ ID NO: 48361 - DNA, 20 bp, Artificial Sequence
  chemically synthesized
tcccagtatcgacagccctt

SEQ ID NO: 48362 - DNA, 20 bp, Artificial Sequence
  chemically synthesized
aagctgagcttgtgcctacc

SEQ ID NO: 48363 - DNA, 20 bp, Artificial Sequence
  chemically synthesized
tgccaggttaaggccagtgg

SEQ ID NO: 48364 - DNA, 20 bp, Artificial Sequence
  chemically synthesized
ctgggaactgcaccaggcac

SEQ ID NO: 48365 - DNA, 20 bp, Artificial Sequence
  chemically synthesized
gtattccatctgtttcagcc

SEQ ID NO: 48366 - DNA, 20 bp, Artificial Sequence
  chemically synthesized
ttgtggggttgtggccagga

SEQ ID NO: 48367 - DNA, 20 bp, Artificial Sequence
  chemically synthesized
ttattttgtgggaatcgaat

SEQ ID NO: 48368 - DNA, 20 bp, Artificial Sequence
  chemically synthesized
atgaaaatattttttggcaa

SEQ ID NO: 48369 - DNA, 20 bp, Artificial Sequence
  chemically synthesized
caatccttttcttttagtca

SEQ ID NO: 48370 - DNA, 20 bp, Artificial Sequence
  chemically synthesized
gttcagcgatgatggtgtca

SEQ ID NO: 48371 - DNA, 20 bp, Artificial Sequence
  chemically synthesized
ccatgcttcctggagagctt

SEQ ID NO: 48372 - DNA, 20 bp, Artificial Sequence
  chemically synthesized
agtaactactggctttctgt

SEQ ID NO: 48373 - DNA, 20 bp, Artificial Sequence
  chemically synthesized
gtcacatcttcggtggaggg

SEQ ID NO: 48374 - DNA, 20 bp, Artificial Sequence
  chemically synthesized
aagcactagggccagggtga

SEQ ID NO: 48375 - DNA, 20 bp, Artificial Sequence
  chemically synthesized
aggcagcagatgcattggca

SEQ ID NO: 48376 - DNA, 20 bp, Artificial Sequence
  chemically synthesized
aggcttaaagggaattctat

SEQ ID NO: 48377 - DNA, 20 bp, Artificial Sequence
  chemically synthesized
aggaggaacatgatgacatg

SEQ ID NO: 48378 - DNA, 20 bp, Artificial Sequence
  chemically synthesized
ccccctcccccatgccccag

SEQ ID NO: 48379 - DNA, 20 bp, Artificial Sequence
  chemically synthesized
aggcaacacttcttaaagag

SEQ ID NO: 48380 - DNA, 20 bp, Artificial Sequence
  chemically synthesized
cctcagaacttgtttggatt

SEQ ID NO: 48381 - DNA, 20 bp, Artificial Sequence
  chemically synthesized
gggcaatcagagtctgcttg

SEQ ID NO: 48382 - DNA, 20 bp, Artificial Sequence
  chemically synthesized
gaaactccatctcaaaaaaa

SEQ ID NO: 48383 - DNA, 20 bp, Artificial Sequence
  chemically synthesized
gttcatggtacctcctaatc

SEQ ID NO: 48384 - DNA, 20 bp, Artificial Sequence
  chemically synthesized
gcctcagtttctcatgacta

SEQ ID NO: 48385 - DNA, 20 bp, Artificial Sequence
  chemically synthesized
tgttccaaacttccaccaga

SEQ ID NO: 48386 - DNA, 20 bp, Artificial Sequence
  chemically synthesized
cacaaccccacaacatccct

SEQ ID NO: 48387 - DNA, 20 bp, Artificial Sequence
  chemically synthesized
tgggcaggcagctgtgagtg

SEQ ID NO: 48388 - DNA, 20 bp, Artificial Sequence
  chemically synthesized
aagtcctgggctggtaatac

SEQ ID NO: 48389 - DNA, 20 bp, Artificial Sequence
  chemically synthesized
taaaggacgccaatgggcct

SEQ ID NO: 48390 - DNA, 20 bp, Artificial Sequence
  chemically synthesized
gagcatgagttctgtgtcat

SEQ ID NO: 48391 - DNA, 20 bp, Artificial Sequence
  chemically synthesized
cccacctgtgccgcggcgag

SEQ ID NO: 48392 - DNA, 20 bp, Artificial Sequence
  chemically synthesized
cgtcagattacgcgcagagg

SEQ ID NO: 48393 - DNA, 20 bp, Artificial Sequence
  chemically synthesized
aagacgtcatataggtacat

SEQ ID NO: 48394 - DNA, 20 bp, Artificial Sequence
  chemically synthesized
ttccttttacacaccatgtt

SEQ ID NO: 48395 - DNA, 20 bp, Artificial Sequence
  chemically synthesized
ggaagggctgtcgatactgg

SEQ ID NO: 48396 - DNA, 20 bp, Artificial Sequence
  chemically synthesized
atcaaaggcctcccctggag

SEQ ID NO: 48397 - DNA, 20 bp, Artificial Sequence
  chemically synthesized
atatgacgtctttgcaaact

SEQ ID NO: 48398 - DNA, 20 bp, Artificial Sequence
  chemically synthesized
gtgggttccgatttggtttg

SEQ ID NO: 48399 - DNA, 20 bp, Artificial Sequence
  chemically synthesized
atttcaagttaccactgctc

SEQ ID NO: 48400 - DNA, 20 bp, Artificial Sequence
  chemically synthesized
gaacaaagatacagagctgg

SEQ ID NO: 48401 - DNA, 20 bp, Artificial Sequence
  chemically synthesized
tctgaaatgtaaaatgttac

SEQ ID NO: 48402 - DNA, 20 bp, Artificial Sequence
  chemically synthesized
tccaaacaagttctgaggtt

SEQ ID NO: 48403 - DNA, 20 bp, Artificial Sequence
  chemically synthesized
agttggagcagacaagagct

SEQ ID NO: 48404 - DNA, 20 bp, Artificial Sequence
  chemically synthesized
agctgggtgcaggtacagag

SEQ ID NO: 48405 - DNA, 20 bp, Artificial Sequence
  chemically synthesized
cctagtgcttcaaatcttaa

SEQ ID NO: 48406 - DNA, 20 bp, Artificial Sequence
  chemically synthesized
ggtggtgcagaagcacaaat

SEQ ID NO: 48407 - DNA, 20 bp, Artificial Sequence
  chemically synthesized
tttacccaaagccttagggc

SEQ ID NO: 48408 - DNA, 20 bp, Artificial Sequence
  chemically synthesized
accatcaaataaatcacaaa

SEQ ID NO: 48409 - DNA, 20 bp, Artificial Sequence
  chemically synthesized
ggtcacactgcagacaggga

SEQ ID NO: 48410 - DNA, 20 bp, Artificial Sequence
  chemically synthesized
gattacgcgcagagggaaga

SEQ ID NO: 48411 - DNA, 20 bp, Artificial Sequence
  chemically synthesized
atcaactttggactccagca

SEQ ID NO: 48412 - DNA, 20 bp, Artificial Sequence
  chemically synthesized
agggaggatcataaattcgc

SEQ ID NO: 48413 - DNA, 20 bp, Artificial Sequence
  chemically synthesized
cctcctgcctggtacacaat

SEQ ID NO: 48414 - DNA, 20 bp, Artificial Sequence
  chemically synthesized
gtacacaataggtgtttact

SEQ ID NO: 48415 - DNA, 20 bp, Artificial Sequence
  chemically synthesized
tgtttactggatgcttgtcc

SEQ ID NO: 48416 - DNA, 20 bp, Artificial Sequence
  chemically synthesized
aaattgaatcttctggaaag

SEQ ID NO: 48417 - DNA, 20 bp, Artificial Sequence
  chemically synthesized
gaggccggagggggtccagg

SEQ ID NO: 48418 - DNA, 20 bp, Artificial Sequence
  chemically synthesized
tgggcagcgaggagtccaca

SEQ ID NO: 48419 - DNA, 20 bp, Artificial Sequence
  chemically synthesized
cagcgaggagtccacagtag

SEQ ID NO: 48420 - DNA, 20 bp, Artificial Sequence
  chemically synthesized
cggcctgccttccagcccag

SEQ ID NO: 48421 - DNA, 20 bp, Artificial Sequence
  chemically synthesized
ttccagcccagttaggattt

SEQ ID NO: 48422 - DNA, 20 bp, Artificial Sequence
  chemically synthesized
tccctctgcgcgtaatctga

SEQ ID NO: 48423 - DNA, 20 bp, Artificial Sequence
  chemically synthesized
ctccagtccgggggttccgt

SEQ ID NO: 48424 - DNA, 20 bp, Artificial Sequence
  chemically synthesized
cgtcaagcacccacacccta

SEQ ID NO: 48425 - DNA, 20 bp, Artificial Sequence
  chemically synthesized
cagcggctcccagctcccag

SEQ ID NO: 48426 - DNA, 20 bp, Artificial Sequence
  chemically synthesized
ccgcagccgggacggtgcgg

SEQ ID NO: 48427 - DNA, 20 bp, Artificial Sequence
  chemically synthesized
ggtgctgtttcctctcgggc

SEQ ID NO: 48428 - DNA, 20 bp, Artificial Sequence
  chemically synthesized
agtgcaggtcgccgagggct

SEQ ID NO: 48429 - DNA, 20 bp, Artificial Sequence
  chemically synthesized
agcactgccaggatatcctg

SEQ ID NO: 48430 - DNA, 20 bp, Artificial Sequence
  chemically synthesized
aggatatcctgcccagattt

SEQ ID NO: 48431 - DNA, 20 bp, Artificial Sequence
  chemically synthesized
ctgcaccaggcacagagaaa

SEQ ID NO: 48432 - DNA, 20 bp, Artificial Sequence
  chemically synthesized
gggcttgccattatagtggg

SEQ ID NO: 48433 - DNA, 20 bp, Artificial Sequence
  chemically synthesized
gccattatagtgggttccga

SEQ ID NO: 48434 - DNA, 20 bp, Artificial Sequence
  chemically synthesized
aactcatgctctagtattcc

SEQ ID NO: 48435 - DNA, 20 bp, Artificial Sequence
  chemically synthesized
gtctgccgaccgtgtgcggg

SEQ ID NO: 48436 - DNA, 20 bp, Artificial Sequence
  chemically synthesized
cgagtttgctcaacaactct

SEQ ID NO: 48437 - DNA, 20 bp, Artificial Sequence
  chemically synthesized
cttctggccctcaggctgtg

SEQ ID NO: 48438 - DNA, 20 bp, Artificial Sequence
  chemically synthesized
cttcttcccggggcgagacc

SEQ ID NO: 48439 - DNA, 20 bp, Artificial Sequence
  chemically synthesized
ttggctgaggttctgtgtcc

SEQ ID NO: 48440 - DNA, 20 bp, Artificial Sequence
  chemically synthesized
agtcagatgtggggttgaat

SEQ ID NO: 48441 - DNA, 20 bp, Artificial Sequence
  chemically synthesized
tggcttcctctcactagctg

SEQ ID NO: 48442 - DNA, 20 bp, Artificial Sequence
  chemically synthesized
caagccccggggggatcact

SEQ ID NO: 48443 - DNA, 20 bp, Artificial Sequence
  chemically synthesized
tgccactcacagctgcctgc

SEQ ID NO: 48444 - DNA, 20 bp, Artificial Sequence
  chemically synthesized
cacctgaaccaagcccttga

SEQ ID NO: 48445 - DNA, 20 bp, Artificial Sequence
  chemically synthesized
gaggatgtttcttctctggt

SEQ ID NO: 48446 - DNA, 20 bp, Artificial Sequence
  chemically synthesized
tcaccccaggtgcattagaa

SEQ ID NO: 48447 - DNA, 20 bp, Artificial Sequence
  chemically synthesized
ggtgtcatgagaattttatt

SEQ ID NO: 48448 - DNA, 20 bp, Artificial Sequence
  chemically synthesized
tttttcttttttttttgaga

SEQ ID NO: 48449 - DNA, 20 bp, Artificial Sequence
  chemically synthesized
tgcctcagcctcccaagaag

SEQ ID NO: 48450 - DNA, 20 bp, Artificial Sequence
  chemically synthesized
ttttgtatttttagtagaga

SEQ ID NO: 48451 - DNA, 20 bp, Artificial Sequence
  chemically synthesized
tgtaaaatgttacgaaaacc

SEQ ID NO: 48452 - DNA, 20 bp, Artificial Sequence
  chemically synthesized
acgaaaaccaaaagtttttt

SEQ ID NO: 48453 - DNA, 20 bp, Artificial Sequence
  chemically synthesized
agcacctgacgtgaactgac

SEQ ID NO: 48454 - DNA, 20 bp, Artificial Sequence
  chemically synthesized
catattcatatattttgctg

SEQ ID NO: 48455 - DNA, 20 bp, Artificial Sequence
  chemically synthesized
catagattacagtatgcagc

SEQ ID NO: 48456 - DNA, 20 bp, Artificial Sequence
  chemically synthesized
tccagattcttccaagcaga

SEQ ID NO: 48457 - DNA, 20 bp, Artificial Sequence
  chemically synthesized
aaacaagttctgaggttcaa

SEQ ID NO: 48458 - DNA, 20 bp, Artificial Sequence
  chemically synthesized
gttcaaaaccgttttggccc

SEQ ID NO: 48459 - DNA, 20 bp, Artificial Sequence
  chemically synthesized
gtaggggccaaggaggagca

SEQ ID NO: 48460 - DNA, 20 bp, Artificial Sequence
  chemically synthesized
aggaggagcatggagtttgg

SEQ ID NO: 48461 - DNA, 20 bp, Artificial Sequence
  chemically synthesized
catagatagtggctgctata

SEQ ID NO: 48462 - DNA, 20 bp, Artificial Sequence
  chemically synthesized
tggaagtggggcctaatggg

SEQ ID NO: 48463 - DNA, 20 bp, Artificial Sequence
  chemically synthesized
atgggggaggaacccctgtg

SEQ ID NO: 48464 - DNA, 20 bp, Artificial Sequence
  chemically synthesized
ataatgagtaagttctcccg

SEQ ID NO: 48465 - DNA, 20 bp, Artificial Sequence
  chemically synthesized
ccgctatgatttcccttgaa

SEQ ID NO: 48466 - DNA, 20 bp, Artificial Sequence
  chemically synthesized
cttgaaggctgattattaaa

SEQ ID NO: 48467 - DNA, 20 bp, Artificial Sequence
  chemically synthesized
tggcacctccctctcttctc

SEQ ID NO: 48468 - DNA, 20 bp, Artificial Sequence
  chemically synthesized
ctcttgcttcttctcttgcc

SEQ ID NO: 48469 - DNA, 20 bp, Artificial Sequence
  chemically synthesized
caccttctgccatcagtgaa

SEQ ID NO: 48470 - DNA, 20 bp, Artificial Sequence
  chemically synthesized
accagaagcagatgctggtg

SEQ ID NO: 48471 - DNA, 20 bp, Artificial Sequence
  chemically synthesized
tgctggtgccatgcttcctg

SEQ ID NO: 48472 - DNA, 20 bp, Artificial Sequence
  chemically synthesized
catttgtagagcatctggat

SEQ ID NO: 48473 - DNA, 20 bp, Artificial Sequence
  chemically synthesized
ttggagctggaattcaggtc

SEQ ID NO: 48474 - DNA, 20 bp, Artificial Sequence
  chemically synthesized
cggtttcctggctccaaagc

SEQ ID NO: 48475 - DNA, 20 bp, Artificial Sequence
  chemically synthesized
tggcctatatgagttcttta

SEQ ID NO: 48476 - DNA, 20 bp, Artificial Sequence
  chemically synthesized
ggggtgagataaagtacacc

SEQ ID NO: 48477 - DNA, 20 bp, Artificial Sequence
  chemically synthesized
taaagtacacctagggtttg

SEQ ID NO: 48478 - DNA, 20 bp, Artificial Sequence
  chemically synthesized
atgtcttccatggccttctt

SEQ ID NO: 48479 - DNA, 20 bp, Artificial Sequence
  chemically synthesized
cactgcatatacactgggga

SEQ ID NO: 48480 - DNA, 20 bp, Artificial Sequence
  chemically synthesized
gggtaccaagcacagtaact

SEQ ID NO: 48481 - DNA, 20 bp, Artificial Sequence
  chemically synthesized
tattctcctcaccctggccc

SEQ ID NO: 48482 - DNA, 20 bp, Artificial Sequence
  chemically synthesized
tagtgcttcaaatcttaaaa

SEQ ID NO: 48483 - DNA, 20 bp, Artificial Sequence
  chemically synthesized
tcttaaaaaaacgtttttat

SEQ ID NO: 48484 - DNA, 20 bp, Artificial Sequence
  chemically synthesized
tggtgcagaagcacaaataa

SEQ ID NO: 48485 - DNA, 20 bp, Artificial Sequence
  chemically synthesized
gcacaaataaaaacgttttt

SEQ ID NO: 48486 - DNA, 20 bp, Artificial Sequence
  chemically synthesized
gggacttcactctggatagc

SEQ ID NO: 48487 - DNA, 20 bp, Artificial Sequence
  chemically synthesized
aggaattttggaccctagag

SEQ ID NO: 48488 - DNA, 20 bp, Artificial Sequence
  chemically synthesized
catcccagggccttgtccct

SEQ ID NO: 48489 - DNA, 20 bp, Artificial Sequence
  chemically synthesized
aatggctggcaggcagacca

SEQ ID NO: 48490 - DNA, 20 bp, Artificial Sequence
  chemically synthesized
gacgtaccactggggcatgg

SEQ ID NO: 48491 - DNA, 20 bp, Artificial Sequence
  chemically synthesized
atacagaaagccagtagtta

SEQ ID NO: 48492 - DNA, 20 bp, Artificial Sequence
  chemically synthesized
aatacatacttgctgtcccc

SEQ ID NO: 48493 - DNA, 20 bp, Artificial Sequence
  chemically synthesized
actacgggccacactcgaca

SEQ ID NO: 48494 - DNA, 20 bp, Artificial Sequence
  chemically synthesized
ataaattgagggaaaaaatc

SEQ ID NO: 48495 - DNA, 20 bp, Artificial Sequence
  chemically synthesized
ggtgagtaatttacaaggaa

SEQ ID NO: 48496 - DNA, 20 bp, Artificial Sequence
  chemically synthesized
ggaaaagggatttattcagc

SEQ ID NO: 48497 - DNA, 20 bp, Artificial Sequence
  chemically synthesized
ccaggaagcatggcaccagc

SEQ ID NO: 48498 - DNA, 20 bp, Artificial Sequence
  chemically synthesized
tgcttctggtgagggcctta

SEQ ID NO: 48499 - DNA, 20 bp, Artificial Sequence
  chemically synthesized
actgaggaccaaatttccac

SEQ ID NO: 48500 - DNA, 20 bp, Artificial Sequence
  chemically synthesized
attatagcagccactatcta

SEQ ID NO: 48501 - DNA, 20 bp, Artificial Sequence
  chemically synthesized
agcagccactatctatggtg

SEQ ID NO: 48502 - DNA, 20 bp, Artificial Sequence
  chemically synthesized
ccactatctatggtgatttg

SEQ ID NO: 48503 - DNA, 20 bp, Artificial Sequence
  chemically synthesized
aactgctctcaggcagacat

SEQ ID NO: 48504 - DNA, 20 bp, Artificial Sequence
  chemically synthesized
acccaaagccttagggccaa

SEQ ID NO: 48505 - DNA, 20 bp, Artificial Sequence
  chemically synthesized
aaacggttttgaacctcaga

SEQ ID NO: 48506 - DNA, 20 bp, Artificial Sequence
  chemically synthesized
gttttgaacctcagaacttg

SEQ ID NO: 48507 - DNA, 20 bp, Artificial Sequence
  chemically synthesized
ggcagtaatgggcaatcaga

SEQ ID NO: 48508 - DNA, 20 bp, Artificial Sequence
  chemically synthesized
aataaatcacaaaaaaaact

SEQ ID NO: 48509 - DNA, 20 bp, Artificial Sequence
  chemically synthesized
tcggatccactgaggaggtc

SEQ ID NO: 48510 - DNA, 20 bp, Artificial Sequence
  chemically synthesized
tggtggcaggtacctgtaat

SEQ ID NO: 48511 - DNA, 20 bp, Artificial Sequence
  chemically synthesized
tgtgctccttatcttccacc

SEQ ID NO: 48512 - DNA, 20 bp, Artificial Sequence
  chemically synthesized
catcatcgctgaactcctac

SEQ ID NO: 48513 - DNA, 20 bp, Artificial Sequence
  chemically synthesized
gtgacctcctctctctgggc

SEQ ID NO: 48514 - DNA, 20 bp, Artificial Sequence
  chemically synthesized
agtttctcatgactaaaaga

SEQ ID NO: 48515 - DNA, 20 bp, Artificial Sequence
  chemically synthesized
ggattggtctaaaaattatt

SEQ ID NO: 48516 - DNA, 20 bp, Artificial Sequence
  chemically synthesized
aaaaaatattttcattctaa

SEQ ID NO: 48517 - DNA, 20 bp, Artificial Sequence
  chemically synthesized
accagagaagaaacatcctc

SEQ ID NO: 48518 - DNA, 20 bp, Artificial Sequence
  chemically synthesized
ggttcaggtggtcatacagc

SEQ ID NO: 48519 - DNA, 20 bp, Artificial Sequence
  chemically synthesized
gtactcactatttccagaac

SEQ ID NO: 48520 - DNA, 20 bp, Artificial Sequence
  chemically synthesized
ttcccctctgccccaggagc

SEQ ID NO: 48521 - DNA, 20 bp, Artificial Sequence
  chemically synthesized
aaaactgcaagtgatccccc

SEQ ID NO: 48522 - DNA, 20 bp, Artificial Sequence
  chemically synthesized
ctgctgccactgagccgtag

SEQ ID NO: 48523 - DNA, 20 bp, Artificial Sequence
  chemically synthesized
gacgattgtcacctcccttt

SEQ ID NO: 48524 - DNA, 20 bp, Artificial Sequence
  chemically synthesized
ccacagctagtgagaggaag

SEQ ID NO: 48525 - DNA, 20 bp, Artificial Sequence
  chemically synthesized
ctagtggtctcgccccggga

SEQ ID NO: 48526 - DNA, 20 bp, Artificial Sequence
  chemically synthesized
ggccctccaccctccgctgc

SEQ ID NO: 48527 - DNA, 20 bp, Artificial Sequence
  chemically synthesized
ggaacccactataatggcaa

SEQ ID NO: 48528 - DNA, 20 bp, Artificial Sequence
  chemically synthesized
gtggctgtggttccgtgctc

SEQ ID NO: 48529 - DNA, 20 bp, Artificial Sequence
  chemically synthesized
gcggaaaccttctagggtgt

SEQ ID NO: 48530 - DNA, 20 bp, Artificial Sequence
  chemically synthesized
gagccccatcggacgatcct

SEQ ID NO: 48531 - DNA, 20 bp, Artificial Sequence
  chemically synthesized
ggaacccccggactggagga

SEQ ID NO: 48532 - DNA, 20 bp, Artificial Sequence
  chemically synthesized
cctcgccctccccaaacagc

SEQ ID NO: 48533 - DNA, 20 bp, Artificial Sequence
  chemically synthesized
ttctgccgggcccacctttt

SEQ ID NO: 48534 - DNA, 20 bp, Artificial Sequence
  chemically synthesized
taccaactagctgctccttg

SEQ ID NO: 48535 - DNA, 20 bp, Artificial Sequence
  chemically synthesized
aactagctgctccttgaaga

SEQ ID NO: 48536 - DNA, 20 bp, Artificial Sequence
  chemically synthesized
agctgctccttgaagagatt

SEQ ID NO: 48537 - DNA, 20 bp, Artificial Sequence
  chemically synthesized
gtccagcctacatgcatttc

SEQ ID NO: 48538 - DNA, 20 bp, Artificial Sequence
  chemically synthesized
atttcaagggatttatacta

SEQ ID NO: 48539 - DNA, 20 bp, Artificial Sequence
  chemically synthesized
gggatttatactacaaagat

SEQ ID NO: 48540 - DNA, 20 bp, Artificial Sequence
  chemically synthesized
atactacaaagattcaggtt

SEQ ID NO: 48541 - DNA, 20 bp, Artificial Sequence
  chemically synthesized
aattctatggtaggcacaag

SEQ ID NO: 48542 - DNA, 20 bp, Artificial Sequence
  chemically synthesized
aggcacaagctcagctttcc

SEQ ID NO: 48543 - DNA, 20 bp, Artificial Sequence
  chemically synthesized
tttccagaagattcaatttg

SEQ ID NO: 48544 - DNA, 20 bp, Artificial Sequence
  chemically synthesized
ggggaaagagagctcctggc

SEQ ID NO: 48545 - DNA, 20 bp, Artificial Sequence
  chemically synthesized
attgtacatgtggcatgaca

SEQ ID NO: 48546 - DNA, 20 bp, Artificial Sequence
  chemically synthesized
atcctcccttgcagatgcac

SEQ ID NO: 48547 - DNA, 20 bp, Artificial Sequence
  chemically synthesized
caaagttgatgctctttcca

SEQ ID NO: 48548 - DNA, 20 bp, Artificial Sequence
  chemically synthesized
cgcagcacagagtaggagct

SEQ ID NO: 48549 - DNA, 20 bp, Artificial Sequence
  chemically synthesized
taattggaattgtatttgca

SEQ ID NO: 48550 - DNA, 20 bp, Artificial Sequence
  chemically synthesized
tgtatttgcaatgtgctttt

SEQ ID NO: 48551 - DNA, 22 bp, Artificial Sequence
  chemically synthesized
gctcccatctattcttgctcca

SEQ ID NO: 48552 - DNA, 22 bp, Artificial Sequence
  chemically synthesized
ccatctattcttgctccagggg

SEQ ID NO: 48553 - DNA, 22 bp, Artificial Sequence
  chemically synthesized
ttcttgctccaggggaggcctt

SEQ ID NO: 48554 - DNA, 22 bp, Artificial Sequence
  chemically synthesized
ttgctccaggggaggcctttga

SEQ ID NO: 48555 - DNA, 22 bp, Artificial Sequence
  chemically synthesized
gctccaggggaggcctttgatg

SEQ ID NO: 48556 - DNA, 22 bp, Artificial Sequence
  chemically synthesized
ctccaggggaggcctttgatga

SEQ ID NO: 48557 - DNA, 22 bp, Artificial Sequence
  chemically synthesized
caggggaggcctttgatgagga

SEQ ID NO: 48558 - DNA, 22 bp, Artificial Sequence
  chemically synthesized
tgatgaggaagctgccaaaagc

SEQ ID NO: 48559 - DNA, 22 bp, Artificial Sequence
  chemically synthesized
gatgaggaagctgccaaaagca

SEQ ID NO: 48560 - DNA, 22 bp, Artificial Sequence
  chemically synthesized
atgaggaagctgccaaaagcac

SEQ ID NO: 48561 - DNA, 22 bp, Artificial Sequence
  chemically synthesized
ccaaaagcacattgcaaataca

SEQ ID NO: 48562 - DNA, 22 bp, Artificial Sequence
  chemically synthesized
caaatacaattccaattacagg

SEQ ID NO: 48563 - DNA, 22 bp, Artificial Sequence
  chemically synthesized
caattacaggcaacaggaagga

SEQ ID NO: 48564 - DNA, 22 bp, Artificial Sequence
  chemically synthesized
caggcaacaggaaggagaacca

SEQ ID NO: 48565 - DNA, 22 bp, Artificial Sequence
  chemically synthesized
tgccacctctgtcagcaaacca

SEQ ID NO: 48566 - DNA, 22 bp, Artificial Sequence
  chemically synthesized
ccacctctgtcagcaaaccatg

SEQ ID NO: 48567 - DNA, 22 bp, Artificial Sequence
  chemically synthesized
tgtcagcaaaccatgagctcct

SEQ ID NO: 48568 - DNA, 22 bp, Artificial Sequence
  chemically synthesized
tcagcaaaccatgagctcctac

SEQ ID NO: 48569 - DNA, 22 bp, Artificial Sequence
  chemically synthesized
ctactctgtgctgcgatggcgg

SEQ ID NO: 48570 - DNA, 22 bp, Artificial Sequence
  chemically synthesized
ctctgtgctgcgatggcgggct

SEQ ID NO: 48571 - DNA, 22 bp, Artificial Sequence
  chemically synthesized
tgtgctgcgatggcgggctcga

SEQ ID NO: 48572 - DNA, 22 bp, Artificial Sequence
  chemically synthesized
tgctgcgatggcgggctcgatg

SEQ ID NO: 48573 - DNA, 22 bp, Artificial Sequence
  chemically synthesized
cgatggcgggctcgatggggat

SEQ ID NO: 48574 - DNA, 22 bp, Artificial Sequence
  chemically synthesized
gatggggataactctgacctta

SEQ ID NO: 48575 - DNA, 22 bp, Artificial Sequence
  chemically synthesized
tgaccttacctcatggagtcac

SEQ ID NO: 48576 - DNA, 22 bp, Artificial Sequence
  chemically synthesized
accttacctcatggagtcactg

SEQ ID NO: 48577 - DNA, 22 bp, Artificial Sequence
  chemically synthesized
acctcatggagtcactgtcaac

SEQ ID NO: 48578 - DNA, 22 bp, Artificial Sequence
  chemically synthesized
cctcatggagtcactgtcaacc

SEQ ID NO: 48579 - DNA, 22 bp, Artificial Sequence
  chemically synthesized
atggagtcactgtcaacccact

SEQ ID NO: 48580 - DNA, 22 bp, Artificial Sequence
  chemically synthesized
tcaacccactggttgcactgtc

SEQ ID NO: 48581 - DNA, 22 bp, Artificial Sequence
  chemically synthesized
gttgcactgtctttgtgcactg

SEQ ID NO: 48582 - DNA, 22 bp, Artificial Sequence
  chemically synthesized
cactgtctttgtgcactggctc

SEQ ID NO: 48583 - DNA, 22 bp, Artificial Sequence
  chemically synthesized
tctttgtgcactggctctctgg

SEQ ID NO: 48584 - DNA, 22 bp, Artificial Sequence
  chemically synthesized
tgtgcactggctctctggagtg

SEQ ID NO: 48585 - DNA, 22 bp, Artificial Sequence
  chemically synthesized
gtgcactggctctctggagtga

SEQ ID NO: 48586 - DNA, 22 bp, Artificial Sequence
  chemically synthesized
tgcactggctctctggagtgag

SEQ ID NO: 48587 - DNA, 22 bp, Artificial Sequence
  chemically synthesized
gctctctggagtgaggtctttg

SEQ ID NO: 48588 - DNA, 22 bp, Artificial Sequence
  chemically synthesized
tctggagtgaggtctttgcaaa

SEQ ID NO: 48589 - DNA, 22 bp, Artificial Sequence
  chemically synthesized
tggagtgaggtctttgcaaaca

SEQ ID NO: 48590 - DNA, 22 bp, Artificial Sequence
  chemically synthesized
gagtgaggtctttgcaaacaaa

SEQ ID NO: 48591 - DNA, 22 bp, Artificial Sequence
  chemically synthesized
tgcaaacaaagtggaaagagca

SEQ ID NO: 48592 - DNA, 22 bp, Artificial Sequence
  chemically synthesized
gcaaacaaagtggaaagagcat

SEQ ID NO: 48593 - DNA, 22 bp, Artificial Sequence
  chemically synthesized
caaacaaagtggaaagagcatc

SEQ ID NO: 48594 - DNA, 22 bp, Artificial Sequence
  chemically synthesized
tggactccagcacctagattca

SEQ ID NO: 48595 - DNA, 22 bp, Artificial Sequence
  chemically synthesized
ggactccagcacctagattcag

SEQ ID NO: 48596 - DNA, 22 bp, Artificial Sequence
  chemically synthesized
gactccagcacctagattcaga

SEQ ID NO: 48597 - DNA, 22 bp, Artificial Sequence
  chemically synthesized
cagcacctagattcagagcagg

SEQ ID NO: 48598 - DNA, 22 bp, Artificial Sequence
  chemically synthesized
gattcagagcaggccatttcac

SEQ ID NO: 48599 - DNA, 22 bp, Artificial Sequence
  chemically synthesized
agagcaggccatttcactcgga

SEQ ID NO: 48600 - DNA, 22 bp, Artificial Sequence
  chemically synthesized
cactcggaatctgctgtgcatc

SEQ ID NO: 48601 - DNA, 22 bp, Artificial Sequence
  chemically synthesized
actcggaatctgctgtgcatct

SEQ ID NO: 48602 - DNA, 22 bp, Artificial Sequence
  chemically synthesized
ggaatctgctgtgcatctgcaa

SEQ ID NO: 48603 - DNA, 22 bp, Artificial Sequence
  chemically synthesized
ctgtgcatctgcaagggaggat

SEQ ID NO: 48604 - DNA, 22 bp, Artificial Sequence
  chemically synthesized
tgcatctgcaagggaggatcat

SEQ ID NO: 48605 - DNA, 22 bp, Artificial Sequence
  chemically synthesized
caagggaggatcataaattcgc

SEQ ID NO: 48606 - DNA, 22 bp, Artificial Sequence
  chemically synthesized
gcctttgtttcttcccagtatc

SEQ ID NO: 48607 - DNA, 22 bp, Artificial Sequence
  chemically synthesized
tgtttcttcccagtatcgacag

SEQ ID NO: 48608 - DNA, 22 bp, Artificial Sequence
  chemically synthesized
gtttcttcccagtatcgacagc

SEQ ID NO: 48609 - DNA, 22 bp, Artificial Sequence
  chemically synthesized
tttcttcccagtatcgacagcc

SEQ ID NO: 48610 - DNA, 22 bp, Artificial Sequence
  chemically synthesized
cttcccagtatcgacagccctt

SEQ ID NO: 48611 - DNA, 22 bp, Artificial Sequence
  chemically synthesized
ttcccagtatcgacagcccttc

SEQ ID NO: 48612 - DNA, 22 bp, Artificial Sequence
  chemically synthesized
cccagtatcgacagcccttcca

SEQ ID NO: 48613 - DNA, 22 bp, Artificial Sequence
  chemically synthesized
ccagtatcgacagcccttccag

SEQ ID NO: 48614 - DNA, 22 bp, Artificial Sequence
  chemically synthesized
ccagaaagagcaagcctcatgt

SEQ ID NO: 48615 - DNA, 22 bp, Artificial Sequence
  chemically synthesized
cagaaagagcaagcctcatgtc

SEQ ID NO: 48616 - DNA, 22 bp, Artificial Sequence
  chemically synthesized
atgtcatgccacatgtacaatc

SEQ ID NO: 48617 - DNA, 22 bp, Artificial Sequence
  chemically synthesized
aggccaggagctctctttcccc

SEQ ID NO: 48618 - DNA, 22 bp, Artificial Sequence
  chemically synthesized
tctttccccttttcatcctcct

SEQ ID NO: 48619 - DNA, 22 bp, Artificial Sequence
  chemically synthesized
tttccccttttcatcctcctgc

SEQ ID NO: 48620 - DNA, 22 bp, Artificial Sequence
  chemically synthesized
tccccttttcatcctcctgcct

SEQ ID NO: 48621 - DNA, 22 bp, Artificial Sequence
  chemically synthesized
ccccttttcatcctcctgcctg

SEQ ID NO: 48622 - DNA, 22 bp, Artificial Sequence
  chemically synthesized
cccttttcatcctcctgcctgg

SEQ ID NO: 48623 - DNA, 22 bp, Artificial Sequence
  chemically synthesized
ttcatcctcctgcctggtacac

SEQ ID NO: 48624 - DNA, 22 bp, Artificial Sequence
  chemically synthesized
tcatcctcctgcctggtacaca

SEQ ID NO: 48625 - DNA, 22 bp, Artificial Sequence
  chemically synthesized
catcctcctgcctggtacacaa

SEQ ID NO: 48626 - DNA, 22 bp, Artificial Sequence
  chemically synthesized
atcctcctgcctggtacacaat

SEQ ID NO: 48627 - DNA, 22 bp, Artificial Sequence
  chemically synthesized
ctgcctggtacacaataggtgt

SEQ ID NO: 48628 - DNA, 22 bp, Artificial Sequence
  chemically synthesized
cctggtacacaataggtgttta

SEQ ID NO: 48629 - DNA, 22 bp, Artificial Sequence
  chemically synthesized
gtacacaataggtgtttactgg

SEQ ID NO: 48630 - DNA, 22 bp, Artificial Sequence
  chemically synthesized
actggatgcttgtccagttgat

SEQ ID NO: 48631 - DNA, 22 bp, Artificial Sequence
  chemically synthesized
ctggatgcttgtccagttgatt

SEQ ID NO: 48632 - DNA, 22 bp, Artificial Sequence
  chemically synthesized
gatgcttgtccagttgatttct

SEQ ID NO: 48633 - DNA, 22 bp, Artificial Sequence
  chemically synthesized
gtccagttgatttcttgaacat

SEQ ID NO: 48634 - DNA, 22 bp, Artificial Sequence
  chemically synthesized
tccagttgatttcttgaacatg

SEQ ID NO: 48635 - DNA, 22 bp, Artificial Sequence
  chemically synthesized
atttcttgaacatggtgtgtaa

SEQ ID NO: 48636 - DNA, 22 bp, Artificial Sequence
  chemically synthesized
cttgaacatggtgtgtaaaagg

SEQ ID NO: 48637 - DNA, 22 bp, Artificial Sequence
  chemically synthesized
ttgaacatggtgtgtaaaagga

SEQ ID NO: 48638 - DNA, 22 bp, Artificial Sequence
  chemically synthesized
gaacatggtgtgtaaaaggaat

SEQ ID NO: 48639 - DNA, 22 bp, Artificial Sequence
  chemically synthesized
aacatggtgtgtaaaaggaatc

SEQ ID NO: 48640 - DNA, 22 bp, Artificial Sequence
  chemically synthesized
tgcaaattgaatcttctggaaa

SEQ ID NO: 48641 - DNA, 22 bp, Artificial Sequence
  chemically synthesized
gcaaattgaatcttctggaaag

SEQ ID NO: 48642 - DNA, 22 bp, Artificial Sequence
  chemically synthesized
caaattgaatcttctggaaagc

SEQ ID NO: 48643 - DNA, 22 bp, Artificial Sequence
  chemically synthesized
aatcttctggaaagctgagctt

SEQ ID NO: 48644 - DNA, 22 bp, Artificial Sequence
  chemically synthesized
ctggaaagctgagcttgtgcct

SEQ ID NO: 48645 - DNA, 22 bp, Artificial Sequence
  chemically synthesized
tggaaagctgagcttgtgccta

SEQ ID NO: 48646 - DNA, 22 bp, Artificial Sequence
  chemically synthesized
gaaagctgagcttgtgcctacc

SEQ ID NO: 48647 - DNA, 22 bp, Artificial Sequence
  chemically synthesized
agcttgtgcctaccatagaatt

SEQ ID NO: 48648 - DNA, 22 bp, Artificial Sequence
  chemically synthesized
gtgcctaccatagaattctgaa

SEQ ID NO: 48649 - DNA, 22 bp, Artificial Sequence
  chemically synthesized
tgcctaccatagaattctgaat

SEQ ID NO: 48650 - DNA, 22 bp, Artificial Sequence
  chemically synthesized
ccatagaattctgaatgtacct

SEQ ID NO: 48651 - DNA, 22 bp, Artificial Sequence
  chemically synthesized
tgaatgtacctatatgacgtct

SEQ ID NO: 48652 - DNA, 22 bp, Artificial Sequence
  chemically synthesized
aatgtacctatatgacgtcttt

SEQ ID NO: 48653 - DNA, 22 bp, Artificial Sequence
  chemically synthesized
tatgacgtctttgcaaacttaa

SEQ ID NO: 48654 - DNA, 22 bp, Artificial Sequence
  chemically synthesized
tgcaaacttaaaacctgaatct

SEQ ID NO: 48655 - DNA, 22 bp, Artificial Sequence
  chemically synthesized
gcaaacttaaaacctgaatctt

SEQ ID NO: 48656 - DNA, 22 bp, Artificial Sequence
  chemically synthesized
caaacttaaaacctgaatcttt

SEQ ID NO: 48657 - DNA, 22 bp, Artificial Sequence
  chemically synthesized
aaaacctgaatctttgtagtat

SEQ ID NO: 48658 - DNA, 22 bp, Artificial Sequence
  chemically synthesized
aaacctgaatctttgtagtata

SEQ ID NO: 48659 - DNA, 22 bp, Artificial Sequence
  chemically synthesized
aatctttgtagtataaatccct

SEQ ID NO: 48660 - DNA, 22 bp, Artificial Sequence
  chemically synthesized
tgtagtataaatcccttgaaat

SEQ ID NO: 48661 - DNA, 22 bp, Artificial Sequence
  chemically synthesized
gtagtataaatcccttgaaatg

SEQ ID NO: 48662 - DNA, 22 bp, Artificial Sequence
  chemically synthesized
tagtataaatcccttgaaatgc

SEQ ID NO: 48663 - DNA, 22 bp, Artificial Sequence
  chemically synthesized
gaaatgcatgtaggctggacat

SEQ ID NO: 48664 - DNA, 22 bp, Artificial Sequence
  chemically synthesized
aaatgcatgtaggctggacatc

SEQ ID NO: 48665 - DNA, 22 bp, Artificial Sequence
  chemically synthesized
gacatcaaaagcaagcaatctc

SEQ ID NO: 48666 - DNA, 22 bp, Artificial Sequence
  chemically synthesized
ttcaaggagcagctagttggta

SEQ ID NO: 48667 - DNA, 22 bp, Artificial Sequence
  chemically synthesized
caaggagcagctagttggtaag

SEQ ID NO: 48668 - DNA, 22 bp, Artificial Sequence
  chemically synthesized
aaggagcagctagttggtaagg

SEQ ID NO: 48669 - DNA, 22 bp, Artificial Sequence
  chemically synthesized
gttggtaaggtcagtgtgcagg

SEQ ID NO: 48670 - DNA, 22 bp, Artificial Sequence
  chemically synthesized
gtaaggtcagtgtgcagggtgc

SEQ ID NO: 48671 - DNA, 22 bp, Artificial Sequence
  chemically synthesized
agtttagaaggctgccaggtta

SEQ ID NO: 48672 - DNA, 22 bp, Artificial Sequence
  chemically synthesized
agaaggctgccaggttaaggcc

SEQ ID NO: 48673 - DNA, 22 bp, Artificial Sequence
  chemically synthesized
gaaggctgccaggttaaggcca

SEQ ID NO: 48674 - DNA, 22 bp, Artificial Sequence
  chemically synthesized
ccaggttaaggccagtggaaag

SEQ ID NO: 48675 - DNA, 22 bp, Artificial Sequence
  chemically synthesized
aggccagtggaaagaattcggt

SEQ ID NO: 48676 - DNA, 22 bp, Artificial Sequence
  chemically synthesized
ggtgggcagcgaggagtccaca

SEQ ID NO: 48677 - DNA, 22 bp, Artificial Sequence
  chemically synthesized
attcagaagtctcactggtcag

SEQ ID NO: 48678 - DNA, 22 bp, Artificial Sequence
  chemically synthesized
agaagtctcactggtcagcagg

SEQ ID NO: 48679 - DNA, 22 bp, Artificial Sequence
  chemically synthesized
actggtcagcaggagacaaggt

SEQ ID NO: 48680 - DNA, 22 bp, Artificial Sequence
  chemically synthesized
gtcagcaggagacaaggtggac

SEQ ID NO: 48681 - DNA, 22 bp, Artificial Sequence
  chemically synthesized
aaaaggtgggcccggcagaact

SEQ ID NO: 48682 - DNA, 22 bp, Artificial Sequence
  chemically synthesized
ggagtctggcatcccacgcagg

SEQ ID NO: 48683 - DNA, 22 bp, Artificial Sequence
  chemically synthesized
gagtctggcatcccacgcaggg

SEQ ID NO: 48684 - DNA, 22 bp, Artificial Sequence
  chemically synthesized
gcatcccacgcagggtgagagg

SEQ ID NO: 48685 - DNA, 22 bp, Artificial Sequence
  chemically synthesized
gggcgccggcctgccttccagc

SEQ ID NO: 48686 - DNA, 22 bp, Artificial Sequence
  chemically synthesized
ccttccagcccagttaggattt

SEQ ID NO: 48687 - DNA, 22 bp, Artificial Sequence
  chemically synthesized
ccagcccagttaggatttggga

SEQ ID NO: 48688 - DNA, 22 bp, Artificial Sequence
  chemically synthesized
cagcccagttaggatttgggag

SEQ ID NO: 48689 - DNA, 22 bp, Artificial Sequence
  chemically synthesized
ggatttgggagttttttcttcc

SEQ ID NO: 48690 - DNA, 22 bp, Artificial Sequence
  chemically synthesized
gggagttttttcttccctctgc

SEQ ID NO: 48691 - DNA, 22 bp, Artificial Sequence
  chemically synthesized
ggagttttttcttccctctgcg

SEQ ID NO: 48692 - DNA, 22 bp, Artificial Sequence
  chemically synthesized
tttcttccctctgcgcgtaatc

SEQ ID NO: 48693 - DNA, 22 bp, Artificial Sequence
  chemically synthesized
ttcttccctctgcgcgtaatct

SEQ ID NO: 48694 - DNA, 22 bp, Artificial Sequence
  chemically synthesized
tcttccctctgcgcgtaatctg

SEQ ID NO: 48695 - DNA, 22 bp, Artificial Sequence
  chemically synthesized
cttccctctgcgcgtaatctga

SEQ ID NO: 48696 - DNA, 22 bp, Artificial Sequence
  chemically synthesized
ttccctctgcgcgtaatctgac

SEQ ID NO: 48697 - DNA, 22 bp, Artificial Sequence
  chemically synthesized
ccctctgcgcgtaatctgacgc

SEQ ID NO: 48698 - DNA, 22 bp, Artificial Sequence
  chemically synthesized
cctctgcgcgtaatctgacgct

SEQ ID NO: 48699 - DNA, 22 bp, Artificial Sequence
  chemically synthesized
tgcgcgtaatctgacgctgttt

SEQ ID NO: 48700 - DNA, 22 bp, Artificial Sequence
  chemically synthesized
cgcgtaatctgacgctgtttgg

SEQ ID NO: 48701 - DNA, 22 bp, Artificial Sequence
  chemically synthesized
acgctgtttggggagggcgagg

SEQ ID NO: 48702 - DNA, 22 bp, Artificial Sequence
  chemically synthesized
tttggggagggcgaggccgaaa

SEQ ID NO: 48703 - DNA, 22 bp, Artificial Sequence
  chemically synthesized
ggggagggcgaggccgaaacct

SEQ ID NO: 48704 - DNA, 22 bp, Artificial Sequence
  chemically synthesized
gggagggcgaggccgaaacctg

SEQ ID NO: 48705 - DNA, 22 bp, Artificial Sequence
  chemically synthesized
atcctccagtccgggggttccg

SEQ ID NO: 48706 - DNA, 22 bp, Artificial Sequence
  chemically synthesized
cagtccgggggttccgttaatg

SEQ ID NO: 48707 - DNA, 22 bp, Artificial Sequence
  chemically synthesized
cgttaatgtttaatcagatagg

SEQ ID NO: 48708 - DNA, 22 bp, Artificial Sequence
  chemically synthesized
atgtttaatcagataggatcgt

SEQ ID NO: 48709 - DNA, 22 bp, Artificial Sequence
  chemically synthesized
aatcagataggatcgtccgatg

SEQ ID NO: 48710 - DNA, 22 bp, Artificial Sequence
  chemically synthesized
atcagataggatcgtccgatgg

SEQ ID NO: 48711 - DNA, 22 bp, Artificial Sequence
  chemically synthesized
tggtggcgtgatctgcgcgccc

SEQ ID NO: 48712 - DNA, 22 bp, Artificial Sequence
  chemically synthesized
gtggcgtgatctgcgcgcccca

SEQ ID NO: 48713 - DNA, 22 bp, Artificial Sequence
  chemically synthesized
cgcgccccaggcgtcaagcacc

SEQ ID NO: 48714 - DNA, 22 bp, Artificial Sequence
  chemically synthesized
gaaggtttccgcagcgacgtcg

SEQ ID NO: 48715 - DNA, 22 bp, Artificial Sequence
  chemically synthesized
ccgcagcgacgtcgaggcgctc

SEQ ID NO: 48716 - DNA, 22 bp, Artificial Sequence
  chemically synthesized
cgcagcgacgtcgaggcgctca

SEQ ID NO: 48717 - DNA, 22 bp, Artificial Sequence
  chemically synthesized
atggttgcaggcgggcgccgcc

SEQ ID NO: 48718 - DNA, 22 bp, Artificial Sequence
  chemically synthesized
caggcgggcgccgccgttcagt

SEQ ID NO: 48719 - DNA, 22 bp, Artificial Sequence
  chemically synthesized
agttcagggtctgagcctggag

SEQ ID NO: 48720 - DNA, 22 bp, Artificial Sequence
  chemically synthesized
agggtctgagcctggaggagtg

SEQ ID NO: 48721 - DNA, 22 bp, Artificial Sequence
  chemically synthesized
agcctggaggagtgagccaggc

SEQ ID NO: 48722 - DNA, 22 bp, Artificial Sequence
  chemically synthesized
gaggagtgagccaggcagtgag

SEQ ID NO: 48723 - DNA, 22 bp, Artificial Sequence
  chemically synthesized
gctcgggcgggccgggacgcgt

SEQ ID NO: 48724 - DNA, 22 bp, Artificial Sequence
  chemically synthesized
gggcgggccgggacgcgtcgtt

SEQ ID NO: 48725 - DNA, 22 bp, Artificial Sequence
  chemically synthesized
cagcagcggctcccagctccca

SEQ ID NO: 48726 - DNA, 22 bp, Artificial Sequence
  chemically synthesized
ccagctcccagccaggattccg

SEQ ID NO: 48727 - DNA, 22 bp, Artificial Sequence
  chemically synthesized
ccagccaggattccgcgcgccc

SEQ ID NO: 48728 - DNA, 22 bp, Artificial Sequence
  chemically synthesized
cgcgcgccccttcacgcgccct

SEQ ID NO: 48729 - DNA, 22 bp, Artificial Sequence
  chemically synthesized
cacgcgccctgctcctgaactt

SEQ ID NO: 48730 - DNA, 22 bp, Artificial Sequence
  chemically synthesized
acgcgccctgctcctgaacttc

SEQ ID NO: 48731 - DNA, 22 bp, Artificial Sequence
  chemically synthesized
ctcctgaacttcagctcctgca

SEQ ID NO: 48732 - DNA, 22 bp, Artificial Sequence
  chemically synthesized
ctgaacttcagctcctgcacag

SEQ ID NO: 48733 - DNA, 22 bp, Artificial Sequence
  chemically synthesized
aacttcagctcctgcacagtcc

SEQ ID NO: 48734 - DNA, 22 bp, Artificial Sequence
  chemically synthesized
cagctcctgcacagtcctcccc

SEQ ID NO: 48735 - DNA, 22 bp, Artificial Sequence
  chemically synthesized
agctcctgcacagtcctcccca

SEQ ID NO: 48736 - DNA, 22 bp, Artificial Sequence
  chemically synthesized
ctgcacagtcctccccaccgca

SEQ ID NO: 48737 - DNA, 22 bp, Artificial Sequence
  chemically synthesized
cacagtcctccccaccgcaagg

SEQ ID NO: 48738 - DNA, 22 bp, Artificial Sequence
  chemically synthesized
cccaccgcaaggctcaaggcgc

SEQ ID NO: 48739 - DNA, 22 bp, Artificial Sequence
  chemically synthesized
aaggcgccgccggcgtggaccg

SEQ ID NO: 48740 - DNA, 22 bp, Artificial Sequence
  chemically synthesized
taggtctcctcgccaggacagc

SEQ ID NO: 48741 - DNA, 22 bp, Artificial Sequence
  chemically synthesized
ggtctcctcgccaggacagcaa

SEQ ID NO: 48742 - DNA, 22 bp, Artificial Sequence
  chemically synthesized
ctcgccaggacagcaacctctc

SEQ ID NO: 48743 - DNA, 22 bp, Artificial Sequence
  chemically synthesized
gccaggacagcaacctctcccc

SEQ ID NO: 48744 - DNA, 22 bp, Artificial Sequence
  chemically synthesized
tcccctggccctcatgggcacc

SEQ ID NO: 48745 - DNA, 22 bp, Artificial Sequence
  chemically synthesized
ccctggccctcatgggcaccgt

SEQ ID NO: 48746 - DNA, 22 bp, Artificial Sequence
  chemically synthesized
gccctcatgggcaccgtcagct

SEQ ID NO: 48747 - DNA, 22 bp, Artificial Sequence
  chemically synthesized
atgggcaccgtcagctccaggc

SEQ ID NO: 48748 - DNA, 22 bp, Artificial Sequence
  chemically synthesized
caggcggtcctggtggccgctg

SEQ ID NO: 48749 - DNA, 22 bp, Artificial Sequence
  chemically synthesized
gtggccgctgccactgctgctg

SEQ ID NO: 48750 - DNA, 22 bp, Artificial Sequence
  chemically synthesized
ccactgctgctgctgctgctgc

SEQ ID NO: 48751 - DNA, 22 bp, Artificial Sequence
  chemically synthesized
ctgctgctgctgctgctgctcc

SEQ ID NO: 48752 - DNA, 22 bp, Artificial Sequence
  chemically synthesized
ctgctgctgctgctgctcctgg

SEQ ID NO: 48753 - DNA, 22 bp, Artificial Sequence
  chemically synthesized
ctgctgctgctgctcctgggtc

SEQ ID NO: 48754 - DNA, 22 bp, Artificial Sequence
  chemically synthesized
ctgctgctgctcctgggtcccg

SEQ ID NO: 48755 - DNA, 22 bp, Artificial Sequence
  chemically synthesized
ctgctgctcctgggtcccgcgg

SEQ ID NO: 48756 - DNA, 22 bp, Artificial Sequence
  chemically synthesized
ctgctcctgggtcccgcgggcg

SEQ ID NO: 48757 - DNA, 22 bp, Artificial Sequence
  chemically synthesized
ctcctgggtcccgcgggcgccc

SEQ ID NO: 48758 - DNA, 22 bp, Artificial Sequence
  chemically synthesized
ctgggtcccgcgggcgcccgtg

SEQ ID NO: 48759 - DNA, 22 bp, Artificial Sequence
  chemically synthesized
ggtcccgcgggcgcccgtgcgc

SEQ ID NO: 48760 - DNA, 22 bp, Artificial Sequence
  chemically synthesized
cgaggagctggtgctagccttg

SEQ ID NO: 48761 - DNA, 22 bp, Artificial Sequence
  chemically synthesized
gtgctagccttgcgttccgagg

SEQ ID NO: 48762 - DNA, 22 bp, Artificial Sequence
  chemically synthesized
gccttgcgttccgaggaggacg

SEQ ID NO: 48763 - DNA, 22 bp, Artificial Sequence
  chemically synthesized
gcgttccgaggaggacggcctg

SEQ ID NO: 48764 - DNA, 22 bp, Artificial Sequence
  chemically synthesized
cgttccgaggaggacggcctgg

SEQ ID NO: 48765 - DNA, 22 bp, Artificial Sequence
  chemically synthesized
cgaggaggacggcctggccgaa

SEQ ID NO: 48766 - DNA, 22 bp, Artificial Sequence
  chemically synthesized
gccgaagcacccgagcacggaa

SEQ ID NO: 48767 - DNA, 22 bp, Artificial Sequence
  chemically synthesized
ccaccgctgcgccaaggtgcgg

SEQ ID NO: 48768 - DNA, 22 bp, Artificial Sequence
  chemically synthesized
caccgctgcgccaaggtgcggg

SEQ ID NO: 48769 - DNA, 22 bp, Artificial Sequence
  chemically synthesized
cgccaaggtgcgggtgtaggga

SEQ ID NO: 48770 - DNA, 22 bp, Artificial Sequence
  chemically synthesized
tttcctctcgggcctcagtttc

SEQ ID NO: 48771 - DNA, 22 bp, Artificial Sequence
  chemically synthesized
cctctcgggcctcagtttcccc

SEQ ID NO: 48772 - DNA, 22 bp, Artificial Sequence
  chemically synthesized
ctctcgggcctcagtttccccc

SEQ ID NO: 48773 - DNA, 22 bp, Artificial Sequence
  chemically synthesized
tcgggcctcagtttccccccat

SEQ ID NO: 48774 - DNA, 22 bp, Artificial Sequence
  chemically synthesized
gggcctcagtttccccccatgt

SEQ ID NO: 48775 - DNA, 22 bp, Artificial Sequence
  chemically synthesized
agtttccccccatgtaagagag

SEQ ID NO: 48776 - DNA, 22 bp, Artificial Sequence
  chemically synthesized
ccccccatgtaagagaggaagt

SEQ ID NO: 48777 - DNA, 22 bp, Artificial Sequence
  chemically synthesized
cccccatgtaagagaggaagtg

SEQ ID NO: 48778 - DNA, 22 bp, Artificial Sequence
  chemically synthesized
ttcgcttggcacgatcttgggg

SEQ ID NO: 48779 - DNA, 22 bp, Artificial Sequence
  chemically synthesized
cgcttggcacgatcttggggac

SEQ ID NO: 48780 - DNA, 22 bp, Artificial Sequence
  chemically synthesized
gcttggcacgatcttggggact

SEQ ID NO: 48781 - DNA, 22 bp, Artificial Sequence
  chemically synthesized
ggcacgatcttggggactgcag

SEQ ID NO: 48782 - DNA, 22 bp, Artificial Sequence
  chemically synthesized
gcacgatcttggggactgcagg

SEQ ID NO: 48783 - DNA, 22 bp, Artificial Sequence
  chemically synthesized
ggggactgcaggcaaggcggcg

SEQ ID NO: 48784 - DNA, 22 bp, Artificial Sequence
  chemically synthesized
gggactgcaggcaaggcggcgg

SEQ ID NO: 48785 - DNA, 22 bp, Artificial Sequence
  chemically synthesized
caggcaaggcggcgggggagga

SEQ ID NO: 48786 - DNA, 22 bp, Artificial Sequence
  chemically synthesized
tttggggacttgctggggcgtg

SEQ ID NO: 48787 - DNA, 22 bp, Artificial Sequence
  chemically synthesized
tggggacttgctggggcgtgcg

SEQ ID NO: 48788 - DNA, 22 bp, Artificial Sequence
  chemically synthesized
ggggacttgctggggcgtgcgg

SEQ ID NO: 48789 - DNA, 22 bp, Artificial Sequence
  chemically synthesized
gggacttgctggggcgtgcggc

SEQ ID NO: 48790 - DNA, 22 bp, Artificial Sequence
  chemically synthesized
gctggggcgtgcggctgcgcta

SEQ ID NO: 48791 - DNA, 22 bp, Artificial Sequence
  chemically synthesized
ctggggcgtgcggctgcgctat

SEQ ID NO: 48792 - DNA, 22 bp, Artificial Sequence
  chemically synthesized
gggcgtgcggctgcgctattca

SEQ ID NO: 48793 - DNA, 22 bp, Artificial Sequence
  chemically synthesized
cgctattcagtgggaaggttcg

SEQ ID NO: 48794 - DNA, 22 bp, Artificial Sequence
  chemically synthesized
ttcagtgggaaggttcgcgggg

SEQ ID NO: 48795 - DNA, 22 bp, Artificial Sequence
  chemically synthesized
agtgggaaggttcgcggggttg

SEQ ID NO: 48796 - DNA, 22 bp, Artificial Sequence
  chemically synthesized
gcggggttgggagacccggagg

SEQ ID NO: 48797 - DNA, 22 bp, Artificial Sequence
  chemically synthesized
ggagacccggaggccgaggaag

SEQ ID NO: 48798 - DNA, 22 bp, Artificial Sequence
  chemically synthesized
ccaggatatcctgcccagattt

SEQ ID NO: 48799 - DNA, 22 bp, Artificial Sequence
  chemically synthesized
cccagatttcccagtttctgcc

SEQ ID NO: 48800 - DNA, 22 bp, Artificial Sequence
  chemically synthesized
cccagtttctgcctcgccgcgg

SEQ ID NO: 48801 - DNA, 22 bp, Artificial Sequence
  chemically synthesized
ccagtttctgcctcgccgcggc

SEQ ID NO: 48802 - DNA, 22 bp, Artificial Sequence
  chemically synthesized
ctgcctcgccgcggcacaggtg

SEQ ID NO: 48803 - DNA, 22 bp, Artificial Sequence
  chemically synthesized
tgcctcgccgcggcacaggtgg

SEQ ID NO: 48804 - DNA, 22 bp, Artificial Sequence
  chemically synthesized
cctcgccgcggcacaggtgggt

SEQ ID NO: 48805 - DNA, 22 bp, Artificial Sequence
  chemically synthesized
gccgcggcacaggtgggtgaag

SEQ ID NO: 48806 - DNA, 22 bp, Artificial Sequence
  chemically synthesized
gaacgtactgggaactgcacca

SEQ ID NO: 48807 - DNA, 22 bp, Artificial Sequence
  chemically synthesized
ggaactgcaccaggcacagaga

SEQ ID NO: 48808 - DNA, 22 bp, Artificial Sequence
  chemically synthesized
caccaggcacagagaaagcggg

SEQ ID NO: 48809 - DNA, 22 bp, Artificial Sequence
  chemically synthesized
gccattatagtgggttccgatt

SEQ ID NO: 48810 - DNA, 22 bp, Artificial Sequence
  chemically synthesized
ccattatagtgggttccgattt

SEQ ID NO: 48811 - DNA, 22 bp, Artificial Sequence
  chemically synthesized
tagtgggttccgatttggtttg

SEQ ID NO: 48812 - DNA, 22 bp, Artificial Sequence
  chemically synthesized
cgatttggtttggaaaacatgg

SEQ ID NO: 48813 - DNA, 22 bp, Artificial Sequence
  chemically synthesized
ggtttggaaaacatgggcagcg

SEQ ID NO: 48814 - DNA, 22 bp, Artificial Sequence
  chemically synthesized
gtttggaaaacatgggcagcgg

SEQ ID NO: 48815 - DNA, 22 bp, Artificial Sequence
  chemically synthesized
ggaaaacatgggcagcggaggg

SEQ ID NO: 48816 - DNA, 22 bp, Artificial Sequence
  chemically synthesized
gaaaacatgggcagcggagggt

SEQ ID NO: 48817 - DNA, 22 bp, Artificial Sequence
  chemically synthesized
gagagaaggccctacccgagac

SEQ ID NO: 48818 - DNA, 22 bp, Artificial Sequence
  chemically synthesized
cccgagacaggggcggggtggg

SEQ ID NO: 48819 - DNA, 22 bp, Artificial Sequence
  chemically synthesized
ggagcacgaggcaatttcttta

SEQ ID NO: 48820 - DNA, 22 bp, Artificial Sequence
  chemically synthesized
ctttatgacacagaactcatgc

SEQ ID NO: 48821 - DNA, 22 bp, Artificial Sequence
  chemically synthesized
tttatgacacagaactcatgct

SEQ ID NO: 48822 - DNA, 22 bp, Artificial Sequence
  chemically synthesized
tatgacacagaactcatgctct

SEQ ID NO: 48823 - DNA, 22 bp, Artificial Sequence
  chemically synthesized
atgacacagaactcatgctcta

SEQ ID NO: 48824 - DNA, 22 bp, Artificial Sequence
  chemically synthesized
tgacacagaactcatgctctag

SEQ ID NO: 48825 - DNA, 22 bp, Artificial Sequence
  chemically synthesized
atgctctagtattccatctgtt

SEQ ID NO: 48826 - DNA, 22 bp, Artificial Sequence
  chemically synthesized
tagtattccatctgtttcagcc

SEQ ID NO: 48827 - DNA, 22 bp, Artificial Sequence
  chemically synthesized
gtattccatctgtttcagccga

SEQ ID NO: 48828 - DNA, 22 bp, Artificial Sequence
  chemically synthesized
catctgtttcagccgaagaaaa

SEQ ID NO: 48829 - DNA, 22 bp, Artificial Sequence
  chemically synthesized
tttcagccgaagaaaagaacca

SEQ ID NO: 48830 - DNA, 22 bp, Artificial Sequence
  chemically synthesized
cagccgaagaaaagaaccagct

SEQ ID NO: 48831 - DNA, 22 bp, Artificial Sequence
  chemically synthesized
agccgaagaaaagaaccagctg

SEQ ID NO: 48832 - DNA, 22 bp, Artificial Sequence
  chemically synthesized
aaggggcaggggagaaggggcg

SEQ ID NO: 48833 - DNA, 22 bp, Artificial Sequence
  chemically synthesized
tcgaggcccattggcgtccttt

SEQ ID NO: 48834 - DNA, 22 bp, Artificial Sequence
  chemically synthesized
gaggcccattggcgtcctttag

SEQ ID NO: 48835 - DNA, 22 bp, Artificial Sequence
  chemically synthesized
gcgtcctttaggactcaggcag

SEQ ID NO: 48836 - DNA, 22 bp, Artificial Sequence
  chemically synthesized
taggactcaggcagggaagggc

SEQ ID NO: 48837 - DNA, 22 bp, Artificial Sequence
  chemically synthesized
aggactcaggcagggaagggcc

SEQ ID NO: 48838 - DNA, 22 bp, Artificial Sequence
  chemically synthesized
ggactcaggcagggaagggccc

SEQ ID NO: 48839 - DNA, 22 bp, Artificial Sequence
  chemically synthesized
aggcagggaagggcccttggtg

SEQ ID NO: 48840 - DNA, 22 bp, Artificial Sequence
  chemically synthesized
ggtgctctggagccggaggtgg

SEQ ID NO: 48841 - DNA, 22 bp, Artificial Sequence
  chemically synthesized
gtgctctggagccggaggtggt

SEQ ID NO: 48842 - DNA, 22 bp, Artificial Sequence
  chemically synthesized
tggagccggaggtggtgcgcct

SEQ ID NO: 48843 - DNA, 22 bp, Artificial Sequence
  chemically synthesized
gagccggaggtggtgcgcctgg

SEQ ID NO: 48844 - DNA, 22 bp, Artificial Sequence
  chemically synthesized
gtactgggaccccggagctgag

SEQ ID NO: 48845 - DNA, 22 bp, Artificial Sequence
  chemically synthesized
ggaccccggagctgagcccggc

SEQ ID NO: 48846 - DNA, 22 bp, Artificial Sequence
  chemically synthesized
agcccggcgcctcagcccacct

SEQ ID NO: 48847 - DNA, 22 bp, Artificial Sequence
  chemically synthesized
agcccacctggctgtctgccga

SEQ ID NO: 48848 - DNA, 22 bp, Artificial Sequence
  chemically synthesized
gctgtctgccgaccgtgtgcgg

SEQ ID NO: 48849 - DNA, 22 bp, Artificial Sequence
  chemically synthesized
tctgccgaccgtgtgcggggcg

SEQ ID NO: 48850 - DNA, 22 bp, Artificial Sequence
  chemically synthesized
ccgaccgtgtgcggggcgagtt

SEQ ID NO: 48851 - DNA, 22 bp, Artificial Sequence
  chemically synthesized
gctcaacaactctgccagcttc

SEQ ID NO: 48852 - DNA, 22 bp, Artificial Sequence
  chemically synthesized
ctcaacaactctgccagcttct

SEQ ID NO: 48853 - DNA, 22 bp, Artificial Sequence
  chemically synthesized
aacaactctgccagcttctggc

SEQ ID NO: 48854 - DNA, 22 bp, Artificial Sequence
  chemically synthesized
tgccagcttctggccctcaggc

SEQ ID NO: 48855 - DNA, 22 bp, Artificial Sequence
  chemically synthesized
ccagcttctggccctcaggctg

SEQ ID NO: 48856 - DNA, 22 bp, Artificial Sequence
  chemically synthesized
ctggccctcaggctgtgggaag

SEQ ID NO: 48857 - DNA, 22 bp, Artificial Sequence
  chemically synthesized
tggccctcaggctgtgggaagc

SEQ ID NO: 48858 - DNA, 22 bp, Artificial Sequence
  chemically synthesized
gccctcaggctgtgggaagctt

SEQ ID NO: 48859 - DNA, 22 bp, Artificial Sequence
  chemically synthesized
aggctgtgggaagcttcttccc

SEQ ID NO: 48860 - DNA, 22 bp, Artificial Sequence
  chemically synthesized
tgggaagcttcttcccggggcg

SEQ ID NO: 48861 - DNA, 22 bp, Artificial Sequence
  chemically synthesized
cttcccggggcgagaccactag

SEQ ID NO: 48862 - DNA, 22 bp, Artificial Sequence
  chemically synthesized
ttcccggggcgagaccactagc

SEQ ID NO: 48863 - DNA, 22 bp, Artificial Sequence
  chemically synthesized
cccggggcgagaccactagctt

SEQ ID NO: 48864 - DNA, 22 bp, Artificial Sequence
  chemically synthesized
ccggggcgagaccactagcttt

SEQ ID NO: 48865 - DNA, 22 bp, Artificial Sequence
  chemically synthesized
gctttttctaagtattaccagc

SEQ ID NO: 48866 - DNA, 22 bp, Artificial Sequence
  chemically synthesized
tttctaagtattaccagcccag

SEQ ID NO: 48867 - DNA, 22 bp, Artificial Sequence
  chemically synthesized
ttctaagtattaccagcccagg

SEQ ID NO: 48868 - DNA, 22 bp, Artificial Sequence
  chemically synthesized
tctaagtattaccagcccagga

SEQ ID NO: 48869 - DNA, 22 bp, Artificial Sequence
  chemically synthesized
ctaagtattaccagcccaggac

SEQ ID NO: 48870 - DNA, 22 bp, Artificial Sequence
  chemically synthesized
taagtattaccagcccaggact

SEQ ID NO: 48871 - DNA, 22 bp, Artificial Sequence
  chemically synthesized
agtattaccagcccaggacttg

SEQ ID NO: 48872 - DNA, 22 bp, Artificial Sequence
  chemically synthesized
ccagcccaggacttggctgagg

SEQ ID NO: 48873 - DNA, 22 bp, Artificial Sequence
  chemically synthesized
ggctgaggttctgtgtccccca

SEQ ID NO: 48874 - DNA, 22 bp, Artificial Sequence
  chemically synthesized
gctgaggttctgtgtcccccag

SEQ ID NO: 48875 - DNA, 22 bp, Artificial Sequence
  chemically synthesized
aggttctgtgtcccccagcttg

SEQ ID NO: 48876 - DNA, 22 bp, Artificial Sequence
  chemically synthesized
tgtgtcccccagcttggagtca

SEQ ID NO: 48877 - DNA, 22 bp, Artificial Sequence
  chemically synthesized
tgtcccccagcttggagtcaga

SEQ ID NO: 48878 - DNA, 22 bp, Artificial Sequence
  chemically synthesized
ggagtcagatgtggggttgaat

SEQ ID NO: 48879 - DNA, 22 bp, Artificial Sequence
  chemically synthesized
gagtcagatgtggggttgaatc

SEQ ID NO: 48880 - DNA, 22 bp, Artificial Sequence
  chemically synthesized
aatcttggcttcctctcactag

SEQ ID NO: 48881 - DNA, 22 bp, Artificial Sequence
  chemically synthesized
ggcttcctctcactagctgtgg

SEQ ID NO: 48882 - DNA, 22 bp, Artificial Sequence
  chemically synthesized
gcttcctctcactagctgtggt

SEQ ID NO: 48883 - DNA, 22 bp, Artificial Sequence
  chemically synthesized
cctctcactagctgtggtgctt

SEQ ID NO: 48884 - DNA, 22 bp, Artificial Sequence
  chemically synthesized
ctctcactagctgtggtgcttg

SEQ ID NO: 48885 - DNA, 22 bp, Artificial Sequence
  chemically synthesized
tcactagctgtggtgcttgaca

SEQ ID NO: 48886 - DNA, 22 bp, Artificial Sequence
  chemically synthesized
actagctgtggtgcttgacaag

SEQ ID NO: 48887 - DNA, 22 bp, Artificial Sequence
  chemically synthesized
gctgtggtgcttgacaagtcac

SEQ ID NO: 48888 - DNA, 22 bp, Artificial Sequence
  chemically synthesized
tggtgcttgacaagtcacttat

SEQ ID NO: 48889 - DNA, 22 bp, Artificial Sequence
  chemically synthesized
gacaagtcacttatccttgagc

SEQ ID NO: 48890 - DNA, 22 bp, Artificial Sequence
  chemically synthesized
acaagtcacttatccttgagcc

SEQ ID NO: 48891 - DNA, 22 bp, Artificial Sequence
  chemically synthesized
atccttgagcctccattgccta

SEQ ID NO: 48892 - DNA, 22 bp, Artificial Sequence
  chemically synthesized
tccttgagcctccattgcctaa

SEQ ID NO: 48893 - DNA, 22 bp, Artificial Sequence
  chemically synthesized
gagcctccattgcctaatcttt

SEQ ID NO: 48894 - DNA, 22 bp, Artificial Sequence
  chemically synthesized
agcctccattgcctaatcttta

SEQ ID NO: 48895 - DNA, 22 bp, Artificial Sequence
  chemically synthesized
cattgcctaatctttaaaaggg

SEQ ID NO: 48896 - DNA, 22 bp, Artificial Sequence
  chemically synthesized
cctaatctttaaaagggaggtg

SEQ ID NO: 48897 - DNA, 22 bp, Artificial Sequence
  chemically synthesized
atctttaaaagggaggtgacaa

SEQ ID NO: 48898 - DNA, 22 bp, Artificial Sequence
  chemically synthesized
taaaagggaggtgacaatcgtc

SEQ ID NO: 48899 - DNA, 22 bp, Artificial Sequence
  chemically synthesized
aaaagggaggtgacaatcgtcc

SEQ ID NO: 48900 - DNA, 22 bp, Artificial Sequence
  chemically synthesized
aaagggaggtgacaatcgtccc

SEQ ID NO: 48901 - DNA, 22 bp, Artificial Sequence
  chemically synthesized
cggctcagtggcagcagatggg

SEQ ID NO: 48902 - DNA, 22 bp, Artificial Sequence
  chemically synthesized
agtggcagcagatggggagatg

SEQ ID NO: 48903 - DNA, 22 bp, Artificial Sequence
  chemically synthesized
tgttgaccatgagtgaacttac

SEQ ID NO: 48904 - DNA, 22 bp, Artificial Sequence
  chemically synthesized
ttgaccatgagtgaacttacaa

SEQ ID NO: 48905 - DNA, 22 bp, Artificial Sequence
  chemically synthesized
accatgagtgaacttacaatgc

SEQ ID NO: 48906 - DNA, 22 bp, Artificial Sequence
  chemically synthesized
acaatgcaagccccggggggat

SEQ ID NO: 48907 - DNA, 22 bp, Artificial Sequence
  chemically synthesized
caatgcaagccccggggggatc

SEQ ID NO: 48908 - DNA, 22 bp, Artificial Sequence
  chemically synthesized
gcagttttgtccctgtctgcag

SEQ ID NO: 48909 - DNA, 22 bp, Artificial Sequence
  chemically synthesized
cagttttgtccctgtctgcagt

SEQ ID NO: 48910 - DNA, 22 bp, Artificial Sequence
  chemically synthesized
tgtccctgtctgcagtgtgacc

SEQ ID NO: 48911 - DNA, 22 bp, Artificial Sequence
  chemically synthesized
gtccctgtctgcagtgtgacct

SEQ ID NO: 48912 - DNA, 22 bp, Artificial Sequence
  chemically synthesized
tccctgtctgcagtgtgacctg

SEQ ID NO: 48913 - DNA, 22 bp, Artificial Sequence
  chemically synthesized
tctgcagtgtgacctgttggtg

SEQ ID NO: 48914 - DNA, 22 bp, Artificial Sequence
  chemically synthesized
cagtgtgacctgttggtgacat

SEQ ID NO: 48915 - DNA, 22 bp, Artificial Sequence
  chemically synthesized
ttggtgacattgtctttgctcc

SEQ ID NO: 48916 - DNA, 22 bp, Artificial Sequence
  chemically synthesized
gtgacattgtctttgctccaaa

SEQ ID NO: 48917 - DNA, 22 bp, Artificial Sequence
  chemically synthesized
tctttgctccaaaccacagctc

SEQ ID NO: 48918 - DNA, 22 bp, Artificial Sequence
  chemically synthesized
tgctccaaaccacagctcctgg

SEQ ID NO: 48919 - DNA, 22 bp, Artificial Sequence
  chemically synthesized
gctccaaaccacagctcctggg

SEQ ID NO: 48920 - DNA, 22 bp, Artificial Sequence
  chemically synthesized
ctccaaaccacagctcctgggg

SEQ ID NO: 48921 - DNA, 22 bp, Artificial Sequence
  chemically synthesized
caaaccacagctcctggggcag

SEQ ID NO: 48922 - DNA, 22 bp, Artificial Sequence
  chemically synthesized
ctggggcagaggggaaaattct

SEQ ID NO: 48923 - DNA, 22 bp, Artificial Sequence
  chemically synthesized
gggcagaggggaaaattctgcc

SEQ ID NO: 48924 - DNA, 22 bp, Artificial Sequence
  chemically synthesized
tgccactcacagctgcctgccc

SEQ ID NO: 48925 - DNA, 22 bp, Artificial Sequence
  chemically synthesized
ccactcacagctgcctgcccac

SEQ ID NO: 48926 - DNA, 22 bp, Artificial Sequence
  chemically synthesized
acagctgcctgcccacgcttct

SEQ ID NO: 48927 - DNA, 22 bp, Artificial Sequence
  chemically synthesized
cctgcccacgcttctgtctgag

SEQ ID NO: 48928 - DNA, 22 bp, Artificial Sequence
  chemically synthesized
cccacgcttctgtctgagtgtg

SEQ ID NO: 48929 - DNA, 22 bp, Artificial Sequence
  chemically synthesized
ctgtctgagtgtgctgggtggc

SEQ ID NO: 48930 - DNA, 22 bp, Artificial Sequence
  chemically synthesized
tgtctgagtgtgctgggtggca

SEQ ID NO: 48931 - DNA, 22 bp, Artificial Sequence
  chemically synthesized
tctgagtgtgctgggtggcagg

SEQ ID NO: 48932 - DNA, 22 bp, Artificial Sequence
  chemically synthesized
agtgtgctgggtggcaggatgg

SEQ ID NO: 48933 - DNA, 22 bp, Artificial Sequence
  chemically synthesized
ggtggcaggatggcaagtcctt

SEQ ID NO: 48934 - DNA, 22 bp, Artificial Sequence
  chemically synthesized
actcagctcagtatagccctct

SEQ ID NO: 48935 - DNA, 22 bp, Artificial Sequence
  chemically synthesized
ctcagctcagtatagccctctt

SEQ ID NO: 48936 - DNA, 22 bp, Artificial Sequence
  chemically synthesized
agctcagtatagccctcttcct

SEQ ID NO: 48937 - DNA, 22 bp, Artificial Sequence
  chemically synthesized
agtatagccctcttccttgttc

SEQ ID NO: 48938 - DNA, 22 bp, Artificial Sequence
  chemically synthesized
ttccttgttccctgagcctttg

SEQ ID NO: 48939 - DNA, 22 bp, Artificial Sequence
  chemically synthesized
ccttgttccctgagcctttgac

SEQ ID NO: 48940 - DNA, 22 bp, Artificial Sequence
  chemically synthesized
cttgttccctgagcctttgact

SEQ ID NO: 48941 - DNA, 22 bp, Artificial Sequence
  chemically synthesized
gttccctgagcctttgactttc

SEQ ID NO: 48942 - DNA, 22 bp, Artificial Sequence
  chemically synthesized
ttccctgagcctttgactttct

SEQ ID NO: 48943 - DNA, 22 bp, Artificial Sequence
  chemically synthesized
cctgagcctttgactttctcga

SEQ ID NO: 48944 - DNA, 22 bp, Artificial Sequence
  chemically synthesized
agcctttgactttctcgaggga

SEQ ID NO: 48945 - DNA, 22 bp, Artificial Sequence
  chemically synthesized
tgactttctcgagggatgttgt

SEQ ID NO: 48946 - DNA, 22 bp, Artificial Sequence
  chemically synthesized
gactttctcgagggatgttgtg

SEQ ID NO: 48947 - DNA, 22 bp, Artificial Sequence
  chemically synthesized
actttctcgagggatgttgtgg

SEQ ID NO: 48948 - DNA, 22 bp, Artificial Sequence
  chemically synthesized
tctcgagggatgttgtggggtt

SEQ ID NO: 48949 - DNA, 22 bp, Artificial Sequence
  chemically synthesized
ctcgagggatgttgtggggttg

SEQ ID NO: 48950 - DNA, 22 bp, Artificial Sequence
  chemically synthesized
tcgagggatgttgtggggttgt

SEQ ID NO: 48951 - DNA, 22 bp, Artificial Sequence
  chemically synthesized
gagggatgttgtggggttgtgg

SEQ ID NO: 48952 - DNA, 22 bp, Artificial Sequence
  chemically synthesized
tggggttgtggccaggataaga

SEQ ID NO: 48953 - DNA, 22 bp, Artificial Sequence
  chemically synthesized
tggccaggataagaaagggcat

SEQ ID NO: 48954 - DNA, 22 bp, Artificial Sequence
  chemically synthesized
caagttaccactgctccaaaac

SEQ ID NO: 48955 - DNA, 22 bp, Artificial Sequence
  chemically synthesized
aagttaccactgctccaaaaca

SEQ ID NO: 48956 - DNA, 22 bp, Artificial Sequence
  chemically synthesized
ccactgctccaaaacaactgtt

SEQ ID NO: 48957 - DNA, 22 bp, Artificial Sequence
  chemically synthesized
ctccaaaacaactgttctggaa

SEQ ID NO: 48958 - DNA, 22 bp, Artificial Sequence
  chemically synthesized
caaaacaactgttctggaaata

SEQ ID NO: 48959 - DNA, 22 bp, Artificial Sequence
  chemically synthesized
ttctggaaatagtgagtacccc

SEQ ID NO: 48960 - DNA, 22 bp, Artificial Sequence
  chemically synthesized
tggaaatagtgagtaccccatc

SEQ ID NO: 48961 - DNA, 22 bp, Artificial Sequence
  chemically synthesized
gaaatagtgagtaccccatcct

SEQ ID NO: 48962 - DNA, 22 bp, Artificial Sequence
  chemically synthesized
agaggtgagtaagcagaggctg

SEQ ID NO: 48963 - DNA, 22 bp, Artificial Sequence
  chemically synthesized
tatgaccacctgaaccaagccc

SEQ ID NO: 48964 - DNA, 22 bp, Artificial Sequence
  chemically synthesized
aaccaagcccttgaggatgttt

SEQ ID NO: 48965 - DNA, 22 bp, Artificial Sequence
  chemically synthesized
gaggatgtttcttctctggtgg

SEQ ID NO: 48966 - DNA, 22 bp, Artificial Sequence
  chemically synthesized
aggatgtttcttctctggtgga

SEQ ID NO: 48967 - DNA, 22 bp, Artificial Sequence
  chemically synthesized
cttctctggtggaagtttggaa

SEQ ID NO: 48968 - DNA, 22 bp, Artificial Sequence
  chemically synthesized
ttctctggtggaagtttggaac

SEQ ID NO: 48969 - DNA, 22 bp, Artificial Sequence
  chemically synthesized
ctctggtggaagtttggaacag

SEQ ID NO: 48970 - DNA, 22 bp, Artificial Sequence
  chemically synthesized
tctggtggaagtttggaacagg

SEQ ID NO: 48971 - DNA, 22 bp, Artificial Sequence
  chemically synthesized
tggtggaagtttggaacaggag

SEQ ID NO: 48972 - DNA, 22 bp, Artificial Sequence
  chemically synthesized
gtggaagtttggaacaggagcc

SEQ ID NO: 48973 - DNA, 22 bp, Artificial Sequence
  chemically synthesized
ggaacaggagcctcctcaagtt

SEQ ID NO: 48974 - DNA, 22 bp, Artificial Sequence
  chemically synthesized
gaacaggagcctcctcaagttc

SEQ ID NO: 48975 - DNA, 22 bp, Artificial Sequence
  chemically synthesized
ctcaagttcatttattcattca

SEQ ID NO: 48976 - DNA, 22 bp, Artificial Sequence
  chemically synthesized
aagttcatttattcattcattc

SEQ ID NO: 48977 - DNA, 22 bp, Artificial Sequence
  chemically synthesized
atttattcattcattcaatggt

SEQ ID NO: 48978 - DNA, 22 bp, Artificial Sequence
  chemically synthesized
attcattcattcaatggttatt

SEQ ID NO: 48979 - DNA, 22 bp, Artificial Sequence
  chemically synthesized
ttcattcattcaatggttattt

SEQ ID NO: 48980 - DNA, 22 bp, Artificial Sequence
  chemically synthesized
attcattcaatggttattttgt

SEQ ID NO: 48981 - DNA, 22 bp, Artificial Sequence
  chemically synthesized
attcaatggttattttgtggga

SEQ ID NO: 48982 - DNA, 22 bp, Artificial Sequence
  chemically synthesized
aatggttattttgtgggaatcg

SEQ ID NO: 48983 - DNA, 22 bp, Artificial Sequence
  chemically synthesized
ttttgtgggaatcgaatttaga

SEQ ID NO: 48984 - DNA, 22 bp, Artificial Sequence
  chemically synthesized
tgtgggaatcgaatttagaatg

SEQ ID NO: 48985 - DNA, 22 bp, Artificial Sequence
  chemically synthesized
gtgggaatcgaatttagaatga

SEQ ID NO: 48986 - DNA, 22 bp, Artificial Sequence
  chemically synthesized
tgggaatcgaatttagaatgaa

SEQ ID NO: 48987 - DNA, 22 bp, Artificial Sequence
  chemically synthesized
agaatgaaaatattttttggca

SEQ ID NO: 48988 - DNA, 22 bp, Artificial Sequence
  chemically synthesized
gaatgaaaatattttttggcaa

SEQ ID NO: 48989 - DNA, 22 bp, Artificial Sequence
  chemically synthesized
tttggcaagcagaaaataattt

SEQ ID NO: 48990 - DNA, 22 bp, Artificial Sequence
  chemically synthesized
ttggcaagcagaaaataatttt

SEQ ID NO: 48991 - DNA, 22 bp, Artificial Sequence
  chemically synthesized
tggcaagcagaaaataattttt

SEQ ID NO: 48992 - DNA, 22 bp, Artificial Sequence
  chemically synthesized
ggcaagcagaaaataattttta

SEQ ID NO: 48993 - DNA, 22 bp, Artificial Sequence
  chemically synthesized
gcaagcagaaaataatttttag

SEQ ID NO: 48994 - DNA, 22 bp, Artificial Sequence
  chemically synthesized
ttagaccaatccttttctttta

SEQ ID NO: 48995 - DNA, 22 bp, Artificial Sequence
  chemically synthesized
tagaccaatccttttcttttag

SEQ ID NO: 48996 - DNA, 22 bp, Artificial Sequence
  chemically synthesized
agaccaatccttttcttttagt

SEQ ID NO: 48997 - DNA, 22 bp, Artificial Sequence
  chemically synthesized
gaccaatccttttcttttagtc

SEQ ID NO: 48998 - DNA, 22 bp, Artificial Sequence
  chemically synthesized
ttcttttagtcatgagaaactg

SEQ ID NO: 48999 - DNA, 22 bp, Artificial Sequence
  chemically synthesized
tcttttagtcatgagaaactga

SEQ ID NO: 49000 - DNA, 22 bp, Artificial Sequence
  chemically synthesized
cttttagtcatgagaaactgag

SEQ ID NO: 49001 - DNA, 22 bp, Artificial Sequence
  chemically synthesized
ttttagtcatgagaaactgagg

SEQ ID NO: 49002 - DNA, 22 bp, Artificial Sequence
  chemically synthesized
ttagtcatgagaaactgaggcc

SEQ ID NO: 49003 - DNA, 22 bp, Artificial Sequence
  chemically synthesized
tagtcatgagaaactgaggccc

SEQ ID NO: 49004 - DNA, 22 bp, Artificial Sequence
  chemically synthesized
agtcatgagaaactgaggccca

SEQ ID NO: 49005 - DNA, 22 bp, Artificial Sequence
  chemically synthesized
gtcatgagaaactgaggcccag

SEQ ID NO: 49006 - DNA, 22 bp, Artificial Sequence
  chemically synthesized
aggcccagagagaggaggtcac

SEQ ID NO: 49007 - DNA, 22 bp, Artificial Sequence
  chemically synthesized
gaactgggtttccagaactgac

SEQ ID NO: 49008 - DNA, 22 bp, Artificial Sequence
  chemically synthesized
ggtttccagaactgacactcca

SEQ ID NO: 49009 - DNA, 22 bp, Artificial Sequence
  chemically synthesized
ccagaactgacactccactgca

SEQ ID NO: 49010 - DNA, 22 bp, Artificial Sequence
  chemically synthesized
cagaactgacactccactgcac

SEQ ID NO: 49011 - DNA, 22 bp, Artificial Sequence
  chemically synthesized
acactccactgcacagagtact

SEQ ID NO: 49012 - DNA, 22 bp, Artificial Sequence
  chemically synthesized
cactgcacagagtactctccca

SEQ ID NO: 49013 - DNA, 22 bp, Artificial Sequence
  chemically synthesized
cacagagtactctcccaattca

SEQ ID NO: 49014 - DNA, 22 bp, Artificial Sequence
  chemically synthesized
tcccaattcattcaatttttat

SEQ ID NO: 49015 - DNA, 22 bp, Artificial Sequence
  chemically synthesized
ccaattcattcaatttttattt

SEQ ID NO: 49016 - DNA, 22 bp, Artificial Sequence
  chemically synthesized
attcaatttttatttagcggaa

SEQ ID NO: 49017 - DNA, 22 bp, Artificial Sequence
  chemically synthesized
aatttttatttagcggaaggca

SEQ ID NO: 49018 - DNA, 22 bp, Artificial Sequence
  chemically synthesized
ttatttagcggaaggcattttc

SEQ ID NO: 49019 - DNA, 22 bp, Artificial Sequence
  chemically synthesized
tatttagcggaaggcattttca

SEQ ID NO: 49020 - DNA, 22 bp, Artificial Sequence
  chemically synthesized
atttagcggaaggcattttcag

SEQ ID NO: 49021 - DNA, 22 bp, Artificial Sequence
  chemically synthesized
tttagcggaaggcattttcaga

SEQ ID NO: 49022 - DNA, 22 bp, Artificial Sequence
  chemically synthesized
agcggaaggcattttcagatgg

SEQ ID NO: 49023 - DNA, 22 bp, Artificial Sequence
  chemically synthesized
gcggaaggcattttcagatggg

SEQ ID NO: 49024 - DNA, 22 bp, Artificial Sequence
  chemically synthesized
tcagatgggtctttgaagcatt

SEQ ID NO: 49025 - DNA, 22 bp, Artificial Sequence
  chemically synthesized
cagatgggtctttgaagcatta

SEQ ID NO: 49026 - DNA, 22 bp, Artificial Sequence
  chemically synthesized
agatgggtctttgaagcattag

SEQ ID NO: 49027 - DNA, 22 bp, Artificial Sequence
  chemically synthesized
tgaagcattagtaggagttcag

SEQ ID NO: 49028 - DNA, 22 bp, Artificial Sequence
  chemically synthesized
gaagcattagtaggagttcagc

SEQ ID NO: 49029 - DNA, 22 bp, Artificial Sequence
  chemically synthesized
aagcattagtaggagttcagcg

SEQ ID NO: 49030 - DNA, 22 bp, Artificial Sequence
  chemically synthesized
gtaggagttcagcgatgatggt

SEQ ID NO: 49031 - DNA, 22 bp, Artificial Sequence
  chemically synthesized
agcgatgatggtgtcatgagaa

SEQ ID NO: 49032 - DNA, 22 bp, Artificial Sequence
  chemically synthesized
tattctaggattaggaggtacc

SEQ ID NO: 49033 - DNA, 22 bp, Artificial Sequence
  chemically synthesized
attctaggattaggaggtacca

SEQ ID NO: 49034 - DNA, 22 bp, Artificial Sequence
  chemically synthesized
ttctaggattaggaggtaccat

SEQ ID NO: 49035 - DNA, 22 bp, Artificial Sequence
  chemically synthesized
taggattaggaggtaccatgaa

SEQ ID NO: 49036 - DNA, 22 bp, Artificial Sequence
  chemically synthesized
ggattaggaggtaccatgaaca

SEQ ID NO: 49037 - DNA, 22 bp, Artificial Sequence
  chemically synthesized
ggaggtaccatgaacaaagata

SEQ ID NO: 49038 - DNA, 22 bp, Artificial Sequence
  chemically synthesized
ggaaaaccagaggtggaagata

SEQ ID NO: 49039 - DNA, 22 bp, Artificial Sequence
  chemically synthesized
tttttcttttttttttgagatg

SEQ ID NO: 49040 - DNA, 22 bp, Artificial Sequence
  chemically synthesized
tttcttttttttttgagatgga

SEQ ID NO: 49041 - DNA, 22 bp, Artificial Sequence
  chemically synthesized
ttcttttttttttgagatggag

SEQ ID NO: 49042 - DNA, 22 bp, Artificial Sequence
  chemically synthesized
tcttttttttttgagatggagt

SEQ ID NO: 49043 - DNA, 22 bp, Artificial Sequence
  chemically synthesized
cttttttttttgagatggagtt

SEQ ID NO: 49044 - DNA, 22 bp, Artificial Sequence
  chemically synthesized
ttttttttttgagatggagttt

SEQ ID NO: 49045 - DNA, 22 bp, Artificial Sequence
  chemically synthesized
ttttttttgagatggagtttcg

SEQ ID NO: 49046 - DNA, 22 bp, Artificial Sequence
  chemically synthesized
tttttttgagatggagtttcgc

SEQ ID NO: 49047 - DNA, 22 bp, Artificial Sequence
  chemically synthesized
ttttttgagatggagtttcgct

SEQ ID NO: 49048 - DNA, 22 bp, Artificial Sequence
  chemically synthesized
tttttgagatggagtttcgctc

SEQ ID NO: 49049 - DNA, 22 bp, Artificial Sequence
  chemically synthesized
ttttgagatggagtttcgctct

SEQ ID NO: 49050 - DNA, 22 bp, Artificial Sequence
  chemically synthesized
tttgagatggagtttcgctctt

SEQ ID NO: 49051 - DNA, 22 bp, Artificial Sequence
  chemically synthesized
ttgagatggagtttcgctcttg

SEQ ID NO: 49052 - DNA, 22 bp, Artificial Sequence
  chemically synthesized
tgagatggagtttcgctcttgt

SEQ ID NO: 49053 - DNA, 22 bp, Artificial Sequence
  chemically synthesized
gagatggagtttcgctcttgtt

SEQ ID NO: 49054 - DNA, 22 bp, Artificial Sequence
  chemically synthesized
agatggagtttcgctcttgttg

SEQ ID NO: 49055 - DNA, 22 bp, Artificial Sequence
  chemically synthesized
cgctcttgttgcccaggctgga

SEQ ID NO: 49056 - DNA, 22 bp, Artificial Sequence
  chemically synthesized
gctcttgttgcccaggctggag

SEQ ID NO: 49057 - DNA, 22 bp, Artificial Sequence
  chemically synthesized
ttgttgcccaggctggagtgca

SEQ ID NO: 49058 - DNA, 22 bp, Artificial Sequence
  chemically synthesized
gttgcccaggctggagtgcaat

SEQ ID NO: 49059 - DNA, 22 bp, Artificial Sequence
  chemically synthesized
ttgcccaggctggagtgcaatg

SEQ ID NO: 49060 - DNA, 22 bp, Artificial Sequence
  chemically synthesized
cccaggctggagtgcaatggtg

SEQ ID NO: 49061 - DNA, 22 bp, Artificial Sequence
  chemically synthesized
gagtgcaatggtgcagtctcag

SEQ ID NO: 49062 - DNA, 22 bp, Artificial Sequence
  chemically synthesized
agctcactgcaacatctgtctc

SEQ ID NO: 49063 - DNA, 22 bp, Artificial Sequence
  chemically synthesized
actgcaacatctgtctcccggg

SEQ ID NO: 49064 - DNA, 22 bp, Artificial Sequence
  chemically synthesized
caacatctgtctcccgggttca

SEQ ID NO: 49065 - DNA, 22 bp, Artificial Sequence
  chemically synthesized
tctcccgggttcaagtggttct

SEQ ID NO: 49066 - DNA, 22 bp, Artificial Sequence
  chemically synthesized
ccgggttcaagtggttctcctg

SEQ ID NO: 49067 - DNA, 22 bp, Artificial Sequence
  chemically synthesized
aagtggttctcctgcctcagcc

SEQ ID NO: 49068 - DNA, 22 bp, Artificial Sequence
  chemically synthesized
tcctgcctcagcctcccaagaa

SEQ ID NO: 49069 - DNA, 22 bp, Artificial Sequence
  chemically synthesized
ctgcctcagcctcccaagaagc

SEQ ID NO: 49070 - DNA, 22 bp, Artificial Sequence
  chemically synthesized
cctcagcctcccaagaagctgg

SEQ ID NO: 49071 - DNA, 22 bp, Artificial Sequence
  chemically synthesized
agcctcccaagaagctgggatt

SEQ ID NO: 49072 - DNA, 22 bp, Artificial Sequence
  chemically synthesized
ccaagaagctgggattacaggt

SEQ ID NO: 49073 - DNA, 22 bp, Artificial Sequence
  chemically synthesized
ggattacaggtacctgccacca

SEQ ID NO: 49074 - DNA, 22 bp, Artificial Sequence
  chemically synthesized
caggtacctgccaccacgcccg

SEQ ID NO: 49075 - DNA, 22 bp, Artificial Sequence
  chemically synthesized
ccaccacgcccggctaattttt

SEQ ID NO: 49076 - DNA, 22 bp, Artificial Sequence
  chemically synthesized
atttttgtatttttagtagaga

SEQ ID NO: 49077 - DNA, 22 bp, Artificial Sequence
  chemically synthesized
ttgtatttttagtagagaaggg

SEQ ID NO: 49078 - DNA, 22 bp, Artificial Sequence
  chemically synthesized
tgtatttttagtagagaagggg

SEQ ID NO: 49079 - DNA, 22 bp, Artificial Sequence
  chemically synthesized
gtatttttagtagagaaggggt

SEQ ID NO: 49080 - DNA, 22 bp, Artificial Sequence
  chemically synthesized
tatttttagtagagaaggggtt

SEQ ID NO: 49081 - DNA, 22 bp, Artificial Sequence
  chemically synthesized
ttagtagagaaggggtttcacc

SEQ ID NO: 49082 - DNA, 22 bp, Artificial Sequence
  chemically synthesized
tagtagagaaggggtttcacca

SEQ ID NO: 49083 - DNA, 22 bp, Artificial Sequence
  chemically synthesized
agtagagaaggggtttcaccac

SEQ ID NO: 49084 - DNA, 22 bp, Artificial Sequence
  chemically synthesized
gtagagaaggggtttcaccacg

SEQ ID NO: 49085 - DNA, 22 bp, Artificial Sequence
  chemically synthesized
caccacgttggccaggctagtc

SEQ ID NO: 49086 - DNA, 22 bp, Artificial Sequence
  chemically synthesized
accacgttggccaggctagtcg

SEQ ID NO: 49087 - DNA, 22 bp, Artificial Sequence
  chemically synthesized
gccaggctagtcgcaaactcct

SEQ ID NO: 49088 - DNA, 22 bp, Artificial Sequence
  chemically synthesized
gtcgcaaactcctgacctcctc

SEQ ID NO: 49089 - DNA, 22 bp, Artificial Sequence
  chemically synthesized
ctgacctcctcagtggatccga

SEQ ID NO: 49090 - DNA, 22 bp, Artificial Sequence
  chemically synthesized
acctcctcagtggatccgagga

SEQ ID NO: 49091 - DNA, 22 bp, Artificial Sequence
  chemically synthesized
ctcagtggatccgaggaggtga

SEQ ID NO: 49092 - DNA, 22 bp, Artificial Sequence
  chemically synthesized
agtggatccgaggaggtgatcc

SEQ ID NO: 49093 - DNA, 22 bp, Artificial Sequence
  chemically synthesized
ccgcctcagcctcccaaagtgc

SEQ ID NO: 49094 - DNA, 22 bp, Artificial Sequence
  chemically synthesized
agcctcccaaagtgctcgaatt

SEQ ID NO: 49095 - DNA, 22 bp, Artificial Sequence
  chemically synthesized
ccaaagtgctcgaattacaggt

SEQ ID NO: 49096 - DNA, 22 bp, Artificial Sequence
  chemically synthesized
gaattacaggtgtgagccacca

SEQ ID NO: 49097 - DNA, 22 bp, Artificial Sequence
  chemically synthesized
caggtgtgagccaccacgcctg

SEQ ID NO: 49098 - DNA, 22 bp, Artificial Sequence
  chemically synthesized
gcctccacagttctttatccac

SEQ ID NO: 49099 - DNA, 22 bp, Artificial Sequence
  chemically synthesized
cacagttctttatccaccgtct

SEQ ID NO: 49100 - DNA, 22 bp, Artificial Sequence
  chemically synthesized
tttatccaccgtctgaaatgta

SEQ ID NO: 49101 - DNA, 22 bp, Artificial Sequence
  chemically synthesized
tatccaccgtctgaaatgtaaa

SEQ ID NO: 49102 - DNA, 22 bp, Artificial Sequence
  chemically synthesized
atccaccgtctgaaatgtaaaa

SEQ ID NO: 49103 - DNA, 22 bp, Artificial Sequence
  chemically synthesized
tccaccgtctgaaatgtaaaat

SEQ ID NO: 49104 - DNA, 22 bp, Artificial Sequence
  chemically synthesized
aaatgtaaaatgttacgaaaac

SEQ ID NO: 49105 - DNA, 22 bp, Artificial Sequence
  chemically synthesized
cgaaaaccaaaagttttttttg

SEQ ID NO: 49106 - DNA, 22 bp, Artificial Sequence
  chemically synthesized
tttttgtgatttatttgatggt

SEQ ID NO: 49107 - DNA, 22 bp, Artificial Sequence
  chemically synthesized
ttttgtgatttatttgatggta

SEQ ID NO: 49108 - DNA, 22 bp, Artificial Sequence
  chemically synthesized
tttgtgatttatttgatggtag

SEQ ID NO: 49109 - DNA, 22 bp, Artificial Sequence
  chemically synthesized
ttgtgatttatttgatggtagc

SEQ ID NO: 49110 - DNA, 22 bp, Artificial Sequence
  chemically synthesized
tgtgatttatttgatggtagca

SEQ ID NO: 49111 - DNA, 22 bp, Artificial Sequence
  chemically synthesized
gtgatttatttgatggtagcac

SEQ ID NO: 49112 - DNA, 22 bp, Artificial Sequence
  chemically synthesized
tgatttatttgatggtagcacc

SEQ ID NO: 49113 - DNA, 22 bp, Artificial Sequence
  chemically synthesized
atttgatggtagcacctgacgt

SEQ ID NO: 49114 - DNA, 22 bp, Artificial Sequence
  chemically synthesized
tttgatggtagcacctgacgtg

SEQ ID NO: 49115 - DNA, 22 bp, Artificial Sequence
  chemically synthesized
gatggtagcacctgacgtgaac

SEQ ID NO: 49116 - DNA, 22 bp, Artificial Sequence
  chemically synthesized
atggtagcacctgacgtgaact

SEQ ID NO: 49117 - DNA, 22 bp, Artificial Sequence
  chemically synthesized
acgtgaactgacatgagattat

SEQ ID NO: 49118 - DNA, 22 bp, Artificial Sequence
  chemically synthesized
acatgagattatttttaattta

SEQ ID NO: 49119 - DNA, 22 bp, Artificial Sequence
  chemically synthesized
tttttaatttagttgtgtgaat

SEQ ID NO: 49120 - DNA, 22 bp, Artificial Sequence
  chemically synthesized
ttaatttagttgtgtgaatatg

SEQ ID NO: 49121 - DNA, 22 bp, Artificial Sequence
  chemically synthesized
taatttagttgtgtgaatatgc

SEQ ID NO: 49122 - DNA, 22 bp, Artificial Sequence
  chemically synthesized
aatttagttgtgtgaatatgca

SEQ ID NO: 49123 - DNA, 22 bp, Artificial Sequence
  chemically synthesized
atttagttgtgtgaatatgcat

SEQ ID NO: 49124 - DNA, 22 bp, Artificial Sequence
  chemically synthesized
agttgtgtgaatatgcatattc

SEQ ID NO: 49125 - DNA, 22 bp, Artificial Sequence
  chemically synthesized
gttgtgtgaatatgcatattca

SEQ ID NO: 49126 - DNA, 22 bp, Artificial Sequence
  chemically synthesized
tgtgaatatgcatattcatata

SEQ ID NO: 49127 - DNA, 22 bp, Artificial Sequence
  chemically synthesized
atatattttgctgcatagatta

SEQ ID NO: 49128 - DNA, 22 bp, Artificial Sequence
  chemically synthesized
tgctgcatagattacagtatgc

SEQ ID NO: 49129 - DNA, 22 bp, Artificial Sequence
  chemically synthesized
gctgcatagattacagtatgca

SEQ ID NO: 49130 - DNA, 22 bp, Artificial Sequence
  chemically synthesized
ctgcatagattacagtatgcag

SEQ ID NO: 49131 - DNA, 22 bp, Artificial Sequence
  chemically synthesized
catagattacagtatgcagctc

SEQ ID NO: 49132 - DNA, 22 bp, Artificial Sequence
  chemically synthesized
cagtatgcagctccagattctt

SEQ ID NO: 49133 - DNA, 22 bp, Artificial Sequence
  chemically synthesized
cagattcttccaagcagactct

SEQ ID NO: 49134 - DNA, 22 bp, Artificial Sequence
  chemically synthesized
ttccaagcagactctgattgcc

SEQ ID NO: 49135 - DNA, 22 bp, Artificial Sequence
  chemically synthesized
ccaagcagactctgattgccca

SEQ ID NO: 49136 - DNA, 22 bp, Artificial Sequence
  chemically synthesized
caagcagactctgattgcccat

SEQ ID NO: 49137 - DNA, 22 bp, Artificial Sequence
  chemically synthesized
tgattgcccattactgcctttc

SEQ ID NO: 49138 - DNA, 22 bp, Artificial Sequence
  chemically synthesized
attgcccattactgcctttcta

SEQ ID NO: 49139 - DNA, 22 bp, Artificial Sequence
  chemically synthesized
cccattactgcctttctaaaat

SEQ ID NO: 49140 - DNA, 22 bp, Artificial Sequence
  chemically synthesized
ctgcctttctaaaatccaaaca

SEQ ID NO: 49141 - DNA, 22 bp, Artificial Sequence
  chemically synthesized
cctttctaaaatccaaacaagt

SEQ ID NO: 49142 - DNA, 22 bp, Artificial Sequence
  chemically synthesized
tctaaaatccaaacaagttctg

SEQ ID NO: 49143 - DNA, 22 bp, Artificial Sequence
  chemically synthesized
ctaaaatccaaacaagttctga

SEQ ID NO: 49144 - DNA, 22 bp, Artificial Sequence
  chemically synthesized
taaaatccaaacaagttctgag

SEQ ID NO: 49145 - DNA, 22 bp, Artificial Sequence
  chemically synthesized
aaatccaaacaagttctgaggt

SEQ ID NO: 49146 - DNA, 22 bp, Artificial Sequence
  chemically synthesized
tgaggttcaaaaccgttttggc

SEQ ID NO: 49147 - DNA, 22 bp, Artificial Sequence
  chemically synthesized
aggttcaaaaccgttttggccc

SEQ ID NO: 49148 - DNA, 22 bp, Artificial Sequence
  chemically synthesized
aaaaccgttttggccctaaggc

SEQ ID NO: 49149 - DNA, 22 bp, Artificial Sequence
  chemically synthesized
tggccctaaggctttgggtaaa

SEQ ID NO: 49150 - DNA, 22 bp, Artificial Sequence
  chemically synthesized
ggccctaaggctttgggtaaag

SEQ ID NO: 49151 - DNA, 22 bp, Artificial Sequence
  chemically synthesized
gccctaaggctttgggtaaagg

SEQ ID NO: 49152 - DNA, 22 bp, Artificial Sequence
  chemically synthesized
aggctttgggtaaagggggtgg

SEQ ID NO: 49153 - DNA, 22 bp, Artificial Sequence
  chemically synthesized
tgggtaaagggggtggactctg

SEQ ID NO: 49154 - DNA, 22 bp, Artificial Sequence
  chemically synthesized
gggtaaagggggtggactctgt

SEQ ID NO: 49155 - DNA, 22 bp, Artificial Sequence
  chemically synthesized
ggtaaagggggtggactctgtt

SEQ ID NO: 49156 - DNA, 22 bp, Artificial Sequence
  chemically synthesized
tgttctactctgactggagtcc

SEQ ID NO: 49157 - DNA, 22 bp, Artificial Sequence
  chemically synthesized
ttctactctgactggagtccaa

SEQ ID NO: 49158 - DNA, 22 bp, Artificial Sequence
  chemically synthesized
tactctgactggagtccaagat

SEQ ID NO: 49159 - DNA, 22 bp, Artificial Sequence
  chemically synthesized
ctctgactggagtccaagatgc

SEQ ID NO: 49160 - DNA, 22 bp, Artificial Sequence
  chemically synthesized
tgactggagtccaagatgcata

SEQ ID NO: 49161 - DNA, 22 bp, Artificial Sequence
  chemically synthesized
actggagtccaagatgcatata

SEQ ID NO: 49162 - DNA, 22 bp, Artificial Sequence
  chemically synthesized
gagtccaagatgcatatataca

SEQ ID NO: 49163 - DNA, 22 bp, Artificial Sequence
  chemically synthesized
caaggtaggttgaggtaggggc

SEQ ID NO: 49164 - DNA, 22 bp, Artificial Sequence
  chemically synthesized
aggtaggggccaaggaggagca

SEQ ID NO: 49165 - DNA, 22 bp, Artificial Sequence
  chemically synthesized
ggacttgattcatgaggctgtg

SEQ ID NO: 49166 - DNA, 22 bp, Artificial Sequence
  chemically synthesized
gacttgattcatgaggctgtgg

SEQ ID NO: 49167 - DNA, 22 bp, Artificial Sequence
  chemically synthesized
gattcatgaggctgtggggagc

SEQ ID NO: 49168 - DNA, 22 bp, Artificial Sequence
  chemically synthesized
attcatgaggctgtggggagcc

SEQ ID NO: 49169 - DNA, 22 bp, Artificial Sequence
  chemically synthesized
atgaggctgtggggagccagtg

SEQ ID NO: 49170 - DNA, 22 bp, Artificial Sequence
  chemically synthesized
tggggagccagtgaaggttctt

SEQ ID NO: 49171 - DNA, 22 bp, Artificial Sequence
  chemically synthesized
ttaagcaggtatgtctgcctga

SEQ ID NO: 49172 - DNA, 22 bp, Artificial Sequence
  chemically synthesized
aagcaggtatgtctgcctgaga

SEQ ID NO: 49173 - DNA, 22 bp, Artificial Sequence
  chemically synthesized
agcaggtatgtctgcctgagag

SEQ ID NO: 49174 - DNA, 22 bp, Artificial Sequence
  chemically synthesized
cctgagagcagttggagcagac

SEQ ID NO: 49175 - DNA, 22 bp, Artificial Sequence
  chemically synthesized
agagcagttggagcagacaaga

SEQ ID NO: 49176 - DNA, 22 bp, Artificial Sequence
  chemically synthesized
gagcagacaagagctaaaaacc

SEQ ID NO: 49177 - DNA, 22 bp, Artificial Sequence
  chemically synthesized
aaaaccaaacaaatcaccatag

SEQ ID NO: 49178 - DNA, 22 bp, Artificial Sequence
  chemically synthesized
ctataatttgtttgtcccctcc

SEQ ID NO: 49179 - DNA, 22 bp, Artificial Sequence
  chemically synthesized
taatttgtttgtcccctccaaa

SEQ ID NO: 49180 - DNA, 22 bp, Artificial Sequence
  chemically synthesized
gtttgtcccctccaaatctcat

SEQ ID NO: 49181 - DNA, 22 bp, Artificial Sequence
  chemically synthesized
tttgtcccctccaaatctcatg

SEQ ID NO: 49182 - DNA, 22 bp, Artificial Sequence
  chemically synthesized
gtcccctccaaatctcatgtgg

SEQ ID NO: 49183 - DNA, 22 bp, Artificial Sequence
  chemically synthesized
tcccctccaaatctcatgtgga

SEQ ID NO: 49184 - DNA, 22 bp, Artificial Sequence
  chemically synthesized
caaatctcatgtggaaatttgg

SEQ ID NO: 49185 - DNA, 22 bp, Artificial Sequence
  chemically synthesized
atgtggaaatttggtcctcagt

SEQ ID NO: 49186 - DNA, 22 bp, Artificial Sequence
  chemically synthesized
ggtcctcagtgttggaagtggg

SEQ ID NO: 49187 - DNA, 22 bp, Artificial Sequence
  chemically synthesized
gtcctcagtgttggaagtgggg

SEQ ID NO: 49188 - DNA, 22 bp, Artificial Sequence
  chemically synthesized
agtgttggaagtggggcctaat

SEQ ID NO: 49189 - DNA, 22 bp, Artificial Sequence
  chemically synthesized
gaagtggggcctaatgggaggt

SEQ ID NO: 49190 - DNA, 22 bp, Artificial Sequence
  chemically synthesized
atgggaggtgtttgggtcatgg

SEQ ID NO: 49191 - DNA, 22 bp, Artificial Sequence
  chemically synthesized
gggtcatgggggaggaacccct

SEQ ID NO: 49192 - DNA, 22 bp, Artificial Sequence
  chemically synthesized
ggtcatgggggaggaacccctg

SEQ ID NO: 49193 - DNA, 22 bp, Artificial Sequence
  chemically synthesized
tgaaaggcttggtgccgtcctt

SEQ ID NO: 49194 - DNA, 22 bp, Artificial Sequence
  chemically synthesized
ggtgccgtccttgtgataatga

SEQ ID NO: 49195 - DNA, 22 bp, Artificial Sequence
  chemically synthesized
gtgccgtccttgtgataatgag

SEQ ID NO: 49196 - DNA, 22 bp, Artificial Sequence
  chemically synthesized
gtgataatgagtaagttctccc

SEQ ID NO: 49197 - DNA, 22 bp, Artificial Sequence
  chemically synthesized
tgataatgagtaagttctcccg

SEQ ID NO: 49198 - DNA, 22 bp, Artificial Sequence
  chemically synthesized
tcccgctatgatttcccttgaa

SEQ ID NO: 49199 - DNA, 22 bp, Artificial Sequence
  chemically synthesized
ccgctatgatttcccttgaagg

SEQ ID NO: 49200 - DNA, 22 bp, Artificial Sequence
  chemically synthesized
tgatttcccttgaaggctgatt

SEQ ID NO: 49201 - DNA, 22 bp, Artificial Sequence
  chemically synthesized
cccttgaaggctgattattaaa

SEQ ID NO: 49202 - DNA, 22 bp, Artificial Sequence
  chemically synthesized
ccttgaaggctgattattaaaa

SEQ ID NO: 49203 - DNA, 22 bp, Artificial Sequence
  chemically synthesized
gaaggctgattattaaaaagag

SEQ ID NO: 49204 - DNA, 22 bp, Artificial Sequence
  chemically synthesized
aaggctgattattaaaaagagc

SEQ ID NO: 49205 - DNA, 22 bp, Artificial Sequence
  chemically synthesized
attattaaaaagagcttggcac

SEQ ID NO: 49206 - DNA, 22 bp, Artificial Sequence
  chemically synthesized
ttaaaaagagcttggcacctcc

SEQ ID NO: 49207 - DNA, 22 bp, Artificial Sequence
  chemically synthesized
aaaagagcttggcacctccctc

SEQ ID NO: 49208 - DNA, 22 bp, Artificial Sequence
  chemically synthesized
ggcacctccctctcttctctct

SEQ ID NO: 49209 - DNA, 22 bp, Artificial Sequence
  chemically synthesized
gcacctccctctcttctctctt

SEQ ID NO: 49210 - DNA, 22 bp, Artificial Sequence
  chemically synthesized
cctctcttctctcttgcttctt

SEQ ID NO: 49211 - DNA, 22 bp, Artificial Sequence
  chemically synthesized
tcttctctcttgcttcttctct

SEQ ID NO: 49212 - DNA, 22 bp, Artificial Sequence
  chemically synthesized
ttctctcttgcttcttctcttg

SEQ ID NO: 49213 - DNA, 22 bp, Artificial Sequence
  chemically synthesized
ctctcttgcttcttctcttgcc

SEQ ID NO: 49214 - DNA, 22 bp, Artificial Sequence
  chemically synthesized
tctcttgcttcttctcttgcca

SEQ ID NO: 49215 - DNA, 22 bp, Artificial Sequence
  chemically synthesized
tcttgcttcttctcttgccatg

SEQ ID NO: 49216 - DNA, 22 bp, Artificial Sequence
  chemically synthesized
ttgcttcttctcttgccatgtg

SEQ ID NO: 49217 - DNA, 22 bp, Artificial Sequence
  chemically synthesized
gcttcttctcttgccatgtgat

SEQ ID NO: 49218 - DNA, 22 bp, Artificial Sequence
  chemically synthesized
cttcttctcttgccatgtgatt

SEQ ID NO: 49219 - DNA, 22 bp, Artificial Sequence
  chemically synthesized
cttctcttgccatgtgattgat

SEQ ID NO: 49220 - DNA, 22 bp, Artificial Sequence
  chemically synthesized
ttctcttgccatgtgattgatc

SEQ ID NO: 49221 - DNA, 22 bp, Artificial Sequence
  chemically synthesized
ctcttgccatgtgattgatctc

SEQ ID NO: 49222 - DNA, 22 bp, Artificial Sequence
  chemically synthesized
tcttgccatgtgattgatctct

SEQ ID NO: 49223 - DNA, 22 bp, Artificial Sequence
  chemically synthesized
ttgccatgtgattgatctctgc

SEQ ID NO: 49224 - DNA, 22 bp, Artificial Sequence
  chemically synthesized
gccatgtgattgatctctgcac

SEQ ID NO: 49225 - DNA, 22 bp, Artificial Sequence
  chemically synthesized
ccatgtgattgatctctgcaca

SEQ ID NO: 49226 - DNA, 22 bp, Artificial Sequence
  chemically synthesized
atctctgcacatgtaggctccc

SEQ ID NO: 49227 - DNA, 22 bp, Artificial Sequence
  chemically synthesized
tgcacatgtaggctccccttca

SEQ ID NO: 49228 - DNA, 22 bp, Artificial Sequence
  chemically synthesized
cacatgtaggctccccttcacc

SEQ ID NO: 49229 - DNA, 22 bp, Artificial Sequence
  chemically synthesized
cccttcaccttctgccatcagt

SEQ ID NO: 49230 - DNA, 22 bp, Artificial Sequence
  chemically synthesized
caccttctgccatcagtgaaag

SEQ ID NO: 49231 - DNA, 22 bp, Artificial Sequence
  chemically synthesized
accttctgccatcagtgaaagc

SEQ ID NO: 49232 - DNA, 22 bp, Artificial Sequence
  chemically synthesized
ctgccatcagtgaaagcagctt

SEQ ID NO: 49233 - DNA, 22 bp, Artificial Sequence
  chemically synthesized
tgccatcagtgaaagcagctta

SEQ ID NO: 49234 - DNA, 22 bp, Artificial Sequence
  chemically synthesized
ccatcagtgaaagcagcttaag

SEQ ID NO: 49235 - DNA, 22 bp, Artificial Sequence
  chemically synthesized
aaggccctcaccagaagcagat

SEQ ID NO: 49236 - DNA, 22 bp, Artificial Sequence
  chemically synthesized
aggccctcaccagaagcagatg

SEQ ID NO: 49237 - DNA, 22 bp, Artificial Sequence
  chemically synthesized
accagaagcagatgctggtgcc

SEQ ID NO: 49238 - DNA, 22 bp, Artificial Sequence
  chemically synthesized
gtgccatgcttcctggagagct

SEQ ID NO: 49239 - DNA, 22 bp, Artificial Sequence
  chemically synthesized
cctggagagcttgcagaatcat

SEQ ID NO: 49240 - DNA, 22 bp, Artificial Sequence
  chemically synthesized
ctggagagcttgcagaatcatg

SEQ ID NO: 49241 - DNA, 22 bp, Artificial Sequence
  chemically synthesized
gagagcttgcagaatcatgagc

SEQ ID NO: 49242 - DNA, 22 bp, Artificial Sequence
  chemically synthesized
gcagaatcatgagctgaataaa

SEQ ID NO: 49243 - DNA, 22 bp, Artificial Sequence
  chemically synthesized
cagaatcatgagctgaataaat

SEQ ID NO: 49244 - DNA, 22 bp, Artificial Sequence
  chemically synthesized
aataaatcccttttccttgtaa

SEQ ID NO: 49245 - DNA, 22 bp, Artificial Sequence
  chemically synthesized
ttccttgtaaattactcacctt

SEQ ID NO: 49246 - DNA, 22 bp, Artificial Sequence
  chemically synthesized
tccttgtaaattactcaccttc

SEQ ID NO: 49247 - DNA, 22 bp, Artificial Sequence
  chemically synthesized
ccttgtaaattactcaccttca

SEQ ID NO: 49248 - DNA, 22 bp, Artificial Sequence
  chemically synthesized
cttgtaaattactcaccttcag

SEQ ID NO: 49249 - DNA, 22 bp, Artificial Sequence
  chemically synthesized
gtaaattactcaccttcaggta

SEQ ID NO: 49250 - DNA, 22 bp, Artificial Sequence
  chemically synthesized
taaattactcaccttcaggtat

SEQ ID NO: 49251 - DNA, 22 bp, Artificial Sequence
  chemically synthesized
ctcaccttcaggtattccttta

SEQ ID NO: 49252 - DNA, 22 bp, Artificial Sequence
  chemically synthesized
accttcaggtattcctttatat

SEQ ID NO: 49253 - DNA, 22 bp, Artificial Sequence
  chemically synthesized
caggtattcctttatatagcaa

SEQ ID NO: 49254 - DNA, 22 bp, Artificial Sequence
  chemically synthesized
aggtattcctttatatagcaac

SEQ ID NO: 49255 - DNA, 22 bp, Artificial Sequence
  chemically synthesized
ctttatatagcaacacaaaagg

SEQ ID NO: 49256 - DNA, 22 bp, Artificial Sequence
  chemically synthesized
tatatagcaacacaaaaggact

SEQ ID NO: 49257 - DNA, 22 bp, Artificial Sequence
  chemically synthesized
atatagcaacacaaaaggacta

SEQ ID NO: 49258 - DNA, 22 bp, Artificial Sequence
  chemically synthesized
tatagcaacacaaaaggactaa

SEQ ID NO: 49259 - DNA, 22 bp, Artificial Sequence
  chemically synthesized
agacagtggccttgacttttct

SEQ ID NO: 49260 - DNA, 22 bp, Artificial Sequence
  chemically synthesized
gacttttctctctctttaagaa

SEQ ID NO: 49261 - DNA, 22 bp, Artificial Sequence
  chemically synthesized
acttttctctctctttaagaag

SEQ ID NO: 49262 - DNA, 22 bp, Artificial Sequence
  chemically synthesized
ttctctctctttaagaagtgtt

SEQ ID NO: 49263 - DNA, 22 bp, Artificial Sequence
  chemically synthesized
tctctctctttaagaagtgttg

SEQ ID NO: 49264 - DNA, 22 bp, Artificial Sequence
  chemically synthesized
ctctctctttaagaagtgttgc

SEQ ID NO: 49265 - DNA, 22 bp, Artificial Sequence
  chemically synthesized
tctctctttaagaagtgttgcc

SEQ ID NO: 49266 - DNA, 22 bp, Artificial Sequence
  chemically synthesized
tctctttaagaagtgttgcctt

SEQ ID NO: 49267 - DNA, 22 bp, Artificial Sequence
  chemically synthesized
tctttaagaagtgttgcctttg

SEQ ID NO: 49268 - DNA, 22 bp, Artificial Sequence
  chemically synthesized
tttaagaagtgttgcctttgct

SEQ ID NO: 49269 - DNA, 22 bp, Artificial Sequence
  chemically synthesized
taagaagtgttgcctttgctca

SEQ ID NO: 49270 - DNA, 22 bp, Artificial Sequence
  chemically synthesized
aagaagtgttgcctttgctcac

SEQ ID NO: 49271 - DNA, 22 bp, Artificial Sequence
  chemically synthesized
agaagtgttgcctttgctcact

SEQ ID NO: 49272 - DNA, 22 bp, Artificial Sequence
  chemically synthesized
cctttgctcacttagtcatccc

SEQ ID NO: 49273 - DNA, 22 bp, Artificial Sequence
  chemically synthesized
tgctcacttagtcatcccttct

SEQ ID NO: 49274 - DNA, 22 bp, Artificial Sequence
  chemically synthesized
gctcacttagtcatcccttctg

SEQ ID NO: 49275 - DNA, 22 bp, Artificial Sequence
  chemically synthesized
ctcacttagtcatcccttctgc

SEQ ID NO: 49276 - DNA, 22 bp, Artificial Sequence
  chemically synthesized
acttagtcatcccttctgcctg

SEQ ID NO: 49277 - DNA, 22 bp, Artificial Sequence
  chemically synthesized
agtcatcccttctgcctgcatt

SEQ ID NO: 49278 - DNA, 22 bp, Artificial Sequence
  chemically synthesized
gtcatcccttctgcctgcattt

SEQ ID NO: 49279 - DNA, 22 bp, Artificial Sequence
  chemically synthesized
ctgcctgcatttgtagagcatc

SEQ ID NO: 49280 - DNA, 22 bp, Artificial Sequence
  chemically synthesized
tgcctgcatttgtagagcatct

SEQ ID NO: 49281 - DNA, 22 bp, Artificial Sequence
  chemically synthesized
cctgcatttgtagagcatctgg

SEQ ID NO: 49282 - DNA, 22 bp, Artificial Sequence
  chemically synthesized
catttgtagagcatctggatgg

SEQ ID NO: 49283 - DNA, 22 bp, Artificial Sequence
  chemically synthesized
gtagagcatctggatgggagat

SEQ ID NO: 49284 - DNA, 22 bp, Artificial Sequence
  chemically synthesized
tagagcatctggatgggagatt

SEQ ID NO: 49285 - DNA, 22 bp, Artificial Sequence
  chemically synthesized
gatgggagatttatataaccgt

SEQ ID NO: 49286 - DNA, 22 bp, Artificial Sequence
  chemically synthesized
atataaccgtcactcttgactt

SEQ ID NO: 49287 - DNA, 22 bp, Artificial Sequence
  chemically synthesized
tataaccgtcactcttgacttt

SEQ ID NO: 49288 - DNA, 22 bp, Artificial Sequence
  chemically synthesized
ttgactttcccagcaggcctat

SEQ ID NO: 49289 - DNA, 22 bp, Artificial Sequence
  chemically synthesized
gactttcccagcaggcctatgt

SEQ ID NO: 49290 - DNA, 22 bp, Artificial Sequence
  chemically synthesized
actttcccagcaggcctatgtc

SEQ ID NO: 49291 - DNA, 22 bp, Artificial Sequence
  chemically synthesized
tcccagcaggcctatgtcatag

SEQ ID NO: 49292 - DNA, 22 bp, Artificial Sequence
  chemically synthesized
cccagcaggcctatgtcatagg

SEQ ID NO: 49293 - DNA, 22 bp, Artificial Sequence
  chemically synthesized
ccagcaggcctatgtcataggt

SEQ ID NO: 49294 - DNA, 22 bp, Artificial Sequence
  chemically synthesized
tgtcataggtactgtggtctct

SEQ ID NO: 49295 - DNA, 22 bp, Artificial Sequence
  chemically synthesized
tggtctctacaatacagcagag

SEQ ID NO: 49296 - DNA, 22 bp, Artificial Sequence
  chemically synthesized
tacaatacagcagaggtatctg

SEQ ID NO: 49297 - DNA, 22 bp, Artificial Sequence
  chemically synthesized
caatacagcagaggtatctgag

SEQ ID NO: 49298 - DNA, 22 bp, Artificial Sequence
  chemically synthesized
aggctccgagaggttgagtgac

SEQ ID NO: 49299 - DNA, 22 bp, Artificial Sequence
  chemically synthesized
cgagaggttgagtgacttgctc

SEQ ID NO: 49300 - DNA, 22 bp, Artificial Sequence
  chemically synthesized
agtgacttgctcatggctgcac

SEQ ID NO: 49301 - DNA, 22 bp, Artificial Sequence
  chemically synthesized
gctcatggctgcacaaccagta

SEQ ID NO: 49302 - DNA, 22 bp, Artificial Sequence
  chemically synthesized
ctcatggctgcacaaccagtaa

SEQ ID NO: 49303 - DNA, 22 bp, Artificial Sequence
  chemically synthesized
atggctgcacaaccagtaaata

SEQ ID NO: 49304 - DNA, 22 bp, Artificial Sequence
  chemically synthesized
cacaaccagtaaatattggagc

SEQ ID NO: 49305 - DNA, 22 bp, Artificial Sequence
  chemically synthesized
gagctggaattcaggtccacgg

SEQ ID NO: 49306 - DNA, 22 bp, Artificial Sequence
  chemically synthesized
gaattcaggtccacggtttcct

SEQ ID NO: 49307 - DNA, 22 bp, Artificial Sequence
  chemically synthesized
aggtccacggtttcctggctcc

SEQ ID NO: 49308 - DNA, 22 bp, Artificial Sequence
  chemically synthesized
cctggctccaaagcccatgatt

SEQ ID NO: 49309 - DNA, 22 bp, Artificial Sequence
  chemically synthesized
ctggctccaaagcccatgattt

SEQ ID NO: 49310 - DNA, 22 bp, Artificial Sequence
  chemically synthesized
gctccaaagcccatgatttttt

SEQ ID NO: 49311 - DNA, 22 bp, Artificial Sequence
  chemically synthesized
caaagcccatgattttttccct

SEQ ID NO: 49312 - DNA, 22 bp, Artificial Sequence
  chemically synthesized
tttccctcaatttattctgact

SEQ ID NO: 49313 - DNA, 22 bp, Artificial Sequence
  chemically synthesized
ttccctcaatttattctgactg

SEQ ID NO: 49314 - DNA, 22 bp, Artificial Sequence
  chemically synthesized
tccctcaatttattctgactgg

SEQ ID NO: 49315 - DNA, 22 bp, Artificial Sequence
  chemically synthesized
ccctcaatttattctgactggg

SEQ ID NO: 49316 - DNA, 22 bp, Artificial Sequence
  chemically synthesized
cctcaatttattctgactgggg

SEQ ID NO: 49317 - DNA, 22 bp, Artificial Sequence
  chemically synthesized
aatttattctgactggggcatg

SEQ ID NO: 49318 - DNA, 22 bp, Artificial Sequence
  chemically synthesized
attctgactggggcatggggga

SEQ ID NO: 49319 - DNA, 22 bp, Artificial Sequence
  chemically synthesized
ttctgactggggcatgggggag

SEQ ID NO: 49320 - DNA, 22 bp, Artificial Sequence
  chemically synthesized
tgactggggcatgggggagggg

SEQ ID NO: 49321 - DNA, 22 bp, Artificial Sequence
  chemically synthesized
actggggcatgggggagggggt

SEQ ID NO: 49322 - DNA, 22 bp, Artificial Sequence
  chemically synthesized
gggcatgggggagggggtggcc

SEQ ID NO: 49323 - DNA, 22 bp, Artificial Sequence
  chemically synthesized
tgggcagggccaccaggagcga

SEQ ID NO: 49324 - DNA, 22 bp, Artificial Sequence
  chemically synthesized
gggcagggccaccaggagcgac

SEQ ID NO: 49325 - DNA, 22 bp, Artificial Sequence
  chemically synthesized
ggcagggccaccaggagcgacc

SEQ ID NO: 49326 - DNA, 22 bp, Artificial Sequence
  chemically synthesized
ggtgcaggtacagaggaaaacc

SEQ ID NO: 49327 - DNA, 22 bp, Artificial Sequence
  chemically synthesized
ttgtcgagtgtggcccgtagtt

SEQ ID NO: 49328 - DNA, 22 bp, Artificial Sequence
  chemically synthesized
tcgagtgtggcccgtagttccc

SEQ ID NO: 49329 - DNA, 22 bp, Artificial Sequence
  chemically synthesized
ccatttttgcctgaatggcaca

SEQ ID NO: 49330 - DNA, 22 bp, Artificial Sequence
  chemically synthesized
ttgcctgaatggcacatttgaa

SEQ ID NO: 49331 - DNA, 22 bp, Artificial Sequence
  chemically synthesized
tgcctgaatggcacatttgaaa

SEQ ID NO: 49332 - DNA, 22 bp, Artificial Sequence
  chemically synthesized
gcctgaatggcacatttgaaag

SEQ ID NO: 49333 - DNA, 22 bp, Artificial Sequence
  chemically synthesized
cctgaatggcacatttgaaagt

SEQ ID NO: 49334 - DNA, 22 bp, Artificial Sequence
  chemically synthesized
aatggcacatttgaaagtgtta

SEQ ID NO: 49335 - DNA, 22 bp, Artificial Sequence
  chemically synthesized
gaaagtgttatataaccatgtg

SEQ ID NO: 49336 - DNA, 22 bp, Artificial Sequence
  chemically synthesized
aaagtgttatataaccatgtga

SEQ ID NO: 49337 - DNA, 22 bp, Artificial Sequence
  chemically synthesized
tataaccatgtgaataataata

SEQ ID NO: 49338 - DNA, 22 bp, Artificial Sequence
  chemically synthesized
gcctatatgagttctttaattt

SEQ ID NO: 49339 - DNA, 22 bp, Artificial Sequence
  chemically synthesized
tatgagttctttaatttgcttt

SEQ ID NO: 49340 - DNA, 22 bp, Artificial Sequence
  chemically synthesized
tttaatttgctttttggtccgc

SEQ ID NO: 49341 - DNA, 22 bp, Artificial Sequence
  chemically synthesized
taatttgctttttggtccgcat

SEQ ID NO: 49342 - DNA, 22 bp, Artificial Sequence
  chemically synthesized
aatttgctttttggtccgcatt

SEQ ID NO: 49343 - DNA, 22 bp, Artificial Sequence
  chemically synthesized
atttgctttttggtccgcattt

SEQ ID NO: 49344 - DNA, 22 bp, Artificial Sequence
  chemically synthesized
gctttttggtccgcatttggta

SEQ ID NO: 49345 - DNA, 22 bp, Artificial Sequence
  chemically synthesized
ctttttggtccgcatttggtaa

SEQ ID NO: 49346 - DNA, 22 bp, Artificial Sequence
  chemically synthesized
tttggtccgcatttggtaactt

SEQ ID NO: 49347 - DNA, 22 bp, Artificial Sequence
  chemically synthesized
ttggtccgcatttggtaacttc

SEQ ID NO: 49348 - DNA, 22 bp, Artificial Sequence
  chemically synthesized
tggtccgcatttggtaacttct

SEQ ID NO: 49349 - DNA, 22 bp, Artificial Sequence
  chemically synthesized
ggtccgcatttggtaacttctt

SEQ ID NO: 49350 - DNA, 22 bp, Artificial Sequence
  chemically synthesized
gtccgcatttggtaacttcttt

SEQ ID NO: 49351 - DNA, 22 bp, Artificial Sequence
  chemically synthesized
ggtaacttctttatcatctact

SEQ ID NO: 49352 - DNA, 22 bp, Artificial Sequence
  chemically synthesized
gtaacttctttatcatctacta

SEQ ID NO: 49353 - DNA, 22 bp, Artificial Sequence
  chemically synthesized
ctttatcatctactatactctg

SEQ ID NO: 49354 - DNA, 22 bp, Artificial Sequence
  chemically synthesized
tttatcatctactatactctgt

SEQ ID NO: 49355 - DNA, 22 bp, Artificial Sequence
  chemically synthesized
tatcatctactatactctgttg

SEQ ID NO: 49356 - DNA, 22 bp, Artificial Sequence
  chemically synthesized
atcatctactatactctgttgt

SEQ ID NO: 49357 - DNA, 22 bp, Artificial Sequence
  chemically synthesized
tcatctactatactctgttgtg

SEQ ID NO: 49358 - DNA, 22 bp, Artificial Sequence
  chemically synthesized
ctatactctgttgtgtctcttt

SEQ ID NO: 49359 - DNA, 22 bp, Artificial Sequence
  chemically synthesized
tactctgttgtgtctcttttgt

SEQ ID NO: 49360 - DNA, 22 bp, Artificial Sequence
  chemically synthesized
tgttgtgtctcttttgttgtaa

SEQ ID NO: 49361 - DNA, 22 bp, Artificial Sequence
  chemically synthesized
ttgtgtctcttttgttgtaatt

SEQ ID NO: 49362 - DNA, 22 bp, Artificial Sequence
  chemically synthesized
tgtctcttttgttgtaatttgt

SEQ ID NO: 49363 - DNA, 22 bp, Artificial Sequence
  chemically synthesized
ttttgttgtaatttgtaagtag

SEQ ID NO: 49364 - DNA, 22 bp, Artificial Sequence
  chemically synthesized
ttgttgtaatttgtaagtaggg

SEQ ID NO: 49365 - DNA, 22 bp, Artificial Sequence
  chemically synthesized
tgttgtaatttgtaagtagggg

SEQ ID NO: 49366 - DNA, 22 bp, Artificial Sequence
  chemically synthesized
gttgtaatttgtaagtaggggt

SEQ ID NO: 49367 - DNA, 22 bp, Artificial Sequence
  chemically synthesized
ttgtaatttgtaagtaggggtg

SEQ ID NO: 49368 - DNA, 22 bp, Artificial Sequence
  chemically synthesized
taatttgtaagtaggggtgaga

SEQ ID NO: 49369 - DNA, 22 bp, Artificial Sequence
  chemically synthesized
gtaagtaggggtgagataaagt

SEQ ID NO: 49370 - DNA, 22 bp, Artificial Sequence
  chemically synthesized
taagtaggggtgagataaagta

SEQ ID NO: 49371 - DNA, 22 bp, Artificial Sequence
  chemically synthesized
gggtttgctgggtttcttccat

SEQ ID NO: 49372 - DNA, 22 bp, Artificial Sequence
  chemically synthesized
gctgggtttcttccatgtcatc

SEQ ID NO: 49373 - DNA, 22 bp, Artificial Sequence
  chemically synthesized
ctgggtttcttccatgtcatca

SEQ ID NO: 49374 - DNA, 22 bp, Artificial Sequence
  chemically synthesized
ggtttcttccatgtcatcatgt

SEQ ID NO: 49375 - DNA, 22 bp, Artificial Sequence
  chemically synthesized
cttccatgtcatcatgttcctc

SEQ ID NO: 49376 - DNA, 22 bp, Artificial Sequence
  chemically synthesized
ttccatgtcatcatgttcctcc

SEQ ID NO: 49377 - DNA, 22 bp, Artificial Sequence
  chemically synthesized
ccatgtcatcatgttcctcctt

SEQ ID NO: 49378 - DNA, 22 bp, Artificial Sequence
  chemically synthesized
catgtcatcatgttcctccttg

SEQ ID NO: 49379 - DNA, 22 bp, Artificial Sequence
  chemically synthesized
ctccttgcatggggccaggatc

SEQ ID NO: 49380 - DNA, 22 bp, Artificial Sequence
  chemically synthesized
cttgcatggggccaggatccgt

SEQ ID NO: 49381 - DNA, 22 bp, Artificial Sequence
  chemically synthesized
gcatggggccaggatccgtgga

SEQ ID NO: 49382 - DNA, 22 bp, Artificial Sequence
  chemically synthesized
catggggccaggatccgtggag

SEQ ID NO: 49383 - DNA, 22 bp, Artificial Sequence
  chemically synthesized
cctggcacctacgtggtggtgc

SEQ ID NO: 49384 - DNA, 22 bp, Artificial Sequence
  chemically synthesized
gcacctacgtggtggtgctgaa

SEQ ID NO: 49385 - DNA, 22 bp, Artificial Sequence
  chemically synthesized
cgtggtggtgctgaaggaggag

SEQ ID NO: 49386 - DNA, 22 bp, Artificial Sequence
  chemically synthesized
aaggaggagacccacctctcgc

SEQ ID NO: 49387 - DNA, 22 bp, Artificial Sequence
  chemically synthesized
tcgcagtcagagcgcactgccc

SEQ ID NO: 49388 - DNA, 22 bp, Artificial Sequence
  chemically synthesized
gcagtcagagcgcactgcccgc

SEQ ID NO: 49389 - DNA, 22 bp, Artificial Sequence
  chemically synthesized
cccgccgcctgcaggcccaggc

SEQ ID NO: 49390 - DNA, 22 bp, Artificial Sequence
  chemically synthesized
caggcccaggctgcccgccggg

SEQ ID NO: 49391 - DNA, 22 bp, Artificial Sequence
  chemically synthesized
cccgccggggatacctcaccaa

SEQ ID NO: 49392 - DNA, 22 bp, Artificial Sequence
  chemically synthesized
accaagatcctgcatgtcttcc

SEQ ID NO: 49393 - DNA, 22 bp, Artificial Sequence
  chemically synthesized
catgtcttccatggccttcttc

SEQ ID NO: 49394 - DNA, 22 bp, Artificial Sequence
  chemically synthesized
ccatggccttcttcctggcttc

SEQ ID NO: 49395 - DNA, 22 bp, Artificial Sequence
  chemically synthesized
catggccttcttcctggcttcc

SEQ ID NO: 49396 - DNA, 22 bp, Artificial Sequence
  chemically synthesized
cttcctggcttcctggtgaaga

SEQ ID NO: 49397 - DNA, 22 bp, Artificial Sequence
  chemically synthesized
ttcctggcttcctggtgaagat

SEQ ID NO: 49398 - DNA, 22 bp, Artificial Sequence
  chemically synthesized
cctggcttcctggtgaagatga

SEQ ID NO: 49399 - DNA, 22 bp, Artificial Sequence
  chemically synthesized
ctggcttcctggtgaagatgag

SEQ ID NO: 49400 - DNA, 22 bp, Artificial Sequence
  chemically synthesized
gcttcctggtgaagatgagtgg

SEQ ID NO: 49401 - DNA, 22 bp, Artificial Sequence
  chemically synthesized
cctggtgaagatgagtggcgac

SEQ ID NO: 49402 - DNA, 22 bp, Artificial Sequence
  chemically synthesized
ctggtgaagatgagtggcgacc

SEQ ID NO: 49403 - DNA, 22 bp, Artificial Sequence
  chemically synthesized
gtgaagatgagtggcgacctgc

SEQ ID NO: 49404 - DNA, 22 bp, Artificial Sequence
  chemically synthesized
ctggagctggtgagccaccctt

SEQ ID NO: 49405 - DNA, 22 bp, Artificial Sequence
  chemically synthesized
gagctggtgagccacccttttt

SEQ ID NO: 49406 - DNA, 22 bp, Artificial Sequence
  chemically synthesized
gtgagccaccctttttgggaat

SEQ ID NO: 49407 - DNA, 22 bp, Artificial Sequence
  chemically synthesized
tttgggaatggcacttcctgat

SEQ ID NO: 49408 - DNA, 22 bp, Artificial Sequence
  chemically synthesized
ttgggaatggcacttcctgata

SEQ ID NO: 49409 - DNA, 22 bp, Artificial Sequence
  chemically synthesized
tgggaatggcacttcctgatag

SEQ ID NO: 49410 - DNA, 22 bp, Artificial Sequence
  chemically synthesized
gggaatggcacttcctgatagg

SEQ ID NO: 49411 - DNA, 22 bp, Artificial Sequence
  chemically synthesized
ggaatggcacttcctgataggg

SEQ ID NO: 49412 - DNA, 22 bp, Artificial Sequence
  chemically synthesized
cctgatagggctgggccactgc

SEQ ID NO: 49413 - DNA, 22 bp, Artificial Sequence
  chemically synthesized
ctgatagggctgggccactgca

SEQ ID NO: 49414 - DNA, 22 bp, Artificial Sequence
  chemically synthesized
atagggctgggccactgcatat

SEQ ID NO: 49415 - DNA, 22 bp, Artificial Sequence
  chemically synthesized
ggccactgcatatacactgggg

SEQ ID NO: 49416 - DNA, 22 bp, Artificial Sequence
  chemically synthesized
catatacactggggactgtgct

SEQ ID NO: 49417 - DNA, 22 bp, Artificial Sequence
  chemically synthesized
gggactgtgcttagtaggccca

SEQ ID NO: 49418 - DNA, 22 bp, Artificial Sequence
  chemically synthesized
tgcttagtaggcccattgctga

SEQ ID NO: 49419 - DNA, 22 bp, Artificial Sequence
  chemically synthesized
agtaggcccattgctgaaaatc

SEQ ID NO: 49420 - DNA, 22 bp, Artificial Sequence
  chemically synthesized
gtaggcccattgctgaaaatca

SEQ ID NO: 49421 - DNA, 22 bp, Artificial Sequence
  chemically synthesized
ctgaaaatcagaaggggacagc

SEQ ID NO: 49422 - DNA, 22 bp, Artificial Sequence
  chemically synthesized
aaaatcagaaggggacagcaag

SEQ ID NO: 49423 - DNA, 22 bp, Artificial Sequence
  chemically synthesized
agcacttatcgggtaccaagca

SEQ ID NO: 49424 - DNA, 22 bp, Artificial Sequence
  chemically synthesized
atcgggtaccaagcacagtaac

SEQ ID NO: 49425 - DNA, 22 bp, Artificial Sequence
  chemically synthesized
tcgggtaccaagcacagtaact

SEQ ID NO: 49426 - DNA, 22 bp, Artificial Sequence
  chemically synthesized
ctggctttctgtatagaattcc

SEQ ID NO: 49427 - DNA, 22 bp, Artificial Sequence
  chemically synthesized
gctttctgtatagaattccctt

SEQ ID NO: 49428 - DNA, 22 bp, Artificial Sequence
  chemically synthesized
tctgtatagaattccctttaag

SEQ ID NO: 49429 - DNA, 22 bp, Artificial Sequence
  chemically synthesized
ctgtatagaattccctttaagc

SEQ ID NO: 49430 - DNA, 22 bp, Artificial Sequence
  chemically synthesized
tgtatagaattccctttaagcc

SEQ ID NO: 49431 - DNA, 22 bp, Artificial Sequence
  chemically synthesized
tatagaattccctttaagcctg

SEQ ID NO: 49432 - DNA, 22 bp, Artificial Sequence
  chemically synthesized
cctttaagcctggccatgcccc

SEQ ID NO: 49433 - DNA, 22 bp, Artificial Sequence
  chemically synthesized
taagcctggccatgccccagtg

SEQ ID NO: 49434 - DNA, 22 bp, Artificial Sequence
  chemically synthesized
aagcctggccatgccccagtgg

SEQ ID NO: 49435 - DNA, 22 bp, Artificial Sequence
  chemically synthesized
agcctggccatgccccagtggt

SEQ ID NO: 49436 - DNA, 22 bp, Artificial Sequence
  chemically synthesized
gccatgccccagtggtacgtct

SEQ ID NO: 49437 - DNA, 22 bp, Artificial Sequence
  chemically synthesized
tcttcatttgaaagacgaggag

SEQ ID NO: 49438 - DNA, 22 bp, Artificial Sequence
  chemically synthesized
catttgaaagacgaggagactg

SEQ ID NO: 49439 - DNA, 22 bp, Artificial Sequence
  chemically synthesized
atttgaaagacgaggagactga

SEQ ID NO: 49440 - DNA, 22 bp, Artificial Sequence
  chemically synthesized
gaaagacgaggagactgaagtt

SEQ ID NO: 49441 - DNA, 22 bp, Artificial Sequence
  chemically synthesized
aaagacgaggagactgaagttc

SEQ ID NO: 49442 - DNA, 22 bp, Artificial Sequence
  chemically synthesized
aagttcagaggggaccacacag

SEQ ID NO: 49443 - DNA, 22 bp, Artificial Sequence
  chemically synthesized
agaggggaccacacagacagct

SEQ ID NO: 49444 - DNA, 22 bp, Artificial Sequence
  chemically synthesized
ggggtagagcctggatcaaacc

SEQ ID NO: 49445 - DNA, 22 bp, Artificial Sequence
  chemically synthesized
gatcaaacccattggtctgcct

SEQ ID NO: 49446 - DNA, 22 bp, Artificial Sequence
  chemically synthesized
gtctgcctgccagccattcttg

SEQ ID NO: 49447 - DNA, 22 bp, Artificial Sequence
  chemically synthesized
cctgccagccattcttgtgcca

SEQ ID NO: 49448 - DNA, 22 bp, Artificial Sequence
  chemically synthesized
ccagccattcttgtgccaatgc

SEQ ID NO: 49449 - DNA, 22 bp, Artificial Sequence
  chemically synthesized
ttgtgccaatgcatctgctgcc

SEQ ID NO: 49450 - DNA, 22 bp, Artificial Sequence
  chemically synthesized
gtgccaatgcatctgctgccta

SEQ ID NO: 49451 - DNA, 22 bp, Artificial Sequence
  chemically synthesized
tgccaatgcatctgctgcctac

SEQ ID NO: 49452 - DNA, 22 bp, Artificial Sequence
  chemically synthesized
ctgcctacggaaacctgtaggg

SEQ ID NO: 49453 - DNA, 22 bp, Artificial Sequence
  chemically synthesized
cctacggaaacctgtagggaca

SEQ ID NO: 49454 - DNA, 22 bp, Artificial Sequence
  chemically synthesized
cggaaacctgtagggacaaggc

SEQ ID NO: 49455 - DNA, 22 bp, Artificial Sequence
  chemically synthesized
tagggacaaggccctgggatgt

SEQ ID NO: 49456 - DNA, 22 bp, Artificial Sequence
  chemically synthesized
ggatgttcagtggagcctgagt

SEQ ID NO: 49457 - DNA, 22 bp, Artificial Sequence
  chemically synthesized
agtggagcctgagtcattttat

SEQ ID NO: 49458 - DNA, 22 bp, Artificial Sequence
  chemically synthesized
agtcattttataaaaaagcatg

SEQ ID NO: 49459 - DNA, 22 bp, Artificial Sequence
  chemically synthesized
tataaaaaagcatgactctagg

SEQ ID NO: 49460 - DNA, 22 bp, Artificial Sequence
  chemically synthesized
ataaaaaagcatgactctaggg

SEQ ID NO: 49461 - DNA, 22 bp, Artificial Sequence
  chemically synthesized
taaaaaagcatgactctagggt

SEQ ID NO: 49462 - DNA, 22 bp, Artificial Sequence
  chemically synthesized
tagggtccaaaattcctttgaa

SEQ ID NO: 49463 - DNA, 22 bp, Artificial Sequence
  chemically synthesized
gggtccaaaattcctttgaagc

SEQ ID NO: 49464 - DNA, 22 bp, Artificial Sequence
  chemically synthesized
ctttgaagctgttgctatccag

SEQ ID NO: 49465 - DNA, 22 bp, Artificial Sequence
  chemically synthesized
tgaagctgttgctatccagagt

SEQ ID NO: 49466 - DNA, 22 bp, Artificial Sequence
  chemically synthesized
gaagctgttgctatccagagtg

SEQ ID NO: 49467 - DNA, 22 bp, Artificial Sequence
  chemically synthesized
aagctgttgctatccagagtga

SEQ ID NO: 49468 - DNA, 22 bp, Artificial Sequence
  chemically synthesized
ttgctatccagagtgaagtccc

SEQ ID NO: 49469 - DNA, 22 bp, Artificial Sequence
  chemically synthesized
ctatccagagtgaagtcccttc

SEQ ID NO: 49470 - DNA, 22 bp, Artificial Sequence
  chemically synthesized
tccagagtgaagtcccttcttt

SEQ ID NO: 49471 - DNA, 22 bp, Artificial Sequence
  chemically synthesized
ctttaggacagggtggccctcc

SEQ ID NO: 49472 - DNA, 22 bp, Artificial Sequence
  chemically synthesized
tttaggacagggtggccctcct

SEQ ID NO: 49473 - DNA, 22 bp, Artificial Sequence
  chemically synthesized
taggacagggtggccctcctcc

SEQ ID NO: 49474 - DNA, 22 bp, Artificial Sequence
  chemically synthesized
aggacagggtggccctcctccc

SEQ ID NO: 49475 - DNA, 22 bp, Artificial Sequence
  chemically synthesized
ggacagggtggccctcctccct

SEQ ID NO: 49476 - DNA, 22 bp, Artificial Sequence
  chemically synthesized
ctccctcctggatgtcacatct

SEQ ID NO: 49477 - DNA, 22 bp, Artificial Sequence
  chemically synthesized
cctcctggatgtcacatcttcg

SEQ ID NO: 49478 - DNA, 22 bp, Artificial Sequence
  chemically synthesized
ctggatgtcacatcttcggtgg

SEQ ID NO: 49479 - DNA, 22 bp, Artificial Sequence
  chemically synthesized
gatgtcacatcttcggtggagg

SEQ ID NO: 49480 - DNA, 22 bp, Artificial Sequence
  chemically synthesized
cggtggaggggcagaaagggga

SEQ ID NO: 49481 - DNA, 22 bp, Artificial Sequence
  chemically synthesized
ggtggaggggcagaaaggggac

SEQ ID NO: 49482 - DNA, 22 bp, Artificial Sequence
  chemically synthesized
ggtattctcctcaccctggccc

SEQ ID NO: 49483 - DNA, 22 bp, Artificial Sequence
  chemically synthesized
tcctcaccctggccctagtgct

SEQ ID NO: 49484 - DNA, 22 bp, Artificial Sequence
  chemically synthesized
ctcaccctggccctagtgcttc

SEQ ID NO: 49485 - DNA, 22 bp, Artificial Sequence
  chemically synthesized
accctggccctagtgcttcaaa

SEQ ID NO: 49486 - DNA, 22 bp, Artificial Sequence
  chemically synthesized
gccctagtgcttcaaatcttaa

SEQ ID NO: 49487 - DNA, 22 bp, Artificial Sequence
  chemically synthesized
gtgcttcaaatcttaaaaaaac

SEQ ID NO: 49488 - DNA, 22 bp, Artificial Sequence
  chemically synthesized
caaatcttaaaaaaacgttttt

SEQ ID NO: 49489 - DNA, 22 bp, Artificial Sequence
  chemically synthesized
aaatcttaaaaaaacgttttta

SEQ ID NO: 49490 - DNA, 22 bp, Artificial Sequence
  chemically synthesized
aaaaaaacgtttttatttgtgc

SEQ ID NO: 49491 - DNA, 22 bp, Artificial Sequence
  chemically synthesized
aaaaaacgtttttatttgtgct

SEQ ID NO: 49492 - DNA, 22 bp, Artificial Sequence
  chemically synthesized
ttatttgtgcttctgcaccacc

SEQ ID NO: 49493 - DNA, 22 bp, Artificial Sequence
  chemically synthesized
tatttgtgcttctgcaccacct

SEQ ID NO: 49494 - DNA, 22 bp, Artificial Sequence
  chemically synthesized
atttgtgcttctgcaccacctt

SEQ ID NO: 49495 - DNA, 22 bp, Artificial Sequence
  chemically synthesized
tttgtgcttctgcaccaccttc

SEQ ID NO: 49496 - DNA, 22 bp, Artificial Sequence
  chemically synthesized
gtgcttctgcaccaccttctag

SEQ ID NO: 49497 - DNA, 22 bp, Artificial Sequence
  chemically synthesized
tgcttctgcaccaccttctagc

SEQ ID NO: 49498 - DNA, 22 bp, Artificial Sequence
  chemically synthesized
gaaggtggtgcagaagcacaaa

SEQ ID NO: 49499 - DNA, 22 bp, Artificial Sequence
  chemically synthesized
ttttaagatttgaagcactagg

SEQ ID NO: 49500 - DNA, 22 bp, Artificial Sequence
  chemically synthesized
tttaagatttgaagcactaggg

SEQ ID NO: 49501 - DNA, 22 bp, Artificial Sequence
  chemically synthesized
ttaagatttgaagcactagggc

SEQ ID NO: 49502 - DNA, 22 bp, Artificial Sequence
  chemically synthesized
taagatttgaagcactagggcc

SEQ ID NO: 49503 - DNA, 22 bp, Artificial Sequence
  chemically synthesized
aagatttgaagcactagggcca

SEQ ID NO: 49504 - DNA, 22 bp, Artificial Sequence
  chemically synthesized
agatttgaagcactagggccag

SEQ ID NO: 49505 - DNA, 22 bp, Artificial Sequence
  chemically synthesized
gaagcactagggccagggtgag

SEQ ID NO: 49506 - DNA, 22 bp, Artificial Sequence
  chemically synthesized
aagcactagggccagggtgagg

SEQ ID NO: 49507 - DNA, 22 bp, Artificial Sequence
  chemically synthesized
gggccagggtgaggagaatacc

SEQ ID NO: 49508 - DNA, 22 bp, Artificial Sequence
  chemically synthesized
tctgcccctccaccgaagatgt

SEQ ID NO: 49509 - DNA, 22 bp, Artificial Sequence
  chemically synthesized
ctgcccctccaccgaagatgtg

SEQ ID NO: 49510 - DNA, 22 bp, Artificial Sequence
  chemically synthesized
tgcccctccaccgaagatgtga

SEQ ID NO: 49511 - DNA, 22 bp, Artificial Sequence
  chemically synthesized
cccctccaccgaagatgtgaca

SEQ ID NO: 49512 - DNA, 22 bp, Artificial Sequence
  chemically synthesized
caccgaagatgtgacatccagg

SEQ ID NO: 49513 - DNA, 22 bp, Artificial Sequence
  chemically synthesized
tcctaaagaagggacttcactc

SEQ ID NO: 49514 - DNA, 22 bp, Artificial Sequence
  chemically synthesized
aagaagggacttcactctggat

SEQ ID NO: 49515 - DNA, 22 bp, Artificial Sequence
  chemically synthesized
cactctggatagcaacagcttc

SEQ ID NO: 49516 - DNA, 22 bp, Artificial Sequence
  chemically synthesized
actctggatagcaacagcttca

SEQ ID NO: 49517 - DNA, 22 bp, Artificial Sequence
  chemically synthesized
tggatagcaacagcttcaaagg

SEQ ID NO: 49518 - DNA, 22 bp, Artificial Sequence
  chemically synthesized
gatagcaacagcttcaaaggaa

SEQ ID NO: 49519 - DNA, 22 bp, Artificial Sequence
  chemically synthesized
caaaggaattttggaccctaga

SEQ ID NO: 49520 - DNA, 22 bp, Artificial Sequence
  chemically synthesized
aaaggaattttggaccctagag

SEQ ID NO: 49521 - DNA, 22 bp, Artificial Sequence
  chemically synthesized
tggaccctagagtcatgctttt

SEQ ID NO: 49522 - DNA, 22 bp, Artificial Sequence
  chemically synthesized
ggaccctagagtcatgcttttt

SEQ ID NO: 49523 - DNA, 22 bp, Artificial Sequence
  chemically synthesized
gaccctagagtcatgctttttt

SEQ ID NO: 49524 - DNA, 22 bp, Artificial Sequence
  chemically synthesized
gagtcatgcttttttataaaat

SEQ ID NO: 49525 - DNA, 22 bp, Artificial Sequence
  chemically synthesized
ttttataaaatgactcaggctc

SEQ ID NO: 49526 - DNA, 22 bp, Artificial Sequence
  chemically synthesized
tttataaaatgactcaggctcc

SEQ ID NO: 49527 - DNA, 22 bp, Artificial Sequence
  chemically synthesized
ttataaaatgactcaggctcca

SEQ ID NO: 49528 - DNA, 22 bp, Artificial Sequence
  chemically synthesized
tataaaatgactcaggctccac

SEQ ID NO: 49529 - DNA, 22 bp, Artificial Sequence
  chemically synthesized
ataaaatgactcaggctccact

SEQ ID NO: 49530 - DNA, 22 bp, Artificial Sequence
  chemically synthesized
taaaatgactcaggctccactg

SEQ ID NO: 49531 - DNA, 22 bp, Artificial Sequence
  chemically synthesized
aggctccactgaacatcccagg

SEQ ID NO: 49532 - DNA, 22 bp, Artificial Sequence
  chemically synthesized
cactgaacatcccagggccttg

SEQ ID NO: 49533 - DNA, 22 bp, Artificial Sequence
  chemically synthesized
aacatcccagggccttgtccct

SEQ ID NO: 49534 - DNA, 22 bp, Artificial Sequence
  chemically synthesized
gtccctacaggtttccgtaggc

SEQ ID NO: 49535 - DNA, 22 bp, Artificial Sequence
  chemically synthesized
tccctacaggtttccgtaggca

SEQ ID NO: 49536 - DNA, 22 bp, Artificial Sequence
  chemically synthesized
caggtttccgtaggcagcagat

SEQ ID NO: 49537 - DNA, 22 bp, Artificial Sequence
  chemically synthesized
ccgtaggcagcagatgcattgg

SEQ ID NO: 49538 - DNA, 22 bp, Artificial Sequence
  chemically synthesized
cgtaggcagcagatgcattggc

SEQ ID NO: 49539 - DNA, 22 bp, Artificial Sequence
  chemically synthesized
gcacaagaatggctggcaggca

SEQ ID NO: 49540 - DNA, 22 bp, Artificial Sequence
  chemically synthesized
gcaggcagaccaatgggtttga

SEQ ID NO: 49541 - DNA, 22 bp, Artificial Sequence
  chemically synthesized
gatccaggctctacccctagct

SEQ ID NO: 49542 - DNA, 22 bp, Artificial Sequence
  chemically synthesized
atccaggctctacccctagctg

SEQ ID NO: 49543 - DNA, 22 bp, Artificial Sequence
  chemically synthesized
tacccctagctgtctgtgtggt

SEQ ID NO: 49544 - DNA, 22 bp, Artificial Sequence
  chemically synthesized
cccctagctgtctgtgtggtcc

SEQ ID NO: 49545 - DNA, 22 bp, Artificial Sequence
  chemically synthesized
gctgtctgtgtggtcccctctg

SEQ ID NO: 49546 - DNA, 22 bp, Artificial Sequence
  chemically synthesized
tctgtgtggtcccctctgaact

SEQ ID NO: 49547 - DNA, 22 bp, Artificial Sequence
  chemically synthesized
tgtggtcccctctgaacttcag

SEQ ID NO: 49548 - DNA, 22 bp, Artificial Sequence
  chemically synthesized
tgaacttcagtctcctcgtctt

SEQ ID NO: 49549 - DNA, 22 bp, Artificial Sequence
  chemically synthesized
aacttcagtctcctcgtctttc

SEQ ID NO: 49550 - DNA, 22 bp, Artificial Sequence
  chemically synthesized
cagtctcctcgtctttcaaatg

SEQ ID NO: 49551 - DNA, 22 bp, Artificial Sequence
  chemically synthesized
agtctcctcgtctttcaaatga

SEQ ID NO: 49552 - DNA, 22 bp, Artificial Sequence
  chemically synthesized
ctcgtctttcaaatgaagatag

SEQ ID NO: 49553 - DNA, 22 bp, Artificial Sequence
  chemically synthesized
gtctttcaaatgaagatagacg

SEQ ID NO: 49554 - DNA, 22 bp, Artificial Sequence
  chemically synthesized
tcaaatgaagatagacgtacca

SEQ ID NO: 49555 - DNA, 22 bp, Artificial Sequence
  chemically synthesized
caaatgaagatagacgtaccac

SEQ ID NO: 49556 - DNA, 22 bp, Artificial Sequence
  chemically synthesized
aaatgaagatagacgtaccact

SEQ ID NO: 49557 - DNA, 22 bp, Artificial Sequence
  chemically synthesized
gggcatggccaggcttaaaggg

SEQ ID NO: 49558 - DNA, 22 bp, Artificial Sequence
  chemically synthesized
aaagggaattctatacagaaag

SEQ ID NO: 49559 - DNA, 22 bp, Artificial Sequence
  chemically synthesized
aagggaattctatacagaaagc

SEQ ID NO: 49560 - DNA, 22 bp, Artificial Sequence
  chemically synthesized
tatacagaaagccagtagttac

SEQ ID NO: 49561 - DNA, 22 bp, Artificial Sequence
  chemically synthesized
tacagaaagccagtagttactg

SEQ ID NO: 49562 - DNA, 22 bp, Artificial Sequence
  chemically synthesized
ctgtgcttggtacccgataagt

SEQ ID NO: 49563 - DNA, 22 bp, Artificial Sequence
  chemically synthesized
tgcttggtacccgataagtgct

SEQ ID NO: 49564 - DNA, 22 bp, Artificial Sequence
  chemically synthesized
ggtacccgataagtgctcaata

SEQ ID NO: 49565 - DNA, 22 bp, Artificial Sequence
  chemically synthesized
gtacccgataagtgctcaatac

SEQ ID NO: 49566 - DNA, 22 bp, Artificial Sequence
  chemically synthesized
aatacatacttgctgtcccctt

SEQ ID NO: 49567 - DNA, 22 bp, Artificial Sequence
  chemically synthesized
gctgtccccttctgattttcag

SEQ ID NO: 49568 - DNA, 22 bp, Artificial Sequence
  chemically synthesized
ctgtccccttctgattttcagc

SEQ ID NO: 49569 - DNA, 22 bp, Artificial Sequence
  chemically synthesized
tccccttctgattttcagcaat

SEQ ID NO: 49570 - DNA, 22 bp, Artificial Sequence
  chemically synthesized
ctgattttcagcaatgggccta

SEQ ID NO: 49571 - DNA, 22 bp, Artificial Sequence
  chemically synthesized
tgattttcagcaatgggcctac

SEQ ID NO: 49572 - DNA, 22 bp, Artificial Sequence
  chemically synthesized
attttcagcaatgggcctacta

SEQ ID NO: 49573 - DNA, 22 bp, Artificial Sequence
  chemically synthesized
tcagcaatgggcctactaagca

SEQ ID NO: 49574 - DNA, 22 bp, Artificial Sequence
  chemically synthesized
cagcaatgggcctactaagcac

SEQ ID NO: 49575 - DNA, 22 bp, Artificial Sequence
  chemically synthesized
agcaatgggcctactaagcaca

SEQ ID NO: 49576 - DNA, 22 bp, Artificial Sequence
  chemically synthesized
ctaagcacagtccccagtgtat

SEQ ID NO: 49577 - DNA, 22 bp, Artificial Sequence
  chemically synthesized
agcacagtccccagtgtatatg

SEQ ID NO: 49578 - DNA, 22 bp, Artificial Sequence
  chemically synthesized
tcaggaagtgccattcccaaaa

SEQ ID NO: 49579 - DNA, 22 bp, Artificial Sequence
  chemically synthesized
ccaaaaagggtggctcaccagc

SEQ ID NO: 49580 - DNA, 22 bp, Artificial Sequence
  chemically synthesized
accagctccagcaggtcgccac

SEQ ID NO: 49581 - DNA, 22 bp, Artificial Sequence
  chemically synthesized
cagcaggtcgccactcatcttc

SEQ ID NO: 49582 - DNA, 22 bp, Artificial Sequence
  chemically synthesized
atcttcaccaggaagccaggaa

SEQ ID NO: 49583 - DNA, 22 bp, Artificial Sequence
  chemically synthesized
caccaggaagccaggaagaagg

SEQ ID NO: 49584 - DNA, 22 bp, Artificial Sequence
  chemically synthesized
accaggaagccaggaagaaggc

SEQ ID NO: 49585 - DNA, 22 bp, Artificial Sequence
  chemically synthesized
ggtgaggtatccccggcgggca

SEQ ID NO: 49586 - DNA, 22 bp, Artificial Sequence
  chemically synthesized
gtgaggtatccccggcgggcag

SEQ ID NO: 49587 - DNA, 22 bp, Artificial Sequence
  chemically synthesized
ggcctgcaggcggcgggcagtg

SEQ ID NO: 49588 - DNA, 22 bp, Artificial Sequence
  chemically synthesized
caggcggcgggcagtgcgctct

SEQ ID NO: 49589 - DNA, 22 bp, Artificial Sequence
  chemically synthesized
tgactgcgagaggtgggtctcc

SEQ ID NO: 49590 - DNA, 22 bp, Artificial Sequence
  chemically synthesized
actgcgagaggtgggtctcctc

SEQ ID NO: 49591 - DNA, 22 bp, Artificial Sequence
  chemically synthesized
cgagaggtgggtctcctccttc

SEQ ID NO: 49592 - DNA, 22 bp, Artificial Sequence
  chemically synthesized
ctccttcagcaccaccacgtag

SEQ ID NO: 49593 - DNA, 22 bp, Artificial Sequence
  chemically synthesized
cttcagcaccaccacgtaggtg

SEQ ID NO: 49594 - DNA, 22 bp, Artificial Sequence
  chemically synthesized
cagcaccaccacgtaggtgcca

SEQ ID NO: 49595 - DNA, 22 bp, Artificial Sequence
  chemically synthesized
agcaccaccacgtaggtgccag

SEQ ID NO: 49596 - DNA, 22 bp, Artificial Sequence
  chemically synthesized
cacggatcctggccccatgcaa

SEQ ID NO: 49597 - DNA, 22 bp, Artificial Sequence
  chemically synthesized
gccccatgcaaggaggaacatg

SEQ ID NO: 49598 - DNA, 22 bp, Artificial Sequence
  chemically synthesized
ggtgtactttatctcaccccta

SEQ ID NO: 49599 - DNA, 22 bp, Artificial Sequence
  chemically synthesized
tatctcacccctacttacaaat

SEQ ID NO: 49600 - DNA, 22 bp, Artificial Sequence
  chemically synthesized
atctcacccctacttacaaatt

SEQ ID NO: 49601 - DNA, 22 bp, Artificial Sequence
  chemically synthesized
tctcacccctacttacaaatta

SEQ ID NO: 49602 - DNA, 22 bp, Artificial Sequence
  chemically synthesized
acccctacttacaaattacaac

SEQ ID NO: 49603 - DNA, 22 bp, Artificial Sequence
  chemically synthesized
cttacaaattacaacaaaagag

SEQ ID NO: 49604 - DNA, 22 bp, Artificial Sequence
  chemically synthesized
acaaattacaacaaaagagaca

SEQ ID NO: 49605 - DNA, 22 bp, Artificial Sequence
  chemically synthesized
caaattacaacaaaagagacac

SEQ ID NO: 49606 - DNA, 22 bp, Artificial Sequence
  chemically synthesized
caacaaaagagacacaacagag

SEQ ID NO: 49607 - DNA, 22 bp, Artificial Sequence
  chemically synthesized
ccaaatgcggaccaaaaagcaa

SEQ ID NO: 49608 - DNA, 22 bp, Artificial Sequence
  chemically synthesized
aagaactcatataggccaacta

SEQ ID NO: 49609 - DNA, 22 bp, Artificial Sequence
  chemically synthesized
atataggccaactattattatt

SEQ ID NO: 49610 - DNA, 22 bp, Artificial Sequence
  chemically synthesized
ttattattcacatggttatata

SEQ ID NO: 49611 - DNA, 22 bp, Artificial Sequence
  chemically synthesized
ttattcacatggttatataaca

SEQ ID NO: 49612 - DNA, 22 bp, Artificial Sequence
  chemically synthesized
ttcacatggttatataacactt

SEQ ID NO: 49613 - DNA, 22 bp, Artificial Sequence
  chemically synthesized
acatggttatataacactttca

SEQ ID NO: 49614 - DNA, 22 bp, Artificial Sequence
  chemically synthesized
tataacactttcaaatgtgcca

SEQ ID NO: 49615 - DNA, 22 bp, Artificial Sequence
  chemically synthesized
tcaaatgtgccattcaggcaaa

SEQ ID NO: 49616 - DNA, 22 bp, Artificial Sequence
  chemically synthesized
caaatgtgccattcaggcaaaa

SEQ ID NO: 49617 - DNA, 22 bp, Artificial Sequence
  chemically synthesized
aaatgtgccattcaggcaaaaa

SEQ ID NO: 49618 - DNA, 22 bp, Artificial Sequence
  chemically synthesized
aggcaaaaatgggaactacggg

SEQ ID NO: 49619 - DNA, 22 bp, Artificial Sequence
  chemically synthesized
cgggccacactcgacaacaggt

SEQ ID NO: 49620 - DNA, 22 bp, Artificial Sequence
  chemically synthesized
gacaacaggttttcctctgtac

SEQ ID NO: 49621 - DNA, 22 bp, Artificial Sequence
  chemically synthesized
tcctctgtacctgcacccagct

SEQ ID NO: 49622 - DNA, 22 bp, Artificial Sequence
  chemically synthesized
cctctgtacctgcacccagctc

SEQ ID NO: 49623 - DNA, 22 bp, Artificial Sequence
  chemically synthesized
ctctgtacctgcacccagctct

SEQ ID NO: 49624 - DNA, 22 bp, Artificial Sequence
  chemically synthesized
tgtacctgcacccagctctcta

SEQ ID NO: 49625 - DNA, 22 bp, Artificial Sequence
  chemically synthesized
tacctgcacccagctctctacg

SEQ ID NO: 49626 - DNA, 22 bp, Artificial Sequence
  chemically synthesized
cacccagctctctacgggcctg

SEQ ID NO: 49627 - DNA, 22 bp, Artificial Sequence
  chemically synthesized
tctacgggcctggtcgctcctg

SEQ ID NO: 49628 - DNA, 22 bp, Artificial Sequence
  chemically synthesized
tacgggcctggtcgctcctggt

SEQ ID NO: 49629 - DNA, 22 bp, Artificial Sequence
  chemically synthesized
cgggcctggtcgctcctggtgg

SEQ ID NO: 49630 - DNA, 22 bp, Artificial Sequence
  chemically synthesized
gtcgctcctggtggccctgccc

SEQ ID NO: 49631 - DNA, 22 bp, Artificial Sequence
  chemically synthesized
ctggtggccctgcccaaaggcc

SEQ ID NO: 49632 - DNA, 22 bp, Artificial Sequence
  chemically synthesized
gtggccctgcccaaaggccacc

SEQ ID NO: 49633 - DNA, 22 bp, Artificial Sequence
  chemically synthesized
cccaaaggccaccccctccccc

SEQ ID NO: 49634 - DNA, 22 bp, Artificial Sequence
  chemically synthesized
ccccatgccccagtcagaataa

SEQ ID NO: 49635 - DNA, 22 bp, Artificial Sequence
  chemically synthesized
agggaaaaaatcatgggctttg

SEQ ID NO: 49636 - DNA, 22 bp, Artificial Sequence
  chemically synthesized
tggagccaggaaaccgtggacc

SEQ ID NO: 49637 - DNA, 22 bp, Artificial Sequence
  chemically synthesized
ggagccaggaaaccgtggacct

SEQ ID NO: 49638 - DNA, 22 bp, Artificial Sequence
  chemically synthesized
gagccaggaaaccgtggacctg

SEQ ID NO: 49639 - DNA, 22 bp, Artificial Sequence
  chemically synthesized
aattccagctccaatatttact

SEQ ID NO: 49640 - DNA, 22 bp, Artificial Sequence
  chemically synthesized
cagctccaatatttactggttg

SEQ ID NO: 49641 - DNA, 22 bp, Artificial Sequence
  chemically synthesized
caatatttactggttgtgcagc

SEQ ID NO: 49642 - DNA, 22 bp, Artificial Sequence
  chemically synthesized
actggttgtgcagccatgagca

SEQ ID NO: 49643 - DNA, 22 bp, Artificial Sequence
  chemically synthesized
ctggttgtgcagccatgagcaa

SEQ ID NO: 49644 - DNA, 22 bp, Artificial Sequence
  chemically synthesized
gttgtgcagccatgagcaagtc

SEQ ID NO: 49645 - DNA, 22 bp, Artificial Sequence
  chemically synthesized
tgcagccatgagcaagtcactc

SEQ ID NO: 49646 - DNA, 22 bp, Artificial Sequence
  chemically synthesized
aacctctcggagcctcagatac

SEQ ID NO: 49647 - DNA, 22 bp, Artificial Sequence
  chemically synthesized
tcggagcctcagatacctctgc

SEQ ID NO: 49648 - DNA, 22 bp, Artificial Sequence
  chemically synthesized
ggagcctcagatacctctgctg

SEQ ID NO: 49649 - DNA, 22 bp, Artificial Sequence
  chemically synthesized
agatacctctgctgtattgtag

SEQ ID NO: 49650 - DNA, 22 bp, Artificial Sequence
  chemically synthesized
tgctgtattgtagagaccacag

SEQ ID NO: 49651 - DNA, 22 bp, Artificial Sequence
  chemically synthesized
ctgtattgtagagaccacagta

SEQ ID NO: 49652 - DNA, 22 bp, Artificial Sequence
  chemically synthesized
tattgtagagaccacagtacct

SEQ ID NO: 49653 - DNA, 22 bp, Artificial Sequence
  chemically synthesized
tagagaccacagtacctatgac

SEQ ID NO: 49654 - DNA, 22 bp, Artificial Sequence
  chemically synthesized
tgacataggcctgctgggaaag

SEQ ID NO: 49655 - DNA, 22 bp, Artificial Sequence
  chemically synthesized
ctgggaaagtcaagagtgacgg

SEQ ID NO: 49656 - DNA, 22 bp, Artificial Sequence
  chemically synthesized
ggaaagtcaagagtgacggtta

SEQ ID NO: 49657 - DNA, 22 bp, Artificial Sequence
  chemically synthesized
tataaatctcccatccagatgc

SEQ ID NO: 49658 - DNA, 22 bp, Artificial Sequence
  chemically synthesized
ccatccagatgctctacaaatg

SEQ ID NO: 49659 - DNA, 22 bp, Artificial Sequence
  chemically synthesized
tacaaatgcaggcagaagggat

SEQ ID NO: 49660 - DNA, 22 bp, Artificial Sequence
  chemically synthesized
caaatgcaggcagaagggatga

SEQ ID NO: 49661 - DNA, 22 bp, Artificial Sequence
  chemically synthesized
agtgagcaaaggcaacacttct

SEQ ID NO: 49662 - DNA, 22 bp, Artificial Sequence
  chemically synthesized
cttaaagagagagaaaagtcaa

SEQ ID NO: 49663 - DNA, 22 bp, Artificial Sequence
  chemically synthesized
ttaaagagagagaaaagtcaag

SEQ ID NO: 49664 - DNA, 22 bp, Artificial Sequence
  chemically synthesized
aaagagagagaaaagtcaaggc

SEQ ID NO: 49665 - DNA, 22 bp, Artificial Sequence
  chemically synthesized
aagagagagaaaagtcaaggcc

SEQ ID NO: 49666 - DNA, 22 bp, Artificial Sequence
  chemically synthesized
tcttagtccttttgtgttgcta

SEQ ID NO: 49667 - DNA, 22 bp, Artificial Sequence
  chemically synthesized
agtccttttgtgttgctatata

SEQ ID NO: 49668 - DNA, 22 bp, Artificial Sequence
  chemically synthesized
gtccttttgtgttgctatataa

SEQ ID NO: 49669 - DNA, 22 bp, Artificial Sequence
  chemically synthesized
ttgtgttgctatataaaggaat

SEQ ID NO: 49670 - DNA, 22 bp, Artificial Sequence
  chemically synthesized
tgtgttgctatataaaggaata

SEQ ID NO: 49671 - DNA, 22 bp, Artificial Sequence
  chemically synthesized
gtgttgctatataaaggaatac

SEQ ID NO: 49672 - DNA, 22 bp, Artificial Sequence
  chemically synthesized
tgttgctatataaaggaatacc

SEQ ID NO: 49673 - DNA, 22 bp, Artificial Sequence
  chemically synthesized
ctatataaaggaatacctgaag

SEQ ID NO: 49674 - DNA, 22 bp, Artificial Sequence
  chemically synthesized
tataaaggaatacctgaaggtg

SEQ ID NO: 49675 - DNA, 22 bp, Artificial Sequence
  chemically synthesized
aaggtgagtaatttacaaggaa

SEQ ID NO: 49676 - DNA, 22 bp, Artificial Sequence
  chemically synthesized
acaaggaaaagggatttattca

SEQ ID NO: 49677 - DNA, 22 bp, Artificial Sequence
  chemically synthesized
caaggaaaagggatttattcag

SEQ ID NO: 49678 - DNA, 22 bp, Artificial Sequence
  chemically synthesized
attcagctcatgattctgcaag

SEQ ID NO: 49679 - DNA, 22 bp, Artificial Sequence
  chemically synthesized
ttcagctcatgattctgcaagc

SEQ ID NO: 49680 - DNA, 22 bp, Artificial Sequence
  chemically synthesized
agctcatgattctgcaagctct

SEQ ID NO: 49681 - DNA, 22 bp, Artificial Sequence
  chemically synthesized
atgattctgcaagctctccagg

SEQ ID NO: 49682 - DNA, 22 bp, Artificial Sequence
  chemically synthesized
tgcaagctctccaggaagcatg

SEQ ID NO: 49683 - DNA, 22 bp, Artificial Sequence
  chemically synthesized
caagctctccaggaagcatggc

SEQ ID NO: 49684 - DNA, 22 bp, Artificial Sequence
  chemically synthesized
tccaggaagcatggcaccagca

SEQ ID NO: 49685 - DNA, 22 bp, Artificial Sequence
  chemically synthesized
caggaagcatggcaccagcatc

SEQ ID NO: 49686 - DNA, 22 bp, Artificial Sequence
  chemically synthesized
cttctggtgagggccttaagct

SEQ ID NO: 49687 - DNA, 22 bp, Artificial Sequence
  chemically synthesized
ctggtgagggccttaagctgct

SEQ ID NO: 49688 - DNA, 22 bp, Artificial Sequence
  chemically synthesized
tggtgagggccttaagctgctt

SEQ ID NO: 49689 - DNA, 22 bp, Artificial Sequence
  chemically synthesized
gtgagggccttaagctgctttc

SEQ ID NO: 49690 - DNA, 22 bp, Artificial Sequence
  chemically synthesized
aagctgctttcactgatggcag

SEQ ID NO: 49691 - DNA, 22 bp, Artificial Sequence
  chemically synthesized
agctgctttcactgatggcaga

SEQ ID NO: 49692 - DNA, 22 bp, Artificial Sequence
  chemically synthesized
ctttcactgatggcagaaggtg

SEQ ID NO: 49693 - DNA, 22 bp, Artificial Sequence
  chemically synthesized
tcactgatggcagaaggtgaag

SEQ ID NO: 49694 - DNA, 22 bp, Artificial Sequence
  chemically synthesized
cactgatggcagaaggtgaagg

SEQ ID NO: 49695 - DNA, 22 bp, Artificial Sequence
  chemically synthesized
actgatggcagaaggtgaaggg

SEQ ID NO: 49696 - DNA, 22 bp, Artificial Sequence
  chemically synthesized
atggcagaaggtgaaggggagc

SEQ ID NO: 49697 - DNA, 22 bp, Artificial Sequence
  chemically synthesized
catgtgcagagatcaatcacat

SEQ ID NO: 49698 - DNA, 22 bp, Artificial Sequence
  chemically synthesized
tttttaataatcagccttcaag

SEQ ID NO: 49699 - DNA, 22 bp, Artificial Sequence
  chemically synthesized
tttaataatcagccttcaaggg

SEQ ID NO: 49700 - DNA, 22 bp, Artificial Sequence
  chemically synthesized
ttaataatcagccttcaaggga

SEQ ID NO: 49701 - DNA, 22 bp, Artificial Sequence
  chemically synthesized
taataatcagccttcaagggaa

SEQ ID NO: 49702 - DNA, 22 bp, Artificial Sequence
  chemically synthesized
aataatcagccttcaagggaaa

SEQ ID NO: 49703 - DNA, 22 bp, Artificial Sequence
  chemically synthesized
ataatcagccttcaagggaaat

SEQ ID NO: 49704 - DNA, 22 bp, Artificial Sequence
  chemically synthesized
caagggaaatcatagcgggaga

SEQ ID NO: 49705 - DNA, 22 bp, Artificial Sequence
  chemically synthesized
aagggaaatcatagcgggagaa

SEQ ID NO: 49706 - DNA, 22 bp, Artificial Sequence
  chemically synthesized
actcattatcacaaggacggca

SEQ ID NO: 49707 - DNA, 22 bp, Artificial Sequence
  chemically synthesized
ctcattatcacaaggacggcac

SEQ ID NO: 49708 - DNA, 22 bp, Artificial Sequence
  chemically synthesized
attatcacaaggacggcaccaa

SEQ ID NO: 49709 - DNA, 22 bp, Artificial Sequence
  chemically synthesized
tcacaaggacggcaccaagcct

SEQ ID NO: 49710 - DNA, 22 bp, Artificial Sequence
  chemically synthesized
tcacaggggttcctcccccatg

SEQ ID NO: 49711 - DNA, 22 bp, Artificial Sequence
  chemically synthesized
cacaggggttcctcccccatga

SEQ ID NO: 49712 - DNA, 22 bp, Artificial Sequence
  chemically synthesized
acaggggttcctcccccatgac

SEQ ID NO: 49713 - DNA, 22 bp, Artificial Sequence
  chemically synthesized
ctcccccatgacccaaacacct

SEQ ID NO: 49714 - DNA, 22 bp, Artificial Sequence
  chemically synthesized
ccccatgacccaaacacctccc

SEQ ID NO: 49715 - DNA, 22 bp, Artificial Sequence
  chemically synthesized
ccattaggccccacttccaaca

SEQ ID NO: 49716 - DNA, 22 bp, Artificial Sequence
  chemically synthesized
ggccccacttccaacactgagg

SEQ ID NO: 49717 - DNA, 22 bp, Artificial Sequence
  chemically synthesized
ccaacactgaggaccaaatttc

SEQ ID NO: 49718 - DNA, 22 bp, Artificial Sequence
  chemically synthesized
caacactgaggaccaaatttcc

SEQ ID NO: 49719 - DNA, 22 bp, Artificial Sequence
  chemically synthesized
aggaccaaatttccacatgaga

SEQ ID NO: 49720 - DNA, 22 bp, Artificial Sequence
  chemically synthesized
ccacatgagatttggaggggac

SEQ ID NO: 49721 - DNA, 22 bp, Artificial Sequence
  chemically synthesized
cacatgagatttggaggggaca

SEQ ID NO: 49722 - DNA, 22 bp, Artificial Sequence
  chemically synthesized
ggaggggacaaacaaattatag

SEQ ID NO: 49723 - DNA, 22 bp, Artificial Sequence
  chemically synthesized
gaggggacaaacaaattatagc

SEQ ID NO: 49724 - DNA, 22 bp, Artificial Sequence
  chemically synthesized
tagcagccactatctatggtga

SEQ ID NO: 49725 - DNA, 22 bp, Artificial Sequence
  chemically synthesized
tctatggtgatttgtttggttt

SEQ ID NO: 49726 - DNA, 22 bp, Artificial Sequence
  chemically synthesized
tggtgatttgtttggtttttag

SEQ ID NO: 49727 - DNA, 22 bp, Artificial Sequence
  chemically synthesized
gtttggtttttagctcttgtct

SEQ ID NO: 49728 - DNA, 22 bp, Artificial Sequence
  chemically synthesized
tttggtttttagctcttgtctg

SEQ ID NO: 49729 - DNA, 22 bp, Artificial Sequence
  chemically synthesized
ggtttttagctcttgtctgctc

SEQ ID NO: 49730 - DNA, 22 bp, Artificial Sequence
  chemically synthesized
gtttttagctcttgtctgctcc

SEQ ID NO: 49731 - DNA, 22 bp, Artificial Sequence
  chemically synthesized
ttagctcttgtctgctccaact

SEQ ID NO: 49732 - DNA, 22 bp, Artificial Sequence
  chemically synthesized
tagctcttgtctgctccaactg

SEQ ID NO: 49733 - DNA, 22 bp, Artificial Sequence
  chemically synthesized
agctcttgtctgctccaactgc

SEQ ID NO: 49734 - DNA, 22 bp, Artificial Sequence
  chemically synthesized
gctcttgtctgctccaactgct

SEQ ID NO: 49735 - DNA, 22 bp, Artificial Sequence
  chemically synthesized
ttgtctgctccaactgctctca

SEQ ID NO: 49736 - DNA, 22 bp, Artificial Sequence
  chemically synthesized
gtctgctccaactgctctcagg

SEQ ID NO: 49737 - DNA, 22 bp, Artificial Sequence
  chemically synthesized
tctgctccaactgctctcaggc

SEQ ID NO: 49738 - DNA, 22 bp, Artificial Sequence
  chemically synthesized
ctccaactgctctcaggcagac

SEQ ID NO: 49739 - DNA, 22 bp, Artificial Sequence
  chemically synthesized
caactgctctcaggcagacata

SEQ ID NO: 49740 - DNA, 22 bp, Artificial Sequence
  chemically synthesized
ctctcaggcagacatacctgct

SEQ ID NO: 49741 - DNA, 22 bp, Artificial Sequence
  chemically synthesized
tcaggcagacatacctgcttaa

SEQ ID NO: 49742 - DNA, 22 bp, Artificial Sequence
  chemically synthesized
aggcagacatacctgcttaaga

SEQ ID NO: 49743 - DNA, 22 bp, Artificial Sequence
  chemically synthesized
cttaagaaccttcactggctcc

SEQ ID NO: 49744 - DNA, 22 bp, Artificial Sequence
  chemically synthesized
aagaaccttcactggctcccca

SEQ ID NO: 49745 - DNA, 22 bp, Artificial Sequence
  chemically synthesized
agaaccttcactggctccccac

SEQ ID NO: 49746 - DNA, 22 bp, Artificial Sequence
  chemically synthesized
cactggctccccacagcctcat

SEQ ID NO: 49747 - DNA, 22 bp, Artificial Sequence
  chemically synthesized
actggctccccacagcctcatg

SEQ ID NO: 49748 - DNA, 22 bp, Artificial Sequence
  chemically synthesized
gctccccacagcctcatgaatc

SEQ ID NO: 49749 - DNA, 22 bp, Artificial Sequence
  chemically synthesized
cccacagcctcatgaatcaagt

SEQ ID NO: 49750 - DNA, 22 bp, Artificial Sequence
  chemically synthesized
atgaatcaagtccaaactccat

SEQ ID NO: 49751 - DNA, 22 bp, Artificial Sequence
  chemically synthesized
catgctcctccttggcccctac

SEQ ID NO: 49752 - DNA, 22 bp, Artificial Sequence
  chemically synthesized
ctccttggcccctacctcaacc

SEQ ID NO: 49753 - DNA, 22 bp, Artificial Sequence
  chemically synthesized
cttggcccctacctcaacctac

SEQ ID NO: 49754 - DNA, 22 bp, Artificial Sequence
  chemically synthesized
ggcccctacctcaacctacctt

SEQ ID NO: 49755 - DNA, 22 bp, Artificial Sequence
  chemically synthesized
gcccctacctcaacctaccttg

SEQ ID NO: 49756 - DNA, 22 bp, Artificial Sequence
  chemically synthesized
cctcaacctaccttgcagcccc

SEQ ID NO: 49757 - DNA, 22 bp, Artificial Sequence
  chemically synthesized
aacctaccttgcagccccatca

SEQ ID NO: 49758 - DNA, 22 bp, Artificial Sequence
  chemically synthesized
ccttgcagccccatcacccata

SEQ ID NO: 49759 - DNA, 22 bp, Artificial Sequence
  chemically synthesized
gcagccccatcacccatatctc

SEQ ID NO: 49760 - DNA, 22 bp, Artificial Sequence
  chemically synthesized
cagccccatcacccatatctct

SEQ ID NO: 49761 - DNA, 22 bp, Artificial Sequence
  chemically synthesized
tgtatatatgcatcttggactc

SEQ ID NO: 49762 - DNA, 22 bp, Artificial Sequence
  chemically synthesized
tatatatgcatcttggactcca

SEQ ID NO: 49763 - DNA, 22 bp, Artificial Sequence
  chemically synthesized
ggactccagtcagagtagaaca

SEQ ID NO: 49764 - DNA, 22 bp, Artificial Sequence
  chemically synthesized
gactccagtcagagtagaacag

SEQ ID NO: 49765 - DNA, 22 bp, Artificial Sequence
  chemically synthesized
cagtcagagtagaacagagtcc

SEQ ID NO: 49766 - DNA, 22 bp, Artificial Sequence
  chemically synthesized
tacccaaagccttagggccaaa

SEQ ID NO: 49767 - DNA, 22 bp, Artificial Sequence
  chemically synthesized
acccaaagccttagggccaaaa

SEQ ID NO: 49768 - DNA, 22 bp, Artificial Sequence
  chemically synthesized
cccaaagccttagggccaaaac

SEQ ID NO: 49769 - DNA, 22 bp, Artificial Sequence
  chemically synthesized
agggccaaaacggttttgaacc

SEQ ID NO: 49770 - DNA, 22 bp, Artificial Sequence
  chemically synthesized
gggccaaaacggttttgaacct

SEQ ID NO: 49771 - DNA, 22 bp, Artificial Sequence
  chemically synthesized
tgaacctcagaacttgtttgga

SEQ ID NO: 49772 - DNA, 22 bp, Artificial Sequence
  chemically synthesized
gaacctcagaacttgtttggat

SEQ ID NO: 49773 - DNA, 22 bp, Artificial Sequence
  chemically synthesized
aacctcagaacttgtttggatt

SEQ ID NO: 49774 - DNA, 22 bp, Artificial Sequence
  chemically synthesized
agaacttgtttggattttagaa

SEQ ID NO: 49775 - DNA, 22 bp, Artificial Sequence
  chemically synthesized
gtttggattttagaaaggcagt

SEQ ID NO: 49776 - DNA, 22 bp, Artificial Sequence
  chemically synthesized
tttggattttagaaaggcagta

SEQ ID NO: 49777 - DNA, 22 bp, Artificial Sequence
  chemically synthesized
ggattttagaaaggcagtaatg

SEQ ID NO: 49778 - DNA, 22 bp, Artificial Sequence
  chemically synthesized
gattttagaaaggcagtaatgg

SEQ ID NO: 49779 - DNA, 22 bp, Artificial Sequence
  chemically synthesized
tagaaaggcagtaatgggcaat

SEQ ID NO: 49780 - DNA, 22 bp, Artificial Sequence
  chemically synthesized
agaaaggcagtaatgggcaatc

SEQ ID NO: 49781 - DNA, 22 bp, Artificial Sequence
  chemically synthesized
gaaaggcagtaatgggcaatca

SEQ ID NO: 49782 - DNA, 22 bp, Artificial Sequence
  chemically synthesized
cttggaagaatctggagctgca

SEQ ID NO: 49783 - DNA, 22 bp, Artificial Sequence
  chemically synthesized
ggaagaatctggagctgcatac

SEQ ID NO: 49784 - DNA, 22 bp, Artificial Sequence
  chemically synthesized
gaagaatctggagctgcatact

SEQ ID NO: 49785 - DNA, 22 bp, Artificial Sequence
  chemically synthesized
gagctgcatactgtaatctatg

SEQ ID NO: 49786 - DNA, 22 bp, Artificial Sequence
  chemically synthesized
catactgtaatctatgcagcaa

SEQ ID NO: 49787 - DNA, 22 bp, Artificial Sequence
  chemically synthesized
taatctatgcagcaaaatatat

SEQ ID NO: 49788 - DNA, 22 bp, Artificial Sequence
  chemically synthesized
tgcagcaaaatatatgaatatg

SEQ ID NO: 49789 - DNA, 22 bp, Artificial Sequence
  chemically synthesized
acacaactaaattaaaaataat

SEQ ID NO: 49790 - DNA, 22 bp, Artificial Sequence
  chemically synthesized
aattaaaaataatctcatgtca

SEQ ID NO: 49791 - DNA, 22 bp, Artificial Sequence
  chemically synthesized
aaaataatctcatgtcagttca

SEQ ID NO: 49792 - DNA, 22 bp, Artificial Sequence
  chemically synthesized
atgtcagttcacgtcaggtgct

SEQ ID NO: 49793 - DNA, 22 bp, Artificial Sequence
  chemically synthesized
acgtcaggtgctaccatcaaat

SEQ ID NO: 49794 - DNA, 22 bp, Artificial Sequence
  chemically synthesized
ccatcaaataaatcacaaaaaa

SEQ ID NO: 49795 - DNA, 22 bp, Artificial Sequence
  chemically synthesized
ttggttttcgtaacattttaca

SEQ ID NO: 49796 - DNA, 22 bp, Artificial Sequence
  chemically synthesized
tggttttcgtaacattttacat

SEQ ID NO: 49797 - DNA, 22 bp, Artificial Sequence
  chemically synthesized
ggttttcgtaacattttacatt

SEQ ID NO: 49798 - DNA, 22 bp, Artificial Sequence
  chemically synthesized
gttttcgtaacattttacattt

SEQ ID NO: 49799 - DNA, 22 bp, Artificial Sequence
  chemically synthesized
tcgtaacattttacatttcaga

SEQ ID NO: 49800 - DNA, 22 bp, Artificial Sequence
  chemically synthesized
cgtaacattttacatttcagac

SEQ ID NO: 49801 - DNA, 22 bp, Artificial Sequence
  chemically synthesized
gtaacattttacatttcagacg

SEQ ID NO: 49802 - DNA, 22 bp, Artificial Sequence
  chemically synthesized
tacatttcagacggtggataaa

SEQ ID NO: 49803 - DNA, 22 bp, Artificial Sequence
  chemically synthesized
acatttcagacggtggataaag

SEQ ID NO: 49804 - DNA, 22 bp, Artificial Sequence
  chemically synthesized
catttcagacggtggataaaga

SEQ ID NO: 49805 - DNA, 22 bp, Artificial Sequence
  chemically synthesized
cagacggtggataaagaactgt

SEQ ID NO: 49806 - DNA, 22 bp, Artificial Sequence
  chemically synthesized
agacggtggataaagaactgtg

SEQ ID NO: 49807 - DNA, 22 bp, Artificial Sequence
  chemically synthesized
tggaggccaggcgtggtggctc

SEQ ID NO: 49808 - DNA, 22 bp, Artificial Sequence
  chemically synthesized
acacctgtaattcgagcacttt

SEQ ID NO: 49809 - DNA, 22 bp, Artificial Sequence
  chemically synthesized
taattcgagcactttgggaggc

SEQ ID NO: 49810 - DNA, 22 bp, Artificial Sequence
  chemically synthesized
gagcactttgggaggctgaggc

SEQ ID NO: 49811 - DNA, 22 bp, Artificial Sequence
  chemically synthesized
tgggaggctgaggcgggaggat

SEQ ID NO: 49812 - DNA, 22 bp, Artificial Sequence
  chemically synthesized
gggaggctgaggcgggaggatc

SEQ ID NO: 49813 - DNA, 22 bp, Artificial Sequence
  chemically synthesized
ggaggctgaggcgggaggatca

SEQ ID NO: 49814 - DNA, 22 bp, Artificial Sequence
  chemically synthesized
aggcgggaggatcacctcctcg

SEQ ID NO: 49815 - DNA, 22 bp, Artificial Sequence
  chemically synthesized
ctcggatccactgaggaggtca

SEQ ID NO: 49816 - DNA, 22 bp, Artificial Sequence
  chemically synthesized
ggatccactgaggaggtcagga

SEQ ID NO: 49817 - DNA, 22 bp, Artificial Sequence
  chemically synthesized
aggaggtcaggagtttgcgact

SEQ ID NO: 49818 - DNA, 22 bp, Artificial Sequence
  chemically synthesized
gcgactagcctggccaacgtgg

SEQ ID NO: 49819 - DNA, 22 bp, Artificial Sequence
  chemically synthesized
cgactagcctggccaacgtggt

SEQ ID NO: 49820 - DNA, 22 bp, Artificial Sequence
  chemically synthesized
gcctggccaacgtggtgaaacc

SEQ ID NO: 49821 - DNA, 22 bp, Artificial Sequence
  chemically synthesized
gccaacgtggtgaaaccccttc

SEQ ID NO: 49822 - DNA, 22 bp, Artificial Sequence
  chemically synthesized
ctctactaaaaatacaaaaatt

SEQ ID NO: 49823 - DNA, 22 bp, Artificial Sequence
  chemically synthesized
tctactaaaaatacaaaaatta

SEQ ID NO: 49824 - DNA, 22 bp, Artificial Sequence
  chemically synthesized
tactaaaaatacaaaaattagc

SEQ ID NO: 49825 - DNA, 22 bp, Artificial Sequence
  chemically synthesized
ctaaaaatacaaaaattagccg

SEQ ID NO: 49826 - DNA, 22 bp, Artificial Sequence
  chemically synthesized
aaaatacaaaaattagccgggc

SEQ ID NO: 49827 - DNA, 22 bp, Artificial Sequence
  chemically synthesized
gccgggcgtggtggcaggtacc

SEQ ID NO: 49828 - DNA, 22 bp, Artificial Sequence
  chemically synthesized
taatcccagcttcttgggaggc

SEQ ID NO: 49829 - DNA, 22 bp, Artificial Sequence
  chemically synthesized
cttgggaggctgaggcaggaga

SEQ ID NO: 49830 - DNA, 22 bp, Artificial Sequence
  chemically synthesized
ttgggaggctgaggcaggagaa

SEQ ID NO: 49831 - DNA, 22 bp, Artificial Sequence
  chemically synthesized
gggaggctgaggcaggagaacc

SEQ ID NO: 49832 - DNA, 22 bp, Artificial Sequence
  chemically synthesized
ggaggctgaggcaggagaacca

SEQ ID NO: 49833 - DNA, 22 bp, Artificial Sequence
  chemically synthesized
aggcaggagaaccacttgaacc

SEQ ID NO: 49834 - DNA, 22 bp, Artificial Sequence
  chemically synthesized
gaacccgggagacagatgttgc

SEQ ID NO: 49835 - DNA, 22 bp, Artificial Sequence
  chemically synthesized
aacccgggagacagatgttgca

SEQ ID NO: 49836 - DNA, 22 bp, Artificial Sequence
  chemically synthesized
cagtgagctgagactgcaccat

SEQ ID NO: 49837 - DNA, 22 bp, Artificial Sequence
  chemically synthesized
agactgcaccattgcactccag

SEQ ID NO: 49838 - DNA, 22 bp, Artificial Sequence
  chemically synthesized
caccattgcactccagcctggg

SEQ ID NO: 49839 - DNA, 22 bp, Artificial Sequence
  chemically synthesized
cactccagcctgggcaacaaga

SEQ ID NO: 49840 - DNA, 22 bp, Artificial Sequence
  chemically synthesized
cagcctgggcaacaagagcgaa

SEQ ID NO: 49841 - DNA, 22 bp, Artificial Sequence
  chemically synthesized
ggcaacaagagcgaaactccat

SEQ ID NO: 49842 - DNA, 22 bp, Artificial Sequence
  chemically synthesized
catctcaaaaaaaaaagaaaaa

SEQ ID NO: 49843 - DNA, 22 bp, Artificial Sequence
  chemically synthesized
aaaaaaaaaagaaaaagaactg

SEQ ID NO: 49844 - DNA, 22 bp, Artificial Sequence
  chemically synthesized
tggacatgtgctccttatcttc

SEQ ID NO: 49845 - DNA, 22 bp, Artificial Sequence
  chemically synthesized
cttatcttccacctctggtttt

SEQ ID NO: 49846 - DNA, 22 bp, Artificial Sequence
  chemically synthesized
atcttccacctctggttttccc

SEQ ID NO: 49847 - DNA, 22 bp, Artificial Sequence
  chemically synthesized
tcttccacctctggttttccca

SEQ ID NO: 49848 - DNA, 22 bp, Artificial Sequence
  chemically synthesized
ccacctctggttttcccagctc

SEQ ID NO: 49849 - DNA, 22 bp, Artificial Sequence
  chemically synthesized
cacctctggttttcccagctct

SEQ ID NO: 49850 - DNA, 22 bp, Artificial Sequence
  chemically synthesized
tggttttcccagctctgtatct

SEQ ID NO: 49851 - DNA, 22 bp, Artificial Sequence
  chemically synthesized
gttttcccagctctgtatcttt

SEQ ID NO: 49852 - DNA, 22 bp, Artificial Sequence
  chemically synthesized
tcccagctctgtatctttgttc

SEQ ID NO: 49853 - DNA, 22 bp, Artificial Sequence
  chemically synthesized
cccagctctgtatctttgttca

SEQ ID NO: 49854 - DNA, 22 bp, Artificial Sequence
  chemically synthesized
ccagctctgtatctttgttcat

SEQ ID NO: 49855 - DNA, 22 bp, Artificial Sequence
  chemically synthesized
tgtatctttgttcatggtacct

SEQ ID NO: 49856 - DNA, 22 bp, Artificial Sequence
  chemically synthesized
tatctttgttcatggtacctcc

SEQ ID NO: 49857 - DNA, 22 bp, Artificial Sequence
  chemically synthesized
tgttcatggtacctcctaatcc

SEQ ID NO: 49858 - DNA, 22 bp, Artificial Sequence
  chemically synthesized
gttcatggtacctcctaatcct

SEQ ID NO: 49859 - DNA, 22 bp, Artificial Sequence
  chemically synthesized
ttcatggtacctcctaatccta

SEQ ID NO: 49860 - DNA, 22 bp, Artificial Sequence
  chemically synthesized
atggtacctcctaatcctagaa

SEQ ID NO: 49861 - DNA, 22 bp, Artificial Sequence
  chemically synthesized
ctaatcctagaataaaattctc

SEQ ID NO: 49862 - DNA, 22 bp, Artificial Sequence
  chemically synthesized
atcctagaataaaattctcatg

SEQ ID NO: 49863 - DNA, 22 bp, Artificial Sequence
  chemically synthesized
gaataaaattctcatgacacca

SEQ ID NO: 49864 - DNA, 22 bp, Artificial Sequence
  chemically synthesized
tcatgacaccatcatcgctgaa

SEQ ID NO: 49865 - DNA, 22 bp, Artificial Sequence
  chemically synthesized
atgacaccatcatcgctgaact

SEQ ID NO: 49866 - DNA, 22 bp, Artificial Sequence
  chemically synthesized
aactcctactaatgcttcaaag

SEQ ID NO: 49867 - DNA, 22 bp, Artificial Sequence
  chemically synthesized
ctactaatgcttcaaagaccca

SEQ ID NO: 49868 - DNA, 22 bp, Artificial Sequence
  chemically synthesized
ctaatgcttcaaagacccatct

SEQ ID NO: 49869 - DNA, 22 bp, Artificial Sequence
  chemically synthesized
atgcttcaaagacccatctgaa

SEQ ID NO: 49870 - DNA, 22 bp, Artificial Sequence
  chemically synthesized
caaagacccatctgaaaatgcc

SEQ ID NO: 49871 - DNA, 22 bp, Artificial Sequence
  chemically synthesized
aaagacccatctgaaaatgcct

SEQ ID NO: 49872 - DNA, 22 bp, Artificial Sequence
  chemically synthesized
aaaatgccttccgctaaataaa

SEQ ID NO: 49873 - DNA, 22 bp, Artificial Sequence
  chemically synthesized
ccgctaaataaaaattgaatga

SEQ ID NO: 49874 - DNA, 22 bp, Artificial Sequence
  chemically synthesized
cgctaaataaaaattgaatgaa

SEQ ID NO: 49875 - DNA, 22 bp, Artificial Sequence
  chemically synthesized
aataaaaattgaatgaattggg

SEQ ID NO: 49876 - DNA, 22 bp, Artificial Sequence
  chemically synthesized
aatgaattgggagagtactctg

SEQ ID NO: 49877 - DNA, 22 bp, Artificial Sequence
  chemically synthesized
ggagagtactctgtgcagtgga

SEQ ID NO: 49878 - DNA, 22 bp, Artificial Sequence
  chemically synthesized
tgtgcagtggagtgtcagttct

SEQ ID NO: 49879 - DNA, 22 bp, Artificial Sequence
  chemically synthesized
tgcagtggagtgtcagttctgg

SEQ ID NO: 49880 - DNA, 22 bp, Artificial Sequence
  chemically synthesized
tggaaacccagttctaatgcac

SEQ ID NO: 49881 - DNA, 22 bp, Artificial Sequence
  chemically synthesized
gaaacccagttctaatgcacct

SEQ ID NO: 49882 - DNA, 22 bp, Artificial Sequence
  chemically synthesized
taatgcacctggggtgacctcc

SEQ ID NO: 49883 - DNA, 22 bp, Artificial Sequence
  chemically synthesized
atgcacctggggtgacctcctc

SEQ ID NO: 49884 - DNA, 22 bp, Artificial Sequence
  chemically synthesized
gggtgacctcctctctctgggc

SEQ ID NO: 49885 - DNA, 22 bp, Artificial Sequence
  chemically synthesized
ctctctctgggcctcagtttct

SEQ ID NO: 49886 - DNA, 22 bp, Artificial Sequence
  chemically synthesized
tctctgggcctcagtttctcat

SEQ ID NO: 49887 - DNA, 22 bp, Artificial Sequence
  chemically synthesized
tctgggcctcagtttctcatga

SEQ ID NO: 49888 - DNA, 22 bp, Artificial Sequence
  chemically synthesized
tgggcctcagtttctcatgact

SEQ ID NO: 49889 - DNA, 22 bp, Artificial Sequence
  chemically synthesized
ggcctcagtttctcatgactaa

SEQ ID NO: 49890 - DNA, 22 bp, Artificial Sequence
  chemically synthesized
agtttctcatgactaaaagaaa

SEQ ID NO: 49891 - DNA, 22 bp, Artificial Sequence
  chemically synthesized
ctcatgactaaaagaaaaggat

SEQ ID NO: 49892 - DNA, 22 bp, Artificial Sequence
  chemically synthesized
tcatgactaaaagaaaaggatt

SEQ ID NO: 49893 - DNA, 22 bp, Artificial Sequence
  chemically synthesized
atgactaaaagaaaaggattgg

SEQ ID NO: 49894 - DNA, 22 bp, Artificial Sequence
  chemically synthesized
aaagaaaaggattggtctaaaa

SEQ ID NO: 49895 - DNA, 22 bp, Artificial Sequence
  chemically synthesized
gtctaaaaattattttctgctt

SEQ ID NO: 49896 - DNA, 22 bp, Artificial Sequence
  chemically synthesized
aaaattattttctgcttgccaa

SEQ ID NO: 49897 - DNA, 22 bp, Artificial Sequence
  chemically synthesized
ttttctgcttgccaaaaaatat

SEQ ID NO: 49898 - DNA, 22 bp, Artificial Sequence
  chemically synthesized
tctgcttgccaaaaaatatttt

SEQ ID NO: 49899 - DNA, 22 bp, Artificial Sequence
  chemically synthesized
ctgcttgccaaaaaatattttc

SEQ ID NO: 49900 - DNA, 22 bp, Artificial Sequence
  chemically synthesized
tgcttgccaaaaaatattttca

SEQ ID NO: 49901 - DNA, 22 bp, Artificial Sequence
  chemically synthesized
cttgccaaaaaatattttcatt

SEQ ID NO: 49902 - DNA, 22 bp, Artificial Sequence
  chemically synthesized
gccaaaaaatattttcattcta

SEQ ID NO: 49903 - DNA, 22 bp, Artificial Sequence
  chemically synthesized
ccaaaaaatattttcattctaa

SEQ ID NO: 49904 - DNA, 22 bp, Artificial Sequence
  chemically synthesized
tcattctaaattcgattcccac

SEQ ID NO: 49905 - DNA, 22 bp, Artificial Sequence
  chemically synthesized
cattctaaattcgattcccaca

SEQ ID NO: 49906 - DNA, 22 bp, Artificial Sequence
  chemically synthesized
attctaaattcgattcccacaa

SEQ ID NO: 49907 - DNA, 22 bp, Artificial Sequence
  chemically synthesized
taaattcgattcccacaaaata

SEQ ID NO: 49908 - DNA, 22 bp, Artificial Sequence
  chemically synthesized
aattcgattcccacaaaataac

SEQ ID NO: 49909 - DNA, 22 bp, Artificial Sequence
  chemically synthesized
gattcccacaaaataaccattg

SEQ ID NO: 49910 - DNA, 22 bp, Artificial Sequence
  chemically synthesized
ccacaaaataaccattgaatga

SEQ ID NO: 49911 - DNA, 22 bp, Artificial Sequence
  chemically synthesized
aatgaatgaataaatgaacttg

SEQ ID NO: 49912 - DNA, 22 bp, Artificial Sequence
  chemically synthesized
gaggaggctcctgttccaaact

SEQ ID NO: 49913 - DNA, 22 bp, Artificial Sequence
  chemically synthesized
aggaggctcctgttccaaactt

SEQ ID NO: 49914 - DNA, 22 bp, Artificial Sequence
  chemically synthesized
ctgttccaaacttccaccagag

SEQ ID NO: 49915 - DNA, 22 bp, Artificial Sequence
  chemically synthesized
ttccaaacttccaccagagaag

SEQ ID NO: 49916 - DNA, 22 bp, Artificial Sequence
  chemically synthesized
caaacttccaccagagaagaaa

SEQ ID NO: 49917 - DNA, 22 bp, Artificial Sequence
  chemically synthesized
ccaccagagaagaaacatcctc

SEQ ID NO: 49918 - DNA, 22 bp, Artificial Sequence
  chemically synthesized
caccagagaagaaacatcctca

SEQ ID NO: 49919 - DNA, 22 bp, Artificial Sequence
  chemically synthesized
aagggcttggttcaggtggtca

SEQ ID NO: 49920 - DNA, 22 bp, Artificial Sequence
  chemically synthesized
ggttcaggtggtcatacagcct

SEQ ID NO: 49921 - DNA, 22 bp, Artificial Sequence
  chemically synthesized
gttcaggtggtcatacagcctc

SEQ ID NO: 49922 - DNA, 22 bp, Artificial Sequence
  chemically synthesized
aggtggtcatacagcctctgct

SEQ ID NO: 49923 - DNA, 22 bp, Artificial Sequence
  chemically synthesized
tgcttactcacctctcaggatg

SEQ ID NO: 49924 - DNA, 22 bp, Artificial Sequence
  chemically synthesized
cttactcacctctcaggatggg

SEQ ID NO: 49925 - DNA, 22 bp, Artificial Sequence
  chemically synthesized
actcacctctcaggatggggta

SEQ ID NO: 49926 - DNA, 22 bp, Artificial Sequence
  chemically synthesized
ctcacctctcaggatggggtac

SEQ ID NO: 49927 - DNA, 22 bp, Artificial Sequence
  chemically synthesized
acctctcaggatggggtactca

SEQ ID NO: 49928 - DNA, 22 bp, Artificial Sequence
  chemically synthesized
tcaggatggggtactcactatt

SEQ ID NO: 49929 - DNA, 22 bp, Artificial Sequence
  chemically synthesized
aggatggggtactcactatttc

SEQ ID NO: 49930 - DNA, 22 bp, Artificial Sequence
  chemically synthesized
actatttccagaacagttgttt

SEQ ID NO: 49931 - DNA, 22 bp, Artificial Sequence
  chemically synthesized
tttccagaacagttgttttgga

SEQ ID NO: 49932 - DNA, 22 bp, Artificial Sequence
  chemically synthesized
ccagaacagttgttttggagca

SEQ ID NO: 49933 - DNA, 22 bp, Artificial Sequence
  chemically synthesized
cagaacagttgttttggagcag

SEQ ID NO: 49934 - DNA, 22 bp, Artificial Sequence
  chemically synthesized
ttttggagcagtggtaacttga

SEQ ID NO: 49935 - DNA, 22 bp, Artificial Sequence
  chemically synthesized
tggagcagtggtaacttgaaat

SEQ ID NO: 49936 - DNA, 22 bp, Artificial Sequence
  chemically synthesized
ggagcagtggtaacttgaaatg

SEQ ID NO: 49937 - DNA, 22 bp, Artificial Sequence
  chemically synthesized
gagcagtggtaacttgaaatgc

SEQ ID NO: 49938 - DNA, 22 bp, Artificial Sequence
  chemically synthesized
gaaatgccctttcttatcctgg

SEQ ID NO: 49939 - DNA, 22 bp, Artificial Sequence
  chemically synthesized
aaatgccctttcttatcctggc

SEQ ID NO: 49940 - DNA, 22 bp, Artificial Sequence
  chemically synthesized
tcttatcctggccacaacccca

SEQ ID NO: 49941 - DNA, 22 bp, Artificial Sequence
  chemically synthesized
cttatcctggccacaaccccac

SEQ ID NO: 49942 - DNA, 22 bp, Artificial Sequence
  chemically synthesized
ttatcctggccacaaccccaca

SEQ ID NO: 49943 - DNA, 22 bp, Artificial Sequence
  chemically synthesized
atcctggccacaaccccacaac

SEQ ID NO: 49944 - DNA, 22 bp, Artificial Sequence
  chemically synthesized
tcctggccacaaccccacaaca

SEQ ID NO: 49945 - DNA, 22 bp, Artificial Sequence
  chemically synthesized
gccacaaccccacaacatccct

SEQ ID NO: 49946 - DNA, 22 bp, Artificial Sequence
  chemically synthesized
gagaaagtcaaaggctcaggga

SEQ ID NO: 49947 - DNA, 22 bp, Artificial Sequence
  chemically synthesized
agggaacaaggaagagggctat

SEQ ID NO: 49948 - DNA, 22 bp, Artificial Sequence
  chemically synthesized
tactgagctgagtaaggacttg

SEQ ID NO: 49949 - DNA, 22 bp, Artificial Sequence
  chemically synthesized
agctgagtaaggacttgccatc

SEQ ID NO: 49950 - DNA, 22 bp, Artificial Sequence
  chemically synthesized
agtaaggacttgccatcctgcc

SEQ ID NO: 49951 - DNA, 22 bp, Artificial Sequence
  chemically synthesized
gccatcctgccacccagcacac

SEQ ID NO: 49952 - DNA, 22 bp, Artificial Sequence
  chemically synthesized
ccatcctgccacccagcacact

SEQ ID NO: 49953 - DNA, 22 bp, Artificial Sequence
  chemically synthesized
ccacccagcacactcagacaga

SEQ ID NO: 49954 - DNA, 22 bp, Artificial Sequence
  chemically synthesized
agacagaagcgtgggcaggcag

SEQ ID NO: 49955 - DNA, 22 bp, Artificial Sequence
  chemically synthesized
tgagtggcagaattttcccctc

SEQ ID NO: 49956 - DNA, 22 bp, Artificial Sequence
  chemically synthesized
tcccctctgccccaggagctgt

SEQ ID NO: 49957 - DNA, 22 bp, Artificial Sequence
  chemically synthesized
cccctctgccccaggagctgtg

SEQ ID NO: 49958 - DNA, 22 bp, Artificial Sequence
  chemically synthesized
ccctctgccccaggagctgtgg

SEQ ID NO: 49959 - DNA, 22 bp, Artificial Sequence
  chemically synthesized
tgccccaggagctgtggtttgg

SEQ ID NO: 49960 - DNA, 22 bp, Artificial Sequence
  chemically synthesized
ccccaggagctgtggtttggag

SEQ ID NO: 49961 - DNA, 22 bp, Artificial Sequence
  chemically synthesized
tggtttggagcaaagacaatgt

SEQ ID NO: 49962 - DNA, 22 bp, Artificial Sequence
  chemically synthesized
ggagcaaagacaatgtcaccaa

SEQ ID NO: 49963 - DNA, 22 bp, Artificial Sequence
  chemically synthesized
gagcaaagacaatgtcaccaac

SEQ ID NO: 49964 - DNA, 22 bp, Artificial Sequence
  chemically synthesized
cagacagggacaaaactgcaag

SEQ ID NO: 49965 - DNA, 22 bp, Artificial Sequence
  chemically synthesized
caagtgatccccccggggcttg

SEQ ID NO: 49966 - DNA, 22 bp, Artificial Sequence
  chemically synthesized
gcattgtaagttcactcatggt

SEQ ID NO: 49967 - DNA, 22 bp, Artificial Sequence
  chemically synthesized
cattgtaagttcactcatggtc

SEQ ID NO: 49968 - DNA, 22 bp, Artificial Sequence
  chemically synthesized
taagttcactcatggtcaacag

SEQ ID NO: 49969 - DNA, 22 bp, Artificial Sequence
  chemically synthesized
actcatggtcaacagaactttc

SEQ ID NO: 49970 - DNA, 22 bp, Artificial Sequence
  chemically synthesized
atggtcaacagaactttccctt

SEQ ID NO: 49971 - DNA, 22 bp, Artificial Sequence
  chemically synthesized
tcccttcatctccccatctgct

SEQ ID NO: 49972 - DNA, 22 bp, Artificial Sequence
  chemically synthesized
cccttcatctccccatctgctg

SEQ ID NO: 49973 - DNA, 22 bp, Artificial Sequence
  chemically synthesized
ccttcatctccccatctgctgc

SEQ ID NO: 49974 - DNA, 22 bp, Artificial Sequence
  chemically synthesized
catctccccatctgctgccact

SEQ ID NO: 49975 - DNA, 22 bp, Artificial Sequence
  chemically synthesized
atctccccatctgctgccactg

SEQ ID NO: 49976 - DNA, 22 bp, Artificial Sequence
  chemically synthesized
cccatctgctgccactgagccg

SEQ ID NO: 49977 - DNA, 22 bp, Artificial Sequence
  chemically synthesized
ctgccactgagccgtagggacg

SEQ ID NO: 49978 - DNA, 22 bp, Artificial Sequence
  chemically synthesized
ccactgagccgtagggacgatt

SEQ ID NO: 49979 - DNA, 22 bp, Artificial Sequence
  chemically synthesized
agccgtagggacgattgtcacc

SEQ ID NO: 49980 - DNA, 22 bp, Artificial Sequence
  chemically synthesized
tcacctcccttttaaagattag

SEQ ID NO: 49981 - DNA, 22 bp, Artificial Sequence
  chemically synthesized
ccttttaaagattaggcaatgg

SEQ ID NO: 49982 - DNA, 22 bp, Artificial Sequence
  chemically synthesized
ttaaagattaggcaatggaggc

SEQ ID NO: 49983 - DNA, 22 bp, Artificial Sequence
  chemically synthesized
taaagattaggcaatggaggct

SEQ ID NO: 49984 - DNA, 22 bp, Artificial Sequence
  chemically synthesized
aaagattaggcaatggaggctc

SEQ ID NO: 49985 - DNA, 22 bp, Artificial Sequence
  chemically synthesized
aagattaggcaatggaggctca

SEQ ID NO: 49986 - DNA, 22 bp, Artificial Sequence
  chemically synthesized
ggcaatggaggctcaaggataa

SEQ ID NO: 49987 - DNA, 22 bp, Artificial Sequence
  chemically synthesized
aaggataagtgacttgtcaagc

SEQ ID NO: 49988 - DNA, 22 bp, Artificial Sequence
  chemically synthesized
gtcaagcaccacagctagtgag

SEQ ID NO: 49989 - DNA, 22 bp, Artificial Sequence
  chemically synthesized
tcaagcaccacagctagtgaga

SEQ ID NO: 49990 - DNA, 22 bp, Artificial Sequence
  chemically synthesized
gtgagaggaagccaagattcaa

SEQ ID NO: 49991 - DNA, 22 bp, Artificial Sequence
  chemically synthesized
aaccccacatctgactccaagc

SEQ ID NO: 49992 - DNA, 22 bp, Artificial Sequence
  chemically synthesized
actccaagctgggggacacaga

SEQ ID NO: 49993 - DNA, 22 bp, Artificial Sequence
  chemically synthesized
caagctgggggacacagaacct

SEQ ID NO: 49994 - DNA, 22 bp, Artificial Sequence
  chemically synthesized
ggggacacagaacctcagccaa

SEQ ID NO: 49995 - DNA, 22 bp, Artificial Sequence
  chemically synthesized
agccaagtcctgggctggtaat

SEQ ID NO: 49996 - DNA, 22 bp, Artificial Sequence
  chemically synthesized
ggctggtaatacttagaaaaag

SEQ ID NO: 49997 - DNA, 22 bp, Artificial Sequence
  chemically synthesized
gtaatacttagaaaaagctagt

SEQ ID NO: 49998 - DNA, 22 bp, Artificial Sequence
  chemically synthesized
agaaaaagctagtggtctcgcc

SEQ ID NO: 49999 - DNA, 22 bp, Artificial Sequence
  chemically synthesized
gaaaaagctagtggtctcgccc

SEQ ID NO: 50000 - DNA, 22 bp, Artificial Sequence
  chemically synthesized
gtggtctcgccccgggaagaag

SEQ ID NO: 50001 - DNA, 22 bp, Artificial Sequence
  chemically synthesized
gccccgggaagaagcttcccac

SEQ ID NO: 50002 - DNA, 22 bp, Artificial Sequence
  chemically synthesized
cccacagcctgagggccagaag

SEQ ID NO: 50003 - DNA, 22 bp, Artificial Sequence
  chemically synthesized
ccacagcctgagggccagaagc

SEQ ID NO: 50004 - DNA, 22 bp, Artificial Sequence
  chemically synthesized
agggccagaagctggcagagtt

SEQ ID NO: 50005 - DNA, 22 bp, Artificial Sequence
  chemically synthesized
gcagagttgttgagcaaactcg

SEQ ID NO: 50006 - DNA, 22 bp, Artificial Sequence
  chemically synthesized
ttgagcaaactcgccccgcaca

SEQ ID NO: 50007 - DNA, 22 bp, Artificial Sequence
  chemically synthesized
agcaaactcgccccgcacacgg

SEQ ID NO: 50008 - DNA, 22 bp, Artificial Sequence
  chemically synthesized
gccccgcacacggtcggcagac

SEQ ID NO: 50009 - DNA, 22 bp, Artificial Sequence
  chemically synthesized
aggcgccgggctcagctccggg

SEQ ID NO: 50010 - DNA, 22 bp, Artificial Sequence
  chemically synthesized
agctccggggtcccagtaccag

SEQ ID NO: 50011 - DNA, 22 bp, Artificial Sequence
  chemically synthesized
cggggtcccagtaccaggcgca

SEQ ID NO: 50012 - DNA, 22 bp, Artificial Sequence
  chemically synthesized
cggctccagagcaccaagggcc

SEQ ID NO: 50013 - DNA, 22 bp, Artificial Sequence
  chemically synthesized
cagagcaccaagggcccttccc

SEQ ID NO: 50014 - DNA, 22 bp, Artificial Sequence
  chemically synthesized
ccctgcctgagtcctaaaggac

SEQ ID NO: 50015 - DNA, 22 bp, Artificial Sequence
  chemically synthesized
cctgcctgagtcctaaaggacg

SEQ ID NO: 50016 - DNA, 22 bp, Artificial Sequence
  chemically synthesized
cctgagtcctaaaggacgccaa

SEQ ID NO: 50017 - DNA, 22 bp, Artificial Sequence
  chemically synthesized
agtcctaaaggacgccaatggg

SEQ ID NO: 50018 - DNA, 22 bp, Artificial Sequence
  chemically synthesized
aaggacgccaatgggcctcgag

SEQ ID NO: 50019 - DNA, 22 bp, Artificial Sequence
  chemically synthesized
gagaatacctccgccccttctc

SEQ ID NO: 50020 - DNA, 22 bp, Artificial Sequence
  chemically synthesized
cgccccttctcccctgcccctt

SEQ ID NO: 50021 - DNA, 22 bp, Artificial Sequence
  chemically synthesized
ctcccctgccccttcagctggt

SEQ ID NO: 50022 - DNA, 22 bp, Artificial Sequence
  chemically synthesized
tcccctgccccttcagctggtt

SEQ ID NO: 50023 - DNA, 22 bp, Artificial Sequence
  chemically synthesized
ccctgccccttcagctggttct

SEQ ID NO: 50024 - DNA, 22 bp, Artificial Sequence
  chemically synthesized
ccccttcagctggttcttttct

SEQ ID NO: 50025 - DNA, 22 bp, Artificial Sequence
  chemically synthesized
cagctggttcttttcttcggct

SEQ ID NO: 50026 - DNA, 22 bp, Artificial Sequence
  chemically synthesized
agctggttcttttcttcggctg

SEQ ID NO: 50027 - DNA, 22 bp, Artificial Sequence
  chemically synthesized
gttcttttcttcggctgaaaca

SEQ ID NO: 50028 - DNA, 22 bp, Artificial Sequence
  chemically synthesized
ttttcttcggctgaaacagatg

SEQ ID NO: 50029 - DNA, 22 bp, Artificial Sequence
  chemically synthesized
ttcttcggctgaaacagatgga

SEQ ID NO: 50030 - DNA, 22 bp, Artificial Sequence
  chemically synthesized
tcttcggctgaaacagatggaa

SEQ ID NO: 50031 - DNA, 22 bp, Artificial Sequence
  chemically synthesized
cttcggctgaaacagatggaat

SEQ ID NO: 50032 - DNA, 22 bp, Artificial Sequence
  chemically synthesized
ttcggctgaaacagatggaata

SEQ ID NO: 50033 - DNA, 22 bp, Artificial Sequence
  chemically synthesized
cggctgaaacagatggaatact

SEQ ID NO: 50034 - DNA, 22 bp, Artificial Sequence
  chemically synthesized
ggctgaaacagatggaatacta

SEQ ID NO: 50035 - DNA, 22 bp, Artificial Sequence
  chemically synthesized
aaacagatggaatactagagca

SEQ ID NO: 50036 - DNA, 22 bp, Artificial Sequence
  chemically synthesized
gagcatgagttctgtgtcataa

SEQ ID NO: 50037 - DNA, 22 bp, Artificial Sequence
  chemically synthesized
tgtgtcataaagaaattgcctc

SEQ ID NO: 50038 - DNA, 22 bp, Artificial Sequence
  chemically synthesized
tgtcataaagaaattgcctcgt

SEQ ID NO: 50039 - DNA, 22 bp, Artificial Sequence
  chemically synthesized
cctcgtgctcccagcatctgcc

SEQ ID NO: 50040 - DNA, 22 bp, Artificial Sequence
  chemically synthesized
gtgctcccagcatctgccgtcc

SEQ ID NO: 50041 - DNA, 22 bp, Artificial Sequence
  chemically synthesized
ccagcatctgccgtccttccca

SEQ ID NO: 50042 - DNA, 22 bp, Artificial Sequence
  chemically synthesized
ccgtccttcccaccccgcccct

SEQ ID NO: 50043 - DNA, 22 bp, Artificial Sequence
  chemically synthesized
cccaccccgcccctgtctcggg

SEQ ID NO: 50044 - DNA, 22 bp, Artificial Sequence
  chemically synthesized
ccaccccgcccctgtctcgggt

SEQ ID NO: 50045 - DNA, 22 bp, Artificial Sequence
  chemically synthesized
tctcgggtagggccttctctcc

SEQ ID NO: 50046 - DNA, 22 bp, Artificial Sequence
  chemically synthesized
gggtagggccttctctccaggc

SEQ ID NO: 50047 - DNA, 22 bp, Artificial Sequence
  chemically synthesized
ctctccaggccctccaccctcc

SEQ ID NO: 50048 - DNA, 22 bp, Artificial Sequence
  chemically synthesized
tctccaggccctccaccctccg

SEQ ID NO: 50049 - DNA, 22 bp, Artificial Sequence
  chemically synthesized
tccaggccctccaccctccgct

SEQ ID NO: 50050 - DNA, 22 bp, Artificial Sequence
  chemically synthesized
caggccctccaccctccgctgc

SEQ ID NO: 50051 - DNA, 22 bp, Artificial Sequence
  chemically synthesized
caccctccgctgcccatgtttt

SEQ ID NO: 50052 - DNA, 22 bp, Artificial Sequence
  chemically synthesized
cgctgcccatgttttccaaacc

SEQ ID NO: 50053 - DNA, 22 bp, Artificial Sequence
  chemically synthesized
cccatgttttccaaaccaaatc

SEQ ID NO: 50054 - DNA, 22 bp, Artificial Sequence
  chemically synthesized
tccaaaccaaatcggaacccac

SEQ ID NO: 50055 - DNA, 22 bp, Artificial Sequence
  chemically synthesized
ccaaaccaaatcggaacccact

SEQ ID NO: 50056 - DNA, 22 bp, Artificial Sequence
  chemically synthesized
caaaccaaatcggaacccacta

SEQ ID NO: 50057 - DNA, 22 bp, Artificial Sequence
  chemically synthesized
taatggcaagcccgctttctct

SEQ ID NO: 50058 - DNA, 22 bp, Artificial Sequence
  chemically synthesized
tctctgtgcctggtgcagttcc

SEQ ID NO: 50059 - DNA, 22 bp, Artificial Sequence
  chemically synthesized
ctctgtgcctggtgcagttccc

SEQ ID NO: 50060 - DNA, 22 bp, Artificial Sequence
  chemically synthesized
tctgtgcctggtgcagttccca

SEQ ID NO: 50061 - DNA, 22 bp, Artificial Sequence
  chemically synthesized
tgtgcctggtgcagttcccagt

SEQ ID NO: 50062 - DNA, 22 bp, Artificial Sequence
  chemically synthesized
tgcctggtgcagttcccagtac

SEQ ID NO: 50063 - DNA, 22 bp, Artificial Sequence
  chemically synthesized
gtgcagttcccagtacgttcca

SEQ ID NO: 50064 - DNA, 22 bp, Artificial Sequence
  chemically synthesized
ccagtacgttccaggcattcac

SEQ ID NO: 50065 - DNA, 22 bp, Artificial Sequence
  chemically synthesized
caggcattcactccttcaccca

SEQ ID NO: 50066 - DNA, 22 bp, Artificial Sequence
  chemically synthesized
actccttcacccacctgtgccg

SEQ ID NO: 50067 - DNA, 22 bp, Artificial Sequence
  chemically synthesized
cttcacccacctgtgccgcggc

SEQ ID NO: 50068 - DNA, 22 bp, Artificial Sequence
  chemically synthesized
cacccacctgtgccgcggcgag

SEQ ID NO: 50069 - DNA, 22 bp, Artificial Sequence
  chemically synthesized
acccacctgtgccgcggcgagg

SEQ ID NO: 50070 - DNA, 22 bp, Artificial Sequence
  chemically synthesized
tgccgcggcgaggcagaaactg

SEQ ID NO: 50071 - DNA, 22 bp, Artificial Sequence
  chemically synthesized
ggaaatctgggcaggatatcct

SEQ ID NO: 50072 - DNA, 22 bp, Artificial Sequence
  chemically synthesized
ggcaggatatcctggcagtgct

SEQ ID NO: 50073 - DNA, 22 bp, Artificial Sequence
  chemically synthesized
gcagtgctctgctcgcccttcc

SEQ ID NO: 50074 - DNA, 22 bp, Artificial Sequence
  chemically synthesized
tgctcgcccttcctcggcctcc

SEQ ID NO: 50075 - DNA, 22 bp, Artificial Sequence
  chemically synthesized
ctcgcccttcctcggcctccgg

SEQ ID NO: 50076 - DNA, 22 bp, Artificial Sequence
  chemically synthesized
gcccttcctcggcctccgggtc

SEQ ID NO: 50077 - DNA, 22 bp, Artificial Sequence
  chemically synthesized
cctcggcctccgggtctcccaa

SEQ ID NO: 50078 - DNA, 22 bp, Artificial Sequence
  chemically synthesized
ctcggcctccgggtctcccaac

SEQ ID NO: 50079 - DNA, 22 bp, Artificial Sequence
  chemically synthesized
ggcctccgggtctcccaacccc

SEQ ID NO: 50080 - DNA, 22 bp, Artificial Sequence
  chemically synthesized
cgggtctcccaaccccgcgaac

SEQ ID NO: 50081 - DNA, 22 bp, Artificial Sequence
  chemically synthesized
ccaaccccgcgaaccttcccac

SEQ ID NO: 50082 - DNA, 22 bp, Artificial Sequence
  chemically synthesized
cccactgaatagcgcagccgca

SEQ ID NO: 50083 - DNA, 22 bp, Artificial Sequence
  chemically synthesized
ccactgaatagcgcagccgcac

SEQ ID NO: 50084 - DNA, 22 bp, Artificial Sequence
  chemically synthesized
aatagcgcagccgcacgcccca

SEQ ID NO: 50085 - DNA, 22 bp, Artificial Sequence
  chemically synthesized
tccaccgtgctccccactaccc

SEQ ID NO: 50086 - DNA, 22 bp, Artificial Sequence
  chemically synthesized
caccgtgctccccactacccgt

SEQ ID NO: 50087 - DNA, 22 bp, Artificial Sequence
  chemically synthesized
cccactacccgtcctcccccgc

SEQ ID NO: 50088 - DNA, 22 bp, Artificial Sequence
  chemically synthesized
cccgtcctcccccgccgccttg

SEQ ID NO: 50089 - DNA, 22 bp, Artificial Sequence
  chemically synthesized
ccccgccgccttgcctgcagtc

SEQ ID NO: 50090 - DNA, 22 bp, Artificial Sequence
  chemically synthesized
gcctgcagtccccaagatcgtg

SEQ ID NO: 50091 - DNA, 22 bp, Artificial Sequence
  chemically synthesized
cctgcagtccccaagatcgtgc

SEQ ID NO: 50092 - DNA, 22 bp, Artificial Sequence
  chemically synthesized
cagtccccaagatcgtgccaag

SEQ ID NO: 50093 - DNA, 22 bp, Artificial Sequence
  chemically synthesized
ggcgacctgcactccacttcct

SEQ ID NO: 50094 - DNA, 22 bp, Artificial Sequence
  chemically synthesized
cactccacttcctctcttacat

SEQ ID NO: 50095 - DNA, 22 bp, Artificial Sequence
  chemically synthesized
cacttcctctcttacatggggg

SEQ ID NO: 50096 - DNA, 22 bp, Artificial Sequence
  chemically synthesized
cctctcttacatggggggaaac

SEQ ID NO: 50097 - DNA, 22 bp, Artificial Sequence
  chemically synthesized
ctctcttacatggggggaaact

SEQ ID NO: 50098 - DNA, 22 bp, Artificial Sequence
  chemically synthesized
tcttacatggggggaaactgag

SEQ ID NO: 50099 - DNA, 22 bp, Artificial Sequence
  chemically synthesized
ttacatggggggaaactgaggc

SEQ ID NO: 50100 - DNA, 22 bp, Artificial Sequence
  chemically synthesized
acatggggggaaactgaggccc

SEQ ID NO: 50101 - DNA, 22 bp, Artificial Sequence
  chemically synthesized
catggggggaaactgaggcccg

SEQ ID NO: 50102 - DNA, 22 bp, Artificial Sequence
  chemically synthesized
aggcccgagaggaaacagcacc

SEQ ID NO: 50103 - DNA, 22 bp, Artificial Sequence
  chemically synthesized
cgggttcgccccggcctcccat

SEQ ID NO: 50104 - DNA, 22 bp, Artificial Sequence
  chemically synthesized
gccccggcctcccatccctaca

SEQ ID NO: 50105 - DNA, 22 bp, Artificial Sequence
  chemically synthesized
ccatccctacacccgcaccttg

SEQ ID NO: 50106 - DNA, 22 bp, Artificial Sequence
  chemically synthesized
cacccgcaccttggcgcagcgg

SEQ ID NO: 50107 - DNA, 22 bp, Artificial Sequence
  chemically synthesized
ggcgcagcggtggaaggtggct

SEQ ID NO: 50108 - DNA, 22 bp, Artificial Sequence
  chemically synthesized
gcgcagcggtggaaggtggctg

SEQ ID NO: 50109 - DNA, 22 bp, Artificial Sequence
  chemically synthesized
tggttccgtgctcgggtgcttc

SEQ ID NO: 50110 - DNA, 22 bp, Artificial Sequence
  chemically synthesized
cgtgctcgggtgcttcggccag

SEQ ID NO: 50111 - DNA, 22 bp, Artificial Sequence
  chemically synthesized
gggtgcttcggccaggccgtcc

SEQ ID NO: 50112 - DNA, 22 bp, Artificial Sequence
  chemically synthesized
cggccaggccgtcctcctcgga

SEQ ID NO: 50113 - DNA, 22 bp, Artificial Sequence
  chemically synthesized
ggccaggccgtcctcctcggaa

SEQ ID NO: 50114 - DNA, 22 bp, Artificial Sequence
  chemically synthesized
ctcggaacgcaaggctagcacc

SEQ ID NO: 50115 - DNA, 22 bp, Artificial Sequence
  chemically synthesized
ggaacgcaaggctagcaccagc

SEQ ID NO: 50116 - DNA, 22 bp, Artificial Sequence
  chemically synthesized
gcaccagctcctcgtagtcgcc

SEQ ID NO: 50117 - DNA, 22 bp, Artificial Sequence
  chemically synthesized
ctcgtagtcgccgtcctcgtcc

SEQ ID NO: 50118 - DNA, 22 bp, Artificial Sequence
  chemically synthesized
gtagtcgccgtcctcgtcctcc

SEQ ID NO: 50119 - DNA, 22 bp, Artificial Sequence
  chemically synthesized
gtcctcctgcgcacgggcgccc

SEQ ID NO: 50120 - DNA, 22 bp, Artificial Sequence
  chemically synthesized
ctgcgcacgggcgcccgcggga

SEQ ID NO: 50121 - DNA, 22 bp, Artificial Sequence
  chemically synthesized
cgcacgggcgcccgcgggaccc

SEQ ID NO: 50122 - DNA, 22 bp, Artificial Sequence
  chemically synthesized
gagctgacggtgcccatgaggg

SEQ ID NO: 50123 - DNA, 22 bp, Artificial Sequence
  chemically synthesized
acggtgcccatgagggccaggg

SEQ ID NO: 50124 - DNA, 22 bp, Artificial Sequence
  chemically synthesized
ctgtcctggcgaggagacctag

SEQ ID NO: 50125 - DNA, 22 bp, Artificial Sequence
  chemically synthesized
tcctggcgaggagacctagagg

SEQ ID NO: 50126 - DNA, 22 bp, Artificial Sequence
  chemically synthesized
gcgaggagacctagaggccgtg

SEQ ID NO: 50127 - DNA, 22 bp, Artificial Sequence
  chemically synthesized
gaggccgtgcgcggtccacgcc

SEQ ID NO: 50128 - DNA, 22 bp, Artificial Sequence
  chemically synthesized
gagccttgcggtggggaggact

SEQ ID NO: 50129 - DNA, 22 bp, Artificial Sequence
  chemically synthesized
agccttgcggtggggaggactg

SEQ ID NO: 50130 - DNA, 22 bp, Artificial Sequence
  chemically synthesized
gcggtggggaggactgtgcagg

SEQ ID NO: 50131 - DNA, 22 bp, Artificial Sequence
  chemically synthesized
cggtggggaggactgtgcagga

SEQ ID NO: 50132 - DNA, 22 bp, Artificial Sequence
  chemically synthesized
tgcaggagctgaagttcaggag

SEQ ID NO: 50133 - DNA, 22 bp, Artificial Sequence
  chemically synthesized
aagttcaggagcagggcgcgtg

SEQ ID NO: 50134 - DNA, 22 bp, Artificial Sequence
  chemically synthesized
aggagcagggcgcgtgaagggg

SEQ ID NO: 50135 - DNA, 22 bp, Artificial Sequence
  chemically synthesized
gctgggagctgggagccgctgc

SEQ ID NO: 50136 - DNA, 22 bp, Artificial Sequence
  chemically synthesized
ggagctgggagccgctgctgca

SEQ ID NO: 50137 - DNA, 22 bp, Artificial Sequence
  chemically synthesized
ggagccgctgctgcaacgacgc

SEQ ID NO: 50138 - DNA, 22 bp, Artificial Sequence
  chemically synthesized
ctgcaacgacgcgtcccggccc

SEQ ID NO: 50139 - DNA, 22 bp, Artificial Sequence
  chemically synthesized
caacgacgcgtcccggcccgcc

SEQ ID NO: 50140 - DNA, 22 bp, Artificial Sequence
  chemically synthesized
actgcctggctcactcctccag

SEQ ID NO: 50141 - DNA, 22 bp, Artificial Sequence
  chemically synthesized
cctggctcactcctccaggctc

SEQ ID NO: 50142 - DNA, 22 bp, Artificial Sequence
  chemically synthesized
gctcactcctccaggctcagac

SEQ ID NO: 50143 - DNA, 22 bp, Artificial Sequence
  chemically synthesized
actcctccaggctcagaccctg

SEQ ID NO: 50144 - DNA, 22 bp, Artificial Sequence
  chemically synthesized
ctccaggctcagaccctgaact

SEQ ID NO: 50145 - DNA, 22 bp, Artificial Sequence
  chemically synthesized
caggctcagaccctgaactgaa

SEQ ID NO: 50146 - DNA, 22 bp, Artificial Sequence
  chemically synthesized
agaccctgaactgaacggcggc

SEQ ID NO: 50147 - DNA, 22 bp, Artificial Sequence
  chemically synthesized
aactgaacggcggcgcccgcct

SEQ ID NO: 50148 - DNA, 22 bp, Artificial Sequence
  chemically synthesized
aacggcggcgcccgcctgcaac

SEQ ID NO: 50149 - DNA, 22 bp, Artificial Sequence
  chemically synthesized
caaccatgagcgcctcgacgtc

SEQ ID NO: 50150 - DNA, 22 bp, Artificial Sequence
  chemically synthesized
gacgtcgctgcggaaaccttct

SEQ ID NO: 50151 - DNA, 22 bp, Artificial Sequence
  chemically synthesized
cggaaaccttctagggtgtggg

SEQ ID NO: 50152 - DNA, 22 bp, Artificial Sequence
  chemically synthesized
ctagggtgtgggtgcttgacgc

SEQ ID NO: 50153 - DNA, 22 bp, Artificial Sequence
  chemically synthesized
tagggtgtgggtgcttgacgcc

SEQ ID NO: 50154 - DNA, 22 bp, Artificial Sequence
  chemically synthesized
gggtgtgggtgcttgacgcctg

SEQ ID NO: 50155 - DNA, 22 bp, Artificial Sequence
  chemically synthesized
gacgcctggggcgcgcagatca

SEQ ID NO: 50156 - DNA, 22 bp, Artificial Sequence
  chemically synthesized
acgcctggggcgcgcagatcac

SEQ ID NO: 50157 - DNA, 22 bp, Artificial Sequence
  chemically synthesized
gggcgcgcagatcacgccacca

SEQ ID NO: 50158 - DNA, 22 bp, Artificial Sequence
  chemically synthesized
tctgattaaacattaacggaac

SEQ ID NO: 50159 - DNA, 22 bp, Artificial Sequence
  chemically synthesized
attaaacattaacggaaccccc

SEQ ID NO: 50160 - DNA, 22 bp, Artificial Sequence
  chemically synthesized
aacattaacggaacccccggac

SEQ ID NO: 50161 - DNA, 22 bp, Artificial Sequence
  chemically synthesized
acggaacccccggactggagga

SEQ ID NO: 50162 - DNA, 22 bp, Artificial Sequence
  chemically synthesized
gaggatcaggtttcggcctcgc

SEQ ID NO: 50163 - DNA, 22 bp, Artificial Sequence
  chemically synthesized
cggcctcgccctccccaaacag

SEQ ID NO: 50164 - DNA, 22 bp, Artificial Sequence
  chemically synthesized
ggcctcgccctccccaaacagc

SEQ ID NO: 50165 - DNA, 22 bp, Artificial Sequence
  chemically synthesized
gccctccccaaacagcgtcaga

SEQ ID NO: 50166 - DNA, 22 bp, Artificial Sequence
  chemically synthesized
cccaaacagcgtcagattacgc

SEQ ID NO: 50167 - DNA, 22 bp, Artificial Sequence
  chemically synthesized
cgcgcagagggaagaaaaaact

SEQ ID NO: 50168 - DNA, 22 bp, Artificial Sequence
  chemically synthesized
ccaaatcctaactgggctggaa

SEQ ID NO: 50169 - DNA, 22 bp, Artificial Sequence
  chemically synthesized
actgggctggaaggcaggccgg

SEQ ID NO: 50170 - DNA, 22 bp, Artificial Sequence
  chemically synthesized
ggctggaaggcaggccggcgcc

SEQ ID NO: 50171 - DNA, 22 bp, Artificial Sequence
  chemically synthesized
gaaggcaggccggcgccctagg

SEQ ID NO: 50172 - DNA, 22 bp, Artificial Sequence
  chemically synthesized
ggggctcctcctctcccgcctc

SEQ ID NO: 50173 - DNA, 22 bp, Artificial Sequence
  chemically synthesized
ctcctctcccgcctctcaccct

SEQ ID NO: 50174 - DNA, 22 bp, Artificial Sequence
  chemically synthesized
ctctcccgcctctcaccctgcg

SEQ ID NO: 50175 - DNA, 22 bp, Artificial Sequence
  chemically synthesized
tcccgcctctcaccctgcgtgg

SEQ ID NO: 50176 - DNA, 22 bp, Artificial Sequence
  chemically synthesized
ccgcctctcaccctgcgtggga

SEQ ID NO: 50177 - DNA, 22 bp, Artificial Sequence
  chemically synthesized
tcaccctgcgtgggatgccaga

SEQ ID NO: 50178 - DNA, 22 bp, Artificial Sequence
  chemically synthesized
accctgcgtgggatgccagact

SEQ ID NO: 50179 - DNA, 22 bp, Artificial Sequence
  chemically synthesized
cgtgggatgccagactccaagt

SEQ ID NO: 50180 - DNA, 22 bp, Artificial Sequence
  chemically synthesized
caagttctgccgggcccacctt

SEQ ID NO: 50181 - DNA, 22 bp, Artificial Sequence
  chemically synthesized
tgccgggcccaccttttcagtg

SEQ ID NO: 50182 - DNA, 22 bp, Artificial Sequence
  chemically synthesized
ccgggcccaccttttcagtgtt

SEQ ID NO: 50183 - DNA, 22 bp, Artificial Sequence
  chemically synthesized
ttcagtgtttcctgggtccacc

SEQ ID NO: 50184 - DNA, 22 bp, Artificial Sequence
  chemically synthesized
tcagtgtttcctgggtccacct

SEQ ID NO: 50185 - DNA, 22 bp, Artificial Sequence
  chemically synthesized
cagtgtttcctgggtccacctt

SEQ ID NO: 50186 - DNA, 22 bp, Artificial Sequence
  chemically synthesized
agtgtttcctgggtccaccttg

SEQ ID NO: 50187 - DNA, 22 bp, Artificial Sequence
  chemically synthesized
cctgggtccaccttgtctcctg

SEQ ID NO: 50188 - DNA, 22 bp, Artificial Sequence
  chemically synthesized
ctgggtccaccttgtctcctgc

SEQ ID NO: 50189 - DNA, 22 bp, Artificial Sequence
  chemically synthesized
ggtccaccttgtctcctgctga

SEQ ID NO: 50190 - DNA, 22 bp, Artificial Sequence
  chemically synthesized
gtctcctgctgaccagtgagac

SEQ ID NO: 50191 - DNA, 22 bp, Artificial Sequence
  chemically synthesized
tctcctgctgaccagtgagact

SEQ ID NO: 50192 - DNA, 22 bp, Artificial Sequence
  chemically synthesized
ctgctgaccagtgagacttctg

SEQ ID NO: 50193 - DNA, 22 bp, Artificial Sequence
  chemically synthesized
ctgaccagtgagacttctgaat

SEQ ID NO: 50194 - DNA, 22 bp, Artificial Sequence
  chemically synthesized
accagtgagacttctgaatcaa

SEQ ID NO: 50195 - DNA, 22 bp, Artificial Sequence
  chemically synthesized
ctgaatcaatcctactgtggac

SEQ ID NO: 50196 - DNA, 22 bp, Artificial Sequence
  chemically synthesized
tgaatcaatcctactgtggact

SEQ ID NO: 50197 - DNA, 22 bp, Artificial Sequence
  chemically synthesized
aatcaatcctactgtggactcc

SEQ ID NO: 50198 - DNA, 22 bp, Artificial Sequence
  chemically synthesized
ctgtggactcctcgctgcccac

SEQ ID NO: 50199 - DNA, 22 bp, Artificial Sequence
  chemically synthesized
tggactcctcgctgcccaccga

SEQ ID NO: 50200 - DNA, 22 bp, Artificial Sequence
  chemically synthesized
ctcgctgcccaccgaattcttt

SEQ ID NO: 50201 - DNA, 22 bp, Artificial Sequence
  chemically synthesized
gctgcccaccgaattctttcca

SEQ ID NO: 50202 - DNA, 22 bp, Artificial Sequence
  chemically synthesized
cccaccgaattctttccactgg

SEQ ID NO: 50203 - DNA, 22 bp, Artificial Sequence
  chemically synthesized
tttccactggccttaacctggc

SEQ ID NO: 50204 - DNA, 22 bp, Artificial Sequence
  chemically synthesized
tccactggccttaacctggcag

SEQ ID NO: 50205 - DNA, 22 bp, Artificial Sequence
  chemically synthesized
ccactggccttaacctggcagc

SEQ ID NO: 50206 - DNA, 22 bp, Artificial Sequence
  chemically synthesized
cactggccttaacctggcagcc

SEQ ID NO: 50207 - DNA, 22 bp, Artificial Sequence
  chemically synthesized
gccttaacctggcagccttcta

SEQ ID NO: 50208 - DNA, 22 bp, Artificial Sequence
  chemically synthesized
aacctggcagccttctaaactt

SEQ ID NO: 50209 - DNA, 22 bp, Artificial Sequence
  chemically synthesized
acctggcagccttctaaactta

SEQ ID NO: 50210 - DNA, 22 bp, Artificial Sequence
  chemically synthesized
gcagccttctaaacttagcctg

SEQ ID NO: 50211 - DNA, 22 bp, Artificial Sequence
  chemically synthesized
ctaaacttagcctggaccccct

SEQ ID NO: 50212 - DNA, 22 bp, Artificial Sequence
  chemically synthesized
taaacttagcctggaccccctc

SEQ ID NO: 50213 - DNA, 22 bp, Artificial Sequence
  chemically synthesized
aacttagcctggaccccctccg

SEQ ID NO: 50214 - DNA, 22 bp, Artificial Sequence
  chemically synthesized
agcctggaccccctccggcctc

SEQ ID NO: 50215 - DNA, 22 bp, Artificial Sequence
  chemically synthesized
gcctggaccccctccggcctct

SEQ ID NO: 50216 - DNA, 22 bp, Artificial Sequence
  chemically synthesized
gaccccctccggcctctgccct

SEQ ID NO: 50217 - DNA, 22 bp, Artificial Sequence
  chemically synthesized
cggcctctgccctttatgcacc

SEQ ID NO: 50218 - DNA, 22 bp, Artificial Sequence
  chemically synthesized
tgccctttatgcaccctgcaca

SEQ ID NO: 50219 - DNA, 22 bp, Artificial Sequence
  chemically synthesized
ccctttatgcaccctgcacact

SEQ ID NO: 50220 - DNA, 22 bp, Artificial Sequence
  chemically synthesized
tatgcaccctgcacactgacct

SEQ ID NO: 50221 - DNA, 22 bp, Artificial Sequence
  chemically synthesized
atgcaccctgcacactgacctt

SEQ ID NO: 50222 - DNA, 22 bp, Artificial Sequence
  chemically synthesized
tgcaccctgcacactgacctta

SEQ ID NO: 50223 - DNA, 22 bp, Artificial Sequence
  chemically synthesized
cacactgaccttaccaactagc

SEQ ID NO: 50224 - DNA, 22 bp, Artificial Sequence
  chemically synthesized
accttaccaactagctgctcct

SEQ ID NO: 50225 - DNA, 22 bp, Artificial Sequence
  chemically synthesized
accaactagctgctccttgaag

SEQ ID NO: 50226 - DNA, 22 bp, Artificial Sequence
  chemically synthesized
ccaactagctgctccttgaaga

SEQ ID NO: 50227 - DNA, 22 bp, Artificial Sequence
  chemically synthesized
gctgctccttgaagagattgct

SEQ ID NO: 50228 - DNA, 22 bp, Artificial Sequence
  chemically synthesized
ctccttgaagagattgcttgct

SEQ ID NO: 50229 - DNA, 22 bp, Artificial Sequence
  chemically synthesized
cttgaagagattgcttgctttt

SEQ ID NO: 50230 - DNA, 22 bp, Artificial Sequence
  chemically synthesized
gaagagattgcttgcttttgat

SEQ ID NO: 50231 - DNA, 22 bp, Artificial Sequence
  chemically synthesized
aagagattgcttgcttttgatg

SEQ ID NO: 50232 - DNA, 22 bp, Artificial Sequence
  chemically synthesized
cttgcttttgatgtccagccta

SEQ ID NO: 50233 - DNA, 22 bp, Artificial Sequence
  chemically synthesized
gcttttgatgtccagcctacat

SEQ ID NO: 50234 - DNA, 22 bp, Artificial Sequence
  chemically synthesized
cttttgatgtccagcctacatg

SEQ ID NO: 50235 - DNA, 22 bp, Artificial Sequence
  chemically synthesized
ttgatgtccagcctacatgcat

SEQ ID NO: 50236 - DNA, 22 bp, Artificial Sequence
  chemically synthesized
tgatgtccagcctacatgcatt

SEQ ID NO: 50237 - DNA, 22 bp, Artificial Sequence
  chemically synthesized
gatgtccagcctacatgcattt

SEQ ID NO: 50238 - DNA, 22 bp, Artificial Sequence
  chemically synthesized
atgtccagcctacatgcatttc

SEQ ID NO: 50239 - DNA, 22 bp, Artificial Sequence
  chemically synthesized
catgcatttcaagggatttata

SEQ ID NO: 50240 - DNA, 22 bp, Artificial Sequence
  chemically synthesized
caagggatttatactacaaaga

SEQ ID NO: 50241 - DNA, 22 bp, Artificial Sequence
  chemically synthesized
aagggatttatactacaaagat

SEQ ID NO: 50242 - DNA, 22 bp, Artificial Sequence
  chemically synthesized
atactacaaagattcaggtttt

SEQ ID NO: 50243 - DNA, 22 bp, Artificial Sequence
  chemically synthesized
tactacaaagattcaggtttta

SEQ ID NO: 50244 - DNA, 22 bp, Artificial Sequence
  chemically synthesized
caaagattcaggttttaagttt

SEQ ID NO: 50245 - DNA, 22 bp, Artificial Sequence
  chemically synthesized
aggttttaagtttgcaaagacg

SEQ ID NO: 50246 - DNA, 22 bp, Artificial Sequence
  chemically synthesized
taagtttgcaaagacgtcatat

SEQ ID NO: 50247 - DNA, 22 bp, Artificial Sequence
  chemically synthesized
aagtttgcaaagacgtcatata

SEQ ID NO: 50248 - DNA, 22 bp, Artificial Sequence
  chemically synthesized
agtttgcaaagacgtcatatag

SEQ ID NO: 50249 - DNA, 22 bp, Artificial Sequence
  chemically synthesized
gcaaagacgtcatataggtaca

SEQ ID NO: 50250 - DNA, 22 bp, Artificial Sequence
  chemically synthesized
caaagacgtcatataggtacat

SEQ ID NO: 50251 - DNA, 22 bp, Artificial Sequence
  chemically synthesized
agaattctatggtaggcacaag

SEQ ID NO: 50252 - DNA, 22 bp, Artificial Sequence
  chemically synthesized
tatggtaggcacaagctcagct

SEQ ID NO: 50253 - DNA, 22 bp, Artificial Sequence
  chemically synthesized
tggtaggcacaagctcagcttt

SEQ ID NO: 50254 - DNA, 22 bp, Artificial Sequence
  chemically synthesized
agctttccagaagattcaattt

SEQ ID NO: 50255 - DNA, 22 bp, Artificial Sequence
  chemically synthesized
tccagaagattcaatttgcaaa

SEQ ID NO: 50256 - DNA, 22 bp, Artificial Sequence
  chemically synthesized
ccagaagattcaatttgcaaag

SEQ ID NO: 50257 - DNA, 22 bp, Artificial Sequence
  chemically synthesized
cagaagattcaatttgcaaaga

SEQ ID NO: 50258 - DNA, 22 bp, Artificial Sequence
  chemically synthesized
aatttgcaaagattccttttac

SEQ ID NO: 50259 - DNA, 22 bp, Artificial Sequence
  chemically synthesized
gcaaagattccttttacacacc

SEQ ID NO: 50260 - DNA, 22 bp, Artificial Sequence
  chemically synthesized
caaagattccttttacacacca

SEQ ID NO: 50261 - DNA, 22 bp, Artificial Sequence
  chemically synthesized
cttttacacaccatgttcaaga

SEQ ID NO: 50262 - DNA, 22 bp, Artificial Sequence
  chemically synthesized
ttacacaccatgttcaagaaat

SEQ ID NO: 50263 - DNA, 22 bp, Artificial Sequence
  chemically synthesized
tacacaccatgttcaagaaatc

SEQ ID NO: 50264 - DNA, 22 bp, Artificial Sequence
  chemically synthesized
acacaccatgttcaagaaatca

SEQ ID NO: 50265 - DNA, 22 bp, Artificial Sequence
  chemically synthesized
cacaccatgttcaagaaatcaa

SEQ ID NO: 50266 - DNA, 22 bp, Artificial Sequence
  chemically synthesized
aagaaatcaactggacaagcat

SEQ ID NO: 50267 - DNA, 22 bp, Artificial Sequence
  chemically synthesized
gacaagcatccagtaaacacct

SEQ ID NO: 50268 - DNA, 22 bp, Artificial Sequence
  chemically synthesized
ttgtgtaccaggcaggaggatg

SEQ ID NO: 50269 - DNA, 22 bp, Artificial Sequence
  chemically synthesized
tgtaccaggcaggaggatgaaa

SEQ ID NO: 50270 - DNA, 22 bp, Artificial Sequence
  chemically synthesized
ctggcctcagattgtacatgtg

SEQ ID NO: 50271 - DNA, 22 bp, Artificial Sequence
  chemically synthesized
gcctcagattgtacatgtggca

SEQ ID NO: 50272 - DNA, 22 bp, Artificial Sequence
  chemically synthesized
agattgtacatgtggcatgaca

SEQ ID NO: 50273 - DNA, 22 bp, Artificial Sequence
  chemically synthesized
tacatgtggcatgacatgaggc

SEQ ID NO: 50274 - DNA, 22 bp, Artificial Sequence
  chemically synthesized
gctctttctggaagggctgtcg

SEQ ID NO: 50275 - DNA, 22 bp, Artificial Sequence
  chemically synthesized
ctctttctggaagggctgtcga

SEQ ID NO: 50276 - DNA, 22 bp, Artificial Sequence
  chemically synthesized
tttctggaagggctgtcgatac

SEQ ID NO: 50277 - DNA, 22 bp, Artificial Sequence
  chemically synthesized
tctggaagggctgtcgatactg

SEQ ID NO: 50278 - DNA, 22 bp, Artificial Sequence
  chemically synthesized
ctggaagggctgtcgatactgg

SEQ ID NO: 50279 - DNA, 22 bp, Artificial Sequence
  chemically synthesized
tggaagggctgtcgatactggg

SEQ ID NO: 50280 - DNA, 22 bp, Artificial Sequence
  chemically synthesized
gaagggctgtcgatactgggaa

SEQ ID NO: 50281 - DNA, 22 bp, Artificial Sequence
  chemically synthesized
tcgatactgggaagaaacaaag

SEQ ID NO: 50282 - DNA, 22 bp, Artificial Sequence
  chemically synthesized
ggaagaaacaaaggcgaattta

SEQ ID NO: 50283 - DNA, 22 bp, Artificial Sequence
  chemically synthesized
atgatcctcccttgcagatgca

SEQ ID NO: 50284 - DNA, 22 bp, Artificial Sequence
  chemically synthesized
tgatcctcccttgcagatgcac

SEQ ID NO: 50285 - DNA, 22 bp, Artificial Sequence
  chemically synthesized
ccttgcagatgcacagcagatt

SEQ ID NO: 50286 - DNA, 22 bp, Artificial Sequence
  chemically synthesized
gcagatgcacagcagattccga

SEQ ID NO: 50287 - DNA, 22 bp, Artificial Sequence
  chemically synthesized
cagatgcacagcagattccgag

SEQ ID NO: 50288 - DNA, 22 bp, Artificial Sequence
  chemically synthesized
cgagtgaaatggcctgctctga

SEQ ID NO: 50289 - DNA, 22 bp, Artificial Sequence
  chemically synthesized
ctctgaatctaggtgctggagt

SEQ ID NO: 50290 - DNA, 22 bp, Artificial Sequence
  chemically synthesized
tgaatctaggtgctggagtcca

SEQ ID NO: 50291 - DNA, 22 bp, Artificial Sequence
  chemically synthesized
aatctaggtgctggagtccaaa

SEQ ID NO: 50292 - DNA, 22 bp, Artificial Sequence
  chemically synthesized
ggtgctggagtccaaagttgat

SEQ ID NO: 50293 - DNA, 22 bp, Artificial Sequence
  chemically synthesized
gagtccaaagttgatgctcttt

SEQ ID NO: 50294 - DNA, 22 bp, Artificial Sequence
  chemically synthesized
atgctctttccactttgtttgc

SEQ ID NO: 50295 - DNA, 22 bp, Artificial Sequence
  chemically synthesized
tttccactttgtttgcaaagac

SEQ ID NO: 50296 - DNA, 22 bp, Artificial Sequence
  chemically synthesized
tccactttgtttgcaaagacct

SEQ ID NO: 50297 - DNA, 22 bp, Artificial Sequence
  chemically synthesized
ccactttgtttgcaaagacctc

SEQ ID NO: 50298 - DNA, 22 bp, Artificial Sequence
  chemically synthesized
cactttgtttgcaaagacctca

SEQ ID NO: 50299 - DNA, 22 bp, Artificial Sequence
  chemically synthesized
tgtttgcaaagacctcactcca

SEQ ID NO: 50300 - DNA, 22 bp, Artificial Sequence
  chemically synthesized
gtttgcaaagacctcactccag

SEQ ID NO: 50301 - DNA, 22 bp, Artificial Sequence
  chemically synthesized
tttgcaaagacctcactccaga

SEQ ID NO: 50302 - DNA, 22 bp, Artificial Sequence
  chemically synthesized
gcaaagacctcactccagagag

SEQ ID NO: 50303 - DNA, 22 bp, Artificial Sequence
  chemically synthesized
caaagacctcactccagagagc

SEQ ID NO: 50304 - DNA, 22 bp, Artificial Sequence
  chemically synthesized
actccagagagccagtgcacaa

SEQ ID NO: 50305 - DNA, 22 bp, Artificial Sequence
  chemically synthesized
cagagagccagtgcacaaagac

SEQ ID NO: 50306 - DNA, 22 bp, Artificial Sequence
  chemically synthesized
acagtgactccatgaggtaagg

SEQ ID NO: 50307 - DNA, 22 bp, Artificial Sequence
  chemically synthesized
catgaggtaaggtcagagttat

SEQ ID NO: 50308 - DNA, 22 bp, Artificial Sequence
  chemically synthesized
tccccatcgagcccgccatcgc

SEQ ID NO: 50309 - DNA, 22 bp, Artificial Sequence
  chemically synthesized
atggtttgctgacagaggtggc

SEQ ID NO: 50310 - DNA, 22 bp, Artificial Sequence
  chemically synthesized
gctgacagaggtggcagaggtg

SEQ ID NO: 50311 - DNA, 22 bp, Artificial Sequence
  chemically synthesized
ctgacagaggtggcagaggtgg

SEQ ID NO: 50312 - DNA, 22 bp, Artificial Sequence
  chemically synthesized
acagaggtggcagaggtggttc

SEQ ID NO: 50313 - DNA, 22 bp, Artificial Sequence
  chemically synthesized
tccttcctgttgcctgtaattg

SEQ ID NO: 50314 - DNA, 22 bp, Artificial Sequence
  chemically synthesized
cttcctgttgcctgtaattgga

SEQ ID NO: 50315 - DNA, 22 bp, Artificial Sequence
  chemically synthesized
cctgttgcctgtaattggaatt

SEQ ID NO: 50316 - DNA, 22 bp, Artificial Sequence
  chemically synthesized
ctgttgcctgtaattggaattg

SEQ ID NO: 50317 - DNA, 22 bp, Artificial Sequence
  chemically synthesized
ttgcctgtaattggaattgtat

SEQ ID NO: 50318 - DNA, 22 bp, Artificial Sequence
  chemically synthesized
cctgtaattggaattgtatttg

SEQ ID NO: 50319 - DNA, 22 bp, Artificial Sequence
  chemically synthesized
taattggaattgtatttgcaat

SEQ ID NO: 50320 - DNA, 22 bp, Artificial Sequence
  chemically synthesized
gaattgtatttgcaatgtgctt

SEQ ID NO: 50321 - DNA, 22 bp, Artificial Sequence
  chemically synthesized
tatttgcaatgtgcttttggca

SEQ ID NO: 50322 - DNA, 22 bp, Artificial Sequence
  chemically synthesized
gcaatgtgcttttggcagcttc

SEQ ID NO: 50323 - DNA, 22 bp, Artificial Sequence
  chemically synthesized
caatgtgcttttggcagcttcc

SEQ ID NO: 50324 - DNA, 22 bp, Artificial Sequence
  chemically synthesized
ttggcagcttcctcatcaaagg

SEQ ID NO: 50325 - DNA, 22 bp, Artificial Sequence
  chemically synthesized
tggcagcttcctcatcaaaggc

SEQ ID NO: 50326 - DNA, 22 bp, Artificial Sequence
  chemically synthesized
ggcagcttcctcatcaaaggcc

SEQ ID NO: 50327 - DNA, 22 bp, Artificial Sequence
  chemically synthesized
gcagcttcctcatcaaaggcct

SEQ ID NO: 50328 - DNA, 22 bp, Artificial Sequence
  chemically synthesized
cctcatcaaaggcctcccctgg

SEQ ID NO: 50329 - DNA, 22 bp, Artificial Sequence
  chemically synthesized
ctcatcaaaggcctcccctgga

SEQ ID NO: 50330 - DNA, 22 bp, Artificial Sequence
  chemically synthesized
atcaaaggcctcccctggagca

SEQ ID NO: 50331 - DNA, 22 bp, Artificial Sequence
  chemically synthesized
ccctggagcaagaatagatggg

SEQ ID NO: 50332 - DNA, 22 bp, Artificial Sequence
  chemically synthesized
gagcaagaatagatgggagcta

SEQ ID NO: 50333 - DNA, 22 bp, Artificial Sequence
  chemically synthesized
actttccctgctgctccccttt

SEQ ID NO: 50334 - DNA, 22 bp, Artificial Sequence
  chemically synthesized
tccctgctgctcccctttggga

SEQ ID NO: 50335 - DNA, 22 bp, Artificial Sequence
  chemically synthesized
ccctgctgctcccctttgggac

SEQ ID NO: 50336 - DNA, 22 bp, Artificial Sequence
  chemically synthesized
cctgctgctcccctttgggacc

SEQ ID NO: 50337 - DNA, 22 bp, Artificial Sequence
  chemically synthesized
ctgctcccctttgggaccttgg

SEQ ID NO: 50338 - DNA, 22 bp, Artificial Sequence
  chemically synthesized
ctcccctttgggaccttggcct

SEQ ID NO: 50339 - DNA, 22 bp, Artificial Sequence
  chemically synthesized
ccctttgggaccttggcctctc

SEQ ID NO: 50340 - DNA, 22 bp, Artificial Sequence
  chemically synthesized
tgggaccttggcctctcaccta

SEQ ID NO: 50341 - DNA, 22 bp, Artificial Sequence
  chemically synthesized
gggaccttggcctctcacctac

SEQ ID NO: 50342 - DNA, 22 bp, Artificial Sequence
  chemically synthesized
ggaccttggcctctcacctacc

SEQ ID NO: 50343 - DNA, 22 bp, Artificial Sequence
  chemically synthesized
ggcctctcacctaccggggtcg

SEQ ID NO: 50344 - DNA, 22 bp, Artificial Sequence
  chemically synthesized
gcctctcacctaccggggtcgt

SEQ ID NO: 50345 - DNA, 20 bp, Artificial Sequence
  chemically synthesized
gtaaggctgaggcctggcac

SEQ ID NO: 50346 - DNA, 20 bp, Artificial Sequence
  chemically synthesized
gcctggcacaggtctgttcc

SEQ ID NO: 50347 - DNA, 20 bp, Artificial Sequence
  chemically synthesized
ggtctgttcctggtcatatc

SEQ ID NO: 50348 - DNA, 20 bp, Artificial Sequence
  chemically synthesized
tctgttcctggtcatatctg

SEQ ID NO: 50349 - DNA, 20 bp, Artificial Sequence
  chemically synthesized
ctgttcctggtcatatctgg

SEQ ID NO: 50350 - DNA, 20 bp, Artificial Sequence
  chemically synthesized
tgttcctggtcatatctgga

SEQ ID NO: 50351 - DNA, 20 bp, Artificial Sequence
  chemically synthesized
gttcctggtcatatctggag

SEQ ID NO: 50352 - DNA, 20 bp, Artificial Sequence
  chemically synthesized
ctggtcatatctggagggga

SEQ ID NO: 50353 - DNA, 20 bp, Artificial Sequence
  chemically synthesized
ggtcatatctggaggggatg

SEQ ID NO: 50354 - DNA, 20 bp, Artificial Sequence
  chemically synthesized
ctggaggggatggagaatgt

SEQ ID NO: 50355 - DNA, 20 bp, Artificial Sequence
  chemically synthesized
aggggatggagaatgtgagc

SEQ ID NO: 50356 - DNA, 20 bp, Artificial Sequence
  chemically synthesized
cgttcctccccacccctctc

SEQ ID NO: 50357 - DNA, 20 bp, Artificial Sequence
  chemically synthesized
gaccttaacctcctcatcta

SEQ ID NO: 50358 - DNA, 20 bp, Artificial Sequence
  chemically synthesized
cttaacctcctcatctatag

SEQ ID NO: 50359 - DNA, 20 bp, Artificial Sequence
  chemically synthesized
ttaacctcctcatctataga

SEQ ID NO: 50360 - DNA, 20 bp, Artificial Sequence
  chemically synthesized
taacctcctcatctatagaa

SEQ ID NO: 50361 - DNA, 20 bp, Artificial Sequence
  chemically synthesized
aacctcctcatctatagaag

SEQ ID NO: 50362 - DNA, 20 bp, Artificial Sequence
  chemically synthesized
cctcctcatctatagaaggg

SEQ ID NO: 50363 - DNA, 20 bp, Artificial Sequence
  chemically synthesized
ctcatctatagaaggggaga

SEQ ID NO: 50364 - DNA, 20 bp, Artificial Sequence
  chemically synthesized
ggggagaaagatgcatgccc

SEQ ID NO: 50365 - DNA, 20 bp, Artificial Sequence
  chemically synthesized
gagaaagatgcatgcccaag

SEQ ID NO: 50366 - DNA, 20 bp, Artificial Sequence
  chemically synthesized
aaagatgcatgcccaagcag

SEQ ID NO: 50367 - DNA, 20 bp, Artificial Sequence
  chemically synthesized
aagatgcatgcccaagcagt

SEQ ID NO: 50368 - DNA, 20 bp, Artificial Sequence
  chemically synthesized
gatgcatgcccaagcagtag

SEQ ID NO: 50369 - DNA, 20 bp, Artificial Sequence
  chemically synthesized
tgcatgcccaagcagtagga

SEQ ID NO: 50370 - DNA, 20 bp, Artificial Sequence
  chemically synthesized
gcatgcccaagcagtaggag

SEQ ID NO: 50371 - DNA, 20 bp, Artificial Sequence
  chemically synthesized
tgcccaagcagtaggagagg

SEQ ID NO: 50372 - DNA, 20 bp, Artificial Sequence
  chemically synthesized
caagcagtaggagaggtggt

SEQ ID NO: 50373 - DNA, 20 bp, Artificial Sequence
  chemically synthesized
aagcagtaggagaggtggtg

SEQ ID NO: 50374 - DNA, 20 bp, Artificial Sequence
  chemically synthesized
aggagaggtggtgaggctta

SEQ ID NO: 50375 - DNA, 20 bp, Artificial Sequence
  chemically synthesized
ggagaggtggtgaggcttat

SEQ ID NO: 50376 - DNA, 20 bp, Artificial Sequence
  chemically synthesized
agaggtggtgaggcttatag

SEQ ID NO: 50377 - DNA, 20 bp, Artificial Sequence
  chemically synthesized
gtgaggcttataggagacaa

SEQ ID NO: 50378 - DNA, 20 bp, Artificial Sequence
  chemically synthesized
ggcttataggagacaacaga

SEQ ID NO: 50379 - DNA, 20 bp, Artificial Sequence
  chemically synthesized
gcttataggagacaacagac

SEQ ID NO: 50380 - DNA, 20 bp, Artificial Sequence
  chemically synthesized
ttataggagacaacagacag

SEQ ID NO: 50381 - DNA, 20 bp, Artificial Sequence
  chemically synthesized
caacagacaggagcccccga

SEQ ID NO: 50382 - DNA, 20 bp, Artificial Sequence
  chemically synthesized
agacaggagcccccgacaga

SEQ ID NO: 50383 - DNA, 20 bp, Artificial Sequence
  chemically synthesized
acaggagcccccgacagaca

SEQ ID NO: 50384 - DNA, 20 bp, Artificial Sequence
  chemically synthesized
caggagcccccgacagacag

SEQ ID NO: 50385 - DNA, 20 bp, Artificial Sequence
  chemically synthesized
ggagcccccgacagacagag

SEQ ID NO: 50386 - DNA, 20 bp, Artificial Sequence
  chemically synthesized
agacagaggagctgtgcaaa

SEQ ID NO: 50387 - DNA, 20 bp, Artificial Sequence
  chemically synthesized
agaggagctgtgcaaacaga

SEQ ID NO: 50388 - DNA, 20 bp, Artificial Sequence
  chemically synthesized
gctgtgcaaacagaaagaaa

SEQ ID NO: 50389 - DNA, 20 bp, Artificial Sequence
  chemically synthesized
ttgttgctgttgctgtatct

SEQ ID NO: 50390 - DNA, 20 bp, Artificial Sequence
  chemically synthesized
tgctgttgctgtatcttggc

SEQ ID NO: 50391 - DNA, 20 bp, Artificial Sequence
  chemically synthesized
ttggctggtgtcccccatcc

SEQ ID NO: 50392 - DNA, 20 bp, Artificial Sequence
  chemically synthesized
tggctggtgtcccccatcct

SEQ ID NO: 50393 - DNA, 20 bp, Artificial Sequence
  chemically synthesized
ggctggtgtcccccatcctg

SEQ ID NO: 50394 - DNA, 20 bp, Artificial Sequence
  chemically synthesized
tgtcccccatcctggggtgc

SEQ ID NO: 50395 - DNA, 20 bp, Artificial Sequence
  chemically synthesized
gtcccccatcctggggtgcc

SEQ ID NO: 50396 - DNA, 20 bp, Artificial Sequence
  chemically synthesized
atcctggggtgccaggactg

SEQ ID NO: 50397 - DNA, 20 bp, Artificial Sequence
  chemically synthesized
gggtgccaggactgcagacc

SEQ ID NO: 50398 - DNA, 20 bp, Artificial Sequence
  chemically synthesized
ccctcatccacttctgctta

SEQ ID NO: 50399 - DNA, 20 bp, Artificial Sequence
  chemically synthesized
cctcatccacttctgcttac

SEQ ID NO: 50400 - DNA, 20 bp, Artificial Sequence
  chemically synthesized
ccacttctgcttacaggaac

SEQ ID NO: 50401 - DNA, 20 bp, Artificial Sequence
  chemically synthesized
acaggaaccagtgtatccac

SEQ ID NO: 50402 - DNA, 20 bp, Artificial Sequence
  chemically synthesized
caggaaccagtgtatccacc

SEQ ID NO: 50403 - DNA, 20 bp, Artificial Sequence
  chemically synthesized
ggaaccagtgtatccaccag

SEQ ID NO: 50404 - DNA, 20 bp, Artificial Sequence
  chemically synthesized
gaaccagtgtatccaccagg

SEQ ID NO: 50405 - DNA, 20 bp, Artificial Sequence
  chemically synthesized
tgtatccaccaggaggtacc

SEQ ID NO: 50406 - DNA, 20 bp, Artificial Sequence
  chemically synthesized
gtatccaccaggaggtaccg

SEQ ID NO: 50407 - DNA, 20 bp, Artificial Sequence
  chemically synthesized
tatccaccaggaggtaccga

SEQ ID NO: 50408 - DNA, 20 bp, Artificial Sequence
  chemically synthesized
atccaccaggaggtaccgag

SEQ ID NO: 50409 - DNA, 20 bp, Artificial Sequence
  chemically synthesized
tccaccaggaggtaccgagg

SEQ ID NO: 50410 - DNA, 20 bp, Artificial Sequence
  chemically synthesized
ccaccaggaggtaccgaggg

SEQ ID NO: 50411 - DNA, 20 bp, Artificial Sequence
  chemically synthesized
aggaggtaccgaggggggac

SEQ ID NO: 50412 - DNA, 20 bp, Artificial Sequence
  chemically synthesized
ggaggtaccgaggggggacc

SEQ ID NO: 50413 - DNA, 20 bp, Artificial Sequence
  chemically synthesized
ggtaccgaggggggaccggg

SEQ ID NO: 50414 - DNA, 20 bp, Artificial Sequence
  chemically synthesized
gtaccgaggggggaccgggc

SEQ ID NO: 50415 - DNA, 20 bp, Artificial Sequence
  chemically synthesized
gaggggggaccgggcaggac

SEQ ID NO: 50416 - DNA, 20 bp, Artificial Sequence
  chemically synthesized
aggggggaccgggcaggact

SEQ ID NO: 50417 - DNA, 20 bp, Artificial Sequence
  chemically synthesized
gaccgggcaggactgggaaa

SEQ ID NO: 50418 - DNA, 20 bp, Artificial Sequence
  chemically synthesized
accgggcaggactgggaaac

SEQ ID NO: 50419 - DNA, 20 bp, Artificial Sequence
  chemically synthesized
gaaacaggacacaaccctca

SEQ ID NO: 50420 - DNA, 20 bp, Artificial Sequence
  chemically synthesized
ggctgctgttattatgaaaa

SEQ ID NO: 50421 - DNA, 20 bp, Artificial Sequence
  chemically synthesized
gctgctgttattatgaaaat

SEQ ID NO: 50422 - DNA, 20 bp, Artificial Sequence
  chemically synthesized
tgctgttattatgaaaatag

SEQ ID NO: 50423 - DNA, 20 bp, Artificial Sequence
  chemically synthesized
ttattatgaaaataggagct

SEQ ID NO: 50424 - DNA, 20 bp, Artificial Sequence
  chemically synthesized
tgaaaataggagctcagctg

SEQ ID NO: 50425 - DNA, 20 bp, Artificial Sequence
  chemically synthesized
tctccatctgccctgcacct

SEQ ID NO: 50426 - DNA, 20 bp, Artificial Sequence
  chemically synthesized
ccatctgccctgcacctcag

SEQ ID NO: 50427 - DNA, 20 bp, Artificial Sequence
  chemically synthesized
catctgccctgcacctcagc

SEQ ID NO: 50428 - DNA, 20 bp, Artificial Sequence
  chemically synthesized
ctgccctgcacctcagcagg

SEQ ID NO: 50429 - DNA, 20 bp, Artificial Sequence
  chemically synthesized
ccacaacccccctcctgccc

SEQ ID NO: 50430 - DNA, 20 bp, Artificial Sequence
  chemically synthesized
ccccagacctgctgcctgcc

SEQ ID NO: 50431 - DNA, 20 bp, Artificial Sequence
  chemically synthesized
cccagacctgctgcctgcct

SEQ ID NO: 50432 - DNA, 20 bp, Artificial Sequence
  chemically synthesized
cctgctgcctgcctgggcca

SEQ ID NO: 50433 - DNA, 20 bp, Artificial Sequence
  chemically synthesized
ctgctgcctgcctgggccat

SEQ ID NO: 50434 - DNA, 20 bp, Artificial Sequence
  chemically synthesized
tgctgcctgcctgggccatg

SEQ ID NO: 50435 - DNA, 20 bp, Artificial Sequence
  chemically synthesized
ctgcctgcctgggccatggg

SEQ ID NO: 50436 - DNA, 20 bp, Artificial Sequence
  chemically synthesized
tgcctgggccatggggagct

SEQ ID NO: 50437 - DNA, 20 bp, Artificial Sequence
  chemically synthesized
ctgggccatggggagctcag

SEQ ID NO: 50438 - DNA, 20 bp, Artificial Sequence
  chemically synthesized
ggggagctcagaagcctctc

SEQ ID NO: 50439 - DNA, 20 bp, Artificial Sequence
  chemically synthesized
agcctctccagaacctctcg

SEQ ID NO: 50440 - DNA, 20 bp, Artificial Sequence
  chemically synthesized
tccagaacctctcgcagtga

SEQ ID NO: 50441 - DNA, 20 bp, Artificial Sequence
  chemically synthesized
ccagaacctctcgcagtgaa

SEQ ID NO: 50442 - DNA, 20 bp, Artificial Sequence
  chemically synthesized
atacttacgattcactgtcc

SEQ ID NO: 50443 - DNA, 20 bp, Artificial Sequence
  chemically synthesized
tacttacgattcactgtccc

SEQ ID NO: 50444 - DNA, 20 bp, Artificial Sequence
  chemically synthesized
tacgattcactgtcccaggt

SEQ ID NO: 50445 - DNA, 20 bp, Artificial Sequence
  chemically synthesized
gattcactgtcccaggtcag

SEQ ID NO: 50446 - DNA, 20 bp, Artificial Sequence
  chemically synthesized
tcactgtcccaggtcagtgg

SEQ ID NO: 50447 - DNA, 20 bp, Artificial Sequence
  chemically synthesized
caggtcagtggtggtgcctg

SEQ ID NO: 50448 - DNA, 20 bp, Artificial Sequence
  chemically synthesized
cagtggtggtgcctgaagct

SEQ ID NO: 50449 - DNA, 20 bp, Artificial Sequence
  chemically synthesized
agtggtggtgcctgaagctg

SEQ ID NO: 50450 - DNA, 20 bp, Artificial Sequence
  chemically synthesized
tggtggtgcctgaagctgag

SEQ ID NO: 50451 - DNA, 20 bp, Artificial Sequence
  chemically synthesized
ggtgcctgaagctgaggaga

SEQ ID NO: 50452 - DNA, 20 bp, Artificial Sequence
  chemically synthesized
gtgcctgaagctgaggagac

SEQ ID NO: 50453 - DNA, 20 bp, Artificial Sequence
  chemically synthesized
tgcctgaagctgaggagaca

SEQ ID NO: 50454 - DNA, 20 bp, Artificial Sequence
  chemically synthesized
ccctgtcctcgtccgtattt

SEQ ID NO: 50455 - DNA, 20 bp, Artificial Sequence
  chemically synthesized
tgtcctcgtccgtatttaag

SEQ ID NO: 50456 - DNA, 20 bp, Artificial Sequence
  chemically synthesized
cctcgtccgtatttaagcag

SEQ ID NO: 50457 - DNA, 20 bp, Artificial Sequence
  chemically synthesized
ccgtatttaagcagtggatc

SEQ ID NO: 50458 - DNA, 20 bp, Artificial Sequence
  chemically synthesized
gtatttaagcagtggatcca

SEQ ID NO: 50459 - DNA, 20 bp, Artificial Sequence
  chemically synthesized
tatttaagcagtggatccag

SEQ ID NO: 50460 - DNA, 20 bp, Artificial Sequence
  chemically synthesized
atttaagcagtggatccaga

SEQ ID NO: 50461 - DNA, 20 bp, Artificial Sequence
  chemically synthesized
tttaagcagtggatccagag

SEQ ID NO: 50462 - DNA, 20 bp, Artificial Sequence
  chemically synthesized
cagtggatccagaggggcaa

SEQ ID NO: 50463 - DNA, 20 bp, Artificial Sequence
  chemically synthesized
agtggatccagaggggcaac

SEQ ID NO: 50464 - DNA, 20 bp, Artificial Sequence
  chemically synthesized
gtggatccagaggggcaacg

SEQ ID NO: 50465 - DNA, 20 bp, Artificial Sequence
  chemically synthesized
tggatccagaggggcaacgg

SEQ ID NO: 50466 - DNA, 20 bp, Artificial Sequence
  chemically synthesized
gatccagaggggcaacgggg

SEQ ID NO: 50467 - DNA, 20 bp, Artificial Sequence
  chemically synthesized
atccagaggggcaacggggg

SEQ ID NO: 50468 - DNA, 20 bp, Artificial Sequence
  chemically synthesized
ggggcaacgggggaggctgc

SEQ ID NO: 50469 - DNA, 20 bp, Artificial Sequence
  chemically synthesized
gctgctggtgaatattaacc

SEQ ID NO: 50470 - DNA, 20 bp, Artificial Sequence
  chemically synthesized
ctgctggtgaatattaacca

SEQ ID NO: 50471 - DNA, 20 bp, Artificial Sequence
  chemically synthesized
aatattaaccaaggtcaccc

SEQ ID NO: 50472 - DNA, 20 bp, Artificial Sequence
  chemically synthesized
accaaggtcaccccagttat

SEQ ID NO: 50473 - DNA, 20 bp, Artificial Sequence
  chemically synthesized
caaggtcaccccagttatcg

SEQ ID NO: 50474 - DNA, 20 bp, Artificial Sequence
  chemically synthesized
aaggtcaccccagttatcgg

SEQ ID NO: 50475 - DNA, 20 bp, Artificial Sequence
  chemically synthesized
ggtcaccccagttatcggag

SEQ ID NO: 50476 - DNA, 20 bp, Artificial Sequence
  chemically synthesized
ccagttatcggaggagcaaa

SEQ ID NO: 50477 - DNA, 20 bp, Artificial Sequence
  chemically synthesized
cagttatcggaggagcaaac

SEQ ID NO: 50478 - DNA, 20 bp, Artificial Sequence
  chemically synthesized
agttatcggaggagcaaaca

SEQ ID NO: 50479 - DNA, 20 bp, Artificial Sequence
  chemically synthesized
gttatcggaggagcaaacag

SEQ ID NO: 50480 - DNA, 20 bp, Artificial Sequence
  chemically synthesized
cggaggagcaaacaggggct

SEQ ID NO: 50481 - DNA, 20 bp, Artificial Sequence
  chemically synthesized
caaacaggggctaagtccac

SEQ ID NO: 50482 - DNA, 20 bp, Artificial Sequence
  chemically synthesized
caggggctaagtccactggc

SEQ ID NO: 50483 - DNA, 20 bp, Artificial Sequence
  chemically synthesized
aggggctaagtccactggct

SEQ ID NO: 50484 - DNA, 20 bp, Artificial Sequence
  chemically synthesized
aagtccactggctgggatct

SEQ ID NO: 50485 - DNA, 20 bp, Artificial Sequence
  chemically synthesized
agtcgcccgcctacgctgcc

SEQ ID NO: 50486 - DNA, 20 bp, Artificial Sequence
  chemically synthesized
cgctgcccggacgctttgcc

SEQ ID NO: 50487 - DNA, 20 bp, Artificial Sequence
  chemically synthesized
gctgcccggacgctttgcct

SEQ ID NO: 50488 - DNA, 20 bp, Artificial Sequence
  chemically synthesized
gcccggacgctttgcctggg

SEQ ID NO: 50489 - DNA, 20 bp, Artificial Sequence
  chemically synthesized
cgctttgcctgggcagtgta

SEQ ID NO: 50490 - DNA, 20 bp, Artificial Sequence
  chemically synthesized
gcttccactgcacttaccga

SEQ ID NO: 50491 - DNA, 20 bp, Artificial Sequence
  chemically synthesized
cttccactgcacttaccgaa

SEQ ID NO: 50492 - DNA, 20 bp, Artificial Sequence
  chemically synthesized
tccactgcacttaccgaaag

SEQ ID NO: 50493 - DNA, 20 bp, Artificial Sequence
  chemically synthesized
ccgaaaggagtcattgtacc

SEQ ID NO: 50494 - DNA, 20 bp, Artificial Sequence
  chemically synthesized
aggagtcattgtacctggct

SEQ ID NO: 50495 - DNA, 20 bp, Artificial Sequence
  chemically synthesized
tgtacctggctcagaaacca

SEQ ID NO: 50496 - DNA, 20 bp, Artificial Sequence
  chemically synthesized
aaccacagcgtcctgtgtcc

SEQ ID NO: 50497 - DNA, 20 bp, Artificial Sequence
  chemically synthesized
accacagcgtcctgtgtcca

SEQ ID NO: 50498 - DNA, 20 bp, Artificial Sequence
  chemically synthesized
acagcgtcctgtgtccaagg

SEQ ID NO: 50499 - DNA, 20 bp, Artificial Sequence
  chemically synthesized
agcgtcctgtgtccaaggtg

SEQ ID NO: 50500 - DNA, 20 bp, Artificial Sequence
  chemically synthesized
gcgtcctgtgtccaaggtgg

SEQ ID NO: 50501 - DNA, 20 bp, Artificial Sequence
  chemically synthesized
cgtcctgtgtccaaggtgga

SEQ ID NO: 50502 - DNA, 20 bp, Artificial Sequence
  chemically synthesized
gtcctgtgtccaaggtggag

SEQ ID NO: 50503 - DNA, 20 bp, Artificial Sequence
  chemically synthesized
tcctgtgtccaaggtggagg

SEQ ID NO: 50504 - DNA, 20 bp, Artificial Sequence
  chemically synthesized
tgtgtccaaggtggaggggg

SEQ ID NO: 50505 - DNA, 20 bp, Artificial Sequence
  chemically synthesized
caaggtggagggggtggcgt

SEQ ID NO: 50506 - DNA, 20 bp, Artificial Sequence
  chemically synthesized
gtggagggggtggcgtgagt

SEQ ID NO: 50507 - DNA, 20 bp, Artificial Sequence
  chemically synthesized
agggggtggcgtgagtcaga

SEQ ID NO: 50508 - DNA, 20 bp, Artificial Sequence
  chemically synthesized
ggcgtgagtcagacagtctc

SEQ ID NO: 50509 - DNA, 20 bp, Artificial Sequence
  chemically synthesized
gcgtgagtcagacagtctct

SEQ ID NO: 50510 - DNA, 20 bp, Artificial Sequence
  chemically synthesized
gtgagtcagacagtctctgg

SEQ ID NO: 50511 - DNA, 20 bp, Artificial Sequence
  chemically synthesized
gagtcagacagtctctggga

SEQ ID NO: 50512 - DNA, 20 bp, Artificial Sequence
  chemically synthesized
gtctctgggagagtaccact

SEQ ID NO: 50513 - DNA, 20 bp, Artificial Sequence
  chemically synthesized
ctgggagagtaccacttagc

SEQ ID NO: 50514 - DNA, 20 bp, Artificial Sequence
  chemically synthesized
ctggccctctgctctcactg

SEQ ID NO: 50515 - DNA, 20 bp, Artificial Sequence
  chemically synthesized
tgctctcactgcagaatcct

SEQ ID NO: 50516 - DNA, 20 bp, Artificial Sequence
  chemically synthesized
tctcactgcagaatccttag

SEQ ID NO: 50517 - DNA, 20 bp, Artificial Sequence
  chemically synthesized
atccttagtggctgttccac

SEQ ID NO: 50518 - DNA, 20 bp, Artificial Sequence
  chemically synthesized
cttagtggctgttccactgg

SEQ ID NO: 50519 - DNA, 20 bp, Artificial Sequence
  chemically synthesized
gtggctgttccactggtagc

SEQ ID NO: 50520 - DNA, 20 bp, Artificial Sequence
  chemically synthesized
agcaagatctaccatttact

SEQ ID NO: 50521 - DNA, 20 bp, Artificial Sequence
  chemically synthesized
ccccaaaatgcctgatgctg

SEQ ID NO: 50522 - DNA, 20 bp, Artificial Sequence
  chemically synthesized
ctgaagacttactgccgccc

SEQ ID NO: 50523 - DNA, 20 bp, Artificial Sequence
  chemically synthesized
tgaagacttactgccgccct

SEQ ID NO: 50524 - DNA, 20 bp, Artificial Sequence
  chemically synthesized
aagacttactgccgccctgg

SEQ ID NO: 50525 - DNA, 20 bp, Artificial Sequence
  chemically synthesized
ttactgccgccctgggagat

SEQ ID NO: 50526 - DNA, 20 bp, Artificial Sequence
  chemically synthesized
actgccgccctgggagatca

SEQ ID NO: 50527 - DNA, 20 bp, Artificial Sequence
  chemically synthesized
gccgccctgggagatcagag

SEQ ID NO: 50528 - DNA, 20 bp, Artificial Sequence
  chemically synthesized
ccgccctgggagatcagagt

SEQ ID NO: 50529 - DNA, 20 bp, Artificial Sequence
  chemically synthesized
cctgggagatcagagtgggt

SEQ ID NO: 50530 - DNA, 20 bp, Artificial Sequence
  chemically synthesized
tgggagatcagagtgggtta

SEQ ID NO: 50531 - DNA, 20 bp, Artificial Sequence
  chemically synthesized
gtgggttagagcccatttga

SEQ ID NO: 50532 - DNA, 20 bp, Artificial Sequence
  chemically synthesized
ttagagcccatttgacagat

SEQ ID NO: 50533 - DNA, 20 bp, Artificial Sequence
  chemically synthesized
tagagcccatttgacagatg

SEQ ID NO: 50534 - DNA, 20 bp, Artificial Sequence
  chemically synthesized
ccatttgacagatgaggaaa

SEQ ID NO: 50535 - DNA, 20 bp, Artificial Sequence
  chemically synthesized
catttgacagatgaggaaac

SEQ ID NO: 50536 - DNA, 20 bp, Artificial Sequence
  chemically synthesized
gacagatgaggaaacaggct

SEQ ID NO: 50537 - DNA, 20 bp, Artificial Sequence
  chemically synthesized
cagatgaggaaacaggctca

SEQ ID NO: 50538 - DNA, 20 bp, Artificial Sequence
  chemically synthesized
atgaggaaacaggctcagag

SEQ ID NO: 50539 - DNA, 20 bp, Artificial Sequence
  chemically synthesized
gaggaaacaggctcagagcg

SEQ ID NO: 50540 - DNA, 20 bp, Artificial Sequence
  chemically synthesized
ggaaacaggctcagagcgga

SEQ ID NO: 50541 - DNA, 20 bp, Artificial Sequence
  chemically synthesized
gcggagagaccgctcatcca

SEQ ID NO: 50542 - DNA, 20 bp, Artificial Sequence
  chemically synthesized
accgctcatccaaagttacc

SEQ ID NO: 50543 - DNA, 20 bp, Artificial Sequence
  chemically synthesized
ctcatccaaagttacccagt

SEQ ID NO: 50544 - DNA, 20 bp, Artificial Sequence
  chemically synthesized
caaagttacccagtcagcct

SEQ ID NO: 50545 - DNA, 20 bp, Artificial Sequence
  chemically synthesized
agacacaaacaccctcttga

SEQ ID NO: 50546 - DNA, 20 bp, Artificial Sequence
  chemically synthesized
caccctcttgatggtcccga

SEQ ID NO: 50547 - DNA, 20 bp, Artificial Sequence
  chemically synthesized
tgatggtcccgatggaaaaa

SEQ ID NO: 50548 - DNA, 20 bp, Artificial Sequence
  chemically synthesized
atggtcccgatggaaaaatg

SEQ ID NO: 50549 - DNA, 20 bp, Artificial Sequence
  chemically synthesized
tggaaaaatggagcatgact

SEQ ID NO: 50550 - DNA, 20 bp, Artificial Sequence
  chemically synthesized
ggaaaaatggagcatgactg

SEQ ID NO: 50551 - DNA, 20 bp, Artificial Sequence
  chemically synthesized
aaaatggagcatgactgagg

SEQ ID NO: 50552 - DNA, 20 bp, Artificial Sequence
  chemically synthesized
actgaggcagacacaaccgt

SEQ ID NO: 50553 - DNA, 20 bp, Artificial Sequence
  chemically synthesized
ctgaggcagacacaaccgtc

SEQ ID NO: 50554 - DNA, 20 bp, Artificial Sequence
  chemically synthesized
ggcagacacaaccgtcaggc

SEQ ID NO: 50555 - DNA, 20 bp, Artificial Sequence
  chemically synthesized
acacaaccgtcaggctggca

SEQ ID NO: 50556 - DNA, 20 bp, Artificial Sequence
  chemically synthesized
cacaaccgtcaggctggcat

SEQ ID NO: 50557 - DNA, 20 bp, Artificial Sequence
  chemically synthesized
acaaccgtcaggctggcatg

SEQ ID NO: 50558 - DNA, 20 bp, Artificial Sequence
  chemically synthesized
caaccgtcaggctggcatgg

SEQ ID NO: 50559 - DNA, 20 bp, Artificial Sequence
  chemically synthesized
aaccgtcaggctggcatggg

SEQ ID NO: 50560 - DNA, 20 bp, Artificial Sequence
  chemically synthesized
aggctggcatggggggccgt

SEQ ID NO: 50561 - DNA, 20 bp, Artificial Sequence
  chemically synthesized
tggcatggggggccgtgaga

SEQ ID NO: 50562 - DNA, 20 bp, Artificial Sequence
  chemically synthesized
ggcatggggggccgtgagac

SEQ ID NO: 50563 - DNA, 20 bp, Artificial Sequence
  chemically synthesized
gcatggggggccgtgagaca

SEQ ID NO: 50564 - DNA, 20 bp, Artificial Sequence
  chemically synthesized
tggggggccgtgagacaggg

SEQ ID NO: 50565 - DNA, 20 bp, Artificial Sequence
  chemically synthesized
gggggccgtgagacagggta

SEQ ID NO: 50566 - DNA, 20 bp, Artificial Sequence
  chemically synthesized
ggggccgtgagacagggtag

SEQ ID NO: 50567 - DNA, 20 bp, Artificial Sequence
  chemically synthesized
gccgtgagacagggtagagg

SEQ ID NO: 50568 - DNA, 20 bp, Artificial Sequence
  chemically synthesized
ccgtgagacagggtagaggt

SEQ ID NO: 50569 - DNA, 20 bp, Artificial Sequence
  chemically synthesized
cgtgagacagggtagaggtg

SEQ ID NO: 50570 - DNA, 20 bp, Artificial Sequence
  chemically synthesized
gagacagggtagaggtgggg

SEQ ID NO: 50571 - DNA, 20 bp, Artificial Sequence
  chemically synthesized
ggtggggaagcacatctgta

SEQ ID NO: 50572 - DNA, 20 bp, Artificial Sequence
  chemically synthesized
ggggaagcacatctgtaaag

SEQ ID NO: 50573 - DNA, 20 bp, Artificial Sequence
  chemically synthesized
ggaagcacatctgtaaagaa

SEQ ID NO: 50574 - DNA, 20 bp, Artificial Sequence
  chemically synthesized
aaagaagagctgtgctgcct

SEQ ID NO: 50575 - DNA, 20 bp, Artificial Sequence
  chemically synthesized
aagaagagctgtgctgcctc

SEQ ID NO: 50576 - DNA, 20 bp, Artificial Sequence
  chemically synthesized
aagagctgtgctgcctcagg

SEQ ID NO: 50577 - DNA, 20 bp, Artificial Sequence
  chemically synthesized
agagctgtgctgcctcaggc

SEQ ID NO: 50578 - DNA, 20 bp, Artificial Sequence
  chemically synthesized
gccgcttcacctctctgaac

SEQ ID NO: 50579 - DNA, 20 bp, Artificial Sequence
  chemically synthesized
ccgcttcacctctctgaacc

SEQ ID NO: 50580 - DNA, 20 bp, Artificial Sequence
  chemically synthesized
actgtttcacctgcatccca

SEQ ID NO: 50581 - DNA, 20 bp, Artificial Sequence
  chemically synthesized
tgtttcacctgcatcccaaa

SEQ ID NO: 50582 - DNA, 20 bp, Artificial Sequence
  chemically synthesized
tcacctgcatcccaaagagt

SEQ ID NO: 50583 - DNA, 20 bp, Artificial Sequence
  chemically synthesized
cctgcatcccaaagagttgg

SEQ ID NO: 50584 - DNA, 20 bp, Artificial Sequence
  chemically synthesized
gagttggaagtttcattccc

SEQ ID NO: 50585 - DNA, 20 bp, Artificial Sequence
  chemically synthesized
cattcccaagcatgcttgtg

SEQ ID NO: 50586 - DNA, 20 bp, Artificial Sequence
  chemically synthesized
agcatgcttgtgaagtgcct

SEQ ID NO: 50587 - DNA, 20 bp, Artificial Sequence
  chemically synthesized
gcatgcttgtgaagtgcctc

SEQ ID NO: 50588 - DNA, 20 bp, Artificial Sequence
  chemically synthesized
cttgtgaagtgcctcgggtg

SEQ ID NO: 50589 - DNA, 20 bp, Artificial Sequence
  chemically synthesized
agtgcctcgggtgaagtgcc

SEQ ID NO: 50590 - DNA, 20 bp, Artificial Sequence
  chemically synthesized
cgggtgaagtgcctggcaca

SEQ ID NO: 50591 - DNA, 20 bp, Artificial Sequence
  chemically synthesized
gtgaagtgcctggcacacag

SEQ ID NO: 50592 - DNA, 20 bp, Artificial Sequence
  chemically synthesized
tgaagtgcctggcacacagt

SEQ ID NO: 50593 - DNA, 20 bp, Artificial Sequence
  chemically synthesized
cacacagtaggctctttatg

SEQ ID NO: 50594 - DNA, 20 bp, Artificial Sequence
  chemically synthesized
acacagtaggctctttatgt

SEQ ID NO: 50595 - DNA, 20 bp, Artificial Sequence
  chemically synthesized
gctctttatgtgggtctgca

SEQ ID NO: 50596 - DNA, 20 bp, Artificial Sequence
  chemically synthesized
ggtctgcacagccctctgct

SEQ ID NO: 50597 - DNA, 20 bp, Artificial Sequence
  chemically synthesized
cctctgcttagtctgccccc

SEQ ID NO: 50598 - DNA, 20 bp, Artificial Sequence
  chemically synthesized
ctctgcttagtctgcccccc

SEQ ID NO: 50599 - DNA, 20 bp, Artificial Sequence
  chemically synthesized
agtctgccccccaggctgct

SEQ ID NO: 50600 - DNA, 20 bp, Artificial Sequence
  chemically synthesized
tctgccccccaggctgctca

SEQ ID NO: 50601 - DNA, 20 bp, Artificial Sequence
  chemically synthesized
gccccccaggctgctcagag

SEQ ID NO: 50602 - DNA, 20 bp, Artificial Sequence
  chemically synthesized
ccccccaggctgctcagagc

SEQ ID NO: 50603 - DNA, 20 bp, Artificial Sequence
  chemically synthesized
ccccaggctgctcagagcag

SEQ ID NO: 50604 - DNA, 20 bp, Artificial Sequence
  chemically synthesized
cccaggctgctcagagcagg

SEQ ID NO: 50605 - DNA, 20 bp, Artificial Sequence
  chemically synthesized
caggctgctcagagcaggag

SEQ ID NO: 50606 - DNA, 20 bp, Artificial Sequence
  chemically synthesized
aggctgctcagagcaggagg

SEQ ID NO: 50607 - DNA, 20 bp, Artificial Sequence
  chemically synthesized
ggaggaggttcaattttgac

SEQ ID NO: 50608 - DNA, 20 bp, Artificial Sequence
  chemically synthesized
ggttcaattttgaccagcct

SEQ ID NO: 50609 - DNA, 20 bp, Artificial Sequence
  chemically synthesized
gttcaattttgaccagcctc

SEQ ID NO: 50610 - DNA, 20 bp, Artificial Sequence
  chemically synthesized
cctgtttctgtttttgctcc

SEQ ID NO: 50611 - DNA, 20 bp, Artificial Sequence
  chemically synthesized
tgtttttgctcctggaaaac

SEQ ID NO: 50612 - DNA, 20 bp, Artificial Sequence
  chemically synthesized
aaaccagtgtgatccgtata

SEQ ID NO: 50613 - DNA, 20 bp, Artificial Sequence
  chemically synthesized
agtgtgatccgtatacagct

SEQ ID NO: 50614 - DNA, 20 bp, Artificial Sequence
  chemically synthesized
tgtgatccgtatacagcttg

SEQ ID NO: 50615 - DNA, 20 bp, Artificial Sequence
  chemically synthesized
tatacagcttggagtttctt

SEQ ID NO: 50616 - DNA, 20 bp, Artificial Sequence
  chemically synthesized
ttggagtttctttggataca

SEQ ID NO: 50617 - DNA, 20 bp, Artificial Sequence
  chemically synthesized
tggatacatggcccccactc

SEQ ID NO: 50618 - DNA, 20 bp, Artificial Sequence
  chemically synthesized
ggatacatggcccccactct

SEQ ID NO: 50619 - DNA, 20 bp, Artificial Sequence
  chemically synthesized
gatacatggcccccactctg

SEQ ID NO: 50620 - DNA, 20 bp, Artificial Sequence
  chemically synthesized
ggcccccactctggggttgt

SEQ ID NO: 50621 - DNA, 20 bp, Artificial Sequence
  chemically synthesized
cccccactctggggttgttg

SEQ ID NO: 50622 - DNA, 20 bp, Artificial Sequence
  chemically synthesized
ccccactctggggttgttgg

SEQ ID NO: 50623 - DNA, 20 bp, Artificial Sequence
  chemically synthesized
ctggggttgttggaggcctt

SEQ ID NO: 50624 - DNA, 20 bp, Artificial Sequence
  chemically synthesized
ggggttgttggaggcctttg

SEQ ID NO: 50625 - DNA, 20 bp, Artificial Sequence
  chemically synthesized
tggaggcctttggagactgc

SEQ ID NO: 50626 - DNA, 20 bp, Artificial Sequence
  chemically synthesized
ggaggcctttggagactgct

SEQ ID NO: 50627 - DNA, 20 bp, Artificial Sequence
  chemically synthesized
gaggcctttggagactgctg

SEQ ID NO: 50628 - DNA, 20 bp, Artificial Sequence
  chemically synthesized
aggcctttggagactgctgg

SEQ ID NO: 50629 - DNA, 20 bp, Artificial Sequence
  chemically synthesized
cctttggagactgctggggg

SEQ ID NO: 50630 - DNA, 20 bp, Artificial Sequence
  chemically synthesized
tttggagactgctgggggtg

SEQ ID NO: 50631 - DNA, 20 bp, Artificial Sequence
  chemically synthesized
ttggagactgctgggggtgg

SEQ ID NO: 50632 - DNA, 20 bp, Artificial Sequence
  chemically synthesized
tggagactgctgggggtgga

SEQ ID NO: 50633 - DNA, 20 bp, Artificial Sequence
  chemically synthesized
ggagactgctgggggtggag

SEQ ID NO: 50634 - DNA, 20 bp, Artificial Sequence
  chemically synthesized
agactgctgggggtggaggg

SEQ ID NO: 50635 - DNA, 20 bp, Artificial Sequence
  chemically synthesized
gactgctgggggtggagggg

SEQ ID NO: 50636 - DNA, 20 bp, Artificial Sequence
  chemically synthesized
actgctgggggtggagggga

SEQ ID NO: 50637 - DNA, 20 bp, Artificial Sequence
  chemically synthesized
ctgctgggggtggaggggag

SEQ ID NO: 50638 - DNA, 20 bp, Artificial Sequence
  chemically synthesized
gctgggggtggaggggaggg

SEQ ID NO: 50639 - DNA, 20 bp, Artificial Sequence
  chemically synthesized
ctgggggtggaggggagggg

SEQ ID NO: 50640 - DNA, 20 bp, Artificial Sequence
  chemically synthesized
ggtggaggggaggggaggta

SEQ ID NO: 50641 - DNA, 20 bp, Artificial Sequence
  chemically synthesized
gtggaggggaggggaggtac

SEQ ID NO: 50642 - DNA, 20 bp, Artificial Sequence
  chemically synthesized
tggaggggaggggaggtaca

SEQ ID NO: 50643 - DNA, 20 bp, Artificial Sequence
  chemically synthesized
gggaggggaggtacagggtt

SEQ ID NO: 50644 - DNA, 20 bp, Artificial Sequence
  chemically synthesized
ggaggggaggtacagggttg

SEQ ID NO: 50645 - DNA, 20 bp, Artificial Sequence
  chemically synthesized
gggaggtacagggttgaggc

SEQ ID NO: 50646 - DNA, 20 bp, Artificial Sequence
  chemically synthesized
aggtacagggttgaggctag

SEQ ID NO: 50647 - DNA, 20 bp, Artificial Sequence
  chemically synthesized
ggtacagggttgaggctagt

SEQ ID NO: 50648 - DNA, 20 bp, Artificial Sequence
  chemically synthesized
gtacagggttgaggctagtg

SEQ ID NO: 50649 - DNA, 20 bp, Artificial Sequence
  chemically synthesized
cttgattgcaatccctttaa

SEQ ID NO: 50650 - DNA, 20 bp, Artificial Sequence
  chemically synthesized
atccctttaaaagcctaaat

SEQ ID NO: 50651 - DNA, 20 bp, Artificial Sequence
  chemically synthesized
gtgcaacccgcaaacctgct

SEQ ID NO: 50652 - DNA, 20 bp, Artificial Sequence
  chemically synthesized
tgcaacccgcaaacctgctt

SEQ ID NO: 50653 - DNA, 20 bp, Artificial Sequence
  chemically synthesized
caacccgcaaacctgcttgg

SEQ ID NO: 50654 - DNA, 20 bp, Artificial Sequence
  chemically synthesized
ccgcaaacctgcttgggagc

SEQ ID NO: 50655 - DNA, 20 bp, Artificial Sequence
  chemically synthesized
gggagctggcgtacgtgccg

SEQ ID NO: 50656 - DNA, 20 bp, Artificial Sequence
  chemically synthesized
gtacgtgccgtagatacttg

SEQ ID NO: 50657 - DNA, 20 bp, Artificial Sequence
  chemically synthesized
acgtgccgtagatacttgca

SEQ ID NO: 50658 - DNA, 20 bp, Artificial Sequence
  chemically synthesized
gtagatacttgcagagtgaa

SEQ ID NO: 50659 - DNA, 20 bp, Artificial Sequence
  chemically synthesized
tacttgcagagtgaatggat

SEQ ID NO: 50660 - DNA, 20 bp, Artificial Sequence
  chemically synthesized
ttgccccttctgtcattcac

SEQ ID NO: 50661 - DNA, 20 bp, Artificial Sequence
  chemically synthesized
tcccatttatgcctccacct

SEQ ID NO: 50662 - DNA, 20 bp, Artificial Sequence
  chemically synthesized
cccatttatgcctccacctt

SEQ ID NO: 50663 - DNA, 20 bp, Artificial Sequence
  chemically synthesized
ccatttatgcctccaccttg

SEQ ID NO: 50664 - DNA, 20 bp, Artificial Sequence
  chemically synthesized
cctccaccttggggctctac

SEQ ID NO: 50665 - DNA, 20 bp, Artificial Sequence
  chemically synthesized
ctccaccttggggctctacc

SEQ ID NO: 50666 - DNA, 20 bp, Artificial Sequence
  chemically synthesized
accttggggctctaccaggc

SEQ ID NO: 50667 - DNA, 20 bp, Artificial Sequence
  chemically synthesized
tctaccaggcgagtgaccca

SEQ ID NO: 50668 - DNA, 20 bp, Artificial Sequence
  chemically synthesized
ctaccaggcgagtgacccac

SEQ ID NO: 50669 - DNA, 20 bp, Artificial Sequence
  chemically synthesized
gagtgacccacaggatcctc

SEQ ID NO: 50670 - DNA, 20 bp, Artificial Sequence
  chemically synthesized
gatcctccagcacacacatt

SEQ ID NO: 50671 - DNA, 20 bp, Artificial Sequence
  chemically synthesized
tccagcacacacattcagac

SEQ ID NO: 50672 - DNA, 20 bp, Artificial Sequence
  chemically synthesized
ccagcacacacattcagacc

SEQ ID NO: 50673 - DNA, 20 bp, Artificial Sequence
  chemically synthesized
cagcacacacattcagacca

SEQ ID NO: 50674 - DNA, 20 bp, Artificial Sequence
  chemically synthesized
agaccagggaacccacttac

SEQ ID NO: 50675 - DNA, 20 bp, Artificial Sequence
  chemically synthesized
ggaacccacttactggctgt

SEQ ID NO: 50676 - DNA, 20 bp, Artificial Sequence
  chemically synthesized
gaacccacttactggctgtg

SEQ ID NO: 50677 - DNA, 20 bp, Artificial Sequence
  chemically synthesized
acttactggctgtgaggcct

SEQ ID NO: 50678 - DNA, 20 bp, Artificial Sequence
  chemically synthesized
cttactggctgtgaggcctc

SEQ ID NO: 50679 - DNA, 20 bp, Artificial Sequence
  chemically synthesized
ctggctgtgaggcctcaggt

SEQ ID NO: 50680 - DNA, 20 bp, Artificial Sequence
  chemically synthesized
gtgagttgtttaaccgctcc

SEQ ID NO: 50681 - DNA, 20 bp, Artificial Sequence
  chemically synthesized
caatttccctatctgtaaaa

SEQ ID NO: 50682 - DNA, 20 bp, Artificial Sequence
  chemically synthesized
aatttccctatctgtaaaat

SEQ ID NO: 50683 - DNA, 20 bp, Artificial Sequence
  chemically synthesized
atttccctatctgtaaaatg

SEQ ID NO: 50684 - DNA, 20 bp, Artificial Sequence
  chemically synthesized
ccctatctgtaaaatgggga

SEQ ID NO: 50685 - DNA, 20 bp, Artificial Sequence
  chemically synthesized
ctgtaaaatggggatggtga

SEQ ID NO: 50686 - DNA, 20 bp, Artificial Sequence
  chemically synthesized
gtgacggtatgtaccttgtt

SEQ ID NO: 50687 - DNA, 20 bp, Artificial Sequence
  chemically synthesized
gtaccttgttgagctgctgt

SEQ ID NO: 50688 - DNA, 20 bp, Artificial Sequence
  chemically synthesized
taccttgttgagctgctgtg

SEQ ID NO: 50689 - DNA, 20 bp, Artificial Sequence
  chemically synthesized
ctgtgaggattaaaatgcaa

SEQ ID NO: 50690 - DNA, 20 bp, Artificial Sequence
  chemically synthesized
ggattaaaatgcaacagttc

SEQ ID NO: 50691 - DNA, 20 bp, Artificial Sequence
  chemically synthesized
gattaaaatgcaacagttca

SEQ ID NO: 50692 - DNA, 20 bp, Artificial Sequence
  chemically synthesized
aaaatgcaacagttcaagga

SEQ ID NO: 50693 - DNA, 20 bp, Artificial Sequence
  chemically synthesized
gcaacagttcaaggaaagct

SEQ ID NO: 50694 - DNA, 20 bp, Artificial Sequence
  chemically synthesized
aacagttcaaggaaagctca

SEQ ID NO: 50695 - DNA, 20 bp, Artificial Sequence
  chemically synthesized
gttcaaggaaagctcagaga

SEQ ID NO: 50696 - DNA, 20 bp, Artificial Sequence
  chemically synthesized
ttcaaggaaagctcagagac

SEQ ID NO: 50697 - DNA, 20 bp, Artificial Sequence
  chemically synthesized
gaaagctcagagacgggtac

SEQ ID NO: 50698 - DNA, 20 bp, Artificial Sequence
  chemically synthesized
aaagctcagagacgggtact

SEQ ID NO: 50699 - DNA, 20 bp, Artificial Sequence
  chemically synthesized
agacgggtactgggtgtgcc

SEQ ID NO: 50700 - DNA, 20 bp, Artificial Sequence
  chemically synthesized
gggtactgggtgtgcccaga

SEQ ID NO: 50701 - DNA, 20 bp, Artificial Sequence
  chemically synthesized
ctgccctccctcccccgtgt

SEQ ID NO: 50702 - DNA, 20 bp, Artificial Sequence
  chemically synthesized
tgccctccctcccccgtgtc

SEQ ID NO: 50703 - DNA, 20 bp, Artificial Sequence
  chemically synthesized
gccctccctcccccgtgtca

SEQ ID NO: 50704 - DNA, 20 bp, Artificial Sequence
  chemically synthesized
ccctccctcccccgtgtcag

SEQ ID NO: 50705 - DNA, 20 bp, Artificial Sequence
  chemically synthesized
ccctcccccgtgtcaggggc

SEQ ID NO: 50706 - DNA, 20 bp, Artificial Sequence
  chemically synthesized
gtgtcaggggctggtgtcac

SEQ ID NO: 50707 - DNA, 20 bp, Artificial Sequence
  chemically synthesized
tgtcaggggctggtgtcact

SEQ ID NO: 50708 - DNA, 20 bp, Artificial Sequence
  chemically synthesized
gtcaggggctggtgtcactg

SEQ ID NO: 50709 - DNA, 20 bp, Artificial Sequence
  chemically synthesized
aggggctggtgtcactgggg

SEQ ID NO: 50710 - DNA, 20 bp, Artificial Sequence
  chemically synthesized
ggggctggtgtcactggggt

SEQ ID NO: 50711 - DNA, 20 bp, Artificial Sequence
  chemically synthesized
gggctggtgtcactggggtg

SEQ ID NO: 50712 - DNA, 20 bp, Artificial Sequence
  chemically synthesized
ctggtgtcactggggtgggg

SEQ ID NO: 50713 - DNA, 20 bp, Artificial Sequence
  chemically synthesized
tggtgtcactggggtggggt

SEQ ID NO: 50714 - DNA, 20 bp, Artificial Sequence
  chemically synthesized
ggtggggtgggccacacttg

SEQ ID NO: 50715 - DNA, 20 bp, Artificial Sequence
  chemically synthesized
tggggtgggccacacttgaa

SEQ ID NO: 50716 - DNA, 20 bp, Artificial Sequence
  chemically synthesized
acacttgaagagctttcctc

SEQ ID NO: 50717 - DNA, 20 bp, Artificial Sequence
  chemically synthesized
cacttgaagagctttcctcc

SEQ ID NO: 50718 - DNA, 20 bp, Artificial Sequence
  chemically synthesized
ttgaagagctttcctccagg

SEQ ID NO: 50719 - DNA, 20 bp, Artificial Sequence
  chemically synthesized
cctccaggcagtctctcatt

SEQ ID NO: 50720 - DNA, 20 bp, Artificial Sequence
  chemically synthesized
tctcattcagttaccctgtg

SEQ ID NO: 50721 - DNA, 20 bp, Artificial Sequence
  chemically synthesized
ctcattcagttaccctgtga

SEQ ID NO: 50722 - DNA, 20 bp, Artificial Sequence
  chemically synthesized
tcattcagttaccctgtgaa

SEQ ID NO: 50723 - DNA, 20 bp, Artificial Sequence
  chemically synthesized
attcagttaccctgtgaagg

SEQ ID NO: 50724 - DNA, 20 bp, Artificial Sequence
  chemically synthesized
cagttaccctgtgaagggag

SEQ ID NO: 50725 - DNA, 20 bp, Artificial Sequence
  chemically synthesized
agttaccctgtgaagggagt

SEQ ID NO: 50726 - DNA, 20 bp, Artificial Sequence
  chemically synthesized
agtaggtaccaccctccttt

SEQ ID NO: 50727 - DNA, 20 bp, Artificial Sequence
  chemically synthesized
gtaggtaccaccctcctttc

SEQ ID NO: 50728 - DNA, 20 bp, Artificial Sequence
  chemically synthesized
ggtaccaccctcctttcagg

SEQ ID NO: 50729 - DNA, 20 bp, Artificial Sequence
  chemically synthesized
accaccctcctttcaggcag

SEQ ID NO: 50730 - DNA, 20 bp, Artificial Sequence
  chemically synthesized
ccaccctcctttcaggcagc

SEQ ID NO: 50731 - DNA, 20 bp, Artificial Sequence
  chemically synthesized
ctttcaggcagcgggaaact

SEQ ID NO: 50732 - DNA, 20 bp, Artificial Sequence
  chemically synthesized
aggcagcgggaaactgagct

SEQ ID NO: 50733 - DNA, 20 bp, Artificial Sequence
  chemically synthesized
actcccctccccttctctct

SEQ ID NO: 50734 - DNA, 20 bp, Artificial Sequence
  chemically synthesized
tctctgagctcccttccctg

SEQ ID NO: 50735 - DNA, 20 bp, Artificial Sequence
  chemically synthesized
ttccctgcagctccatcccc

SEQ ID NO: 50736 - DNA, 20 bp, Artificial Sequence
  chemically synthesized
gcagctccatcccctggctt

SEQ ID NO: 50737 - DNA, 20 bp, Artificial Sequence
  chemically synthesized
cagctccatcccctggcttc

SEQ ID NO: 50738 - DNA, 20 bp, Artificial Sequence
  chemically synthesized
agctccatcccctggcttca

SEQ ID NO: 50739 - DNA, 20 bp, Artificial Sequence
  chemically synthesized
agggcccctgtccttcccct

SEQ ID NO: 50740 - DNA, 20 bp, Artificial Sequence
  chemically synthesized
cccctgtccttcccctgagc

SEQ ID NO: 50741 - DNA, 20 bp, Artificial Sequence
  chemically synthesized
cttcccctgagctggctgaa

SEQ ID NO: 50742 - DNA, 20 bp, Artificial Sequence
  chemically synthesized
cgctgctctacatccactca

SEQ ID NO: 50743 - DNA, 20 bp, Artificial Sequence
  chemically synthesized
tctacatccactcacagctc

SEQ ID NO: 50744 - DNA, 20 bp, Artificial Sequence
  chemically synthesized
tccactcacagctccagcac

SEQ ID NO: 50745 - DNA, 20 bp, Artificial Sequence
  chemically synthesized
ccactcacagctccagcact

SEQ ID NO: 50746 - DNA, 20 bp, Artificial Sequence
  chemically synthesized
acagctccagcactgggctg

SEQ ID NO: 50747 - DNA, 20 bp, Artificial Sequence
  chemically synthesized
tccagcactgggctgtggtt

SEQ ID NO: 50748 - DNA, 20 bp, Artificial Sequence
  chemically synthesized
ccagcactgggctgtggttg

SEQ ID NO: 50749 - DNA, 20 bp, Artificial Sequence
  chemically synthesized
tggttgaggtcgcctgccct

SEQ ID NO: 50750 - DNA, 20 bp, Artificial Sequence
  chemically synthesized
ttgaggtcgcctgccctcgg

SEQ ID NO: 50751 - DNA, 20 bp, Artificial Sequence
  chemically synthesized
cgcctgccctcggtagctcc

SEQ ID NO: 50752 - DNA, 20 bp, Artificial Sequence
  chemically synthesized
gcctgccctcggtagctcct

SEQ ID NO: 50753 - DNA, 20 bp, Artificial Sequence
  chemically synthesized
tgggcatttcttcccctctc

SEQ ID NO: 50754 - DNA, 20 bp, Artificial Sequence
  chemically synthesized
gggcatttcttcccctctct

SEQ ID NO: 50755 - DNA, 20 bp, Artificial Sequence
  chemically synthesized
tgcacaatgacccccactct

SEQ ID NO: 50756 - DNA, 20 bp, Artificial Sequence
  chemically synthesized
cctgctgtccctcccacctg

SEQ ID NO: 50757 - DNA, 20 bp, Artificial Sequence
  chemically synthesized
tccctcccacctgtggaact

SEQ ID NO: 50758 - DNA, 20 bp, Artificial Sequence
  chemically synthesized
tcccacctgtggaactgagt

SEQ ID NO: 50759 - DNA, 20 bp, Artificial Sequence
  chemically synthesized
cacctgtggaactgagtgag

SEQ ID NO: 50760 - DNA, 20 bp, Artificial Sequence
  chemically synthesized
ctgtggaactgagtgagcag

SEQ ID NO: 50761 - DNA, 20 bp, Artificial Sequence
  chemically synthesized
tggaactgagtgagcagcag

SEQ ID NO: 50762 - DNA, 20 bp, Artificial Sequence
  chemically synthesized
ccacctttcctgctctcctc

SEQ ID NO: 50763 - DNA, 20 bp, Artificial Sequence
  chemically synthesized
gctctcctcaagctctcctc

SEQ ID NO: 50764 - DNA, 20 bp, Artificial Sequence
  chemically synthesized
tcctcaagctctgtctcttc

SEQ ID NO: 50765 - DNA, 20 bp, Artificial Sequence
  chemically synthesized
tcaagctctgtctcttctgg

SEQ ID NO: 50766 - DNA, 20 bp, Artificial Sequence
  chemically synthesized
caagctctgtctcttctggc

SEQ ID NO: 50767 - DNA, 20 bp, Artificial Sequence
  chemically synthesized
tctgtctcttctggcaggca

SEQ ID NO: 50768 - DNA, 20 bp, Artificial Sequence
  chemically synthesized
ctgtctcttctggcaggcac

SEQ ID NO: 50769 - DNA, 20 bp, Artificial Sequence
  chemically synthesized
gtctcttctggcaggcacag

SEQ ID NO: 50770 - DNA, 20 bp, Artificial Sequence
  chemically synthesized
ctcttctggcaggcacagga

SEQ ID NO: 50771 - DNA, 20 bp, Artificial Sequence
  chemically synthesized
ttctggcaggcacaggagag

SEQ ID NO: 50772 - DNA, 20 bp, Artificial Sequence
  chemically synthesized
aggcacaggagagtggcctg

SEQ ID NO: 50773 - DNA, 20 bp, Artificial Sequence
  chemically synthesized
ggcacaggagagtggcctga

SEQ ID NO: 50774 - DNA, 20 bp, Artificial Sequence
  chemically synthesized
caggagagtggcctgaaggc

SEQ ID NO: 50775 - DNA, 20 bp, Artificial Sequence
  chemically synthesized
gagagtggcctgaaggctgg

SEQ ID NO: 50776 - DNA, 20 bp, Artificial Sequence
  chemically synthesized
agagtggcctgaaggctggc

SEQ ID NO: 50777 - DNA, 20 bp, Artificial Sequence
  chemically synthesized
agtggcctgaaggctggcag

SEQ ID NO: 50778 - DNA, 20 bp, Artificial Sequence
  chemically synthesized
gtggcctgaaggctggcagg

SEQ ID NO: 50779 - DNA, 20 bp, Artificial Sequence
  chemically synthesized
aggttgccgcccctccaacc

SEQ ID NO: 50780 - DNA, 20 bp, Artificial Sequence
  chemically synthesized
cccctccaacctggaattcc

SEQ ID NO: 50781 - DNA, 20 bp, Artificial Sequence
  chemically synthesized
ctccaacctggaattcctgg

SEQ ID NO: 50782 - DNA, 20 bp, Artificial Sequence
  chemically synthesized
caacctggaattcctggcag

SEQ ID NO: 50783 - DNA, 20 bp, Artificial Sequence
  chemically synthesized
cctggaattcctggcagcag

SEQ ID NO: 50784 - DNA, 20 bp, Artificial Sequence
  chemically synthesized
ggaattcctggcagcagcag

SEQ ID NO: 50785 - DNA, 20 bp, Artificial Sequence
  chemically synthesized
ttcctggcagcagcagcggc

SEQ ID NO: 50786 - DNA, 20 bp, Artificial Sequence
  chemically synthesized
tcctggcagcagcagcggct

SEQ ID NO: 50787 - DNA, 20 bp, Artificial Sequence
  chemically synthesized
agcagcggctaggccttcct

SEQ ID NO: 50788 - DNA, 20 bp, Artificial Sequence
  chemically synthesized
cagcggctaggccttcctcg

SEQ ID NO: 50789 - DNA, 20 bp, Artificial Sequence
  chemically synthesized
agcggctaggccttcctcgg

SEQ ID NO: 50790 - DNA, 20 bp, Artificial Sequence
  chemically synthesized
cccgaccccctcctccttct

SEQ ID NO: 50791 - DNA, 20 bp, Artificial Sequence
  chemically synthesized
ccccctcctccttcttggtt

SEQ ID NO: 50792 - DNA, 20 bp, Artificial Sequence
  chemically synthesized
tcctccttcttggttcagct

SEQ ID NO: 50793 - DNA, 20 bp, Artificial Sequence
  chemically synthesized
cctccttcttggttcagctc

SEQ ID NO: 50794 - DNA, 20 bp, Artificial Sequence
  chemically synthesized
ttggttcagctcaggactct

SEQ ID NO: 50795 - DNA, 20 bp, Artificial Sequence
  chemically synthesized
tggttcagctcaggactctg

SEQ ID NO: 50796 - DNA, 20 bp, Artificial Sequence
  chemically synthesized
ggttcagctcaggactctga

SEQ ID NO: 50797 - DNA, 20 bp, Artificial Sequence
  chemically synthesized
ggactctgagggttgctgcg

SEQ ID NO: 50798 - DNA, 20 bp, Artificial Sequence
  chemically synthesized
actctgagggttgctgcgtg

SEQ ID NO: 50799 - DNA, 20 bp, Artificial Sequence
  chemically synthesized
ctctgagggttgctgcgtgg

SEQ ID NO: 50800 - DNA, 20 bp, Artificial Sequence
  chemically synthesized
tgagggttgctgcgtggagg

SEQ ID NO: 50801 - DNA, 20 bp, Artificial Sequence
  chemically synthesized
cgtggaggcagtgcatgccc

SEQ ID NO: 50802 - DNA, 20 bp, Artificial Sequence
  chemically synthesized
gtggaggcagtgcatgccct

SEQ ID NO: 50803 - DNA, 20 bp, Artificial Sequence
  chemically synthesized
ggcagtgcatgccctgggca

SEQ ID NO: 50804 - DNA, 20 bp, Artificial Sequence
  chemically synthesized
catgccctgggcacagtgcc

SEQ ID NO: 50805 - DNA, 20 bp, Artificial Sequence
  chemically synthesized
gtgcccagttcctgcccacc

SEQ ID NO: 50806 - DNA, 20 bp, Artificial Sequence
  chemically synthesized
tgcccagttcctgcccaccc

SEQ ID NO: 50807 - DNA, 20 bp, Artificial Sequence
  chemically synthesized
ccagttcctgcccacccagg

SEQ ID NO: 50808 - DNA, 20 bp, Artificial Sequence
  chemically synthesized
gttcctgcccacccaggaag

SEQ ID NO: 50809 - DNA, 20 bp, Artificial Sequence
  chemically synthesized
cccacccaggaagtagactt

SEQ ID NO: 50810 - DNA, 20 bp, Artificial Sequence
  chemically synthesized
ccacccaggaagtagacttc

SEQ ID NO: 50811 - DNA, 20 bp, Artificial Sequence
  chemically synthesized
cccaggaagtagacttcggg

SEQ ID NO: 50812 - DNA, 20 bp, Artificial Sequence
  chemically synthesized
caggaagtagacttcgggtg

SEQ ID NO: 50813 - DNA, 20 bp, Artificial Sequence
  chemically synthesized
aggaagtagacttcgggtgg

SEQ ID NO: 50814 - DNA, 20 bp, Artificial Sequence
  chemically synthesized
aagtagacttcgggtggagg

SEQ ID NO: 50815 - DNA, 20 bp, Artificial Sequence
  chemically synthesized
tagacttcgggtggaggcag

SEQ ID NO: 50816 - DNA, 20 bp, Artificial Sequence
  chemically synthesized
agacttcgggtggaggcagt

SEQ ID NO: 50817 - DNA, 20 bp, Artificial Sequence
  chemically synthesized
ttcgggtggaggcagtaggc

SEQ ID NO: 50818 - DNA, 20 bp, Artificial Sequence
  chemically synthesized
tcgggtggaggcagtaggct

SEQ ID NO: 50819 - DNA, 20 bp, Artificial Sequence
  chemically synthesized
cgggtggaggcagtaggctg

SEQ ID NO: 50820 - DNA, 20 bp, Artificial Sequence
  chemically synthesized
ggtggaggcagtaggctggg

SEQ ID NO: 50821 - DNA, 20 bp, Artificial Sequence
  chemically synthesized
gtggaggcagtaggctgggg

SEQ ID NO: 50822 - DNA, 20 bp, Artificial Sequence
  chemically synthesized
tggaggcagtaggctgggga

SEQ ID NO: 50823 - DNA, 20 bp, Artificial Sequence
  chemically synthesized
ggaggcagtaggctggggag

SEQ ID NO: 50824 - DNA, 20 bp, Artificial Sequence
  chemically synthesized
ggcagtaggctggggagggg

SEQ ID NO: 50825 - DNA, 20 bp, Artificial Sequence
  chemically synthesized
gcagtaggctggggaggggc

SEQ ID NO: 50826 - DNA, 20 bp, Artificial Sequence
  chemically synthesized
cagtaggctggggaggggcg

SEQ ID NO: 50827 - DNA, 20 bp, Artificial Sequence
  chemically synthesized
gtaggctggggaggggcggg

SEQ ID NO: 50828 - DNA, 20 bp, Artificial Sequence
  chemically synthesized
ctggggaggggcggggagct

SEQ ID NO: 50829 - DNA, 20 bp, Artificial Sequence
  chemically synthesized
ggaggggcggggagcttgga

SEQ ID NO: 50830 - DNA, 20 bp, Artificial Sequence
  chemically synthesized
gaggggcggggagcttggac

SEQ ID NO: 50831 - DNA, 20 bp, Artificial Sequence
  chemically synthesized
gggcggggagcttggacagg

SEQ ID NO: 50832 - DNA, 20 bp, Artificial Sequence
  chemically synthesized
ggcggggagcttggacagga

SEQ ID NO: 50833 - DNA, 20 bp, Artificial Sequence
  chemically synthesized
cggggagcttggacaggaag

SEQ ID NO: 50834 - DNA, 20 bp, Artificial Sequence
  chemically synthesized
aaggagccttgctcattgcc

SEQ ID NO: 50835 - DNA, 20 bp, Artificial Sequence
  chemically synthesized
gagccttgctcattgcccgg

SEQ ID NO: 50836 - DNA, 20 bp, Artificial Sequence
  chemically synthesized
gctcattgcccggcagacac

SEQ ID NO: 50837 - DNA, 20 bp, Artificial Sequence
  chemically synthesized
ttgcccggcagacacaagac

SEQ ID NO: 50838 - DNA, 20 bp, Artificial Sequence
  chemically synthesized
tgcccggcagacacaagact

SEQ ID NO: 50839 - DNA, 20 bp, Artificial Sequence
  chemically synthesized
agactgggccctcataaact

SEQ ID NO: 50840 - DNA, 20 bp, Artificial Sequence
  chemically synthesized
tgggccctcataaactcaga

SEQ ID NO: 50841 - DNA, 20 bp, Artificial Sequence
  chemically synthesized
cctcataaactcagacagcc

SEQ ID NO: 50842 - DNA, 20 bp, Artificial Sequence
  chemically synthesized
acctgttgtacctgcccttt

SEQ ID NO: 50843 - DNA, 20 bp, Artificial Sequence
  chemically synthesized
gccctttcagctctgtgacc

SEQ ID NO: 50844 - DNA, 20 bp, Artificial Sequence
  chemically synthesized
ccctttcagctctgtgaccc

SEQ ID NO: 50845 - DNA, 20 bp, Artificial Sequence
  chemically synthesized
tcagctctgtgacccgggac

SEQ ID NO: 50846 - DNA, 20 bp, Artificial Sequence
  chemically synthesized
acaagtcaccctctcccttt

SEQ ID NO: 50847 - DNA, 20 bp, Artificial Sequence
  chemically synthesized
ctctccctttgagttgccgc

SEQ ID NO: 50848 - DNA, 20 bp, Artificial Sequence
  chemically synthesized
ctccctttgagttgccgcaa

SEQ ID NO: 50849 - DNA, 20 bp, Artificial Sequence
  chemically synthesized
tccctttgagttgccgcaag

SEQ ID NO: 50850 - DNA, 20 bp, Artificial Sequence
  chemically synthesized
ttgagttgccgcaagaggta

SEQ ID NO: 50851 - DNA, 20 bp, Artificial Sequence
  chemically synthesized
agaggtacagtcacactgcc

SEQ ID NO: 50852 - DNA, 20 bp, Artificial Sequence
  chemically synthesized
aggtacagtcacactgccca

SEQ ID NO: 50853 - DNA, 20 bp, Artificial Sequence
  chemically synthesized
ggtacagtcacactgcccag

SEQ ID NO: 50854 - DNA, 20 bp, Artificial Sequence
  chemically synthesized
cacactgcccagaggattac

SEQ ID NO: 50855 - DNA, 20 bp, Artificial Sequence
  chemically synthesized
cagaggattactagaaatga

SEQ ID NO: 50856 - DNA, 20 bp, Artificial Sequence
  chemically synthesized
agaggattactagaaatgac

SEQ ID NO: 50857 - DNA, 20 bp, Artificial Sequence
  chemically synthesized
aatgacaggcctcgccctcc

SEQ ID NO: 50858 - DNA, 20 bp, Artificial Sequence
  chemically synthesized
caggcctcgccctcctggca

SEQ ID NO: 50859 - DNA, 20 bp, Artificial Sequence
  chemically synthesized
tcgccctcctggcacagacc

SEQ ID NO: 50860 - DNA, 20 bp, Artificial Sequence
  chemically synthesized
acagacctggcaccaataac

SEQ ID NO: 50861 - DNA, 20 bp, Artificial Sequence
  chemically synthesized
gacctggcaccaataactgg

SEQ ID NO: 50862 - DNA, 20 bp, Artificial Sequence
  chemically synthesized
acctggcaccaataactggc

SEQ ID NO: 50863 - DNA, 20 bp, Artificial Sequence
  chemically synthesized
accaataactggcaggtttc

SEQ ID NO: 50864 - DNA, 20 bp, Artificial Sequence
  chemically synthesized
ccaataactggcaggtttct

SEQ ID NO: 50865 - DNA, 20 bp, Artificial Sequence
  chemically synthesized
caataactggcaggtttctg

SEQ ID NO: 50866 - DNA, 20 bp, Artificial Sequence
  chemically synthesized
aactggcaggtttctggggc

SEQ ID NO: 50867 - DNA, 20 bp, Artificial Sequence
  chemically synthesized
caggtttctggggccagctg

SEQ ID NO: 50868 - DNA, 20 bp, Artificial Sequence
  chemically synthesized
ggtttctggggccagctgca

SEQ ID NO: 50869 - DNA, 20 bp, Artificial Sequence
  chemically synthesized
gtttctggggccagctgcag

SEQ ID NO: 50870 - DNA, 20 bp, Artificial Sequence
  chemically synthesized
tttctggggccagctgcaga

SEQ ID NO: 50871 - DNA, 20 bp, Artificial Sequence
  chemically synthesized
ctggggccagctgcagaggg

SEQ ID NO: 50872 - DNA, 20 bp, Artificial Sequence
  chemically synthesized
ggggccagctgcagagggaa

SEQ ID NO: 50873 - DNA, 20 bp, Artificial Sequence
  chemically synthesized
gggccagctgcagagggaag

SEQ ID NO: 50874 - DNA, 20 bp, Artificial Sequence
  chemically synthesized
gctgcagagggaagaggact

SEQ ID NO: 50875 - DNA, 20 bp, Artificial Sequence
  chemically synthesized
tgagccacctatgaaatgcc

SEQ ID NO: 50876 - DNA, 20 bp, Artificial Sequence
  chemically synthesized
gccacctatgaaatgcccag

SEQ ID NO: 50877 - DNA, 20 bp, Artificial Sequence
  chemically synthesized
ccacctatgaaatgcccagt

SEQ ID NO: 50878 - DNA, 20 bp, Artificial Sequence
  chemically synthesized
cctatgaaatgcccagtggg

SEQ ID NO: 50879 - DNA, 20 bp, Artificial Sequence
  chemically synthesized
atgcccagtgggcagcccca

SEQ ID NO: 50880 - DNA, 20 bp, Artificial Sequence
  chemically synthesized
ccagtgggcagccccacagt

SEQ ID NO: 50881 - DNA, 20 bp, Artificial Sequence
  chemically synthesized
cagtgggcagccccacagtt

SEQ ID NO: 50882 - DNA, 20 bp, Artificial Sequence
  chemically synthesized
tgggcagccccacagttggg

SEQ ID NO: 50883 - DNA, 20 bp, Artificial Sequence
  chemically synthesized
gggcagccccacagttgggc

SEQ ID NO: 50884 - DNA, 20 bp, Artificial Sequence
  chemically synthesized
ttgggcaggtctgtgtgcac

SEQ ID NO: 50885 - DNA, 20 bp, Artificial Sequence
  chemically synthesized
tgggcaggtctgtgtgcact

SEQ ID NO: 50886 - DNA, 20 bp, Artificial Sequence
  chemically synthesized
gggcaggtctgtgtgcactg

SEQ ID NO: 50887 - DNA, 20 bp, Artificial Sequence
  chemically synthesized
gcaggtctgtgtgcactggg

SEQ ID NO: 50888 - DNA, 20 bp, Artificial Sequence
  chemically synthesized
caggtctgtgtgcactgggg

SEQ ID NO: 50889 - DNA, 20 bp, Artificial Sequence
  chemically synthesized
cactggggaggtgtgtgtca

SEQ ID NO: 50890 - DNA, 20 bp, Artificial Sequence
  chemically synthesized
actggggaggtgtgtgtcat

SEQ ID NO: 50891 - DNA, 20 bp, Artificial Sequence
  chemically synthesized
gaggtgtgtgtcataggacc

SEQ ID NO: 50892 - DNA, 20 bp, Artificial Sequence
  chemically synthesized
tcctatgacacacacctccc

SEQ ID NO: 50893 - DNA, 20 bp, Artificial Sequence
  chemically synthesized
acacacctccccagtgcaca

SEQ ID NO: 50894 - DNA, 20 bp, Artificial Sequence
  chemically synthesized
cacacagacctgcccaactg

SEQ ID NO: 50895 - DNA, 20 bp, Artificial Sequence
  chemically synthesized
acacagacctgcccaactgt

SEQ ID NO: 50896 - DNA, 20 bp, Artificial Sequence
  chemically synthesized
cacagacctgcccaactgtg

SEQ ID NO: 50897 - DNA, 20 bp, Artificial Sequence
  chemically synthesized
ccaactgtggggctgcccac

SEQ ID NO: 50898 - DNA, 20 bp, Artificial Sequence
  chemically synthesized
caactgtggggctgcccact

SEQ ID NO: 50899 - DNA, 20 bp, Artificial Sequence
  chemically synthesized
gctgcccactgggcatttca

SEQ ID NO: 50900 - DNA, 20 bp, Artificial Sequence
  chemically synthesized
ctgcccactgggcatttcat

SEQ ID NO: 50901 - DNA, 20 bp, Artificial Sequence
  chemically synthesized
cccactgggcatttcatagg

SEQ ID NO: 50902 - DNA, 20 bp, Artificial Sequence
  chemically synthesized
tgggcatttcataggtggct

SEQ ID NO: 50903 - DNA, 20 bp, Artificial Sequence
  chemically synthesized
gctcagtcctcttccctctg

SEQ ID NO: 50904 - DNA, 20 bp, Artificial Sequence
  chemically synthesized
agtcctcttccctctgcagc

SEQ ID NO: 50905 - DNA, 20 bp, Artificial Sequence
  chemically synthesized
cttccctctgcagctggccc

SEQ ID NO: 50906 - DNA, 20 bp, Artificial Sequence
  chemically synthesized
agctggccccagaaacctgc

SEQ ID NO: 50907 - DNA, 20 bp, Artificial Sequence
  chemically synthesized
cccagaaacctgccagttat

SEQ ID NO: 50908 - DNA, 20 bp, Artificial Sequence
  chemically synthesized
aacctgccagttattggtgc

SEQ ID NO: 50909 - DNA, 20 bp, Artificial Sequence
  chemically synthesized
acctgccagttattggtgcc

SEQ ID NO: 50910 - DNA, 20 bp, Artificial Sequence
  chemically synthesized
tattggtgccaggtctgtgc

SEQ ID NO: 50911 - DNA, 20 bp, Artificial Sequence
  chemically synthesized
attggtgccaggtctgtgcc

SEQ ID NO: 50912 - DNA, 20 bp, Artificial Sequence
  chemically synthesized
tggtgccaggtctgtgccag

SEQ ID NO: 50913 - DNA, 20 bp, Artificial Sequence
  chemically synthesized
ggtgccaggtctgtgccagg

SEQ ID NO: 50914 - DNA, 20 bp, Artificial Sequence
  chemically synthesized
gtgccaggtctgtgccagga

SEQ ID NO: 50915 - DNA, 20 bp, Artificial Sequence
  chemically synthesized
caggtctgtgccaggagggc

SEQ ID NO: 50916 - DNA, 20 bp, Artificial Sequence
  chemically synthesized
aggtctgtgccaggagggcg

SEQ ID NO: 50917 - DNA, 20 bp, Artificial Sequence
  chemically synthesized
agggcgaggcctgtcatttc

SEQ ID NO: 50918 - DNA, 20 bp, Artificial Sequence
  chemically synthesized
tgtcatttctagtaatcctc

SEQ ID NO: 50919 - DNA, 20 bp, Artificial Sequence
  chemically synthesized
gtcatttctagtaatcctct

SEQ ID NO: 50920 - DNA, 20 bp, Artificial Sequence
  chemically synthesized
atttctagtaatcctctggg

SEQ ID NO: 50921 - DNA, 20 bp, Artificial Sequence
  chemically synthesized
cagtgtgactgtacctcttg

SEQ ID NO: 50922 - DNA, 20 bp, Artificial Sequence
  chemically synthesized
gtacctcttgcggcaactca

SEQ ID NO: 50923 - DNA, 20 bp, Artificial Sequence
  chemically synthesized
tacctcttgcggcaactcaa

SEQ ID NO: 50924 - DNA, 20 bp, Artificial Sequence
  chemically synthesized
acctcttgcggcaactcaaa

SEQ ID NO: 50925 - DNA, 20 bp, Artificial Sequence
  chemically synthesized
ctcttgcggcaactcaaagg

SEQ ID NO: 50926 - DNA, 20 bp, Artificial Sequence
  chemically synthesized
cttgcggcaactcaaaggga

SEQ ID NO: 50927 - DNA, 20 bp, Artificial Sequence
  chemically synthesized
ttgcggcaactcaaagggag

SEQ ID NO: 50928 - DNA, 20 bp, Artificial Sequence
  chemically synthesized
tgcggcaactcaaagggaga

SEQ ID NO: 50929 - DNA, 20 bp, Artificial Sequence
  chemically synthesized
agggagagggtgacttgtcc

SEQ ID NO: 50930 - DNA, 20 bp, Artificial Sequence
  chemically synthesized
gggagagggtgacttgtccc

SEQ ID NO: 50931 - DNA, 20 bp, Artificial Sequence
  chemically synthesized
gggtgacttgtcccgggtca

SEQ ID NO: 50932 - DNA, 20 bp, Artificial Sequence
  chemically synthesized
gtgacttgtcccgggtcaca

SEQ ID NO: 50933 - DNA, 20 bp, Artificial Sequence
  chemically synthesized
gtcccgggtcacagagctga

SEQ ID NO: 50934 - DNA, 20 bp, Artificial Sequence
  chemically synthesized
tcccgggtcacagagctgaa

SEQ ID NO: 50935 - DNA, 20 bp, Artificial Sequence
  chemically synthesized
cccgggtcacagagctgaaa

SEQ ID NO: 50936 - DNA, 20 bp, Artificial Sequence
  chemically synthesized
gggtcacagagctgaaaggg

SEQ ID NO: 50937 - DNA, 20 bp, Artificial Sequence
  chemically synthesized
ggtcacagagctgaaagggc

SEQ ID NO: 50938 - DNA, 20 bp, Artificial Sequence
  chemically synthesized
agctgaaagggcaggtacaa

SEQ ID NO: 50939 - DNA, 20 bp, Artificial Sequence
  chemically synthesized
gctgaaagggcaggtacaac

SEQ ID NO: 50940 - DNA, 20 bp, Artificial Sequence
  chemically synthesized
aggtacaacaggtgacatgc

SEQ ID NO: 50941 - DNA, 20 bp, Artificial Sequence
  chemically synthesized
ggtacaacaggtgacatgcc

SEQ ID NO: 50942 - DNA, 20 bp, Artificial Sequence
  chemically synthesized
ggtgacatgccgggctgtct

SEQ ID NO: 50943 - DNA, 20 bp, Artificial Sequence
  chemically synthesized
gccgggctgtctgagtttat

SEQ ID NO: 50944 - DNA, 20 bp, Artificial Sequence
  chemically synthesized
ccgggctgtctgagtttatg

SEQ ID NO: 50945 - DNA, 20 bp, Artificial Sequence
  chemically synthesized
cgggctgtctgagtttatga

SEQ ID NO: 50946 - DNA, 20 bp, Artificial Sequence
  chemically synthesized
tgtctgagtttatgagggcc

SEQ ID NO: 50947 - DNA, 20 bp, Artificial Sequence
  chemically synthesized
gggcccagtcttgtgtctgc

SEQ ID NO: 50948 - DNA, 20 bp, Artificial Sequence
  chemically synthesized
ggcccagtcttgtgtctgcc

SEQ ID NO: 50949 - DNA, 20 bp, Artificial Sequence
  chemically synthesized
tcttgtgtctgccgggcaat

SEQ ID NO: 50950 - DNA, 20 bp, Artificial Sequence
  chemically synthesized
gtgtctgccgggcaatgagc

SEQ ID NO: 50951 - DNA, 20 bp, Artificial Sequence
  chemically synthesized
tgtctgccgggcaatgagca

SEQ ID NO: 50952 - DNA, 20 bp, Artificial Sequence
  chemically synthesized
agcaaggctccttcctgtcc

SEQ ID NO: 50953 - DNA, 20 bp, Artificial Sequence
  chemically synthesized
ccaagctccccgcccctccc

SEQ ID NO: 50954 - DNA, 20 bp, Artificial Sequence
  chemically synthesized
cagcctactgcctccacccg

SEQ ID NO: 50955 - DNA, 20 bp, Artificial Sequence
  chemically synthesized
tccacccgaagtctacttcc

SEQ ID NO: 50956 - DNA, 20 bp, Artificial Sequence
  chemically synthesized
ccacccgaagtctacttcct

SEQ ID NO: 50957 - DNA, 20 bp, Artificial Sequence
  chemically synthesized
cccgaagtctacttcctggg

SEQ ID NO: 50958 - DNA, 20 bp, Artificial Sequence
  chemically synthesized
ccgaagtctacttcctgggt

SEQ ID NO: 50959 - DNA, 20 bp, Artificial Sequence
  chemically synthesized
aagtctacttcctgggtggg

SEQ ID NO: 50960 - DNA, 20 bp, Artificial Sequence
  chemically synthesized
agtctacttcctgggtgggc

SEQ ID NO: 50961 - DNA, 20 bp, Artificial Sequence
  chemically synthesized
cttcctgggtgggcaggaac

SEQ ID NO: 50962 - DNA, 20 bp, Artificial Sequence
  chemically synthesized
ttcctgggtgggcaggaact

SEQ ID NO: 50963 - DNA, 20 bp, Artificial Sequence
  chemically synthesized
caggaactgggcactgtgcc

SEQ ID NO: 50964 - DNA, 20 bp, Artificial Sequence
  chemically synthesized
aggaactgggcactgtgccc

SEQ ID NO: 50965 - DNA, 20 bp, Artificial Sequence
  chemically synthesized
ggaactgggcactgtgccca

SEQ ID NO: 50966 - DNA, 20 bp, Artificial Sequence
  chemically synthesized
gggcatgcactgcctccacg

SEQ ID NO: 50967 - DNA, 20 bp, Artificial Sequence
  chemically synthesized
tgcctccacgcagcaaccct

SEQ ID NO: 50968 - DNA, 20 bp, Artificial Sequence
  chemically synthesized
cctccacgcagcaaccctca

SEQ ID NO: 50969 - DNA, 20 bp, Artificial Sequence
  chemically synthesized
gcagcaaccctcagagtcct

SEQ ID NO: 50970 - DNA, 20 bp, Artificial Sequence
  chemically synthesized
tcagagtcctgagctgaacc

SEQ ID NO: 50971 - DNA, 20 bp, Artificial Sequence
  chemically synthesized
gagtcctgagctgaaccaag

SEQ ID NO: 50972 - DNA, 20 bp, Artificial Sequence
  chemically synthesized
agtcctgagctgaaccaaga

SEQ ID NO: 50973 - DNA, 20 bp, Artificial Sequence
  chemically synthesized
tcctgagctgaaccaagaag

SEQ ID NO: 50974 - DNA, 20 bp, Artificial Sequence
  chemically synthesized
cctgagctgaaccaagaagg

SEQ ID NO: 50975 - DNA, 20 bp, Artificial Sequence
  chemically synthesized
tgagctgaaccaagaaggag

SEQ ID NO: 50976 - DNA, 20 bp, Artificial Sequence
  chemically synthesized
gagctgaaccaagaaggagg

SEQ ID NO: 50977 - DNA, 20 bp, Artificial Sequence
  chemically synthesized
agctgaaccaagaaggagga

SEQ ID NO: 50978 - DNA, 20 bp, Artificial Sequence
  chemically synthesized
gctgaaccaagaaggaggag

SEQ ID NO: 50979 - DNA, 20 bp, Artificial Sequence
  chemically synthesized
ctgaaccaagaaggaggagg

SEQ ID NO: 50980 - DNA, 20 bp, Artificial Sequence
  chemically synthesized
accaagaaggaggagggggt

SEQ ID NO: 50981 - DNA, 20 bp, Artificial Sequence
  chemically synthesized
ccaagaaggaggagggggtc

SEQ ID NO: 50982 - DNA, 20 bp, Artificial Sequence
  chemically synthesized
gaggagggggtcgggcctcc

SEQ ID NO: 50983 - DNA, 20 bp, Artificial Sequence
  chemically synthesized
aggagggggtcgggcctccg

SEQ ID NO: 50984 - DNA, 20 bp, Artificial Sequence
  chemically synthesized
agggggtcgggcctccgagg

SEQ ID NO: 50985 - DNA, 20 bp, Artificial Sequence
  chemically synthesized
gggggtcgggcctccgagga

SEQ ID NO: 50986 - DNA, 20 bp, Artificial Sequence
  chemically synthesized
tcgggcctccgaggaaggcc

SEQ ID NO: 50987 - DNA, 20 bp, Artificial Sequence
  chemically synthesized
ggcctagccgctgctgctgc

SEQ ID NO: 50988 - DNA, 20 bp, Artificial Sequence
  chemically synthesized
gcctagccgctgctgctgcc

SEQ ID NO: 50989 - DNA, 20 bp, Artificial Sequence
  chemically synthesized
gctgctgctgccaggaattc

SEQ ID NO: 50990 - DNA, 20 bp, Artificial Sequence
  chemically synthesized
ctgctgctgccaggaattcc

SEQ ID NO: 50991 - DNA, 20 bp, Artificial Sequence
  chemically synthesized
tgctgccaggaattccaggt

SEQ ID NO: 50992 - DNA, 20 bp, Artificial Sequence
  chemically synthesized
ctgccaggaattccaggttg

SEQ ID NO: 50993 - DNA, 20 bp, Artificial Sequence
  chemically synthesized
tgccaggaattccaggttgg

SEQ ID NO: 50994 - DNA, 20 bp, Artificial Sequence
  chemically synthesized
gccaggaattccaggttgga

SEQ ID NO: 50995 - DNA, 20 bp, Artificial Sequence
  chemically synthesized
ccaggaattccaggttggag

SEQ ID NO: 50996 - DNA, 20 bp, Artificial Sequence
  chemically synthesized
ggaattccaggttggagggg

SEQ ID NO: 50997 - DNA, 20 bp, Artificial Sequence
  chemically synthesized
gaggggcggcaacctcctgc

SEQ ID NO: 50998 - DNA, 20 bp, Artificial Sequence
  chemically synthesized
ggcaacctcctgccagcctt

SEQ ID NO: 50999 - DNA, 20 bp, Artificial Sequence
  chemically synthesized
gcaacctcctgccagccttc

SEQ ID NO: 51000 - DNA, 20 bp, Artificial Sequence
  chemically synthesized
ggccactctcctgtgcctgc

SEQ ID NO: 51001 - DNA, 20 bp, Artificial Sequence
  chemically synthesized
cactctcctgtgcctgccag

SEQ ID NO: 51002 - DNA, 20 bp, Artificial Sequence
  chemically synthesized
ctctcctgtgcctgccagaa

SEQ ID NO: 51003 - DNA, 20 bp, Artificial Sequence
  chemically synthesized
cctgtgcctgccagaagaga

SEQ ID NO: 51004 - DNA, 20 bp, Artificial Sequence
  chemically synthesized
tgtgcctgccagaagagaca

SEQ ID NO: 51005 - DNA, 20 bp, Artificial Sequence
  chemically synthesized
tgccagaagagacagagctt

SEQ ID NO: 51006 - DNA, 20 bp, Artificial Sequence
  chemically synthesized
gccagaagagacagagcttg

SEQ ID NO: 51007 - DNA, 20 bp, Artificial Sequence
  chemically synthesized
cagaagagacagagcttgag

SEQ ID NO: 51008 - DNA, 20 bp, Artificial Sequence
  chemically synthesized
gaagagacagagcttgagga

SEQ ID NO: 51009 - DNA, 20 bp, Artificial Sequence
  chemically synthesized
acagagcttgaggagagctt

SEQ ID NO: 51010 - DNA, 20 bp, Artificial Sequence
  chemically synthesized
cagagcttgaggagagcttg

SEQ ID NO: 51011 - DNA, 20 bp, Artificial Sequence
  chemically synthesized
gagcttgaggagagcttgag

SEQ ID NO: 51012 - DNA, 20 bp, Artificial Sequence
  chemically synthesized
gcttgaggagagcttgagga

SEQ ID NO: 51013 - DNA, 20 bp, Artificial Sequence
  chemically synthesized
tgaggagagcttgaggagag

SEQ ID NO: 51014 - DNA, 20 bp, Artificial Sequence
  chemically synthesized
gaggagagcttgaggagagc

SEQ ID NO: 51015 - DNA, 20 bp, Artificial Sequence
  chemically synthesized
agagcttgaggagagcagga

SEQ ID NO: 51016 - DNA, 20 bp, Artificial Sequence
  chemically synthesized
gagcttgaggagagcaggaa

SEQ ID NO: 51017 - DNA, 20 bp, Artificial Sequence
  chemically synthesized
cttgaggagagcaggaaagg

SEQ ID NO: 51018 - DNA, 20 bp, Artificial Sequence
  chemically synthesized
ttgaggagagcaggaaaggt

SEQ ID NO: 51019 - DNA, 20 bp, Artificial Sequence
  chemically synthesized
cattgctgctgctgctcact

SEQ ID NO: 51020 - DNA, 20 bp, Artificial Sequence
  chemically synthesized
ctgctgctcactcagttcca

SEQ ID NO: 51021 - DNA, 20 bp, Artificial Sequence
  chemically synthesized
tgctgctcactcagttccac

SEQ ID NO: 51022 - DNA, 20 bp, Artificial Sequence
  chemically synthesized
tgctcactcagttccacagg

SEQ ID NO: 51023 - DNA, 20 bp, Artificial Sequence
  chemically synthesized
gctcactcagttccacaggt

SEQ ID NO: 51024 - DNA, 20 bp, Artificial Sequence
  chemically synthesized
tcactcagttccacaggtgg

SEQ ID NO: 51025 - DNA, 20 bp, Artificial Sequence
  chemically synthesized
cactcagttccacaggtggg

SEQ ID NO: 51026 - DNA, 20 bp, Artificial Sequence
  chemically synthesized
actcagttccacaggtggga

SEQ ID NO: 51027 - DNA, 20 bp, Artificial Sequence
  chemically synthesized
agttccacaggtgggaggga

SEQ ID NO: 51028 - DNA, 20 bp, Artificial Sequence
  chemically synthesized
tccacaggtgggagggacag

SEQ ID NO: 51029 - DNA, 20 bp, Artificial Sequence
  chemically synthesized
ccacaggtgggagggacagc

SEQ ID NO: 51030 - DNA, 20 bp, Artificial Sequence
  chemically synthesized
cacaggtgggagggacagca

SEQ ID NO: 51031 - DNA, 20 bp, Artificial Sequence
  chemically synthesized
gtgggagggacagcagggct

SEQ ID NO: 51032 - DNA, 20 bp, Artificial Sequence
  chemically synthesized
gggagggacagcagggctta

SEQ ID NO: 51033 - DNA, 20 bp, Artificial Sequence
  chemically synthesized
agggacagcagggcttagag

SEQ ID NO: 51034 - DNA, 20 bp, Artificial Sequence
  chemically synthesized
gggacagcagggcttagagt

SEQ ID NO: 51035 - DNA, 20 bp, Artificial Sequence
  chemically synthesized
ggacagcagggcttagagtg

SEQ ID NO: 51036 - DNA, 20 bp, Artificial Sequence
  chemically synthesized
gacagcagggcttagagtgg

SEQ ID NO: 51037 - DNA, 20 bp, Artificial Sequence
  chemically synthesized
ttagagtgggggtcattgtg

SEQ ID NO: 51038 - DNA, 20 bp, Artificial Sequence
  chemically synthesized
agtgggggtcattgtgcaga

SEQ ID NO: 51039 - DNA, 20 bp, Artificial Sequence
  chemically synthesized
gtgggggtcattgtgcagat

SEQ ID NO: 51040 - DNA, 20 bp, Artificial Sequence
  chemically synthesized
attgtgcagatgggaaaaca

SEQ ID NO: 51041 - DNA, 20 bp, Artificial Sequence
  chemically synthesized
ttgtgcagatgggaaaacaa

SEQ ID NO: 51042 - DNA, 20 bp, Artificial Sequence
  chemically synthesized
cagatgggaaaacaaaggcc

SEQ ID NO: 51043 - DNA, 20 bp, Artificial Sequence
  chemically synthesized
gatgggaaaacaaaggccca

SEQ ID NO: 51044 - DNA, 20 bp, Artificial Sequence
  chemically synthesized
tgggaaaacaaaggcccaga

SEQ ID NO: 51045 - DNA, 20 bp, Artificial Sequence
  chemically synthesized
gggaaaacaaaggcccagag

SEQ ID NO: 51046 - DNA, 20 bp, Artificial Sequence
  chemically synthesized
ggaaaacaaaggcccagaga

SEQ ID NO: 51047 - DNA, 20 bp, Artificial Sequence
  chemically synthesized
gaaaacaaaggcccagagag

SEQ ID NO: 51048 - DNA, 20 bp, Artificial Sequence
  chemically synthesized
aacaaaggcccagagagggg

SEQ ID NO: 51049 - DNA, 20 bp, Artificial Sequence
  chemically synthesized
cagagaggggaagaaatgcc

SEQ ID NO: 51050 - DNA, 20 bp, Artificial Sequence
  chemically synthesized
agagaggggaagaaatgccc

SEQ ID NO: 51051 - DNA, 20 bp, Artificial Sequence
  chemically synthesized
agaggggaagaaatgcccag

SEQ ID NO: 51052 - DNA, 20 bp, Artificial Sequence
  chemically synthesized
agaaatgcccaggagctacc

SEQ ID NO: 51053 - DNA, 20 bp, Artificial Sequence
  chemically synthesized
gaaatgcccaggagctaccg

SEQ ID NO: 51054 - DNA, 20 bp, Artificial Sequence
  chemically synthesized
aaatgcccaggagctaccga

SEQ ID NO: 51055 - DNA, 20 bp, Artificial Sequence
  chemically synthesized
tgcccaggagctaccgaggg

SEQ ID NO: 51056 - DNA, 20 bp, Artificial Sequence
  chemically synthesized
gcccaggagctaccgagggc

SEQ ID NO: 51057 - DNA, 20 bp, Artificial Sequence
  chemically synthesized
agggcaggcgacctcaacca

SEQ ID NO: 51058 - DNA, 20 bp, Artificial Sequence
  chemically synthesized
aggcgacctcaaccacagcc

SEQ ID NO: 51059 - DNA, 20 bp, Artificial Sequence
  chemically synthesized
cctcaaccacagcccagtgc

SEQ ID NO: 51060 - DNA, 20 bp, Artificial Sequence
  chemically synthesized
tcaaccacagcccagtgctg

SEQ ID NO: 51061 - DNA, 20 bp, Artificial Sequence
  chemically synthesized
cagcccagtgctggagctgt

SEQ ID NO: 51062 - DNA, 20 bp, Artificial Sequence
  chemically synthesized
cccagtgctggagctgtgag

SEQ ID NO: 51063 - DNA, 20 bp, Artificial Sequence
  chemically synthesized
gctggagctgtgagtggatg

SEQ ID NO: 51064 - DNA, 20 bp, Artificial Sequence
  chemically synthesized
tggagctgtgagtggatgta

SEQ ID NO: 51065 - DNA, 20 bp, Artificial Sequence
  chemically synthesized
agctgtgagtggatgtagag

SEQ ID NO: 51066 - DNA, 20 bp, Artificial Sequence
  chemically synthesized
tgtgagtggatgtagagcag

SEQ ID NO: 51067 - DNA, 20 bp, Artificial Sequence
  chemically synthesized
agagcagcggaatatccatt

SEQ ID NO: 51068 - DNA, 20 bp, Artificial Sequence
  chemically synthesized
cagcggaatatccattcagc

SEQ ID NO: 51069 - DNA, 20 bp, Artificial Sequence
  chemically synthesized
gaatatccattcagccagct

SEQ ID NO: 51070 - DNA, 20 bp, Artificial Sequence
  chemically synthesized
aatatccattcagccagctc

SEQ ID NO: 51071 - DNA, 20 bp, Artificial Sequence
  chemically synthesized
atatccattcagccagctca

SEQ ID NO: 51072 - DNA, 20 bp, Artificial Sequence
  chemically synthesized
tatccattcagccagctcag

SEQ ID NO: 51073 - DNA, 20 bp, Artificial Sequence
  chemically synthesized
ccattcagccagctcagggg

SEQ ID NO: 51074 - DNA, 20 bp, Artificial Sequence
  chemically synthesized
cattcagccagctcagggga

SEQ ID NO: 51075 - DNA, 20 bp, Artificial Sequence
  chemically synthesized
cagccagctcaggggaagga

SEQ ID NO: 51076 - DNA, 20 bp, Artificial Sequence
  chemically synthesized
agccagctcaggggaaggac

SEQ ID NO: 51077 - DNA, 20 bp, Artificial Sequence
  chemically synthesized
gccagctcaggggaaggaca

SEQ ID NO: 51078 - DNA, 20 bp, Artificial Sequence
  chemically synthesized
ccagctcaggggaaggacag

SEQ ID NO: 51079 - DNA, 20 bp, Artificial Sequence
  chemically synthesized
ggggaaggacaggggccctg

SEQ ID NO: 51080 - DNA, 20 bp, Artificial Sequence
  chemically synthesized
aaggacaggggccctgaagc

SEQ ID NO: 51081 - DNA, 20 bp, Artificial Sequence
  chemically synthesized
aggacaggggccctgaagcc

SEQ ID NO: 51082 - DNA, 20 bp, Artificial Sequence
  chemically synthesized
ggacaggggccctgaagcca

SEQ ID NO: 51083 - DNA, 20 bp, Artificial Sequence
  chemically synthesized
gacaggggccctgaagccag

SEQ ID NO: 51084 - DNA, 20 bp, Artificial Sequence
  chemically synthesized
ggggccctgaagccagggga

SEQ ID NO: 51085 - DNA, 20 bp, Artificial Sequence
  chemically synthesized
ggccctgaagccaggggatg

SEQ ID NO: 51086 - DNA, 20 bp, Artificial Sequence
  chemically synthesized
gaagccaggggatggagctg

SEQ ID NO: 51087 - DNA, 20 bp, Artificial Sequence
  chemically synthesized
aagccaggggatggagctgc

SEQ ID NO: 51088 - DNA, 20 bp, Artificial Sequence
  chemically synthesized
agccaggggatggagctgca

SEQ ID NO: 51089 - DNA, 20 bp, Artificial Sequence
  chemically synthesized
caggggatggagctgcaggg

SEQ ID NO: 51090 - DNA, 20 bp, Artificial Sequence
  chemically synthesized
aggggatggagctgcaggga

SEQ ID NO: 51091 - DNA, 20 bp, Artificial Sequence
  chemically synthesized
ggggatggagctgcagggaa

SEQ ID NO: 51092 - DNA, 20 bp, Artificial Sequence
  chemically synthesized
ggatggagctgcagggaagg

SEQ ID NO: 51093 - DNA, 20 bp, Artificial Sequence
  chemically synthesized
gagctgcagggaagggagct

SEQ ID NO: 51094 - DNA, 20 bp, Artificial Sequence
  chemically synthesized
gctgcagggaagggagctca

SEQ ID NO: 51095 - DNA, 20 bp, Artificial Sequence
  chemically synthesized
tgcagggaagggagctcaga

SEQ ID NO: 51096 - DNA, 20 bp, Artificial Sequence
  chemically synthesized
agggaagggagctcagagag

SEQ ID NO: 51097 - DNA, 20 bp, Artificial Sequence
  chemically synthesized
gggaagggagctcagagaga

SEQ ID NO: 51098 - DNA, 20 bp, Artificial Sequence
  chemically synthesized
ggaagggagctcagagagaa

SEQ ID NO: 51099 - DNA, 20 bp, Artificial Sequence
  chemically synthesized
gaagggagctcagagagaag

SEQ ID NO: 51100 - DNA, 20 bp, Artificial Sequence
  chemically synthesized
agggagctcagagagaaggg

SEQ ID NO: 51101 - DNA, 20 bp, Artificial Sequence
  chemically synthesized
gggagctcagagagaagggg

SEQ ID NO: 51102 - DNA, 20 bp, Artificial Sequence
  chemically synthesized
ggagctcagagagaagggga

SEQ ID NO: 51103 - DNA, 20 bp, Artificial Sequence
  chemically synthesized
gagctcagagagaaggggag

SEQ ID NO: 51104 - DNA, 20 bp, Artificial Sequence
  chemically synthesized
gctcagagagaaggggaggg

SEQ ID NO: 51105 - DNA, 20 bp, Artificial Sequence
  chemically synthesized
agagaaggggaggggagtct

SEQ ID NO: 51106 - DNA, 20 bp, Artificial Sequence
  chemically synthesized
aggggaggggagtctgagct

SEQ ID NO: 51107 - DNA, 20 bp, Artificial Sequence
  chemically synthesized
ctcagtttcccgctgcctga

SEQ ID NO: 51108 - DNA, 20 bp, Artificial Sequence
  chemically synthesized
tcagtttcccgctgcctgaa

SEQ ID NO: 51109 - DNA, 20 bp, Artificial Sequence
  chemically synthesized
agtttcccgctgcctgaaag

SEQ ID NO: 51110 - DNA, 20 bp, Artificial Sequence
  chemically synthesized
gtttcccgctgcctgaaagg

SEQ ID NO: 51111 - DNA, 20 bp, Artificial Sequence
  chemically synthesized
tttcccgctgcctgaaagga

SEQ ID NO: 51112 - DNA, 20 bp, Artificial Sequence
  chemically synthesized
cccgctgcctgaaaggaggg

SEQ ID NO: 51113 - DNA, 20 bp, Artificial Sequence
  chemically synthesized
ggtggtacctactcccttca

SEQ ID NO: 51114 - DNA, 20 bp, Artificial Sequence
  chemically synthesized
gtggtacctactcccttcac

SEQ ID NO: 51115 - DNA, 20 bp, Artificial Sequence
  chemically synthesized
tggtacctactcccttcaca

SEQ ID NO: 51116 - DNA, 20 bp, Artificial Sequence
  chemically synthesized
ccttcacagggtaactgaat

SEQ ID NO: 51117 - DNA, 20 bp, Artificial Sequence
  chemically synthesized
ttcacagggtaactgaatga

SEQ ID NO: 51118 - DNA, 20 bp, Artificial Sequence
  chemically synthesized
taactgaatgagagactgcc

SEQ ID NO: 51119 - DNA, 20 bp, Artificial Sequence
  chemically synthesized
actgaatgagagactgcctg

SEQ ID NO: 51120 - DNA, 20 bp, Artificial Sequence
  chemically synthesized
ctgaatgagagactgcctgg

SEQ ID NO: 51121 - DNA, 20 bp, Artificial Sequence
  chemically synthesized
atgagagactgcctggagga

SEQ ID NO: 51122 - DNA, 20 bp, Artificial Sequence
  chemically synthesized
tgcctggaggaaagctcttc

SEQ ID NO: 51123 - DNA, 20 bp, Artificial Sequence
  chemically synthesized
ggaggaaagctcttcaagtg

SEQ ID NO: 51124 - DNA, 20 bp, Artificial Sequence
  chemically synthesized
aagtgtggcccaccccaccc

SEQ ID NO: 51125 - DNA, 20 bp, Artificial Sequence
  chemically synthesized
ccaccccaccccagtgacac

SEQ ID NO: 51126 - DNA, 20 bp, Artificial Sequence
  chemically synthesized
agtgacaccagcccctgaca

SEQ ID NO: 51127 - DNA, 20 bp, Artificial Sequence
  chemically synthesized
gtgacaccagcccctgacac

SEQ ID NO: 51128 - DNA, 20 bp, Artificial Sequence
  chemically synthesized
tgacaccagcccctgacacg

SEQ ID NO: 51129 - DNA, 20 bp, Artificial Sequence
  chemically synthesized
gacaccagcccctgacacgg

SEQ ID NO: 51130 - DNA, 20 bp, Artificial Sequence
  chemically synthesized
caccagcccctgacacgggg

SEQ ID NO: 51131 - DNA, 20 bp, Artificial Sequence
  chemically synthesized
accagcccctgacacggggg

SEQ ID NO: 51132 - DNA, 20 bp, Artificial Sequence
  chemically synthesized
ccagcccctgacacggggga

SEQ ID NO: 51133 - DNA, 20 bp, Artificial Sequence
  chemically synthesized
agcccctgacacgggggagg

SEQ ID NO: 51134 - DNA, 20 bp, Artificial Sequence
  chemically synthesized
gcccctgacacgggggaggg

SEQ ID NO: 51135 - DNA, 20 bp, Artificial Sequence
  chemically synthesized
cccctgacacgggggaggga

SEQ ID NO: 51136 - DNA, 20 bp, Artificial Sequence
  chemically synthesized
ctgacacgggggagggaggg

SEQ ID NO: 51137 - DNA, 20 bp, Artificial Sequence
  chemically synthesized
cgggggagggagggcagcat

SEQ ID NO: 51138 - DNA, 20 bp, Artificial Sequence
  chemically synthesized
gggggagggagggcagcatc

SEQ ID NO: 51139 - DNA, 20 bp, Artificial Sequence
  chemically synthesized
gggagggagggcagcatcag

SEQ ID NO: 51140 - DNA, 20 bp, Artificial Sequence
  chemically synthesized
ggagggagggcagcatcagg

SEQ ID NO: 51141 - DNA, 20 bp, Artificial Sequence
  chemically synthesized
gagggagggcagcatcagga

SEQ ID NO: 51142 - DNA, 20 bp, Artificial Sequence
  chemically synthesized
agggagggcagcatcaggag

SEQ ID NO: 51143 - DNA, 20 bp, Artificial Sequence
  chemically synthesized
cagcatcaggaggggctttc

SEQ ID NO: 51144 - DNA, 20 bp, Artificial Sequence
  chemically synthesized
agcatcaggaggggctttct

SEQ ID NO: 51145 - DNA, 20 bp, Artificial Sequence
  chemically synthesized
aggggctttctgggcacacc

SEQ ID NO: 51146 - DNA, 20 bp, Artificial Sequence
  chemically synthesized
cacacccagtacccgtctct

SEQ ID NO: 51147 - DNA, 20 bp, Artificial Sequence
  chemically synthesized
ctgttgcattttaatcctca

SEQ ID NO: 51148 - DNA, 20 bp, Artificial Sequence
  chemically synthesized
ttgcattttaatcctcacag

SEQ ID NO: 51149 - DNA, 20 bp, Artificial Sequence
  chemically synthesized
aatcctcacagcagctcaac

SEQ ID NO: 51150 - DNA, 20 bp, Artificial Sequence
  chemically synthesized
atcctcacagcagctcaaca

SEQ ID NO: 51151 - DNA, 20 bp, Artificial Sequence
  chemically synthesized
ccgtcaccatccccatttta

SEQ ID NO: 51152 - DNA, 20 bp, Artificial Sequence
  chemically synthesized
caccatccccattttacaga

SEQ ID NO: 51153 - DNA, 20 bp, Artificial Sequence
  chemically synthesized
accatccccattttacagat

SEQ ID NO: 51154 - DNA, 20 bp, Artificial Sequence
  chemically synthesized
ccatccccattttacagata

SEQ ID NO: 51155 - DNA, 20 bp, Artificial Sequence
  chemically synthesized
attttacagatagggaaatt

SEQ ID NO: 51156 - DNA, 20 bp, Artificial Sequence
  chemically synthesized
ttttacagatagggaaattg

SEQ ID NO: 51157 - DNA, 20 bp, Artificial Sequence
  chemically synthesized
cagatagggaaattgaggct

SEQ ID NO: 51158 - DNA, 20 bp, Artificial Sequence
  chemically synthesized
gatagggaaattgaggctcg

SEQ ID NO: 51159 - DNA, 20 bp, Artificial Sequence
  chemically synthesized
agggaaattgaggctcggag

SEQ ID NO: 51160 - DNA, 20 bp, Artificial Sequence
  chemically synthesized
agcggttaaacaactcacct

SEQ ID NO: 51161 - DNA, 20 bp, Artificial Sequence
  chemically synthesized
gcggttaaacaactcacctg

SEQ ID NO: 51162 - DNA, 20 bp, Artificial Sequence
  chemically synthesized
acaactcacctgaggcctca

SEQ ID NO: 51163 - DNA, 20 bp, Artificial Sequence
  chemically synthesized
ctcacctgaggcctcacagc

SEQ ID NO: 51164 - DNA, 20 bp, Artificial Sequence
  chemically synthesized
cctgaggcctcacagccagt

SEQ ID NO: 51165 - DNA, 20 bp, Artificial Sequence
  chemically synthesized
gaggcctcacagccagtaag

SEQ ID NO: 51166 - DNA, 20 bp, Artificial Sequence
  chemically synthesized
aggcctcacagccagtaagt

SEQ ID NO: 51167 - DNA, 20 bp, Artificial Sequence
  chemically synthesized
cagccagtaagtgggttccc

SEQ ID NO: 51168 - DNA, 20 bp, Artificial Sequence
  chemically synthesized
cctggtctgaatgtgtgtgc

SEQ ID NO: 51169 - DNA, 20 bp, Artificial Sequence
  chemically synthesized
tggtctgaatgtgtgtgctg

SEQ ID NO: 51170 - DNA, 20 bp, Artificial Sequence
  chemically synthesized
ggtctgaatgtgtgtgctgg

SEQ ID NO: 51171 - DNA, 20 bp, Artificial Sequence
  chemically synthesized
gtgtgtgctggaggatcctg

SEQ ID NO: 51172 - DNA, 20 bp, Artificial Sequence
  chemically synthesized
tgtgtgctggaggatcctgt

SEQ ID NO: 51173 - DNA, 20 bp, Artificial Sequence
  chemically synthesized
gatcctgtgggtcactcgcc

SEQ ID NO: 51174 - DNA, 20 bp, Artificial Sequence
  chemically synthesized
cctgtgggtcactcgcctgg

SEQ ID NO: 51175 - DNA, 20 bp, Artificial Sequence
  chemically synthesized
tgtgggtcactcgcctggta

SEQ ID NO: 51176 - DNA, 20 bp, Artificial Sequence
  chemically synthesized
cactcgcctggtagagcccc

SEQ ID NO: 51177 - DNA, 20 bp, Artificial Sequence
  chemically synthesized
actcgcctggtagagcccca

SEQ ID NO: 51178 - DNA, 20 bp, Artificial Sequence
  chemically synthesized
cgcctggtagagccccaagg

SEQ ID NO: 51179 - DNA, 20 bp, Artificial Sequence
  chemically synthesized
cctggtagagccccaaggtg

SEQ ID NO: 51180 - DNA, 20 bp, Artificial Sequence
  chemically synthesized
ctggtagagccccaaggtgg

SEQ ID NO: 51181 - DNA, 20 bp, Artificial Sequence
  chemically synthesized
ccccaaggtggaggcataaa

SEQ ID NO: 51182 - DNA, 20 bp, Artificial Sequence
  chemically synthesized
cccaaggtggaggcataaat

SEQ ID NO: 51183 - DNA, 20 bp, Artificial Sequence
  chemically synthesized
ggtggaggcataaatgggac

SEQ ID NO: 51184 - DNA, 20 bp, Artificial Sequence
  chemically synthesized
taaatgggactggtgaatga

SEQ ID NO: 51185 - DNA, 20 bp, Artificial Sequence
  chemically synthesized
atgggactggtgaatgacag

SEQ ID NO: 51186 - DNA, 20 bp, Artificial Sequence
  chemically synthesized
tgggactggtgaatgacaga

SEQ ID NO: 51187 - DNA, 20 bp, Artificial Sequence
  chemically synthesized
gggactggtgaatgacagaa

SEQ ID NO: 51188 - DNA, 20 bp, Artificial Sequence
  chemically synthesized
ggactggtgaatgacagaag

SEQ ID NO: 51189 - DNA, 20 bp, Artificial Sequence
  chemically synthesized
cactcatccattcactctgc

SEQ ID NO: 51190 - DNA, 20 bp, Artificial Sequence
  chemically synthesized
attcactctgcaagtatcta

SEQ ID NO: 51191 - DNA, 20 bp, Artificial Sequence
  chemically synthesized
agtatctacggcacgtacgc

SEQ ID NO: 51192 - DNA, 20 bp, Artificial Sequence
  chemically synthesized
cggcacgtacgccagctccc

SEQ ID NO: 51193 - DNA, 20 bp, Artificial Sequence
  chemically synthesized
cacgtacgccagctcccaag

SEQ ID NO: 51194 - DNA, 20 bp, Artificial Sequence
  chemically synthesized
acgtacgccagctcccaagc

SEQ ID NO: 51195 - DNA, 20 bp, Artificial Sequence
  chemically synthesized
ccagctcccaagcaggtttg

SEQ ID NO: 51196 - DNA, 20 bp, Artificial Sequence
  chemically synthesized
cagctcccaagcaggtttgc

SEQ ID NO: 51197 - DNA, 20 bp, Artificial Sequence
  chemically synthesized
aagcaggtttgcgggttgca

SEQ ID NO: 51198 - DNA, 20 bp, Artificial Sequence
  chemically synthesized
caggtttgcgggttgcacag

SEQ ID NO: 51199 - DNA, 20 bp, Artificial Sequence
  chemically synthesized
aggtttgcgggttgcacagc

SEQ ID NO: 51200 - DNA, 20 bp, Artificial Sequence
  chemically synthesized
gcgggcgatgcaatctgatt

SEQ ID NO: 51201 - DNA, 20 bp, Artificial Sequence
  chemically synthesized
cgggcgatgcaatctgattt

SEQ ID NO: 51202 - DNA, 20 bp, Artificial Sequence
  chemically synthesized
caatctgatttaggctttta

SEQ ID NO: 51203 - DNA, 20 bp, Artificial Sequence
  chemically synthesized
aatctgatttaggcttttaa

SEQ ID NO: 51204 - DNA, 20 bp, Artificial Sequence
  chemically synthesized
atctgatttaggcttttaaa

SEQ ID NO: 51205 - DNA, 20 bp, Artificial Sequence
  chemically synthesized
cttttaaagggattgcaatc

SEQ ID NO: 51206 - DNA, 20 bp, Artificial Sequence
  chemically synthesized
ttaaagggattgcaatcaag

SEQ ID NO: 51207 - DNA, 20 bp, Artificial Sequence
  chemically synthesized
taaagggattgcaatcaagt

SEQ ID NO: 51208 - DNA, 20 bp, Artificial Sequence
  chemically synthesized
aaagggattgcaatcaagtg

SEQ ID NO: 51209 - DNA, 20 bp, Artificial Sequence
  chemically synthesized
gcaatcaagtggggccccac

SEQ ID NO: 51210 - DNA, 20 bp, Artificial Sequence
  chemically synthesized
cctcccctcccctccacccc

SEQ ID NO: 51211 - DNA, 20 bp, Artificial Sequence
  chemically synthesized
cccctcccctccacccccag

SEQ ID NO: 51212 - DNA, 20 bp, Artificial Sequence
  chemically synthesized
tccacccccagcagtctcca

SEQ ID NO: 51213 - DNA, 20 bp, Artificial Sequence
  chemically synthesized
ccacccccagcagtctccaa

SEQ ID NO: 51214 - DNA, 20 bp, Artificial Sequence
  chemically synthesized
ccaaaggcctccaacaaccc

SEQ ID NO: 51215 - DNA, 20 bp, Artificial Sequence
  chemically synthesized
aaaggcctccaacaacccca

SEQ ID NO: 51216 - DNA, 20 bp, Artificial Sequence
  chemically synthesized
ggcctccaacaaccccagag

SEQ ID NO: 51217 - DNA, 20 bp, Artificial Sequence
  chemically synthesized
gcctccaacaaccccagagt

SEQ ID NO: 51218 - DNA, 20 bp, Artificial Sequence
  chemically synthesized
cctccaacaaccccagagtg

SEQ ID NO: 51219 - DNA, 20 bp, Artificial Sequence
  chemically synthesized
ctccaacaaccccagagtgg

SEQ ID NO: 51220 - DNA, 20 bp, Artificial Sequence
  chemically synthesized
gagtgggggccatgtatcca

SEQ ID NO: 51221 - DNA, 20 bp, Artificial Sequence
  chemically synthesized
catgtatccaaagaaactcc

SEQ ID NO: 51222 - DNA, 20 bp, Artificial Sequence
  chemically synthesized
aagaaactccaagctgtata

SEQ ID NO: 51223 - DNA, 20 bp, Artificial Sequence
  chemically synthesized
aagctgtatacggatcacac

SEQ ID NO: 51224 - DNA, 20 bp, Artificial Sequence
  chemically synthesized
tacggatcacactggttttc

SEQ ID NO: 51225 - DNA, 20 bp, Artificial Sequence
  chemically synthesized
acggatcacactggttttcc

SEQ ID NO: 51226 - DNA, 20 bp, Artificial Sequence
  chemically synthesized
ggatcacactggttttccag

SEQ ID NO: 51227 - DNA, 20 bp, Artificial Sequence
  chemically synthesized
tggttttccaggagcaaaaa

SEQ ID NO: 51228 - DNA, 20 bp, Artificial Sequence
  chemically synthesized
tccaggagcaaaaacagaaa

SEQ ID NO: 51229 - DNA, 20 bp, Artificial Sequence
  chemically synthesized
ccaggagcaaaaacagaaac

SEQ ID NO: 51230 - DNA, 20 bp, Artificial Sequence
  chemically synthesized
gcaaaaacagaaacaggcct

SEQ ID NO: 51231 - DNA, 20 bp, Artificial Sequence
  chemically synthesized
caaaaacagaaacaggcctg

SEQ ID NO: 51232 - DNA, 20 bp, Artificial Sequence
  chemically synthesized
aacagaaacaggcctgaggc

SEQ ID NO: 51233 - DNA, 20 bp, Artificial Sequence
  chemically synthesized
attgaacctcctcctgctct

SEQ ID NO: 51234 - DNA, 20 bp, Artificial Sequence
  chemically synthesized
gaacctcctcctgctctgag

SEQ ID NO: 51235 - DNA, 20 bp, Artificial Sequence
  chemically synthesized
tcctcctgctctgagcagcc

SEQ ID NO: 51236 - DNA, 20 bp, Artificial Sequence
  chemically synthesized
cctcctgctctgagcagcct

SEQ ID NO: 51237 - DNA, 20 bp, Artificial Sequence
  chemically synthesized
ctcctgctctgagcagcctg

SEQ ID NO: 51238 - DNA, 20 bp, Artificial Sequence
  chemically synthesized
tcctgctctgagcagcctgg

SEQ ID NO: 51239 - DNA, 20 bp, Artificial Sequence
  chemically synthesized
cctgctctgagcagcctggg

SEQ ID NO: 51240 - DNA, 20 bp, Artificial Sequence
  chemically synthesized
gctctgagcagcctgggggg

SEQ ID NO: 51241 - DNA, 20 bp, Artificial Sequence
  chemically synthesized
agcagcctggggggcagact

SEQ ID NO: 51242 - DNA, 20 bp, Artificial Sequence
  chemically synthesized
agcctggggggcagactaag

SEQ ID NO: 51243 - DNA, 20 bp, Artificial Sequence
  chemically synthesized
cctggggggcagactaagca

SEQ ID NO: 51244 - DNA, 20 bp, Artificial Sequence
  chemically synthesized
ctggggggcagactaagcag

SEQ ID NO: 51245 - DNA, 20 bp, Artificial Sequence
  chemically synthesized
tggggggcagactaagcaga

SEQ ID NO: 51246 - DNA, 20 bp, Artificial Sequence
  chemically synthesized
agactaagcagagggctgtg

SEQ ID NO: 51247 - DNA, 20 bp, Artificial Sequence
  chemically synthesized
gggctgtgcagacccacata

SEQ ID NO: 51248 - DNA, 20 bp, Artificial Sequence
  chemically synthesized
gctgtgcagacccacataaa

SEQ ID NO: 51249 - DNA, 20 bp, Artificial Sequence
  chemically synthesized
ataaagagcctactgtgtgc

SEQ ID NO: 51250 - DNA, 20 bp, Artificial Sequence
  chemically synthesized
taaagagcctactgtgtgcc

SEQ ID NO: 51251 - DNA, 20 bp, Artificial Sequence
  chemically synthesized
gtgtgccaggcacttcaccc

SEQ ID NO: 51252 - DNA, 20 bp, Artificial Sequence
  chemically synthesized
tgtgccaggcacttcacccg

SEQ ID NO: 51253 - DNA, 20 bp, Artificial Sequence
  chemically synthesized
cttcacccgaggcacttcac

SEQ ID NO: 51254 - DNA, 20 bp, Artificial Sequence
  chemically synthesized
aggcacttcacaagcatgct

SEQ ID NO: 51255 - DNA, 20 bp, Artificial Sequence
  chemically synthesized
ggcacttcacaagcatgctt

SEQ ID NO: 51256 - DNA, 20 bp, Artificial Sequence
  chemically synthesized
gaatgaaacttccaactctt

SEQ ID NO: 51257 - DNA, 20 bp, Artificial Sequence
  chemically synthesized
aatgaaacttccaactcttt

SEQ ID NO: 51258 - DNA, 20 bp, Artificial Sequence
  chemically synthesized
acttccaactctttgggatg

SEQ ID NO: 51259 - DNA, 20 bp, Artificial Sequence
  chemically synthesized
cttccaactctttgggatgc

SEQ ID NO: 51260 - DNA, 20 bp, Artificial Sequence
  chemically synthesized
tctttgggatgcaggtgaaa

SEQ ID NO: 51261 - DNA, 20 bp, Artificial Sequence
  chemically synthesized
gatgcaggtgaaacagttcc

SEQ ID NO: 51262 - DNA, 20 bp, Artificial Sequence
  chemically synthesized
aggtgaaacagttcctggtt

SEQ ID NO: 51263 - DNA, 20 bp, Artificial Sequence
  chemically synthesized
gtgaaacagttcctggttca

SEQ ID NO: 51264 - DNA, 20 bp, Artificial Sequence
  chemically synthesized
gaaacagttcctggttcaga

SEQ ID NO: 51265 - DNA, 20 bp, Artificial Sequence
  chemically synthesized
aaacagttcctggttcagag

SEQ ID NO: 51266 - DNA, 20 bp, Artificial Sequence
  chemically synthesized
gttcctggttcagagaggtg

SEQ ID NO: 51267 - DNA, 20 bp, Artificial Sequence
  chemically synthesized
cctggttcagagaggtgaag

SEQ ID NO: 51268 - DNA, 20 bp, Artificial Sequence
  chemically synthesized
agaggtgaagcggcctgcct

SEQ ID NO: 51269 - DNA, 20 bp, Artificial Sequence
  chemically synthesized
gaggtgaagcggcctgcctg

SEQ ID NO: 51270 - DNA, 20 bp, Artificial Sequence
  chemically synthesized
gtgaagcggcctgcctgagg

SEQ ID NO: 51271 - DNA, 20 bp, Artificial Sequence
  chemically synthesized
gcggcctgcctgaggcagca

SEQ ID NO: 51272 - DNA, 20 bp, Artificial Sequence
  chemically synthesized
ggcagcacagctcttcttta

SEQ ID NO: 51273 - DNA, 20 bp, Artificial Sequence
  chemically synthesized
cccacctctaccctgtctca

SEQ ID NO: 51274 - DNA, 20 bp, Artificial Sequence
  chemically synthesized
tgtctcacggccccccatgc

SEQ ID NO: 51275 - DNA, 20 bp, Artificial Sequence
  chemically synthesized
ggccccccatgccagcctga

SEQ ID NO: 51276 - DNA, 20 bp, Artificial Sequence
  chemically synthesized
cctgacggttgtgtctgcct

SEQ ID NO: 51277 - DNA, 20 bp, Artificial Sequence
  chemically synthesized
gtcatgctccatttttccat

SEQ ID NO: 51278 - DNA, 20 bp, Artificial Sequence
  chemically synthesized
tcatgctccatttttccatc

SEQ ID NO: 51279 - DNA, 20 bp, Artificial Sequence
  chemically synthesized
atttttccatcgggaccatc

SEQ ID NO: 51280 - DNA, 20 bp, Artificial Sequence
  chemically synthesized
ttttccatcgggaccatcaa

SEQ ID NO: 51281 - DNA, 20 bp, Artificial Sequence
  chemically synthesized
tttccatcgggaccatcaag

SEQ ID NO: 51282 - DNA, 20 bp, Artificial Sequence
  chemically synthesized
ttccatcgggaccatcaaga

SEQ ID NO: 51283 - DNA, 20 bp, Artificial Sequence
  chemically synthesized
tcaagagggtgtttgtgtct

SEQ ID NO: 51284 - DNA, 20 bp, Artificial Sequence
  chemically synthesized
caagagggtgtttgtgtcta

SEQ ID NO: 51285 - DNA, 20 bp, Artificial Sequence
  chemically synthesized
tgtttgtgtctaaggctgac

SEQ ID NO: 51286 - DNA, 20 bp, Artificial Sequence
  chemically synthesized
gtttgtgtctaaggctgact

SEQ ID NO: 51287 - DNA, 20 bp, Artificial Sequence
  chemically synthesized
taaggctgactgggtaactt

SEQ ID NO: 51288 - DNA, 20 bp, Artificial Sequence
  chemically synthesized
ctgactgggtaactttggat

SEQ ID NO: 51289 - DNA, 20 bp, Artificial Sequence
  chemically synthesized
actgggtaactttggatgag

SEQ ID NO: 51290 - DNA, 20 bp, Artificial Sequence
  chemically synthesized
atgagcggtctctccgctct

SEQ ID NO: 51291 - DNA, 20 bp, Artificial Sequence
  chemically synthesized
ctgtttcctcatctgtcaaa

SEQ ID NO: 51292 - DNA, 20 bp, Artificial Sequence
  chemically synthesized
tgtttcctcatctgtcaaat

SEQ ID NO: 51293 - DNA, 20 bp, Artificial Sequence
  chemically synthesized
tctaacccactctgatctcc

SEQ ID NO: 51294 - DNA, 20 bp, Artificial Sequence
  chemically synthesized
ctaacccactctgatctccc

SEQ ID NO: 51295 - DNA, 20 bp, Artificial Sequence
  chemically synthesized
taacccactctgatctccca

SEQ ID NO: 51296 - DNA, 20 bp, Artificial Sequence
  chemically synthesized
cccactctgatctcccaggg

SEQ ID NO: 51297 - DNA, 20 bp, Artificial Sequence
  chemically synthesized
actctgatctcccagggcgg

SEQ ID NO: 51298 - DNA, 20 bp, Artificial Sequence
  chemically synthesized
tgatctcccagggcggcagt

SEQ ID NO: 51299 - DNA, 20 bp, Artificial Sequence
  chemically synthesized
ccagggcggcagtaagtctt

SEQ ID NO: 51300 - DNA, 20 bp, Artificial Sequence
  chemically synthesized
cggcagtaagtcttcagcat

SEQ ID NO: 51301 - DNA, 20 bp, Artificial Sequence
  chemically synthesized
ggcagtaagtcttcagcatc

SEQ ID NO: 51302 - DNA, 20 bp, Artificial Sequence
  chemically synthesized
gtcttcagcatcaggcattt

SEQ ID NO: 51303 - DNA, 20 bp, Artificial Sequence
  chemically synthesized
tcttcagcatcaggcatttt

SEQ ID NO: 51304 - DNA, 20 bp, Artificial Sequence
  chemically synthesized
cttcagcatcaggcattttg

SEQ ID NO: 51305 - DNA, 20 bp, Artificial Sequence
  chemically synthesized
tcaggcattttggggtgact

SEQ ID NO: 51306 - DNA, 20 bp, Artificial Sequence
  chemically synthesized
ttttggggtgactcagtaaa

SEQ ID NO: 51307 - DNA, 20 bp, Artificial Sequence
  chemically synthesized
tggggtgactcagtaaatgg

SEQ ID NO: 51308 - DNA, 20 bp, Artificial Sequence
  chemically synthesized
taaatggtagatcttgctac

SEQ ID NO: 51309 - DNA, 20 bp, Artificial Sequence
  chemically synthesized
atggtagatcttgctaccag

SEQ ID NO: 51310 - DNA, 20 bp, Artificial Sequence
  chemically synthesized
agatcttgctaccagtggaa

SEQ ID NO: 51311 - DNA, 20 bp, Artificial Sequence
  chemically synthesized
ctaccagtggaacagccact

SEQ ID NO: 51312 - DNA, 20 bp, Artificial Sequence
  chemically synthesized
taccagtggaacagccacta

SEQ ID NO: 51313 - DNA, 20 bp, Artificial Sequence
  chemically synthesized
aacagccactaaggattctg

SEQ ID NO: 51314 - DNA, 20 bp, Artificial Sequence
  chemically synthesized
gccactaaggattctgcagt

SEQ ID NO: 51315 - DNA, 20 bp, Artificial Sequence
  chemically synthesized
cactaaggattctgcagtga

SEQ ID NO: 51316 - DNA, 20 bp, Artificial Sequence
  chemically synthesized
taaggattctgcagtgagag

SEQ ID NO: 51317 - DNA, 20 bp, Artificial Sequence
  chemically synthesized
aggattctgcagtgagagca

SEQ ID NO: 51318 - DNA, 20 bp, Artificial Sequence
  chemically synthesized
ggattctgcagtgagagcag

SEQ ID NO: 51319 - DNA, 20 bp, Artificial Sequence
  chemically synthesized
gattctgcagtgagagcaga

SEQ ID NO: 51320 - DNA, 20 bp, Artificial Sequence
  chemically synthesized
ctgcagtgagagcagagggc

SEQ ID NO: 51321 - DNA, 20 bp, Artificial Sequence
  chemically synthesized
gtgagagcagagggccagct

SEQ ID NO: 51322 - DNA, 20 bp, Artificial Sequence
  chemically synthesized
agagcagagggccagctaag

SEQ ID NO: 51323 - DNA, 20 bp, Artificial Sequence
  chemically synthesized
ccagctaagtggtactctcc

SEQ ID NO: 51324 - DNA, 20 bp, Artificial Sequence
  chemically synthesized
agctaagtggtactctccca

SEQ ID NO: 51325 - DNA, 20 bp, Artificial Sequence
  chemically synthesized
tcacgccaccccctccacct

SEQ ID NO: 51326 - DNA, 20 bp, Artificial Sequence
  chemically synthesized
caccccctccaccttggaca

SEQ ID NO: 51327 - DNA, 20 bp, Artificial Sequence
  chemically synthesized
accccctccaccttggacac

SEQ ID NO: 51328 - DNA, 20 bp, Artificial Sequence
  chemically synthesized
accttggacacaggacgctg

SEQ ID NO: 51329 - DNA, 20 bp, Artificial Sequence
  chemically synthesized
cacaggacgctgtggtttct

SEQ ID NO: 51330 - DNA, 20 bp, Artificial Sequence
  chemically synthesized
ggacgctgtggtttctgagc

SEQ ID NO: 51331 - DNA, 20 bp, Artificial Sequence
  chemically synthesized
gacgctgtggtttctgagcc

SEQ ID NO: 51332 - DNA, 20 bp, Artificial Sequence
  chemically synthesized
ccaggtacaatgactccttt

SEQ ID NO: 51333 - DNA, 20 bp, Artificial Sequence
  chemically synthesized
gtacaatgactcctttcggt

SEQ ID NO: 51334 - DNA, 20 bp, Artificial Sequence
  chemically synthesized
atgactcctttcggtaagtg

SEQ ID NO: 51335 - DNA, 20 bp, Artificial Sequence
  chemically synthesized
actcctttcggtaagtgcag

SEQ ID NO: 51336 - DNA, 20 bp, Artificial Sequence
  chemically synthesized
cctttcggtaagtgcagtgg

SEQ ID NO: 51337 - DNA, 20 bp, Artificial Sequence
  chemically synthesized
agtggaagctgtacactgcc

SEQ ID NO: 51338 - DNA, 20 bp, Artificial Sequence
  chemically synthesized
gtggaagctgtacactgccc

SEQ ID NO: 51339 - DNA, 20 bp, Artificial Sequence
  chemically synthesized
agctgtacactgcccaggca

SEQ ID NO: 51340 - DNA, 20 bp, Artificial Sequence
  chemically synthesized
cactgcccaggcaaagcgtc

SEQ ID NO: 51341 - DNA, 20 bp, Artificial Sequence
  chemically synthesized
actgcccaggcaaagcgtcc

SEQ ID NO: 51342 - DNA, 20 bp, Artificial Sequence
  chemically synthesized
gcccaggcaaagcgtccggg

SEQ ID NO: 51343 - DNA, 20 bp, Artificial Sequence
  chemically synthesized
ggcaaagcgtccgggcagcg

SEQ ID NO: 51344 - DNA, 20 bp, Artificial Sequence
  chemically synthesized
gcaaagcgtccgggcagcgt

SEQ ID NO: 51345 - DNA, 20 bp, Artificial Sequence
  chemically synthesized
aagcgtccgggcagcgtagg

SEQ ID NO: 51346 - DNA, 20 bp, Artificial Sequence
  chemically synthesized
agcgtccgggcagcgtaggc

SEQ ID NO: 51347 - DNA, 20 bp, Artificial Sequence
  chemically synthesized
ggcagcgtaggcgggcgact

SEQ ID NO: 51348 - DNA, 20 bp, Artificial Sequence
  chemically synthesized
taggcgggcgactcagatcc

SEQ ID NO: 51349 - DNA, 20 bp, Artificial Sequence
  chemically synthesized
cgggcgactcagatcccagc

SEQ ID NO: 51350 - DNA, 20 bp, Artificial Sequence
  chemically synthesized
gcgactcagatcccagccag

SEQ ID NO: 51351 - DNA, 20 bp, Artificial Sequence
  chemically synthesized
cagatcccagccagtggact

SEQ ID NO: 51352 - DNA, 20 bp, Artificial Sequence
  chemically synthesized
ctgtttgctcctccgataac

SEQ ID NO: 51353 - DNA, 20 bp, Artificial Sequence
  chemically synthesized
tgtttgctcctccgataact

SEQ ID NO: 51354 - DNA, 20 bp, Artificial Sequence
  chemically synthesized
gtttgctcctccgataactg

SEQ ID NO: 51355 - DNA, 20 bp, Artificial Sequence
  chemically synthesized
tccgataactggggtgacct

SEQ ID NO: 51356 - DNA, 20 bp, Artificial Sequence
  chemically synthesized
tgaccttggttaatattcac

SEQ ID NO: 51357 - DNA, 20 bp, Artificial Sequence
  chemically synthesized
ccttggttaatattcaccag

SEQ ID NO: 51358 - DNA, 20 bp, Artificial Sequence
  chemically synthesized
agcctcccccgttgcccctc

SEQ ID NO: 51359 - DNA, 20 bp, Artificial Sequence
  chemically synthesized
ctggatccactgcttaaata

SEQ ID NO: 51360 - DNA, 20 bp, Artificial Sequence
  chemically synthesized
tccactgcttaaatacggac

SEQ ID NO: 51361 - DNA, 20 bp, Artificial Sequence
  chemically synthesized
ccactgcttaaatacggacg

SEQ ID NO: 51362 - DNA, 20 bp, Artificial Sequence
  chemically synthesized
tgcttaaatacggacgagga

SEQ ID NO: 51363 - DNA, 20 bp, Artificial Sequence
  chemically synthesized
gcttaaatacggacgaggac

SEQ ID NO: 51364 - DNA, 20 bp, Artificial Sequence
  chemically synthesized
cttaaatacggacgaggaca

SEQ ID NO: 51365 - DNA, 20 bp, Artificial Sequence
  chemically synthesized
aggacagggccctgtctcct

SEQ ID NO: 51366 - DNA, 20 bp, Artificial Sequence
  chemically synthesized
gggccctgtctcctcagctt

SEQ ID NO: 51367 - DNA, 20 bp, Artificial Sequence
  chemically synthesized
ggccctgtctcctcagcttc

SEQ ID NO: 51368 - DNA, 20 bp, Artificial Sequence
  chemically synthesized
ttcaggcaccaccactgacc

SEQ ID NO: 51369 - DNA, 20 bp, Artificial Sequence
  chemically synthesized
tcaggcaccaccactgacct

SEQ ID NO: 51370 - DNA, 20 bp, Artificial Sequence
  chemically synthesized
gcaccaccactgacctggga

SEQ ID NO: 51371 - DNA, 20 bp, Artificial Sequence
  chemically synthesized
gacctgggacagtgaatcgt

SEQ ID NO: 51372 - DNA, 20 bp, Artificial Sequence
  chemically synthesized
gtaagtatgcctttcactgc

SEQ ID NO: 51373 - DNA, 20 bp, Artificial Sequence
  chemically synthesized
aagtatgcctttcactgcga

SEQ ID NO: 51374 - DNA, 20 bp, Artificial Sequence
  chemically synthesized
agtatgcctttcactgcgag

SEQ ID NO: 51375 - DNA, 20 bp, Artificial Sequence
  chemically synthesized
cctttcactgcgagaggttc

SEQ ID NO: 51376 - DNA, 20 bp, Artificial Sequence
  chemically synthesized
tttcactgcgagaggttctg

SEQ ID NO: 51377 - DNA, 20 bp, Artificial Sequence
  chemically synthesized
tcactgcgagaggttctgga

SEQ ID NO: 51378 - DNA, 20 bp, Artificial Sequence
  chemically synthesized
cactgcgagaggttctggag

SEQ ID NO: 51379 - DNA, 20 bp, Artificial Sequence
  chemically synthesized
gaggttctggagaggcttct

SEQ ID NO: 51380 - DNA, 20 bp, Artificial Sequence
  chemically synthesized
agaggcttctgagctcccca

SEQ ID NO: 51381 - DNA, 20 bp, Artificial Sequence
  chemically synthesized
cttctgagctccccatggcc

SEQ ID NO: 51382 - DNA, 20 bp, Artificial Sequence
  chemically synthesized
ttctgagctccccatggccc

SEQ ID NO: 51383 - DNA, 20 bp, Artificial Sequence
  chemically synthesized
tgagctccccatggcccagg

SEQ ID NO: 51384 - DNA, 20 bp, Artificial Sequence
  chemically synthesized
gagctccccatggcccaggc

SEQ ID NO: 51385 - DNA, 20 bp, Artificial Sequence
  chemically synthesized
ctccccatggcccaggcagg

SEQ ID NO: 51386 - DNA, 20 bp, Artificial Sequence
  chemically synthesized
cccatggcccaggcaggcag

SEQ ID NO: 51387 - DNA, 20 bp, Artificial Sequence
  chemically synthesized
ccatggcccaggcaggcagc

SEQ ID NO: 51388 - DNA, 20 bp, Artificial Sequence
  chemically synthesized
gcccaggcaggcagcaggtc

SEQ ID NO: 51389 - DNA, 20 bp, Artificial Sequence
  chemically synthesized
cccaggcaggcagcaggtct

SEQ ID NO: 51390 - DNA, 20 bp, Artificial Sequence
  chemically synthesized
ccaggcaggcagcaggtctg

SEQ ID NO: 51391 - DNA, 20 bp, Artificial Sequence
  chemically synthesized
ggcaggcagcaggtctgggg

SEQ ID NO: 51392 - DNA, 20 bp, Artificial Sequence
  chemically synthesized
gcaggcagcaggtctggggc

SEQ ID NO: 51393 - DNA, 20 bp, Artificial Sequence
  chemically synthesized
aggcagcaggtctggggcag

SEQ ID NO: 51394 - DNA, 20 bp, Artificial Sequence
  chemically synthesized
ggcagcaggtctggggcagg

SEQ ID NO: 51395 - DNA, 20 bp, Artificial Sequence
  chemically synthesized
gcagcaggtctggggcagga

SEQ ID NO: 51396 - DNA, 20 bp, Artificial Sequence
  chemically synthesized
cagcaggtctggggcaggag

SEQ ID NO: 51397 - DNA, 20 bp, Artificial Sequence
  chemically synthesized
agcaggtctggggcaggagg

SEQ ID NO: 51398 - DNA, 20 bp, Artificial Sequence
  chemically synthesized
gcaggtctggggcaggaggg

SEQ ID NO: 51399 - DNA, 20 bp, Artificial Sequence
  chemically synthesized
ctggggcaggaggggggttg

SEQ ID NO: 51400 - DNA, 20 bp, Artificial Sequence
  chemically synthesized
ggggcaggaggggggttgtg

SEQ ID NO: 51401 - DNA, 20 bp, Artificial Sequence
  chemically synthesized
gcaggaggggggttgtggag

SEQ ID NO: 51402 - DNA, 20 bp, Artificial Sequence
  chemically synthesized
caggaggggggttgtggagt

SEQ ID NO: 51403 - DNA, 20 bp, Artificial Sequence
  chemically synthesized
ggagtgggtatccgcctgct

SEQ ID NO: 51404 - DNA, 20 bp, Artificial Sequence
  chemically synthesized
gagtgggtatccgcctgctg

SEQ ID NO: 51405 - DNA, 20 bp, Artificial Sequence
  chemically synthesized
ggtatccgcctgctgaggtg

SEQ ID NO: 51406 - DNA, 20 bp, Artificial Sequence
  chemically synthesized
gtatccgcctgctgaggtgc

SEQ ID NO: 51407 - DNA, 20 bp, Artificial Sequence
  chemically synthesized
tatccgcctgctgaggtgca

SEQ ID NO: 51408 - DNA, 20 bp, Artificial Sequence
  chemically synthesized
ccgcctgctgaggtgcaggg

SEQ ID NO: 51409 - DNA, 20 bp, Artificial Sequence
  chemically synthesized
ctgctgaggtgcagggcaga

SEQ ID NO: 51410 - DNA, 20 bp, Artificial Sequence
  chemically synthesized
gctgaggtgcagggcagatg

SEQ ID NO: 51411 - DNA, 20 bp, Artificial Sequence
  chemically synthesized
tgaggtgcagggcagatgga

SEQ ID NO: 51412 - DNA, 20 bp, Artificial Sequence
  chemically synthesized
gaggtgcagggcagatggag

SEQ ID NO: 51413 - DNA, 20 bp, Artificial Sequence
  chemically synthesized
cagggcagatggagaggctg

SEQ ID NO: 51414 - DNA, 20 bp, Artificial Sequence
  chemically synthesized
cagatggagaggctgcagct

SEQ ID NO: 51415 - DNA, 20 bp, Artificial Sequence
  chemically synthesized
agctcctattttcataataa

SEQ ID NO: 51416 - DNA, 20 bp, Artificial Sequence
  chemically synthesized
tcctattttcataataacag

SEQ ID NO: 51417 - DNA, 20 bp, Artificial Sequence
  chemically synthesized
ttcataataacagcagccat

SEQ ID NO: 51418 - DNA, 20 bp, Artificial Sequence
  chemically synthesized
tcataataacagcagccatg

SEQ ID NO: 51419 - DNA, 20 bp, Artificial Sequence
  chemically synthesized
cataataacagcagccatga

SEQ ID NO: 51420 - DNA, 20 bp, Artificial Sequence
  chemically synthesized
gagggttgtgtcctgtttcc

SEQ ID NO: 51421 - DNA, 20 bp, Artificial Sequence
  chemically synthesized
tcctgtttcccagtcctgcc

SEQ ID NO: 51422 - DNA, 20 bp, Artificial Sequence
  chemically synthesized
agtcctgcccggtcccccct

SEQ ID NO: 51423 - DNA, 20 bp, Artificial Sequence
  chemically synthesized
ggtcccccctcggtacctcc

SEQ ID NO: 51424 - DNA, 20 bp, Artificial Sequence
  chemically synthesized
cccccctcggtacctcctgg

SEQ ID NO: 51425 - DNA, 20 bp, Artificial Sequence
  chemically synthesized
gtacctcctggtggatacac

SEQ ID NO: 51426 - DNA, 20 bp, Artificial Sequence
  chemically synthesized
gtggatacactggttcctgt

SEQ ID NO: 51427 - DNA, 20 bp, Artificial Sequence
  chemically synthesized
gatacactggttcctgtaag

SEQ ID NO: 51428 - DNA, 20 bp, Artificial Sequence
  chemically synthesized
acactggttcctgtaagcag

SEQ ID NO: 51429 - DNA, 20 bp, Artificial Sequence
  chemically synthesized
ctggttcctgtaagcagaag

SEQ ID NO: 51430 - DNA, 20 bp, Artificial Sequence
  chemically synthesized
tcctgtaagcagaagtggat

SEQ ID NO: 51431 - DNA, 20 bp, Artificial Sequence
  chemically synthesized
cctgtaagcagaagtggatg

SEQ ID NO: 51432 - DNA, 20 bp, Artificial Sequence
  chemically synthesized
ctgtaagcagaagtggatga

SEQ ID NO: 51433 - DNA, 20 bp, Artificial Sequence
  chemically synthesized
cagaagtggatgagggtgtc

SEQ ID NO: 51434 - DNA, 20 bp, Artificial Sequence
  chemically synthesized
agaagtggatgagggtgtct

SEQ ID NO: 51435 - DNA, 20 bp, Artificial Sequence
  chemically synthesized
gatgagggtgtctaggtctg

SEQ ID NO: 51436 - DNA, 20 bp, Artificial Sequence
  chemically synthesized
ggtgtctaggtctgcagtcc

SEQ ID NO: 51437 - DNA, 20 bp, Artificial Sequence
  chemically synthesized
ggtctgcagtcctggcaccc

SEQ ID NO: 51438 - DNA, 20 bp, Artificial Sequence
  chemically synthesized
gtctgcagtcctggcacccc

SEQ ID NO: 51439 - DNA, 20 bp, Artificial Sequence
  chemically synthesized
gcagtcctggcaccccagga

SEQ ID NO: 51440 - DNA, 20 bp, Artificial Sequence
  chemically synthesized
cagtcctggcaccccaggat

SEQ ID NO: 51441 - DNA, 20 bp, Artificial Sequence
  chemically synthesized
agtcctggcaccccaggatg

SEQ ID NO: 51442 - DNA, 20 bp, Artificial Sequence
  chemically synthesized
gtcctggcaccccaggatgg

SEQ ID NO: 51443 - DNA, 20 bp, Artificial Sequence
  chemically synthesized
caccccaggatgggggacac

SEQ ID NO: 51444 - DNA, 20 bp, Artificial Sequence
  chemically synthesized
caggatgggggacaccagcc

SEQ ID NO: 51445 - DNA, 20 bp, Artificial Sequence
  chemically synthesized
gggggacaccagccaagata

SEQ ID NO: 51446 - DNA, 20 bp, Artificial Sequence
  chemically synthesized
caccagccaagatacagcaa

SEQ ID NO: 51447 - DNA, 20 bp, Artificial Sequence
  chemically synthesized
aagatacagcaacagcaaca

SEQ ID NO: 51448 - DNA, 20 bp, Artificial Sequence
  chemically synthesized
acagcaacagcaacaaagcg

SEQ ID NO: 51449 - DNA, 20 bp, Artificial Sequence
  chemically synthesized
gccatttctttctgtttgca

SEQ ID NO: 51450 - DNA, 20 bp, Artificial Sequence
  chemically synthesized
tgcacagctcctctgtctgt

SEQ ID NO: 51451 - DNA, 20 bp, Artificial Sequence
  chemically synthesized
gcacagctcctctgtctgtc

SEQ ID NO: 51452 - DNA, 20 bp, Artificial Sequence
  chemically synthesized
cacagctcctctgtctgtcg

SEQ ID NO: 51453 - DNA, 20 bp, Artificial Sequence
  chemically synthesized
acagctcctctgtctgtcgg

SEQ ID NO: 51454 - DNA, 20 bp, Artificial Sequence
  chemically synthesized
tcctgtctgttgtctcctat

SEQ ID NO: 51455 - DNA, 20 bp, Artificial Sequence
  chemically synthesized
tcaccacctctcctactgct

SEQ ID NO: 51456 - DNA, 20 bp, Artificial Sequence
  chemically synthesized
caccacctctcctactgctt

SEQ ID NO: 51457 - DNA, 20 bp, Artificial Sequence
  chemically synthesized
tgcatctttctccccttcta

SEQ ID NO: 51458 - DNA, 20 bp, Artificial Sequence
  chemically synthesized
ctttctccccttctatagat

SEQ ID NO: 51459 - DNA, 20 bp, Artificial Sequence
  chemically synthesized
tttctccccttctatagatg

SEQ ID NO: 51460 - DNA, 20 bp, Artificial Sequence
  chemically synthesized
tctccccttctatagatgag

SEQ ID NO: 51461 - DNA, 20 bp, Artificial Sequence
  chemically synthesized
ctccccttctatagatgagg

SEQ ID NO: 51462 - DNA, 20 bp, Artificial Sequence
  chemically synthesized
cttctatagatgaggaggtt

SEQ ID NO: 51463 - DNA, 20 bp, Artificial Sequence
  chemically synthesized
ttctatagatgaggaggtta

SEQ ID NO: 51464 - DNA, 20 bp, Artificial Sequence
  chemically synthesized
tagatgaggaggttaaggtc

SEQ ID NO: 51465 - DNA, 20 bp, Artificial Sequence
  chemically synthesized
gatgaggaggttaaggtcca

SEQ ID NO: 51466 - DNA, 20 bp, Artificial Sequence
  chemically synthesized
tgaggaggttaaggtccaga

SEQ ID NO: 51467 - DNA, 20 bp, Artificial Sequence
  chemically synthesized
gaggaggttaaggtccagag

SEQ ID NO: 51468 - DNA, 20 bp, Artificial Sequence
  chemically synthesized
aggaggttaaggtccagaga

SEQ ID NO: 51469 - DNA, 20 bp, Artificial Sequence
  chemically synthesized
ggaggttaaggtccagagag

SEQ ID NO: 51470 - DNA, 20 bp, Artificial Sequence
  chemically synthesized
ggttaaggtccagagagggg

SEQ ID NO: 51471 - DNA, 20 bp, Artificial Sequence
  chemically synthesized
gttaaggtccagagaggggt

SEQ ID NO: 51472 - DNA, 20 bp, Artificial Sequence
  chemically synthesized
ttaaggtccagagaggggtg

SEQ ID NO: 51473 - DNA, 20 bp, Artificial Sequence
  chemically synthesized
aaggtccagagaggggtggg

SEQ ID NO: 51474 - DNA, 20 bp, Artificial Sequence
  chemically synthesized
aggtccagagaggggtgggg

SEQ ID NO: 51475 - DNA, 20 bp, Artificial Sequence
  chemically synthesized
agaggggtggggaggaacgc

SEQ ID NO: 51476 - DNA, 20 bp, Artificial Sequence
  chemically synthesized
ctcacattctccatcccctc

SEQ ID NO: 51477 - DNA, 20 bp, Artificial Sequence
  chemically synthesized
ccatcccctccagatatgac

SEQ ID NO: 51478 - DNA, 20 bp, Artificial Sequence
  chemically synthesized
catcccctccagatatgacc

SEQ ID NO: 51479 - DNA, 20 bp, Artificial Sequence
  chemically synthesized
cctccagatatgaccaggaa

SEQ ID NO: 51480 - DNA, 20 bp, Artificial Sequence
  chemically synthesized
gaccaggaacagacctgtgc

SEQ ID NO: 51481 - DNA, 20 bp, Artificial Sequence
  chemically synthesized
accaggaacagacctgtgcc

SEQ ID NO: 51482 - DNA, 20 bp, Artificial Sequence
  chemically synthesized
aacagacctgtgccaggcct

SEQ ID NO: 51483 - DNA, 20 bp, Artificial Sequence
  chemically synthesized
tgttcctggtcatatctgga

SEQ ID NO: 51484 - DNA, 20 bp, Artificial Sequence
  chemically synthesized
ggtcatatctggaggggatg

SEQ ID NO: 51485 - DNA, 20 bp, Artificial Sequence
  chemically synthesized
ttggctggtgtcccccatcc

SEQ ID NO: 51486 - DNA, 20 bp, Artificial Sequence
  chemically synthesized
tctgccctgcacctcagcag

SEQ ID NO: 51487 - DNA, 20 bp, Artificial Sequence
  chemically synthesized
tcctcgtccgtatttaagca

SEQ ID NO: 51488 - DNA, 20 bp, Artificial Sequence
  chemically synthesized
ggcaacgggggaggctgctg

SEQ ID NO: 51489 - DNA, 20 bp, Artificial Sequence
  chemically synthesized
caggggctaagtccactggc

SEQ ID NO: 51490 - DNA, 20 bp, Artificial Sequence
  chemically synthesized
ctaagtccactggctgggat

SEQ ID NO: 51491 - DNA, 20 bp, Artificial Sequence
  chemically synthesized
cttccactgcacttaccgaa

SEQ ID NO: 51492 - DNA, 20 bp, Artificial Sequence
  chemically synthesized
cgtcctgtgtccaaggtgga

SEQ ID NO: 51493 - DNA, 20 bp, Artificial Sequence
  chemically synthesized
tccaaggtggagggggtggc

SEQ ID NO: 51494 - DNA, 20 bp, Artificial Sequence
  chemically synthesized
gtgagtcagacagtctctgg

SEQ ID NO: 51495 - DNA, 20 bp, Artificial Sequence
  chemically synthesized
ctggccctctgctctcactg

SEQ ID NO: 51496 - DNA, 20 bp, Artificial Sequence
  chemically synthesized
gtagcaagatctaccattta

SEQ ID NO: 51497 - DNA, 20 bp, Artificial Sequence
  chemically synthesized
ttactgccgccctgggagat

SEQ ID NO: 51498 - DNA, 20 bp, Artificial Sequence
  chemically synthesized
tgccgccctgggagatcaga

SEQ ID NO: 51499 - DNA, 20 bp, Artificial Sequence
  chemically synthesized
tggcatggggggccgtgaga

SEQ ID NO: 51500 - DNA, 20 bp, Artificial Sequence
  chemically synthesized
actgtttcacctgcatccca

SEQ ID NO: 51501 - DNA, 20 bp, Artificial Sequence
  chemically synthesized
aagcatgcttgtgaagtgcc

SEQ ID NO: 51502 - DNA, 20 bp, Artificial Sequence
  chemically synthesized
gcacacagtaggctctttat

SEQ ID NO: 51503 - DNA, 20 bp, Artificial Sequence
  chemically synthesized
agtgtgatccgtatacagct

SEQ ID NO: 51504 - DNA, 20 bp, Artificial Sequence
  chemically synthesized
gtatacagcttggagtttct

SEQ ID NO: 51505 - DNA, 20 bp, Artificial Sequence
  chemically synthesized
tggatacatggcccccactc

SEQ ID NO: 51506 - DNA, 20 bp, Artificial Sequence
  chemically synthesized
ggaggcctttggagactgct

SEQ ID NO: 51507 - DNA, 20 bp, Artificial Sequence
  chemically synthesized
ggtggaggggaggggaggta

SEQ ID NO: 51508 - DNA, 20 bp, Artificial Sequence
  chemically synthesized
gtacgtgccgtagatacttg

SEQ ID NO: 51509 - DNA, 20 bp, Artificial Sequence
  chemically synthesized
gtgccgtagatacttgcaga

SEQ ID NO: 51510 - DNA, 20 bp, Artificial Sequence
  chemically synthesized
cgtagatacttgcagagtga

SEQ ID NO: 51511 - DNA, 20 bp, Artificial Sequence
  chemically synthesized
gatacttgcagagtgaatgg

SEQ ID NO: 51512 - DNA, 20 bp, Artificial Sequence
  chemically synthesized
ccaccttggggctctaccag

SEQ ID NO: 51513 - DNA, 20 bp, Artificial Sequence
  chemically synthesized
tctaccaggcgagtgaccca

SEQ ID NO: 51514 - DNA, 20 bp, Artificial Sequence
  chemically synthesized
tactggctgtgaggcctcag

SEQ ID NO: 51515 - DNA, 20 bp, Artificial Sequence
  chemically synthesized
aatttccctatctgtaaaat

SEQ ID NO: 51516 - DNA, 20 bp, Artificial Sequence
  chemically synthesized
gtaccttgttgagctgctgt

SEQ ID NO: 51517 - DNA, 20 bp, Artificial Sequence
  chemically synthesized
agttcaaggaaagctcagag

SEQ ID NO: 51518 - DNA, 20 bp, Artificial Sequence
  chemically synthesized
ggaaagctcagagacgggta

SEQ ID NO: 51519 - DNA, 20 bp, Artificial Sequence
  chemically synthesized
gtgtcaggggctggtgtcac

SEQ ID NO: 51520 - DNA, 20 bp, Artificial Sequence
  chemically synthesized
aggggctggtgtcactgggg

SEQ ID NO: 51521 - DNA, 20 bp, Artificial Sequence
  chemically synthesized
tcattcagttaccctgtgaa

SEQ ID NO: 51522 - DNA, 20 bp, Artificial Sequence
  chemically synthesized
ctgtccttcccctgagctgg

SEQ ID NO: 51523 - DNA, 20 bp, Artificial Sequence
  chemically synthesized
ccttcccctgagctggctga

SEQ ID NO: 51524 - DNA, 20 bp, Artificial Sequence
  chemically synthesized
tgtccctcccacctgtggaa

SEQ ID NO: 51525 - DNA, 20 bp, Artificial Sequence
  chemically synthesized
gtctcttctggcaggcacag

SEQ ID NO: 51526 - DNA, 20 bp, Artificial Sequence
  chemically synthesized
aggttgccgcccctccaacc

SEQ ID NO: 51527 - DNA, 20 bp, Artificial Sequence
  chemically synthesized
ttggttcagctcaggactct

SEQ ID NO: 51528 - DNA, 20 bp, Artificial Sequence
  chemically synthesized
gcccacccaggaagtagact

SEQ ID NO: 51529 - DNA, 20 bp, Artificial Sequence
  chemically synthesized
ggacaagtcaccctctccct

SEQ ID NO: 51530 - DNA, 20 bp, Artificial Sequence
  chemically synthesized
aggtacagtcacactgccca

SEQ ID NO: 51531 - DNA, 20 bp, Artificial Sequence
  chemically synthesized
cttgcggcaactcaaaggga

SEQ ID NO: 51532 - DNA, 20 bp, Artificial Sequence
  chemically synthesized
aagggagagggtgacttgtc

SEQ ID NO: 51533 - DNA, 20 bp, Artificial Sequence
  chemically synthesized
caggtgacatgccgggctgt

SEQ ID NO: 51534 - DNA, 20 bp, Artificial Sequence
  chemically synthesized
ctccacccgaagtctacttc

SEQ ID NO: 51535 - DNA, 20 bp, Artificial Sequence
  chemically synthesized
tgcctccacgcagcaaccct

SEQ ID NO: 51536 - DNA, 20 bp, Artificial Sequence
  chemically synthesized
agctgaaccaagaaggagga

SEQ ID NO: 51537 - DNA, 20 bp, Artificial Sequence
  chemically synthesized
gcctagccgctgctgctgcc

SEQ ID NO: 51538 - DNA, 20 bp, Artificial Sequence
  chemically synthesized
gtgggagggacagcagggct

SEQ ID NO: 51539 - DNA, 20 bp, Artificial Sequence
  chemically synthesized
gggacagcagggcttagagt

SEQ ID NO: 51540 - DNA, 20 bp, Artificial Sequence
  chemically synthesized
cacagcccagtgctggagct

SEQ ID NO: 51541 - DNA, 20 bp, Artificial Sequence
  chemically synthesized
gcccagtgctggagctgtga

SEQ ID NO: 51542 - DNA, 20 bp, Artificial Sequence
  chemically synthesized
tgtgagtggatgtagagcag

SEQ ID NO: 51543 - DNA, 20 bp, Artificial Sequence
  chemically synthesized
ggacaggggccctgaagcca

SEQ ID NO: 51544 - DNA, 20 bp, Artificial Sequence
  chemically synthesized
gagctcagagagaaggggag

SEQ ID NO: 51545 - DNA, 20 bp, Artificial Sequence
  chemically synthesized
agtttcccgctgcctgaaag

SEQ ID NO: 51546 - DNA, 20 bp, Artificial Sequence
  chemically synthesized
ggtggtacctactcccttca

SEQ ID NO: 51547 - DNA, 20 bp, Artificial Sequence
  chemically synthesized
ctactcccttcacagggtaa

SEQ ID NO: 51548 - DNA, 20 bp, Artificial Sequence
  chemically synthesized
tgaggcctcacagccagtaa

SEQ ID NO: 51549 - DNA, 20 bp, Artificial Sequence
  chemically synthesized
cagtaagtgggttccctggt

SEQ ID NO: 51550 - DNA, 20 bp, Artificial Sequence
  chemically synthesized
tggtctgaatgtgtgtgctg

SEQ ID NO: 51551 - DNA, 20 bp, Artificial Sequence
  chemically synthesized
tgtgtgtgctggaggatcct

SEQ ID NO: 51552 - DNA, 20 bp, Artificial Sequence
  chemically synthesized
tggaggcataaatgggactg

SEQ ID NO: 51553 - DNA, 20 bp, Artificial Sequence
  chemically synthesized
gccagctcccaagcaggttt

SEQ ID NO: 51554 - DNA, 20 bp, Artificial Sequence
  chemically synthesized
aatctgatttaggcttttaa

SEQ ID NO: 51555 - DNA, 20 bp, Artificial Sequence
  chemically synthesized
ccaaaggcctccaacaaccc

SEQ ID NO: 51556 - DNA, 20 bp, Artificial Sequence
  chemically synthesized
aaagaaactccaagctgtat

SEQ ID NO: 51557 - DNA, 20 bp, Artificial Sequence
  chemically synthesized
ggcacttcacaagcatgctt

SEQ ID NO: 51558 - DNA, 20 bp, Artificial Sequence
  chemically synthesized
gaatgaaacttccaactctt

SEQ ID NO: 51559 - DNA, 20 bp, Artificial Sequence
  chemically synthesized
ttttccatcgggaccatcaa

SEQ ID NO: 51560 - DNA, 20 bp, Artificial Sequence
  chemically synthesized
gtgtttgtgtctaaggctga

SEQ ID NO: 51561 - DNA, 20 bp, Artificial Sequence
  chemically synthesized
ctaaggctgactgggtaact

SEQ ID NO: 51562 - DNA, 20 bp, Artificial Sequence
  chemically synthesized
gtcttcagcatcaggcattt

SEQ ID NO: 51563 - DNA, 20 bp, Artificial Sequence
  chemically synthesized
ctaccagtggaacagccact

SEQ ID NO: 51564 - DNA, 20 bp, Artificial Sequence
  chemically synthesized
ctgtttgctcctccgataac

SEQ ID NO: 51565 - DNA, 20 bp, Artificial Sequence
  chemically synthesized
cagcctcccccgttgcccct

SEQ ID NO: 51566 - DNA, 20 bp, Artificial Sequence
  chemically synthesized
accaccactgacctgggaca

SEQ ID NO: 51567 - DNA, 20 bp, Artificial Sequence
  chemically synthesized
cagcaggtctggggcaggag

SEQ ID NO: 51568 - DNA, 20 bp, Artificial Sequence
  chemically synthesized
ctggggcaggaggggggttg

SEQ ID NO: 51569 - DNA, 20 bp, Artificial Sequence
  chemically synthesized
ggcaggaggggggttgtgga

SEQ ID NO: 51570 - DNA, 20 bp, Artificial Sequence
  chemically synthesized
ttcataataacagcagccat

SEQ ID NO: 51571 - DNA, 20 bp, Artificial Sequence
  chemically synthesized
tcccccctcggtacctcctg

SEQ ID NO: 51572 - DNA, 20 bp, Artificial Sequence
  chemically synthesized
actggttcctgtaagcagaa

SEQ ID NO: 51573 - DNA, 20 bp, Artificial Sequence
  chemically synthesized
tcctgtaagcagaagtggat

SEQ ID NO: 51574 - DNA, 20 bp, Artificial Sequence
  chemically synthesized
ggtctgcagtcctggcaccc

SEQ ID NO: 51575 - DNA, 20 bp, Artificial Sequence
  chemically synthesized
gaggaggttaaggtccagag

SEQ ID NO: 51576 - DNA, 20 bp, Artificial Sequence
  chemically synthesized
tggtcatatctggaggggat

SEQ ID NO: 51577 - DNA, 20 bp, Artificial Sequence
  chemically synthesized
acctcctcatctatagaagg

SEQ ID NO: 51578 - DNA, 20 bp, Artificial Sequence
  chemically synthesized
cagacagaggagctgtgcaa

SEQ ID NO: 51579 - DNA, 20 bp, Artificial Sequence
  chemically synthesized
cagaggagctgtgcaaacag

SEQ ID NO: 51580 - DNA, 20 bp, Artificial Sequence
  chemically synthesized
aaggagtcattgtacctggc

SEQ ID NO: 51581 - DNA, 20 bp, Artificial Sequence
  chemically synthesized
gctggccctctgctctcact

SEQ ID NO: 51582 - DNA, 20 bp, Artificial Sequence
  chemically synthesized
gagacgggtactgggtgtgc

SEQ ID NO: 51583 - DNA, 20 bp, Artificial Sequence
  chemically synthesized
tcacactgcccagaggatta

SEQ ID NO: 51584 - DNA, 20 bp, Artificial Sequence
  chemically synthesized
tcttccctctgcagctggcc

SEQ ID NO: 51585 - DNA, 20 bp, Artificial Sequence
  chemically synthesized
aaacaaaggcccagagaggg

SEQ ID NO: 51586 - DNA, 20 bp, Artificial Sequence
  chemically synthesized
agagtgggggccatgtatcc

SEQ ID NO: 51587 - DNA, 20 bp, Artificial Sequence
  chemically synthesized
ctggttttccaggagcaaaa

SEQ ID NO: 51588 - DNA, 20 bp, Artificial Sequence
  chemically synthesized
tgtttctgtttttgctcctg

SEQ ID NO: 51589 - DNA, 20 bp, Artificial Sequence
  chemically synthesized
gggggtcattgtgcagatgg

SEQ ID NO: 51590 - DNA, 20 bp, Artificial Sequence
  chemically synthesized
cacactggttttccaggagc

SEQ ID NO: 51591 - DNA, 20 bp, Artificial Sequence
  chemically synthesized
ccaagcagtaggagaggtgg

SEQ ID NO: 51592 - DNA, 20 bp, Artificial Sequence
  chemically synthesized
gtgcaaacagaaagaaatgg

SEQ ID NO: 51593 - DNA, 20 bp, Artificial Sequence
  chemically synthesized
acctagacaccctcatccac

SEQ ID NO: 51594 - DNA, 20 bp, Artificial Sequence
  chemically synthesized
tctcgcagtgaaaggcatac

SEQ ID NO: 51595 - DNA, 20 bp, Artificial Sequence
  chemically synthesized
gtcgcccgcctacgctgccc

SEQ ID NO: 51596 - DNA, 20 bp, Artificial Sequence
  chemically synthesized
gacgctttgcctgggcagtg

SEQ ID NO: 51597 - DNA, 20 bp, Artificial Sequence
  chemically synthesized
gagctgtgctgcctcaggca

SEQ ID NO: 51598 - DNA, 20 bp, Artificial Sequence
  chemically synthesized
cttcacctctctgaaccagg

SEQ ID NO: 51599 - DNA, 20 bp, Artificial Sequence
  chemically synthesized
cacctgcatcccaaagagtt

SEQ ID NO: 51600 - DNA, 20 bp, Artificial Sequence
  chemically synthesized
gttggaagtttcattcccaa

SEQ ID NO: 51601 - DNA, 20 bp, Artificial Sequence
  chemically synthesized
ttatgtgggtctgcacagcc

SEQ ID NO: 51602 - DNA, 20 bp, Artificial Sequence
  chemically synthesized
tcaattttgaccagcctcag

SEQ ID NO: 51603 - DNA, 20 bp, Artificial Sequence
  chemically synthesized
ttgaccagcctcaggcctgt

SEQ ID NO: 51604 - DNA, 20 bp, Artificial Sequence
  chemically synthesized
gaaaaccagtgtgatccgta

SEQ ID NO: 51605 - DNA, 20 bp, Artificial Sequence
  chemically synthesized
agtgtgatccgtatacagct

SEQ ID NO: 51606 - DNA, 20 bp, Artificial Sequence
  chemically synthesized
gttgaggctagtggggcccc

SEQ ID NO: 51607 - DNA, 20 bp, Artificial Sequence
  chemically synthesized
caatccctttaaaagcctaa

SEQ ID NO: 51608 - DNA, 20 bp, Artificial Sequence
  chemically synthesized
gcccgctgtgcaacccgcaa

SEQ ID NO: 51609 - DNA, 20 bp, Artificial Sequence
  chemically synthesized
tggctgtgaggcctcaggtg

SEQ ID NO: 51610 - DNA, 20 bp, Artificial Sequence
  chemically synthesized
tgtaccttgttgagctgctg

SEQ ID NO: 51611 - DNA, 20 bp, Artificial Sequence
  chemically synthesized
ggtggggtgggccacacttg

SEQ ID NO: 51612 - DNA, 20 bp, Artificial Sequence
  chemically synthesized
ccttccctgcagctccatcc

SEQ ID NO: 51613 - DNA, 20 bp, Artificial Sequence
  chemically synthesized
atttcttcccctctctgggc

SEQ ID NO: 51614 - DNA, 20 bp, Artificial Sequence
  chemically synthesized
cagtaggctggggaggggcg

SEQ ID NO: 51615 - DNA, 20 bp, Artificial Sequence
  chemically synthesized
gaggtacagtcacactgccc

SEQ ID NO: 51616 - DNA, 20 bp, Artificial Sequence
  chemically synthesized
agacctggcaccaataactg

SEQ ID NO: 51617 - DNA, 20 bp, Artificial Sequence
  chemically synthesized
caggtgacatgccgggctgt

SEQ ID NO: 51618 - DNA, 20 bp, Artificial Sequence
  chemically synthesized
cctgtgcctgccagaagaga

SEQ ID NO: 51619 - DNA, 20 bp, Artificial Sequence
  chemically synthesized
cagaagagacagagcttgag

SEQ ID NO: 51620 - DNA, 20 bp, Artificial Sequence
  chemically synthesized
tccacaggtgggagggacag

SEQ ID NO: 51621 - DNA, 20 bp, Artificial Sequence
  chemically synthesized
gaaggggaggggagtctgag

SEQ ID NO: 51622 - DNA, 20 bp, Artificial Sequence
  chemically synthesized
ggagggagggcagcatcagg

SEQ ID NO: 51623 - DNA, 20 bp, Artificial Sequence
  chemically synthesized
ggcacacccagtacccgtct

SEQ ID NO: 51624 - DNA, 20 bp, Artificial Sequence
  chemically synthesized
gcacgtacgccagctcccaa

SEQ ID NO: 51625 - DNA, 20 bp, Artificial Sequence
  chemically synthesized
gttgcacagcgggcgatgca

SEQ ID NO: 51626 - DNA, 20 bp, Artificial Sequence
  chemically synthesized
agcgggcgatgcaatctgat

SEQ ID NO: 51627 - DNA, 20 bp, Artificial Sequence
  chemically synthesized
caatctgatttaggctttta

SEQ ID NO: 51628 - DNA, 20 bp, Artificial Sequence
  chemically synthesized
ccaagctgtatacggatcac

SEQ ID NO: 51629 - DNA, 20 bp, Artificial Sequence
  chemically synthesized
tcacccgaggcacttcacaa

SEQ ID NO: 51630 - DNA, 20 bp, Artificial Sequence
  chemically synthesized
agcacagctcttctttacag

SEQ ID NO: 51631 - DNA, 20 bp, Artificial Sequence
  chemically synthesized
ttccatcgggaccatcaaga

SEQ ID NO: 51632 - DNA, 20 bp, Artificial Sequence
  chemically synthesized
gagcggtctctccgctctga

SEQ ID NO: 51633 - DNA, 20 bp, Artificial Sequence
  chemically synthesized
gctaccagtggaacagccac

SEQ ID NO: 51634 - DNA, 20 bp, Artificial Sequence
  chemically synthesized
ccaccttggacacaggacgc

SEQ ID NO: 51635 - DNA, 20 bp, Artificial Sequence
  chemically synthesized
tcccagccagtggacttagc

SEQ ID NO: 51636 - DNA, 20 bp, Artificial Sequence
  chemically synthesized
ccccgttgcccctctggatc

SEQ ID NO: 51637 - DNA, 20 bp, Artificial Sequence
  chemically synthesized
cgaggacagggccctgtctc

SEQ ID NO: 51638 - DNA, 20 bp, Artificial Sequence
  chemically synthesized
ttcactgcgagaggttctgg

SEQ ID NO: 51639 - DNA, 20 bp, Artificial Sequence
  chemically synthesized
cagcagccatgagggttgtg

SEQ ID NO: 51640 - DNA, 20 bp, Artificial Sequence
  chemically synthesized
aacaaagcgcagccatttct

SEQ ID NO: 51641 - DNA, 20 bp, Artificial Sequence
  chemically synthesized
ataagcctcaccacctctcc

SEQ ID NO: 51642 - DNA, 22 bp, Artificial Sequence
  chemically synthesized
aggcctggcacaggtctgttcc

SEQ ID NO: 51643 - DNA, 22 bp, Artificial Sequence
  chemically synthesized
gcacaggtctgttcctggtcat

SEQ ID NO: 51644 - DNA, 22 bp, Artificial Sequence
  chemically synthesized
ttcctggtcatatctggagggg

SEQ ID NO: 51645 - DNA, 22 bp, Artificial Sequence
  chemically synthesized
ctggtcatatctggaggggatg

SEQ ID NO: 51646 - DNA, 22 bp, Artificial Sequence
  chemically synthesized
gtcatatctggaggggatggag

SEQ ID NO: 51647 - DNA, 22 bp, Artificial Sequence
  chemically synthesized
gaggggatggagaatgtgagcc

SEQ ID NO: 51648 - DNA, 22 bp, Artificial Sequence
  chemically synthesized
ctccccacccctctctggacct

SEQ ID NO: 51649 - DNA, 22 bp, Artificial Sequence
  chemically synthesized
cccacccctctctggaccttaa

SEQ ID NO: 51650 - DNA, 22 bp, Artificial Sequence
  chemically synthesized
tctggaccttaacctcctcatc

SEQ ID NO: 51651 - DNA, 22 bp, Artificial Sequence
  chemically synthesized
tggaccttaacctcctcatcta

SEQ ID NO: 51652 - DNA, 22 bp, Artificial Sequence
  chemically synthesized
gaccttaacctcctcatctata

SEQ ID NO: 51653 - DNA, 22 bp, Artificial Sequence
  chemically synthesized
aacctcctcatctatagaaggg

SEQ ID NO: 51654 - DNA, 22 bp, Artificial Sequence
  chemically synthesized
acctcctcatctatagaagggg

SEQ ID NO: 51655 - DNA, 22 bp, Artificial Sequence
  chemically synthesized
ctcatctatagaaggggagaaa

SEQ ID NO: 51656 - DNA, 22 bp, Artificial Sequence
  chemically synthesized
atctatagaaggggagaaagat

SEQ ID NO: 51657 - DNA, 22 bp, Artificial Sequence
  chemically synthesized
tagaaggggagaaagatgcatg

SEQ ID NO: 51658 - DNA, 22 bp, Artificial Sequence
  chemically synthesized
ataggagacaacagacaggagc

SEQ ID NO: 51659 - DNA, 22 bp, Artificial Sequence
  chemically synthesized
taggagacaacagacaggagcc

SEQ ID NO: 51660 - DNA, 22 bp, Artificial Sequence
  chemically synthesized
tgcaaacagaaagaaatggctg

SEQ ID NO: 51661 - DNA, 22 bp, Artificial Sequence
  chemically synthesized
cgctttgttgctgttgctgtat

SEQ ID NO: 51662 - DNA, 22 bp, Artificial Sequence
  chemically synthesized
tgttgctgttgctgtatcttgg

SEQ ID NO: 51663 - DNA, 22 bp, Artificial Sequence
  chemically synthesized
gttgctgttgctgtatcttggc

SEQ ID NO: 51664 - DNA, 22 bp, Artificial Sequence
  chemically synthesized
ttgctgttgctgtatcttggct

SEQ ID NO: 51665 - DNA, 22 bp, Artificial Sequence
  chemically synthesized
ctgttgctgtatcttggctggt

SEQ ID NO: 51666 - DNA, 22 bp, Artificial Sequence
  chemically synthesized
ttgctgtatcttggctggtgtc

SEQ ID NO: 51667 - DNA, 22 bp, Artificial Sequence
  chemically synthesized
ctgtatcttggctggtgtcccc

SEQ ID NO: 51668 - DNA, 22 bp, Artificial Sequence
  chemically synthesized
tatcttggctggtgtcccccat

SEQ ID NO: 51669 - DNA, 22 bp, Artificial Sequence
  chemically synthesized
ggctggtgtcccccatcctggg

SEQ ID NO: 51670 - DNA, 22 bp, Artificial Sequence
  chemically synthesized
gctggtgtcccccatcctgggg

SEQ ID NO: 51671 - DNA, 22 bp, Artificial Sequence
  chemically synthesized
gtgtcccccatcctggggtgcc

SEQ ID NO: 51672 - DNA, 22 bp, Artificial Sequence
  chemically synthesized
gggtgccaggactgcagaccta

SEQ ID NO: 51673 - DNA, 22 bp, Artificial Sequence
  chemically synthesized
cagacctagacaccctcatcca

SEQ ID NO: 51674 - DNA, 22 bp, Artificial Sequence
  chemically synthesized
gacaccctcatccacttctgct

SEQ ID NO: 51675 - DNA, 22 bp, Artificial Sequence
  chemically synthesized
atccacttctgcttacaggaac

SEQ ID NO: 51676 - DNA, 22 bp, Artificial Sequence
  chemically synthesized
ctgcttacaggaaccagtgtat

SEQ ID NO: 51677 - DNA, 22 bp, Artificial Sequence
  chemically synthesized
tgcttacaggaaccagtgtatc

SEQ ID NO: 51678 - DNA, 22 bp, Artificial Sequence
  chemically synthesized
cttacaggaaccagtgtatcca

SEQ ID NO: 51679 - DNA, 22 bp, Artificial Sequence
  chemically synthesized
acaggaaccagtgtatccacca

SEQ ID NO: 51680 - DNA, 22 bp, Artificial Sequence
  chemically synthesized
caggaaccagtgtatccaccag

SEQ ID NO: 51681 - DNA, 22 bp, Artificial Sequence
  chemically synthesized
ggaaacaggacacaaccctcat

SEQ ID NO: 51682 - DNA, 22 bp, Artificial Sequence
  chemically synthesized
atggctgctgttattatgaaaa

SEQ ID NO: 51683 - DNA, 22 bp, Artificial Sequence
  chemically synthesized
ctgttattatgaaaataggagc

SEQ ID NO: 51684 - DNA, 22 bp, Artificial Sequence
  chemically synthesized
ttattatgaaaataggagctca

SEQ ID NO: 51685 - DNA, 22 bp, Artificial Sequence
  chemically synthesized
ttatgaaaataggagctcagct

SEQ ID NO: 51686 - DNA, 22 bp, Artificial Sequence
  chemically synthesized
tgaaaataggagctcagctgca

SEQ ID NO: 51687 - DNA, 22 bp, Artificial Sequence
  chemically synthesized
agctgcagcctctccatctgcc

SEQ ID NO: 51688 - DNA, 22 bp, Artificial Sequence
  chemically synthesized
cagcctctccatctgccctgca

SEQ ID NO: 51689 - DNA, 22 bp, Artificial Sequence
  chemically synthesized
tccatctgccctgcacctcagc

SEQ ID NO: 51690 - DNA, 22 bp, Artificial Sequence
  chemically synthesized
catctgccctgcacctcagcag

SEQ ID NO: 51691 - DNA, 22 bp, Artificial Sequence
  chemically synthesized
ccctgcacctcagcaggcggat

SEQ ID NO: 51692 - DNA, 22 bp, Artificial Sequence
  chemically synthesized
cacctcagcaggcggataccca

SEQ ID NO: 51693 - DNA, 22 bp, Artificial Sequence
  chemically synthesized
agcaggcggatacccactccac

SEQ ID NO: 51694 - DNA, 22 bp, Artificial Sequence
  chemically synthesized
cacaacccccctcctgccccag

SEQ ID NO: 51695 - DNA, 22 bp, Artificial Sequence
  chemically synthesized
ctgccccagacctgctgcctgc

SEQ ID NO: 51696 - DNA, 22 bp, Artificial Sequence
  chemically synthesized
ccccagacctgctgcctgcctg

SEQ ID NO: 51697 - DNA, 22 bp, Artificial Sequence
  chemically synthesized
ctgcctgcctgggccatgggga

SEQ ID NO: 51698 - DNA, 22 bp, Artificial Sequence
  chemically synthesized
cctgcctgggccatggggagct

SEQ ID NO: 51699 - DNA, 22 bp, Artificial Sequence
  chemically synthesized
cctgggccatggggagctcaga

SEQ ID NO: 51700 - DNA, 22 bp, Artificial Sequence
  chemically synthesized
ggccatggggagctcagaagcc

SEQ ID NO: 51701 - DNA, 22 bp, Artificial Sequence
  chemically synthesized
agaagcctctccagaacctctc

SEQ ID NO: 51702 - DNA, 22 bp, Artificial Sequence
  chemically synthesized
tccagaacctctcgcagtgaaa

SEQ ID NO: 51703 - DNA, 22 bp, Artificial Sequence
  chemically synthesized
cagaacctctcgcagtgaaagg

SEQ ID NO: 51704 - DNA, 22 bp, Artificial Sequence
  chemically synthesized
tcgcagtgaaaggcatacttac

SEQ ID NO: 51705 - DNA, 22 bp, Artificial Sequence
  chemically synthesized
gcagtgaaaggcatacttacga

SEQ ID NO: 51706 - DNA, 22 bp, Artificial Sequence
  chemically synthesized
acgattcactgtcccaggtcag

SEQ ID NO: 51707 - DNA, 22 bp, Artificial Sequence
  chemically synthesized
cgattcactgtcccaggtcagt

SEQ ID NO: 51708 - DNA, 22 bp, Artificial Sequence
  chemically synthesized
actgtcccaggtcagtggtggt

SEQ ID NO: 51709 - DNA, 22 bp, Artificial Sequence
  chemically synthesized
tcccaggtcagtggtggtgcct

SEQ ID NO: 51710 - DNA, 22 bp, Artificial Sequence
  chemically synthesized
aagctgaggagacagggccctg

SEQ ID NO: 51711 - DNA, 22 bp, Artificial Sequence
  chemically synthesized
aggagacagggccctgtcctcg

SEQ ID NO: 51712 - DNA, 22 bp, Artificial Sequence
  chemically synthesized
tcctcgtccgtatttaagcagt

SEQ ID NO: 51713 - DNA, 22 bp, Artificial Sequence
  chemically synthesized
gtccgtatttaagcagtggatc

SEQ ID NO: 51714 - DNA, 22 bp, Artificial Sequence
  chemically synthesized
aagcagtggatccagaggggca

SEQ ID NO: 51715 - DNA, 22 bp, Artificial Sequence
  chemically synthesized
agcagtggatccagaggggcaa

SEQ ID NO: 51716 - DNA, 22 bp, Artificial Sequence
  chemically synthesized
ctggtgaatattaaccaaggtc

SEQ ID NO: 51717 - DNA, 22 bp, Artificial Sequence
  chemically synthesized
gtgaatattaaccaaggtcacc

SEQ ID NO: 51718 - DNA, 22 bp, Artificial Sequence
  chemically synthesized
accaaggtcaccccagttatcg

SEQ ID NO: 51719 - DNA, 22 bp, Artificial Sequence
  chemically synthesized
tcggaggagcaaacaggggcta

SEQ ID NO: 51720 - DNA, 22 bp, Artificial Sequence
  chemically synthesized
agtccactggctgggatctgag

SEQ ID NO: 51721 - DNA, 22 bp, Artificial Sequence
  chemically synthesized
gctgggatctgagtcgcccgcc

SEQ ID NO: 51722 - DNA, 22 bp, Artificial Sequence
  chemically synthesized
ggatctgagtcgcccgcctacg

SEQ ID NO: 51723 - DNA, 22 bp, Artificial Sequence
  chemically synthesized
agtcgcccgcctacgctgcccg

SEQ ID NO: 51724 - DNA, 22 bp, Artificial Sequence
  chemically synthesized
cgctgcccggacgctttgcctg

SEQ ID NO: 51725 - DNA, 22 bp, Artificial Sequence
  chemically synthesized
cccggacgctttgcctgggcag

SEQ ID NO: 51726 - DNA, 22 bp, Artificial Sequence
  chemically synthesized
tgcctgggcagtgtacagcttc

SEQ ID NO: 51727 - DNA, 22 bp, Artificial Sequence
  chemically synthesized
gcctgggcagtgtacagcttcc

SEQ ID NO: 51728 - DNA, 22 bp, Artificial Sequence
  chemically synthesized
cctgggcagtgtacagcttcca

SEQ ID NO: 51729 - DNA, 22 bp, Artificial Sequence
  chemically synthesized
ggcagtgtacagcttccactgc

SEQ ID NO: 51730 - DNA, 22 bp, Artificial Sequence
  chemically synthesized
ccactgcacttaccgaaaggag

SEQ ID NO: 51731 - DNA, 22 bp, Artificial Sequence
  chemically synthesized
cactgcacttaccgaaaggagt

SEQ ID NO: 51732 - DNA, 22 bp, Artificial Sequence
  chemically synthesized
cacttaccgaaaggagtcattg

SEQ ID NO: 51733 - DNA, 22 bp, Artificial Sequence
  chemically synthesized
accgaaaggagtcattgtacct

SEQ ID NO: 51734 - DNA, 22 bp, Artificial Sequence
  chemically synthesized
ccgaaaggagtcattgtacctg

SEQ ID NO: 51735 - DNA, 22 bp, Artificial Sequence
  chemically synthesized
tacctggctcagaaaccacagc

SEQ ID NO: 51736 - DNA, 22 bp, Artificial Sequence
  chemically synthesized
gctcagaaaccacagcgtcctg

SEQ ID NO: 51737 - DNA, 22 bp, Artificial Sequence
  chemically synthesized
agaaaccacagcgtcctgtgtc

SEQ ID NO: 51738 - DNA, 22 bp, Artificial Sequence
  chemically synthesized
tgtccaaggtggagggggtggc

SEQ ID NO: 51739 - DNA, 22 bp, Artificial Sequence
  chemically synthesized
tgggagagtaccacttagctgg

SEQ ID NO: 51740 - DNA, 22 bp, Artificial Sequence
  chemically synthesized
ggagagtaccacttagctggcc

SEQ ID NO: 51741 - DNA, 22 bp, Artificial Sequence
  chemically synthesized
agctggccctctgctctcactg

SEQ ID NO: 51742 - DNA, 22 bp, Artificial Sequence
  chemically synthesized
gctggccctctgctctcactgc

SEQ ID NO: 51743 - DNA, 22 bp, Artificial Sequence
  chemically synthesized
gccctctgctctcactgcagaa

SEQ ID NO: 51744 - DNA, 22 bp, Artificial Sequence
  chemically synthesized
tgctctcactgcagaatcctta

SEQ ID NO: 51745 - DNA, 22 bp, Artificial Sequence
  chemically synthesized
ctctcactgcagaatccttagt

SEQ ID NO: 51746 - DNA, 22 bp, Artificial Sequence
  chemically synthesized
tcactgcagaatccttagtggc

SEQ ID NO: 51747 - DNA, 22 bp, Artificial Sequence
  chemically synthesized
actgcagaatccttagtggctg

SEQ ID NO: 51748 - DNA, 22 bp, Artificial Sequence
  chemically synthesized
cagaatccttagtggctgttcc

SEQ ID NO: 51749 - DNA, 22 bp, Artificial Sequence
  chemically synthesized
agtggctgttccactggtagca

SEQ ID NO: 51750 - DNA, 22 bp, Artificial Sequence
  chemically synthesized
gtggctgttccactggtagcaa

SEQ ID NO: 51751 - DNA, 22 bp, Artificial Sequence
  chemically synthesized
ttccactggtagcaagatctac

SEQ ID NO: 51752 - DNA, 22 bp, Artificial Sequence
  chemically synthesized
cactggtagcaagatctaccat

SEQ ID NO: 51753 - DNA, 22 bp, Artificial Sequence
  chemically synthesized
gtagcaagatctaccatttact

SEQ ID NO: 51754 - DNA, 22 bp, Artificial Sequence
  chemically synthesized
ccatttactgagtcaccccaaa

SEQ ID NO: 51755 - DNA, 22 bp, Artificial Sequence
  chemically synthesized
actgagtcaccccaaaatgcct

SEQ ID NO: 51756 - DNA, 22 bp, Artificial Sequence
  chemically synthesized
ctgagtcaccccaaaatgcctg

SEQ ID NO: 51757 - DNA, 22 bp, Artificial Sequence
  chemically synthesized
agtcaccccaaaatgcctgatg

SEQ ID NO: 51758 - DNA, 22 bp, Artificial Sequence
  chemically synthesized
atgctgaagacttactgccgcc

SEQ ID NO: 51759 - DNA, 22 bp, Artificial Sequence
  chemically synthesized
aagacttactgccgccctggga

SEQ ID NO: 51760 - DNA, 22 bp, Artificial Sequence
  chemically synthesized
actgccgccctgggagatcaga

SEQ ID NO: 51761 - DNA, 22 bp, Artificial Sequence
  chemically synthesized
ctgccgccctgggagatcagag

SEQ ID NO: 51762 - DNA, 22 bp, Artificial Sequence
  chemically synthesized
ccgccctgggagatcagagtgg

SEQ ID NO: 51763 - DNA, 22 bp, Artificial Sequence
  chemically synthesized
ggagatcagagtgggttagagc

SEQ ID NO: 51764 - DNA, 22 bp, Artificial Sequence
  chemically synthesized
gagcccatttgacagatgagga

SEQ ID NO: 51765 - DNA, 22 bp, Artificial Sequence
  chemically synthesized
gacagatgaggaaacaggctca

SEQ ID NO: 51766 - DNA, 22 bp, Artificial Sequence
  chemically synthesized
acagatgaggaaacaggctcag

SEQ ID NO: 51767 - DNA, 22 bp, Artificial Sequence
  chemically synthesized
agagcggagagaccgctcatcc

SEQ ID NO: 51768 - DNA, 22 bp, Artificial Sequence
  chemically synthesized
atccaaagttacccagtcagcc

SEQ ID NO: 51769 - DNA, 22 bp, Artificial Sequence
  chemically synthesized
cccagtcagccttagacacaaa

SEQ ID NO: 51770 - DNA, 22 bp, Artificial Sequence
  chemically synthesized
agacacaaacaccctcttgatg

SEQ ID NO: 51771 - DNA, 22 bp, Artificial Sequence
  chemically synthesized
gacacaaacaccctcttgatgg

SEQ ID NO: 51772 - DNA, 22 bp, Artificial Sequence
  chemically synthesized
ttgatggtcccgatggaaaaat

SEQ ID NO: 51773 - DNA, 22 bp, Artificial Sequence
  chemically synthesized
gatggtcccgatggaaaaatgg

SEQ ID NO: 51774 - DNA, 22 bp, Artificial Sequence
  chemically synthesized
atggtcccgatggaaaaatgga

SEQ ID NO: 51775 - DNA, 22 bp, Artificial Sequence
  chemically synthesized
aggcagacacaaccgtcaggct

SEQ ID NO: 51776 - DNA, 22 bp, Artificial Sequence
  chemically synthesized
gcatggggggccgtgagacagg

SEQ ID NO: 51777 - DNA, 22 bp, Artificial Sequence
  chemically synthesized
taaagaagagctgtgctgcctc

SEQ ID NO: 51778 - DNA, 22 bp, Artificial Sequence
  chemically synthesized
tgctgcctcaggcaggccgctt

SEQ ID NO: 51779 - DNA, 22 bp, Artificial Sequence
  chemically synthesized
cctcaggcaggccgcttcacct

SEQ ID NO: 51780 - DNA, 22 bp, Artificial Sequence
  chemically synthesized
aggcaggccgcttcacctctct

SEQ ID NO: 51781 - DNA, 22 bp, Artificial Sequence
  chemically synthesized
cacctctctgaaccaggaactg

SEQ ID NO: 51782 - DNA, 22 bp, Artificial Sequence
  chemically synthesized
acctctctgaaccaggaactgt

SEQ ID NO: 51783 - DNA, 22 bp, Artificial Sequence
  chemically synthesized
tctgaaccaggaactgtttcac

SEQ ID NO: 51784 - DNA, 22 bp, Artificial Sequence
  chemically synthesized
tgaaccaggaactgtttcacct

SEQ ID NO: 51785 - DNA, 22 bp, Artificial Sequence
  chemically synthesized
aaccaggaactgtttcacctgc

SEQ ID NO: 51786 - DNA, 22 bp, Artificial Sequence
  chemically synthesized
tttcacctgcatcccaaagagt

SEQ ID NO: 51787 - DNA, 22 bp, Artificial Sequence
  chemically synthesized
cacctgcatcccaaagagttgg

SEQ ID NO: 51788 - DNA, 22 bp, Artificial Sequence
  chemically synthesized
acctgcatcccaaagagttgga

SEQ ID NO: 51789 - DNA, 22 bp, Artificial Sequence
  chemically synthesized
catcccaaagagttggaagttt

SEQ ID NO: 51790 - DNA, 22 bp, Artificial Sequence
  chemically synthesized
gaagtttcattcccaagcatgc

SEQ ID NO: 51791 - DNA, 22 bp, Artificial Sequence
  chemically synthesized
cattcccaagcatgcttgtgaa

SEQ ID NO: 51792 - DNA, 22 bp, Artificial Sequence
  chemically synthesized
attcccaagcatgcttgtgaag

SEQ ID NO: 51793 - DNA, 22 bp, Artificial Sequence
  chemically synthesized
ccaagcatgcttgtgaagtgcc

SEQ ID NO: 51794 - DNA, 22 bp, Artificial Sequence
  chemically synthesized
gtgaagtgcctcgggtgaagtg

SEQ ID NO: 51795 - DNA, 22 bp, Artificial Sequence
  chemically synthesized
tgaagtgcctcgggtgaagtgc

SEQ ID NO: 51796 - DNA, 22 bp, Artificial Sequence
  chemically synthesized
gggtgaagtgcctggcacacag

SEQ ID NO: 51797 - DNA, 22 bp, Artificial Sequence
  chemically synthesized
gcacacagtaggctctttatgt

SEQ ID NO: 51798 - DNA, 22 bp, Artificial Sequence
  chemically synthesized
tttatgtgggtctgcacagccc

SEQ ID NO: 51799 - DNA, 22 bp, Artificial Sequence
  chemically synthesized
tatgtgggtctgcacagccctc

SEQ ID NO: 51800 - DNA, 22 bp, Artificial Sequence
  chemically synthesized
atgtgggtctgcacagccctct

SEQ ID NO: 51801 - DNA, 22 bp, Artificial Sequence
  chemically synthesized
tgtgggtctgcacagccctctg

SEQ ID NO: 51802 - DNA, 22 bp, Artificial Sequence
  chemically synthesized
cacagccctctgcttagtctgc

SEQ ID NO: 51803 - DNA, 22 bp, Artificial Sequence
  chemically synthesized
tgcttagtctgccccccaggct

SEQ ID NO: 51804 - DNA, 22 bp, Artificial Sequence
  chemically synthesized
cttagtctgccccccaggctgc

SEQ ID NO: 51805 - DNA, 22 bp, Artificial Sequence
  chemically synthesized
agtctgccccccaggctgctca

SEQ ID NO: 51806 - DNA, 22 bp, Artificial Sequence
  chemically synthesized
gtctgccccccaggctgctcag

SEQ ID NO: 51807 - DNA, 22 bp, Artificial Sequence
  chemically synthesized
ccccccaggctgctcagagcag

SEQ ID NO: 51808 - DNA, 22 bp, Artificial Sequence
  chemically synthesized
ctcagagcaggaggaggttcaa

SEQ ID NO: 51809 - DNA, 22 bp, Artificial Sequence
  chemically synthesized
agagcaggaggaggttcaattt

SEQ ID NO: 51810 - DNA, 22 bp, Artificial Sequence
  chemically synthesized
aattttgaccagcctcaggcct

SEQ ID NO: 51811 - DNA, 22 bp, Artificial Sequence
  chemically synthesized
tgaccagcctcaggcctgtttc

SEQ ID NO: 51812 - DNA, 22 bp, Artificial Sequence
  chemically synthesized
gaccagcctcaggcctgtttct

SEQ ID NO: 51813 - DNA, 22 bp, Artificial Sequence
  chemically synthesized
accagcctcaggcctgtttctg

SEQ ID NO: 51814 - DNA, 22 bp, Artificial Sequence
  chemically synthesized
aggcctgtttctgtttttgctc

SEQ ID NO: 51815 - DNA, 22 bp, Artificial Sequence
  chemically synthesized
tttctgtttttgctcctggaaa

SEQ ID NO: 51816 - DNA, 22 bp, Artificial Sequence
  chemically synthesized
ctgtttttgctcctggaaaacc

SEQ ID NO: 51817 - DNA, 22 bp, Artificial Sequence
  chemically synthesized
tgtttttgctcctggaaaacca

SEQ ID NO: 51818 - DNA, 22 bp, Artificial Sequence
  chemically synthesized
tttttgctcctggaaaaccagt

SEQ ID NO: 51819 - DNA, 22 bp, Artificial Sequence
  chemically synthesized
ttgctcctggaaaaccagtgtg

SEQ ID NO: 51820 - DNA, 22 bp, Artificial Sequence
  chemically synthesized
tgctcctggaaaaccagtgtga

SEQ ID NO: 51821 - DNA, 22 bp, Artificial Sequence
  chemically synthesized
gctcctggaaaaccagtgtgat

SEQ ID NO: 51822 - DNA, 22 bp, Artificial Sequence
  chemically synthesized
ctcctggaaaaccagtgtgatc

SEQ ID NO: 51823 - DNA, 22 bp, Artificial Sequence
  chemically synthesized
ctggaaaaccagtgtgatccgt

SEQ ID NO: 51824 - DNA, 22 bp, Artificial Sequence
  chemically synthesized
gaaaaccagtgtgatccgtata

SEQ ID NO: 51825 - DNA, 22 bp, Artificial Sequence
  chemically synthesized
ggagtttctttggatacatggc

SEQ ID NO: 51826 - DNA, 22 bp, Artificial Sequence
  chemically synthesized
gagtttctttggatacatggcc

SEQ ID NO: 51827 - DNA, 22 bp, Artificial Sequence
  chemically synthesized
ctttggatacatggcccccact

SEQ ID NO: 51828 - DNA, 22 bp, Artificial Sequence
  chemically synthesized
tttggatacatggcccccactc

SEQ ID NO: 51829 - DNA, 22 bp, Artificial Sequence
  chemically synthesized
tggatacatggcccccactctg

SEQ ID NO: 51830 - DNA, 22 bp, Artificial Sequence
  chemically synthesized
ggatacatggcccccactctgg

SEQ ID NO: 51831 - DNA, 22 bp, Artificial Sequence
  chemically synthesized
gatacatggcccccactctggg

SEQ ID NO: 51832 - DNA, 22 bp, Artificial Sequence
  chemically synthesized
tggggttgttggaggcctttgg

SEQ ID NO: 51833 - DNA, 22 bp, Artificial Sequence
  chemically synthesized
gggttgttggaggcctttggag

SEQ ID NO: 51834 - DNA, 22 bp, Artificial Sequence
  chemically synthesized
ttggaggcctttggagactgct

SEQ ID NO: 51835 - DNA, 22 bp, Artificial Sequence
  chemically synthesized
gaggcctttggagactgctggg

SEQ ID NO: 51836 - DNA, 22 bp, Artificial Sequence
  chemically synthesized
tggagactgctgggggtggagg

SEQ ID NO: 51837 - DNA, 22 bp, Artificial Sequence
  chemically synthesized
ggagactgctgggggtggaggg

SEQ ID NO: 51838 - DNA, 22 bp, Artificial Sequence
  chemically synthesized
gagactgctgggggtggagggg

SEQ ID NO: 51839 - DNA, 22 bp, Artificial Sequence
  chemically synthesized
ctgggggtggaggggaggggag

SEQ ID NO: 51840 - DNA, 22 bp, Artificial Sequence
  chemically synthesized
ggggtggaggggaggggaggta

SEQ ID NO: 51841 - DNA, 22 bp, Artificial Sequence
  chemically synthesized
aggctagtggggccccacttga

SEQ ID NO: 51842 - DNA, 22 bp, Artificial Sequence
  chemically synthesized
gtggggccccacttgattgcaa

SEQ ID NO: 51843 - DNA, 22 bp, Artificial Sequence
  chemically synthesized
gattgcaatccctttaaaagcc

SEQ ID NO: 51844 - DNA, 22 bp, Artificial Sequence
  chemically synthesized
attgcaatccctttaaaagcct

SEQ ID NO: 51845 - DNA, 22 bp, Artificial Sequence
  chemically synthesized
caatccctttaaaagcctaaat

SEQ ID NO: 51846 - DNA, 22 bp, Artificial Sequence
  chemically synthesized
taaaagcctaaatcagattgca

SEQ ID NO: 51847 - DNA, 22 bp, Artificial Sequence
  chemically synthesized
aaaagcctaaatcagattgcat

SEQ ID NO: 51848 - DNA, 22 bp, Artificial Sequence
  chemically synthesized
aaagcctaaatcagattgcatc

SEQ ID NO: 51849 - DNA, 22 bp, Artificial Sequence
  chemically synthesized
aatcagattgcatcgcccgctg

SEQ ID NO: 51850 - DNA, 22 bp, Artificial Sequence
  chemically synthesized
catcgcccgctgtgcaacccgc

SEQ ID NO: 51851 - DNA, 22 bp, Artificial Sequence
  chemically synthesized
tgcaacccgcaaacctgcttgg

SEQ ID NO: 51852 - DNA, 22 bp, Artificial Sequence
  chemically synthesized
cttgggagctggcgtacgtgcc

SEQ ID NO: 51853 - DNA, 22 bp, Artificial Sequence
  chemically synthesized
gggagctggcgtacgtgccgta

SEQ ID NO: 51854 - DNA, 22 bp, Artificial Sequence
  chemically synthesized
ggagctggcgtacgtgccgtag

SEQ ID NO: 51855 - DNA, 22 bp, Artificial Sequence
  chemically synthesized
gcgtacgtgccgtagatacttg

SEQ ID NO: 51856 - DNA, 22 bp, Artificial Sequence
  chemically synthesized
gcagagtgaatggatgagtgca

SEQ ID NO: 51857 - DNA, 22 bp, Artificial Sequence
  chemically synthesized
cagagtgaatggatgagtgcat

SEQ ID NO: 51858 - DNA, 22 bp, Artificial Sequence
  chemically synthesized
ttgccccttctgtcattcacca

SEQ ID NO: 51859 - DNA, 22 bp, Artificial Sequence
  chemically synthesized
tgccccttctgtcattcaccag

SEQ ID NO: 51860 - DNA, 22 bp, Artificial Sequence
  chemically synthesized
gccccttctgtcattcaccagt

SEQ ID NO: 51861 - DNA, 22 bp, Artificial Sequence
  chemically synthesized
ccccttctgtcattcaccagtc

SEQ ID NO: 51862 - DNA, 22 bp, Artificial Sequence
  chemically synthesized
ctgtcattcaccagtcccattt

SEQ ID NO: 51863 - DNA, 22 bp, Artificial Sequence
  chemically synthesized
tgtcattcaccagtcccattta

SEQ ID NO: 51864 - DNA, 22 bp, Artificial Sequence
  chemically synthesized
tcattcaccagtcccatttatg

SEQ ID NO: 51865 - DNA, 22 bp, Artificial Sequence
  chemically synthesized
accagtcccatttatgcctcca

SEQ ID NO: 51866 - DNA, 22 bp, Artificial Sequence
  chemically synthesized
atgcctccaccttggggctcta

SEQ ID NO: 51867 - DNA, 22 bp, Artificial Sequence
  chemically synthesized
tgcctccaccttggggctctac

SEQ ID NO: 51868 - DNA, 22 bp, Artificial Sequence
  chemically synthesized
caccttggggctctaccaggcg

SEQ ID NO: 51869 - DNA, 22 bp, Artificial Sequence
  chemically synthesized
ggggctctaccaggcgagtgac

SEQ ID NO: 51870 - DNA, 22 bp, Artificial Sequence
  chemically synthesized
gggctctaccaggcgagtgacc

SEQ ID NO: 51871 - DNA, 22 bp, Artificial Sequence
  chemically synthesized
taccaggcgagtgacccacagg

SEQ ID NO: 51872 - DNA, 22 bp, Artificial Sequence
  chemically synthesized
ccaggcgagtgacccacaggat

SEQ ID NO: 51873 - DNA, 22 bp, Artificial Sequence
  chemically synthesized
cagcacacacattcagaccagg

SEQ ID NO: 51874 - DNA, 22 bp, Artificial Sequence
  chemically synthesized
agaccagggaacccacttactg

SEQ ID NO: 51875 - DNA, 22 bp, Artificial Sequence
  chemically synthesized
actggctgtgaggcctcaggtg

SEQ ID NO: 51876 - DNA, 22 bp, Artificial Sequence
  chemically synthesized
ctggctgtgaggcctcaggtga

SEQ ID NO: 51877 - DNA, 22 bp, Artificial Sequence
  chemically synthesized
gctgtgaggcctcaggtgagtt

SEQ ID NO: 51878 - DNA, 22 bp, Artificial Sequence
  chemically synthesized
tgaggcctcaggtgagttgttt

SEQ ID NO: 51879 - DNA, 22 bp, Artificial Sequence
  chemically synthesized
aggtgagttgtttaaccgctcc

SEQ ID NO: 51880 - DNA, 22 bp, Artificial Sequence
  chemically synthesized
tttaaccgctccgagcctcaat

SEQ ID NO: 51881 - DNA, 22 bp, Artificial Sequence
  chemically synthesized
aaccgctccgagcctcaatttc

SEQ ID NO: 51882 - DNA, 22 bp, Artificial Sequence
  chemically synthesized
accgctccgagcctcaatttcc

SEQ ID NO: 51883 - DNA, 22 bp, Artificial Sequence
  chemically synthesized
cgagcctcaatttccctatctg

SEQ ID NO: 51884 - DNA, 22 bp, Artificial Sequence
  chemically synthesized
aatttccctatctgtaaaatgg

SEQ ID NO: 51885 - DNA, 22 bp, Artificial Sequence
  chemically synthesized
ccctatctgtaaaatggggatg

SEQ ID NO: 51886 - DNA, 22 bp, Artificial Sequence
  chemically synthesized
cctatctgtaaaatggggatgg

SEQ ID NO: 51887 - DNA, 22 bp, Artificial Sequence
  chemically synthesized
tctgtaaaatggggatggtgac

SEQ ID NO: 51888 - DNA, 22 bp, Artificial Sequence
  chemically synthesized
taaaatggggatggtgacggta

SEQ ID NO: 51889 - DNA, 22 bp, Artificial Sequence
  chemically synthesized
gttgagctgctgtgaggattaa

SEQ ID NO: 51890 - DNA, 22 bp, Artificial Sequence
  chemically synthesized
ttgagctgctgtgaggattaaa

SEQ ID NO: 51891 - DNA, 22 bp, Artificial Sequence
  chemically synthesized
agctgctgtgaggattaaaatg

SEQ ID NO: 51892 - DNA, 22 bp, Artificial Sequence
  chemically synthesized
ctgtgaggattaaaatgcaaca

SEQ ID NO: 51893 - DNA, 22 bp, Artificial Sequence
  chemically synthesized
tgaggattaaaatgcaacagtt

SEQ ID NO: 51894 - DNA, 22 bp, Artificial Sequence
  chemically synthesized
aaatgcaacagttcaaggaaag

SEQ ID NO: 51895 - DNA, 22 bp, Artificial Sequence
  chemically synthesized
aaggaaagctcagagacgggta

SEQ ID NO: 51896 - DNA, 22 bp, Artificial Sequence
  chemically synthesized
agagacgggtactgggtgtgcc

SEQ ID NO: 51897 - DNA, 22 bp, Artificial Sequence
  chemically synthesized
ggtgtgcccagaaagcccctcc

SEQ ID NO: 51898 - DNA, 22 bp, Artificial Sequence
  chemically synthesized
ctgatgctgccctccctccccc

SEQ ID NO: 51899 - DNA, 22 bp, Artificial Sequence
  chemically synthesized
atgctgccctccctcccccgtg

SEQ ID NO: 51900 - DNA, 22 bp, Artificial Sequence
  chemically synthesized
ccctccctcccccgtgtcaggg

SEQ ID NO: 51901 - DNA, 22 bp, Artificial Sequence
  chemically synthesized
cctcccccgtgtcaggggctgg

SEQ ID NO: 51902 - DNA, 22 bp, Artificial Sequence
  chemically synthesized
ccccgtgtcaggggctggtgtc

SEQ ID NO: 51903 - DNA, 22 bp, Artificial Sequence
  chemically synthesized
gtgtcactggggtggggtgggc

SEQ ID NO: 51904 - DNA, 22 bp, Artificial Sequence
  chemically synthesized
gggtggggtgggccacacttga

SEQ ID NO: 51905 - DNA, 22 bp, Artificial Sequence
  chemically synthesized
gaagagctttcctccaggcagt

SEQ ID NO: 51906 - DNA, 22 bp, Artificial Sequence
  chemically synthesized
aagagctttcctccaggcagtc

SEQ ID NO: 51907 - DNA, 22 bp, Artificial Sequence
  chemically synthesized
tcctccaggcagtctctcattc

SEQ ID NO: 51908 - DNA, 22 bp, Artificial Sequence
  chemically synthesized
cctccaggcagtctctcattca

SEQ ID NO: 51909 - DNA, 22 bp, Artificial Sequence
  chemically synthesized
ctccaggcagtctctcattcag

SEQ ID NO: 51910 - DNA, 22 bp, Artificial Sequence
  chemically synthesized
caggcagtctctcattcagtta

SEQ ID NO: 51911 - DNA, 22 bp, Artificial Sequence
  chemically synthesized
tcattcagttaccctgtgaagg

SEQ ID NO: 51912 - DNA, 22 bp, Artificial Sequence
  chemically synthesized
attcagttaccctgtgaaggga

SEQ ID NO: 51913 - DNA, 22 bp, Artificial Sequence
  chemically synthesized
agttaccctgtgaagggagtag

SEQ ID NO: 51914 - DNA, 22 bp, Artificial Sequence
  chemically synthesized
ccctgtgaagggagtaggtacc

SEQ ID NO: 51915 - DNA, 22 bp, Artificial Sequence
  chemically synthesized
tgaagggagtaggtaccaccct

SEQ ID NO: 51916 - DNA, 22 bp, Artificial Sequence
  chemically synthesized
ctttcaggcagcgggaaactga

SEQ ID NO: 51917 - DNA, 22 bp, Artificial Sequence
  chemically synthesized
tcaggcagcgggaaactgagct

SEQ ID NO: 51918 - DNA, 22 bp, Artificial Sequence
  chemically synthesized
caggcagcgggaaactgagctc

SEQ ID NO: 51919 - DNA, 22 bp, Artificial Sequence
  chemically synthesized
aggcagcgggaaactgagctca

SEQ ID NO: 51920 - DNA, 22 bp, Artificial Sequence
  chemically synthesized
agctcagactcccctccccttc

SEQ ID NO: 51921 - DNA, 22 bp, Artificial Sequence
  chemically synthesized
agactcccctccccttctctct

SEQ ID NO: 51922 - DNA, 22 bp, Artificial Sequence
  chemically synthesized
ccctccccttctctctgagctc

SEQ ID NO: 51923 - DNA, 22 bp, Artificial Sequence
  chemically synthesized
cccttctctctgagctcccttc

SEQ ID NO: 51924 - DNA, 22 bp, Artificial Sequence
  chemically synthesized
ctctctgagctcccttccctgc

SEQ ID NO: 51925 - DNA, 22 bp, Artificial Sequence
  chemically synthesized
tctctgagctcccttccctgca

SEQ ID NO: 51926 - DNA, 22 bp, Artificial Sequence
  chemically synthesized
tctgagctcccttccctgcagc

SEQ ID NO: 51927 - DNA, 22 bp, Artificial Sequence
  chemically synthesized
tgagctcccttccctgcagctc

SEQ ID NO: 51928 - DNA, 22 bp, Artificial Sequence
  chemically synthesized
agctcccttccctgcagctcca

SEQ ID NO: 51929 - DNA, 22 bp, Artificial Sequence
  chemically synthesized
ccttccctgcagctccatcccc

SEQ ID NO: 51930 - DNA, 22 bp, Artificial Sequence
  chemically synthesized
ccctgcagctccatcccctggc

SEQ ID NO: 51931 - DNA, 22 bp, Artificial Sequence
  chemically synthesized
cctgcagctccatcccctggct

SEQ ID NO: 51932 - DNA, 22 bp, Artificial Sequence
  chemically synthesized
cagctccatcccctggcttcag

SEQ ID NO: 51933 - DNA, 22 bp, Artificial Sequence
  chemically synthesized
catcccctggcttcagggcccc

SEQ ID NO: 51934 - DNA, 22 bp, Artificial Sequence
  chemically synthesized
gcttcagggcccctgtccttcc

SEQ ID NO: 51935 - DNA, 22 bp, Artificial Sequence
  chemically synthesized
cagggcccctgtccttcccctg

SEQ ID NO: 51936 - DNA, 22 bp, Artificial Sequence
  chemically synthesized
agggcccctgtccttcccctga

SEQ ID NO: 51937 - DNA, 22 bp, Artificial Sequence
  chemically synthesized
tccttcccctgagctggctgaa

SEQ ID NO: 51938 - DNA, 22 bp, Artificial Sequence
  chemically synthesized
cccctgagctggctgaatggat

SEQ ID NO: 51939 - DNA, 22 bp, Artificial Sequence
  chemically synthesized
ccctgagctggctgaatggata

SEQ ID NO: 51940 - DNA, 22 bp, Artificial Sequence
  chemically synthesized
agctggctgaatggatattccg

SEQ ID NO: 51941 - DNA, 22 bp, Artificial Sequence
  chemically synthesized
gctgaatggatattccgctgct

SEQ ID NO: 51942 - DNA, 22 bp, Artificial Sequence
  chemically synthesized
aatggatattccgctgctctac

SEQ ID NO: 51943 - DNA, 22 bp, Artificial Sequence
  chemically synthesized
cgctgctctacatccactcaca

SEQ ID NO: 51944 - DNA, 22 bp, Artificial Sequence
  chemically synthesized
ctctacatccactcacagctcc

SEQ ID NO: 51945 - DNA, 22 bp, Artificial Sequence
  chemically synthesized
tacatccactcacagctccagc

SEQ ID NO: 51946 - DNA, 22 bp, Artificial Sequence
  chemically synthesized
catccactcacagctccagcac

SEQ ID NO: 51947 - DNA, 22 bp, Artificial Sequence
  chemically synthesized
acagctccagcactgggctgtg

SEQ ID NO: 51948 - DNA, 22 bp, Artificial Sequence
  chemically synthesized
cagcactgggctgtggttgagg

SEQ ID NO: 51949 - DNA, 22 bp, Artificial Sequence
  chemically synthesized
ggctgtggttgaggtcgcctgc

SEQ ID NO: 51950 - DNA, 22 bp, Artificial Sequence
  chemically synthesized
tggttgaggtcgcctgccctcg

SEQ ID NO: 51951 - DNA, 22 bp, Artificial Sequence
  chemically synthesized
aggtcgcctgccctcggtagct

SEQ ID NO: 51952 - DNA, 22 bp, Artificial Sequence
  chemically synthesized
ccctcggtagctcctgggcatt

SEQ ID NO: 51953 - DNA, 22 bp, Artificial Sequence
  chemically synthesized
ggtagctcctgggcatttcttc

SEQ ID NO: 51954 - DNA, 22 bp, Artificial Sequence
  chemically synthesized
ctgggcatttcttcccctctct

SEQ ID NO: 51955 - DNA, 22 bp, Artificial Sequence
  chemically synthesized
ggcatttcttcccctctctggg

SEQ ID NO: 51956 - DNA, 22 bp, Artificial Sequence
  chemically synthesized
cttcccctctctgggcctttgt

SEQ ID NO: 51957 - DNA, 22 bp, Artificial Sequence
  chemically synthesized
ttcccctctctgggcctttgtt

SEQ ID NO: 51958 - DNA, 22 bp, Artificial Sequence
  chemically synthesized
cccctctctgggcctttgtttt

SEQ ID NO: 51959 - DNA, 22 bp, Artificial Sequence
  chemically synthesized
ccctctctgggcctttgttttc

SEQ ID NO: 51960 - DNA, 22 bp, Artificial Sequence
  chemically synthesized
tctgggcctttgttttcccatc

SEQ ID NO: 51961 - DNA, 22 bp, Artificial Sequence
  chemically synthesized
tgggcctttgttttcccatctg

SEQ ID NO: 51962 - DNA, 22 bp, Artificial Sequence
  chemically synthesized
ggcctttgttttcccatctgca

SEQ ID NO: 51963 - DNA, 22 bp, Artificial Sequence
  chemically synthesized
tgttttcccatctgcacaatga

SEQ ID NO: 51964 - DNA, 22 bp, Artificial Sequence
  chemically synthesized
gttttcccatctgcacaatgac

SEQ ID NO: 51965 - DNA, 22 bp, Artificial Sequence
  chemically synthesized
ttttcccatctgcacaatgacc

SEQ ID NO: 51966 - DNA, 22 bp, Artificial Sequence
  chemically synthesized
tcccatctgcacaatgaccccc

SEQ ID NO: 51967 - DNA, 22 bp, Artificial Sequence
  chemically synthesized
cccatctgcacaatgaccccca

SEQ ID NO: 51968 - DNA, 22 bp, Artificial Sequence
  chemically synthesized
ccatctgcacaatgacccccac

SEQ ID NO: 51969 - DNA, 22 bp, Artificial Sequence
  chemically synthesized
cacaatgacccccactctaagc

SEQ ID NO: 51970 - DNA, 22 bp, Artificial Sequence
  chemically synthesized
taagccctgctgtccctcccac

SEQ ID NO: 51971 - DNA, 22 bp, Artificial Sequence
  chemically synthesized
agccctgctgtccctcccacct

SEQ ID NO: 51972 - DNA, 22 bp, Artificial Sequence
  chemically synthesized
ctgtccctcccacctgtggaac

SEQ ID NO: 51973 - DNA, 22 bp, Artificial Sequence
  chemically synthesized
tccctcccacctgtggaactga

SEQ ID NO: 51974 - DNA, 22 bp, Artificial Sequence
  chemically synthesized
ccacctgtggaactgagtgagc

SEQ ID NO: 51975 - DNA, 22 bp, Artificial Sequence
  chemically synthesized
tggaactgagtgagcagcagca

SEQ ID NO: 51976 - DNA, 22 bp, Artificial Sequence
  chemically synthesized
agtgagcagcagcagcaatgtc

SEQ ID NO: 51977 - DNA, 22 bp, Artificial Sequence
  chemically synthesized
tcctgctctcctcaagctctcc

SEQ ID NO: 51978 - DNA, 22 bp, Artificial Sequence
  chemically synthesized
cctgctctcctcaagctctcct

SEQ ID NO: 51979 - DNA, 22 bp, Artificial Sequence
  chemically synthesized
ctgctctcctcaagctctcctc

SEQ ID NO: 51980 - DNA, 22 bp, Artificial Sequence
  chemically synthesized
ctctcctcaagctctcctcaag

SEQ ID NO: 51981 - DNA, 22 bp, Artificial Sequence
  chemically synthesized
tcctcaagctctcctcaagctc

SEQ ID NO: 51982 - DNA, 22 bp, Artificial Sequence
  chemically synthesized
ctcaagctctcctcaagctctg

SEQ ID NO: 51983 - DNA, 22 bp, Artificial Sequence
  chemically synthesized
aagctctcctcaagctctgtct

SEQ ID NO: 51984 - DNA, 22 bp, Artificial Sequence
  chemically synthesized
tcctcaagctctgtctcttctg

SEQ ID NO: 51985 - DNA, 22 bp, Artificial Sequence
  chemically synthesized
ctcaagctctgtctcttctggc

SEQ ID NO: 51986 - DNA, 22 bp, Artificial Sequence
  chemically synthesized
aagctctgtctcttctggcagg

SEQ ID NO: 51987 - DNA, 22 bp, Artificial Sequence
  chemically synthesized
tgtctcttctggcaggcacagg

SEQ ID NO: 51988 - DNA, 22 bp, Artificial Sequence
  chemically synthesized
tctcttctggcaggcacaggag

SEQ ID NO: 51989 - DNA, 22 bp, Artificial Sequence
  chemically synthesized
ttctggcaggcacaggagagtg

SEQ ID NO: 51990 - DNA, 22 bp, Artificial Sequence
  chemically synthesized
ctggcaggcacaggagagtggc

SEQ ID NO: 51991 - DNA, 22 bp, Artificial Sequence
  chemically synthesized
tggcaggcacaggagagtggcc

SEQ ID NO: 51992 - DNA, 22 bp, Artificial Sequence
  chemically synthesized
gcaggcacaggagagtggcctg

SEQ ID NO: 51993 - DNA, 22 bp, Artificial Sequence
  chemically synthesized
aaggctggcaggaggttgccgc

SEQ ID NO: 51994 - DNA, 22 bp, Artificial Sequence
  chemically synthesized
gcaggaggttgccgcccctcca

SEQ ID NO: 51995 - DNA, 22 bp, Artificial Sequence
  chemically synthesized
ccgcccctccaacctggaattc

SEQ ID NO: 51996 - DNA, 22 bp, Artificial Sequence
  chemically synthesized
caacctggaattcctggcagca

SEQ ID NO: 51997 - DNA, 22 bp, Artificial Sequence
  chemically synthesized
gaattcctggcagcagcagcgg

SEQ ID NO: 51998 - DNA, 22 bp, Artificial Sequence
  chemically synthesized
ctggcagcagcagcggctaggc

SEQ ID NO: 51999 - DNA, 22 bp, Artificial Sequence
  chemically synthesized
gcagcagcagcggctaggcctt

SEQ ID NO: 52000 - DNA, 22 bp, Artificial Sequence
  chemically synthesized
ggccttcctcggaggcccgacc

SEQ ID NO: 52001 - DNA, 22 bp, Artificial Sequence
  chemically synthesized
cctcggaggcccgaccccctcc

SEQ ID NO: 52002 - DNA, 22 bp, Artificial Sequence
  chemically synthesized
ctcggaggcccgaccccctcct

SEQ ID NO: 52003 - DNA, 22 bp, Artificial Sequence
  chemically synthesized
ggaggcccgaccccctcctcct

SEQ ID NO: 52004 - DNA, 22 bp, Artificial Sequence
  chemically synthesized
ctccttcttggttcagctcagg

SEQ ID NO: 52005 - DNA, 22 bp, Artificial Sequence
  chemically synthesized
cttcttggttcagctcaggact

SEQ ID NO: 52006 - DNA, 22 bp, Artificial Sequence
  chemically synthesized
cttggttcagctcaggactctg

SEQ ID NO: 52007 - DNA, 22 bp, Artificial Sequence
  chemically synthesized
ttggttcagctcaggactctga

SEQ ID NO: 52008 - DNA, 22 bp, Artificial Sequence
  chemically synthesized
ggttcagctcaggactctgagg

SEQ ID NO: 52009 - DNA, 22 bp, Artificial Sequence
  chemically synthesized
gttcagctcaggactctgaggg

SEQ ID NO: 52010 - DNA, 22 bp, Artificial Sequence
  chemically synthesized
agctcaggactctgagggttgc

SEQ ID NO: 52011 - DNA, 22 bp, Artificial Sequence
  chemically synthesized
aggactctgagggttgctgcgt

SEQ ID NO: 52012 - DNA, 22 bp, Artificial Sequence
  chemically synthesized
tgagggttgctgcgtggaggca

SEQ ID NO: 52013 - DNA, 22 bp, Artificial Sequence
  chemically synthesized
agggttgctgcgtggaggcagt

SEQ ID NO: 52014 - DNA, 22 bp, Artificial Sequence
  chemically synthesized
ctgcgtggaggcagtgcatgcc

SEQ ID NO: 52015 - DNA, 22 bp, Artificial Sequence
  chemically synthesized
cgtggaggcagtgcatgccctg

SEQ ID NO: 52016 - DNA, 22 bp, Artificial Sequence
  chemically synthesized
ggcacagtgcccagttcctgcc

SEQ ID NO: 52017 - DNA, 22 bp, Artificial Sequence
  chemically synthesized
ctgcccacccaggaagtagact

SEQ ID NO: 52018 - DNA, 22 bp, Artificial Sequence
  chemically synthesized
cccacccaggaagtagacttcg

SEQ ID NO: 52019 - DNA, 22 bp, Artificial Sequence
  chemically synthesized
cgggtggaggcagtaggctggg

SEQ ID NO: 52020 - DNA, 22 bp, Artificial Sequence
  chemically synthesized
gggtggaggcagtaggctgggg

SEQ ID NO: 52021 - DNA, 22 bp, Artificial Sequence
  chemically synthesized
gggaggggcggggagcttggac

SEQ ID NO: 52022 - DNA, 22 bp, Artificial Sequence
  chemically synthesized
ggacaggaaggagccttgctca

SEQ ID NO: 52023 - DNA, 22 bp, Artificial Sequence
  chemically synthesized
gacaggaaggagccttgctcat

SEQ ID NO: 52024 - DNA, 22 bp, Artificial Sequence
  chemically synthesized
gctcattgcccggcagacacaa

SEQ ID NO: 52025 - DNA, 22 bp, Artificial Sequence
  chemically synthesized
ctcattgcccggcagacacaag

SEQ ID NO: 52026 - DNA, 22 bp, Artificial Sequence
  chemically synthesized
attgcccggcagacacaagact

SEQ ID NO: 52027 - DNA, 22 bp, Artificial Sequence
  chemically synthesized
cccggcagacacaagactgggc

SEQ ID NO: 52028 - DNA, 22 bp, Artificial Sequence
  chemically synthesized
ggccctcataaactcagacagc

SEQ ID NO: 52029 - DNA, 22 bp, Artificial Sequence
  chemically synthesized
ataaactcagacagcccggcat

SEQ ID NO: 52030 - DNA, 22 bp, Artificial Sequence
  chemically synthesized
agacagcccggcatgtcacctg

SEQ ID NO: 52031 - DNA, 22 bp, Artificial Sequence
  chemically synthesized
ttgtacctgccctttcagctct

SEQ ID NO: 52032 - DNA, 22 bp, Artificial Sequence
  chemically synthesized
tacctgccctttcagctctgtg

SEQ ID NO: 52033 - DNA, 22 bp, Artificial Sequence
  chemically synthesized
ccctttcagctctgtgacccgg

SEQ ID NO: 52034 - DNA, 22 bp, Artificial Sequence
  chemically synthesized
tcagctctgtgacccgggacaa

SEQ ID NO: 52035 - DNA, 22 bp, Artificial Sequence
  chemically synthesized
cagctctgtgacccgggacaag

SEQ ID NO: 52036 - DNA, 22 bp, Artificial Sequence
  chemically synthesized
agctctgtgacccgggacaagt

SEQ ID NO: 52037 - DNA, 22 bp, Artificial Sequence
  chemically synthesized
tgtgacccgggacaagtcaccc

SEQ ID NO: 52038 - DNA, 22 bp, Artificial Sequence
  chemically synthesized
tgacccgggacaagtcaccctc

SEQ ID NO: 52039 - DNA, 22 bp, Artificial Sequence
  chemically synthesized
tccctttgagttgccgcaagag

SEQ ID NO: 52040 - DNA, 22 bp, Artificial Sequence
  chemically synthesized
cctttgagttgccgcaagaggt

SEQ ID NO: 52041 - DNA, 22 bp, Artificial Sequence
  chemically synthesized
tgagttgccgcaagaggtacag

SEQ ID NO: 52042 - DNA, 22 bp, Artificial Sequence
  chemically synthesized
gagttgccgcaagaggtacagt

SEQ ID NO: 52043 - DNA, 22 bp, Artificial Sequence
  chemically synthesized
agttgccgcaagaggtacagtc

SEQ ID NO: 52044 - DNA, 22 bp, Artificial Sequence
  chemically synthesized
ccgcaagaggtacagtcacact

SEQ ID NO: 52045 - DNA, 22 bp, Artificial Sequence
  chemically synthesized
cccagaggattactagaaatga

SEQ ID NO: 52046 - DNA, 22 bp, Artificial Sequence
  chemically synthesized
ctagaaatgacaggcctcgccc

SEQ ID NO: 52047 - DNA, 22 bp, Artificial Sequence
  chemically synthesized
gaaatgacaggcctcgccctcc

SEQ ID NO: 52048 - DNA, 22 bp, Artificial Sequence
  chemically synthesized
gccctcctggcacagacctggc

SEQ ID NO: 52049 - DNA, 22 bp, Artificial Sequence
  chemically synthesized
ctggcacagacctggcaccaat

SEQ ID NO: 52050 - DNA, 22 bp, Artificial Sequence
  chemically synthesized
gcacagacctggcaccaataac

SEQ ID NO: 52051 - DNA, 22 bp, Artificial Sequence
  chemically synthesized
gcaccaataactggcaggtttc

SEQ ID NO: 52052 - DNA, 22 bp, Artificial Sequence
  chemically synthesized
gcaggtttctggggccagctgc

SEQ ID NO: 52053 - DNA, 22 bp, Artificial Sequence
  chemically synthesized
ctggggccagctgcagagggaa

SEQ ID NO: 52054 - DNA, 22 bp, Artificial Sequence
  chemically synthesized
tggggccagctgcagagggaag

SEQ ID NO: 52055 - DNA, 22 bp, Artificial Sequence
  chemically synthesized
gggccagctgcagagggaagag

SEQ ID NO: 52056 - DNA, 22 bp, Artificial Sequence
  chemically synthesized
cagagggaagaggactgagcca

SEQ ID NO: 52057 - DNA, 22 bp, Artificial Sequence
  chemically synthesized
agccacctatgaaatgcccagt

SEQ ID NO: 52058 - DNA, 22 bp, Artificial Sequence
  chemically synthesized
tgaaatgcccagtgggcagccc

SEQ ID NO: 52059 - DNA, 22 bp, Artificial Sequence
  chemically synthesized
ggcaggtctgtgtgcactgggg

SEQ ID NO: 52060 - DNA, 22 bp, Artificial Sequence
  chemically synthesized
tgtgcactggggaggtgtgtgt

SEQ ID NO: 52061 - DNA, 22 bp, Artificial Sequence
  chemically synthesized
gggaggtgtgtgtcataggacc

SEQ ID NO: 52062 - DNA, 22 bp, Artificial Sequence
  chemically synthesized
tgacacacacctccccagtgca

SEQ ID NO: 52063 - DNA, 22 bp, Artificial Sequence
  chemically synthesized
cccagtgcacacagacctgccc

SEQ ID NO: 52064 - DNA, 22 bp, Artificial Sequence
  chemically synthesized
cccaactgtggggctgcccact

SEQ ID NO: 52065 - DNA, 22 bp, Artificial Sequence
  chemically synthesized
tggggctgcccactgggcattt

SEQ ID NO: 52066 - DNA, 22 bp, Artificial Sequence
  chemically synthesized
cccactgggcatttcataggtg

SEQ ID NO: 52067 - DNA, 22 bp, Artificial Sequence
  chemically synthesized
ggcatttcataggtggctcagt

SEQ ID NO: 52068 - DNA, 22 bp, Artificial Sequence
  chemically synthesized
cataggtggctcagtcctcttc

SEQ ID NO: 52069 - DNA, 22 bp, Artificial Sequence
  chemically synthesized
ataggtggctcagtcctcttcc

SEQ ID NO: 52070 - DNA, 22 bp, Artificial Sequence
  chemically synthesized
agtcctcttccctctgcagctg

SEQ ID NO: 52071 - DNA, 22 bp, Artificial Sequence
  chemically synthesized
ttccctctgcagctggccccag

SEQ ID NO: 52072 - DNA, 22 bp, Artificial Sequence
  chemically synthesized
ccctctgcagctggccccagaa

SEQ ID NO: 52073 - DNA, 22 bp, Artificial Sequence
  chemically synthesized
cctctgcagctggccccagaaa

SEQ ID NO: 52074 - DNA, 22 bp, Artificial Sequence
  chemically synthesized
tgcagctggccccagaaacctg

SEQ ID NO: 52075 - DNA, 22 bp, Artificial Sequence
  chemically synthesized
cagctggccccagaaacctgcc

SEQ ID NO: 52076 - DNA, 22 bp, Artificial Sequence
  chemically synthesized
gccccagaaacctgccagttat

SEQ ID NO: 52077 - DNA, 22 bp, Artificial Sequence
  chemically synthesized
ccagttattggtgccaggtctg

SEQ ID NO: 52078 - DNA, 22 bp, Artificial Sequence
  chemically synthesized
ttggtgccaggtctgtgccagg

SEQ ID NO: 52079 - DNA, 22 bp, Artificial Sequence
  chemically synthesized
gtgccaggtctgtgccaggagg

SEQ ID NO: 52080 - DNA, 22 bp, Artificial Sequence
  chemically synthesized
tgccaggagggcgaggcctgtc

SEQ ID NO: 52081 - DNA, 22 bp, Artificial Sequence
  chemically synthesized
tcatttctagtaatcctctggg

SEQ ID NO: 52082 - DNA, 22 bp, Artificial Sequence
  chemically synthesized
ctagtaatcctctgggcagtgt

SEQ ID NO: 52083 - DNA, 22 bp, Artificial Sequence
  chemically synthesized
tagtaatcctctgggcagtgtg

SEQ ID NO: 52084 - DNA, 22 bp, Artificial Sequence
  chemically synthesized
gtaatcctctgggcagtgtgac

SEQ ID NO: 52085 - DNA, 22 bp, Artificial Sequence
  chemically synthesized
tgggcagtgtgactgtacctct

SEQ ID NO: 52086 - DNA, 22 bp, Artificial Sequence
  chemically synthesized
ggcagtgtgactgtacctcttg

SEQ ID NO: 52087 - DNA, 22 bp, Artificial Sequence
  chemically synthesized
tacctcttgcggcaactcaaag

SEQ ID NO: 52088 - DNA, 22 bp, Artificial Sequence
  chemically synthesized
ttgcggcaactcaaagggagag

SEQ ID NO: 52089 - DNA, 22 bp, Artificial Sequence
  chemically synthesized
gcggcaactcaaagggagaggg

SEQ ID NO: 52090 - DNA, 22 bp, Artificial Sequence
  chemically synthesized
cggcaactcaaagggagagggt

SEQ ID NO: 52091 - DNA, 22 bp, Artificial Sequence
  chemically synthesized
aaagggagagggtgacttgtcc

SEQ ID NO: 52092 - DNA, 22 bp, Artificial Sequence
  chemically synthesized
gtcccgggtcacagagctgaaa

SEQ ID NO: 52093 - DNA, 22 bp, Artificial Sequence
  chemically synthesized
tcccgggtcacagagctgaaag

SEQ ID NO: 52094 - DNA, 22 bp, Artificial Sequence
  chemically synthesized
aaagggcaggtacaacaggtga

SEQ ID NO: 52095 - DNA, 22 bp, Artificial Sequence
  chemically synthesized
tctgagtttatgagggcccagt

SEQ ID NO: 52096 - DNA, 22 bp, Artificial Sequence
  chemically synthesized
agtttatgagggcccagtcttg

SEQ ID NO: 52097 - DNA, 22 bp, Artificial Sequence
  chemically synthesized
atgagggcccagtcttgtgtct

SEQ ID NO: 52098 - DNA, 22 bp, Artificial Sequence
  chemically synthesized
tgagggcccagtcttgtgtctg

SEQ ID NO: 52099 - DNA, 22 bp, Artificial Sequence
  chemically synthesized
gtgtctgccgggcaatgagcaa

SEQ ID NO: 52100 - DNA, 22 bp, Artificial Sequence
  chemically synthesized
tgtctgccgggcaatgagcaag

SEQ ID NO: 52101 - DNA, 22 bp, Artificial Sequence
  chemically synthesized
ccgggcaatgagcaaggctcct

SEQ ID NO: 52102 - DNA, 22 bp, Artificial Sequence
  chemically synthesized
cttcctgtccaagctccccgcc

SEQ ID NO: 52103 - DNA, 22 bp, Artificial Sequence
  chemically synthesized
cctgtccaagctccccgcccct

SEQ ID NO: 52104 - DNA, 22 bp, Artificial Sequence
  chemically synthesized
ctgtccaagctccccgcccctc

SEQ ID NO: 52105 - DNA, 22 bp, Artificial Sequence
  chemically synthesized
tccaagctccccgcccctcccc

SEQ ID NO: 52106 - DNA, 22 bp, Artificial Sequence
  chemically synthesized
cccgcccctccccagcctactg

SEQ ID NO: 52107 - DNA, 22 bp, Artificial Sequence
  chemically synthesized
cccagcctactgcctccacccg

SEQ ID NO: 52108 - DNA, 22 bp, Artificial Sequence
  chemically synthesized
ctgcctccacccgaagtctact

SEQ ID NO: 52109 - DNA, 22 bp, Artificial Sequence
  chemically synthesized
cctccacccgaagtctacttcc

SEQ ID NO: 52110 - DNA, 22 bp, Artificial Sequence
  chemically synthesized
cacccgaagtctacttcctggg

SEQ ID NO: 52111 - DNA, 22 bp, Artificial Sequence
  chemically synthesized
cttcctgggtgggcaggaactg

SEQ ID NO: 52112 - DNA, 22 bp, Artificial Sequence
  chemically synthesized
cctgggtgggcaggaactgggc

SEQ ID NO: 52113 - DNA, 22 bp, Artificial Sequence
  chemically synthesized
ctgggtgggcaggaactgggca

SEQ ID NO: 52114 - DNA, 22 bp, Artificial Sequence
  chemically synthesized
ggtgggcaggaactgggcactg

SEQ ID NO: 52115 - DNA, 22 bp, Artificial Sequence
  chemically synthesized
ggcactgtgcccagggcatgca

SEQ ID NO: 52116 - DNA, 22 bp, Artificial Sequence
  chemically synthesized
tgcccagggcatgcactgcctc

SEQ ID NO: 52117 - DNA, 22 bp, Artificial Sequence
  chemically synthesized
cctccacgcagcaaccctcaga

SEQ ID NO: 52118 - DNA, 22 bp, Artificial Sequence
  chemically synthesized
cacgcagcaaccctcagagtcc

SEQ ID NO: 52119 - DNA, 22 bp, Artificial Sequence
  chemically synthesized
agagtcctgagctgaaccaaga

SEQ ID NO: 52120 - DNA, 22 bp, Artificial Sequence
  chemically synthesized
agctgaaccaagaaggaggagg

SEQ ID NO: 52121 - DNA, 22 bp, Artificial Sequence
  chemically synthesized
aaccaagaaggaggagggggtc

SEQ ID NO: 52122 - DNA, 22 bp, Artificial Sequence
  chemically synthesized
cgaggaaggcctagccgctgct

SEQ ID NO: 52123 - DNA, 22 bp, Artificial Sequence
  chemically synthesized
gccgctgctgctgccaggaatt

SEQ ID NO: 52124 - DNA, 22 bp, Artificial Sequence
  chemically synthesized
ctgctgccaggaattccaggtt

SEQ ID NO: 52125 - DNA, 22 bp, Artificial Sequence
  chemically synthesized
ctgccaggaattccaggttgga

SEQ ID NO: 52126 - DNA, 22 bp, Artificial Sequence
  chemically synthesized
ccaggaattccaggttggaggg

SEQ ID NO: 52127 - DNA, 22 bp, Artificial Sequence
  chemically synthesized
caggttggaggggcggcaacct

SEQ ID NO: 52128 - DNA, 22 bp, Artificial Sequence
  chemically synthesized
gaggggcggcaacctcctgcca

SEQ ID NO: 52129 - DNA, 22 bp, Artificial Sequence
  chemically synthesized
ctgccagccttcaggccactct

SEQ ID NO: 52130 - DNA, 22 bp, Artificial Sequence
  chemically synthesized
ccagccttcaggccactctcct

SEQ ID NO: 52131 - DNA, 22 bp, Artificial Sequence
  chemically synthesized
caggccactctcctgtgcctgc

SEQ ID NO: 52132 - DNA, 22 bp, Artificial Sequence
  chemically synthesized
aggccactctcctgtgcctgcc

SEQ ID NO: 52133 - DNA, 22 bp, Artificial Sequence
  chemically synthesized
tcctgtgcctgccagaagagac

SEQ ID NO: 52134 - DNA, 22 bp, Artificial Sequence
  chemically synthesized
ctgtgcctgccagaagagacag

SEQ ID NO: 52135 - DNA, 22 bp, Artificial Sequence
  chemically synthesized
tgcctgccagaagagacagagc

SEQ ID NO: 52136 - DNA, 22 bp, Artificial Sequence
  chemically synthesized
ccagaagagacagagcttgagg

SEQ ID NO: 52137 - DNA, 22 bp, Artificial Sequence
  chemically synthesized
gaggagagcttgaggagagcag

SEQ ID NO: 52138 - DNA, 22 bp, Artificial Sequence
  chemically synthesized
aggagagcttgaggagagcagg

SEQ ID NO: 52139 - DNA, 22 bp, Artificial Sequence
  chemically synthesized
gaggagagcaggaaaggtggga

SEQ ID NO: 52140 - DNA, 22 bp, Artificial Sequence
  chemically synthesized
aggagagcaggaaaggtgggac

SEQ ID NO: 52141 - DNA, 22 bp, Artificial Sequence
  chemically synthesized
ctgctgctgctcactcagttcc

SEQ ID NO: 52142 - DNA, 22 bp, Artificial Sequence
  chemically synthesized
ctgctgctcactcagttccaca

SEQ ID NO: 52143 - DNA, 22 bp, Artificial Sequence
  chemically synthesized
ctgctcactcagttccacaggt

SEQ ID NO: 52144 - DNA, 22 bp, Artificial Sequence
  chemically synthesized
ctcactcagttccacaggtggg

SEQ ID NO: 52145 - DNA, 22 bp, Artificial Sequence
  chemically synthesized
actcagttccacaggtgggagg

SEQ ID NO: 52146 - DNA, 22 bp, Artificial Sequence
  chemically synthesized
agttccacaggtgggagggaca

SEQ ID NO: 52147 - DNA, 22 bp, Artificial Sequence
  chemically synthesized
cacaggtgggagggacagcagg

SEQ ID NO: 52148 - DNA, 22 bp, Artificial Sequence
  chemically synthesized
agagtgggggtcattgtgcaga

SEQ ID NO: 52149 - DNA, 22 bp, Artificial Sequence
  chemically synthesized
gagtgggggtcattgtgcagat

SEQ ID NO: 52150 - DNA, 22 bp, Artificial Sequence
  chemically synthesized
tgcagatgggaaaacaaaggcc

SEQ ID NO: 52151 - DNA, 22 bp, Artificial Sequence
  chemically synthesized
ccgagggcaggcgacctcaacc

SEQ ID NO: 52152 - DNA, 22 bp, Artificial Sequence
  chemically synthesized
aaccacagcccagtgctggagc

SEQ ID NO: 52153 - DNA, 22 bp, Artificial Sequence
  chemically synthesized
gagctgtgagtggatgtagagc

SEQ ID NO: 52154 - DNA, 22 bp, Artificial Sequence
  chemically synthesized
tgagtggatgtagagcagcgga

SEQ ID NO: 52155 - DNA, 22 bp, Artificial Sequence
  chemically synthesized
agccagctcaggggaaggacag

SEQ ID NO: 52156 - DNA, 22 bp, Artificial Sequence
  chemically synthesized
aggggaaggacaggggccctga

SEQ ID NO: 52157 - DNA, 22 bp, Artificial Sequence
  chemically synthesized
aagccaggggatggagctgcag

SEQ ID NO: 52158 - DNA, 22 bp, Artificial Sequence
  chemically synthesized
cagggaagggagctcagagaga

SEQ ID NO: 52159 - DNA, 22 bp, Artificial Sequence
  chemically synthesized
agagagaaggggaggggagtct

SEQ ID NO: 52160 - DNA, 22 bp, Artificial Sequence
  chemically synthesized
agctcagtttcccgctgcctga

SEQ ID NO: 52161 - DNA, 22 bp, Artificial Sequence
  chemically synthesized
agtttcccgctgcctgaaagga

SEQ ID NO: 52162 - DNA, 22 bp, Artificial Sequence
  chemically synthesized
cccgctgcctgaaaggagggtg

SEQ ID NO: 52163 - DNA, 22 bp, Artificial Sequence
  chemically synthesized
ccgctgcctgaaaggagggtgg

SEQ ID NO: 52164 - DNA, 22 bp, Artificial Sequence
  chemically synthesized
cctgaaaggagggtggtaccta

SEQ ID NO: 52165 - DNA, 22 bp, Artificial Sequence
  chemically synthesized
aaaggagggtggtacctactcc

SEQ ID NO: 52166 - DNA, 22 bp, Artificial Sequence
  chemically synthesized
ctcccttcacagggtaactgaa

SEQ ID NO: 52167 - DNA, 22 bp, Artificial Sequence
  chemically synthesized
ccttcacagggtaactgaatga

SEQ ID NO: 52168 - DNA, 22 bp, Artificial Sequence
  chemically synthesized
cacagggtaactgaatgagaga

SEQ ID NO: 52169 - DNA, 22 bp, Artificial Sequence
  chemically synthesized
acagggtaactgaatgagagac

SEQ ID NO: 52170 - DNA, 22 bp, Artificial Sequence
  chemically synthesized
aatgagagactgcctggaggaa

SEQ ID NO: 52171 - DNA, 22 bp, Artificial Sequence
  chemically synthesized
cctggaggaaagctcttcaagt

SEQ ID NO: 52172 - DNA, 22 bp, Artificial Sequence
  chemically synthesized
gaggaaagctcttcaagtgtgg

SEQ ID NO: 52173 - DNA, 22 bp, Artificial Sequence
  chemically synthesized
ttcaagtgtggcccaccccacc

SEQ ID NO: 52174 - DNA, 22 bp, Artificial Sequence
  chemically synthesized
caagtgtggcccaccccacccc

SEQ ID NO: 52175 - DNA, 22 bp, Artificial Sequence
  chemically synthesized
aagtgtggcccaccccacccca

SEQ ID NO: 52176 - DNA, 22 bp, Artificial Sequence
  chemically synthesized
acacgggggagggagggcagca

SEQ ID NO: 52177 - DNA, 22 bp, Artificial Sequence
  chemically synthesized
tctgggcacacccagtacccgt

SEQ ID NO: 52178 - DNA, 22 bp, Artificial Sequence
  chemically synthesized
ctgggcacacccagtacccgtc

SEQ ID NO: 52179 - DNA, 22 bp, Artificial Sequence
  chemically synthesized
tgggcacacccagtacccgtct

SEQ ID NO: 52180 - DNA, 22 bp, Artificial Sequence
  chemically synthesized
ggcacacccagtacccgtctct

SEQ ID NO: 52181 - DNA, 22 bp, Artificial Sequence
  chemically synthesized
tgagctttccttgaactgttgc

SEQ ID NO: 52182 - DNA, 22 bp, Artificial Sequence
  chemically synthesized
agctttccttgaactgttgcat

SEQ ID NO: 52183 - DNA, 22 bp, Artificial Sequence
  chemically synthesized
tccttgaactgttgcattttaa

SEQ ID NO: 52184 - DNA, 22 bp, Artificial Sequence
  chemically synthesized
ccttgaactgttgcattttaat

SEQ ID NO: 52185 - DNA, 22 bp, Artificial Sequence
  chemically synthesized
cttgaactgttgcattttaatc

SEQ ID NO: 52186 - DNA, 22 bp, Artificial Sequence
  chemically synthesized
gaactgttgcattttaatcctc

SEQ ID NO: 52187 - DNA, 22 bp, Artificial Sequence
  chemically synthesized
aactgttgcattttaatcctca

SEQ ID NO: 52188 - DNA, 22 bp, Artificial Sequence
  chemically synthesized
ttgcattttaatcctcacagca

SEQ ID NO: 52189 - DNA, 22 bp, Artificial Sequence
  chemically synthesized
cattttaatcctcacagcagct

SEQ ID NO: 52190 - DNA, 22 bp, Artificial Sequence
  chemically synthesized
taatcctcacagcagctcaaca

SEQ ID NO: 52191 - DNA, 22 bp, Artificial Sequence
  chemically synthesized
aatcctcacagcagctcaacaa

SEQ ID NO: 52192 - DNA, 22 bp, Artificial Sequence
  chemically synthesized
atcctcacagcagctcaacaag

SEQ ID NO: 52193 - DNA, 22 bp, Artificial Sequence
  chemically synthesized
acagcagctcaacaaggtacat

SEQ ID NO: 52194 - DNA, 22 bp, Artificial Sequence
  chemically synthesized
aacaaggtacataccgtcacca

SEQ ID NO: 52195 - DNA, 22 bp, Artificial Sequence
  chemically synthesized
tacagatagggaaattgaggct

SEQ ID NO: 52196 - DNA, 22 bp, Artificial Sequence
  chemically synthesized
acagatagggaaattgaggctc

SEQ ID NO: 52197 - DNA, 22 bp, Artificial Sequence
  chemically synthesized
cagatagggaaattgaggctcg

SEQ ID NO: 52198 - DNA, 22 bp, Artificial Sequence
  chemically synthesized
aggctcggagcggttaaacaac

SEQ ID NO: 52199 - DNA, 22 bp, Artificial Sequence
  chemically synthesized
ggagcggttaaacaactcacct

SEQ ID NO: 52200 - DNA, 22 bp, Artificial Sequence
  chemically synthesized
aacaactcacctgaggcctcac

SEQ ID NO: 52201 - DNA, 22 bp, Artificial Sequence
  chemically synthesized
acctgaggcctcacagccagta

SEQ ID NO: 52202 - DNA, 22 bp, Artificial Sequence
  chemically synthesized
aggcctcacagccagtaagtgg

SEQ ID NO: 52203 - DNA, 22 bp, Artificial Sequence
  chemically synthesized
acagccagtaagtgggttccct

SEQ ID NO: 52204 - DNA, 22 bp, Artificial Sequence
  chemically synthesized
cctggtctgaatgtgtgtgctg

SEQ ID NO: 52205 - DNA, 22 bp, Artificial Sequence
  chemically synthesized
gtctgaatgtgtgtgctggagg

SEQ ID NO: 52206 - DNA, 22 bp, Artificial Sequence
  chemically synthesized
aatgtgtgtgctggaggatcct

SEQ ID NO: 52207 - DNA, 22 bp, Artificial Sequence
  chemically synthesized
gaggatcctgtgggtcactcgc

SEQ ID NO: 52208 - DNA, 22 bp, Artificial Sequence
  chemically synthesized
tgggtcactcgcctggtagagc

SEQ ID NO: 52209 - DNA, 22 bp, Artificial Sequence
  chemically synthesized
gcctggtagagccccaaggtgg

SEQ ID NO: 52210 - DNA, 22 bp, Artificial Sequence
  chemically synthesized
gtagagccccaaggtggaggca

SEQ ID NO: 52211 - DNA, 22 bp, Artificial Sequence
  chemically synthesized
gtgaatgacagaaggggcaaaa

SEQ ID NO: 52212 - DNA, 22 bp, Artificial Sequence
  chemically synthesized
atccattcactctgcaagtatc

SEQ ID NO: 52213 - DNA, 22 bp, Artificial Sequence
  chemically synthesized
actctgcaagtatctacggcac

SEQ ID NO: 52214 - DNA, 22 bp, Artificial Sequence
  chemically synthesized
tgcaagtatctacggcacgtac

SEQ ID NO: 52215 - DNA, 22 bp, Artificial Sequence
  chemically synthesized
caagtatctacggcacgtacgc

SEQ ID NO: 52216 - DNA, 22 bp, Artificial Sequence
  chemically synthesized
cggcacgtacgccagctcccaa

SEQ ID NO: 52217 - DNA, 22 bp, Artificial Sequence
  chemically synthesized
ccaagcaggtttgcgggttgca

SEQ ID NO: 52218 - DNA, 22 bp, Artificial Sequence
  chemically synthesized
gcgggttgcacagcgggcgatg

SEQ ID NO: 52219 - DNA, 22 bp, Artificial Sequence
  chemically synthesized
cgggttgcacagcgggcgatgc

SEQ ID NO: 52220 - DNA, 22 bp, Artificial Sequence
  chemically synthesized
cacagcgggcgatgcaatctga

SEQ ID NO: 52221 - DNA, 22 bp, Artificial Sequence
  chemically synthesized
atttaggcttttaaagggattg

SEQ ID NO: 52222 - DNA, 22 bp, Artificial Sequence
  chemically synthesized
aggcttttaaagggattgcaat

SEQ ID NO: 52223 - DNA, 22 bp, Artificial Sequence
  chemically synthesized
ggcttttaaagggattgcaatc

SEQ ID NO: 52224 - DNA, 22 bp, Artificial Sequence
  chemically synthesized
ttaaagggattgcaatcaagtg

SEQ ID NO: 52225 - DNA, 22 bp, Artificial Sequence
  chemically synthesized
taaagggattgcaatcaagtgg

SEQ ID NO: 52226 - DNA, 22 bp, Artificial Sequence
  chemically synthesized
aaagggattgcaatcaagtggg

SEQ ID NO: 52227 - DNA, 22 bp, Artificial Sequence
  chemically synthesized
aagggattgcaatcaagtgggg

SEQ ID NO: 52228 - DNA, 22 bp, Artificial Sequence
  chemically synthesized
caatcaagtggggccccactag

SEQ ID NO: 52229 - DNA, 22 bp, Artificial Sequence
  chemically synthesized
gcctcaaccctgtacctcccct

SEQ ID NO: 52230 - DNA, 22 bp, Artificial Sequence
  chemically synthesized
aaccctgtacctcccctcccct

SEQ ID NO: 52231 - DNA, 22 bp, Artificial Sequence
  chemically synthesized
tacctcccctcccctccacccc

SEQ ID NO: 52232 - DNA, 22 bp, Artificial Sequence
  chemically synthesized
ccctcccctccacccccagcag

SEQ ID NO: 52233 - DNA, 22 bp, Artificial Sequence
  chemically synthesized
ccctccacccccagcagtctcc

SEQ ID NO: 52234 - DNA, 22 bp, Artificial Sequence
  chemically synthesized
cacccccagcagtctccaaagg

SEQ ID NO: 52235 - DNA, 22 bp, Artificial Sequence
  chemically synthesized
caaaggcctccaacaaccccag

SEQ ID NO: 52236 - DNA, 22 bp, Artificial Sequence
  chemically synthesized
caacaaccccagagtgggggcc

SEQ ID NO: 52237 - DNA, 22 bp, Artificial Sequence
  chemically synthesized
caagctgtatacggatcacact

SEQ ID NO: 52238 - DNA, 22 bp, Artificial Sequence
  chemically synthesized
tatacggatcacactggttttc

SEQ ID NO: 52239 - DNA, 22 bp, Artificial Sequence
  chemically synthesized
gttttccaggagcaaaaacaga

SEQ ID NO: 52240 - DNA, 22 bp, Artificial Sequence
  chemically synthesized
tccaggagcaaaaacagaaaca

SEQ ID NO: 52241 - DNA, 22 bp, Artificial Sequence
  chemically synthesized
ccaggagcaaaaacagaaacag

SEQ ID NO: 52242 - DNA, 22 bp, Artificial Sequence
  chemically synthesized
caggagcaaaaacagaaacagg

SEQ ID NO: 52243 - DNA, 22 bp, Artificial Sequence
  chemically synthesized
aggctggtcaaaattgaacctc

SEQ ID NO: 52244 - DNA, 22 bp, Artificial Sequence
  chemically synthesized
gtcaaaattgaacctcctcctg

SEQ ID NO: 52245 - DNA, 22 bp, Artificial Sequence
  chemically synthesized
aacctcctcctgctctgagcag

SEQ ID NO: 52246 - DNA, 22 bp, Artificial Sequence
  chemically synthesized
ctcctgctctgagcagcctggg

SEQ ID NO: 52247 - DNA, 22 bp, Artificial Sequence
  chemically synthesized
ctgctctgagcagcctgggggg

SEQ ID NO: 52248 - DNA, 22 bp, Artificial Sequence
  chemically synthesized
ctctgagcagcctggggggcag

SEQ ID NO: 52249 - DNA, 22 bp, Artificial Sequence
  chemically synthesized
tgagcagcctggggggcagact

SEQ ID NO: 52250 - DNA, 22 bp, Artificial Sequence
  chemically synthesized
agcagcctggggggcagactaa

SEQ ID NO: 52251 - DNA, 22 bp, Artificial Sequence
  chemically synthesized
gggggcagactaagcagagggc

SEQ ID NO: 52252 - DNA, 22 bp, Artificial Sequence
  chemically synthesized
agcagagggctgtgcagaccca

SEQ ID NO: 52253 - DNA, 22 bp, Artificial Sequence
  chemically synthesized
tgcagacccacataaagagcct

SEQ ID NO: 52254 - DNA, 22 bp, Artificial Sequence
  chemically synthesized
ctgtgtgccaggcacttcaccc

SEQ ID NO: 52255 - DNA, 22 bp, Artificial Sequence
  chemically synthesized
tgtgccaggcacttcacccgag

SEQ ID NO: 52256 - DNA, 22 bp, Artificial Sequence
  chemically synthesized
cacccgaggcacttcacaagca

SEQ ID NO: 52257 - DNA, 22 bp, Artificial Sequence
  chemically synthesized
acccgaggcacttcacaagcat

SEQ ID NO: 52258 - DNA, 22 bp, Artificial Sequence
  chemically synthesized
cacaagcatgcttgggaatgaa

SEQ ID NO: 52259 - DNA, 22 bp, Artificial Sequence
  chemically synthesized
acaagcatgcttgggaatgaaa

SEQ ID NO: 52260 - DNA, 22 bp, Artificial Sequence
  chemically synthesized
gggaatgaaacttccaactctt

SEQ ID NO: 52261 - DNA, 22 bp, Artificial Sequence
  chemically synthesized
ggaatgaaacttccaactcttt

SEQ ID NO: 52262 - DNA, 22 bp, Artificial Sequence
  chemically synthesized
ccaactctttgggatgcaggtg

SEQ ID NO: 52263 - DNA, 22 bp, Artificial Sequence
  chemically synthesized
caactctttgggatgcaggtga

SEQ ID NO: 52264 - DNA, 22 bp, Artificial Sequence
  chemically synthesized
tttgggatgcaggtgaaacagt

SEQ ID NO: 52265 - DNA, 22 bp, Artificial Sequence
  chemically synthesized
tgggatgcaggtgaaacagttc

SEQ ID NO: 52266 - DNA, 22 bp, Artificial Sequence
  chemically synthesized
gggatgcaggtgaaacagttcc

SEQ ID NO: 52267 - DNA, 22 bp, Artificial Sequence
  chemically synthesized
ggatgcaggtgaaacagttcct

SEQ ID NO: 52268 - DNA, 22 bp, Artificial Sequence
  chemically synthesized
ctggttcagagaggtgaagcgg

SEQ ID NO: 52269 - DNA, 22 bp, Artificial Sequence
  chemically synthesized
gttcagagaggtgaagcggcct

SEQ ID NO: 52270 - DNA, 22 bp, Artificial Sequence
  chemically synthesized
agagaggtgaagcggcctgcct

SEQ ID NO: 52271 - DNA, 22 bp, Artificial Sequence
  chemically synthesized
cctgaggcagcacagctcttct

SEQ ID NO: 52272 - DNA, 22 bp, Artificial Sequence
  chemically synthesized
aggcagcacagctcttctttac

SEQ ID NO: 52273 - DNA, 22 bp, Artificial Sequence
  chemically synthesized
ttctttacagatgtgcttcccc

SEQ ID NO: 52274 - DNA, 22 bp, Artificial Sequence
  chemically synthesized
ctttacagatgtgcttccccac

SEQ ID NO: 52275 - DNA, 22 bp, Artificial Sequence
  chemically synthesized
tttacagatgtgcttccccacc

SEQ ID NO: 52276 - DNA, 22 bp, Artificial Sequence
  chemically synthesized
tacagatgtgcttccccacctc

SEQ ID NO: 52277 - DNA, 22 bp, Artificial Sequence
  chemically synthesized
acagatgtgcttccccacctct

SEQ ID NO: 52278 - DNA, 22 bp, Artificial Sequence
  chemically synthesized
cagatgtgcttccccacctcta

SEQ ID NO: 52279 - DNA, 22 bp, Artificial Sequence
  chemically synthesized
ccccacctctaccctgtctcac

SEQ ID NO: 52280 - DNA, 22 bp, Artificial Sequence
  chemically synthesized
cccacctctaccctgtctcacg

SEQ ID NO: 52281 - DNA, 22 bp, Artificial Sequence
  chemically synthesized
taccctgtctcacggcccccca

SEQ ID NO: 52282 - DNA, 22 bp, Artificial Sequence
  chemically synthesized
ccctgtctcacggccccccatg

SEQ ID NO: 52283 - DNA, 22 bp, Artificial Sequence
  chemically synthesized
tctcacggccccccatgccagc

SEQ ID NO: 52284 - DNA, 22 bp, Artificial Sequence
  chemically synthesized
acggccccccatgccagcctga

SEQ ID NO: 52285 - DNA, 22 bp, Artificial Sequence
  chemically synthesized
acggttgtgtctgcctcagtca

SEQ ID NO: 52286 - DNA, 22 bp, Artificial Sequence
  chemically synthesized
tgtctgcctcagtcatgctcca

SEQ ID NO: 52287 - DNA, 22 bp, Artificial Sequence
  chemically synthesized
cctcagtcatgctccatttttc

SEQ ID NO: 52288 - DNA, 22 bp, Artificial Sequence
  chemically synthesized
agtcatgctccatttttccatc

SEQ ID NO: 52289 - DNA, 22 bp, Artificial Sequence
  chemically synthesized
catttttccatcgggaccatca

SEQ ID NO: 52290 - DNA, 22 bp, Artificial Sequence
  chemically synthesized
ttccatcgggaccatcaagagg

SEQ ID NO: 52291 - DNA, 22 bp, Artificial Sequence
  chemically synthesized
tccatcgggaccatcaagaggg

SEQ ID NO: 52292 - DNA, 22 bp, Artificial Sequence
  chemically synthesized
ccatcgggaccatcaagagggt

SEQ ID NO: 52293 - DNA, 22 bp, Artificial Sequence
  chemically synthesized
catcgggaccatcaagagggtg

SEQ ID NO: 52294 - DNA, 22 bp, Artificial Sequence
  chemically synthesized
gtgtctaaggctgactgggtaa

SEQ ID NO: 52295 - DNA, 22 bp, Artificial Sequence
  chemically synthesized
tgtctaaggctgactgggtaac

SEQ ID NO: 52296 - DNA, 22 bp, Artificial Sequence
  chemically synthesized
aggctgactgggtaactttgga

SEQ ID NO: 52297 - DNA, 22 bp, Artificial Sequence
  chemically synthesized
actgggtaactttggatgagcg

SEQ ID NO: 52298 - DNA, 22 bp, Artificial Sequence
  chemically synthesized
ggtaactttggatgagcggtct

SEQ ID NO: 52299 - DNA, 22 bp, Artificial Sequence
  chemically synthesized
tggatgagcggtctctccgctc

SEQ ID NO: 52300 - DNA, 22 bp, Artificial Sequence
  chemically synthesized
ggatgagcggtctctccgctct

SEQ ID NO: 52301 - DNA, 22 bp, Artificial Sequence
  chemically synthesized
gatgagcggtctctccgctctg

SEQ ID NO: 52302 - DNA, 22 bp, Artificial Sequence
  chemically synthesized
tccgctctgagcctgtttcctc

SEQ ID NO: 52303 - DNA, 22 bp, Artificial Sequence
  chemically synthesized
cgctctgagcctgtttcctcat

SEQ ID NO: 52304 - DNA, 22 bp, Artificial Sequence
  chemically synthesized
tgagcctgtttcctcatctgtc

SEQ ID NO: 52305 - DNA, 22 bp, Artificial Sequence
  chemically synthesized
agcctgtttcctcatctgtcaa

SEQ ID NO: 52306 - DNA, 22 bp, Artificial Sequence
  chemically synthesized
tttcctcatctgtcaaatgggc

SEQ ID NO: 52307 - DNA, 22 bp, Artificial Sequence
  chemically synthesized
cctcatctgtcaaatgggctct

SEQ ID NO: 52308 - DNA, 22 bp, Artificial Sequence
  chemically synthesized
ctcatctgtcaaatgggctcta

SEQ ID NO: 52309 - DNA, 22 bp, Artificial Sequence
  chemically synthesized
atctgtcaaatgggctctaacc

SEQ ID NO: 52310 - DNA, 22 bp, Artificial Sequence
  chemically synthesized
tcaaatgggctctaacccactc

SEQ ID NO: 52311 - DNA, 22 bp, Artificial Sequence
  chemically synthesized
taacccactctgatctcccagg

SEQ ID NO: 52312 - DNA, 22 bp, Artificial Sequence
  chemically synthesized
acccactctgatctcccagggc

SEQ ID NO: 52313 - DNA, 22 bp, Artificial Sequence
  chemically synthesized
tgatctcccagggcggcagtaa

SEQ ID NO: 52314 - DNA, 22 bp, Artificial Sequence
  chemically synthesized
atctcccagggcggcagtaagt

SEQ ID NO: 52315 - DNA, 22 bp, Artificial Sequence
  chemically synthesized
ccagggcggcagtaagtcttca

SEQ ID NO: 52316 - DNA, 22 bp, Artificial Sequence
  chemically synthesized
cagcatcaggcattttggggtg

SEQ ID NO: 52317 - DNA, 22 bp, Artificial Sequence
  chemically synthesized
agcatcaggcattttggggtga

SEQ ID NO: 52318 - DNA, 22 bp, Artificial Sequence
  chemically synthesized
tggggtgactcagtaaatggta

SEQ ID NO: 52319 - DNA, 22 bp, Artificial Sequence
  chemically synthesized
ggggtgactcagtaaatggtag

SEQ ID NO: 52320 - DNA, 22 bp, Artificial Sequence
  chemically synthesized
gggtgactcagtaaatggtaga

SEQ ID NO: 52321 - DNA, 22 bp, Artificial Sequence
  chemically synthesized
agtaaatggtagatcttgctac

SEQ ID NO: 52322 - DNA, 22 bp, Artificial Sequence
  chemically synthesized
gctaccagtggaacagccacta

SEQ ID NO: 52323 - DNA, 22 bp, Artificial Sequence
  chemically synthesized
ctaccagtggaacagccactaa

SEQ ID NO: 52324 - DNA, 22 bp, Artificial Sequence
  chemically synthesized
ccagtggaacagccactaagga

SEQ ID NO: 52325 - DNA, 22 bp, Artificial Sequence
  chemically synthesized
aggattctgcagtgagagcaga

SEQ ID NO: 52326 - DNA, 22 bp, Artificial Sequence
  chemically synthesized
tgcagtgagagcagagggccag

SEQ ID NO: 52327 - DNA, 22 bp, Artificial Sequence
  chemically synthesized
cagtgagagcagagggccagct

SEQ ID NO: 52328 - DNA, 22 bp, Artificial Sequence
  chemically synthesized
agtggtactctcccagagactg

SEQ ID NO: 52329 - DNA, 22 bp, Artificial Sequence
  chemically synthesized
tcccagagactgtctgactcac

SEQ ID NO: 52330 - DNA, 22 bp, Artificial Sequence
  chemically synthesized
ccagagactgtctgactcacgc

SEQ ID NO: 52331 - DNA, 22 bp, Artificial Sequence
  chemically synthesized
tctgactcacgccaccccctcc

SEQ ID NO: 52332 - DNA, 22 bp, Artificial Sequence
  chemically synthesized
actcacgccaccccctccacct

SEQ ID NO: 52333 - DNA, 22 bp, Artificial Sequence
  chemically synthesized
acgccaccccctccaccttgga

SEQ ID NO: 52334 - DNA, 22 bp, Artificial Sequence
  chemically synthesized
caccttggacacaggacgctgt

SEQ ID NO: 52335 - DNA, 22 bp, Artificial Sequence
  chemically synthesized
ggacacaggacgctgtggtttc

SEQ ID NO: 52336 - DNA, 22 bp, Artificial Sequence
  chemically synthesized
gacacaggacgctgtggtttct

SEQ ID NO: 52337 - DNA, 22 bp, Artificial Sequence
  chemically synthesized
tggtttctgagccaggtacaat

SEQ ID NO: 52338 - DNA, 22 bp, Artificial Sequence
  chemically synthesized
ctgagccaggtacaatgactcc

SEQ ID NO: 52339 - DNA, 22 bp, Artificial Sequence
  chemically synthesized
tgagccaggtacaatgactcct

SEQ ID NO: 52340 - DNA, 22 bp, Artificial Sequence
  chemically synthesized
agccaggtacaatgactccttt

SEQ ID NO: 52341 - DNA, 22 bp, Artificial Sequence
  chemically synthesized
ctttcggtaagtgcagtggaag

SEQ ID NO: 52342 - DNA, 22 bp, Artificial Sequence
  chemically synthesized
tcggtaagtgcagtggaagctg

SEQ ID NO: 52343 - DNA, 22 bp, Artificial Sequence
  chemically synthesized
cggtaagtgcagtggaagctgt

SEQ ID NO: 52344 - DNA, 22 bp, Artificial Sequence
  chemically synthesized
ggtaagtgcagtggaagctgta

SEQ ID NO: 52345 - DNA, 22 bp, Artificial Sequence
  chemically synthesized
tacactgcccaggcaaagcgtc

SEQ ID NO: 52346 - DNA, 22 bp, Artificial Sequence
  chemically synthesized
cccaggcaaagcgtccgggcag

SEQ ID NO: 52347 - DNA, 22 bp, Artificial Sequence
  chemically synthesized
agatcccagccagtggacttag

SEQ ID NO: 52348 - DNA, 22 bp, Artificial Sequence
  chemically synthesized
agcccctgtttgctcctccgat

SEQ ID NO: 52349 - DNA, 22 bp, Artificial Sequence
  chemically synthesized
gcccctgtttgctcctccgata

SEQ ID NO: 52350 - DNA, 22 bp, Artificial Sequence
  chemically synthesized
tttgctcctccgataactgggg

SEQ ID NO: 52351 - DNA, 22 bp, Artificial Sequence
  chemically synthesized
gctcctccgataactggggtga

SEQ ID NO: 52352 - DNA, 22 bp, Artificial Sequence
  chemically synthesized
ctcctccgataactggggtgac

SEQ ID NO: 52353 - DNA, 22 bp, Artificial Sequence
  chemically synthesized
ctccgataactggggtgacctt

SEQ ID NO: 52354 - DNA, 22 bp, Artificial Sequence
  chemically synthesized
cgataactggggtgaccttggt

SEQ ID NO: 52355 - DNA, 22 bp, Artificial Sequence
  chemically synthesized
gggtgaccttggttaatattca

SEQ ID NO: 52356 - DNA, 22 bp, Artificial Sequence
  chemically synthesized
ggttaatattcaccagcagcct

SEQ ID NO: 52357 - DNA, 22 bp, Artificial Sequence
  chemically synthesized
gttaatattcaccagcagcctc

SEQ ID NO: 52358 - DNA, 22 bp, Artificial Sequence
  chemically synthesized
atattcaccagcagcctccccc

SEQ ID NO: 52359 - DNA, 22 bp, Artificial Sequence
  chemically synthesized
accagcagcctcccccgttgcc

SEQ ID NO: 52360 - DNA, 22 bp, Artificial Sequence
  chemically synthesized
ccccgttgcccctctggatcca

SEQ ID NO: 52361 - DNA, 22 bp, Artificial Sequence
  chemically synthesized
cccctctggatccactgcttaa

SEQ ID NO: 52362 - DNA, 22 bp, Artificial Sequence
  chemically synthesized
tggatccactgcttaaatacgg

SEQ ID NO: 52363 - DNA, 22 bp, Artificial Sequence
  chemically synthesized
gatccactgcttaaatacggac

SEQ ID NO: 52364 - DNA, 22 bp, Artificial Sequence
  chemically synthesized
cttaaatacggacgaggacagg

SEQ ID NO: 52365 - DNA, 22 bp, Artificial Sequence
  chemically synthesized
aaatacggacgaggacagggcc

SEQ ID NO: 52366 - DNA, 22 bp, Artificial Sequence
  chemically synthesized
aatacggacgaggacagggccc

SEQ ID NO: 52367 - DNA, 22 bp, Artificial Sequence
  chemically synthesized
tctcctcagcttcaggcaccac

SEQ ID NO: 52368 - DNA, 22 bp, Artificial Sequence
  chemically synthesized
ctcagcttcaggcaccaccact

SEQ ID NO: 52369 - DNA, 22 bp, Artificial Sequence
  chemically synthesized
agcttcaggcaccaccactgac

SEQ ID NO: 52370 - DNA, 22 bp, Artificial Sequence
  chemically synthesized
caggcaccaccactgacctggg

SEQ ID NO: 52371 - DNA, 22 bp, Artificial Sequence
  chemically synthesized
aggcaccaccactgacctggga

SEQ ID NO: 52372 - DNA, 22 bp, Artificial Sequence
  chemically synthesized
acctgggacagtgaatcgtaag

SEQ ID NO: 52373 - DNA, 22 bp, Artificial Sequence
  chemically synthesized
ggacagtgaatcgtaagtatgc

SEQ ID NO: 52374 - DNA, 22 bp, Artificial Sequence
  chemically synthesized
tcactgcgagaggttctggaga

SEQ ID NO: 52375 - DNA, 22 bp, Artificial Sequence
  chemically synthesized
cactgcgagaggttctggagag

SEQ ID NO: 52376 - DNA, 22 bp, Artificial Sequence
  chemically synthesized
actgcgagaggttctggagagg

SEQ ID NO: 52377 - DNA, 22 bp, Artificial Sequence
  chemically synthesized
cgagaggttctggagaggcttc

SEQ ID NO: 52378 - DNA, 22 bp, Artificial Sequence
  chemically synthesized
tggagaggcttctgagctcccc

SEQ ID NO: 52379 - DNA, 22 bp, Artificial Sequence
  chemically synthesized
gagaggcttctgagctccccat

SEQ ID NO: 52380 - DNA, 22 bp, Artificial Sequence
  chemically synthesized
ctgagctccccatggcccaggc

SEQ ID NO: 52381 - DNA, 22 bp, Artificial Sequence
  chemically synthesized
tgagctccccatggcccaggca

SEQ ID NO: 52382 - DNA, 22 bp, Artificial Sequence
  chemically synthesized
agctccccatggcccaggcagg

SEQ ID NO: 52383 - DNA, 22 bp, Artificial Sequence
  chemically synthesized
cccatggcccaggcaggcagca

SEQ ID NO: 52384 - DNA, 22 bp, Artificial Sequence
  chemically synthesized
gggcaggaggggggttgtggag

SEQ ID NO: 52385 - DNA, 22 bp, Artificial Sequence
  chemically synthesized
tggagtgggtatccgcctgctg

SEQ ID NO: 52386 - DNA, 22 bp, Artificial Sequence
  chemically synthesized
ctgaggtgcagggcagatggag

SEQ ID NO: 52387 - DNA, 22 bp, Artificial Sequence
  chemically synthesized
aggtgcagggcagatggagagg

SEQ ID NO: 52388 - DNA, 22 bp, Artificial Sequence
  chemically synthesized
cagctgagctcctattttcata

SEQ ID NO: 52389 - DNA, 22 bp, Artificial Sequence
  chemically synthesized
agctcctattttcataataaca

SEQ ID NO: 52390 - DNA, 22 bp, Artificial Sequence
  chemically synthesized
ctattttcataataacagcagc

SEQ ID NO: 52391 - DNA, 22 bp, Artificial Sequence
  chemically synthesized
ttttcataataacagcagccat

SEQ ID NO: 52392 - DNA, 22 bp, Artificial Sequence
  chemically synthesized
tcataataacagcagccatgag

SEQ ID NO: 52393 - DNA, 22 bp, Artificial Sequence
  chemically synthesized
cataataacagcagccatgagg

SEQ ID NO: 52394 - DNA, 22 bp, Artificial Sequence
  chemically synthesized
ataataacagcagccatgaggg

SEQ ID NO: 52395 - DNA, 22 bp, Artificial Sequence
  chemically synthesized
tgtcctgtttcccagtcctgcc

SEQ ID NO: 52396 - DNA, 22 bp, Artificial Sequence
  chemically synthesized
tttcccagtcctgcccggtccc

SEQ ID NO: 52397 - DNA, 22 bp, Artificial Sequence
  chemically synthesized
cccagtcctgcccggtcccccc

SEQ ID NO: 52398 - DNA, 22 bp, Artificial Sequence
  chemically synthesized
ccagtcctgcccggtcccccct

SEQ ID NO: 52399 - DNA, 22 bp, Artificial Sequence
  chemically synthesized
cccggtcccccctcggtacctc

SEQ ID NO: 52400 - DNA, 22 bp, Artificial Sequence
  chemically synthesized
ggtacctcctggtggatacact

SEQ ID NO: 52401 - DNA, 22 bp, Artificial Sequence
  chemically synthesized
ctggtggatacactggttcctg

SEQ ID NO: 52402 - DNA, 22 bp, Artificial Sequence
  chemically synthesized
gtggatacactggttcctgtaa

SEQ ID NO: 52403 - DNA, 22 bp, Artificial Sequence
  chemically synthesized
gttcctgtaagcagaagtggat

SEQ ID NO: 52404 - DNA, 22 bp, Artificial Sequence
  chemically synthesized
ctgtaagcagaagtggatgagg

SEQ ID NO: 52405 - DNA, 22 bp, Artificial Sequence
  chemically synthesized
taagcagaagtggatgagggtg

SEQ ID NO: 52406 - DNA, 22 bp, Artificial Sequence
  chemically synthesized
ggtctgcagtcctggcacccca

SEQ ID NO: 52407 - DNA, 22 bp, Artificial Sequence
  chemically synthesized
cagtcctggcaccccaggatgg

SEQ ID NO: 52408 - DNA, 22 bp, Artificial Sequence
  chemically synthesized
gcaccccaggatgggggacacc

SEQ ID NO: 52409 - DNA, 22 bp, Artificial Sequence
  chemically synthesized
ctttctgtttgcacagctcctc

SEQ ID NO: 52410 - DNA, 22 bp, Artificial Sequence
  chemically synthesized
tttctgtttgcacagctcctct

SEQ ID NO: 52411 - DNA, 22 bp, Artificial Sequence
  chemically synthesized
tctgtttgcacagctcctctgt

SEQ ID NO: 52412 - DNA, 22 bp, Artificial Sequence
  chemically synthesized
ctgtttgcacagctcctctgtc

SEQ ID NO: 52413 - DNA, 22 bp, Artificial Sequence
  chemically synthesized
tgtttgcacagctcctctgtct

SEQ ID NO: 52414 - DNA, 22 bp, Artificial Sequence
  chemically synthesized
tttgcacagctcctctgtctgt

SEQ ID NO: 52415 - DNA, 22 bp, Artificial Sequence
  chemically synthesized
gcacagctcctctgtctgtcgg

SEQ ID NO: 52416 - DNA, 22 bp, Artificial Sequence
  chemically synthesized
cacagctcctctgtctgtcggg

SEQ ID NO: 52417 - DNA, 22 bp, Artificial Sequence
  chemically synthesized
ctctgtctgtcgggggctcctg

SEQ ID NO: 52418 - DNA, 22 bp, Artificial Sequence
  chemically synthesized
tgtctgtcgggggctcctgtct

SEQ ID NO: 52419 - DNA, 22 bp, Artificial Sequence
  chemically synthesized
tctgtcgggggctcctgtctgt

SEQ ID NO: 52420 - DNA, 22 bp, Artificial Sequence
  chemically synthesized
tcgggggctcctgtctgttgtc

SEQ ID NO: 52421 - DNA, 22 bp, Artificial Sequence
  chemically synthesized
ctgtctgttgtctcctataagc

SEQ ID NO: 52422 - DNA, 22 bp, Artificial Sequence
  chemically synthesized
tctgttgtctcctataagcctc

SEQ ID NO: 52423 - DNA, 22 bp, Artificial Sequence
  chemically synthesized
ttgtctcctataagcctcacca

SEQ ID NO: 52424 - DNA, 22 bp, Artificial Sequence
  chemically synthesized
tctcctataagcctcaccacct

SEQ ID NO: 52425 - DNA, 22 bp, Artificial Sequence
  chemically synthesized
ctataagcctcaccacctctcc

SEQ ID NO: 52426 - DNA, 22 bp, Artificial Sequence
  chemically synthesized
taagcctcaccacctctcctac

SEQ ID NO: 52427 - DNA, 22 bp, Artificial Sequence
  chemically synthesized
accacctctcctactgcttggg

SEQ ID NO: 52428 - DNA, 22 bp, Artificial Sequence
  chemically synthesized
tcctactgcttgggcatgcatc

SEQ ID NO: 52429 - DNA, 22 bp, Artificial Sequence
  chemically synthesized
ctactgcttgggcatgcatctt

SEQ ID NO: 52430 - DNA, 22 bp, Artificial Sequence
  chemically synthesized
ctgcttgggcatgcatctttct

SEQ ID NO: 52431 - DNA, 22 bp, Artificial Sequence
  chemically synthesized
cttgggcatgcatctttctccc

SEQ ID NO: 52432 - DNA, 22 bp, Artificial Sequence
  chemically synthesized
gggcatgcatctttctcccctt

SEQ ID NO: 52433 - DNA, 22 bp, Artificial Sequence
  chemically synthesized
ggcatgcatctttctccccttc

SEQ ID NO: 52434 - DNA, 22 bp, Artificial Sequence
  chemically synthesized
tctccccttctatagatgagga

SEQ ID NO: 52435 - DNA, 22 bp, Artificial Sequence
  chemically synthesized
ctccccttctatagatgaggag

SEQ ID NO: 52436 - DNA, 22 bp, Artificial Sequence
  chemically synthesized
tccccttctatagatgaggagg

SEQ ID NO: 52437 - DNA, 22 bp, Artificial Sequence
  chemically synthesized
cccttctatagatgaggaggtt

SEQ ID NO: 52438 - DNA, 22 bp, Artificial Sequence
  chemically synthesized
ctatagatgaggaggttaaggt

SEQ ID NO: 52439 - DNA, 22 bp, Artificial Sequence
  chemically synthesized
tatagatgaggaggttaaggtc

SEQ ID NO: 52440 - DNA, 22 bp, Artificial Sequence
  chemically synthesized
tagatgaggaggttaaggtcca

SEQ ID NO: 52441 - DNA, 22 bp, Artificial Sequence
  chemically synthesized
aggtccagagaggggtggggag

SEQ ID NO: 52442 - DNA, 22 bp, Artificial Sequence
  chemically synthesized
acattctccatcccctccagat

SEQ ID NO: 52443 - DNA, 22 bp, Artificial Sequence
  chemically synthesized
tccatcccctccagatatgacc

SEQ ID NO: 52444 - DNA, 22 bp, Artificial Sequence
  chemically synthesized
catcccctccagatatgaccag

SEQ ID NO: 52445 - DNA, 22 bp, Artificial Sequence
  chemically synthesized
cagatatgaccaggaacagacc

SEQ ID NO: 52446 - DNA, 20 bp, Artificial Sequence
  chemically synthesized
cgagcgagccgcgatgacaa

SEQ ID NO: 52447 - DNA, 20 bp, Artificial Sequence
  chemically synthesized
tcccatcaacatttctgtgc

SEQ ID NO: 52448 - DNA, 20 bp, Artificial Sequence
  chemically synthesized
tgctggactccttccactcg

SEQ ID NO: 52449 - DNA, 20 bp, Artificial Sequence
  chemically synthesized
gctggactccttccactcgc

SEQ ID NO: 52450 - DNA, 20 bp, Artificial Sequence
  chemically synthesized
ttccactcgcgggtcgtctc

SEQ ID NO: 52451 - DNA, 20 bp, Artificial Sequence
  chemically synthesized
ccactcgcgggtcgtctcca

SEQ ID NO: 52452 - DNA, 20 bp, Artificial Sequence
  chemically synthesized
cgcgggtcgtctccagagct

SEQ ID NO: 52453 - DNA, 20 bp, Artificial Sequence
  chemically synthesized
gtctccagagctcagaaaat

SEQ ID NO: 52454 - DNA, 20 bp, Artificial Sequence
  chemically synthesized
tctccagagctcagaaaatg

SEQ ID NO: 52455 - DNA, 20 bp, Artificial Sequence
  chemically synthesized
agctcagaaaatgaggtgat

SEQ ID NO: 52456 - DNA, 20 bp, Artificial Sequence
  chemically synthesized
tcagaaaatgaggtgatcag

SEQ ID NO: 52457 - DNA, 20 bp, Artificial Sequence
  chemically synthesized
cagaaaatgaggtgatcagt

SEQ ID NO: 52458 - DNA, 20 bp, Artificial Sequence
  chemically synthesized
aatgaggtgatcagtgggac

SEQ ID NO: 52459 - DNA, 20 bp, Artificial Sequence
  chemically synthesized
aggtgatcagtgggacgagt

SEQ ID NO: 52460 - DNA, 20 bp, Artificial Sequence
  chemically synthesized
ggtgatcagtgggacgagta

SEQ ID NO: 52461 - DNA, 20 bp, Artificial Sequence
  chemically synthesized
gatcagtgggacgagtaagg

SEQ ID NO: 52462 - DNA, 20 bp, Artificial Sequence
  chemically synthesized
atcagtgggacgagtaagga

SEQ ID NO: 52463 - DNA, 20 bp, Artificial Sequence
  chemically synthesized
tcagtgggacgagtaaggaa

SEQ ID NO: 52464 - DNA, 20 bp, Artificial Sequence
  chemically synthesized
cagtgggacgagtaaggaag

SEQ ID NO: 52465 - DNA, 20 bp, Artificial Sequence
  chemically synthesized
agtgggacgagtaaggaagg

SEQ ID NO: 52466 - DNA, 20 bp, Artificial Sequence
  chemically synthesized
gtgggacgagtaaggaaggg

SEQ ID NO: 52467 - DNA, 20 bp, Artificial Sequence
  chemically synthesized
gacgagtaaggaaggggggt

SEQ ID NO: 52468 - DNA, 20 bp, Artificial Sequence
  chemically synthesized
acgagtaaggaaggggggtt

SEQ ID NO: 52469 - DNA, 20 bp, Artificial Sequence
  chemically synthesized
gagtaaggaaggggggttgg

SEQ ID NO: 52470 - DNA, 20 bp, Artificial Sequence
  chemically synthesized
gtaaggaaggggggttggga

SEQ ID NO: 52471 - DNA, 20 bp, Artificial Sequence
  chemically synthesized
taaggaaggggggttgggag

SEQ ID NO: 52472 - DNA, 20 bp, Artificial Sequence
  chemically synthesized
aaggaaggggggttgggaga

SEQ ID NO: 52473 - DNA, 20 bp, Artificial Sequence
  chemically synthesized
aggaaggggggttgggagag

SEQ ID NO: 52474 - DNA, 20 bp, Artificial Sequence
  chemically synthesized
ggggttgggagaggggcgat

SEQ ID NO: 52475 - DNA, 20 bp, Artificial Sequence
  chemically synthesized
gggttgggagaggggcgatt

SEQ ID NO: 52476 - DNA, 20 bp, Artificial Sequence
  chemically synthesized
agaggggcgattgggcaacc

SEQ ID NO: 52477 - DNA, 20 bp, Artificial Sequence
  chemically synthesized
gcaacccggctgcacaaaca

SEQ ID NO: 52478 - DNA, 20 bp, Artificial Sequence
  chemically synthesized
caacccggctgcacaaacac

SEQ ID NO: 52479 - DNA, 20 bp, Artificial Sequence
  chemically synthesized
acccggctgcacaaacacgg

SEQ ID NO: 52480 - DNA, 20 bp, Artificial Sequence
  chemically synthesized
cccggctgcacaaacacggg

SEQ ID NO: 52481 - DNA, 20 bp, Artificial Sequence
  chemically synthesized
tgcacaaacacgggaggtca

SEQ ID NO: 52482 - DNA, 20 bp, Artificial Sequence
  chemically synthesized
gggaggtcaaagattgcgcc

SEQ ID NO: 52483 - DNA, 20 bp, Artificial Sequence
  chemically synthesized
aagattgcgcccagcccgcc

SEQ ID NO: 52484 - DNA, 20 bp, Artificial Sequence
  chemically synthesized
agattgcgcccagcccgccc

SEQ ID NO: 52485 - DNA, 20 bp, Artificial Sequence
  chemically synthesized
tgcgcccagcccgcccaggc

SEQ ID NO: 52486 - DNA, 20 bp, Artificial Sequence
  chemically synthesized
gcgcccagcccgcccaggcc

SEQ ID NO: 52487 - DNA, 20 bp, Artificial Sequence
  chemically synthesized
cagcccgcccaggccgggaa

SEQ ID NO: 52488 - DNA, 20 bp, Artificial Sequence
  chemically synthesized
cccaggccgggaatggaata

SEQ ID NO: 52489 - DNA, 20 bp, Artificial Sequence
  chemically synthesized
ccaggccgggaatggaataa

SEQ ID NO: 52490 - DNA, 20 bp, Artificial Sequence
  chemically synthesized
caggccgggaatggaataaa

SEQ ID NO: 52491 - DNA, 20 bp, Artificial Sequence
  chemically synthesized
gggaatggaataaagggacg

SEQ ID NO: 52492 - DNA, 20 bp, Artificial Sequence
  chemically synthesized
ggaatggaataaagggacgc

SEQ ID NO: 52493 - DNA, 20 bp, Artificial Sequence
  chemically synthesized
gaatggaataaagggacgcg

SEQ ID NO: 52494 - DNA, 20 bp, Artificial Sequence
  chemically synthesized
aataaagggacgcggggcgc

SEQ ID NO: 52495 - DNA, 20 bp, Artificial Sequence
  chemically synthesized
taaagggacgcggggcgccg

SEQ ID NO: 52496 - DNA, 20 bp, Artificial Sequence
  chemically synthesized
aaagggacgcggggcgccgg

SEQ ID NO: 52497 - DNA, 20 bp, Artificial Sequence
  chemically synthesized
gcggggcgccggaggctgca

SEQ ID NO: 52498 - DNA, 20 bp, Artificial Sequence
  chemically synthesized
gggcgccggaggctgcacag

SEQ ID NO: 52499 - DNA, 20 bp, Artificial Sequence
  chemically synthesized
gccggaggctgcacagaagc

SEQ ID NO: 52500 - DNA, 20 bp, Artificial Sequence
  chemically synthesized
gtccgactgtgctcgctgct

SEQ ID NO: 52501 - DNA, 20 bp, Artificial Sequence
  chemically synthesized
tcgctgctcagcgccgcacc

SEQ ID NO: 52502 - DNA, 20 bp, Artificial Sequence
  chemically synthesized
ctgctcagcgccgcacccgg

SEQ ID NO: 52503 - DNA, 20 bp, Artificial Sequence
  chemically synthesized
cagcgccgcacccggaagat

SEQ ID NO: 52504 - DNA, 20 bp, Artificial Sequence
  chemically synthesized
agcgccgcacccggaagatg

SEQ ID NO: 52505 - DNA, 20 bp, Artificial Sequence
  chemically synthesized
ccggaagatgaggctcgccg

SEQ ID NO: 52506 - DNA, 20 bp, Artificial Sequence
  chemically synthesized
cggaagatgaggctcgccgt

SEQ ID NO: 52507 - DNA, 20 bp, Artificial Sequence
  chemically synthesized
gaagatgaggctcgccgtgg

SEQ ID NO: 52508 - DNA, 20 bp, Artificial Sequence
  chemically synthesized
gctcgccgtgggagccctgc

SEQ ID NO: 52509 - DNA, 20 bp, Artificial Sequence
  chemically synthesized
cctgctggtctgcgccgtcc

SEQ ID NO: 52510 - DNA, 20 bp, Artificial Sequence
  chemically synthesized
ctgctggtctgcgccgtcct

SEQ ID NO: 52511 - DNA, 20 bp, Artificial Sequence
  chemically synthesized
tggtctgcgccgtcctgggt

SEQ ID NO: 52512 - DNA, 20 bp, Artificial Sequence
  chemically synthesized
tgcgccgtcctgggtgagtg

SEQ ID NO: 52513 - DNA, 20 bp, Artificial Sequence
  chemically synthesized
gcgccgtcctgggtgagtgc

SEQ ID NO: 52514 - DNA, 20 bp, Artificial Sequence
  chemically synthesized
gtcctgggtgagtgcgggca

SEQ ID NO: 52515 - DNA, 20 bp, Artificial Sequence
  chemically synthesized
tcctgggtgagtgcgggcac

SEQ ID NO: 52516 - DNA, 20 bp, Artificial Sequence
  chemically synthesized
cctgggtgagtgcgggcacg

SEQ ID NO: 52517 - DNA, 20 bp, Artificial Sequence
  chemically synthesized
gggtgagtgcgggcacgggg

SEQ ID NO: 52518 - DNA, 20 bp, Artificial Sequence
  chemically synthesized
gcgggcacggggtagcaccg

SEQ ID NO: 52519 - DNA, 20 bp, Artificial Sequence
  chemically synthesized
gggcacggggtagcaccgca

SEQ ID NO: 52520 - DNA, 20 bp, Artificial Sequence
  chemically synthesized
gggtagcaccgcagagtcgc

SEQ ID NO: 52521 - DNA, 20 bp, Artificial Sequence
  chemically synthesized
cccgcgcgttccctgcaacc

SEQ ID NO: 52522 - DNA, 20 bp, Artificial Sequence
  chemically synthesized
ccgcgcgttccctgcaaccc

SEQ ID NO: 52523 - DNA, 20 bp, Artificial Sequence
  chemically synthesized
cgcgttccctgcaacccggg

SEQ ID NO: 52524 - DNA, 20 bp, Artificial Sequence
  chemically synthesized
caacccgggcggccaccgcg

SEQ ID NO: 52525 - DNA, 20 bp, Artificial Sequence
  chemically synthesized
gcctgcatgcactccgcgct

SEQ ID NO: 52526 - DNA, 20 bp, Artificial Sequence
  chemically synthesized
cctgcatgcactccgcgctc

SEQ ID NO: 52527 - DNA, 20 bp, Artificial Sequence
  chemically synthesized
catgcactccgcgctcaggc

SEQ ID NO: 52528 - DNA, 20 bp, Artificial Sequence
  chemically synthesized
gcactccgcgctcaggctgg

SEQ ID NO: 52529 - DNA, 20 bp, Artificial Sequence
  chemically synthesized
ccgcgctcaggctggaagcc

SEQ ID NO: 52530 - DNA, 20 bp, Artificial Sequence
  chemically synthesized
cgcgctcaggctggaagcct

SEQ ID NO: 52531 - DNA, 20 bp, Artificial Sequence
  chemically synthesized
aggctggaagcctgggtgtc

SEQ ID NO: 52532 - DNA, 20 bp, Artificial Sequence
  chemically synthesized
ggctggaagcctgggtgtct

SEQ ID NO: 52533 - DNA, 20 bp, Artificial Sequence
  chemically synthesized
gcctctctacgccccacccc

SEQ ID NO: 52534 - DNA, 20 bp, Artificial Sequence
  chemically synthesized
ccccacccctggcctttgct

SEQ ID NO: 52535 - DNA, 20 bp, Artificial Sequence
  chemically synthesized
cccacccctggcctttgctt

SEQ ID NO: 52536 - DNA, 20 bp, Artificial Sequence
  chemically synthesized
ctggcctttgcttgggcttc

SEQ ID NO: 52537 - DNA, 20 bp, Artificial Sequence
  chemically synthesized
tccccctcctcctctttgtc

SEQ ID NO: 52538 - DNA, 20 bp, Artificial Sequence
  chemically synthesized
tctttgtccagtaaatcttg

SEQ ID NO: 52539 - DNA, 20 bp, Artificial Sequence
  chemically synthesized
ttgtccagtaaatcttgcag

SEQ ID NO: 52540 - DNA, 20 bp, Artificial Sequence
  chemically synthesized
agcagtgaaatacaataaat

SEQ ID NO: 52541 - DNA, 20 bp, Artificial Sequence
  chemically synthesized
cagtgaaatacaataaatca

SEQ ID NO: 52542 - DNA, 20 bp, Artificial Sequence
  chemically synthesized
taaatcagagcacgtctaac

SEQ ID NO: 52543 - DNA, 20 bp, Artificial Sequence
  chemically synthesized
aaatcagagcacgtctaacc

SEQ ID NO: 52544 - DNA, 20 bp, Artificial Sequence
  chemically synthesized
ctttgctgctgcctcttgtc

SEQ ID NO: 52545 - DNA, 20 bp, Artificial Sequence
  chemically synthesized
cttgtcaagtccgaactcct

SEQ ID NO: 52546 - DNA, 20 bp, Artificial Sequence
  chemically synthesized
caagtccgaactccttagca

SEQ ID NO: 52547 - DNA, 20 bp, Artificial Sequence
  chemically synthesized
aactccttagcatggcattc

SEQ ID NO: 52548 - DNA, 20 bp, Artificial Sequence
  chemically synthesized
actccttagcatggcattca

SEQ ID NO: 52549 - DNA, 20 bp, Artificial Sequence
  chemically synthesized
gcatggcattcaaggcctcc

SEQ ID NO: 52550 - DNA, 20 bp, Artificial Sequence
  chemically synthesized
catggcattcaaggcctccc

SEQ ID NO: 52551 - DNA, 20 bp, Artificial Sequence
  chemically synthesized
gggtctgaccattccccttt

SEQ ID NO: 52552 - DNA, 20 bp, Artificial Sequence
  chemically synthesized
gtctgaccattcccctttca

SEQ ID NO: 52553 - DNA, 20 bp, Artificial Sequence
  chemically synthesized
tctgaccattcccctttcag

SEQ ID NO: 52554 - DNA, 20 bp, Artificial Sequence
  chemically synthesized
tttcagaggctgatgtcccc

SEQ ID NO: 52555 - DNA, 20 bp, Artificial Sequence
  chemically synthesized
ttcagaggctgatgtcccct

SEQ ID NO: 52556 - DNA, 20 bp, Artificial Sequence
  chemically synthesized
ctgatgtcccctgggtgccc

SEQ ID NO: 52557 - DNA, 20 bp, Artificial Sequence
  chemically synthesized
tgatgtcccctgggtgccct

SEQ ID NO: 52558 - DNA, 20 bp, Artificial Sequence
  chemically synthesized
atgtcccctgggtgccctgg

SEQ ID NO: 52559 - DNA, 20 bp, Artificial Sequence
  chemically synthesized
cctgggtgccctgggagctg

SEQ ID NO: 52560 - DNA, 20 bp, Artificial Sequence
  chemically synthesized
ggagctgtagatgtcctgcc

SEQ ID NO: 52561 - DNA, 20 bp, Artificial Sequence
  chemically synthesized
gagctgtagatgtcctgcca

SEQ ID NO: 52562 - DNA, 20 bp, Artificial Sequence
  chemically synthesized
ctgtagatgtcctgccaagg

SEQ ID NO: 52563 - DNA, 20 bp, Artificial Sequence
  chemically synthesized
tagatgtcctgccaaggaag

SEQ ID NO: 52564 - DNA, 20 bp, Artificial Sequence
  chemically synthesized
gccaaggaagcggtgccatc

SEQ ID NO: 52565 - DNA, 20 bp, Artificial Sequence
  chemically synthesized
aaggaagcggtgccatcgag

SEQ ID NO: 52566 - DNA, 20 bp, Artificial Sequence
  chemically synthesized
aagcggtgccatcgagcggt

SEQ ID NO: 52567 - DNA, 20 bp, Artificial Sequence
  chemically synthesized
gcggtgccatcgagcggtca

SEQ ID NO: 52568 - DNA, 20 bp, Artificial Sequence
  chemically synthesized
gccatcgagcggtcagagca

SEQ ID NO: 52569 - DNA, 20 bp, Artificial Sequence
  chemically synthesized
ccatcgagcggtcagagcat

SEQ ID NO: 52570 - DNA, 20 bp, Artificial Sequence
  chemically synthesized
catcgagcggtcagagcatg

SEQ ID NO: 52571 - DNA, 20 bp, Artificial Sequence
  chemically synthesized
cggtcagagcatggggtttg

SEQ ID NO: 52572 - DNA, 20 bp, Artificial Sequence
  chemically synthesized
cagagcatggggtttgaagc

SEQ ID NO: 52573 - DNA, 20 bp, Artificial Sequence
  chemically synthesized
gggtttgaagccagacttct

SEQ ID NO: 52574 - DNA, 20 bp, Artificial Sequence
  chemically synthesized
aagccagacttcttggatcc

SEQ ID NO: 52575 - DNA, 20 bp, Artificial Sequence
  chemically synthesized
gacttcttggatccaagtcc

SEQ ID NO: 52576 - DNA, 20 bp, Artificial Sequence
  chemically synthesized
tcttggatccaagtcctggc

SEQ ID NO: 52577 - DNA, 20 bp, Artificial Sequence
  chemically synthesized
agtcctggccggctcctcac

SEQ ID NO: 52578 - DNA, 20 bp, Artificial Sequence
  chemically synthesized
gtcctggccggctcctcacc

SEQ ID NO: 52579 - DNA, 20 bp, Artificial Sequence
  chemically synthesized
tcctggccggctcctcacca

SEQ ID NO: 52580 - DNA, 20 bp, Artificial Sequence
  chemically synthesized
ctggccggctcctcaccagg

SEQ ID NO: 52581 - DNA, 20 bp, Artificial Sequence
  chemically synthesized
tggccggctcctcaccaggg

SEQ ID NO: 52582 - DNA, 20 bp, Artificial Sequence
  chemically synthesized
ggccggctcctcaccaggga

SEQ ID NO: 52583 - DNA, 20 bp, Artificial Sequence
  chemically synthesized
gccggctcctcaccagggag

SEQ ID NO: 52584 - DNA, 20 bp, Artificial Sequence
  chemically synthesized
ccggctcctcaccagggagg

SEQ ID NO: 52585 - DNA, 20 bp, Artificial Sequence
  chemically synthesized
caccagggagggggtcatca

SEQ ID NO: 52586 - DNA, 20 bp, Artificial Sequence
  chemically synthesized
gggtcatcacagcacttgcc

SEQ ID NO: 52587 - DNA, 20 bp, Artificial Sequence
  chemically synthesized
ggtcatcacagcacttgcct

SEQ ID NO: 52588 - DNA, 20 bp, Artificial Sequence
  chemically synthesized
tcatcacagcacttgcctgg

SEQ ID NO: 52589 - DNA, 20 bp, Artificial Sequence
  chemically synthesized
catcacagcacttgcctggg

SEQ ID NO: 52590 - DNA, 20 bp, Artificial Sequence
  chemically synthesized
atcacagcacttgcctggga

SEQ ID NO: 52591 - DNA, 20 bp, Artificial Sequence
  chemically synthesized
cttgcctgggagggtcaaat

SEQ ID NO: 52592 - DNA, 20 bp, Artificial Sequence
  chemically synthesized
ttgcctgggagggtcaaatg

SEQ ID NO: 52593 - DNA, 20 bp, Artificial Sequence
  chemically synthesized
tgcctgggagggtcaaatga

SEQ ID NO: 52594 - DNA, 20 bp, Artificial Sequence
  chemically synthesized
tgggagggtcaaatgagggt

SEQ ID NO: 52595 - DNA, 20 bp, Artificial Sequence
  chemically synthesized
agggtcaaatgagggtcagc

SEQ ID NO: 52596 - DNA, 20 bp, Artificial Sequence
  chemically synthesized
gggtcaaatgagggtcagcg

SEQ ID NO: 52597 - DNA, 20 bp, Artificial Sequence
  chemically synthesized
tcaaatgagggtcagcgagg

SEQ ID NO: 52598 - DNA, 20 bp, Artificial Sequence
  chemically synthesized
aatgagggtcagcgaggtgg

SEQ ID NO: 52599 - DNA, 20 bp, Artificial Sequence
  chemically synthesized
tcagcgaggtggcagatgct

SEQ ID NO: 52600 - DNA, 20 bp, Artificial Sequence
  chemically synthesized
aggtggcagatgctgagtac

SEQ ID NO: 52601 - DNA, 20 bp, Artificial Sequence
  chemically synthesized
tggcagatgctgagtaccag

SEQ ID NO: 52602 - DNA, 20 bp, Artificial Sequence
  chemically synthesized
cagatgctgagtaccagtgg

SEQ ID NO: 52603 - DNA, 20 bp, Artificial Sequence
  chemically synthesized
atgttgcacacatcctgcta

SEQ ID NO: 52604 - DNA, 20 bp, Artificial Sequence
  chemically synthesized
tgttgcacacatcctgctat

SEQ ID NO: 52605 - DNA, 20 bp, Artificial Sequence
  chemically synthesized
gttgcacacatcctgctatg

SEQ ID NO: 52606 - DNA, 20 bp, Artificial Sequence
  chemically synthesized
gcacacatcctgctatgggg

SEQ ID NO: 52607 - DNA, 20 bp, Artificial Sequence
  chemically synthesized
cacatcctgctatggggcag

SEQ ID NO: 52608 - DNA, 20 bp, Artificial Sequence
  chemically synthesized
gccacactccccgacctcct

SEQ ID NO: 52609 - DNA, 20 bp, Artificial Sequence
  chemically synthesized
ccacactccccgacctcctg

SEQ ID NO: 52610 - DNA, 20 bp, Artificial Sequence
  chemically synthesized
cactccccgacctcctgagg

SEQ ID NO: 52611 - DNA, 20 bp, Artificial Sequence
  chemically synthesized
actccccgacctcctgaggt

SEQ ID NO: 52612 - DNA, 20 bp, Artificial Sequence
  chemically synthesized
ctccccgacctcctgaggtg

SEQ ID NO: 52613 - DNA, 20 bp, Artificial Sequence
  chemically synthesized
taacttctgcctgccattca

SEQ ID NO: 52614 - DNA, 20 bp, Artificial Sequence
  chemically synthesized
aacttctgcctgccattcat

SEQ ID NO: 52615 - DNA, 20 bp, Artificial Sequence
  chemically synthesized
acttctgcctgccattcatg

SEQ ID NO: 52616 - DNA, 20 bp, Artificial Sequence
  chemically synthesized
tggggcatttgtcacactgt

SEQ ID NO: 52617 - DNA, 20 bp, Artificial Sequence
  chemically synthesized
ggggcatttgtcacactgtt

SEQ ID NO: 52618 - DNA, 20 bp, Artificial Sequence
  chemically synthesized
gggcatttgtcacactgttg

SEQ ID NO: 52619 - DNA, 20 bp, Artificial Sequence
  chemically synthesized
actgttggggcttccacgtt

SEQ ID NO: 52620 - DNA, 20 bp, Artificial Sequence
  chemically synthesized
gtttagttttctctccccat

SEQ ID NO: 52621 - DNA, 20 bp, Artificial Sequence
  chemically synthesized
agttttctctccccataagc

SEQ ID NO: 52622 - DNA, 20 bp, Artificial Sequence
  chemically synthesized
ccataagctagcaattcctt

SEQ ID NO: 52623 - DNA, 20 bp, Artificial Sequence
  chemically synthesized
ataagctagcaattccttga

SEQ ID NO: 52624 - DNA, 20 bp, Artificial Sequence
  chemically synthesized
aagctagcaattccttgaga

SEQ ID NO: 52625 - DNA, 20 bp, Artificial Sequence
  chemically synthesized
agctagcaattccttgagag

SEQ ID NO: 52626 - DNA, 20 bp, Artificial Sequence
  chemically synthesized
tacttgcctttatccccgca

SEQ ID NO: 52627 - DNA, 20 bp, Artificial Sequence
  chemically synthesized
cttgcctttatccccgcaca

SEQ ID NO: 52628 - DNA, 20 bp, Artificial Sequence
  chemically synthesized
tccccgcacagagcacttca

SEQ ID NO: 52629 - DNA, 20 bp, Artificial Sequence
  chemically synthesized
ccccgcacagagcacttcac

SEQ ID NO: 52630 - DNA, 20 bp, Artificial Sequence
  chemically synthesized
gagcacttcacaggctgtgc

SEQ ID NO: 52631 - DNA, 20 bp, Artificial Sequence
  chemically synthesized
agcacttcacaggctgtgca

SEQ ID NO: 52632 - DNA, 20 bp, Artificial Sequence
  chemically synthesized
gtgcaaggtaatgctccact

SEQ ID NO: 52633 - DNA, 20 bp, Artificial Sequence
  chemically synthesized
tgcaaggtaatgctccactg

SEQ ID NO: 52634 - DNA, 20 bp, Artificial Sequence
  chemically synthesized
tgaggacacattctcgccta

SEQ ID NO: 52635 - DNA, 20 bp, Artificial Sequence
  chemically synthesized
gaggacacattctcgcctat

SEQ ID NO: 52636 - DNA, 20 bp, Artificial Sequence
  chemically synthesized
attctcgcctatgggaactc

SEQ ID NO: 52637 - DNA, 20 bp, Artificial Sequence
  chemically synthesized
tctcgcctatgggaactctg

SEQ ID NO: 52638 - DNA, 20 bp, Artificial Sequence
  chemically synthesized
ctcgcctatgggaactctgg

SEQ ID NO: 52639 - DNA, 20 bp, Artificial Sequence
  chemically synthesized
gcctatgggaactctggagg

SEQ ID NO: 52640 - DNA, 20 bp, Artificial Sequence
  chemically synthesized
cctatgggaactctggaggc

SEQ ID NO: 52641 - DNA, 20 bp, Artificial Sequence
  chemically synthesized
ctatgggaactctggaggca

SEQ ID NO: 52642 - DNA, 20 bp, Artificial Sequence
  chemically synthesized
actctggaggcagggctttg

SEQ ID NO: 52643 - DNA, 20 bp, Artificial Sequence
  chemically synthesized
tctggaggcagggctttgtg

SEQ ID NO: 52644 - DNA, 20 bp, Artificial Sequence
  chemically synthesized
ctggaggcagggctttgtgg

SEQ ID NO: 52645 - DNA, 20 bp, Artificial Sequence
  chemically synthesized
tggaggcagggctttgtgga

SEQ ID NO: 52646 - DNA, 20 bp, Artificial Sequence
  chemically synthesized
ggaggcagggctttgtggag

SEQ ID NO: 52647 - DNA, 20 bp, Artificial Sequence
  chemically synthesized
gctttgtggaggggctgcca

SEQ ID NO: 52648 - DNA, 20 bp, Artificial Sequence
  chemically synthesized
ctttgtggaggggctgccac

SEQ ID NO: 52649 - DNA, 20 bp, Artificial Sequence
  chemically synthesized
cacaggcttatgttgcctcc

SEQ ID NO: 52650 - DNA, 20 bp, Artificial Sequence
  chemically synthesized
acaggcttatgttgcctcct

SEQ ID NO: 52651 - DNA, 20 bp, Artificial Sequence
  chemically synthesized
ttgcctcctaggatttccca

SEQ ID NO: 52652 - DNA, 20 bp, Artificial Sequence
  chemically synthesized
tgcctcctaggatttcccat

SEQ ID NO: 52653 - DNA, 20 bp, Artificial Sequence
  chemically synthesized
cctaggatttcccatgggcc

SEQ ID NO: 52654 - DNA, 20 bp, Artificial Sequence
  chemically synthesized
taggatttcccatgggccaa

SEQ ID NO: 52655 - DNA, 20 bp, Artificial Sequence
  chemically synthesized
aggatttcccatgggccaag

SEQ ID NO: 52656 - DNA, 20 bp, Artificial Sequence
  chemically synthesized
ggatttcccatgggccaaga

SEQ ID NO: 52657 - DNA, 20 bp, Artificial Sequence
  chemically synthesized
ccatgggccaagagggaaaa

SEQ ID NO: 52658 - DNA, 20 bp, Artificial Sequence
  chemically synthesized
catgggccaagagggaaaat

SEQ ID NO: 52659 - DNA, 20 bp, Artificial Sequence
  chemically synthesized
atgggccaagagggaaaatg

SEQ ID NO: 52660 - DNA, 20 bp, Artificial Sequence
  chemically synthesized
tgggccaagagggaaaatgg

SEQ ID NO: 52661 - DNA, 20 bp, Artificial Sequence
  chemically synthesized
agagggaaaatgggggtcgc

SEQ ID NO: 52662 - DNA, 20 bp, Artificial Sequence
  chemically synthesized
gagggaaaatgggggtcgct

SEQ ID NO: 52663 - DNA, 20 bp, Artificial Sequence
  chemically synthesized
agggaaaatgggggtcgctg

SEQ ID NO: 52664 - DNA, 20 bp, Artificial Sequence
  chemically synthesized
gaaaatgggggtcgctgggg

SEQ ID NO: 52665 - DNA, 20 bp, Artificial Sequence
  chemically synthesized
gtcgctggggtggccatccc

SEQ ID NO: 52666 - DNA, 20 bp, Artificial Sequence
  chemically synthesized
gctggggtggccatccctgg

SEQ ID NO: 52667 - DNA, 20 bp, Artificial Sequence
  chemically synthesized
tggcccctcctcatgcatcc

SEQ ID NO: 52668 - DNA, 20 bp, Artificial Sequence
  chemically synthesized
gcccctcctcatgcatcctg

SEQ ID NO: 52669 - DNA, 20 bp, Artificial Sequence
  chemically synthesized
ccctcctcatgcatcctgga

SEQ ID NO: 52670 - DNA, 20 bp, Artificial Sequence
  chemically synthesized
tcatgcatcctggagagctg

SEQ ID NO: 52671 - DNA, 20 bp, Artificial Sequence
  chemically synthesized
catgcatcctggagagctgt

SEQ ID NO: 52672 - DNA, 20 bp, Artificial Sequence
  chemically synthesized
agctgtgggcctcctctcca

SEQ ID NO: 52673 - DNA, 20 bp, Artificial Sequence
  chemically synthesized
gctgtgggcctcctctccac

SEQ ID NO: 52674 - DNA, 20 bp, Artificial Sequence
  chemically synthesized
cctcctctccacaggctttg

SEQ ID NO: 52675 - DNA, 20 bp, Artificial Sequence
  chemically synthesized
caggctttgtggatcttctt

SEQ ID NO: 52676 - DNA, 20 bp, Artificial Sequence
  chemically synthesized
ggctttgtggatcttcttca

SEQ ID NO: 52677 - DNA, 20 bp, Artificial Sequence
  chemically synthesized
ttgtggatcttcttcagagc

SEQ ID NO: 52678 - DNA, 20 bp, Artificial Sequence
  chemically synthesized
ggatcttcttcagagccagt

SEQ ID NO: 52679 - DNA, 20 bp, Artificial Sequence
  chemically synthesized
cttcttcagagccagtgagt

SEQ ID NO: 52680 - DNA, 20 bp, Artificial Sequence
  chemically synthesized
ccagtgagtcagccttgctg

SEQ ID NO: 52681 - DNA, 20 bp, Artificial Sequence
  chemically synthesized
gtgagtcagccttgctgtgg

SEQ ID NO: 52682 - DNA, 20 bp, Artificial Sequence
  chemically synthesized
gccttgctgtggtggcccac

SEQ ID NO: 52683 - DNA, 20 bp, Artificial Sequence
  chemically synthesized
ccttgctgtggtggcccaca

SEQ ID NO: 52684 - DNA, 20 bp, Artificial Sequence
  chemically synthesized
ttgctgtggtggcccacaag

SEQ ID NO: 52685 - DNA, 20 bp, Artificial Sequence
  chemically synthesized
ctgtggtggcccacaaggag

SEQ ID NO: 52686 - DNA, 20 bp, Artificial Sequence
  chemically synthesized
gtggtggcccacaaggagtg

SEQ ID NO: 52687 - DNA, 20 bp, Artificial Sequence
  chemically synthesized
cccacaaggagtggagatga

SEQ ID NO: 52688 - DNA, 20 bp, Artificial Sequence
  chemically synthesized
cacaaggagtggagatgaca

SEQ ID NO: 52689 - DNA, 20 bp, Artificial Sequence
  chemically synthesized
acaaggagtggagatgacag

SEQ ID NO: 52690 - DNA, 20 bp, Artificial Sequence
  chemically synthesized
caaggagtggagatgacaga

SEQ ID NO: 52691 - DNA, 20 bp, Artificial Sequence
  chemically synthesized
gtggagatgacagagggcct

SEQ ID NO: 52692 - DNA, 20 bp, Artificial Sequence
  chemically synthesized
tggagatgacagagggcctt

SEQ ID NO: 52693 - DNA, 20 bp, Artificial Sequence
  chemically synthesized
ggagatgacagagggccttg

SEQ ID NO: 52694 - DNA, 20 bp, Artificial Sequence
  chemically synthesized
atgacagagggccttgggga

SEQ ID NO: 52695 - DNA, 20 bp, Artificial Sequence
  chemically synthesized
tgacagagggccttggggac

SEQ ID NO: 52696 - DNA, 20 bp, Artificial Sequence
  chemically synthesized
gacagagggccttggggaca

SEQ ID NO: 52697 - DNA, 20 bp, Artificial Sequence
  chemically synthesized
gggccttggggacagggcaa

SEQ ID NO: 52698 - DNA, 20 bp, Artificial Sequence
  chemically synthesized
cagggcaaaagctcatgtga

SEQ ID NO: 52699 - DNA, 20 bp, Artificial Sequence
  chemically synthesized
agggcaaaagctcatgtgat

SEQ ID NO: 52700 - DNA, 20 bp, Artificial Sequence
  chemically synthesized
gggcaaaagctcatgtgata

SEQ ID NO: 52701 - DNA, 20 bp, Artificial Sequence
  chemically synthesized
atgctgtctctgcaaccaca

SEQ ID NO: 52702 - DNA, 20 bp, Artificial Sequence
  chemically synthesized
tgcaaccacatggattttaa

SEQ ID NO: 52703 - DNA, 20 bp, Artificial Sequence
  chemically synthesized
tggattttaatagttaccca

SEQ ID NO: 52704 - DNA, 20 bp, Artificial Sequence
  chemically synthesized
ttttaatagttacccatggc

SEQ ID NO: 52705 - DNA, 20 bp, Artificial Sequence
  chemically synthesized
tagttacccatggctggctt

SEQ ID NO: 52706 - DNA, 20 bp, Artificial Sequence
  chemically synthesized
gcttcagctttttttgtgaa

SEQ ID NO: 52707 - DNA, 20 bp, Artificial Sequence
  chemically synthesized
tcagctttttttgtgaatgg

SEQ ID NO: 52708 - DNA, 20 bp, Artificial Sequence
  chemically synthesized
ttttgtgaatggcagccaaa

SEQ ID NO: 52709 - DNA, 20 bp, Artificial Sequence
  chemically synthesized
tgaatggcagccaaaaagtg

SEQ ID NO: 52710 - DNA, 20 bp, Artificial Sequence
  chemically synthesized
gccaaaaagtgtggtgaaaa

SEQ ID NO: 52711 - DNA, 20 bp, Artificial Sequence
  chemically synthesized
caaaaagtgtggtgaaaatg

SEQ ID NO: 52712 - DNA, 20 bp, Artificial Sequence
  chemically synthesized
aaaaagtgtggtgaaaatgg

SEQ ID NO: 52713 - DNA, 20 bp, Artificial Sequence
  chemically synthesized
aaaagtgtggtgaaaatgga

SEQ ID NO: 52714 - DNA, 20 bp, Artificial Sequence
  chemically synthesized
gtgtggtgaaaatggaggga

SEQ ID NO: 52715 - DNA, 20 bp, Artificial Sequence
  chemically synthesized
gtgaaaatggagggatagtt

SEQ ID NO: 52716 - DNA, 20 bp, Artificial Sequence
  chemically synthesized
aaaatggagggatagttcag

SEQ ID NO: 52717 - DNA, 20 bp, Artificial Sequence
  chemically synthesized
aatggagggatagttcagtg

SEQ ID NO: 52718 - DNA, 20 bp, Artificial Sequence
  chemically synthesized
gagggatagttcagtggaga

SEQ ID NO: 52719 - DNA, 20 bp, Artificial Sequence
  chemically synthesized
gggatagttcagtggagaca

SEQ ID NO: 52720 - DNA, 20 bp, Artificial Sequence
  chemically synthesized
ggatagttcagtggagacag

SEQ ID NO: 52721 - DNA, 20 bp, Artificial Sequence
  chemically synthesized
gatagttcagtggagacaga

SEQ ID NO: 52722 - DNA, 20 bp, Artificial Sequence
  chemically synthesized
atagttcagtggagacagag

SEQ ID NO: 52723 - DNA, 20 bp, Artificial Sequence
  chemically synthesized
agttcagtggagacagaggg

SEQ ID NO: 52724 - DNA, 20 bp, Artificial Sequence
  chemically synthesized
aggggagactgttgaatttg

SEQ ID NO: 52725 - DNA, 20 bp, Artificial Sequence
  chemically synthesized
gggagactgttgaatttgtg

SEQ ID NO: 52726 - DNA, 20 bp, Artificial Sequence
  chemically synthesized
tgttgaatttgtggagtttt

SEQ ID NO: 52727 - DNA, 20 bp, Artificial Sequence
  chemically synthesized
agtttttagttcttcctaaa

SEQ ID NO: 52728 - DNA, 20 bp, Artificial Sequence
  chemically synthesized
tttttagttcttcctaaaca

SEQ ID NO: 52729 - DNA, 20 bp, Artificial Sequence
  chemically synthesized
tttagttcttcctaaacaga

SEQ ID NO: 52730 - DNA, 20 bp, Artificial Sequence
  chemically synthesized
tcttcctaaacagagagcaa

SEQ ID NO: 52731 - DNA, 20 bp, Artificial Sequence
  chemically synthesized
ctaaacagagagcaacagac

SEQ ID NO: 52732 - DNA, 20 bp, Artificial Sequence
  chemically synthesized
aaacagagagcaacagacaa

SEQ ID NO: 52733 - DNA, 20 bp, Artificial Sequence
  chemically synthesized
agagcaacagacaagagtta

SEQ ID NO: 52734 - DNA, 20 bp, Artificial Sequence
  chemically synthesized
gttaatttaccctcaactac

SEQ ID NO: 52735 - DNA, 20 bp, Artificial Sequence
  chemically synthesized
tttaccctcaactactggcc

SEQ ID NO: 52736 - DNA, 20 bp, Artificial Sequence
  chemically synthesized
accctcaactactggccaag

SEQ ID NO: 52737 - DNA, 20 bp, Artificial Sequence
  chemically synthesized
ccctcaactactggccaaga

SEQ ID NO: 52738 - DNA, 20 bp, Artificial Sequence
  chemically synthesized
cctcaactactggccaagaa

SEQ ID NO: 52739 - DNA, 20 bp, Artificial Sequence
  chemically synthesized
ctcaactactggccaagaag

SEQ ID NO: 52740 - DNA, 20 bp, Artificial Sequence
  chemically synthesized
ggccaagaaggggtgtaact

SEQ ID NO: 52741 - DNA, 20 bp, Artificial Sequence
  chemically synthesized
gttttcttcttttgtgccct

SEQ ID NO: 52742 - DNA, 20 bp, Artificial Sequence
  chemically synthesized
ttcttcttttgtgccctgag

SEQ ID NO: 52743 - DNA, 20 bp, Artificial Sequence
  chemically synthesized
ttcttttgtgccctgagtag

SEQ ID NO: 52744 - DNA, 20 bp, Artificial Sequence
  chemically synthesized
tgtgccctgagtagcagacc

SEQ ID NO: 52745 - DNA, 20 bp, Artificial Sequence
  chemically synthesized
tgccctgagtagcagaccca

SEQ ID NO: 52746 - DNA, 20 bp, Artificial Sequence
  chemically synthesized
tgagtagcagacccagagtc

SEQ ID NO: 52747 - DNA, 20 bp, Artificial Sequence
  chemically synthesized
agtagcagacccagagtctg

SEQ ID NO: 52748 - DNA, 20 bp, Artificial Sequence
  chemically synthesized
agacccagagtctggagacc

SEQ ID NO: 52749 - DNA, 20 bp, Artificial Sequence
  chemically synthesized
gagtctggagacccagattc

SEQ ID NO: 52750 - DNA, 20 bp, Artificial Sequence
  chemically synthesized
agtctggagacccagattct

SEQ ID NO: 52751 - DNA, 20 bp, Artificial Sequence
  chemically synthesized
ggagacccagattctaggcc

SEQ ID NO: 52752 - DNA, 20 bp, Artificial Sequence
  chemically synthesized
cccagattctaggcctggct

SEQ ID NO: 52753 - DNA, 20 bp, Artificial Sequence
  chemically synthesized
ggcctggcttggccaacgac

SEQ ID NO: 52754 - DNA, 20 bp, Artificial Sequence
  chemically synthesized
ctggcttggccaacgacaag

SEQ ID NO: 52755 - DNA, 20 bp, Artificial Sequence
  chemically synthesized
tggcttggccaacgacaagc

SEQ ID NO: 52756 - DNA, 20 bp, Artificial Sequence
  chemically synthesized
ggcttggccaacgacaagca

SEQ ID NO: 52757 - DNA, 20 bp, Artificial Sequence
  chemically synthesized
aacgacaagcagggtgacct

SEQ ID NO: 52758 - DNA, 20 bp, Artificial Sequence
  chemically synthesized
acgacaagcagggtgacctt

SEQ ID NO: 52759 - DNA, 20 bp, Artificial Sequence
  chemically synthesized
ccttgggttaaaaaaaaaaa

SEQ ID NO: 52760 - DNA, 20 bp, Artificial Sequence
  chemically synthesized
cttgggttaaaaaaaaaaaa

SEQ ID NO: 52761 - DNA, 20 bp, Artificial Sequence
  chemically synthesized
aaaaaaaggcatcattctct

SEQ ID NO: 52762 - DNA, 20 bp, Artificial Sequence
  chemically synthesized
tctcactccctcttctcaaa

SEQ ID NO: 52763 - DNA, 20 bp, Artificial Sequence
  chemically synthesized
actccctcttctcaaaaaga

SEQ ID NO: 52764 - DNA, 20 bp, Artificial Sequence
  chemically synthesized
gatggcaattcctcccccgc

SEQ ID NO: 52765 - DNA, 20 bp, Artificial Sequence
  chemically synthesized
cctcccccgctggttttcca

SEQ ID NO: 52766 - DNA, 20 bp, Artificial Sequence
  chemically synthesized
cccgctggttttccatagtt

SEQ ID NO: 52767 - DNA, 20 bp, Artificial Sequence
  chemically synthesized
ccgctggttttccatagttg

SEQ ID NO: 52768 - DNA, 20 bp, Artificial Sequence
  chemically synthesized
ctggttttccatagttgagg

SEQ ID NO: 52769 - DNA, 20 bp, Artificial Sequence
  chemically synthesized
ttttccatagttgaggtagc

SEQ ID NO: 52770 - DNA, 20 bp, Artificial Sequence
  chemically synthesized
gaggtagcaagccaatgtgt

SEQ ID NO: 52771 - DNA, 20 bp, Artificial Sequence
  chemically synthesized
aggtagcaagccaatgtgtt

SEQ ID NO: 52772 - DNA, 20 bp, Artificial Sequence
  chemically synthesized
ggtagcaagccaatgtgttg

SEQ ID NO: 52773 - DNA, 20 bp, Artificial Sequence
  chemically synthesized
agcaagccaatgtgttgggg

SEQ ID NO: 52774 - DNA, 20 bp, Artificial Sequence
  chemically synthesized
gaaaacgccctgtgcatact

SEQ ID NO: 52775 - DNA, 20 bp, Artificial Sequence
  chemically synthesized
aaaacgccctgtgcatactg

SEQ ID NO: 52776 - DNA, 20 bp, Artificial Sequence
  chemically synthesized
atactgaggcttatgttcca

SEQ ID NO: 52777 - DNA, 20 bp, Artificial Sequence
  chemically synthesized
tactgaggcttatgttccat

SEQ ID NO: 52778 - DNA, 20 bp, Artificial Sequence
  chemically synthesized
actgaggcttatgttccatg

SEQ ID NO: 52779 - DNA, 20 bp, Artificial Sequence
  chemically synthesized
ctgaggcttatgttccatgg

SEQ ID NO: 52780 - DNA, 20 bp, Artificial Sequence
  chemically synthesized
tgaggcttatgttccatggg

SEQ ID NO: 52781 - DNA, 20 bp, Artificial Sequence
  chemically synthesized
gcttatgttccatggggggc

SEQ ID NO: 52782 - DNA, 20 bp, Artificial Sequence
  chemically synthesized
cttatgttccatggggggcc

SEQ ID NO: 52783 - DNA, 20 bp, Artificial Sequence
  chemically synthesized
ttatgttccatggggggcca

SEQ ID NO: 52784 - DNA, 20 bp, Artificial Sequence
  chemically synthesized
tatgttccatggggggccag

SEQ ID NO: 52785 - DNA, 20 bp, Artificial Sequence
  chemically synthesized
ttccatggggggccaggggc

SEQ ID NO: 52786 - DNA, 20 bp, Artificial Sequence
  chemically synthesized
tccatggggggccaggggcc

SEQ ID NO: 52787 - DNA, 20 bp, Artificial Sequence
  chemically synthesized
tggggggccaggggccagga

SEQ ID NO: 52788 - DNA, 20 bp, Artificial Sequence
  chemically synthesized
gccaggggccaggacagtga

SEQ ID NO: 52789 - DNA, 20 bp, Artificial Sequence
  chemically synthesized
ccaggggccaggacagtgat

SEQ ID NO: 52790 - DNA, 20 bp, Artificial Sequence
  chemically synthesized
aggggccaggacagtgatgg

SEQ ID NO: 52791 - DNA, 20 bp, Artificial Sequence
  chemically synthesized
ggggccaggacagtgatggg

SEQ ID NO: 52792 - DNA, 20 bp, Artificial Sequence
  chemically synthesized
ggccaggacagtgatgggag

SEQ ID NO: 52793 - DNA, 20 bp, Artificial Sequence
  chemically synthesized
ggacagtgatgggaggagac

SEQ ID NO: 52794 - DNA, 20 bp, Artificial Sequence
  chemically synthesized
gacagtgatgggaggagaca

SEQ ID NO: 52795 - DNA, 20 bp, Artificial Sequence
  chemically synthesized
agtgatgggaggagacaagg

SEQ ID NO: 52796 - DNA, 20 bp, Artificial Sequence
  chemically synthesized
gggaggagacaaggcggata

SEQ ID NO: 52797 - DNA, 20 bp, Artificial Sequence
  chemically synthesized
gaggagacaaggcggataca

SEQ ID NO: 52798 - DNA, 20 bp, Artificial Sequence
  chemically synthesized
aggagacaaggcggatacag

SEQ ID NO: 52799 - DNA, 20 bp, Artificial Sequence
  chemically synthesized
gagacaaggcggatacagag

SEQ ID NO: 52800 - DNA, 20 bp, Artificial Sequence
  chemically synthesized
acaaggcggatacagaggag

SEQ ID NO: 52801 - DNA, 20 bp, Artificial Sequence
  chemically synthesized
gaggagcagattgtcatctc

SEQ ID NO: 52802 - DNA, 20 bp, Artificial Sequence
  chemically synthesized
agcagattgtcatctccagc

SEQ ID NO: 52803 - DNA, 20 bp, Artificial Sequence
  chemically synthesized
gcagattgtcatctccagct

SEQ ID NO: 52804 - DNA, 20 bp, Artificial Sequence
  chemically synthesized
agattgtcatctccagctgg

SEQ ID NO: 52805 - DNA, 20 bp, Artificial Sequence
  chemically synthesized
gattgtcatctccagctggg

SEQ ID NO: 52806 - DNA, 20 bp, Artificial Sequence
  chemically synthesized
catctccagctgggaggtga

SEQ ID NO: 52807 - DNA, 20 bp, Artificial Sequence
  chemically synthesized
tggccatgcctgcacccctc

SEQ ID NO: 52808 - DNA, 20 bp, Artificial Sequence
  chemically synthesized
catgcctgcacccctctggc

SEQ ID NO: 52809 - DNA, 20 bp, Artificial Sequence
  chemically synthesized
gcctgcacccctctggccag

SEQ ID NO: 52810 - DNA, 20 bp, Artificial Sequence
  chemically synthesized
ctgcacccctctggccagca

SEQ ID NO: 52811 - DNA, 20 bp, Artificial Sequence
  chemically synthesized
tgcacccctctggccagcag

SEQ ID NO: 52812 - DNA, 20 bp, Artificial Sequence
  chemically synthesized
gcacccctctggccagcaga

SEQ ID NO: 52813 - DNA, 20 bp, Artificial Sequence
  chemically synthesized
cccctctggccagcagaggg

SEQ ID NO: 52814 - DNA, 20 bp, Artificial Sequence
  chemically synthesized
tctggccagcagagggtggt

SEQ ID NO: 52815 - DNA, 20 bp, Artificial Sequence
  chemically synthesized
ggccagcagagggtggtcag

SEQ ID NO: 52816 - DNA, 20 bp, Artificial Sequence
  chemically synthesized
gccagcagagggtggtcagt

SEQ ID NO: 52817 - DNA, 20 bp, Artificial Sequence
  chemically synthesized
gagggtggtcagtaggaaac

SEQ ID NO: 52818 - DNA, 20 bp, Artificial Sequence
  chemically synthesized
agggtggtcagtaggaaact

SEQ ID NO: 52819 - DNA, 20 bp, Artificial Sequence
  chemically synthesized
ggtggtcagtaggaaactgg

SEQ ID NO: 52820 - DNA, 20 bp, Artificial Sequence
  chemically synthesized
gtggtcagtaggaaactggg

SEQ ID NO: 52821 - DNA, 20 bp, Artificial Sequence
  chemically synthesized
gtaggaaactgggaggccat

SEQ ID NO: 52822 - DNA, 20 bp, Artificial Sequence
  chemically synthesized
taggaaactgggaggccatt

SEQ ID NO: 52823 - DNA, 20 bp, Artificial Sequence
  chemically synthesized
aggaaactgggaggccatta

SEQ ID NO: 52824 - DNA, 20 bp, Artificial Sequence
  chemically synthesized
ccattagggcaaccttctat

SEQ ID NO: 52825 - DNA, 20 bp, Artificial Sequence
  chemically synthesized
agggcaaccttctattggct

SEQ ID NO: 52826 - DNA, 20 bp, Artificial Sequence
  chemically synthesized
accttctattggctcagact

SEQ ID NO: 52827 - DNA, 20 bp, Artificial Sequence
  chemically synthesized
attggctcagactcagaatg

SEQ ID NO: 52828 - DNA, 20 bp, Artificial Sequence
  chemically synthesized
ggctcagactcagaatgcag

SEQ ID NO: 52829 - DNA, 20 bp, Artificial Sequence
  chemically synthesized
gcagtagaacttgtgccctg

SEQ ID NO: 52830 - DNA, 20 bp, Artificial Sequence
  chemically synthesized
cttgtgccctgtagtgttca

SEQ ID NO: 52831 - DNA, 20 bp, Artificial Sequence
  chemically synthesized
tgccctgtagtgttcatgga

SEQ ID NO: 52832 - DNA, 20 bp, Artificial Sequence
  chemically synthesized
gccctgtagtgttcatggac

SEQ ID NO: 52833 - DNA, 20 bp, Artificial Sequence
  chemically synthesized
cctgtagtgttcatggacag

SEQ ID NO: 52834 - DNA, 20 bp, Artificial Sequence
  chemically synthesized
tagtgttcatggacaggagt

SEQ ID NO: 52835 - DNA, 20 bp, Artificial Sequence
  chemically synthesized
gtgttcatggacaggagtga

SEQ ID NO: 52836 - DNA, 20 bp, Artificial Sequence
  chemically synthesized
tgttcatggacaggagtgag

SEQ ID NO: 52837 - DNA, 20 bp, Artificial Sequence
  chemically synthesized
ttcatggacaggagtgagag

SEQ ID NO: 52838 - DNA, 20 bp, Artificial Sequence
  chemically synthesized
tcatggacaggagtgagagg

SEQ ID NO: 52839 - DNA, 20 bp, Artificial Sequence
  chemically synthesized
ggacaggagtgagaggagga

SEQ ID NO: 52840 - DNA, 20 bp, Artificial Sequence
  chemically synthesized
gacaggagtgagaggaggac

SEQ ID NO: 52841 - DNA, 20 bp, Artificial Sequence
  chemically synthesized
agtgagaggaggacaggact

SEQ ID NO: 52842 - DNA, 20 bp, Artificial Sequence
  chemically synthesized
gtgagaggaggacaggactg

SEQ ID NO: 52843 - DNA, 20 bp, Artificial Sequence
  chemically synthesized
tgagaggaggacaggactga

SEQ ID NO: 52844 - DNA, 20 bp, Artificial Sequence
  chemically synthesized
gagaggaggacaggactgag

SEQ ID NO: 52845 - DNA, 20 bp, Artificial Sequence
  chemically synthesized
aggacaggactgaggggatg

SEQ ID NO: 52846 - DNA, 20 bp, Artificial Sequence
  chemically synthesized
actgaggggatgtggctgtc

SEQ ID NO: 52847 - DNA, 20 bp, Artificial Sequence
  chemically synthesized
ctgaggggatgtggctgtca

SEQ ID NO: 52848 - DNA, 20 bp, Artificial Sequence
  chemically synthesized
tgtggctgtcaaggcctttc

SEQ ID NO: 52849 - DNA, 20 bp, Artificial Sequence
  chemically synthesized
gtggctgtcaaggcctttct

SEQ ID NO: 52850 - DNA, 20 bp, Artificial Sequence
  chemically synthesized
tggctgtcaaggcctttcta

SEQ ID NO: 52851 - DNA, 20 bp, Artificial Sequence
  chemically synthesized
ggctgtcaaggcctttctag

SEQ ID NO: 52852 - DNA, 20 bp, Artificial Sequence
  chemically synthesized
gggcgatgctgtctctccct

SEQ ID NO: 52853 - DNA, 20 bp, Artificial Sequence
  chemically synthesized
atgctgtctctccctcagca

SEQ ID NO: 52854 - DNA, 20 bp, Artificial Sequence
  chemically synthesized
tgctgtctctccctcagcat

SEQ ID NO: 52855 - DNA, 20 bp, Artificial Sequence
  chemically synthesized
gctgtctctccctcagcata

SEQ ID NO: 52856 - DNA, 20 bp, Artificial Sequence
  chemically synthesized
tgtctctccctcagcatagg

SEQ ID NO: 52857 - DNA, 20 bp, Artificial Sequence
  chemically synthesized
ctctccctcagcatagggag

SEQ ID NO: 52858 - DNA, 20 bp, Artificial Sequence
  chemically synthesized
tctccctcagcatagggagt

SEQ ID NO: 52859 - DNA, 20 bp, Artificial Sequence
  chemically synthesized
ggagtgggcccttccacctc

SEQ ID NO: 52860 - DNA, 20 bp, Artificial Sequence
  chemically synthesized
cacctctggcctctctcccc

SEQ ID NO: 52861 - DNA, 20 bp, Artificial Sequence
  chemically synthesized
acctctggcctctctccccc

SEQ ID NO: 52862 - DNA, 20 bp, Artificial Sequence
  chemically synthesized
cctctggcctctctccccca

SEQ ID NO: 52863 - DNA, 20 bp, Artificial Sequence
  chemically synthesized
ctctcccccagggctgtgtc

SEQ ID NO: 52864 - DNA, 20 bp, Artificial Sequence
  chemically synthesized
gctgtccctgataaaactgt

SEQ ID NO: 52865 - DNA, 20 bp, Artificial Sequence
  chemically synthesized
tccctgataaaactgtgaga

SEQ ID NO: 52866 - DNA, 20 bp, Artificial Sequence
  chemically synthesized
taaaactgtgagatggtgtg

SEQ ID NO: 52867 - DNA, 20 bp, Artificial Sequence
  chemically synthesized
tgtgagatggtgtgcagtgt

SEQ ID NO: 52868 - DNA, 20 bp, Artificial Sequence
  chemically synthesized
tgagatggtgtgcagtgtcg

SEQ ID NO: 52869 - DNA, 20 bp, Artificial Sequence
  chemically synthesized
ggtgtgcagtgtcggagcat

SEQ ID NO: 52870 - DNA, 20 bp, Artificial Sequence
  chemically synthesized
gtgtgcagtgtcggagcatg

SEQ ID NO: 52871 - DNA, 20 bp, Artificial Sequence
  chemically synthesized
tgtcggagcatgaggccact

SEQ ID NO: 52872 - DNA, 20 bp, Artificial Sequence
  chemically synthesized
agcatgaggccactaagtgc

SEQ ID NO: 52873 - DNA, 20 bp, Artificial Sequence
  chemically synthesized
catgaggccactaagtgcca

SEQ ID NO: 52874 - DNA, 20 bp, Artificial Sequence
  chemically synthesized
agtttccgcgaccatatgaa

SEQ ID NO: 52875 - DNA, 20 bp, Artificial Sequence
  chemically synthesized
aaaagcgtcattccatccga

SEQ ID NO: 52876 - DNA, 20 bp, Artificial Sequence
  chemically synthesized
gtcattccatccgatggtcc

SEQ ID NO: 52877 - DNA, 20 bp, Artificial Sequence
  chemically synthesized
gtcccagtgttgcttgtgtg

SEQ ID NO: 52878 - DNA, 20 bp, Artificial Sequence
  chemically synthesized
cagtgttgcttgtgtgaaga

SEQ ID NO: 52879 - DNA, 20 bp, Artificial Sequence
  chemically synthesized
gcctcctaccttgattgcat

SEQ ID NO: 52880 - DNA, 20 bp, Artificial Sequence
  chemically synthesized
cctcctaccttgattgcatc

SEQ ID NO: 52881 - DNA, 20 bp, Artificial Sequence
  chemically synthesized
ctcctaccttgattgcatca

SEQ ID NO: 52882 - DNA, 20 bp, Artificial Sequence
  chemically synthesized
gcaatggccctgatgcaatc

SEQ ID NO: 52883 - DNA, 20 bp, Artificial Sequence
  chemically synthesized
caatggccctgatgcaatca

SEQ ID NO: 52884 - DNA, 20 bp, Artificial Sequence
  chemically synthesized
tggccctgatgcaatcaagg

SEQ ID NO: 52885 - DNA, 20 bp, Artificial Sequence
  chemically synthesized
ggccctgatgcaatcaaggt

SEQ ID NO: 52886 - DNA, 20 bp, Artificial Sequence
  chemically synthesized
ccctgatgcaatcaaggtag

SEQ ID NO: 52887 - DNA, 20 bp, Artificial Sequence
  chemically synthesized
cctgatgcaatcaaggtagg

SEQ ID NO: 52888 - DNA, 20 bp, Artificial Sequence
  chemically synthesized
gtaggaggctttcttcacac

SEQ ID NO: 52889 - DNA, 20 bp, Artificial Sequence
  chemically synthesized
tttcttcacacaagcaacac

SEQ ID NO: 52890 - DNA, 20 bp, Artificial Sequence
  chemically synthesized
ttcttcacacaagcaacact

SEQ ID NO: 52891 - DNA, 20 bp, Artificial Sequence
  chemically synthesized
acaagcaacactgggaccat

SEQ ID NO: 52892 - DNA, 20 bp, Artificial Sequence
  chemically synthesized
gcaacactgggaccatcgga

SEQ ID NO: 52893 - DNA, 20 bp, Artificial Sequence
  chemically synthesized
atggaatgacgcttttcata

SEQ ID NO: 52894 - DNA, 20 bp, Artificial Sequence
  chemically synthesized
tgacgcttttcatatggtcg

SEQ ID NO: 52895 - DNA, 20 bp, Artificial Sequence
  chemically synthesized
tcatatggtcgcggaaactc

SEQ ID NO: 52896 - DNA, 20 bp, Artificial Sequence
  chemically synthesized
gtcgcggaaactctggcact

SEQ ID NO: 52897 - DNA, 20 bp, Artificial Sequence
  chemically synthesized
gcggaaactctggcacttag

SEQ ID NO: 52898 - DNA, 20 bp, Artificial Sequence
  chemically synthesized
cgacactgcacaccatctca

SEQ ID NO: 52899 - DNA, 20 bp, Artificial Sequence
  chemically synthesized
acaccatctcacagttttat

SEQ ID NO: 52900 - DNA, 20 bp, Artificial Sequence
  chemically synthesized
caccatctcacagttttatc

SEQ ID NO: 52901 - DNA, 20 bp, Artificial Sequence
  chemically synthesized
accatctcacagttttatca

SEQ ID NO: 52902 - DNA, 20 bp, Artificial Sequence
  chemically synthesized
tctcacagttttatcaggga

SEQ ID NO: 52903 - DNA, 20 bp, Artificial Sequence
  chemically synthesized
acagttttatcagggacagc

SEQ ID NO: 52904 - DNA, 20 bp, Artificial Sequence
  chemically synthesized
ttatcagggacagccagaca

SEQ ID NO: 52905 - DNA, 20 bp, Artificial Sequence
  chemically synthesized
gggacagccagacacagccc

SEQ ID NO: 52906 - DNA, 20 bp, Artificial Sequence
  chemically synthesized
ggacagccagacacagccct

SEQ ID NO: 52907 - DNA, 20 bp, Artificial Sequence
  chemically synthesized
gacagccagacacagccctg

SEQ ID NO: 52908 - DNA, 20 bp, Artificial Sequence
  chemically synthesized
acagccagacacagccctgg

SEQ ID NO: 52909 - DNA, 20 bp, Artificial Sequence
  chemically synthesized
agccagacacagccctgggg

SEQ ID NO: 52910 - DNA, 20 bp, Artificial Sequence
  chemically synthesized
ccagacacagccctggggga

SEQ ID NO: 52911 - DNA, 20 bp, Artificial Sequence
  chemically synthesized
agacacagccctgggggaga

SEQ ID NO: 52912 - DNA, 20 bp, Artificial Sequence
  chemically synthesized
gacacagccctgggggagag

SEQ ID NO: 52913 - DNA, 20 bp, Artificial Sequence
  chemically synthesized
cagccctgggggagagaggc

SEQ ID NO: 52914 - DNA, 20 bp, Artificial Sequence
  chemically synthesized
gccctgggggagagaggcca

SEQ ID NO: 52915 - DNA, 20 bp, Artificial Sequence
  chemically synthesized
ccctgggggagagaggccag

SEQ ID NO: 52916 - DNA, 20 bp, Artificial Sequence
  chemically synthesized
tgggggagagaggccagagg

SEQ ID NO: 52917 - DNA, 20 bp, Artificial Sequence
  chemically synthesized
gggagagaggccagaggtgg

SEQ ID NO: 52918 - DNA, 20 bp, Artificial Sequence
  chemically synthesized
ggagagaggccagaggtgga

SEQ ID NO: 52919 - DNA, 20 bp, Artificial Sequence
  chemically synthesized
gagagaggccagaggtggaa

SEQ ID NO: 52920 - DNA, 20 bp, Artificial Sequence
  chemically synthesized
aagggcccactccctatgct

SEQ ID NO: 52921 - DNA, 20 bp, Artificial Sequence
  chemically synthesized
agggcccactccctatgctg

SEQ ID NO: 52922 - DNA, 20 bp, Artificial Sequence
  chemically synthesized
gggcccactccctatgctga

SEQ ID NO: 52923 - DNA, 20 bp, Artificial Sequence
  chemically synthesized
gcccactccctatgctgagg

SEQ ID NO: 52924 - DNA, 20 bp, Artificial Sequence
  chemically synthesized
ccactccctatgctgaggga

SEQ ID NO: 52925 - DNA, 20 bp, Artificial Sequence
  chemically synthesized
tccctatgctgagggagaga

SEQ ID NO: 52926 - DNA, 20 bp, Artificial Sequence
  chemically synthesized
gggagagacagcatcgcccc

SEQ ID NO: 52927 - DNA, 20 bp, Artificial Sequence
  chemically synthesized
gagacagcatcgcccctaga

SEQ ID NO: 52928 - DNA, 20 bp, Artificial Sequence
  chemically synthesized
agacagcatcgcccctagaa

SEQ ID NO: 52929 - DNA, 20 bp, Artificial Sequence
  chemically synthesized
cgcccctagaaaggccttga

SEQ ID NO: 52930 - DNA, 20 bp, Artificial Sequence
  chemically synthesized
ccttgacagccacatcccct

SEQ ID NO: 52931 - DNA, 20 bp, Artificial Sequence
  chemically synthesized
actcctgtccatgaacacta

SEQ ID NO: 52932 - DNA, 20 bp, Artificial Sequence
  chemically synthesized
ctcctgtccatgaacactac

SEQ ID NO: 52933 - DNA, 20 bp, Artificial Sequence
  chemically synthesized
tcctgtccatgaacactaca

SEQ ID NO: 52934 - DNA, 20 bp, Artificial Sequence
  chemically synthesized
ccatgaacactacagggcac

SEQ ID NO: 52935 - DNA, 20 bp, Artificial Sequence
  chemically synthesized
cacaagttctactgcattct

SEQ ID NO: 52936 - DNA, 20 bp, Artificial Sequence
  chemically synthesized
ttctactgcattctgagtct

SEQ ID NO: 52937 - DNA, 20 bp, Artificial Sequence
  chemically synthesized
gcattctgagtctgagccaa

SEQ ID NO: 52938 - DNA, 20 bp, Artificial Sequence
  chemically synthesized
ttctgagtctgagccaatag

SEQ ID NO: 52939 - DNA, 20 bp, Artificial Sequence
  chemically synthesized
tctgagtctgagccaataga

SEQ ID NO: 52940 - DNA, 20 bp, Artificial Sequence
  chemically synthesized
ccaatagaaggttgccctaa

SEQ ID NO: 52941 - DNA, 20 bp, Artificial Sequence
  chemically synthesized
aggttgccctaatggcctcc

SEQ ID NO: 52942 - DNA, 20 bp, Artificial Sequence
  chemically synthesized
tcctactgaccaccctctgc

SEQ ID NO: 52943 - DNA, 20 bp, Artificial Sequence
  chemically synthesized
actgaccaccctctgctggc

SEQ ID NO: 52944 - DNA, 20 bp, Artificial Sequence
  chemically synthesized
tgaccaccctctgctggcca

SEQ ID NO: 52945 - DNA, 20 bp, Artificial Sequence
  chemically synthesized
gaccaccctctgctggccag

SEQ ID NO: 52946 - DNA, 20 bp, Artificial Sequence
  chemically synthesized
accaccctctgctggccaga

SEQ ID NO: 52947 - DNA, 20 bp, Artificial Sequence
  chemically synthesized
ccaccctctgctggccagag

SEQ ID NO: 52948 - DNA, 20 bp, Artificial Sequence
  chemically synthesized
ctctgctggccagaggggtg

SEQ ID NO: 52949 - DNA, 20 bp, Artificial Sequence
  chemically synthesized
tctgctggccagaggggtgc

SEQ ID NO: 52950 - DNA, 20 bp, Artificial Sequence
  chemically synthesized
tggccagaggggtgcaggca

SEQ ID NO: 52951 - DNA, 20 bp, Artificial Sequence
  chemically synthesized
caggcatggccatcacctcc

SEQ ID NO: 52952 - DNA, 20 bp, Artificial Sequence
  chemically synthesized
catggccatcacctcccagc

SEQ ID NO: 52953 - DNA, 20 bp, Artificial Sequence
  chemically synthesized
tggccatcacctcccagctg

SEQ ID NO: 52954 - DNA, 20 bp, Artificial Sequence
  chemically synthesized
gtctcctcccatcactgtcc

SEQ ID NO: 52955 - DNA, 20 bp, Artificial Sequence
  chemically synthesized
cccatcactgtcctggcccc

SEQ ID NO: 52956 - DNA, 20 bp, Artificial Sequence
  chemically synthesized
tcctggcccctggcccccca

SEQ ID NO: 52957 - DNA, 20 bp, Artificial Sequence
  chemically synthesized
cctggccccccatggaacat

SEQ ID NO: 52958 - DNA, 20 bp, Artificial Sequence
  chemically synthesized
cccccatggaacataagcct

SEQ ID NO: 52959 - DNA, 20 bp, Artificial Sequence
  chemically synthesized
aacataagcctcagtatgca

SEQ ID NO: 52960 - DNA, 20 bp, Artificial Sequence
  chemically synthesized
acataagcctcagtatgcac

SEQ ID NO: 52961 - DNA, 20 bp, Artificial Sequence
  chemically synthesized
cataagcctcagtatgcaca

SEQ ID NO: 52962 - DNA, 20 bp, Artificial Sequence
  chemically synthesized
cagtatgcacagggcgtttt

SEQ ID NO: 52963 - DNA, 20 bp, Artificial Sequence
  chemically synthesized
tttcagctaccccaacacat

SEQ ID NO: 52964 - DNA, 20 bp, Artificial Sequence
  chemically synthesized
ttggcttgctacctcaacta

SEQ ID NO: 52965 - DNA, 20 bp, Artificial Sequence
  chemically synthesized
ctacctcaactatggaaaac

SEQ ID NO: 52966 - DNA, 20 bp, Artificial Sequence
  chemically synthesized
cctcaactatggaaaaccag

SEQ ID NO: 52967 - DNA, 20 bp, Artificial Sequence
  chemically synthesized
ctcaactatggaaaaccagc

SEQ ID NO: 52968 - DNA, 20 bp, Artificial Sequence
  chemically synthesized
tcaactatggaaaaccagcg

SEQ ID NO: 52969 - DNA, 20 bp, Artificial Sequence
  chemically synthesized
caactatggaaaaccagcgg

SEQ ID NO: 52970 - DNA, 20 bp, Artificial Sequence
  chemically synthesized
actatggaaaaccagcgggg

SEQ ID NO: 52971 - DNA, 20 bp, Artificial Sequence
  chemically synthesized
ctatggaaaaccagcggggg

SEQ ID NO: 52972 - DNA, 20 bp, Artificial Sequence
  chemically synthesized
ggaggaattgccatcttttt

SEQ ID NO: 52973 - DNA, 20 bp, Artificial Sequence
  chemically synthesized
ggaattgccatctttttgag

SEQ ID NO: 52974 - DNA, 20 bp, Artificial Sequence
  chemically synthesized
aattgccatctttttgagaa

SEQ ID NO: 52975 - DNA, 20 bp, Artificial Sequence
  chemically synthesized
attgccatctttttgagaag

SEQ ID NO: 52976 - DNA, 20 bp, Artificial Sequence
  chemically synthesized
ttgccatctttttgagaaga

SEQ ID NO: 52977 - DNA, 20 bp, Artificial Sequence
  chemically synthesized
gccatctttttgagaagagg

SEQ ID NO: 52978 - DNA, 20 bp, Artificial Sequence
  chemically synthesized
tctttttgagaagagggagt

SEQ ID NO: 52979 - DNA, 20 bp, Artificial Sequence
  chemically synthesized
tgagaagagggagtgagact

SEQ ID NO: 52980 - DNA, 20 bp, Artificial Sequence
  chemically synthesized
agaagagggagtgagactca

SEQ ID NO: 52981 - DNA, 20 bp, Artificial Sequence
  chemically synthesized
cctttttttttttttaaccc

SEQ ID NO: 52982 - DNA, 20 bp, Artificial Sequence
  chemically synthesized
ctttttttttttttaaccca

SEQ ID NO: 52983 - DNA, 20 bp, Artificial Sequence
  chemically synthesized
aaggtcaccctgcttgtcgt

SEQ ID NO: 52984 - DNA, 20 bp, Artificial Sequence
  chemically synthesized
caccctgcttgtcgttggcc

SEQ ID NO: 52985 - DNA, 20 bp, Artificial Sequence
  chemically synthesized
ctgcttgtcgttggccaagc

SEQ ID NO: 52986 - DNA, 20 bp, Artificial Sequence
  chemically synthesized
tgcttgtcgttggccaagcc

SEQ ID NO: 52987 - DNA, 20 bp, Artificial Sequence
  chemically synthesized
gtcgttggccaagccaggcc

SEQ ID NO: 52988 - DNA, 20 bp, Artificial Sequence
  chemically synthesized
gccaagccaggcctagaatc

SEQ ID NO: 52989 - DNA, 20 bp, Artificial Sequence
  chemically synthesized
ccaagccaggcctagaatct

SEQ ID NO: 52990 - DNA, 20 bp, Artificial Sequence
  chemically synthesized
aggcctagaatctgggtctc

SEQ ID NO: 52991 - DNA, 20 bp, Artificial Sequence
  chemically synthesized
gaatctgggtctccagactc

SEQ ID NO: 52992 - DNA, 20 bp, Artificial Sequence
  chemically synthesized
aatctgggtctccagactct

SEQ ID NO: 52993 - DNA, 20 bp, Artificial Sequence
  chemically synthesized
cagactctgggtctgctact

SEQ ID NO: 52994 - DNA, 20 bp, Artificial Sequence
  chemically synthesized
agactctgggtctgctactc

SEQ ID NO: 52995 - DNA, 20 bp, Artificial Sequence
  chemically synthesized
gactctgggtctgctactca

SEQ ID NO: 52996 - DNA, 20 bp, Artificial Sequence
  chemically synthesized
gtctgctactcagggcacaa

SEQ ID NO: 52997 - DNA, 20 bp, Artificial Sequence
  chemically synthesized
tgctactcagggcacaaaag

SEQ ID NO: 52998 - DNA, 20 bp, Artificial Sequence
  chemically synthesized
acaaaagaagaaaacattct

SEQ ID NO: 52999 - DNA, 20 bp, Artificial Sequence
  chemically synthesized
ttctgagttacaccccttct

SEQ ID NO: 53000 - DNA, 20 bp, Artificial Sequence
  chemically synthesized
gagttacaccccttcttggc

SEQ ID NO: 53001 - DNA, 20 bp, Artificial Sequence
  chemically synthesized
ttacaccccttcttggccag

SEQ ID NO: 53002 - DNA, 20 bp, Artificial Sequence
  chemically synthesized
ccccttcttggccagtagtt

SEQ ID NO: 53003 - DNA, 20 bp, Artificial Sequence
  chemically synthesized
cccttcttggccagtagttg

SEQ ID NO: 53004 - DNA, 20 bp, Artificial Sequence
  chemically synthesized
ccttcttggccagtagttga

SEQ ID NO: 53005 - DNA, 20 bp, Artificial Sequence
  chemically synthesized
gttgagggtaaattaacgaa

SEQ ID NO: 53006 - DNA, 20 bp, Artificial Sequence
  chemically synthesized
cttgtctgttgctctctgtt

SEQ ID NO: 53007 - DNA, 20 bp, Artificial Sequence
  chemically synthesized
ttgtctgttgctctctgttt

SEQ ID NO: 53008 - DNA, 20 bp, Artificial Sequence
  chemically synthesized
tctgttgctctctgtttagg

SEQ ID NO: 53009 - DNA, 20 bp, Artificial Sequence
  chemically synthesized
taaaaactccacaaattcaa

SEQ ID NO: 53010 - DNA, 20 bp, Artificial Sequence
  chemically synthesized
tccattttcaccacactttt

SEQ ID NO: 53011 - DNA, 20 bp, Artificial Sequence
  chemically synthesized
ttggctgccattcacaaaaa

SEQ ID NO: 53012 - DNA, 20 bp, Artificial Sequence
  chemically synthesized
gccattcacaaaaaaagctg

SEQ ID NO: 53013 - DNA, 20 bp, Artificial Sequence
  chemically synthesized
ttcacaaaaaaagctgaagc

SEQ ID NO: 53014 - DNA, 20 bp, Artificial Sequence
  chemically synthesized
aaaaaagctgaagccagcca

SEQ ID NO: 53015 - DNA, 20 bp, Artificial Sequence
  chemically synthesized
aaaaagctgaagccagccat

SEQ ID NO: 53016 - DNA, 20 bp, Artificial Sequence
  chemically synthesized
ggtaactattaaaatccatg

SEQ ID NO: 53017 - DNA, 20 bp, Artificial Sequence
  chemically synthesized
tattaaaatccatgtggttg

SEQ ID NO: 53018 - DNA, 20 bp, Artificial Sequence
  chemically synthesized
ttaaaatccatgtggttgca

SEQ ID NO: 53019 - DNA, 20 bp, Artificial Sequence
  chemically synthesized
aatccatgtggttgcagaga

SEQ ID NO: 53020 - DNA, 20 bp, Artificial Sequence
  chemically synthesized
agacagcatccctatcacat

SEQ ID NO: 53021 - DNA, 20 bp, Artificial Sequence
  chemically synthesized
tgagcttttgccctgtcccc

SEQ ID NO: 53022 - DNA, 20 bp, Artificial Sequence
  chemically synthesized
gagcttttgccctgtcccca

SEQ ID NO: 53023 - DNA, 20 bp, Artificial Sequence
  chemically synthesized
tctgtcatctccactccttg

SEQ ID NO: 53024 - DNA, 20 bp, Artificial Sequence
  chemically synthesized
ctgtcatctccactccttgt

SEQ ID NO: 53025 - DNA, 20 bp, Artificial Sequence
  chemically synthesized
ccactccttgtgggccacca

SEQ ID NO: 53026 - DNA, 20 bp, Artificial Sequence
  chemically synthesized
tccttgtgggccaccacagc

SEQ ID NO: 53027 - DNA, 20 bp, Artificial Sequence
  chemically synthesized
ccttgtgggccaccacagca

SEQ ID NO: 53028 - DNA, 20 bp, Artificial Sequence
  chemically synthesized
ccacagcaaggctgactcac

SEQ ID NO: 53029 - DNA, 20 bp, Artificial Sequence
  chemically synthesized
aggctgactcactggctctg

SEQ ID NO: 53030 - DNA, 20 bp, Artificial Sequence
  chemically synthesized
ctgactcactggctctgaag

SEQ ID NO: 53031 - DNA, 20 bp, Artificial Sequence
  chemically synthesized
ggctctgaagaagatccaca

SEQ ID NO: 53032 - DNA, 20 bp, Artificial Sequence
  chemically synthesized
aagaagatccacaaagcctg

SEQ ID NO: 53033 - DNA, 20 bp, Artificial Sequence
  chemically synthesized
gaagatccacaaagcctgtg

SEQ ID NO: 53034 - DNA, 20 bp, Artificial Sequence
  chemically synthesized
agatccacaaagcctgtgga

SEQ ID NO: 53035 - DNA, 20 bp, Artificial Sequence
  chemically synthesized
gatccacaaagcctgtggag

SEQ ID NO: 53036 - DNA, 20 bp, Artificial Sequence
  chemically synthesized
tccacaaagcctgtggagag

SEQ ID NO: 53037 - DNA, 20 bp, Artificial Sequence
  chemically synthesized
ccacaaagcctgtggagagg

SEQ ID NO: 53038 - DNA, 20 bp, Artificial Sequence
  chemically synthesized
gcctgtggagaggaggccca

SEQ ID NO: 53039 - DNA, 20 bp, Artificial Sequence
  chemically synthesized
agaggaggcccacagctctc

SEQ ID NO: 53040 - DNA, 20 bp, Artificial Sequence
  chemically synthesized
gaggaggcccacagctctcc

SEQ ID NO: 53041 - DNA, 20 bp, Artificial Sequence
  chemically synthesized
cacagctctccaggatgcat

SEQ ID NO: 53042 - DNA, 20 bp, Artificial Sequence
  chemically synthesized
acagctctccaggatgcatg

SEQ ID NO: 53043 - DNA, 20 bp, Artificial Sequence
  chemically synthesized
agctctccaggatgcatgag

SEQ ID NO: 53044 - DNA, 20 bp, Artificial Sequence
  chemically synthesized
gctctccaggatgcatgagg

SEQ ID NO: 53045 - DNA, 20 bp, Artificial Sequence
  chemically synthesized
ctctccaggatgcatgagga

SEQ ID NO: 53046 - DNA, 20 bp, Artificial Sequence
  chemically synthesized
tctccaggatgcatgaggag

SEQ ID NO: 53047 - DNA, 20 bp, Artificial Sequence
  chemically synthesized
gatgcatgaggaggggccac

SEQ ID NO: 53048 - DNA, 20 bp, Artificial Sequence
  chemically synthesized
atgcatgaggaggggccacc

SEQ ID NO: 53049 - DNA, 20 bp, Artificial Sequence
  chemically synthesized
tgcatgaggaggggccacca

SEQ ID NO: 53050 - DNA, 20 bp, Artificial Sequence
  chemically synthesized
tgaggaggggccaccaggga

SEQ ID NO: 53051 - DNA, 20 bp, Artificial Sequence
  chemically synthesized
gccaccagggatggccaccc

SEQ ID NO: 53052 - DNA, 20 bp, Artificial Sequence
  chemically synthesized
gcgacccccattttccctct

SEQ ID NO: 53053 - DNA, 20 bp, Artificial Sequence
  chemically synthesized
ccattttccctcttggccca

SEQ ID NO: 53054 - DNA, 20 bp, Artificial Sequence
  chemically synthesized
cattttccctcttggcccat

SEQ ID NO: 53055 - DNA, 20 bp, Artificial Sequence
  chemically synthesized
tcttggcccatgggaaatcc

SEQ ID NO: 53056 - DNA, 20 bp, Artificial Sequence
  chemically synthesized
cttggcccatgggaaatcct

SEQ ID NO: 53057 - DNA, 20 bp, Artificial Sequence
  chemically synthesized
tggcccatgggaaatcctag

SEQ ID NO: 53058 - DNA, 20 bp, Artificial Sequence
  chemically synthesized
ggcccatgggaaatcctagg

SEQ ID NO: 53059 - DNA, 20 bp, Artificial Sequence
  chemically synthesized
gaaatcctaggaggcaacat

SEQ ID NO: 53060 - DNA, 20 bp, Artificial Sequence
  chemically synthesized
taggaggcaacataagcctg

SEQ ID NO: 53061 - DNA, 20 bp, Artificial Sequence
  chemically synthesized
gaggcaacataagcctgtgg

SEQ ID NO: 53062 - DNA, 20 bp, Artificial Sequence
  chemically synthesized
cctgtggcagcccctccaca

SEQ ID NO: 53063 - DNA, 20 bp, Artificial Sequence
  chemically synthesized
cctccacaaagccctgcctc

SEQ ID NO: 53064 - DNA, 20 bp, Artificial Sequence
  chemically synthesized
tccacaaagccctgcctcca

SEQ ID NO: 53065 - DNA, 20 bp, Artificial Sequence
  chemically synthesized
ccctgcctccagagttccca

SEQ ID NO: 53066 - DNA, 20 bp, Artificial Sequence
  chemically synthesized
cctgcctccagagttcccat

SEQ ID NO: 53067 - DNA, 20 bp, Artificial Sequence
  chemically synthesized
cctccagagttcccataggc

SEQ ID NO: 53068 - DNA, 20 bp, Artificial Sequence
  chemically synthesized
cataggcgagaatgtgtcct

SEQ ID NO: 53069 - DNA, 20 bp, Artificial Sequence
  chemically synthesized
aggcgagaatgtgtcctcag

SEQ ID NO: 53070 - DNA, 20 bp, Artificial Sequence
  chemically synthesized
gcgagaatgtgtcctcagtg

SEQ ID NO: 53071 - DNA, 20 bp, Artificial Sequence
  chemically synthesized
cagtggagcattaccttgca

SEQ ID NO: 53072 - DNA, 20 bp, Artificial Sequence
  chemically synthesized
attaccttgcacagcctgtg

SEQ ID NO: 53073 - DNA, 20 bp, Artificial Sequence
  chemically synthesized
agcctgtgaagtgctctgtg

SEQ ID NO: 53074 - DNA, 20 bp, Artificial Sequence
  chemically synthesized
gcctgtgaagtgctctgtgc

SEQ ID NO: 53075 - DNA, 20 bp, Artificial Sequence
  chemically synthesized
cctgtgaagtgctctgtgcg

SEQ ID NO: 53076 - DNA, 20 bp, Artificial Sequence
  chemically synthesized
aagtgctctgtgcggggata

SEQ ID NO: 53077 - DNA, 20 bp, Artificial Sequence
  chemically synthesized
agtgctctgtgcggggataa

SEQ ID NO: 53078 - DNA, 20 bp, Artificial Sequence
  chemically synthesized
ctctgtgcggggataaaggc

SEQ ID NO: 53079 - DNA, 20 bp, Artificial Sequence
  chemically synthesized
ggggataaaggcaagtaacg

SEQ ID NO: 53080 - DNA, 20 bp, Artificial Sequence
  chemically synthesized
gggataaaggcaagtaacgt

SEQ ID NO: 53081 - DNA, 20 bp, Artificial Sequence
  chemically synthesized
ggataaaggcaagtaacgtg

SEQ ID NO: 53082 - DNA, 20 bp, Artificial Sequence
  chemically synthesized
gtaacgtggggtcctctctc

SEQ ID NO: 53083 - DNA, 20 bp, Artificial Sequence
  chemically synthesized
taacgtggggtcctctctca

SEQ ID NO: 53084 - DNA, 20 bp, Artificial Sequence
  chemically synthesized
gtcctctctcaaggaattgc

SEQ ID NO: 53085 - DNA, 20 bp, Artificial Sequence
  chemically synthesized
ctcaaggaattgctagctta

SEQ ID NO: 53086 - DNA, 20 bp, Artificial Sequence
  chemically synthesized
tcaaggaattgctagcttat

SEQ ID NO: 53087 - DNA, 20 bp, Artificial Sequence
  chemically synthesized
caaggaattgctagcttatg

SEQ ID NO: 53088 - DNA, 20 bp, Artificial Sequence
  chemically synthesized
aggaattgctagcttatggg

SEQ ID NO: 53089 - DNA, 20 bp, Artificial Sequence
  chemically synthesized
gaattgctagcttatgggga

SEQ ID NO: 53090 - DNA, 20 bp, Artificial Sequence
  chemically synthesized
tggggagagaaaactaaacg

SEQ ID NO: 53091 - DNA, 20 bp, Artificial Sequence
  chemically synthesized
ggagagaaaactaaacgtgg

SEQ ID NO: 53092 - DNA, 20 bp, Artificial Sequence
  chemically synthesized
actaaacgtggaagccccaa

SEQ ID NO: 53093 - DNA, 20 bp, Artificial Sequence
  chemically synthesized
tgtgacaaatgccccatgaa

SEQ ID NO: 53094 - DNA, 20 bp, Artificial Sequence
  chemically synthesized
gacaaatgccccatgaatgg

SEQ ID NO: 53095 - DNA, 20 bp, Artificial Sequence
  chemically synthesized
acaaatgccccatgaatggc

SEQ ID NO: 53096 - DNA, 20 bp, Artificial Sequence
  chemically synthesized
aatgccccatgaatggcagg

SEQ ID NO: 53097 - DNA, 20 bp, Artificial Sequence
  chemically synthesized
gccccatgaatggcaggcag

SEQ ID NO: 53098 - DNA, 20 bp, Artificial Sequence
  chemically synthesized
catgaatggcaggcagaagt

SEQ ID NO: 53099 - DNA, 20 bp, Artificial Sequence
  chemically synthesized
tgaatggcaggcagaagtta

SEQ ID NO: 53100 - DNA, 20 bp, Artificial Sequence
  chemically synthesized
caggcagaagttagagtatg

SEQ ID NO: 53101 - DNA, 20 bp, Artificial Sequence
  chemically synthesized
aggcagaagttagagtatga

SEQ ID NO: 53102 - DNA, 20 bp, Artificial Sequence
  chemically synthesized
ggcagaagttagagtatgaa

SEQ ID NO: 53103 - DNA, 20 bp, Artificial Sequence
  chemically synthesized
gcagaagttagagtatgaag

SEQ ID NO: 53104 - DNA, 20 bp, Artificial Sequence
  chemically synthesized
cagaagttagagtatgaagg

SEQ ID NO: 53105 - DNA, 20 bp, Artificial Sequence
  chemically synthesized
gtatgaagggggccccacct

SEQ ID NO: 53106 - DNA, 20 bp, Artificial Sequence
  chemically synthesized
tatgaagggggccccacctc

SEQ ID NO: 53107 - DNA, 20 bp, Artificial Sequence
  chemically synthesized
tgaagggggccccacctcag

SEQ ID NO: 53108 - DNA, 20 bp, Artificial Sequence
  chemically synthesized
gaagggggccccacctcagg

SEQ ID NO: 53109 - DNA, 20 bp, Artificial Sequence
  chemically synthesized
ggggccccacctcaggaggt

SEQ ID NO: 53110 - DNA, 20 bp, Artificial Sequence
  chemically synthesized
gggccccacctcaggaggtc

SEQ ID NO: 53111 - DNA, 20 bp, Artificial Sequence
  chemically synthesized
ggccccacctcaggaggtcg

SEQ ID NO: 53112 - DNA, 20 bp, Artificial Sequence
  chemically synthesized
ccccacctcaggaggtcggg

SEQ ID NO: 53113 - DNA, 20 bp, Artificial Sequence
  chemically synthesized
cctcaggaggtcggggagtg

SEQ ID NO: 53114 - DNA, 20 bp, Artificial Sequence
  chemically synthesized
gaggtcggggagtgtggcgt

SEQ ID NO: 53115 - DNA, 20 bp, Artificial Sequence
  chemically synthesized
tggcgtcagccactgcccca

SEQ ID NO: 53116 - DNA, 20 bp, Artificial Sequence
  chemically synthesized
cgtcagccactgccccatag

SEQ ID NO: 53117 - DNA, 20 bp, Artificial Sequence
  chemically synthesized
gtcagccactgccccatagc

SEQ ID NO: 53118 - DNA, 20 bp, Artificial Sequence
  chemically synthesized
atgtgtgcaacatctgccac

SEQ ID NO: 53119 - DNA, 20 bp, Artificial Sequence
  chemically synthesized
caacatctgccactggtact

SEQ ID NO: 53120 - DNA, 20 bp, Artificial Sequence
  chemically synthesized
tgaccctcatttgaccctcc

SEQ ID NO: 53121 - DNA, 20 bp, Artificial Sequence
  chemically synthesized
gaccctcatttgaccctccc

SEQ ID NO: 53122 - DNA, 20 bp, Artificial Sequence
  chemically synthesized
ctcatttgaccctcccaggc

SEQ ID NO: 53123 - DNA, 20 bp, Artificial Sequence
  chemically synthesized
tgctgtgatgaccccctccc

SEQ ID NO: 53124 - DNA, 20 bp, Artificial Sequence
  chemically synthesized
gtgatgaccccctccctggt

SEQ ID NO: 53125 - DNA, 20 bp, Artificial Sequence
  chemically synthesized
tgatgaccccctccctggtg

SEQ ID NO: 53126 - DNA, 20 bp, Artificial Sequence
  chemically synthesized
atgaccccctccctggtgag

SEQ ID NO: 53127 - DNA, 20 bp, Artificial Sequence
  chemically synthesized
ccccctccctggtgaggagc

SEQ ID NO: 53128 - DNA, 20 bp, Artificial Sequence
  chemically synthesized
ctccctggtgaggagccggc

SEQ ID NO: 53129 - DNA, 20 bp, Artificial Sequence
  chemically synthesized
tccctggtgaggagccggcc

SEQ ID NO: 53130 - DNA, 20 bp, Artificial Sequence
  chemically synthesized
gtgaggagccggccaggact

SEQ ID NO: 53131 - DNA, 20 bp, Artificial Sequence
  chemically synthesized
gccggccaggacttggatcc

SEQ ID NO: 53132 - DNA, 20 bp, Artificial Sequence
  chemically synthesized
ggccaggacttggatccaag

SEQ ID NO: 53133 - DNA, 20 bp, Artificial Sequence
  chemically synthesized
ggacttggatccaagaagtc

SEQ ID NO: 53134 - DNA, 20 bp, Artificial Sequence
  chemically synthesized
cccatgctctgaccgctcga

SEQ ID NO: 53135 - DNA, 20 bp, Artificial Sequence
  chemically synthesized
gctcgatggcaccgcttcct

SEQ ID NO: 53136 - DNA, 20 bp, Artificial Sequence
  chemically synthesized
cgatggcaccgcttccttgg

SEQ ID NO: 53137 - DNA, 20 bp, Artificial Sequence
  chemically synthesized
gatggcaccgcttccttggc

SEQ ID NO: 53138 - DNA, 20 bp, Artificial Sequence
  chemically synthesized
cttccttggcaggacatcta

SEQ ID NO: 53139 - DNA, 20 bp, Artificial Sequence
  chemically synthesized
ggcaggacatctacagctcc

SEQ ID NO: 53140 - DNA, 20 bp, Artificial Sequence
  chemically synthesized
gcaggacatctacagctccc

SEQ ID NO: 53141 - DNA, 20 bp, Artificial Sequence
  chemically synthesized
caggacatctacagctccca

SEQ ID NO: 53142 - DNA, 20 bp, Artificial Sequence
  chemically synthesized
tctacagctcccagggcacc

SEQ ID NO: 53143 - DNA, 20 bp, Artificial Sequence
  chemically synthesized
ctacagctcccagggcaccc

SEQ ID NO: 53144 - DNA, 20 bp, Artificial Sequence
  chemically synthesized
tacagctcccagggcaccca

SEQ ID NO: 53145 - DNA, 20 bp, Artificial Sequence
  chemically synthesized
acagctcccagggcacccag

SEQ ID NO: 53146 - DNA, 20 bp, Artificial Sequence
  chemically synthesized
ccagggcacccaggggacat

SEQ ID NO: 53147 - DNA, 20 bp, Artificial Sequence
  chemically synthesized
caggggacatcagcctctga

SEQ ID NO: 53148 - DNA, 20 bp, Artificial Sequence
  chemically synthesized
aggggacatcagcctctgaa

SEQ ID NO: 53149 - DNA, 20 bp, Artificial Sequence
  chemically synthesized
ggggacatcagcctctgaaa

SEQ ID NO: 53150 - DNA, 20 bp, Artificial Sequence
  chemically synthesized
gggacatcagcctctgaaag

SEQ ID NO: 53151 - DNA, 20 bp, Artificial Sequence
  chemically synthesized
atcagcctctgaaaggggaa

SEQ ID NO: 53152 - DNA, 20 bp, Artificial Sequence
  chemically synthesized
gcctctgaaaggggaatggt

SEQ ID NO: 53153 - DNA, 20 bp, Artificial Sequence
  chemically synthesized
gaaaggggaatggtcagacc

SEQ ID NO: 53154 - DNA, 20 bp, Artificial Sequence
  chemically synthesized
aaaggggaatggtcagaccc

SEQ ID NO: 53155 - DNA, 20 bp, Artificial Sequence
  chemically synthesized
aggggaatggtcagacccgg

SEQ ID NO: 53156 - DNA, 20 bp, Artificial Sequence
  chemically synthesized
ggggaatggtcagacccggg

SEQ ID NO: 53157 - DNA, 20 bp, Artificial Sequence
  chemically synthesized
gaggccttgaatgccatgct

SEQ ID NO: 53158 - DNA, 20 bp, Artificial Sequence
  chemically synthesized
aggccttgaatgccatgcta

SEQ ID NO: 53159 - DNA, 20 bp, Artificial Sequence
  chemically synthesized
gccttgaatgccatgctaag

SEQ ID NO: 53160 - DNA, 20 bp, Artificial Sequence
  chemically synthesized
gaatgccatgctaaggagtt

SEQ ID NO: 53161 - DNA, 20 bp, Artificial Sequence
  chemically synthesized
ctaaggagttcggacttgac

SEQ ID NO: 53162 - DNA, 20 bp, Artificial Sequence
  chemically synthesized
aaggagttcggacttgacaa

SEQ ID NO: 53163 - DNA, 20 bp, Artificial Sequence
  chemically synthesized
aggagttcggacttgacaag

SEQ ID NO: 53164 - DNA, 20 bp, Artificial Sequence
  chemically synthesized
agttcggacttgacaagagg

SEQ ID NO: 53165 - DNA, 20 bp, Artificial Sequence
  chemically synthesized
tcggacttgacaagaggcag

SEQ ID NO: 53166 - DNA, 20 bp, Artificial Sequence
  chemically synthesized
cttgacaagaggcagcagca

SEQ ID NO: 53167 - DNA, 20 bp, Artificial Sequence
  chemically synthesized
ttgacaagaggcagcagcaa

SEQ ID NO: 53168 - DNA, 20 bp, Artificial Sequence
  chemically synthesized
tgacaagaggcagcagcaaa

SEQ ID NO: 53169 - DNA, 20 bp, Artificial Sequence
  chemically synthesized
agcaaagggttttgataacc

SEQ ID NO: 53170 - DNA, 20 bp, Artificial Sequence
  chemically synthesized
aagggttttgataacctggt

SEQ ID NO: 53171 - DNA, 20 bp, Artificial Sequence
  chemically synthesized
ttattgtatttcactgctgc

SEQ ID NO: 53172 - DNA, 20 bp, Artificial Sequence
  chemically synthesized
ttcactgctgcaagatttac

SEQ ID NO: 53173 - DNA, 20 bp, Artificial Sequence
  chemically synthesized
gctgcaagatttactggaca

SEQ ID NO: 53174 - DNA, 20 bp, Artificial Sequence
  chemically synthesized
tgcaagatttactggacaaa

SEQ ID NO: 53175 - DNA, 20 bp, Artificial Sequence
  chemically synthesized
gcaagatttactggacaaag

SEQ ID NO: 53176 - DNA, 20 bp, Artificial Sequence
  chemically synthesized
aagatttactggacaaagag

SEQ ID NO: 53177 - DNA, 20 bp, Artificial Sequence
  chemically synthesized
agatttactggacaaagagg

SEQ ID NO: 53178 - DNA, 20 bp, Artificial Sequence
  chemically synthesized
atttactggacaaagaggag

SEQ ID NO: 53179 - DNA, 20 bp, Artificial Sequence
  chemically synthesized
tttactggacaaagaggagg

SEQ ID NO: 53180 - DNA, 20 bp, Artificial Sequence
  chemically synthesized
ttactggacaaagaggagga

SEQ ID NO: 53181 - DNA, 20 bp, Artificial Sequence
  chemically synthesized
tactggacaaagaggaggag

SEQ ID NO: 53182 - DNA, 20 bp, Artificial Sequence
  chemically synthesized
actggacaaagaggaggagg

SEQ ID NO: 53183 - DNA, 20 bp, Artificial Sequence
  chemically synthesized
tggacaaagaggaggagggg

SEQ ID NO: 53184 - DNA, 20 bp, Artificial Sequence
  chemically synthesized
acaaagaggaggagggggag

SEQ ID NO: 53185 - DNA, 20 bp, Artificial Sequence
  chemically synthesized
agaggaggagggggagaaga

SEQ ID NO: 53186 - DNA, 20 bp, Artificial Sequence
  chemically synthesized
gaggagggggagaagacagt

SEQ ID NO: 53187 - DNA, 20 bp, Artificial Sequence
  chemically synthesized
gggggagaagacagtgagtg

SEQ ID NO: 53188 - DNA, 20 bp, Artificial Sequence
  chemically synthesized
gaagacagtgagtgcagtga

SEQ ID NO: 53189 - DNA, 20 bp, Artificial Sequence
  chemically synthesized
aagacagtgagtgcagtgaa

SEQ ID NO: 53190 - DNA, 20 bp, Artificial Sequence
  chemically synthesized
tgagtgcagtgaaaggtgtc

SEQ ID NO: 53191 - DNA, 20 bp, Artificial Sequence
  chemically synthesized
gtgcagtgaaaggtgtctag

SEQ ID NO: 53192 - DNA, 20 bp, Artificial Sequence
  chemically synthesized
tgaaaggtgtctagaagccc

SEQ ID NO: 53193 - DNA, 20 bp, Artificial Sequence
  chemically synthesized
ggtgtctagaagcccaagca

SEQ ID NO: 53194 - DNA, 20 bp, Artificial Sequence
  chemically synthesized
gtgtctagaagcccaagcaa

SEQ ID NO: 53195 - DNA, 20 bp, Artificial Sequence
  chemically synthesized
ctagaagcccaagcaaaggc

SEQ ID NO: 53196 - DNA, 20 bp, Artificial Sequence
  chemically synthesized
tagaagcccaagcaaaggcc

SEQ ID NO: 53197 - DNA, 20 bp, Artificial Sequence
  chemically synthesized
agaagcccaagcaaaggcca

SEQ ID NO: 53198 - DNA, 20 bp, Artificial Sequence
  chemically synthesized
gaagcccaagcaaaggccag

SEQ ID NO: 53199 - DNA, 20 bp, Artificial Sequence
  chemically synthesized
gcccaagcaaaggccagggg

SEQ ID NO: 53200 - DNA, 20 bp, Artificial Sequence
  chemically synthesized
cccaagcaaaggccaggggt

SEQ ID NO: 53201 - DNA, 20 bp, Artificial Sequence
  chemically synthesized
ccaagcaaaggccaggggtg

SEQ ID NO: 53202 - DNA, 20 bp, Artificial Sequence
  chemically synthesized
caaaggccaggggtggggcg

SEQ ID NO: 53203 - DNA, 20 bp, Artificial Sequence
  chemically synthesized
aaggccaggggtggggcgta

SEQ ID NO: 53204 - DNA, 20 bp, Artificial Sequence
  chemically synthesized
ggccaggggtggggcgtaga

SEQ ID NO: 53205 - DNA, 20 bp, Artificial Sequence
  chemically synthesized
gccaggggtggggcgtagag

SEQ ID NO: 53206 - DNA, 20 bp, Artificial Sequence
  chemically synthesized
ggtggggcgtagagaggcaa

SEQ ID NO: 53207 - DNA, 20 bp, Artificial Sequence
  chemically synthesized
gggcgtagagaggcaatgga

SEQ ID NO: 53208 - DNA, 20 bp, Artificial Sequence
  chemically synthesized
ggcgtagagaggcaatggaa

SEQ ID NO: 53209 - DNA, 20 bp, Artificial Sequence
  chemically synthesized
agaggcaatggaaaggcacc

SEQ ID NO: 53210 - DNA, 20 bp, Artificial Sequence
  chemically synthesized
tggaaaggcacccagacacc

SEQ ID NO: 53211 - DNA, 20 bp, Artificial Sequence
  chemically synthesized
ggaaaggcacccagacaccc

SEQ ID NO: 53212 - DNA, 20 bp, Artificial Sequence
  chemically synthesized
cacccagacacccaggcttc

SEQ ID NO: 53213 - DNA, 20 bp, Artificial Sequence
  chemically synthesized
gacacccaggcttccagcct

SEQ ID NO: 53214 - DNA, 20 bp, Artificial Sequence
  chemically synthesized
ccaggcttccagcctgagcg

SEQ ID NO: 53215 - DNA, 20 bp, Artificial Sequence
  chemically synthesized
aggcttccagcctgagcgcg

SEQ ID NO: 53216 - DNA, 20 bp, Artificial Sequence
  chemically synthesized
gcctgagcgcggagtgcatg

SEQ ID NO: 53217 - DNA, 20 bp, Artificial Sequence
  chemically synthesized
cctgagcgcggagtgcatgc

SEQ ID NO: 53218 - DNA, 20 bp, Artificial Sequence
  chemically synthesized
cggagtgcatgcaggctgcg

SEQ ID NO: 53219 - DNA, 20 bp, Artificial Sequence
  chemically synthesized
agtgcatgcaggctgcgcgg

SEQ ID NO: 53220 - DNA, 20 bp, Artificial Sequence
  chemically synthesized
caggctgcgcggtggccgcc

SEQ ID NO: 53221 - DNA, 20 bp, Artificial Sequence
  chemically synthesized
aggctgcgcggtggccgccc

SEQ ID NO: 53222 - DNA, 20 bp, Artificial Sequence
  chemically synthesized
cgcggtggccgcccgggttg

SEQ ID NO: 53223 - DNA, 20 bp, Artificial Sequence
  chemically synthesized
gcggtggccgcccgggttgc

SEQ ID NO: 53224 - DNA, 20 bp, Artificial Sequence
  chemically synthesized
cggtggccgcccgggttgca

SEQ ID NO: 53225 - DNA, 20 bp, Artificial Sequence
  chemically synthesized
cccgggttgcagggaacgcg

SEQ ID NO: 53226 - DNA, 20 bp, Artificial Sequence
  chemically synthesized
ccgggttgcagggaacgcgc

SEQ ID NO: 53227 - DNA, 20 bp, Artificial Sequence
  chemically synthesized
gttgcagggaacgcgcgggc

SEQ ID NO: 53228 - DNA, 20 bp, Artificial Sequence
  chemically synthesized
cgcgcgggccagcgactctg

SEQ ID NO: 53229 - DNA, 20 bp, Artificial Sequence
  chemically synthesized
accccgtgcccgcactcacc

SEQ ID NO: 53230 - DNA, 20 bp, Artificial Sequence
  chemically synthesized
ccccgtgcccgcactcaccc

SEQ ID NO: 53231 - DNA, 20 bp, Artificial Sequence
  chemically synthesized
gtgcccgcactcacccagga

SEQ ID NO: 53232 - DNA, 20 bp, Artificial Sequence
  chemically synthesized
cgcactcacccaggacggcg

SEQ ID NO: 53233 - DNA, 20 bp, Artificial Sequence
  chemically synthesized
tcacccaggacggcgcagac

SEQ ID NO: 53234 - DNA, 20 bp, Artificial Sequence
  chemically synthesized
cccaggacggcgcagaccag

SEQ ID NO: 53235 - DNA, 20 bp, Artificial Sequence
  chemically synthesized
ccaggacggcgcagaccagc

SEQ ID NO: 53236 - DNA, 20 bp, Artificial Sequence
  chemically synthesized
caggacggcgcagaccagca

SEQ ID NO: 53237 - DNA, 20 bp, Artificial Sequence
  chemically synthesized
gcagaccagcagggctccca

SEQ ID NO: 53238 - DNA, 20 bp, Artificial Sequence
  chemically synthesized
accagcagggctcccacggc

SEQ ID NO: 53239 - DNA, 20 bp, Artificial Sequence
  chemically synthesized
ccacggcgagcctcatcttc

SEQ ID NO: 53240 - DNA, 20 bp, Artificial Sequence
  chemically synthesized
cacggcgagcctcatcttcc

SEQ ID NO: 53241 - DNA, 20 bp, Artificial Sequence
  chemically synthesized
cgagcctcatcttccgggtg

SEQ ID NO: 53242 - DNA, 20 bp, Artificial Sequence
  chemically synthesized
catcttccgggtgcggcgct

SEQ ID NO: 53243 - DNA, 20 bp, Artificial Sequence
  chemically synthesized
cttccgggtgcggcgctgag

SEQ ID NO: 53244 - DNA, 20 bp, Artificial Sequence
  chemically synthesized
cgggtgcggcgctgagcagc

SEQ ID NO: 53245 - DNA, 20 bp, Artificial Sequence
  chemically synthesized
gcggcgctgagcagcgagca

SEQ ID NO: 53246 - DNA, 20 bp, Artificial Sequence
  chemically synthesized
cgctgagcagcgagcacagt

SEQ ID NO: 53247 - DNA, 20 bp, Artificial Sequence
  chemically synthesized
cagtcggactcgcttctgtg

SEQ ID NO: 53248 - DNA, 20 bp, Artificial Sequence
  chemically synthesized
actcgcttctgtgcagcctc

SEQ ID NO: 53249 - DNA, 20 bp, Artificial Sequence
  chemically synthesized
gcgtccctttattccattcc

SEQ ID NO: 53250 - DNA, 20 bp, Artificial Sequence
  chemically synthesized
cctttattccattcccggcc

SEQ ID NO: 53251 - DNA, 20 bp, Artificial Sequence
  chemically synthesized
ctttattccattcccggcct

SEQ ID NO: 53252 - DNA, 20 bp, Artificial Sequence
  chemically synthesized
tattccattcccggcctggg

SEQ ID NO: 53253 - DNA, 20 bp, Artificial Sequence
  chemically synthesized
attccattcccggcctgggc

SEQ ID NO: 53254 - DNA, 20 bp, Artificial Sequence
  chemically synthesized
cattcccggcctgggcgggc

SEQ ID NO: 53255 - DNA, 20 bp, Artificial Sequence
  chemically synthesized
attcccggcctgggcgggct

SEQ ID NO: 53256 - DNA, 20 bp, Artificial Sequence
  chemically synthesized
tttgacctcccgtgtttgtg

SEQ ID NO: 53257 - DNA, 20 bp, Artificial Sequence
  chemically synthesized
acctcccgtgtttgtgcagc

SEQ ID NO: 53258 - DNA, 20 bp, Artificial Sequence
  chemically synthesized
cctcccgtgtttgtgcagcc

SEQ ID NO: 53259 - DNA, 20 bp, Artificial Sequence
  chemically synthesized
cactgatcacctcattttct

SEQ ID NO: 53260 - DNA, 20 bp, Artificial Sequence
  chemically synthesized
tcacctcattttctgagctc

SEQ ID NO: 53261 - DNA, 20 bp, Artificial Sequence
  chemically synthesized
acctcattttctgagctctg

SEQ ID NO: 53262 - DNA, 20 bp, Artificial Sequence
  chemically synthesized
gagctctggagacgacccgc

SEQ ID NO: 53263 - DNA, 20 bp, Artificial Sequence
  chemically synthesized
ctctggagacgacccgcgag

SEQ ID NO: 53264 - DNA, 20 bp, Artificial Sequence
  chemically synthesized
tggagacgacccgcgagtgg

SEQ ID NO: 53265 - DNA, 20 bp, Artificial Sequence
  chemically synthesized
ggagacgacccgcgagtgga

SEQ ID NO: 53266 - DNA, 20 bp, Artificial Sequence
  chemically synthesized
agacgacccgcgagtggaag

SEQ ID NO: 53267 - DNA, 20 bp, Artificial Sequence
  chemically synthesized
acccgcgagtggaaggagtc

SEQ ID NO: 53268 - DNA, 20 bp, Artificial Sequence
  chemically synthesized
cgagtggaaggagtccagca

SEQ ID NO: 53269 - DNA, 20 bp, Artificial Sequence
  chemically synthesized
gtccagcacagaaatgttga

SEQ ID NO: 53270 - DNA, 20 bp, Artificial Sequence
  chemically synthesized
tccagcacagaaatgttgat

SEQ ID NO: 53271 - DNA, 20 bp, Artificial Sequence
  chemically synthesized
agcacagaaatgttgatggg

SEQ ID NO: 53272 - DNA, 20 bp, Artificial Sequence
  chemically synthesized
gcacagaaatgttgatggga

SEQ ID NO: 53273 - DNA, 20 bp, Artificial Sequence
  chemically synthesized
cacagaaatgttgatgggaa

SEQ ID NO: 53274 - DNA, 20 bp, Artificial Sequence
  chemically synthesized
tgttgatgggaagggacatg

SEQ ID NO: 53275 - DNA, 20 bp, Artificial Sequence
  chemically synthesized
aagggacatgaagcacaatg

SEQ ID NO: 53276 - DNA, 20 bp, Artificial Sequence
  chemically synthesized
caatgcagccattgtcatcg

SEQ ID NO: 53277 - DNA, 20 bp, Artificial Sequence
  chemically synthesized
cattgtcatcgcggctcgct

SEQ ID NO: 53278 - DNA, 20 bp, Artificial Sequence
  chemically synthesized
gtgctggactccttccactc

SEQ ID NO: 53279 - DNA, 20 bp, Artificial Sequence
  chemically synthesized
aaaatgaggtgatcagtggg

SEQ ID NO: 53280 - DNA, 20 bp, Artificial Sequence
  chemically synthesized
cagtgggacgagtaaggaag

SEQ ID NO: 53281 - DNA, 20 bp, Artificial Sequence
  chemically synthesized
gcgcccagcccgcccaggcc

SEQ ID NO: 53282 - DNA, 20 bp, Artificial Sequence
  chemically synthesized
cagcccgcccaggccgggaa

SEQ ID NO: 53283 - DNA, 20 bp, Artificial Sequence
  chemically synthesized
gcgccggaggctgcacagaa

SEQ ID NO: 53284 - DNA, 20 bp, Artificial Sequence
  chemically synthesized
ccctgctggtctgcgccgtc

SEQ ID NO: 53285 - DNA, 20 bp, Artificial Sequence
  chemically synthesized
gctggtctgcgccgtcctgg

SEQ ID NO: 53286 - DNA, 20 bp, Artificial Sequence
  chemically synthesized
gtcctgggtgagtgcgggca

SEQ ID NO: 53287 - DNA, 20 bp, Artificial Sequence
  chemically synthesized
gcgggcacggggtagcaccg

SEQ ID NO: 53288 - DNA, 20 bp, Artificial Sequence
  chemically synthesized
tccgcgctcaggctggaagc

SEQ ID NO: 53289 - DNA, 20 bp, Artificial Sequence
  chemically synthesized
caggctggaagcctgggtgt

SEQ ID NO: 53290 - DNA, 20 bp, Artificial Sequence
  chemically synthesized
agcatggcattcaaggcctc

SEQ ID NO: 53291 - DNA, 20 bp, Artificial Sequence
  chemically synthesized
ctttcagaggctgatgtccc

SEQ ID NO: 53292 - DNA, 20 bp, Artificial Sequence
  chemically synthesized
gccatcgagcggtcagagca

SEQ ID NO: 53293 - DNA, 20 bp, Artificial Sequence
  chemically synthesized
ggggtttgaagccagacttc

SEQ ID NO: 53294 - DNA, 20 bp, Artificial Sequence
  chemically synthesized
ggccggctcctcaccaggga

SEQ ID NO: 53295 - DNA, 20 bp, Artificial Sequence
  chemically synthesized
tcatcacagcacttgcctgg

SEQ ID NO: 53296 - DNA, 20 bp, Artificial Sequence
  chemically synthesized
cttgcctgggagggtcaaat

SEQ ID NO: 53297 - DNA, 20 bp, Artificial Sequence
  chemically synthesized
ggtcagcgaggtggcagatg

SEQ ID NO: 53298 - DNA, 20 bp, Artificial Sequence
  chemically synthesized
cacaggcttatgttgcctcc

SEQ ID NO: 53299 - DNA, 20 bp, Artificial Sequence
  chemically synthesized
catgggccaagagggaaaat

SEQ ID NO: 53300 - DNA, 20 bp, Artificial Sequence
  chemically synthesized
agagggaaaatgggggtcgc

SEQ ID NO: 53301 - DNA, 20 bp, Artificial Sequence
  chemically synthesized
gcctcctctccacaggcttt

SEQ ID NO: 53302 - DNA, 20 bp, Artificial Sequence
  chemically synthesized
gtggatcttcttcagagcca

SEQ ID NO: 53303 - DNA, 20 bp, Artificial Sequence
  chemically synthesized
ccttgctgtggtggcccaca

SEQ ID NO: 53304 - DNA, 20 bp, Artificial Sequence
  chemically synthesized
agggcaaaagctcatgtgat

SEQ ID NO: 53305 - DNA, 20 bp, Artificial Sequence
  chemically synthesized
gatgctgtctctgcaaccac

SEQ ID NO: 53306 - DNA, 20 bp, Artificial Sequence
  chemically synthesized
ggctggcttcagcttttttt

SEQ ID NO: 53307 - DNA, 20 bp, Artificial Sequence
  chemically synthesized
aaaaagtgtggtgaaaatgg

SEQ ID NO: 53308 - DNA, 20 bp, Artificial Sequence
  chemically synthesized
tggagacagaggggagactg

SEQ ID NO: 53309 - DNA, 20 bp, Artificial Sequence
  chemically synthesized
aggggagactgttgaatttg

SEQ ID NO: 53310 - DNA, 20 bp, Artificial Sequence
  chemically synthesized
ctaaacagagagcaacagac

SEQ ID NO: 53311 - DNA, 20 bp, Artificial Sequence
  chemically synthesized
ccctcaactactggccaaga

SEQ ID NO: 53312 - DNA, 20 bp, Artificial Sequence
  chemically synthesized
ggccaagaaggggtgtaact

SEQ ID NO: 53313 - DNA, 20 bp, Artificial Sequence
  chemically synthesized
atgttttcttcttttgtgcc

SEQ ID NO: 53314 - DNA, 20 bp, Artificial Sequence
  chemically synthesized
tgtgccctgagtagcagacc

SEQ ID NO: 53315 - DNA, 20 bp, Artificial Sequence
  chemically synthesized
ctggcttggccaacgacaag

SEQ ID NO: 53316 - DNA, 20 bp, Artificial Sequence
  chemically synthesized
caacgacaagcagggtgacc

SEQ ID NO: 53317 - DNA, 20 bp, Artificial Sequence
  chemically synthesized
aaaaaaaaaggcatcattct

SEQ ID NO: 53318 - DNA, 20 bp, Artificial Sequence
  chemically synthesized
gaggtagcaagccaatgtgt

SEQ ID NO: 53319 - DNA, 20 bp, Artificial Sequence
  chemically synthesized
cagtgatgggaggagacaag

SEQ ID NO: 53320 - DNA, 20 bp, Artificial Sequence
  chemically synthesized
ctgcacccctctggccagca

SEQ ID NO: 53321 - DNA, 20 bp, Artificial Sequence
  chemically synthesized
accttctattggctcagact

SEQ ID NO: 53322 - DNA, 20 bp, Artificial Sequence
  chemically synthesized
gccctgtagtgttcatggac

SEQ ID NO: 53323 - DNA, 20 bp, Artificial Sequence
  chemically synthesized
tgagaggaggacaggactga

SEQ ID NO: 53324 - DNA, 20 bp, Artificial Sequence
  chemically synthesized
gctgtctctccctcagcata

SEQ ID NO: 53325 - DNA, 20 bp, Artificial Sequence
  chemically synthesized
agcatgaggccactaagtgc

SEQ ID NO: 53326 - DNA, 20 bp, Artificial Sequence
  chemically synthesized
cacaagcaacactgggacca

SEQ ID NO: 53327 - DNA, 20 bp, Artificial Sequence
  chemically synthesized
gcaacactgggaccatcgga

SEQ ID NO: 53328 - DNA, 20 bp, Artificial Sequence
  chemically synthesized
ggcacaagttctactgcatt

SEQ ID NO: 53329 - DNA, 20 bp, Artificial Sequence
  chemically synthesized
gaccaccctctgctggccag

SEQ ID NO: 53330 - DNA, 20 bp, Artificial Sequence
  chemically synthesized
ctatggaaaaccagcggggg

SEQ ID NO: 53331 - DNA, 20 bp, Artificial Sequence
  chemically synthesized
ttgccatctttttgagaaga

SEQ ID NO: 53332 - DNA, 20 bp, Artificial Sequence
  chemically synthesized
agaagagggagtgagactca

SEQ ID NO: 53333 - DNA, 20 bp, Artificial Sequence
  chemically synthesized
gtcgttggccaagccaggcc

SEQ ID NO: 53334 - DNA, 20 bp, Artificial Sequence
  chemically synthesized
ggccaagccaggcctagaat

SEQ ID NO: 53335 - DNA, 20 bp, Artificial Sequence
  chemically synthesized
agaatctgggtctccagact

SEQ ID NO: 53336 - DNA, 20 bp, Artificial Sequence
  chemically synthesized
gcacaaaagaagaaaacatt

SEQ ID NO: 53337 - DNA, 20 bp, Artificial Sequence
  chemically synthesized
ccccttcttggccagtagtt

SEQ ID NO: 53338 - DNA, 20 bp, Artificial Sequence
  chemically synthesized
gttgagggtaaattaacgaa

SEQ ID NO: 53339 - DNA, 20 bp, Artificial Sequence
  chemically synthesized
aaaaaaagctgaagccagcc

SEQ ID NO: 53340 - DNA, 20 bp, Artificial Sequence
  chemically synthesized
agaggaggcccacagctctc

SEQ ID NO: 53341 - DNA, 20 bp, Artificial Sequence
  chemically synthesized
atgcatgaggaggggccacc

SEQ ID NO: 53342 - DNA, 20 bp, Artificial Sequence
  chemically synthesized
cctccacaaagccctgcctc

SEQ ID NO: 53343 - DNA, 20 bp, Artificial Sequence
  chemically synthesized
cctccagagttcccataggc

SEQ ID NO: 53344 - DNA, 20 bp, Artificial Sequence
  chemically synthesized
gcctgtgaagtgctctgtgc

SEQ ID NO: 53345 - DNA, 20 bp, Artificial Sequence
  chemically synthesized
ggggataaaggcaagtaacg

SEQ ID NO: 53346 - DNA, 20 bp, Artificial Sequence
  chemically synthesized
taacgtggggtcctctctca

SEQ ID NO: 53347 - DNA, 20 bp, Artificial Sequence
  chemically synthesized
aacagtgtgacaaatgcccc

SEQ ID NO: 53348 - DNA, 20 bp, Artificial Sequence
  chemically synthesized
catgaatggcaggcagaagt

SEQ ID NO: 53349 - DNA, 20 bp, Artificial Sequence
  chemically synthesized
ggccccacctcaggaggtcg

SEQ ID NO: 53350 - DNA, 20 bp, Artificial Sequence
  chemically synthesized
cgtcagccactgccccatag

SEQ ID NO: 53351 - DNA, 20 bp, Artificial Sequence
  chemically synthesized
ggtgaggagccggccaggac

SEQ ID NO: 53352 - DNA, 20 bp, Artificial Sequence
  chemically synthesized
gggacatcagcctctgaaag

SEQ ID NO: 53353 - DNA, 20 bp, Artificial Sequence
  chemically synthesized
atggtcagacccgggaggcc

SEQ ID NO: 53354 - DNA, 20 bp, Artificial Sequence
  chemically synthesized
aggccttgaatgccatgcta

SEQ ID NO: 53355 - DNA, 20 bp, Artificial Sequence
  chemically synthesized
cttgacaagaggcagcagca

SEQ ID NO: 53356 - DNA, 20 bp, Artificial Sequence
  chemically synthesized
aggaggagggggagaagaca

SEQ ID NO: 53357 - DNA, 20 bp, Artificial Sequence
  chemically synthesized
tagaagcccaagcaaaggcc

SEQ ID NO: 53358 - DNA, 20 bp, Artificial Sequence
  chemically synthesized
ccaggcttccagcctgagcg

SEQ ID NO: 53359 - DNA, 20 bp, Artificial Sequence
  chemically synthesized
gcaggctgcgcggtggccgc

SEQ ID NO: 53360 - DNA, 20 bp, Artificial Sequence
  chemically synthesized
cccacggcgagcctcatctt

SEQ ID NO: 53361 - DNA, 20 bp, Artificial Sequence
  chemically synthesized
gacctcccgtgtttgtgcag

SEQ ID NO: 53362 - DNA, 20 bp, Artificial Sequence
  chemically synthesized
ctgagctctggagacgaccc

SEQ ID NO: 53363 - DNA, 20 bp, Artificial Sequence
  chemically synthesized
ggagacgacccgcgagtgga

SEQ ID NO: 53364 - DNA, 20 bp, Artificial Sequence
  chemically synthesized
tcgcgggtcgtctccagagc

SEQ ID NO: 53365 - DNA, 20 bp, Artificial Sequence
  chemically synthesized
tggccaagaaggggtgtaac

SEQ ID NO: 53366 - DNA, 20 bp, Artificial Sequence
  chemically synthesized
aaccttctattggctcagac

SEQ ID NO: 53367 - DNA, 20 bp, Artificial Sequence
  chemically synthesized
ggtcccagtgttgcttgtgt

SEQ ID NO: 53368 - DNA, 20 bp, Artificial Sequence
  chemically synthesized
agggagagacagcatcgccc

SEQ ID NO: 53369 - DNA, 20 bp, Artificial Sequence
  chemically synthesized
gagaagagggagtgagactc

SEQ ID NO: 53370 - DNA, 20 bp, Artificial Sequence
  chemically synthesized
tgtcgttggccaagccaggc

SEQ ID NO: 53371 - DNA, 20 bp, Artificial Sequence
  chemically synthesized
ctgctactcagggcacaaaa

SEQ ID NO: 53372 - DNA, 20 bp, Artificial Sequence
  chemically synthesized
agttgagggtaaattaacga

SEQ ID NO: 53373 - DNA, 20 bp, Artificial Sequence
  chemically synthesized
gcctccagagttcccatagg

SEQ ID NO: 53374 - DNA, 20 bp, Artificial Sequence
  chemically synthesized
ggaattgctagcttatgggg

SEQ ID NO: 53375 - DNA, 20 bp, Artificial Sequence
  chemically synthesized
gcgagtggaaggagtccagc

SEQ ID NO: 53376 - DNA, 20 bp, Artificial Sequence
  chemically synthesized
agcacgtctaaccaggttat

SEQ ID NO: 53377 - DNA, 20 bp, Artificial Sequence
  chemically synthesized
gccaatgtgttggggtagct

SEQ ID NO: 53378 - DNA, 20 bp, Artificial Sequence
  chemically synthesized
ctgtgtctggctgtccctga

SEQ ID NO: 53379 - DNA, 20 bp, Artificial Sequence
  chemically synthesized
ggcttgctacctcaactatg

SEQ ID NO: 53380 - DNA, 20 bp, Artificial Sequence
  chemically synthesized
ctactcagggcacaaaagaa

SEQ ID NO: 53381 - DNA, 20 bp, Artificial Sequence
  chemically synthesized
ctctctgtttaggaagaact

SEQ ID NO: 53382 - DNA, 20 bp, Artificial Sequence
  chemically synthesized
attgctagcttatggggaga

SEQ ID NO: 53383 - DNA, 20 bp, Artificial Sequence
  chemically synthesized
ccgcgatgacaatggctgca

SEQ ID NO: 53384 - DNA, 20 bp, Artificial Sequence
  chemically synthesized
aggaaggggggttgggagag

SEQ ID NO: 53385 - DNA, 20 bp, Artificial Sequence
  chemically synthesized
gctgcacaaacacgggaggt

SEQ ID NO: 53386 - DNA, 20 bp, Artificial Sequence
  chemically synthesized
ctctacgccccacccctggc

SEQ ID NO: 53387 - DNA, 20 bp, Artificial Sequence
  chemically synthesized
gccccacccctggcctttgc

SEQ ID NO: 53388 - DNA, 20 bp, Artificial Sequence
  chemically synthesized
gccatcgagcggtcagagca

SEQ ID NO: 53389 - DNA, 20 bp, Artificial Sequence
  chemically synthesized
tggggcatttgtcacactgt

SEQ ID NO: 53390 - DNA, 20 bp, Artificial Sequence
  chemically synthesized
ttgtcacactgttggggctt

SEQ ID NO: 53391 - DNA, 20 bp, Artificial Sequence
  chemically synthesized
acactgttggggcttccacg

SEQ ID NO: 53392 - DNA, 20 bp, Artificial Sequence
  chemically synthesized
gcctatgggaactctggagg

SEQ ID NO: 53393 - DNA, 20 bp, Artificial Sequence
  chemically synthesized
ggctttgtggaggggctgcc

SEQ ID NO: 53394 - DNA, 20 bp, Artificial Sequence
  chemically synthesized
ccacaggcttatgttgcctc

SEQ ID NO: 53395 - DNA, 20 bp, Artificial Sequence
  chemically synthesized
gagctgtgggcctcctctcc

SEQ ID NO: 53396 - DNA, 20 bp, Artificial Sequence
  chemically synthesized
ggatgctgtctctgcaacca

SEQ ID NO: 53397 - DNA, 20 bp, Artificial Sequence
  chemically synthesized
gattttaatagttacccatg

SEQ ID NO: 53398 - DNA, 20 bp, Artificial Sequence
  chemically synthesized
aatagttacccatggctggc

SEQ ID NO: 53399 - DNA, 20 bp, Artificial Sequence
  chemically synthesized
aggggagactgttgaatttg

SEQ ID NO: 53400 - DNA, 20 bp, Artificial Sequence
  chemically synthesized
ccaagaaggggtgtaactca

SEQ ID NO: 53401 - DNA, 20 bp, Artificial Sequence
  chemically synthesized
gcagacccagagtctggaga

SEQ ID NO: 53402 - DNA, 20 bp, Artificial Sequence
  chemically synthesized
ctggagacccagattctagg

SEQ ID NO: 53403 - DNA, 20 bp, Artificial Sequence
  chemically synthesized
aagatggcaattcctccccc

SEQ ID NO: 53404 - DNA, 20 bp, Artificial Sequence
  chemically synthesized
tgaaaacgccctgtgcatac

SEQ ID NO: 53405 - DNA, 20 bp, Artificial Sequence
  chemically synthesized
agacaaggcggatacagagg

SEQ ID NO: 53406 - DNA, 20 bp, Artificial Sequence
  chemically synthesized
agcatgaggccactaagtgc

SEQ ID NO: 53407 - DNA, 20 bp, Artificial Sequence
  chemically synthesized
attccatccgatggtcccag

SEQ ID NO: 53408 - DNA, 20 bp, Artificial Sequence
  chemically synthesized
tgtgtgaagaaagcctccta

SEQ ID NO: 53409 - DNA, 20 bp, Artificial Sequence
  chemically synthesized
gccctgatgcaatcaaggta

SEQ ID NO: 53410 - DNA, 20 bp, Artificial Sequence
  chemically synthesized
actgggaccatcggatggaa

SEQ ID NO: 53411 - DNA, 20 bp, Artificial Sequence
  chemically synthesized
tccgacactgcacaccatct

SEQ ID NO: 53412 - DNA, 20 bp, Artificial Sequence
  chemically synthesized
gaaggttgccctaatggcct

SEQ ID NO: 53413 - DNA, 20 bp, Artificial Sequence
  chemically synthesized
cataagcctcagtatgcaca

SEQ ID NO: 53414 - DNA, 20 bp, Artificial Sequence
  chemically synthesized
gttttcagctaccccaacac

SEQ ID NO: 53415 - DNA, 20 bp, Artificial Sequence
  chemically synthesized
ttttttttaacccaaggtca

SEQ ID NO: 53416 - DNA, 20 bp, Artificial Sequence
  chemically synthesized
tgtaactcttgtctgttgct

SEQ ID NO: 53417 - DNA, 20 bp, Artificial Sequence
  chemically synthesized
agagacagcatccctatcac

SEQ ID NO: 53418 - DNA, 20 bp, Artificial Sequence
  chemically synthesized
gggtcctctctcaaggaatt

SEQ ID NO: 53419 - DNA, 20 bp, Artificial Sequence
  chemically synthesized
caggacttggatccaagaag

SEQ ID NO: 53420 - DNA, 20 bp, Artificial Sequence
  chemically synthesized
atgctctgaccgctcgatgg

SEQ ID NO: 53421 - DNA, 20 bp, Artificial Sequence
  chemically synthesized
cttgacaagaggcagcagca

SEQ ID NO: 53422 - DNA, 20 bp, Artificial Sequence
  chemically synthesized
tgataacctggttagacgtg

SEQ ID NO: 53423 - DNA, 20 bp, Artificial Sequence
  chemically synthesized
atttattgtatttcactgct

SEQ ID NO: 53424 - DNA, 20 bp, Artificial Sequence
  chemically synthesized
atggaaaggcacccagacac

SEQ ID NO: 53425 - DNA, 20 bp, Artificial Sequence
  chemically synthesized
tgagcagcgagcacagtcgg

SEQ ID NO: 53426 - DNA, 20 bp, Artificial Sequence
  chemically synthesized
tgggcgcaatctttgacctc

SEQ ID NO: 53427 - DNA, 22 bp, Artificial Sequence
  chemically synthesized
cattgtgcttcatgtcccttcc

SEQ ID NO: 53428 - DNA, 22 bp, Artificial Sequence
  chemically synthesized
tgcttcatgtcccttcccatca

SEQ ID NO: 53429 - DNA, 22 bp, Artificial Sequence
  chemically synthesized
catgtcccttcccatcaacatt

SEQ ID NO: 53430 - DNA, 22 bp, Artificial Sequence
  chemically synthesized
atgtcccttcccatcaacattt

SEQ ID NO: 53431 - DNA, 22 bp, Artificial Sequence
  chemically synthesized
cccatcaacatttctgtgctgg

SEQ ID NO: 53432 - DNA, 22 bp, Artificial Sequence
  chemically synthesized
ccatcaacatttctgtgctgga

SEQ ID NO: 53433 - DNA, 22 bp, Artificial Sequence
  chemically synthesized
ctgtgctggactccttccactc

SEQ ID NO: 53434 - DNA, 22 bp, Artificial Sequence
  chemically synthesized
tgtgctggactccttccactcg

SEQ ID NO: 53435 - DNA, 22 bp, Artificial Sequence
  chemically synthesized
tgctggactccttccactcgcg

SEQ ID NO: 53436 - DNA, 22 bp, Artificial Sequence
  chemically synthesized
gactccttccactcgcgggtcg

SEQ ID NO: 53437 - DNA, 22 bp, Artificial Sequence
  chemically synthesized
cttccactcgcgggtcgtctcc

SEQ ID NO: 53438 - DNA, 22 bp, Artificial Sequence
  chemically synthesized
ccactcgcgggtcgtctccaga

SEQ ID NO: 53439 - DNA, 22 bp, Artificial Sequence
  chemically synthesized
cactcgcgggtcgtctccagag

SEQ ID NO: 53440 - DNA, 22 bp, Artificial Sequence
  chemically synthesized
gcgggtcgtctccagagctcag

SEQ ID NO: 53441 - DNA, 22 bp, Artificial Sequence
  chemically synthesized
cagagctcagaaaatgaggtga

SEQ ID NO: 53442 - DNA, 22 bp, Artificial Sequence
  chemically synthesized
agaaaatgaggtgatcagtggg

SEQ ID NO: 53443 - DNA, 22 bp, Artificial Sequence
  chemically synthesized
ggagaggggcgattgggcaacc

SEQ ID NO: 53444 - DNA, 22 bp, Artificial Sequence
  chemically synthesized
ggcaacccggctgcacaaacac

SEQ ID NO: 53445 - DNA, 22 bp, Artificial Sequence
  chemically synthesized
cacaaacacgggaggtcaaaga

SEQ ID NO: 53446 - DNA, 22 bp, Artificial Sequence
  chemically synthesized
cgcccagcccgcccaggccggg

SEQ ID NO: 53447 - DNA, 22 bp, Artificial Sequence
  chemically synthesized
cacagaagcgagtccgactgtg

SEQ ID NO: 53448 - DNA, 22 bp, Artificial Sequence
  chemically synthesized
tgctcgctgctcagcgccgcac

SEQ ID NO: 53449 - DNA, 22 bp, Artificial Sequence
  chemically synthesized
gctgctcagcgccgcacccgga

SEQ ID NO: 53450 - DNA, 22 bp, Artificial Sequence
  chemically synthesized
ctcagcgccgcacccggaagat

SEQ ID NO: 53451 - DNA, 22 bp, Artificial Sequence
  chemically synthesized
agcgccgcacccggaagatgag

SEQ ID NO: 53452 - DNA, 22 bp, Artificial Sequence
  chemically synthesized
gccgtgggagccctgctggtct

SEQ ID NO: 53453 - DNA, 22 bp, Artificial Sequence
  chemically synthesized
ctggtctgcgccgtcctgggtg

SEQ ID NO: 53454 - DNA, 22 bp, Artificial Sequence
  chemically synthesized
gtctgcgccgtcctgggtgagt

SEQ ID NO: 53455 - DNA, 22 bp, Artificial Sequence
  chemically synthesized
cgccgtcctgggtgagtgcggg

SEQ ID NO: 53456 - DNA, 22 bp, Artificial Sequence
  chemically synthesized
ggtgagtgcgggcacggggtag

SEQ ID NO: 53457 - DNA, 22 bp, Artificial Sequence
  chemically synthesized
gcccgcgcgttccctgcaaccc

SEQ ID NO: 53458 - DNA, 22 bp, Artificial Sequence
  chemically synthesized
cctgcaacccgggcggccaccg

SEQ ID NO: 53459 - DNA, 22 bp, Artificial Sequence
  chemically synthesized
caacccgggcggccaccgcgca

SEQ ID NO: 53460 - DNA, 22 bp, Artificial Sequence
  chemically synthesized
catgcactccgcgctcaggctg

SEQ ID NO: 53461 - DNA, 22 bp, Artificial Sequence
  chemically synthesized
cgcgctcaggctggaagcctgg

SEQ ID NO: 53462 - DNA, 22 bp, Artificial Sequence
  chemically synthesized
aggctggaagcctgggtgtctg

SEQ ID NO: 53463 - DNA, 22 bp, Artificial Sequence
  chemically synthesized
gaagcctgggtgtctgggtgcc

SEQ ID NO: 53464 - DNA, 22 bp, Artificial Sequence
  chemically synthesized
ggtgtctgggtgcctttccatt

SEQ ID NO: 53465 - DNA, 22 bp, Artificial Sequence
  chemically synthesized
ggtgcctttccattgcctctct

SEQ ID NO: 53466 - DNA, 22 bp, Artificial Sequence
  chemically synthesized
tccattgcctctctacgcccca

SEQ ID NO: 53467 - DNA, 22 bp, Artificial Sequence
  chemically synthesized
ccattgcctctctacgccccac

SEQ ID NO: 53468 - DNA, 22 bp, Artificial Sequence
  chemically synthesized
cattgcctctctacgccccacc

SEQ ID NO: 53469 - DNA, 22 bp, Artificial Sequence
  chemically synthesized
cctctctacgccccacccctgg

SEQ ID NO: 53470 - DNA, 22 bp, Artificial Sequence
  chemically synthesized
tctacgccccacccctggcctt

SEQ ID NO: 53471 - DNA, 22 bp, Artificial Sequence
  chemically synthesized
tacgccccacccctggcctttg

SEQ ID NO: 53472 - DNA, 22 bp, Artificial Sequence
  chemically synthesized
cgccccacccctggcctttgct

SEQ ID NO: 53473 - DNA, 22 bp, Artificial Sequence
  chemically synthesized
gcctttgcttgggcttctagac

SEQ ID NO: 53474 - DNA, 22 bp, Artificial Sequence
  chemically synthesized
tgcttgggcttctagacacctt

SEQ ID NO: 53475 - DNA, 22 bp, Artificial Sequence
  chemically synthesized
gcttgggcttctagacaccttt

SEQ ID NO: 53476 - DNA, 22 bp, Artificial Sequence
  chemically synthesized
cttgggcttctagacacctttc

SEQ ID NO: 53477 - DNA, 22 bp, Artificial Sequence
  chemically synthesized
gggcttctagacacctttcact

SEQ ID NO: 53478 - DNA, 22 bp, Artificial Sequence
  chemically synthesized
ggcttctagacacctttcactg

SEQ ID NO: 53479 - DNA, 22 bp, Artificial Sequence
  chemically synthesized
ctagacacctttcactgcactc

SEQ ID NO: 53480 - DNA, 22 bp, Artificial Sequence
  chemically synthesized
tagacacctttcactgcactca

SEQ ID NO: 53481 - DNA, 22 bp, Artificial Sequence
  chemically synthesized
gacacctttcactgcactcact

SEQ ID NO: 53482 - DNA, 22 bp, Artificial Sequence
  chemically synthesized
tcactgcactcactgtcttctc

SEQ ID NO: 53483 - DNA, 22 bp, Artificial Sequence
  chemically synthesized
cactgcactcactgtcttctcc

SEQ ID NO: 53484 - DNA, 22 bp, Artificial Sequence
  chemically synthesized
actgcactcactgtcttctccc

SEQ ID NO: 53485 - DNA, 22 bp, Artificial Sequence
  chemically synthesized
cactcactgtcttctccccctc

SEQ ID NO: 53486 - DNA, 22 bp, Artificial Sequence
  chemically synthesized
actgtcttctccccctcctcct

SEQ ID NO: 53487 - DNA, 22 bp, Artificial Sequence
  chemically synthesized
tcttctccccctcctcctcttt

SEQ ID NO: 53488 - DNA, 22 bp, Artificial Sequence
  chemically synthesized
ctccccctcctcctctttgtcc

SEQ ID NO: 53489 - DNA, 22 bp, Artificial Sequence
  chemically synthesized
tccccctcctcctctttgtcca

SEQ ID NO: 53490 - DNA, 22 bp, Artificial Sequence
  chemically synthesized
cccctcctcctctttgtccagt

SEQ ID NO: 53491 - DNA, 22 bp, Artificial Sequence
  chemically synthesized
ctcctctttgtccagtaaatct

SEQ ID NO: 53492 - DNA, 22 bp, Artificial Sequence
  chemically synthesized
ctctttgtccagtaaatcttgc

SEQ ID NO: 53493 - DNA, 22 bp, Artificial Sequence
  chemically synthesized
tttgtccagtaaatcttgcagc

SEQ ID NO: 53494 - DNA, 22 bp, Artificial Sequence
  chemically synthesized
tgtccagtaaatcttgcagcag

SEQ ID NO: 53495 - DNA, 22 bp, Artificial Sequence
  chemically synthesized
gtccagtaaatcttgcagcagt

SEQ ID NO: 53496 - DNA, 22 bp, Artificial Sequence
  chemically synthesized
tccagtaaatcttgcagcagtg

SEQ ID NO: 53497 - DNA, 22 bp, Artificial Sequence
  chemically synthesized
gcagcagtgaaatacaataaat

SEQ ID NO: 53498 - DNA, 22 bp, Artificial Sequence
  chemically synthesized
cagcagtgaaatacaataaatc

SEQ ID NO: 53499 - DNA, 22 bp, Artificial Sequence
  chemically synthesized
accaggttatcaaaaccctttg

SEQ ID NO: 53500 - DNA, 22 bp, Artificial Sequence
  chemically synthesized
tcaaaaccctttgctgctgcct

SEQ ID NO: 53501 - DNA, 22 bp, Artificial Sequence
  chemically synthesized
tgctgctgcctcttgtcaagtc

SEQ ID NO: 53502 - DNA, 22 bp, Artificial Sequence
  chemically synthesized
gctgctgcctcttgtcaagtcc

SEQ ID NO: 53503 - DNA, 22 bp, Artificial Sequence
  chemically synthesized
ctgctgcctcttgtcaagtccg

SEQ ID NO: 53504 - DNA, 22 bp, Artificial Sequence
  chemically synthesized
ctgcctcttgtcaagtccgaac

SEQ ID NO: 53505 - DNA, 22 bp, Artificial Sequence
  chemically synthesized
cctcttgtcaagtccgaactcc

SEQ ID NO: 53506 - DNA, 22 bp, Artificial Sequence
  chemically synthesized
ttgtcaagtccgaactccttag

SEQ ID NO: 53507 - DNA, 22 bp, Artificial Sequence
  chemically synthesized
gtcaagtccgaactccttagca

SEQ ID NO: 53508 - DNA, 22 bp, Artificial Sequence
  chemically synthesized
tcaagtccgaactccttagcat

SEQ ID NO: 53509 - DNA, 22 bp, Artificial Sequence
  chemically synthesized
cttagcatggcattcaaggcct

SEQ ID NO: 53510 - DNA, 22 bp, Artificial Sequence
  chemically synthesized
agcatggcattcaaggcctccc

SEQ ID NO: 53511 - DNA, 22 bp, Artificial Sequence
  chemically synthesized
gcatggcattcaaggcctcccg

SEQ ID NO: 53512 - DNA, 22 bp, Artificial Sequence
  chemically synthesized
aaggcctcccgggtctgaccat

SEQ ID NO: 53513 - DNA, 22 bp, Artificial Sequence
  chemically synthesized
ccgggtctgaccattccccttt

SEQ ID NO: 53514 - DNA, 22 bp, Artificial Sequence
  chemically synthesized
accattcccctttcagaggctg

SEQ ID NO: 53515 - DNA, 22 bp, Artificial Sequence
  chemically synthesized
ccctttcagaggctgatgtccc

SEQ ID NO: 53516 - DNA, 22 bp, Artificial Sequence
  chemically synthesized
tcagaggctgatgtcccctggg

SEQ ID NO: 53517 - DNA, 22 bp, Artificial Sequence
  chemically synthesized
cagaggctgatgtcccctgggt

SEQ ID NO: 53518 - DNA, 22 bp, Artificial Sequence
  chemically synthesized
agaggctgatgtcccctgggtg

SEQ ID NO: 53519 - DNA, 22 bp, Artificial Sequence
  chemically synthesized
atgtcccctgggtgccctggga

SEQ ID NO: 53520 - DNA, 22 bp, Artificial Sequence
  chemically synthesized
ggtgccctgggagctgtagatg

SEQ ID NO: 53521 - DNA, 22 bp, Artificial Sequence
  chemically synthesized
ggagctgtagatgtcctgccaa

SEQ ID NO: 53522 - DNA, 22 bp, Artificial Sequence
  chemically synthesized
tagatgtcctgccaaggaagcg

SEQ ID NO: 53523 - DNA, 22 bp, Artificial Sequence
  chemically synthesized
ccaaggaagcggtgccatcgag

SEQ ID NO: 53524 - DNA, 22 bp, Artificial Sequence
  chemically synthesized
gaagccagacttcttggatcca

SEQ ID NO: 53525 - DNA, 22 bp, Artificial Sequence
  chemically synthesized
aagccagacttcttggatccaa

SEQ ID NO: 53526 - DNA, 22 bp, Artificial Sequence
  chemically synthesized
cttggatccaagtcctggccgg

SEQ ID NO: 53527 - DNA, 22 bp, Artificial Sequence
  chemically synthesized
ttggatccaagtcctggccggc

SEQ ID NO: 53528 - DNA, 22 bp, Artificial Sequence
  chemically synthesized
ggatccaagtcctggccggctc

SEQ ID NO: 53529 - DNA, 22 bp, Artificial Sequence
  chemically synthesized
gatccaagtcctggccggctcc

SEQ ID NO: 53530 - DNA, 22 bp, Artificial Sequence
  chemically synthesized
gccggctcctcaccagggaggg

SEQ ID NO: 53531 - DNA, 22 bp, Artificial Sequence
  chemically synthesized
ctcaccagggagggggtcatca

SEQ ID NO: 53532 - DNA, 22 bp, Artificial Sequence
  chemically synthesized
accagggagggggtcatcacag

SEQ ID NO: 53533 - DNA, 22 bp, Artificial Sequence
  chemically synthesized
gcctgggagggtcaaatgaggg

SEQ ID NO: 53534 - DNA, 22 bp, Artificial Sequence
  chemically synthesized
cctgggagggtcaaatgagggt

SEQ ID NO: 53535 - DNA, 22 bp, Artificial Sequence
  chemically synthesized
ggagggtcaaatgagggtcagc

SEQ ID NO: 53536 - DNA, 22 bp, Artificial Sequence
  chemically synthesized
agtaccagtggcagatgttgca

SEQ ID NO: 53537 - DNA, 22 bp, Artificial Sequence
  chemically synthesized
cacacatcctgctatggggcag

SEQ ID NO: 53538 - DNA, 22 bp, Artificial Sequence
  chemically synthesized
ctatggggcagtggctgacgcc

SEQ ID NO: 53539 - DNA, 22 bp, Artificial Sequence
  chemically synthesized
tggggcagtggctgacgccaca

SEQ ID NO: 53540 - DNA, 22 bp, Artificial Sequence
  chemically synthesized
acgccacactccccgacctcct

SEQ ID NO: 53541 - DNA, 22 bp, Artificial Sequence
  chemically synthesized
cccgacctcctgaggtggggcc

SEQ ID NO: 53542 - DNA, 22 bp, Artificial Sequence
  chemically synthesized
ctgaggtggggcccccttcata

SEQ ID NO: 53543 - DNA, 22 bp, Artificial Sequence
  chemically synthesized
aggtggggcccccttcatactc

SEQ ID NO: 53544 - DNA, 22 bp, Artificial Sequence
  chemically synthesized
catactctaacttctgcctgcc

SEQ ID NO: 53545 - DNA, 22 bp, Artificial Sequence
  chemically synthesized
atactctaacttctgcctgcca

SEQ ID NO: 53546 - DNA, 22 bp, Artificial Sequence
  chemically synthesized
taacttctgcctgccattcatg

SEQ ID NO: 53547 - DNA, 22 bp, Artificial Sequence
  chemically synthesized
acttctgcctgccattcatggg

SEQ ID NO: 53548 - DNA, 22 bp, Artificial Sequence
  chemically synthesized
ctgcctgccattcatggggcat

SEQ ID NO: 53549 - DNA, 22 bp, Artificial Sequence
  chemically synthesized
tgcctgccattcatggggcatt

SEQ ID NO: 53550 - DNA, 22 bp, Artificial Sequence
  chemically synthesized
cctgccattcatggggcatttg

SEQ ID NO: 53551 - DNA, 22 bp, Artificial Sequence
  chemically synthesized
ccattcatggggcatttgtcac

SEQ ID NO: 53552 - DNA, 22 bp, Artificial Sequence
  chemically synthesized
atggggcatttgtcacactgtt

SEQ ID NO: 53553 - DNA, 22 bp, Artificial Sequence
  chemically synthesized
gtcacactgttggggcttccac

SEQ ID NO: 53554 - DNA, 22 bp, Artificial Sequence
  chemically synthesized
tcacactgttggggcttccacg

SEQ ID NO: 53555 - DNA, 22 bp, Artificial Sequence
  chemically synthesized
ttggggcttccacgtttagttt

SEQ ID NO: 53556 - DNA, 22 bp, Artificial Sequence
  chemically synthesized
gggcttccacgtttagttttct

SEQ ID NO: 53557 - DNA, 22 bp, Artificial Sequence
  chemically synthesized
ccacgtttagttttctctcccc

SEQ ID NO: 53558 - DNA, 22 bp, Artificial Sequence
  chemically synthesized
cacgtttagttttctctcccca

SEQ ID NO: 53559 - DNA, 22 bp, Artificial Sequence
  chemically synthesized
agttttctctccccataagcta

SEQ ID NO: 53560 - DNA, 22 bp, Artificial Sequence
  chemically synthesized
gttttctctccccataagctag

SEQ ID NO: 53561 - DNA, 22 bp, Artificial Sequence
  chemically synthesized
tctctccccataagctagcaat

SEQ ID NO: 53562 - DNA, 22 bp, Artificial Sequence
  chemically synthesized
ctctccccataagctagcaatt

SEQ ID NO: 53563 - DNA, 22 bp, Artificial Sequence
  chemically synthesized
tctccccataagctagcaattc

SEQ ID NO: 53564 - DNA, 22 bp, Artificial Sequence
  chemically synthesized
tccccataagctagcaattcct

SEQ ID NO: 53565 - DNA, 22 bp, Artificial Sequence
  chemically synthesized
cccataagctagcaattccttg

SEQ ID NO: 53566 - DNA, 22 bp, Artificial Sequence
  chemically synthesized
gcaattccttgagagaggaccc

SEQ ID NO: 53567 - DNA, 22 bp, Artificial Sequence
  chemically synthesized
cttgagagaggaccccacgtta

SEQ ID NO: 53568 - DNA, 22 bp, Artificial Sequence
  chemically synthesized
gagagaggaccccacgttactt

SEQ ID NO: 53569 - DNA, 22 bp, Artificial Sequence
  chemically synthesized
agagaggaccccacgttacttg

SEQ ID NO: 53570 - DNA, 22 bp, Artificial Sequence
  chemically synthesized
cttgcctttatccccgcacaga

SEQ ID NO: 53571 - DNA, 22 bp, Artificial Sequence
  chemically synthesized
gcctttatccccgcacagagca

SEQ ID NO: 53572 - DNA, 22 bp, Artificial Sequence
  chemically synthesized
cctttatccccgcacagagcac

SEQ ID NO: 53573 - DNA, 22 bp, Artificial Sequence
  chemically synthesized
tatccccgcacagagcacttca

SEQ ID NO: 53574 - DNA, 22 bp, Artificial Sequence
  chemically synthesized
atccccgcacagagcacttcac

SEQ ID NO: 53575 - DNA, 22 bp, Artificial Sequence
  chemically synthesized
tccccgcacagagcacttcaca

SEQ ID NO: 53576 - DNA, 22 bp, Artificial Sequence
  chemically synthesized
cacaggctgtgcaaggtaatgc

SEQ ID NO: 53577 - DNA, 22 bp, Artificial Sequence
  chemically synthesized
acaggctgtgcaaggtaatgct

SEQ ID NO: 53578 - DNA, 22 bp, Artificial Sequence
  chemically synthesized
tgcaaggtaatgctccactgag

SEQ ID NO: 53579 - DNA, 22 bp, Artificial Sequence
  chemically synthesized
cactgaggacacattctcgcct

SEQ ID NO: 53580 - DNA, 22 bp, Artificial Sequence
  chemically synthesized
aggacacattctcgcctatggg

SEQ ID NO: 53581 - DNA, 22 bp, Artificial Sequence
  chemically synthesized
tcgcctatgggaactctggagg

SEQ ID NO: 53582 - DNA, 22 bp, Artificial Sequence
  chemically synthesized
gcctatgggaactctggaggca

SEQ ID NO: 53583 - DNA, 22 bp, Artificial Sequence
  chemically synthesized
tgggaactctggaggcagggct

SEQ ID NO: 53584 - DNA, 22 bp, Artificial Sequence
  chemically synthesized
tggaggcagggctttgtggagg

SEQ ID NO: 53585 - DNA, 22 bp, Artificial Sequence
  chemically synthesized
gaggcagggctttgtggagggg

SEQ ID NO: 53586 - DNA, 22 bp, Artificial Sequence
  chemically synthesized
tgtggaggggctgccacaggct

SEQ ID NO: 53587 - DNA, 22 bp, Artificial Sequence
  chemically synthesized
gtggaggggctgccacaggctt

SEQ ID NO: 53588 - DNA, 22 bp, Artificial Sequence
  chemically synthesized
tggaggggctgccacaggctta

SEQ ID NO: 53589 - DNA, 22 bp, Artificial Sequence
  chemically synthesized
ccacaggcttatgttgcctcct

SEQ ID NO: 53590 - DNA, 22 bp, Artificial Sequence
  chemically synthesized
atgttgcctcctaggatttccc

SEQ ID NO: 53591 - DNA, 22 bp, Artificial Sequence
  chemically synthesized
tgttgcctcctaggatttccca

SEQ ID NO: 53592 - DNA, 22 bp, Artificial Sequence
  chemically synthesized
cctcctaggatttcccatgggc

SEQ ID NO: 53593 - DNA, 22 bp, Artificial Sequence
  chemically synthesized
ctaggatttcccatgggccaag

SEQ ID NO: 53594 - DNA, 22 bp, Artificial Sequence
  chemically synthesized
ggatttcccatgggccaagagg

SEQ ID NO: 53595 - DNA, 22 bp, Artificial Sequence
  chemically synthesized
cccatgggccaagagggaaaat

SEQ ID NO: 53596 - DNA, 22 bp, Artificial Sequence
  chemically synthesized
ccatgggccaagagggaaaatg

SEQ ID NO: 53597 - DNA, 22 bp, Artificial Sequence
  chemically synthesized
gggtggccatccctggtggccc

SEQ ID NO: 53598 - DNA, 22 bp, Artificial Sequence
  chemically synthesized
gtggcccctcctcatgcatcct

SEQ ID NO: 53599 - DNA, 22 bp, Artificial Sequence
  chemically synthesized
ctcatgcatcctggagagctgt

SEQ ID NO: 53600 - DNA, 22 bp, Artificial Sequence
  chemically synthesized
atgcatcctggagagctgtggg

SEQ ID NO: 53601 - DNA, 22 bp, Artificial Sequence
  chemically synthesized
gagagctgtgggcctcctctcc

SEQ ID NO: 53602 - DNA, 22 bp, Artificial Sequence
  chemically synthesized
tgggcctcctctccacaggctt

SEQ ID NO: 53603 - DNA, 22 bp, Artificial Sequence
  chemically synthesized
ctctccacaggctttgtggatc

SEQ ID NO: 53604 - DNA, 22 bp, Artificial Sequence
  chemically synthesized
tccacaggctttgtggatcttc

SEQ ID NO: 53605 - DNA, 22 bp, Artificial Sequence
  chemically synthesized
cacaggctttgtggatcttctt

SEQ ID NO: 53606 - DNA, 22 bp, Artificial Sequence
  chemically synthesized
tgtggatcttcttcagagccag

SEQ ID NO: 53607 - DNA, 22 bp, Artificial Sequence
  chemically synthesized
gtggatcttcttcagagccagt

SEQ ID NO: 53608 - DNA, 22 bp, Artificial Sequence
  chemically synthesized
tggatcttcttcagagccagtg

SEQ ID NO: 53609 - DNA, 22 bp, Artificial Sequence
  chemically synthesized
cttcagagccagtgagtcagcc

SEQ ID NO: 53610 - DNA, 22 bp, Artificial Sequence
  chemically synthesized
ttcagagccagtgagtcagcct

SEQ ID NO: 53611 - DNA, 22 bp, Artificial Sequence
  chemically synthesized
cagagccagtgagtcagccttg

SEQ ID NO: 53612 - DNA, 22 bp, Artificial Sequence
  chemically synthesized
agagccagtgagtcagccttgc

SEQ ID NO: 53613 - DNA, 22 bp, Artificial Sequence
  chemically synthesized
gctgtggtggcccacaaggagt

SEQ ID NO: 53614 - DNA, 22 bp, Artificial Sequence
  chemically synthesized
ctgtggtggcccacaaggagtg

SEQ ID NO: 53615 - DNA, 22 bp, Artificial Sequence
  chemically synthesized
tggtggcccacaaggagtggag

SEQ ID NO: 53616 - DNA, 22 bp, Artificial Sequence
  chemically synthesized
ggggacagggcaaaagctcatg

SEQ ID NO: 53617 - DNA, 22 bp, Artificial Sequence
  chemically synthesized
gggacagggcaaaagctcatgt

SEQ ID NO: 53618 - DNA, 22 bp, Artificial Sequence
  chemically synthesized
atgtgatagggatgctgtctct

SEQ ID NO: 53619 - DNA, 22 bp, Artificial Sequence
  chemically synthesized
tctctgcaaccacatggatttt

SEQ ID NO: 53620 - DNA, 22 bp, Artificial Sequence
  chemically synthesized
tgcaaccacatggattttaata

SEQ ID NO: 53621 - DNA, 22 bp, Artificial Sequence
  chemically synthesized
caaccacatggattttaatagt

SEQ ID NO: 53622 - DNA, 22 bp, Artificial Sequence
  chemically synthesized
taatagttacccatggctggct

SEQ ID NO: 53623 - DNA, 22 bp, Artificial Sequence
  chemically synthesized
aatagttacccatggctggctt

SEQ ID NO: 53624 - DNA, 22 bp, Artificial Sequence
  chemically synthesized
atagttacccatggctggcttc

SEQ ID NO: 53625 - DNA, 22 bp, Artificial Sequence
  chemically synthesized
cccatggctggcttcagctttt

SEQ ID NO: 53626 - DNA, 22 bp, Artificial Sequence
  chemically synthesized
gcttcagctttttttgtgaatg

SEQ ID NO: 53627 - DNA, 22 bp, Artificial Sequence
  chemically synthesized
cagctttttttgtgaatggcag

SEQ ID NO: 53628 - DNA, 22 bp, Artificial Sequence
  chemically synthesized
agctttttttgtgaatggcagc

SEQ ID NO: 53629 - DNA, 22 bp, Artificial Sequence
  chemically synthesized
tttttgtgaatggcagccaaaa

SEQ ID NO: 53630 - DNA, 22 bp, Artificial Sequence
  chemically synthesized
ttttgtgaatggcagccaaaaa

SEQ ID NO: 53631 - DNA, 22 bp, Artificial Sequence
  chemically synthesized
tttgtgaatggcagccaaaaag

SEQ ID NO: 53632 - DNA, 22 bp, Artificial Sequence
  chemically synthesized
ttgtgaatggcagccaaaaagt

SEQ ID NO: 53633 - DNA, 22 bp, Artificial Sequence
  chemically synthesized
tgtgaatggcagccaaaaagtg

SEQ ID NO: 53634 - DNA, 22 bp, Artificial Sequence
  chemically synthesized
gtgaatggcagccaaaaagtgt

SEQ ID NO: 53635 - DNA, 22 bp, Artificial Sequence
  chemically synthesized
tgaatggcagccaaaaagtgtg

SEQ ID NO: 53636 - DNA, 22 bp, Artificial Sequence
  chemically synthesized
agtggagacagaggggagactg

SEQ ID NO: 53637 - DNA, 22 bp, Artificial Sequence
  chemically synthesized
ttgaatttgtggagtttttagt

SEQ ID NO: 53638 - DNA, 22 bp, Artificial Sequence
  chemically synthesized
aatttgtggagtttttagttct

SEQ ID NO: 53639 - DNA, 22 bp, Artificial Sequence
  chemically synthesized
gtggagtttttagttcttccta

SEQ ID NO: 53640 - DNA, 22 bp, Artificial Sequence
  chemically synthesized
tggagtttttagttcttcctaa

SEQ ID NO: 53641 - DNA, 22 bp, Artificial Sequence
  chemically synthesized
ttagttcttcctaaacagagag

SEQ ID NO: 53642 - DNA, 22 bp, Artificial Sequence
  chemically synthesized
tagttcttcctaaacagagagc

SEQ ID NO: 53643 - DNA, 22 bp, Artificial Sequence
  chemically synthesized
agttcttcctaaacagagagca

SEQ ID NO: 53644 - DNA, 22 bp, Artificial Sequence
  chemically synthesized
gttcttcctaaacagagagcaa

SEQ ID NO: 53645 - DNA, 22 bp, Artificial Sequence
  chemically synthesized
ttcctaaacagagagcaacaga

SEQ ID NO: 53646 - DNA, 22 bp, Artificial Sequence
  chemically synthesized
cctaaacagagagcaacagaca

SEQ ID NO: 53647 - DNA, 22 bp, Artificial Sequence
  chemically synthesized
ctaaacagagagcaacagacaa

SEQ ID NO: 53648 - DNA, 22 bp, Artificial Sequence
  chemically synthesized
aacagagagcaacagacaagag

SEQ ID NO: 53649 - DNA, 22 bp, Artificial Sequence
  chemically synthesized
cagacaaattaattcttttcgt

SEQ ID NO: 53650 - DNA, 22 bp, Artificial Sequence
  chemically synthesized
attcttttcgttaatttaccct

SEQ ID NO: 53651 - DNA, 22 bp, Artificial Sequence
  chemically synthesized
ttttcgttaatttaccctcaac

SEQ ID NO: 53652 - DNA, 22 bp, Artificial Sequence
  chemically synthesized
ttcgttaatttaccctcaacta

SEQ ID NO: 53653 - DNA, 22 bp, Artificial Sequence
  chemically synthesized
tcgttaatttaccctcaactac

SEQ ID NO: 53654 - DNA, 22 bp, Artificial Sequence
  chemically synthesized
cgttaatttaccctcaactact

SEQ ID NO: 53655 - DNA, 22 bp, Artificial Sequence
  chemically synthesized
gttaatttaccctcaactactg

SEQ ID NO: 53656 - DNA, 22 bp, Artificial Sequence
  chemically synthesized
atttaccctcaactactggcca

SEQ ID NO: 53657 - DNA, 22 bp, Artificial Sequence
  chemically synthesized
accctcaactactggccaagaa

SEQ ID NO: 53658 - DNA, 22 bp, Artificial Sequence
  chemically synthesized
ccctcaactactggccaagaag

SEQ ID NO: 53659 - DNA, 22 bp, Artificial Sequence
  chemically synthesized
aactactggccaagaaggggtg

SEQ ID NO: 53660 - DNA, 22 bp, Artificial Sequence
  chemically synthesized
ctggccaagaaggggtgtaact

SEQ ID NO: 53661 - DNA, 22 bp, Artificial Sequence
  chemically synthesized
gccaagaaggggtgtaactcag

SEQ ID NO: 53662 - DNA, 22 bp, Artificial Sequence
  chemically synthesized
agaatgttttcttcttttgtgc

SEQ ID NO: 53663 - DNA, 22 bp, Artificial Sequence
  chemically synthesized
tcttcttttgtgccctgagtag

SEQ ID NO: 53664 - DNA, 22 bp, Artificial Sequence
  chemically synthesized
cttcttttgtgccctgagtagc

SEQ ID NO: 53665 - DNA, 22 bp, Artificial Sequence
  chemically synthesized
ttcttttgtgccctgagtagca

SEQ ID NO: 53666 - DNA, 22 bp, Artificial Sequence
  chemically synthesized
cttttgtgccctgagtagcaga

SEQ ID NO: 53667 - DNA, 22 bp, Artificial Sequence
  chemically synthesized
ttttgtgccctgagtagcagac

SEQ ID NO: 53668 - DNA, 22 bp, Artificial Sequence
  chemically synthesized
ttgtgccctgagtagcagaccc

SEQ ID NO: 53669 - DNA, 22 bp, Artificial Sequence
  chemically synthesized
tgtgccctgagtagcagaccca

SEQ ID NO: 53670 - DNA, 22 bp, Artificial Sequence
  chemically synthesized
gtgccctgagtagcagacccag

SEQ ID NO: 53671 - DNA, 22 bp, Artificial Sequence
  chemically synthesized
tgccctgagtagcagacccaga

SEQ ID NO: 53672 - DNA, 22 bp, Artificial Sequence
  chemically synthesized
agtagcagacccagagtctgga

SEQ ID NO: 53673 - DNA, 22 bp, Artificial Sequence
  chemically synthesized
gagacccagattctaggcctgg

SEQ ID NO: 53674 - DNA, 22 bp, Artificial Sequence
  chemically synthesized
taggcctggcttggccaacgac

SEQ ID NO: 53675 - DNA, 22 bp, Artificial Sequence
  chemically synthesized
ggcctggcttggccaacgacaa

SEQ ID NO: 53676 - DNA, 22 bp, Artificial Sequence
  chemically synthesized
gcttggccaacgacaagcaggg

SEQ ID NO: 53677 - DNA, 22 bp, Artificial Sequence
  chemically synthesized
ggccaacgacaagcagggtgac

SEQ ID NO: 53678 - DNA, 22 bp, Artificial Sequence
  chemically synthesized
gccaacgacaagcagggtgacc

SEQ ID NO: 53679 - DNA, 22 bp, Artificial Sequence
  chemically synthesized
gggttaaaaaaaaaaaaaggca

SEQ ID NO: 53680 - DNA, 22 bp, Artificial Sequence
  chemically synthesized
ggttaaaaaaaaaaaaaggcat

SEQ ID NO: 53681 - DNA, 22 bp, Artificial Sequence
  chemically synthesized
aaaaaaaaaaaaggcatcattc

SEQ ID NO: 53682 - DNA, 22 bp, Artificial Sequence
  chemically synthesized
tctgagtctcactccctcttct

SEQ ID NO: 53683 - DNA, 22 bp, Artificial Sequence
  chemically synthesized
tgagtctcactccctcttctca

SEQ ID NO: 53684 - DNA, 22 bp, Artificial Sequence
  chemically synthesized
agtctcactccctcttctcaaa

SEQ ID NO: 53685 - DNA, 22 bp, Artificial Sequence
  chemically synthesized
actccctcttctcaaaaagatg

SEQ ID NO: 53686 - DNA, 22 bp, Artificial Sequence
  chemically synthesized
cctcttctcaaaaagatggcaa

SEQ ID NO: 53687 - DNA, 22 bp, Artificial Sequence
  chemically synthesized
ttctcaaaaagatggcaattcc

SEQ ID NO: 53688 - DNA, 22 bp, Artificial Sequence
  chemically synthesized
ctcaaaaagatggcaattcctc

SEQ ID NO: 53689 - DNA, 22 bp, Artificial Sequence
  chemically synthesized
tcaaaaagatggcaattcctcc

SEQ ID NO: 53690 - DNA, 22 bp, Artificial Sequence
  chemically synthesized
aaaaagatggcaattcctcccc

SEQ ID NO: 53691 - DNA, 22 bp, Artificial Sequence
  chemically synthesized
ctcccccgctggttttccatag

SEQ ID NO: 53692 - DNA, 22 bp, Artificial Sequence
  chemically synthesized
ccccgctggttttccatagttg

SEQ ID NO: 53693 - DNA, 22 bp, Artificial Sequence
  chemically synthesized
gttttccatagttgaggtagca

SEQ ID NO: 53694 - DNA, 22 bp, Artificial Sequence
  chemically synthesized
tccatagttgaggtagcaagcc

SEQ ID NO: 53695 - DNA, 22 bp, Artificial Sequence
  chemically synthesized
ccatagttgaggtagcaagcca

SEQ ID NO: 53696 - DNA, 22 bp, Artificial Sequence
  chemically synthesized
catagttgaggtagcaagccaa

SEQ ID NO: 53697 - DNA, 22 bp, Artificial Sequence
  chemically synthesized
aggtagcaagccaatgtgttgg

SEQ ID NO: 53698 - DNA, 22 bp, Artificial Sequence
  chemically synthesized
gggtagctgaaaacgccctgtg

SEQ ID NO: 53699 - DNA, 22 bp, Artificial Sequence
  chemically synthesized
aaaacgccctgtgcatactgag

SEQ ID NO: 53700 - DNA, 22 bp, Artificial Sequence
  chemically synthesized
tgcatactgaggcttatgttcc

SEQ ID NO: 53701 - DNA, 22 bp, Artificial Sequence
  chemically synthesized
aggcttatgttccatggggggc

SEQ ID NO: 53702 - DNA, 22 bp, Artificial Sequence
  chemically synthesized
atgttccatggggggccagggg

SEQ ID NO: 53703 - DNA, 22 bp, Artificial Sequence
  chemically synthesized
tgttccatggggggccaggggc

SEQ ID NO: 53704 - DNA, 22 bp, Artificial Sequence
  chemically synthesized
catggggggccaggggccagga

SEQ ID NO: 53705 - DNA, 22 bp, Artificial Sequence
  chemically synthesized
tcatctccagctgggaggtgat

SEQ ID NO: 53706 - DNA, 22 bp, Artificial Sequence
  chemically synthesized
cagctgggaggtgatggccatg

SEQ ID NO: 53707 - DNA, 22 bp, Artificial Sequence
  chemically synthesized
ggaggtgatggccatgcctgca

SEQ ID NO: 53708 - DNA, 22 bp, Artificial Sequence
  chemically synthesized
cacccctctggccagcagaggg

SEQ ID NO: 53709 - DNA, 22 bp, Artificial Sequence
  chemically synthesized
tggccagcagagggtggtcagt

SEQ ID NO: 53710 - DNA, 22 bp, Artificial Sequence
  chemically synthesized
gccagcagagggtggtcagtag

SEQ ID NO: 53711 - DNA, 22 bp, Artificial Sequence
  chemically synthesized
ggaggccattagggcaaccttc

SEQ ID NO: 53712 - DNA, 22 bp, Artificial Sequence
  chemically synthesized
gggcaaccttctattggctcag

SEQ ID NO: 53713 - DNA, 22 bp, Artificial Sequence
  chemically synthesized
ctattggctcagactcagaatg

SEQ ID NO: 53714 - DNA, 22 bp, Artificial Sequence
  chemically synthesized
tattggctcagactcagaatgc

SEQ ID NO: 53715 - DNA, 22 bp, Artificial Sequence
  chemically synthesized
ttggctcagactcagaatgcag

SEQ ID NO: 53716 - DNA, 22 bp, Artificial Sequence
  chemically synthesized
gctcagactcagaatgcagtag

SEQ ID NO: 53717 - DNA, 22 bp, Artificial Sequence
  chemically synthesized
agactcagaatgcagtagaact

SEQ ID NO: 53718 - DNA, 22 bp, Artificial Sequence
  chemically synthesized
agaatgcagtagaacttgtgcc

SEQ ID NO: 53719 - DNA, 22 bp, Artificial Sequence
  chemically synthesized
gtgccctgtagtgttcatggac

SEQ ID NO: 53720 - DNA, 22 bp, Artificial Sequence
  chemically synthesized
tgccctgtagtgttcatggaca

SEQ ID NO: 53721 - DNA, 22 bp, Artificial Sequence
  chemically synthesized
tagtgttcatggacaggagtga

SEQ ID NO: 53722 - DNA, 22 bp, Artificial Sequence
  chemically synthesized
atggacaggagtgagaggagga

SEQ ID NO: 53723 - DNA, 22 bp, Artificial Sequence
  chemically synthesized
aggggatgtggctgtcaaggcc

SEQ ID NO: 53724 - DNA, 22 bp, Artificial Sequence
  chemically synthesized
tcaaggcctttctaggggcgat

SEQ ID NO: 53725 - DNA, 22 bp, Artificial Sequence
  chemically synthesized
tctaggggcgatgctgtctctc

SEQ ID NO: 53726 - DNA, 22 bp, Artificial Sequence
  chemically synthesized
ctaggggcgatgctgtctctcc

SEQ ID NO: 53727 - DNA, 22 bp, Artificial Sequence
  chemically synthesized
taggggcgatgctgtctctccc

SEQ ID NO: 53728 - DNA, 22 bp, Artificial Sequence
  chemically synthesized
ggggcgatgctgtctctccctc

SEQ ID NO: 53729 - DNA, 22 bp, Artificial Sequence
  chemically synthesized
tctctccctcagcatagggagt

SEQ ID NO: 53730 - DNA, 22 bp, Artificial Sequence
  chemically synthesized
tccctcagcatagggagtgggc

SEQ ID NO: 53731 - DNA, 22 bp, Artificial Sequence
  chemically synthesized
cctcagcatagggagtgggccc

SEQ ID NO: 53732 - DNA, 22 bp, Artificial Sequence
  chemically synthesized
agcatagggagtgggcccttcc

SEQ ID NO: 53733 - DNA, 22 bp, Artificial Sequence
  chemically synthesized
ccacctctggcctctctccccc

SEQ ID NO: 53734 - DNA, 22 bp, Artificial Sequence
  chemically synthesized
cacctctggcctctctccccca

SEQ ID NO: 53735 - DNA, 22 bp, Artificial Sequence
  chemically synthesized
tggcctctctcccccagggctg

SEQ ID NO: 53736 - DNA, 22 bp, Artificial Sequence
  chemically synthesized
gcctctctcccccagggctgtg

SEQ ID NO: 53737 - DNA, 22 bp, Artificial Sequence
  chemically synthesized
tctcccccagggctgtgtctgg

SEQ ID NO: 53738 - DNA, 22 bp, Artificial Sequence
  chemically synthesized
tcccccagggctgtgtctggct

SEQ ID NO: 53739 - DNA, 22 bp, Artificial Sequence
  chemically synthesized
ccccagggctgtgtctggctgt

SEQ ID NO: 53740 - DNA, 22 bp, Artificial Sequence
  chemically synthesized
tgtctggctgtccctgataaaa

SEQ ID NO: 53741 - DNA, 22 bp, Artificial Sequence
  chemically synthesized
gctgtccctgataaaactgtga

SEQ ID NO: 53742 - DNA, 22 bp, Artificial Sequence
  chemically synthesized
tccctgataaaactgtgagatg

SEQ ID NO: 53743 - DNA, 22 bp, Artificial Sequence
  chemically synthesized
ataaaactgtgagatggtgtgc

SEQ ID NO: 53744 - DNA, 22 bp, Artificial Sequence
  chemically synthesized
tgagatggtgtgcagtgtcgga

SEQ ID NO: 53745 - DNA, 22 bp, Artificial Sequence
  chemically synthesized
agtgccagagtttccgcgacca

SEQ ID NO: 53746 - DNA, 22 bp, Artificial Sequence
  chemically synthesized
ccgcgaccatatgaaaagcgtc

SEQ ID NO: 53747 - DNA, 22 bp, Artificial Sequence
  chemically synthesized
cgcgaccatatgaaaagcgtca

SEQ ID NO: 53748 - DNA, 22 bp, Artificial Sequence
  chemically synthesized
catccgatggtcccagtgttgc

SEQ ID NO: 53749 - DNA, 22 bp, Artificial Sequence
  chemically synthesized
cttgtgtgaagaaagcctccta

SEQ ID NO: 53750 - DNA, 22 bp, Artificial Sequence
  chemically synthesized
gtgtgaagaaagcctcctacct

SEQ ID NO: 53751 - DNA, 22 bp, Artificial Sequence
  chemically synthesized
tgtgaagaaagcctcctacctt

SEQ ID NO: 53752 - DNA, 22 bp, Artificial Sequence
  chemically synthesized
ctaccttgattgcatcagggcc

SEQ ID NO: 53753 - DNA, 22 bp, Artificial Sequence
  chemically synthesized
ccttgattgcatcagggccatt

SEQ ID NO: 53754 - DNA, 22 bp, Artificial Sequence
  chemically synthesized
atgcaatcaaggtaggaggctt

SEQ ID NO: 53755 - DNA, 22 bp, Artificial Sequence
  chemically synthesized
tcttcacacaagcaacactggg

SEQ ID NO: 53756 - DNA, 22 bp, Artificial Sequence
  chemically synthesized
cttcacacaagcaacactggga

SEQ ID NO: 53757 - DNA, 22 bp, Artificial Sequence
  chemically synthesized
ttcacacaagcaacactgggac

SEQ ID NO: 53758 - DNA, 22 bp, Artificial Sequence
  chemically synthesized
cacacaagcaacactgggacca

SEQ ID NO: 53759 - DNA, 22 bp, Artificial Sequence
  chemically synthesized
acacaagcaacactgggaccat

SEQ ID NO: 53760 - DNA, 22 bp, Artificial Sequence
  chemically synthesized
ggaccatcggatggaatgacgc

SEQ ID NO: 53761 - DNA, 22 bp, Artificial Sequence
  chemically synthesized
ttcatatggtcgcggaaactct

SEQ ID NO: 53762 - DNA, 22 bp, Artificial Sequence
  chemically synthesized
tcatatggtcgcggaaactctg

SEQ ID NO: 53763 - DNA, 22 bp, Artificial Sequence
  chemically synthesized
catatggtcgcggaaactctgg

SEQ ID NO: 53764 - DNA, 22 bp, Artificial Sequence
  chemically synthesized
atatggtcgcggaaactctggc

SEQ ID NO: 53765 - DNA, 22 bp, Artificial Sequence
  chemically synthesized
tggcacttagtggcctcatgct

SEQ ID NO: 53766 - DNA, 22 bp, Artificial Sequence
  chemically synthesized
gcacttagtggcctcatgctcc

SEQ ID NO: 53767 - DNA, 22 bp, Artificial Sequence
  chemically synthesized
agtggcctcatgctccgacact

SEQ ID NO: 53768 - DNA, 22 bp, Artificial Sequence
  chemically synthesized
gtggcctcatgctccgacactg

SEQ ID NO: 53769 - DNA, 22 bp, Artificial Sequence
  chemically synthesized
atgctccgacactgcacaccat

SEQ ID NO: 53770 - DNA, 22 bp, Artificial Sequence
  chemically synthesized
cgacactgcacaccatctcaca

SEQ ID NO: 53771 - DNA, 22 bp, Artificial Sequence
  chemically synthesized
cacaccatctcacagttttatc

SEQ ID NO: 53772 - DNA, 22 bp, Artificial Sequence
  chemically synthesized
acagttttatcagggacagcca

SEQ ID NO: 53773 - DNA, 22 bp, Artificial Sequence
  chemically synthesized
tatcagggacagccagacacag

SEQ ID NO: 53774 - DNA, 22 bp, Artificial Sequence
  chemically synthesized
atcagggacagccagacacagc

SEQ ID NO: 53775 - DNA, 22 bp, Artificial Sequence
  chemically synthesized
tcagggacagccagacacagcc

SEQ ID NO: 53776 - DNA, 22 bp, Artificial Sequence
  chemically synthesized
ggggagagaggccagaggtgga

SEQ ID NO: 53777 - DNA, 22 bp, Artificial Sequence
  chemically synthesized
cctatgctgagggagagacagc

SEQ ID NO: 53778 - DNA, 22 bp, Artificial Sequence
  chemically synthesized
tgctgagggagagacagcatcg

SEQ ID NO: 53779 - DNA, 22 bp, Artificial Sequence
  chemically synthesized
agggagagacagcatcgcccct

SEQ ID NO: 53780 - DNA, 22 bp, Artificial Sequence
  chemically synthesized
gaaaggccttgacagccacatc

SEQ ID NO: 53781 - DNA, 22 bp, Artificial Sequence
  chemically synthesized
gacagccacatcccctcagtcc

SEQ ID NO: 53782 - DNA, 22 bp, Artificial Sequence
  chemically synthesized
acagccacatcccctcagtcct

SEQ ID NO: 53783 - DNA, 22 bp, Artificial Sequence
  chemically synthesized
agtcctgtcctcctctcactcc

SEQ ID NO: 53784 - DNA, 22 bp, Artificial Sequence
  chemically synthesized
tcctcctctcactcctgtccat

SEQ ID NO: 53785 - DNA, 22 bp, Artificial Sequence
  chemically synthesized
ctctcactcctgtccatgaaca

SEQ ID NO: 53786 - DNA, 22 bp, Artificial Sequence
  chemically synthesized
tcactcctgtccatgaacacta

SEQ ID NO: 53787 - DNA, 22 bp, Artificial Sequence
  chemically synthesized
actcctgtccatgaacactaca

SEQ ID NO: 53788 - DNA, 22 bp, Artificial Sequence
  chemically synthesized
ctgtccatgaacactacagggc

SEQ ID NO: 53789 - DNA, 22 bp, Artificial Sequence
  chemically synthesized
tccatgaacactacagggcaca

SEQ ID NO: 53790 - DNA, 22 bp, Artificial Sequence
  chemically synthesized
cagggcacaagttctactgcat

SEQ ID NO: 53791 - DNA, 22 bp, Artificial Sequence
  chemically synthesized
tactgcattctgagtctgagcc

SEQ ID NO: 53792 - DNA, 22 bp, Artificial Sequence
  chemically synthesized
ctgcattctgagtctgagccaa

SEQ ID NO: 53793 - DNA, 22 bp, Artificial Sequence
  chemically synthesized
cattctgagtctgagccaatag

SEQ ID NO: 53794 - DNA, 22 bp, Artificial Sequence
  chemically synthesized
tgagtctgagccaatagaaggt

SEQ ID NO: 53795 - DNA, 22 bp, Artificial Sequence
  chemically synthesized
agtctgagccaatagaaggttg

SEQ ID NO: 53796 - DNA, 22 bp, Artificial Sequence
  chemically synthesized
agccaatagaaggttgccctaa

SEQ ID NO: 53797 - DNA, 22 bp, Artificial Sequence
  chemically synthesized
ccctaatggcctcccagtttcc

SEQ ID NO: 53798 - DNA, 22 bp, Artificial Sequence
  chemically synthesized
atggcctcccagtttcctactg

SEQ ID NO: 53799 - DNA, 22 bp, Artificial Sequence
  chemically synthesized
ccagtttcctactgaccaccct

SEQ ID NO: 53800 - DNA, 22 bp, Artificial Sequence
  chemically synthesized
cctactgaccaccctctgctgg

SEQ ID NO: 53801 - DNA, 22 bp, Artificial Sequence
  chemically synthesized
ctactgaccaccctctgctggc

SEQ ID NO: 53802 - DNA, 22 bp, Artificial Sequence
  chemically synthesized
ctgaccaccctctgctggccag

SEQ ID NO: 53803 - DNA, 22 bp, Artificial Sequence
  chemically synthesized
accaccctctgctggccagagg

SEQ ID NO: 53804 - DNA, 22 bp, Artificial Sequence
  chemically synthesized
tgctggccagaggggtgcaggc

SEQ ID NO: 53805 - DNA, 22 bp, Artificial Sequence
  chemically synthesized
ctggccagaggggtgcaggcat

SEQ ID NO: 53806 - DNA, 22 bp, Artificial Sequence
  chemically synthesized
gccagaggggtgcaggcatggc

SEQ ID NO: 53807 - DNA, 22 bp, Artificial Sequence
  chemically synthesized
ccagctggagatgacaatctgc

SEQ ID NO: 53808 - DNA, 22 bp, Artificial Sequence
  chemically synthesized
gagatgacaatctgctcctctg

SEQ ID NO: 53809 - DNA, 22 bp, Artificial Sequence
  chemically synthesized
ctcctctgtatccgccttgtct

SEQ ID NO: 53810 - DNA, 22 bp, Artificial Sequence
  chemically synthesized
ctctgtatccgccttgtctcct

SEQ ID NO: 53811 - DNA, 22 bp, Artificial Sequence
  chemically synthesized
tgtatccgccttgtctcctccc

SEQ ID NO: 53812 - DNA, 22 bp, Artificial Sequence
  chemically synthesized
tatccgccttgtctcctcccat

SEQ ID NO: 53813 - DNA, 22 bp, Artificial Sequence
  chemically synthesized
gtctcctcccatcactgtcctg

SEQ ID NO: 53814 - DNA, 22 bp, Artificial Sequence
  chemically synthesized
tctcctcccatcactgtcctgg

SEQ ID NO: 53815 - DNA, 22 bp, Artificial Sequence
  chemically synthesized
ctcccatcactgtcctggcccc

SEQ ID NO: 53816 - DNA, 22 bp, Artificial Sequence
  chemically synthesized
ccatcactgtcctggcccctgg

SEQ ID NO: 53817 - DNA, 22 bp, Artificial Sequence
  chemically synthesized
tcctggcccctggccccccatg

SEQ ID NO: 53818 - DNA, 22 bp, Artificial Sequence
  chemically synthesized
gcccctggccccccatggaaca

SEQ ID NO: 53819 - DNA, 22 bp, Artificial Sequence
  chemically synthesized
gccccccatggaacataagcct

SEQ ID NO: 53820 - DNA, 22 bp, Artificial Sequence
  chemically synthesized
agtatgcacagggcgttttcag

SEQ ID NO: 53821 - DNA, 22 bp, Artificial Sequence
  chemically synthesized
tcagctaccccaacacattggc

SEQ ID NO: 53822 - DNA, 22 bp, Artificial Sequence
  chemically synthesized
cagctaccccaacacattggct

SEQ ID NO: 53823 - DNA, 22 bp, Artificial Sequence
  chemically synthesized
agctaccccaacacattggctt

SEQ ID NO: 53824 - DNA, 22 bp, Artificial Sequence
  chemically synthesized
ccccaacacattggcttgctac

SEQ ID NO: 53825 - DNA, 22 bp, Artificial Sequence
  chemically synthesized
gcttgctacctcaactatggaa

SEQ ID NO: 53826 - DNA, 22 bp, Artificial Sequence
  chemically synthesized
gctacctcaactatggaaaacc

SEQ ID NO: 53827 - DNA, 22 bp, Artificial Sequence
  chemically synthesized
ctacctcaactatggaaaacca

SEQ ID NO: 53828 - DNA, 22 bp, Artificial Sequence
  chemically synthesized
cctcaactatggaaaaccagcg

SEQ ID NO: 53829 - DNA, 22 bp, Artificial Sequence
  chemically synthesized
aactatggaaaaccagcggggg

SEQ ID NO: 53830 - DNA, 22 bp, Artificial Sequence
  chemically synthesized
tggaaaaccagcgggggaggaa

SEQ ID NO: 53831 - DNA, 22 bp, Artificial Sequence
  chemically synthesized
ccatctttttgagaagagggag

SEQ ID NO: 53832 - DNA, 22 bp, Artificial Sequence
  chemically synthesized
tttgagaagagggagtgagact

SEQ ID NO: 53833 - DNA, 22 bp, Artificial Sequence
  chemically synthesized
ttgagaagagggagtgagactc

SEQ ID NO: 53834 - DNA, 22 bp, Artificial Sequence
  chemically synthesized
tgagaagagggagtgagactca

SEQ ID NO: 53835 - DNA, 22 bp, Artificial Sequence
  chemically synthesized
gagaagagggagtgagactcag

SEQ ID NO: 53836 - DNA, 22 bp, Artificial Sequence
  chemically synthesized
agaagagggagtgagactcaga

SEQ ID NO: 53837 - DNA, 22 bp, Artificial Sequence
  chemically synthesized
agagaatgatgccttttttttt

SEQ ID NO: 53838 - DNA, 22 bp, Artificial Sequence
  chemically synthesized
tttttttttttaacccaaggtc

SEQ ID NO: 53839 - DNA, 22 bp, Artificial Sequence
  chemically synthesized
ttttttttttaacccaaggtca

SEQ ID NO: 53840 - DNA, 22 bp, Artificial Sequence
  chemically synthesized
tttttttttaacccaaggtcac

SEQ ID NO: 53841 - DNA, 22 bp, Artificial Sequence
  chemically synthesized
ttttttttaacccaaggtcacc

SEQ ID NO: 53842 - DNA, 22 bp, Artificial Sequence
  chemically synthesized
tttttttaacccaaggtcaccc

SEQ ID NO: 53843 - DNA, 22 bp, Artificial Sequence
  chemically synthesized
ttttttaacccaaggtcaccct

SEQ ID NO: 53844 - DNA, 22 bp, Artificial Sequence
  chemically synthesized
tttttaacccaaggtcaccctg

SEQ ID NO: 53845 - DNA, 22 bp, Artificial Sequence
  chemically synthesized
ttttaacccaaggtcaccctgc

SEQ ID NO: 53846 - DNA, 22 bp, Artificial Sequence
  chemically synthesized
tttaacccaaggtcaccctgct

SEQ ID NO: 53847 - DNA, 22 bp, Artificial Sequence
  chemically synthesized
ttaacccaaggtcaccctgctt

SEQ ID NO: 53848 - DNA, 22 bp, Artificial Sequence
  chemically synthesized
taacccaaggtcaccctgcttg

SEQ ID NO: 53849 - DNA, 22 bp, Artificial Sequence
  chemically synthesized
aacccaaggtcaccctgcttgt

SEQ ID NO: 53850 - DNA, 22 bp, Artificial Sequence
  chemically synthesized
acccaaggtcaccctgcttgtc

SEQ ID NO: 53851 - DNA, 22 bp, Artificial Sequence
  chemically synthesized
cttgtcgttggccaagccaggc

SEQ ID NO: 53852 - DNA, 22 bp, Artificial Sequence
  chemically synthesized
gtcgttggccaagccaggccta

SEQ ID NO: 53853 - DNA, 22 bp, Artificial Sequence
  chemically synthesized
tcgttggccaagccaggcctag

SEQ ID NO: 53854 - DNA, 22 bp, Artificial Sequence
  chemically synthesized
gccaagccaggcctagaatctg

SEQ ID NO: 53855 - DNA, 22 bp, Artificial Sequence
  chemically synthesized
gaatctgggtctccagactctg

SEQ ID NO: 53856 - DNA, 22 bp, Artificial Sequence
  chemically synthesized
ggtctccagactctgggtctgc

SEQ ID NO: 53857 - DNA, 22 bp, Artificial Sequence
  chemically synthesized
cagactctgggtctgctactca

SEQ ID NO: 53858 - DNA, 22 bp, Artificial Sequence
  chemically synthesized
tgggtctgctactcagggcaca

SEQ ID NO: 53859 - DNA, 22 bp, Artificial Sequence
  chemically synthesized
ggtctgctactcagggcacaaa

SEQ ID NO: 53860 - DNA, 22 bp, Artificial Sequence
  chemically synthesized
ctactcagggcacaaaagaaga

SEQ ID NO: 53861 - DNA, 22 bp, Artificial Sequence
  chemically synthesized
ctcagggcacaaaagaagaaaa

SEQ ID NO: 53862 - DNA, 22 bp, Artificial Sequence
  chemically synthesized
agggcacaaaagaagaaaacat

SEQ ID NO: 53863 - DNA, 22 bp, Artificial Sequence
  chemically synthesized
tgagttacaccccttcttggcc

SEQ ID NO: 53864 - DNA, 22 bp, Artificial Sequence
  chemically synthesized
agttacaccccttcttggccag

SEQ ID NO: 53865 - DNA, 22 bp, Artificial Sequence
  chemically synthesized
caccccttcttggccagtagtt

SEQ ID NO: 53866 - DNA, 22 bp, Artificial Sequence
  chemically synthesized
cttggccagtagttgagggtaa

SEQ ID NO: 53867 - DNA, 22 bp, Artificial Sequence
  chemically synthesized
ttggccagtagttgagggtaaa

SEQ ID NO: 53868 - DNA, 22 bp, Artificial Sequence
  chemically synthesized
ggccagtagttgagggtaaatt

SEQ ID NO: 53869 - DNA, 22 bp, Artificial Sequence
  chemically synthesized
gccagtagttgagggtaaatta

SEQ ID NO: 53870 - DNA, 22 bp, Artificial Sequence
  chemically synthesized
agggtaaattaacgaaaagaat

SEQ ID NO: 53871 - DNA, 22 bp, Artificial Sequence
  chemically synthesized
acgaaaagaattaatttgtctg

SEQ ID NO: 53872 - DNA, 22 bp, Artificial Sequence
  chemically synthesized
atttgtctgtaactcttgtctg

SEQ ID NO: 53873 - DNA, 22 bp, Artificial Sequence
  chemically synthesized
gtctgtaactcttgtctgttgc

SEQ ID NO: 53874 - DNA, 22 bp, Artificial Sequence
  chemically synthesized
tctgtaactcttgtctgttgct

SEQ ID NO: 53875 - DNA, 22 bp, Artificial Sequence
  chemically synthesized
taactcttgtctgttgctctct

SEQ ID NO: 53876 - DNA, 22 bp, Artificial Sequence
  chemically synthesized
ttgtctgttgctctctgtttag

SEQ ID NO: 53877 - DNA, 22 bp, Artificial Sequence
  chemically synthesized
gtctgttgctctctgtttagga

SEQ ID NO: 53878 - DNA, 22 bp, Artificial Sequence
  chemically synthesized
tctgttgctctctgtttaggaa

SEQ ID NO: 53879 - DNA, 22 bp, Artificial Sequence
  chemically synthesized
ttgctctctgtttaggaagaac

SEQ ID NO: 53880 - DNA, 22 bp, Artificial Sequence
  chemically synthesized
ctctctgtttaggaagaactaa

SEQ ID NO: 53881 - DNA, 22 bp, Artificial Sequence
  chemically synthesized
tctgtttaggaagaactaaaaa

SEQ ID NO: 53882 - DNA, 22 bp, Artificial Sequence
  chemically synthesized
tgtttaggaagaactaaaaact

SEQ ID NO: 53883 - DNA, 22 bp, Artificial Sequence
  chemically synthesized
tttaggaagaactaaaaactcc

SEQ ID NO: 53884 - DNA, 22 bp, Artificial Sequence
  chemically synthesized
aggaagaactaaaaactccaca

SEQ ID NO: 53885 - DNA, 22 bp, Artificial Sequence
  chemically synthesized
ggaagaactaaaaactccacaa

SEQ ID NO: 53886 - DNA, 22 bp, Artificial Sequence
  chemically synthesized
aaaactccacaaattcaacagt

SEQ ID NO: 53887 - DNA, 22 bp, Artificial Sequence
  chemically synthesized
cacaaattcaacagtctcccct

SEQ ID NO: 53888 - DNA, 22 bp, Artificial Sequence
  chemically synthesized
aacagtctcccctctgtctcca

SEQ ID NO: 53889 - DNA, 22 bp, Artificial Sequence
  chemically synthesized
ccctctgtctccactgaactat

SEQ ID NO: 53890 - DNA, 22 bp, Artificial Sequence
  chemically synthesized
tgtctccactgaactatccctc

SEQ ID NO: 53891 - DNA, 22 bp, Artificial Sequence
  chemically synthesized
tctccactgaactatccctcca

SEQ ID NO: 53892 - DNA, 22 bp, Artificial Sequence
  chemically synthesized
cactgaactatccctccatttt

SEQ ID NO: 53893 - DNA, 22 bp, Artificial Sequence
  chemically synthesized
aactatccctccattttcacca

SEQ ID NO: 53894 - DNA, 22 bp, Artificial Sequence
  chemically synthesized
tccctccattttcaccacactt

SEQ ID NO: 53895 - DNA, 22 bp, Artificial Sequence
  chemically synthesized
cattttcaccacactttttggc

SEQ ID NO: 53896 - DNA, 22 bp, Artificial Sequence
  chemically synthesized
tcaccacactttttggctgcca

SEQ ID NO: 53897 - DNA, 22 bp, Artificial Sequence
  chemically synthesized
caccacactttttggctgccat

SEQ ID NO: 53898 - DNA, 22 bp, Artificial Sequence
  chemically synthesized
accacactttttggctgccatt

SEQ ID NO: 53899 - DNA, 22 bp, Artificial Sequence
  chemically synthesized
tttggctgccattcacaaaaaa

SEQ ID NO: 53900 - DNA, 22 bp, Artificial Sequence
  chemically synthesized
ttggctgccattcacaaaaaaa

SEQ ID NO: 53901 - DNA, 22 bp, Artificial Sequence
  chemically synthesized
tggctgccattcacaaaaaaag

SEQ ID NO: 53902 - DNA, 22 bp, Artificial Sequence
  chemically synthesized
ggctgccattcacaaaaaaagc

SEQ ID NO: 53903 - DNA, 22 bp, Artificial Sequence
  chemically synthesized
gctgccattcacaaaaaaagct

SEQ ID NO: 53904 - DNA, 22 bp, Artificial Sequence
  chemically synthesized
ccattcacaaaaaaagctgaag

SEQ ID NO: 53905 - DNA, 22 bp, Artificial Sequence
  chemically synthesized
acaaaaaaagctgaagccagcc

SEQ ID NO: 53906 - DNA, 22 bp, Artificial Sequence
  chemically synthesized
aagccagccatgggtaactatt

SEQ ID NO: 53907 - DNA, 22 bp, Artificial Sequence
  chemically synthesized
ttaaaatccatgtggttgcaga

SEQ ID NO: 53908 - DNA, 22 bp, Artificial Sequence
  chemically synthesized
aaatccatgtggttgcagagac

SEQ ID NO: 53909 - DNA, 22 bp, Artificial Sequence
  chemically synthesized
cagagacagcatccctatcaca

SEQ ID NO: 53910 - DNA, 22 bp, Artificial Sequence
  chemically synthesized
tcacatgagcttttgccctgtc

SEQ ID NO: 53911 - DNA, 22 bp, Artificial Sequence
  chemically synthesized
ttgccctgtccccaaggccctc

SEQ ID NO: 53912 - DNA, 22 bp, Artificial Sequence
  chemically synthesized
tgccctgtccccaaggccctct

SEQ ID NO: 53913 - DNA, 22 bp, Artificial Sequence
  chemically synthesized
gccctgtccccaaggccctctg

SEQ ID NO: 53914 - DNA, 22 bp, Artificial Sequence
  chemically synthesized
ccctgtccccaaggccctctgt

SEQ ID NO: 53915 - DNA, 22 bp, Artificial Sequence
  chemically synthesized
tccccaaggccctctgtcatct

SEQ ID NO: 53916 - DNA, 22 bp, Artificial Sequence
  chemically synthesized
tgtcatctccactccttgtggg

SEQ ID NO: 53917 - DNA, 22 bp, Artificial Sequence
  chemically synthesized
tcatctccactccttgtgggcc

SEQ ID NO: 53918 - DNA, 22 bp, Artificial Sequence
  chemically synthesized
cactccttgtgggccaccacag

SEQ ID NO: 53919 - DNA, 22 bp, Artificial Sequence
  chemically synthesized
cttgtgggccaccacagcaagg

SEQ ID NO: 53920 - DNA, 22 bp, Artificial Sequence
  chemically synthesized
gtgggccaccacagcaaggctg

SEQ ID NO: 53921 - DNA, 22 bp, Artificial Sequence
  chemically synthesized
tgggccaccacagcaaggctga

SEQ ID NO: 53922 - DNA, 22 bp, Artificial Sequence
  chemically synthesized
actcactggctctgaagaagat

SEQ ID NO: 53923 - DNA, 22 bp, Artificial Sequence
  chemically synthesized
actggctctgaagaagatccac

SEQ ID NO: 53924 - DNA, 22 bp, Artificial Sequence
  chemically synthesized
gctctgaagaagatccacaaag

SEQ ID NO: 53925 - DNA, 22 bp, Artificial Sequence
  chemically synthesized
tgaagaagatccacaaagcctg

SEQ ID NO: 53926 - DNA, 22 bp, Artificial Sequence
  chemically synthesized
aagaagatccacaaagcctgtg

SEQ ID NO: 53927 - DNA, 22 bp, Artificial Sequence
  chemically synthesized
tggagaggaggcccacagctct

SEQ ID NO: 53928 - DNA, 22 bp, Artificial Sequence
  chemically synthesized
tccaggatgcatgaggaggggc

SEQ ID NO: 53929 - DNA, 22 bp, Artificial Sequence
  chemically synthesized
caggatgcatgaggaggggcca

SEQ ID NO: 53930 - DNA, 22 bp, Artificial Sequence
  chemically synthesized
tccctcttggcccatgggaaat

SEQ ID NO: 53931 - DNA, 22 bp, Artificial Sequence
  chemically synthesized
ccctcttggcccatgggaaatc

SEQ ID NO: 53932 - DNA, 22 bp, Artificial Sequence
  chemically synthesized
cctcttggcccatgggaaatcc

SEQ ID NO: 53933 - DNA, 22 bp, Artificial Sequence
  chemically synthesized
ttggcccatgggaaatcctagg

SEQ ID NO: 53934 - DNA, 22 bp, Artificial Sequence
  chemically synthesized
ggcccatgggaaatcctaggag

SEQ ID NO: 53935 - DNA, 22 bp, Artificial Sequence
  chemically synthesized
gcccatgggaaatcctaggagg

SEQ ID NO: 53936 - DNA, 22 bp, Artificial Sequence
  chemically synthesized
ggaggcaacataagcctgtggc

SEQ ID NO: 53937 - DNA, 22 bp, Artificial Sequence
  chemically synthesized
tggcagcccctccacaaagccc

SEQ ID NO: 53938 - DNA, 22 bp, Artificial Sequence
  chemically synthesized
cacaaagccctgcctccagagt

SEQ ID NO: 53939 - DNA, 22 bp, Artificial Sequence
  chemically synthesized
cctccagagttcccataggcga

SEQ ID NO: 53940 - DNA, 22 bp, Artificial Sequence
  chemically synthesized
cagagttcccataggcgagaat

SEQ ID NO: 53941 - DNA, 22 bp, Artificial Sequence
  chemically synthesized
ccataggcgagaatgtgtcctc

SEQ ID NO: 53942 - DNA, 22 bp, Artificial Sequence
  chemically synthesized
agtggagcattaccttgcacag

SEQ ID NO: 53943 - DNA, 22 bp, Artificial Sequence
  chemically synthesized
ccttgcacagcctgtgaagtgc

SEQ ID NO: 53944 - DNA, 22 bp, Artificial Sequence
  chemically synthesized
gcacagcctgtgaagtgctctg

SEQ ID NO: 53945 - DNA, 22 bp, Artificial Sequence
  chemically synthesized
cacagcctgtgaagtgctctgt

SEQ ID NO: 53946 - DNA, 22 bp, Artificial Sequence
  chemically synthesized
tgaagtgctctgtgcggggata

SEQ ID NO: 53947 - DNA, 22 bp, Artificial Sequence
  chemically synthesized
tgtgcggggataaaggcaagta

SEQ ID NO: 53948 - DNA, 22 bp, Artificial Sequence
  chemically synthesized
tgcggggataaaggcaagtaac

SEQ ID NO: 53949 - DNA, 22 bp, Artificial Sequence
  chemically synthesized
tctcaaggaattgctagcttat

SEQ ID NO: 53950 - DNA, 22 bp, Artificial Sequence
  chemically synthesized
tcaaggaattgctagcttatgg

SEQ ID NO: 53951 - DNA, 22 bp, Artificial Sequence
  chemically synthesized
aaggaattgctagcttatgggg

SEQ ID NO: 53952 - DNA, 22 bp, Artificial Sequence
  chemically synthesized
ctagcttatggggagagaaaac

SEQ ID NO: 53953 - DNA, 22 bp, Artificial Sequence
  chemically synthesized
gcttatggggagagaaaactaa

SEQ ID NO: 53954 - DNA, 22 bp, Artificial Sequence
  chemically synthesized
atggggagagaaaactaaacgt

SEQ ID NO: 53955 - DNA, 22 bp, Artificial Sequence
  chemically synthesized
tggggagagaaaactaaacgtg

SEQ ID NO: 53956 - DNA, 22 bp, Artificial Sequence
  chemically synthesized
aacgtggaagccccaacagtgt

SEQ ID NO: 53957 - DNA, 22 bp, Artificial Sequence
  chemically synthesized
gagtatgaagggggccccacct

SEQ ID NO: 53958 - DNA, 22 bp, Artificial Sequence
  chemically synthesized
aggaggtcggggagtgtggcgt

SEQ ID NO: 53959 - DNA, 22 bp, Artificial Sequence
  chemically synthesized
ccccatagcaggatgtgtgcaa

SEQ ID NO: 53960 - DNA, 22 bp, Artificial Sequence
  chemically synthesized
ccactggtactcagcatctgcc

SEQ ID NO: 53961 - DNA, 22 bp, Artificial Sequence
  chemically synthesized
gtactcagcatctgccacctcg

SEQ ID NO: 53962 - DNA, 22 bp, Artificial Sequence
  chemically synthesized
agcatctgccacctcgctgacc

SEQ ID NO: 53963 - DNA, 22 bp, Artificial Sequence
  chemically synthesized
ccacctcgctgaccctcatttg

SEQ ID NO: 53964 - DNA, 22 bp, Artificial Sequence
  chemically synthesized
gctgaccctcatttgaccctcc

SEQ ID NO: 53965 - DNA, 22 bp, Artificial Sequence
  chemically synthesized
accctcatttgaccctcccagg

SEQ ID NO: 53966 - DNA, 22 bp, Artificial Sequence
  chemically synthesized
atttgaccctcccaggcaagtg

SEQ ID NO: 53967 - DNA, 22 bp, Artificial Sequence
  chemically synthesized
gaccctcccaggcaagtgctgt

SEQ ID NO: 53968 - DNA, 22 bp, Artificial Sequence
  chemically synthesized
accctcccaggcaagtgctgtg

SEQ ID NO: 53969 - DNA, 22 bp, Artificial Sequence
  chemically synthesized
ccaggcaagtgctgtgatgacc

SEQ ID NO: 53970 - DNA, 22 bp, Artificial Sequence
  chemically synthesized
tgatgaccccctccctggtgag

SEQ ID NO: 53971 - DNA, 22 bp, Artificial Sequence
  chemically synthesized
cctggtgaggagccggccagga

SEQ ID NO: 53972 - DNA, 22 bp, Artificial Sequence
  chemically synthesized
gtgaggagccggccaggacttg

SEQ ID NO: 53973 - DNA, 22 bp, Artificial Sequence
  chemically synthesized
ggatccaagaagtctggcttca

SEQ ID NO: 53974 - DNA, 22 bp, Artificial Sequence
  chemically synthesized
gatccaagaagtctggcttcaa

SEQ ID NO: 53975 - DNA, 22 bp, Artificial Sequence
  chemically synthesized
gcttcaaaccccatgctctgac

SEQ ID NO: 53976 - DNA, 22 bp, Artificial Sequence
  chemically synthesized
caaaccccatgctctgaccgct

SEQ ID NO: 53977 - DNA, 22 bp, Artificial Sequence
  chemically synthesized
aaaccccatgctctgaccgctc

SEQ ID NO: 53978 - DNA, 22 bp, Artificial Sequence
  chemically synthesized
tgaccgctcgatggcaccgctt

SEQ ID NO: 53979 - DNA, 22 bp, Artificial Sequence
  chemically synthesized
accgctcgatggcaccgcttcc

SEQ ID NO: 53980 - DNA, 22 bp, Artificial Sequence
  chemically synthesized
gatggcaccgcttccttggcag

SEQ ID NO: 53981 - DNA, 22 bp, Artificial Sequence
  chemically synthesized
ccttggcaggacatctacagct

SEQ ID NO: 53982 - DNA, 22 bp, Artificial Sequence
  chemically synthesized
cttggcaggacatctacagctc

SEQ ID NO: 53983 - DNA, 22 bp, Artificial Sequence
  chemically synthesized
ggcaggacatctacagctccca

SEQ ID NO: 53984 - DNA, 22 bp, Artificial Sequence
  chemically synthesized
gcaggacatctacagctcccag

SEQ ID NO: 53985 - DNA, 22 bp, Artificial Sequence
  chemically synthesized
cagctcccagggcacccagggg

SEQ ID NO: 53986 - DNA, 22 bp, Artificial Sequence
  chemically synthesized
ccagggcacccaggggacatca

SEQ ID NO: 53987 - DNA, 22 bp, Artificial Sequence
  chemically synthesized
tgaaaggggaatggtcagaccc

SEQ ID NO: 53988 - DNA, 22 bp, Artificial Sequence
  chemically synthesized
aaaggggaatggtcagacccgg

SEQ ID NO: 53989 - DNA, 22 bp, Artificial Sequence
  chemically synthesized
gaatgccatgctaaggagttcg

SEQ ID NO: 53990 - DNA, 22 bp, Artificial Sequence
  chemically synthesized
aatgccatgctaaggagttcgg

SEQ ID NO: 53991 - DNA, 22 bp, Artificial Sequence
  chemically synthesized
aggagttcggacttgacaagag

SEQ ID NO: 53992 - DNA, 22 bp, Artificial Sequence
  chemically synthesized
ggacttgacaagaggcagcagc

SEQ ID NO: 53993 - DNA, 22 bp, Artificial Sequence
  chemically synthesized
gacaagaggcagcagcaaaggg

SEQ ID NO: 53994 - DNA, 22 bp, Artificial Sequence
  chemically synthesized
acaagaggcagcagcaaagggt

SEQ ID NO: 53995 - DNA, 22 bp, Artificial Sequence
  chemically synthesized
tgataacctggttagacgtgct

SEQ ID NO: 53996 - DNA, 22 bp, Artificial Sequence
  chemically synthesized
gataacctggttagacgtgctc

SEQ ID NO: 53997 - DNA, 22 bp, Artificial Sequence
  chemically synthesized
ataacctggttagacgtgctct

SEQ ID NO: 53998 - DNA, 22 bp, Artificial Sequence
  chemically synthesized
gttagacgtgctctgatttatt

SEQ ID NO: 53999 - DNA, 22 bp, Artificial Sequence
  chemically synthesized
gacgtgctctgatttattgtat

SEQ ID NO: 54000 - DNA, 22 bp, Artificial Sequence
  chemically synthesized
tgatttattgtatttcactgct

SEQ ID NO: 54001 - DNA, 22 bp, Artificial Sequence
  chemically synthesized
atttattgtatttcactgctgc

SEQ ID NO: 54002 - DNA, 22 bp, Artificial Sequence
  chemically synthesized
attgtatttcactgctgcaaga

SEQ ID NO: 54003 - DNA, 22 bp, Artificial Sequence
  chemically synthesized
ttgtatttcactgctgcaagat

SEQ ID NO: 54004 - DNA, 22 bp, Artificial Sequence
  chemically synthesized
tatttcactgctgcaagattta

SEQ ID NO: 54005 - DNA, 22 bp, Artificial Sequence
  chemically synthesized
cactgctgcaagatttactgga

SEQ ID NO: 54006 - DNA, 22 bp, Artificial Sequence
  chemically synthesized
actgctgcaagatttactggac

SEQ ID NO: 54007 - DNA, 22 bp, Artificial Sequence
  chemically synthesized
ctgcaagatttactggacaaag

SEQ ID NO: 54008 - DNA, 22 bp, Artificial Sequence
  chemically synthesized
caagatttactggacaaagagg

SEQ ID NO: 54009 - DNA, 22 bp, Artificial Sequence
  chemically synthesized
actggacaaagaggaggagggg

SEQ ID NO: 54010 - DNA, 22 bp, Artificial Sequence
  chemically synthesized
ctggacaaagaggaggaggggg

SEQ ID NO: 54011 - DNA, 22 bp, Artificial Sequence
  chemically synthesized
gacaaagaggaggagggggaga

SEQ ID NO: 54012 - DNA, 22 bp, Artificial Sequence
  chemically synthesized
gaagcccaagcaaaggccaggg

SEQ ID NO: 54013 - DNA, 22 bp, Artificial Sequence
  chemically synthesized
ccagcctgagcgcggagtgcat

SEQ ID NO: 54014 - DNA, 22 bp, Artificial Sequence
  chemically synthesized
cagcctgagcgcggagtgcatg

SEQ ID NO: 54015 - DNA, 22 bp, Artificial Sequence
  chemically synthesized
agcgcggagtgcatgcaggctg

SEQ ID NO: 54016 - DNA, 22 bp, Artificial Sequence
  chemically synthesized
cgcggtggccgcccgggttgca

SEQ ID NO: 54017 - DNA, 22 bp, Artificial Sequence
  chemically synthesized
cagggaacgcgcgggccagcga

SEQ ID NO: 54018 - DNA, 22 bp, Artificial Sequence
  chemically synthesized
tgcggtgctaccccgtgcccgc

SEQ ID NO: 54019 - DNA, 22 bp, Artificial Sequence
  chemically synthesized
cggtgctaccccgtgcccgcac

SEQ ID NO: 54020 - DNA, 22 bp, Artificial Sequence
  chemically synthesized
ccccgtgcccgcactcacccag

SEQ ID NO: 54021 - DNA, 22 bp, Artificial Sequence
  chemically synthesized
acccaggacggcgcagaccagc

SEQ ID NO: 54022 - DNA, 22 bp, Artificial Sequence
  chemically synthesized
ccacggcgagcctcatcttccg

SEQ ID NO: 54023 - DNA, 22 bp, Artificial Sequence
  chemically synthesized
atcttccgggtgcggcgctgag

SEQ ID NO: 54024 - DNA, 22 bp, Artificial Sequence
  chemically synthesized
ccgggtgcggcgctgagcagcg

SEQ ID NO: 54025 - DNA, 22 bp, Artificial Sequence
  chemically synthesized
cgggtgcggcgctgagcagcga

SEQ ID NO: 54026 - DNA, 22 bp, Artificial Sequence
  chemically synthesized
agcagcgagcacagtcggactc

SEQ ID NO: 54027 - DNA, 22 bp, Artificial Sequence
  chemically synthesized
gcttctgtgcagcctccggcgc

SEQ ID NO: 54028 - DNA, 22 bp, Artificial Sequence
  chemically synthesized
ctgtgcagcctccggcgccccg

SEQ ID NO: 54029 - DNA, 22 bp, Artificial Sequence
  chemically synthesized
tgtgcagcctccggcgccccgc

SEQ ID NO: 54030 - DNA, 22 bp, Artificial Sequence
  chemically synthesized
tgcagcctccggcgccccgcgt

SEQ ID NO: 54031 - DNA, 22 bp, Artificial Sequence
  chemically synthesized
cggcgccccgcgtccctttatt

SEQ ID NO: 54032 - DNA, 22 bp, Artificial Sequence
  chemically synthesized
tattccattcccggcctgggcg

SEQ ID NO: 54033 - DNA, 22 bp, Artificial Sequence
  chemically synthesized
attccattcccggcctgggcgg

SEQ ID NO: 54034 - DNA, 22 bp, Artificial Sequence
  chemically synthesized
ttccattcccggcctgggcggg

SEQ ID NO: 54035 - DNA, 22 bp, Artificial Sequence
  chemically synthesized
cattcccggcctgggcgggctg

SEQ ID NO: 54036 - DNA, 22 bp, Artificial Sequence
  chemically synthesized
ccggcctgggcgggctgggcgc

SEQ ID NO: 54037 - DNA, 22 bp, Artificial Sequence
  chemically synthesized
ggcgggctgggcgcaatctttg

SEQ ID NO: 54038 - DNA, 22 bp, Artificial Sequence
  chemically synthesized
ggcgcaatctttgacctcccgt

SEQ ID NO: 54039 - DNA, 22 bp, Artificial Sequence
  chemically synthesized
tgacctcccgtgtttgtgcagc

SEQ ID NO: 54040 - DNA, 22 bp, Artificial Sequence
  chemically synthesized
gacctcccgtgtttgtgcagcc

SEQ ID NO: 54041 - DNA, 22 bp, Artificial Sequence
  chemically synthesized
acctcccgtgtttgtgcagccg

SEQ ID NO: 54042 - DNA, 22 bp, Artificial Sequence
  chemically synthesized
ccgtgtttgtgcagccgggttg

SEQ ID NO: 54043 - DNA, 22 bp, Artificial Sequence
  chemically synthesized
gtgcagccgggttgcccaatcg

SEQ ID NO: 54044 - DNA, 22 bp, Artificial Sequence
  chemically synthesized
tgcagccgggttgcccaatcgc

SEQ ID NO: 54045 - DNA, 22 bp, Artificial Sequence
  chemically synthesized
cccaatcgcccctctcccaacc

SEQ ID NO: 54046 - DNA, 22 bp, Artificial Sequence
  chemically synthesized
tcccaaccccccttccttactc

SEQ ID NO: 54047 - DNA, 22 bp, Artificial Sequence
  chemically synthesized
ccaaccccccttccttactcgt

SEQ ID NO: 54048 - DNA, 22 bp, Artificial Sequence
  chemically synthesized
ccttactcgtcccactgatcac

SEQ ID NO: 54049 - DNA, 22 bp, Artificial Sequence
  chemically synthesized
cttactcgtcccactgatcacc

SEQ ID NO: 54050 - DNA, 22 bp, Artificial Sequence
  chemically synthesized
actcgtcccactgatcacctca

SEQ ID NO: 54051 - DNA, 22 bp, Artificial Sequence
  chemically synthesized
ctcgtcccactgatcacctcat

SEQ ID NO: 54052 - DNA, 22 bp, Artificial Sequence
  chemically synthesized
gtcccactgatcacctcatttt

SEQ ID NO: 54053 - DNA, 22 bp, Artificial Sequence
  chemically synthesized
atcacctcattttctgagctct

SEQ ID NO: 54054 - DNA, 22 bp, Artificial Sequence
  chemically synthesized
attttctgagctctggagacga

SEQ ID NO: 54055 - DNA, 22 bp, Artificial Sequence
  chemically synthesized
tctgagctctggagacgacccg

SEQ ID NO: 54056 - DNA, 22 bp, Artificial Sequence
  chemically synthesized
ctgagctctggagacgacccgc

SEQ ID NO: 54057 - DNA, 22 bp, Artificial Sequence
  chemically synthesized
tgagctctggagacgacccgcg

SEQ ID NO: 54058 - DNA, 22 bp, Artificial Sequence
  chemically synthesized
agctctggagacgacccgcgag

SEQ ID NO: 54059 - DNA, 22 bp, Artificial Sequence
  chemically synthesized
tggagacgacccgcgagtggaa

SEQ ID NO: 54060 - DNA, 22 bp, Artificial Sequence
  chemically synthesized
gagacgacccgcgagtggaagg

SEQ ID NO: 54061 - DNA, 22 bp, Artificial Sequence
  chemically synthesized
atgggaagggacatgaagcaca

SEQ ID NO: 54062 - DNA, 22 bp, Artificial Sequence
  chemically synthesized
tcatcgcggctcgctcggtgcc

SEQ ID NO: 54063 - DNA, 20 bp, Artificial Sequence
  chemically synthesized
actaagtcaataatcagaat

SEQ ID NO: 54064 - DNA, 20 bp, Artificial Sequence
  chemically synthesized
aagtcaataatcagaatcag

SEQ ID NO: 54065 - DNA, 20 bp, Artificial Sequence
  chemically synthesized
agtcaataatcagaatcagc

SEQ ID NO: 54066 - DNA, 20 bp, Artificial Sequence
  chemically synthesized
aatcagaatcagcaggtttg

SEQ ID NO: 54067 - DNA, 20 bp, Artificial Sequence
  chemically synthesized
agaatcagcaggtttgcagt

SEQ ID NO: 54068 - DNA, 20 bp, Artificial Sequence
  chemically synthesized
cagcaggtttgcagtcagat

SEQ ID NO: 54069 - DNA, 20 bp, Artificial Sequence
  chemically synthesized
caggtttgcagtcagattgg

SEQ ID NO: 54070 - DNA, 20 bp, Artificial Sequence
  chemically synthesized
aggtttgcagtcagattggc

SEQ ID NO: 54071 - DNA, 20 bp, Artificial Sequence
  chemically synthesized
ggtttgcagtcagattggca

SEQ ID NO: 54072 - DNA, 20 bp, Artificial Sequence
  chemically synthesized
gcagtcagattggcagggat

SEQ ID NO: 54073 - DNA, 20 bp, Artificial Sequence
  chemically synthesized
gtcagattggcagggataag

SEQ ID NO: 54074 - DNA, 20 bp, Artificial Sequence
  chemically synthesized
attggcagggataagcagcc

SEQ ID NO: 54075 - DNA, 20 bp, Artificial Sequence
  chemically synthesized
cagggataagcagcctagct

SEQ ID NO: 54076 - DNA, 20 bp, Artificial Sequence
  chemically synthesized
agggataagcagcctagctc

SEQ ID NO: 54077 - DNA, 20 bp, Artificial Sequence
  chemically synthesized
ggataagcagcctagctcag

SEQ ID NO: 54078 - DNA, 20 bp, Artificial Sequence
  chemically synthesized
taagcagcctagctcaggag

SEQ ID NO: 54079 - DNA, 20 bp, Artificial Sequence
  chemically synthesized
cagcctagctcaggagaagt

SEQ ID NO: 54080 - DNA, 20 bp, Artificial Sequence
  chemically synthesized
ctcaggagaagtgagtataa

SEQ ID NO: 54081 - DNA, 20 bp, Artificial Sequence
  chemically synthesized
agaagtgagtataaaagccc

SEQ ID NO: 54082 - DNA, 20 bp, Artificial Sequence
  chemically synthesized
gaagtgagtataaaagcccc

SEQ ID NO: 54083 - DNA, 20 bp, Artificial Sequence
  chemically synthesized
tgagtataaaagccccaggc

SEQ ID NO: 54084 - DNA, 20 bp, Artificial Sequence
  chemically synthesized
gagtataaaagccccaggct

SEQ ID NO: 54085 - DNA, 20 bp, Artificial Sequence
  chemically synthesized
gtataaaagccccaggctgg

SEQ ID NO: 54086 - DNA, 20 bp, Artificial Sequence
  chemically synthesized
taaaagccccaggctgggag

SEQ ID NO: 54087 - DNA, 20 bp, Artificial Sequence
  chemically synthesized
caggctgggagcagccatca

SEQ ID NO: 54088 - DNA, 20 bp, Artificial Sequence
  chemically synthesized
gctgggagcagccatcacag

SEQ ID NO: 54089 - DNA, 20 bp, Artificial Sequence
  chemically synthesized
cacagaagtccactcattct

SEQ ID NO: 54090 - DNA, 20 bp, Artificial Sequence
  chemically synthesized
agaagtccactcattcttgg

SEQ ID NO: 54091 - DNA, 20 bp, Artificial Sequence
  chemically synthesized
gaagtccactcattcttggc

SEQ ID NO: 54092 - DNA, 20 bp, Artificial Sequence
  chemically synthesized
tccactcattcttggcagga

SEQ ID NO: 54093 - DNA, 20 bp, Artificial Sequence
  chemically synthesized
ctgctcctcctctgccttgc

SEQ ID NO: 54094 - DNA, 20 bp, Artificial Sequence
  chemically synthesized
cctcctctgccttgctggac

SEQ ID NO: 54095 - DNA, 20 bp, Artificial Sequence
  chemically synthesized
ctggactggtatttgtgtct

SEQ ID NO: 54096 - DNA, 20 bp, Artificial Sequence
  chemically synthesized
tggactggtatttgtgtctg

SEQ ID NO: 54097 - DNA, 20 bp, Artificial Sequence
  chemically synthesized
ctggtatttgtgtctgaggc

SEQ ID NO: 54098 - DNA, 20 bp, Artificial Sequence
  chemically synthesized
tgtgtctgaggctggcccta

SEQ ID NO: 54099 - DNA, 20 bp, Artificial Sequence
  chemically synthesized
tctgaggctggccctacggt

SEQ ID NO: 54100 - DNA, 20 bp, Artificial Sequence
  chemically synthesized
gacatcccattcctacattt

SEQ ID NO: 54101 - DNA, 20 bp, Artificial Sequence
  chemically synthesized
tttaagattcacgctaaatg

SEQ ID NO: 54102 - DNA, 20 bp, Artificial Sequence
  chemically synthesized
aagattcacgctaaatgaag

SEQ ID NO: 54103 - DNA, 20 bp, Artificial Sequence
  chemically synthesized
attcacgctaaatgaagtag

SEQ ID NO: 54104 - DNA, 20 bp, Artificial Sequence
  chemically synthesized
gaagtagaagtgactccttc

SEQ ID NO: 54105 - DNA, 20 bp, Artificial Sequence
  chemically synthesized
ctccttccagctttgccaac

SEQ ID NO: 54106 - DNA, 20 bp, Artificial Sequence
  chemically synthesized
tgccaaccagcttttattac

SEQ ID NO: 54107 - DNA, 20 bp, Artificial Sequence
  chemically synthesized
gccaaccagcttttattact

SEQ ID NO: 54108 - DNA, 20 bp, Artificial Sequence
  chemically synthesized
ccaaccagcttttattacta

SEQ ID NO: 54109 - DNA, 20 bp, Artificial Sequence
  chemically synthesized
ccagcttttattactagggc

SEQ ID NO: 54110 - DNA, 20 bp, Artificial Sequence
  chemically synthesized
cagcttttattactagggca

SEQ ID NO: 54111 - DNA, 20 bp, Artificial Sequence
  chemically synthesized
agcttttattactagggcaa

SEQ ID NO: 54112 - DNA, 20 bp, Artificial Sequence
  chemically synthesized
attactagggcaagggtacc

SEQ ID NO: 54113 - DNA, 20 bp, Artificial Sequence
  chemically synthesized
taattaattcaaacttcaaa

SEQ ID NO: 54114 - DNA, 20 bp, Artificial Sequence
  chemically synthesized
ttcaaacttcaaaaagaatg

SEQ ID NO: 54115 - DNA, 20 bp, Artificial Sequence
  chemically synthesized
aaaaagaatgaagttccact

SEQ ID NO: 54116 - DNA, 20 bp, Artificial Sequence
  chemically synthesized
gaagttccactgagcttact

SEQ ID NO: 54117 - DNA, 20 bp, Artificial Sequence
  chemically synthesized
ttccactgagcttactgagc

SEQ ID NO: 54118 - DNA, 20 bp, Artificial Sequence
  chemically synthesized
tccactgagcttactgagct

SEQ ID NO: 54119 - DNA, 20 bp, Artificial Sequence
  chemically synthesized
tgagctgggacttgaactct

SEQ ID NO: 54120 - DNA, 20 bp, Artificial Sequence
  chemically synthesized
agcattctacctcattgctt

SEQ ID NO: 54121 - DNA, 20 bp, Artificial Sequence
  chemically synthesized
acctcattgctttggtgcat

SEQ ID NO: 54122 - DNA, 20 bp, Artificial Sequence
  chemically synthesized
cctcattgctttggtgcatt

SEQ ID NO: 54123 - DNA, 20 bp, Artificial Sequence
  chemically synthesized
tgcattaggtttgtaatatc

SEQ ID NO: 54124 - DNA, 20 bp, Artificial Sequence
  chemically synthesized
atctggtacctctgtttcct

SEQ ID NO: 54125 - DNA, 20 bp, Artificial Sequence
  chemically synthesized
ggtacctctgtttcctcaga

SEQ ID NO: 54126 - DNA, 20 bp, Artificial Sequence
  chemically synthesized
ctgtttcctcagatagatga

SEQ ID NO: 54127 - DNA, 20 bp, Artificial Sequence
  chemically synthesized
tcagatagatgatagaaata

SEQ ID NO: 54128 - DNA, 20 bp, Artificial Sequence
  chemically synthesized
agaaataaagatatgatatt

SEQ ID NO: 54129 - DNA, 20 bp, Artificial Sequence
  chemically synthesized
gaaataaagatatgatatta

SEQ ID NO: 54130 - DNA, 20 bp, Artificial Sequence
  chemically synthesized
ataaagatatgatattaagg

SEQ ID NO: 54131 - DNA, 20 bp, Artificial Sequence
  chemically synthesized
agctgttaatactgaatttt

SEQ ID NO: 54132 - DNA, 20 bp, Artificial Sequence
  chemically synthesized
ttaatactgaattttcagaa

SEQ ID NO: 54133 - DNA, 20 bp, Artificial Sequence
  chemically synthesized
atccctccataaaatgtatt

SEQ ID NO: 54134 - DNA, 20 bp, Artificial Sequence
  chemically synthesized
tccctccataaaatgtattt

SEQ ID NO: 54135 - DNA, 20 bp, Artificial Sequence
  chemically synthesized
ccctccataaaatgtatttg

SEQ ID NO: 54136 - DNA, 20 bp, Artificial Sequence
  chemically synthesized
cctccataaaatgtatttgg

SEQ ID NO: 54137 - DNA, 20 bp, Artificial Sequence
  chemically synthesized
tgtatttgggggacaaactg

SEQ ID NO: 54138 - DNA, 20 bp, Artificial Sequence
  chemically synthesized
gtatttgggggacaaactgc

SEQ ID NO: 54139 - DNA, 20 bp, Artificial Sequence
  chemically synthesized
atttgggggacaaactgcag

SEQ ID NO: 54140 - DNA, 20 bp, Artificial Sequence
  chemically synthesized
aactgcaggagattatattc

SEQ ID NO: 54141 - DNA, 20 bp, Artificial Sequence
  chemically synthesized
gagattatattctggcccta

SEQ ID NO: 54142 - DNA, 20 bp, Artificial Sequence
  chemically synthesized
atttattgattaatctttaa

SEQ ID NO: 54143 - DNA, 20 bp, Artificial Sequence
  chemically synthesized
tttattgattaatctttaaa

SEQ ID NO: 54144 - DNA, 20 bp, Artificial Sequence
  chemically synthesized
tgattaatctttaaaaggct

SEQ ID NO: 54145 - DNA, 20 bp, Artificial Sequence
  chemically synthesized
aggcttagtgaacaatattc

SEQ ID NO: 54146 - DNA, 20 bp, Artificial Sequence
  chemically synthesized
ttagtgaacaatattctagt

SEQ ID NO: 54147 - DNA, 20 bp, Artificial Sequence
  chemically synthesized
tatctaattcttaaatcctc

SEQ ID NO: 54148 - DNA, 20 bp, Artificial Sequence
  chemically synthesized
ctaattcttaaatcctctag

SEQ ID NO: 54149 - DNA, 20 bp, Artificial Sequence
  chemically synthesized
aattaactaatactataaaa

SEQ ID NO: 54150 - DNA, 20 bp, Artificial Sequence
  chemically synthesized
attaactaatactataaaat

SEQ ID NO: 54151 - DNA, 20 bp, Artificial Sequence
  chemically synthesized
ctaatactataaaatgggtc

SEQ ID NO: 54152 - DNA, 20 bp, Artificial Sequence
  chemically synthesized
ctataaaatgggtctggatg

SEQ ID NO: 54153 - DNA, 20 bp, Artificial Sequence
  chemically synthesized
tgacattattttataacaac

SEQ ID NO: 54154 - DNA, 20 bp, Artificial Sequence
  chemically synthesized
attattttataacaactggt

SEQ ID NO: 54155 - DNA, 20 bp, Artificial Sequence
  chemically synthesized
tattttataacaactggtaa

SEQ ID NO: 54156 - DNA, 20 bp, Artificial Sequence
  chemically synthesized
attttataacaactggtaag

SEQ ID NO: 54157 - DNA, 20 bp, Artificial Sequence
  chemically synthesized
ttttataacaactggtaaga

SEQ ID NO: 54158 - DNA, 20 bp, Artificial Sequence
  chemically synthesized
ttataacaactggtaagagg

SEQ ID NO: 54159 - DNA, 20 bp, Artificial Sequence
  chemically synthesized
ctggtaagagggagtgacta

SEQ ID NO: 54160 - DNA, 20 bp, Artificial Sequence
  chemically synthesized
agcaacaactaaaatgatct

SEQ ID NO: 54161 - DNA, 20 bp, Artificial Sequence
  chemically synthesized
gcaacaactaaaatgatctc

SEQ ID NO: 54162 - DNA, 20 bp, Artificial Sequence
  chemically synthesized
tgatctcaggaaaacctgtt

SEQ ID NO: 54163 - DNA, 20 bp, Artificial Sequence
  chemically synthesized
aacctgtttggccctatgta

SEQ ID NO: 54164 - DNA, 20 bp, Artificial Sequence
  chemically synthesized
tatggtacattacatctttt

SEQ ID NO: 54165 - DNA, 20 bp, Artificial Sequence
  chemically synthesized
tttcagtaattccactcaaa

SEQ ID NO: 54166 - DNA, 20 bp, Artificial Sequence
  chemically synthesized
tcagtaattccactcaaatg

SEQ ID NO: 54167 - DNA, 20 bp, Artificial Sequence
  chemically synthesized
tcaaatggagacttttaaca

SEQ ID NO: 54168 - DNA, 20 bp, Artificial Sequence
  chemically synthesized
tttaacaaagcaactgttct

SEQ ID NO: 54169 - DNA, 20 bp, Artificial Sequence
  chemically synthesized
ttaacaaagcaactgttctc

SEQ ID NO: 54170 - DNA, 20 bp, Artificial Sequence
  chemically synthesized
taacaaagcaactgttctca

SEQ ID NO: 54171 - DNA, 20 bp, Artificial Sequence
  chemically synthesized
aacaaagcaactgttctcag

SEQ ID NO: 54172 - DNA, 20 bp, Artificial Sequence
  chemically synthesized
aaattcattatacacatccc

SEQ ID NO: 54173 - DNA, 20 bp, Artificial Sequence
  chemically synthesized
ttatacacatccctggttga

SEQ ID NO: 54174 - DNA, 20 bp, Artificial Sequence
  chemically synthesized
tacacatccctggttgatag

SEQ ID NO: 54175 - DNA, 20 bp, Artificial Sequence
  chemically synthesized
ctggttgatagcagtgtgtc

SEQ ID NO: 54176 - DNA, 20 bp, Artificial Sequence
  chemically synthesized
ggttgatagcagtgtgtctg

SEQ ID NO: 54177 - DNA, 20 bp, Artificial Sequence
  chemically synthesized
gttgatagcagtgtgtctgg

SEQ ID NO: 54178 - DNA, 20 bp, Artificial Sequence
  chemically synthesized
gatagcagtgtgtctggagg

SEQ ID NO: 54179 - DNA, 20 bp, Artificial Sequence
  chemically synthesized
ggcagaaaccattcttgctt

SEQ ID NO: 54180 - DNA, 20 bp, Artificial Sequence
  chemically synthesized
aattacgtctgtgttatact

SEQ ID NO: 54181 - DNA, 20 bp, Artificial Sequence
  chemically synthesized
tacgtctgtgttatactgag

SEQ ID NO: 54182 - DNA, 20 bp, Artificial Sequence
  chemically synthesized
acgtctgtgttatactgagt

SEQ ID NO: 54183 - DNA, 20 bp, Artificial Sequence
  chemically synthesized
cgtctgtgttatactgagta

SEQ ID NO: 54184 - DNA, 20 bp, Artificial Sequence
  chemically synthesized
ctgtgttatactgagtaggg

SEQ ID NO: 54185 - DNA, 20 bp, Artificial Sequence
  chemically synthesized
gacacttacgttcctgataa

SEQ ID NO: 54186 - DNA, 20 bp, Artificial Sequence
  chemically synthesized
acacttacgttcctgataat

SEQ ID NO: 54187 - DNA, 20 bp, Artificial Sequence
  chemically synthesized
tacgttcctgataatgggat

SEQ ID NO: 54188 - DNA, 20 bp, Artificial Sequence
  chemically synthesized
gtgtaattcttgtttcgctc

SEQ ID NO: 54189 - DNA, 20 bp, Artificial Sequence
  chemically synthesized
tccagatttctaataccaca

SEQ ID NO: 54190 - DNA, 20 bp, Artificial Sequence
  chemically synthesized
tcacgtgtcttctctacacc

SEQ ID NO: 54191 - DNA, 20 bp, Artificial Sequence
  chemically synthesized
cacgtgtcttctctacaccc

SEQ ID NO: 54192 - DNA, 20 bp, Artificial Sequence
  chemically synthesized
acgtgtcttctctacaccca

SEQ ID NO: 54193 - DNA, 20 bp, Artificial Sequence
  chemically synthesized
cttctctacacccagggcac

SEQ ID NO: 54194 - DNA, 20 bp, Artificial Sequence
  chemically synthesized
cccagggcaccggtgaatcc

SEQ ID NO: 54195 - DNA, 20 bp, Artificial Sequence
  chemically synthesized
tgaatccaagtgtcctctga

SEQ ID NO: 54196 - DNA, 20 bp, Artificial Sequence
  chemically synthesized
caagtgtcctctgatggtca

SEQ ID NO: 54197 - DNA, 20 bp, Artificial Sequence
  chemically synthesized
tcctctgatggtcaaagttc

SEQ ID NO: 54198 - DNA, 20 bp, Artificial Sequence
  chemically synthesized
caaagttctagatgctgtcc

SEQ ID NO: 54199 - DNA, 20 bp, Artificial Sequence
  chemically synthesized
aaagttctagatgctgtccg

SEQ ID NO: 54200 - DNA, 20 bp, Artificial Sequence
  chemically synthesized
gttctagatgctgtccgagg

SEQ ID NO: 54201 - DNA, 20 bp, Artificial Sequence
  chemically synthesized
aggcagtcctgccatcaatg

SEQ ID NO: 54202 - DNA, 20 bp, Artificial Sequence
  chemically synthesized
aatgtggccgtgcatgtgtt

SEQ ID NO: 54203 - DNA, 20 bp, Artificial Sequence
  chemically synthesized
tggccgtgcatgtgttcaga

SEQ ID NO: 54204 - DNA, 20 bp, Artificial Sequence
  chemically synthesized
ggccgtgcatgtgttcagaa

SEQ ID NO: 54205 - DNA, 20 bp, Artificial Sequence
  chemically synthesized
gaaaggctgctgatgacacc

SEQ ID NO: 54206 - DNA, 20 bp, Artificial Sequence
  chemically synthesized
aaaggctgctgatgacacct

SEQ ID NO: 54207 - DNA, 20 bp, Artificial Sequence
  chemically synthesized
aggctgctgatgacacctgg

SEQ ID NO: 54208 - DNA, 20 bp, Artificial Sequence
  chemically synthesized
acctgggagccatttgcctc

SEQ ID NO: 54209 - DNA, 20 bp, Artificial Sequence
  chemically synthesized
aaatggctcccaggtgtcat

SEQ ID NO: 54210 - DNA, 20 bp, Artificial Sequence
  chemically synthesized
tggctcccaggtgtcatcag

SEQ ID NO: 54211 - DNA, 20 bp, Artificial Sequence
  chemically synthesized
agcctttctgaacacatgca

SEQ ID NO: 54212 - DNA, 20 bp, Artificial Sequence
  chemically synthesized
cacatgcacggccacattga

SEQ ID NO: 54213 - DNA, 20 bp, Artificial Sequence
  chemically synthesized
atgcacggccacattgatgg

SEQ ID NO: 54214 - DNA, 20 bp, Artificial Sequence
  chemically synthesized
tgcacggccacattgatggc

SEQ ID NO: 54215 - DNA, 20 bp, Artificial Sequence
  chemically synthesized
cattgatggcaggactgcct

SEQ ID NO: 54216 - DNA, 20 bp, Artificial Sequence
  chemically synthesized
gatggcaggactgcctcgga

SEQ ID NO: 54217 - DNA, 20 bp, Artificial Sequence
  chemically synthesized
ggactgcctcggacagcatc

SEQ ID NO: 54218 - DNA, 20 bp, Artificial Sequence
  chemically synthesized
gcatctagaactttgaccat

SEQ ID NO: 54219 - DNA, 20 bp, Artificial Sequence
  chemically synthesized
atctagaactttgaccatca

SEQ ID NO: 54220 - DNA, 20 bp, Artificial Sequence
  chemically synthesized
tctagaactttgaccatcag

SEQ ID NO: 54221 - DNA, 20 bp, Artificial Sequence
  chemically synthesized
tttgaccatcagaggacact

SEQ ID NO: 54222 - DNA, 20 bp, Artificial Sequence
  chemically synthesized
cagaggacacttggattcac

SEQ ID NO: 54223 - DNA, 20 bp, Artificial Sequence
  chemically synthesized
acttggattcaccggtgccc

SEQ ID NO: 54224 - DNA, 20 bp, Artificial Sequence
  chemically synthesized
cttggattcaccggtgccct

SEQ ID NO: 54225 - DNA, 20 bp, Artificial Sequence
  chemically synthesized
attcaccggtgccctgggtg

SEQ ID NO: 54226 - DNA, 20 bp, Artificial Sequence
  chemically synthesized
tcaccggtgccctgggtgta

SEQ ID NO: 54227 - DNA, 20 bp, Artificial Sequence
  chemically synthesized
ccggtgccctgggtgtagag

SEQ ID NO: 54228 - DNA, 20 bp, Artificial Sequence
  chemically synthesized
tgggtgtagagaagacacgt

SEQ ID NO: 54229 - DNA, 20 bp, Artificial Sequence
  chemically synthesized
gtgtagagaagacacgtgag

SEQ ID NO: 54230 - DNA, 20 bp, Artificial Sequence
  chemically synthesized
gagaagttaacaaaattgat

SEQ ID NO: 54231 - DNA, 20 bp, Artificial Sequence
  chemically synthesized
gaagttaacaaaattgatca

SEQ ID NO: 54232 - DNA, 20 bp, Artificial Sequence
  chemically synthesized
aacaaaattgatcagagtga

SEQ ID NO: 54233 - DNA, 20 bp, Artificial Sequence
  chemically synthesized
acaaaattgatcagagtgaa

SEQ ID NO: 54234 - DNA, 20 bp, Artificial Sequence
  chemically synthesized
gtgaaaggatttattctttg

SEQ ID NO: 54235 - DNA, 20 bp, Artificial Sequence
  chemically synthesized
ggatttattctttgtggtat

SEQ ID NO: 54236 - DNA, 20 bp, Artificial Sequence
  chemically synthesized
tctttgtggtattagaaatc

SEQ ID NO: 54237 - DNA, 20 bp, Artificial Sequence
  chemically synthesized
tttgtggtattagaaatctg

SEQ ID NO: 54238 - DNA, 20 bp, Artificial Sequence
  chemically synthesized
ttagaaatctggagcgaaac

SEQ ID NO: 54239 - DNA, 20 bp, Artificial Sequence
  chemically synthesized
ttacacactgatcccattat

SEQ ID NO: 54240 - DNA, 20 bp, Artificial Sequence
  chemically synthesized
tacacactgatcccattatc

SEQ ID NO: 54241 - DNA, 20 bp, Artificial Sequence
  chemically synthesized
gatcccattatcaggaacgt

SEQ ID NO: 54242 - DNA, 20 bp, Artificial Sequence
  chemically synthesized
cgtaagtgtcgacaattaat

SEQ ID NO: 54243 - DNA, 20 bp, Artificial Sequence
  chemically synthesized
aattaatgagcttccctact

SEQ ID NO: 54244 - DNA, 20 bp, Artificial Sequence
  chemically synthesized
cttccctactcagtataaca

SEQ ID NO: 54245 - DNA, 20 bp, Artificial Sequence
  chemically synthesized
cacagacgtaattgtttcca

SEQ ID NO: 54246 - DNA, 20 bp, Artificial Sequence
  chemically synthesized
gacgtaattgtttccaaagc

SEQ ID NO: 54247 - DNA, 20 bp, Artificial Sequence
  chemically synthesized
aattgtttccaaagcaagaa

SEQ ID NO: 54248 - DNA, 20 bp, Artificial Sequence
  chemically synthesized
gcaagaatggtttctgcctc

SEQ ID NO: 54249 - DNA, 20 bp, Artificial Sequence
  chemically synthesized
ccagacacactgctatcaac

SEQ ID NO: 54250 - DNA, 20 bp, Artificial Sequence
  chemically synthesized
cagacacactgctatcaacc

SEQ ID NO: 54251 - DNA, 20 bp, Artificial Sequence
  chemically synthesized
agacacactgctatcaacca

SEQ ID NO: 54252 - DNA, 20 bp, Artificial Sequence
  chemically synthesized
ggatgtgtataatgaatttt

SEQ ID NO: 54253 - DNA, 20 bp, Artificial Sequence
  chemically synthesized
gatgtgtataatgaatttta

SEQ ID NO: 54254 - DNA, 20 bp, Artificial Sequence
  chemically synthesized
atgtgtataatgaattttaa

SEQ ID NO: 54255 - DNA, 20 bp, Artificial Sequence
  chemically synthesized
gtgtataatgaattttaagg

SEQ ID NO: 54256 - DNA, 20 bp, Artificial Sequence
  chemically synthesized
atgaattttaagggagaaaa

SEQ ID NO: 54257 - DNA, 20 bp, Artificial Sequence
  chemically synthesized
tgaattttaagggagaaaat

SEQ ID NO: 54258 - DNA, 20 bp, Artificial Sequence
  chemically synthesized
agggagaaaataggtcccct

SEQ ID NO: 54259 - DNA, 20 bp, Artificial Sequence
  chemically synthesized
gaaaataggtcccctgagaa

SEQ ID NO: 54260 - DNA, 20 bp, Artificial Sequence
  chemically synthesized
gagaacagttgctttgttaa

SEQ ID NO: 54261 - DNA, 20 bp, Artificial Sequence
  chemically synthesized
tttgttaaaagtctccattt

SEQ ID NO: 54262 - DNA, 20 bp, Artificial Sequence
  chemically synthesized
gttaaaagtctccatttgag

SEQ ID NO: 54263 - DNA, 20 bp, Artificial Sequence
  chemically synthesized
atttgagtggaattactgaa

SEQ ID NO: 54264 - DNA, 20 bp, Artificial Sequence
  chemically synthesized
aagatgtaatgtaccataca

SEQ ID NO: 54265 - DNA, 20 bp, Artificial Sequence
  chemically synthesized
agatgtaatgtaccatacat

SEQ ID NO: 54266 - DNA, 20 bp, Artificial Sequence
  chemically synthesized
gatgtaatgtaccatacata

SEQ ID NO: 54267 - DNA, 20 bp, Artificial Sequence
  chemically synthesized
gtaccatacatagggccaaa

SEQ ID NO: 54268 - DNA, 20 bp, Artificial Sequence
  chemically synthesized
taccatacatagggccaaac

SEQ ID NO: 54269 - DNA, 20 bp, Artificial Sequence
  chemically synthesized
agggccaaacaggttttcct

SEQ ID NO: 54270 - DNA, 20 bp, Artificial Sequence
  chemically synthesized
aggttttcctgagatcattt

SEQ ID NO: 54271 - DNA, 20 bp, Artificial Sequence
  chemically synthesized
gatcattttagttgttgcta

SEQ ID NO: 54272 - DNA, 20 bp, Artificial Sequence
  chemically synthesized
ctatagtcactccctcttac

SEQ ID NO: 54273 - DNA, 20 bp, Artificial Sequence
  chemically synthesized
cagttgttataaaataatgt

SEQ ID NO: 54274 - DNA, 20 bp, Artificial Sequence
  chemically synthesized
aataatgtcagaactacatc

SEQ ID NO: 54275 - DNA, 20 bp, Artificial Sequence
  chemically synthesized
ctacatccagacccatttta

SEQ ID NO: 54276 - DNA, 20 bp, Artificial Sequence
  chemically synthesized
ccagacccattttatagtat

SEQ ID NO: 54277 - DNA, 20 bp, Artificial Sequence
  chemically synthesized
atagtattagttaattcttc

SEQ ID NO: 54278 - DNA, 20 bp, Artificial Sequence
  chemically synthesized
agtattagttaattcttcta

SEQ ID NO: 54279 - DNA, 20 bp, Artificial Sequence
  chemically synthesized
gtattagttaattcttctag

SEQ ID NO: 54280 - DNA, 20 bp, Artificial Sequence
  chemically synthesized
ttaattcttctagaggattt

SEQ ID NO: 54281 - DNA, 20 bp, Artificial Sequence
  chemically synthesized
cttctagaggatttaagaat

SEQ ID NO: 54282 - DNA, 20 bp, Artificial Sequence
  chemically synthesized
ttaagaattagatatctgac

SEQ ID NO: 54283 - DNA, 20 bp, Artificial Sequence
  chemically synthesized
tgactagaatattgttcact

SEQ ID NO: 54284 - DNA, 20 bp, Artificial Sequence
  chemically synthesized
attgttcactaagcctttta

SEQ ID NO: 54285 - DNA, 20 bp, Artificial Sequence
  chemically synthesized
aaatacgttttgaataacta

SEQ ID NO: 54286 - DNA, 20 bp, Artificial Sequence
  chemically synthesized
aatacgttttgaataactat

SEQ ID NO: 54287 - DNA, 20 bp, Artificial Sequence
  chemically synthesized
atacgttttgaataactata

SEQ ID NO: 54288 - DNA, 20 bp, Artificial Sequence
  chemically synthesized
gttttgaataactatagggc

SEQ ID NO: 54289 - DNA, 20 bp, Artificial Sequence
  chemically synthesized
ggccagaatataatctcctg

SEQ ID NO: 54290 - DNA, 20 bp, Artificial Sequence
  chemically synthesized
tgtcccccaaatacatttta

SEQ ID NO: 54291 - DNA, 20 bp, Artificial Sequence
  chemically synthesized
tcccccaaatacattttatg

SEQ ID NO: 54292 - DNA, 20 bp, Artificial Sequence
  chemically synthesized
cccccaaatacattttatgg

SEQ ID NO: 54293 - DNA, 20 bp, Artificial Sequence
  chemically synthesized
ccccaaatacattttatgga

SEQ ID NO: 54294 - DNA, 20 bp, Artificial Sequence
  chemically synthesized
gggatacttttctgaaaatt

SEQ ID NO: 54295 - DNA, 20 bp, Artificial Sequence
  chemically synthesized
ttctgaaaattcagtattaa

SEQ ID NO: 54296 - DNA, 20 bp, Artificial Sequence
  chemically synthesized
tttatttctatcatctatct

SEQ ID NO: 54297 - DNA, 20 bp, Artificial Sequence
  chemically synthesized
ttatttctatcatctatctg

SEQ ID NO: 54298 - DNA, 20 bp, Artificial Sequence
  chemically synthesized
ctatcatctatctgaggaaa

SEQ ID NO: 54299 - DNA, 20 bp, Artificial Sequence
  chemically synthesized
atcatctatctgaggaaaca

SEQ ID NO: 54300 - DNA, 20 bp, Artificial Sequence
  chemically synthesized
tcatctatctgaggaaacag

SEQ ID NO: 54301 - DNA, 20 bp, Artificial Sequence
  chemically synthesized
atctgaggaaacagaggtac

SEQ ID NO: 54302 - DNA, 20 bp, Artificial Sequence
  chemically synthesized
attacaaacctaatgcacca

SEQ ID NO: 54303 - DNA, 20 bp, Artificial Sequence
  chemically synthesized
acctaatgcaccaaagcaat

SEQ ID NO: 54304 - DNA, 20 bp, Artificial Sequence
  chemically synthesized
cctaatgcaccaaagcaatg

SEQ ID NO: 54305 - DNA, 20 bp, Artificial Sequence
  chemically synthesized
aatgcaccaaagcaatgagg

SEQ ID NO: 54306 - DNA, 20 bp, Artificial Sequence
  chemically synthesized
aagcaatgaggtagaatgct

SEQ ID NO: 54307 - DNA, 20 bp, Artificial Sequence
  chemically synthesized
gcaatgaggtagaatgctca

SEQ ID NO: 54308 - DNA, 20 bp, Artificial Sequence
  chemically synthesized
aggtagaatgctcagagttc

SEQ ID NO: 54309 - DNA, 20 bp, Artificial Sequence
  chemically synthesized
aatgctcagagttcaagtcc

SEQ ID NO: 54310 - DNA, 20 bp, Artificial Sequence
  chemically synthesized
tcagagttcaagtcccagct

SEQ ID NO: 54311 - DNA, 20 bp, Artificial Sequence
  chemically synthesized
agttcaagtcccagctcagt

SEQ ID NO: 54312 - DNA, 20 bp, Artificial Sequence
  chemically synthesized
aagtcccagctcagtaagct

SEQ ID NO: 54313 - DNA, 20 bp, Artificial Sequence
  chemically synthesized
tcccagctcagtaagctcag

SEQ ID NO: 54314 - DNA, 20 bp, Artificial Sequence
  chemically synthesized
gtggaacttcattctttttg

SEQ ID NO: 54315 - DNA, 20 bp, Artificial Sequence
  chemically synthesized
tgaattaattatattaaaaa

SEQ ID NO: 54316 - DNA, 20 bp, Artificial Sequence
  chemically synthesized
attatattaaaaatagatgc

SEQ ID NO: 54317 - DNA, 20 bp, Artificial Sequence
  chemically synthesized
ttatattaaaaatagatgct

SEQ ID NO: 54318 - DNA, 20 bp, Artificial Sequence
  chemically synthesized
gatgctgggtacccttgccc

SEQ ID NO: 54319 - DNA, 20 bp, Artificial Sequence
  chemically synthesized
tacccttgccctagtaataa

SEQ ID NO: 54320 - DNA, 20 bp, Artificial Sequence
  chemically synthesized
cttgccctagtaataaaagc

SEQ ID NO: 54321 - DNA, 20 bp, Artificial Sequence
  chemically synthesized
ccctagtaataaaagctggt

SEQ ID NO: 54322 - DNA, 20 bp, Artificial Sequence
  chemically synthesized
gtaataaaagctggttggca

SEQ ID NO: 54323 - DNA, 20 bp, Artificial Sequence
  chemically synthesized
taaaagctggttggcaaagc

SEQ ID NO: 54324 - DNA, 20 bp, Artificial Sequence
  chemically synthesized
aagctggttggcaaagctgg

SEQ ID NO: 54325 - DNA, 20 bp, Artificial Sequence
  chemically synthesized
agctggttggcaaagctgga

SEQ ID NO: 54326 - DNA, 20 bp, Artificial Sequence
  chemically synthesized
ctggttggcaaagctggaag

SEQ ID NO: 54327 - DNA, 20 bp, Artificial Sequence
  chemically synthesized
ggagtcacttctacttcatt

SEQ ID NO: 54328 - DNA, 20 bp, Artificial Sequence
  chemically synthesized
tttagcgtgaatcttaaatg

SEQ ID NO: 54329 - DNA, 20 bp, Artificial Sequence
  chemically synthesized
ttagcgtgaatcttaaatgt

SEQ ID NO: 54330 - DNA, 20 bp, Artificial Sequence
  chemically synthesized
gtgaatcttaaatgtaggaa

SEQ ID NO: 54331 - DNA, 20 bp, Artificial Sequence
  chemically synthesized
tgaatcttaaatgtaggaat

SEQ ID NO: 54332 - DNA, 20 bp, Artificial Sequence
  chemically synthesized
aatgtaggaatgggatgtca

SEQ ID NO: 54333 - DNA, 20 bp, Artificial Sequence
  chemically synthesized
tgtcacagaaacactcaccg

SEQ ID NO: 54334 - DNA, 20 bp, Artificial Sequence
  chemically synthesized
gtcacagaaacactcaccgt

SEQ ID NO: 54335 - DNA, 20 bp, Artificial Sequence
  chemically synthesized
tcacagaaacactcaccgta

SEQ ID NO: 54336 - DNA, 20 bp, Artificial Sequence
  chemically synthesized
agaaacactcaccgtagggc

SEQ ID NO: 54337 - DNA, 20 bp, Artificial Sequence
  chemically synthesized
actcaccgtagggccagcct

SEQ ID NO: 54338 - DNA, 20 bp, Artificial Sequence
  chemically synthesized
ccagcctcagacacaaatac

SEQ ID NO: 54339 - DNA, 20 bp, Artificial Sequence
  chemically synthesized
ctcagacacaaataccagtc

SEQ ID NO: 54340 - DNA, 20 bp, Artificial Sequence
  chemically synthesized
gacacaaataccagtccagc

SEQ ID NO: 54341 - DNA, 20 bp, Artificial Sequence
  chemically synthesized
acacaaataccagtccagca

SEQ ID NO: 54342 - DNA, 20 bp, Artificial Sequence
  chemically synthesized
caaataccagtccagcaagg

SEQ ID NO: 54343 - DNA, 20 bp, Artificial Sequence
  chemically synthesized
aataccagtccagcaaggca

SEQ ID NO: 54344 - DNA, 20 bp, Artificial Sequence
  chemically synthesized
ataccagtccagcaaggcag

SEQ ID NO: 54345 - DNA, 20 bp, Artificial Sequence
  chemically synthesized
accagtccagcaaggcagag

SEQ ID NO: 54346 - DNA, 20 bp, Artificial Sequence
  chemically synthesized
ccagtccagcaaggcagagg

SEQ ID NO: 54347 - DNA, 20 bp, Artificial Sequence
  chemically synthesized
agtccagcaaggcagaggag

SEQ ID NO: 54348 - DNA, 20 bp, Artificial Sequence
  chemically synthesized
ccagcaaggcagaggaggag

SEQ ID NO: 54349 - DNA, 20 bp, Artificial Sequence
  chemically synthesized
gcagaggaggagcagacgat

SEQ ID NO: 54350 - DNA, 20 bp, Artificial Sequence
  chemically synthesized
gaggaggagcagacgatgag

SEQ ID NO: 54351 - DNA, 20 bp, Artificial Sequence
  chemically synthesized
cgatgagaagccatcctgcc

SEQ ID NO: 54352 - DNA, 20 bp, Artificial Sequence
  chemically synthesized
gaagccatcctgccaagaat

SEQ ID NO: 54353 - DNA, 20 bp, Artificial Sequence
  chemically synthesized
gccatcctgccaagaatgag

SEQ ID NO: 54354 - DNA, 20 bp, Artificial Sequence
  chemically synthesized
gaatgagtggacttctgtga

SEQ ID NO: 54355 - DNA, 20 bp, Artificial Sequence
  chemically synthesized
acttctgtgatggctgctcc

SEQ ID NO: 54356 - DNA, 20 bp, Artificial Sequence
  chemically synthesized
tgtgatggctgctcccagcc

SEQ ID NO: 54357 - DNA, 20 bp, Artificial Sequence
  chemically synthesized
gtgatggctgctcccagcct

SEQ ID NO: 54358 - DNA, 20 bp, Artificial Sequence
  chemically synthesized
tgatggctgctcccagcctg

SEQ ID NO: 54359 - DNA, 20 bp, Artificial Sequence
  chemically synthesized
cttttatactcacttctcct

SEQ ID NO: 54360 - DNA, 20 bp, Artificial Sequence
  chemically synthesized
tatactcacttctcctgagc

SEQ ID NO: 54361 - DNA, 20 bp, Artificial Sequence
  chemically synthesized
atactcacttctcctgagct

SEQ ID NO: 54362 - DNA, 20 bp, Artificial Sequence
  chemically synthesized
gctgattctgattattgact

SEQ ID NO: 54363 - DNA, 20 bp, Artificial Sequence
  chemically synthesized
aggtttgcagtcagattggc

SEQ ID NO: 54364 - DNA, 20 bp, Artificial Sequence
  chemically synthesized
agcagcctagctcaggagaa

SEQ ID NO: 54365 - DNA, 20 bp, Artificial Sequence
  chemically synthesized
agaagtccactcattcttgg

SEQ ID NO: 54366 - DNA, 20 bp, Artificial Sequence
  chemically synthesized
tgtctgaggctggccctacg

SEQ ID NO: 54367 - DNA, 20 bp, Artificial Sequence
  chemically synthesized
ccagcttttattactagggc

SEQ ID NO: 54368 - DNA, 20 bp, Artificial Sequence
  chemically synthesized
taattaattcaaacttcaaa

SEQ ID NO: 54369 - DNA, 20 bp, Artificial Sequence
  chemically synthesized
tattaaggaagctgttaata

SEQ ID NO: 54370 - DNA, 20 bp, Artificial Sequence
  chemically synthesized
ctaattcttaaatcctctag

SEQ ID NO: 54371 - DNA, 20 bp, Artificial Sequence
  chemically synthesized
gaattaactaatactataaa

SEQ ID NO: 54372 - DNA, 20 bp, Artificial Sequence
  chemically synthesized
actaatactataaaatgggt

SEQ ID NO: 54373 - DNA, 20 bp, Artificial Sequence
  chemically synthesized
ttttataacaactggtaaga

SEQ ID NO: 54374 - DNA, 20 bp, Artificial Sequence
  chemically synthesized
acaattacgtctgtgttata

SEQ ID NO: 54375 - DNA, 20 bp, Artificial Sequence
  chemically synthesized
gacacttacgttcctgataa

SEQ ID NO: 54376 - DNA, 20 bp, Artificial Sequence
  chemically synthesized
tccagatttctaataccaca

SEQ ID NO: 54377 - DNA, 20 bp, Artificial Sequence
  chemically synthesized
tctctacacccagggcaccg

SEQ ID NO: 54378 - DNA, 20 bp, Artificial Sequence
  chemically synthesized
ctttgaccatcagaggacac

SEQ ID NO: 54379 - DNA, 20 bp, Artificial Sequence
  chemically synthesized
cacttggattcaccggtgcc

SEQ ID NO: 54380 - DNA, 20 bp, Artificial Sequence
  chemically synthesized
gagaagttaacaaaattgat

SEQ ID NO: 54381 - DNA, 20 bp, Artificial Sequence
  chemically synthesized
aacaaaattgatcagagtga

SEQ ID NO: 54382 - DNA, 20 bp, Artificial Sequence
  chemically synthesized
ttagaaatctggagcgaaac

SEQ ID NO: 54383 - DNA, 20 bp, Artificial Sequence
  chemically synthesized
gacgtaattgtttccaaagc

SEQ ID NO: 54384 - DNA, 20 bp, Artificial Sequence
  chemically synthesized
cagacacactgctatcaacc

SEQ ID NO: 54385 - DNA, 20 bp, Artificial Sequence
  chemically synthesized
atcaaccagggatgtgtata

SEQ ID NO: 54386 - DNA, 20 bp, Artificial Sequence
  chemically synthesized
gctttgttaaaagtctccat

SEQ ID NO: 54387 - DNA, 20 bp, Artificial Sequence
  chemically synthesized
gttaaaagtctccatttgag

SEQ ID NO: 54388 - DNA, 20 bp, Artificial Sequence
  chemically synthesized
agtattagttaattcttcta

SEQ ID NO: 54389 - DNA, 20 bp, Artificial Sequence
  chemically synthesized
ttaattcttctagaggattt

SEQ ID NO: 54390 - DNA, 20 bp, Artificial Sequence
  chemically synthesized
ttaagaattagatatctgac

SEQ ID NO: 54391 - DNA, 20 bp, Artificial Sequence
  chemically synthesized
gattaatcaataaatacgtt

SEQ ID NO: 54392 - DNA, 20 bp, Artificial Sequence
  chemically synthesized
gttttgaataactatagggc

SEQ ID NO: 54393 - DNA, 20 bp, Artificial Sequence
  chemically synthesized
cccccaaatacattttatgg

SEQ ID NO: 54394 - DNA, 20 bp, Artificial Sequence
  chemically synthesized
aatgcaccaaagcaatgagg

SEQ ID NO: 54395 - DNA, 20 bp, Artificial Sequence
  chemically synthesized
aagcaatgaggtagaatgct

SEQ ID NO: 54396 - DNA, 20 bp, Artificial Sequence
  chemically synthesized
aacttcattctttttgaagt

SEQ ID NO: 54397 - DNA, 20 bp, Artificial Sequence
  chemically synthesized
aattatattaaaaatagatg

SEQ ID NO: 54398 - DNA, 20 bp, Artificial Sequence
  chemically synthesized
agctggttggcaaagctgga

SEQ ID NO: 54399 - DNA, 20 bp, Artificial Sequence
  chemically synthesized
tcacttctacttcatttagc

SEQ ID NO: 54400 - DNA, 20 bp, Artificial Sequence
  chemically synthesized
ttagcgtgaatcttaaatgt

SEQ ID NO: 54401 - DNA, 20 bp, Artificial Sequence
  chemically synthesized
gtgaatcttaaatgtaggaa

SEQ ID NO: 54402 - DNA, 20 bp, Artificial Sequence
  chemically synthesized
cgatgagaagccatcctgcc

SEQ ID NO: 54403 - DNA, 20 bp, Artificial Sequence
  chemically synthesized
gagaagccatcctgccaaga

SEQ ID NO: 54404 - DNA, 20 bp, Artificial Sequence
  chemically synthesized
ataattaattcaaacttcaa

SEQ ID NO: 54405 - DNA, 20 bp, Artificial Sequence
  chemically synthesized
tctgtttcctcagatagatg

SEQ ID NO: 54406 - DNA, 20 bp, Artificial Sequence
  chemically synthesized
aagctgttaatactgaattt

SEQ ID NO: 54407 - DNA, 20 bp, Artificial Sequence
  chemically synthesized
tctaattcttaaatcctcta

SEQ ID NO: 54408 - DNA, 20 bp, Artificial Sequence
  chemically synthesized
tgatagcagtgtgtctggag

SEQ ID NO: 54409 - DNA, 20 bp, Artificial Sequence
  chemically synthesized
ctccagatttctaataccac

SEQ ID NO: 54410 - DNA, 20 bp, Artificial Sequence
  chemically synthesized
caatgtggccgtgcatgtgt

SEQ ID NO: 54411 - DNA, 20 bp, Artificial Sequence
  chemically synthesized
aggatttattctttgtggta

SEQ ID NO: 54412 - DNA, 20 bp, Artificial Sequence
  chemically synthesized
attagaaatctggagcgaaa

SEQ ID NO: 54413 - DNA, 20 bp, Artificial Sequence
  chemically synthesized
agacgtaattgtttccaaag

SEQ ID NO: 54414 - DNA, 20 bp, Artificial Sequence
  chemically synthesized
tgtgtataatgaattttaag

SEQ ID NO: 54415 - DNA, 20 bp, Artificial Sequence
  chemically synthesized
gttaattcttctagaggatt

SEQ ID NO: 54416 - DNA, 20 bp, Artificial Sequence
  chemically synthesized
tttaagaattagatatctga

SEQ ID NO: 54417 - DNA, 20 bp, Artificial Sequence
  chemically synthesized
cgttttgaataactataggg

SEQ ID NO: 54418 - DNA, 20 bp, Artificial Sequence
  chemically synthesized
taatgcaccaaagcaatgag

SEQ ID NO: 54419 - DNA, 20 bp, Artificial Sequence
  chemically synthesized
aaatgtaggaatgggatgtc

SEQ ID NO: 54420 - DNA, 20 bp, Artificial Sequence
  chemically synthesized
acgatgagaagccatcctgc

SEQ ID NO: 54421 - DNA, 20 bp, Artificial Sequence
  chemically synthesized
attctggccctatagttatt

SEQ ID NO: 54422 - DNA, 20 bp, Artificial Sequence
  chemically synthesized
aacaactaaaatgatctcag

SEQ ID NO: 54423 - DNA, 20 bp, Artificial Sequence
  chemically synthesized
taagtcaataatcagaatca

SEQ ID NO: 54424 - DNA, 20 bp, Artificial Sequence
  chemically synthesized
tcagaatcagcaggtttgca

SEQ ID NO: 54425 - DNA, 20 bp, Artificial Sequence
  chemically synthesized
agtccactcattcttggcag

SEQ ID NO: 54426 - DNA, 20 bp, Artificial Sequence
  chemically synthesized
tctgaggctggccctacggt

SEQ ID NO: 54427 - DNA, 20 bp, Artificial Sequence
  chemically synthesized
gtgacatcccattcctacat

SEQ ID NO: 54428 - DNA, 20 bp, Artificial Sequence
  chemically synthesized
atgaagtagaagtgactcct

SEQ ID NO: 54429 - DNA, 20 bp, Artificial Sequence
  chemically synthesized
gactccttccagctttgcca

SEQ ID NO: 54430 - DNA, 20 bp, Artificial Sequence
  chemically synthesized
tcaaaaagaatgaagttcca

SEQ ID NO: 54431 - DNA, 20 bp, Artificial Sequence
  chemically synthesized
gaactctgagcattctacct

SEQ ID NO: 54432 - DNA, 20 bp, Artificial Sequence
  chemically synthesized
tacctcattgctttggtgca

SEQ ID NO: 54433 - DNA, 20 bp, Artificial Sequence
  chemically synthesized
aggtttgtaatatctggtac

SEQ ID NO: 54434 - DNA, 20 bp, Artificial Sequence
  chemically synthesized
gtatttgggggacaaactgc

SEQ ID NO: 54435 - DNA, 20 bp, Artificial Sequence
  chemically synthesized
atagttattcaaaacgtatt

SEQ ID NO: 54436 - DNA, 20 bp, Artificial Sequence
  chemically synthesized
tatttattgattaatcttta

SEQ ID NO: 54437 - DNA, 20 bp, Artificial Sequence
  chemically synthesized
actaaaatgatctcaggaaa

SEQ ID NO: 54438 - DNA, 20 bp, Artificial Sequence
  chemically synthesized
tgtctggaggcagaaaccat

SEQ ID NO: 54439 - DNA, 20 bp, Artificial Sequence
  chemically synthesized
taatgggatcagtgtgtaat

SEQ ID NO: 54440 - DNA, 20 bp, Artificial Sequence
  chemically synthesized
gtgtgtaattcttgtttcgc

SEQ ID NO: 54441 - DNA, 20 bp, Artificial Sequence
  chemically synthesized
actttgaccatcagaggaca

SEQ ID NO: 54442 - DNA, 20 bp, Artificial Sequence
  chemically synthesized
taacaaaattgatcagagtg

SEQ ID NO: 54443 - DNA, 20 bp, Artificial Sequence
  chemically synthesized
aacgtaagtgtcgacaatta

SEQ ID NO: 54444 - DNA, 20 bp, Artificial Sequence
  chemically synthesized
actcagtataacacagacgt

SEQ ID NO: 54445 - DNA, 20 bp, Artificial Sequence
  chemically synthesized
gtaattgtttccaaagcaag

SEQ ID NO: 54446 - DNA, 20 bp, Artificial Sequence
  chemically synthesized
aaaataggtcccctgagaac

SEQ ID NO: 54447 - DNA, 20 bp, Artificial Sequence
  chemically synthesized
tgtaccatacatagggccaa

SEQ ID NO: 54448 - DNA, 20 bp, Artificial Sequence
  chemically synthesized
tagtattagttaattcttct

SEQ ID NO: 54449 - DNA, 20 bp, Artificial Sequence
  chemically synthesized
atattgttcactaagccttt

SEQ ID NO: 54450 - DNA, 20 bp, Artificial Sequence
  chemically synthesized
ttttaaagattaatcaataa

SEQ ID NO: 54451 - DNA, 20 bp, Artificial Sequence
  chemically synthesized
agggccagaatataatctcc

SEQ ID NO: 54452 - DNA, 20 bp, Artificial Sequence
  chemically synthesized
ttttctgaaaattcagtatt

SEQ ID NO: 54453 - DNA, 20 bp, Artificial Sequence
  chemically synthesized
cagtggaacttcattctttt

SEQ ID NO: 54454 - DNA, 20 bp, Artificial Sequence
  chemically synthesized
tgtgatggctgctcccagcc

SEQ ID NO: 54455 - DNA, 20 bp, Artificial Sequence
  chemically synthesized
tactcacttctcctgagcta

SEQ ID NO: 54456 - DNA, 20 bp, Artificial Sequence
  chemically synthesized
tgccaatctgactgcaaacc

SEQ ID NO: 54457 - DNA, 20 bp, Artificial Sequence
  chemically synthesized
tctgactgcaaacctgctga

SEQ ID NO: 54458 - DNA, 22 bp, Artificial Sequence
  chemically synthesized
actaagtcaataatcagaatca

SEQ ID NO: 54459 - DNA, 22 bp, Artificial Sequence
  chemically synthesized
agtcaataatcagaatcagcag

SEQ ID NO: 54460 - DNA, 22 bp, Artificial Sequence
  chemically synthesized
gcagtcagattggcagggataa

SEQ ID NO: 54461 - DNA, 22 bp, Artificial Sequence
  chemically synthesized
cagtcagattggcagggataag

SEQ ID NO: 54462 - DNA, 22 bp, Artificial Sequence
  chemically synthesized
gcagggataagcagcctagctc

SEQ ID NO: 54463 - DNA, 22 bp, Artificial Sequence
  chemically synthesized
gctcaggagaagtgagtataaa

SEQ ID NO: 54464 - DNA, 22 bp, Artificial Sequence
  chemically synthesized
aggagaagtgagtataaaagcc

SEQ ID NO: 54465 - DNA, 22 bp, Artificial Sequence
  chemically synthesized
ggagcagccatcacagaagtcc

SEQ ID NO: 54466 - DNA, 22 bp, Artificial Sequence
  chemically synthesized
attcttggcaggatggcttctc

SEQ ID NO: 54467 - DNA, 22 bp, Artificial Sequence
  chemically synthesized
ttggcaggatggcttctcatcg

SEQ ID NO: 54468 - DNA, 22 bp, Artificial Sequence
  chemically synthesized
ggcaggatggcttctcatcgtc

SEQ ID NO: 54469 - DNA, 22 bp, Artificial Sequence
  chemically synthesized
gcaggatggcttctcatcgtct

SEQ ID NO: 54470 - DNA, 22 bp, Artificial Sequence
  chemically synthesized
ctcatcgtctgctcctcctctg

SEQ ID NO: 54471 - DNA, 22 bp, Artificial Sequence
  chemically synthesized
tcatcgtctgctcctcctctgc

SEQ ID NO: 54472 - DNA, 22 bp, Artificial Sequence
  chemically synthesized
atcgtctgctcctcctctgcct

SEQ ID NO: 54473 - DNA, 22 bp, Artificial Sequence
  chemically synthesized
ctcctcctctgccttgctggac

SEQ ID NO: 54474 - DNA, 22 bp, Artificial Sequence
  chemically synthesized
ctcctctgccttgctggactgg

SEQ ID NO: 54475 - DNA, 22 bp, Artificial Sequence
  chemically synthesized
ctctgccttgctggactggtat

SEQ ID NO: 54476 - DNA, 22 bp, Artificial Sequence
  chemically synthesized
tgccttgctggactggtatttg

SEQ ID NO: 54477 - DNA, 22 bp, Artificial Sequence
  chemically synthesized
ccttgctggactggtatttgtg

SEQ ID NO: 54478 - DNA, 22 bp, Artificial Sequence
  chemically synthesized
gctggactggtatttgtgtctg

SEQ ID NO: 54479 - DNA, 22 bp, Artificial Sequence
  chemically synthesized
ctggactggtatttgtgtctga

SEQ ID NO: 54480 - DNA, 22 bp, Artificial Sequence
  chemically synthesized
gactggtatttgtgtctgaggc

SEQ ID NO: 54481 - DNA, 22 bp, Artificial Sequence
  chemically synthesized
gtatttgtgtctgaggctggcc

SEQ ID NO: 54482 - DNA, 22 bp, Artificial Sequence
  chemically synthesized
gtgtctgaggctggccctacgg

SEQ ID NO: 54483 - DNA, 22 bp, Artificial Sequence
  chemically synthesized
tgtctgaggctggccctacggt

SEQ ID NO: 54484 - DNA, 22 bp, Artificial Sequence
  chemically synthesized
aggctggccctacggtgagtgt

SEQ ID NO: 54485 - DNA, 22 bp, Artificial Sequence
  chemically synthesized
gccctacggtgagtgtttctgt

SEQ ID NO: 54486 - DNA, 22 bp, Artificial Sequence
  chemically synthesized
cggtgagtgtttctgtgacatc

SEQ ID NO: 54487 - DNA, 22 bp, Artificial Sequence
  chemically synthesized
ctgtgacatcccattcctacat

SEQ ID NO: 54488 - DNA, 22 bp, Artificial Sequence
  chemically synthesized
tgtgacatcccattcctacatt

SEQ ID NO: 54489 - DNA, 22 bp, Artificial Sequence
  chemically synthesized
tgacatcccattcctacattta

SEQ ID NO: 54490 - DNA, 22 bp, Artificial Sequence
  chemically synthesized
ctacatttaagattcacgctaa

SEQ ID NO: 54491 - DNA, 22 bp, Artificial Sequence
  chemically synthesized
catttaagattcacgctaaatg

SEQ ID NO: 54492 - DNA, 22 bp, Artificial Sequence
  chemically synthesized
aagattcacgctaaatgaagta

SEQ ID NO: 54493 - DNA, 22 bp, Artificial Sequence
  chemically synthesized
agattcacgctaaatgaagtag

SEQ ID NO: 54494 - DNA, 22 bp, Artificial Sequence
  chemically synthesized
acgctaaatgaagtagaagtga

SEQ ID NO: 54495 - DNA, 22 bp, Artificial Sequence
  chemically synthesized
aatgaagtagaagtgactcctt

SEQ ID NO: 54496 - DNA, 22 bp, Artificial Sequence
  chemically synthesized
cttccagctttgccaaccagct

SEQ ID NO: 54497 - DNA, 22 bp, Artificial Sequence
  chemically synthesized
ccagctttgccaaccagctttt

SEQ ID NO: 54498 - DNA, 22 bp, Artificial Sequence
  chemically synthesized
cagctttgccaaccagctttta

SEQ ID NO: 54499 - DNA, 22 bp, Artificial Sequence
  chemically synthesized
tgccaaccagcttttattacta

SEQ ID NO: 54500 - DNA, 22 bp, Artificial Sequence
  chemically synthesized
gccaaccagcttttattactag

SEQ ID NO: 54501 - DNA, 22 bp, Artificial Sequence
  chemically synthesized
ccaaccagcttttattactagg

SEQ ID NO: 54502 - DNA, 22 bp, Artificial Sequence
  chemically synthesized
ttattactagggcaagggtacc

SEQ ID NO: 54503 - DNA, 22 bp, Artificial Sequence
  chemically synthesized
tattactagggcaagggtaccc

SEQ ID NO: 54504 - DNA, 22 bp, Artificial Sequence
  chemically synthesized
attactagggcaagggtaccca

SEQ ID NO: 54505 - DNA, 22 bp, Artificial Sequence
  chemically synthesized
ttactagggcaagggtacccag

SEQ ID NO: 54506 - DNA, 22 bp, Artificial Sequence
  chemically synthesized
ctagggcaagggtacccagcat

SEQ ID NO: 54507 - DNA, 22 bp, Artificial Sequence
  chemically synthesized
gggcaagggtacccagcatcta

SEQ ID NO: 54508 - DNA, 22 bp, Artificial Sequence
  chemically synthesized
tttttaatataattaattcaaa

SEQ ID NO: 54509 - DNA, 22 bp, Artificial Sequence
  chemically synthesized
ttaatataattaattcaaactt

SEQ ID NO: 54510 - DNA, 22 bp, Artificial Sequence
  chemically synthesized
taatataattaattcaaacttc

SEQ ID NO: 54511 - DNA, 22 bp, Artificial Sequence
  chemically synthesized
aatataattaattcaaacttca

SEQ ID NO: 54512 - DNA, 22 bp, Artificial Sequence
  chemically synthesized
atataattaattcaaacttcaa

SEQ ID NO: 54513 - DNA, 22 bp, Artificial Sequence
  chemically synthesized
attcaaacttcaaaaagaatga

SEQ ID NO: 54514 - DNA, 22 bp, Artificial Sequence
  chemically synthesized
aaacttcaaaaagaatgaagtt

SEQ ID NO: 54515 - DNA, 22 bp, Artificial Sequence
  chemically synthesized
caaaaagaatgaagttccactg

SEQ ID NO: 54516 - DNA, 22 bp, Artificial Sequence
  chemically synthesized
aaaaagaatgaagttccactga

SEQ ID NO: 54517 - DNA, 22 bp, Artificial Sequence
  chemically synthesized
cactgagcttactgagctggga

SEQ ID NO: 54518 - DNA, 22 bp, Artificial Sequence
  chemically synthesized
agcttactgagctgggacttga

SEQ ID NO: 54519 - DNA, 22 bp, Artificial Sequence
  chemically synthesized
actgagctgggacttgaactct

SEQ ID NO: 54520 - DNA, 22 bp, Artificial Sequence
  chemically synthesized
ctgagctgggacttgaactctg

SEQ ID NO: 54521 - DNA, 22 bp, Artificial Sequence
  chemically synthesized
agctgggacttgaactctgagc

SEQ ID NO: 54522 - DNA, 22 bp, Artificial Sequence
  chemically synthesized
ggacttgaactctgagcattct

SEQ ID NO: 54523 - DNA, 22 bp, Artificial Sequence
  chemically synthesized
gaactctgagcattctacctca

SEQ ID NO: 54524 - DNA, 22 bp, Artificial Sequence
  chemically synthesized
aactctgagcattctacctcat

SEQ ID NO: 54525 - DNA, 22 bp, Artificial Sequence
  chemically synthesized
tgagcattctacctcattgctt

SEQ ID NO: 54526 - DNA, 22 bp, Artificial Sequence
  chemically synthesized
agcattctacctcattgctttg

SEQ ID NO: 54527 - DNA, 22 bp, Artificial Sequence
  chemically synthesized
tacctcattgctttggtgcatt

SEQ ID NO: 54528 - DNA, 22 bp, Artificial Sequence
  chemically synthesized
cctcattgctttggtgcattag

SEQ ID NO: 54529 - DNA, 22 bp, Artificial Sequence
  chemically synthesized
attgctttggtgcattaggttt

SEQ ID NO: 54530 - DNA, 22 bp, Artificial Sequence
  chemically synthesized
ctttggtgcattaggtttgtaa

SEQ ID NO: 54531 - DNA, 22 bp, Artificial Sequence
  chemically synthesized
tggtgcattaggtttgtaatat

SEQ ID NO: 54532 - DNA, 22 bp, Artificial Sequence
  chemically synthesized
ggtgcattaggtttgtaatatc

SEQ ID NO: 54533 - DNA, 22 bp, Artificial Sequence
  chemically synthesized
gtgcattaggtttgtaatatct

SEQ ID NO: 54534 - DNA, 22 bp, Artificial Sequence
  chemically synthesized
ggtttgtaatatctggtacctc

SEQ ID NO: 54535 - DNA, 22 bp, Artificial Sequence
  chemically synthesized
gtaatatctggtacctctgttt

SEQ ID NO: 54536 - DNA, 22 bp, Artificial Sequence
  chemically synthesized
taatatctggtacctctgtttc

SEQ ID NO: 54537 - DNA, 22 bp, Artificial Sequence
  chemically synthesized
gtacctctgtttcctcagatag

SEQ ID NO: 54538 - DNA, 22 bp, Artificial Sequence
  chemically synthesized
tgtttcctcagatagatgatag

SEQ ID NO: 54539 - DNA, 22 bp, Artificial Sequence
  chemically synthesized
tttcctcagatagatgatagaa

SEQ ID NO: 54540 - DNA, 22 bp, Artificial Sequence
  chemically synthesized
cctcagatagatgatagaaata

SEQ ID NO: 54541 - DNA, 22 bp, Artificial Sequence
  chemically synthesized
ctcagatagatgatagaaataa

SEQ ID NO: 54542 - DNA, 22 bp, Artificial Sequence
  chemically synthesized
agatagatgatagaaataaaga

SEQ ID NO: 54543 - DNA, 22 bp, Artificial Sequence
  chemically synthesized
aggaagctgttaatactgaatt

SEQ ID NO: 54544 - DNA, 22 bp, Artificial Sequence
  chemically synthesized
ttaatactgaattttcagaaaa

SEQ ID NO: 54545 - DNA, 22 bp, Artificial Sequence
  chemically synthesized
atactgaattttcagaaaagta

SEQ ID NO: 54546 - DNA, 22 bp, Artificial Sequence
  chemically synthesized
aattttcagaaaagtatccctc

SEQ ID NO: 54547 - DNA, 22 bp, Artificial Sequence
  chemically synthesized
tcagaaaagtatccctccataa

SEQ ID NO: 54548 - DNA, 22 bp, Artificial Sequence
  chemically synthesized
cagaaaagtatccctccataaa

SEQ ID NO: 54549 - DNA, 22 bp, Artificial Sequence
  chemically synthesized
agaaaagtatccctccataaaa

SEQ ID NO: 54550 - DNA, 22 bp, Artificial Sequence
  chemically synthesized
cataaaatgtatttgggggaca

SEQ ID NO: 54551 - DNA, 22 bp, Artificial Sequence
  chemically synthesized
gggggacaaactgcaggagatt

SEQ ID NO: 54552 - DNA, 22 bp, Artificial Sequence
  chemically synthesized
ggggacaaactgcaggagatta

SEQ ID NO: 54553 - DNA, 22 bp, Artificial Sequence
  chemically synthesized
caggagattatattctggccct

SEQ ID NO: 54554 - DNA, 22 bp, Artificial Sequence
  chemically synthesized
tattctggccctatagttattc

SEQ ID NO: 54555 - DNA, 22 bp, Artificial Sequence
  chemically synthesized
tggccctatagttattcaaaac

SEQ ID NO: 54556 - DNA, 22 bp, Artificial Sequence
  chemically synthesized
gccctatagttattcaaaacgt

SEQ ID NO: 54557 - DNA, 22 bp, Artificial Sequence
  chemically synthesized
tagttattcaaaacgtatttat

SEQ ID NO: 54558 - DNA, 22 bp, Artificial Sequence
  chemically synthesized
ttcaaaacgtatttattgatta

SEQ ID NO: 54559 - DNA, 22 bp, Artificial Sequence
  chemically synthesized
aaaacgtatttattgattaatc

SEQ ID NO: 54560 - DNA, 22 bp, Artificial Sequence
  chemically synthesized
attgattaatctttaaaaggct

SEQ ID NO: 54561 - DNA, 22 bp, Artificial Sequence
  chemically synthesized
ttgattaatctttaaaaggctt

SEQ ID NO: 54562 - DNA, 22 bp, Artificial Sequence
  chemically synthesized
attaatctttaaaaggcttagt

SEQ ID NO: 54563 - DNA, 22 bp, Artificial Sequence
  chemically synthesized
atctttaaaaggcttagtgaac

SEQ ID NO: 54564 - DNA, 22 bp, Artificial Sequence
  chemically synthesized
taaaaggcttagtgaacaatat

SEQ ID NO: 54565 - DNA, 22 bp, Artificial Sequence
  chemically synthesized
aaaaggcttagtgaacaatatt

SEQ ID NO: 54566 - DNA, 22 bp, Artificial Sequence
  chemically synthesized
aaaggcttagtgaacaatattc

SEQ ID NO: 54567 - DNA, 22 bp, Artificial Sequence
  chemically synthesized
agtgaacaatattctagtcaga

SEQ ID NO: 54568 - DNA, 22 bp, Artificial Sequence
  chemically synthesized
gtgaacaatattctagtcagat

SEQ ID NO: 54569 - DNA, 22 bp, Artificial Sequence
  chemically synthesized
tagtcagatatctaattcttaa

SEQ ID NO: 54570 - DNA, 22 bp, Artificial Sequence
  chemically synthesized
gtcagatatctaattcttaaat

SEQ ID NO: 54571 - DNA, 22 bp, Artificial Sequence
  chemically synthesized
attcttaaatcctctagaagaa

SEQ ID NO: 54572 - DNA, 22 bp, Artificial Sequence
  chemically synthesized
ttaaatcctctagaagaattaa

SEQ ID NO: 54573 - DNA, 22 bp, Artificial Sequence
  chemically synthesized
aaatcctctagaagaattaact

SEQ ID NO: 54574 - DNA, 22 bp, Artificial Sequence
  chemically synthesized
aatcctctagaagaattaacta

SEQ ID NO: 54575 - DNA, 22 bp, Artificial Sequence
  chemically synthesized
tagaagaattaactaatactat

SEQ ID NO: 54576 - DNA, 22 bp, Artificial Sequence
  chemically synthesized
gaagaattaactaatactataa

SEQ ID NO: 54577 - DNA, 22 bp, Artificial Sequence
  chemically synthesized
actaatactataaaatgggtct

SEQ ID NO: 54578 - DNA, 22 bp, Artificial Sequence
  chemically synthesized
atactataaaatgggtctggat

SEQ ID NO: 54579 - DNA, 22 bp, Artificial Sequence
  chemically synthesized
taaaatgggtctggatgtagtt

SEQ ID NO: 54580 - DNA, 22 bp, Artificial Sequence
  chemically synthesized
gatgtagttctgacattatttt

SEQ ID NO: 54581 - DNA, 22 bp, Artificial Sequence
  chemically synthesized
tgacattattttataacaactg

SEQ ID NO: 54582 - DNA, 22 bp, Artificial Sequence
  chemically synthesized
acattattttataacaactggt

SEQ ID NO: 54583 - DNA, 22 bp, Artificial Sequence
  chemically synthesized
ttttataacaactggtaagagg

SEQ ID NO: 54584 - DNA, 22 bp, Artificial Sequence
  chemically synthesized
tataacaactggtaagagggag

SEQ ID NO: 54585 - DNA, 22 bp, Artificial Sequence
  chemically synthesized
ataacaactggtaagagggagt

SEQ ID NO: 54586 - DNA, 22 bp, Artificial Sequence
  chemically synthesized
taacaactggtaagagggagtg

SEQ ID NO: 54587 - DNA, 22 bp, Artificial Sequence
  chemically synthesized
gtaagagggagtgactatagca

SEQ ID NO: 54588 - DNA, 22 bp, Artificial Sequence
  chemically synthesized
tagcaacaactaaaatgatctc

SEQ ID NO: 54589 - DNA, 22 bp, Artificial Sequence
  chemically synthesized
aaatgatctcaggaaaacctgt

SEQ ID NO: 54590 - DNA, 22 bp, Artificial Sequence
  chemically synthesized
aggaaaacctgtttggccctat

SEQ ID NO: 54591 - DNA, 22 bp, Artificial Sequence
  chemically synthesized
tttggccctatgtatggtacat

SEQ ID NO: 54592 - DNA, 22 bp, Artificial Sequence
  chemically synthesized
ggccctatgtatggtacattac

SEQ ID NO: 54593 - DNA, 22 bp, Artificial Sequence
  chemically synthesized
gccctatgtatggtacattaca

SEQ ID NO: 54594 - DNA, 22 bp, Artificial Sequence
  chemically synthesized
tgtatggtacattacatctttt

SEQ ID NO: 54595 - DNA, 22 bp, Artificial Sequence
  chemically synthesized
catcttttcagtaattccactc

SEQ ID NO: 54596 - DNA, 22 bp, Artificial Sequence
  chemically synthesized
ttcagtaattccactcaaatgg

SEQ ID NO: 54597 - DNA, 22 bp, Artificial Sequence
  chemically synthesized
tcagtaattccactcaaatgga

SEQ ID NO: 54598 - DNA, 22 bp, Artificial Sequence
  chemically synthesized
cagtaattccactcaaatggag

SEQ ID NO: 54599 - DNA, 22 bp, Artificial Sequence
  chemically synthesized
agtaattccactcaaatggaga

SEQ ID NO: 54600 - DNA, 22 bp, Artificial Sequence
  chemically synthesized
cactcaaatggagacttttaac

SEQ ID NO: 54601 - DNA, 22 bp, Artificial Sequence
  chemically synthesized
aaatggagacttttaacaaagc

SEQ ID NO: 54602 - DNA, 22 bp, Artificial Sequence
  chemically synthesized
ttaacaaagcaactgttctcag

SEQ ID NO: 54603 - DNA, 22 bp, Artificial Sequence
  chemically synthesized
taacaaagcaactgttctcagg

SEQ ID NO: 54604 - DNA, 22 bp, Artificial Sequence
  chemically synthesized
aacaaagcaactgttctcaggg

SEQ ID NO: 54605 - DNA, 22 bp, Artificial Sequence
  chemically synthesized
acaaagcaactgttctcagggg

SEQ ID NO: 54606 - DNA, 22 bp, Artificial Sequence
  chemically synthesized
ttctcaggggacctattttctc

SEQ ID NO: 54607 - DNA, 22 bp, Artificial Sequence
  chemically synthesized
tcaggggacctattttctccct

SEQ ID NO: 54608 - DNA, 22 bp, Artificial Sequence
  chemically synthesized
aggggacctattttctccctta

SEQ ID NO: 54609 - DNA, 22 bp, Artificial Sequence
  chemically synthesized
ttttctcccttaaaattcatta

SEQ ID NO: 54610 - DNA, 22 bp, Artificial Sequence
  chemically synthesized
tctcccttaaaattcattatac

SEQ ID NO: 54611 - DNA, 22 bp, Artificial Sequence
  chemically synthesized
ctcccttaaaattcattataca

SEQ ID NO: 54612 - DNA, 22 bp, Artificial Sequence
  chemically synthesized
tcccttaaaattcattatacac

SEQ ID NO: 54613 - DNA, 22 bp, Artificial Sequence
  chemically synthesized
ccttaaaattcattatacacat

SEQ ID NO: 54614 - DNA, 22 bp, Artificial Sequence
  chemically synthesized
aaaattcattatacacatccct

SEQ ID NO: 54615 - DNA, 22 bp, Artificial Sequence
  chemically synthesized
aaattcattatacacatccctg

SEQ ID NO: 54616 - DNA, 22 bp, Artificial Sequence
  chemically synthesized
attatacacatccctggttgat

SEQ ID NO: 54617 - DNA, 22 bp, Artificial Sequence
  chemically synthesized
tacacatccctggttgatagca

SEQ ID NO: 54618 - DNA, 22 bp, Artificial Sequence
  chemically synthesized
gttgatagcagtgtgtctggag

SEQ ID NO: 54619 - DNA, 22 bp, Artificial Sequence
  chemically synthesized
atagcagtgtgtctggaggcag

SEQ ID NO: 54620 - DNA, 22 bp, Artificial Sequence
  chemically synthesized
gaggcagaaaccattcttgctt

SEQ ID NO: 54621 - DNA, 22 bp, Artificial Sequence
  chemically synthesized
ttgctttggaaacaattacgtc

SEQ ID NO: 54622 - DNA, 22 bp, Artificial Sequence
  chemically synthesized
gctttggaaacaattacgtctg

SEQ ID NO: 54623 - DNA, 22 bp, Artificial Sequence
  chemically synthesized
ctttggaaacaattacgtctgt

SEQ ID NO: 54624 - DNA, 22 bp, Artificial Sequence
  chemically synthesized
tggaaacaattacgtctgtgtt

SEQ ID NO: 54625 - DNA, 22 bp, Artificial Sequence
  chemically synthesized
ggaaacaattacgtctgtgtta

SEQ ID NO: 54626 - DNA, 22 bp, Artificial Sequence
  chemically synthesized
gaaacaattacgtctgtgttat

SEQ ID NO: 54627 - DNA, 22 bp, Artificial Sequence
  chemically synthesized
cgtctgtgttatactgagtagg

SEQ ID NO: 54628 - DNA, 22 bp, Artificial Sequence
  chemically synthesized
tgttatactgagtagggaagct

SEQ ID NO: 54629 - DNA, 22 bp, Artificial Sequence
  chemically synthesized
tactgagtagggaagctcatta

SEQ ID NO: 54630 - DNA, 22 bp, Artificial Sequence
  chemically synthesized
agtagggaagctcattaattgt

SEQ ID NO: 54631 - DNA, 22 bp, Artificial Sequence
  chemically synthesized
attaattgtcgacacttacgtt

SEQ ID NO: 54632 - DNA, 22 bp, Artificial Sequence
  chemically synthesized
attgtcgacacttacgttcctg

SEQ ID NO: 54633 - DNA, 22 bp, Artificial Sequence
  chemically synthesized
tcgacacttacgttcctgataa

SEQ ID NO: 54634 - DNA, 22 bp, Artificial Sequence
  chemically synthesized
acgttcctgataatgggatcag

SEQ ID NO: 54635 - DNA, 22 bp, Artificial Sequence
  chemically synthesized
cgttcctgataatgggatcagt

SEQ ID NO: 54636 - DNA, 22 bp, Artificial Sequence
  chemically synthesized
ctgataatgggatcagtgtgta

SEQ ID NO: 54637 - DNA, 22 bp, Artificial Sequence
  chemically synthesized
ataatgggatcagtgtgtaatt

SEQ ID NO: 54638 - DNA, 22 bp, Artificial Sequence
  chemically synthesized
ttgtttcgctccagatttctaa

SEQ ID NO: 54639 - DNA, 22 bp, Artificial Sequence
  chemically synthesized
gtttcgctccagatttctaata

SEQ ID NO: 54640 - DNA, 22 bp, Artificial Sequence
  chemically synthesized
tttcgctccagatttctaatac

SEQ ID NO: 54641 - DNA, 22 bp, Artificial Sequence
  chemically synthesized
cgctccagatttctaataccac

SEQ ID NO: 54642 - DNA, 22 bp, Artificial Sequence
  chemically synthesized
gctccagatttctaataccaca

SEQ ID NO: 54643 - DNA, 22 bp, Artificial Sequence
  chemically synthesized
cagatttctaataccacaaaga

SEQ ID NO: 54644 - DNA, 22 bp, Artificial Sequence
  chemically synthesized
ctaataccacaaagaataaatc

SEQ ID NO: 54645 - DNA, 22 bp, Artificial Sequence
  chemically synthesized
taataccacaaagaataaatcc

SEQ ID NO: 54646 - DNA, 22 bp, Artificial Sequence
  chemically synthesized
ataccacaaagaataaatcctt

SEQ ID NO: 54647 - DNA, 22 bp, Artificial Sequence
  chemically synthesized
tcactctgatcaattttgttaa

SEQ ID NO: 54648 - DNA, 22 bp, Artificial Sequence
  chemically synthesized
cactctgatcaattttgttaac

SEQ ID NO: 54649 - DNA, 22 bp, Artificial Sequence
  chemically synthesized
actctgatcaattttgttaact

SEQ ID NO: 54650 - DNA, 22 bp, Artificial Sequence
  chemically synthesized
tgatcaattttgttaacttctc

SEQ ID NO: 54651 - DNA, 22 bp, Artificial Sequence
  chemically synthesized
atcaattttgttaacttctcac

SEQ ID NO: 54652 - DNA, 22 bp, Artificial Sequence
  chemically synthesized
tgttaacttctcacgtgtcttc

SEQ ID NO: 54653 - DNA, 22 bp, Artificial Sequence
  chemically synthesized
gttaacttctcacgtgtcttct

SEQ ID NO: 54654 - DNA, 22 bp, Artificial Sequence
  chemically synthesized
ttaacttctcacgtgtcttctc

SEQ ID NO: 54655 - DNA, 22 bp, Artificial Sequence
  chemically synthesized
acttctcacgtgtcttctctac

SEQ ID NO: 54656 - DNA, 22 bp, Artificial Sequence
  chemically synthesized
ctcacgtgtcttctctacaccc

SEQ ID NO: 54657 - DNA, 22 bp, Artificial Sequence
  chemically synthesized
tcacgtgtcttctctacaccca

SEQ ID NO: 54658 - DNA, 22 bp, Artificial Sequence
  chemically synthesized
acgtgtcttctctacacccagg

SEQ ID NO: 54659 - DNA, 22 bp, Artificial Sequence
  chemically synthesized
ctctacacccagggcaccggtg

SEQ ID NO: 54660 - DNA, 22 bp, Artificial Sequence
  chemically synthesized
tctacacccagggcaccggtga

SEQ ID NO: 54661 - DNA, 22 bp, Artificial Sequence
  chemically synthesized
tacacccagggcaccggtgaat

SEQ ID NO: 54662 - DNA, 22 bp, Artificial Sequence
  chemically synthesized
cacccagggcaccggtgaatcc

SEQ ID NO: 54663 - DNA, 22 bp, Artificial Sequence
  chemically synthesized
tgatggtcaaagttctagatgc

SEQ ID NO: 54664 - DNA, 22 bp, Artificial Sequence
  chemically synthesized
atggtcaaagttctagatgctg

SEQ ID NO: 54665 - DNA, 22 bp, Artificial Sequence
  chemically synthesized
tagatgctgtccgaggcagtcc

SEQ ID NO: 54666 - DNA, 22 bp, Artificial Sequence
  chemically synthesized
gatgctgtccgaggcagtcctg

SEQ ID NO: 54667 - DNA, 22 bp, Artificial Sequence
  chemically synthesized
tccgaggcagtcctgccatcaa

SEQ ID NO: 54668 - DNA, 22 bp, Artificial Sequence
  chemically synthesized
ccatcaatgtggccgtgcatgt

SEQ ID NO: 54669 - DNA, 22 bp, Artificial Sequence
  chemically synthesized
agaaaggctgctgatgacacct

SEQ ID NO: 54670 - DNA, 22 bp, Artificial Sequence
  chemically synthesized
ctgatgacacctgggagccatt

SEQ ID NO: 54671 - DNA, 22 bp, Artificial Sequence
  chemically synthesized
atgacacctgggagccatttgc

SEQ ID NO: 54672 - DNA, 22 bp, Artificial Sequence
  chemically synthesized
ccaggtgtcatcagcagccttt

SEQ ID NO: 54673 - DNA, 22 bp, Artificial Sequence
  chemically synthesized
tctgaacacatgcacggccaca

SEQ ID NO: 54674 - DNA, 22 bp, Artificial Sequence
  chemically synthesized
ctgaacacatgcacggccacat

SEQ ID NO: 54675 - DNA, 22 bp, Artificial Sequence
  chemically synthesized
tgaacacatgcacggccacatt

SEQ ID NO: 54676 - DNA, 22 bp, Artificial Sequence
  chemically synthesized
aacacatgcacggccacattga

SEQ ID NO: 54677 - DNA, 22 bp, Artificial Sequence
  chemically synthesized
atggcaggactgcctcggacag

SEQ ID NO: 54678 - DNA, 22 bp, Artificial Sequence
  chemically synthesized
cctcggacagcatctagaactt

SEQ ID NO: 54679 - DNA, 22 bp, Artificial Sequence
  chemically synthesized
ggacagcatctagaactttgac

SEQ ID NO: 54680 - DNA, 22 bp, Artificial Sequence
  chemically synthesized
gaactttgaccatcagaggaca

SEQ ID NO: 54681 - DNA, 22 bp, Artificial Sequence
  chemically synthesized
tgaccatcagaggacacttgga

SEQ ID NO: 54682 - DNA, 22 bp, Artificial Sequence
  chemically synthesized
gaccatcagaggacacttggat

SEQ ID NO: 54683 - DNA, 22 bp, Artificial Sequence
  chemically synthesized
accatcagaggacacttggatt

SEQ ID NO: 54684 - DNA, 22 bp, Artificial Sequence
  chemically synthesized
ggattcaccggtgccctgggtg

SEQ ID NO: 54685 - DNA, 22 bp, Artificial Sequence
  chemically synthesized
gattcaccggtgccctgggtgt

SEQ ID NO: 54686 - DNA, 22 bp, Artificial Sequence
  chemically synthesized
accggtgccctgggtgtagaga

SEQ ID NO: 54687 - DNA, 22 bp, Artificial Sequence
  chemically synthesized
ggtgtagagaagacacgtgaga

SEQ ID NO: 54688 - DNA, 22 bp, Artificial Sequence
  chemically synthesized
acaaaattgatcagagtgaaag

SEQ ID NO: 54689 - DNA, 22 bp, Artificial Sequence
  chemically synthesized
atcagagtgaaaggatttattc

SEQ ID NO: 54690 - DNA, 22 bp, Artificial Sequence
  chemically synthesized
attctttgtggtattagaaatc

SEQ ID NO: 54691 - DNA, 22 bp, Artificial Sequence
  chemically synthesized
ttctttgtggtattagaaatct

SEQ ID NO: 54692 - DNA, 22 bp, Artificial Sequence
  chemically synthesized
tttgtggtattagaaatctgga

SEQ ID NO: 54693 - DNA, 22 bp, Artificial Sequence
  chemically synthesized
tgtggtattagaaatctggagc

SEQ ID NO: 54694 - DNA, 22 bp, Artificial Sequence
  chemically synthesized
gtggtattagaaatctggagcg

SEQ ID NO: 54695 - DNA, 22 bp, Artificial Sequence
  chemically synthesized
tggtattagaaatctggagcga

SEQ ID NO: 54696 - DNA, 22 bp, Artificial Sequence
  chemically synthesized
gaaatctggagcgaaacaagaa

SEQ ID NO: 54697 - DNA, 22 bp, Artificial Sequence
  chemically synthesized
gagcgaaacaagaattacacac

SEQ ID NO: 54698 - DNA, 22 bp, Artificial Sequence
  chemically synthesized
cacactgatcccattatcagga

SEQ ID NO: 54699 - DNA, 22 bp, Artificial Sequence
  chemically synthesized
atcccattatcaggaacgtaag

SEQ ID NO: 54700 - DNA, 22 bp, Artificial Sequence
  chemically synthesized
tcaggaacgtaagtgtcgacaa

SEQ ID NO: 54701 - DNA, 22 bp, Artificial Sequence
  chemically synthesized
atgagcttccctactcagtata

SEQ ID NO: 54702 - DNA, 22 bp, Artificial Sequence
  chemically synthesized
ccctactcagtataacacagac

SEQ ID NO: 54703 - DNA, 22 bp, Artificial Sequence
  chemically synthesized
cctactcagtataacacagacg

SEQ ID NO: 54704 - DNA, 22 bp, Artificial Sequence
  chemically synthesized
ctcagtataacacagacgtaat

SEQ ID NO: 54705 - DNA, 22 bp, Artificial Sequence
  chemically synthesized
agtataacacagacgtaattgt

SEQ ID NO: 54706 - DNA, 22 bp, Artificial Sequence
  chemically synthesized
tttccaaagcaagaatggtttc

SEQ ID NO: 54707 - DNA, 22 bp, Artificial Sequence
  chemically synthesized
ccaaagcaagaatggtttctgc

SEQ ID NO: 54708 - DNA, 22 bp, Artificial Sequence
  chemically synthesized
caaagcaagaatggtttctgcc

SEQ ID NO: 54709 - DNA, 22 bp, Artificial Sequence
  chemically synthesized
ctgcctccagacacactgctat

SEQ ID NO: 54710 - DNA, 22 bp, Artificial Sequence
  chemically synthesized
tgcctccagacacactgctatc

SEQ ID NO: 54711 - DNA, 22 bp, Artificial Sequence
  chemically synthesized
cctccagacacactgctatcaa

SEQ ID NO: 54712 - DNA, 22 bp, Artificial Sequence
  chemically synthesized
cagacacactgctatcaaccag

SEQ ID NO: 54713 - DNA, 22 bp, Artificial Sequence
  chemically synthesized
ctatcaaccagggatgtgtata

SEQ ID NO: 54714 - DNA, 22 bp, Artificial Sequence
  chemically synthesized
tcaaccagggatgtgtataatg

SEQ ID NO: 54715 - DNA, 22 bp, Artificial Sequence
  chemically synthesized
taagggagaaaataggtcccct

SEQ ID NO: 54716 - DNA, 22 bp, Artificial Sequence
  chemically synthesized
aagggagaaaataggtcccctg

SEQ ID NO: 54717 - DNA, 22 bp, Artificial Sequence
  chemically synthesized
agggagaaaataggtcccctga

SEQ ID NO: 54718 - DNA, 22 bp, Artificial Sequence
  chemically synthesized
agaacagttgctttgttaaaag

SEQ ID NO: 54719 - DNA, 22 bp, Artificial Sequence
  chemically synthesized
ctttgttaaaagtctccatttg

SEQ ID NO: 54720 - DNA, 22 bp, Artificial Sequence
  chemically synthesized
tgttaaaagtctccatttgagt

SEQ ID NO: 54721 - DNA, 22 bp, Artificial Sequence
  chemically synthesized
gttaaaagtctccatttgagtg

SEQ ID NO: 54722 - DNA, 22 bp, Artificial Sequence
  chemically synthesized
ttaaaagtctccatttgagtgg

SEQ ID NO: 54723 - DNA, 22 bp, Artificial Sequence
  chemically synthesized
aaagtctccatttgagtggaat

SEQ ID NO: 54724 - DNA, 22 bp, Artificial Sequence
  chemically synthesized
catttgagtggaattactgaaa

SEQ ID NO: 54725 - DNA, 22 bp, Artificial Sequence
  chemically synthesized
gagtggaattactgaaaagatg

SEQ ID NO: 54726 - DNA, 22 bp, Artificial Sequence
  chemically synthesized
agtggaattactgaaaagatgt

SEQ ID NO: 54727 - DNA, 22 bp, Artificial Sequence
  chemically synthesized
ctgaaaagatgtaatgtaccat

SEQ ID NO: 54728 - DNA, 22 bp, Artificial Sequence
  chemically synthesized
aaaagatgtaatgtaccataca

SEQ ID NO: 54729 - DNA, 22 bp, Artificial Sequence
  chemically synthesized
tcctgagatcattttagttgtt

SEQ ID NO: 54730 - DNA, 22 bp, Artificial Sequence
  chemically synthesized
cctgagatcattttagttgttg

SEQ ID NO: 54731 - DNA, 22 bp, Artificial Sequence
  chemically synthesized
ctgagatcattttagttgttgc

SEQ ID NO: 54732 - DNA, 22 bp, Artificial Sequence
  chemically synthesized
agatcattttagttgttgctat

SEQ ID NO: 54733 - DNA, 22 bp, Artificial Sequence
  chemically synthesized
tagttgttgctatagtcactcc

SEQ ID NO: 54734 - DNA, 22 bp, Artificial Sequence
  chemically synthesized
agttgttgctatagtcactccc

SEQ ID NO: 54735 - DNA, 22 bp, Artificial Sequence
  chemically synthesized
gttgttgctatagtcactccct

SEQ ID NO: 54736 - DNA, 22 bp, Artificial Sequence
  chemically synthesized
ttgctatagtcactccctctta

SEQ ID NO: 54737 - DNA, 22 bp, Artificial Sequence
  chemically synthesized
ctatagtcactccctcttacca

SEQ ID NO: 54738 - DNA, 22 bp, Artificial Sequence
  chemically synthesized
tagtcactccctcttaccagtt

SEQ ID NO: 54739 - DNA, 22 bp, Artificial Sequence
  chemically synthesized
cctcttaccagttgttataaaa

SEQ ID NO: 54740 - DNA, 22 bp, Artificial Sequence
  chemically synthesized
ttaccagttgttataaaataat

SEQ ID NO: 54741 - DNA, 22 bp, Artificial Sequence
  chemically synthesized
accagttgttataaaataatgt

SEQ ID NO: 54742 - DNA, 22 bp, Artificial Sequence
  chemically synthesized
ccagttgttataaaataatgtc

SEQ ID NO: 54743 - DNA, 22 bp, Artificial Sequence
  chemically synthesized
ttataaaataatgtcagaacta

SEQ ID NO: 54744 - DNA, 22 bp, Artificial Sequence
  chemically synthesized
taaaataatgtcagaactacat

SEQ ID NO: 54745 - DNA, 22 bp, Artificial Sequence
  chemically synthesized
catccagacccattttatagta

SEQ ID NO: 54746 - DNA, 22 bp, Artificial Sequence
  chemically synthesized
tatagtattagttaattcttct

SEQ ID NO: 54747 - DNA, 22 bp, Artificial Sequence
  chemically synthesized
atagtattagttaattcttcta

SEQ ID NO: 54748 - DNA, 22 bp, Artificial Sequence
  chemically synthesized
tagtattagttaattcttctag

SEQ ID NO: 54749 - DNA, 22 bp, Artificial Sequence
  chemically synthesized
gttaattcttctagaggattta

SEQ ID NO: 54750 - DNA, 22 bp, Artificial Sequence
  chemically synthesized
attcttctagaggatttaagaa

SEQ ID NO: 54751 - DNA, 22 bp, Artificial Sequence
  chemically synthesized
ttctagaggatttaagaattag

SEQ ID NO: 54752 - DNA, 22 bp, Artificial Sequence
  chemically synthesized
ctagaggatttaagaattagat

SEQ ID NO: 54753 - DNA, 22 bp, Artificial Sequence
  chemically synthesized
tagaggatttaagaattagata

SEQ ID NO: 54754 - DNA, 22 bp, Artificial Sequence
  chemically synthesized
gaggatttaagaattagatatc

SEQ ID NO: 54755 - DNA, 22 bp, Artificial Sequence
  chemically synthesized
aagaattagatatctgactaga

SEQ ID NO: 54756 - DNA, 22 bp, Artificial Sequence
  chemically synthesized
agaattagatatctgactagaa

SEQ ID NO: 54757 - DNA, 22 bp, Artificial Sequence
  chemically synthesized
gatatctgactagaatattgtt

SEQ ID NO: 54758 - DNA, 22 bp, Artificial Sequence
  chemically synthesized
actagaatattgttcactaagc

SEQ ID NO: 54759 - DNA, 22 bp, Artificial Sequence
  chemically synthesized
gaatattgttcactaagccttt

SEQ ID NO: 54760 - DNA, 22 bp, Artificial Sequence
  chemically synthesized
ttcactaagccttttaaagatt

SEQ ID NO: 54761 - DNA, 22 bp, Artificial Sequence
  chemically synthesized
actaagccttttaaagattaat

SEQ ID NO: 54762 - DNA, 22 bp, Artificial Sequence
  chemically synthesized
agccttttaaagattaatcaat

SEQ ID NO: 54763 - DNA, 22 bp, Artificial Sequence
  chemically synthesized
ttaaagattaatcaataaatac

SEQ ID NO: 54764 - DNA, 22 bp, Artificial Sequence
  chemically synthesized
taaagattaatcaataaatacg

SEQ ID NO: 54765 - DNA, 22 bp, Artificial Sequence
  chemically synthesized
aaagattaatcaataaatacgt

SEQ ID NO: 54766 - DNA, 22 bp, Artificial Sequence
  chemically synthesized
aagattaatcaataaatacgtt

SEQ ID NO: 54767 - DNA, 22 bp, Artificial Sequence
  chemically synthesized
atcaataaatacgttttgaata

SEQ ID NO: 54768 - DNA, 22 bp, Artificial Sequence
  chemically synthesized
tgaataactatagggccagaat

SEQ ID NO: 54769 - DNA, 22 bp, Artificial Sequence
  chemically synthesized
gaataactatagggccagaata

SEQ ID NO: 54770 - DNA, 22 bp, Artificial Sequence
  chemically synthesized
aataactatagggccagaatat

SEQ ID NO: 54771 - DNA, 22 bp, Artificial Sequence
  chemically synthesized
tagggccagaatataatctcct

SEQ ID NO: 54772 - DNA, 22 bp, Artificial Sequence
  chemically synthesized
ctgcagtttgtcccccaaatac

SEQ ID NO: 54773 - DNA, 22 bp, Artificial Sequence
  chemically synthesized
cagtttgtcccccaaatacatt

SEQ ID NO: 54774 - DNA, 22 bp, Artificial Sequence
  chemically synthesized
gtcccccaaatacattttatgg

SEQ ID NO: 54775 - DNA, 22 bp, Artificial Sequence
  chemically synthesized
tcccccaaatacattttatgga

SEQ ID NO: 54776 - DNA, 22 bp, Artificial Sequence
  chemically synthesized
tatggagggatacttttctgaa

SEQ ID NO: 54777 - DNA, 22 bp, Artificial Sequence
  chemically synthesized
atggagggatacttttctgaaa

SEQ ID NO: 54778 - DNA, 22 bp, Artificial Sequence
  chemically synthesized
tggagggatacttttctgaaaa

SEQ ID NO: 54779 - DNA, 22 bp, Artificial Sequence
  chemically synthesized
ttctgaaaattcagtattaaca

SEQ ID NO: 54780 - DNA, 22 bp, Artificial Sequence
  chemically synthesized
tctgaaaattcagtattaacag

SEQ ID NO: 54781 - DNA, 22 bp, Artificial Sequence
  chemically synthesized
ctgaaaattcagtattaacagc

SEQ ID NO: 54782 - DNA, 22 bp, Artificial Sequence
  chemically synthesized
tgaaaattcagtattaacagct

SEQ ID NO: 54783 - DNA, 22 bp, Artificial Sequence
  chemically synthesized
aaaattcagtattaacagcttc

SEQ ID NO: 54784 - DNA, 22 bp, Artificial Sequence
  chemically synthesized
agtattaacagcttccttaata

SEQ ID NO: 54785 - DNA, 22 bp, Artificial Sequence
  chemically synthesized
acagcttccttaatatcatatc

SEQ ID NO: 54786 - DNA, 22 bp, Artificial Sequence
  chemically synthesized
ccttaatatcatatctttattt

SEQ ID NO: 54787 - DNA, 22 bp, Artificial Sequence
  chemically synthesized
cttaatatcatatctttatttc

SEQ ID NO: 54788 - DNA, 22 bp, Artificial Sequence
  chemically synthesized
aatatcatatctttatttctat

SEQ ID NO: 54789 - DNA, 22 bp, Artificial Sequence
  chemically synthesized
atatcatatctttatttctatc

SEQ ID NO: 54790 - DNA, 22 bp, Artificial Sequence
  chemically synthesized
tatttctatcatctatctgagg

SEQ ID NO: 54791 - DNA, 22 bp, Artificial Sequence
  chemically synthesized
atttctatcatctatctgagga

SEQ ID NO: 54792 - DNA, 22 bp, Artificial Sequence
  chemically synthesized
tttctatcatctatctgaggaa

SEQ ID NO: 54793 - DNA, 22 bp, Artificial Sequence
  chemically synthesized
ctatcatctatctgaggaaaca

SEQ ID NO: 54794 - DNA, 22 bp, Artificial Sequence
  chemically synthesized
tatcatctatctgaggaaacag

SEQ ID NO: 54795 - DNA, 22 bp, Artificial Sequence
  chemically synthesized
tcatctatctgaggaaacagag

SEQ ID NO: 54796 - DNA, 22 bp, Artificial Sequence
  chemically synthesized
tctgaggaaacagaggtaccag

SEQ ID NO: 54797 - DNA, 22 bp, Artificial Sequence
  chemically synthesized
aggaaacagaggtaccagatat

SEQ ID NO: 54798 - DNA, 22 bp, Artificial Sequence
  chemically synthesized
caaacctaatgcaccaaagcaa

SEQ ID NO: 54799 - DNA, 22 bp, Artificial Sequence
  chemically synthesized
atgcaccaaagcaatgaggtag

SEQ ID NO: 54800 - DNA, 22 bp, Artificial Sequence
  chemically synthesized
agagttcaagtcccagctcagt

SEQ ID NO: 54801 - DNA, 22 bp, Artificial Sequence
  chemically synthesized
aagtcccagctcagtaagctca

SEQ ID NO: 54802 - DNA, 22 bp, Artificial Sequence
  chemically synthesized
agtaagctcagtggaacttcat

SEQ ID NO: 54803 - DNA, 22 bp, Artificial Sequence
  chemically synthesized
agtggaacttcattctttttga

SEQ ID NO: 54804 - DNA, 22 bp, Artificial Sequence
  chemically synthesized
cattctttttgaagtttgaatt

SEQ ID NO: 54805 - DNA, 22 bp, Artificial Sequence
  chemically synthesized
attctttttgaagtttgaatta

SEQ ID NO: 54806 - DNA, 22 bp, Artificial Sequence
  chemically synthesized
tttttgaagtttgaattaatta

SEQ ID NO: 54807 - DNA, 22 bp, Artificial Sequence
  chemically synthesized
tttgaagtttgaattaattata

SEQ ID NO: 54808 - DNA, 22 bp, Artificial Sequence
  chemically synthesized
ttgaagtttgaattaattatat

SEQ ID NO: 54809 - DNA, 22 bp, Artificial Sequence
  chemically synthesized
tgaagtttgaattaattatatt

SEQ ID NO: 54810 - DNA, 22 bp, Artificial Sequence
  chemically synthesized
gaagtttgaattaattatatta

SEQ ID NO: 54811 - DNA, 22 bp, Artificial Sequence
  chemically synthesized
aagtttgaattaattatattaa

SEQ ID NO: 54812 - DNA, 22 bp, Artificial Sequence
  chemically synthesized
gaattaattatattaaaaatag

SEQ ID NO: 54813 - DNA, 22 bp, Artificial Sequence
  chemically synthesized
aattaattatattaaaaataga

SEQ ID NO: 54814 - DNA, 22 bp, Artificial Sequence
  chemically synthesized
attatattaaaaatagatgctg

SEQ ID NO: 54815 - DNA, 22 bp, Artificial Sequence
  chemically synthesized
tattaaaaatagatgctgggta

SEQ ID NO: 54816 - DNA, 22 bp, Artificial Sequence
  chemically synthesized
aaaatagatgctgggtaccctt

SEQ ID NO: 54817 - DNA, 22 bp, Artificial Sequence
  chemically synthesized
ggtacccttgccctagtaataa

SEQ ID NO: 54818 - DNA, 22 bp, Artificial Sequence
  chemically synthesized
gccctagtaataaaagctggtt

SEQ ID NO: 54819 - DNA, 22 bp, Artificial Sequence
  chemically synthesized
ccctagtaataaaagctggttg

SEQ ID NO: 54820 - DNA, 22 bp, Artificial Sequence
  chemically synthesized
gtaataaaagctggttggcaaa

SEQ ID NO: 54821 - DNA, 22 bp, Artificial Sequence
  chemically synthesized
gttggcaaagctggaaggagtc

SEQ ID NO: 54822 - DNA, 22 bp, Artificial Sequence
  chemically synthesized
gcaaagctggaaggagtcactt

SEQ ID NO: 54823 - DNA, 22 bp, Artificial Sequence
  chemically synthesized
gaaggagtcacttctacttcat

SEQ ID NO: 54824 - DNA, 22 bp, Artificial Sequence
  chemically synthesized
ctacttcatttagcgtgaatct

SEQ ID NO: 54825 - DNA, 22 bp, Artificial Sequence
  chemically synthesized
tacttcatttagcgtgaatctt

SEQ ID NO: 54826 - DNA, 22 bp, Artificial Sequence
  chemically synthesized
cttcatttagcgtgaatcttaa

SEQ ID NO: 54827 - DNA, 22 bp, Artificial Sequence
  chemically synthesized
catttagcgtgaatcttaaatg

SEQ ID NO: 54828 - DNA, 22 bp, Artificial Sequence
  chemically synthesized
atttagcgtgaatcttaaatgt

SEQ ID NO: 54829 - DNA, 22 bp, Artificial Sequence
  chemically synthesized
agcgtgaatcttaaatgtagga

SEQ ID NO: 54830 - DNA, 22 bp, Artificial Sequence
  chemically synthesized
gcgtgaatcttaaatgtaggaa

SEQ ID NO: 54831 - DNA, 22 bp, Artificial Sequence
  chemically synthesized
aaatgtaggaatgggatgtcac

SEQ ID NO: 54832 - DNA, 22 bp, Artificial Sequence
  chemically synthesized
aatgtaggaatgggatgtcaca

SEQ ID NO: 54833 - DNA, 22 bp, Artificial Sequence
  chemically synthesized
accgtagggccagcctcagaca

SEQ ID NO: 54834 - DNA, 22 bp, Artificial Sequence
  chemically synthesized
agacacaaataccagtccagca

SEQ ID NO: 54835 - DNA, 22 bp, Artificial Sequence
  chemically synthesized
ccaagaatgagtggacttctgt

SEQ ID NO: 54836 - DNA, 22 bp, Artificial Sequence
  chemically synthesized
ctgtgatggctgctcccagcct

SEQ ID NO: 54837 - DNA, 22 bp, Artificial Sequence
  chemically synthesized
tgtgatggctgctcccagcctg

SEQ ID NO: 54838 - DNA, 22 bp, Artificial Sequence
  chemically synthesized
tgatggctgctcccagcctggg

SEQ ID NO: 54839 - DNA, 22 bp, Artificial Sequence
  chemically synthesized
ctcccagcctggggcttttata

SEQ ID NO: 54840 - DNA, 22 bp, Artificial Sequence
  chemically synthesized
ccagcctggggcttttatactc

SEQ ID NO: 54841 - DNA, 22 bp, Artificial Sequence
  chemically synthesized
gggcttttatactcacttctcc

SEQ ID NO: 54842 - DNA, 22 bp, Artificial Sequence
  chemically synthesized
ttatactcacttctcctgagct

SEQ ID NO: 54843 - DNA, 22 bp, Artificial Sequence
  chemically synthesized
tatactcacttctcctgagcta

SEQ ID NO: 54844 - DNA, 22 bp, Artificial Sequence
  chemically synthesized
atactcacttctcctgagctag

SEQ ID NO: 54845 - DNA, 22 bp, Artificial Sequence
  chemically synthesized
tactcacttctcctgagctagg

SEQ ID NO: 54846 - DNA, 22 bp, Artificial Sequence
  chemically synthesized
acttctcctgagctaggctgct

SEQ ID NO: 54847 - DNA, 22 bp, Artificial Sequence
  chemically synthesized
ctcctgagctaggctgcttatc

SEQ ID NO: 54848 - DNA, 22 bp, Artificial Sequence
  chemically synthesized
tcctgagctaggctgcttatcc

SEQ ID NO: 54849 - DNA, 22 bp, Artificial Sequence
  chemically synthesized
ctgagctaggctgcttatccct

SEQ ID NO: 54850 - DNA, 22 bp, Artificial Sequence
  chemically synthesized
agctaggctgcttatccctgcc

SEQ ID NO: 54851 - DNA, 22 bp, Artificial Sequence
  chemically synthesized
ggctgcttatccctgccaatct

SEQ ID NO: 54852 - DNA, 22 bp, Artificial Sequence
  chemically synthesized
cttatccctgccaatctgactg

SEQ ID NO: 54853 - DNA, 22 bp, Artificial Sequence
  chemically synthesized
atccctgccaatctgactgcaa

SEQ ID NO: 54854 - DNA, 22 bp, Artificial Sequence
  chemically synthesized
tccctgccaatctgactgcaaa

SEQ ID NO: 54855 - DNA, 22 bp, Artificial Sequence
  chemically synthesized
ccaatctgactgcaaacctgct

SEQ ID NO: 54856 - DNA, 22 bp, Artificial Sequence
  chemically synthesized
actgcaaacctgctgattctga

SEQ ID NO: 54857 - DNA, 22 bp, Artificial Sequence
  chemically synthesized
caaacctgctgattctgattat

SEQ ID NO: 54858 - DNA, 22 bp, Artificial Sequence
  chemically synthesized
ctgattctgattattgacttag

SEQ ID NO: 54859 - DNA, 22 bp, Artificial Sequence
  chemically synthesized
attctgattattgacttagtca

SEQ ID NO: 54860 - DNA, 20 bp, Artificial Sequence
  chemically synthesized
gcacttcaattgtggaaaat

SEQ ID NO: 54861 - DNA, 20 bp, Artificial Sequence
  chemically synthesized
gaaaatcagctttgacttct

SEQ ID NO: 54862 - DNA, 20 bp, Artificial Sequence
  chemically synthesized
aaatcagctttgacttctga

SEQ ID NO: 54863 - DNA, 20 bp, Artificial Sequence
  chemically synthesized
cttctgagagcaaatgcccc

SEQ ID NO: 54864 - DNA, 20 bp, Artificial Sequence
  chemically synthesized
ctgagagcaaatgcccctgg

SEQ ID NO: 54865 - DNA, 20 bp, Artificial Sequence
  chemically synthesized
caaatgcccctggaagctgt

SEQ ID NO: 54866 - DNA, 20 bp, Artificial Sequence
  chemically synthesized
ccctggaagctgttggccaa

SEQ ID NO: 54867 - DNA, 20 bp, Artificial Sequence
  chemically synthesized
agctgttggccaacagtgcg

SEQ ID NO: 54868 - DNA, 20 bp, Artificial Sequence
  chemically synthesized
gctgttggccaacagtgcgt

SEQ ID NO: 54869 - DNA, 20 bp, Artificial Sequence
  chemically synthesized
ctgttggccaacagtgcgtg

SEQ ID NO: 54870 - DNA, 20 bp, Artificial Sequence
  chemically synthesized
ttggccaacagtgcgtgggg

SEQ ID NO: 54871 - DNA, 20 bp, Artificial Sequence
  chemically synthesized
ggccaacagtgcgtggggtg

SEQ ID NO: 54872 - DNA, 20 bp, Artificial Sequence
  chemically synthesized
gccaacagtgcgtggggtgg

SEQ ID NO: 54873 - DNA, 20 bp, Artificial Sequence
  chemically synthesized
ggtggaggccgtccccttgc

SEQ ID NO: 54874 - DNA, 20 bp, Artificial Sequence
  chemically synthesized
ggccgtccccttgctggctt

SEQ ID NO: 54875 - DNA, 20 bp, Artificial Sequence
  chemically synthesized
ttgctggcttgagcccctat

SEQ ID NO: 54876 - DNA, 20 bp, Artificial Sequence
  chemically synthesized
tgagtctctcctgcgtgact

SEQ ID NO: 54877 - DNA, 20 bp, Artificial Sequence
  chemically synthesized
taccgttccttgctcaccac

SEQ ID NO: 54878 - DNA, 20 bp, Artificial Sequence
  chemically synthesized
tccttgctcaccaccggatc

SEQ ID NO: 54879 - DNA, 20 bp, Artificial Sequence
  chemically synthesized
ccttgctcaccaccggatct

SEQ ID NO: 54880 - DNA, 20 bp, Artificial Sequence
  chemically synthesized
gatctgggcgtatttctgca

SEQ ID NO: 54881 - DNA, 20 bp, Artificial Sequence
  chemically synthesized
atttctgcatggcctgtgct

SEQ ID NO: 54882 - DNA, 20 bp, Artificial Sequence
  chemically synthesized
tgtgctgagcatcttgtaac

SEQ ID NO: 54883 - DNA, 20 bp, Artificial Sequence
  chemically synthesized
ttgtaactagaactttctaa

SEQ ID NO: 54884 - DNA, 20 bp, Artificial Sequence
  chemically synthesized
tgtaactagaactttctaat

SEQ ID NO: 54885 - DNA, 20 bp, Artificial Sequence
  chemically synthesized
gtaactagaactttctaatg

SEQ ID NO: 54886 - DNA, 20 bp, Artificial Sequence
  chemically synthesized
tttctaatggggtttccttg

SEQ ID NO: 54887 - DNA, 20 bp, Artificial Sequence
  chemically synthesized
ttctaatggggtttccttgt

SEQ ID NO: 54888 - DNA, 20 bp, Artificial Sequence
  chemically synthesized
ctaatggggtttccttgtgg

SEQ ID NO: 54889 - DNA, 20 bp, Artificial Sequence
  chemically synthesized
tttccttgtgggagttcctt

SEQ ID NO: 54890 - DNA, 20 bp, Artificial Sequence
  chemically synthesized
gggagttcctttagccttcc

SEQ ID NO: 54891 - DNA, 20 bp, Artificial Sequence
  chemically synthesized
ttagccttcccggtgttttt

SEQ ID NO: 54892 - DNA, 20 bp, Artificial Sequence
  chemically synthesized
tcccggtgtttttcagatct

SEQ ID NO: 54893 - DNA, 20 bp, Artificial Sequence
  chemically synthesized
tcagatcttagtcacccttc

SEQ ID NO: 54894 - DNA, 20 bp, Artificial Sequence
  chemically synthesized
cagatcttagtcacccttcc

SEQ ID NO: 54895 - DNA, 20 bp, Artificial Sequence
  chemically synthesized
gtcacccttccaggcttgcg

SEQ ID NO: 54896 - DNA, 20 bp, Artificial Sequence
  chemically synthesized
acccttccaggcttgcgtag

SEQ ID NO: 54897 - DNA, 20 bp, Artificial Sequence
  chemically synthesized
cccttccaggcttgcgtagt

SEQ ID NO: 54898 - DNA, 20 bp, Artificial Sequence
  chemically synthesized
ccaggcttgcgtagtaggtg

SEQ ID NO: 54899 - DNA, 20 bp, Artificial Sequence
  chemically synthesized
ttgatgcatttcatgaattc

SEQ ID NO: 54900 - DNA, 20 bp, Artificial Sequence
  chemically synthesized
ttcatgaattctggttgttt

SEQ ID NO: 54901 - DNA, 20 bp, Artificial Sequence
  chemically synthesized
tgaattctggttgtttcagt

SEQ ID NO: 54902 - DNA, 20 bp, Artificial Sequence
  chemically synthesized
gaattctggttgtttcagtc

SEQ ID NO: 54903 - DNA, 20 bp, Artificial Sequence
  chemically synthesized
tctggttgtttcagtcagga

SEQ ID NO: 54904 - DNA, 20 bp, Artificial Sequence
  chemically synthesized
ctggttgtttcagtcaggat

SEQ ID NO: 54905 - DNA, 20 bp, Artificial Sequence
  chemically synthesized
ttgtttcagtcaggatgggc

SEQ ID NO: 54906 - DNA, 20 bp, Artificial Sequence
  chemically synthesized
tgtttcagtcaggatgggca

SEQ ID NO: 54907 - DNA, 20 bp, Artificial Sequence
  chemically synthesized
gatgggcaaggattgtgctg

SEQ ID NO: 54908 - DNA, 20 bp, Artificial Sequence
  chemically synthesized
aggattgtgctgcagcaacc

SEQ ID NO: 54909 - DNA, 20 bp, Artificial Sequence
  chemically synthesized
attgtgctgcagcaaccgag

SEQ ID NO: 54910 - DNA, 20 bp, Artificial Sequence
  chemically synthesized
tgcagcaaccgagaagctca

SEQ ID NO: 54911 - DNA, 20 bp, Artificial Sequence
  chemically synthesized
agctcaatgcttcaaccctt

SEQ ID NO: 54912 - DNA, 20 bp, Artificial Sequence
  chemically synthesized
caatgcttcaaccctttaga

SEQ ID NO: 54913 - DNA, 20 bp, Artificial Sequence
  chemically synthesized
aatgcttcaaccctttagaa

SEQ ID NO: 54914 - DNA, 20 bp, Artificial Sequence
  chemically synthesized
atgcttcaaccctttagaaa

SEQ ID NO: 54915 - DNA, 20 bp, Artificial Sequence
  chemically synthesized
cccgctctacttgtcccatg

SEQ ID NO: 54916 - DNA, 20 bp, Artificial Sequence
  chemically synthesized
ccgctctacttgtcccatgt

SEQ ID NO: 54917 - DNA, 20 bp, Artificial Sequence
  chemically synthesized
cttgtcccatgtgggatgaa

SEQ ID NO: 54918 - DNA, 20 bp, Artificial Sequence
  chemically synthesized
tgtcccatgtgggatgaaca

SEQ ID NO: 54919 - DNA, 20 bp, Artificial Sequence
  chemically synthesized
gtcccatgtgggatgaacag

SEQ ID NO: 54920 - DNA, 20 bp, Artificial Sequence
  chemically synthesized
tcccatgtgggatgaacaga

SEQ ID NO: 54921 - DNA, 20 bp, Artificial Sequence
  chemically synthesized
cccatgtgggatgaacagag

SEQ ID NO: 54922 - DNA, 20 bp, Artificial Sequence
  chemically synthesized
cagaggggatctacccaccc

SEQ ID NO: 54923 - DNA, 20 bp, Artificial Sequence
  chemically synthesized
agaggggatctacccaccct

SEQ ID NO: 54924 - DNA, 20 bp, Artificial Sequence
  chemically synthesized
gaggggatctacccaccctg

SEQ ID NO: 54925 - DNA, 20 bp, Artificial Sequence
  chemically synthesized
atctacccaccctggggaca

SEQ ID NO: 54926 - DNA, 20 bp, Artificial Sequence
  chemically synthesized
caccctggggacacagcaac

SEQ ID NO: 54927 - DNA, 20 bp, Artificial Sequence
  chemically synthesized
gggacacagcaaccagactg

SEQ ID NO: 54928 - DNA, 20 bp, Artificial Sequence
  chemically synthesized
ggacacagcaaccagactga

SEQ ID NO: 54929 - DNA, 20 bp, Artificial Sequence
  chemically synthesized
acacagcaaccagactgaag

SEQ ID NO: 54930 - DNA, 20 bp, Artificial Sequence
  chemically synthesized
cacagcaaccagactgaagg

SEQ ID NO: 54931 - DNA, 20 bp, Artificial Sequence
  chemically synthesized
aaccagactgaaggaggttt

SEQ ID NO: 54932 - DNA, 20 bp, Artificial Sequence
  chemically synthesized
agctcctcacttccccgctc

SEQ ID NO: 54933 - DNA, 20 bp, Artificial Sequence
  chemically synthesized
cgctccagaccatctgactc

SEQ ID NO: 54934 - DNA, 20 bp, Artificial Sequence
  chemically synthesized
tcctgatgtcacgatttcaa

SEQ ID NO: 54935 - DNA, 20 bp, Artificial Sequence
  chemically synthesized
gatgtcacgatttcaacagt

SEQ ID NO: 54936 - DNA, 20 bp, Artificial Sequence
  chemically synthesized
agtaagcgtgataccaatga

SEQ ID NO: 54937 - DNA, 20 bp, Artificial Sequence
  chemically synthesized
gtgataccaatgacagtgat

SEQ ID NO: 54938 - DNA, 20 bp, Artificial Sequence
  chemically synthesized
gaaaactcctactgccattg

SEQ ID NO: 54939 - DNA, 20 bp, Artificial Sequence
  chemically synthesized
gccattgaagcgtctgctgt

SEQ ID NO: 54940 - DNA, 20 bp, Artificial Sequence
  chemically synthesized
gtctgctgtcagcatcttcc

SEQ ID NO: 54941 - DNA, 20 bp, Artificial Sequence
  chemically synthesized
ctgtcagcatcttccaagct

SEQ ID NO: 54942 - DNA, 20 bp, Artificial Sequence
  chemically synthesized
atcttccaagcttggataac

SEQ ID NO: 54943 - DNA, 20 bp, Artificial Sequence
  chemically synthesized
ccagcccttctgccctgccc

SEQ ID NO: 54944 - DNA, 20 bp, Artificial Sequence
  chemically synthesized
tgcccaagtgccacccattt

SEQ ID NO: 54945 - DNA, 20 bp, Artificial Sequence
  chemically synthesized
gcccaagtgccacccatttg

SEQ ID NO: 54946 - DNA, 20 bp, Artificial Sequence
  chemically synthesized
agtgccacccatttgaggaa

SEQ ID NO: 54947 - DNA, 20 bp, Artificial Sequence
  chemically synthesized
gtgccacccatttgaggaaa

SEQ ID NO: 54948 - DNA, 20 bp, Artificial Sequence
  chemically synthesized
gaggaaaaggacaaatgaat

SEQ ID NO: 54949 - DNA, 20 bp, Artificial Sequence
  chemically synthesized
ttttgtttgtttgtttctga

SEQ ID NO: 54950 - DNA, 20 bp, Artificial Sequence
  chemically synthesized
ttgtttgtttgtttctgata

SEQ ID NO: 54951 - DNA, 20 bp, Artificial Sequence
  chemically synthesized
gtttctgatagagctgatat

SEQ ID NO: 54952 - DNA, 20 bp, Artificial Sequence
  chemically synthesized
ttctgatagagctgatattg

SEQ ID NO: 54953 - DNA, 20 bp, Artificial Sequence
  chemically synthesized
tctgatagagctgatattgg

SEQ ID NO: 54954 - DNA, 20 bp, Artificial Sequence
  chemically synthesized
ctgatagagctgatattgga

SEQ ID NO: 54955 - DNA, 20 bp, Artificial Sequence
  chemically synthesized
tagagctgatattggagggt

SEQ ID NO: 54956 - DNA, 20 bp, Artificial Sequence
  chemically synthesized
agagctgatattggagggtg

SEQ ID NO: 54957 - DNA, 20 bp, Artificial Sequence
  chemically synthesized
agggtgaggcttatgcctgt

SEQ ID NO: 54958 - DNA, 20 bp, Artificial Sequence
  chemically synthesized
gggtgaggcttatgcctgtt

SEQ ID NO: 54959 - DNA, 20 bp, Artificial Sequence
  chemically synthesized
ggcttatgcctgttgggatt

SEQ ID NO: 54960 - DNA, 20 bp, Artificial Sequence
  chemically synthesized
gcttatgcctgttgggattt

SEQ ID NO: 54961 - DNA, 20 bp, Artificial Sequence
  chemically synthesized
cctgttgggatttgggcttc

SEQ ID NO: 54962 - DNA, 20 bp, Artificial Sequence
  chemically synthesized
tagaaactgacctctcatgc

SEQ ID NO: 54963 - DNA, 20 bp, Artificial Sequence
  chemically synthesized
aactgacctctcatgctggt

SEQ ID NO: 54964 - DNA, 20 bp, Artificial Sequence
  chemically synthesized
ctggtcagcttcaccatctc

SEQ ID NO: 54965 - DNA, 20 bp, Artificial Sequence
  chemically synthesized
atctccagcaatgtgcgact

SEQ ID NO: 54966 - DNA, 20 bp, Artificial Sequence
  chemically synthesized
tctccagcaatgtgcgactt

SEQ ID NO: 54967 - DNA, 20 bp, Artificial Sequence
  chemically synthesized
cagcaatgtgcgacttaggc

SEQ ID NO: 54968 - DNA, 20 bp, Artificial Sequence
  chemically synthesized
agcaatgtgcgacttaggcc

SEQ ID NO: 54969 - DNA, 20 bp, Artificial Sequence
  chemically synthesized
cttaggccaggctccacaac

SEQ ID NO: 54970 - DNA, 20 bp, Artificial Sequence
  chemically synthesized
ttaggccaggctccacaact

SEQ ID NO: 54971 - DNA, 20 bp, Artificial Sequence
  chemically synthesized
gccaggctccacaactaggc

SEQ ID NO: 54972 - DNA, 20 bp, Artificial Sequence
  chemically synthesized
caggctccacaactaggcca

SEQ ID NO: 54973 - DNA, 20 bp, Artificial Sequence
  chemically synthesized
aggctccacaactaggccag

SEQ ID NO: 54974 - DNA, 20 bp, Artificial Sequence
  chemically synthesized
ctccacaactaggccagagg

SEQ ID NO: 54975 - DNA, 20 bp, Artificial Sequence
  chemically synthesized
ctaggccagaggaagatttc

SEQ ID NO: 54976 - DNA, 20 bp, Artificial Sequence
  chemically synthesized
taggccagaggaagatttct

SEQ ID NO: 54977 - DNA, 20 bp, Artificial Sequence
  chemically synthesized
aggaagatttctgggctaca

SEQ ID NO: 54978 - DNA, 20 bp, Artificial Sequence
  chemically synthesized
ggaagatttctgggctacat

SEQ ID NO: 54979 - DNA, 20 bp, Artificial Sequence
  chemically synthesized
atttctgggctacatgggac

SEQ ID NO: 54980 - DNA, 20 bp, Artificial Sequence
  chemically synthesized
tttctgggctacatgggaca

SEQ ID NO: 54981 - DNA, 20 bp, Artificial Sequence
  chemically synthesized
gggctacatgggacaaggac

SEQ ID NO: 54982 - DNA, 20 bp, Artificial Sequence
  chemically synthesized
ggctacatgggacaaggaca

SEQ ID NO: 54983 - DNA, 20 bp, Artificial Sequence
  chemically synthesized
gggacaaggacaaggaactt

SEQ ID NO: 54984 - DNA, 20 bp, Artificial Sequence
  chemically synthesized
gacaaggacaaggaacttta

SEQ ID NO: 54985 - DNA, 20 bp, Artificial Sequence
  chemically synthesized
acaaggaactttagagaaat

SEQ ID NO: 54986 - DNA, 20 bp, Artificial Sequence
  chemically synthesized
caaatttgatttacattttg

SEQ ID NO: 54987 - DNA, 20 bp, Artificial Sequence
  chemically synthesized
ttgatttacattttgcagat

SEQ ID NO: 54988 - DNA, 20 bp, Artificial Sequence
  chemically synthesized
tgatttacattttgcagatg

SEQ ID NO: 54989 - DNA, 20 bp, Artificial Sequence
  chemically synthesized
ttttgcagatgaggaaacta

SEQ ID NO: 54990 - DNA, 20 bp, Artificial Sequence
  chemically synthesized
cagatgaggaaactacggca

SEQ ID NO: 54991 - DNA, 20 bp, Artificial Sequence
  chemically synthesized
gatgaggaaactacggcaca

SEQ ID NO: 54992 - DNA, 20 bp, Artificial Sequence
  chemically synthesized
gaggaaactacggcacagag

SEQ ID NO: 54993 - DNA, 20 bp, Artificial Sequence
  chemically synthesized
aactacggcacagagaagtt

SEQ ID NO: 54994 - DNA, 20 bp, Artificial Sequence
  chemically synthesized
actacggcacagagaagttg

SEQ ID NO: 54995 - DNA, 20 bp, Artificial Sequence
  chemically synthesized
agaagttgaggaacttccct

SEQ ID NO: 54996 - DNA, 20 bp, Artificial Sequence
  chemically synthesized
aagttgaggaacttccctga

SEQ ID NO: 54997 - DNA, 20 bp, Artificial Sequence
  chemically synthesized
ggaacttccctgagagcaca

SEQ ID NO: 54998 - DNA, 20 bp, Artificial Sequence
  chemically synthesized
ccctctcccatatgatacaa

SEQ ID NO: 54999 - DNA, 20 bp, Artificial Sequence
  chemically synthesized
agtgacactcctgcttttcc

SEQ ID NO: 55000 - DNA, 20 bp, Artificial Sequence
  chemically synthesized
tgcttttccgagttgctgcc

SEQ ID NO: 55001 - DNA, 20 bp, Artificial Sequence
  chemically synthesized
gcttttccgagttgctgcct

SEQ ID NO: 55002 - DNA, 20 bp, Artificial Sequence
  chemically synthesized
gttgctgcctgggtccctgc

SEQ ID NO: 55003 - DNA, 20 bp, Artificial Sequence
  chemically synthesized
ttgctgcctgggtccctgct

SEQ ID NO: 55004 - DNA, 20 bp, Artificial Sequence
  chemically synthesized
tgctgcctgggtccctgctg

SEQ ID NO: 55005 - DNA, 20 bp, Artificial Sequence
  chemically synthesized
ctgcctgggtccctgctggg

SEQ ID NO: 55006 - DNA, 20 bp, Artificial Sequence
  chemically synthesized
tgcctgggtccctgctgggg

SEQ ID NO: 55007 - DNA, 20 bp, Artificial Sequence
  chemically synthesized
gcctgggtccctgctgggga

SEQ ID NO: 55008 - DNA, 20 bp, Artificial Sequence
  chemically synthesized
ctgggtccctgctggggagg

SEQ ID NO: 55009 - DNA, 20 bp, Artificial Sequence
  chemically synthesized
gctggggagggagtttgcct

SEQ ID NO: 55010 - DNA, 20 bp, Artificial Sequence
  chemically synthesized
gggagggagtttgcctcagt

SEQ ID NO: 55011 - DNA, 20 bp, Artificial Sequence
  chemically synthesized
gagggagtttgcctcagtga

SEQ ID NO: 55012 - DNA, 20 bp, Artificial Sequence
  chemically synthesized
ctttctctgacttctctact

SEQ ID NO: 55013 - DNA, 20 bp, Artificial Sequence
  chemically synthesized
tttctctgacttctctactc

SEQ ID NO: 55014 - DNA, 20 bp, Artificial Sequence
  chemically synthesized
ttctctgacttctctactca

SEQ ID NO: 55015 - DNA, 20 bp, Artificial Sequence
  chemically synthesized
ggtcattccatttgtccttt

SEQ ID NO: 55016 - DNA, 20 bp, Artificial Sequence
  chemically synthesized
ttgtccttttagaactgacc

SEQ ID NO: 55017 - DNA, 20 bp, Artificial Sequence
  chemically synthesized
tgtccttttagaactgaccc

SEQ ID NO: 55018 - DNA, 20 bp, Artificial Sequence
  chemically synthesized
agaactgacccaggttcctg

SEQ ID NO: 55019 - DNA, 20 bp, Artificial Sequence
  chemically synthesized
actgacccaggttcctgcgg

SEQ ID NO: 55020 - DNA, 20 bp, Artificial Sequence
  chemically synthesized
gttcctgcggaagctgtccc

SEQ ID NO: 55021 - DNA, 20 bp, Artificial Sequence
  chemically synthesized
cggaagctgtccctggttct

SEQ ID NO: 55022 - DNA, 20 bp, Artificial Sequence
  chemically synthesized
gtccctggttctgagtcctg

SEQ ID NO: 55023 - DNA, 20 bp, Artificial Sequence
  chemically synthesized
tgcctgtgaataatccaacc

SEQ ID NO: 55024 - DNA, 20 bp, Artificial Sequence
  chemically synthesized
cctgtgaataatccaaccaa

SEQ ID NO: 55025 - DNA, 20 bp, Artificial Sequence
  chemically synthesized
tccaaccaagagcaacacaa

SEQ ID NO: 55026 - DNA, 20 bp, Artificial Sequence
  chemically synthesized
caagagcaacacaaaagcct

SEQ ID NO: 55027 - DNA, 20 bp, Artificial Sequence
  chemically synthesized
cacaaaagcctcagcctttc

SEQ ID NO: 55028 - DNA, 20 bp, Artificial Sequence
  chemically synthesized
acaaaagcctcagcctttca

SEQ ID NO: 55029 - DNA, 20 bp, Artificial Sequence
  chemically synthesized
aaaagcctcagcctttcaag

SEQ ID NO: 55030 - DNA, 20 bp, Artificial Sequence
  chemically synthesized
tcagcctttcaaggagcact

SEQ ID NO: 55031 - DNA, 20 bp, Artificial Sequence
  chemically synthesized
cagcctttcaaggagcactt

SEQ ID NO: 55032 - DNA, 20 bp, Artificial Sequence
  chemically synthesized
agcctttcaaggagcacttg

SEQ ID NO: 55033 - DNA, 20 bp, Artificial Sequence
  chemically synthesized
aaggagcacttggggtgttt

SEQ ID NO: 55034 - DNA, 20 bp, Artificial Sequence
  chemically synthesized
aggagcacttggggtgtttg

SEQ ID NO: 55035 - DNA, 20 bp, Artificial Sequence
  chemically synthesized
ggggtgtttgaggtcatctg

SEQ ID NO: 55036 - DNA, 20 bp, Artificial Sequence
  chemically synthesized
gggtgtttgaggtcatctgt

SEQ ID NO: 55037 - DNA, 20 bp, Artificial Sequence
  chemically synthesized
tttgaggtcatctgtgggtg

SEQ ID NO: 55038 - DNA, 20 bp, Artificial Sequence
  chemically synthesized
ttgaggtcatctgtgggtgt

SEQ ID NO: 55039 - DNA, 20 bp, Artificial Sequence
  chemically synthesized
ctgactgtttctcatgcctc

SEQ ID NO: 55040 - DNA, 20 bp, Artificial Sequence
  chemically synthesized
ctgtttctcatgcctctgga

SEQ ID NO: 55041 - DNA, 20 bp, Artificial Sequence
  chemically synthesized
tgtttctcatgcctctggaa

SEQ ID NO: 55042 - DNA, 20 bp, Artificial Sequence
  chemically synthesized
tcatgcctctggaaaggtcc

SEQ ID NO: 55043 - DNA, 20 bp, Artificial Sequence
  chemically synthesized
catgcctctggaaaggtcct

SEQ ID NO: 55044 - DNA, 20 bp, Artificial Sequence
  chemically synthesized
acaccctgaccctctccacc

SEQ ID NO: 55045 - DNA, 20 bp, Artificial Sequence
  chemically synthesized
accctctccacccagatcca

SEQ ID NO: 55046 - DNA, 20 bp, Artificial Sequence
  chemically synthesized
ttcactgctccccactgcca

SEQ ID NO: 55047 - DNA, 20 bp, Artificial Sequence
  chemically synthesized
tgctccccactgccatagac

SEQ ID NO: 55048 - DNA, 20 bp, Artificial Sequence
  chemically synthesized
ccatagaccagcattctccc

SEQ ID NO: 55049 - DNA, 20 bp, Artificial Sequence
  chemically synthesized
catagaccagcattctcccc

SEQ ID NO: 55050 - DNA, 20 bp, Artificial Sequence
  chemically synthesized
gaccagcattctccccggga

SEQ ID NO: 55051 - DNA, 20 bp, Artificial Sequence
  chemically synthesized
cattctccccgggatggacc

SEQ ID NO: 55052 - DNA, 20 bp, Artificial Sequence
  chemically synthesized
attctccccgggatggacct

SEQ ID NO: 55053 - DNA, 20 bp, Artificial Sequence
  chemically synthesized
ttctctctatcccccataca

SEQ ID NO: 55054 - DNA, 20 bp, Artificial Sequence
  chemically synthesized
atgtttgcttgtttgttgtt

SEQ ID NO: 55055 - DNA, 20 bp, Artificial Sequence
  chemically synthesized
ttggataaatgcttcccgct

SEQ ID NO: 55056 - DNA, 20 bp, Artificial Sequence
  chemically synthesized
atgcttcccgctcggattta

SEQ ID NO: 55057 - DNA, 20 bp, Artificial Sequence
  chemically synthesized
gcttcccgctcggatttatg

SEQ ID NO: 55058 - DNA, 20 bp, Artificial Sequence
  chemically synthesized
ttcccgctcggatttatgga

SEQ ID NO: 55059 - DNA, 20 bp, Artificial Sequence
  chemically synthesized
tcccgctcggatttatggag

SEQ ID NO: 55060 - DNA, 20 bp, Artificial Sequence
  chemically synthesized
tcggatttatggagaggatc

SEQ ID NO: 55061 - DNA, 20 bp, Artificial Sequence
  chemically synthesized
ggagaggatcaagttgctcc

SEQ ID NO: 55062 - DNA, 20 bp, Artificial Sequence
  chemically synthesized
gagaggatcaagttgctcct

SEQ ID NO: 55063 - DNA, 20 bp, Artificial Sequence
  chemically synthesized
aggatcaagttgctcctggg

SEQ ID NO: 55064 - DNA, 20 bp, Artificial Sequence
  chemically synthesized
ggatcaagttgctcctggga

SEQ ID NO: 55065 - DNA, 20 bp, Artificial Sequence
  chemically synthesized
atcaagttgctcctgggaag

SEQ ID NO: 55066 - DNA, 20 bp, Artificial Sequence
  chemically synthesized
gttgctcctgggaaggagat

SEQ ID NO: 55067 - DNA, 20 bp, Artificial Sequence
  chemically synthesized
aaatctgtatttcctgtttc

SEQ ID NO: 55068 - DNA, 20 bp, Artificial Sequence
  chemically synthesized
gtatttcctgtttctggtgt

SEQ ID NO: 55069 - DNA, 20 bp, Artificial Sequence
  chemically synthesized
atttcctgtttctggtgtga

SEQ ID NO: 55070 - DNA, 20 bp, Artificial Sequence
  chemically synthesized
ctgtttctggtgtgagagcc

SEQ ID NO: 55071 - DNA, 20 bp, Artificial Sequence
  chemically synthesized
tttctggtgtgagagcctgg

SEQ ID NO: 55072 - DNA, 20 bp, Artificial Sequence
  chemically synthesized
actattgtcctcttaacaaa

SEQ ID NO: 55073 - DNA, 20 bp, Artificial Sequence
  chemically synthesized
ctattgtcctcttaacaaat

SEQ ID NO: 55074 - DNA, 20 bp, Artificial Sequence
  chemically synthesized
tattgtcctcttaacaaatg

SEQ ID NO: 55075 - DNA, 20 bp, Artificial Sequence
  chemically synthesized
ctcttaacaaatggggctca

SEQ ID NO: 55076 - DNA, 20 bp, Artificial Sequence
  chemically synthesized
tcttaacaaatggggctcac

SEQ ID NO: 55077 - DNA, 20 bp, Artificial Sequence
  chemically synthesized
cttaacaaatggggctcaca

SEQ ID NO: 55078 - DNA, 20 bp, Artificial Sequence
  chemically synthesized
ctcacagggtgccccctgtc

SEQ ID NO: 55079 - DNA, 20 bp, Artificial Sequence
  chemically synthesized
acagggtgccccctgtccgg

SEQ ID NO: 55080 - DNA, 20 bp, Artificial Sequence
  chemically synthesized
agggtgccccctgtccggca

SEQ ID NO: 55081 - DNA, 20 bp, Artificial Sequence
  chemically synthesized
cagagcttgcacttcaaact

SEQ ID NO: 55082 - DNA, 20 bp, Artificial Sequence
  chemically synthesized
agagcttgcacttcaaacta

SEQ ID NO: 55083 - DNA, 20 bp, Artificial Sequence
  chemically synthesized
aaactaaggcttcctttatt

SEQ ID NO: 55084 - DNA, 20 bp, Artificial Sequence
  chemically synthesized
aactaaggcttcctttattt

SEQ ID NO: 55085 - DNA, 20 bp, Artificial Sequence
  chemically synthesized
ttctctcccctgcaaactcc

SEQ ID NO: 55086 - DNA, 20 bp, Artificial Sequence
  chemically synthesized
tctctcccctgcaaactcct

SEQ ID NO: 55087 - DNA, 20 bp, Artificial Sequence
  chemically synthesized
tcccctgcaaactcctaggc

SEQ ID NO: 55088 - DNA, 20 bp, Artificial Sequence
  chemically synthesized
cccctgcaaactcctaggcg

SEQ ID NO: 55089 - DNA, 20 bp, Artificial Sequence
  chemically synthesized
caaactcctaggcgaggtaa

SEQ ID NO: 55090 - DNA, 20 bp, Artificial Sequence
  chemically synthesized
aaactcctaggcgaggtaaa

SEQ ID NO: 55091 - DNA, 20 bp, Artificial Sequence
  chemically synthesized
tcctaggcgaggtaaaaggt

SEQ ID NO: 55092 - DNA, 20 bp, Artificial Sequence
  chemically synthesized
cctaggcgaggtaaaaggtc

SEQ ID NO: 55093 - DNA, 20 bp, Artificial Sequence
  chemically synthesized
aggtaaaaggtcaggactct

SEQ ID NO: 55094 - DNA, 20 bp, Artificial Sequence
  chemically synthesized
ggtaaaaggtcaggactcta

SEQ ID NO: 55095 - DNA, 20 bp, Artificial Sequence
  chemically synthesized
ggtcaggactctaaggttcc

SEQ ID NO: 55096 - DNA, 20 bp, Artificial Sequence
  chemically synthesized
ggactctaaggttcctggct

SEQ ID NO: 55097 - DNA, 20 bp, Artificial Sequence
  chemically synthesized
tctaaggttcctggctgagc

SEQ ID NO: 55098 - DNA, 20 bp, Artificial Sequence
  chemically synthesized
aaggttcctggctgagctgg

SEQ ID NO: 55099 - DNA, 20 bp, Artificial Sequence
  chemically synthesized
cgtttccctctcatctgttt

SEQ ID NO: 55100 - DNA, 20 bp, Artificial Sequence
  chemically synthesized
tttccctctcatctgtttca

SEQ ID NO: 55101 - DNA, 20 bp, Artificial Sequence
  chemically synthesized
ccctctcatctgtttcagag

SEQ ID NO: 55102 - DNA, 20 bp, Artificial Sequence
  chemically synthesized
cctctcatctgtttcagagc

SEQ ID NO: 55103 - DNA, 20 bp, Artificial Sequence
  chemically synthesized
catctgtttcagagcaggat

SEQ ID NO: 55104 - DNA, 20 bp, Artificial Sequence
  chemically synthesized
atctgtttcagagcaggatg

SEQ ID NO: 55105 - DNA, 20 bp, Artificial Sequence
  chemically synthesized
caggatgaggttcctgcctg

SEQ ID NO: 55106 - DNA, 20 bp, Artificial Sequence
  chemically synthesized
ggatgaggttcctgcctgca

SEQ ID NO: 55107 - DNA, 20 bp, Artificial Sequence
  chemically synthesized
gatgaggttcctgcctgcag

SEQ ID NO: 55108 - DNA, 20 bp, Artificial Sequence
  chemically synthesized
atgaggttcctgcctgcaga

SEQ ID NO: 55109 - DNA, 20 bp, Artificial Sequence
  chemically synthesized
ggttcctgcctgcagaggga

SEQ ID NO: 55110 - DNA, 20 bp, Artificial Sequence
  chemically synthesized
cctgcagagggaaagtgact

SEQ ID NO: 55111 - DNA, 20 bp, Artificial Sequence
  chemically synthesized
ggaaagtgacttggaacacc

SEQ ID NO: 55112 - DNA, 20 bp, Artificial Sequence
  chemically synthesized
gaaagtgacttggaacaccc

SEQ ID NO: 55113 - DNA, 20 bp, Artificial Sequence
  chemically synthesized
aaagtgacttggaacaccca

SEQ ID NO: 55114 - DNA, 20 bp, Artificial Sequence
  chemically synthesized
ggaacacccagggtgccccg

SEQ ID NO: 55115 - DNA, 20 bp, Artificial Sequence
  chemically synthesized
acccagggtgccccgcagct

SEQ ID NO: 55116 - DNA, 20 bp, Artificial Sequence
  chemically synthesized
gtgccccgcagcttggcctt

SEQ ID NO: 55117 - DNA, 20 bp, Artificial Sequence
  chemically synthesized
gcttggccttcagctgatgt

SEQ ID NO: 55118 - DNA, 20 bp, Artificial Sequence
  chemically synthesized
cttggccttcagctgatgtt

SEQ ID NO: 55119 - DNA, 20 bp, Artificial Sequence
  chemically synthesized
ttggccttcagctgatgtta

SEQ ID NO: 55120 - DNA, 20 bp, Artificial Sequence
  chemically synthesized
cttcagctgatgttagggca

SEQ ID NO: 55121 - DNA, 20 bp, Artificial Sequence
  chemically synthesized
cagctgatgttagggcacag

SEQ ID NO: 55122 - DNA, 20 bp, Artificial Sequence
  chemically synthesized
agctgatgttagggcacagc

SEQ ID NO: 55123 - DNA, 20 bp, Artificial Sequence
  chemically synthesized
tagggcacagcaggttgatg

SEQ ID NO: 55124 - DNA, 20 bp, Artificial Sequence
  chemically synthesized
cacagcaggttgatgcagtg

SEQ ID NO: 55125 - DNA, 20 bp, Artificial Sequence
  chemically synthesized
aggttgatgcagtgtggtcc

SEQ ID NO: 55126 - DNA, 20 bp, Artificial Sequence
  chemically synthesized
gttgatgcagtgtggtcctg

SEQ ID NO: 55127 - DNA, 20 bp, Artificial Sequence
  chemically synthesized
ttgatgcagtgtggtcctgg

SEQ ID NO: 55128 - DNA, 20 bp, Artificial Sequence
  chemically synthesized
tgcagtgtggtcctggagga

SEQ ID NO: 55129 - DNA, 20 bp, Artificial Sequence
  chemically synthesized
cagtgtggtcctggaggatg

SEQ ID NO: 55130 - DNA, 20 bp, Artificial Sequence
  chemically synthesized
ttgtttatcgtgatcccata

SEQ ID NO: 55131 - DNA, 20 bp, Artificial Sequence
  chemically synthesized
atcgtgatcccatatggact

SEQ ID NO: 55132 - DNA, 20 bp, Artificial Sequence
  chemically synthesized
tcgtgatcccatatggactg

SEQ ID NO: 55133 - DNA, 20 bp, Artificial Sequence
  chemically synthesized
tgatcccatatggactgagg

SEQ ID NO: 55134 - DNA, 20 bp, Artificial Sequence
  chemically synthesized
actgaggaagtatgtgctgt

SEQ ID NO: 55135 - DNA, 20 bp, Artificial Sequence
  chemically synthesized
ctgaggaagtatgtgctgtt

SEQ ID NO: 55136 - DNA, 20 bp, Artificial Sequence
  chemically synthesized
tgaggaagtatgtgctgttg

SEQ ID NO: 55137 - DNA, 20 bp, Artificial Sequence
  chemically synthesized
gaagtatgtgctgttgggga

SEQ ID NO: 55138 - DNA, 20 bp, Artificial Sequence
  chemically synthesized
tatgtgctgttggggacagc

SEQ ID NO: 55139 - DNA, 20 bp, Artificial Sequence
  chemically synthesized
atgtgctgttggggacagcc

SEQ ID NO: 55140 - DNA, 20 bp, Artificial Sequence
  chemically synthesized
ttggggacagccaggcctaa

SEQ ID NO: 55141 - DNA, 20 bp, Artificial Sequence
  chemically synthesized
gggacagccaggcctaacag

SEQ ID NO: 55142 - DNA, 20 bp, Artificial Sequence
  chemically synthesized
gacagccaggcctaacagtg

SEQ ID NO: 55143 - DNA, 20 bp, Artificial Sequence
  chemically synthesized
agccaggcctaacagtggag

SEQ ID NO: 55144 - DNA, 20 bp, Artificial Sequence
  chemically synthesized
agtggagaagacctgccttc

SEQ ID NO: 55145 - DNA, 20 bp, Artificial Sequence
  chemically synthesized
gtggagaagacctgccttcc

SEQ ID NO: 55146 - DNA, 20 bp, Artificial Sequence
  chemically synthesized
cctgccttccaggcccacac

SEQ ID NO: 55147 - DNA, 20 bp, Artificial Sequence
  chemically synthesized
ccttccaggcccacactgga

SEQ ID NO: 55148 - DNA, 20 bp, Artificial Sequence
  chemically synthesized
ttccaggcccacactggaca

SEQ ID NO: 55149 - DNA, 20 bp, Artificial Sequence
  chemically synthesized
ggacagagcatttgacctgc

SEQ ID NO: 55150 - DNA, 20 bp, Artificial Sequence
  chemically synthesized
gacagagcatttgacctgct

SEQ ID NO: 55151 - DNA, 20 bp, Artificial Sequence
  chemically synthesized
gcatttgacctgctgggcct

SEQ ID NO: 55152 - DNA, 20 bp, Artificial Sequence
  chemically synthesized
gagtttccccatgtgtactt

SEQ ID NO: 55153 - DNA, 20 bp, Artificial Sequence
  chemically synthesized
agtttccccatgtgtacttt

SEQ ID NO: 55154 - DNA, 20 bp, Artificial Sequence
  chemically synthesized
gtttccccatgtgtactttg

SEQ ID NO: 55155 - DNA, 20 bp, Artificial Sequence
  chemically synthesized
atgtgtactttggggataat

SEQ ID NO: 55156 - DNA, 20 bp, Artificial Sequence
  chemically synthesized
actttggggataatgagtcc

SEQ ID NO: 55157 - DNA, 20 bp, Artificial Sequence
  chemically synthesized
ctttggggataatgagtcct

SEQ ID NO: 55158 - DNA, 20 bp, Artificial Sequence
  chemically synthesized
gagtcctaggctgcgtcctg

SEQ ID NO: 55159 - DNA, 20 bp, Artificial Sequence
  chemically synthesized
tgcgtcctgcagaacctgtc

SEQ ID NO: 55160 - DNA, 20 bp, Artificial Sequence
  chemically synthesized
cgtcctgcagaacctgtctg

SEQ ID NO: 55161 - DNA, 20 bp, Artificial Sequence
  chemically synthesized
gtcctgcagaacctgtctgg

SEQ ID NO: 55162 - DNA, 20 bp, Artificial Sequence
  chemically synthesized
acctgtctggaggatcacgt

SEQ ID NO: 55163 - DNA, 20 bp, Artificial Sequence
  chemically synthesized
gtctggaggatcacgttgga

SEQ ID NO: 55164 - DNA, 20 bp, Artificial Sequence
  chemically synthesized
aatacatttttttaaaactc

SEQ ID NO: 55165 - DNA, 20 bp, Artificial Sequence
  chemically synthesized
acatttttttaaaactctgg

SEQ ID NO: 55166 - DNA, 20 bp, Artificial Sequence
  chemically synthesized
ttttaaaactctggaagata

SEQ ID NO: 55167 - DNA, 20 bp, Artificial Sequence
  chemically synthesized
aaactctggaagatacagtg

SEQ ID NO: 55168 - DNA, 20 bp, Artificial Sequence
  chemically synthesized
ctggaagatacagtgaagct

SEQ ID NO: 55169 - DNA, 20 bp, Artificial Sequence
  chemically synthesized
tggaagatacagtgaagctg

SEQ ID NO: 55170 - DNA, 20 bp, Artificial Sequence
  chemically synthesized
acagtgaagctgaggtctta

SEQ ID NO: 55171 - DNA, 20 bp, Artificial Sequence
  chemically synthesized
gtcttatggttgtcccatca

SEQ ID NO: 55172 - DNA, 20 bp, Artificial Sequence
  chemically synthesized
atatttgtcttcctcataat

SEQ ID NO: 55173 - DNA, 20 bp, Artificial Sequence
  chemically synthesized
tatttgtcttcctcataatg

SEQ ID NO: 55174 - DNA, 20 bp, Artificial Sequence
  chemically synthesized
gactgatccctgttgattcc

SEQ ID NO: 55175 - DNA, 20 bp, Artificial Sequence
  chemically synthesized
actgatccctgttgattccc

SEQ ID NO: 55176 - DNA, 20 bp, Artificial Sequence
  chemically synthesized
ctgatccctgttgattccca

SEQ ID NO: 55177 - DNA, 20 bp, Artificial Sequence
  chemically synthesized
tgatccctgttgattcccag

SEQ ID NO: 55178 - DNA, 20 bp, Artificial Sequence
  chemically synthesized
atccctgttgattcccaggg

SEQ ID NO: 55179 - DNA, 20 bp, Artificial Sequence
  chemically synthesized
tgttgattcccaggggagcc

SEQ ID NO: 55180 - DNA, 20 bp, Artificial Sequence
  chemically synthesized
gttgattcccaggggagccc

SEQ ID NO: 55181 - DNA, 20 bp, Artificial Sequence
  chemically synthesized
gggagcccaggaattccctc

SEQ ID NO: 55182 - DNA, 20 bp, Artificial Sequence
  chemically synthesized
ggagcccaggaattccctct

SEQ ID NO: 55183 - DNA, 20 bp, Artificial Sequence
  chemically synthesized
agcccaggaattccctctgg

SEQ ID NO: 55184 - DNA, 20 bp, Artificial Sequence
  chemically synthesized
gcccaggaattccctctggg

SEQ ID NO: 55185 - DNA, 20 bp, Artificial Sequence
  chemically synthesized
ttccctctgggaggttatgc

SEQ ID NO: 55186 - DNA, 20 bp, Artificial Sequence
  chemically synthesized
ggaggttatgctagtttgaa

SEQ ID NO: 55187 - DNA, 20 bp, Artificial Sequence
  chemically synthesized
gaggttatgctagtttgaat

SEQ ID NO: 55188 - DNA, 20 bp, Artificial Sequence
  chemically synthesized
aggttatgctagtttgaatg

SEQ ID NO: 55189 - DNA, 20 bp, Artificial Sequence
  chemically synthesized
gactgtcaactcgtgtgtga

SEQ ID NO: 55190 - DNA, 20 bp, Artificial Sequence
  chemically synthesized
gtgtgacagacaattcttca

SEQ ID NO: 55191 - DNA, 20 bp, Artificial Sequence
  chemically synthesized
aattcttcaaagtaaaacga

SEQ ID NO: 55192 - DNA, 20 bp, Artificial Sequence
  chemically synthesized
aaagtaaaacgatggtgtct

SEQ ID NO: 55193 - DNA, 20 bp, Artificial Sequence
  chemically synthesized
aagtaaaacgatggtgtcta

SEQ ID NO: 55194 - DNA, 20 bp, Artificial Sequence
  chemically synthesized
gtgtctaaggtgaccgccct

SEQ ID NO: 55195 - DNA, 20 bp, Artificial Sequence
  chemically synthesized
tgccacctccttccctgccc

SEQ ID NO: 55196 - DNA, 20 bp, Artificial Sequence
  chemically synthesized
gccacctccttccctgccct

SEQ ID NO: 55197 - DNA, 20 bp, Artificial Sequence
  chemically synthesized
cttccctgccctgggctctc

SEQ ID NO: 55198 - DNA, 20 bp, Artificial Sequence
  chemically synthesized
cctgccctgggctctccaga

SEQ ID NO: 55199 - DNA, 20 bp, Artificial Sequence
  chemically synthesized
cctgttctcctaccaaatgc

SEQ ID NO: 55200 - DNA, 20 bp, Artificial Sequence
  chemically synthesized
ctaccaaatgccagttaaat

SEQ ID NO: 55201 - DNA, 20 bp, Artificial Sequence
  chemically synthesized
accaaatgccagttaaataa

SEQ ID NO: 55202 - DNA, 20 bp, Artificial Sequence
  chemically synthesized
ccaaatgccagttaaataag

SEQ ID NO: 55203 - DNA, 20 bp, Artificial Sequence
  chemically synthesized
aaatgccagttaaataagag

SEQ ID NO: 55204 - DNA, 20 bp, Artificial Sequence
  chemically synthesized
gttaaataagaggagtcctg

SEQ ID NO: 55205 - DNA, 20 bp, Artificial Sequence
  chemically synthesized
ttaaataagaggagtcctgt

SEQ ID NO: 55206 - DNA, 20 bp, Artificial Sequence
  chemically synthesized
aggagtcctgtgggtcgccc

SEQ ID NO: 55207 - DNA, 20 bp, Artificial Sequence
  chemically synthesized
ggagtcctgtgggtcgccca

SEQ ID NO: 55208 - DNA, 20 bp, Artificial Sequence
  chemically synthesized
ctgtgggtcgcccaaggctg

SEQ ID NO: 55209 - DNA, 20 bp, Artificial Sequence
  chemically synthesized
tgtgggtcgcccaaggctgc

SEQ ID NO: 55210 - DNA, 20 bp, Artificial Sequence
  chemically synthesized
ctgcgggctgtgtcaacatc

SEQ ID NO: 55211 - DNA, 20 bp, Artificial Sequence
  chemically synthesized
cgggctgtgtcaacatctgg

SEQ ID NO: 55212 - DNA, 20 bp, Artificial Sequence
  chemically synthesized
tgtgtcaacatctggtggat

SEQ ID NO: 55213 - DNA, 20 bp, Artificial Sequence
  chemically synthesized
gagcttctgctcaccacctt

SEQ ID NO: 55214 - DNA, 20 bp, Artificial Sequence
  chemically synthesized
gctcaatgcctgctccacac

SEQ ID NO: 55215 - DNA, 20 bp, Artificial Sequence
  chemically synthesized
ctcaatgcctgctccacact

SEQ ID NO: 55216 - DNA, 20 bp, Artificial Sequence
  chemically synthesized
tgcctgctccacactgggca

SEQ ID NO: 55217 - DNA, 20 bp, Artificial Sequence
  chemically synthesized
gcctgctccacactgggcac

SEQ ID NO: 55218 - DNA, 20 bp, Artificial Sequence
  chemically synthesized
cctgctccacactgggcaca

SEQ ID NO: 55219 - DNA, 20 bp, Artificial Sequence
  chemically synthesized
cacagggtgtttttctcatg

SEQ ID NO: 55220 - DNA, 20 bp, Artificial Sequence
  chemically synthesized
gtttttctcatgaagtgtgc

SEQ ID NO: 55221 - DNA, 20 bp, Artificial Sequence
  chemically synthesized
tttttctcatgaagtgtgct

SEQ ID NO: 55222 - DNA, 20 bp, Artificial Sequence
  chemically synthesized
tcatgaagtgtgctaggcgt

SEQ ID NO: 55223 - DNA, 20 bp, Artificial Sequence
  chemically synthesized
agtgtgctaggcgtgagctg

SEQ ID NO: 55224 - DNA, 20 bp, Artificial Sequence
  chemically synthesized
gtgtgctaggcgtgagctgt

SEQ ID NO: 55225 - DNA, 20 bp, Artificial Sequence
  chemically synthesized
aggcgtgagctgtgggccac

SEQ ID NO: 55226 - DNA, 20 bp, Artificial Sequence
  chemically synthesized
tgggccaccagcaacccttc

SEQ ID NO: 55227 - DNA, 20 bp, Artificial Sequence
  chemically synthesized
accagcaacccttctggttt

SEQ ID NO: 55228 - DNA, 20 bp, Artificial Sequence
  chemically synthesized
ccagcaacccttctggttta

SEQ ID NO: 55229 - DNA, 20 bp, Artificial Sequence
  chemically synthesized
agcaacccttctggtttaag

SEQ ID NO: 55230 - DNA, 20 bp, Artificial Sequence
  chemically synthesized
gcaacccttctggtttaagg

SEQ ID NO: 55231 - DNA, 20 bp, Artificial Sequence
  chemically synthesized
ttaaggaggaattacctctg

SEQ ID NO: 55232 - DNA, 20 bp, Artificial Sequence
  chemically synthesized
aggaggaattacctctgcag

SEQ ID NO: 55233 - DNA, 20 bp, Artificial Sequence
  chemically synthesized
gaattacctctgcagaagtt

SEQ ID NO: 55234 - DNA, 20 bp, Artificial Sequence
  chemically synthesized
gaagtttagcgtgaccctcg

SEQ ID NO: 55235 - DNA, 20 bp, Artificial Sequence
  chemically synthesized
aagtttagcgtgaccctcga

SEQ ID NO: 55236 - DNA, 20 bp, Artificial Sequence
  chemically synthesized
agtttagcgtgaccctcgaa

SEQ ID NO: 55237 - DNA, 20 bp, Artificial Sequence
  chemically synthesized
gtttagcgtgaccctcgaag

SEQ ID NO: 55238 - DNA, 20 bp, Artificial Sequence
  chemically synthesized
ttagcgtgaccctcgaaggg

SEQ ID NO: 55239 - DNA, 20 bp, Artificial Sequence
  chemically synthesized
agcgtgaccctcgaagggga

SEQ ID NO: 55240 - DNA, 20 bp, Artificial Sequence
  chemically synthesized
gaccctcgaaggggagagtg

SEQ ID NO: 55241 - DNA, 20 bp, Artificial Sequence
  chemically synthesized
ctcgaaggggagagtgtggt

SEQ ID NO: 55242 - DNA, 20 bp, Artificial Sequence
  chemically synthesized
tcgaaggggagagtgtggtg

SEQ ID NO: 55243 - DNA, 20 bp, Artificial Sequence
  chemically synthesized
aaggggagagtgtggtgagg

SEQ ID NO: 55244 - DNA, 20 bp, Artificial Sequence
  chemically synthesized
gagagtgtggtgaggtggta

SEQ ID NO: 55245 - DNA, 20 bp, Artificial Sequence
  chemically synthesized
tgtggtgaggtggtatggtt

SEQ ID NO: 55246 - DNA, 20 bp, Artificial Sequence
  chemically synthesized
tggtgaggtggtatggttca

SEQ ID NO: 55247 - DNA, 20 bp, Artificial Sequence
  chemically synthesized
ggtgaggtggtatggttcag

SEQ ID NO: 55248 - DNA, 20 bp, Artificial Sequence
  chemically synthesized
gtggtatggttcagaggaac

SEQ ID NO: 55249 - DNA, 20 bp, Artificial Sequence
  chemically synthesized
gtatggttcagaggaacaag

SEQ ID NO: 55250 - DNA, 20 bp, Artificial Sequence
  chemically synthesized
agaggaacaagtagcccatc

SEQ ID NO: 55251 - DNA, 20 bp, Artificial Sequence
  chemically synthesized
gaacaagtagcccatcaagc

SEQ ID NO: 55252 - DNA, 20 bp, Artificial Sequence
  chemically synthesized
aagccagctttgccacttat

SEQ ID NO: 55253 - DNA, 20 bp, Artificial Sequence
  chemically synthesized
ttatgagctgtgtgacattg

SEQ ID NO: 55254 - DNA, 20 bp, Artificial Sequence
  chemically synthesized
tatgagctgtgtgacattgt

SEQ ID NO: 55255 - DNA, 20 bp, Artificial Sequence
  chemically synthesized
tgagctgtgtgacattgtgg

SEQ ID NO: 55256 - DNA, 20 bp, Artificial Sequence
  chemically synthesized
tgtgtgacattgtgggagac

SEQ ID NO: 55257 - DNA, 20 bp, Artificial Sequence
  chemically synthesized
gtgacattgtgggagaccag

SEQ ID NO: 55258 - DNA, 20 bp, Artificial Sequence
  chemically synthesized
gggagaccagtagcctctct

SEQ ID NO: 55259 - DNA, 20 bp, Artificial Sequence
  chemically synthesized
ccagtagcctctctgagcct

SEQ ID NO: 55260 - DNA, 20 bp, Artificial Sequence
  chemically synthesized
tctctgagcctcagtttcct

SEQ ID NO: 55261 - DNA, 20 bp, Artificial Sequence
  chemically synthesized
agcctcagtttcctcagatt

SEQ ID NO: 55262 - DNA, 20 bp, Artificial Sequence
  chemically synthesized
cctcagtttcctcagatttg

SEQ ID NO: 55263 - DNA, 20 bp, Artificial Sequence
  chemically synthesized
tttcctcagatttggagttt

SEQ ID NO: 55264 - DNA, 20 bp, Artificial Sequence
  chemically synthesized
tcctcagatttggagtttaa

SEQ ID NO: 55265 - DNA, 20 bp, Artificial Sequence
  chemically synthesized
agatttggagtttaagagca

SEQ ID NO: 55266 - DNA, 20 bp, Artificial Sequence
  chemically synthesized
tttggagtttaagagcacag

SEQ ID NO: 55267 - DNA, 20 bp, Artificial Sequence
  chemically synthesized
gcagatatactcacacatcg

SEQ ID NO: 55268 - DNA, 20 bp, Artificial Sequence
  chemically synthesized
cacacatcgcagtgctgcta

SEQ ID NO: 55269 - DNA, 20 bp, Artificial Sequence
  chemically synthesized
catcgcagtgctgctacagt

SEQ ID NO: 55270 - DNA, 20 bp, Artificial Sequence
  chemically synthesized
tgctgctacagtgagtaaat

SEQ ID NO: 55271 - DNA, 20 bp, Artificial Sequence
  chemically synthesized
tacagtgagtaaatgagaaa

SEQ ID NO: 55272 - DNA, 20 bp, Artificial Sequence
  chemically synthesized
gtgagtaaatgagaaacagc

SEQ ID NO: 55273 - DNA, 20 bp, Artificial Sequence
  chemically synthesized
tgagtaaatgagaaacagcc

SEQ ID NO: 55274 - DNA, 20 bp, Artificial Sequence
  chemically synthesized
gagtaaatgagaaacagcca

SEQ ID NO: 55275 - DNA, 20 bp, Artificial Sequence
  chemically synthesized
agtaaatgagaaacagccag

SEQ ID NO: 55276 - DNA, 20 bp, Artificial Sequence
  chemically synthesized
taaatgagaaacagccaggg

SEQ ID NO: 55277 - DNA, 20 bp, Artificial Sequence
  chemically synthesized
aaatgagaaacagccagggg

SEQ ID NO: 55278 - DNA, 20 bp, Artificial Sequence
  chemically synthesized
cagccaggggaggtacttca

SEQ ID NO: 55279 - DNA, 20 bp, Artificial Sequence
  chemically synthesized
agccaggggaggtacttcat

SEQ ID NO: 55280 - DNA, 20 bp, Artificial Sequence
  chemically synthesized
gccaggggaggtacttcata

SEQ ID NO: 55281 - DNA, 20 bp, Artificial Sequence
  chemically synthesized
tcatagggatgtctgattca

SEQ ID NO: 55282 - DNA, 20 bp, Artificial Sequence
  chemically synthesized
agggatgtctgattcacaga

SEQ ID NO: 55283 - DNA, 20 bp, Artificial Sequence
  chemically synthesized
ctgattcacagaaagctcat

SEQ ID NO: 55284 - DNA, 20 bp, Artificial Sequence
  chemically synthesized
cacagaaagctcataagtgc

SEQ ID NO: 55285 - DNA, 20 bp, Artificial Sequence
  chemically synthesized
gctcataagtgcaagaaatg

SEQ ID NO: 55286 - DNA, 20 bp, Artificial Sequence
  chemically synthesized
ctatttattctctgttctaa

SEQ ID NO: 55287 - DNA, 20 bp, Artificial Sequence
  chemically synthesized
tatttattctctgttctaat

SEQ ID NO: 55288 - DNA, 20 bp, Artificial Sequence
  chemically synthesized
ttgaacatcataccaactca

SEQ ID NO: 55289 - DNA, 20 bp, Artificial Sequence
  chemically synthesized
tgaacatcataccaactcaa

SEQ ID NO: 55290 - DNA, 20 bp, Artificial Sequence
  chemically synthesized
acatcataccaactcaaagg

SEQ ID NO: 55291 - DNA, 20 bp, Artificial Sequence
  chemically synthesized
catcataccaactcaaaggc

SEQ ID NO: 55292 - DNA, 20 bp, Artificial Sequence
  chemically synthesized
aactcaaaggcaggtcttac

SEQ ID NO: 55293 - DNA, 20 bp, Artificial Sequence
  chemically synthesized
caggtcttactagcaatgac

SEQ ID NO: 55294 - DNA, 20 bp, Artificial Sequence
  chemically synthesized
aggtcttactagcaatgact

SEQ ID NO: 55295 - DNA, 20 bp, Artificial Sequence
  chemically synthesized
ggtcttactagcaatgactg

SEQ ID NO: 55296 - DNA, 20 bp, Artificial Sequence
  chemically synthesized
tactagcaatgactggggct

SEQ ID NO: 55297 - DNA, 20 bp, Artificial Sequence
  chemically synthesized
ctagcaatgactggggctca

SEQ ID NO: 55298 - DNA, 20 bp, Artificial Sequence
  chemically synthesized
agcaatgactggggctcaga

SEQ ID NO: 55299 - DNA, 20 bp, Artificial Sequence
  chemically synthesized
gcaatgactggggctcagag

SEQ ID NO: 55300 - DNA, 20 bp, Artificial Sequence
  chemically synthesized
gactggggctcagagaggtt

SEQ ID NO: 55301 - DNA, 20 bp, Artificial Sequence
  chemically synthesized
agaggtttggcgacttcacg

SEQ ID NO: 55302 - DNA, 20 bp, Artificial Sequence
  chemically synthesized
gaggtttggcgacttcacga

SEQ ID NO: 55303 - DNA, 20 bp, Artificial Sequence
  chemically synthesized
gcgacttcacgaaggtcaca

SEQ ID NO: 55304 - DNA, 20 bp, Artificial Sequence
  chemically synthesized
cacgaaggtcacacagctgt

SEQ ID NO: 55305 - DNA, 20 bp, Artificial Sequence
  chemically synthesized
acgaaggtcacacagctgtc

SEQ ID NO: 55306 - DNA, 20 bp, Artificial Sequence
  chemically synthesized
cgaaggtcacacagctgtca

SEQ ID NO: 55307 - DNA, 20 bp, Artificial Sequence
  chemically synthesized
gaaggtcacacagctgtcag

SEQ ID NO: 55308 - DNA, 20 bp, Artificial Sequence
  chemically synthesized
aaggtcacacagctgtcagg

SEQ ID NO: 55309 - DNA, 20 bp, Artificial Sequence
  chemically synthesized
cacacagctgtcagggggaa

SEQ ID NO: 55310 - DNA, 20 bp, Artificial Sequence
  chemically synthesized
cagctgtcagggggaaaagt

SEQ ID NO: 55311 - DNA, 20 bp, Artificial Sequence
  chemically synthesized
cagggggaaaagtcagaact

SEQ ID NO: 55312 - DNA, 20 bp, Artificial Sequence
  chemically synthesized
gaaaagtcagaacttggatc

SEQ ID NO: 55313 - DNA, 20 bp, Artificial Sequence
  chemically synthesized
aaaagtcagaacttggatcc

SEQ ID NO: 55314 - DNA, 20 bp, Artificial Sequence
  chemically synthesized
agaacttggatccaggtctt

SEQ ID NO: 55315 - DNA, 20 bp, Artificial Sequence
  chemically synthesized
gatccaggtcttcagactct

SEQ ID NO: 55316 - DNA, 20 bp, Artificial Sequence
  chemically synthesized
atccaggtcttcagactctc

SEQ ID NO: 55317 - DNA, 20 bp, Artificial Sequence
  chemically synthesized
ggtcttcagactctcaggtc

SEQ ID NO: 55318 - DNA, 20 bp, Artificial Sequence
  chemically synthesized
tctcaggtctggtgtcatcc

SEQ ID NO: 55319 - DNA, 20 bp, Artificial Sequence
  chemically synthesized
ctcaggtctggtgtcatcct

SEQ ID NO: 55320 - DNA, 20 bp, Artificial Sequence
  chemically synthesized
tcaggtctggtgtcatccta

SEQ ID NO: 55321 - DNA, 20 bp, Artificial Sequence
  chemically synthesized
caggtctggtgtcatcctag

SEQ ID NO: 55322 - DNA, 20 bp, Artificial Sequence
  chemically synthesized
aggtctggtgtcatcctagg

SEQ ID NO: 55323 - DNA, 20 bp, Artificial Sequence
  chemically synthesized
tggtgtcatcctagggggct

SEQ ID NO: 55324 - DNA, 20 bp, Artificial Sequence
  chemically synthesized
catcctagggggcttggtga

SEQ ID NO: 55325 - DNA, 20 bp, Artificial Sequence
  chemically synthesized
ccatatctttaatgtatttg

SEQ ID NO: 55326 - DNA, 20 bp, Artificial Sequence
  chemically synthesized
atatctttaatgtatttgtg

SEQ ID NO: 55327 - DNA, 20 bp, Artificial Sequence
  chemically synthesized
atctttaatgtatttgtgga

SEQ ID NO: 55328 - DNA, 20 bp, Artificial Sequence
  chemically synthesized
aatgtatttgtggagagtga

SEQ ID NO: 55329 - DNA, 20 bp, Artificial Sequence
  chemically synthesized
atgtatttgtggagagtgaa

SEQ ID NO: 55330 - DNA, 20 bp, Artificial Sequence
  chemically synthesized
tgtggagagtgaaaggctgt

SEQ ID NO: 55331 - DNA, 20 bp, Artificial Sequence
  chemically synthesized
gagagtgaaaggctgtcagt

SEQ ID NO: 55332 - DNA, 20 bp, Artificial Sequence
  chemically synthesized
gtgaaaggctgtcagtgagt

SEQ ID NO: 55333 - DNA, 20 bp, Artificial Sequence
  chemically synthesized
ggctgtcagtgagtaagctt

SEQ ID NO: 55334 - DNA, 20 bp, Artificial Sequence
  chemically synthesized
ctgtcagtgagtaagcttaa

SEQ ID NO: 55335 - DNA, 20 bp, Artificial Sequence
  chemically synthesized
agtgagtaagcttaagagaa

SEQ ID NO: 55336 - DNA, 20 bp, Artificial Sequence
  chemically synthesized
gtgagtaagcttaagagaac

SEQ ID NO: 55337 - DNA, 20 bp, Artificial Sequence
  chemically synthesized
gagtaagcttaagagaacag

SEQ ID NO: 55338 - DNA, 20 bp, Artificial Sequence
  chemically synthesized
aagagaacaggagacttgtg

SEQ ID NO: 55339 - DNA, 20 bp, Artificial Sequence
  chemically synthesized
agagaacaggagacttgtgt

SEQ ID NO: 55340 - DNA, 20 bp, Artificial Sequence
  chemically synthesized
caggagacttgtgtgggaaa

SEQ ID NO: 55341 - DNA, 20 bp, Artificial Sequence
  chemically synthesized
agacttgtgtgggaaacagt

SEQ ID NO: 55342 - DNA, 20 bp, Artificial Sequence
  chemically synthesized
aacagtcggtatccattgat

SEQ ID NO: 55343 - DNA, 20 bp, Artificial Sequence
  chemically synthesized
attgattagactgaatcatg

SEQ ID NO: 55344 - DNA, 20 bp, Artificial Sequence
  chemically synthesized
gaactatcgaaatcactatt

SEQ ID NO: 55345 - DNA, 20 bp, Artificial Sequence
  chemically synthesized
atgactcaacctcatccttt

SEQ ID NO: 55346 - DNA, 20 bp, Artificial Sequence
  chemically synthesized
ctttaagtacacattcatga

SEQ ID NO: 55347 - DNA, 20 bp, Artificial Sequence
  chemically synthesized
aagtacacattcatgacagt

SEQ ID NO: 55348 - DNA, 20 bp, Artificial Sequence
  chemically synthesized
tacacattcatgacagtgag

SEQ ID NO: 55349 - DNA, 20 bp, Artificial Sequence
  chemically synthesized
cattcatgacagtgagtggt

SEQ ID NO: 55350 - DNA, 20 bp, Artificial Sequence
  chemically synthesized
catgacagtgagtggttaga

SEQ ID NO: 55351 - DNA, 20 bp, Artificial Sequence
  chemically synthesized
agtggttagacagtgattcc

SEQ ID NO: 55352 - DNA, 20 bp, Artificial Sequence
  chemically synthesized
ttagacagtgattcctagat

SEQ ID NO: 55353 - DNA, 20 bp, Artificial Sequence
  chemically synthesized
cagtgattcctagattagtt

SEQ ID NO: 55354 - DNA, 20 bp, Artificial Sequence
  chemically synthesized
agtgattcctagattagttt

SEQ ID NO: 55355 - DNA, 20 bp, Artificial Sequence
  chemically synthesized
attcctagattagtttggga

SEQ ID NO: 55356 - DNA, 20 bp, Artificial Sequence
  chemically synthesized
ttcctagattagtttgggat

SEQ ID NO: 55357 - DNA, 20 bp, Artificial Sequence
  chemically synthesized
tcctagattagtttgggatg

SEQ ID NO: 55358 - DNA, 20 bp, Artificial Sequence
  chemically synthesized
tagattagtttgggatgggg

SEQ ID NO: 55359 - DNA, 20 bp, Artificial Sequence
  chemically synthesized
ggatggggcagtgccttcca

SEQ ID NO: 55360 - DNA, 20 bp, Artificial Sequence
  chemically synthesized
gatggggcagtgccttccat

SEQ ID NO: 55361 - DNA, 20 bp, Artificial Sequence
  chemically synthesized
ggcagtgccttccataggac

SEQ ID NO: 55362 - DNA, 20 bp, Artificial Sequence
  chemically synthesized
gcagtgccttccataggaca

SEQ ID NO: 55363 - DNA, 20 bp, Artificial Sequence
  chemically synthesized
ccataggacaaggccattcc

SEQ ID NO: 55364 - DNA, 20 bp, Artificial Sequence
  chemically synthesized
taggacaaggccattcctgg

SEQ ID NO: 55365 - DNA, 20 bp, Artificial Sequence
  chemically synthesized
ggacaaggccattcctggta

SEQ ID NO: 55366 - DNA, 20 bp, Artificial Sequence
  chemically synthesized
aaggccattcctggtagaga

SEQ ID NO: 55367 - DNA, 20 bp, Artificial Sequence
  chemically synthesized
ggccattcctggtagagacg

SEQ ID NO: 55368 - DNA, 20 bp, Artificial Sequence
  chemically synthesized
gccattcctggtagagacgg

SEQ ID NO: 55369 - DNA, 20 bp, Artificial Sequence
  chemically synthesized
ccattcctggtagagacgga

SEQ ID NO: 55370 - DNA, 20 bp, Artificial Sequence
  chemically synthesized
attcctggtagagacggagg

SEQ ID NO: 55371 - DNA, 20 bp, Artificial Sequence
  chemically synthesized
cctggtagagacggagggag

SEQ ID NO: 55372 - DNA, 20 bp, Artificial Sequence
  chemically synthesized
ctggtagagacggagggagc

SEQ ID NO: 55373 - DNA, 20 bp, Artificial Sequence
  chemically synthesized
ggagggagcaggctgtcctt

SEQ ID NO: 55374 - DNA, 20 bp, Artificial Sequence
  chemically synthesized
ggagcaggctgtccttcagc

SEQ ID NO: 55375 - DNA, 20 bp, Artificial Sequence
  chemically synthesized
gagcaggctgtccttcagct

SEQ ID NO: 55376 - DNA, 20 bp, Artificial Sequence
  chemically synthesized
agcaggctgtccttcagcta

SEQ ID NO: 55377 - DNA, 20 bp, Artificial Sequence
  chemically synthesized
gcaggctgtccttcagctag

SEQ ID NO: 55378 - DNA, 20 bp, Artificial Sequence
  chemically synthesized
ctgtccttcagctaggggcc

SEQ ID NO: 55379 - DNA, 20 bp, Artificial Sequence
  chemically synthesized
tgtccttcagctaggggccc

SEQ ID NO: 55380 - DNA, 20 bp, Artificial Sequence
  chemically synthesized
gtccttcagctaggggccca

SEQ ID NO: 55381 - DNA, 20 bp, Artificial Sequence
  chemically synthesized
tccttcagctaggggcccag

SEQ ID NO: 55382 - DNA, 20 bp, Artificial Sequence
  chemically synthesized
taggggcccaggggacttcc

SEQ ID NO: 55383 - DNA, 20 bp, Artificial Sequence
  chemically synthesized
ttcctggctgctgtgtcctt

SEQ ID NO: 55384 - DNA, 20 bp, Artificial Sequence
  chemically synthesized
ctggctgctgtgtcctttag

SEQ ID NO: 55385 - DNA, 20 bp, Artificial Sequence
  chemically synthesized
tggctgctgtgtcctttagc

SEQ ID NO: 55386 - DNA, 20 bp, Artificial Sequence
  chemically synthesized
ggctgctgtgtcctttagca

SEQ ID NO: 55387 - DNA, 20 bp, Artificial Sequence
  chemically synthesized
tgtgtcctttagcagggcct

SEQ ID NO: 55388 - DNA, 20 bp, Artificial Sequence
  chemically synthesized
tgtcctttagcagggccttg

SEQ ID NO: 55389 - DNA, 20 bp, Artificial Sequence
  chemically synthesized
gtcctttagcagggccttgg

SEQ ID NO: 55390 - DNA, 20 bp, Artificial Sequence
  chemically synthesized
tttagcagggccttggagga

SEQ ID NO: 55391 - DNA, 20 bp, Artificial Sequence
  chemically synthesized
agcagggccttggaggatgg

SEQ ID NO: 55392 - DNA, 20 bp, Artificial Sequence
  chemically synthesized
gcagggccttggaggatgga

SEQ ID NO: 55393 - DNA, 20 bp, Artificial Sequence
  chemically synthesized
ggaggatggaaggactctcc

SEQ ID NO: 55394 - DNA, 20 bp, Artificial Sequence
  chemically synthesized
gactctcctggcccttacca

SEQ ID NO: 55395 - DNA, 20 bp, Artificial Sequence
  chemically synthesized
actctcctggcccttaccac

SEQ ID NO: 55396 - DNA, 20 bp, Artificial Sequence
  chemically synthesized
ctctcctggcccttaccaca

SEQ ID NO: 55397 - DNA, 20 bp, Artificial Sequence
  chemically synthesized
tctcctggcccttaccacag

SEQ ID NO: 55398 - DNA, 20 bp, Artificial Sequence
  chemically synthesized
cccttaccacaggggctatt

SEQ ID NO: 55399 - DNA, 20 bp, Artificial Sequence
  chemically synthesized
ccttaccacaggggctattc

SEQ ID NO: 55400 - DNA, 20 bp, Artificial Sequence
  chemically synthesized
ccacaggggctattcaggaa

SEQ ID NO: 55401 - DNA, 20 bp, Artificial Sequence
  chemically synthesized
tcaggaacagcctcctgccg

SEQ ID NO: 55402 - DNA, 20 bp, Artificial Sequence
  chemically synthesized
acagcctcctgccgtggcac

SEQ ID NO: 55403 - DNA, 20 bp, Artificial Sequence
  chemically synthesized
agcctcctgccgtggcactg

SEQ ID NO: 55404 - DNA, 20 bp, Artificial Sequence
  chemically synthesized
ctgccgtggcactggagctg

SEQ ID NO: 55405 - DNA, 20 bp, Artificial Sequence
  chemically synthesized
ccgtggcactggagctgcgg

SEQ ID NO: 55406 - DNA, 20 bp, Artificial Sequence
  chemically synthesized
ggagctgcggtggccctctg

SEQ ID NO: 55407 - DNA, 20 bp, Artificial Sequence
  chemically synthesized
cggtggccctctgaagactg

SEQ ID NO: 55408 - DNA, 20 bp, Artificial Sequence
  chemically synthesized
ggtggccctctgaagactgc

SEQ ID NO: 55409 - DNA, 20 bp, Artificial Sequence
  chemically synthesized
gtggccctctgaagactgca

SEQ ID NO: 55410 - DNA, 20 bp, Artificial Sequence
  chemically synthesized
ccctctgaagactgcaggga

SEQ ID NO: 55411 - DNA, 20 bp, Artificial Sequence
  chemically synthesized
gaagactgcagggacagcaa

SEQ ID NO: 55412 - DNA, 20 bp, Artificial Sequence
  chemically synthesized
aagactgcagggacagcaac

SEQ ID NO: 55413 - DNA, 20 bp, Artificial Sequence
  chemically synthesized
cagggacagcaacaggcaca

SEQ ID NO: 55414 - DNA, 20 bp, Artificial Sequence
  chemically synthesized
ggacagcaacaggcacaaag

SEQ ID NO: 55415 - DNA, 20 bp, Artificial Sequence
  chemically synthesized
agcaacaggcacaaagaagt

SEQ ID NO: 55416 - DNA, 20 bp, Artificial Sequence
  chemically synthesized
gcaacaggcacaaagaagtc

SEQ ID NO: 55417 - DNA, 20 bp, Artificial Sequence
  chemically synthesized
caaagaagtcaggctgcatg

SEQ ID NO: 55418 - DNA, 20 bp, Artificial Sequence
  chemically synthesized
agtcaggctgcatgtggccc

SEQ ID NO: 55419 - DNA, 20 bp, Artificial Sequence
  chemically synthesized
aggctgcatgtggccccagt

SEQ ID NO: 55420 - DNA, 20 bp, Artificial Sequence
  chemically synthesized
ggctgcatgtggccccagtc

SEQ ID NO: 55421 - DNA, 20 bp, Artificial Sequence
  chemically synthesized
atgtggccccagtcgggact

SEQ ID NO: 55422 - DNA, 20 bp, Artificial Sequence
  chemically synthesized
gtggccccagtcgggactca

SEQ ID NO: 55423 - DNA, 20 bp, Artificial Sequence
  chemically synthesized
tggccccagtcgggactcag

SEQ ID NO: 55424 - DNA, 20 bp, Artificial Sequence
  chemically synthesized
gccccagtcgggactcagag

SEQ ID NO: 55425 - DNA, 20 bp, Artificial Sequence
  chemically synthesized
ccccagtcgggactcagagg

SEQ ID NO: 55426 - DNA, 20 bp, Artificial Sequence
  chemically synthesized
agtcgggactcagaggagga

SEQ ID NO: 55427 - DNA, 20 bp, Artificial Sequence
  chemically synthesized
gtcgggactcagaggaggaa

SEQ ID NO: 55428 - DNA, 20 bp, Artificial Sequence
  chemically synthesized
tcgggactcagaggaggaaa

SEQ ID NO: 55429 - DNA, 20 bp, Artificial Sequence
  chemically synthesized
gggactcagaggaggaaagg

SEQ ID NO: 55430 - DNA, 20 bp, Artificial Sequence
  chemically synthesized
ggactcagaggaggaaaggg

SEQ ID NO: 55431 - DNA, 20 bp, Artificial Sequence
  chemically synthesized
gactcagaggaggaaaggga

SEQ ID NO: 55432 - DNA, 20 bp, Artificial Sequence
  chemically synthesized
actcagaggaggaaagggag

SEQ ID NO: 55433 - DNA, 20 bp, Artificial Sequence
  chemically synthesized
aggaggaaagggaggggttg

SEQ ID NO: 55434 - DNA, 20 bp, Artificial Sequence
  chemically synthesized
ggaggaaagggaggggttgc

SEQ ID NO: 55435 - DNA, 20 bp, Artificial Sequence
  chemically synthesized
gaggaaagggaggggttgcg

SEQ ID NO: 55436 - DNA, 20 bp, Artificial Sequence
  chemically synthesized
aggaaagggaggggttgcgg

SEQ ID NO: 55437 - DNA, 20 bp, Artificial Sequence
  chemically synthesized
ggaggggttgcgggggtcaa

SEQ ID NO: 55438 - DNA, 20 bp, Artificial Sequence
  chemically synthesized
gaggggttgcgggggtcaat

SEQ ID NO: 55439 - DNA, 20 bp, Artificial Sequence
  chemically synthesized
gtgatgtgcttcctctccca

SEQ ID NO: 55440 - DNA, 20 bp, Artificial Sequence
  chemically synthesized
gtgcttcctctcccatagct

SEQ ID NO: 55441 - DNA, 20 bp, Artificial Sequence
  chemically synthesized
tgcttcctctcccatagctg

SEQ ID NO: 55442 - DNA, 20 bp, Artificial Sequence
  chemically synthesized
cttcctctcccatagctgag

SEQ ID NO: 55443 - DNA, 20 bp, Artificial Sequence
  chemically synthesized
tagctgaggagtccttgcaa

SEQ ID NO: 55444 - DNA, 20 bp, Artificial Sequence
  chemically synthesized
gtccttgcaatggccttcct

SEQ ID NO: 55445 - DNA, 20 bp, Artificial Sequence
  chemically synthesized
caatggccttcctgagccat

SEQ ID NO: 55446 - DNA, 20 bp, Artificial Sequence
  chemically synthesized
tggccttcctgagccatcag

SEQ ID NO: 55447 - DNA, 20 bp, Artificial Sequence
  chemically synthesized
ggccttcctgagccatcagc

SEQ ID NO: 55448 - DNA, 20 bp, Artificial Sequence
  chemically synthesized
ctgagccatcagcaggccta

SEQ ID NO: 55449 - DNA, 20 bp, Artificial Sequence
  chemically synthesized
caggcctatggccatgtgac

SEQ ID NO: 55450 - DNA, 20 bp, Artificial Sequence
  chemically synthesized
aggcctatggccatgtgact

SEQ ID NO: 55451 - DNA, 20 bp, Artificial Sequence
  chemically synthesized
ggcctatggccatgtgacta

SEQ ID NO: 55452 - DNA, 20 bp, Artificial Sequence
  chemically synthesized
cctatggccatgtgactagg

SEQ ID NO: 55453 - DNA, 20 bp, Artificial Sequence
  chemically synthesized
ctatggccatgtgactaggg

SEQ ID NO: 55454 - DNA, 20 bp, Artificial Sequence
  chemically synthesized
atggccatgtgactagggag

SEQ ID NO: 55455 - DNA, 20 bp, Artificial Sequence
  chemically synthesized
gccatgtgactagggaggag

SEQ ID NO: 55456 - DNA, 20 bp, Artificial Sequence
  chemically synthesized
ccatgtgactagggaggaga

SEQ ID NO: 55457 - DNA, 20 bp, Artificial Sequence
  chemically synthesized
catgtgactagggaggagaa

SEQ ID NO: 55458 - DNA, 20 bp, Artificial Sequence
  chemically synthesized
actagggaggagaagggata

SEQ ID NO: 55459 - DNA, 20 bp, Artificial Sequence
  chemically synthesized
ctagggaggagaagggatat

SEQ ID NO: 55460 - DNA, 20 bp, Artificial Sequence
  chemically synthesized
tagggaggagaagggatata

SEQ ID NO: 55461 - DNA, 20 bp, Artificial Sequence
  chemically synthesized
ggagaagggatatagggtaa

SEQ ID NO: 55462 - DNA, 20 bp, Artificial Sequence
  chemically synthesized
gatatagggtaatggtcttc

SEQ ID NO: 55463 - DNA, 20 bp, Artificial Sequence
  chemically synthesized
atatagggtaatggtcttct

SEQ ID NO: 55464 - DNA, 20 bp, Artificial Sequence
  chemically synthesized
tatagggtaatggtcttctg

SEQ ID NO: 55465 - DNA, 20 bp, Artificial Sequence
  chemically synthesized
aatggtcttctggggcctgc

SEQ ID NO: 55466 - DNA, 20 bp, Artificial Sequence
  chemically synthesized
atggtcttctggggcctgct

SEQ ID NO: 55467 - DNA, 20 bp, Artificial Sequence
  chemically synthesized
cttctggggcctgctgggcc

SEQ ID NO: 55468 - DNA, 20 bp, Artificial Sequence
  chemically synthesized
ggggcctgctgggcctggtc

SEQ ID NO: 55469 - DNA, 20 bp, Artificial Sequence
  chemically synthesized
tgctgggcctggtcaagtct

SEQ ID NO: 55470 - DNA, 20 bp, Artificial Sequence
  chemically synthesized
gctgggcctggtcaagtctg

SEQ ID NO: 55471 - DNA, 20 bp, Artificial Sequence
  chemically synthesized
tgggcctggtcaagtctgag

SEQ ID NO: 55472 - DNA, 20 bp, Artificial Sequence
  chemically synthesized
gggcctggtcaagtctgagg

SEQ ID NO: 55473 - DNA, 20 bp, Artificial Sequence
  chemically synthesized
gcctggtcaagtctgaggag

SEQ ID NO: 55474 - DNA, 20 bp, Artificial Sequence
  chemically synthesized
ggtcaagtctgaggaggaga

SEQ ID NO: 55475 - DNA, 20 bp, Artificial Sequence
  chemically synthesized
tcaagtctgaggaggagata

SEQ ID NO: 55476 - DNA, 20 bp, Artificial Sequence
  chemically synthesized
aggaggagatagagaaaaca

SEQ ID NO: 55477 - DNA, 20 bp, Artificial Sequence
  chemically synthesized
aggagatagagaaaacaaag

SEQ ID NO: 55478 - DNA, 20 bp, Artificial Sequence
  chemically synthesized
gagatagagaaaacaaagca

SEQ ID NO: 55479 - DNA, 20 bp, Artificial Sequence
  chemically synthesized
cagagaccctcctcttcatc

SEQ ID NO: 55480 - DNA, 20 bp, Artificial Sequence
  chemically synthesized
agagaccctcctcttcatct

SEQ ID NO: 55481 - DNA, 20 bp, Artificial Sequence
  chemically synthesized
gagaccctcctcttcatctg

SEQ ID NO: 55482 - DNA, 20 bp, Artificial Sequence
  chemically synthesized
gaccctcctcttcatctggg

SEQ ID NO: 55483 - DNA, 20 bp, Artificial Sequence
  chemically synthesized
cctcctcttcatctggggag

SEQ ID NO: 55484 - DNA, 20 bp, Artificial Sequence
  chemically synthesized
ctcctcttcatctggggaga

SEQ ID NO: 55485 - DNA, 20 bp, Artificial Sequence
  chemically synthesized
tcctcttcatctggggagaa

SEQ ID NO: 55486 - DNA, 20 bp, Artificial Sequence
  chemically synthesized
agaagggacctgattctaaa

SEQ ID NO: 55487 - DNA, 20 bp, Artificial Sequence
  chemically synthesized
aagggacctgattctaaacg

SEQ ID NO: 55488 - DNA, 20 bp, Artificial Sequence
  chemically synthesized
gattctaaacggagatatgt

SEQ ID NO: 55489 - DNA, 20 bp, Artificial Sequence
  chemically synthesized
attctaaacggagatatgtg

SEQ ID NO: 55490 - DNA, 20 bp, Artificial Sequence
  chemically synthesized
cggagatatgtgaggctttc

SEQ ID NO: 55491 - DNA, 20 bp, Artificial Sequence
  chemically synthesized
ggagatatgtgaggctttct

SEQ ID NO: 55492 - DNA, 20 bp, Artificial Sequence
  chemically synthesized
gagatatgtgaggctttctg

SEQ ID NO: 55493 - DNA, 20 bp, Artificial Sequence
  chemically synthesized
atatgtgaggctttctgggg

SEQ ID NO: 55494 - DNA, 20 bp, Artificial Sequence
  chemically synthesized
gaggctttctggggcagcga

SEQ ID NO: 55495 - DNA, 20 bp, Artificial Sequence
  chemically synthesized
gctttctggggcagcgatgg

SEQ ID NO: 55496 - DNA, 20 bp, Artificial Sequence
  chemically synthesized
ctttctggggcagcgatgga

SEQ ID NO: 55497 - DNA, 20 bp, Artificial Sequence
  chemically synthesized
tggggcagcgatggaaggac

SEQ ID NO: 55498 - DNA, 20 bp, Artificial Sequence
  chemically synthesized
ggggcagcgatggaaggaca

SEQ ID NO: 55499 - DNA, 20 bp, Artificial Sequence
  chemically synthesized
cagcgatggaaggacaagga

SEQ ID NO: 55500 - DNA, 20 bp, Artificial Sequence
  chemically synthesized
atggaaggacaaggacagaa

SEQ ID NO: 55501 - DNA, 20 bp, Artificial Sequence
  chemically synthesized
tggaaggacaaggacagaat

SEQ ID NO: 55502 - DNA, 20 bp, Artificial Sequence
  chemically synthesized
taggtgtccttgttgcccca

SEQ ID NO: 55503 - DNA, 20 bp, Artificial Sequence
  chemically synthesized
ggtgtccttgttgccccatg

SEQ ID NO: 55504 - DNA, 20 bp, Artificial Sequence
  chemically synthesized
ccttgttgccccatggagaa

SEQ ID NO: 55505 - DNA, 20 bp, Artificial Sequence
  chemically synthesized
cttgttgccccatggagaat

SEQ ID NO: 55506 - DNA, 20 bp, Artificial Sequence
  chemically synthesized
gccccatggagaatgggctt

SEQ ID NO: 55507 - DNA, 20 bp, Artificial Sequence
  chemically synthesized
ccccatggagaatgggcttc

SEQ ID NO: 55508 - DNA, 20 bp, Artificial Sequence
  chemically synthesized
catggagaatgggcttcagg

SEQ ID NO: 55509 - DNA, 20 bp, Artificial Sequence
  chemically synthesized
gcttcaggaagaatctgcct

SEQ ID NO: 55510 - DNA, 20 bp, Artificial Sequence
  chemically synthesized
aatctgcctcagtcattttc

SEQ ID NO: 55511 - DNA, 20 bp, Artificial Sequence
  chemically synthesized
ctgcctcagtcattttccag

SEQ ID NO: 55512 - DNA, 20 bp, Artificial Sequence
  chemically synthesized
gtcattttccagaagtgcct

SEQ ID NO: 55513 - DNA, 20 bp, Artificial Sequence
  chemically synthesized
cattttccagaagtgcctga

SEQ ID NO: 55514 - DNA, 20 bp, Artificial Sequence
  chemically synthesized
attttccagaagtgcctgag

SEQ ID NO: 55515 - DNA, 20 bp, Artificial Sequence
  chemically synthesized
ccagaagtgcctgagaggtg

SEQ ID NO: 55516 - DNA, 20 bp, Artificial Sequence
  chemically synthesized
cagaagtgcctgagaggtgc

SEQ ID NO: 55517 - DNA, 20 bp, Artificial Sequence
  chemically synthesized
agaagtgcctgagaggtgca

SEQ ID NO: 55518 - DNA, 20 bp, Artificial Sequence
  chemically synthesized
gcctgagaggtgcagggccc

SEQ ID NO: 55519 - DNA, 20 bp, Artificial Sequence
  chemically synthesized
agaggtgcagggcccgagtc

SEQ ID NO: 55520 - DNA, 20 bp, Artificial Sequence
  chemically synthesized
gtgcagggcccgagtctggt

SEQ ID NO: 55521 - DNA, 20 bp, Artificial Sequence
  chemically synthesized
tgcagggcccgagtctggtt

SEQ ID NO: 55522 - DNA, 20 bp, Artificial Sequence
  chemically synthesized
gcccgagtctggttaggtga

SEQ ID NO: 55523 - DNA, 20 bp, Artificial Sequence
  chemically synthesized
cgagtctggttaggtgacag

SEQ ID NO: 55524 - DNA, 20 bp, Artificial Sequence
  chemically synthesized
gagtctggttaggtgacagc

SEQ ID NO: 55525 - DNA, 20 bp, Artificial Sequence
  chemically synthesized
tggttaggtgacagcgggtc

SEQ ID NO: 55526 - DNA, 20 bp, Artificial Sequence
  chemically synthesized
gttaggtgacagcgggtcaa

SEQ ID NO: 55527 - DNA, 20 bp, Artificial Sequence
  chemically synthesized
ttaggtgacagcgggtcaag

SEQ ID NO: 55528 - DNA, 20 bp, Artificial Sequence
  chemically synthesized
aggtgacagcgggtcaagag

SEQ ID NO: 55529 - DNA, 20 bp, Artificial Sequence
  chemically synthesized
ggtgacagcgggtcaagagg

SEQ ID NO: 55530 - DNA, 20 bp, Artificial Sequence
  chemically synthesized
tcctctctcttgtgttgctg

SEQ ID NO: 55531 - DNA, 20 bp, Artificial Sequence
  chemically synthesized
tgctgcagatgccacaaaac

SEQ ID NO: 55532 - DNA, 20 bp, Artificial Sequence
  chemically synthesized
gctgcagatgccacaaaact

SEQ ID NO: 55533 - DNA, 20 bp, Artificial Sequence
  chemically synthesized
gatgccacaaaactgggcca

SEQ ID NO: 55534 - DNA, 20 bp, Artificial Sequence
  chemically synthesized
aaactgggccacggcacgat

SEQ ID NO: 55535 - DNA, 20 bp, Artificial Sequence
  chemically synthesized
aactgggccacggcacgatc

SEQ ID NO: 55536 - DNA, 20 bp, Artificial Sequence
  chemically synthesized
tgggccacggcacgatcagg

SEQ ID NO: 55537 - DNA, 20 bp, Artificial Sequence
  chemically synthesized
acggcacgatcaggcagttc

SEQ ID NO: 55538 - DNA, 20 bp, Artificial Sequence
  chemically synthesized
cggcacgatcaggcagttct

SEQ ID NO: 55539 - DNA, 20 bp, Artificial Sequence
  chemically synthesized
ggcacgatcaggcagttctg

SEQ ID NO: 55540 - DNA, 20 bp, Artificial Sequence
  chemically synthesized
tcaggcagttctggggcccc

SEQ ID NO: 55541 - DNA, 20 bp, Artificial Sequence
  chemically synthesized
caggcagttctggggccccc

SEQ ID NO: 55542 - DNA, 20 bp, Artificial Sequence
  chemically synthesized
ggcagttctggggcccccag

SEQ ID NO: 55543 - DNA, 20 bp, Artificial Sequence
  chemically synthesized
gcagttctggggcccccagg

SEQ ID NO: 55544 - DNA, 20 bp, Artificial Sequence
  chemically synthesized
cagttctggggcccccagga

SEQ ID NO: 55545 - DNA, 20 bp, Artificial Sequence
  chemically synthesized
ttctggggcccccaggaggg

SEQ ID NO: 55546 - DNA, 20 bp, Artificial Sequence
  chemically synthesized
ggcccccaggagggcagcct

SEQ ID NO: 55547 - DNA, 20 bp, Artificial Sequence
  chemically synthesized
gcccccaggagggcagcctt

SEQ ID NO: 55548 - DNA, 20 bp, Artificial Sequence
  chemically synthesized
cccccaggagggcagccttg

SEQ ID NO: 55549 - DNA, 20 bp, Artificial Sequence
  chemically synthesized
ccaggagggcagccttgggg

SEQ ID NO: 55550 - DNA, 20 bp, Artificial Sequence
  chemically synthesized
caggagggcagccttggggt

SEQ ID NO: 55551 - DNA, 20 bp, Artificial Sequence
  chemically synthesized
gggcagccttggggtgggca

SEQ ID NO: 55552 - DNA, 20 bp, Artificial Sequence
  chemically synthesized
agccttggggtgggcacagc

SEQ ID NO: 55553 - DNA, 20 bp, Artificial Sequence
  chemically synthesized
ggggtgggcacagccagccc

SEQ ID NO: 55554 - DNA, 20 bp, Artificial Sequence
  chemically synthesized
gtgggcacagccagccctgg

SEQ ID NO: 55555 - DNA, 20 bp, Artificial Sequence
  chemically synthesized
tgggcacagccagccctggc

SEQ ID NO: 55556 - DNA, 20 bp, Artificial Sequence
  chemically synthesized
acagccagccctggcaggat

SEQ ID NO: 55557 - DNA, 20 bp, Artificial Sequence
  chemically synthesized
cctggcaggatgagcaactc

SEQ ID NO: 55558 - DNA, 20 bp, Artificial Sequence
  chemically synthesized
ctggcaggatgagcaactct

SEQ ID NO: 55559 - DNA, 20 bp, Artificial Sequence
  chemically synthesized
gcaggatgagcaactctggg

SEQ ID NO: 55560 - DNA, 20 bp, Artificial Sequence
  chemically synthesized
caggatgagcaactctgggt

SEQ ID NO: 55561 - DNA, 20 bp, Artificial Sequence
  chemically synthesized
aggatgagcaactctgggtg

SEQ ID NO: 55562 - DNA, 20 bp, Artificial Sequence
  chemically synthesized
ggatgagcaactctgggtgg

SEQ ID NO: 55563 - DNA, 20 bp, Artificial Sequence
  chemically synthesized
gatgagcaactctgggtggg

SEQ ID NO: 55564 - DNA, 20 bp, Artificial Sequence
  chemically synthesized
atgagcaactctgggtgggg

SEQ ID NO: 55565 - DNA, 20 bp, Artificial Sequence
  chemically synthesized
gagcaactctgggtgggggg

SEQ ID NO: 55566 - DNA, 20 bp, Artificial Sequence
  chemically synthesized
caactctgggtgggggggag

SEQ ID NO: 55567 - DNA, 20 bp, Artificial Sequence
  chemically synthesized
aactctgggtgggggggagt

SEQ ID NO: 55568 - DNA, 20 bp, Artificial Sequence
  chemically synthesized
actctgggtgggggggagtg

SEQ ID NO: 55569 - DNA, 20 bp, Artificial Sequence
  chemically synthesized
ctctgggtgggggggagtgg

SEQ ID NO: 55570 - DNA, 20 bp, Artificial Sequence
  chemically synthesized
ggtgggggggagtgggggat

SEQ ID NO: 55571 - DNA, 20 bp, Artificial Sequence
  chemically synthesized
gggggggagtgggggatgag

SEQ ID NO: 55572 - DNA, 20 bp, Artificial Sequence
  chemically synthesized
ggggggagtgggggatgagc

SEQ ID NO: 55573 - DNA, 20 bp, Artificial Sequence
  chemically synthesized
gggggagtgggggatgagca

SEQ ID NO: 55574 - DNA, 20 bp, Artificial Sequence
  chemically synthesized
ggggagtgggggatgagcag

SEQ ID NO: 55575 - DNA, 20 bp, Artificial Sequence
  chemically synthesized
gggagtgggggatgagcagg

SEQ ID NO: 55576 - DNA, 20 bp, Artificial Sequence
  chemically synthesized
gggatgagcagggggacatg

SEQ ID NO: 55577 - DNA, 20 bp, Artificial Sequence
  chemically synthesized
cagggggacatgaagatgct

SEQ ID NO: 55578 - DNA, 20 bp, Artificial Sequence
  chemically synthesized
ggggacatgaagatgcttgg

SEQ ID NO: 55579 - DNA, 20 bp, Artificial Sequence
  chemically synthesized
ggacatgaagatgcttggtg

SEQ ID NO: 55580 - DNA, 20 bp, Artificial Sequence
  chemically synthesized
tgaagatgcttggtggagcc

SEQ ID NO: 55581 - DNA, 20 bp, Artificial Sequence
  chemically synthesized
gaagatgcttggtggagcct

SEQ ID NO: 55582 - DNA, 20 bp, Artificial Sequence
  chemically synthesized
aagatgcttggtggagcctg

SEQ ID NO: 55583 - DNA, 20 bp, Artificial Sequence
  chemically synthesized
cttggtggagcctggggtca

SEQ ID NO: 55584 - DNA, 20 bp, Artificial Sequence
  chemically synthesized
gtggagcctggggtcatggc

SEQ ID NO: 55585 - DNA, 20 bp, Artificial Sequence
  chemically synthesized
ctggggtcatggctggtatc

SEQ ID NO: 55586 - DNA, 20 bp, Artificial Sequence
  chemically synthesized
cctcccctgtgattccttct

SEQ ID NO: 55587 - DNA, 20 bp, Artificial Sequence
  chemically synthesized
ctcccctgtgattccttctt

SEQ ID NO: 55588 - DNA, 20 bp, Artificial Sequence
  chemically synthesized
tcccctgtgattccttcttg

SEQ ID NO: 55589 - DNA, 20 bp, Artificial Sequence
  chemically synthesized
gattccttcttggggactcc

SEQ ID NO: 55590 - DNA, 20 bp, Artificial Sequence
  chemically synthesized
ccttcttggggactccaaga

SEQ ID NO: 55591 - DNA, 20 bp, Artificial Sequence
  chemically synthesized
cttcttggggactccaagac

SEQ ID NO: 55592 - DNA, 20 bp, Artificial Sequence
  chemically synthesized
tggggactccaagacaggac

SEQ ID NO: 55593 - DNA, 20 bp, Artificial Sequence
  chemically synthesized
ggggactccaagacaggaca

SEQ ID NO: 55594 - DNA, 20 bp, Artificial Sequence
  chemically synthesized
gactccaagacaggacaagg

SEQ ID NO: 55595 - DNA, 20 bp, Artificial Sequence
  chemically synthesized
caagacaggacaaggaagac

SEQ ID NO: 55596 - DNA, 20 bp, Artificial Sequence
  chemically synthesized
agacaggacaaggaagactg

SEQ ID NO: 55597 - DNA, 20 bp, Artificial Sequence
  chemically synthesized
caaggaagactggagccctc

SEQ ID NO: 55598 - DNA, 20 bp, Artificial Sequence
  chemically synthesized
agactggagccctccagaaa

SEQ ID NO: 55599 - DNA, 20 bp, Artificial Sequence
  chemically synthesized
tggagccctccagaaacaga

SEQ ID NO: 55600 - DNA, 20 bp, Artificial Sequence
  chemically synthesized
ggagccctccagaaacagat

SEQ ID NO: 55601 - DNA, 20 bp, Artificial Sequence
  chemically synthesized
cctccagaaacagatgggcc

SEQ ID NO: 55602 - DNA, 20 bp, Artificial Sequence
  chemically synthesized
ctccagaaacagatgggccc

SEQ ID NO: 55603 - DNA, 20 bp, Artificial Sequence
  chemically synthesized
acagatgggcccaggtccgt

SEQ ID NO: 55604 - DNA, 20 bp, Artificial Sequence
  chemically synthesized
tgggcccaggtccgtaagct

SEQ ID NO: 55605 - DNA, 20 bp, Artificial Sequence
  chemically synthesized
gggcccaggtccgtaagctg

SEQ ID NO: 55606 - DNA, 20 bp, Artificial Sequence
  chemically synthesized
aggtccgtaagctgaggatt

SEQ ID NO: 55607 - DNA, 20 bp, Artificial Sequence
  chemically synthesized
gctgaggattcagtcccccc

SEQ ID NO: 55608 - DNA, 20 bp, Artificial Sequence
  chemically synthesized
attcagtcccccctggattc

SEQ ID NO: 55609 - DNA, 20 bp, Artificial Sequence
  chemically synthesized
gtcccccctggattcaagcc

SEQ ID NO: 55610 - DNA, 20 bp, Artificial Sequence
  chemically synthesized
aagcccagcatgtgcctacc

SEQ ID NO: 55611 - DNA, 20 bp, Artificial Sequence
  chemically synthesized
ccagcatgtgcctacccagc

SEQ ID NO: 55612 - DNA, 20 bp, Artificial Sequence
  chemically synthesized
agccagatgctccatgaaca

SEQ ID NO: 55613 - DNA, 20 bp, Artificial Sequence
  chemically synthesized
gatgctccatgaacacagtt

SEQ ID NO: 55614 - DNA, 20 bp, Artificial Sequence
  chemically synthesized
atgctccatgaacacagttc

SEQ ID NO: 55615 - DNA, 20 bp, Artificial Sequence
  chemically synthesized
tgctccatgaacacagttca

SEQ ID NO: 55616 - DNA, 20 bp, Artificial Sequence
  chemically synthesized
gctccatgaacacagttcag

SEQ ID NO: 55617 - DNA, 20 bp, Artificial Sequence
  chemically synthesized
ctccatgaacacagttcagg

SEQ ID NO: 55618 - DNA, 20 bp, Artificial Sequence
  chemically synthesized
aacacagttcagggggcccg

SEQ ID NO: 55619 - DNA, 20 bp, Artificial Sequence
  chemically synthesized
cagttcagggggcccgaaga

SEQ ID NO: 55620 - DNA, 20 bp, Artificial Sequence
  chemically synthesized
ccgaagacagcactgttacc

SEQ ID NO: 55621 - DNA, 20 bp, Artificial Sequence
  chemically synthesized
gaagacagcactgttacctg

SEQ ID NO: 55622 - DNA, 20 bp, Artificial Sequence
  chemically synthesized
tgttacctggagcccacata

SEQ ID NO: 55623 - DNA, 20 bp, Artificial Sequence
  chemically synthesized
ctggagcccacatacagcct

SEQ ID NO: 55624 - DNA, 20 bp, Artificial Sequence
  chemically synthesized
gagcccacatacagcctcag

SEQ ID NO: 55625 - DNA, 20 bp, Artificial Sequence
  chemically synthesized
agcccacatacagcctcagc

SEQ ID NO: 55626 - DNA, 20 bp, Artificial Sequence
  chemically synthesized
acatacagcctcagcaggca

SEQ ID NO: 55627 - DNA, 20 bp, Artificial Sequence
  chemically synthesized
catacagcctcagcaggcaa

SEQ ID NO: 55628 - DNA, 20 bp, Artificial Sequence
  chemically synthesized
atacagcctcagcaggcaaa

SEQ ID NO: 55629 - DNA, 20 bp, Artificial Sequence
  chemically synthesized
acagcctcagcaggcaaagg

SEQ ID NO: 55630 - DNA, 20 bp, Artificial Sequence
  chemically synthesized
tcagcaggcaaagggagact

SEQ ID NO: 55631 - DNA, 20 bp, Artificial Sequence
  chemically synthesized
agcaggcaaagggagactca

SEQ ID NO: 55632 - DNA, 20 bp, Artificial Sequence
  chemically synthesized
agggagactcagagaaaaca

SEQ ID NO: 55633 - DNA, 20 bp, Artificial Sequence
  chemically synthesized
gggagactcagagaaaacat

SEQ ID NO: 55634 - DNA, 20 bp, Artificial Sequence
  chemically synthesized
gagactcagagaaaacatgg

SEQ ID NO: 55635 - DNA, 20 bp, Artificial Sequence
  chemically synthesized
agactcagagaaaacatggg

SEQ ID NO: 55636 - DNA, 20 bp, Artificial Sequence
  chemically synthesized
gactcagagaaaacatggga

SEQ ID NO: 55637 - DNA, 20 bp, Artificial Sequence
  chemically synthesized
gaaaacatgggagggattta

SEQ ID NO: 55638 - DNA, 20 bp, Artificial Sequence
  chemically synthesized
gagggatttacagtcacatg

SEQ ID NO: 55639 - DNA, 20 bp, Artificial Sequence
  chemically synthesized
agggatttacagtcacatgc

SEQ ID NO: 55640 - DNA, 20 bp, Artificial Sequence
  chemically synthesized
gatttacagtcacatgcagg

SEQ ID NO: 55641 - DNA, 20 bp, Artificial Sequence
  chemically synthesized
atttacagtcacatgcaggc

SEQ ID NO: 55642 - DNA, 20 bp, Artificial Sequence
  chemically synthesized
tttacagtcacatgcaggca

SEQ ID NO: 55643 - DNA, 20 bp, Artificial Sequence
  chemically synthesized
agtcacatgcaggcagggac

SEQ ID NO: 55644 - DNA, 20 bp, Artificial Sequence
  chemically synthesized
aacccttctttaatgtcatc

SEQ ID NO: 55645 - DNA, 20 bp, Artificial Sequence
  chemically synthesized
acccttctttaatgtcatcc

SEQ ID NO: 55646 - DNA, 20 bp, Artificial Sequence
  chemically synthesized
cccttctttaatgtcatcca

SEQ ID NO: 55647 - DNA, 20 bp, Artificial Sequence
  chemically synthesized
cttctttaatgtcatccagg

SEQ ID NO: 55648 - DNA, 20 bp, Artificial Sequence
  chemically synthesized
ttctttaatgtcatccaggg

SEQ ID NO: 55649 - DNA, 20 bp, Artificial Sequence
  chemically synthesized
tctttaatgtcatccaggga

SEQ ID NO: 55650 - DNA, 20 bp, Artificial Sequence
  chemically synthesized
ctttaatgtcatccagggag

SEQ ID NO: 55651 - DNA, 20 bp, Artificial Sequence
  chemically synthesized
tttaatgtcatccagggagg

SEQ ID NO: 55652 - DNA, 20 bp, Artificial Sequence
  chemically synthesized
atgtcatccagggagggggc

SEQ ID NO: 55653 - DNA, 20 bp, Artificial Sequence
  chemically synthesized
tgtcatccagggagggggcc

SEQ ID NO: 55654 - DNA, 20 bp, Artificial Sequence
  chemically synthesized
gtcatccagggagggggcca

SEQ ID NO: 55655 - DNA, 20 bp, Artificial Sequence
  chemically synthesized
tccagggagggggccaggga

SEQ ID NO: 55656 - DNA, 20 bp, Artificial Sequence
  chemically synthesized
cagggagggggccagggatg

SEQ ID NO: 55657 - DNA, 20 bp, Artificial Sequence
  chemically synthesized
agggagggggccagggatgg

SEQ ID NO: 55658 - DNA, 20 bp, Artificial Sequence
  chemically synthesized
gggagggggccagggatgga

SEQ ID NO: 55659 - DNA, 20 bp, Artificial Sequence
  chemically synthesized
ggagggggccagggatggag

SEQ ID NO: 55660 - DNA, 20 bp, Artificial Sequence
  chemically synthesized
agggggccagggatggaggg

SEQ ID NO: 55661 - DNA, 20 bp, Artificial Sequence
  chemically synthesized
gggggccagggatggagggg

SEQ ID NO: 55662 - DNA, 20 bp, Artificial Sequence
  chemically synthesized
ggggccagggatggagggga

SEQ ID NO: 55663 - DNA, 20 bp, Artificial Sequence
  chemically synthesized
gggccagggatggaggggag

SEQ ID NO: 55664 - DNA, 20 bp, Artificial Sequence
  chemically synthesized
agggatggaggggaggggtt

SEQ ID NO: 55665 - DNA, 20 bp, Artificial Sequence
  chemically synthesized
gggatggaggggaggggttg

SEQ ID NO: 55666 - DNA, 20 bp, Artificial Sequence
  chemically synthesized
gatggaggggaggggttgag

SEQ ID NO: 55667 - DNA, 20 bp, Artificial Sequence
  chemically synthesized
gaggggaggggttgaggagc

SEQ ID NO: 55668 - DNA, 20 bp, Artificial Sequence
  chemically synthesized
ggggaggggttgaggagcga

SEQ ID NO: 55669 - DNA, 20 bp, Artificial Sequence
  chemically synthesized
gggaggggttgaggagcgag

SEQ ID NO: 55670 - DNA, 20 bp, Artificial Sequence
  chemically synthesized
aggggttgaggagcgagagg

SEQ ID NO: 55671 - DNA, 20 bp, Artificial Sequence
  chemically synthesized
gagcgagaggcagttatttt

SEQ ID NO: 55672 - DNA, 20 bp, Artificial Sequence
  chemically synthesized
agcgagaggcagttattttt

SEQ ID NO: 55673 - DNA, 20 bp, Artificial Sequence
  chemically synthesized
gagaggcagttatttttggg

SEQ ID NO: 55674 - DNA, 20 bp, Artificial Sequence
  chemically synthesized
agaggcagttatttttgggt

SEQ ID NO: 55675 - DNA, 20 bp, Artificial Sequence
  chemically synthesized
gattcaccacttttcccatg

SEQ ID NO: 55676 - DNA, 20 bp, Artificial Sequence
  chemically synthesized
ttcaccacttttcccatgaa

SEQ ID NO: 55677 - DNA, 20 bp, Artificial Sequence
  chemically synthesized
tcaccacttttcccatgaag

SEQ ID NO: 55678 - DNA, 20 bp, Artificial Sequence
  chemically synthesized
caccacttttcccatgaaga

SEQ ID NO: 55679 - DNA, 20 bp, Artificial Sequence
  chemically synthesized
accacttttcccatgaagag

SEQ ID NO: 55680 - DNA, 20 bp, Artificial Sequence
  chemically synthesized
cacttttcccatgaagaggg

SEQ ID NO: 55681 - DNA, 20 bp, Artificial Sequence
  chemically synthesized
tcccatgaagaggggagact

SEQ ID NO: 55682 - DNA, 20 bp, Artificial Sequence
  chemically synthesized
tggtattttgttcaatcatt

SEQ ID NO: 55683 - DNA, 20 bp, Artificial Sequence
  chemically synthesized
tattttgttcaatcattaag

SEQ ID NO: 55684 - DNA, 20 bp, Artificial Sequence
  chemically synthesized
gttcaatcattaagaagaca

SEQ ID NO: 55685 - DNA, 20 bp, Artificial Sequence
  chemically synthesized
ttcaatcattaagaagacaa

SEQ ID NO: 55686 - DNA, 20 bp, Artificial Sequence
  chemically synthesized
tcaatcattaagaagacaaa

SEQ ID NO: 55687 - DNA, 20 bp, Artificial Sequence
  chemically synthesized
gggtttgttgaacttgacct

SEQ ID NO: 55688 - DNA, 20 bp, Artificial Sequence
  chemically synthesized
ggtttgttgaacttgacctc

SEQ ID NO: 55689 - DNA, 20 bp, Artificial Sequence
  chemically synthesized
gtttgttgaacttgacctcg

SEQ ID NO: 55690 - DNA, 20 bp, Artificial Sequence
  chemically synthesized
tttgttgaacttgacctcgg

SEQ ID NO: 55691 - DNA, 20 bp, Artificial Sequence
  chemically synthesized
ttgttgaacttgacctcggg

SEQ ID NO: 55692 - DNA, 20 bp, Artificial Sequence
  chemically synthesized
tgttgaacttgacctcgggg

SEQ ID NO: 55693 - DNA, 20 bp, Artificial Sequence
  chemically synthesized
gaacttgacctcggggggga

SEQ ID NO: 55694 - DNA, 20 bp, Artificial Sequence
  chemically synthesized
gacctcgggggggatagaca

SEQ ID NO: 55695 - DNA, 20 bp, Artificial Sequence
  chemically synthesized
acctcgggggggatagacat

SEQ ID NO: 55696 - DNA, 20 bp, Artificial Sequence
  chemically synthesized
gggggggatagacatgggta

SEQ ID NO: 55697 - DNA, 20 bp, Artificial Sequence
  chemically synthesized
gggtatggcctctaaaaaca

SEQ ID NO: 55698 - DNA, 20 bp, Artificial Sequence
  chemically synthesized
ggcctctaaaaacatggccc

SEQ ID NO: 55699 - DNA, 20 bp, Artificial Sequence
  chemically synthesized
ctctaaaaacatggccccag

SEQ ID NO: 55700 - DNA, 20 bp, Artificial Sequence
  chemically synthesized
aaacatggccccagcagctt

SEQ ID NO: 55701 - DNA, 20 bp, Artificial Sequence
  chemically synthesized
ttcagtccctttctcgtcga

SEQ ID NO: 55702 - DNA, 20 bp, Artificial Sequence
  chemically synthesized
gtccctttctcgtcgatggt

SEQ ID NO: 55703 - DNA, 20 bp, Artificial Sequence
  chemically synthesized
tttctcgtcgatggtcagca

SEQ ID NO: 55704 - DNA, 20 bp, Artificial Sequence
  chemically synthesized
ggtcagcacagccttatgca

SEQ ID NO: 55705 - DNA, 20 bp, Artificial Sequence
  chemically synthesized
gcacagccttatgcacggcc

SEQ ID NO: 55706 - DNA, 20 bp, Artificial Sequence
  chemically synthesized
acagccttatgcacggcctg

SEQ ID NO: 55707 - DNA, 20 bp, Artificial Sequence
  chemically synthesized
cagccttatgcacggcctgg

SEQ ID NO: 55708 - DNA, 20 bp, Artificial Sequence
  chemically synthesized
agccttatgcacggcctgga

SEQ ID NO: 55709 - DNA, 20 bp, Artificial Sequence
  chemically synthesized
gccttatgcacggcctggag

SEQ ID NO: 55710 - DNA, 20 bp, Artificial Sequence
  chemically synthesized
cttatgcacggcctggaggg

SEQ ID NO: 55711 - DNA, 20 bp, Artificial Sequence
  chemically synthesized
tatgcacggcctggagggga

SEQ ID NO: 55712 - DNA, 20 bp, Artificial Sequence
  chemically synthesized
gcacggcctggaggggagag

SEQ ID NO: 55713 - DNA, 20 bp, Artificial Sequence
  chemically synthesized
cggcctggaggggagagaag

SEQ ID NO: 55714 - DNA, 20 bp, Artificial Sequence
  chemically synthesized
gcctggaggggagagaagca

SEQ ID NO: 55715 - DNA, 20 bp, Artificial Sequence
  chemically synthesized
gagaagcagagacacgttgt

SEQ ID NO: 55716 - DNA, 20 bp, Artificial Sequence
  chemically synthesized
agaagcagagacacgttgta

SEQ ID NO: 55717 - DNA, 20 bp, Artificial Sequence
  chemically synthesized
acacgttgtaaggctgatcc

SEQ ID NO: 55718 - DNA, 20 bp, Artificial Sequence
  chemically synthesized
cacgttgtaaggctgatccc

SEQ ID NO: 55719 - DNA, 20 bp, Artificial Sequence
  chemically synthesized
taaggctgatcccaggcctc

SEQ ID NO: 55720 - DNA, 20 bp, Artificial Sequence
  chemically synthesized
gctgatcccaggcctcgagc

SEQ ID NO: 55721 - DNA, 20 bp, Artificial Sequence
  chemically synthesized
ctgatcccaggcctcgagca

SEQ ID NO: 55722 - DNA, 20 bp, Artificial Sequence
  chemically synthesized
ggcctcgagcaaggctcacg

SEQ ID NO: 55723 - DNA, 20 bp, Artificial Sequence
  chemically synthesized
aggctcacgtggacacctcc

SEQ ID NO: 55724 - DNA, 20 bp, Artificial Sequence
  chemically synthesized
ggctcacgtggacacctccc

SEQ ID NO: 55725 - DNA, 20 bp, Artificial Sequence
  chemically synthesized
tcacgtggacacctcccagg

SEQ ID NO: 55726 - DNA, 20 bp, Artificial Sequence
  chemically synthesized
caggaagcgctcactccccc

SEQ ID NO: 55727 - DNA, 20 bp, Artificial Sequence
  chemically synthesized
aagcgctcactccccctgga

SEQ ID NO: 55728 - DNA, 20 bp, Artificial Sequence
  chemically synthesized
tcactccccctggacggccc

SEQ ID NO: 55729 - DNA, 20 bp, Artificial Sequence
  chemically synthesized
tcctctccctccctgtcaca

SEQ ID NO: 55730 - DNA, 20 bp, Artificial Sequence
  chemically synthesized
cctctccctccctgtcacat

SEQ ID NO: 55731 - DNA, 20 bp, Artificial Sequence
  chemically synthesized
cataggccttgctcctcctc

SEQ ID NO: 55732 - DNA, 20 bp, Artificial Sequence
  chemically synthesized
ataggccttgctcctcctca

SEQ ID NO: 55733 - DNA, 20 bp, Artificial Sequence
  chemically synthesized
cttgctcctcctcaaggctt

SEQ ID NO: 55734 - DNA, 20 bp, Artificial Sequence
  chemically synthesized
ctcctcaaggctttggctga

SEQ ID NO: 55735 - DNA, 20 bp, Artificial Sequence
  chemically synthesized
tcctcaaggctttggctgat

SEQ ID NO: 55736 - DNA, 20 bp, Artificial Sequence
  chemically synthesized
cctcaaggctttggctgatg

SEQ ID NO: 55737 - DNA, 20 bp, Artificial Sequence
  chemically synthesized
aaggctttggctgatggggc

SEQ ID NO: 55738 - DNA, 20 bp, Artificial Sequence
  chemically synthesized
cctctgtccatcttcctgac

SEQ ID NO: 55739 - DNA, 20 bp, Artificial Sequence
  chemically synthesized
caagcgcctctccccctgct

SEQ ID NO: 55740 - DNA, 20 bp, Artificial Sequence
  chemically synthesized
aagcgcctctccccctgctc

SEQ ID NO: 55741 - DNA, 20 bp, Artificial Sequence
  chemically synthesized
gctcaggtgcacccacaact

SEQ ID NO: 55742 - DNA, 20 bp, Artificial Sequence
  chemically synthesized
ggtgcacccacaactcagaa

SEQ ID NO: 55743 - DNA, 20 bp, Artificial Sequence
  chemically synthesized
gtgcacccacaactcagaac

SEQ ID NO: 55744 - DNA, 20 bp, Artificial Sequence
  chemically synthesized
tgcacccacaactcagaaca

SEQ ID NO: 55745 - DNA, 20 bp, Artificial Sequence
  chemically synthesized
acccacaactcagaacaggg

SEQ ID NO: 55746 - DNA, 20 bp, Artificial Sequence
  chemically synthesized
ccacaactcagaacagggaa

SEQ ID NO: 55747 - DNA, 20 bp, Artificial Sequence
  chemically synthesized
cgtcactccacgtctgcctc

SEQ ID NO: 55748 - DNA, 20 bp, Artificial Sequence
  chemically synthesized
gtcactccacgtctgcctcc

SEQ ID NO: 55749 - DNA, 20 bp, Artificial Sequence
  chemically synthesized
tcactccacgtctgcctcca

SEQ ID NO: 55750 - DNA, 20 bp, Artificial Sequence
  chemically synthesized
ctccagggctctctcctttc

SEQ ID NO: 55751 - DNA, 20 bp, Artificial Sequence
  chemically synthesized
gctctctcctttctagtaca

SEQ ID NO: 55752 - DNA, 20 bp, Artificial Sequence
  chemically synthesized
cctttctagtacacggcttg

SEQ ID NO: 55753 - DNA, 20 bp, Artificial Sequence
  chemically synthesized
tacacggcttgaagctcctt

SEQ ID NO: 55754 - DNA, 20 bp, Artificial Sequence
  chemically synthesized
acacggcttgaagctccttg

SEQ ID NO: 55755 - DNA, 20 bp, Artificial Sequence
  chemically synthesized
cttgaagctccttgaggaca

SEQ ID NO: 55756 - DNA, 20 bp, Artificial Sequence
  chemically synthesized
ctccttgaggacacggaccc

SEQ ID NO: 55757 - DNA, 20 bp, Artificial Sequence
  chemically synthesized
cttgaggacacggaccctgg

SEQ ID NO: 55758 - DNA, 20 bp, Artificial Sequence
  chemically synthesized
gaccctggcagtgaccttca

SEQ ID NO: 55759 - DNA, 20 bp, Artificial Sequence
  chemically synthesized
gcagtgaccttcacagtgcc

SEQ ID NO: 55760 - DNA, 20 bp, Artificial Sequence
  chemically synthesized
cttcacagtgcccagacccc

SEQ ID NO: 55761 - DNA, 20 bp, Artificial Sequence
  chemically synthesized
gcccagaccccaagataatg

SEQ ID NO: 55762 - DNA, 20 bp, Artificial Sequence
  chemically synthesized
caagataatgcagccattca

SEQ ID NO: 55763 - DNA, 20 bp, Artificial Sequence
  chemically synthesized
tgcagccattcatggaactg

SEQ ID NO: 55764 - DNA, 20 bp, Artificial Sequence
  chemically synthesized
atggaactgcagttgttcat

SEQ ID NO: 55765 - DNA, 20 bp, Artificial Sequence
  chemically synthesized
agttgttcattggtcgcctt

SEQ ID NO: 55766 - DNA, 20 bp, Artificial Sequence
  chemically synthesized
cgcctttagttttccaaaat

SEQ ID NO: 55767 - DNA, 20 bp, Artificial Sequence
  chemically synthesized
tccaaaataagtgtcatctt

SEQ ID NO: 55768 - DNA, 20 bp, Artificial Sequence
  chemically synthesized
gctgaaatcattcattaatt

SEQ ID NO: 55769 - DNA, 20 bp, Artificial Sequence
  chemically synthesized
aattcagacaccaaatctca

SEQ ID NO: 55770 - DNA, 20 bp, Artificial Sequence
  chemically synthesized
acaccaaatctcacagatcg

SEQ ID NO: 55771 - DNA, 20 bp, Artificial Sequence
  chemically synthesized
caccaaatctcacagatcga

SEQ ID NO: 55772 - DNA, 20 bp, Artificial Sequence
  chemically synthesized
ccaaatctcacagatcgaag

SEQ ID NO: 55773 - DNA, 20 bp, Artificial Sequence
  chemically synthesized
atctcacagatcgaaggagt

SEQ ID NO: 55774 - DNA, 20 bp, Artificial Sequence
  chemically synthesized
gaaattcctttgaaacaact

SEQ ID NO: 55775 - DNA, 20 bp, Artificial Sequence
  chemically synthesized
tagcccaaacctttctgtgt

SEQ ID NO: 55776 - DNA, 20 bp, Artificial Sequence
  chemically synthesized
caaacctttctgtgtcagta

SEQ ID NO: 55777 - DNA, 20 bp, Artificial Sequence
  chemically synthesized
tgtgtcagtatggataaatc

SEQ ID NO: 55778 - DNA, 20 bp, Artificial Sequence
  chemically synthesized
gtgtcagtatggataaatca

SEQ ID NO: 55779 - DNA, 20 bp, Artificial Sequence
  chemically synthesized
ataaatcaaggcccaatgtc

SEQ ID NO: 55780 - DNA, 20 bp, Artificial Sequence
  chemically synthesized
aatcaaggcccaatgtctag

SEQ ID NO: 55781 - DNA, 20 bp, Artificial Sequence
  chemically synthesized
atcaaggcccaatgtctaga

SEQ ID NO: 55782 - DNA, 20 bp, Artificial Sequence
  chemically synthesized
gcccaatgtctagaaggtct

SEQ ID NO: 55783 - DNA, 20 bp, Artificial Sequence
  chemically synthesized
cccaatgtctagaaggtctt

SEQ ID NO: 55784 - DNA, 20 bp, Artificial Sequence
  chemically synthesized
tgtctagaaggtcttgggca

SEQ ID NO: 55785 - DNA, 20 bp, Artificial Sequence
  chemically synthesized
tcttgggcaaagttgaaatt

SEQ ID NO: 55786 - DNA, 20 bp, Artificial Sequence
  chemically synthesized
cttgggcaaagttgaaattc

SEQ ID NO: 55787 - DNA, 20 bp, Artificial Sequence
  chemically synthesized
ttgggcaaagttgaaattca

SEQ ID NO: 55788 - DNA, 20 bp, Artificial Sequence
  chemically synthesized
gcaaagttgaaattcagggt

SEQ ID NO: 55789 - DNA, 20 bp, Artificial Sequence
  chemically synthesized
agggtcagtgacacaacctc

SEQ ID NO: 55790 - DNA, 20 bp, Artificial Sequence
  chemically synthesized
gggtcagtgacacaacctca

SEQ ID NO: 55791 - DNA, 20 bp, Artificial Sequence
  chemically synthesized
ggtcagtgacacaacctcaa

SEQ ID NO: 55792 - DNA, 20 bp, Artificial Sequence
  chemically synthesized
tcagtgacacaacctcaagg

SEQ ID NO: 55793 - DNA, 20 bp, Artificial Sequence
  chemically synthesized
cagtgacacaacctcaaggg

SEQ ID NO: 55794 - DNA, 20 bp, Artificial Sequence
  chemically synthesized
aacctcaagggaggccccga

SEQ ID NO: 55795 - DNA, 20 bp, Artificial Sequence
  chemically synthesized
aagggaggccccgaaagtgc

SEQ ID NO: 55796 - DNA, 20 bp, Artificial Sequence
  chemically synthesized
ccccgaaagtgccagctgca

SEQ ID NO: 55797 - DNA, 20 bp, Artificial Sequence
  chemically synthesized
cgaaagtgccagctgcacag

SEQ ID NO: 55798 - DNA, 20 bp, Artificial Sequence
  chemically synthesized
ctgcacagcagtcccctgcc

SEQ ID NO: 55799 - DNA, 20 bp, Artificial Sequence
  chemically synthesized
tgtttgaccacgtcccgtgt

SEQ ID NO: 55800 - DNA, 20 bp, Artificial Sequence
  chemically synthesized
cgtcccgtgtcagtgaatca

SEQ ID NO: 55801 - DNA, 20 bp, Artificial Sequence
  chemically synthesized
gtcccgtgtcagtgaatcac

SEQ ID NO: 55802 - DNA, 20 bp, Artificial Sequence
  chemically synthesized
cagtgaatcacgggcatctt

SEQ ID NO: 55803 - DNA, 20 bp, Artificial Sequence
  chemically synthesized
agtgaatcacgggcatcttc

SEQ ID NO: 55804 - DNA, 20 bp, Artificial Sequence
  chemically synthesized
tgaatcacgggcatcttcag

SEQ ID NO: 55805 - DNA, 20 bp, Artificial Sequence
  chemically synthesized
cacgggcatcttcaggagct

SEQ ID NO: 55806 - DNA, 20 bp, Artificial Sequence
  chemically synthesized
gcatcttcaggagctcagcc

SEQ ID NO: 55807 - DNA, 20 bp, Artificial Sequence
  chemically synthesized
catcttcaggagctcagcct

SEQ ID NO: 55808 - DNA, 20 bp, Artificial Sequence
  chemically synthesized
gggtcttcatttgtttccct

SEQ ID NO: 55809 - DNA, 20 bp, Artificial Sequence
  chemically synthesized
gtttccctcggccccttcct

SEQ ID NO: 55810 - DNA, 20 bp, Artificial Sequence
  chemically synthesized
ctcggccccttcctcagcct

SEQ ID NO: 55811 - DNA, 20 bp, Artificial Sequence
  chemically synthesized
tcggccccttcctcagcctc

SEQ ID NO: 55812 - DNA, 20 bp, Artificial Sequence
  chemically synthesized
ccccttcctcagcctcagga

SEQ ID NO: 55813 - DNA, 20 bp, Artificial Sequence
  chemically synthesized
ccttcctcagcctcaggaca

SEQ ID NO: 55814 - DNA, 20 bp, Artificial Sequence
  chemically synthesized
tcagcctcaggacagagctg

SEQ ID NO: 55815 - DNA, 20 bp, Artificial Sequence
  chemically synthesized
cccccacacattcttcccta

SEQ ID NO: 55816 - DNA, 20 bp, Artificial Sequence
  chemically synthesized
acattcttccctacagatac

SEQ ID NO: 55817 - DNA, 20 bp, Artificial Sequence
  chemically synthesized
cattcttccctacagatacc

SEQ ID NO: 55818 - DNA, 20 bp, Artificial Sequence
  chemically synthesized
attcttccctacagatacca

SEQ ID NO: 55819 - DNA, 20 bp, Artificial Sequence
  chemically synthesized
tacagataccagggtgcaac

SEQ ID NO: 55820 - DNA, 20 bp, Artificial Sequence
  chemically synthesized
acagataccagggtgcaaca

SEQ ID NO: 55821 - DNA, 20 bp, Artificial Sequence
  chemically synthesized
ccagggtgcaacaaggtcgt

SEQ ID NO: 55822 - DNA, 20 bp, Artificial Sequence
  chemically synthesized
cagggtgcaacaaggtcgtc

SEQ ID NO: 55823 - DNA, 20 bp, Artificial Sequence
  chemically synthesized
agggtgcaacaaggtcgtca

SEQ ID NO: 55824 - DNA, 20 bp, Artificial Sequence
  chemically synthesized
tcgtcagggtgatctcacct

SEQ ID NO: 55825 - DNA, 20 bp, Artificial Sequence
  chemically synthesized
gtcagggtgatctcaccttg

SEQ ID NO: 55826 - DNA, 20 bp, Artificial Sequence
  chemically synthesized
cagggtgatctcaccttgga

SEQ ID NO: 55827 - DNA, 20 bp, Artificial Sequence
  chemically synthesized
gatctcaccttggagagctt

SEQ ID NO: 55828 - DNA, 20 bp, Artificial Sequence
  chemically synthesized
atctcaccttggagagcttc

SEQ ID NO: 55829 - DNA, 20 bp, Artificial Sequence
  chemically synthesized
tctcaccttggagagcttca

SEQ ID NO: 55830 - DNA, 20 bp, Artificial Sequence
  chemically synthesized
ctcaccttggagagcttcag

SEQ ID NO: 55831 - DNA, 20 bp, Artificial Sequence
  chemically synthesized
gggtgcctcctctgtgaccc

SEQ ID NO: 55832 - DNA, 20 bp, Artificial Sequence
  chemically synthesized
gtgcctcctctgtgaccccg

SEQ ID NO: 55833 - DNA, 20 bp, Artificial Sequence
  chemically synthesized
gcctcctctgtgaccccgga

SEQ ID NO: 55834 - DNA, 20 bp, Artificial Sequence
  chemically synthesized
cctcctctgtgaccccggag

SEQ ID NO: 55835 - DNA, 20 bp, Artificial Sequence
  chemically synthesized
ctctgtgaccccggagaggt

SEQ ID NO: 55836 - DNA, 20 bp, Artificial Sequence
  chemically synthesized
agaggtcagccccattgctg

SEQ ID NO: 55837 - DNA, 20 bp, Artificial Sequence
  chemically synthesized
agccccattgctgaagacct

SEQ ID NO: 55838 - DNA, 20 bp, Artificial Sequence
  chemically synthesized
ctgaagaccttagtgatgcc

SEQ ID NO: 55839 - DNA, 20 bp, Artificial Sequence
  chemically synthesized
ttagtgatgcccagttgacc

SEQ ID NO: 55840 - DNA, 20 bp, Artificial Sequence
  chemically synthesized
tagtgatgcccagttgaccc

SEQ ID NO: 55841 - DNA, 20 bp, Artificial Sequence
  chemically synthesized
agttgacccaggacgctctt

SEQ ID NO: 55842 - DNA, 20 bp, Artificial Sequence
  chemically synthesized
ccaggacgctcttcagatca

SEQ ID NO: 55843 - DNA, 20 bp, Artificial Sequence
  chemically synthesized
caggacgctcttcagatcat

SEQ ID NO: 55844 - DNA, 20 bp, Artificial Sequence
  chemically synthesized
gctcttcagatcataggttc

SEQ ID NO: 55845 - DNA, 20 bp, Artificial Sequence
  chemically synthesized
cagatcataggttccagtaa

SEQ ID NO: 55846 - DNA, 20 bp, Artificial Sequence
  chemically synthesized
tcataggttccagtaatgga

SEQ ID NO: 55847 - DNA, 20 bp, Artificial Sequence
  chemically synthesized
ggttccagtaatggacagtt

SEQ ID NO: 55848 - DNA, 20 bp, Artificial Sequence
  chemically synthesized
gttccagtaatggacagttt

SEQ ID NO: 55849 - DNA, 20 bp, Artificial Sequence
  chemically synthesized
tggacagtttgggtaaatgt

SEQ ID NO: 55850 - DNA, 20 bp, Artificial Sequence
  chemically synthesized
cagtttgggtaaatgtaagc

SEQ ID NO: 55851 - DNA, 20 bp, Artificial Sequence
  chemically synthesized
tttgggtaaatgtaagctgg

SEQ ID NO: 55852 - DNA, 20 bp, Artificial Sequence
  chemically synthesized
aagctggcagacctgtcgtg

SEQ ID NO: 55853 - DNA, 20 bp, Artificial Sequence
  chemically synthesized
ggcagacctgtcgtgcagaa

SEQ ID NO: 55854 - DNA, 20 bp, Artificial Sequence
  chemically synthesized
gtcgtgcagaaaagaaattc

SEQ ID NO: 55855 - DNA, 20 bp, Artificial Sequence
  chemically synthesized
tcgtgcagaaaagaaattca

SEQ ID NO: 55856 - DNA, 20 bp, Artificial Sequence
  chemically synthesized
cagaaaagaaattcaaggca

SEQ ID NO: 55857 - DNA, 20 bp, Artificial Sequence
  chemically synthesized
aagaaattcaaggcatggca

SEQ ID NO: 55858 - DNA, 20 bp, Artificial Sequence
  chemically synthesized
cagcattcctcttgttcttc

SEQ ID NO: 55859 - DNA, 20 bp, Artificial Sequence
  chemically synthesized
agcattcctcttgttcttct

SEQ ID NO: 55860 - DNA, 20 bp, Artificial Sequence
  chemically synthesized
tgttcttctgggacccacca

SEQ ID NO: 55861 - DNA, 20 bp, Artificial Sequence
  chemically synthesized
tctgggacccaccacagtgc

SEQ ID NO: 55862 - DNA, 20 bp, Artificial Sequence
  chemically synthesized
ctgtgtcctccacccacact

SEQ ID NO: 55863 - DNA, 20 bp, Artificial Sequence
  chemically synthesized
gtcctccacccacactaaga

SEQ ID NO: 55864 - DNA, 20 bp, Artificial Sequence
  chemically synthesized
tcctccacccacactaagat

SEQ ID NO: 55865 - DNA, 20 bp, Artificial Sequence
  chemically synthesized
cccacactaagatgggaact

SEQ ID NO: 55866 - DNA, 20 bp, Artificial Sequence
  chemically synthesized
ctaagatgggaactcggctt

SEQ ID NO: 55867 - DNA, 20 bp, Artificial Sequence
  chemically synthesized
gctttggtttgttctacttt

SEQ ID NO: 55868 - DNA, 20 bp, Artificial Sequence
  chemically synthesized
acttttagctcttctacatt

SEQ ID NO: 55869 - DNA, 20 bp, Artificial Sequence
  chemically synthesized
agctcttctacattgagtca

SEQ ID NO: 55870 - DNA, 20 bp, Artificial Sequence
  chemically synthesized
taacatcgaatgaatcacaa

SEQ ID NO: 55871 - DNA, 20 bp, Artificial Sequence
  chemically synthesized
tgccacctcctctgatattc

SEQ ID NO: 55872 - DNA, 20 bp, Artificial Sequence
  chemically synthesized
gccacctcctctgatattct

SEQ ID NO: 55873 - DNA, 20 bp, Artificial Sequence
  chemically synthesized
ctctgatattctaggtgtcc

SEQ ID NO: 55874 - DNA, 20 bp, Artificial Sequence
  chemically synthesized
tgatattctaggtgtcctgg

SEQ ID NO: 55875 - DNA, 20 bp, Artificial Sequence
  chemically synthesized
gcctgtctcatcttgccctg

SEQ ID NO: 55876 - DNA, 20 bp, Artificial Sequence
  chemically synthesized
ctcatcttgccctgtagtgt

SEQ ID NO: 55877 - DNA, 20 bp, Artificial Sequence
  chemically synthesized
tcatcttgccctgtagtgtt

SEQ ID NO: 55878 - DNA, 20 bp, Artificial Sequence
  chemically synthesized
ccctgtagtgttgggtcacc

SEQ ID NO: 55879 - DNA, 20 bp, Artificial Sequence
  chemically synthesized
gtgttgggtcacctggcccc

SEQ ID NO: 55880 - DNA, 20 bp, Artificial Sequence
  chemically synthesized
cccccagcctgtaacatccc

SEQ ID NO: 55881 - DNA, 20 bp, Artificial Sequence
  chemically synthesized
ccccagcctgtaacatcccc

SEQ ID NO: 55882 - DNA, 20 bp, Artificial Sequence
  chemically synthesized
cccagcctgtaacatcccca

SEQ ID NO: 55883 - DNA, 20 bp, Artificial Sequence
  chemically synthesized
catccccagggccctacacc

SEQ ID NO: 55884 - DNA, 20 bp, Artificial Sequence
  chemically synthesized
tccccagggccctacaccca

SEQ ID NO: 55885 - DNA, 20 bp, Artificial Sequence
  chemically synthesized
gccctacacccagagaaaca

SEQ ID NO: 55886 - DNA, 20 bp, Artificial Sequence
  chemically synthesized
ccctacacccagagaaacac

SEQ ID NO: 55887 - DNA, 20 bp, Artificial Sequence
  chemically synthesized
cctacacccagagaaacacg

SEQ ID NO: 55888 - DNA, 20 bp, Artificial Sequence
  chemically synthesized
cacccagagaaacacggggc

SEQ ID NO: 55889 - DNA, 20 bp, Artificial Sequence
  chemically synthesized
ccagagaaacacggggctgg

SEQ ID NO: 55890 - DNA, 20 bp, Artificial Sequence
  chemically synthesized
gagaaacacggggctggtgg

SEQ ID NO: 55891 - DNA, 20 bp, Artificial Sequence
  chemically synthesized
acggggctggtggcagtgcc

SEQ ID NO: 55892 - DNA, 20 bp, Artificial Sequence
  chemically synthesized
agtgcccagtgacaaccgtt

SEQ ID NO: 55893 - DNA, 20 bp, Artificial Sequence
  chemically synthesized
gcccagtgacaaccgtttag

SEQ ID NO: 55894 - DNA, 20 bp, Artificial Sequence
  chemically synthesized
gtgacaaccgtttagtggat

SEQ ID NO: 55895 - DNA, 20 bp, Artificial Sequence
  chemically synthesized
gacaaccgtttagtggataa

SEQ ID NO: 55896 - DNA, 20 bp, Artificial Sequence
  chemically synthesized
aaccgtttagtggataagag

SEQ ID NO: 55897 - DNA, 20 bp, Artificial Sequence
  chemically synthesized
ccgtttagtggataagagaa

SEQ ID NO: 55898 - DNA, 20 bp, Artificial Sequence
  chemically synthesized
taagagaagagtgaccacac

SEQ ID NO: 55899 - DNA, 20 bp, Artificial Sequence
  chemically synthesized
aagagaagagtgaccacacc

SEQ ID NO: 55900 - DNA, 20 bp, Artificial Sequence
  chemically synthesized
aagagtgaccacaccaggct

SEQ ID NO: 55901 - DNA, 20 bp, Artificial Sequence
  chemically synthesized
ccaggctgagtgctcctctc

SEQ ID NO: 55902 - DNA, 20 bp, Artificial Sequence
  chemically synthesized
tgctcctctctggttttcca

SEQ ID NO: 55903 - DNA, 20 bp, Artificial Sequence
  chemically synthesized
gctcctctctggttttccat

SEQ ID NO: 55904 - DNA, 20 bp, Artificial Sequence
  chemically synthesized
ctcctctctggttttccatg

SEQ ID NO: 55905 - DNA, 20 bp, Artificial Sequence
  chemically synthesized
cctctctggttttccatggg

SEQ ID NO: 55906 - DNA, 20 bp, Artificial Sequence
  chemically synthesized
tggggagacaatgccaccct

SEQ ID NO: 55907 - DNA, 20 bp, Artificial Sequence
  chemically synthesized
ggagacaatgccaccctgag

SEQ ID NO: 55908 - DNA, 20 bp, Artificial Sequence
  chemically synthesized
gagacaatgccaccctgagc

SEQ ID NO: 55909 - DNA, 20 bp, Artificial Sequence
  chemically synthesized
agacaatgccaccctgagca

SEQ ID NO: 55910 - DNA, 20 bp, Artificial Sequence
  chemically synthesized
atgccaccctgagcagggtc

SEQ ID NO: 55911 - DNA, 20 bp, Artificial Sequence
  chemically synthesized
ccctgagcagggtctggtgt

SEQ ID NO: 55912 - DNA, 20 bp, Artificial Sequence
  chemically synthesized
tgagcagggtctggtgtgag

SEQ ID NO: 55913 - DNA, 20 bp, Artificial Sequence
  chemically synthesized
gagcagggtctggtgtgagc

SEQ ID NO: 55914 - DNA, 20 bp, Artificial Sequence
  chemically synthesized
cagggtctggtgtgagcggg

SEQ ID NO: 55915 - DNA, 20 bp, Artificial Sequence
  chemically synthesized
tctggtgtgagcgggcagct

SEQ ID NO: 55916 - DNA, 20 bp, Artificial Sequence
  chemically synthesized
gtgagcgggcagcttggctc

SEQ ID NO: 55917 - DNA, 20 bp, Artificial Sequence
  chemically synthesized
tgagcgggcagcttggctct

SEQ ID NO: 55918 - DNA, 20 bp, Artificial Sequence
  chemically synthesized
tctctgatccgttaccctct

SEQ ID NO: 55919 - DNA, 20 bp, Artificial Sequence
  chemically synthesized
ctttgttctttctcaacccc

SEQ ID NO: 55920 - DNA, 20 bp, Artificial Sequence
  chemically synthesized
ttgttctttctcaacccctg

SEQ ID NO: 55921 - DNA, 20 bp, Artificial Sequence
  chemically synthesized
ttctttctcaacccctggag

SEQ ID NO: 55922 - DNA, 20 bp, Artificial Sequence
  chemically synthesized
ctttctcaacccctggagca

SEQ ID NO: 55923 - DNA, 20 bp, Artificial Sequence
  chemically synthesized
aacccctggagcagagacct

SEQ ID NO: 55924 - DNA, 20 bp, Artificial Sequence
  chemically synthesized
acccctggagcagagacctc

SEQ ID NO: 55925 - DNA, 20 bp, Artificial Sequence
  chemically synthesized
ccctggagcagagacctcag

SEQ ID NO: 55926 - DNA, 20 bp, Artificial Sequence
  chemically synthesized
cctggagcagagacctcagg

SEQ ID NO: 55927 - DNA, 20 bp, Artificial Sequence
  chemically synthesized
gcagagacctcaggaggtgc

SEQ ID NO: 55928 - DNA, 20 bp, Artificial Sequence
  chemically synthesized
gacctcaggaggtgctggca

SEQ ID NO: 55929 - DNA, 20 bp, Artificial Sequence
  chemically synthesized
caggaggtgctggcatggaa

SEQ ID NO: 55930 - DNA, 20 bp, Artificial Sequence
  chemically synthesized
ggaggtgctggcatggaaca

SEQ ID NO: 55931 - DNA, 20 bp, Artificial Sequence
  chemically synthesized
ggcatggaacagagaaattc

SEQ ID NO: 55932 - DNA, 20 bp, Artificial Sequence
  chemically synthesized
caccttttgtattttcatct

SEQ ID NO: 55933 - DNA, 20 bp, Artificial Sequence
  chemically synthesized
gtattttcatcttggtttta

SEQ ID NO: 55934 - DNA, 20 bp, Artificial Sequence
  chemically synthesized
ttacagtgtacaaaacgaac

SEQ ID NO: 55935 - DNA, 20 bp, Artificial Sequence
  chemically synthesized
gtgtacaaaacgaactagat

SEQ ID NO: 55936 - DNA, 20 bp, Artificial Sequence
  chemically synthesized
tacaaaacgaactagatcag

SEQ ID NO: 55937 - DNA, 20 bp, Artificial Sequence
  chemically synthesized
acaaaacgaactagatcagc

SEQ ID NO: 55938 - DNA, 20 bp, Artificial Sequence
  chemically synthesized
caaaacgaactagatcagca

SEQ ID NO: 55939 - DNA, 20 bp, Artificial Sequence
  chemically synthesized
cgaactagatcagcagggca

SEQ ID NO: 55940 - DNA, 20 bp, Artificial Sequence
  chemically synthesized
gaactagatcagcagggcat

SEQ ID NO: 55941 - DNA, 20 bp, Artificial Sequence
  chemically synthesized
cacacacatacactaatgtg

SEQ ID NO: 55942 - DNA, 20 bp, Artificial Sequence
  chemically synthesized
ctaatgtgtggctcatgttt

SEQ ID NO: 55943 - DNA, 20 bp, Artificial Sequence
  chemically synthesized
tgtttaagtatcacttacta

SEQ ID NO: 55944 - DNA, 20 bp, Artificial Sequence
  chemically synthesized
gtttaagtatcacttactac

SEQ ID NO: 55945 - DNA, 20 bp, Artificial Sequence
  chemically synthesized
ctacaggacacccaatctaa

SEQ ID NO: 55946 - DNA, 20 bp, Artificial Sequence
  chemically synthesized
ccaatctaacagcaccgata

SEQ ID NO: 55947 - DNA, 20 bp, Artificial Sequence
  chemically synthesized
taacagcaccgataaagtga

SEQ ID NO: 55948 - DNA, 20 bp, Artificial Sequence
  chemically synthesized
acagcaccgataaagtgaca

SEQ ID NO: 55949 - DNA, 20 bp, Artificial Sequence
  chemically synthesized
ataaagtgacagagaaacgc

SEQ ID NO: 55950 - DNA, 20 bp, Artificial Sequence
  chemically synthesized
acgcaagccttctgcgaaca

SEQ ID NO: 55951 - DNA, 20 bp, Artificial Sequence
  chemically synthesized
agccttctgcgaacatggcc

SEQ ID NO: 55952 - DNA, 20 bp, Artificial Sequence
  chemically synthesized
aattccgaaccttgcttttc

SEQ ID NO: 55953 - DNA, 20 bp, Artificial Sequence
  chemically synthesized
attccgaaccttgcttttct

SEQ ID NO: 55954 - DNA, 20 bp, Artificial Sequence
  chemically synthesized
cttttctgggccttgccaca

SEQ ID NO: 55955 - DNA, 20 bp, Artificial Sequence
  chemically synthesized
ttttctgggccttgccacac

SEQ ID NO: 55956 - DNA, 20 bp, Artificial Sequence
  chemically synthesized
aggctcttcccccgtccccc

SEQ ID NO: 55957 - DNA, 20 bp, Artificial Sequence
  chemically synthesized
ggctcttcccccgtcccccc

SEQ ID NO: 55958 - DNA, 20 bp, Artificial Sequence
  chemically synthesized
gctcttcccccgtcccccca

SEQ ID NO: 55959 - DNA, 20 bp, Artificial Sequence
  chemically synthesized
cactccactgctgcctttgc

SEQ ID NO: 55960 - DNA, 20 bp, Artificial Sequence
  chemically synthesized
actccactgctgcctttgcc

SEQ ID NO: 55961 - DNA, 20 bp, Artificial Sequence
  chemically synthesized
ccactgctgcctttgccagg

SEQ ID NO: 55962 - DNA, 20 bp, Artificial Sequence
  chemically synthesized
gaagcccatctgttcctttt

SEQ ID NO: 55963 - DNA, 20 bp, Artificial Sequence
  chemically synthesized
ctgttcctttttggttctgc

SEQ ID NO: 55964 - DNA, 20 bp, Artificial Sequence
  chemically synthesized
tttggttctgccagaacgtg

SEQ ID NO: 55965 - DNA, 20 bp, Artificial Sequence
  chemically synthesized
ggttctgccagaacgtgtgg

SEQ ID NO: 55966 - DNA, 20 bp, Artificial Sequence
  chemically synthesized
tggtgctgctgtccctgccc

SEQ ID NO: 55967 - DNA, 20 bp, Artificial Sequence
  chemically synthesized
ggtgctgctgtccctgccct

SEQ ID NO: 55968 - DNA, 20 bp, Artificial Sequence
  chemically synthesized
gctgtccctgccctgggcac

SEQ ID NO: 55969 - DNA, 20 bp, Artificial Sequence
  chemically synthesized
ctgccctgggcactggatat

SEQ ID NO: 55970 - DNA, 20 bp, Artificial Sequence
  chemically synthesized
tgccctgggcactggatatt

SEQ ID NO: 55971 - DNA, 20 bp, Artificial Sequence
  chemically synthesized
cctgggcactggatattggg

SEQ ID NO: 55972 - DNA, 20 bp, Artificial Sequence
  chemically synthesized
ctgggcactggatattggga

SEQ ID NO: 55973 - DNA, 20 bp, Artificial Sequence
  chemically synthesized
tgggcactggatattgggaa

SEQ ID NO: 55974 - DNA, 20 bp, Artificial Sequence
  chemically synthesized
cactggatattgggaaggga

SEQ ID NO: 55975 - DNA, 20 bp, Artificial Sequence
  chemically synthesized
ggaagggacagtgtccacac

SEQ ID NO: 55976 - DNA, 20 bp, Artificial Sequence
  chemically synthesized
aagggacagtgtccacactg

SEQ ID NO: 55977 - DNA, 20 bp, Artificial Sequence
  chemically synthesized
ggacagtgtccacactggag

SEQ ID NO: 55978 - DNA, 20 bp, Artificial Sequence
  chemically synthesized
gacagtgtccacactggagt

SEQ ID NO: 55979 - DNA, 20 bp, Artificial Sequence
  chemically synthesized
agtgtccacactggagtggg

SEQ ID NO: 55980 - DNA, 20 bp, Artificial Sequence
  chemically synthesized
acactggagtgggaagtccc

SEQ ID NO: 55981 - DNA, 20 bp, Artificial Sequence
  chemically synthesized
cactggagtgggaagtcccc

SEQ ID NO: 55982 - DNA, 20 bp, Artificial Sequence
  chemically synthesized
actggagtgggaagtcccca

SEQ ID NO: 55983 - DNA, 20 bp, Artificial Sequence
  chemically synthesized
agtgggaagtccccagggac

SEQ ID NO: 55984 - DNA, 20 bp, Artificial Sequence
  chemically synthesized
gacctttacctcctcacccc

SEQ ID NO: 55985 - DNA, 20 bp, Artificial Sequence
  chemically synthesized
acctttacctcctcacccct

SEQ ID NO: 55986 - DNA, 20 bp, Artificial Sequence
  chemically synthesized
cctgggtactgtcctcctca

SEQ ID NO: 55987 - DNA, 20 bp, Artificial Sequence
  chemically synthesized
tgggtactgtcctcctcatg

SEQ ID NO: 55988 - DNA, 20 bp, Artificial Sequence
  chemically synthesized
actgtcctcctcatggagca

SEQ ID NO: 55989 - DNA, 20 bp, Artificial Sequence
  chemically synthesized
tcctcctcatggagcatgga

SEQ ID NO: 55990 - DNA, 20 bp, Artificial Sequence
  chemically synthesized
tggatggcgctgcctgaact

SEQ ID NO: 55991 - DNA, 20 bp, Artificial Sequence
  chemically synthesized
atggcgctgcctgaactcag

SEQ ID NO: 55992 - DNA, 20 bp, Artificial Sequence
  chemically synthesized
gcgctgcctgaactcagtgg

SEQ ID NO: 55993 - DNA, 20 bp, Artificial Sequence
  chemically synthesized
actcagtggtggcctcattc

SEQ ID NO: 55994 - DNA, 20 bp, Artificial Sequence
  chemically synthesized
cagtggtggcctcattctgg

SEQ ID NO: 55995 - DNA, 20 bp, Artificial Sequence
  chemically synthesized
gtggcctcattctggaagcc

SEQ ID NO: 55996 - DNA, 20 bp, Artificial Sequence
  chemically synthesized
ttctggaagccaagtttata

SEQ ID NO: 55997 - DNA, 20 bp, Artificial Sequence
  chemically synthesized
ctggaagccaagtttataca

SEQ ID NO: 55998 - DNA, 20 bp, Artificial Sequence
  chemically synthesized
gaagccaagtttatacagag

SEQ ID NO: 55999 - DNA, 20 bp, Artificial Sequence
  chemically synthesized
gccaagtttatacagagtag

SEQ ID NO: 56000 - DNA, 20 bp, Artificial Sequence
  chemically synthesized
tatacagagtagcagtgacc

SEQ ID NO: 56001 - DNA, 20 bp, Artificial Sequence
  chemically synthesized
atacagagtagcagtgaccc

SEQ ID NO: 56002 - DNA, 20 bp, Artificial Sequence
  chemically synthesized
tacagagtagcagtgaccca

SEQ ID NO: 56003 - DNA, 20 bp, Artificial Sequence
  chemically synthesized
gtagcagtgacccagggatg

SEQ ID NO: 56004 - DNA, 20 bp, Artificial Sequence
  chemically synthesized
tagcagtgacccagggatgt

SEQ ID NO: 56005 - DNA, 20 bp, Artificial Sequence
  chemically synthesized
agcagtgacccagggatgtg

SEQ ID NO: 56006 - DNA, 20 bp, Artificial Sequence
  chemically synthesized
gatgtggggttcaccctcct

SEQ ID NO: 56007 - DNA, 20 bp, Artificial Sequence
  chemically synthesized
gttcaccctcctcagccctc

SEQ ID NO: 56008 - DNA, 20 bp, Artificial Sequence
  chemically synthesized
accctcctcagccctctggc

SEQ ID NO: 56009 - DNA, 20 bp, Artificial Sequence
  chemically synthesized
agccctctggccagtcctga

SEQ ID NO: 56010 - DNA, 20 bp, Artificial Sequence
  chemically synthesized
gccctctggccagtcctgat

SEQ ID NO: 56011 - DNA, 20 bp, Artificial Sequence
  chemically synthesized
tggccagtcctgatgggcct

SEQ ID NO: 56012 - DNA, 20 bp, Artificial Sequence
  chemically synthesized
gatgggcctcagtcccaaca

SEQ ID NO: 56013 - DNA, 20 bp, Artificial Sequence
  chemically synthesized
gcctcagtcccaacatggct

SEQ ID NO: 56014 - DNA, 20 bp, Artificial Sequence
  chemically synthesized
ctcagtcccaacatggctaa

SEQ ID NO: 56015 - DNA, 20 bp, Artificial Sequence
  chemically synthesized
tcagtcccaacatggctaag

SEQ ID NO: 56016 - DNA, 20 bp, Artificial Sequence
  chemically synthesized
cccaacatggctaagaggtg

SEQ ID NO: 56017 - DNA, 20 bp, Artificial Sequence
  chemically synthesized
ccaacatggctaagaggtgt

SEQ ID NO: 56018 - DNA, 20 bp, Artificial Sequence
  chemically synthesized
acatggctaagaggtgtggg

SEQ ID NO: 56019 - DNA, 20 bp, Artificial Sequence
  chemically synthesized
aagaggtgtgggcagcttct

SEQ ID NO: 56020 - DNA, 20 bp, Artificial Sequence
  chemically synthesized
ggcagcttcttggtcaccct

SEQ ID NO: 56021 - DNA, 20 bp, Artificial Sequence
  chemically synthesized
gcagcttcttggtcaccctc

SEQ ID NO: 56022 - DNA, 20 bp, Artificial Sequence
  chemically synthesized
cttcttggtcaccctcaggt

SEQ ID NO: 56023 - DNA, 20 bp, Artificial Sequence
  chemically synthesized
ttcttggtcaccctcaggtt

SEQ ID NO: 56024 - DNA, 20 bp, Artificial Sequence
  chemically synthesized
tcttggtcaccctcaggttg

SEQ ID NO: 56025 - DNA, 20 bp, Artificial Sequence
  chemically synthesized
caccttctgtcttcattttc

SEQ ID NO: 56026 - DNA, 20 bp, Artificial Sequence
  chemically synthesized
accttctgtcttcattttcc

SEQ ID NO: 56027 - DNA, 20 bp, Artificial Sequence
  chemically synthesized
gtcttcattttccaggaact

SEQ ID NO: 56028 - DNA, 20 bp, Artificial Sequence
  chemically synthesized
ggaacttggtgatgatatcg

SEQ ID NO: 56029 - DNA, 20 bp, Artificial Sequence
  chemically synthesized
gaacttggtgatgatatcgt

SEQ ID NO: 56030 - DNA, 20 bp, Artificial Sequence
  chemically synthesized
ttggtgatgatatcgtgggt

SEQ ID NO: 56031 - DNA, 20 bp, Artificial Sequence
  chemically synthesized
tcgtgggtgagttcattttc

SEQ ID NO: 56032 - DNA, 20 bp, Artificial Sequence
  chemically synthesized
cgtgggtgagttcattttcc

SEQ ID NO: 56033 - DNA, 20 bp, Artificial Sequence
  chemically synthesized
agttcattttccaggtgctg

SEQ ID NO: 56034 - DNA, 20 bp, Artificial Sequence
  chemically synthesized
gtgctgtagtttcccctcat

SEQ ID NO: 56035 - DNA, 20 bp, Artificial Sequence
  chemically synthesized
tgctgtagtttcccctcatc

SEQ ID NO: 56036 - DNA, 20 bp, Artificial Sequence
  chemically synthesized
tgtagtttcccctcatcagg

SEQ ID NO: 56037 - DNA, 20 bp, Artificial Sequence
  chemically synthesized
gtagtttcccctcatcaggc

SEQ ID NO: 56038 - DNA, 20 bp, Artificial Sequence
  chemically synthesized
gtttcccctcatcaggcagg

SEQ ID NO: 56039 - DNA, 20 bp, Artificial Sequence
  chemically synthesized
tcccctcatcaggcaggaag

SEQ ID NO: 56040 - DNA, 20 bp, Artificial Sequence
  chemically synthesized
ctcatcaggcaggaagaaga

SEQ ID NO: 56041 - DNA, 20 bp, Artificial Sequence
  chemically synthesized
atcaggcaggaagaagatgg

SEQ ID NO: 56042 - DNA, 20 bp, Artificial Sequence
  chemically synthesized
aggcaggaagaagatggcgg

SEQ ID NO: 56043 - DNA, 20 bp, Artificial Sequence
  chemically synthesized
aagatggcggtggcattgcc

SEQ ID NO: 56044 - DNA, 20 bp, Artificial Sequence
  chemically synthesized
agatggcggtggcattgccc

SEQ ID NO: 56045 - DNA, 20 bp, Artificial Sequence
  chemically synthesized
gcattgcccaggtatttcat

SEQ ID NO: 56046 - DNA, 20 bp, Artificial Sequence
  chemically synthesized
ttgcccaggtatttcatcag

SEQ ID NO: 56047 - DNA, 20 bp, Artificial Sequence
  chemically synthesized
ggtatttcatcagcagcacc

SEQ ID NO: 56048 - DNA, 20 bp, Artificial Sequence
  chemically synthesized
tttcatcagcagcacccagc

SEQ ID NO: 56049 - DNA, 20 bp, Artificial Sequence
  chemically synthesized
atcagcagcacccagctgga

SEQ ID NO: 56050 - DNA, 20 bp, Artificial Sequence
  chemically synthesized
cccagctggacagcttctta

SEQ ID NO: 56051 - DNA, 20 bp, Artificial Sequence
  chemically synthesized
tggacagcttcttacagtgc

SEQ ID NO: 56052 - DNA, 20 bp, Artificial Sequence
  chemically synthesized
catgcctaaacgcttcatca

SEQ ID NO: 56053 - DNA, 20 bp, Artificial Sequence
  chemically synthesized
atgcctaaacgcttcatcat

SEQ ID NO: 56054 - DNA, 20 bp, Artificial Sequence
  chemically synthesized
cttcatcataggcaccttca

SEQ ID NO: 56055 - DNA, 20 bp, Artificial Sequence
  chemically synthesized
catcataggcaccttcacgg

SEQ ID NO: 56056 - DNA, 20 bp, Artificial Sequence
  chemically synthesized
gcaccttcacggtggtcacc

SEQ ID NO: 56057 - DNA, 20 bp, Artificial Sequence
  chemically synthesized
cggtggtcacctggtccacg

SEQ ID NO: 56058 - DNA, 20 bp, Artificial Sequence
  chemically synthesized
tggtcacctggtccacgtgg

SEQ ID NO: 56059 - DNA, 20 bp, Artificial Sequence
  chemically synthesized
cacgtggaagtcctcttcct

SEQ ID NO: 56060 - DNA, 20 bp, Artificial Sequence
  chemically synthesized
cctcggtgtccttgacttca

SEQ ID NO: 56061 - DNA, 20 bp, Artificial Sequence
  chemically synthesized
ctcggtgtccttgacttcaa

SEQ ID NO: 56062 - DNA, 20 bp, Artificial Sequence
  chemically synthesized
tcggtgtccttgacttcaaa

SEQ ID NO: 56063 - DNA, 20 bp, Artificial Sequence
  chemically synthesized
aagggtctctcccatttgcc

SEQ ID NO: 56064 - DNA, 20 bp, Artificial Sequence
  chemically synthesized
gggtctctcccatttgcctg

SEQ ID NO: 56065 - DNA, 20 bp, Artificial Sequence
  chemically synthesized
gtctctcccatttgcctgga

SEQ ID NO: 56066 - DNA, 20 bp, Artificial Sequence
  chemically synthesized
ctctcccatttgcctggaga

SEQ ID NO: 56067 - DNA, 20 bp, Artificial Sequence
  chemically synthesized
tctcccatttgcctggagag

SEQ ID NO: 56068 - DNA, 20 bp, Artificial Sequence
  chemically synthesized
ctcccatttgcctggagaga

SEQ ID NO: 56069 - DNA, 20 bp, Artificial Sequence
  chemically synthesized
tcccatttgcctggagagag

SEQ ID NO: 56070 - DNA, 20 bp, Artificial Sequence
  chemically synthesized
catttgcctggagagagggg

SEQ ID NO: 56071 - DNA, 20 bp, Artificial Sequence
  chemically synthesized
atttgcctggagagagggga

SEQ ID NO: 56072 - DNA, 20 bp, Artificial Sequence
  chemically synthesized
tgcctggagagaggggaagg

SEQ ID NO: 56073 - DNA, 20 bp, Artificial Sequence
  chemically synthesized
gcctggagagaggggaaggt

SEQ ID NO: 56074 - DNA, 20 bp, Artificial Sequence
  chemically synthesized
gaggggaaggtgggcatcac

SEQ ID NO: 56075 - DNA, 20 bp, Artificial Sequence
  chemically synthesized
aggggaaggtgggcatcacc

SEQ ID NO: 56076 - DNA, 20 bp, Artificial Sequence
  chemically synthesized
ggggaaggtgggcatcacca

SEQ ID NO: 56077 - DNA, 20 bp, Artificial Sequence
  chemically synthesized
gggaaggtgggcatcaccag

SEQ ID NO: 56078 - DNA, 20 bp, Artificial Sequence
  chemically synthesized
aggtgggcatcaccaggggt

SEQ ID NO: 56079 - DNA, 20 bp, Artificial Sequence
  chemically synthesized
ggcatcaccaggggtgagtg

SEQ ID NO: 56080 - DNA, 20 bp, Artificial Sequence
  chemically synthesized
gcatcaccaggggtgagtga

SEQ ID NO: 56081 - DNA, 20 bp, Artificial Sequence
  chemically synthesized
accaggggtgagtgaaggtt

SEQ ID NO: 56082 - DNA, 20 bp, Artificial Sequence
  chemically synthesized
aggggtgagtgaaggtttgg

SEQ ID NO: 56083 - DNA, 20 bp, Artificial Sequence
  chemically synthesized
gggtgagtgaaggtttggaa

SEQ ID NO: 56084 - DNA, 20 bp, Artificial Sequence
  chemically synthesized
agtgaaggtttggaagagtg

SEQ ID NO: 56085 - DNA, 20 bp, Artificial Sequence
  chemically synthesized
gaaggtttggaagagtgtag

SEQ ID NO: 56086 - DNA, 20 bp, Artificial Sequence
  chemically synthesized
tggaagagtgtagcagaata

SEQ ID NO: 56087 - DNA, 20 bp, Artificial Sequence
  chemically synthesized
tagcagaataaagaaaccat

SEQ ID NO: 56088 - DNA, 20 bp, Artificial Sequence
  chemically synthesized
aaaccatgagtcccctccct

SEQ ID NO: 56089 - DNA, 20 bp, Artificial Sequence
  chemically synthesized
ccatgagtcccctccctgag

SEQ ID NO: 56090 - DNA, 20 bp, Artificial Sequence
  chemically synthesized
tcccctccctgagaagccct

SEQ ID NO: 56091 - DNA, 20 bp, Artificial Sequence
  chemically synthesized
cttgacgacacacatccctc

SEQ ID NO: 56092 - DNA, 20 bp, Artificial Sequence
  chemically synthesized
ttgacgacacacatccctcg

SEQ ID NO: 56093 - DNA, 20 bp, Artificial Sequence
  chemically synthesized
gacacacatccctcgaggct

SEQ ID NO: 56094 - DNA, 20 bp, Artificial Sequence
  chemically synthesized
ctcagcttcatcatctgtaa

SEQ ID NO: 56095 - DNA, 20 bp, Artificial Sequence
  chemically synthesized
tcagcttcatcatctgtaaa

SEQ ID NO: 56096 - DNA, 20 bp, Artificial Sequence
  chemically synthesized
ggtgctgaaactgaccatcc

SEQ ID NO: 56097 - DNA, 20 bp, Artificial Sequence
  chemically synthesized
gaccatccaagctgccgaaa

SEQ ID NO: 56098 - DNA, 20 bp, Artificial Sequence
  chemically synthesized
agctgccgaaaaagattgtg

SEQ ID NO: 56099 - DNA, 20 bp, Artificial Sequence
  chemically synthesized
gctgccgaaaaagattgtgt

SEQ ID NO: 56100 - DNA, 20 bp, Artificial Sequence
  chemically synthesized
ctgccgaaaaagattgtgtg

SEQ ID NO: 56101 - DNA, 20 bp, Artificial Sequence
  chemically synthesized
gtgtggggataattcaaaac

SEQ ID NO: 56102 - DNA, 20 bp, Artificial Sequence
  chemically synthesized
gtggggataattcaaaacta

SEQ ID NO: 56103 - DNA, 20 bp, Artificial Sequence
  chemically synthesized
tggggataattcaaaactag

SEQ ID NO: 56104 - DNA, 20 bp, Artificial Sequence
  chemically synthesized
ggataattcaaaactagagg

SEQ ID NO: 56105 - DNA, 20 bp, Artificial Sequence
  chemically synthesized
ttcaaaactagaggaagatg

SEQ ID NO: 56106 - DNA, 20 bp, Artificial Sequence
  chemically synthesized
gatgcagaatttctacatcg

SEQ ID NO: 56107 - DNA, 20 bp, Artificial Sequence
  chemically synthesized
tttctacatcgtggcgatgt

SEQ ID NO: 56108 - DNA, 20 bp, Artificial Sequence
  chemically synthesized
ttctacatcgtggcgatgtc

SEQ ID NO: 56109 - DNA, 20 bp, Artificial Sequence
  chemically synthesized
catcgtggcgatgtcaggct

SEQ ID NO: 56110 - DNA, 20 bp, Artificial Sequence
  chemically synthesized
tcgtggcgatgtcaggctaa

SEQ ID NO: 56111 - DNA, 20 bp, Artificial Sequence
  chemically synthesized
caggctaagagatgccatcg

SEQ ID NO: 56112 - DNA, 20 bp, Artificial Sequence
  chemically synthesized
tcgtggctgtgcatttttat

SEQ ID NO: 56113 - DNA, 20 bp, Artificial Sequence
  chemically synthesized
ttggaatcatatgtttattt

SEQ ID NO: 56114 - DNA, 20 bp, Artificial Sequence
  chemically synthesized
tggaatcatatgtttatttg

SEQ ID NO: 56115 - DNA, 20 bp, Artificial Sequence
  chemically synthesized
ggaatcatatgtttatttga

SEQ ID NO: 56116 - DNA, 20 bp, Artificial Sequence
  chemically synthesized
atgtttatttgagggtgtct

SEQ ID NO: 56117 - DNA, 20 bp, Artificial Sequence
  chemically synthesized
ggatattacaaataaaatgt

SEQ ID NO: 56118 - DNA, 20 bp, Artificial Sequence
  chemically synthesized
atattacaaataaaatgttg

SEQ ID NO: 56119 - DNA, 20 bp, Artificial Sequence
  chemically synthesized
caaataaaatgttggagcat

SEQ ID NO: 56120 - DNA, 20 bp, Artificial Sequence
  chemically synthesized
aaataaaatgttggagcatc

SEQ ID NO: 56121 - DNA, 20 bp, Artificial Sequence
  chemically synthesized
gttggagcatcaggcatatt

SEQ ID NO: 56122 - DNA, 20 bp, Artificial Sequence
  chemically synthesized
atatttggtaccttctgtct

SEQ ID NO: 56123 - DNA, 20 bp, Artificial Sequence
  chemically synthesized
tatttggtaccttctgtcta

SEQ ID NO: 56124 - DNA, 20 bp, Artificial Sequence
  chemically synthesized
gctccctgccccttgttaat

SEQ ID NO: 56125 - DNA, 20 bp, Artificial Sequence
  chemically synthesized
ccctgccccttgttaattgg

SEQ ID NO: 56126 - DNA, 20 bp, Artificial Sequence
  chemically synthesized
ccccttgttaattggcagct

SEQ ID NO: 56127 - DNA, 20 bp, Artificial Sequence
  chemically synthesized
tggcagctcagttattcatc

SEQ ID NO: 56128 - DNA, 20 bp, Artificial Sequence
  chemically synthesized
ggcagctcagttattcatcc

SEQ ID NO: 56129 - DNA, 20 bp, Artificial Sequence
  chemically synthesized
gcagctcagttattcatcca

SEQ ID NO: 56130 - DNA, 20 bp, Artificial Sequence
  chemically synthesized
acattctgcttactattcct

SEQ ID NO: 56131 - DNA, 20 bp, Artificial Sequence
  chemically synthesized
attctgcttactattcctga

SEQ ID NO: 56132 - DNA, 20 bp, Artificial Sequence
  chemically synthesized
tgagagctttcctcatcctc

SEQ ID NO: 56133 - DNA, 20 bp, Artificial Sequence
  chemically synthesized
gctttcctcatcctctagat

SEQ ID NO: 56134 - DNA, 20 bp, Artificial Sequence
  chemically synthesized
ttcctcatcctctagattgg

SEQ ID NO: 56135 - DNA, 20 bp, Artificial Sequence
  chemically synthesized
tcctcatcctctagattggc

SEQ ID NO: 56136 - DNA, 20 bp, Artificial Sequence
  chemically synthesized
cctcatcctctagattggca

SEQ ID NO: 56137 - DNA, 20 bp, Artificial Sequence
  chemically synthesized
ctcatcctctagattggcag

SEQ ID NO: 56138 - DNA, 20 bp, Artificial Sequence
  chemically synthesized
ctagattggcaggggaaatg

SEQ ID NO: 56139 - DNA, 20 bp, Artificial Sequence
  chemically synthesized
caggggaaatgcagatgcct

SEQ ID NO: 56140 - DNA, 20 bp, Artificial Sequence
  chemically synthesized
gggaaatgcagatgcctgag

SEQ ID NO: 56141 - DNA, 20 bp, Artificial Sequence
  chemically synthesized
cctcccctctgccataccaa

SEQ ID NO: 56142 - DNA, 20 bp, Artificial Sequence
  chemically synthesized
tcccctctgccataccaaca

SEQ ID NO: 56143 - DNA, 20 bp, Artificial Sequence
  chemically synthesized
accaacagagcttcaccatc

SEQ ID NO: 56144 - DNA, 20 bp, Artificial Sequence
  chemically synthesized
ccaacagagcttcaccatcg

SEQ ID NO: 56145 - DNA, 20 bp, Artificial Sequence
  chemically synthesized
agcttcaccatcgaggcatg

SEQ ID NO: 56146 - DNA, 20 bp, Artificial Sequence
  chemically synthesized
cttcaccatcgaggcatgca

SEQ ID NO: 56147 - DNA, 20 bp, Artificial Sequence
  chemically synthesized
caccatcgaggcatgcagag

SEQ ID NO: 56148 - DNA, 20 bp, Artificial Sequence
  chemically synthesized
atcgaggcatgcagagtgga

SEQ ID NO: 56149 - DNA, 20 bp, Artificial Sequence
  chemically synthesized
tcgaggcatgcagagtggac

SEQ ID NO: 56150 - DNA, 20 bp, Artificial Sequence
  chemically synthesized
cgaggcatgcagagtggaca

SEQ ID NO: 56151 - DNA, 20 bp, Artificial Sequence
  chemically synthesized
gaggcatgcagagtggacag

SEQ ID NO: 56152 - DNA, 20 bp, Artificial Sequence
  chemically synthesized
tgcagagtggacaggggcct

SEQ ID NO: 56153 - DNA, 20 bp, Artificial Sequence
  chemically synthesized
gcagagtggacaggggcctc

SEQ ID NO: 56154 - DNA, 20 bp, Artificial Sequence
  chemically synthesized
cagagtggacaggggcctca

SEQ ID NO: 56155 - DNA, 20 bp, Artificial Sequence
  chemically synthesized
gcctcagggacccctgatcc

SEQ ID NO: 56156 - DNA, 20 bp, Artificial Sequence
  chemically synthesized
cctgatcccagctttctcat

SEQ ID NO: 56157 - DNA, 20 bp, Artificial Sequence
  chemically synthesized
atcccagctttctcattgga

SEQ ID NO: 56158 - DNA, 20 bp, Artificial Sequence
  chemically synthesized
ccagctttctcattggacag

SEQ ID NO: 56159 - DNA, 20 bp, Artificial Sequence
  chemically synthesized
cagctttctcattggacaga

SEQ ID NO: 56160 - DNA, 20 bp, Artificial Sequence
  chemically synthesized
gctttctcattggacagaag

SEQ ID NO: 56161 - DNA, 20 bp, Artificial Sequence
  chemically synthesized
ctttctcattggacagaagg

SEQ ID NO: 56162 - DNA, 20 bp, Artificial Sequence
  chemically synthesized
ttctcattggacagaaggag

SEQ ID NO: 56163 - DNA, 20 bp, Artificial Sequence
  chemically synthesized
attggacagaaggaggagac

SEQ ID NO: 56164 - DNA, 20 bp, Artificial Sequence
  chemically synthesized
ttggacagaaggaggagact

SEQ ID NO: 56165 - DNA, 20 bp, Artificial Sequence
  chemically synthesized
tggacagaaggaggagactg

SEQ ID NO: 56166 - DNA, 20 bp, Artificial Sequence
  chemically synthesized
cagaaggaggagactggggc

SEQ ID NO: 56167 - DNA, 20 bp, Artificial Sequence
  chemically synthesized
gaaggaggagactggggctg

SEQ ID NO: 56168 - DNA, 20 bp, Artificial Sequence
  chemically synthesized
aggaggagactggggctgga

SEQ ID NO: 56169 - DNA, 20 bp, Artificial Sequence
  chemically synthesized
ggaggagactggggctggag

SEQ ID NO: 56170 - DNA, 20 bp, Artificial Sequence
  chemically synthesized
gaggagactggggctggaga

SEQ ID NO: 56171 - DNA, 20 bp, Artificial Sequence
  chemically synthesized
actggggctggagagggacc

SEQ ID NO: 56172 - DNA, 20 bp, Artificial Sequence
  chemically synthesized
ctggggctggagagggacct

SEQ ID NO: 56173 - DNA, 20 bp, Artificial Sequence
  chemically synthesized
gagggacctgggcccccact

SEQ ID NO: 56174 - DNA, 20 bp, Artificial Sequence
  chemically synthesized
agggacctgggcccccacta

SEQ ID NO: 56175 - DNA, 20 bp, Artificial Sequence
  chemically synthesized
ctgggcccccactaaggcca

SEQ ID NO: 56176 - DNA, 20 bp, Artificial Sequence
  chemically synthesized
ggcccccactaaggccacag

SEQ ID NO: 56177 - DNA, 20 bp, Artificial Sequence
  chemically synthesized
cccccactaaggccacagca

SEQ ID NO: 56178 - DNA, 20 bp, Artificial Sequence
  chemically synthesized
cactaaggccacagcagagc

SEQ ID NO: 56179 - DNA, 20 bp, Artificial Sequence
  chemically synthesized
actaaggccacagcagagcc

SEQ ID NO: 56180 - DNA, 20 bp, Artificial Sequence
  chemically synthesized
ccacagcagagccaggactt

SEQ ID NO: 56181 - DNA, 20 bp, Artificial Sequence
  chemically synthesized
gactttagctgtgctgactg

SEQ ID NO: 56182 - DNA, 20 bp, Artificial Sequence
  chemically synthesized
tagctgtgctgactgcagcc

SEQ ID NO: 56183 - DNA, 20 bp, Artificial Sequence
  chemically synthesized
ccactgccctcctttgcctc

SEQ ID NO: 56184 - DNA, 20 bp, Artificial Sequence
  chemically synthesized
actgccctcctttgcctcaa

SEQ ID NO: 56185 - DNA, 20 bp, Artificial Sequence
  chemically synthesized
ccctcctttgcctcaagagc

SEQ ID NO: 56186 - DNA, 20 bp, Artificial Sequence
  chemically synthesized
cctcctttgcctcaagagca

SEQ ID NO: 56187 - DNA, 20 bp, Artificial Sequence
  chemically synthesized
ctcctttgcctcaagagcaa

SEQ ID NO: 56188 - DNA, 20 bp, Artificial Sequence
  chemically synthesized
cctttgcctcaagagcaagg

SEQ ID NO: 56189 - DNA, 20 bp, Artificial Sequence
  chemically synthesized
cctcaagagcaagggagcct

SEQ ID NO: 56190 - DNA, 20 bp, Artificial Sequence
  chemically synthesized
tcaagagcaagggagcctca

SEQ ID NO: 56191 - DNA, 20 bp, Artificial Sequence
  chemically synthesized
agagcaagggagcctcagag

SEQ ID NO: 56192 - DNA, 20 bp, Artificial Sequence
  chemically synthesized
agcaagggagcctcagagtg

SEQ ID NO: 56193 - DNA, 20 bp, Artificial Sequence
  chemically synthesized
gcaagggagcctcagagtgg

SEQ ID NO: 56194 - DNA, 20 bp, Artificial Sequence
  chemically synthesized
agggagcctcagagtggagg

SEQ ID NO: 56195 - DNA, 20 bp, Artificial Sequence
  chemically synthesized
gagcctcagagtggaggaag

SEQ ID NO: 56196 - DNA, 20 bp, Artificial Sequence
  chemically synthesized
agagtggaggaagcagcccc

SEQ ID NO: 56197 - DNA, 20 bp, Artificial Sequence
  chemically synthesized
cctcccctatgctgttttcc

SEQ ID NO: 56198 - DNA, 20 bp, Artificial Sequence
  chemically synthesized
ctcccctatgctgttttcct

SEQ ID NO: 56199 - DNA, 20 bp, Artificial Sequence
  chemically synthesized
cctatgctgttttcctggga

SEQ ID NO: 56200 - DNA, 20 bp, Artificial Sequence
  chemically synthesized
atgctgttttcctgggacag

SEQ ID NO: 56201 - DNA, 20 bp, Artificial Sequence
  chemically synthesized
tgctgttttcctgggacagt

SEQ ID NO: 56202 - DNA, 20 bp, Artificial Sequence
  chemically synthesized
ctgttttcctgggacagtgg

SEQ ID NO: 56203 - DNA, 20 bp, Artificial Sequence
  chemically synthesized
tttcctgggacagtgggagc

SEQ ID NO: 56204 - DNA, 20 bp, Artificial Sequence
  chemically synthesized
tgggacagtgggagctggct

SEQ ID NO: 56205 - DNA, 20 bp, Artificial Sequence
  chemically synthesized
ggagctggcttagaatgccc

SEQ ID NO: 56206 - DNA, 20 bp, Artificial Sequence
  chemically synthesized
gagctggcttagaatgccct

SEQ ID NO: 56207 - DNA, 20 bp, Artificial Sequence
  chemically synthesized
agctggcttagaatgccctg

SEQ ID NO: 56208 - DNA, 20 bp, Artificial Sequence
  chemically synthesized
ttagaatgccctggggcccc

SEQ ID NO: 56209 - DNA, 20 bp, Artificial Sequence
  chemically synthesized
tagaatgccctggggccccc

SEQ ID NO: 56210 - DNA, 20 bp, Artificial Sequence
  chemically synthesized
ccctggggcccccaggaccc

SEQ ID NO: 56211 - DNA, 20 bp, Artificial Sequence
  chemically synthesized
accctggcattttaacccct

SEQ ID NO: 56212 - DNA, 20 bp, Artificial Sequence
  chemically synthesized
ccctggcattttaacccctc

SEQ ID NO: 56213 - DNA, 20 bp, Artificial Sequence
  chemically synthesized
cctggcattttaacccctca

SEQ ID NO: 56214 - DNA, 20 bp, Artificial Sequence
  chemically synthesized
ctggcattttaacccctcag

SEQ ID NO: 56215 - DNA, 20 bp, Artificial Sequence
  chemically synthesized
gcattttaacccctcagggg

SEQ ID NO: 56216 - DNA, 20 bp, Artificial Sequence
  chemically synthesized
cattttaacccctcaggggc

SEQ ID NO: 56217 - DNA, 20 bp, Artificial Sequence
  chemically synthesized
tttaacccctcaggggcagg

SEQ ID NO: 56218 - DNA, 20 bp, Artificial Sequence
  chemically synthesized
ttaacccctcaggggcagga

SEQ ID NO: 56219 - DNA, 20 bp, Artificial Sequence
  chemically synthesized
acccctcaggggcaggaagg

SEQ ID NO: 56220 - DNA, 20 bp, Artificial Sequence
  chemically synthesized
caggggcaggaaggcagcct

SEQ ID NO: 56221 - DNA, 20 bp, Artificial Sequence
  chemically synthesized
caggaaggcagcctgagata

SEQ ID NO: 56222 - DNA, 20 bp, Artificial Sequence
  chemically synthesized
gaaggcagcctgagatacag

SEQ ID NO: 56223 - DNA, 20 bp, Artificial Sequence
  chemically synthesized
aggcagcctgagatacagaa

SEQ ID NO: 56224 - DNA, 20 bp, Artificial Sequence
  chemically synthesized
tatgccacacaccatcccca

SEQ ID NO: 56225 - DNA, 20 bp, Artificial Sequence
  chemically synthesized
ttaatcctaaaaaaacctga

SEQ ID NO: 56226 - DNA, 20 bp, Artificial Sequence
  chemically synthesized
tcctaaaaaaacctgacagc

SEQ ID NO: 56227 - DNA, 20 bp, Artificial Sequence
  chemically synthesized
aaaaaacctgacagcaagaa

SEQ ID NO: 56228 - DNA, 20 bp, Artificial Sequence
  chemically synthesized
aatggtattttgtccatgct

SEQ ID NO: 56229 - DNA, 20 bp, Artificial Sequence
  chemically synthesized
tattttgtccatgctaagat

SEQ ID NO: 56230 - DNA, 20 bp, Artificial Sequence
  chemically synthesized
tccatgctaagatgagaaat

SEQ ID NO: 56231 - DNA, 20 bp, Artificial Sequence
  chemically synthesized
gatgagaaattagcacctca

SEQ ID NO: 56232 - DNA, 20 bp, Artificial Sequence
  chemically synthesized
tgagaaattagcacctcaaa

SEQ ID NO: 56233 - DNA, 20 bp, Artificial Sequence
  chemically synthesized
gagaaattagcacctcaaag

SEQ ID NO: 56234 - DNA, 20 bp, Artificial Sequence
  chemically synthesized
aaattagcacctcaaagagg

SEQ ID NO: 56235 - DNA, 20 bp, Artificial Sequence
  chemically synthesized
gaatgcattgtttttgtcaa

SEQ ID NO: 56236 - DNA, 20 bp, Artificial Sequence
  chemically synthesized
ttgtcaaaagctaattgtgt

SEQ ID NO: 56237 - DNA, 20 bp, Artificial Sequence
  chemically synthesized
gtcaaaagctaattgtgtta

SEQ ID NO: 56238 - DNA, 20 bp, Artificial Sequence
  chemically synthesized
tcaaaagctaattgtgttag

SEQ ID NO: 56239 - DNA, 20 bp, Artificial Sequence
  chemically synthesized
aaagctaattgtgttagagg

SEQ ID NO: 56240 - DNA, 20 bp, Artificial Sequence
  chemically synthesized
aagctaattgtgttagaggc

SEQ ID NO: 56241 - DNA, 20 bp, Artificial Sequence
  chemically synthesized
ttagaggcaggatttgaacc

SEQ ID NO: 56242 - DNA, 20 bp, Artificial Sequence
  chemically synthesized
tagaggcaggatttgaaccc

SEQ ID NO: 56243 - DNA, 20 bp, Artificial Sequence
  chemically synthesized
ggatttgaacccaggtcttt

SEQ ID NO: 56244 - DNA, 20 bp, Artificial Sequence
  chemically synthesized
tgcaaaactgatactgattc

SEQ ID NO: 56245 - DNA, 20 bp, Artificial Sequence
  chemically synthesized
gcaaaactgatactgattct

SEQ ID NO: 56246 - DNA, 20 bp, Artificial Sequence
  chemically synthesized
tgatactgattctgggacac

SEQ ID NO: 56247 - DNA, 20 bp, Artificial Sequence
  chemically synthesized
atactgattctgggacacta

SEQ ID NO: 56248 - DNA, 20 bp, Artificial Sequence
  chemically synthesized
tgggacactagagtcgtgta

SEQ ID NO: 56249 - DNA, 20 bp, Artificial Sequence
  chemically synthesized
catgaaactatccctttatg

SEQ ID NO: 56250 - DNA, 20 bp, Artificial Sequence
  chemically synthesized
gtgtattacaatttgttcta

SEQ ID NO: 56251 - DNA, 20 bp, Artificial Sequence
  chemically synthesized
acaatttgttctatagttct

SEQ ID NO: 56252 - DNA, 20 bp, Artificial Sequence
  chemically synthesized
cattatatattctacatata

SEQ ID NO: 56253 - DNA, 20 bp, Artificial Sequence
  chemically synthesized
tctacatatacagtatacac

SEQ ID NO: 56254 - DNA, 20 bp, Artificial Sequence
  chemically synthesized
ctacatatacagtatacaca

SEQ ID NO: 56255 - DNA, 20 bp, Artificial Sequence
  chemically synthesized
cagtatacacaaggacatta

SEQ ID NO: 56256 - DNA, 20 bp, Artificial Sequence
  chemically synthesized
agtatacacaaggacattaa

SEQ ID NO: 56257 - DNA, 20 bp, Artificial Sequence
  chemically synthesized
aggacattaaaggctctgaa

SEQ ID NO: 56258 - DNA, 20 bp, Artificial Sequence
  chemically synthesized
aaaggctctgaaaagttctg

SEQ ID NO: 56259 - DNA, 20 bp, Artificial Sequence
  chemically synthesized
aggctctgaaaagttctgca

SEQ ID NO: 56260 - DNA, 20 bp, Artificial Sequence
  chemically synthesized
gaaaagttctgcagagctgt

SEQ ID NO: 56261 - DNA, 20 bp, Artificial Sequence
  chemically synthesized
aagttctgcagagctgtcag

SEQ ID NO: 56262 - DNA, 20 bp, Artificial Sequence
  chemically synthesized
agagctgtcagtagttttga

SEQ ID NO: 56263 - DNA, 20 bp, Artificial Sequence
  chemically synthesized
ttcctcaaattactcaatga

SEQ ID NO: 56264 - DNA, 20 bp, Artificial Sequence
  chemically synthesized
ctcaatgatggaaaacattt

SEQ ID NO: 56265 - DNA, 20 bp, Artificial Sequence
  chemically synthesized
aacattttagtgtttgtgtg

SEQ ID NO: 56266 - DNA, 20 bp, Artificial Sequence
  chemically synthesized
tgtttgtgtgtagaaaactg

SEQ ID NO: 56267 - DNA, 20 bp, Artificial Sequence
  chemically synthesized
actgaagaatccacgctgaa

SEQ ID NO: 56268 - DNA, 20 bp, Artificial Sequence
  chemically synthesized
cacgctgaaaagcattgcta

SEQ ID NO: 56269 - DNA, 20 bp, Artificial Sequence
  chemically synthesized
atggcccataatgcattgcc

SEQ ID NO: 56270 - DNA, 20 bp, Artificial Sequence
  chemically synthesized
tggcccataatgcattgcca

SEQ ID NO: 56271 - DNA, 20 bp, Artificial Sequence
  chemically synthesized
gcccataatgcattgccaag

SEQ ID NO: 56272 - DNA, 20 bp, Artificial Sequence
  chemically synthesized
ccataatgcattgccaagga

SEQ ID NO: 56273 - DNA, 20 bp, Artificial Sequence
  chemically synthesized
tgcattgccaaggagagttc

SEQ ID NO: 56274 - DNA, 20 bp, Artificial Sequence
  chemically synthesized
aaggagagttcaagaactga

SEQ ID NO: 56275 - DNA, 20 bp, Artificial Sequence
  chemically synthesized
agttcaagaactgatggttt

SEQ ID NO: 56276 - DNA, 20 bp, Artificial Sequence
  chemically synthesized
aatatttttgcttgtttcta

SEQ ID NO: 56277 - DNA, 20 bp, Artificial Sequence
  chemically synthesized
atatttttgcttgtttctat

SEQ ID NO: 56278 - DNA, 20 bp, Artificial Sequence
  chemically synthesized
tttgcttgtttctatgggaa

SEQ ID NO: 56279 - DNA, 20 bp, Artificial Sequence
  chemically synthesized
ttgtttctatgggaacagct

SEQ ID NO: 56280 - DNA, 20 bp, Artificial Sequence
  chemically synthesized
tgtttctatgggaacagctc

SEQ ID NO: 56281 - DNA, 20 bp, Artificial Sequence
  chemically synthesized
tctatgggaacagctcaggc

SEQ ID NO: 56282 - DNA, 20 bp, Artificial Sequence
  chemically synthesized
gggaacagctcaggctggtt

SEQ ID NO: 56283 - DNA, 20 bp, Artificial Sequence
  chemically synthesized
gttgagcaaccttaccttta

SEQ ID NO: 56284 - DNA, 20 bp, Artificial Sequence
  chemically synthesized
gagcaaccttacctttaaag

SEQ ID NO: 56285 - DNA, 20 bp, Artificial Sequence
  chemically synthesized
ttaaagaagatgtaattcac

SEQ ID NO: 56286 - DNA, 20 bp, Artificial Sequence
  chemically synthesized
aaagaagatgtaattcacca

SEQ ID NO: 56287 - DNA, 20 bp, Artificial Sequence
  chemically synthesized
gcaaaaactgtgtctctgtc

SEQ ID NO: 56288 - DNA, 20 bp, Artificial Sequence
  chemically synthesized
caaatccacaattttccctt

SEQ ID NO: 56289 - DNA, 20 bp, Artificial Sequence
  chemically synthesized
gtaatcgttgatctgtttct

SEQ ID NO: 56290 - DNA, 20 bp, Artificial Sequence
  chemically synthesized
gatctgtttcttggcctctt

SEQ ID NO: 56291 - DNA, 20 bp, Artificial Sequence
  chemically synthesized
tggcctcttcggtgtccccg

SEQ ID NO: 56292 - DNA, 20 bp, Artificial Sequence
  chemically synthesized
ttcggtgtccccgaagttga

SEQ ID NO: 56293 - DNA, 20 bp, Artificial Sequence
  chemically synthesized
tgtccccgaagttgacagtg

SEQ ID NO: 56294 - DNA, 20 bp, Artificial Sequence
  chemically synthesized
gtccccgaagttgacagtga

SEQ ID NO: 56295 - DNA, 20 bp, Artificial Sequence
  chemically synthesized
agttgacagtgaaggcttct

SEQ ID NO: 56296 - DNA, 20 bp, Artificial Sequence
  chemically synthesized
tgacagtgaaggcttctgag

SEQ ID NO: 56297 - DNA, 20 bp, Artificial Sequence
  chemically synthesized
tcctccaaaaacttatccac

SEQ ID NO: 56298 - DNA, 20 bp, Artificial Sequence
  chemically synthesized
aaaaacttatccactagctt

SEQ ID NO: 56299 - DNA, 20 bp, Artificial Sequence
  chemically synthesized
aaaacttatccactagcttc

SEQ ID NO: 56300 - DNA, 20 bp, Artificial Sequence
  chemically synthesized
actagcttcaggccctcgct

SEQ ID NO: 56301 - DNA, 20 bp, Artificial Sequence
  chemically synthesized
ctagcttcaggccctcgctg

SEQ ID NO: 56302 - DNA, 20 bp, Artificial Sequence
  chemically synthesized
ttcaggccctcgctgaggaa

SEQ ID NO: 56303 - DNA, 20 bp, Artificial Sequence
  chemically synthesized
tcaggccctcgctgaggaac

SEQ ID NO: 56304 - DNA, 20 bp, Artificial Sequence
  chemically synthesized
gctgaggaacaggccattgc

SEQ ID NO: 56305 - DNA, 20 bp, Artificial Sequence
  chemically synthesized
gaggaacaggccattgccgg

SEQ ID NO: 56306 - DNA, 20 bp, Artificial Sequence
  chemically synthesized
aacaggccattgccggtggt

SEQ ID NO: 56307 - DNA, 20 bp, Artificial Sequence
  chemically synthesized
ggccattgccggtggtcagc

SEQ ID NO: 56308 - DNA, 20 bp, Artificial Sequence
  chemically synthesized
ccattgccggtggtcagctg

SEQ ID NO: 56309 - DNA, 20 bp, Artificial Sequence
  chemically synthesized
tgccggtggtcagctggagc

SEQ ID NO: 56310 - DNA, 20 bp, Artificial Sequence
  chemically synthesized
gtcagctggagctggctgtc

SEQ ID NO: 56311 - DNA, 20 bp, Artificial Sequence
  chemically synthesized
gctggagctggctgtctggc

SEQ ID NO: 56312 - DNA, 20 bp, Artificial Sequence
  chemically synthesized
agctggctgtctggctggtt

SEQ ID NO: 56313 - DNA, 20 bp, Artificial Sequence
  chemically synthesized
gctggctgtctggctggttg

SEQ ID NO: 56314 - DNA, 20 bp, Artificial Sequence
  chemically synthesized
ctggctgtctggctggttga

SEQ ID NO: 56315 - DNA, 20 bp, Artificial Sequence
  chemically synthesized
tgtctggctggttgagggta

SEQ ID NO: 56316 - DNA, 20 bp, Artificial Sequence
  chemically synthesized
tctggctggttgagggtacg

SEQ ID NO: 56317 - DNA, 20 bp, Artificial Sequence
  chemically synthesized
ctggctggttgagggtacgg

SEQ ID NO: 56318 - DNA, 20 bp, Artificial Sequence
  chemically synthesized
ggctggttgagggtacggag

SEQ ID NO: 56319 - DNA, 20 bp, Artificial Sequence
  chemically synthesized
tgagggtacggaggagttcc

SEQ ID NO: 56320 - DNA, 20 bp, Artificial Sequence
  chemically synthesized
gggtacggaggagttcctgg

SEQ ID NO: 56321 - DNA, 20 bp, Artificial Sequence
  chemically synthesized
ggagttcctggaagccttca

SEQ ID NO: 56322 - DNA, 20 bp, Artificial Sequence
  chemically synthesized
ctggaagccttcatggatct

SEQ ID NO: 56323 - DNA, 20 bp, Artificial Sequence
  chemically synthesized
ccttcatggatctgagcctc

SEQ ID NO: 56324 - DNA, 20 bp, Artificial Sequence
  chemically synthesized
tgagcctccggaatctccgt

SEQ ID NO: 56325 - DNA, 20 bp, Artificial Sequence
  chemically synthesized
gagcctccggaatctccgtg

SEQ ID NO: 56326 - DNA, 20 bp, Artificial Sequence
  chemically synthesized
atctccgtgaggttgaaatt

SEQ ID NO: 56327 - DNA, 20 bp, Artificial Sequence
  chemically synthesized
tctccgtgaggttgaaattc

SEQ ID NO: 56328 - DNA, 20 bp, Artificial Sequence
  chemically synthesized
aggttgaaattcaggccctc

SEQ ID NO: 56329 - DNA, 20 bp, Artificial Sequence
  chemically synthesized
ggttgaaattcaggccctcc

SEQ ID NO: 56330 - DNA, 20 bp, Artificial Sequence
  chemically synthesized
gccctccaggatttcatcgt

SEQ ID NO: 56331 - DNA, 20 bp, Artificial Sequence
  chemically synthesized
caggatttcatcgtgagtgt

SEQ ID NO: 56332 - DNA, 20 bp, Artificial Sequence
  chemically synthesized
ttcatcgtgagtgtcagcct

SEQ ID NO: 56333 - DNA, 20 bp, Artificial Sequence
  chemically synthesized
tgagtgtcagccttggtccc

SEQ ID NO: 56334 - DNA, 20 bp, Artificial Sequence
  chemically synthesized
gagtgtcagccttggtcccc

SEQ ID NO: 56335 - DNA, 20 bp, Artificial Sequence
  chemically synthesized
agtgtcagccttggtcccca

SEQ ID NO: 56336 - DNA, 20 bp, Artificial Sequence
  chemically synthesized
tgtcagccttggtccccagg

SEQ ID NO: 56337 - DNA, 20 bp, Artificial Sequence
  chemically synthesized
tcagccttggtccccaggga

SEQ ID NO: 56338 - DNA, 20 bp, Artificial Sequence
  chemically synthesized
tccccagggagagcattgca

SEQ ID NO: 56339 - DNA, 20 bp, Artificial Sequence
  chemically synthesized
ccccagggagagcattgcaa

SEQ ID NO: 56340 - DNA, 20 bp, Artificial Sequence
  chemically synthesized
ggagagcattgcaaaggctg

SEQ ID NO: 56341 - DNA, 20 bp, Artificial Sequence
  chemically synthesized
aaggctgtagcgatgctcac

SEQ ID NO: 56342 - DNA, 20 bp, Artificial Sequence
  chemically synthesized
aggctgtagcgatgctcact

SEQ ID NO: 56343 - DNA, 20 bp, Artificial Sequence
  chemically synthesized
ggctgtagcgatgctcactg

SEQ ID NO: 56344 - DNA, 20 bp, Artificial Sequence
  chemically synthesized
ctgtagcgatgctcactggg

SEQ ID NO: 56345 - DNA, 20 bp, Artificial Sequence
  chemically synthesized
tagcgatgctcactggggag

SEQ ID NO: 56346 - DNA, 20 bp, Artificial Sequence
  chemically synthesized
cgatgctcactggggagaag

SEQ ID NO: 56347 - DNA, 20 bp, Artificial Sequence
  chemically synthesized
cactggggagaagaagatat

SEQ ID NO: 56348 - DNA, 20 bp, Artificial Sequence
  chemically synthesized
gaagaagatattggtgctgt

SEQ ID NO: 56349 - DNA, 20 bp, Artificial Sequence
  chemically synthesized
agatattggtgctgttggac

SEQ ID NO: 56350 - DNA, 20 bp, Artificial Sequence
  chemically synthesized
gtgctgttggactggtgtgc

SEQ ID NO: 56351 - DNA, 20 bp, Artificial Sequence
  chemically synthesized
tgttggactggtgtgccagc

SEQ ID NO: 56352 - DNA, 20 bp, Artificial Sequence
  chemically synthesized
tggactggtgtgccagctgg

SEQ ID NO: 56353 - DNA, 20 bp, Artificial Sequence
  chemically synthesized
tggtgtgccagctggcggta

SEQ ID NO: 56354 - DNA, 20 bp, Artificial Sequence
  chemically synthesized
ggtgtgccagctggcggtat

SEQ ID NO: 56355 - DNA, 20 bp, Artificial Sequence
  chemically synthesized
ccagctggcggtataggctg

SEQ ID NO: 56356 - DNA, 20 bp, Artificial Sequence
  chemically synthesized
cagctggcggtataggctga

SEQ ID NO: 56357 - DNA, 20 bp, Artificial Sequence
  chemically synthesized
gtataggctgaaggcgaact

SEQ ID NO: 56358 - DNA, 20 bp, Artificial Sequence
  chemically synthesized
aggctgaaggcgaactcagc

SEQ ID NO: 56359 - DNA, 20 bp, Artificial Sequence
  chemically synthesized
ggctgaaggcgaactcagcc

SEQ ID NO: 56360 - DNA, 20 bp, Artificial Sequence
  chemically synthesized
gaaggcgaactcagccaggt

SEQ ID NO: 56361 - DNA, 20 bp, Artificial Sequence
  chemically synthesized
aaggcgaactcagccaggtt

SEQ ID NO: 56362 - DNA, 20 bp, Artificial Sequence
  chemically synthesized
aggcgaactcagccaggttg

SEQ ID NO: 56363 - DNA, 20 bp, Artificial Sequence
  chemically synthesized
ggcgaactcagccaggttgg

SEQ ID NO: 56364 - DNA, 20 bp, Artificial Sequence
  chemically synthesized
ggttgggggtgatcttgttg

SEQ ID NO: 56365 - DNA, 20 bp, Artificial Sequence
  chemically synthesized
gttgggggtgatcttgttga

SEQ ID NO: 56366 - DNA, 20 bp, Artificial Sequence
  chemically synthesized
ggggtgatcttgttgaaggt

SEQ ID NO: 56367 - DNA, 20 bp, Artificial Sequence
  chemically synthesized
gggtgatcttgttgaaggtt

SEQ ID NO: 56368 - DNA, 20 bp, Artificial Sequence
  chemically synthesized
aggttgggtgatcctgatca

SEQ ID NO: 56369 - DNA, 20 bp, Artificial Sequence
  chemically synthesized
ttgggtgatcctgatcatgg

SEQ ID NO: 56370 - DNA, 20 bp, Artificial Sequence
  chemically synthesized
tgggtgatcctgatcatggt

SEQ ID NO: 56371 - DNA, 20 bp, Artificial Sequence
  chemically synthesized
ggtgggatgtatctgtcttc

SEQ ID NO: 56372 - DNA, 20 bp, Artificial Sequence
  chemically synthesized
gtgggatgtatctgtcttct

SEQ ID NO: 56373 - DNA, 20 bp, Artificial Sequence
  chemically synthesized
ggatgtatctgtcttctggg

SEQ ID NO: 56374 - DNA, 20 bp, Artificial Sequence
  chemically synthesized
tcttctgggcagcatctccc

SEQ ID NO: 56375 - DNA, 20 bp, Artificial Sequence
  chemically synthesized
cttctgggcagcatctccct

SEQ ID NO: 56376 - DNA, 20 bp, Artificial Sequence
  chemically synthesized
ttctgggcagcatctccctg

SEQ ID NO: 56377 - DNA, 20 bp, Artificial Sequence
  chemically synthesized
agcatctccctggggatcct

SEQ ID NO: 56378 - DNA, 20 bp, Artificial Sequence
  chemically synthesized
tctccctggggatcctcagc

SEQ ID NO: 56379 - DNA, 20 bp, Artificial Sequence
  chemically synthesized
ctccctggggatcctcagcc

SEQ ID NO: 56380 - DNA, 20 bp, Artificial Sequence
  chemically synthesized
tccctggggatcctcagcca

SEQ ID NO: 56381 - DNA, 20 bp, Artificial Sequence
  chemically synthesized
cctggggatcctcagccagg

SEQ ID NO: 56382 - DNA, 20 bp, Artificial Sequence
  chemically synthesized
gggatcctcagccagggaga

SEQ ID NO: 56383 - DNA, 20 bp, Artificial Sequence
  chemically synthesized
ggatcctcagccagggagac

SEQ ID NO: 56384 - DNA, 20 bp, Artificial Sequence
  chemically synthesized
gatcctcagccagggagaca

SEQ ID NO: 56385 - DNA, 20 bp, Artificial Sequence
  chemically synthesized
tcagccagggagacagggac

SEQ ID NO: 56386 - DNA, 20 bp, Artificial Sequence
  chemically synthesized
cagccagggagacagggacc

SEQ ID NO: 56387 - DNA, 20 bp, Artificial Sequence
  chemically synthesized
ccagggagacagggaccagg

SEQ ID NO: 56388 - DNA, 20 bp, Artificial Sequence
  chemically synthesized
gagacagggaccaggcagca

SEQ ID NO: 56389 - DNA, 20 bp, Artificial Sequence
  chemically synthesized
agacagggaccaggcagcac

SEQ ID NO: 56390 - DNA, 20 bp, Artificial Sequence
  chemically synthesized
accaggcagcacaggcctgc

SEQ ID NO: 56391 - DNA, 20 bp, Artificial Sequence
  chemically synthesized
aggcagcacaggcctgccag

SEQ ID NO: 56392 - DNA, 20 bp, Artificial Sequence
  chemically synthesized
ggcagcacaggcctgccagc

SEQ ID NO: 56393 - DNA, 20 bp, Artificial Sequence
  chemically synthesized
cagcacaggcctgccagcag

SEQ ID NO: 56394 - DNA, 20 bp, Artificial Sequence
  chemically synthesized
agcacaggcctgccagcagg

SEQ ID NO: 56395 - DNA, 20 bp, Artificial Sequence
  chemically synthesized
ccagcaggaggatgccccac

SEQ ID NO: 56396 - DNA, 20 bp, Artificial Sequence
  chemically synthesized
caggaggatgccccacgaga

SEQ ID NO: 56397 - DNA, 20 bp, Artificial Sequence
  chemically synthesized
gaggatgccccacgagacag

SEQ ID NO: 56398 - DNA, 20 bp, Artificial Sequence
  chemically synthesized
atgccccacgagacagaaga

SEQ ID NO: 56399 - DNA, 20 bp, Artificial Sequence
  chemically synthesized
agaagacggcattgtcctgc

SEQ ID NO: 56400 - DNA, 20 bp, Artificial Sequence
  chemically synthesized
gacggcattgtcctgcaaga

SEQ ID NO: 56401 - DNA, 20 bp, Artificial Sequence
  chemically synthesized
cggcattgtcctgcaagaca

SEQ ID NO: 56402 - DNA, 20 bp, Artificial Sequence
  chemically synthesized
attgtcctgcaagacagaga

SEQ ID NO: 56403 - DNA, 20 bp, Artificial Sequence
  chemically synthesized
ttgtcctgcaagacagagat

SEQ ID NO: 56404 - DNA, 20 bp, Artificial Sequence
  chemically synthesized
tgtcctgcaagacagagatg

SEQ ID NO: 56405 - DNA, 20 bp, Artificial Sequence
  chemically synthesized
gtcctgcaagacagagatgg

SEQ ID NO: 56406 - DNA, 20 bp, Artificial Sequence
  chemically synthesized
tcctgcaagacagagatggg

SEQ ID NO: 56407 - DNA, 20 bp, Artificial Sequence
  chemically synthesized
cctgcaagacagagatgggg

SEQ ID NO: 56408 - DNA, 20 bp, Artificial Sequence
  chemically synthesized
caagacagagatgggggggc

SEQ ID NO: 56409 - DNA, 20 bp, Artificial Sequence
  chemically synthesized
aagacagagatgggggggcc

SEQ ID NO: 56410 - DNA, 20 bp, Artificial Sequence
  chemically synthesized
agatgggggggccaggcccc

SEQ ID NO: 56411 - DNA, 20 bp, Artificial Sequence
  chemically synthesized
ggggggccaggccccgagtc

SEQ ID NO: 56412 - DNA, 20 bp, Artificial Sequence
  chemically synthesized
gggggccaggccccgagtca

SEQ ID NO: 56413 - DNA, 20 bp, Artificial Sequence
  chemically synthesized
tcaaggcacatgatgactcc

SEQ ID NO: 56414 - DNA, 20 bp, Artificial Sequence
  chemically synthesized
acatgatgactcccagtgat

SEQ ID NO: 56415 - DNA, 20 bp, Artificial Sequence
  chemically synthesized
catgatgactcccagtgatc

SEQ ID NO: 56416 - DNA, 20 bp, Artificial Sequence
  chemically synthesized
atgatgactcccagtgatca

SEQ ID NO: 56417 - DNA, 20 bp, Artificial Sequence
  chemically synthesized
gatcagggattgacaccacg

SEQ ID NO: 56418 - DNA, 20 bp, Artificial Sequence
  chemically synthesized
cagggattgacaccacgtgg

SEQ ID NO: 56419 - DNA, 20 bp, Artificial Sequence
  chemically synthesized
tgacaccacgtggaagtgcc

SEQ ID NO: 56420 - DNA, 20 bp, Artificial Sequence
  chemically synthesized
gacaccacgtggaagtgcct

SEQ ID NO: 56421 - DNA, 20 bp, Artificial Sequence
  chemically synthesized
acaccacgtggaagtgccta

SEQ ID NO: 56422 - DNA, 20 bp, Artificial Sequence
  chemically synthesized
gtgcctagggattattaaac

SEQ ID NO: 56423 - DNA, 20 bp, Artificial Sequence
  chemically synthesized
ttattaaaccagcctgtgcc

SEQ ID NO: 56424 - DNA, 20 bp, Artificial Sequence
  chemically synthesized
tgccaagtacttgccgacat

SEQ ID NO: 56425 - DNA, 20 bp, Artificial Sequence
  chemically synthesized
gccgacatcagtaacactga

SEQ ID NO: 56426 - DNA, 20 bp, Artificial Sequence
  chemically synthesized
atcagtaacactgaaagaat

SEQ ID NO: 56427 - DNA, 20 bp, Artificial Sequence
  chemically synthesized
agtaacactgaaagaatcag

SEQ ID NO: 56428 - DNA, 20 bp, Artificial Sequence
  chemically synthesized
cactgaaagaatcagaagaa

SEQ ID NO: 56429 - DNA, 20 bp, Artificial Sequence
  chemically synthesized
gaagaatagcaaaatgtacg

SEQ ID NO: 56430 - DNA, 20 bp, Artificial Sequence
  chemically synthesized
cgtagtgcttaccatatgcc

SEQ ID NO: 56431 - DNA, 20 bp, Artificial Sequence
  chemically synthesized
ctttcttgtaacaatcccgt

SEQ ID NO: 56432 - DNA, 20 bp, Artificial Sequence
  chemically synthesized
tttcttgtaacaatcccgtg

SEQ ID NO: 56433 - DNA, 20 bp, Artificial Sequence
  chemically synthesized
atgctaatatccttctttta

SEQ ID NO: 56434 - DNA, 20 bp, Artificial Sequence
  chemically synthesized
atatccttcttttacagatg

SEQ ID NO: 56435 - DNA, 20 bp, Artificial Sequence
  chemically synthesized
ttttacagatgaagaaacca

SEQ ID NO: 56436 - DNA, 20 bp, Artificial Sequence
  chemically synthesized
acagatgaagaaaccaaagc

SEQ ID NO: 56437 - DNA, 20 bp, Artificial Sequence
  chemically synthesized
agatgaagaaaccaaagcca

SEQ ID NO: 56438 - DNA, 20 bp, Artificial Sequence
  chemically synthesized
atgaagaaaccaaagccaga

SEQ ID NO: 56439 - DNA, 20 bp, Artificial Sequence
  chemically synthesized
gaaaccaaagccagagagat

SEQ ID NO: 56440 - DNA, 20 bp, Artificial Sequence
  chemically synthesized
aaaccaaagccagagagatt

SEQ ID NO: 56441 - DNA, 20 bp, Artificial Sequence
  chemically synthesized
caaagccagagagattaggt

SEQ ID NO: 56442 - DNA, 20 bp, Artificial Sequence
  chemically synthesized
gtcagctattcaatgtcact

SEQ ID NO: 56443 - DNA, 20 bp, Artificial Sequence
  chemically synthesized
tcagctattcaatgtcactg

SEQ ID NO: 56444 - DNA, 20 bp, Artificial Sequence
  chemically synthesized
gctattcaatgtcactgagg

SEQ ID NO: 56445 - DNA, 20 bp, Artificial Sequence
  chemically synthesized
attcaatgtcactgaggaag

SEQ ID NO: 56446 - DNA, 20 bp, Artificial Sequence
  chemically synthesized
caatgtcactgaggaagtag

SEQ ID NO: 56447 - DNA, 20 bp, Artificial Sequence
  chemically synthesized
cactgaggaagtagcagaac

SEQ ID NO: 56448 - DNA, 20 bp, Artificial Sequence
  chemically synthesized
cagaaccagaatcctacatc

SEQ ID NO: 56449 - DNA, 20 bp, Artificial Sequence
  chemically synthesized
agaaccagaatcctacatct

SEQ ID NO: 56450 - DNA, 20 bp, Artificial Sequence
  chemically synthesized
ctacatctaggtcctgcacc

SEQ ID NO: 56451 - DNA, 20 bp, Artificial Sequence
  chemically synthesized
tacatctaggtcctgcaccc

SEQ ID NO: 56452 - DNA, 20 bp, Artificial Sequence
  chemically synthesized
taggtcctgcacccaggctc

SEQ ID NO: 56453 - DNA, 20 bp, Artificial Sequence
  chemically synthesized
tcctgcacccaggctctgga

SEQ ID NO: 56454 - DNA, 20 bp, Artificial Sequence
  chemically synthesized
cttacatctgcaatgaccct

SEQ ID NO: 56455 - DNA, 20 bp, Artificial Sequence
  chemically synthesized
caatgaccctaagatgcaaa

SEQ ID NO: 56456 - DNA, 20 bp, Artificial Sequence
  chemically synthesized
accctaagatgcaaatggta

SEQ ID NO: 56457 - DNA, 20 bp, Artificial Sequence
  chemically synthesized
gtacagccattgttttacaa

SEQ ID NO: 56458 - DNA, 20 bp, Artificial Sequence
  chemically synthesized
cagccattgttttacaaaag

SEQ ID NO: 56459 - DNA, 20 bp, Artificial Sequence
  chemically synthesized
gttttacaaaagaagaaaat

SEQ ID NO: 56460 - DNA, 20 bp, Artificial Sequence
  chemically synthesized
ttttacaaaagaagaaaatg

SEQ ID NO: 56461 - DNA, 20 bp, Artificial Sequence
  chemically synthesized
aaaagaagaaaatgaggcac

SEQ ID NO: 56462 - DNA, 20 bp, Artificial Sequence
  chemically synthesized
agaagaaaatgaggcacaag

SEQ ID NO: 56463 - DNA, 20 bp, Artificial Sequence
  chemically synthesized
aagaaaatgaggcacaagaa

SEQ ID NO: 56464 - DNA, 20 bp, Artificial Sequence
  chemically synthesized
agaaaatgaggcacaagaag

SEQ ID NO: 56465 - DNA, 20 bp, Artificial Sequence
  chemically synthesized
atgaggcacaagaagaggaa

SEQ ID NO: 56466 - DNA, 20 bp, Artificial Sequence
  chemically synthesized
tgaggcacaagaagaggaat

SEQ ID NO: 56467 - DNA, 20 bp, Artificial Sequence
  chemically synthesized
tgggcctgcccacgattatc

SEQ ID NO: 56468 - DNA, 20 bp, Artificial Sequence
  chemically synthesized
gggcctgcccacgattatcc

SEQ ID NO: 56469 - DNA, 20 bp, Artificial Sequence
  chemically synthesized
gcccacgattatccaggaat

SEQ ID NO: 56470 - DNA, 20 bp, Artificial Sequence
  chemically synthesized
cccacgattatccaggaatc

SEQ ID NO: 56471 - DNA, 20 bp, Artificial Sequence
  chemically synthesized
cgattatccaggaatcgggc

SEQ ID NO: 56472 - DNA, 20 bp, Artificial Sequence
  chemically synthesized
atccaggaatcgggccagat

SEQ ID NO: 56473 - DNA, 20 bp, Artificial Sequence
  chemically synthesized
aatcgggccagatcagaatc

SEQ ID NO: 56474 - DNA, 20 bp, Artificial Sequence
  chemically synthesized
tcagaatcaagaatcatgtc

SEQ ID NO: 56475 - DNA, 20 bp, Artificial Sequence
  chemically synthesized
aatcaagaatcatgtcaagc

SEQ ID NO: 56476 - DNA, 20 bp, Artificial Sequence
  chemically synthesized
caagaatcatgtcaagctgg

SEQ ID NO: 56477 - DNA, 20 bp, Artificial Sequence
  chemically synthesized
catgtcaagctggaagccct

SEQ ID NO: 56478 - DNA, 20 bp, Artificial Sequence
  chemically synthesized
tgtcaagctggaagcccttg

SEQ ID NO: 56479 - DNA, 20 bp, Artificial Sequence
  chemically synthesized
gtcaagctggaagcccttgg

SEQ ID NO: 56480 - DNA, 20 bp, Artificial Sequence
  chemically synthesized
tcaagctggaagcccttgga

SEQ ID NO: 56481 - DNA, 20 bp, Artificial Sequence
  chemically synthesized
ttctatctaatcccactatt

SEQ ID NO: 56482 - DNA, 20 bp, Artificial Sequence
  chemically synthesized
tatctaatcccactatttag

SEQ ID NO: 56483 - DNA, 20 bp, Artificial Sequence
  chemically synthesized
taatcccactatttagtggc

SEQ ID NO: 56484 - DNA, 20 bp, Artificial Sequence
  chemically synthesized
aatcccactatttagtggcc

SEQ ID NO: 56485 - DNA, 20 bp, Artificial Sequence
  chemically synthesized
atcccactatttagtggcca

SEQ ID NO: 56486 - DNA, 20 bp, Artificial Sequence
  chemically synthesized
tggccagggaaactgctgca

SEQ ID NO: 56487 - DNA, 20 bp, Artificial Sequence
  chemically synthesized
ccagggaaactgctgcacag

SEQ ID NO: 56488 - DNA, 20 bp, Artificial Sequence
  chemically synthesized
cagggaaactgctgcacaga

SEQ ID NO: 56489 - DNA, 20 bp, Artificial Sequence
  chemically synthesized
agggaaactgctgcacagaa

SEQ ID NO: 56490 - DNA, 20 bp, Artificial Sequence
  chemically synthesized
gggaaatgcatcttgcacaa

SEQ ID NO: 56491 - DNA, 20 bp, Artificial Sequence
  chemically synthesized
tgcatcttgcacaatggcaa

SEQ ID NO: 56492 - DNA, 20 bp, Artificial Sequence
  chemically synthesized
tcttgcacaatggcaacagc

SEQ ID NO: 56493 - DNA, 20 bp, Artificial Sequence
  chemically synthesized
ttgcacaatggcaacagcta

SEQ ID NO: 56494 - DNA, 20 bp, Artificial Sequence
  chemically synthesized
gcacaatggcaacagctaga

SEQ ID NO: 56495 - DNA, 20 bp, Artificial Sequence
  chemically synthesized
atggcaacagctagagagca

SEQ ID NO: 56496 - DNA, 20 bp, Artificial Sequence
  chemically synthesized
ggcaacagctagagagcatg

SEQ ID NO: 56497 - DNA, 20 bp, Artificial Sequence
  chemically synthesized
gcaacagctagagagcatgg

SEQ ID NO: 56498 - DNA, 20 bp, Artificial Sequence
  chemically synthesized
caacagctagagagcatgga

SEQ ID NO: 56499 - DNA, 20 bp, Artificial Sequence
  chemically synthesized
aacagctagagagcatggag

SEQ ID NO: 56500 - DNA, 20 bp, Artificial Sequence
  chemically synthesized
ggggctgtgattaaacctcc

SEQ ID NO: 56501 - DNA, 20 bp, Artificial Sequence
  chemically synthesized
gggctgtgattaaacctcct

SEQ ID NO: 56502 - DNA, 20 bp, Artificial Sequence
  chemically synthesized
gctgtgattaaacctcctgg

SEQ ID NO: 56503 - DNA, 20 bp, Artificial Sequence
  chemically synthesized
tgttcccacccaacactcac

SEQ ID NO: 56504 - DNA, 20 bp, Artificial Sequence
  chemically synthesized
gttcccacccaacactcaca

SEQ ID NO: 56505 - DNA, 20 bp, Artificial Sequence
  chemically synthesized
ccaacactcacaaggatcct

SEQ ID NO: 56506 - DNA, 20 bp, Artificial Sequence
  chemically synthesized
tcacaaggatcctcagccct

SEQ ID NO: 56507 - DNA, 20 bp, Artificial Sequence
  chemically synthesized
cacaaggatcctcagccctt

SEQ ID NO: 56508 - DNA, 20 bp, Artificial Sequence
  chemically synthesized
acaaggatcctcagccctta

SEQ ID NO: 56509 - DNA, 20 bp, Artificial Sequence
  chemically synthesized
gcccttagggtttttttccc

SEQ ID NO: 56510 - DNA, 20 bp, Artificial Sequence
  chemically synthesized
ccttagggtttttttcccaa

SEQ ID NO: 56511 - DNA, 20 bp, Artificial Sequence
  chemically synthesized
agggtttttttcccaagaga

SEQ ID NO: 56512 - DNA, 20 bp, Artificial Sequence
  chemically synthesized
gggtttttttcccaagagac

SEQ ID NO: 56513 - DNA, 20 bp, Artificial Sequence
  chemically synthesized
ggtttttttcccaagagacg

SEQ ID NO: 56514 - DNA, 20 bp, Artificial Sequence
  chemically synthesized
gctgtccccacaatgctctg

SEQ ID NO: 56515 - DNA, 20 bp, Artificial Sequence
  chemically synthesized
cccacaatgctctgtggtcc

SEQ ID NO: 56516 - DNA, 20 bp, Artificial Sequence
  chemically synthesized
tgctctgtggtcccagacac

SEQ ID NO: 56517 - DNA, 20 bp, Artificial Sequence
  chemically synthesized
tgtggtcccagacacaagaa

SEQ ID NO: 56518 - DNA, 20 bp, Artificial Sequence
  chemically synthesized
gtggtcccagacacaagaat

SEQ ID NO: 56519 - DNA, 20 bp, Artificial Sequence
  chemically synthesized
agaataggctgatgctcctg

SEQ ID NO: 56520 - DNA, 20 bp, Artificial Sequence
  chemically synthesized
taggctgatgctcctgcagt

SEQ ID NO: 56521 - DNA, 20 bp, Artificial Sequence
  chemically synthesized
cagtcagcttacctgccgtc

SEQ ID NO: 56522 - DNA, 20 bp, Artificial Sequence
  chemically synthesized
agtcagcttacctgccgtct

SEQ ID NO: 56523 - DNA, 20 bp, Artificial Sequence
  chemically synthesized
cctgccgtctgggtcactaa

SEQ ID NO: 56524 - DNA, 20 bp, Artificial Sequence
  chemically synthesized
ctgggtcactaatggtgtcc

SEQ ID NO: 56525 - DNA, 20 bp, Artificial Sequence
  chemically synthesized
cactaatggtgtcccagttc

SEQ ID NO: 56526 - DNA, 20 bp, Artificial Sequence
  chemically synthesized
actaatggtgtcccagttct

SEQ ID NO: 56527 - DNA, 20 bp, Artificial Sequence
  chemically synthesized
cagttctgggctcttgctgt

SEQ ID NO: 56528 - DNA, 20 bp, Artificial Sequence
  chemically synthesized
agttctgggctcttgctgtc

SEQ ID NO: 56529 - DNA, 20 bp, Artificial Sequence
  chemically synthesized
gttctgggctcttgctgtca

SEQ ID NO: 56530 - DNA, 20 bp, Artificial Sequence
  chemically synthesized
ttctgggctcttgctgtcag

SEQ ID NO: 56531 - DNA, 20 bp, Artificial Sequence
  chemically synthesized
gctcttgctgtcaggggctt

SEQ ID NO: 56532 - DNA, 20 bp, Artificial Sequence
  chemically synthesized
tcttgctgtcaggggcttta

SEQ ID NO: 56533 - DNA, 20 bp, Artificial Sequence
  chemically synthesized
agacgctcatctctccttga

SEQ ID NO: 56534 - DNA, 20 bp, Artificial Sequence
  chemically synthesized
cgctcatctctccttgaaag

SEQ ID NO: 56535 - DNA, 20 bp, Artificial Sequence
  chemically synthesized
gctcatctctccttgaaagc

SEQ ID NO: 56536 - DNA, 20 bp, Artificial Sequence
  chemically synthesized
ctcatctctccttgaaagca

SEQ ID NO: 56537 - DNA, 20 bp, Artificial Sequence
  chemically synthesized
tcatctctccttgaaagcag

SEQ ID NO: 56538 - DNA, 20 bp, Artificial Sequence
  chemically synthesized
caggggtttgtgctgcttta

SEQ ID NO: 56539 - DNA, 20 bp, Artificial Sequence
  chemically synthesized
gggtttgtgctgctttaaag

SEQ ID NO: 56540 - DNA, 20 bp, Artificial Sequence
  chemically synthesized
ttgtgctgctttaaagtaga

SEQ ID NO: 56541 - DNA, 20 bp, Artificial Sequence
  chemically synthesized
gtgctgctttaaagtagatg

SEQ ID NO: 56542 - DNA, 20 bp, Artificial Sequence
  chemically synthesized
tgctgctttaaagtagatgg

SEQ ID NO: 56543 - DNA, 20 bp, Artificial Sequence
  chemically synthesized
ctgctttaaagtagatggag

SEQ ID NO: 56544 - DNA, 20 bp, Artificial Sequence
  chemically synthesized
tgctttaaagtagatggagg

SEQ ID NO: 56545 - DNA, 20 bp, Artificial Sequence
  chemically synthesized
tttaaagtagatggaggagg

SEQ ID NO: 56546 - DNA, 20 bp, Artificial Sequence
  chemically synthesized
ttaaagtagatggaggaggt

SEQ ID NO: 56547 - DNA, 20 bp, Artificial Sequence
  chemically synthesized
aagtagatggaggaggtggg

SEQ ID NO: 56548 - DNA, 20 bp, Artificial Sequence
  chemically synthesized
tggaggaggtgggaagtgaa

SEQ ID NO: 56549 - DNA, 20 bp, Artificial Sequence
  chemically synthesized
aaagacacctcttttaactt

SEQ ID NO: 56550 - DNA, 20 bp, Artificial Sequence
  chemically synthesized
acacctcttttaacttcaga

SEQ ID NO: 56551 - DNA, 20 bp, Artificial Sequence
  chemically synthesized
cttttaacttcagatagacc

SEQ ID NO: 56552 - DNA, 20 bp, Artificial Sequence
  chemically synthesized
ttttaacttcagatagacct

SEQ ID NO: 56553 - DNA, 20 bp, Artificial Sequence
  chemically synthesized
aatctgactctgtcactttc

SEQ ID NO: 56554 - DNA, 20 bp, Artificial Sequence
  chemically synthesized
atctgactctgtcactttcc

SEQ ID NO: 56555 - DNA, 20 bp, Artificial Sequence
  chemically synthesized
ctgtcactttccaggtgtat

SEQ ID NO: 56556 - DNA, 20 bp, Artificial Sequence
  chemically synthesized
cactttccaggtgtatgagc

SEQ ID NO: 56557 - DNA, 20 bp, Artificial Sequence
  chemically synthesized
actttccaggtgtatgagcc

SEQ ID NO: 56558 - DNA, 20 bp, Artificial Sequence
  chemically synthesized
ccaggtgtatgagccaggac

SEQ ID NO: 56559 - DNA, 20 bp, Artificial Sequence
  chemically synthesized
ggacaagtcattcatctccc

SEQ ID NO: 56560 - DNA, 20 bp, Artificial Sequence
  chemically synthesized
ctcattttgcctcatacata

SEQ ID NO: 56561 - DNA, 20 bp, Artificial Sequence
  chemically synthesized
ataaagtgatgtttatgtat

SEQ ID NO: 56562 - DNA, 20 bp, Artificial Sequence
  chemically synthesized
gatgtttatgtatgagaatt

SEQ ID NO: 56563 - DNA, 20 bp, Artificial Sequence
  chemically synthesized
gtatgagaatttagtgaaat

SEQ ID NO: 56564 - DNA, 20 bp, Artificial Sequence
  chemically synthesized
aacaccaaaccttacatcaa

SEQ ID NO: 56565 - DNA, 20 bp, Artificial Sequence
  chemically synthesized
acaccaaaccttacatcaaa

SEQ ID NO: 56566 - DNA, 20 bp, Artificial Sequence
  chemically synthesized
accttacatcaaaaggatct

SEQ ID NO: 56567 - DNA, 20 bp, Artificial Sequence
  chemically synthesized
cttacatcaaaaggatctga

SEQ ID NO: 56568 - DNA, 20 bp, Artificial Sequence
  chemically synthesized
ttacatcaaaaggatctgag

SEQ ID NO: 56569 - DNA, 20 bp, Artificial Sequence
  chemically synthesized
tacatcaaaaggatctgaga

SEQ ID NO: 56570 - DNA, 20 bp, Artificial Sequence
  chemically synthesized
tctgagagggcaactctttt

SEQ ID NO: 56571 - DNA, 20 bp, Artificial Sequence
  chemically synthesized
ctgagagggcaactcttttg

SEQ ID NO: 56572 - DNA, 20 bp, Artificial Sequence
  chemically synthesized
tgagagggcaactcttttga

SEQ ID NO: 56573 - DNA, 20 bp, Artificial Sequence
  chemically synthesized
agagggcaactcttttgagg

SEQ ID NO: 56574 - DNA, 20 bp, Artificial Sequence
  chemically synthesized
gagggcaactcttttgaggg

SEQ ID NO: 56575 - DNA, 20 bp, Artificial Sequence
  chemically synthesized
agggcaactcttttgaggga

SEQ ID NO: 56576 - DNA, 20 bp, Artificial Sequence
  chemically synthesized
gggcaactcttttgagggag

SEQ ID NO: 56577 - DNA, 20 bp, Artificial Sequence
  chemically synthesized
aactcttttgagggaggggt

SEQ ID NO: 56578 - DNA, 20 bp, Artificial Sequence
  chemically synthesized
tcttttgagggaggggttgg

SEQ ID NO: 56579 - DNA, 20 bp, Artificial Sequence
  chemically synthesized
cttttgagggaggggttggc

SEQ ID NO: 56580 - DNA, 20 bp, Artificial Sequence
  chemically synthesized
tggcaggtgttgcaaattca

SEQ ID NO: 56581 - DNA, 20 bp, Artificial Sequence
  chemically synthesized
ggcaggtgttgcaaattcaa

SEQ ID NO: 56582 - DNA, 20 bp, Artificial Sequence
  chemically synthesized
tgttgcaaattcaaaggctt

SEQ ID NO: 56583 - DNA, 20 bp, Artificial Sequence
  chemically synthesized
gttgcaaattcaaaggcttc

SEQ ID NO: 56584 - DNA, 20 bp, Artificial Sequence
  chemically synthesized
aattcaaaggcttcaggtga

SEQ ID NO: 56585 - DNA, 20 bp, Artificial Sequence
  chemically synthesized
attcaaaggcttcaggtgat

SEQ ID NO: 56586 - DNA, 20 bp, Artificial Sequence
  chemically synthesized
aaaggcttcaggtgataggc

SEQ ID NO: 56587 - DNA, 20 bp, Artificial Sequence
  chemically synthesized
gcttcaggtgataggccagt

SEQ ID NO: 56588 - DNA, 20 bp, Artificial Sequence
  chemically synthesized
cttcaggtgataggccagtg

SEQ ID NO: 56589 - DNA, 20 bp, Artificial Sequence
  chemically synthesized
aggaatacatgtttcatacc

SEQ ID NO: 56590 - DNA, 20 bp, Artificial Sequence
  chemically synthesized
ggaatacatgtttcataccc

SEQ ID NO: 56591 - DNA, 20 bp, Artificial Sequence
  chemically synthesized
gaatacatgtttcatacccg

SEQ ID NO: 56592 - DNA, 20 bp, Artificial Sequence
  chemically synthesized
catgtttcatacccggggct

SEQ ID NO: 56593 - DNA, 20 bp, Artificial Sequence
  chemically synthesized
catacccggggctgagacaa

SEQ ID NO: 56594 - DNA, 20 bp, Artificial Sequence
  chemically synthesized
atacccggggctgagacaat

SEQ ID NO: 56595 - DNA, 20 bp, Artificial Sequence
  chemically synthesized
tacccggggctgagacaata

SEQ ID NO: 56596 - DNA, 20 bp, Artificial Sequence
  chemically synthesized
cccggggctgagacaatagg

SEQ ID NO: 56597 - DNA, 20 bp, Artificial Sequence
  chemically synthesized
ggggctgagacaatagggag

SEQ ID NO: 56598 - DNA, 20 bp, Artificial Sequence
  chemically synthesized
gctgagacaatagggagtgg

SEQ ID NO: 56599 - DNA, 20 bp, Artificial Sequence
  chemically synthesized
ctgagacaatagggagtggt

SEQ ID NO: 56600 - DNA, 20 bp, Artificial Sequence
  chemically synthesized
tgagacaatagggagtggtg

SEQ ID NO: 56601 - DNA, 20 bp, Artificial Sequence
  chemically synthesized
atagggagtggtggggcctg

SEQ ID NO: 56602 - DNA, 20 bp, Artificial Sequence
  chemically synthesized
ggtggggcctgtggctgaac

SEQ ID NO: 56603 - DNA, 20 bp, Artificial Sequence
  chemically synthesized
gggcctgtggctgaaccagc

SEQ ID NO: 56604 - DNA, 20 bp, Artificial Sequence
  chemically synthesized
gcctgtggctgaaccagcga

SEQ ID NO: 56605 - DNA, 20 bp, Artificial Sequence
  chemically synthesized
tgtggctgaaccagcgagag

SEQ ID NO: 56606 - DNA, 20 bp, Artificial Sequence
  chemically synthesized
gtggctgaaccagcgagagc

SEQ ID NO: 56607 - DNA, 20 bp, Artificial Sequence
  chemically synthesized
cagcgagagcaggctctgcc

SEQ ID NO: 56608 - DNA, 20 bp, Artificial Sequence
  chemically synthesized
gagcaggctctgccgagcaa

SEQ ID NO: 56609 - DNA, 20 bp, Artificial Sequence
  chemically synthesized
gctctgccgagcaatggtca

SEQ ID NO: 56610 - DNA, 20 bp, Artificial Sequence
  chemically synthesized
gtcaaagtcaacgtcatcca

SEQ ID NO: 56611 - DNA, 20 bp, Artificial Sequence
  chemically synthesized
caacgtcatccacagcaaca

SEQ ID NO: 56612 - DNA, 20 bp, Artificial Sequence
  chemically synthesized
acagaacctgccctgcccca

SEQ ID NO: 56613 - DNA, 20 bp, Artificial Sequence
  chemically synthesized
ccacagtgatccttctactc

SEQ ID NO: 56614 - DNA, 20 bp, Artificial Sequence
  chemically synthesized
ccttctactccagatatgcc

SEQ ID NO: 56615 - DNA, 20 bp, Artificial Sequence
  chemically synthesized
cttctactccagatatgccc

SEQ ID NO: 56616 - DNA, 20 bp, Artificial Sequence
  chemically synthesized
ctccagatatgcccaggctt

SEQ ID NO: 56617 - DNA, 20 bp, Artificial Sequence
  chemically synthesized
atgcccaggcttcggaccac

SEQ ID NO: 56618 - DNA, 20 bp, Artificial Sequence
  chemically synthesized
ggcttcggaccaccagcctg

SEQ ID NO: 56619 - DNA, 20 bp, Artificial Sequence
  chemically synthesized
accaccagcctgcagccccc

SEQ ID NO: 56620 - DNA, 20 bp, Artificial Sequence
  chemically synthesized
ccaccagcctgcagccccct

SEQ ID NO: 56621 - DNA, 20 bp, Artificial Sequence
  chemically synthesized
ccagcctgcagccccctagg

SEQ ID NO: 56622 - DNA, 20 bp, Artificial Sequence
  chemically synthesized
ggtagaacctgccgtcttca

SEQ ID NO: 56623 - DNA, 20 bp, Artificial Sequence
  chemically synthesized
gaacctgccgtcttcacaga

SEQ ID NO: 56624 - DNA, 20 bp, Artificial Sequence
  chemically synthesized
aacctgccgtcttcacagat

SEQ ID NO: 56625 - DNA, 20 bp, Artificial Sequence
  chemically synthesized
tcttcacagatgggaaaact

SEQ ID NO: 56626 - DNA, 20 bp, Artificial Sequence
  chemically synthesized
cttcacagatgggaaaactg

SEQ ID NO: 56627 - DNA, 20 bp, Artificial Sequence
  chemically synthesized
agatgggaaaactgaggtcc

SEQ ID NO: 56628 - DNA, 20 bp, Artificial Sequence
  chemically synthesized
ggaaaactgaggtcctagct

SEQ ID NO: 56629 - DNA, 20 bp, Artificial Sequence
  chemically synthesized
gaaaactgaggtcctagctg

SEQ ID NO: 56630 - DNA, 20 bp, Artificial Sequence
  chemically synthesized
aaactgaggtcctagctgag

SEQ ID NO: 56631 - DNA, 20 bp, Artificial Sequence
  chemically synthesized
ctagctgaggagaatatgcc

SEQ ID NO: 56632 - DNA, 20 bp, Artificial Sequence
  chemically synthesized
gctgaggagaatatgcccgg

SEQ ID NO: 56633 - DNA, 20 bp, Artificial Sequence
  chemically synthesized
gcagccacattgttaactac

SEQ ID NO: 56634 - DNA, 20 bp, Artificial Sequence
  chemically synthesized
catcatcttaacaaaataca

SEQ ID NO: 56635 - DNA, 20 bp, Artificial Sequence
  chemically synthesized
cttaacaaaatacaaagaaa

SEQ ID NO: 56636 - DNA, 20 bp, Artificial Sequence
  chemically synthesized
ttaacaaaatacaaagaaaa

SEQ ID NO: 56637 - DNA, 20 bp, Artificial Sequence
  chemically synthesized
gaaaaaggtgtccttgaatt

SEQ ID NO: 56638 - DNA, 20 bp, Artificial Sequence
  chemically synthesized
aaaaaggtgtccttgaattt

SEQ ID NO: 56639 - DNA, 20 bp, Artificial Sequence
  chemically synthesized
gaatttgggaaatgaaaaac

SEQ ID NO: 56640 - DNA, 20 bp, Artificial Sequence
  chemically synthesized
atttgggaaatgaaaaactg

SEQ ID NO: 56641 - DNA, 20 bp, Artificial Sequence
  chemically synthesized
aatgaaaaactggagaaaaa

SEQ ID NO: 56642 - DNA, 20 bp, Artificial Sequence
  chemically synthesized
aaaaactggagaaaaaaagc

SEQ ID NO: 56643 - DNA, 20 bp, Artificial Sequence
  chemically synthesized
agctggaaataacaaatatt

SEQ ID NO: 56644 - DNA, 20 bp, Artificial Sequence
  chemically synthesized
ttgagattcttcaaccccct

SEQ ID NO: 56645 - DNA, 20 bp, Artificial Sequence
  chemically synthesized
caacccccttggacttttaa

SEQ ID NO: 56646 - DNA, 20 bp, Artificial Sequence
  chemically synthesized
ttaaaagtttccttccaata

SEQ ID NO: 56647 - DNA, 20 bp, Artificial Sequence
  chemically synthesized
ttccaataaagcaacaaatg

SEQ ID NO: 56648 - DNA, 20 bp, Artificial Sequence
  chemically synthesized
aaagcaacaaatgaagtgca

SEQ ID NO: 56649 - DNA, 20 bp, Artificial Sequence
  chemically synthesized
caacaaatgaagtgcaaagc

SEQ ID NO: 56650 - DNA, 20 bp, Artificial Sequence
  chemically synthesized
tctctccaccacctttctcc

SEQ ID NO: 56651 - DNA, 20 bp, Artificial Sequence
  chemically synthesized
ctcctggccctcgtgcctct

SEQ ID NO: 56652 - DNA, 20 bp, Artificial Sequence
  chemically synthesized
gtgcctctaagtaatccaaa

SEQ ID NO: 56653 - DNA, 20 bp, Artificial Sequence
  chemically synthesized
tctaagtaatccaaatggaa

SEQ ID NO: 56654 - DNA, 20 bp, Artificial Sequence
  chemically synthesized
tacatgtttgtatttttctt

SEQ ID NO: 56655 - DNA, 20 bp, Artificial Sequence
  chemically synthesized
tgtttgtatttttcttcagc

SEQ ID NO: 56656 - DNA, 20 bp, Artificial Sequence
  chemically synthesized
tgtatttttcttcagctagc

SEQ ID NO: 56657 - DNA, 20 bp, Artificial Sequence
  chemically synthesized
cttcagctagctagtgttgt

SEQ ID NO: 56658 - DNA, 20 bp, Artificial Sequence
  chemically synthesized
agctagtgttgttagaacta

SEQ ID NO: 56659 - DNA, 20 bp, Artificial Sequence
  chemically synthesized
agtgttgttagaactaaaga

SEQ ID NO: 56660 - DNA, 20 bp, Artificial Sequence
  chemically synthesized
actaaagacggtgctaaaat

SEQ ID NO: 56661 - DNA, 20 bp, Artificial Sequence
  chemically synthesized
cttcccaactgaactttgtg

SEQ ID NO: 56662 - DNA, 20 bp, Artificial Sequence
  chemically synthesized
gaactttgtgcagtccttca

SEQ ID NO: 56663 - DNA, 20 bp, Artificial Sequence
  chemically synthesized
gtgcagtccttcatggctta

SEQ ID NO: 56664 - DNA, 20 bp, Artificial Sequence
  chemically synthesized
tggaaattcccccatcatta

SEQ ID NO: 56665 - DNA, 20 bp, Artificial Sequence
  chemically synthesized
ggaaattcccccatcattac

SEQ ID NO: 56666 - DNA, 20 bp, Artificial Sequence
  chemically synthesized
gaaattcccccatcattaca

SEQ ID NO: 56667 - DNA, 20 bp, Artificial Sequence
  chemically synthesized
tcccccatcattacagggct

SEQ ID NO: 56668 - DNA, 20 bp, Artificial Sequence
  chemically synthesized
cccatcattacagggctcag

SEQ ID NO: 56669 - DNA, 20 bp, Artificial Sequence
  chemically synthesized
tcattacagggctcagtggt

SEQ ID NO: 56670 - DNA, 20 bp, Artificial Sequence
  chemically synthesized
cattacagggctcagtggtc

SEQ ID NO: 56671 - DNA, 20 bp, Artificial Sequence
  chemically synthesized
ttacagggctcagtggtcag

SEQ ID NO: 56672 - DNA, 20 bp, Artificial Sequence
  chemically synthesized
tacagggctcagtggtcagg

SEQ ID NO: 56673 - DNA, 20 bp, Artificial Sequence
  chemically synthesized
acagggctcagtggtcagga

SEQ ID NO: 56674 - DNA, 20 bp, Artificial Sequence
  chemically synthesized
agggctcagtggtcaggagg

SEQ ID NO: 56675 - DNA, 20 bp, Artificial Sequence
  chemically synthesized
ctcagtggtcaggagggagt

SEQ ID NO: 56676 - DNA, 20 bp, Artificial Sequence
  chemically synthesized
tcagtggtcaggagggagtt

SEQ ID NO: 56677 - DNA, 20 bp, Artificial Sequence
  chemically synthesized
aggagggagttgggcctctg

SEQ ID NO: 56678 - DNA, 20 bp, Artificial Sequence
  chemically synthesized
ggagggagttgggcctctgc

SEQ ID NO: 56679 - DNA, 20 bp, Artificial Sequence
  chemically synthesized
gagggagttgggcctctgca

SEQ ID NO: 56680 - DNA, 20 bp, Artificial Sequence
  chemically synthesized
ggagttgggcctctgcaggg

SEQ ID NO: 56681 - DNA, 20 bp, Artificial Sequence
  chemically synthesized
gagttgggcctctgcagggt

SEQ ID NO: 56682 - DNA, 20 bp, Artificial Sequence
  chemically synthesized
agttgggcctctgcagggtg

SEQ ID NO: 56683 - DNA, 20 bp, Artificial Sequence
  chemically synthesized
gtggggacactaaatatgct

SEQ ID NO: 56684 - DNA, 20 bp, Artificial Sequence
  chemically synthesized
gggacactaaatatgctgag

SEQ ID NO: 56685 - DNA, 20 bp, Artificial Sequence
  chemically synthesized
ctaaatatgctgagtggcct

SEQ ID NO: 56686 - DNA, 20 bp, Artificial Sequence
  chemically synthesized
taaatatgctgagtggcctc

SEQ ID NO: 56687 - DNA, 20 bp, Artificial Sequence
  chemically synthesized
aaatatgctgagtggcctca

SEQ ID NO: 56688 - DNA, 20 bp, Artificial Sequence
  chemically synthesized
atgctgagtggcctcagggc

SEQ ID NO: 56689 - DNA, 20 bp, Artificial Sequence
  chemically synthesized
gctgagtggcctcagggcca

SEQ ID NO: 56690 - DNA, 20 bp, Artificial Sequence
  chemically synthesized
ctgagtggcctcagggccag

SEQ ID NO: 56691 - DNA, 20 bp, Artificial Sequence
  chemically synthesized
ggcctcagggccagaggttg

SEQ ID NO: 56692 - DNA, 20 bp, Artificial Sequence
  chemically synthesized
gggccagaggttgtggcttc

SEQ ID NO: 56693 - DNA, 20 bp, Artificial Sequence
  chemically synthesized
gaggttgtggcttctagccc

SEQ ID NO: 56694 - DNA, 20 bp, Artificial Sequence
  chemically synthesized
gttgtggcttctagccctgg

SEQ ID NO: 56695 - DNA, 20 bp, Artificial Sequence
  chemically synthesized
ttgtggcttctagccctggc

SEQ ID NO: 56696 - DNA, 20 bp, Artificial Sequence
  chemically synthesized
tgtggcttctagccctggca

SEQ ID NO: 56697 - DNA, 20 bp, Artificial Sequence
  chemically synthesized
cagggccatcactatccact

SEQ ID NO: 56698 - DNA, 20 bp, Artificial Sequence
  chemically synthesized
atcactatccacttggcctt

SEQ ID NO: 56699 - DNA, 20 bp, Artificial Sequence
  chemically synthesized
ctatccacttggcctttagc

SEQ ID NO: 56700 - DNA, 20 bp, Artificial Sequence
  chemically synthesized
ggcctttagcaagaatcctc

SEQ ID NO: 56701 - DNA, 20 bp, Artificial Sequence
  chemically synthesized
tagcaagaatcctctggtcc

SEQ ID NO: 56702 - DNA, 20 bp, Artificial Sequence
  chemically synthesized
agcaagaatcctctggtcct

SEQ ID NO: 56703 - DNA, 20 bp, Artificial Sequence
  chemically synthesized
gcaagaatcctctggtcctg

SEQ ID NO: 56704 - DNA, 20 bp, Artificial Sequence
  chemically synthesized
tcctggggcctcactctccc

SEQ ID NO: 56705 - DNA, 20 bp, Artificial Sequence
  chemically synthesized
tcactctccccagttgtgca

SEQ ID NO: 56706 - DNA, 20 bp, Artificial Sequence
  chemically synthesized
ctctccccagttgtgcaaag

SEQ ID NO: 56707 - DNA, 20 bp, Artificial Sequence
  chemically synthesized
tctccccagttgtgcaaagt

SEQ ID NO: 56708 - DNA, 20 bp, Artificial Sequence
  chemically synthesized
ctccccagttgtgcaaagtg

SEQ ID NO: 56709 - DNA, 20 bp, Artificial Sequence
  chemically synthesized
ccagttgtgcaaagtggggc

SEQ ID NO: 56710 - DNA, 20 bp, Artificial Sequence
  chemically synthesized
cagttgtgcaaagtggggct

SEQ ID NO: 56711 - DNA, 20 bp, Artificial Sequence
  chemically synthesized
gttgtgcaaagtggggctgg

SEQ ID NO: 56712 - DNA, 20 bp, Artificial Sequence
  chemically synthesized
gtgcaaagtggggctgggag

SEQ ID NO: 56713 - DNA, 20 bp, Artificial Sequence
  chemically synthesized
gggctgggagaagacttcac

SEQ ID NO: 56714 - DNA, 20 bp, Artificial Sequence
  chemically synthesized
ggctgggagaagacttcact

SEQ ID NO: 56715 - DNA, 20 bp, Artificial Sequence
  chemically synthesized
gctgggagaagacttcactg

SEQ ID NO: 56716 - DNA, 20 bp, Artificial Sequence
  chemically synthesized
gggccctctgtacactaaca

SEQ ID NO: 56717 - DNA, 20 bp, Artificial Sequence
  chemically synthesized
ggccctctgtacactaacat

SEQ ID NO: 56718 - DNA, 20 bp, Artificial Sequence
  chemically synthesized
tgtacactaacataggtttt

SEQ ID NO: 56719 - DNA, 20 bp, Artificial Sequence
  chemically synthesized
gtacactaacataggttttt

SEQ ID NO: 56720 - DNA, 20 bp, Artificial Sequence
  chemically synthesized
taggtttttgggtttttttt

SEQ ID NO: 56721 - DNA, 20 bp, Artificial Sequence
  chemically synthesized
tttttgggttttttttgaga

SEQ ID NO: 56722 - DNA, 20 bp, Artificial Sequence
  chemically synthesized
tttgggttttttttgagaca

SEQ ID NO: 56723 - DNA, 20 bp, Artificial Sequence
  chemically synthesized
cagagtctcgctttatctgc

SEQ ID NO: 56724 - DNA, 20 bp, Artificial Sequence
  chemically synthesized
agagtctcgctttatctgcc

SEQ ID NO: 56725 - DNA, 20 bp, Artificial Sequence
  chemically synthesized
gagtctcgctttatctgcca

SEQ ID NO: 56726 - DNA, 20 bp, Artificial Sequence
  chemically synthesized
tctcgctttatctgccaggg

SEQ ID NO: 56727 - DNA, 20 bp, Artificial Sequence
  chemically synthesized
tcgctttatctgccagggtg

SEQ ID NO: 56728 - DNA, 20 bp, Artificial Sequence
  chemically synthesized
ttatctgccagggtggagtg

SEQ ID NO: 56729 - DNA, 20 bp, Artificial Sequence
  chemically synthesized
tctgccagggtggagtgcag

SEQ ID NO: 56730 - DNA, 20 bp, Artificial Sequence
  chemically synthesized
ggagtgcagtggcgtgatct

SEQ ID NO: 56731 - DNA, 20 bp, Artificial Sequence
  chemically synthesized
tcactgaaacctccacctcc

SEQ ID NO: 56732 - DNA, 20 bp, Artificial Sequence
  chemically synthesized
cactgaaacctccacctccc

SEQ ID NO: 56733 - DNA, 20 bp, Artificial Sequence
  chemically synthesized
aacctccacctcccgggttc

SEQ ID NO: 56734 - DNA, 20 bp, Artificial Sequence
  chemically synthesized
ttcaagaaattcttctgtct

SEQ ID NO: 56735 - DNA, 20 bp, Artificial Sequence
  chemically synthesized
ttctgtctcagcttcccaaa

SEQ ID NO: 56736 - DNA, 20 bp, Artificial Sequence
  chemically synthesized
gtctcagcttcccaaatagc

SEQ ID NO: 56737 - DNA, 20 bp, Artificial Sequence
  chemically synthesized
tctcagcttcccaaatagct

SEQ ID NO: 56738 - DNA, 20 bp, Artificial Sequence
  chemically synthesized
ttcccaaatagctgggatta

SEQ ID NO: 56739 - DNA, 20 bp, Artificial Sequence
  chemically synthesized
tcccaaatagctgggattac

SEQ ID NO: 56740 - DNA, 20 bp, Artificial Sequence
  chemically synthesized
caggcgtgtgccaccacgcc

SEQ ID NO: 56741 - DNA, 20 bp, Artificial Sequence
  chemically synthesized
ctggctaatttttgtatttt

SEQ ID NO: 56742 - DNA, 20 bp, Artificial Sequence
  chemically synthesized
gctaatttttgtatttttag

SEQ ID NO: 56743 - DNA, 20 bp, Artificial Sequence
  chemically synthesized
taatttttgtatttttagta

SEQ ID NO: 56744 - DNA, 20 bp, Artificial Sequence
  chemically synthesized
tttgtatttttagtagagct

SEQ ID NO: 56745 - DNA, 20 bp, Artificial Sequence
  chemically synthesized
ttgtatttttagtagagctg

SEQ ID NO: 56746 - DNA, 20 bp, Artificial Sequence
  chemically synthesized
gagctgaggtttcaccgtgt

SEQ ID NO: 56747 - DNA, 20 bp, Artificial Sequence
  chemically synthesized
tgaggtttcaccgtgttggc

SEQ ID NO: 56748 - DNA, 20 bp, Artificial Sequence
  chemically synthesized
gaggtttcaccgtgttggcc

SEQ ID NO: 56749 - DNA, 20 bp, Artificial Sequence
  chemically synthesized
gtttcaccgtgttggccagg

SEQ ID NO: 56750 - DNA, 20 bp, Artificial Sequence
  chemically synthesized
tttcaccgtgttggccaggc

SEQ ID NO: 56751 - DNA, 20 bp, Artificial Sequence
  chemically synthesized
acctcttgatccgcctgcct

SEQ ID NO: 56752 - DNA, 20 bp, Artificial Sequence
  chemically synthesized
ccgcctgccttggcctccca

SEQ ID NO: 56753 - DNA, 20 bp, Artificial Sequence
  chemically synthesized
gccttggcctcccaaagtgc

SEQ ID NO: 56754 - DNA, 20 bp, Artificial Sequence
  chemically synthesized
ccttggcctcccaaagtgct

SEQ ID NO: 56755 - DNA, 20 bp, Artificial Sequence
  chemically synthesized
cttggcctcccaaagtgctg

SEQ ID NO: 56756 - DNA, 20 bp, Artificial Sequence
  chemically synthesized
ctcccaaagtgctggggtta

SEQ ID NO: 56757 - DNA, 20 bp, Artificial Sequence
  chemically synthesized
tcccaaagtgctggggttac

SEQ ID NO: 56758 - DNA, 20 bp, Artificial Sequence
  chemically synthesized
aaagtgctggggttacaggc

SEQ ID NO: 56759 - DNA, 20 bp, Artificial Sequence
  chemically synthesized
agtgctggggttacaggcga

SEQ ID NO: 56760 - DNA, 20 bp, Artificial Sequence
  chemically synthesized
caggcgagagcccctgcacc

SEQ ID NO: 56761 - DNA, 20 bp, Artificial Sequence
  chemically synthesized
cgagagcccctgcacccagc

SEQ ID NO: 56762 - DNA, 20 bp, Artificial Sequence
  chemically synthesized
gagagcccctgcacccagcc

SEQ ID NO: 56763 - DNA, 20 bp, Artificial Sequence
  chemically synthesized
ctgcacccagccaggattct

SEQ ID NO: 56764 - DNA, 20 bp, Artificial Sequence
  chemically synthesized
acccagccaggattcttggt

SEQ ID NO: 56765 - DNA, 20 bp, Artificial Sequence
  chemically synthesized
gccaggattcttggttagaa

SEQ ID NO: 56766 - DNA, 20 bp, Artificial Sequence
  chemically synthesized
ttcttggttagaatggcatc

SEQ ID NO: 56767 - DNA, 20 bp, Artificial Sequence
  chemically synthesized
tcttggttagaatggcatct

SEQ ID NO: 56768 - DNA, 20 bp, Artificial Sequence
  chemically synthesized
aatggcatctgggttcaatg

SEQ ID NO: 56769 - DNA, 20 bp, Artificial Sequence
  chemically synthesized
ctgggttcaatgtagcaaaa

SEQ ID NO: 56770 - DNA, 20 bp, Artificial Sequence
  chemically synthesized
gttcaatgtagcaaaacaga

SEQ ID NO: 56771 - DNA, 20 bp, Artificial Sequence
  chemically synthesized
tcaatgtagcaaaacagatg

SEQ ID NO: 56772 - DNA, 20 bp, Artificial Sequence
  chemically synthesized
aaacagatggagaattccca

SEQ ID NO: 56773 - DNA, 20 bp, Artificial Sequence
  chemically synthesized
agatggagaattcccatggc

SEQ ID NO: 56774 - DNA, 20 bp, Artificial Sequence
  chemically synthesized
gatggagaattcccatggct

SEQ ID NO: 56775 - DNA, 20 bp, Artificial Sequence
  chemically synthesized
gaattcccatggctaggcat

SEQ ID NO: 56776 - DNA, 20 bp, Artificial Sequence
  chemically synthesized
tcccatggctaggcatgaga

SEQ ID NO: 56777 - DNA, 20 bp, Artificial Sequence
  chemically synthesized
cccatggctaggcatgagac

SEQ ID NO: 56778 - DNA, 20 bp, Artificial Sequence
  chemically synthesized
gcatgagacaggtgccctcc

SEQ ID NO: 56779 - DNA, 20 bp, Artificial Sequence
  chemically synthesized
gagacaggtgccctcctaga

SEQ ID NO: 56780 - DNA, 20 bp, Artificial Sequence
  chemically synthesized
agacaggtgccctcctagac

SEQ ID NO: 56781 - DNA, 20 bp, Artificial Sequence
  chemically synthesized
gacaggtgccctcctagaca

SEQ ID NO: 56782 - DNA, 20 bp, Artificial Sequence
  chemically synthesized
acaggtgccctcctagacag

SEQ ID NO: 56783 - DNA, 20 bp, Artificial Sequence
  chemically synthesized
cctcctagacaggggaattc

SEQ ID NO: 56784 - DNA, 20 bp, Artificial Sequence
  chemically synthesized
ctcctagacaggggaattct

SEQ ID NO: 56785 - DNA, 20 bp, Artificial Sequence
  chemically synthesized
acaggggaattctgggctca

SEQ ID NO: 56786 - DNA, 20 bp, Artificial Sequence
  chemically synthesized
caggggaattctgggctcaa

SEQ ID NO: 56787 - DNA, 20 bp, Artificial Sequence
  chemically synthesized
ggggaattctgggctcaaag

SEQ ID NO: 56788 - DNA, 20 bp, Artificial Sequence
  chemically synthesized
gggaattctgggctcaaagg

SEQ ID NO: 56789 - DNA, 20 bp, Artificial Sequence
  chemically synthesized
aattctgggctcaaaggagg

SEQ ID NO: 56790 - DNA, 20 bp, Artificial Sequence
  chemically synthesized
ttctgggctcaaaggaggtg

SEQ ID NO: 56791 - DNA, 20 bp, Artificial Sequence
  chemically synthesized
ctgggctcaaaggaggtgga

SEQ ID NO: 56792 - DNA, 20 bp, Artificial Sequence
  chemically synthesized
tgggctcaaaggaggtggag

SEQ ID NO: 56793 - DNA, 20 bp, Artificial Sequence
  chemically synthesized
ctcaaaggaggtggagaggc

SEQ ID NO: 56794 - DNA, 20 bp, Artificial Sequence
  chemically synthesized
aggaggtggagaggctggtg

SEQ ID NO: 56795 - DNA, 20 bp, Artificial Sequence
  chemically synthesized
ggaggtggagaggctggtgc

SEQ ID NO: 56796 - DNA, 20 bp, Artificial Sequence
  chemically synthesized
gaggtggagaggctggtgca

SEQ ID NO: 56797 - DNA, 20 bp, Artificial Sequence
  chemically synthesized
ggtggagaggctggtgcagg

SEQ ID NO: 56798 - DNA, 20 bp, Artificial Sequence
  chemically synthesized
gtggagaggctggtgcaggg

SEQ ID NO: 56799 - DNA, 20 bp, Artificial Sequence
  chemically synthesized
tggagaggctggtgcaggga

SEQ ID NO: 56800 - DNA, 20 bp, Artificial Sequence
  chemically synthesized
agaggctggtgcagggaggg

SEQ ID NO: 56801 - DNA, 20 bp, Artificial Sequence
  chemically synthesized
gctggtgcagggagggtggc

SEQ ID NO: 56802 - DNA, 20 bp, Artificial Sequence
  chemically synthesized
ctggtgcagggagggtggcg

SEQ ID NO: 56803 - DNA, 20 bp, Artificial Sequence
  chemically synthesized
tggtgcagggagggtggcga

SEQ ID NO: 56804 - DNA, 20 bp, Artificial Sequence
  chemically synthesized
ggtgcagggagggtggcgag

SEQ ID NO: 56805 - DNA, 20 bp, Artificial Sequence
  chemically synthesized
gtgcagggagggtggcgagg

SEQ ID NO: 56806 - DNA, 20 bp, Artificial Sequence
  chemically synthesized
ggagggtggcgagggggtga

SEQ ID NO: 56807 - DNA, 20 bp, Artificial Sequence
  chemically synthesized
ggtggcgagggggtgacagc

SEQ ID NO: 56808 - DNA, 20 bp, Artificial Sequence
  chemically synthesized
gtggcgagggggtgacagct

SEQ ID NO: 56809 - DNA, 20 bp, Artificial Sequence
  chemically synthesized
ggcgagggggtgacagctgg

SEQ ID NO: 56810 - DNA, 20 bp, Artificial Sequence
  chemically synthesized
gcgagggggtgacagctggg

SEQ ID NO: 56811 - DNA, 20 bp, Artificial Sequence
  chemically synthesized
gagggggtgacagctgggag

SEQ ID NO: 56812 - DNA, 20 bp, Artificial Sequence
  chemically synthesized
ccacacccatccatctttcc

SEQ ID NO: 56813 - DNA, 20 bp, Artificial Sequence
  chemically synthesized
tggtgtcacatcacctactc

SEQ ID NO: 56814 - DNA, 20 bp, Artificial Sequence
  chemically synthesized
actctggtttcctcctttca

SEQ ID NO: 56815 - DNA, 20 bp, Artificial Sequence
  chemically synthesized
ggtttcctcctttcacagtg

SEQ ID NO: 56816 - DNA, 20 bp, Artificial Sequence
  chemically synthesized
tttcctcctttcacagtgaa

SEQ ID NO: 56817 - DNA, 20 bp, Artificial Sequence
  chemically synthesized
ctttcacagtgaagagtttg

SEQ ID NO: 56818 - DNA, 20 bp, Artificial Sequence
  chemically synthesized
acagtgaagagtttgaagcc

SEQ ID NO: 56819 - DNA, 20 bp, Artificial Sequence
  chemically synthesized
agtgaagagtttgaagccca

SEQ ID NO: 56820 - DNA, 20 bp, Artificial Sequence
  chemically synthesized
tgaagagtttgaagcccaga

SEQ ID NO: 56821 - DNA, 20 bp, Artificial Sequence
  chemically synthesized
gaagagtttgaagcccagag

SEQ ID NO: 56822 - DNA, 20 bp, Artificial Sequence
  chemically synthesized
aagagtttgaagcccagaga

SEQ ID NO: 56823 - DNA, 20 bp, Artificial Sequence
  chemically synthesized
gtttgaagcccagagagggt

SEQ ID NO: 56824 - DNA, 20 bp, Artificial Sequence
  chemically synthesized
tttgaagcccagagagggtc

SEQ ID NO: 56825 - DNA, 20 bp, Artificial Sequence
  chemically synthesized
ttgaagcccagagagggtca

SEQ ID NO: 56826 - DNA, 20 bp, Artificial Sequence
  chemically synthesized
gagagggtcagggccttgtt

SEQ ID NO: 56827 - DNA, 20 bp, Artificial Sequence
  chemically synthesized
agagggtcagggccttgttg

SEQ ID NO: 56828 - DNA, 20 bp, Artificial Sequence
  chemically synthesized
agggccttgttgaggctata

SEQ ID NO: 56829 - DNA, 20 bp, Artificial Sequence
  chemically synthesized
ccttgttgaggctatacagc

SEQ ID NO: 56830 - DNA, 20 bp, Artificial Sequence
  chemically synthesized
gttgaggctatacagcaagt

SEQ ID NO: 56831 - DNA, 20 bp, Artificial Sequence
  chemically synthesized
tatacagcaagtcagtgaca

SEQ ID NO: 56832 - DNA, 20 bp, Artificial Sequence
  chemically synthesized
cagcaagtcagtgacaaagc

SEQ ID NO: 56833 - DNA, 20 bp, Artificial Sequence
  chemically synthesized
gtcagtgacaaagctggaac

SEQ ID NO: 56834 - DNA, 20 bp, Artificial Sequence
  chemically synthesized
gacaaagctggaacaagtct

SEQ ID NO: 56835 - DNA, 20 bp, Artificial Sequence
  chemically synthesized
ggaacaagtcttggctttcc

SEQ ID NO: 56836 - DNA, 20 bp, Artificial Sequence
  chemically synthesized
gtcttggctttcccagcact

SEQ ID NO: 56837 - DNA, 20 bp, Artificial Sequence
  chemically synthesized
cagcactcagatcatgaact

SEQ ID NO: 56838 - DNA, 20 bp, Artificial Sequence
  chemically synthesized
actcagatcatgaactgaga

SEQ ID NO: 56839 - DNA, 20 bp, Artificial Sequence
  chemically synthesized
aactgagacagctgtgtcct

SEQ ID NO: 56840 - DNA, 20 bp, Artificial Sequence
  chemically synthesized
acagctgtgtcctcagatct

SEQ ID NO: 56841 - DNA, 20 bp, Artificial Sequence
  chemically synthesized
agatctcagatgatgaatgt

SEQ ID NO: 56842 - DNA, 20 bp, Artificial Sequence
  chemically synthesized
cagatgatgaatgtcagaat

SEQ ID NO: 56843 - DNA, 20 bp, Artificial Sequence
  chemically synthesized
agatgatgaatgtcagaatt

SEQ ID NO: 56844 - DNA, 20 bp, Artificial Sequence
  chemically synthesized
tcagaattgggctgtgacat

SEQ ID NO: 56845 - DNA, 20 bp, Artificial Sequence
  chemically synthesized
tgggctgtgacattggtctc

SEQ ID NO: 56846 - DNA, 20 bp, Artificial Sequence
  chemically synthesized
attggtctcaagcatcatgt

SEQ ID NO: 56847 - DNA, 20 bp, Artificial Sequence
  chemically synthesized
ttggtctcaagcatcatgtt

SEQ ID NO: 56848 - DNA, 20 bp, Artificial Sequence
  chemically synthesized
ttgggttcattatgcctccc

SEQ ID NO: 56849 - DNA, 20 bp, Artificial Sequence
  chemically synthesized
caagctgttccttataacat

SEQ ID NO: 56850 - DNA, 20 bp, Artificial Sequence
  chemically synthesized
aagctgttccttataacatc

SEQ ID NO: 56851 - DNA, 20 bp, Artificial Sequence
  chemically synthesized
ctccaaaacctgctctctcc

SEQ ID NO: 56852 - DNA, 20 bp, Artificial Sequence
  chemically synthesized
ctctctcctggcccttctat

SEQ ID NO: 56853 - DNA, 20 bp, Artificial Sequence
  chemically synthesized
ctctcctggcccttctatca

SEQ ID NO: 56854 - DNA, 20 bp, Artificial Sequence
  chemically synthesized
tctcctggcccttctatcag

SEQ ID NO: 56855 - DNA, 20 bp, Artificial Sequence
  chemically synthesized
cctggcccttctatcagagg

SEQ ID NO: 56856 - DNA, 20 bp, Artificial Sequence
  chemically synthesized
gcagcaccctgcactcctaa

SEQ ID NO: 56857 - DNA, 20 bp, Artificial Sequence
  chemically synthesized
caccctgcactcctaaaagc

SEQ ID NO: 56858 - DNA, 20 bp, Artificial Sequence
  chemically synthesized
cactcctaaaagctagtgcc

SEQ ID NO: 56859 - DNA, 20 bp, Artificial Sequence
  chemically synthesized
actcctaaaagctagtgcct

SEQ ID NO: 56860 - DNA, 20 bp, Artificial Sequence
  chemically synthesized
tcctaaaagctagtgcctgg

SEQ ID NO: 56861 - DNA, 20 bp, Artificial Sequence
  chemically synthesized
cctaaaagctagtgcctggg

SEQ ID NO: 56862 - DNA, 20 bp, Artificial Sequence
  chemically synthesized
ctaaaagctagtgcctggga

SEQ ID NO: 56863 - DNA, 20 bp, Artificial Sequence
  chemically synthesized
ctagtgcctgggagggcgac

SEQ ID NO: 56864 - DNA, 20 bp, Artificial Sequence
  chemically synthesized
agtgcctgggagggcgactg

SEQ ID NO: 56865 - DNA, 20 bp, Artificial Sequence
  chemically synthesized
tgcctgggagggcgactgga

SEQ ID NO: 56866 - DNA, 20 bp, Artificial Sequence
  chemically synthesized
gcctgggagggcgactggag

SEQ ID NO: 56867 - DNA, 20 bp, Artificial Sequence
  chemically synthesized
ctgggagggcgactggagag

SEQ ID NO: 56868 - DNA, 20 bp, Artificial Sequence
  chemically synthesized
gagggcgactggagaggaga

SEQ ID NO: 56869 - DNA, 20 bp, Artificial Sequence
  chemically synthesized
gagaggagaaagtcgccatc

SEQ ID NO: 56870 - DNA, 20 bp, Artificial Sequence
  chemically synthesized
gagaaagtcgccatctggcc

SEQ ID NO: 56871 - DNA, 20 bp, Artificial Sequence
  chemically synthesized
ccatctggccaagtacccca

SEQ ID NO: 56872 - DNA, 20 bp, Artificial Sequence
  chemically synthesized
gccaagtaccccatggtgta

SEQ ID NO: 56873 - DNA, 20 bp, Artificial Sequence
  chemically synthesized
ccccatggtgtacggacact

SEQ ID NO: 56874 - DNA, 20 bp, Artificial Sequence
  chemically synthesized
cccatggtgtacggacactg

SEQ ID NO: 56875 - DNA, 20 bp, Artificial Sequence
  chemically synthesized
ggtgtacggacactgaggcc

SEQ ID NO: 56876 - DNA, 20 bp, Artificial Sequence
  chemically synthesized
gaggccaagctttaaaccaa

SEQ ID NO: 56877 - DNA, 20 bp, Artificial Sequence
  chemically synthesized
agctttaaaccaaaagaatg

SEQ ID NO: 56878 - DNA, 20 bp, Artificial Sequence
  chemically synthesized
gctttaaaccaaaagaatga

SEQ ID NO: 56879 - DNA, 20 bp, Artificial Sequence
  chemically synthesized
ccaaaagaatgaaggcttca

SEQ ID NO: 56880 - DNA, 20 bp, Artificial Sequence
  chemically synthesized
aggcttcatggtgacatttc

SEQ ID NO: 56881 - DNA, 20 bp, Artificial Sequence
  chemically synthesized
ggcttcatggtgacatttct

SEQ ID NO: 56882 - DNA, 20 bp, Artificial Sequence
  chemically synthesized
catggtgacatttctgggat

SEQ ID NO: 56883 - DNA, 20 bp, Artificial Sequence
  chemically synthesized
atggtgacatttctgggatc

SEQ ID NO: 56884 - DNA, 20 bp, Artificial Sequence
  chemically synthesized
tggtgacatttctgggatcg

SEQ ID NO: 56885 - DNA, 20 bp, Artificial Sequence
  chemically synthesized
tgacatttctgggatcgggg

SEQ ID NO: 56886 - DNA, 20 bp, Artificial Sequence
  chemically synthesized
gacatttctgggatcggggc

SEQ ID NO: 56887 - DNA, 20 bp, Artificial Sequence
  chemically synthesized
atttctgggatcggggcagg

SEQ ID NO: 56888 - DNA, 20 bp, Artificial Sequence
  chemically synthesized
tttctgggatcggggcaggt

SEQ ID NO: 56889 - DNA, 20 bp, Artificial Sequence
  chemically synthesized
tctgggatcggggcaggtgg

SEQ ID NO: 56890 - DNA, 20 bp, Artificial Sequence
  chemically synthesized
gcaggtgggagcactctttg

SEQ ID NO: 56891 - DNA, 20 bp, Artificial Sequence
  chemically synthesized
caggtgggagcactctttgc

SEQ ID NO: 56892 - DNA, 20 bp, Artificial Sequence
  chemically synthesized
aggtgggagcactctttgcg

SEQ ID NO: 56893 - DNA, 20 bp, Artificial Sequence
  chemically synthesized
gggagcactctttgcggggc

SEQ ID NO: 56894 - DNA, 20 bp, Artificial Sequence
  chemically synthesized
ggagcactctttgcggggcc

SEQ ID NO: 56895 - DNA, 20 bp, Artificial Sequence
  chemically synthesized
gagcactctttgcggggcca

SEQ ID NO: 56896 - DNA, 20 bp, Artificial Sequence
  chemically synthesized
actctttgcggggccaggga

SEQ ID NO: 56897 - DNA, 20 bp, Artificial Sequence
  chemically synthesized
ctctttgcggggccagggac

SEQ ID NO: 56898 - DNA, 20 bp, Artificial Sequence
  chemically synthesized
tctttgcggggccagggaca

SEQ ID NO: 56899 - DNA, 20 bp, Artificial Sequence
  chemically synthesized
ttgcggggccagggacaggg

SEQ ID NO: 56900 - DNA, 20 bp, Artificial Sequence
  chemically synthesized
ggggccagggacagggaagc

SEQ ID NO: 56901 - DNA, 20 bp, Artificial Sequence
  chemically synthesized
aatctcacaccatttctacc

SEQ ID NO: 56902 - DNA, 20 bp, Artificial Sequence
  chemically synthesized
atctcacaccatttctaccc

SEQ ID NO: 56903 - DNA, 20 bp, Artificial Sequence
  chemically synthesized
ctcacaccatttctacccgg

SEQ ID NO: 56904 - DNA, 20 bp, Artificial Sequence
  chemically synthesized
tctacccgggagcataaaat

SEQ ID NO: 56905 - DNA, 20 bp, Artificial Sequence
  chemically synthesized
ctacccgggagcataaaata

SEQ ID NO: 56906 - DNA, 20 bp, Artificial Sequence
  chemically synthesized
tacccgggagcataaaataa

SEQ ID NO: 56907 - DNA, 20 bp, Artificial Sequence
  chemically synthesized
ggagcataaaataagggacc

SEQ ID NO: 56908 - DNA, 20 bp, Artificial Sequence
  chemically synthesized
agcataaaataagggaccaa

SEQ ID NO: 56909 - DNA, 20 bp, Artificial Sequence
  chemically synthesized
ataagggaccaagagcaacc

SEQ ID NO: 56910 - DNA, 20 bp, Artificial Sequence
  chemically synthesized
agggaccaagagcaacccgg

SEQ ID NO: 56911 - DNA, 20 bp, Artificial Sequence
  chemically synthesized
gggaccaagagcaacccggc

SEQ ID NO: 56912 - DNA, 20 bp, Artificial Sequence
  chemically synthesized
ggaccaagagcaacccggca

SEQ ID NO: 56913 - DNA, 20 bp, Artificial Sequence
  chemically synthesized
aagagcaacccggcagggtg

SEQ ID NO: 56914 - DNA, 20 bp, Artificial Sequence
  chemically synthesized
agagcaacccggcagggtgc

SEQ ID NO: 56915 - DNA, 20 bp, Artificial Sequence
  chemically synthesized
gagcaacccggcagggtgca

SEQ ID NO: 56916 - DNA, 20 bp, Artificial Sequence
  chemically synthesized
caacccggcagggtgcaggg

SEQ ID NO: 56917 - DNA, 20 bp, Artificial Sequence
  chemically synthesized
acccggcagggtgcagggaa

SEQ ID NO: 56918 - DNA, 20 bp, Artificial Sequence
  chemically synthesized
agggaagagaatctcgccta

SEQ ID NO: 56919 - DNA, 20 bp, Artificial Sequence
  chemically synthesized
ggtcaaacaacctgttgaac

SEQ ID NO: 56920 - DNA, 20 bp, Artificial Sequence
  chemically synthesized
gtcaaacaacctgttgaact

SEQ ID NO: 56921 - DNA, 20 bp, Artificial Sequence
  chemically synthesized
actgggcaataaataaaccc

SEQ ID NO: 56922 - DNA, 20 bp, Artificial Sequence
  chemically synthesized
taaataaacccaagtgtgac

SEQ ID NO: 56923 - DNA, 20 bp, Artificial Sequence
  chemically synthesized
aaataaacccaagtgtgacc

SEQ ID NO: 56924 - DNA, 20 bp, Artificial Sequence
  chemically synthesized
gaccaggccctgtcacttac

SEQ ID NO: 56925 - DNA, 20 bp, Artificial Sequence
  chemically synthesized
caggccctgtcacttactgg

SEQ ID NO: 56926 - DNA, 20 bp, Artificial Sequence
  chemically synthesized
aggccctgtcacttactggc

SEQ ID NO: 56927 - DNA, 20 bp, Artificial Sequence
  chemically synthesized
ggccctgtcacttactggca

SEQ ID NO: 56928 - DNA, 20 bp, Artificial Sequence
  chemically synthesized
gccctgtcacttactggcag

SEQ ID NO: 56929 - DNA, 20 bp, Artificial Sequence
  chemically synthesized
ccctgtcacttactggcagg

SEQ ID NO: 56930 - DNA, 20 bp, Artificial Sequence
  chemically synthesized
tcacttactggcagggggcc

SEQ ID NO: 56931 - DNA, 20 bp, Artificial Sequence
  chemically synthesized
cacttactggcagggggcct

SEQ ID NO: 56932 - DNA, 20 bp, Artificial Sequence
  chemically synthesized
acttactggcagggggcctg

SEQ ID NO: 56933 - DNA, 20 bp, Artificial Sequence
  chemically synthesized
gtaaatgacttcacttcttt

SEQ ID NO: 56934 - DNA, 20 bp, Artificial Sequence
  chemically synthesized
gacttcacttctttgagcac

SEQ ID NO: 56935 - DNA, 20 bp, Artificial Sequence
  chemically synthesized
ttctttgagcactagcttca

SEQ ID NO: 56936 - DNA, 20 bp, Artificial Sequence
  chemically synthesized
ctagcttcatagctgtacaa

SEQ ID NO: 56937 - DNA, 20 bp, Artificial Sequence
  chemically synthesized
agcttcatagctgtacaatg

SEQ ID NO: 56938 - DNA, 20 bp, Artificial Sequence
  chemically synthesized
catagctgtacaatggagaa

SEQ ID NO: 56939 - DNA, 20 bp, Artificial Sequence
  chemically synthesized
caatggagaaaagaatcctt

SEQ ID NO: 56940 - DNA, 20 bp, Artificial Sequence
  chemically synthesized
ggagaaaagaatcctttgga

SEQ ID NO: 56941 - DNA, 20 bp, Artificial Sequence
  chemically synthesized
gagaaaagaatcctttggac

SEQ ID NO: 56942 - DNA, 20 bp, Artificial Sequence
  chemically synthesized
agaaaagaatcctttggaca

SEQ ID NO: 56943 - DNA, 20 bp, Artificial Sequence
  chemically synthesized
agaatcctttggacagggat

SEQ ID NO: 56944 - DNA, 20 bp, Artificial Sequence
  chemically synthesized
gaatcctttggacagggatg

SEQ ID NO: 56945 - DNA, 20 bp, Artificial Sequence
  chemically synthesized
gaataactgacgtaatgcat

SEQ ID NO: 56946 - DNA, 20 bp, Artificial Sequence
  chemically synthesized
taactgacgtaatgcatgag

SEQ ID NO: 56947 - DNA, 20 bp, Artificial Sequence
  chemically synthesized
aactgacgtaatgcatgagt

SEQ ID NO: 56948 - DNA, 20 bp, Artificial Sequence
  chemically synthesized
cgtaatgcatgagtgggcac

SEQ ID NO: 56949 - DNA, 20 bp, Artificial Sequence
  chemically synthesized
gtaatgcatgagtgggcacc

SEQ ID NO: 56950 - DNA, 20 bp, Artificial Sequence
  chemically synthesized
tgcatgagtgggcaccaggt

SEQ ID NO: 56951 - DNA, 20 bp, Artificial Sequence
  chemically synthesized
gcatgagtgggcaccaggtg

SEQ ID NO: 56952 - DNA, 20 bp, Artificial Sequence
  chemically synthesized
tgagtgggcaccaggtgagg

SEQ ID NO: 56953 - DNA, 20 bp, Artificial Sequence
  chemically synthesized
gccctccctgtacctgcaca

SEQ ID NO: 56954 - DNA, 20 bp, Artificial Sequence
  chemically synthesized
ccctccctgtacctgcacac

SEQ ID NO: 56955 - DNA, 20 bp, Artificial Sequence
  chemically synthesized
cctgtacctgcacacaggtt

SEQ ID NO: 56956 - DNA, 20 bp, Artificial Sequence
  chemically synthesized
cacaggttgagctcctgccc

SEQ ID NO: 56957 - DNA, 20 bp, Artificial Sequence
  chemically synthesized
caggttgagctcctgcccga

SEQ ID NO: 56958 - DNA, 20 bp, Artificial Sequence
  chemically synthesized
ttgagctcctgcccgagaga

SEQ ID NO: 56959 - DNA, 20 bp, Artificial Sequence
  chemically synthesized
agctcctgcccgagagatgg

SEQ ID NO: 56960 - DNA, 20 bp, Artificial Sequence
  chemically synthesized
agagatggtagatttcttcc

SEQ ID NO: 56961 - DNA, 20 bp, Artificial Sequence
  chemically synthesized
agatggtagatttcttcccg

SEQ ID NO: 56962 - DNA, 20 bp, Artificial Sequence
  chemically synthesized
atggtagatttcttcccgga

SEQ ID NO: 56963 - DNA, 20 bp, Artificial Sequence
  chemically synthesized
ggagagcctgctgcactccc

SEQ ID NO: 56964 - DNA, 20 bp, Artificial Sequence
  chemically synthesized
gagagcctgctgcactcccc

SEQ ID NO: 56965 - DNA, 20 bp, Artificial Sequence
  chemically synthesized
tgcactccccaggaccattt

SEQ ID NO: 56966 - DNA, 20 bp, Artificial Sequence
  chemically synthesized
actccccaggaccatttcag

SEQ ID NO: 56967 - DNA, 20 bp, Artificial Sequence
  chemically synthesized
ctccccaggaccatttcagc

SEQ ID NO: 56968 - DNA, 20 bp, Artificial Sequence
  chemically synthesized
cccaggaccatttcagcagg

SEQ ID NO: 56969 - DNA, 20 bp, Artificial Sequence
  chemically synthesized
ccaggaccatttcagcagga

SEQ ID NO: 56970 - DNA, 20 bp, Artificial Sequence
  chemically synthesized
caggaccatttcagcaggaa

SEQ ID NO: 56971 - DNA, 20 bp, Artificial Sequence
  chemically synthesized
aggaccatttcagcaggaag

SEQ ID NO: 56972 - DNA, 20 bp, Artificial Sequence
  chemically synthesized
agcaggaaggggctcctgct

SEQ ID NO: 56973 - DNA, 20 bp, Artificial Sequence
  chemically synthesized
aggaaggggctcctgctcag

SEQ ID NO: 56974 - DNA, 20 bp, Artificial Sequence
  chemically synthesized
ggctcctgctcagcagtgaa

SEQ ID NO: 56975 - DNA, 20 bp, Artificial Sequence
  chemically synthesized
ctcagcagtgaacagcatct

SEQ ID NO: 56976 - DNA, 20 bp, Artificial Sequence
  chemically synthesized
cagtgaacagcatctgagtt

SEQ ID NO: 56977 - DNA, 20 bp, Artificial Sequence
  chemically synthesized
tccaactgtttactgcctgc

SEQ ID NO: 56978 - DNA, 20 bp, Artificial Sequence
  chemically synthesized
cagctgcctaaccctatgct

SEQ ID NO: 56979 - DNA, 20 bp, Artificial Sequence
  chemically synthesized
accctatgctaagcaaacat

SEQ ID NO: 56980 - DNA, 20 bp, Artificial Sequence
  chemically synthesized
tgctaagcaaacatcagcct

SEQ ID NO: 56981 - DNA, 20 bp, Artificial Sequence
  chemically synthesized
ttgccacacttactaacacc

SEQ ID NO: 56982 - DNA, 20 bp, Artificial Sequence
  chemically synthesized
tactaacacctggtgtttta

SEQ ID NO: 56983 - DNA, 20 bp, Artificial Sequence
  chemically synthesized
actaacacctggtgttttac

SEQ ID NO: 56984 - DNA, 20 bp, Artificial Sequence
  chemically synthesized
tatcatctaatctgtcctca

SEQ ID NO: 56985 - DNA, 20 bp, Artificial Sequence
  chemically synthesized
gtcctcaaagcttaccctat

SEQ ID NO: 56986 - DNA, 20 bp, Artificial Sequence
  chemically synthesized
tcctcaaagcttaccctata

SEQ ID NO: 56987 - DNA, 20 bp, Artificial Sequence
  chemically synthesized
ccctataaggtgcaaattat

SEQ ID NO: 56988 - DNA, 20 bp, Artificial Sequence
  chemically synthesized
aaattattagccctatttta

SEQ ID NO: 56989 - DNA, 20 bp, Artificial Sequence
  chemically synthesized
tattagccctattttataga

SEQ ID NO: 56990 - DNA, 20 bp, Artificial Sequence
  chemically synthesized
attttatagatagaaaaatt

SEQ ID NO: 56991 - DNA, 20 bp, Artificial Sequence
  chemically synthesized
gatagaaaaattgagcccca

SEQ ID NO: 56992 - DNA, 20 bp, Artificial Sequence
  chemically synthesized
tagaaaaattgagccccaaa

SEQ ID NO: 56993 - DNA, 20 bp, Artificial Sequence
  chemically synthesized
aaataactcactaaaaatca

SEQ ID NO: 56994 - DNA, 20 bp, Artificial Sequence
  chemically synthesized
ataactcactaaaaatcaca

SEQ ID NO: 56995 - DNA, 20 bp, Artificial Sequence
  chemically synthesized
agctacttgcttacaaaact

SEQ ID NO: 56996 - DNA, 20 bp, Artificial Sequence
  chemically synthesized
gtaatcctaaatgttttgtc

SEQ ID NO: 56997 - DNA, 20 bp, Artificial Sequence
  chemically synthesized
taatcctaaatgttttgtct

SEQ ID NO: 56998 - DNA, 20 bp, Artificial Sequence
  chemically synthesized
atgttttgtctgggattaaa

SEQ ID NO: 56999 - DNA, 20 bp, Artificial Sequence
  chemically synthesized
ttgaatcatctctgtgtaca

SEQ ID NO: 57000 - DNA, 20 bp, Artificial Sequence
  chemically synthesized
catctctgtgtacaaagctg

SEQ ID NO: 57001 - DNA, 20 bp, Artificial Sequence
  chemically synthesized
tctgtgtacaaagctgaagc

SEQ ID NO: 57002 - DNA, 20 bp, Artificial Sequence
  chemically synthesized
gtgtacaaagctgaagccag

SEQ ID NO: 57003 - DNA, 20 bp, Artificial Sequence
  chemically synthesized
tgaagccagaagtcttgaat

SEQ ID NO: 57004 - DNA, 20 bp, Artificial Sequence
  chemically synthesized
agtcttgaatcagaaaactt

SEQ ID NO: 57005 - DNA, 20 bp, Artificial Sequence
  chemically synthesized
tcttgaatcagaaaacttca

SEQ ID NO: 57006 - DNA, 20 bp, Artificial Sequence
  chemically synthesized
cttgaatcagaaaacttcag

SEQ ID NO: 57007 - DNA, 20 bp, Artificial Sequence
  chemically synthesized
gaatcagaaaacttcagagg

SEQ ID NO: 57008 - DNA, 20 bp, Artificial Sequence
  chemically synthesized
agaaaacttcagaggcagcc

SEQ ID NO: 57009 - DNA, 20 bp, Artificial Sequence
  chemically synthesized
agaggcagcctggctaaatg

SEQ ID NO: 57010 - DNA, 20 bp, Artificial Sequence
  chemically synthesized
aggcagcctggctaaatgaa

SEQ ID NO: 57011 - DNA, 20 bp, Artificial Sequence
  chemically synthesized
ggcagcctggctaaatgaag

SEQ ID NO: 57012 - DNA, 20 bp, Artificial Sequence
  chemically synthesized
gcagcctggctaaatgaaga

SEQ ID NO: 57013 - DNA, 20 bp, Artificial Sequence
  chemically synthesized
cagcctggctaaatgaagag

SEQ ID NO: 57014 - DNA, 20 bp, Artificial Sequence
  chemically synthesized
gcctggctaaatgaagaggg

SEQ ID NO: 57015 - DNA, 20 bp, Artificial Sequence
  chemically synthesized
ctaaatgaagaggggagcat

SEQ ID NO: 57016 - DNA, 20 bp, Artificial Sequence
  chemically synthesized
aagaggggagcatcagtctg

SEQ ID NO: 57017 - DNA, 20 bp, Artificial Sequence
  chemically synthesized
tcagtctgtggctaaaatta

SEQ ID NO: 57018 - DNA, 20 bp, Artificial Sequence
  chemically synthesized
cagtctgtggctaaaattaa

SEQ ID NO: 57019 - DNA, 20 bp, Artificial Sequence
  chemically synthesized
tggctaaaattaaaggctct

SEQ ID NO: 57020 - DNA, 20 bp, Artificial Sequence
  chemically synthesized
ggctaaaattaaaggctctg

SEQ ID NO: 57021 - DNA, 20 bp, Artificial Sequence
  chemically synthesized
aaaattaaaggctctgaggc

SEQ ID NO: 57022 - DNA, 20 bp, Artificial Sequence
  chemically synthesized
gctccacgtcaacttgctat

SEQ ID NO: 57023 - DNA, 20 bp, Artificial Sequence
  chemically synthesized
tgctattagctgtgtgacct

SEQ ID NO: 57024 - DNA, 20 bp, Artificial Sequence
  chemically synthesized
ttagctgtgtgaccttggac

SEQ ID NO: 57025 - DNA, 20 bp, Artificial Sequence
  chemically synthesized
tacttaacctctctgaacct

SEQ ID NO: 57026 - DNA, 20 bp, Artificial Sequence
  chemically synthesized
ctctctgaacctcagtttcc

SEQ ID NO: 57027 - DNA, 20 bp, Artificial Sequence
  chemically synthesized
ctctgaacctcagtttcctg

SEQ ID NO: 57028 - DNA, 20 bp, Artificial Sequence
  chemically synthesized
aacctcagtttcctggagat

SEQ ID NO: 57029 - DNA, 20 bp, Artificial Sequence
  chemically synthesized
tcagtttcctggagatgaga

SEQ ID NO: 57030 - DNA, 20 bp, Artificial Sequence
  chemically synthesized
cagtttcctggagatgagaa

SEQ ID NO: 57031 - DNA, 20 bp, Artificial Sequence
  chemically synthesized
tttcctggagatgagaaagg

SEQ ID NO: 57032 - DNA, 20 bp, Artificial Sequence
  chemically synthesized
gagaaaggtggactttgtca

SEQ ID NO: 57033 - DNA, 20 bp, Artificial Sequence
  chemically synthesized
gaaaggtggactttgtcata

SEQ ID NO: 57034 - DNA, 20 bp, Artificial Sequence
  chemically synthesized
ttaaatacacataaaatgcc

SEQ ID NO: 57035 - DNA, 20 bp, Artificial Sequence
  chemically synthesized
aatacacataaaatgccaag

SEQ ID NO: 57036 - DNA, 20 bp, Artificial Sequence
  chemically synthesized
gccaagaagtgcctgctgcg

SEQ ID NO: 57037 - DNA, 20 bp, Artificial Sequence
  chemically synthesized
agaagtgcctgctgcgcagc

SEQ ID NO: 57038 - DNA, 20 bp, Artificial Sequence
  chemically synthesized
ctgctgcgcagcaagttctc

SEQ ID NO: 57039 - DNA, 20 bp, Artificial Sequence
  chemically synthesized
cagcaagttctcgagaatac

SEQ ID NO: 57040 - DNA, 20 bp, Artificial Sequence
  chemically synthesized
agttcttgctgctattgctg

SEQ ID NO: 57041 - DNA, 20 bp, Artificial Sequence
  chemically synthesized
gttcttgctgctattgctgc

SEQ ID NO: 57042 - DNA, 20 bp, Artificial Sequence
  chemically synthesized
tgctattgctgcaggtcttt

SEQ ID NO: 57043 - DNA, 20 bp, Artificial Sequence
  chemically synthesized
ctattgctgcaggtctttta

SEQ ID NO: 57044 - DNA, 20 bp, Artificial Sequence
  chemically synthesized
tattgctgcaggtcttttag

SEQ ID NO: 57045 - DNA, 20 bp, Artificial Sequence
  chemically synthesized
ggtcttttagaggcgttcta

SEQ ID NO: 57046 - DNA, 20 bp, Artificial Sequence
  chemically synthesized
gtcttttagaggcgttctat

SEQ ID NO: 57047 - DNA, 20 bp, Artificial Sequence
  chemically synthesized
agaggcgttctataggaaac

SEQ ID NO: 57048 - DNA, 20 bp, Artificial Sequence
  chemically synthesized
ctataggaaactggccacct

SEQ ID NO: 57049 - DNA, 20 bp, Artificial Sequence
  chemically synthesized
gaaactggccaccttggcct

SEQ ID NO: 57050 - DNA, 20 bp, Artificial Sequence
  chemically synthesized
tttgacctgtctccaaaact

SEQ ID NO: 57051 - DNA, 20 bp, Artificial Sequence
  chemically synthesized
cctgtctccaaaactcagtg

SEQ ID NO: 57052 - DNA, 20 bp, Artificial Sequence
  chemically synthesized
ctgtctccaaaactcagtgc

SEQ ID NO: 57053 - DNA, 20 bp, Artificial Sequence
  chemically synthesized
attaaatccttccaacactt

SEQ ID NO: 57054 - DNA, 20 bp, Artificial Sequence
  chemically synthesized
taaatccttccaacacttca

SEQ ID NO: 57055 - DNA, 20 bp, Artificial Sequence
  chemically synthesized
cttccaacacttcagagatc

SEQ ID NO: 57056 - DNA, 20 bp, Artificial Sequence
  chemically synthesized
ttccaacacttcagagatca

SEQ ID NO: 57057 - DNA, 20 bp, Artificial Sequence
  chemically synthesized
aacacttcagagatcaaggt

SEQ ID NO: 57058 - DNA, 20 bp, Artificial Sequence
  chemically synthesized
acacttcagagatcaaggtc

SEQ ID NO: 57059 - DNA, 20 bp, Artificial Sequence
  chemically synthesized
cttcagagatcaaggtcggg

SEQ ID NO: 57060 - DNA, 20 bp, Artificial Sequence
  chemically synthesized
ttcagagatcaaggtcgggt

SEQ ID NO: 57061 - DNA, 20 bp, Artificial Sequence
  chemically synthesized
tcagagatcaaggtcgggtg

SEQ ID NO: 57062 - DNA, 20 bp, Artificial Sequence
  chemically synthesized
agatcaaggtcgggtggggt

SEQ ID NO: 57063 - DNA, 20 bp, Artificial Sequence
  chemically synthesized
gatcaaggtcgggtggggtg

SEQ ID NO: 57064 - DNA, 20 bp, Artificial Sequence
  chemically synthesized
atcaaggtcgggtggggtga

SEQ ID NO: 57065 - DNA, 20 bp, Artificial Sequence
  chemically synthesized
tcaaggtcgggtggggtgag

SEQ ID NO: 57066 - DNA, 20 bp, Artificial Sequence
  chemically synthesized
aaggtcgggtggggtgaggg

SEQ ID NO: 57067 - DNA, 20 bp, Artificial Sequence
  chemically synthesized
aggtcgggtggggtgagggg

SEQ ID NO: 57068 - DNA, 20 bp, Artificial Sequence
  chemically synthesized
ggtcgggtggggtgagggga

SEQ ID NO: 57069 - DNA, 20 bp, Artificial Sequence
  chemically synthesized
gtcgggtggggtgaggggag

SEQ ID NO: 57070 - DNA, 20 bp, Artificial Sequence
  chemically synthesized
ggtggggtgaggggagggga

SEQ ID NO: 57071 - DNA, 20 bp, Artificial Sequence
  chemically synthesized
ggggtgaggggaggggacag

SEQ ID NO: 57072 - DNA, 20 bp, Artificial Sequence
  chemically synthesized
aggggaggggacagaagtca

SEQ ID NO: 57073 - DNA, 20 bp, Artificial Sequence
  chemically synthesized
ggggaggggacagaagtcaa

SEQ ID NO: 57074 - DNA, 20 bp, Artificial Sequence
  chemically synthesized
aaggttatcatgttttgccc

SEQ ID NO: 57075 - DNA, 20 bp, Artificial Sequence
  chemically synthesized
ggttatcatgttttgcccaa

SEQ ID NO: 57076 - DNA, 20 bp, Artificial Sequence
  chemically synthesized
tcatgttttgcccaagagaa

SEQ ID NO: 57077 - DNA, 20 bp, Artificial Sequence
  chemically synthesized
atgttttgcccaagagaaca

SEQ ID NO: 57078 - DNA, 20 bp, Artificial Sequence
  chemically synthesized
gttttgcccaagagaacaga

SEQ ID NO: 57079 - DNA, 20 bp, Artificial Sequence
  chemically synthesized
ttttgcccaagagaacagag

SEQ ID NO: 57080 - DNA, 20 bp, Artificial Sequence
  chemically synthesized
cccaagagaacagagaggtt

SEQ ID NO: 57081 - DNA, 20 bp, Artificial Sequence
  chemically synthesized
agaggttgagcaactgtctg

SEQ ID NO: 57082 - DNA, 20 bp, Artificial Sequence
  chemically synthesized
agcaactgtctgaagtcacc

SEQ ID NO: 57083 - DNA, 20 bp, Artificial Sequence
  chemically synthesized
tgtctgaagtcaccgagcat

SEQ ID NO: 57084 - DNA, 20 bp, Artificial Sequence
  chemically synthesized
tctgaagtcaccgagcatca

SEQ ID NO: 57085 - DNA, 20 bp, Artificial Sequence
  chemically synthesized
tgaagtcaccgagcatcaga

SEQ ID NO: 57086 - DNA, 20 bp, Artificial Sequence
  chemically synthesized
gaagtcaccgagcatcagag

SEQ ID NO: 57087 - DNA, 20 bp, Artificial Sequence
  chemically synthesized
ccgagcatcagagaggcctc

SEQ ID NO: 57088 - DNA, 20 bp, Artificial Sequence
  chemically synthesized
catcagagaggcctcaagtc

SEQ ID NO: 57089 - DNA, 20 bp, Artificial Sequence
  chemically synthesized
gagaggcctcaagtccagcc

SEQ ID NO: 57090 - DNA, 20 bp, Artificial Sequence
  chemically synthesized
agaggcctcaagtccagccc

SEQ ID NO: 57091 - DNA, 20 bp, Artificial Sequence
  chemically synthesized
caggtttcctgttccccatc

SEQ ID NO: 57092 - DNA, 20 bp, Artificial Sequence
  chemically synthesized
ctgttccccatccagcgcct

SEQ ID NO: 57093 - DNA, 20 bp, Artificial Sequence
  chemically synthesized
ccatccagcgcctgagaccc

SEQ ID NO: 57094 - DNA, 20 bp, Artificial Sequence
  chemically synthesized
atccagcgcctgagacccaa

SEQ ID NO: 57095 - DNA, 20 bp, Artificial Sequence
  chemically synthesized
cgcctgagacccaagagaaa

SEQ ID NO: 57096 - DNA, 20 bp, Artificial Sequence
  chemically synthesized
cccaagagaaacagtgacac

SEQ ID NO: 57097 - DNA, 20 bp, Artificial Sequence
  chemically synthesized
ccaagagaaacagtgacact

SEQ ID NO: 57098 - DNA, 20 bp, Artificial Sequence
  chemically synthesized
caagagaaacagtgacacta

SEQ ID NO: 57099 - DNA, 20 bp, Artificial Sequence
  chemically synthesized
agaaacagtgacactagggc

SEQ ID NO: 57100 - DNA, 20 bp, Artificial Sequence
  chemically synthesized
gaaacagtgacactagggcc

SEQ ID NO: 57101 - DNA, 20 bp, Artificial Sequence
  chemically synthesized
gtgacactagggccaggttc

SEQ ID NO: 57102 - DNA, 20 bp, Artificial Sequence
  chemically synthesized
gacactagggccaggttcaa

SEQ ID NO: 57103 - DNA, 20 bp, Artificial Sequence
  chemically synthesized
tagggccaggttcaagagtt

SEQ ID NO: 57104 - DNA, 20 bp, Artificial Sequence
  chemically synthesized
agggccaggttcaagagttt

SEQ ID NO: 57105 - DNA, 20 bp, Artificial Sequence
  chemically synthesized
gggccaggttcaagagtttg

SEQ ID NO: 57106 - DNA, 20 bp, Artificial Sequence
  chemically synthesized
aggttcaagagtttggggac

SEQ ID NO: 57107 - DNA, 20 bp, Artificial Sequence
  chemically synthesized
gttcaagagtttggggactg

SEQ ID NO: 57108 - DNA, 20 bp, Artificial Sequence
  chemically synthesized
aagagtttggggactggagc

SEQ ID NO: 57109 - DNA, 20 bp, Artificial Sequence
  chemically synthesized
agagtttggggactggagcc

SEQ ID NO: 57110 - DNA, 20 bp, Artificial Sequence
  chemically synthesized
gggactggagccaggtgcct

SEQ ID NO: 57111 - DNA, 20 bp, Artificial Sequence
  chemically synthesized
aggtgcctgagcccgaatta

SEQ ID NO: 57112 - DNA, 20 bp, Artificial Sequence
  chemically synthesized
gcctgagcccgaattatgga

SEQ ID NO: 57113 - DNA, 20 bp, Artificial Sequence
  chemically synthesized
attatggatggtgtgtgatt

SEQ ID NO: 57114 - DNA, 20 bp, Artificial Sequence
  chemically synthesized
ttatggatggtgtgtgattt

SEQ ID NO: 57115 - DNA, 20 bp, Artificial Sequence
  chemically synthesized
tatggatggtgtgtgatttg

SEQ ID NO: 57116 - DNA, 20 bp, Artificial Sequence
  chemically synthesized
gatggtgtgtgatttggggc

SEQ ID NO: 57117 - DNA, 20 bp, Artificial Sequence
  chemically synthesized
catcttcctcatctgtaaaa

SEQ ID NO: 57118 - DNA, 20 bp, Artificial Sequence
  chemically synthesized
atcttcctcatctgtaaaat

SEQ ID NO: 57119 - DNA, 20 bp, Artificial Sequence
  chemically synthesized
ctgtaaaatgggaatcacac

SEQ ID NO: 57120 - DNA, 20 bp, Artificial Sequence
  chemically synthesized
aatcacactagtaactgcct

SEQ ID NO: 57121 - DNA, 20 bp, Artificial Sequence
  chemically synthesized
tcacactagtaactgccttg

SEQ ID NO: 57122 - DNA, 20 bp, Artificial Sequence
  chemically synthesized
cacactagtaactgccttgg

SEQ ID NO: 57123 - DNA, 20 bp, Artificial Sequence
  chemically synthesized
acactagtaactgccttgga

SEQ ID NO: 57124 - DNA, 20 bp, Artificial Sequence
  chemically synthesized
taactgccttggagggttat

SEQ ID NO: 57125 - DNA, 20 bp, Artificial Sequence
  chemically synthesized
aactgccttggagggttatg

SEQ ID NO: 57126 - DNA, 20 bp, Artificial Sequence
  chemically synthesized
atgaggcttaatcacgcact

SEQ ID NO: 57127 - DNA, 20 bp, Artificial Sequence
  chemically synthesized
gcttaatcacgcactgagct

SEQ ID NO: 57128 - DNA, 20 bp, Artificial Sequence
  chemically synthesized
tcacgcactgagcttagccg

SEQ ID NO: 57129 - DNA, 20 bp, Artificial Sequence
  chemically synthesized
cactgagcttagccgtggcc

SEQ ID NO: 57130 - DNA, 20 bp, Artificial Sequence
  chemically synthesized
agcttagccgtggcctggtg

SEQ ID NO: 57131 - DNA, 20 bp, Artificial Sequence
  chemically synthesized
cttagccgtggcctggtgca

SEQ ID NO: 57132 - DNA, 20 bp, Artificial Sequence
  chemically synthesized
cctggtgcagagcgattatt

SEQ ID NO: 57133 - DNA, 20 bp, Artificial Sequence
  chemically synthesized
ctggtgcagagcgattattc

SEQ ID NO: 57134 - DNA, 20 bp, Artificial Sequence
  chemically synthesized
gagcgattattcaggaatgc

SEQ ID NO: 57135 - DNA, 20 bp, Artificial Sequence
  chemically synthesized
ttattcaggaatgccagctt

SEQ ID NO: 57136 - DNA, 20 bp, Artificial Sequence
  chemically synthesized
aggaatgccagcttgagccc

SEQ ID NO: 57137 - DNA, 20 bp, Artificial Sequence
  chemically synthesized
ggaatgccagcttgagccct

SEQ ID NO: 57138 - DNA, 20 bp, Artificial Sequence
  chemically synthesized
ccagcttgagccctgggtga

SEQ ID NO: 57139 - DNA, 20 bp, Artificial Sequence
  chemically synthesized
ctgggtgacagtgcccctca

SEQ ID NO: 57140 - DNA, 20 bp, Artificial Sequence
  chemically synthesized
cacagcttcctgtcctccac

SEQ ID NO: 57141 - DNA, 20 bp, Artificial Sequence
  chemically synthesized
acagcttcctgtcctccact

SEQ ID NO: 57142 - DNA, 20 bp, Artificial Sequence
  chemically synthesized
cttcctgtcctccactggga

SEQ ID NO: 57143 - DNA, 20 bp, Artificial Sequence
  chemically synthesized
ttcctgtcctccactgggac

SEQ ID NO: 57144 - DNA, 20 bp, Artificial Sequence
  chemically synthesized
cctgtcctccactgggacag

SEQ ID NO: 57145 - DNA, 20 bp, Artificial Sequence
  chemically synthesized
ctgtcctccactgggacagg

SEQ ID NO: 57146 - DNA, 20 bp, Artificial Sequence
  chemically synthesized
tgtcctccactgggacagga

SEQ ID NO: 57147 - DNA, 20 bp, Artificial Sequence
  chemically synthesized
tccactgggacaggagggcc

SEQ ID NO: 57148 - DNA, 20 bp, Artificial Sequence
  chemically synthesized
cactgggacaggagggccca

SEQ ID NO: 57149 - DNA, 20 bp, Artificial Sequence
  chemically synthesized
actgggacaggagggcccag

SEQ ID NO: 57150 - DNA, 20 bp, Artificial Sequence
  chemically synthesized
caggagggcccagaggtcca

SEQ ID NO: 57151 - DNA, 20 bp, Artificial Sequence
  chemically synthesized
gcccagaggtccacggtgca

SEQ ID NO: 57152 - DNA, 20 bp, Artificial Sequence
  chemically synthesized
cccagaggtccacggtgcat

SEQ ID NO: 57153 - DNA, 20 bp, Artificial Sequence
  chemically synthesized
ccagaggtccacggtgcatg

SEQ ID NO: 57154 - DNA, 20 bp, Artificial Sequence
  chemically synthesized
agaggtccacggtgcatggg

SEQ ID NO: 57155 - DNA, 20 bp, Artificial Sequence
  chemically synthesized
gaggtccacggtgcatgggg

SEQ ID NO: 57156 - DNA, 20 bp, Artificial Sequence
  chemically synthesized
ggggaggcccattttgatgt

SEQ ID NO: 57157 - DNA, 20 bp, Artificial Sequence
  chemically synthesized
gggaggcccattttgatgta

SEQ ID NO: 57158 - DNA, 20 bp, Artificial Sequence
  chemically synthesized
gcccattttgatgtaaggct

SEQ ID NO: 57159 - DNA, 20 bp, Artificial Sequence
  chemically synthesized
cccattttgatgtaaggctg

SEQ ID NO: 57160 - DNA, 20 bp, Artificial Sequence
  chemically synthesized
tttgatgtaaggctgaggcc

SEQ ID NO: 57161 - DNA, 20 bp, Artificial Sequence
  chemically synthesized
tgtaaggctgaggcctggca

SEQ ID NO: 57162 - DNA, 20 bp, Artificial Sequence
  chemically synthesized
gtaaggctgaggcctggcac

SEQ ID NO: 57163 - DNA, 20 bp, Artificial Sequence
  chemically synthesized
gcctggcacaggtctgttcc

SEQ ID NO: 57164 - DNA, 20 bp, Artificial Sequence
  chemically synthesized
ggtctgttcctggtcatatc

SEQ ID NO: 57165 - DNA, 20 bp, Artificial Sequence
  chemically synthesized
tctgttcctggtcatatctg

SEQ ID NO: 57166 - DNA, 20 bp, Artificial Sequence
  chemically synthesized
ctgttcctggtcatatctgg

SEQ ID NO: 57167 - DNA, 20 bp, Artificial Sequence
  chemically synthesized
tgttcctggtcatatctgga

SEQ ID NO: 57168 - DNA, 20 bp, Artificial Sequence
  chemically synthesized
gttcctggtcatatctggag

SEQ ID NO: 57169 - DNA, 20 bp, Artificial Sequence
  chemically synthesized
ctggtcatatctggagggga

SEQ ID NO: 57170 - DNA, 20 bp, Artificial Sequence
  chemically synthesized
ggtcatatctggaggggatg

SEQ ID NO: 57171 - DNA, 20 bp, Artificial Sequence
  chemically synthesized
ctggaggggatggagaatgt

SEQ ID NO: 57172 - DNA, 20 bp, Artificial Sequence
  chemically synthesized
aggggatggagaatgtgagc

SEQ ID NO: 57173 - DNA, 20 bp, Artificial Sequence
  chemically synthesized
cgttcctccccacccctctc

SEQ ID NO: 57174 - DNA, 20 bp, Artificial Sequence
  chemically synthesized
gaccttaacctcctcatcta

SEQ ID NO: 57175 - DNA, 20 bp, Artificial Sequence
  chemically synthesized
cttaacctcctcatctatag

SEQ ID NO: 57176 - DNA, 20 bp, Artificial Sequence
  chemically synthesized
ttaacctcctcatctataga

SEQ ID NO: 57177 - DNA, 20 bp, Artificial Sequence
  chemically synthesized
taacctcctcatctatagaa

SEQ ID NO: 57178 - DNA, 20 bp, Artificial Sequence
  chemically synthesized
aacctcctcatctatagaag

SEQ ID NO: 57179 - DNA, 20 bp, Artificial Sequence
  chemically synthesized
cctcctcatctatagaaggg

SEQ ID NO: 57180 - DNA, 20 bp, Artificial Sequence
  chemically synthesized
ctcatctatagaaggggaga

SEQ ID NO: 57181 - DNA, 20 bp, Artificial Sequence
  chemically synthesized
ggggagaaagatgcatgccc

SEQ ID NO: 57182 - DNA, 20 bp, Artificial Sequence
  chemically synthesized
gagaaagatgcatgcccaag

SEQ ID NO: 57183 - DNA, 20 bp, Artificial Sequence
  chemically synthesized
aaagatgcatgcccaagcag

SEQ ID NO: 57184 - DNA, 20 bp, Artificial Sequence
  chemically synthesized
aagatgcatgcccaagcagt

SEQ ID NO: 57185 - DNA, 20 bp, Artificial Sequence
  chemically synthesized
gatgcatgcccaagcagtag

SEQ ID NO: 57186 - DNA, 20 bp, Artificial Sequence
  chemically synthesized
tgcatgcccaagcagtagga

SEQ ID NO: 57187 - DNA, 20 bp, Artificial Sequence
  chemically synthesized
gcatgcccaagcagtaggag

SEQ ID NO: 57188 - DNA, 20 bp, Artificial Sequence
  chemically synthesized
tgcccaagcagtaggagagg

SEQ ID NO: 57189 - DNA, 20 bp, Artificial Sequence
  chemically synthesized
caagcagtaggagaggtggt

SEQ ID NO: 57190 - DNA, 20 bp, Artificial Sequence
  chemically synthesized
aagcagtaggagaggtggtg

SEQ ID NO: 57191 - DNA, 20 bp, Artificial Sequence
  chemically synthesized
aggagaggtggtgaggctta

SEQ ID NO: 57192 - DNA, 20 bp, Artificial Sequence
  chemically synthesized
ggagaggtggtgaggcttat

SEQ ID NO: 57193 - DNA, 20 bp, Artificial Sequence
  chemically synthesized
agaggtggtgaggcttatag

SEQ ID NO: 57194 - DNA, 20 bp, Artificial Sequence
  chemically synthesized
gtgaggcttataggagacaa

SEQ ID NO: 57195 - DNA, 20 bp, Artificial Sequence
  chemically synthesized
ggcttataggagacaacaga

SEQ ID NO: 57196 - DNA, 20 bp, Artificial Sequence
  chemically synthesized
gcttataggagacaacagac

SEQ ID NO: 57197 - DNA, 20 bp, Artificial Sequence
  chemically synthesized
ttataggagacaacagacag

SEQ ID NO: 57198 - DNA, 20 bp, Artificial Sequence
  chemically synthesized
caacagacaggagcccccga

SEQ ID NO: 57199 - DNA, 20 bp, Artificial Sequence
  chemically synthesized
agacaggagcccccgacaga

SEQ ID NO: 57200 - DNA, 20 bp, Artificial Sequence
  chemically synthesized
acaggagcccccgacagaca

SEQ ID NO: 57201 - DNA, 20 bp, Artificial Sequence
  chemically synthesized
caggagcccccgacagacag

SEQ ID NO: 57202 - DNA, 20 bp, Artificial Sequence
  chemically synthesized
ggagcccccgacagacagag

SEQ ID NO: 57203 - DNA, 20 bp, Artificial Sequence
  chemically synthesized
agacagaggagctgtgcaaa

SEQ ID NO: 57204 - DNA, 20 bp, Artificial Sequence
  chemically synthesized
agaggagctgtgcaaacaga

SEQ ID NO: 57205 - DNA, 20 bp, Artificial Sequence
  chemically synthesized
gctgtgcaaacagaaagaaa

SEQ ID NO: 57206 - DNA, 20 bp, Artificial Sequence
  chemically synthesized
ttgttgctgttgctgtatct

SEQ ID NO: 57207 - DNA, 20 bp, Artificial Sequence
  chemically synthesized
tgctgttgctgtatcttggc

SEQ ID NO: 57208 - DNA, 20 bp, Artificial Sequence
  chemically synthesized
ttggctggtgtcccccatcc

SEQ ID NO: 57209 - DNA, 20 bp, Artificial Sequence
  chemically synthesized
tggctggtgtcccccatcct

SEQ ID NO: 57210 - DNA, 20 bp, Artificial Sequence
  chemically synthesized
ggctggtgtcccccatcctg

SEQ ID NO: 57211 - DNA, 20 bp, Artificial Sequence
  chemically synthesized
tgtcccccatcctggggtgc

SEQ ID NO: 57212 - DNA, 20 bp, Artificial Sequence
  chemically synthesized
gtcccccatcctggggtgcc

SEQ ID NO: 57213 - DNA, 20 bp, Artificial Sequence
  chemically synthesized
atcctggggtgccaggactg

SEQ ID NO: 57214 - DNA, 20 bp, Artificial Sequence
  chemically synthesized
gggtgccaggactgcagacc

SEQ ID NO: 57215 - DNA, 20 bp, Artificial Sequence
  chemically synthesized
ccctcatccacttctgctta

SEQ ID NO: 57216 - DNA, 20 bp, Artificial Sequence
  chemically synthesized
cctcatccacttctgcttac

SEQ ID NO: 57217 - DNA, 20 bp, Artificial Sequence
  chemically synthesized
ccacttctgcttacaggaac

SEQ ID NO: 57218 - DNA, 20 bp, Artificial Sequence
  chemically synthesized
acaggaaccagtgtatccac

SEQ ID NO: 57219 - DNA, 20 bp, Artificial Sequence
  chemically synthesized
caggaaccagtgtatccacc

SEQ ID NO: 57220 - DNA, 20 bp, Artificial Sequence
  chemically synthesized
ggaaccagtgtatccaccag

SEQ ID NO: 57221 - DNA, 20 bp, Artificial Sequence
  chemically synthesized
gaaccagtgtatccaccagg

SEQ ID NO: 57222 - DNA, 20 bp, Artificial Sequence
  chemically synthesized
tgtatccaccaggaggtacc

SEQ ID NO: 57223 - DNA, 20 bp, Artificial Sequence
  chemically synthesized
gtatccaccaggaggtaccg

SEQ ID NO: 57224 - DNA, 20 bp, Artificial Sequence
  chemically synthesized
tatccaccaggaggtaccga

SEQ ID NO: 57225 - DNA, 20 bp, Artificial Sequence
  chemically synthesized
atccaccaggaggtaccgag

SEQ ID NO: 57226 - DNA, 20 bp, Artificial Sequence
  chemically synthesized
tccaccaggaggtaccgagg

SEQ ID NO: 57227 - DNA, 20 bp, Artificial Sequence
  chemically synthesized
ccaccaggaggtaccgaggg

SEQ ID NO: 57228 - DNA, 20 bp, Artificial Sequence
  chemically synthesized
aggaggtaccgaggggggac

SEQ ID NO: 57229 - DNA, 20 bp, Artificial Sequence
  chemically synthesized
ggaggtaccgaggggggacc

SEQ ID NO: 57230 - DNA, 20 bp, Artificial Sequence
  chemically synthesized
ggtaccgaggggggaccggg

SEQ ID NO: 57231 - DNA, 20 bp, Artificial Sequence
  chemically synthesized
gtaccgaggggggaccgggc

SEQ ID NO: 57232 - DNA, 20 bp, Artificial Sequence
  chemically synthesized
gaggggggaccgggcaggac

SEQ ID NO: 57233 - DNA, 20 bp, Artificial Sequence
  chemically synthesized
aggggggaccgggcaggact

SEQ ID NO: 57234 - DNA, 20 bp, Artificial Sequence
  chemically synthesized
gaccgggcaggactgggaaa

SEQ ID NO: 57235 - DNA, 20 bp, Artificial Sequence
  chemically synthesized
accgggcaggactgggaaac

SEQ ID NO: 57236 - DNA, 20 bp, Artificial Sequence
  chemically synthesized
gaaacaggacacaaccctca

SEQ ID NO: 57237 - DNA, 20 bp, Artificial Sequence
  chemically synthesized
ggctgctgttattatgaaaa

SEQ ID NO: 57238 - DNA, 20 bp, Artificial Sequence
  chemically synthesized
gctgctgttattatgaaaat

SEQ ID NO: 57239 - DNA, 20 bp, Artificial Sequence
  chemically synthesized
tgctgttattatgaaaatag

SEQ ID NO: 57240 - DNA, 20 bp, Artificial Sequence
  chemically synthesized
ttattatgaaaataggagct

SEQ ID NO: 57241 - DNA, 20 bp, Artificial Sequence
  chemically synthesized
tgaaaataggagctcagctg

SEQ ID NO: 57242 - DNA, 20 bp, Artificial Sequence
  chemically synthesized
tctccatctgccctgcacct

SEQ ID NO: 57243 - DNA, 20 bp, Artificial Sequence
  chemically synthesized
ccatctgccctgcacctcag

SEQ ID NO: 57244 - DNA, 20 bp, Artificial Sequence
  chemically synthesized
catctgccctgcacctcagc

SEQ ID NO: 57245 - DNA, 20 bp, Artificial Sequence
  chemically synthesized
ctgccctgcacctcagcagg

SEQ ID NO: 57246 - DNA, 20 bp, Artificial Sequence
  chemically synthesized
ccacaacccccctcctgccc

SEQ ID NO: 57247 - DNA, 20 bp, Artificial Sequence
  chemically synthesized
ccccagacctgctgcctgcc

SEQ ID NO: 57248 - DNA, 20 bp, Artificial Sequence
  chemically synthesized
cccagacctgctgcctgcct

SEQ ID NO: 57249 - DNA, 20 bp, Artificial Sequence
  chemically synthesized
cctgctgcctgcctgggcca

SEQ ID NO: 57250 - DNA, 20 bp, Artificial Sequence
  chemically synthesized
ctgctgcctgcctgggccat

SEQ ID NO: 57251 - DNA, 20 bp, Artificial Sequence
  chemically synthesized
tgctgcctgcctgggccatg

SEQ ID NO: 57252 - DNA, 20 bp, Artificial Sequence
  chemically synthesized
ctgcctgcctgggccatggg

SEQ ID NO: 57253 - DNA, 20 bp, Artificial Sequence
  chemically synthesized
tgcctgggccatggggagct

SEQ ID NO: 57254 - DNA, 20 bp, Artificial Sequence
  chemically synthesized
ctgggccatggggagctcag

SEQ ID NO: 57255 - DNA, 20 bp, Artificial Sequence
  chemically synthesized
ggggagctcagaagcctctc

SEQ ID NO: 57256 - DNA, 20 bp, Artificial Sequence
  chemically synthesized
agcctctccagaacctctcg

SEQ ID NO: 57257 - DNA, 20 bp, Artificial Sequence
  chemically synthesized
tccagaacctctcgcagtga

SEQ ID NO: 57258 - DNA, 20 bp, Artificial Sequence
  chemically synthesized
ccagaacctctcgcagtgaa

SEQ ID NO: 57259 - DNA, 20 bp, Artificial Sequence
  chemically synthesized
atacttacgattcactgtcc

SEQ ID NO: 57260 - DNA, 20 bp, Artificial Sequence
  chemically synthesized
tacttacgattcactgtccc

SEQ ID NO: 57261 - DNA, 20 bp, Artificial Sequence
  chemically synthesized
tacgattcactgtcccaggt

SEQ ID NO: 57262 - DNA, 20 bp, Artificial Sequence
  chemically synthesized
gattcactgtcccaggtcag

SEQ ID NO: 57263 - DNA, 20 bp, Artificial Sequence
  chemically synthesized
tcactgtcccaggtcagtgg

SEQ ID NO: 57264 - DNA, 20 bp, Artificial Sequence
  chemically synthesized
caggtcagtggtggtgcctg

SEQ ID NO: 57265 - DNA, 20 bp, Artificial Sequence
  chemically synthesized
cagtggtggtgcctgaagct

SEQ ID NO: 57266 - DNA, 20 bp, Artificial Sequence
  chemically synthesized
agtggtggtgcctgaagctg

SEQ ID NO: 57267 - DNA, 20 bp, Artificial Sequence
  chemically synthesized
tggtggtgcctgaagctgag

SEQ ID NO: 57268 - DNA, 20 bp, Artificial Sequence
  chemically synthesized
ggtgcctgaagctgaggaga

SEQ ID NO: 57269 - DNA, 20 bp, Artificial Sequence
  chemically synthesized
gtgcctgaagctgaggagac

SEQ ID NO: 57270 - DNA, 20 bp, Artificial Sequence
  chemically synthesized
tgcctgaagctgaggagaca

SEQ ID NO: 57271 - DNA, 20 bp, Artificial Sequence
  chemically synthesized
ccctgtcctcgtccgtattt

SEQ ID NO: 57272 - DNA, 20 bp, Artificial Sequence
  chemically synthesized
tgtcctcgtccgtatttaag

SEQ ID NO: 57273 - DNA, 20 bp, Artificial Sequence
  chemically synthesized
cctcgtccgtatttaagcag

SEQ ID NO: 57274 - DNA, 20 bp, Artificial Sequence
  chemically synthesized
ccgtatttaagcagtggatc

SEQ ID NO: 57275 - DNA, 20 bp, Artificial Sequence
  chemically synthesized
gtatttaagcagtggatcca

SEQ ID NO: 57276 - DNA, 20 bp, Artificial Sequence
  chemically synthesized
tatttaagcagtggatccag

SEQ ID NO: 57277 - DNA, 20 bp, Artificial Sequence
  chemically synthesized
atttaagcagtggatccaga

SEQ ID NO: 57278 - DNA, 20 bp, Artificial Sequence
  chemically synthesized
tttaagcagtggatccagag

SEQ ID NO: 57279 - DNA, 20 bp, Artificial Sequence
  chemically synthesized
cagtggatccagaggggcaa

SEQ ID NO: 57280 - DNA, 20 bp, Artificial Sequence
  chemically synthesized
agtggatccagaggggcaac

SEQ ID NO: 57281 - DNA, 20 bp, Artificial Sequence
  chemically synthesized
gtggatccagaggggcaacg

SEQ ID NO: 57282 - DNA, 20 bp, Artificial Sequence
  chemically synthesized
tggatccagaggggcaacgg

SEQ ID NO: 57283 - DNA, 20 bp, Artificial Sequence
  chemically synthesized
gatccagaggggcaacgggg

SEQ ID NO: 57284 - DNA, 20 bp, Artificial Sequence
  chemically synthesized
atccagaggggcaacggggg

SEQ ID NO: 57285 - DNA, 20 bp, Artificial Sequence
  chemically synthesized
ggggcaacgggggaggctgc

SEQ ID NO: 57286 - DNA, 20 bp, Artificial Sequence
  chemically synthesized
gctgctggtgaatattaacc

SEQ ID NO: 57287 - DNA, 20 bp, Artificial Sequence
  chemically synthesized
ctgctggtgaatattaacca

SEQ ID NO: 57288 - DNA, 20 bp, Artificial Sequence
  chemically synthesized
aatattaaccaaggtcaccc

SEQ ID NO: 57289 - DNA, 20 bp, Artificial Sequence
  chemically synthesized
accaaggtcaccccagttat

SEQ ID NO: 57290 - DNA, 20 bp, Artificial Sequence
  chemically synthesized
caaggtcaccccagttatcg

SEQ ID NO: 57291 - DNA, 20 bp, Artificial Sequence
  chemically synthesized
aaggtcaccccagttatcgg

SEQ ID NO: 57292 - DNA, 20 bp, Artificial Sequence
  chemically synthesized
ggtcaccccagttatcggag

SEQ ID NO: 57293 - DNA, 20 bp, Artificial Sequence
  chemically synthesized
ccagttatcggaggagcaaa

SEQ ID NO: 57294 - DNA, 20 bp, Artificial Sequence
  chemically synthesized
cagttatcggaggagcaaac

SEQ ID NO: 57295 - DNA, 20 bp, Artificial Sequence
  chemically synthesized
agttatcggaggagcaaaca

SEQ ID NO: 57296 - DNA, 20 bp, Artificial Sequence
  chemically synthesized
gttatcggaggagcaaacag

SEQ ID NO: 57297 - DNA, 20 bp, Artificial Sequence
  chemically synthesized
cggaggagcaaacaggggct

SEQ ID NO: 57298 - DNA, 20 bp, Artificial Sequence
  chemically synthesized
caaacaggggctaagtccac

SEQ ID NO: 57299 - DNA, 20 bp, Artificial Sequence
  chemically synthesized
caggggctaagtccactggc

SEQ ID NO: 57300 - DNA, 20 bp, Artificial Sequence
  chemically synthesized
aggggctaagtccactggct

SEQ ID NO: 57301 - DNA, 20 bp, Artificial Sequence
  chemically synthesized
aagtccactggctgggatct

SEQ ID NO: 57302 - DNA, 20 bp, Artificial Sequence
  chemically synthesized
agtcgcccgcctacgctgcc

SEQ ID NO: 57303 - DNA, 20 bp, Artificial Sequence
  chemically synthesized
cgctgcccggacgctttgcc

SEQ ID NO: 57304 - DNA, 20 bp, Artificial Sequence
  chemically synthesized
gctgcccggacgctttgcct

SEQ ID NO: 57305 - DNA, 20 bp, Artificial Sequence
  chemically synthesized
gcccggacgctttgcctggg

SEQ ID NO: 57306 - DNA, 20 bp, Artificial Sequence
  chemically synthesized
cgctttgcctgggcagtgta

SEQ ID NO: 57307 - DNA, 20 bp, Artificial Sequence
  chemically synthesized
gcttccactgcacttaccga

SEQ ID NO: 57308 - DNA, 20 bp, Artificial Sequence
  chemically synthesized
cttccactgcacttaccgaa

SEQ ID NO: 57309 - DNA, 20 bp, Artificial Sequence
  chemically synthesized
tccactgcacttaccgaaag

SEQ ID NO: 57310 - DNA, 20 bp, Artificial Sequence
  chemically synthesized
ccgaaaggagtcattgtacc

SEQ ID NO: 57311 - DNA, 20 bp, Artificial Sequence
  chemically synthesized
aggagtcattgtacctggct

SEQ ID NO: 57312 - DNA, 20 bp, Artificial Sequence
  chemically synthesized
tgtacctggctcagaaacca

SEQ ID NO: 57313 - DNA, 20 bp, Artificial Sequence
  chemically synthesized
aaccacagcgtcctgtgtcc

SEQ ID NO: 57314 - DNA, 20 bp, Artificial Sequence
  chemically synthesized
accacagcgtcctgtgtcca

SEQ ID NO: 57315 - DNA, 20 bp, Artificial Sequence
  chemically synthesized
acagcgtcctgtgtccaagg

SEQ ID NO: 57316 - DNA, 20 bp, Artificial Sequence
  chemically synthesized
agcgtcctgtgtccaaggtg

SEQ ID NO: 57317 - DNA, 20 bp, Artificial Sequence
  chemically synthesized
gcgtcctgtgtccaaggtgg

SEQ ID NO: 57318 - DNA, 20 bp, Artificial Sequence
  chemically synthesized
cgtcctgtgtccaaggtgga

SEQ ID NO: 57319 - DNA, 20 bp, Artificial Sequence
  chemically synthesized
gtcctgtgtccaaggtggag

SEQ ID NO: 57320 - DNA, 20 bp, Artificial Sequence
  chemically synthesized
tcctgtgtccaaggtggagg

SEQ ID NO: 57321 - DNA, 20 bp, Artificial Sequence
  chemically synthesized
tgtgtccaaggtggaggggg

SEQ ID NO: 57322 - DNA, 20 bp, Artificial Sequence
  chemically synthesized
caaggtggagggggtggcgt

SEQ ID NO: 57323 - DNA, 20 bp, Artificial Sequence
  chemically synthesized
gtggagggggtggcgtgagt

SEQ ID NO: 57324 - DNA, 20 bp, Artificial Sequence
  chemically synthesized
agggggtggcgtgagtcaga

SEQ ID NO: 57325 - DNA, 20 bp, Artificial Sequence
  chemically synthesized
ggcgtgagtcagacagtctc

SEQ ID NO: 57326 - DNA, 20 bp, Artificial Sequence
  chemically synthesized
gcgtgagtcagacagtctct

SEQ ID NO: 57327 - DNA, 20 bp, Artificial Sequence
  chemically synthesized
gtgagtcagacagtctctgg

SEQ ID NO: 57328 - DNA, 20 bp, Artificial Sequence
  chemically synthesized
gagtcagacagtctctggga

SEQ ID NO: 57329 - DNA, 20 bp, Artificial Sequence
  chemically synthesized
gtctctgggagagtaccact

SEQ ID NO: 57330 - DNA, 20 bp, Artificial Sequence
  chemically synthesized
ctgggagagtaccacttagc

SEQ ID NO: 57331 - DNA, 20 bp, Artificial Sequence
  chemically synthesized
ctggccctctgctctcactg

SEQ ID NO: 57332 - DNA, 20 bp, Artificial Sequence
  chemically synthesized
tgctctcactgcagaatcct

SEQ ID NO: 57333 - DNA, 20 bp, Artificial Sequence
  chemically synthesized
tctcactgcagaatccttag

SEQ ID NO: 57334 - DNA, 20 bp, Artificial Sequence
  chemically synthesized
atccttagtggctgttccac

SEQ ID NO: 57335 - DNA, 20 bp, Artificial Sequence
  chemically synthesized
cttagtggctgttccactgg

SEQ ID NO: 57336 - DNA, 20 bp, Artificial Sequence
  chemically synthesized
gtggctgttccactggtagc

SEQ ID NO: 57337 - DNA, 20 bp, Artificial Sequence
  chemically synthesized
agcaagatctaccatttact

SEQ ID NO: 57338 - DNA, 20 bp, Artificial Sequence
  chemically synthesized
ccccaaaatgcctgatgctg

SEQ ID NO: 57339 - DNA, 20 bp, Artificial Sequence
  chemically synthesized
ctgaagacttactgccgccc

SEQ ID NO: 57340 - DNA, 20 bp, Artificial Sequence
  chemically synthesized
tgaagacttactgccgccct

SEQ ID NO: 57341 - DNA, 20 bp, Artificial Sequence
  chemically synthesized
aagacttactgccgccctgg

SEQ ID NO: 57342 - DNA, 20 bp, Artificial Sequence
  chemically synthesized
ttactgccgccctgggagat

SEQ ID NO: 57343 - DNA, 20 bp, Artificial Sequence
  chemically synthesized
actgccgccctgggagatca

SEQ ID NO: 57344 - DNA, 20 bp, Artificial Sequence
  chemically synthesized
gccgccctgggagatcagag

SEQ ID NO: 57345 - DNA, 20 bp, Artificial Sequence
  chemically synthesized
ccgccctgggagatcagagt

SEQ ID NO: 57346 - DNA, 20 bp, Artificial Sequence
  chemically synthesized
cctgggagatcagagtgggt

SEQ ID NO: 57347 - DNA, 20 bp, Artificial Sequence
  chemically synthesized
tgggagatcagagtgggtta

SEQ ID NO: 57348 - DNA, 20 bp, Artificial Sequence
  chemically synthesized
gtgggttagagcccatttga

SEQ ID NO: 57349 - DNA, 20 bp, Artificial Sequence
  chemically synthesized
ttagagcccatttgacagat

SEQ ID NO: 57350 - DNA, 20 bp, Artificial Sequence
  chemically synthesized
tagagcccatttgacagatg

SEQ ID NO: 57351 - DNA, 20 bp, Artificial Sequence
  chemically synthesized
ccatttgacagatgaggaaa

SEQ ID NO: 57352 - DNA, 20 bp, Artificial Sequence
  chemically synthesized
catttgacagatgaggaaac

SEQ ID NO: 57353 - DNA, 20 bp, Artificial Sequence
  chemically synthesized
gacagatgaggaaacaggct

SEQ ID NO: 57354 - DNA, 20 bp, Artificial Sequence
  chemically synthesized
cagatgaggaaacaggctca

SEQ ID NO: 57355 - DNA, 20 bp, Artificial Sequence
  chemically synthesized
atgaggaaacaggctcagag

SEQ ID NO: 57356 - DNA, 20 bp, Artificial Sequence
  chemically synthesized
gaggaaacaggctcagagcg

SEQ ID NO: 57357 - DNA, 20 bp, Artificial Sequence
  chemically synthesized
ggaaacaggctcagagcgga

SEQ ID NO: 57358 - DNA, 20 bp, Artificial Sequence
  chemically synthesized
gcggagagaccgctcatcca

SEQ ID NO: 57359 - DNA, 20 bp, Artificial Sequence
  chemically synthesized
accgctcatccaaagttacc

SEQ ID NO: 57360 - DNA, 20 bp, Artificial Sequence
  chemically synthesized
ctcatccaaagttacccagt

SEQ ID NO: 57361 - DNA, 20 bp, Artificial Sequence
  chemically synthesized
caaagttacccagtcagcct

SEQ ID NO: 57362 - DNA, 20 bp, Artificial Sequence
  chemically synthesized
agacacaaacaccctcttga

SEQ ID NO: 57363 - DNA, 20 bp, Artificial Sequence
  chemically synthesized
caccctcttgatggtcccga

SEQ ID NO: 57364 - DNA, 20 bp, Artificial Sequence
  chemically synthesized
tgatggtcccgatggaaaaa

SEQ ID NO: 57365 - DNA, 20 bp, Artificial Sequence
  chemically synthesized
atggtcccgatggaaaaatg

SEQ ID NO: 57366 - DNA, 20 bp, Artificial Sequence
  chemically synthesized
tggaaaaatggagcatgact

SEQ ID NO: 57367 - DNA, 20 bp, Artificial Sequence
  chemically synthesized
ggaaaaatggagcatgactg

SEQ ID NO: 57368 - DNA, 20 bp, Artificial Sequence
  chemically synthesized
aaaatggagcatgactgagg

SEQ ID NO: 57369 - DNA, 20 bp, Artificial Sequence
  chemically synthesized
actgaggcagacacaaccgt

SEQ ID NO: 57370 - DNA, 20 bp, Artificial Sequence
  chemically synthesized
ctgaggcagacacaaccgtc

SEQ ID NO: 57371 - DNA, 20 bp, Artificial Sequence
  chemically synthesized
ggcagacacaaccgtcaggc

SEQ ID NO: 57372 - DNA, 20 bp, Artificial Sequence
  chemically synthesized
acacaaccgtcaggctggca

SEQ ID NO: 57373 - DNA, 20 bp, Artificial Sequence
  chemically synthesized
cacaaccgtcaggctggcat

SEQ ID NO: 57374 - DNA, 20 bp, Artificial Sequence
  chemically synthesized
acaaccgtcaggctggcatg

SEQ ID NO: 57375 - DNA, 20 bp, Artificial Sequence
  chemically synthesized
caaccgtcaggctggcatgg

SEQ ID NO: 57376 - DNA, 20 bp, Artificial Sequence
  chemically synthesized
aaccgtcaggctggcatggg

SEQ ID NO: 57377 - DNA, 20 bp, Artificial Sequence
  chemically synthesized
aggctggcatggggggccgt

SEQ ID NO: 57378 - DNA, 20 bp, Artificial Sequence
  chemically synthesized
tggcatggggggccgtgaga

SEQ ID NO: 57379 - DNA, 20 bp, Artificial Sequence
  chemically synthesized
ggcatggggggccgtgagac

SEQ ID NO: 57380 - DNA, 20 bp, Artificial Sequence
  chemically synthesized
gcatggggggccgtgagaca

SEQ ID NO: 57381 - DNA, 20 bp, Artificial Sequence
  chemically synthesized
tggggggccgtgagacaggg

SEQ ID NO: 57382 - DNA, 20 bp, Artificial Sequence
  chemically synthesized
gggggccgtgagacagggta

SEQ ID NO: 57383 - DNA, 20 bp, Artificial Sequence
  chemically synthesized
ggggccgtgagacagggtag

SEQ ID NO: 57384 - DNA, 20 bp, Artificial Sequence
  chemically synthesized
gccgtgagacagggtagagg

SEQ ID NO: 57385 - DNA, 20 bp, Artificial Sequence
  chemically synthesized
ccgtgagacagggtagaggt

SEQ ID NO: 57386 - DNA, 20 bp, Artificial Sequence
  chemically synthesized
cgtgagacagggtagaggtg

SEQ ID NO: 57387 - DNA, 20 bp, Artificial Sequence
  chemically synthesized
gagacagggtagaggtgggg

SEQ ID NO: 57388 - DNA, 20 bp, Artificial Sequence
  chemically synthesized
ggtggggaagcacatctgta

SEQ ID NO: 57389 - DNA, 20 bp, Artificial Sequence
  chemically synthesized
ggggaagcacatctgtaaag

SEQ ID NO: 57390 - DNA, 20 bp, Artificial Sequence
  chemically synthesized
ggaagcacatctgtaaagaa

SEQ ID NO: 57391 - DNA, 20 bp, Artificial Sequence
  chemically synthesized
aaagaagagctgtgctgcct

SEQ ID NO: 57392 - DNA, 20 bp, Artificial Sequence
  chemically synthesized
aagaagagctgtgctgcctc

SEQ ID NO: 57393 - DNA, 20 bp, Artificial Sequence
  chemically synthesized
aagagctgtgctgcctcagg

SEQ ID NO: 57394 - DNA, 20 bp, Artificial Sequence
  chemically synthesized
agagctgtgctgcctcaggc

SEQ ID NO: 57395 - DNA, 20 bp, Artificial Sequence
  chemically synthesized
gccgcttcacctctctgaac

SEQ ID NO: 57396 - DNA, 20 bp, Artificial Sequence
  chemically synthesized
ccgcttcacctctctgaacc

SEQ ID NO: 57397 - DNA, 20 bp, Artificial Sequence
  chemically synthesized
actgtttcacctgcatccca

SEQ ID NO: 57398 - DNA, 20 bp, Artificial Sequence
  chemically synthesized
tgtttcacctgcatcccaaa

SEQ ID NO: 57399 - DNA, 20 bp, Artificial Sequence
  chemically synthesized
tcacctgcatcccaaagagt

SEQ ID NO: 57400 - DNA, 20 bp, Artificial Sequence
  chemically synthesized
cctgcatcccaaagagttgg

SEQ ID NO: 57401 - DNA, 20 bp, Artificial Sequence
  chemically synthesized
gagttggaagtttcattccc

SEQ ID NO: 57402 - DNA, 20 bp, Artificial Sequence
  chemically synthesized
cattcccaagcatgcttgtg

SEQ ID NO: 57403 - DNA, 20 bp, Artificial Sequence
  chemically synthesized
agcatgcttgtgaagtgcct

SEQ ID NO: 57404 - DNA, 20 bp, Artificial Sequence
  chemically synthesized
gcatgcttgtgaagtgcctc

SEQ ID NO: 57405 - DNA, 20 bp, Artificial Sequence
  chemically synthesized
cttgtgaagtgcctcgggtg

SEQ ID NO: 57406 - DNA, 20 bp, Artificial Sequence
  chemically synthesized
agtgcctcgggtgaagtgcc

SEQ ID NO: 57407 - DNA, 20 bp, Artificial Sequence
  chemically synthesized
cgggtgaagtgcctggcaca

SEQ ID NO: 57408 - DNA, 20 bp, Artificial Sequence
  chemically synthesized
gtgaagtgcctggcacacag

SEQ ID NO: 57409 - DNA, 20 bp, Artificial Sequence
  chemically synthesized
tgaagtgcctggcacacagt

SEQ ID NO: 57410 - DNA, 20 bp, Artificial Sequence
  chemically synthesized
cacacagtaggctctttatg

SEQ ID NO: 57411 - DNA, 20 bp, Artificial Sequence
  chemically synthesized
acacagtaggctctttatgt

SEQ ID NO: 57412 - DNA, 20 bp, Artificial Sequence
  chemically synthesized
gctctttatgtgggtctgca

SEQ ID NO: 57413 - DNA, 20 bp, Artificial Sequence
  chemically synthesized
ggtctgcacagccctctgct

SEQ ID NO: 57414 - DNA, 20 bp, Artificial Sequence
  chemically synthesized
cctctgcttagtctgccccc

SEQ ID NO: 57415 - DNA, 20 bp, Artificial Sequence
  chemically synthesized
ctctgcttagtctgcccccc

SEQ ID NO: 57416 - DNA, 20 bp, Artificial Sequence
  chemically synthesized
agtctgccccccaggctgct

SEQ ID NO: 57417 - DNA, 20 bp, Artificial Sequence
  chemically synthesized
tctgccccccaggctgctca

SEQ ID NO: 57418 - DNA, 20 bp, Artificial Sequence
  chemically synthesized
gccccccaggctgctcagag

SEQ ID NO: 57419 - DNA, 20 bp, Artificial Sequence
  chemically synthesized
ccccccaggctgctcagagc

SEQ ID NO: 57420 - DNA, 20 bp, Artificial Sequence
  chemically synthesized
ccccaggctgctcagagcag

SEQ ID NO: 57421 - DNA, 20 bp, Artificial Sequence
  chemically synthesized
cccaggctgctcagagcagg

SEQ ID NO: 57422 - DNA, 20 bp, Artificial Sequence
  chemically synthesized
caggctgctcagagcaggag

SEQ ID NO: 57423 - DNA, 20 bp, Artificial Sequence
  chemically synthesized
aggctgctcagagcaggagg

SEQ ID NO: 57424 - DNA, 20 bp, Artificial Sequence
  chemically synthesized
ggaggaggttcaattttgac

SEQ ID NO: 57425 - DNA, 20 bp, Artificial Sequence
  chemically synthesized
ggttcaattttgaccagcct

SEQ ID NO: 57426 - DNA, 20 bp, Artificial Sequence
  chemically synthesized
gttcaattttgaccagcctc

SEQ ID NO: 57427 - DNA, 20 bp, Artificial Sequence
  chemically synthesized
cctgtttctgtttttgctcc

SEQ ID NO: 57428 - DNA, 20 bp, Artificial Sequence
  chemically synthesized
tgtttttgctcctggaaaac

SEQ ID NO: 57429 - DNA, 20 bp, Artificial Sequence
  chemically synthesized
aaaccagtgtgatccgtata

SEQ ID NO: 57430 - DNA, 20 bp, Artificial Sequence
  chemically synthesized
agtgtgatccgtatacagct

SEQ ID NO: 57431 - DNA, 20 bp, Artificial Sequence
  chemically synthesized
tgtgatccgtatacagcttg

SEQ ID NO: 57432 - DNA, 20 bp, Artificial Sequence
  chemically synthesized
tatacagcttggagtttctt

SEQ ID NO: 57433 - DNA, 20 bp, Artificial Sequence
  chemically synthesized
ttggagtttctttggataca

SEQ ID NO: 57434 - DNA, 20 bp, Artificial Sequence
  chemically synthesized
tggatacatggcccccactc

SEQ ID NO: 57435 - DNA, 20 bp, Artificial Sequence
  chemically synthesized
ggatacatggcccccactct

SEQ ID NO: 57436 - DNA, 20 bp, Artificial Sequence
  chemically synthesized
gatacatggcccccactctg

SEQ ID NO: 57437 - DNA, 20 bp, Artificial Sequence
  chemically synthesized
ggcccccactctggggttgt

SEQ ID NO: 57438 - DNA, 20 bp, Artificial Sequence
  chemically synthesized
cccccactctggggttgttg

SEQ ID NO: 57439 - DNA, 20 bp, Artificial Sequence
  chemically synthesized
ccccactctggggttgttgg

SEQ ID NO: 57440 - DNA, 20 bp, Artificial Sequence
  chemically synthesized
ctggggttgttggaggcctt

SEQ ID NO: 57441 - DNA, 20 bp, Artificial Sequence
  chemically synthesized
ggggttgttggaggcctttg

SEQ ID NO: 57442 - DNA, 20 bp, Artificial Sequence
  chemically synthesized
tggaggcctttggagactgc

SEQ ID NO: 57443 - DNA, 20 bp, Artificial Sequence
  chemically synthesized
ggaggcctttggagactgct

SEQ ID NO: 57444 - DNA, 20 bp, Artificial Sequence
  chemically synthesized
gaggcctttggagactgctg

SEQ ID NO: 57445 - DNA, 20 bp, Artificial Sequence
  chemically synthesized
aggcctttggagactgctgg

SEQ ID NO: 57446 - DNA, 20 bp, Artificial Sequence
  chemically synthesized
cctttggagactgctggggg

SEQ ID NO: 57447 - DNA, 20 bp, Artificial Sequence
  chemically synthesized
tttggagactgctgggggtg

SEQ ID NO: 57448 - DNA, 20 bp, Artificial Sequence
  chemically synthesized
ttggagactgctgggggtgg

SEQ ID NO: 57449 - DNA, 20 bp, Artificial Sequence
  chemically synthesized
tggagactgctgggggtgga

SEQ ID NO: 57450 - DNA, 20 bp, Artificial Sequence
  chemically synthesized
ggagactgctgggggtggag

SEQ ID NO: 57451 - DNA, 20 bp, Artificial Sequence
  chemically synthesized
agactgctgggggtggaggg

SEQ ID NO: 57452 - DNA, 20 bp, Artificial Sequence
  chemically synthesized
gactgctgggggtggagggg

SEQ ID NO: 57453 - DNA, 20 bp, Artificial Sequence
  chemically synthesized
actgctgggggtggagggga

SEQ ID NO: 57454 - DNA, 20 bp, Artificial Sequence
  chemically synthesized
ctgctgggggtggaggggag

SEQ ID NO: 57455 - DNA, 20 bp, Artificial Sequence
  chemically synthesized
gctgggggtggaggggaggg

SEQ ID NO: 57456 - DNA, 20 bp, Artificial Sequence
  chemically synthesized
ctgggggtggaggggagggg

SEQ ID NO: 57457 - DNA, 20 bp, Artificial Sequence
  chemically synthesized
ggtggaggggaggggaggta

SEQ ID NO: 57458 - DNA, 20 bp, Artificial Sequence
  chemically synthesized
gtggaggggaggggaggtac

SEQ ID NO: 57459 - DNA, 20 bp, Artificial Sequence
  chemically synthesized
tggaggggaggggaggtaca

SEQ ID NO: 57460 - DNA, 20 bp, Artificial Sequence
  chemically synthesized
gggaggggaggtacagggtt

SEQ ID NO: 57461 - DNA, 20 bp, Artificial Sequence
  chemically synthesized
ggaggggaggtacagggttg

SEQ ID NO: 57462 - DNA, 20 bp, Artificial Sequence
  chemically synthesized
gggaggtacagggttgaggc

SEQ ID NO: 57463 - DNA, 20 bp, Artificial Sequence
  chemically synthesized
aggtacagggttgaggctag

SEQ ID NO: 57464 - DNA, 20 bp, Artificial Sequence
  chemically synthesized
ggtacagggttgaggctagt

SEQ ID NO: 57465 - DNA, 20 bp, Artificial Sequence
  chemically synthesized
gtacagggttgaggctagtg

SEQ ID NO: 57466 - DNA, 20 bp, Artificial Sequence
  chemically synthesized
cttgattgcaatccctttaa

SEQ ID NO: 57467 - DNA, 20 bp, Artificial Sequence
  chemically synthesized
atccctttaaaagcctaaat

SEQ ID NO: 57468 - DNA, 20 bp, Artificial Sequence
  chemically synthesized
gtgcaacccgcaaacctgct

SEQ ID NO: 57469 - DNA, 20 bp, Artificial Sequence
  chemically synthesized
tgcaacccgcaaacctgctt

SEQ ID NO: 57470 - DNA, 20 bp, Artificial Sequence
  chemically synthesized
caacccgcaaacctgcttgg

SEQ ID NO: 57471 - DNA, 20 bp, Artificial Sequence
  chemically synthesized
ccgcaaacctgcttgggagc

SEQ ID NO: 57472 - DNA, 20 bp, Artificial Sequence
  chemically synthesized
gggagctggcgtacgtgccg

SEQ ID NO: 57473 - DNA, 20 bp, Artificial Sequence
  chemically synthesized
gtacgtgccgtagatacttg

SEQ ID NO: 57474 - DNA, 20 bp, Artificial Sequence
  chemically synthesized
acgtgccgtagatacttgca

SEQ ID NO: 57475 - DNA, 20 bp, Artificial Sequence
  chemically synthesized
gtagatacttgcagagtgaa

SEQ ID NO: 57476 - DNA, 20 bp, Artificial Sequence
  chemically synthesized
tacttgcagagtgaatggat

SEQ ID NO: 57477 - DNA, 20 bp, Artificial Sequence
  chemically synthesized
ttgccccttctgtcattcac

SEQ ID NO: 57478 - DNA, 20 bp, Artificial Sequence
  chemically synthesized
tcccatttatgcctccacct

SEQ ID NO: 57479 - DNA, 20 bp, Artificial Sequence
  chemically synthesized
cccatttatgcctccacctt

SEQ ID NO: 57480 - DNA, 20 bp, Artificial Sequence
  chemically synthesized
ccatttatgcctccaccttg

SEQ ID NO: 57481 - DNA, 20 bp, Artificial Sequence
  chemically synthesized
cctccaccttggggctctac

SEQ ID NO: 57482 - DNA, 20 bp, Artificial Sequence
  chemically synthesized
ctccaccttggggctctacc

SEQ ID NO: 57483 - DNA, 20 bp, Artificial Sequence
  chemically synthesized
accttggggctctaccaggc

SEQ ID NO: 57484 - DNA, 20 bp, Artificial Sequence
  chemically synthesized
tctaccaggcgagtgaccca

SEQ ID NO: 57485 - DNA, 20 bp, Artificial Sequence
  chemically synthesized
ctaccaggcgagtgacccac

SEQ ID NO: 57486 - DNA, 20 bp, Artificial Sequence
  chemically synthesized
gagtgacccacaggatcctc

SEQ ID NO: 57487 - DNA, 20 bp, Artificial Sequence
  chemically synthesized
gatcctccagcacacacatt

SEQ ID NO: 57488 - DNA, 20 bp, Artificial Sequence
  chemically synthesized
tccagcacacacattcagac

SEQ ID NO: 57489 - DNA, 20 bp, Artificial Sequence
  chemically synthesized
ccagcacacacattcagacc

SEQ ID NO: 57490 - DNA, 20 bp, Artificial Sequence
  chemically synthesized
cagcacacacattcagacca

SEQ ID NO: 57491 - DNA, 20 bp, Artificial Sequence
  chemically synthesized
agaccagggaacccacttac

SEQ ID NO: 57492 - DNA, 20 bp, Artificial Sequence
  chemically synthesized
ggaacccacttactggctgt

SEQ ID NO: 57493 - DNA, 20 bp, Artificial Sequence
  chemically synthesized
gaacccacttactggctgtg

SEQ ID NO: 57494 - DNA, 20 bp, Artificial Sequence
  chemically synthesized
acttactggctgtgaggcct

SEQ ID NO: 57495 - DNA, 20 bp, Artificial Sequence
  chemically synthesized
cttactggctgtgaggcctc

SEQ ID NO: 57496 - DNA, 20 bp, Artificial Sequence
  chemically synthesized
ctggctgtgaggcctcaggt

SEQ ID NO: 57497 - DNA, 20 bp, Artificial Sequence
  chemically synthesized
gtgagttgtttaaccgctcc

SEQ ID NO: 57498 - DNA, 20 bp, Artificial Sequence
  chemically synthesized
caatttccctatctgtaaaa

SEQ ID NO: 57499 - DNA, 20 bp, Artificial Sequence
  chemically synthesized
aatttccctatctgtaaaat

SEQ ID NO: 57500 - DNA, 20 bp, Artificial Sequence
  chemically synthesized
atttccctatctgtaaaatg

SEQ ID NO: 57501 - DNA, 20 bp, Artificial Sequence
  chemically synthesized
ccctatctgtaaaatgggga

SEQ ID NO: 57502 - DNA, 20 bp, Artificial Sequence
  chemically synthesized
ctgtaaaatggggatggtga

SEQ ID NO: 57503 - DNA, 20 bp, Artificial Sequence
  chemically synthesized
gtgacggtatgtaccttgtt

SEQ ID NO: 57504 - DNA, 20 bp, Artificial Sequence
  chemically synthesized
gtaccttgttgagctgctgt

SEQ ID NO: 57505 - DNA, 20 bp, Artificial Sequence
  chemically synthesized
taccttgttgagctgctgtg

SEQ ID NO: 57506 - DNA, 20 bp, Artificial Sequence
  chemically synthesized
ctgtgaggattaaaatgcaa

SEQ ID NO: 57507 - DNA, 20 bp, Artificial Sequence
  chemically synthesized
ggattaaaatgcaacagttc

SEQ ID NO: 57508 - DNA, 20 bp, Artificial Sequence
  chemically synthesized
gattaaaatgcaacagttca

SEQ ID NO: 57509 - DNA, 20 bp, Artificial Sequence
  chemically synthesized
aaaatgcaacagttcaagga

SEQ ID NO: 57510 - DNA, 20 bp, Artificial Sequence
  chemically synthesized
gcaacagttcaaggaaagct

SEQ ID NO: 57511 - DNA, 20 bp, Artificial Sequence
  chemically synthesized
aacagttcaaggaaagctca

SEQ ID NO: 57512 - DNA, 20 bp, Artificial Sequence
  chemically synthesized
gttcaaggaaagctcagaga

SEQ ID NO: 57513 - DNA, 20 bp, Artificial Sequence
  chemically synthesized
ttcaaggaaagctcagagac

SEQ ID NO: 57514 - DNA, 20 bp, Artificial Sequence
  chemically synthesized
gaaagctcagagacgggtac

SEQ ID NO: 57515 - DNA, 20 bp, Artificial Sequence
  chemically synthesized
aaagctcagagacgggtact

SEQ ID NO: 57516 - DNA, 20 bp, Artificial Sequence
  chemically synthesized
agacgggtactgggtgtgcc

SEQ ID NO: 57517 - DNA, 20 bp, Artificial Sequence
  chemically synthesized
gggtactgggtgtgcccaga

SEQ ID NO: 57518 - DNA, 20 bp, Artificial Sequence
  chemically synthesized
ctgccctccctcccccgtgt

SEQ ID NO: 57519 - DNA, 20 bp, Artificial Sequence
  chemically synthesized
tgccctccctcccccgtgtc

SEQ ID NO: 57520 - DNA, 20 bp, Artificial Sequence
  chemically synthesized
gccctccctcccccgtgtca

SEQ ID NO: 57521 - DNA, 20 bp, Artificial Sequence
  chemically synthesized
ccctccctcccccgtgtcag

SEQ ID NO: 57522 - DNA, 20 bp, Artificial Sequence
  chemically synthesized
ccctcccccgtgtcaggggc

SEQ ID NO: 57523 - DNA, 20 bp, Artificial Sequence
  chemically synthesized
gtgtcaggggctggtgtcac

SEQ ID NO: 57524 - DNA, 20 bp, Artificial Sequence
  chemically synthesized
tgtcaggggctggtgtcact

SEQ ID NO: 57525 - DNA, 20 bp, Artificial Sequence
  chemically synthesized
gtcaggggctggtgtcactg

SEQ ID NO: 57526 - DNA, 20 bp, Artificial Sequence
  chemically synthesized
aggggctggtgtcactgggg

SEQ ID NO: 57527 - DNA, 20 bp, Artificial Sequence
  chemically synthesized
ggggctggtgtcactggggt

SEQ ID NO: 57528 - DNA, 20 bp, Artificial Sequence
  chemically synthesized
gggctggtgtcactggggtg

SEQ ID NO: 57529 - DNA, 20 bp, Artificial Sequence
  chemically synthesized
ctggtgtcactggggtgggg

SEQ ID NO: 57530 - DNA, 20 bp, Artificial Sequence
  chemically synthesized
tggtgtcactggggtggggt

SEQ ID NO: 57531 - DNA, 20 bp, Artificial Sequence
  chemically synthesized
ggtggggtgggccacacttg

SEQ ID NO: 57532 - DNA, 20 bp, Artificial Sequence
  chemically synthesized
tggggtgggccacacttgaa

SEQ ID NO: 57533 - DNA, 20 bp, Artificial Sequence
  chemically synthesized
acacttgaagagctttcctc

SEQ ID NO: 57534 - DNA, 20 bp, Artificial Sequence
  chemically synthesized
cacttgaagagctttcctcc

SEQ ID NO: 57535 - DNA, 20 bp, Artificial Sequence
  chemically synthesized
ttgaagagctttcctccagg

SEQ ID NO: 57536 - DNA, 20 bp, Artificial Sequence
  chemically synthesized
cctccaggcagtctctcatt

SEQ ID NO: 57537 - DNA, 20 bp, Artificial Sequence
  chemically synthesized
tctcattcagttaccctgtg

SEQ ID NO: 57538 - DNA, 20 bp, Artificial Sequence
  chemically synthesized
ctcattcagttaccctgtga

SEQ ID NO: 57539 - DNA, 20 bp, Artificial Sequence
  chemically synthesized
tcattcagttaccctgtgaa

SEQ ID NO: 57540 - DNA, 20 bp, Artificial Sequence
  chemically synthesized
attcagttaccctgtgaagg

SEQ ID NO: 57541 - DNA, 20 bp, Artificial Sequence
  chemically synthesized
cagttaccctgtgaagggag

SEQ ID NO: 57542 - DNA, 20 bp, Artificial Sequence
  chemically synthesized
agttaccctgtgaagggagt

SEQ ID NO: 57543 - DNA, 20 bp, Artificial Sequence
  chemically synthesized
agtaggtaccaccctccttt

SEQ ID NO: 57544 - DNA, 20 bp, Artificial Sequence
  chemically synthesized
gtaggtaccaccctcctttc

SEQ ID NO: 57545 - DNA, 20 bp, Artificial Sequence
  chemically synthesized
ggtaccaccctcctttcagg

SEQ ID NO: 57546 - DNA, 20 bp, Artificial Sequence
  chemically synthesized
accaccctcctttcaggcag

SEQ ID NO: 57547 - DNA, 20 bp, Artificial Sequence
  chemically synthesized
ccaccctcctttcaggcagc

SEQ ID NO: 57548 - DNA, 20 bp, Artificial Sequence
  chemically synthesized
ctttcaggcagcgggaaact

SEQ ID NO: 57549 - DNA, 20 bp, Artificial Sequence
  chemically synthesized
aggcagcgggaaactgagct

SEQ ID NO: 57550 - DNA, 20 bp, Artificial Sequence
  chemically synthesized
actcccctccccttctctct

SEQ ID NO: 57551 - DNA, 20 bp, Artificial Sequence
  chemically synthesized
tctctgagctcccttccctg

SEQ ID NO: 57552 - DNA, 20 bp, Artificial Sequence
  chemically synthesized
ttccctgcagctccatcccc

SEQ ID NO: 57553 - DNA, 20 bp, Artificial Sequence
  chemically synthesized
gcagctccatcccctggctt

SEQ ID NO: 57554 - DNA, 20 bp, Artificial Sequence
  chemically synthesized
cagctccatcccctggcttc

SEQ ID NO: 57555 - DNA, 20 bp, Artificial Sequence
  chemically synthesized
agctccatcccctggcttca

SEQ ID NO: 57556 - DNA, 20 bp, Artificial Sequence
  chemically synthesized
agggcccctgtccttcccct

SEQ ID NO: 57557 - DNA, 20 bp, Artificial Sequence
  chemically synthesized
cccctgtccttcccctgagc

SEQ ID NO: 57558 - DNA, 20 bp, Artificial Sequence
  chemically synthesized
cttcccctgagctggctgaa

SEQ ID NO: 57559 - DNA, 20 bp, Artificial Sequence
  chemically synthesized
cgctgctctacatccactca

SEQ ID NO: 57560 - DNA, 20 bp, Artificial Sequence
  chemically synthesized
tctacatccactcacagctc

SEQ ID NO: 57561 - DNA, 20 bp, Artificial Sequence
  chemically synthesized
tccactcacagctccagcac

SEQ ID NO: 57562 - DNA, 20 bp, Artificial Sequence
  chemically synthesized
ccactcacagctccagcact

SEQ ID NO: 57563 - DNA, 20 bp, Artificial Sequence
  chemically synthesized
acagctccagcactgggctg

SEQ ID NO: 57564 - DNA, 20 bp, Artificial Sequence
  chemically synthesized
tccagcactgggctgtggtt

SEQ ID NO: 57565 - DNA, 20 bp, Artificial Sequence
  chemically synthesized
ccagcactgggctgtggttg

SEQ ID NO: 57566 - DNA, 20 bp, Artificial Sequence
  chemically synthesized
tggttgaggtcgcctgccct

SEQ ID NO: 57567 - DNA, 20 bp, Artificial Sequence
  chemically synthesized
ttgaggtcgcctgccctcgg

SEQ ID NO: 57568 - DNA, 20 bp, Artificial Sequence
  chemically synthesized
cgcctgccctcggtagctcc

SEQ ID NO: 57569 - DNA, 20 bp, Artificial Sequence
  chemically synthesized
gcctgccctcggtagctcct

SEQ ID NO: 57570 - DNA, 20 bp, Artificial Sequence
  chemically synthesized
tgggcatttcttcccctctc

SEQ ID NO: 57571 - DNA, 20 bp, Artificial Sequence
  chemically synthesized
gggcatttcttcccctctct

SEQ ID NO: 57572 - DNA, 20 bp, Artificial Sequence
  chemically synthesized
tgcacaatgacccccactct

SEQ ID NO: 57573 - DNA, 20 bp, Artificial Sequence
  chemically synthesized
cctgctgtccctcccacctg

SEQ ID NO: 57574 - DNA, 20 bp, Artificial Sequence
  chemically synthesized
tccctcccacctgtggaact

SEQ ID NO: 57575 - DNA, 20 bp, Artificial Sequence
  chemically synthesized
tcccacctgtggaactgagt

SEQ ID NO: 57576 - DNA, 20 bp, Artificial Sequence
  chemically synthesized
cacctgtggaactgagtgag

SEQ ID NO: 57577 - DNA, 20 bp, Artificial Sequence
  chemically synthesized
ctgtggaactgagtgagcag

SEQ ID NO: 57578 - DNA, 20 bp, Artificial Sequence
  chemically synthesized
tggaactgagtgagcagcag

SEQ ID NO: 57579 - DNA, 20 bp, Artificial Sequence
  chemically synthesized
ccacctttcctgctctcctc

SEQ ID NO: 57580 - DNA, 20 bp, Artificial Sequence
  chemically synthesized
gctctcctcaagctctcctc

SEQ ID NO: 57581 - DNA, 20 bp, Artificial Sequence
  chemically synthesized
tcctcaagctctgtctcttc

SEQ ID NO: 57582 - DNA, 20 bp, Artificial Sequence
  chemically synthesized
tcaagctctgtctcttctgg

SEQ ID NO: 57583 - DNA, 20 bp, Artificial Sequence
  chemically synthesized
caagctctgtctcttctggc

SEQ ID NO: 57584 - DNA, 20 bp, Artificial Sequence
  chemically synthesized
tctgtctcttctggcaggca

SEQ ID NO: 57585 - DNA, 20 bp, Artificial Sequence
  chemically synthesized
ctgtctcttctggcaggcac

SEQ ID NO: 57586 - DNA, 20 bp, Artificial Sequence
  chemically synthesized
gtctcttctggcaggcacag

SEQ ID NO: 57587 - DNA, 20 bp, Artificial Sequence
  chemically synthesized
ctcttctggcaggcacagga

SEQ ID NO: 57588 - DNA, 20 bp, Artificial Sequence
  chemically synthesized
ttctggcaggcacaggagag

SEQ ID NO: 57589 - DNA, 20 bp, Artificial Sequence
  chemically synthesized
aggcacaggagagtggcctg

SEQ ID NO: 57590 - DNA, 20 bp, Artificial Sequence
  chemically synthesized
ggcacaggagagtggcctga

SEQ ID NO: 57591 - DNA, 20 bp, Artificial Sequence
  chemically synthesized
caggagagtggcctgaaggc

SEQ ID NO: 57592 - DNA, 20 bp, Artificial Sequence
  chemically synthesized
gagagtggcctgaaggctgg

SEQ ID NO: 57593 - DNA, 20 bp, Artificial Sequence
  chemically synthesized
agagtggcctgaaggctggc

SEQ ID NO: 57594 - DNA, 20 bp, Artificial Sequence
  chemically synthesized
agtggcctgaaggctggcag

SEQ ID NO: 57595 - DNA, 20 bp, Artificial Sequence
  chemically synthesized
gtggcctgaaggctggcagg

SEQ ID NO: 57596 - DNA, 20 bp, Artificial Sequence
  chemically synthesized
aggttgccgcccctccaacc

SEQ ID NO: 57597 - DNA, 20 bp, Artificial Sequence
  chemically synthesized
cccctccaacctggaattcc

SEQ ID NO: 57598 - DNA, 20 bp, Artificial Sequence
  chemically synthesized
ctccaacctggaattcctgg

SEQ ID NO: 57599 - DNA, 20 bp, Artificial Sequence
  chemically synthesized
caacctggaattcctggcag

SEQ ID NO: 57600 - DNA, 20 bp, Artificial Sequence
  chemically synthesized
cctggaattcctggcagcag

SEQ ID NO: 57601 - DNA, 20 bp, Artificial Sequence
  chemically synthesized
ggaattcctggcagcagcag

SEQ ID NO: 57602 - DNA, 20 bp, Artificial Sequence
  chemically synthesized
ttcctggcagcagcagcggc

SEQ ID NO: 57603 - DNA, 20 bp, Artificial Sequence
  chemically synthesized
tcctggcagcagcagcggct

SEQ ID NO: 57604 - DNA, 20 bp, Artificial Sequence
  chemically synthesized
agcagcggctaggccttcct

SEQ ID NO: 57605 - DNA, 20 bp, Artificial Sequence
  chemically synthesized
cagcggctaggccttcctcg

SEQ ID NO: 57606 - DNA, 20 bp, Artificial Sequence
  chemically synthesized
agcggctaggccttcctcgg

SEQ ID NO: 57607 - DNA, 20 bp, Artificial Sequence
  chemically synthesized
cccgaccccctcctccttct

SEQ ID NO: 57608 - DNA, 20 bp, Artificial Sequence
  chemically synthesized
ccccctcctccttcttggtt

SEQ ID NO: 57609 - DNA, 20 bp, Artificial Sequence
  chemically synthesized
tcctccttcttggttcagct

SEQ ID NO: 57610 - DNA, 20 bp, Artificial Sequence
  chemically synthesized
cctccttcttggttcagctc

SEQ ID NO: 57611 - DNA, 20 bp, Artificial Sequence
  chemically synthesized
ttggttcagctcaggactct

SEQ ID NO: 57612 - DNA, 20 bp, Artificial Sequence
  chemically synthesized
tggttcagctcaggactctg

SEQ ID NO: 57613 - DNA, 20 bp, Artificial Sequence
  chemically synthesized
ggttcagctcaggactctga

SEQ ID NO: 57614 - DNA, 20 bp, Artificial Sequence
  chemically synthesized
ggactctgagggttgctgcg

SEQ ID NO: 57615 - DNA, 20 bp, Artificial Sequence
  chemically synthesized
actctgagggttgctgcgtg

SEQ ID NO: 57616 - DNA, 20 bp, Artificial Sequence
  chemically synthesized
ctctgagggttgctgcgtgg

SEQ ID NO: 57617 - DNA, 20 bp, Artificial Sequence
  chemically synthesized
tgagggttgctgcgtggagg

SEQ ID NO: 57618 - DNA, 20 bp, Artificial Sequence
  chemically synthesized
cgtggaggcagtgcatgccc

SEQ ID NO: 57619 - DNA, 20 bp, Artificial Sequence
  chemically synthesized
gtggaggcagtgcatgccct

SEQ ID NO: 57620 - DNA, 20 bp, Artificial Sequence
  chemically synthesized
ggcagtgcatgccctgggca

SEQ ID NO: 57621 - DNA, 20 bp, Artificial Sequence
  chemically synthesized
catgccctgggcacagtgcc

SEQ ID NO: 57622 - DNA, 20 bp, Artificial Sequence
  chemically synthesized
gtgcccagttcctgcccacc

SEQ ID NO: 57623 - DNA, 20 bp, Artificial Sequence
  chemically synthesized
tgcccagttcctgcccaccc

SEQ ID NO: 57624 - DNA, 20 bp, Artificial Sequence
  chemically synthesized
ccagttcctgcccacccagg

SEQ ID NO: 57625 - DNA, 20 bp, Artificial Sequence
  chemically synthesized
gttcctgcccacccaggaag

SEQ ID NO: 57626 - DNA, 20 bp, Artificial Sequence
  chemically synthesized
cccacccaggaagtagactt

SEQ ID NO: 57627 - DNA, 20 bp, Artificial Sequence
  chemically synthesized
ccacccaggaagtagacttc

SEQ ID NO: 57628 - DNA, 20 bp, Artificial Sequence
  chemically synthesized
cccaggaagtagacttcggg

SEQ ID NO: 57629 - DNA, 20 bp, Artificial Sequence
  chemically synthesized
caggaagtagacttcgggtg

SEQ ID NO: 57630 - DNA, 20 bp, Artificial Sequence
  chemically synthesized
aggaagtagacttcgggtgg

SEQ ID NO: 57631 - DNA, 20 bp, Artificial Sequence
  chemically synthesized
aagtagacttcgggtggagg

SEQ ID NO: 57632 - DNA, 20 bp, Artificial Sequence
  chemically synthesized
tagacttcgggtggaggcag

SEQ ID NO: 57633 - DNA, 20 bp, Artificial Sequence
  chemically synthesized
agacttcgggtggaggcagt

SEQ ID NO: 57634 - DNA, 20 bp, Artificial Sequence
  chemically synthesized
ttcgggtggaggcagtaggc

SEQ ID NO: 57635 - DNA, 20 bp, Artificial Sequence
  chemically synthesized
tcgggtggaggcagtaggct

SEQ ID NO: 57636 - DNA, 20 bp, Artificial Sequence
  chemically synthesized
cgggtggaggcagtaggctg

SEQ ID NO: 57637 - DNA, 20 bp, Artificial Sequence
  chemically synthesized
ggtggaggcagtaggctggg

SEQ ID NO: 57638 - DNA, 20 bp, Artificial Sequence
  chemically synthesized
gtggaggcagtaggctgggg

SEQ ID NO: 57639 - DNA, 20 bp, Artificial Sequence
  chemically synthesized
tggaggcagtaggctgggga

SEQ ID NO: 57640 - DNA, 20 bp, Artificial Sequence
  chemically synthesized
ggaggcagtaggctggggag

SEQ ID NO: 57641 - DNA, 20 bp, Artificial Sequence
  chemically synthesized
ggcagtaggctggggagggg

SEQ ID NO: 57642 - DNA, 20 bp, Artificial Sequence
  chemically synthesized
gcagtaggctggggaggggc

SEQ ID NO: 57643 - DNA, 20 bp, Artificial Sequence
  chemically synthesized
cagtaggctggggaggggcg

SEQ ID NO: 57644 - DNA, 20 bp, Artificial Sequence
  chemically synthesized
gtaggctggggaggggcggg

SEQ ID NO: 57645 - DNA, 20 bp, Artificial Sequence
  chemically synthesized
ctggggaggggcggggagct

SEQ ID NO: 57646 - DNA, 20 bp, Artificial Sequence
  chemically synthesized
ggaggggcggggagcttgga

SEQ ID NO: 57647 - DNA, 20 bp, Artificial Sequence
  chemically synthesized
gaggggcggggagcttggac

SEQ ID NO: 57648 - DNA, 20 bp, Artificial Sequence
  chemically synthesized
gggcggggagcttggacagg

SEQ ID NO: 57649 - DNA, 20 bp, Artificial Sequence
  chemically synthesized
ggcggggagcttggacagga

SEQ ID NO: 57650 - DNA, 20 bp, Artificial Sequence
  chemically synthesized
cggggagcttggacaggaag

SEQ ID NO: 57651 - DNA, 20 bp, Artificial Sequence
  chemically synthesized
aaggagccttgctcattgcc

SEQ ID NO: 57652 - DNA, 20 bp, Artificial Sequence
  chemically synthesized
gagccttgctcattgcccgg

SEQ ID NO: 57653 - DNA, 20 bp, Artificial Sequence
  chemically synthesized
gctcattgcccggcagacac

SEQ ID NO: 57654 - DNA, 20 bp, Artificial Sequence
  chemically synthesized
ttgcccggcagacacaagac

SEQ ID NO: 57655 - DNA, 20 bp, Artificial Sequence
  chemically synthesized
tgcccggcagacacaagact

SEQ ID NO: 57656 - DNA, 20 bp, Artificial Sequence
  chemically synthesized
agactgggccctcataaact

SEQ ID NO: 57657 - DNA, 20 bp, Artificial Sequence
  chemically synthesized
tgggccctcataaactcaga

SEQ ID NO: 57658 - DNA, 20 bp, Artificial Sequence
  chemically synthesized
cctcataaactcagacagcc

SEQ ID NO: 57659 - DNA, 20 bp, Artificial Sequence
  chemically synthesized
acctgttgtacctgcccttt

SEQ ID NO: 57660 - DNA, 20 bp, Artificial Sequence
  chemically synthesized
gccctttcagctctgtgacc

SEQ ID NO: 57661 - DNA, 20 bp, Artificial Sequence
  chemically synthesized
ccctttcagctctgtgaccc

SEQ ID NO: 57662 - DNA, 20 bp, Artificial Sequence
  chemically synthesized
tcagctctgtgacccgggac

SEQ ID NO: 57663 - DNA, 20 bp, Artificial Sequence
  chemically synthesized
acaagtcaccctctcccttt

SEQ ID NO: 57664 - DNA, 20 bp, Artificial Sequence
  chemically synthesized
ctctccctttgagttgccgc

SEQ ID NO: 57665 - DNA, 20 bp, Artificial Sequence
  chemically synthesized
ctccctttgagttgccgcaa

SEQ ID NO: 57666 - DNA, 20 bp, Artificial Sequence
  chemically synthesized
tccctttgagttgccgcaag

SEQ ID NO: 57667 - DNA, 20 bp, Artificial Sequence
  chemically synthesized
ttgagttgccgcaagaggta

SEQ ID NO: 57668 - DNA, 20 bp, Artificial Sequence
  chemically synthesized
agaggtacagtcacactgcc

SEQ ID NO: 57669 - DNA, 20 bp, Artificial Sequence
  chemically synthesized
aggtacagtcacactgccca

SEQ ID NO: 57670 - DNA, 20 bp, Artificial Sequence
  chemically synthesized
ggtacagtcacactgcccag

SEQ ID NO: 57671 - DNA, 20 bp, Artificial Sequence
  chemically synthesized
cacactgcccagaggattac

SEQ ID NO: 57672 - DNA, 20 bp, Artificial Sequence
  chemically synthesized
cagaggattactagaaatga

SEQ ID NO: 57673 - DNA, 20 bp, Artificial Sequence
  chemically synthesized
agaggattactagaaatgac

SEQ ID NO: 57674 - DNA, 20 bp, Artificial Sequence
  chemically synthesized
aatgacaggcctcgccctcc

SEQ ID NO: 57675 - DNA, 20 bp, Artificial Sequence
  chemically synthesized
caggcctcgccctcctggca

SEQ ID NO: 57676 - DNA, 20 bp, Artificial Sequence
  chemically synthesized
tcgccctcctggcacagacc

SEQ ID NO: 57677 - DNA, 20 bp, Artificial Sequence
  chemically synthesized
acagacctggcaccaataac

SEQ ID NO: 57678 - DNA, 20 bp, Artificial Sequence
  chemically synthesized
gacctggcaccaataactgg

SEQ ID NO: 57679 - DNA, 20 bp, Artificial Sequence
  chemically synthesized
acctggcaccaataactggc

SEQ ID NO: 57680 - DNA, 20 bp, Artificial Sequence
  chemically synthesized
accaataactggcaggtttc

SEQ ID NO: 57681 - DNA, 20 bp, Artificial Sequence
  chemically synthesized
ccaataactggcaggtttct

SEQ ID NO: 57682 - DNA, 20 bp, Artificial Sequence
  chemically synthesized
caataactggcaggtttctg

SEQ ID NO: 57683 - DNA, 20 bp, Artificial Sequence
  chemically synthesized
aactggcaggtttctggggc

SEQ ID NO: 57684 - DNA, 20 bp, Artificial Sequence
  chemically synthesized
caggtttctggggccagctg

SEQ ID NO: 57685 - DNA, 20 bp, Artificial Sequence
  chemically synthesized
ggtttctggggccagctgca

SEQ ID NO: 57686 - DNA, 20 bp, Artificial Sequence
  chemically synthesized
gtttctggggccagctgcag

SEQ ID NO: 57687 - DNA, 20 bp, Artificial Sequence
  chemically synthesized
tttctggggccagctgcaga

SEQ ID NO: 57688 - DNA, 20 bp, Artificial Sequence
  chemically synthesized
ctggggccagctgcagaggg

SEQ ID NO: 57689 - DNA, 20 bp, Artificial Sequence
  chemically synthesized
ggggccagctgcagagggaa

SEQ ID NO: 57690 - DNA, 20 bp, Artificial Sequence
  chemically synthesized
gggccagctgcagagggaag

SEQ ID NO: 57691 - DNA, 20 bp, Artificial Sequence
  chemically synthesized
gctgcagagggaagaggact

SEQ ID NO: 57692 - DNA, 20 bp, Artificial Sequence
  chemically synthesized
tgagccacctatgaaatgcc

SEQ ID NO: 57693 - DNA, 20 bp, Artificial Sequence
  chemically synthesized
gccacctatgaaatgcccag

SEQ ID NO: 57694 - DNA, 20 bp, Artificial Sequence
  chemically synthesized
ccacctatgaaatgcccagt

SEQ ID NO: 57695 - DNA, 20 bp, Artificial Sequence
  chemically synthesized
cctatgaaatgcccagtggg

SEQ ID NO: 57696 - DNA, 20 bp, Artificial Sequence
  chemically synthesized
atgcccagtgggcagcccca

SEQ ID NO: 57697 - DNA, 20 bp, Artificial Sequence
  chemically synthesized
ccagtgggcagccccacagt

SEQ ID NO: 57698 - DNA, 20 bp, Artificial Sequence
  chemically synthesized
cagtgggcagccccacagtt

SEQ ID NO: 57699 - DNA, 20 bp, Artificial Sequence
  chemically synthesized
tgggcagccccacagttggg

SEQ ID NO: 57700 - DNA, 20 bp, Artificial Sequence
  chemically synthesized
gggcagccccacagttgggc

SEQ ID NO: 57701 - DNA, 20 bp, Artificial Sequence
  chemically synthesized
ttgggcaggtctgtgtgcac

SEQ ID NO: 57702 - DNA, 20 bp, Artificial Sequence
  chemically synthesized
tgggcaggtctgtgtgcact

SEQ ID NO: 57703 - DNA, 20 bp, Artificial Sequence
  chemically synthesized
gggcaggtctgtgtgcactg

SEQ ID NO: 57704 - DNA, 20 bp, Artificial Sequence
  chemically synthesized
gcaggtctgtgtgcactggg

SEQ ID NO: 57705 - DNA, 20 bp, Artificial Sequence
  chemically synthesized
caggtctgtgtgcactgggg

SEQ ID NO: 57706 - DNA, 20 bp, Artificial Sequence
  chemically synthesized
cactggggaggtgtgtgtca

SEQ ID NO: 57707 - DNA, 20 bp, Artificial Sequence
  chemically synthesized
actggggaggtgtgtgtcat

SEQ ID NO: 57708 - DNA, 20 bp, Artificial Sequence
  chemically synthesized
gaggtgtgtgtcataggacc

SEQ ID NO: 57709 - DNA, 20 bp, Artificial Sequence
  chemically synthesized
tgtgtgtcataggacctggc

SEQ ID NO: 57710 - DNA, 20 bp, Artificial Sequence
  chemically synthesized
gtgtgtcataggacctggct

SEQ ID NO: 57711 - DNA, 20 bp, Artificial Sequence
  chemically synthesized
tcataggacctggctgggtg

SEQ ID NO: 57712 - DNA, 20 bp, Artificial Sequence
  chemically synthesized
taggacctggctgggtgcag

SEQ ID NO: 57713 - DNA, 20 bp, Artificial Sequence
  chemically synthesized
aggacctggctgggtgcaga

SEQ ID NO: 57714 - DNA, 20 bp, Artificial Sequence
  chemically synthesized
ggacctggctgggtgcagaa

SEQ ID NO: 57715 - DNA, 20 bp, Artificial Sequence
  chemically synthesized
gctgggtgcagaagggattg

SEQ ID NO: 57716 - DNA, 20 bp, Artificial Sequence
  chemically synthesized
gggtgcagaagggattgcag

SEQ ID NO: 57717 - DNA, 20 bp, Artificial Sequence
  chemically synthesized
ggtgcagaagggattgcagt

SEQ ID NO: 57718 - DNA, 20 bp, Artificial Sequence
  chemically synthesized
gtgcagaagggattgcagtg

SEQ ID NO: 57719 - DNA, 20 bp, Artificial Sequence
  chemically synthesized
gcagaagggattgcagtggg

SEQ ID NO: 57720 - DNA, 20 bp, Artificial Sequence
  chemically synthesized
aagggattgcagtggggagc

SEQ ID NO: 57721 - DNA, 20 bp, Artificial Sequence
  chemically synthesized
agggattgcagtggggagct

SEQ ID NO: 57722 - DNA, 20 bp, Artificial Sequence
  chemically synthesized
gggattgcagtggggagctg

SEQ ID NO: 57723 - DNA, 20 bp, Artificial Sequence
  chemically synthesized
cagtggggagctggggcttt

SEQ ID NO: 57724 - DNA, 20 bp, Artificial Sequence
  chemically synthesized
gtggggagctggggcttttg

SEQ ID NO: 57725 - DNA, 20 bp, Artificial Sequence
  chemically synthesized
tggggagctggggcttttgg

SEQ ID NO: 57726 - DNA, 20 bp, Artificial Sequence
  chemically synthesized
gggagctggggcttttggag

SEQ ID NO: 57727 - DNA, 20 bp, Artificial Sequence
  chemically synthesized
ggagctggggcttttggagg

SEQ ID NO: 57728 - DNA, 20 bp, Artificial Sequence
  chemically synthesized
gggcttttggaggaggaatg

SEQ ID NO: 57729 - DNA, 20 bp, Artificial Sequence
  chemically synthesized
ttttggaggaggaatgaaga

SEQ ID NO: 57730 - DNA, 20 bp, Artificial Sequence
  chemically synthesized
gaggaggaatgaagaaagca

SEQ ID NO: 57731 - DNA, 20 bp, Artificial Sequence
  chemically synthesized
aggaggaatgaagaaagcat

SEQ ID NO: 57732 - DNA, 20 bp, Artificial Sequence
  chemically synthesized
aggaatgaagaaagcatggg

SEQ ID NO: 57733 - DNA, 20 bp, Artificial Sequence
  chemically synthesized
ggaatgaagaaagcatgggt

SEQ ID NO: 57734 - DNA, 20 bp, Artificial Sequence
  chemically synthesized
aatgaagaaagcatgggtgg

SEQ ID NO: 57735 - DNA, 20 bp, Artificial Sequence
  chemically synthesized
gaagaaagcatgggtgggag

SEQ ID NO: 57736 - DNA, 20 bp, Artificial Sequence
  chemically synthesized
aagaaagcatgggtgggagc

SEQ ID NO: 57737 - DNA, 20 bp, Artificial Sequence
  chemically synthesized
aagcatgggtgggagcaggt

SEQ ID NO: 57738 - DNA, 20 bp, Artificial Sequence
  chemically synthesized
agcatgggtgggagcaggtg

SEQ ID NO: 57739 - DNA, 20 bp, Artificial Sequence
  chemically synthesized
tgggtgggagcaggtgaggc

SEQ ID NO: 57740 - DNA, 20 bp, Artificial Sequence
  chemically synthesized
tgggagcaggtgaggcaagt

SEQ ID NO: 57741 - DNA, 20 bp, Artificial Sequence
  chemically synthesized
gggagcaggtgaggcaagta

SEQ ID NO: 57742 - DNA, 20 bp, Artificial Sequence
  chemically synthesized
ggagcaggtgaggcaagtaa

SEQ ID NO: 57743 - DNA, 20 bp, Artificial Sequence
  chemically synthesized
gagcaggtgaggcaagtaag

SEQ ID NO: 57744 - DNA, 20 bp, Artificial Sequence
  chemically synthesized
ggtgaggcaagtaaggggct

SEQ ID NO: 57745 - DNA, 20 bp, Artificial Sequence
  chemically synthesized
caagtaaggggctcagaatt

SEQ ID NO: 57746 - DNA, 20 bp, Artificial Sequence
  chemically synthesized
aagtaaggggctcagaattt

SEQ ID NO: 57747 - DNA, 20 bp, Artificial Sequence
  chemically synthesized
agtaaggggctcagaatttg

SEQ ID NO: 57748 - DNA, 20 bp, Artificial Sequence
  chemically synthesized
aatttggggtcctgctcttt

SEQ ID NO: 57749 - DNA, 20 bp, Artificial Sequence
  chemically synthesized
ttggggtcctgctcttttgg

SEQ ID NO: 57750 - DNA, 20 bp, Artificial Sequence
  chemically synthesized
tggggtcctgctcttttggc

SEQ ID NO: 57751 - DNA, 20 bp, Artificial Sequence
  chemically synthesized
ggggtcctgctcttttggca

SEQ ID NO: 57752 - DNA, 20 bp, Artificial Sequence
  chemically synthesized
ctgctcttttggcagggctc

SEQ ID NO: 57753 - DNA, 20 bp, Artificial Sequence
  chemically synthesized
tgctcttttggcagggctct

SEQ ID NO: 57754 - DNA, 20 bp, Artificial Sequence
  chemically synthesized
ttttggcagggctctaggct

SEQ ID NO: 57755 - DNA, 20 bp, Artificial Sequence
  chemically synthesized
gctcagcccccgccctgctc

SEQ ID NO: 57756 - DNA, 20 bp, Artificial Sequence
  chemically synthesized
cctgctctggacatccatcc

SEQ ID NO: 57757 - DNA, 20 bp, Artificial Sequence
  chemically synthesized
ctgctctggacatccatcct

SEQ ID NO: 57758 - DNA, 20 bp, Artificial Sequence
  chemically synthesized
gctctggacatccatcctgg

SEQ ID NO: 57759 - DNA, 20 bp, Artificial Sequence
  chemically synthesized
ctctggacatccatcctggg

SEQ ID NO: 57760 - DNA, 20 bp, Artificial Sequence
  chemically synthesized
tggacatccatcctgggagg

SEQ ID NO: 57761 - DNA, 20 bp, Artificial Sequence
  chemically synthesized
ggacatccatcctgggagga

SEQ ID NO: 57762 - DNA, 20 bp, Artificial Sequence
  chemically synthesized
gacatccatcctgggaggaa

SEQ ID NO: 57763 - DNA, 20 bp, Artificial Sequence
  chemically synthesized
tccatcctgggaggaagggc

SEQ ID NO: 57764 - DNA, 20 bp, Artificial Sequence
  chemically synthesized
ccatcctgggaggaagggct

SEQ ID NO: 57765 - DNA, 20 bp, Artificial Sequence
  chemically synthesized
gaggaagggctaggataatc

SEQ ID NO: 57766 - DNA, 20 bp, Artificial Sequence
  chemically synthesized
gataatctggaaaaacgcac

SEQ ID NO: 57767 - DNA, 20 bp, Artificial Sequence
  chemically synthesized
ataatctggaaaaacgcacc

SEQ ID NO: 57768 - DNA, 20 bp, Artificial Sequence
  chemically synthesized
aacgcaccaggacaaaatcc

SEQ ID NO: 57769 - DNA, 20 bp, Artificial Sequence
  chemically synthesized
acgcaccaggacaaaatccc

SEQ ID NO: 57770 - DNA, 20 bp, Artificial Sequence
  chemically synthesized
cgcaccaggacaaaatcccg

SEQ ID NO: 57771 - DNA, 20 bp, Artificial Sequence
  chemically synthesized
gcaccaggacaaaatcccgg

SEQ ID NO: 57772 - DNA, 20 bp, Artificial Sequence
  chemically synthesized
ggacaaaatcccgggggttg

SEQ ID NO: 57773 - DNA, 20 bp, Artificial Sequence
  chemically synthesized
caaaatcccgggggttgtgg

SEQ ID NO: 57774 - DNA, 20 bp, Artificial Sequence
  chemically synthesized
aaaatcccgggggttgtggt

SEQ ID NO: 57775 - DNA, 20 bp, Artificial Sequence
  chemically synthesized
aatcccgggggttgtggtgg

SEQ ID NO: 57776 - DNA, 20 bp, Artificial Sequence
  chemically synthesized
atcccgggggttgtggtggg

SEQ ID NO: 57777 - DNA, 20 bp, Artificial Sequence
  chemically synthesized
tcccgggggttgtggtggga

SEQ ID NO: 57778 - DNA, 20 bp, Artificial Sequence
  chemically synthesized
cccgggggttgtggtgggag

SEQ ID NO: 57779 - DNA, 20 bp, Artificial Sequence
  chemically synthesized
gggggttgtggtgggagggg

SEQ ID NO: 57780 - DNA, 20 bp, Artificial Sequence
  chemically synthesized
ggggttgtggtgggaggggt

SEQ ID NO: 57781 - DNA, 20 bp, Artificial Sequence
  chemically synthesized
ggttgtggtgggaggggtgg

SEQ ID NO: 57782 - DNA, 20 bp, Artificial Sequence
  chemically synthesized
gtgggaggggtgggagtact

SEQ ID NO: 57783 - DNA, 20 bp, Artificial Sequence
  chemically synthesized
ggaggggtgggagtactcag

SEQ ID NO: 57784 - DNA, 20 bp, Artificial Sequence
  chemically synthesized
agtactcagtggccattcac

SEQ ID NO: 57785 - DNA, 20 bp, Artificial Sequence
  chemically synthesized
gtactcagtggccattcaca

SEQ ID NO: 57786 - DNA, 20 bp, Artificial Sequence
  chemically synthesized
tcacaaggatactgtgcccc

SEQ ID NO: 57787 - DNA, 20 bp, Artificial Sequence
  chemically synthesized
cacaaggatactgtgccccc

SEQ ID NO: 57788 - DNA, 20 bp, Artificial Sequence
  chemically synthesized
tactgtgcccccaggaaccc

SEQ ID NO: 57789 - DNA, 20 bp, Artificial Sequence
  chemically synthesized
actgtgcccccaggaacccc

SEQ ID NO: 57790 - DNA, 20 bp, Artificial Sequence
  chemically synthesized
ccccaggaaccccaggacat

SEQ ID NO: 57791 - DNA, 20 bp, Artificial Sequence
  chemically synthesized
cccaggaaccccaggacatg

SEQ ID NO: 57792 - DNA, 20 bp, Artificial Sequence
  chemically synthesized
ccaggaaccccaggacatga

SEQ ID NO: 57793 - DNA, 20 bp, Artificial Sequence
  chemically synthesized
caggaaccccaggacatgag

SEQ ID NO: 57794 - DNA, 20 bp, Artificial Sequence
  chemically synthesized
aggaaccccaggacatgagg

SEQ ID NO: 57795 - DNA, 20 bp, Artificial Sequence
  chemically synthesized
accccaggacatgaggggga

SEQ ID NO: 57796 - DNA, 20 bp, Artificial Sequence
  chemically synthesized
gggggaaagtcttgtccacc

SEQ ID NO: 57797 - DNA, 20 bp, Artificial Sequence
  chemically synthesized
acttccacaattgtctattg

SEQ ID NO: 57798 - DNA, 20 bp, Artificial Sequence
  chemically synthesized
caattgtctattgcagcatc

SEQ ID NO: 57799 - DNA, 20 bp, Artificial Sequence
  chemically synthesized
aattgtctattgcagcatct

SEQ ID NO: 57800 - DNA, 20 bp, Artificial Sequence
  chemically synthesized
agcatctgggctgatccccc

SEQ ID NO: 57801 - DNA, 20 bp, Artificial Sequence
  chemically synthesized
catctgggctgatcccccca

SEQ ID NO: 57802 - DNA, 20 bp, Artificial Sequence
  chemically synthesized
atctgggctgatccccccag

SEQ ID NO: 57803 - DNA, 20 bp, Artificial Sequence
  chemically synthesized
cccccagaggaaatgcatca

SEQ ID NO: 57804 - DNA, 20 bp, Artificial Sequence
  chemically synthesized
ccccagaggaaatgcatcat

SEQ ID NO: 57805 - DNA, 20 bp, Artificial Sequence
  chemically synthesized
cagaggaaatgcatcatggg

SEQ ID NO: 57806 - DNA, 20 bp, Artificial Sequence
  chemically synthesized
gcatcatgggaagatcctgt

SEQ ID NO: 57807 - DNA, 20 bp, Artificial Sequence
  chemically synthesized
catgggaagatcctgtgagc

SEQ ID NO: 57808 - DNA, 20 bp, Artificial Sequence
  chemically synthesized
agatcctgtgagctggtcat

SEQ ID NO: 57809 - DNA, 20 bp, Artificial Sequence
  chemically synthesized
cctgtgagctggtcatgagt

SEQ ID NO: 57810 - DNA, 20 bp, Artificial Sequence
  chemically synthesized
ctgtgagctggtcatgagta

SEQ ID NO: 57811 - DNA, 20 bp, Artificial Sequence
  chemically synthesized
tgtgagctggtcatgagtaa

SEQ ID NO: 57812 - DNA, 20 bp, Artificial Sequence
  chemically synthesized
gtgagctggtcatgagtaag

SEQ ID NO: 57813 - DNA, 20 bp, Artificial Sequence
  chemically synthesized
ggtcatgagtaaggggcatc

SEQ ID NO: 57814 - DNA, 20 bp, Artificial Sequence
  chemically synthesized
gtcatgagtaaggggcatct

SEQ ID NO: 57815 - DNA, 20 bp, Artificial Sequence
  chemically synthesized
tcatgagtaaggggcatctg

SEQ ID NO: 57816 - DNA, 20 bp, Artificial Sequence
  chemically synthesized
catgagtaaggggcatctgg

SEQ ID NO: 57817 - DNA, 20 bp, Artificial Sequence
  chemically synthesized
tgagtaaggggcatctgggg

SEQ ID NO: 57818 - DNA, 20 bp, Artificial Sequence
  chemically synthesized
gagtaaggggcatctggggg

SEQ ID NO: 57819 - DNA, 20 bp, Artificial Sequence
  chemically synthesized
ggggaggccctgccccacca

SEQ ID NO: 57820 - DNA, 20 bp, Artificial Sequence
  chemically synthesized
gggaggccctgccccaccac

SEQ ID NO: 57821 - DNA, 20 bp, Artificial Sequence
  chemically synthesized
ggaggccctgccccaccaca

SEQ ID NO: 57822 - DNA, 20 bp, Artificial Sequence
  chemically synthesized
ccccaccacagggccctgcc

SEQ ID NO: 57823 - DNA, 20 bp, Artificial Sequence
  chemically synthesized
ccaccacagggccctgcctg

SEQ ID NO: 57824 - DNA, 20 bp, Artificial Sequence
  chemically synthesized
cacagggccctgcctggaga

SEQ ID NO: 57825 - DNA, 20 bp, Artificial Sequence
  chemically synthesized
acagggccctgcctggagat

SEQ ID NO: 57826 - DNA, 20 bp, Artificial Sequence
  chemically synthesized
agggccctgcctggagatgg

SEQ ID NO: 57827 - DNA, 20 bp, Artificial Sequence
  chemically synthesized
gcctggagatgggagcctcg

SEQ ID NO: 57828 - DNA, 20 bp, Artificial Sequence
  chemically synthesized
gagatgggagcctcgtggta

SEQ ID NO: 57829 - DNA, 20 bp, Artificial Sequence
  chemically synthesized
agatgggagcctcgtggtat

SEQ ID NO: 57830 - DNA, 20 bp, Artificial Sequence
  chemically synthesized
gggagcctcgtggtatgggc

SEQ ID NO: 57831 - DNA, 20 bp, Artificial Sequence
  chemically synthesized
gcctcgtggtatgggctgga

SEQ ID NO: 57832 - DNA, 20 bp, Artificial Sequence
  chemically synthesized
cctcgtggtatgggctggat

SEQ ID NO: 57833 - DNA, 20 bp, Artificial Sequence
  chemically synthesized
ctcgtggtatgggctggata

SEQ ID NO: 57834 - DNA, 20 bp, Artificial Sequence
  chemically synthesized
tatgggctggatagggatgt

SEQ ID NO: 57835 - DNA, 20 bp, Artificial Sequence
  chemically synthesized
tgggctggatagggatgtga

SEQ ID NO: 57836 - DNA, 20 bp, Artificial Sequence
  chemically synthesized
tggatagggatgtgagagtc

SEQ ID NO: 57837 - DNA, 20 bp, Artificial Sequence
  chemically synthesized
gggatgtgagagtcgagatt

SEQ ID NO: 57838 - DNA, 20 bp, Artificial Sequence
  chemically synthesized
ggatgtgagagtcgagattt

SEQ ID NO: 57839 - DNA, 20 bp, Artificial Sequence
  chemically synthesized
gatgtgagagtcgagatttg

SEQ ID NO: 57840 - DNA, 20 bp, Artificial Sequence
  chemically synthesized
gagtcgagatttggggtctg

SEQ ID NO: 57841 - DNA, 20 bp, Artificial Sequence
  chemically synthesized
cgagatttggggtctgcagc

SEQ ID NO: 57842 - DNA, 20 bp, Artificial Sequence
  chemically synthesized
gagatttggggtctgcagca

SEQ ID NO: 57843 - DNA, 20 bp, Artificial Sequence
  chemically synthesized
tggggtctgcagcaaggaat

SEQ ID NO: 57844 - DNA, 20 bp, Artificial Sequence
  chemically synthesized
ggggtctgcagcaaggaatc

SEQ ID NO: 57845 - DNA, 20 bp, Artificial Sequence
  chemically synthesized
tctgcagcaaggaatcgggt

SEQ ID NO: 57846 - DNA, 20 bp, Artificial Sequence
  chemically synthesized
ctgcagcaaggaatcgggta

SEQ ID NO: 57847 - DNA, 20 bp, Artificial Sequence
  chemically synthesized
tgcagcaaggaatcgggtaa

SEQ ID NO: 57848 - DNA, 20 bp, Artificial Sequence
  chemically synthesized
gcagcaaggaatcgggtaag

SEQ ID NO: 57849 - DNA, 20 bp, Artificial Sequence
  chemically synthesized
cagcaaggaatcgggtaagg

SEQ ID NO: 57850 - DNA, 20 bp, Artificial Sequence
  chemically synthesized
aaggaatcgggtaagggggt

SEQ ID NO: 57851 - DNA, 20 bp, Artificial Sequence
  chemically synthesized
aggaatcgggtaagggggtg

SEQ ID NO: 57852 - DNA, 20 bp, Artificial Sequence
  chemically synthesized
ggtaagggggtgaggtgtgc

SEQ ID NO: 57853 - DNA, 20 bp, Artificial Sequence
  chemically synthesized
aagggggtgaggtgtgccag

SEQ ID NO: 57854 - DNA, 20 bp, Artificial Sequence
  chemically synthesized
gtgaggtgtgccagtggccc

SEQ ID NO: 57855 - DNA, 20 bp, Artificial Sequence
  chemically synthesized
tgaggtgtgccagtggccct

SEQ ID NO: 57856 - DNA, 20 bp, Artificial Sequence
  chemically synthesized
tgtgccagtggccctgggcc

SEQ ID NO: 57857 - DNA, 20 bp, Artificial Sequence
  chemically synthesized
ggccctgggccaagtaaatc

SEQ ID NO: 57858 - DNA, 20 bp, Artificial Sequence
  chemically synthesized
gggccaagtaaatcaagact

SEQ ID NO: 57859 - DNA, 20 bp, Artificial Sequence
  chemically synthesized
ccaagtaaatcaagactgag

SEQ ID NO: 57860 - DNA, 20 bp, Artificial Sequence
  chemically synthesized
gtaaatcaagactgagtggc

SEQ ID NO: 57861 - DNA, 20 bp, Artificial Sequence
  chemically synthesized
atcaagactgagtggctggt

SEQ ID NO: 57862 - DNA, 20 bp, Artificial Sequence
  chemically synthesized
tcaagactgagtggctggtc

SEQ ID NO: 57863 - DNA, 20 bp, Artificial Sequence
  chemically synthesized
aagactgagtggctggtcag

SEQ ID NO: 57864 - DNA, 20 bp, Artificial Sequence
  chemically synthesized
gtggctggtcaggagaacaa

SEQ ID NO: 57865 - DNA, 20 bp, Artificial Sequence
  chemically synthesized
gctggtcaggagaacaacag

SEQ ID NO: 57866 - DNA, 20 bp, Artificial Sequence
  chemically synthesized
gagaacaacagtggacttca

SEQ ID NO: 57867 - DNA, 20 bp, Artificial Sequence
  chemically synthesized
agaacaacagtggacttcat

SEQ ID NO: 57868 - DNA, 20 bp, Artificial Sequence
  chemically synthesized
aacaacagtggacttcatgg

SEQ ID NO: 57869 - DNA, 20 bp, Artificial Sequence
  chemically synthesized
ttcatgggagctgaactcat

SEQ ID NO: 57870 - DNA, 20 bp, Artificial Sequence
  chemically synthesized
gggagctgaactcattggca

SEQ ID NO: 57871 - DNA, 20 bp, Artificial Sequence
  chemically synthesized
actcattggcaaagtgcccc

SEQ ID NO: 57872 - DNA, 20 bp, Artificial Sequence
  chemically synthesized
tcattggcaaagtgcccccg

SEQ ID NO: 57873 - DNA, 20 bp, Artificial Sequence
  chemically synthesized
attggcaaagtgcccccgga

SEQ ID NO: 57874 - DNA, 20 bp, Artificial Sequence
  chemically synthesized
aaagtgcccccggagagtgc

SEQ ID NO: 57875 - DNA, 20 bp, Artificial Sequence
  chemically synthesized
tcactatgcaccctccttcc

SEQ ID NO: 57876 - DNA, 20 bp, Artificial Sequence
  chemically synthesized
cactatgcaccctccttccc

SEQ ID NO: 57877 - DNA, 20 bp, Artificial Sequence
  chemically synthesized
gcaccctccttcccaggcac

SEQ ID NO: 57878 - DNA, 20 bp, Artificial Sequence
  chemically synthesized
aggcaccagcttccttcttt

SEQ ID NO: 57879 - DNA, 20 bp, Artificial Sequence
  chemically synthesized
gcaccagcttccttctttga

SEQ ID NO: 57880 - DNA, 20 bp, Artificial Sequence
  chemically synthesized
cagcttccttctttgagagt

SEQ ID NO: 57881 - DNA, 20 bp, Artificial Sequence
  chemically synthesized
tccttctttgagagtcagtg

SEQ ID NO: 57882 - DNA, 20 bp, Artificial Sequence
  chemically synthesized
ccttctttgagagtcagtgc

SEQ ID NO: 57883 - DNA, 20 bp, Artificial Sequence
  chemically synthesized
tgagagtcagtgcaggtcac

SEQ ID NO: 57884 - DNA, 20 bp, Artificial Sequence
  chemically synthesized
gtcagtgcaggtcactggtt

SEQ ID NO: 57885 - DNA, 20 bp, Artificial Sequence
  chemically synthesized
tcagtgcaggtcactggtta

SEQ ID NO: 57886 - DNA, 20 bp, Artificial Sequence
  chemically synthesized
gcaggtcactggttaaggcg

SEQ ID NO: 57887 - DNA, 20 bp, Artificial Sequence
  chemically synthesized
caggtcactggttaaggcgt

SEQ ID NO: 57888 - DNA, 20 bp, Artificial Sequence
  chemically synthesized
cactggttaaggcgtgggtt

SEQ ID NO: 57889 - DNA, 20 bp, Artificial Sequence
  chemically synthesized
actggttaaggcgtgggttc

SEQ ID NO: 57890 - DNA, 20 bp, Artificial Sequence
  chemically synthesized
tgggttcgggatctaatatc

SEQ ID NO: 57891 - DNA, 20 bp, Artificial Sequence
  chemically synthesized
gggttcgggatctaatatct

SEQ ID NO: 57892 - DNA, 20 bp, Artificial Sequence
  chemically synthesized
ggttcgggatctaatatctg

SEQ ID NO: 57893 - DNA, 20 bp, Artificial Sequence
  chemically synthesized
gggatctaatatctggggcc

SEQ ID NO: 57894 - DNA, 20 bp, Artificial Sequence
  chemically synthesized
taatatctggggccaagcct

SEQ ID NO: 57895 - DNA, 20 bp, Artificial Sequence
  chemically synthesized
agctccatcgctctttttgt

SEQ ID NO: 57896 - DNA, 20 bp, Artificial Sequence
  chemically synthesized
tcgctctttttgtgagctct

SEQ ID NO: 57897 - DNA, 20 bp, Artificial Sequence
  chemically synthesized
ctttttgtgagctcttagac

SEQ ID NO: 57898 - DNA, 20 bp, Artificial Sequence
  chemically synthesized
cacttaacctctctgtgcct

SEQ ID NO: 57899 - DNA, 20 bp, Artificial Sequence
  chemically synthesized
gcctcggtttcctcatctgt

SEQ ID NO: 57900 - DNA, 20 bp, Artificial Sequence
  chemically synthesized
cggtttcctcatctgtgaga

SEQ ID NO: 57901 - DNA, 20 bp, Artificial Sequence
  chemically synthesized
ggtttcctcatctgtgagat

SEQ ID NO: 57902 - DNA, 20 bp, Artificial Sequence
  chemically synthesized
ttcctcatctgtgagatagg

SEQ ID NO: 57903 - DNA, 20 bp, Artificial Sequence
  chemically synthesized
ctgtgagataggaagactct

SEQ ID NO: 57904 - DNA, 20 bp, Artificial Sequence
  chemically synthesized
tgagataggaagactctaag

SEQ ID NO: 57905 - DNA, 20 bp, Artificial Sequence
  chemically synthesized
agataggaagactctaagaa

SEQ ID NO: 57906 - DNA, 20 bp, Artificial Sequence
  chemically synthesized
ctaagaagagtcacttccat

SEQ ID NO: 57907 - DNA, 20 bp, Artificial Sequence
  chemically synthesized
taagaagagtcacttccatc

SEQ ID NO: 57908 - DNA, 20 bp, Artificial Sequence
  chemically synthesized
tcacttccatcaggactgtg

SEQ ID NO: 57909 - DNA, 20 bp, Artificial Sequence
  chemically synthesized
caggactgtgaagatcgaat

SEQ ID NO: 57910 - DNA, 20 bp, Artificial Sequence
  chemically synthesized
cgaatgagataataacattt

SEQ ID NO: 57911 - DNA, 20 bp, Artificial Sequence
  chemically synthesized
ataataacatttaagcactt

SEQ ID NO: 57912 - DNA, 20 bp, Artificial Sequence
  chemically synthesized
taataacatttaagcacttc

SEQ ID NO: 57913 - DNA, 20 bp, Artificial Sequence
  chemically synthesized
taacatttaagcacttcggg

SEQ ID NO: 57914 - DNA, 20 bp, Artificial Sequence
  chemically synthesized
taagcacttcgggcagcctc

SEQ ID NO: 57915 - DNA, 20 bp, Artificial Sequence
  chemically synthesized
gggcagcctctggcatgtga

SEQ ID NO: 57916 - DNA, 20 bp, Artificial Sequence
  chemically synthesized
ggcagcctctggcatgtgat

SEQ ID NO: 57917 - DNA, 20 bp, Artificial Sequence
  chemically synthesized
tctggcatgtgatgggcccc

SEQ ID NO: 57918 - DNA, 20 bp, Artificial Sequence
  chemically synthesized
caagtcaatgctaaccacca

SEQ ID NO: 57919 - DNA, 20 bp, Artificial Sequence
  chemically synthesized
aagtcaatgctaaccaccaa

SEQ ID NO: 57920 - DNA, 20 bp, Artificial Sequence
  chemically synthesized
ccaccaaaggccatgacctt

SEQ ID NO: 57921 - DNA, 20 bp, Artificial Sequence
  chemically synthesized
caccaaaggccatgaccttt

SEQ ID NO: 57922 - DNA, 20 bp, Artificial Sequence
  chemically synthesized
accaaaggccatgacctttg

SEQ ID NO: 57923 - DNA, 20 bp, Artificial Sequence
  chemically synthesized
tgacctttggggatgtgtcc

SEQ ID NO: 57924 - DNA, 20 bp, Artificial Sequence
  chemically synthesized
cctggctctgaaaaaccata

SEQ ID NO: 57925 - DNA, 20 bp, Artificial Sequence
  chemically synthesized
gctctgaaaaaccatataga

SEQ ID NO: 57926 - DNA, 20 bp, Artificial Sequence
  chemically synthesized
ctctgaaaaaccatatagat

SEQ ID NO: 57927 - DNA, 20 bp, Artificial Sequence
  chemically synthesized
aaaaccatatagatgggtct

SEQ ID NO: 57928 - DNA, 20 bp, Artificial Sequence
  chemically synthesized
aaaccatatagatgggtctc

SEQ ID NO: 57929 - DNA, 20 bp, Artificial Sequence
  chemically synthesized
aaccatatagatgggtctca

SEQ ID NO: 57930 - DNA, 20 bp, Artificial Sequence
  chemically synthesized
accatatagatgggtctcag

SEQ ID NO: 57931 - DNA, 20 bp, Artificial Sequence
  chemically synthesized
tagatgggtctcaggggtct

SEQ ID NO: 57932 - DNA, 20 bp, Artificial Sequence
  chemically synthesized
atgggtctcaggggtctaag

SEQ ID NO: 57933 - DNA, 20 bp, Artificial Sequence
  chemically synthesized
tgggtctcaggggtctaagt

SEQ ID NO: 57934 - DNA, 20 bp, Artificial Sequence
  chemically synthesized
gggtctcaggggtctaagtg

SEQ ID NO: 57935 - DNA, 20 bp, Artificial Sequence
  chemically synthesized
ggtctcaggggtctaagtgg

SEQ ID NO: 57936 - DNA, 20 bp, Artificial Sequence
  chemically synthesized
gggggaacaactgctgcgtt

SEQ ID NO: 57937 - DNA, 20 bp, Artificial Sequence
  chemically synthesized
acaactgctgcgtttggccc

SEQ ID NO: 57938 - DNA, 20 bp, Artificial Sequence
  chemically synthesized
gctgcgtttggccccagatt

SEQ ID NO: 57939 - DNA, 20 bp, Artificial Sequence
  chemically synthesized
ctgcgtttggccccagattt

SEQ ID NO: 57940 - DNA, 20 bp, Artificial Sequence
  chemically synthesized
tgcgtttggccccagatttg

SEQ ID NO: 57941 - DNA, 20 bp, Artificial Sequence
  chemically synthesized
cgtttggccccagatttggg

SEQ ID NO: 57942 - DNA, 20 bp, Artificial Sequence
  chemically synthesized
ttggccccagatttggggag

SEQ ID NO: 57943 - DNA, 20 bp, Artificial Sequence
  chemically synthesized
ggggagcagcacctgttgtt

SEQ ID NO: 57944 - DNA, 20 bp, Artificial Sequence
  chemically synthesized
gggagcagcacctgttgttg

SEQ ID NO: 57945 - DNA, 20 bp, Artificial Sequence
  chemically synthesized
ggagcagcacctgttgttga

SEQ ID NO: 57946 - DNA, 20 bp, Artificial Sequence
  chemically synthesized
gttgttgagggacacctcct

SEQ ID NO: 57947 - DNA, 20 bp, Artificial Sequence
  chemically synthesized
attcaaacttccattttttc

SEQ ID NO: 57948 - DNA, 20 bp, Artificial Sequence
  chemically synthesized
aacttccattttttccagaa

SEQ ID NO: 57949 - DNA, 20 bp, Artificial Sequence
  chemically synthesized
acttccattttttccagaaa

SEQ ID NO: 57950 - DNA, 20 bp, Artificial Sequence
  chemically synthesized
aaggctgtcaatcccctctt

SEQ ID NO: 57951 - DNA, 20 bp, Artificial Sequence
  chemically synthesized
aggctgtcaatcccctcttt

SEQ ID NO: 57952 - DNA, 20 bp, Artificial Sequence
  chemically synthesized
ggctgtcaatcccctcttta

SEQ ID NO: 57953 - DNA, 20 bp, Artificial Sequence
  chemically synthesized
gctgtcaatcccctctttag

SEQ ID NO: 57954 - DNA, 20 bp, Artificial Sequence
  chemically synthesized
tttaggggccgtgctcattt

SEQ ID NO: 57955 - DNA, 20 bp, Artificial Sequence
  chemically synthesized
gtgctcattttggctttccg

SEQ ID NO: 57956 - DNA, 20 bp, Artificial Sequence
  chemically synthesized
tgctcattttggctttccga

SEQ ID NO: 57957 - DNA, 20 bp, Artificial Sequence
  chemically synthesized
attttggctttccgaaggtg

SEQ ID NO: 57958 - DNA, 20 bp, Artificial Sequence
  chemically synthesized
ttttggctttccgaaggtga

SEQ ID NO: 57959 - DNA, 20 bp, Artificial Sequence
  chemically synthesized
tttggctttccgaaggtgaa

SEQ ID NO: 57960 - DNA, 20 bp, Artificial Sequence
  chemically synthesized
gctttccgaaggtgaagggc

SEQ ID NO: 57961 - DNA, 20 bp, Artificial Sequence
  chemically synthesized
ctttccgaaggtgaagggcc

SEQ ID NO: 57962 - DNA, 20 bp, Artificial Sequence
  chemically synthesized
ggtgaagggccaggtgcctt

SEQ ID NO: 57963 - DNA, 20 bp, Artificial Sequence
  chemically synthesized
ggtgccttcagcatctttct

SEQ ID NO: 57964 - DNA, 20 bp, Artificial Sequence
  chemically synthesized
ttctgagcacctgtgacatg

SEQ ID NO: 57965 - DNA, 20 bp, Artificial Sequence
  chemically synthesized
ctgagcacctgtgacatgca

SEQ ID NO: 57966 - DNA, 20 bp, Artificial Sequence
  chemically synthesized
tgagcacctgtgacatgcag

SEQ ID NO: 57967 - DNA, 20 bp, Artificial Sequence
  chemically synthesized
cctgtgacatgcagaggatg

SEQ ID NO: 57968 - DNA, 20 bp, Artificial Sequence
  chemically synthesized
ctgtgacatgcagaggatgt

SEQ ID NO: 57969 - DNA, 20 bp, Artificial Sequence
  chemically synthesized
tgtgacatgcagaggatgtg

SEQ ID NO: 57970 - DNA, 20 bp, Artificial Sequence
  chemically synthesized
cagaggatgtggggtgactg

SEQ ID NO: 57971 - DNA, 20 bp, Artificial Sequence
  chemically synthesized
ggatgtggggtgactgcagc

SEQ ID NO: 57972 - DNA, 20 bp, Artificial Sequence
  chemically synthesized
gatgtggggtgactgcagct

SEQ ID NO: 57973 - DNA, 20 bp, Artificial Sequence
  chemically synthesized
gtggggtgactgcagctagg

SEQ ID NO: 57974 - DNA, 20 bp, Artificial Sequence
  chemically synthesized
tgactgcagctaggtggact

SEQ ID NO: 57975 - DNA, 20 bp, Artificial Sequence
  chemically synthesized
cagctaggtggacttggatc

SEQ ID NO: 57976 - DNA, 20 bp, Artificial Sequence
  chemically synthesized
agctaggtggacttggatcc

SEQ ID NO: 57977 - DNA, 20 bp, Artificial Sequence
  chemically synthesized
gctaggtggacttggatccg

SEQ ID NO: 57978 - DNA, 20 bp, Artificial Sequence
  chemically synthesized
ctaggtggacttggatccgg

SEQ ID NO: 57979 - DNA, 20 bp, Artificial Sequence
  chemically synthesized
aggtggacttggatccgggg

SEQ ID NO: 57980 - DNA, 20 bp, Artificial Sequence
  chemically synthesized
ggtggacttggatccggggg

SEQ ID NO: 57981 - DNA, 20 bp, Artificial Sequence
  chemically synthesized
ttggatccgggggaggccct

SEQ ID NO: 57982 - DNA, 20 bp, Artificial Sequence
  chemically synthesized
ggggaggccctcagttctct

SEQ ID NO: 57983 - DNA, 20 bp, Artificial Sequence
  chemically synthesized
gccctcagttctctgagcct

SEQ ID NO: 57984 - DNA, 20 bp, Artificial Sequence
  chemically synthesized
tggtttcctcatctataaaa

SEQ ID NO: 57985 - DNA, 20 bp, Artificial Sequence
  chemically synthesized
ggtttcctcatctataaaat

SEQ ID NO: 57986 - DNA, 20 bp, Artificial Sequence
  chemically synthesized
gtttcctcatctataaaata

SEQ ID NO: 57987 - DNA, 20 bp, Artificial Sequence
  chemically synthesized
catctataaaatagggataa

SEQ ID NO: 57988 - DNA, 20 bp, Artificial Sequence
  chemically synthesized
ataaaagtttctttcccaca

SEQ ID NO: 57989 - DNA, 20 bp, Artificial Sequence
  chemically synthesized
ctttcccacatagctcttct

SEQ ID NO: 57990 - DNA, 20 bp, Artificial Sequence
  chemically synthesized
tttcccacatagctcttctg

SEQ ID NO: 57991 - DNA, 20 bp, Artificial Sequence
  chemically synthesized
cacatagctcttctgaggct

SEQ ID NO: 57992 - DNA, 20 bp, Artificial Sequence
  chemically synthesized
agctcttctgaggcttagat

SEQ ID NO: 57993 - DNA, 20 bp, Artificial Sequence
  chemically synthesized
gctcttctgaggcttagatg

SEQ ID NO: 57994 - DNA, 20 bp, Artificial Sequence
  chemically synthesized
aggcttagatgaggcgatgc

SEQ ID NO: 57995 - DNA, 20 bp, Artificial Sequence
  chemically synthesized
cttagatgaggcgatgctgg

SEQ ID NO: 57996 - DNA, 20 bp, Artificial Sequence
  chemically synthesized
ttagatgaggcgatgctggt

SEQ ID NO: 57997 - DNA, 20 bp, Artificial Sequence
  chemically synthesized
tagatgaggcgatgctggtg

SEQ ID NO: 57998 - DNA, 20 bp, Artificial Sequence
  chemically synthesized
tgctggtggggtgtttaaca

SEQ ID NO: 57999 - DNA, 20 bp, Artificial Sequence
  chemically synthesized
ctggtggggtgtttaacaca

SEQ ID NO: 58000 - DNA, 20 bp, Artificial Sequence
  chemically synthesized
tgtttaacacagagctctgt

SEQ ID NO: 58001 - DNA, 20 bp, Artificial Sequence
  chemically synthesized
acagagctctgttagcataa

SEQ ID NO: 58002 - DNA, 20 bp, Artificial Sequence
  chemically synthesized
actcatttaatgaatgaatg

SEQ ID NO: 58003 - DNA, 20 bp, Artificial Sequence
  chemically synthesized
caccattttttcacctcctc

SEQ ID NO: 58004 - DNA, 20 bp, Artificial Sequence
  chemically synthesized
cctccagtcacctttcaaat

SEQ ID NO: 58005 - DNA, 20 bp, Artificial Sequence
  chemically synthesized
ttagccaacttgcaaaaccc

SEQ ID NO: 58006 - DNA, 20 bp, Artificial Sequence
  chemically synthesized
gccaacttgcaaaaccccag

SEQ ID NO: 58007 - DNA, 20 bp, Artificial Sequence
  chemically synthesized
ccttctgtgtgtaatctcct

SEQ ID NO: 58008 - DNA, 20 bp, Artificial Sequence
  chemically synthesized
ctgagccacttcctgtgtgt

SEQ ID NO: 58009 - DNA, 20 bp, Artificial Sequence
  chemically synthesized
tgagccacttcctgtgtgtt

SEQ ID NO: 58010 - DNA, 20 bp, Artificial Sequence
  chemically synthesized
gagccacttcctgtgtgttg

SEQ ID NO: 58011 - DNA, 20 bp, Artificial Sequence
  chemically synthesized
gccacttcctgtgtgttggg

SEQ ID NO: 58012 - DNA, 20 bp, Artificial Sequence
  chemically synthesized
ccacttcctgtgtgttgggg

SEQ ID NO: 58013 - DNA, 20 bp, Artificial Sequence
  chemically synthesized
cacttcctgtgtgttgggga

SEQ ID NO: 58014 - DNA, 20 bp, Artificial Sequence
  chemically synthesized
acttcctgtgtgttggggag

SEQ ID NO: 58015 - DNA, 20 bp, Artificial Sequence
  chemically synthesized
ttcctgtgtgttggggaggg

SEQ ID NO: 58016 - DNA, 20 bp, Artificial Sequence
  chemically synthesized
tcctgtgtgttggggagggg

SEQ ID NO: 58017 - DNA, 20 bp, Artificial Sequence
  chemically synthesized
cctgtgtgttggggagggga

SEQ ID NO: 58018 - DNA, 20 bp, Artificial Sequence
  chemically synthesized
ctgtgtgttggggaggggag

SEQ ID NO: 58019 - DNA, 20 bp, Artificial Sequence
  chemically synthesized
tgtgtgttggggaggggagg

SEQ ID NO: 58020 - DNA, 20 bp, Artificial Sequence
  chemically synthesized
gtgtgttggggaggggaggg

SEQ ID NO: 58021 - DNA, 20 bp, Artificial Sequence
  chemically synthesized
ggggggatttctgcattttc

SEQ ID NO: 58022 - DNA, 20 bp, Artificial Sequence
  chemically synthesized
ctgcattttctggaactatg

SEQ ID NO: 58023 - DNA, 20 bp, Artificial Sequence
  chemically synthesized
ggaactatgtggcctactca

SEQ ID NO: 58024 - DNA, 20 bp, Artificial Sequence
  chemically synthesized
ttcttttttttttttttttt

SEQ ID NO: 58025 - DNA, 20 bp, Artificial Sequence
  chemically synthesized
ttttttttttttttttgaga

SEQ ID NO: 58026 - DNA, 20 bp, Artificial Sequence
  chemically synthesized
ttttttttttttttgagaca

SEQ ID NO: 58027 - DNA, 20 bp, Artificial Sequence
  chemically synthesized
ttttgagacagagtctcact

SEQ ID NO: 58028 - DNA, 20 bp, Artificial Sequence
  chemically synthesized
cagagtctcactcagtcacc

SEQ ID NO: 58029 - DNA, 20 bp, Artificial Sequence
  chemically synthesized
agagtctcactcagtcaccc

SEQ ID NO: 58030 - DNA, 20 bp, Artificial Sequence
  chemically synthesized
tctcactcagtcacccaggc

SEQ ID NO: 58031 - DNA, 20 bp, Artificial Sequence
  chemically synthesized
tcactcagtcacccaggctg

SEQ ID NO: 58032 - DNA, 20 bp, Artificial Sequence
  chemically synthesized
cagtcacccaggctggagta

SEQ ID NO: 58033 - DNA, 20 bp, Artificial Sequence
  chemically synthesized
tcacccaggctggagtacag

SEQ ID NO: 58034 - DNA, 20 bp, Artificial Sequence
  chemically synthesized
ggagtacagtggcgcaatct

SEQ ID NO: 58035 - DNA, 20 bp, Artificial Sequence
  chemically synthesized
aaactccacctctcgaattc

SEQ ID NO: 58036 - DNA, 20 bp, Artificial Sequence
  chemically synthesized
ctctcgaattctggaattac

SEQ ID NO: 58037 - DNA, 20 bp, Artificial Sequence
  chemically synthesized
tacgagcgattctcgtgcct

SEQ ID NO: 58038 - DNA, 20 bp, Artificial Sequence
  chemically synthesized
gattctcgtgcctcagcctc

SEQ ID NO: 58039 - DNA, 20 bp, Artificial Sequence
  chemically synthesized
ttctcgtgcctcagcctcca

SEQ ID NO: 58040 - DNA, 20 bp, Artificial Sequence
  chemically synthesized
tcgtgcctcagcctccagag

SEQ ID NO: 58041 - DNA, 20 bp, Artificial Sequence
  chemically synthesized
gcctcagcctccagagtagc

SEQ ID NO: 58042 - DNA, 20 bp, Artificial Sequence
  chemically synthesized
ctccagagtagctggcatta

SEQ ID NO: 58043 - DNA, 20 bp, Artificial Sequence
  chemically synthesized
tccagagtagctggcattac

SEQ ID NO: 58044 - DNA, 20 bp, Artificial Sequence
  chemically synthesized
caggcatgtgctaccaattc

SEQ ID NO: 58045 - DNA, 20 bp, Artificial Sequence
  chemically synthesized
ccagttaatttttgtatttt

SEQ ID NO: 58046 - DNA, 20 bp, Artificial Sequence
  chemically synthesized
gttaatttttgtatttttag

SEQ ID NO: 58047 - DNA, 20 bp, Artificial Sequence
  chemically synthesized
ttttgtatttttagtagtga

SEQ ID NO: 58048 - DNA, 20 bp, Artificial Sequence
  chemically synthesized
tttgtatttttagtagtgac

SEQ ID NO: 58049 - DNA, 20 bp, Artificial Sequence
  chemically synthesized
ttgtatttttagtagtgaca

SEQ ID NO: 58050 - DNA, 20 bp, Artificial Sequence
  chemically synthesized
gtgacagggtttcaccatgt

SEQ ID NO: 58051 - DNA, 20 bp, Artificial Sequence
  chemically synthesized
cagggtttcaccatgttggc

SEQ ID NO: 58052 - DNA, 20 bp, Artificial Sequence
  chemically synthesized
agggtttcaccatgttggcc

SEQ ID NO: 58053 - DNA, 20 bp, Artificial Sequence
  chemically synthesized
tttcaccatgttggccaggc

SEQ ID NO: 58054 - DNA, 20 bp, Artificial Sequence
  chemically synthesized
ccaggctggtctcaaactcc

SEQ ID NO: 58055 - DNA, 20 bp, Artificial Sequence
  chemically synthesized
ggtctcaaactcctggcctc

SEQ ID NO: 58056 - DNA, 20 bp, Artificial Sequence
  chemically synthesized
ctcaagttatctgcccgcct

SEQ ID NO: 58057 - DNA, 20 bp, Artificial Sequence
  chemically synthesized
ctgcccgcctcggcctccca

SEQ ID NO: 58058 - DNA, 20 bp, Artificial Sequence
  chemically synthesized
gcctcggcctcccaaagtgc

SEQ ID NO: 58059 - DNA, 20 bp, Artificial Sequence
  chemically synthesized
ctcccaaagtgctggaatta

SEQ ID NO: 58060 - DNA, 20 bp, Artificial Sequence
  chemically synthesized
tcccaaagtgctggaattac

SEQ ID NO: 58061 - DNA, 20 bp, Artificial Sequence
  chemically synthesized
agtgctggaattacaggtgt

SEQ ID NO: 58062 - DNA, 20 bp, Artificial Sequence
  chemically synthesized
caggtgtgagccactgtgcc

SEQ ID NO: 58063 - DNA, 20 bp, Artificial Sequence
  chemically synthesized
ctttactctttatccttact

SEQ ID NO: 58064 - DNA, 20 bp, Artificial Sequence
  chemically synthesized
actctttatccttactcaga

SEQ ID NO: 58065 - DNA, 20 bp, Artificial Sequence
  chemically synthesized
tctttatccttactcagaca

SEQ ID NO: 58066 - DNA, 20 bp, Artificial Sequence
  chemically synthesized
ttactcagacagagaaaaat

SEQ ID NO: 58067 - DNA, 20 bp, Artificial Sequence
  chemically synthesized
tactcagacagagaaaaata

SEQ ID NO: 58068 - DNA, 20 bp, Artificial Sequence
  chemically synthesized
agacagagaaaaataaggca

SEQ ID NO: 58069 - DNA, 20 bp, Artificial Sequence
  chemically synthesized
aaggcaaagctatacattat

SEQ ID NO: 58070 - DNA, 20 bp, Artificial Sequence
  chemically synthesized
aggcaaagctatacattata

SEQ ID NO: 58071 - DNA, 20 bp, Artificial Sequence
  chemically synthesized
ggcaaagctatacattataa

SEQ ID NO: 58072 - DNA, 20 bp, Artificial Sequence
  chemically synthesized
gcaaagctatacattataag

SEQ ID NO: 58073 - DNA, 20 bp, Artificial Sequence
  chemically synthesized
atacattataaggggcaaca

SEQ ID NO: 58074 - DNA, 20 bp, Artificial Sequence
  chemically synthesized
ataaggggcaacatagttaa

SEQ ID NO: 58075 - DNA, 20 bp, Artificial Sequence
  chemically synthesized
aggggcaacatagttaaaag

SEQ ID NO: 58076 - DNA, 20 bp, Artificial Sequence
  chemically synthesized
ggggcaacatagttaaaaga

SEQ ID NO: 58077 - DNA, 20 bp, Artificial Sequence
  chemically synthesized
aaggaataaaaatgcatcta

SEQ ID NO: 58078 - DNA, 20 bp, Artificial Sequence
  chemically synthesized
ctaaaactcatgttttattg

SEQ ID NO: 58079 - DNA, 20 bp, Artificial Sequence
  chemically synthesized
tattttaactttactctttt

SEQ ID NO: 58080 - DNA, 20 bp, Artificial Sequence
  chemically synthesized
attttaactttactcttttg

SEQ ID NO: 58081 - DNA, 20 bp, Artificial Sequence
  chemically synthesized
actttactcttttgaggtta

SEQ ID NO: 58082 - DNA, 20 bp, Artificial Sequence
  chemically synthesized
ctttactcttttgaggttat

SEQ ID NO: 58083 - DNA, 20 bp, Artificial Sequence
  chemically synthesized
tttgaggttatgggccttga

SEQ ID NO: 58084 - DNA, 20 bp, Artificial Sequence
  chemically synthesized
atgggccttgatggtcatta

SEQ ID NO: 58085 - DNA, 20 bp, Artificial Sequence
  chemically synthesized
ccttgatggtcattacggat

SEQ ID NO: 58086 - DNA, 20 bp, Artificial Sequence
  chemically synthesized
tgatggtcattacggattgg

SEQ ID NO: 58087 - DNA, 20 bp, Artificial Sequence
  chemically synthesized
attacggattggaagctttt

SEQ ID NO: 58088 - DNA, 20 bp, Artificial Sequence
  chemically synthesized
tacggattggaagcttttaa

SEQ ID NO: 58089 - DNA, 20 bp, Artificial Sequence
  chemically synthesized
ctataattatgatttgattt

SEQ ID NO: 58090 - DNA, 20 bp, Artificial Sequence
  chemically synthesized
aattatgatttgattttaga

SEQ ID NO: 58091 - DNA, 20 bp, Artificial Sequence
  chemically synthesized
atggtcaacttgtcgcattt

SEQ ID NO: 58092 - DNA, 20 bp, Artificial Sequence
  chemically synthesized
acttgtcgcattttggtcaa

SEQ ID NO: 58093 - DNA, 20 bp, Artificial Sequence
  chemically synthesized
cttgtcgcattttggtcaat

SEQ ID NO: 58094 - DNA, 20 bp, Artificial Sequence
  chemically synthesized
tggtcaataggaaccctttt

SEQ ID NO: 58095 - DNA, 20 bp, Artificial Sequence
  chemically synthesized
gacaatctctgctgatgttt

SEQ ID NO: 58096 - DNA, 20 bp, Artificial Sequence
  chemically synthesized
agcaacacacacttgctttc

SEQ ID NO: 58097 - DNA, 20 bp, Artificial Sequence
  chemically synthesized
acacacacttgctttctggc

SEQ ID NO: 58098 - DNA, 20 bp, Artificial Sequence
  chemically synthesized
cacacacttgctttctggca

SEQ ID NO: 58099 - DNA, 20 bp, Artificial Sequence
  chemically synthesized
aggccaccatgttcatgttc

SEQ ID NO: 58100 - DNA, 20 bp, Artificial Sequence
  chemically synthesized
ggccaccatgttcatgttcc

SEQ ID NO: 58101 - DNA, 20 bp, Artificial Sequence
  chemically synthesized
tcttcattttctcttgcccc

SEQ ID NO: 58102 - DNA, 20 bp, Artificial Sequence
  chemically synthesized
ttttctcttgccccaagaca

SEQ ID NO: 58103 - DNA, 20 bp, Artificial Sequence
  chemically synthesized
cttgccccaagacatggcac

SEQ ID NO: 58104 - DNA, 20 bp, Artificial Sequence
  chemically synthesized
ttgccccaagacatggcact

SEQ ID NO: 58105 - DNA, 20 bp, Artificial Sequence
  chemically synthesized
tgccccaagacatggcactg

SEQ ID NO: 58106 - DNA, 20 bp, Artificial Sequence
  chemically synthesized
tggcactggggtatcttccc

SEQ ID NO: 58107 - DNA, 20 bp, Artificial Sequence
  chemically synthesized
ggcactggggtatcttccct

SEQ ID NO: 58108 - DNA, 20 bp, Artificial Sequence
  chemically synthesized
cactggggtatcttccctgg

SEQ ID NO: 58109 - DNA, 20 bp, Artificial Sequence
  chemically synthesized
ctggggtatcttccctggga

SEQ ID NO: 58110 - DNA, 20 bp, Artificial Sequence
  chemically synthesized
ggtatcttccctgggagaga

SEQ ID NO: 58111 - DNA, 20 bp, Artificial Sequence
  chemically synthesized
tcttccctgggagagaaagc

SEQ ID NO: 58112 - DNA, 20 bp, Artificial Sequence
  chemically synthesized
tgggagagaaagcaagcacg

SEQ ID NO: 58113 - DNA, 20 bp, Artificial Sequence
  chemically synthesized
agaaagcaagcacgcagtga

SEQ ID NO: 58114 - DNA, 20 bp, Artificial Sequence
  chemically synthesized
aaagcaagcacgcagtgaca

SEQ ID NO: 58115 - DNA, 20 bp, Artificial Sequence
  chemically synthesized
aagcaagcacgcagtgacag

SEQ ID NO: 58116 - DNA, 20 bp, Artificial Sequence
  chemically synthesized
acgcagtgacagaggccttc

SEQ ID NO: 58117 - DNA, 20 bp, Artificial Sequence
  chemically synthesized
cgcagtgacagaggccttct

SEQ ID NO: 58118 - DNA, 20 bp, Artificial Sequence
  chemically synthesized
cagaggccttctgggaacca

SEQ ID NO: 58119 - DNA, 20 bp, Artificial Sequence
  chemically synthesized
agaggccttctgggaaccac

SEQ ID NO: 58120 - DNA, 20 bp, Artificial Sequence
  chemically synthesized
ggccttctgggaaccacagg

SEQ ID NO: 58121 - DNA, 20 bp, Artificial Sequence
  chemically synthesized
gccttctgggaaccacaggc

SEQ ID NO: 58122 - DNA, 20 bp, Artificial Sequence
  chemically synthesized
ccttctgggaaccacaggca

SEQ ID NO: 58123 - DNA, 20 bp, Artificial Sequence
  chemically synthesized
tgggaaccacaggcagggct

SEQ ID NO: 58124 - DNA, 20 bp, Artificial Sequence
  chemically synthesized
acaggcagggctgagcgtgc

SEQ ID NO: 58125 - DNA, 20 bp, Artificial Sequence
  chemically synthesized
gtgcaagactcacccttgcg

SEQ ID NO: 58126 - DNA, 20 bp, Artificial Sequence
  chemically synthesized
tgcaagactcacccttgcgt

SEQ ID NO: 58127 - DNA, 20 bp, Artificial Sequence
  chemically synthesized
gcaagactcacccttgcgtg

SEQ ID NO: 58128 - DNA, 20 bp, Artificial Sequence
  chemically synthesized
tcacccttgcgtggggacta

SEQ ID NO: 58129 - DNA, 20 bp, Artificial Sequence
  chemically synthesized
cacccttgcgtggggactat

SEQ ID NO: 58130 - DNA, 20 bp, Artificial Sequence
  chemically synthesized
cccttgcgtggggactatgg

SEQ ID NO: 58131 - DNA, 20 bp, Artificial Sequence
  chemically synthesized
cgtggggactatgggagacc

SEQ ID NO: 58132 - DNA, 20 bp, Artificial Sequence
  chemically synthesized
ggggactatgggagacccag

SEQ ID NO: 58133 - DNA, 20 bp, Artificial Sequence
  chemically synthesized
gggactatgggagacccagc

SEQ ID NO: 58134 - DNA, 20 bp, Artificial Sequence
  chemically synthesized
tgggagacccagcaggactt

SEQ ID NO: 58135 - DNA, 20 bp, Artificial Sequence
  chemically synthesized
gggagacccagcaggacttg

SEQ ID NO: 58136 - DNA, 20 bp, Artificial Sequence
  chemically synthesized
ggagacccagcaggacttga

SEQ ID NO: 58137 - DNA, 20 bp, Artificial Sequence
  chemically synthesized
ggacttgagggcttattatt

SEQ ID NO: 58138 - DNA, 20 bp, Artificial Sequence
  chemically synthesized
tcagaaatacatgccctgcg

SEQ ID NO: 58139 - DNA, 20 bp, Artificial Sequence
  chemically synthesized
cagaaatacatgccctgcgt

SEQ ID NO: 58140 - DNA, 20 bp, Artificial Sequence
  chemically synthesized
aaatacatgccctgcgtggg

SEQ ID NO: 58141 - DNA, 20 bp, Artificial Sequence
  chemically synthesized
catgccctgcgtgggtggct

SEQ ID NO: 58142 - DNA, 20 bp, Artificial Sequence
  chemically synthesized
tgcgtgggtggcttagataa

SEQ ID NO: 58143 - DNA, 20 bp, Artificial Sequence
  chemically synthesized
cgtgggtggcttagataaca

SEQ ID NO: 58144 - DNA, 20 bp, Artificial Sequence
  chemically synthesized
tgggtggcttagataacaga

SEQ ID NO: 58145 - DNA, 20 bp, Artificial Sequence
  chemically synthesized
gcttagataacagagagcaa

SEQ ID NO: 58146 - DNA, 20 bp, Artificial Sequence
  chemically synthesized
cttagataacagagagcaat

SEQ ID NO: 58147 - DNA, 20 bp, Artificial Sequence
  chemically synthesized
ttagataacagagagcaata

SEQ ID NO: 58148 - DNA, 20 bp, Artificial Sequence
  chemically synthesized
cctattgctctctgttatct

SEQ ID NO: 58149 - DNA, 20 bp, Artificial Sequence
  chemically synthesized
tgttatctaagccacccacg

SEQ ID NO: 58150 - DNA, 20 bp, Artificial Sequence
  chemically synthesized
gttatctaagccacccacgc

SEQ ID NO: 58151 - DNA, 20 bp, Artificial Sequence
  chemically synthesized
ttatctaagccacccacgca

SEQ ID NO: 58152 - DNA, 20 bp, Artificial Sequence
  chemically synthesized
ggcatgtatttctgaataat

SEQ ID NO: 58153 - DNA, 20 bp, Artificial Sequence
  chemically synthesized
tttctgaataataagccctc

SEQ ID NO: 58154 - DNA, 20 bp, Artificial Sequence
  chemically synthesized
aataagccctcaagtcctgc

SEQ ID NO: 58155 - DNA, 20 bp, Artificial Sequence
  chemically synthesized
ataagccctcaagtcctgct

SEQ ID NO: 58156 - DNA, 20 bp, Artificial Sequence
  chemically synthesized
aagtcctgctgggtctccca

SEQ ID NO: 58157 - DNA, 20 bp, Artificial Sequence
  chemically synthesized
gtctcccatagtccccacgc

SEQ ID NO: 58158 - DNA, 20 bp, Artificial Sequence
  chemically synthesized
tctcccatagtccccacgca

SEQ ID NO: 58159 - DNA, 20 bp, Artificial Sequence
  chemically synthesized
ctcccatagtccccacgcaa

SEQ ID NO: 58160 - DNA, 20 bp, Artificial Sequence
  chemically synthesized
catagtccccacgcaagggt

SEQ ID NO: 58161 - DNA, 20 bp, Artificial Sequence
  chemically synthesized
aagggtgagtcttgcacgct

SEQ ID NO: 58162 - DNA, 20 bp, Artificial Sequence
  chemically synthesized
tgcacgctcagccctgcctg

SEQ ID NO: 58163 - DNA, 20 bp, Artificial Sequence
  chemically synthesized
tcagccctgcctgtggttcc

SEQ ID NO: 58164 - DNA, 20 bp, Artificial Sequence
  chemically synthesized
gccctgcctgtggttcccag

SEQ ID NO: 58165 - DNA, 20 bp, Artificial Sequence
  chemically synthesized
ccctgcctgtggttcccaga

SEQ ID NO: 58166 - DNA, 20 bp, Artificial Sequence
  chemically synthesized
tgcgtgcttgctttctctcc

SEQ ID NO: 58167 - DNA, 20 bp, Artificial Sequence
  chemically synthesized
gcgtgcttgctttctctccc

SEQ ID NO: 58168 - DNA, 20 bp, Artificial Sequence
  chemically synthesized
cgtgcttgctttctctccca

SEQ ID NO: 58169 - DNA, 20 bp, Artificial Sequence
  chemically synthesized
gcttgctttctctcccaggg

SEQ ID NO: 58170 - DNA, 20 bp, Artificial Sequence
  chemically synthesized
ctctcccagggaagataccc

SEQ ID NO: 58171 - DNA, 20 bp, Artificial Sequence
  chemically synthesized
gataccccagtgccatgtct

SEQ ID NO: 58172 - DNA, 20 bp, Artificial Sequence
  chemically synthesized
ataccccagtgccatgtctt

SEQ ID NO: 58173 - DNA, 20 bp, Artificial Sequence
  chemically synthesized
taccccagtgccatgtcttg

SEQ ID NO: 58174 - DNA, 20 bp, Artificial Sequence
  chemically synthesized
ccagtgccatgtcttggggc

SEQ ID NO: 58175 - DNA, 20 bp, Artificial Sequence
  chemically synthesized
agtgccatgtcttggggcaa

SEQ ID NO: 58176 - DNA, 20 bp, Artificial Sequence
  chemically synthesized
tcttggggcaagagaaaatg

SEQ ID NO: 58177 - DNA, 20 bp, Artificial Sequence
  chemically synthesized
ggggcaagagaaaatgaaga

SEQ ID NO: 58178 - DNA, 20 bp, Artificial Sequence
  chemically synthesized
agagaaaatgaagacagacc

SEQ ID NO: 58179 - DNA, 20 bp, Artificial Sequence
  chemically synthesized
acagacctggaacatgaaca

SEQ ID NO: 58180 - DNA, 20 bp, Artificial Sequence
  chemically synthesized
gacctggaacatgaacatgg

SEQ ID NO: 58181 - DNA, 20 bp, Artificial Sequence
  chemically synthesized
catgaacatggtggccttgc

SEQ ID NO: 58182 - DNA, 20 bp, Artificial Sequence
  chemically synthesized
aacatggtggccttgccaga

SEQ ID NO: 58183 - DNA, 20 bp, Artificial Sequence
  chemically synthesized
tggtggccttgccagaaagc

SEQ ID NO: 58184 - DNA, 20 bp, Artificial Sequence
  chemically synthesized
agtgtgtgttgctgaaacat

SEQ ID NO: 58185 - DNA, 20 bp, Artificial Sequence
  chemically synthesized
gtgtgttgctgaaacatcag

SEQ ID NO: 58186 - DNA, 20 bp, Artificial Sequence
  chemically synthesized
gtgttgctgaaacatcagca

SEQ ID NO: 58187 - DNA, 20 bp, Artificial Sequence
  chemically synthesized
aacatcagcagagattgtca

SEQ ID NO: 58188 - DNA, 20 bp, Artificial Sequence
  chemically synthesized
acatcagcagagattgtcaa

SEQ ID NO: 58189 - DNA, 20 bp, Artificial Sequence
  chemically synthesized
catcagcagagattgtcaaa

SEQ ID NO: 58190 - DNA, 20 bp, Artificial Sequence
  chemically synthesized
cagagattgtcaaagggata

SEQ ID NO: 58191 - DNA, 20 bp, Artificial Sequence
  chemically synthesized
gagattgtcaaagggataaa

SEQ ID NO: 58192 - DNA, 20 bp, Artificial Sequence
  chemically synthesized
gggataaagagataacttaa

SEQ ID NO: 58193 - DNA, 20 bp, Artificial Sequence
  chemically synthesized
ggataaagagataacttaaa

SEQ ID NO: 58194 - DNA, 20 bp, Artificial Sequence
  chemically synthesized
gataaagagataacttaaaa

SEQ ID NO: 58195 - DNA, 20 bp, Artificial Sequence
  chemically synthesized
cctattgaccaaaatgcgac

SEQ ID NO: 58196 - DNA, 20 bp, Artificial Sequence
  chemically synthesized
ctaaaatcaaatcataatta

SEQ ID NO: 58197 - DNA, 20 bp, Artificial Sequence
  chemically synthesized
aaatcataattatagttcaa

SEQ ID NO: 58198 - DNA, 20 bp, Artificial Sequence
  chemically synthesized
aatcataattatagttcaat

SEQ ID NO: 58199 - DNA, 20 bp, Artificial Sequence
  chemically synthesized
atagttcaataggacacatt

SEQ ID NO: 58200 - DNA, 20 bp, Artificial Sequence
  chemically synthesized
ggacacattgagtctcttaa

SEQ ID NO: 58201 - DNA, 20 bp, Artificial Sequence
  chemically synthesized
tccaatccgtaatgaccatc

SEQ ID NO: 58202 - DNA, 20 bp, Artificial Sequence
  chemically synthesized
ccaatccgtaatgaccatca

SEQ ID NO: 58203 - DNA, 20 bp, Artificial Sequence
  chemically synthesized
atcaaggcccataacctcaa

SEQ ID NO: 58204 - DNA, 20 bp, Artificial Sequence
  chemically synthesized
caaggcccataacctcaaaa

SEQ ID NO: 58205 - DNA, 20 bp, Artificial Sequence
  chemically synthesized
cccataacctcaaaagagta

SEQ ID NO: 58206 - DNA, 20 bp, Artificial Sequence
  chemically synthesized
aaaagagtaaagttaaaata

SEQ ID NO: 58207 - DNA, 20 bp, Artificial Sequence
  chemically synthesized
agtaaagttaaaataaagtt

SEQ ID NO: 58208 - DNA, 20 bp, Artificial Sequence
  chemically synthesized
agttaaaataaagttcagaa

SEQ ID NO: 58209 - DNA, 20 bp, Artificial Sequence
  chemically synthesized
gttaaaataaagttcagaaa

SEQ ID NO: 58210 - DNA, 20 bp, Artificial Sequence
  chemically synthesized
aaataaagttcagaaaaggt

SEQ ID NO: 58211 - DNA, 20 bp, Artificial Sequence
  chemically synthesized
ggttagctgcaataaaacat

SEQ ID NO: 58212 - DNA, 20 bp, Artificial Sequence
  chemically synthesized
ctgcaataaaacatgagttt

SEQ ID NO: 58213 - DNA, 20 bp, Artificial Sequence
  chemically synthesized
tgagttttagtaattttaac

SEQ ID NO: 58214 - DNA, 20 bp, Artificial Sequence
  chemically synthesized
gttttagtaattttaacaag

SEQ ID NO: 58215 - DNA, 20 bp, Artificial Sequence
  chemically synthesized
ttttagtaattttaacaaga

SEQ ID NO: 58216 - DNA, 20 bp, Artificial Sequence
  chemically synthesized
tttagtaattttaacaagaa

SEQ ID NO: 58217 - DNA, 20 bp, Artificial Sequence
  chemically synthesized
ttagtaattttaacaagaag

SEQ ID NO: 58218 - DNA, 20 bp, Artificial Sequence
  chemically synthesized
attttaacaagaaggggatg

SEQ ID NO: 58219 - DNA, 20 bp, Artificial Sequence
  chemically synthesized
acaagaaggggatgaagcta

SEQ ID NO: 58220 - DNA, 20 bp, Artificial Sequence
  chemically synthesized
atgttgccccttataatgta

SEQ ID NO: 58221 - DNA, 20 bp, Artificial Sequence
  chemically synthesized
tgccttatttttctctgtct

SEQ ID NO: 58222 - DNA, 20 bp, Artificial Sequence
  chemically synthesized
ttatttttctctgtctgagt

SEQ ID NO: 58223 - DNA, 20 bp, Artificial Sequence
  chemically synthesized
tatttttctctgtctgagta

SEQ ID NO: 58224 - DNA, 20 bp, Artificial Sequence
  chemically synthesized
tctctgtctgagtaaggata

SEQ ID NO: 58225 - DNA, 20 bp, Artificial Sequence
  chemically synthesized
tctgtctgagtaaggataaa

SEQ ID NO: 58226 - DNA, 20 bp, Artificial Sequence
  chemically synthesized
ctgagtaaggataaagagta

SEQ ID NO: 58227 - DNA, 20 bp, Artificial Sequence
  chemically synthesized
tgagtaaggataaagagtaa

SEQ ID NO: 58228 - DNA, 20 bp, Artificial Sequence
  chemically synthesized
taaggataaagagtaaaggc

SEQ ID NO: 58229 - DNA, 20 bp, Artificial Sequence
  chemically synthesized
aaggataaagagtaaaggcc

SEQ ID NO: 58230 - DNA, 20 bp, Artificial Sequence
  chemically synthesized
taaagagtaaaggccaggca

SEQ ID NO: 58231 - DNA, 20 bp, Artificial Sequence
  chemically synthesized
agagtaaaggccaggcacag

SEQ ID NO: 58232 - DNA, 20 bp, Artificial Sequence
  chemically synthesized
gtggctcacacctgtaattc

SEQ ID NO: 58233 - DNA, 20 bp, Artificial Sequence
  chemically synthesized
cacctgtaattccagcactt

SEQ ID NO: 58234 - DNA, 20 bp, Artificial Sequence
  chemically synthesized
acctgtaattccagcacttt

SEQ ID NO: 58235 - DNA, 20 bp, Artificial Sequence
  chemically synthesized
ctgtaattccagcactttgg

SEQ ID NO: 58236 - DNA, 20 bp, Artificial Sequence
  chemically synthesized
tgtaattccagcactttggg

SEQ ID NO: 58237 - DNA, 20 bp, Artificial Sequence
  chemically synthesized
ttccagcactttgggaggcc

SEQ ID NO: 58238 - DNA, 20 bp, Artificial Sequence
  chemically synthesized
tccagcactttgggaggccg

SEQ ID NO: 58239 - DNA, 20 bp, Artificial Sequence
  chemically synthesized
agcactttgggaggccgagg

SEQ ID NO: 58240 - DNA, 20 bp, Artificial Sequence
  chemically synthesized
gcactttgggaggccgaggc

SEQ ID NO: 58241 - DNA, 20 bp, Artificial Sequence
  chemically synthesized
ctttgggaggccgaggcggg

SEQ ID NO: 58242 - DNA, 20 bp, Artificial Sequence
  chemically synthesized
ccgaggcgggcagataactt

SEQ ID NO: 58243 - DNA, 20 bp, Artificial Sequence
  chemically synthesized
cgaggcgggcagataacttg

SEQ ID NO: 58244 - DNA, 20 bp, Artificial Sequence
  chemically synthesized
gcgggcagataacttgaggc

SEQ ID NO: 58245 - DNA, 20 bp, Artificial Sequence
  chemically synthesized
cgggcagataacttgaggcc

SEQ ID NO: 58246 - DNA, 20 bp, Artificial Sequence
  chemically synthesized
ggcagataacttgaggccag

SEQ ID NO: 58247 - DNA, 20 bp, Artificial Sequence
  chemically synthesized
taacttgaggccaggagttt

SEQ ID NO: 58248 - DNA, 20 bp, Artificial Sequence
  chemically synthesized
tgaggccaggagtttgagac

SEQ ID NO: 58249 - DNA, 20 bp, Artificial Sequence
  chemically synthesized
ccaggagtttgagaccagcc

SEQ ID NO: 58250 - DNA, 20 bp, Artificial Sequence
  chemically synthesized
tgagaccagcctggccaaca

SEQ ID NO: 58251 - DNA, 20 bp, Artificial Sequence
  chemically synthesized
ctaaaaatacaaaaattaac

SEQ ID NO: 58252 - DNA, 20 bp, Artificial Sequence
  chemically synthesized
atacaaaaattaactggaat

SEQ ID NO: 58253 - DNA, 20 bp, Artificial Sequence
  chemically synthesized
caaaaattaactggaattgg

SEQ ID NO: 58254 - DNA, 20 bp, Artificial Sequence
  chemically synthesized
gtagcacatgcctgtaatgc

SEQ ID NO: 58255 - DNA, 20 bp, Artificial Sequence
  chemically synthesized
gcctgtaatgccagctactc

SEQ ID NO: 58256 - DNA, 20 bp, Artificial Sequence
  chemically synthesized
ctgtaatgccagctactctg

SEQ ID NO: 58257 - DNA, 20 bp, Artificial Sequence
  chemically synthesized
tgtaatgccagctactctgg

SEQ ID NO: 58258 - DNA, 20 bp, Artificial Sequence
  chemically synthesized
tgccagctactctggaggct

SEQ ID NO: 58259 - DNA, 20 bp, Artificial Sequence
  chemically synthesized
gccagctactctggaggctg

SEQ ID NO: 58260 - DNA, 20 bp, Artificial Sequence
  chemically synthesized
tactctggaggctgaggcac

SEQ ID NO: 58261 - DNA, 20 bp, Artificial Sequence
  chemically synthesized
acgagaatcgctcgtaattc

SEQ ID NO: 58262 - DNA, 20 bp, Artificial Sequence
  chemically synthesized
cgctcgtaattccagaattc

SEQ ID NO: 58263 - DNA, 20 bp, Artificial Sequence
  chemically synthesized
ctcgtaattccagaattcga

SEQ ID NO: 58264 - DNA, 20 bp, Artificial Sequence
  chemically synthesized
tcgtaattccagaattcgag

SEQ ID NO: 58265 - DNA, 20 bp, Artificial Sequence
  chemically synthesized
taattccagaattcgagagg

SEQ ID NO: 58266 - DNA, 20 bp, Artificial Sequence
  chemically synthesized
attccagaattcgagaggtg

SEQ ID NO: 58267 - DNA, 20 bp, Artificial Sequence
  chemically synthesized
aattcgagaggtggagtttg

SEQ ID NO: 58268 - DNA, 20 bp, Artificial Sequence
  chemically synthesized
cgagaggtggagtttgcagt

SEQ ID NO: 58269 - DNA, 20 bp, Artificial Sequence
  chemically synthesized
ggtggagtttgcagtaagcc

SEQ ID NO: 58270 - DNA, 20 bp, Artificial Sequence
  chemically synthesized
aagattgcgccactgtactc

SEQ ID NO: 58271 - DNA, 20 bp, Artificial Sequence
  chemically synthesized
tgcgccactgtactccagcc

SEQ ID NO: 58272 - DNA, 20 bp, Artificial Sequence
  chemically synthesized
gcgccactgtactccagcct

SEQ ID NO: 58273 - DNA, 20 bp, Artificial Sequence
  chemically synthesized
gtactccagcctgggtgact

SEQ ID NO: 58274 - DNA, 20 bp, Artificial Sequence
  chemically synthesized
tccagcctgggtgactgagt

SEQ ID NO: 58275 - DNA, 20 bp, Artificial Sequence
  chemically synthesized
gtctcaaaaaaaaaaaaaaa

SEQ ID NO: 58276 - DNA, 20 bp, Artificial Sequence
  chemically synthesized
tcaaaaaaaaaaaaaaaaag

SEQ ID NO: 58277 - DNA, 20 bp, Artificial Sequence
  chemically synthesized
aaaaaaaaaaaaaaaagaag

SEQ ID NO: 58278 - DNA, 20 bp, Artificial Sequence
  chemically synthesized
aaaaaaaaagaagaagctgt

SEQ ID NO: 58279 - DNA, 20 bp, Artificial Sequence
  chemically synthesized
aaaaaagaagaagctgtgag

SEQ ID NO: 58280 - DNA, 20 bp, Artificial Sequence
  chemically synthesized
aaaaagaagaagctgtgagt

SEQ ID NO: 58281 - DNA, 20 bp, Artificial Sequence
  chemically synthesized
gaagctgtgagtaggccaca

SEQ ID NO: 58282 - DNA, 20 bp, Artificial Sequence
  chemically synthesized
gtgagtaggccacatagttc

SEQ ID NO: 58283 - DNA, 20 bp, Artificial Sequence
  chemically synthesized
ccacatagttccagaaaatg

SEQ ID NO: 58284 - DNA, 20 bp, Artificial Sequence
  chemically synthesized
cccctcccctccccaacaca

SEQ ID NO: 58285 - DNA, 20 bp, Artificial Sequence
  chemically synthesized
ccctcccctccccaacacac

SEQ ID NO: 58286 - DNA, 20 bp, Artificial Sequence
  chemically synthesized
tcccctccccaacacacagg

SEQ ID NO: 58287 - DNA, 20 bp, Artificial Sequence
  chemically synthesized
cctccccaacacacaggaag

SEQ ID NO: 58288 - DNA, 20 bp, Artificial Sequence
  chemically synthesized
ccaacacacaggaagtggct

SEQ ID NO: 58289 - DNA, 20 bp, Artificial Sequence
  chemically synthesized
caacacacaggaagtggctc

SEQ ID NO: 58290 - DNA, 20 bp, Artificial Sequence
  chemically synthesized
acacacaggaagtggctcag

SEQ ID NO: 58291 - DNA, 20 bp, Artificial Sequence
  chemically synthesized
gtggctcaggagattacaca

SEQ ID NO: 58292 - DNA, 20 bp, Artificial Sequence
  chemically synthesized
gctcaggagattacacacag

SEQ ID NO: 58293 - DNA, 20 bp, Artificial Sequence
  chemically synthesized
ctcaggagattacacacaga

SEQ ID NO: 58294 - DNA, 20 bp, Artificial Sequence
  chemically synthesized
ggagattacacacagaagga

SEQ ID NO: 58295 - DNA, 20 bp, Artificial Sequence
  chemically synthesized
cagaaggaaagtgtgtctgc

SEQ ID NO: 58296 - DNA, 20 bp, Artificial Sequence
  chemically synthesized
agaaggaaagtgtgtctgct

SEQ ID NO: 58297 - DNA, 20 bp, Artificial Sequence
  chemically synthesized
gaaggaaagtgtgtctgctg

SEQ ID NO: 58298 - DNA, 20 bp, Artificial Sequence
  chemically synthesized
tgtgtctgctggggttttgc

SEQ ID NO: 58299 - DNA, 20 bp, Artificial Sequence
  chemically synthesized
tctgctggggttttgcaagt

SEQ ID NO: 58300 - DNA, 20 bp, Artificial Sequence
  chemically synthesized
ttgcaagttggctaatttga

SEQ ID NO: 58301 - DNA, 20 bp, Artificial Sequence
  chemically synthesized
tgcaagttggctaatttgaa

SEQ ID NO: 58302 - DNA, 20 bp, Artificial Sequence
  chemically synthesized
tggctaatttgaaaggtgac

SEQ ID NO: 58303 - DNA, 20 bp, Artificial Sequence
  chemically synthesized
gctaatttgaaaggtgactg

SEQ ID NO: 58304 - DNA, 20 bp, Artificial Sequence
  chemically synthesized
ctaatttgaaaggtgactgg

SEQ ID NO: 58305 - DNA, 20 bp, Artificial Sequence
  chemically synthesized
aatttgaaaggtgactggag

SEQ ID NO: 58306 - DNA, 20 bp, Artificial Sequence
  chemically synthesized
atttgaaaggtgactggagg

SEQ ID NO: 58307 - DNA, 20 bp, Artificial Sequence
  chemically synthesized
gactggaggaggtgaaaaaa

SEQ ID NO: 58308 - DNA, 20 bp, Artificial Sequence
  chemically synthesized
acttcattcattcattaaat

SEQ ID NO: 58309 - DNA, 20 bp, Artificial Sequence
  chemically synthesized
tcattcattaaatgagttat

SEQ ID NO: 58310 - DNA, 20 bp, Artificial Sequence
  chemically synthesized
ttcattaaatgagttataag

SEQ ID NO: 58311 - DNA, 20 bp, Artificial Sequence
  chemically synthesized
ttaaatgagttataagaaga

SEQ ID NO: 58312 - DNA, 20 bp, Artificial Sequence
  chemically synthesized
agttataagaagacagacac

SEQ ID NO: 58313 - DNA, 20 bp, Artificial Sequence
  chemically synthesized
acaagtgtccattatgctaa

SEQ ID NO: 58314 - DNA, 20 bp, Artificial Sequence
  chemically synthesized
aagtgtccattatgctaaca

SEQ ID NO: 58315 - DNA, 20 bp, Artificial Sequence
  chemically synthesized
ctctgtgttaaacaccccac

SEQ ID NO: 58316 - DNA, 20 bp, Artificial Sequence
  chemically synthesized
ccaccagcatcgcctcatct

SEQ ID NO: 58317 - DNA, 20 bp, Artificial Sequence
  chemically synthesized
gcatcgcctcatctaagcct

SEQ ID NO: 58318 - DNA, 20 bp, Artificial Sequence
  chemically synthesized
tcgcctcatctaagcctcag

SEQ ID NO: 58319 - DNA, 20 bp, Artificial Sequence
  chemically synthesized
gcctcatctaagcctcagaa

SEQ ID NO: 58320 - DNA, 20 bp, Artificial Sequence
  chemically synthesized
taagcctcagaagagctatg

SEQ ID NO: 58321 - DNA, 20 bp, Artificial Sequence
  chemically synthesized
aagcctcagaagagctatgt

SEQ ID NO: 58322 - DNA, 20 bp, Artificial Sequence
  chemically synthesized
ctcagaagagctatgtggga

SEQ ID NO: 58323 - DNA, 20 bp, Artificial Sequence
  chemically synthesized
aaacttttatccctatttta

SEQ ID NO: 58324 - DNA, 20 bp, Artificial Sequence
  chemically synthesized
tttatccctattttatagat

SEQ ID NO: 58325 - DNA, 20 bp, Artificial Sequence
  chemically synthesized
ttatccctattttatagatg

SEQ ID NO: 58326 - DNA, 20 bp, Artificial Sequence
  chemically synthesized
attttatagatgaggaaacc

SEQ ID NO: 58327 - DNA, 20 bp, Artificial Sequence
  chemically synthesized
ttttatagatgaggaaacca

SEQ ID NO: 58328 - DNA, 20 bp, Artificial Sequence
  chemically synthesized
tagatgaggaaaccaaggct

SEQ ID NO: 58329 - DNA, 20 bp, Artificial Sequence
  chemically synthesized
gatgaggaaaccaaggctca

SEQ ID NO: 58330 - DNA, 20 bp, Artificial Sequence
  chemically synthesized
aaaccaaggctcagagaact

SEQ ID NO: 58331 - DNA, 20 bp, Artificial Sequence
  chemically synthesized
aaccaaggctcagagaactg

SEQ ID NO: 58332 - DNA, 20 bp, Artificial Sequence
  chemically synthesized
accaaggctcagagaactga

SEQ ID NO: 58333 - DNA, 20 bp, Artificial Sequence
  chemically synthesized
agagaactgagggcctcccc

SEQ ID NO: 58334 - DNA, 20 bp, Artificial Sequence
  chemically synthesized
tgagggcctcccccggatcc

SEQ ID NO: 58335 - DNA, 20 bp, Artificial Sequence
  chemically synthesized
cccccggatccaagtccacc

SEQ ID NO: 58336 - DNA, 20 bp, Artificial Sequence
  chemically synthesized
gatccaagtccacctagctg

SEQ ID NO: 58337 - DNA, 20 bp, Artificial Sequence
  chemically synthesized
cccacatcctctgcatgtca

SEQ ID NO: 58338 - DNA, 20 bp, Artificial Sequence
  chemically synthesized
ccacatcctctgcatgtcac

SEQ ID NO: 58339 - DNA, 20 bp, Artificial Sequence
  chemically synthesized
ctctgcatgtcacaggtgct

SEQ ID NO: 58340 - DNA, 20 bp, Artificial Sequence
  chemically synthesized
gcatgtcacaggtgctcaga

SEQ ID NO: 58341 - DNA, 20 bp, Artificial Sequence
  chemically synthesized
aggtgctcagaaagatgctg

SEQ ID NO: 58342 - DNA, 20 bp, Artificial Sequence
  chemically synthesized
ggtgctcagaaagatgctga

SEQ ID NO: 58343 - DNA, 20 bp, Artificial Sequence
  chemically synthesized
agaaagatgctgaaggcacc

SEQ ID NO: 58344 - DNA, 20 bp, Artificial Sequence
  chemically synthesized
ggcacctggcccttcacctt

SEQ ID NO: 58345 - DNA, 20 bp, Artificial Sequence
  chemically synthesized
cctggcccttcaccttcgga

SEQ ID NO: 58346 - DNA, 20 bp, Artificial Sequence
  chemically synthesized
caccttcggaaagccaaaat

SEQ ID NO: 58347 - DNA, 20 bp, Artificial Sequence
  chemically synthesized
tcggaaagccaaaatgagca

SEQ ID NO: 58348 - DNA, 20 bp, Artificial Sequence
  chemically synthesized
caaaatgagcacggccccta

SEQ ID NO: 58349 - DNA, 20 bp, Artificial Sequence
  chemically synthesized
aaatgagcacggcccctaaa

SEQ ID NO: 58350 - DNA, 20 bp, Artificial Sequence
  chemically synthesized
aatgagcacggcccctaaag

SEQ ID NO: 58351 - DNA, 20 bp, Artificial Sequence
  chemically synthesized
atgagcacggcccctaaaga

SEQ ID NO: 58352 - DNA, 20 bp, Artificial Sequence
  chemically synthesized
tgagcacggcccctaaagag

SEQ ID NO: 58353 - DNA, 20 bp, Artificial Sequence
  chemically synthesized
gcccctaaagaggggattga

SEQ ID NO: 58354 - DNA, 20 bp, Artificial Sequence
  chemically synthesized
aggggattgacagccttttc

SEQ ID NO: 58355 - DNA, 20 bp, Artificial Sequence
  chemically synthesized
acagccttttctggaaaaaa

SEQ ID NO: 58356 - DNA, 20 bp, Artificial Sequence
  chemically synthesized
gccttttctggaaaaaatgg

SEQ ID NO: 58357 - DNA, 20 bp, Artificial Sequence
  chemically synthesized
aaaaatggaagtttgaatct

SEQ ID NO: 58358 - DNA, 20 bp, Artificial Sequence
  chemically synthesized
aaaatggaagtttgaatctg

SEQ ID NO: 58359 - DNA, 20 bp, Artificial Sequence
  chemically synthesized
aatggaagtttgaatctgag

SEQ ID NO: 58360 - DNA, 20 bp, Artificial Sequence
  chemically synthesized
atggaagtttgaatctgagg

SEQ ID NO: 58361 - DNA, 20 bp, Artificial Sequence
  chemically synthesized
gaggaggtgtccctcaacaa

SEQ ID NO: 58362 - DNA, 20 bp, Artificial Sequence
  chemically synthesized
aggaggtgtccctcaacaac

SEQ ID NO: 58363 - DNA, 20 bp, Artificial Sequence
  chemically synthesized
caggtgctgctccccaaatc

SEQ ID NO: 58364 - DNA, 20 bp, Artificial Sequence
  chemically synthesized
aggtgctgctccccaaatct

SEQ ID NO: 58365 - DNA, 20 bp, Artificial Sequence
  chemically synthesized
ggtgctgctccccaaatctg

SEQ ID NO: 58366 - DNA, 20 bp, Artificial Sequence
  chemically synthesized
cccaaatctggggccaaacg

SEQ ID NO: 58367 - DNA, 20 bp, Artificial Sequence
  chemically synthesized
aaatctggggccaaacgcag

SEQ ID NO: 58368 - DNA, 20 bp, Artificial Sequence
  chemically synthesized
gcagcagttgttcccccact

SEQ ID NO: 58369 - DNA, 20 bp, Artificial Sequence
  chemically synthesized
gttcccccacttagacccct

SEQ ID NO: 58370 - DNA, 20 bp, Artificial Sequence
  chemically synthesized
acccctgagacccatctata

SEQ ID NO: 58371 - DNA, 20 bp, Artificial Sequence
  chemically synthesized
gacccatctatatggttttt

SEQ ID NO: 58372 - DNA, 20 bp, Artificial Sequence
  chemically synthesized
cccatctatatggtttttca

SEQ ID NO: 58373 - DNA, 20 bp, Artificial Sequence
  chemically synthesized
tctatatggtttttcagagc

SEQ ID NO: 58374 - DNA, 20 bp, Artificial Sequence
  chemically synthesized
ctatatggtttttcagagcc

SEQ ID NO: 58375 - DNA, 20 bp, Artificial Sequence
  chemically synthesized
agagccaggacacatcccca

SEQ ID NO: 58376 - DNA, 20 bp, Artificial Sequence
  chemically synthesized
gagccaggacacatccccaa

SEQ ID NO: 58377 - DNA, 20 bp, Artificial Sequence
  chemically synthesized
ggacacatccccaaaggtca

SEQ ID NO: 58378 - DNA, 20 bp, Artificial Sequence
  chemically synthesized
tccccaaaggtcatggcctt

SEQ ID NO: 58379 - DNA, 20 bp, Artificial Sequence
  chemically synthesized
ccaaaggtcatggcctttgg

SEQ ID NO: 58380 - DNA, 20 bp, Artificial Sequence
  chemically synthesized
aggtcatggcctttggtggt

SEQ ID NO: 58381 - DNA, 20 bp, Artificial Sequence
  chemically synthesized
tttggtggttagcattgact

SEQ ID NO: 58382 - DNA, 20 bp, Artificial Sequence
  chemically synthesized
ttggtggttagcattgactt

SEQ ID NO: 58383 - DNA, 20 bp, Artificial Sequence
  chemically synthesized
tggtggttagcattgacttg

SEQ ID NO: 58384 - DNA, 20 bp, Artificial Sequence
  chemically synthesized
acttggggcccatcacatgc

SEQ ID NO: 58385 - DNA, 20 bp, Artificial Sequence
  chemically synthesized
ttggggcccatcacatgcca

SEQ ID NO: 58386 - DNA, 20 bp, Artificial Sequence
  chemically synthesized
tggggcccatcacatgccag

SEQ ID NO: 58387 - DNA, 20 bp, Artificial Sequence
  chemically synthesized
cacatgccagaggctgcccg

SEQ ID NO: 58388 - DNA, 20 bp, Artificial Sequence
  chemically synthesized
attatctcattcgatcttca

SEQ ID NO: 58389 - DNA, 20 bp, Artificial Sequence
  chemically synthesized
ttcgatcttcacagtcctga

SEQ ID NO: 58390 - DNA, 20 bp, Artificial Sequence
  chemically synthesized
gatcttcacagtcctgatgg

SEQ ID NO: 58391 - DNA, 20 bp, Artificial Sequence
  chemically synthesized
ctgatggaagtgactcttct

SEQ ID NO: 58392 - DNA, 20 bp, Artificial Sequence
  chemically synthesized
gatggaagtgactcttctta

SEQ ID NO: 58393 - DNA, 20 bp, Artificial Sequence
  chemically synthesized
cttagagtcttcctatctca

SEQ ID NO: 58394 - DNA, 20 bp, Artificial Sequence
  chemically synthesized
agtcttcctatctcacagat

SEQ ID NO: 58395 - DNA, 20 bp, Artificial Sequence
  chemically synthesized
gtcttcctatctcacagatg

SEQ ID NO: 58396 - DNA, 20 bp, Artificial Sequence
  chemically synthesized
atctcacagatgaggaaacc

SEQ ID NO: 58397 - DNA, 20 bp, Artificial Sequence
  chemically synthesized
tctcacagatgaggaaaccg

SEQ ID NO: 58398 - DNA, 20 bp, Artificial Sequence
  chemically synthesized
cagatgaggaaaccgaggca

SEQ ID NO: 58399 - DNA, 20 bp, Artificial Sequence
  chemically synthesized
gatgaggaaaccgaggcaca

SEQ ID NO: 58400 - DNA, 20 bp, Artificial Sequence
  chemically synthesized
tgaggaaaccgaggcacaga

SEQ ID NO: 58401 - DNA, 20 bp, Artificial Sequence
  chemically synthesized
gaggaaaccgaggcacagag

SEQ ID NO: 58402 - DNA, 20 bp, Artificial Sequence
  chemically synthesized
aaccgaggcacagagaggtt

SEQ ID NO: 58403 - DNA, 20 bp, Artificial Sequence
  chemically synthesized
cgaggcacagagaggttaag

SEQ ID NO: 58404 - DNA, 20 bp, Artificial Sequence
  chemically synthesized
agaggttaagtggcttgtct

SEQ ID NO: 58405 - DNA, 20 bp, Artificial Sequence
  chemically synthesized
aggttaagtggcttgtctaa

SEQ ID NO: 58406 - DNA, 20 bp, Artificial Sequence
  chemically synthesized
cttgtctaagagctcacaaa

SEQ ID NO: 58407 - DNA, 20 bp, Artificial Sequence
  chemically synthesized
tgtctaagagctcacaaaaa

SEQ ID NO: 58408 - DNA, 20 bp, Artificial Sequence
  chemically synthesized
agagctcacaaaaagagcga

SEQ ID NO: 58409 - DNA, 20 bp, Artificial Sequence
  chemically synthesized
agctcacaaaaagagcgatg

SEQ ID NO: 58410 - DNA, 20 bp, Artificial Sequence
  chemically synthesized
acaaaaagagcgatggagct

SEQ ID NO: 58411 - DNA, 20 bp, Artificial Sequence
  chemically synthesized
caaaaagagcgatggagcta

SEQ ID NO: 58412 - DNA, 20 bp, Artificial Sequence
  chemically synthesized
agagcgatggagctaaggct

SEQ ID NO: 58413 - DNA, 20 bp, Artificial Sequence
  chemically synthesized
atggagctaaggcttggccc

SEQ ID NO: 58414 - DNA, 20 bp, Artificial Sequence
  chemically synthesized
taaggcttggccccagatat

SEQ ID NO: 58415 - DNA, 20 bp, Artificial Sequence
  chemically synthesized
tcccgaacccacgccttaac

SEQ ID NO: 58416 - DNA, 20 bp, Artificial Sequence
  chemically synthesized
gtgacctgcactgactctca

SEQ ID NO: 58417 - DNA, 20 bp, Artificial Sequence
  chemically synthesized
acctgcactgactctcaaag

SEQ ID NO: 58418 - DNA, 20 bp, Artificial Sequence
  chemically synthesized
cctgcactgactctcaaaga

SEQ ID NO: 58419 - DNA, 20 bp, Artificial Sequence
  chemically synthesized
gcactgactctcaaagaagg

SEQ ID NO: 58420 - DNA, 20 bp, Artificial Sequence
  chemically synthesized
tgactctcaaagaaggaagc

SEQ ID NO: 58421 - DNA, 20 bp, Artificial Sequence
  chemically synthesized
caaagaaggaagctggtgcc

SEQ ID NO: 58422 - DNA, 20 bp, Artificial Sequence
  chemically synthesized
aaagaaggaagctggtgcct

SEQ ID NO: 58423 - DNA, 20 bp, Artificial Sequence
  chemically synthesized
gaaggaagctggtgcctggg

SEQ ID NO: 58424 - DNA, 20 bp, Artificial Sequence
  chemically synthesized
aaggaagctggtgcctggga

SEQ ID NO: 58425 - DNA, 20 bp, Artificial Sequence
  chemically synthesized
ggaagctggtgcctgggaag

SEQ ID NO: 58426 - DNA, 20 bp, Artificial Sequence
  chemically synthesized
gaagctggtgcctgggaagg

SEQ ID NO: 58427 - DNA, 20 bp, Artificial Sequence
  chemically synthesized
aagctggtgcctgggaagga

SEQ ID NO: 58428 - DNA, 20 bp, Artificial Sequence
  chemically synthesized
tgcctgggaaggagggtgca

SEQ ID NO: 58429 - DNA, 20 bp, Artificial Sequence
  chemically synthesized
tgggaaggagggtgcatagt

SEQ ID NO: 58430 - DNA, 20 bp, Artificial Sequence
  chemically synthesized
gggaaggagggtgcatagtg

SEQ ID NO: 58431 - DNA, 20 bp, Artificial Sequence
  chemically synthesized
ggaaggagggtgcatagtga

SEQ ID NO: 58432 - DNA, 20 bp, Artificial Sequence
  chemically synthesized
gtgcatagtgagggtgtgca

SEQ ID NO: 58433 - DNA, 20 bp, Artificial Sequence
  chemically synthesized
tgcatagtgagggtgtgcat

SEQ ID NO: 58434 - DNA, 20 bp, Artificial Sequence
  chemically synthesized
gcatagtgagggtgtgcatg

SEQ ID NO: 58435 - DNA, 20 bp, Artificial Sequence
  chemically synthesized
gcatggggtgtgtgtgtttg

SEQ ID NO: 58436 - DNA, 20 bp, Artificial Sequence
  chemically synthesized
catggggtgtgtgtgtttgt

SEQ ID NO: 58437 - DNA, 20 bp, Artificial Sequence
  chemically synthesized
atggggtgtgtgtgtttgtg

SEQ ID NO: 58438 - DNA, 20 bp, Artificial Sequence
  chemically synthesized
gggtgtgtgtgtttgtgggg

SEQ ID NO: 58439 - DNA, 20 bp, Artificial Sequence
  chemically synthesized
gtgtgtgtttgtggggtggc

SEQ ID NO: 58440 - DNA, 20 bp, Artificial Sequence
  chemically synthesized
gtggggtggccagcactctc

SEQ ID NO: 58441 - DNA, 20 bp, Artificial Sequence
  chemically synthesized
tggggtggccagcactctcc

SEQ ID NO: 58442 - DNA, 20 bp, Artificial Sequence
  chemically synthesized
ggggtggccagcactctccg

SEQ ID NO: 58443 - DNA, 20 bp, Artificial Sequence
  chemically synthesized
gggtggccagcactctccgg

SEQ ID NO: 58444 - DNA, 20 bp, Artificial Sequence
  chemically synthesized
tccgggggcactttgccaat

SEQ ID NO: 58445 - DNA, 20 bp, Artificial Sequence
  chemically synthesized
gggcactttgccaatgagtt

SEQ ID NO: 58446 - DNA, 20 bp, Artificial Sequence
  chemically synthesized
caatgagttcagctcccatg

SEQ ID NO: 58447 - DNA, 20 bp, Artificial Sequence
  chemically synthesized
tccactgttgttctcctgac

SEQ ID NO: 58448 - DNA, 20 bp, Artificial Sequence
  chemically synthesized
tgttctcctgaccagccact

SEQ ID NO: 58449 - DNA, 20 bp, Artificial Sequence
  chemically synthesized
ccactcagtcttgatttact

SEQ ID NO: 58450 - DNA, 20 bp, Artificial Sequence
  chemically synthesized
cagtcttgatttacttggcc

SEQ ID NO: 58451 - DNA, 20 bp, Artificial Sequence
  chemically synthesized
agtcttgatttacttggccc

SEQ ID NO: 58452 - DNA, 20 bp, Artificial Sequence
  chemically synthesized
gtcttgatttacttggccca

SEQ ID NO: 58453 - DNA, 20 bp, Artificial Sequence
  chemically synthesized
tttacttggcccagggccac

SEQ ID NO: 58454 - DNA, 20 bp, Artificial Sequence
  chemically synthesized
ccttacccgattccttgctg

SEQ ID NO: 58455 - DNA, 20 bp, Artificial Sequence
  chemically synthesized
tcgactctcacatccctatc

SEQ ID NO: 58456 - DNA, 20 bp, Artificial Sequence
  chemically synthesized
ccctatccagcccataccac

SEQ ID NO: 58457 - DNA, 20 bp, Artificial Sequence
  chemically synthesized
cctatccagcccataccacg

SEQ ID NO: 58458 - DNA, 20 bp, Artificial Sequence
  chemically synthesized
taccacgaggctcccatctc

SEQ ID NO: 58459 - DNA, 20 bp, Artificial Sequence
  chemically synthesized
accacgaggctcccatctcc

SEQ ID NO: 58460 - DNA, 20 bp, Artificial Sequence
  chemically synthesized
acgaggctcccatctccagg

SEQ ID NO: 58461 - DNA, 20 bp, Artificial Sequence
  chemically synthesized
cgaggctcccatctccaggc

SEQ ID NO: 58462 - DNA, 20 bp, Artificial Sequence
  chemically synthesized
gaggctcccatctccaggca

SEQ ID NO: 58463 - DNA, 20 bp, Artificial Sequence
  chemically synthesized
catctccaggcagggccctg

SEQ ID NO: 58464 - DNA, 20 bp, Artificial Sequence
  chemically synthesized
ctccaggcagggccctgtgg

SEQ ID NO: 58465 - DNA, 20 bp, Artificial Sequence
  chemically synthesized
tccaggcagggccctgtggt

SEQ ID NO: 58466 - DNA, 20 bp, Artificial Sequence
  chemically synthesized
ccaggcagggccctgtggtg

SEQ ID NO: 58467 - DNA, 20 bp, Artificial Sequence
  chemically synthesized
ggcagggccctgtggtgggg

SEQ ID NO: 58468 - DNA, 20 bp, Artificial Sequence
  chemically synthesized
gcagggccctgtggtggggc

SEQ ID NO: 58469 - DNA, 20 bp, Artificial Sequence
  chemically synthesized
cagggccctgtggtggggca

SEQ ID NO: 58470 - DNA, 20 bp, Artificial Sequence
  chemically synthesized
tggtggggcagggcctcccc

SEQ ID NO: 58471 - DNA, 20 bp, Artificial Sequence
  chemically synthesized
agatgccccttactcatgac

SEQ ID NO: 58472 - DNA, 20 bp, Artificial Sequence
  chemically synthesized
ccttactcatgaccagctca

SEQ ID NO: 58473 - DNA, 20 bp, Artificial Sequence
  chemically synthesized
cttactcatgaccagctcac

SEQ ID NO: 58474 - DNA, 20 bp, Artificial Sequence
  chemically synthesized
ttcccatgatgcatttcctc

SEQ ID NO: 58475 - DNA, 20 bp, Artificial Sequence
  chemically synthesized
tcccatgatgcatttcctct

SEQ ID NO: 58476 - DNA, 20 bp, Artificial Sequence
  chemically synthesized
cccatgatgcatttcctctg

SEQ ID NO: 58477 - DNA, 20 bp, Artificial Sequence
  chemically synthesized
ccatgatgcatttcctctgg

SEQ ID NO: 58478 - DNA, 20 bp, Artificial Sequence
  chemically synthesized
catgatgcatttcctctggg

SEQ ID NO: 58479 - DNA, 20 bp, Artificial Sequence
  chemically synthesized
tgcatttcctctggggggat

SEQ ID NO: 58480 - DNA, 20 bp, Artificial Sequence
  chemically synthesized
ttcctctggggggatcagcc

SEQ ID NO: 58481 - DNA, 20 bp, Artificial Sequence
  chemically synthesized
gatcagcccagatgctgcaa

SEQ ID NO: 58482 - DNA, 20 bp, Artificial Sequence
  chemically synthesized
gatgctgcaatagacaattg

SEQ ID NO: 58483 - DNA, 20 bp, Artificial Sequence
  chemically synthesized
gctgcaatagacaattgtgg

SEQ ID NO: 58484 - DNA, 20 bp, Artificial Sequence
  chemically synthesized
tagacaattgtggaagtaac

SEQ ID NO: 58485 - DNA, 20 bp, Artificial Sequence
  chemically synthesized
agacaattgtggaagtaacc

SEQ ID NO: 58486 - DNA, 20 bp, Artificial Sequence
  chemically synthesized
caattgtggaagtaaccagg

SEQ ID NO: 58487 - DNA, 20 bp, Artificial Sequence
  chemically synthesized
gtggaagtaaccaggtggac

SEQ ID NO: 58488 - DNA, 20 bp, Artificial Sequence
  chemically synthesized
agactttccccctcatgtcc

SEQ ID NO: 58489 - DNA, 20 bp, Artificial Sequence
  chemically synthesized
gactttccccctcatgtcct

SEQ ID NO: 58490 - DNA, 20 bp, Artificial Sequence
  chemically synthesized
actttccccctcatgtcctg

SEQ ID NO: 58491 - DNA, 20 bp, Artificial Sequence
  chemically synthesized
ccctcatgtcctggggttcc

SEQ ID NO: 58492 - DNA, 20 bp, Artificial Sequence
  chemically synthesized
cctcatgtcctggggttcct

SEQ ID NO: 58493 - DNA, 20 bp, Artificial Sequence
  chemically synthesized
ctcatgtcctggggttcctg

SEQ ID NO: 58494 - DNA, 20 bp, Artificial Sequence
  chemically synthesized
tcatgtcctggggttcctgg

SEQ ID NO: 58495 - DNA, 20 bp, Artificial Sequence
  chemically synthesized
tcctggggttcctgggggca

SEQ ID NO: 58496 - DNA, 20 bp, Artificial Sequence
  chemically synthesized
gggcacagtatccttgtgaa

SEQ ID NO: 58497 - DNA, 20 bp, Artificial Sequence
  chemically synthesized
tatccttgtgaatggccact

SEQ ID NO: 58498 - DNA, 20 bp, Artificial Sequence
  chemically synthesized
acccctcccaccacaacccc

SEQ ID NO: 58499 - DNA, 20 bp, Artificial Sequence
  chemically synthesized
cccctcccaccacaaccccc

SEQ ID NO: 58500 - DNA, 20 bp, Artificial Sequence
  chemically synthesized
caacccccgggattttgtcc

SEQ ID NO: 58501 - DNA, 20 bp, Artificial Sequence
  chemically synthesized
tttgtcctggtgcgtttttc

SEQ ID NO: 58502 - DNA, 20 bp, Artificial Sequence
  chemically synthesized
tgcgtttttccagattatcc

SEQ ID NO: 58503 - DNA, 20 bp, Artificial Sequence
  chemically synthesized
attatcctagcccttcctcc

SEQ ID NO: 58504 - DNA, 20 bp, Artificial Sequence
  chemically synthesized
ttatcctagcccttcctccc

SEQ ID NO: 58505 - DNA, 20 bp, Artificial Sequence
  chemically synthesized
cctagcccttcctcccagga

SEQ ID NO: 58506 - DNA, 20 bp, Artificial Sequence
  chemically synthesized
ttcctcccaggatggatgtc

SEQ ID NO: 58507 - DNA, 20 bp, Artificial Sequence
  chemically synthesized
cctcccaggatggatgtcca

SEQ ID NO: 58508 - DNA, 20 bp, Artificial Sequence
  chemically synthesized
cccaggatggatgtccagag

SEQ ID NO: 58509 - DNA, 20 bp, Artificial Sequence
  chemically synthesized
ccaggatggatgtccagagc

SEQ ID NO: 58510 - DNA, 20 bp, Artificial Sequence
  chemically synthesized
caggatggatgtccagagca

SEQ ID NO: 58511 - DNA, 20 bp, Artificial Sequence
  chemically synthesized
gatggatgtccagagcaggg

SEQ ID NO: 58512 - DNA, 20 bp, Artificial Sequence
  chemically synthesized
atggatgtccagagcagggc

SEQ ID NO: 58513 - DNA, 20 bp, Artificial Sequence
  chemically synthesized
tggatgtccagagcagggcg

SEQ ID NO: 58514 - DNA, 20 bp, Artificial Sequence
  chemically synthesized
ggatgtccagagcagggcgg

SEQ ID NO: 58515 - DNA, 20 bp, Artificial Sequence
  chemically synthesized
tccagagcagggcgggggct

SEQ ID NO: 58516 - DNA, 20 bp, Artificial Sequence
  chemically synthesized
agcagggcgggggctgagcc

SEQ ID NO: 58517 - DNA, 20 bp, Artificial Sequence
  chemically synthesized
cagggcgggggctgagccta

SEQ ID NO: 58518 - DNA, 20 bp, Artificial Sequence
  chemically synthesized
tgagcctagagccctgccaa

SEQ ID NO: 58519 - DNA, 20 bp, Artificial Sequence
  chemically synthesized
agcctagagccctgccaaaa

SEQ ID NO: 58520 - DNA, 20 bp, Artificial Sequence
  chemically synthesized
ctagagccctgccaaaagag

SEQ ID NO: 58521 - DNA, 20 bp, Artificial Sequence
  chemically synthesized
tagagccctgccaaaagagc

SEQ ID NO: 58522 - DNA, 20 bp, Artificial Sequence
  chemically synthesized
agagcaggaccccaaattct

SEQ ID NO: 58523 - DNA, 20 bp, Artificial Sequence
  chemically synthesized
tttcttcattcctcctccaa

SEQ ID NO: 58524 - DNA, 20 bp, Artificial Sequence
  chemically synthesized
cattcctcctccaaaagccc

SEQ ID NO: 58525 - DNA, 20 bp, Artificial Sequence
  chemically synthesized
actgcaatcccttctgcacc

SEQ ID NO: 58526 - DNA, 20 bp, Artificial Sequence
  chemically synthesized
caatcccttctgcacccagc

SEQ ID NO: 58527 - DNA, 20 bp, Artificial Sequence
  chemically synthesized
aatcccttctgcacccagcc

SEQ ID NO: 58528 - DNA, 20 bp, Artificial Sequence
  chemically synthesized
tcctatgacacacacctccc

SEQ ID NO: 58529 - DNA, 20 bp, Artificial Sequence
  chemically synthesized
acacacctccccagtgcaca

SEQ ID NO: 58530 - DNA, 20 bp, Artificial Sequence
  chemically synthesized
cacacagacctgcccaactg

SEQ ID NO: 58531 - DNA, 20 bp, Artificial Sequence
  chemically synthesized
acacagacctgcccaactgt

SEQ ID NO: 58532 - DNA, 20 bp, Artificial Sequence
  chemically synthesized
cacagacctgcccaactgtg

SEQ ID NO: 58533 - DNA, 20 bp, Artificial Sequence
  chemically synthesized
ccaactgtggggctgcccac

SEQ ID NO: 58534 - DNA, 20 bp, Artificial Sequence
  chemically synthesized
caactgtggggctgcccact

SEQ ID NO: 58535 - DNA, 20 bp, Artificial Sequence
  chemically synthesized
gctgcccactgggcatttca

SEQ ID NO: 58536 - DNA, 20 bp, Artificial Sequence
  chemically synthesized
ctgcccactgggcatttcat

SEQ ID NO: 58537 - DNA, 20 bp, Artificial Sequence
  chemically synthesized
cccactgggcatttcatagg

SEQ ID NO: 58538 - DNA, 20 bp, Artificial Sequence
  chemically synthesized
tgggcatttcataggtggct

SEQ ID NO: 58539 - DNA, 20 bp, Artificial Sequence
  chemically synthesized
gctcagtcctcttccctctg

SEQ ID NO: 58540 - DNA, 20 bp, Artificial Sequence
  chemically synthesized
agtcctcttccctctgcagc

SEQ ID NO: 58541 - DNA, 20 bp, Artificial Sequence
  chemically synthesized
cttccctctgcagctggccc

SEQ ID NO: 58542 - DNA, 20 bp, Artificial Sequence
  chemically synthesized
agctggccccagaaacctgc

SEQ ID NO: 58543 - DNA, 20 bp, Artificial Sequence
  chemically synthesized
cccagaaacctgccagttat

SEQ ID NO: 58544 - DNA, 20 bp, Artificial Sequence
  chemically synthesized
aacctgccagttattggtgc

SEQ ID NO: 58545 - DNA, 20 bp, Artificial Sequence
  chemically synthesized
acctgccagttattggtgcc

SEQ ID NO: 58546 - DNA, 20 bp, Artificial Sequence
  chemically synthesized
tattggtgccaggtctgtgc

SEQ ID NO: 58547 - DNA, 20 bp, Artificial Sequence
  chemically synthesized
attggtgccaggtctgtgcc

SEQ ID NO: 58548 - DNA, 20 bp, Artificial Sequence
  chemically synthesized
tggtgccaggtctgtgccag

SEQ ID NO: 58549 - DNA, 20 bp, Artificial Sequence
  chemically synthesized
ggtgccaggtctgtgccagg

SEQ ID NO: 58550 - DNA, 20 bp, Artificial Sequence
  chemically synthesized
gtgccaggtctgtgccagga

SEQ ID NO: 58551 - DNA, 20 bp, Artificial Sequence
  chemically synthesized
caggtctgtgccaggagggc

SEQ ID NO: 58552 - DNA, 20 bp, Artificial Sequence
  chemically synthesized
aggtctgtgccaggagggcg

SEQ ID NO: 58553 - DNA, 20 bp, Artificial Sequence
  chemically synthesized
agggcgaggcctgtcatttc

SEQ ID NO: 58554 - DNA, 20 bp, Artificial Sequence
  chemically synthesized
tgtcatttctagtaatcctc

SEQ ID NO: 58555 - DNA, 20 bp, Artificial Sequence
  chemically synthesized
gtcatttctagtaatcctct

SEQ ID NO: 58556 - DNA, 20 bp, Artificial Sequence
  chemically synthesized
atttctagtaatcctctggg

SEQ ID NO: 58557 - DNA, 20 bp, Artificial Sequence
  chemically synthesized
cagtgtgactgtacctcttg

SEQ ID NO: 58558 - DNA, 20 bp, Artificial Sequence
  chemically synthesized
gtacctcttgcggcaactca

SEQ ID NO: 58559 - DNA, 20 bp, Artificial Sequence
  chemically synthesized
tacctcttgcggcaactcaa

SEQ ID NO: 58560 - DNA, 20 bp, Artificial Sequence
  chemically synthesized
acctcttgcggcaactcaaa

SEQ ID NO: 58561 - DNA, 20 bp, Artificial Sequence
  chemically synthesized
ctcttgcggcaactcaaagg

SEQ ID NO: 58562 - DNA, 20 bp, Artificial Sequence
  chemically synthesized
cttgcggcaactcaaaggga

SEQ ID NO: 58563 - DNA, 20 bp, Artificial Sequence
  chemically synthesized
ttgcggcaactcaaagggag

SEQ ID NO: 58564 - DNA, 20 bp, Artificial Sequence
  chemically synthesized
tgcggcaactcaaagggaga

SEQ ID NO: 58565 - DNA, 20 bp, Artificial Sequence
  chemically synthesized
agggagagggtgacttgtcc

SEQ ID NO: 58566 - DNA, 20 bp, Artificial Sequence
  chemically synthesized
gggagagggtgacttgtccc

SEQ ID NO: 58567 - DNA, 20 bp, Artificial Sequence
  chemically synthesized
gggtgacttgtcccgggtca

SEQ ID NO: 58568 - DNA, 20 bp, Artificial Sequence
  chemically synthesized
gtgacttgtcccgggtcaca

SEQ ID NO: 58569 - DNA, 20 bp, Artificial Sequence
  chemically synthesized
gtcccgggtcacagagctga

SEQ ID NO: 58570 - DNA, 20 bp, Artificial Sequence
  chemically synthesized
tcccgggtcacagagctgaa

SEQ ID NO: 58571 - DNA, 20 bp, Artificial Sequence
  chemically synthesized
cccgggtcacagagctgaaa

SEQ ID NO: 58572 - DNA, 20 bp, Artificial Sequence
  chemically synthesized
gggtcacagagctgaaaggg

SEQ ID NO: 58573 - DNA, 20 bp, Artificial Sequence
  chemically synthesized
ggtcacagagctgaaagggc

SEQ ID NO: 58574 - DNA, 20 bp, Artificial Sequence
  chemically synthesized
agctgaaagggcaggtacaa

SEQ ID NO: 58575 - DNA, 20 bp, Artificial Sequence
  chemically synthesized
gctgaaagggcaggtacaac

SEQ ID NO: 58576 - DNA, 20 bp, Artificial Sequence
  chemically synthesized
aggtacaacaggtgacatgc

SEQ ID NO: 58577 - DNA, 20 bp, Artificial Sequence
  chemically synthesized
ggtacaacaggtgacatgcc

SEQ ID NO: 58578 - DNA, 20 bp, Artificial Sequence
  chemically synthesized
ggtgacatgccgggctgtct

SEQ ID NO: 58579 - DNA, 20 bp, Artificial Sequence
  chemically synthesized
gccgggctgtctgagtttat

SEQ ID NO: 58580 - DNA, 20 bp, Artificial Sequence
  chemically synthesized
ccgggctgtctgagtttatg

SEQ ID NO: 58581 - DNA, 20 bp, Artificial Sequence
  chemically synthesized
cgggctgtctgagtttatga

SEQ ID NO: 58582 - DNA, 20 bp, Artificial Sequence
  chemically synthesized
tgtctgagtttatgagggcc

SEQ ID NO: 58583 - DNA, 20 bp, Artificial Sequence
  chemically synthesized
gggcccagtcttgtgtctgc

SEQ ID NO: 58584 - DNA, 20 bp, Artificial Sequence
  chemically synthesized
ggcccagtcttgtgtctgcc

SEQ ID NO: 58585 - DNA, 20 bp, Artificial Sequence
  chemically synthesized
tcttgtgtctgccgggcaat

SEQ ID NO: 58586 - DNA, 20 bp, Artificial Sequence
  chemically synthesized
gtgtctgccgggcaatgagc

SEQ ID NO: 58587 - DNA, 20 bp, Artificial Sequence
  chemically synthesized
tgtctgccgggcaatgagca

SEQ ID NO: 58588 - DNA, 20 bp, Artificial Sequence
  chemically synthesized
agcaaggctccttcctgtcc

SEQ ID NO: 58589 - DNA, 20 bp, Artificial Sequence
  chemically synthesized
ccaagctccccgcccctccc

SEQ ID NO: 58590 - DNA, 20 bp, Artificial Sequence
  chemically synthesized
cagcctactgcctccacccg

SEQ ID NO: 58591 - DNA, 20 bp, Artificial Sequence
  chemically synthesized
tccacccgaagtctacttcc

SEQ ID NO: 58592 - DNA, 20 bp, Artificial Sequence
  chemically synthesized
ccacccgaagtctacttcct

SEQ ID NO: 58593 - DNA, 20 bp, Artificial Sequence
  chemically synthesized
cccgaagtctacttcctggg

SEQ ID NO: 58594 - DNA, 20 bp, Artificial Sequence
  chemically synthesized
ccgaagtctacttcctgggt

SEQ ID NO: 58595 - DNA, 20 bp, Artificial Sequence
  chemically synthesized
aagtctacttcctgggtggg

SEQ ID NO: 58596 - DNA, 20 bp, Artificial Sequence
  chemically synthesized
agtctacttcctgggtgggc

SEQ ID NO: 58597 - DNA, 20 bp, Artificial Sequence
  chemically synthesized
cttcctgggtgggcaggaac

SEQ ID NO: 58598 - DNA, 20 bp, Artificial Sequence
  chemically synthesized
ttcctgggtgggcaggaact

SEQ ID NO: 58599 - DNA, 20 bp, Artificial Sequence
  chemically synthesized
caggaactgggcactgtgcc

SEQ ID NO: 58600 - DNA, 20 bp, Artificial Sequence
  chemically synthesized
aggaactgggcactgtgccc

SEQ ID NO: 58601 - DNA, 20 bp, Artificial Sequence
  chemically synthesized
ggaactgggcactgtgccca

SEQ ID NO: 58602 - DNA, 20 bp, Artificial Sequence
  chemically synthesized
gggcatgcactgcctccacg

SEQ ID NO: 58603 - DNA, 20 bp, Artificial Sequence
  chemically synthesized
tgcctccacgcagcaaccct

SEQ ID NO: 58604 - DNA, 20 bp, Artificial Sequence
  chemically synthesized
cctccacgcagcaaccctca

SEQ ID NO: 58605 - DNA, 20 bp, Artificial Sequence
  chemically synthesized
gcagcaaccctcagagtcct

SEQ ID NO: 58606 - DNA, 20 bp, Artificial Sequence
  chemically synthesized
tcagagtcctgagctgaacc

SEQ ID NO: 58607 - DNA, 20 bp, Artificial Sequence
  chemically synthesized
gagtcctgagctgaaccaag

SEQ ID NO: 58608 - DNA, 20 bp, Artificial Sequence
  chemically synthesized
agtcctgagctgaaccaaga

SEQ ID NO: 58609 - DNA, 20 bp, Artificial Sequence
  chemically synthesized
tcctgagctgaaccaagaag

SEQ ID NO: 58610 - DNA, 20 bp, Artificial Sequence
  chemically synthesized
cctgagctgaaccaagaagg

SEQ ID NO: 58611 - DNA, 20 bp, Artificial Sequence
  chemically synthesized
tgagctgaaccaagaaggag

SEQ ID NO: 58612 - DNA, 20 bp, Artificial Sequence
  chemically synthesized
gagctgaaccaagaaggagg

SEQ ID NO: 58613 - DNA, 20 bp, Artificial Sequence
  chemically synthesized
agctgaaccaagaaggagga

SEQ ID NO: 58614 - DNA, 20 bp, Artificial Sequence
  chemically synthesized
gctgaaccaagaaggaggag

SEQ ID NO: 58615 - DNA, 20 bp, Artificial Sequence
  chemically synthesized
ctgaaccaagaaggaggagg

SEQ ID NO: 58616 - DNA, 20 bp, Artificial Sequence
  chemically synthesized
accaagaaggaggagggggt

SEQ ID NO: 58617 - DNA, 20 bp, Artificial Sequence
  chemically synthesized
ccaagaaggaggagggggtc

SEQ ID NO: 58618 - DNA, 20 bp, Artificial Sequence
  chemically synthesized
gaggagggggtcgggcctcc

SEQ ID NO: 58619 - DNA, 20 bp, Artificial Sequence
  chemically synthesized
aggagggggtcgggcctccg

SEQ ID NO: 58620 - DNA, 20 bp, Artificial Sequence
  chemically synthesized
agggggtcgggcctccgagg

SEQ ID NO: 58621 - DNA, 20 bp, Artificial Sequence
  chemically synthesized
gggggtcgggcctccgagga

SEQ ID NO: 58622 - DNA, 20 bp, Artificial Sequence
  chemically synthesized
tcgggcctccgaggaaggcc

SEQ ID NO: 58623 - DNA, 20 bp, Artificial Sequence
  chemically synthesized
ggcctagccgctgctgctgc

SEQ ID NO: 58624 - DNA, 20 bp, Artificial Sequence
  chemically synthesized
gcctagccgctgctgctgcc

SEQ ID NO: 58625 - DNA, 20 bp, Artificial Sequence
  chemically synthesized
gctgctgctgccaggaattc

SEQ ID NO: 58626 - DNA, 20 bp, Artificial Sequence
  chemically synthesized
ctgctgctgccaggaattcc

SEQ ID NO: 58627 - DNA, 20 bp, Artificial Sequence
  chemically synthesized
tgctgccaggaattccaggt

SEQ ID NO: 58628 - DNA, 20 bp, Artificial Sequence
  chemically synthesized
ctgccaggaattccaggttg

SEQ ID NO: 58629 - DNA, 20 bp, Artificial Sequence
  chemically synthesized
tgccaggaattccaggttgg

SEQ ID NO: 58630 - DNA, 20 bp, Artificial Sequence
  chemically synthesized
gccaggaattccaggttgga

SEQ ID NO: 58631 - DNA, 20 bp, Artificial Sequence
  chemically synthesized
ccaggaattccaggttggag

SEQ ID NO: 58632 - DNA, 20 bp, Artificial Sequence
  chemically synthesized
ggaattccaggttggagggg

SEQ ID NO: 58633 - DNA, 20 bp, Artificial Sequence
  chemically synthesized
gaggggcggcaacctcctgc

SEQ ID NO: 58634 - DNA, 20 bp, Artificial Sequence
  chemically synthesized
ggcaacctcctgccagcctt

SEQ ID NO: 58635 - DNA, 20 bp, Artificial Sequence
  chemically synthesized
gcaacctcctgccagccttc

SEQ ID NO: 58636 - DNA, 20 bp, Artificial Sequence
  chemically synthesized
ggccactctcctgtgcctgc

SEQ ID NO: 58637 - DNA, 20 bp, Artificial Sequence
  chemically synthesized
cactctcctgtgcctgccag

SEQ ID NO: 58638 - DNA, 20 bp, Artificial Sequence
  chemically synthesized
ctctcctgtgcctgccagaa

SEQ ID NO: 58639 - DNA, 20 bp, Artificial Sequence
  chemically synthesized
cctgtgcctgccagaagaga

SEQ ID NO: 58640 - DNA, 20 bp, Artificial Sequence
  chemically synthesized
tgtgcctgccagaagagaca

SEQ ID NO: 58641 - DNA, 20 bp, Artificial Sequence
  chemically synthesized
tgccagaagagacagagctt

SEQ ID NO: 58642 - DNA, 20 bp, Artificial Sequence
  chemically synthesized
gccagaagagacagagcttg

SEQ ID NO: 58643 - DNA, 20 bp, Artificial Sequence
  chemically synthesized
cagaagagacagagcttgag

SEQ ID NO: 58644 - DNA, 20 bp, Artificial Sequence
  chemically synthesized
gaagagacagagcttgagga

SEQ ID NO: 58645 - DNA, 20 bp, Artificial Sequence
  chemically synthesized
acagagcttgaggagagctt

SEQ ID NO: 58646 - DNA, 20 bp, Artificial Sequence
  chemically synthesized
cagagcttgaggagagcttg

SEQ ID NO: 58647 - DNA, 20 bp, Artificial Sequence
  chemically synthesized
gagcttgaggagagcttgag

SEQ ID NO: 58648 - DNA, 20 bp, Artificial Sequence
  chemically synthesized
gcttgaggagagcttgagga

SEQ ID NO: 58649 - DNA, 20 bp, Artificial Sequence
  chemically synthesized
tgaggagagcttgaggagag

SEQ ID NO: 58650 - DNA, 20 bp, Artificial Sequence
  chemically synthesized
gaggagagcttgaggagagc

SEQ ID NO: 58651 - DNA, 20 bp, Artificial Sequence
  chemically synthesized
agagcttgaggagagcagga

SEQ ID NO: 58652 - DNA, 20 bp, Artificial Sequence
  chemically synthesized
gagcttgaggagagcaggaa

SEQ ID NO: 58653 - DNA, 20 bp, Artificial Sequence
  chemically synthesized
cttgaggagagcaggaaagg

SEQ ID NO: 58654 - DNA, 20 bp, Artificial Sequence
  chemically synthesized
ttgaggagagcaggaaaggt

SEQ ID NO: 58655 - DNA, 20 bp, Artificial Sequence
  chemically synthesized
cattgctgctgctgctcact

SEQ ID NO: 58656 - DNA, 20 bp, Artificial Sequence
  chemically synthesized
ctgctgctcactcagttcca

SEQ ID NO: 58657 - DNA, 20 bp, Artificial Sequence
  chemically synthesized
tgctgctcactcagttccac

SEQ ID NO: 58658 - DNA, 20 bp, Artificial Sequence
  chemically synthesized
tgctcactcagttccacagg

SEQ ID NO: 58659 - DNA, 20 bp, Artificial Sequence
  chemically synthesized
gctcactcagttccacaggt

SEQ ID NO: 58660 - DNA, 20 bp, Artificial Sequence
  chemically synthesized
tcactcagttccacaggtgg

SEQ ID NO: 58661 - DNA, 20 bp, Artificial Sequence
  chemically synthesized
cactcagttccacaggtggg

SEQ ID NO: 58662 - DNA, 20 bp, Artificial Sequence
  chemically synthesized
actcagttccacaggtggga

SEQ ID NO: 58663 - DNA, 20 bp, Artificial Sequence
  chemically synthesized
agttccacaggtgggaggga

SEQ ID NO: 58664 - DNA, 20 bp, Artificial Sequence
  chemically synthesized
tccacaggtgggagggacag

SEQ ID NO: 58665 - DNA, 20 bp, Artificial Sequence
  chemically synthesized
ccacaggtgggagggacagc

SEQ ID NO: 58666 - DNA, 20 bp, Artificial Sequence
  chemically synthesized
cacaggtgggagggacagca

SEQ ID NO: 58667 - DNA, 20 bp, Artificial Sequence
  chemically synthesized
gtgggagggacagcagggct

SEQ ID NO: 58668 - DNA, 20 bp, Artificial Sequence
  chemically synthesized
gggagggacagcagggctta

SEQ ID NO: 58669 - DNA, 20 bp, Artificial Sequence
  chemically synthesized
agggacagcagggcttagag

SEQ ID NO: 58670 - DNA, 20 bp, Artificial Sequence
  chemically synthesized
gggacagcagggcttagagt

SEQ ID NO: 58671 - DNA, 20 bp, Artificial Sequence
  chemically synthesized
ggacagcagggcttagagtg

SEQ ID NO: 58672 - DNA, 20 bp, Artificial Sequence
  chemically synthesized
gacagcagggcttagagtgg

SEQ ID NO: 58673 - DNA, 20 bp, Artificial Sequence
  chemically synthesized
ttagagtgggggtcattgtg

SEQ ID NO: 58674 - DNA, 20 bp, Artificial Sequence
  chemically synthesized
agtgggggtcattgtgcaga

SEQ ID NO: 58675 - DNA, 20 bp, Artificial Sequence
  chemically synthesized
gtgggggtcattgtgcagat

SEQ ID NO: 58676 - DNA, 20 bp, Artificial Sequence
  chemically synthesized
attgtgcagatgggaaaaca

SEQ ID NO: 58677 - DNA, 20 bp, Artificial Sequence
  chemically synthesized
ttgtgcagatgggaaaacaa

SEQ ID NO: 58678 - DNA, 20 bp, Artificial Sequence
  chemically synthesized
cagatgggaaaacaaaggcc

SEQ ID NO: 58679 - DNA, 20 bp, Artificial Sequence
  chemically synthesized
gatgggaaaacaaaggccca

SEQ ID NO: 58680 - DNA, 20 bp, Artificial Sequence
  chemically synthesized
tgggaaaacaaaggcccaga

SEQ ID NO: 58681 - DNA, 20 bp, Artificial Sequence
  chemically synthesized
gggaaaacaaaggcccagag

SEQ ID NO: 58682 - DNA, 20 bp, Artificial Sequence
  chemically synthesized
ggaaaacaaaggcccagaga

SEQ ID NO: 58683 - DNA, 20 bp, Artificial Sequence
  chemically synthesized
gaaaacaaaggcccagagag

SEQ ID NO: 58684 - DNA, 20 bp, Artificial Sequence
  chemically synthesized
aacaaaggcccagagagggg

SEQ ID NO: 58685 - DNA, 20 bp, Artificial Sequence
  chemically synthesized
cagagaggggaagaaatgcc

SEQ ID NO: 58686 - DNA, 20 bp, Artificial Sequence
  chemically synthesized
agagaggggaagaaatgccc

SEQ ID NO: 58687 - DNA, 20 bp, Artificial Sequence
  chemically synthesized
agaggggaagaaatgcccag

SEQ ID NO: 58688 - DNA, 20 bp, Artificial Sequence
  chemically synthesized
agaaatgcccaggagctacc

SEQ ID NO: 58689 - DNA, 20 bp, Artificial Sequence
  chemically synthesized
gaaatgcccaggagctaccg

SEQ ID NO: 58690 - DNA, 20 bp, Artificial Sequence
  chemically synthesized
aaatgcccaggagctaccga

SEQ ID NO: 58691 - DNA, 20 bp, Artificial Sequence
  chemically synthesized
tgcccaggagctaccgaggg

SEQ ID NO: 58692 - DNA, 20 bp, Artificial Sequence
  chemically synthesized
gcccaggagctaccgagggc

SEQ ID NO: 58693 - DNA, 20 bp, Artificial Sequence
  chemically synthesized
agggcaggcgacctcaacca

SEQ ID NO: 58694 - DNA, 20 bp, Artificial Sequence
  chemically synthesized
aggcgacctcaaccacagcc

SEQ ID NO: 58695 - DNA, 20 bp, Artificial Sequence
  chemically synthesized
cctcaaccacagcccagtgc

SEQ ID NO: 58696 - DNA, 20 bp, Artificial Sequence
  chemically synthesized
tcaaccacagcccagtgctg

SEQ ID NO: 58697 - DNA, 20 bp, Artificial Sequence
  chemically synthesized
cagcccagtgctggagctgt

SEQ ID NO: 58698 - DNA, 20 bp, Artificial Sequence
  chemically synthesized
cccagtgctggagctgtgag

SEQ ID NO: 58699 - DNA, 20 bp, Artificial Sequence
  chemically synthesized
gctggagctgtgagtggatg

SEQ ID NO: 58700 - DNA, 20 bp, Artificial Sequence
  chemically synthesized
tggagctgtgagtggatgta

SEQ ID NO: 58701 - DNA, 20 bp, Artificial Sequence
  chemically synthesized
agctgtgagtggatgtagag

SEQ ID NO: 58702 - DNA, 20 bp, Artificial Sequence
  chemically synthesized
tgtgagtggatgtagagcag

SEQ ID NO: 58703 - DNA, 20 bp, Artificial Sequence
  chemically synthesized
agagcagcggaatatccatt

SEQ ID NO: 58704 - DNA, 20 bp, Artificial Sequence
  chemically synthesized
cagcggaatatccattcagc

SEQ ID NO: 58705 - DNA, 20 bp, Artificial Sequence
  chemically synthesized
gaatatccattcagccagct

SEQ ID NO: 58706 - DNA, 20 bp, Artificial Sequence
  chemically synthesized
aatatccattcagccagctc

SEQ ID NO: 58707 - DNA, 20 bp, Artificial Sequence
  chemically synthesized
atatccattcagccagctca

SEQ ID NO: 58708 - DNA, 20 bp, Artificial Sequence
  chemically synthesized
tatccattcagccagctcag

SEQ ID NO: 58709 - DNA, 20 bp, Artificial Sequence
  chemically synthesized
ccattcagccagctcagggg

SEQ ID NO: 58710 - DNA, 20 bp, Artificial Sequence
  chemically synthesized
cattcagccagctcagggga

SEQ ID NO: 58711 - DNA, 20 bp, Artificial Sequence
  chemically synthesized
cagccagctcaggggaagga

SEQ ID NO: 58712 - DNA, 20 bp, Artificial Sequence
  chemically synthesized
agccagctcaggggaaggac

SEQ ID NO: 58713 - DNA, 20 bp, Artificial Sequence
  chemically synthesized
gccagctcaggggaaggaca

SEQ ID NO: 58714 - DNA, 20 bp, Artificial Sequence
  chemically synthesized
ccagctcaggggaaggacag

SEQ ID NO: 58715 - DNA, 20 bp, Artificial Sequence
  chemically synthesized
ggggaaggacaggggccctg

SEQ ID NO: 58716 - DNA, 20 bp, Artificial Sequence
  chemically synthesized
aaggacaggggccctgaagc

SEQ ID NO: 58717 - DNA, 20 bp, Artificial Sequence
  chemically synthesized
aggacaggggccctgaagcc

SEQ ID NO: 58718 - DNA, 20 bp, Artificial Sequence
  chemically synthesized
ggacaggggccctgaagcca

SEQ ID NO: 58719 - DNA, 20 bp, Artificial Sequence
  chemically synthesized
gacaggggccctgaagccag

SEQ ID NO: 58720 - DNA, 20 bp, Artificial Sequence
  chemically synthesized
ggggccctgaagccagggga

SEQ ID NO: 58721 - DNA, 20 bp, Artificial Sequence
  chemically synthesized
ggccctgaagccaggggatg

SEQ ID NO: 58722 - DNA, 20 bp, Artificial Sequence
  chemically synthesized
gaagccaggggatggagctg

SEQ ID NO: 58723 - DNA, 20 bp, Artificial Sequence
  chemically synthesized
aagccaggggatggagctgc

SEQ ID NO: 58724 - DNA, 20 bp, Artificial Sequence
  chemically synthesized
agccaggggatggagctgca

SEQ ID NO: 58725 - DNA, 20 bp, Artificial Sequence
  chemically synthesized
caggggatggagctgcaggg

SEQ ID NO: 58726 - DNA, 20 bp, Artificial Sequence
  chemically synthesized
aggggatggagctgcaggga

SEQ ID NO: 58727 - DNA, 20 bp, Artificial Sequence
  chemically synthesized
ggggatggagctgcagggaa

SEQ ID NO: 58728 - DNA, 20 bp, Artificial Sequence
  chemically synthesized
ggatggagctgcagggaagg

SEQ ID NO: 58729 - DNA, 20 bp, Artificial Sequence
  chemically synthesized
gagctgcagggaagggagct

SEQ ID NO: 58730 - DNA, 20 bp, Artificial Sequence
  chemically synthesized
gctgcagggaagggagctca

SEQ ID NO: 58731 - DNA, 20 bp, Artificial Sequence
  chemically synthesized
tgcagggaagggagctcaga

SEQ ID NO: 58732 - DNA, 20 bp, Artificial Sequence
  chemically synthesized
agggaagggagctcagagag

SEQ ID NO: 58733 - DNA, 20 bp, Artificial Sequence
  chemically synthesized
gggaagggagctcagagaga

SEQ ID NO: 58734 - DNA, 20 bp, Artificial Sequence
  chemically synthesized
ggaagggagctcagagagaa

SEQ ID NO: 58735 - DNA, 20 bp, Artificial Sequence
  chemically synthesized
gaagggagctcagagagaag

SEQ ID NO: 58736 - DNA, 20 bp, Artificial Sequence
  chemically synthesized
agggagctcagagagaaggg

SEQ ID NO: 58737 - DNA, 20 bp, Artificial Sequence
  chemically synthesized
gggagctcagagagaagggg

SEQ ID NO: 58738 - DNA, 20 bp, Artificial Sequence
  chemically synthesized
ggagctcagagagaagggga

SEQ ID NO: 58739 - DNA, 20 bp, Artificial Sequence
  chemically synthesized
gagctcagagagaaggggag

SEQ ID NO: 58740 - DNA, 20 bp, Artificial Sequence
  chemically synthesized
gctcagagagaaggggaggg

SEQ ID NO: 58741 - DNA, 20 bp, Artificial Sequence
  chemically synthesized
agagaaggggaggggagtct

SEQ ID NO: 58742 - DNA, 20 bp, Artificial Sequence
  chemically synthesized
aggggaggggagtctgagct

SEQ ID NO: 58743 - DNA, 20 bp, Artificial Sequence
  chemically synthesized
ctcagtttcccgctgcctga

SEQ ID NO: 58744 - DNA, 20 bp, Artificial Sequence
  chemically synthesized
tcagtttcccgctgcctgaa

SEQ ID NO: 58745 - DNA, 20 bp, Artificial Sequence
  chemically synthesized
agtttcccgctgcctgaaag

SEQ ID NO: 58746 - DNA, 20 bp, Artificial Sequence
  chemically synthesized
gtttcccgctgcctgaaagg

SEQ ID NO: 58747 - DNA, 20 bp, Artificial Sequence
  chemically synthesized
tttcccgctgcctgaaagga

SEQ ID NO: 58748 - DNA, 20 bp, Artificial Sequence
  chemically synthesized
cccgctgcctgaaaggaggg

SEQ ID NO: 58749 - DNA, 20 bp, Artificial Sequence
  chemically synthesized
ggtggtacctactcccttca

SEQ ID NO: 58750 - DNA, 20 bp, Artificial Sequence
  chemically synthesized
gtggtacctactcccttcac

SEQ ID NO: 58751 - DNA, 20 bp, Artificial Sequence
  chemically synthesized
tggtacctactcccttcaca

SEQ ID NO: 58752 - DNA, 20 bp, Artificial Sequence
  chemically synthesized
ccttcacagggtaactgaat

SEQ ID NO: 58753 - DNA, 20 bp, Artificial Sequence
  chemically synthesized
ttcacagggtaactgaatga

SEQ ID NO: 58754 - DNA, 20 bp, Artificial Sequence
  chemically synthesized
taactgaatgagagactgcc

SEQ ID NO: 58755 - DNA, 20 bp, Artificial Sequence
  chemically synthesized
actgaatgagagactgcctg

SEQ ID NO: 58756 - DNA, 20 bp, Artificial Sequence
  chemically synthesized
ctgaatgagagactgcctgg

SEQ ID NO: 58757 - DNA, 20 bp, Artificial Sequence
  chemically synthesized
atgagagactgcctggagga

SEQ ID NO: 58758 - DNA, 20 bp, Artificial Sequence
  chemically synthesized
tgcctggaggaaagctcttc

SEQ ID NO: 58759 - DNA, 20 bp, Artificial Sequence
  chemically synthesized
ggaggaaagctcttcaagtg

SEQ ID NO: 58760 - DNA, 20 bp, Artificial Sequence
  chemically synthesized
aagtgtggcccaccccaccc

SEQ ID NO: 58761 - DNA, 20 bp, Artificial Sequence
  chemically synthesized
ccaccccaccccagtgacac

SEQ ID NO: 58762 - DNA, 20 bp, Artificial Sequence
  chemically synthesized
agtgacaccagcccctgaca

SEQ ID NO: 58763 - DNA, 20 bp, Artificial Sequence
  chemically synthesized
gtgacaccagcccctgacac

SEQ ID NO: 58764 - DNA, 20 bp, Artificial Sequence
  chemically synthesized
tgacaccagcccctgacacg

SEQ ID NO: 58765 - DNA, 20 bp, Artificial Sequence
  chemically synthesized
gacaccagcccctgacacgg

SEQ ID NO: 58766 - DNA, 20 bp, Artificial Sequence
  chemically synthesized
caccagcccctgacacgggg

SEQ ID NO: 58767 - DNA, 20 bp, Artificial Sequence
  chemically synthesized
accagcccctgacacggggg

SEQ ID NO: 58768 - DNA, 20 bp, Artificial Sequence
  chemically synthesized
ccagcccctgacacggggga

SEQ ID NO: 58769 - DNA, 20 bp, Artificial Sequence
  chemically synthesized
agcccctgacacgggggagg

SEQ ID NO: 58770 - DNA, 20 bp, Artificial Sequence
  chemically synthesized
gcccctgacacgggggaggg

SEQ ID NO: 58771 - DNA, 20 bp, Artificial Sequence
  chemically synthesized
cccctgacacgggggaggga

SEQ ID NO: 58772 - DNA, 20 bp, Artificial Sequence
  chemically synthesized
ctgacacgggggagggaggg

SEQ ID NO: 58773 - DNA, 20 bp, Artificial Sequence
  chemically synthesized
cgggggagggagggcagcat

SEQ ID NO: 58774 - DNA, 20 bp, Artificial Sequence
  chemically synthesized
gggggagggagggcagcatc

SEQ ID NO: 58775 - DNA, 20 bp, Artificial Sequence
  chemically synthesized
gggagggagggcagcatcag

SEQ ID NO: 58776 - DNA, 20 bp, Artificial Sequence
  chemically synthesized
ggagggagggcagcatcagg

SEQ ID NO: 58777 - DNA, 20 bp, Artificial Sequence
  chemically synthesized
gagggagggcagcatcagga

SEQ ID NO: 58778 - DNA, 20 bp, Artificial Sequence
  chemically synthesized
agggagggcagcatcaggag

SEQ ID NO: 58779 - DNA, 20 bp, Artificial Sequence
  chemically synthesized
cagcatcaggaggggctttc

SEQ ID NO: 58780 - DNA, 20 bp, Artificial Sequence
  chemically synthesized
agcatcaggaggggctttct

SEQ ID NO: 58781 - DNA, 20 bp, Artificial Sequence
  chemically synthesized
aggggctttctgggcacacc

SEQ ID NO: 58782 - DNA, 20 bp, Artificial Sequence
  chemically synthesized
cacacccagtacccgtctct

SEQ ID NO: 58783 - DNA, 20 bp, Artificial Sequence
  chemically synthesized
ctgttgcattttaatcctca

SEQ ID NO: 58784 - DNA, 20 bp, Artificial Sequence
  chemically synthesized
ttgcattttaatcctcacag

SEQ ID NO: 58785 - DNA, 20 bp, Artificial Sequence
  chemically synthesized
aatcctcacagcagctcaac

SEQ ID NO: 58786 - DNA, 20 bp, Artificial Sequence
  chemically synthesized
atcctcacagcagctcaaca

SEQ ID NO: 58787 - DNA, 20 bp, Artificial Sequence
  chemically synthesized
ccgtcaccatccccatttta

SEQ ID NO: 58788 - DNA, 20 bp, Artificial Sequence
  chemically synthesized
caccatccccattttacaga

SEQ ID NO: 58789 - DNA, 20 bp, Artificial Sequence
  chemically synthesized
accatccccattttacagat

SEQ ID NO: 58790 - DNA, 20 bp, Artificial Sequence
  chemically synthesized
ccatccccattttacagata

SEQ ID NO: 58791 - DNA, 20 bp, Artificial Sequence
  chemically synthesized
attttacagatagggaaatt

SEQ ID NO: 58792 - DNA, 20 bp, Artificial Sequence
  chemically synthesized
ttttacagatagggaaattg

SEQ ID NO: 58793 - DNA, 20 bp, Artificial Sequence
  chemically synthesized
cagatagggaaattgaggct

SEQ ID NO: 58794 - DNA, 20 bp, Artificial Sequence
  chemically synthesized
gatagggaaattgaggctcg

SEQ ID NO: 58795 - DNA, 20 bp, Artificial Sequence
  chemically synthesized
agggaaattgaggctcggag

SEQ ID NO: 58796 - DNA, 20 bp, Artificial Sequence
  chemically synthesized
agcggttaaacaactcacct

SEQ ID NO: 58797 - DNA, 20 bp, Artificial Sequence
  chemically synthesized
gcggttaaacaactcacctg

SEQ ID NO: 58798 - DNA, 20 bp, Artificial Sequence
  chemically synthesized
acaactcacctgaggcctca

SEQ ID NO: 58799 - DNA, 20 bp, Artificial Sequence
  chemically synthesized
ctcacctgaggcctcacagc

SEQ ID NO: 58800 - DNA, 20 bp, Artificial Sequence
  chemically synthesized
cctgaggcctcacagccagt

SEQ ID NO: 58801 - DNA, 20 bp, Artificial Sequence
  chemically synthesized
gaggcctcacagccagtaag

SEQ ID NO: 58802 - DNA, 20 bp, Artificial Sequence
  chemically synthesized
aggcctcacagccagtaagt

SEQ ID NO: 58803 - DNA, 20 bp, Artificial Sequence
  chemically synthesized
cagccagtaagtgggttccc

SEQ ID NO: 58804 - DNA, 20 bp, Artificial Sequence
  chemically synthesized
cctggtctgaatgtgtgtgc

SEQ ID NO: 58805 - DNA, 20 bp, Artificial Sequence
  chemically synthesized
tggtctgaatgtgtgtgctg

SEQ ID NO: 58806 - DNA, 20 bp, Artificial Sequence
  chemically synthesized
ggtctgaatgtgtgtgctgg

SEQ ID NO: 58807 - DNA, 20 bp, Artificial Sequence
  chemically synthesized
gtgtgtgctggaggatcctg

SEQ ID NO: 58808 - DNA, 20 bp, Artificial Sequence
  chemically synthesized
tgtgtgctggaggatcctgt

SEQ ID NO: 58809 - DNA, 20 bp, Artificial Sequence
  chemically synthesized
gatcctgtgggtcactcgcc

SEQ ID NO: 58810 - DNA, 20 bp, Artificial Sequence
  chemically synthesized
cctgtgggtcactcgcctgg

SEQ ID NO: 58811 - DNA, 20 bp, Artificial Sequence
  chemically synthesized
tgtgggtcactcgcctggta

SEQ ID NO: 58812 - DNA, 20 bp, Artificial Sequence
  chemically synthesized
cactcgcctggtagagcccc

SEQ ID NO: 58813 - DNA, 20 bp, Artificial Sequence
  chemically synthesized
actcgcctggtagagcccca

SEQ ID NO: 58814 - DNA, 20 bp, Artificial Sequence
  chemically synthesized
cgcctggtagagccccaagg

SEQ ID NO: 58815 - DNA, 20 bp, Artificial Sequence
  chemically synthesized
cctggtagagccccaaggtg

SEQ ID NO: 58816 - DNA, 20 bp, Artificial Sequence
  chemically synthesized
ctggtagagccccaaggtgg

SEQ ID NO: 58817 - DNA, 20 bp, Artificial Sequence
  chemically synthesized
ccccaaggtggaggcataaa

SEQ ID NO: 58818 - DNA, 20 bp, Artificial Sequence
  chemically synthesized
cccaaggtggaggcataaat

SEQ ID NO: 58819 - DNA, 20 bp, Artificial Sequence
  chemically synthesized
ggtggaggcataaatgggac

SEQ ID NO: 58820 - DNA, 20 bp, Artificial Sequence
  chemically synthesized
taaatgggactggtgaatga

SEQ ID NO: 58821 - DNA, 20 bp, Artificial Sequence
  chemically synthesized
atgggactggtgaatgacag

SEQ ID NO: 58822 - DNA, 20 bp, Artificial Sequence
  chemically synthesized
tgggactggtgaatgacaga

SEQ ID NO: 58823 - DNA, 20 bp, Artificial Sequence
  chemically synthesized
gggactggtgaatgacagaa

SEQ ID NO: 58824 - DNA, 20 bp, Artificial Sequence
  chemically synthesized
ggactggtgaatgacagaag

SEQ ID NO: 58825 - DNA, 20 bp, Artificial Sequence
  chemically synthesized
cactcatccattcactctgc

SEQ ID NO: 58826 - DNA, 20 bp, Artificial Sequence
  chemically synthesized
attcactctgcaagtatcta

SEQ ID NO: 58827 - DNA, 20 bp, Artificial Sequence
  chemically synthesized
agtatctacggcacgtacgc

SEQ ID NO: 58828 - DNA, 20 bp, Artificial Sequence
  chemically synthesized
cggcacgtacgccagctccc

SEQ ID NO: 58829 - DNA, 20 bp, Artificial Sequence
  chemically synthesized
cacgtacgccagctcccaag

SEQ ID NO: 58830 - DNA, 20 bp, Artificial Sequence
  chemically synthesized
acgtacgccagctcccaagc

SEQ ID NO: 58831 - DNA, 20 bp, Artificial Sequence
  chemically synthesized
ccagctcccaagcaggtttg

SEQ ID NO: 58832 - DNA, 20 bp, Artificial Sequence
  chemically synthesized
cagctcccaagcaggtttgc

SEQ ID NO: 58833 - DNA, 20 bp, Artificial Sequence
  chemically synthesized
aagcaggtttgcgggttgca

SEQ ID NO: 58834 - DNA, 20 bp, Artificial Sequence
  chemically synthesized
caggtttgcgggttgcacag

SEQ ID NO: 58835 - DNA, 20 bp, Artificial Sequence
  chemically synthesized
aggtttgcgggttgcacagc

SEQ ID NO: 58836 - DNA, 20 bp, Artificial Sequence
  chemically synthesized
gcgggcgatgcaatctgatt

SEQ ID NO: 58837 - DNA, 20 bp, Artificial Sequence
  chemically synthesized
cgggcgatgcaatctgattt

SEQ ID NO: 58838 - DNA, 20 bp, Artificial Sequence
  chemically synthesized
caatctgatttaggctttta

SEQ ID NO: 58839 - DNA, 20 bp, Artificial Sequence
  chemically synthesized
aatctgatttaggcttttaa

SEQ ID NO: 58840 - DNA, 20 bp, Artificial Sequence
  chemically synthesized
atctgatttaggcttttaaa

SEQ ID NO: 58841 - DNA, 20 bp, Artificial Sequence
  chemically synthesized
cttttaaagggattgcaatc

SEQ ID NO: 58842 - DNA, 20 bp, Artificial Sequence
  chemically synthesized
ttaaagggattgcaatcaag

SEQ ID NO: 58843 - DNA, 20 bp, Artificial Sequence
  chemically synthesized
taaagggattgcaatcaagt

SEQ ID NO: 58844 - DNA, 20 bp, Artificial Sequence
  chemically synthesized
aaagggattgcaatcaagtg

SEQ ID NO: 58845 - DNA, 20 bp, Artificial Sequence
  chemically synthesized
gcaatcaagtggggccccac

SEQ ID NO: 58846 - DNA, 20 bp, Artificial Sequence
  chemically synthesized
cctcccctcccctccacccc

SEQ ID NO: 58847 - DNA, 20 bp, Artificial Sequence
  chemically synthesized
cccctcccctccacccccag

SEQ ID NO: 58848 - DNA, 20 bp, Artificial Sequence
  chemically synthesized
tccacccccagcagtctcca

SEQ ID NO: 58849 - DNA, 20 bp, Artificial Sequence
  chemically synthesized
ccacccccagcagtctccaa

SEQ ID NO: 58850 - DNA, 20 bp, Artificial Sequence
  chemically synthesized
ccaaaggcctccaacaaccc

SEQ ID NO: 58851 - DNA, 20 bp, Artificial Sequence
  chemically synthesized
aaaggcctccaacaacccca

SEQ ID NO: 58852 - DNA, 20 bp, Artificial Sequence
  chemically synthesized
ggcctccaacaaccccagag

SEQ ID NO: 58853 - DNA, 20 bp, Artificial Sequence
  chemically synthesized
gcctccaacaaccccagagt

SEQ ID NO: 58854 - DNA, 20 bp, Artificial Sequence
  chemically synthesized
cctccaacaaccccagagtg

SEQ ID NO: 58855 - DNA, 20 bp, Artificial Sequence
  chemically synthesized
ctccaacaaccccagagtgg

SEQ ID NO: 58856 - DNA, 20 bp, Artificial Sequence
  chemically synthesized
gagtgggggccatgtatcca

SEQ ID NO: 58857 - DNA, 20 bp, Artificial Sequence
  chemically synthesized
catgtatccaaagaaactcc

SEQ ID NO: 58858 - DNA, 20 bp, Artificial Sequence
  chemically synthesized
aagaaactccaagctgtata

SEQ ID NO: 58859 - DNA, 20 bp, Artificial Sequence
  chemically synthesized
aagctgtatacggatcacac

SEQ ID NO: 58860 - DNA, 20 bp, Artificial Sequence
  chemically synthesized
tacggatcacactggttttc

SEQ ID NO: 58861 - DNA, 20 bp, Artificial Sequence
  chemically synthesized
acggatcacactggttttcc

SEQ ID NO: 58862 - DNA, 20 bp, Artificial Sequence
  chemically synthesized
ggatcacactggttttccag

SEQ ID NO: 58863 - DNA, 20 bp, Artificial Sequence
  chemically synthesized
tggttttccaggagcaaaaa

SEQ ID NO: 58864 - DNA, 20 bp, Artificial Sequence
  chemically synthesized
tccaggagcaaaaacagaaa

SEQ ID NO: 58865 - DNA, 20 bp, Artificial Sequence
  chemically synthesized
ccaggagcaaaaacagaaac

SEQ ID NO: 58866 - DNA, 20 bp, Artificial Sequence
  chemically synthesized
gcaaaaacagaaacaggcct

SEQ ID NO: 58867 - DNA, 20 bp, Artificial Sequence
  chemically synthesized
caaaaacagaaacaggcctg

SEQ ID NO: 58868 - DNA, 20 bp, Artificial Sequence
  chemically synthesized
aacagaaacaggcctgaggc

SEQ ID NO: 58869 - DNA, 20 bp, Artificial Sequence
  chemically synthesized
attgaacctcctcctgctct

SEQ ID NO: 58870 - DNA, 20 bp, Artificial Sequence
  chemically synthesized
gaacctcctcctgctctgag

SEQ ID NO: 58871 - DNA, 20 bp, Artificial Sequence
  chemically synthesized
tcctcctgctctgagcagcc

SEQ ID NO: 58872 - DNA, 20 bp, Artificial Sequence
  chemically synthesized
cctcctgctctgagcagcct

SEQ ID NO: 58873 - DNA, 20 bp, Artificial Sequence
  chemically synthesized
ctcctgctctgagcagcctg

SEQ ID NO: 58874 - DNA, 20 bp, Artificial Sequence
  chemically synthesized
tcctgctctgagcagcctgg

SEQ ID NO: 58875 - DNA, 20 bp, Artificial Sequence
  chemically synthesized
cctgctctgagcagcctggg

SEQ ID NO: 58876 - DNA, 20 bp, Artificial Sequence
  chemically synthesized
gctctgagcagcctgggggg

SEQ ID NO: 58877 - DNA, 20 bp, Artificial Sequence
  chemically synthesized
agcagcctggggggcagact

SEQ ID NO: 58878 - DNA, 20 bp, Artificial Sequence
  chemically synthesized
agcctggggggcagactaag

SEQ ID NO: 58879 - DNA, 20 bp, Artificial Sequence
  chemically synthesized
cctggggggcagactaagca

SEQ ID NO: 58880 - DNA, 20 bp, Artificial Sequence
  chemically synthesized
ctggggggcagactaagcag

SEQ ID NO: 58881 - DNA, 20 bp, Artificial Sequence
  chemically synthesized
tggggggcagactaagcaga

SEQ ID NO: 58882 - DNA, 20 bp, Artificial Sequence
  chemically synthesized
agactaagcagagggctgtg

SEQ ID NO: 58883 - DNA, 20 bp, Artificial Sequence
  chemically synthesized
gggctgtgcagacccacata

SEQ ID NO: 58884 - DNA, 20 bp, Artificial Sequence
  chemically synthesized
gctgtgcagacccacataaa

SEQ ID NO: 58885 - DNA, 20 bp, Artificial Sequence
  chemically synthesized
ataaagagcctactgtgtgc

SEQ ID NO: 58886 - DNA, 20 bp, Artificial Sequence
  chemically synthesized
taaagagcctactgtgtgcc

SEQ ID NO: 58887 - DNA, 20 bp, Artificial Sequence
  chemically synthesized
gtgtgccaggcacttcaccc

SEQ ID NO: 58888 - DNA, 20 bp, Artificial Sequence
  chemically synthesized
tgtgccaggcacttcacccg

SEQ ID NO: 58889 - DNA, 20 bp, Artificial Sequence
  chemically synthesized
cttcacccgaggcacttcac

SEQ ID NO: 58890 - DNA, 20 bp, Artificial Sequence
  chemically synthesized
aggcacttcacaagcatgct

SEQ ID NO: 58891 - DNA, 20 bp, Artificial Sequence
  chemically synthesized
ggcacttcacaagcatgctt

SEQ ID NO: 58892 - DNA, 20 bp, Artificial Sequence
  chemically synthesized
gaatgaaacttccaactctt

SEQ ID NO: 58893 - DNA, 20 bp, Artificial Sequence
  chemically synthesized
aatgaaacttccaactcttt

SEQ ID NO: 58894 - DNA, 20 bp, Artificial Sequence
  chemically synthesized
acttccaactctttgggatg

SEQ ID NO: 58895 - DNA, 20 bp, Artificial Sequence
  chemically synthesized
cttccaactctttgggatgc

SEQ ID NO: 58896 - DNA, 20 bp, Artificial Sequence
  chemically synthesized
tctttgggatgcaggtgaaa

SEQ ID NO: 58897 - DNA, 20 bp, Artificial Sequence
  chemically synthesized
gatgcaggtgaaacagttcc

SEQ ID NO: 58898 - DNA, 20 bp, Artificial Sequence
  chemically synthesized
aggtgaaacagttcctggtt

SEQ ID NO: 58899 - DNA, 20 bp, Artificial Sequence
  chemically synthesized
gtgaaacagttcctggttca

SEQ ID NO: 58900 - DNA, 20 bp, Artificial Sequence
  chemically synthesized
gaaacagttcctggttcaga

SEQ ID NO: 58901 - DNA, 20 bp, Artificial Sequence
  chemically synthesized
aaacagttcctggttcagag

SEQ ID NO: 58902 - DNA, 20 bp, Artificial Sequence
  chemically synthesized
gttcctggttcagagaggtg

SEQ ID NO: 58903 - DNA, 20 bp, Artificial Sequence
  chemically synthesized
cctggttcagagaggtgaag

SEQ ID NO: 58904 - DNA, 20 bp, Artificial Sequence
  chemically synthesized
agaggtgaagcggcctgcct

SEQ ID NO: 58905 - DNA, 20 bp, Artificial Sequence
  chemically synthesized
gaggtgaagcggcctgcctg

SEQ ID NO: 58906 - DNA, 20 bp, Artificial Sequence
  chemically synthesized
gtgaagcggcctgcctgagg

SEQ ID NO: 58907 - DNA, 20 bp, Artificial Sequence
  chemically synthesized
gcggcctgcctgaggcagca

SEQ ID NO: 58908 - DNA, 20 bp, Artificial Sequence
  chemically synthesized
ggcagcacagctcttcttta

SEQ ID NO: 58909 - DNA, 20 bp, Artificial Sequence
  chemically synthesized
cccacctctaccctgtctca

SEQ ID NO: 58910 - DNA, 20 bp, Artificial Sequence
  chemically synthesized
tgtctcacggccccccatgc

SEQ ID NO: 58911 - DNA, 20 bp, Artificial Sequence
  chemically synthesized
ggccccccatgccagcctga

SEQ ID NO: 58912 - DNA, 20 bp, Artificial Sequence
  chemically synthesized
cctgacggttgtgtctgcct

SEQ ID NO: 58913 - DNA, 20 bp, Artificial Sequence
  chemically synthesized
gtcatgctccatttttccat

SEQ ID NO: 58914 - DNA, 20 bp, Artificial Sequence
  chemically synthesized
tcatgctccatttttccatc

SEQ ID NO: 58915 - DNA, 20 bp, Artificial Sequence
  chemically synthesized
atttttccatcgggaccatc

SEQ ID NO: 58916 - DNA, 20 bp, Artificial Sequence
  chemically synthesized
ttttccatcgggaccatcaa

SEQ ID NO: 58917 - DNA, 20 bp, Artificial Sequence
  chemically synthesized
tttccatcgggaccatcaag

SEQ ID NO: 58918 - DNA, 20 bp, Artificial Sequence
  chemically synthesized
ttccatcgggaccatcaaga

SEQ ID NO: 58919 - DNA, 20 bp, Artificial Sequence
  chemically synthesized
tcaagagggtgtttgtgtct

SEQ ID NO: 58920 - DNA, 20 bp, Artificial Sequence
  chemically synthesized
caagagggtgtttgtgtcta

SEQ ID NO: 58921 - DNA, 20 bp, Artificial Sequence
  chemically synthesized
tgtttgtgtctaaggctgac

SEQ ID NO: 58922 - DNA, 20 bp, Artificial Sequence
  chemically synthesized
gtttgtgtctaaggctgact

SEQ ID NO: 58923 - DNA, 20 bp, Artificial Sequence
  chemically synthesized
taaggctgactgggtaactt

SEQ ID NO: 58924 - DNA, 20 bp, Artificial Sequence
  chemically synthesized
ctgactgggtaactttggat

SEQ ID NO: 58925 - DNA, 20 bp, Artificial Sequence
  chemically synthesized
actgggtaactttggatgag

SEQ ID NO: 58926 - DNA, 20 bp, Artificial Sequence
  chemically synthesized
atgagcggtctctccgctct

SEQ ID NO: 58927 - DNA, 20 bp, Artificial Sequence
  chemically synthesized
ctgtttcctcatctgtcaaa

SEQ ID NO: 58928 - DNA, 20 bp, Artificial Sequence
  chemically synthesized
tgtttcctcatctgtcaaat

SEQ ID NO: 58929 - DNA, 20 bp, Artificial Sequence
  chemically synthesized
tctaacccactctgatctcc

SEQ ID NO: 58930 - DNA, 20 bp, Artificial Sequence
  chemically synthesized
ctaacccactctgatctccc

SEQ ID NO: 58931 - DNA, 20 bp, Artificial Sequence
  chemically synthesized
taacccactctgatctccca

SEQ ID NO: 58932 - DNA, 20 bp, Artificial Sequence
  chemically synthesized
cccactctgatctcccaggg

SEQ ID NO: 58933 - DNA, 20 bp, Artificial Sequence
  chemically synthesized
actctgatctcccagggcgg

SEQ ID NO: 58934 - DNA, 20 bp, Artificial Sequence
  chemically synthesized
tgatctcccagggcggcagt

SEQ ID NO: 58935 - DNA, 20 bp, Artificial Sequence
  chemically synthesized
ccagggcggcagtaagtctt

SEQ ID NO: 58936 - DNA, 20 bp, Artificial Sequence
  chemically synthesized
cggcagtaagtcttcagcat

SEQ ID NO: 58937 - DNA, 20 bp, Artificial Sequence
  chemically synthesized
ggcagtaagtcttcagcatc

SEQ ID NO: 58938 - DNA, 20 bp, Artificial Sequence
  chemically synthesized
gtcttcagcatcaggcattt

SEQ ID NO: 58939 - DNA, 20 bp, Artificial Sequence
  chemically synthesized
tcttcagcatcaggcatttt

SEQ ID NO: 58940 - DNA, 20 bp, Artificial Sequence
  chemically synthesized
cttcagcatcaggcattttg

SEQ ID NO: 58941 - DNA, 20 bp, Artificial Sequence
  chemically synthesized
tcaggcattttggggtgact

SEQ ID NO: 58942 - DNA, 20 bp, Artificial Sequence
  chemically synthesized
ttttggggtgactcagtaaa

SEQ ID NO: 58943 - DNA, 20 bp, Artificial Sequence
  chemically synthesized
tggggtgactcagtaaatgg

SEQ ID NO: 58944 - DNA, 20 bp, Artificial Sequence
  chemically synthesized
taaatggtagatcttgctac

SEQ ID NO: 58945 - DNA, 20 bp, Artificial Sequence
  chemically synthesized
atggtagatcttgctaccag

SEQ ID NO: 58946 - DNA, 20 bp, Artificial Sequence
  chemically synthesized
agatcttgctaccagtggaa

SEQ ID NO: 58947 - DNA, 20 bp, Artificial Sequence
  chemically synthesized
ctaccagtggaacagccact

SEQ ID NO: 58948 - DNA, 20 bp, Artificial Sequence
  chemically synthesized
taccagtggaacagccacta

SEQ ID NO: 58949 - DNA, 20 bp, Artificial Sequence
  chemically synthesized
aacagccactaaggattctg

SEQ ID NO: 58950 - DNA, 20 bp, Artificial Sequence
  chemically synthesized
gccactaaggattctgcagt

SEQ ID NO: 58951 - DNA, 20 bp, Artificial Sequence
  chemically synthesized
cactaaggattctgcagtga

SEQ ID NO: 58952 - DNA, 20 bp, Artificial Sequence
  chemically synthesized
taaggattctgcagtgagag

SEQ ID NO: 58953 - DNA, 20 bp, Artificial Sequence
  chemically synthesized
aggattctgcagtgagagca

SEQ ID NO: 58954 - DNA, 20 bp, Artificial Sequence
  chemically synthesized
ggattctgcagtgagagcag

SEQ ID NO: 58955 - DNA, 20 bp, Artificial Sequence
  chemically synthesized
gattctgcagtgagagcaga

SEQ ID NO: 58956 - DNA, 20 bp, Artificial Sequence
  chemically synthesized
ctgcagtgagagcagagggc

SEQ ID NO: 58957 - DNA, 20 bp, Artificial Sequence
  chemically synthesized
gtgagagcagagggccagct

SEQ ID NO: 58958 - DNA, 20 bp, Artificial Sequence
  chemically synthesized
agagcagagggccagctaag

SEQ ID NO: 58959 - DNA, 20 bp, Artificial Sequence
  chemically synthesized
ccagctaagtggtactctcc

SEQ ID NO: 58960 - DNA, 20 bp, Artificial Sequence
  chemically synthesized
agctaagtggtactctccca

SEQ ID NO: 58961 - DNA, 20 bp, Artificial Sequence
  chemically synthesized
tcacgccaccccctccacct

SEQ ID NO: 58962 - DNA, 20 bp, Artificial Sequence
  chemically synthesized
caccccctccaccttggaca

SEQ ID NO: 58963 - DNA, 20 bp, Artificial Sequence
  chemically synthesized
accccctccaccttggacac

SEQ ID NO: 58964 - DNA, 20 bp, Artificial Sequence
  chemically synthesized
accttggacacaggacgctg

SEQ ID NO: 58965 - DNA, 20 bp, Artificial Sequence
  chemically synthesized
cacaggacgctgtggtttct

SEQ ID NO: 58966 - DNA, 20 bp, Artificial Sequence
  chemically synthesized
ggacgctgtggtttctgagc

SEQ ID NO: 58967 - DNA, 20 bp, Artificial Sequence
  chemically synthesized
gacgctgtggtttctgagcc

SEQ ID NO: 58968 - DNA, 20 bp, Artificial Sequence
  chemically synthesized
ccaggtacaatgactccttt

SEQ ID NO: 58969 - DNA, 20 bp, Artificial Sequence
  chemically synthesized
gtacaatgactcctttcggt

SEQ ID NO: 58970 - DNA, 20 bp, Artificial Sequence
  chemically synthesized
atgactcctttcggtaagtg

SEQ ID NO: 58971 - DNA, 20 bp, Artificial Sequence
  chemically synthesized
actcctttcggtaagtgcag

SEQ ID NO: 58972 - DNA, 20 bp, Artificial Sequence
  chemically synthesized
cctttcggtaagtgcagtgg

SEQ ID NO: 58973 - DNA, 20 bp, Artificial Sequence
  chemically synthesized
agtggaagctgtacactgcc

SEQ ID NO: 58974 - DNA, 20 bp, Artificial Sequence
  chemically synthesized
gtggaagctgtacactgccc

SEQ ID NO: 58975 - DNA, 20 bp, Artificial Sequence
  chemically synthesized
agctgtacactgcccaggca

SEQ ID NO: 58976 - DNA, 20 bp, Artificial Sequence
  chemically synthesized
cactgcccaggcaaagcgtc

SEQ ID NO: 58977 - DNA, 20 bp, Artificial Sequence
  chemically synthesized
actgcccaggcaaagcgtcc

SEQ ID NO: 58978 - DNA, 20 bp, Artificial Sequence
  chemically synthesized
gcccaggcaaagcgtccggg

SEQ ID NO: 58979 - DNA, 20 bp, Artificial Sequence
  chemically synthesized
ggcaaagcgtccgggcagcg

SEQ ID NO: 58980 - DNA, 20 bp, Artificial Sequence
  chemically synthesized
gcaaagcgtccgggcagcgt

SEQ ID NO: 58981 - DNA, 20 bp, Artificial Sequence
  chemically synthesized
aagcgtccgggcagcgtagg

SEQ ID NO: 58982 - DNA, 20 bp, Artificial Sequence
  chemically synthesized
agcgtccgggcagcgtaggc

SEQ ID NO: 58983 - DNA, 20 bp, Artificial Sequence
  chemically synthesized
ggcagcgtaggcgggcgact

SEQ ID NO: 58984 - DNA, 20 bp, Artificial Sequence
  chemically synthesized
taggcgggcgactcagatcc

SEQ ID NO: 58985 - DNA, 20 bp, Artificial Sequence
  chemically synthesized
cgggcgactcagatcccagc

SEQ ID NO: 58986 - DNA, 20 bp, Artificial Sequence
  chemically synthesized
gcgactcagatcccagccag

SEQ ID NO: 58987 - DNA, 20 bp, Artificial Sequence
  chemically synthesized
cagatcccagccagtggact

SEQ ID NO: 58988 - DNA, 20 bp, Artificial Sequence
  chemically synthesized
ctgtttgctcctccgataac

SEQ ID NO: 58989 - DNA, 20 bp, Artificial Sequence
  chemically synthesized
tgtttgctcctccgataact

SEQ ID NO: 58990 - DNA, 20 bp, Artificial Sequence
  chemically synthesized
gtttgctcctccgataactg

SEQ ID NO: 58991 - DNA, 20 bp, Artificial Sequence
  chemically synthesized
tccgataactggggtgacct

SEQ ID NO: 58992 - DNA, 20 bp, Artificial Sequence
  chemically synthesized
tgaccttggttaatattcac

SEQ ID NO: 58993 - DNA, 20 bp, Artificial Sequence
  chemically synthesized
ccttggttaatattcaccag

SEQ ID NO: 58994 - DNA, 20 bp, Artificial Sequence
  chemically synthesized
agcctcccccgttgcccctc

SEQ ID NO: 58995 - DNA, 20 bp, Artificial Sequence
  chemically synthesized
ctggatccactgcttaaata

SEQ ID NO: 58996 - DNA, 20 bp, Artificial Sequence
  chemically synthesized
tccactgcttaaatacggac

SEQ ID NO: 58997 - DNA, 20 bp, Artificial Sequence
  chemically synthesized
ccactgcttaaatacggacg

SEQ ID NO: 58998 - DNA, 20 bp, Artificial Sequence
  chemically synthesized
tgcttaaatacggacgagga

SEQ ID NO: 58999 - DNA, 20 bp, Artificial Sequence
  chemically synthesized
gcttaaatacggacgaggac

SEQ ID NO: 59000 - DNA, 20 bp, Artificial Sequence
  chemically synthesized
cttaaatacggacgaggaca

SEQ ID NO: 59001 - DNA, 20 bp, Artificial Sequence
  chemically synthesized
aggacagggccctgtctcct

SEQ ID NO: 59002 - DNA, 20 bp, Artificial Sequence
  chemically synthesized
gggccctgtctcctcagctt

SEQ ID NO: 59003 - DNA, 20 bp, Artificial Sequence
  chemically synthesized
ggccctgtctcctcagcttc

SEQ ID NO: 59004 - DNA, 20 bp, Artificial Sequence
  chemically synthesized
ttcaggcaccaccactgacc

SEQ ID NO: 59005 - DNA, 20 bp, Artificial Sequence
  chemically synthesized
tcaggcaccaccactgacct

SEQ ID NO: 59006 - DNA, 20 bp, Artificial Sequence
  chemically synthesized
gcaccaccactgacctggga

SEQ ID NO: 59007 - DNA, 20 bp, Artificial Sequence
  chemically synthesized
gacctgggacagtgaatcgt

SEQ ID NO: 59008 - DNA, 20 bp, Artificial Sequence
  chemically synthesized
gtaagtatgcctttcactgc

SEQ ID NO: 59009 - DNA, 20 bp, Artificial Sequence
  chemically synthesized
aagtatgcctttcactgcga

SEQ ID NO: 59010 - DNA, 20 bp, Artificial Sequence
  chemically synthesized
agtatgcctttcactgcgag

SEQ ID NO: 59011 - DNA, 20 bp, Artificial Sequence
  chemically synthesized
cctttcactgcgagaggttc

SEQ ID NO: 59012 - DNA, 20 bp, Artificial Sequence
  chemically synthesized
tttcactgcgagaggttctg

SEQ ID NO: 59013 - DNA, 20 bp, Artificial Sequence
  chemically synthesized
tcactgcgagaggttctgga

SEQ ID NO: 59014 - DNA, 20 bp, Artificial Sequence
  chemically synthesized
cactgcgagaggttctggag

SEQ ID NO: 59015 - DNA, 20 bp, Artificial Sequence
  chemically synthesized
gaggttctggagaggcttct

SEQ ID NO: 59016 - DNA, 20 bp, Artificial Sequence
  chemically synthesized
agaggcttctgagctcccca

SEQ ID NO: 59017 - DNA, 20 bp, Artificial Sequence
  chemically synthesized
cttctgagctccccatggcc

SEQ ID NO: 59018 - DNA, 20 bp, Artificial Sequence
  chemically synthesized
ttctgagctccccatggccc

SEQ ID NO: 59019 - DNA, 20 bp, Artificial Sequence
  chemically synthesized
tgagctccccatggcccagg

SEQ ID NO: 59020 - DNA, 20 bp, Artificial Sequence
  chemically synthesized
gagctccccatggcccaggc

SEQ ID NO: 59021 - DNA, 20 bp, Artificial Sequence
  chemically synthesized
ctccccatggcccaggcagg

SEQ ID NO: 59022 - DNA, 20 bp, Artificial Sequence
  chemically synthesized
cccatggcccaggcaggcag

SEQ ID NO: 59023 - DNA, 20 bp, Artificial Sequence
  chemically synthesized
ccatggcccaggcaggcagc

SEQ ID NO: 59024 - DNA, 20 bp, Artificial Sequence
  chemically synthesized
gcccaggcaggcagcaggtc

SEQ ID NO: 59025 - DNA, 20 bp, Artificial Sequence
  chemically synthesized
cccaggcaggcagcaggtct

SEQ ID NO: 59026 - DNA, 20 bp, Artificial Sequence
  chemically synthesized
ccaggcaggcagcaggtctg

SEQ ID NO: 59027 - DNA, 20 bp, Artificial Sequence
  chemically synthesized
ggcaggcagcaggtctgggg

SEQ ID NO: 59028 - DNA, 20 bp, Artificial Sequence
  chemically synthesized
gcaggcagcaggtctggggc

SEQ ID NO: 59029 - DNA, 20 bp, Artificial Sequence
  chemically synthesized
aggcagcaggtctggggcag

SEQ ID NO: 59030 - DNA, 20 bp, Artificial Sequence
  chemically synthesized
ggcagcaggtctggggcagg

SEQ ID NO: 59031 - DNA, 20 bp, Artificial Sequence
  chemically synthesized
gcagcaggtctggggcagga

SEQ ID NO: 59032 - DNA, 20 bp, Artificial Sequence
  chemically synthesized
cagcaggtctggggcaggag

SEQ ID NO: 59033 - DNA, 20 bp, Artificial Sequence
  chemically synthesized
agcaggtctggggcaggagg

SEQ ID NO: 59034 - DNA, 20 bp, Artificial Sequence
  chemically synthesized
gcaggtctggggcaggaggg

SEQ ID NO: 59035 - DNA, 20 bp, Artificial Sequence
  chemically synthesized
ctggggcaggaggggggttg

SEQ ID NO: 59036 - DNA, 20 bp, Artificial Sequence
  chemically synthesized
ggggcaggaggggggttgtg

SEQ ID NO: 59037 - DNA, 20 bp, Artificial Sequence
  chemically synthesized
gcaggaggggggttgtggag

SEQ ID NO: 59038 - DNA, 20 bp, Artificial Sequence
  chemically synthesized
caggaggggggttgtggagt

SEQ ID NO: 59039 - DNA, 20 bp, Artificial Sequence
  chemically synthesized
ggagtgggtatccgcctgct

SEQ ID NO: 59040 - DNA, 20 bp, Artificial Sequence
  chemically synthesized
gagtgggtatccgcctgctg

SEQ ID NO: 59041 - DNA, 20 bp, Artificial Sequence
  chemically synthesized
ggtatccgcctgctgaggtg

SEQ ID NO: 59042 - DNA, 20 bp, Artificial Sequence
  chemically synthesized
gtatccgcctgctgaggtgc

SEQ ID NO: 59043 - DNA, 20 bp, Artificial Sequence
  chemically synthesized
tatccgcctgctgaggtgca

SEQ ID NO: 59044 - DNA, 20 bp, Artificial Sequence
  chemically synthesized
ccgcctgctgaggtgcaggg

SEQ ID NO: 59045 - DNA, 20 bp, Artificial Sequence
  chemically synthesized
ctgctgaggtgcagggcaga

SEQ ID NO: 59046 - DNA, 20 bp, Artificial Sequence
  chemically synthesized
gctgaggtgcagggcagatg

SEQ ID NO: 59047 - DNA, 20 bp, Artificial Sequence
  chemically synthesized
tgaggtgcagggcagatgga

SEQ ID NO: 59048 - DNA, 20 bp, Artificial Sequence
  chemically synthesized
gaggtgcagggcagatggag

SEQ ID NO: 59049 - DNA, 20 bp, Artificial Sequence
  chemically synthesized
cagggcagatggagaggctg

SEQ ID NO: 59050 - DNA, 20 bp, Artificial Sequence
  chemically synthesized
cagatggagaggctgcagct

SEQ ID NO: 59051 - DNA, 20 bp, Artificial Sequence
  chemically synthesized
agctcctattttcataataa

SEQ ID NO: 59052 - DNA, 20 bp, Artificial Sequence
  chemically synthesized
tcctattttcataataacag

SEQ ID NO: 59053 - DNA, 20 bp, Artificial Sequence
  chemically synthesized
ttcataataacagcagccat

SEQ ID NO: 59054 - DNA, 20 bp, Artificial Sequence
  chemically synthesized
tcataataacagcagccatg

SEQ ID NO: 59055 - DNA, 20 bp, Artificial Sequence
  chemically synthesized
cataataacagcagccatga

SEQ ID NO: 59056 - DNA, 20 bp, Artificial Sequence
  chemically synthesized
gagggttgtgtcctgtttcc

SEQ ID NO: 59057 - DNA, 20 bp, Artificial Sequence
  chemically synthesized
tcctgtttcccagtcctgcc

SEQ ID NO: 59058 - DNA, 20 bp, Artificial Sequence
  chemically synthesized
agtcctgcccggtcccccct

SEQ ID NO: 59059 - DNA, 20 bp, Artificial Sequence
  chemically synthesized
ggtcccccctcggtacctcc

SEQ ID NO: 59060 - DNA, 20 bp, Artificial Sequence
  chemically synthesized
cccccctcggtacctcctgg

SEQ ID NO: 59061 - DNA, 20 bp, Artificial Sequence
  chemically synthesized
gtacctcctggtggatacac

SEQ ID NO: 59062 - DNA, 20 bp, Artificial Sequence
  chemically synthesized
gtggatacactggttcctgt

SEQ ID NO: 59063 - DNA, 20 bp, Artificial Sequence
  chemically synthesized
gatacactggttcctgtaag

SEQ ID NO: 59064 - DNA, 20 bp, Artificial Sequence
  chemically synthesized
acactggttcctgtaagcag

SEQ ID NO: 59065 - DNA, 20 bp, Artificial Sequence
  chemically synthesized
ctggttcctgtaagcagaag

SEQ ID NO: 59066 - DNA, 20 bp, Artificial Sequence
  chemically synthesized
tcctgtaagcagaagtggat

SEQ ID NO: 59067 - DNA, 20 bp, Artificial Sequence
  chemically synthesized
cctgtaagcagaagtggatg

SEQ ID NO: 59068 - DNA, 20 bp, Artificial Sequence
  chemically synthesized
ctgtaagcagaagtggatga

SEQ ID NO: 59069 - DNA, 20 bp, Artificial Sequence
  chemically synthesized
cagaagtggatgagggtgtc

SEQ ID NO: 59070 - DNA, 20 bp, Artificial Sequence
  chemically synthesized
agaagtggatgagggtgtct

SEQ ID NO: 59071 - DNA, 20 bp, Artificial Sequence
  chemically synthesized
gatgagggtgtctaggtctg

SEQ ID NO: 59072 - DNA, 20 bp, Artificial Sequence
  chemically synthesized
ggtgtctaggtctgcagtcc

SEQ ID NO: 59073 - DNA, 20 bp, Artificial Sequence
  chemically synthesized
ggtctgcagtcctggcaccc

SEQ ID NO: 59074 - DNA, 20 bp, Artificial Sequence
  chemically synthesized
gtctgcagtcctggcacccc

SEQ ID NO: 59075 - DNA, 20 bp, Artificial Sequence
  chemically synthesized
gcagtcctggcaccccagga

SEQ ID NO: 59076 - DNA, 20 bp, Artificial Sequence
  chemically synthesized
cagtcctggcaccccaggat

SEQ ID NO: 59077 - DNA, 20 bp, Artificial Sequence
  chemically synthesized
agtcctggcaccccaggatg

SEQ ID NO: 59078 - DNA, 20 bp, Artificial Sequence
  chemically synthesized
gtcctggcaccccaggatgg

SEQ ID NO: 59079 - DNA, 20 bp, Artificial Sequence
  chemically synthesized
caccccaggatgggggacac

SEQ ID NO: 59080 - DNA, 20 bp, Artificial Sequence
  chemically synthesized
caggatgggggacaccagcc

SEQ ID NO: 59081 - DNA, 20 bp, Artificial Sequence
  chemically synthesized
gggggacaccagccaagata

SEQ ID NO: 59082 - DNA, 20 bp, Artificial Sequence
  chemically synthesized
caccagccaagatacagcaa

SEQ ID NO: 59083 - DNA, 20 bp, Artificial Sequence
  chemically synthesized
aagatacagcaacagcaaca

SEQ ID NO: 59084 - DNA, 20 bp, Artificial Sequence
  chemically synthesized
acagcaacagcaacaaagcg

SEQ ID NO: 59085 - DNA, 20 bp, Artificial Sequence
  chemically synthesized
gccatttctttctgtttgca

SEQ ID NO: 59086 - DNA, 20 bp, Artificial Sequence
  chemically synthesized
tgcacagctcctctgtctgt

SEQ ID NO: 59087 - DNA, 20 bp, Artificial Sequence
  chemically synthesized
gcacagctcctctgtctgtc

SEQ ID NO: 59088 - DNA, 20 bp, Artificial Sequence
  chemically synthesized
cacagctcctctgtctgtcg

SEQ ID NO: 59089 - DNA, 20 bp, Artificial Sequence
  chemically synthesized
acagctcctctgtctgtcgg

SEQ ID NO: 59090 - DNA, 20 bp, Artificial Sequence
  chemically synthesized
tcctgtctgttgtctcctat

SEQ ID NO: 59091 - DNA, 20 bp, Artificial Sequence
  chemically synthesized
tcaccacctctcctactgct

SEQ ID NO: 59092 - DNA, 20 bp, Artificial Sequence
  chemically synthesized
caccacctctcctactgctt

SEQ ID NO: 59093 - DNA, 20 bp, Artificial Sequence
  chemically synthesized
tgcatctttctccccttcta

SEQ ID NO: 59094 - DNA, 20 bp, Artificial Sequence
  chemically synthesized
ctttctccccttctatagat

SEQ ID NO: 59095 - DNA, 20 bp, Artificial Sequence
  chemically synthesized
tttctccccttctatagatg

SEQ ID NO: 59096 - DNA, 20 bp, Artificial Sequence
  chemically synthesized
tctccccttctatagatgag

SEQ ID NO: 59097 - DNA, 20 bp, Artificial Sequence
  chemically synthesized
ctccccttctatagatgagg

SEQ ID NO: 59098 - DNA, 20 bp, Artificial Sequence
  chemically synthesized
cttctatagatgaggaggtt

SEQ ID NO: 59099 - DNA, 20 bp, Artificial Sequence
  chemically synthesized
ttctatagatgaggaggtta

SEQ ID NO: 59100 - DNA, 20 bp, Artificial Sequence
  chemically synthesized
tagatgaggaggttaaggtc

SEQ ID NO: 59101 - DNA, 20 bp, Artificial Sequence
  chemically synthesized
gatgaggaggttaaggtcca

SEQ ID NO: 59102 - DNA, 20 bp, Artificial Sequence
  chemically synthesized
tgaggaggttaaggtccaga

SEQ ID NO: 59103 - DNA, 20 bp, Artificial Sequence
  chemically synthesized
gaggaggttaaggtccagag

SEQ ID NO: 59104 - DNA, 20 bp, Artificial Sequence
  chemically synthesized
aggaggttaaggtccagaga

SEQ ID NO: 59105 - DNA, 20 bp, Artificial Sequence
  chemically synthesized
ggaggttaaggtccagagag

SEQ ID NO: 59106 - DNA, 20 bp, Artificial Sequence
  chemically synthesized
ggttaaggtccagagagggg

SEQ ID NO: 59107 - DNA, 20 bp, Artificial Sequence
  chemically synthesized
gttaaggtccagagaggggt

SEQ ID NO: 59108 - DNA, 20 bp, Artificial Sequence
  chemically synthesized
ttaaggtccagagaggggtg

SEQ ID NO: 59109 - DNA, 20 bp, Artificial Sequence
  chemically synthesized
aaggtccagagaggggtggg

SEQ ID NO: 59110 - DNA, 20 bp, Artificial Sequence
  chemically synthesized
aggtccagagaggggtgggg

SEQ ID NO: 59111 - DNA, 20 bp, Artificial Sequence
  chemically synthesized
agaggggtggggaggaacgc

SEQ ID NO: 59112 - DNA, 20 bp, Artificial Sequence
  chemically synthesized
ctcacattctccatcccctc

SEQ ID NO: 59113 - DNA, 20 bp, Artificial Sequence
  chemically synthesized
ccatcccctccagatatgac

SEQ ID NO: 59114 - DNA, 20 bp, Artificial Sequence
  chemically synthesized
catcccctccagatatgacc

SEQ ID NO: 59115 - DNA, 20 bp, Artificial Sequence
  chemically synthesized
cctccagatatgaccaggaa

SEQ ID NO: 59116 - DNA, 20 bp, Artificial Sequence
  chemically synthesized
gaccaggaacagacctgtgc

SEQ ID NO: 59117 - DNA, 20 bp, Artificial Sequence
  chemically synthesized
accaggaacagacctgtgcc

SEQ ID NO: 59118 - DNA, 20 bp, Artificial Sequence
  chemically synthesized
aacagacctgtgccaggcct

SEQ ID NO: 59119 - DNA, 20 bp, Artificial Sequence
  chemically synthesized
gcctcagccttacatcaaaa

SEQ ID NO: 59120 - DNA, 20 bp, Artificial Sequence
  chemically synthesized
cctcagccttacatcaaaat

SEQ ID NO: 59121 - DNA, 20 bp, Artificial Sequence
  chemically synthesized
atgggcctccccatgcaccg

SEQ ID NO: 59122 - DNA, 20 bp, Artificial Sequence
  chemically synthesized
ccccatgcaccgtggacctc

SEQ ID NO: 59123 - DNA, 20 bp, Artificial Sequence
  chemically synthesized
cccatgcaccgtggacctct

SEQ ID NO: 59124 - DNA, 20 bp, Artificial Sequence
  chemically synthesized
acctctgggccctcctgtcc

SEQ ID NO: 59125 - DNA, 20 bp, Artificial Sequence
  chemically synthesized
tctgggccctcctgtcccag

SEQ ID NO: 59126 - DNA, 20 bp, Artificial Sequence
  chemically synthesized
tgggccctcctgtcccagtg

SEQ ID NO: 59127 - DNA, 20 bp, Artificial Sequence
  chemically synthesized
gggccctcctgtcccagtgg

SEQ ID NO: 59128 - DNA, 20 bp, Artificial Sequence
  chemically synthesized
cctcctgtcccagtggagga

SEQ ID NO: 59129 - DNA, 20 bp, Artificial Sequence
  chemically synthesized
ctcctgtcccagtggaggac

SEQ ID NO: 59130 - DNA, 20 bp, Artificial Sequence
  chemically synthesized
ctgtcccagtggaggacagg

SEQ ID NO: 59131 - DNA, 20 bp, Artificial Sequence
  chemically synthesized
agtggaggacaggaagctgt

SEQ ID NO: 59132 - DNA, 20 bp, Artificial Sequence
  chemically synthesized
gtggaggacaggaagctgtg

SEQ ID NO: 59133 - DNA, 20 bp, Artificial Sequence
  chemically synthesized
tggaggacaggaagctgtga

SEQ ID NO: 59134 - DNA, 20 bp, Artificial Sequence
  chemically synthesized
ggaggacaggaagctgtgag

SEQ ID NO: 59135 - DNA, 20 bp, Artificial Sequence
  chemically synthesized
ctgtgaggggcactgtcacc

SEQ ID NO: 59136 - DNA, 20 bp, Artificial Sequence
  chemically synthesized
tgtgaggggcactgtcaccc

SEQ ID NO: 59137 - DNA, 20 bp, Artificial Sequence
  chemically synthesized
gtgaggggcactgtcaccca

SEQ ID NO: 59138 - DNA, 20 bp, Artificial Sequence
  chemically synthesized
ggcactgtcacccagggctc

SEQ ID NO: 59139 - DNA, 20 bp, Artificial Sequence
  chemically synthesized
ctgtcacccagggctcaagc

SEQ ID NO: 59140 - DNA, 20 bp, Artificial Sequence
  chemically synthesized
cctgaataatcgctctgcac

SEQ ID NO: 59141 - DNA, 20 bp, Artificial Sequence
  chemically synthesized
ctgaataatcgctctgcacc

SEQ ID NO: 59142 - DNA, 20 bp, Artificial Sequence
  chemically synthesized
aatcgctctgcaccaggcca

SEQ ID NO: 59143 - DNA, 20 bp, Artificial Sequence
  chemically synthesized
ctctgcaccaggccacggct

SEQ ID NO: 59144 - DNA, 20 bp, Artificial Sequence
  chemically synthesized
caccaggccacggctaagct

SEQ ID NO: 59145 - DNA, 20 bp, Artificial Sequence
  chemically synthesized
gctaagctcagtgcgtgatt

SEQ ID NO: 59146 - DNA, 20 bp, Artificial Sequence
  chemically synthesized
attaagcctcataaccctcc

SEQ ID NO: 59147 - DNA, 20 bp, Artificial Sequence
  chemically synthesized
ttaagcctcataaccctcca

SEQ ID NO: 59148 - DNA, 20 bp, Artificial Sequence
  chemically synthesized
agcctcataaccctccaagg

SEQ ID NO: 59149 - DNA, 20 bp, Artificial Sequence
  chemically synthesized
taaccctccaaggcagttac

SEQ ID NO: 59150 - DNA, 20 bp, Artificial Sequence
  chemically synthesized
ctagtgtgattcccatttta

SEQ ID NO: 59151 - DNA, 20 bp, Artificial Sequence
  chemically synthesized
gtgattcccattttacagat

SEQ ID NO: 59152 - DNA, 20 bp, Artificial Sequence
  chemically synthesized
tgattcccattttacagatg

SEQ ID NO: 59153 - DNA, 20 bp, Artificial Sequence
  chemically synthesized
ttcccattttacagatgagg

SEQ ID NO: 59154 - DNA, 20 bp, Artificial Sequence
  chemically synthesized
cattttacagatgaggaaga

SEQ ID NO: 59155 - DNA, 20 bp, Artificial Sequence
  chemically synthesized
attttacagatgaggaagat

SEQ ID NO: 59156 - DNA, 20 bp, Artificial Sequence
  chemically synthesized
ttttacagatgaggaagatg

SEQ ID NO: 59157 - DNA, 20 bp, Artificial Sequence
  chemically synthesized
acagatgaggaagatgggga

SEQ ID NO: 59158 - DNA, 20 bp, Artificial Sequence
  chemically synthesized
agatgaggaagatggggaca

SEQ ID NO: 59159 - DNA, 20 bp, Artificial Sequence
  chemically synthesized
atgaggaagatggggacaga

SEQ ID NO: 59160 - DNA, 20 bp, Artificial Sequence
  chemically synthesized
tgaggaagatggggacagag

SEQ ID NO: 59161 - DNA, 20 bp, Artificial Sequence
  chemically synthesized
gggacagagaggtgaataac

SEQ ID NO: 59162 - DNA, 20 bp, Artificial Sequence
  chemically synthesized
atcacacaccatccataatt

SEQ ID NO: 59163 - DNA, 20 bp, Artificial Sequence
  chemically synthesized
tcacacaccatccataattc

SEQ ID NO: 59164 - DNA, 20 bp, Artificial Sequence
  chemically synthesized
caccatccataattcgggct

SEQ ID NO: 59165 - DNA, 20 bp, Artificial Sequence
  chemically synthesized
accatccataattcgggctc

SEQ ID NO: 59166 - DNA, 20 bp, Artificial Sequence
  chemically synthesized
ataattcgggctcaggcacc

SEQ ID NO: 59167 - DNA, 20 bp, Artificial Sequence
  chemically synthesized
cgggctcaggcacctggctc

SEQ ID NO: 59168 - DNA, 20 bp, Artificial Sequence
  chemically synthesized
agtccccaaactcttgaacc

SEQ ID NO: 59169 - DNA, 20 bp, Artificial Sequence
  chemically synthesized
caaactcttgaacctggccc

SEQ ID NO: 59170 - DNA, 20 bp, Artificial Sequence
  chemically synthesized
cctagtgtcactgtttctct

SEQ ID NO: 59171 - DNA, 20 bp, Artificial Sequence
  chemically synthesized
ctagtgtcactgtttctctt

SEQ ID NO: 59172 - DNA, 20 bp, Artificial Sequence
  chemically synthesized
tcactgtttctcttgggtct

SEQ ID NO: 59173 - DNA, 20 bp, Artificial Sequence
  chemically synthesized
cactgtttctcttgggtctc

SEQ ID NO: 59174 - DNA, 20 bp, Artificial Sequence
  chemically synthesized
ttctcttgggtctcaggcgc

SEQ ID NO: 59175 - DNA, 20 bp, Artificial Sequence
  chemically synthesized
cttgggtctcaggcgctgga

SEQ ID NO: 59176 - DNA, 20 bp, Artificial Sequence
  chemically synthesized
ttgggtctcaggcgctggat

SEQ ID NO: 59177 - DNA, 20 bp, Artificial Sequence
  chemically synthesized
tgggtctcaggcgctggatg

SEQ ID NO: 59178 - DNA, 20 bp, Artificial Sequence
  chemically synthesized
ctcaggcgctggatggggaa

SEQ ID NO: 59179 - DNA, 20 bp, Artificial Sequence
  chemically synthesized
tcaggcgctggatggggaac

SEQ ID NO: 59180 - DNA, 20 bp, Artificial Sequence
  chemically synthesized
tggatggggaacaggaaacc

SEQ ID NO: 59181 - DNA, 20 bp, Artificial Sequence
  chemically synthesized
ggatggggaacaggaaacct

SEQ ID NO: 59182 - DNA, 20 bp, Artificial Sequence
  chemically synthesized
ggggaacaggaaacctgggc

SEQ ID NO: 59183 - DNA, 20 bp, Artificial Sequence
  chemically synthesized
aggaaacctgggctggactt

SEQ ID NO: 59184 - DNA, 20 bp, Artificial Sequence
  chemically synthesized
ggaaacctgggctggacttg

SEQ ID NO: 59185 - DNA, 20 bp, Artificial Sequence
  chemically synthesized
cttgaggcctctctgatgct

SEQ ID NO: 59186 - DNA, 20 bp, Artificial Sequence
  chemically synthesized
tctctgatgctcggtgactt

SEQ ID NO: 59187 - DNA, 20 bp, Artificial Sequence
  chemically synthesized
tgatgctcggtgacttcaga

SEQ ID NO: 59188 - DNA, 20 bp, Artificial Sequence
  chemically synthesized
gctcaacctctctgttctct

SEQ ID NO: 59189 - DNA, 20 bp, Artificial Sequence
  chemically synthesized
ctcaacctctctgttctctt

SEQ ID NO: 59190 - DNA, 20 bp, Artificial Sequence
  chemically synthesized
ccacccgaccttgatctctg

SEQ ID NO: 59191 - DNA, 20 bp, Artificial Sequence
  chemically synthesized
gaccttgatctctgaagtgt

SEQ ID NO: 59192 - DNA, 20 bp, Artificial Sequence
  chemically synthesized
cttgatctctgaagtgttgg

SEQ ID NO: 59193 - DNA, 20 bp, Artificial Sequence
  chemically synthesized
ttgatctctgaagtgttgga

SEQ ID NO: 59194 - DNA, 20 bp, Artificial Sequence
  chemically synthesized
gatttaatttttcctgcact

SEQ ID NO: 59195 - DNA, 20 bp, Artificial Sequence
  chemically synthesized
atttttcctgcactgagttt

SEQ ID NO: 59196 - DNA, 20 bp, Artificial Sequence
  chemically synthesized
ttttcctgcactgagttttg

SEQ ID NO: 59197 - DNA, 20 bp, Artificial Sequence
  chemically synthesized
cctgcactgagttttggaga

SEQ ID NO: 59198 - DNA, 20 bp, Artificial Sequence
  chemically synthesized
ctgcactgagttttggagac

SEQ ID NO: 59199 - DNA, 20 bp, Artificial Sequence
  chemically synthesized
agttttggagacaggtcaaa

SEQ ID NO: 59200 - DNA, 20 bp, Artificial Sequence
  chemically synthesized
gacaggtcaaaaagatgacc

SEQ ID NO: 59201 - DNA, 20 bp, Artificial Sequence
  chemically synthesized
acaggtcaaaaagatgacca

SEQ ID NO: 59202 - DNA, 20 bp, Artificial Sequence
  chemically synthesized
tcaaaaagatgaccaaggcc

SEQ ID NO: 59203 - DNA, 20 bp, Artificial Sequence
  chemically synthesized
caaaaagatgaccaaggcca

SEQ ID NO: 59204 - DNA, 20 bp, Artificial Sequence
  chemically synthesized
aaagatgaccaaggccaagg

SEQ ID NO: 59205 - DNA, 20 bp, Artificial Sequence
  chemically synthesized
atgaccaaggccaaggtggc

SEQ ID NO: 59206 - DNA, 20 bp, Artificial Sequence
  chemically synthesized
ccaaggtggccagtttccta

SEQ ID NO: 59207 - DNA, 20 bp, Artificial Sequence
  chemically synthesized
ttcctatagaacgcctctaa

SEQ ID NO: 59208 - DNA, 20 bp, Artificial Sequence
  chemically synthesized
gaacgcctctaaaagacctg

SEQ ID NO: 59209 - DNA, 20 bp, Artificial Sequence
  chemically synthesized
ctctaaaagacctgcagcaa

SEQ ID NO: 59210 - DNA, 20 bp, Artificial Sequence
  chemically synthesized
taaaagacctgcagcaatag

SEQ ID NO: 59211 - DNA, 20 bp, Artificial Sequence
  chemically synthesized
agacctgcagcaatagcagc

SEQ ID NO: 59212 - DNA, 20 bp, Artificial Sequence
  chemically synthesized
gcagcaatagcagcaagaac

SEQ ID NO: 59213 - DNA, 20 bp, Artificial Sequence
  chemically synthesized
cagcaagaactggtattctc

SEQ ID NO: 59214 - DNA, 20 bp, Artificial Sequence
  chemically synthesized
attctcgagaacttgctgcg

SEQ ID NO: 59215 - DNA, 20 bp, Artificial Sequence
  chemically synthesized
ctcgagaacttgctgcgcag

SEQ ID NO: 59216 - DNA, 20 bp, Artificial Sequence
  chemically synthesized
tcgagaacttgctgcgcagc

SEQ ID NO: 59217 - DNA, 20 bp, Artificial Sequence
  chemically synthesized
gctgcgcagcaggcacttct

SEQ ID NO: 59218 - DNA, 20 bp, Artificial Sequence
  chemically synthesized
atgtgtatttaatttcacaa

SEQ ID NO: 59219 - DNA, 20 bp, Artificial Sequence
  chemically synthesized
ttcacaatagctctatgaca

SEQ ID NO: 59220 - DNA, 20 bp, Artificial Sequence
  chemically synthesized
aagtccacctttctcatctc

SEQ ID NO: 59221 - DNA, 20 bp, Artificial Sequence
  chemically synthesized
agtccacctttctcatctcc

SEQ ID NO: 59222 - DNA, 20 bp, Artificial Sequence
  chemically synthesized
tttctcatctccaggaaact

SEQ ID NO: 59223 - DNA, 20 bp, Artificial Sequence
  chemically synthesized
ttctcatctccaggaaactg

SEQ ID NO: 59224 - DNA, 20 bp, Artificial Sequence
  chemically synthesized
atctccaggaaactgaggtt

SEQ ID NO: 59225 - DNA, 20 bp, Artificial Sequence
  chemically synthesized
ctccaggaaactgaggttca

SEQ ID NO: 59226 - DNA, 20 bp, Artificial Sequence
  chemically synthesized
ccaggaaactgaggttcaga

SEQ ID NO: 59227 - DNA, 20 bp, Artificial Sequence
  chemically synthesized
caggaaactgaggttcagag

SEQ ID NO: 59228 - DNA, 20 bp, Artificial Sequence
  chemically synthesized
aactgaggttcagagaggtt

SEQ ID NO: 59229 - DNA, 20 bp, Artificial Sequence
  chemically synthesized
agaggttaagtaacttgtcc

SEQ ID NO: 59230 - DNA, 20 bp, Artificial Sequence
  chemically synthesized
gaggttaagtaacttgtcca

SEQ ID NO: 59231 - DNA, 20 bp, Artificial Sequence
  chemically synthesized
gtaacttgtccaaggtcaca

SEQ ID NO: 59232 - DNA, 20 bp, Artificial Sequence
  chemically synthesized
gtccaaggtcacacagctaa

SEQ ID NO: 59233 - DNA, 20 bp, Artificial Sequence
  chemically synthesized
aaggtcacacagctaatagc

SEQ ID NO: 59234 - DNA, 20 bp, Artificial Sequence
  chemically synthesized
cagctaatagcaagttgacg

SEQ ID NO: 59235 - DNA, 20 bp, Artificial Sequence
  chemically synthesized
gctaatagcaagttgacgtg

SEQ ID NO: 59236 - DNA, 20 bp, Artificial Sequence
  chemically synthesized
caagttgacgtggagcaatc

SEQ ID NO: 59237 - DNA, 20 bp, Artificial Sequence
  chemically synthesized
gacgtggagcaatctggcct

SEQ ID NO: 59238 - DNA, 20 bp, Artificial Sequence
  chemically synthesized
cgtggagcaatctggcctca

SEQ ID NO: 59239 - DNA, 20 bp, Artificial Sequence
  chemically synthesized
ggcctcagagcctttaattt

SEQ ID NO: 59240 - DNA, 20 bp, Artificial Sequence
  chemically synthesized
agagcctttaattttagcca

SEQ ID NO: 59241 - DNA, 20 bp, Artificial Sequence
  chemically synthesized
ctgatgctcccctcttcatt

SEQ ID NO: 59242 - DNA, 20 bp, Artificial Sequence
  chemically synthesized
tgctcccctcttcatttagc

SEQ ID NO: 59243 - DNA, 20 bp, Artificial Sequence
  chemically synthesized
gctcccctcttcatttagcc

SEQ ID NO: 59244 - DNA, 20 bp, Artificial Sequence
  chemically synthesized
atttagccaggctgcctctg

SEQ ID NO: 59245 - DNA, 20 bp, Artificial Sequence
  chemically synthesized
cctctgaagttttctgattc

SEQ ID NO: 59246 - DNA, 20 bp, Artificial Sequence
  chemically synthesized
gttttctgattcaagacttc

SEQ ID NO: 59247 - DNA, 20 bp, Artificial Sequence
  chemically synthesized
tgattcaagacttctggctt

SEQ ID NO: 59248 - DNA, 20 bp, Artificial Sequence
  chemically synthesized
tctggcttcagctttgtaca

SEQ ID NO: 59249 - DNA, 20 bp, Artificial Sequence
  chemically synthesized
tggcttcagctttgtacaca

SEQ ID NO: 59250 - DNA, 20 bp, Artificial Sequence
  chemically synthesized
acacagagatgattcaatgt

SEQ ID NO: 59251 - DNA, 20 bp, Artificial Sequence
  chemically synthesized
cacagagatgattcaatgtc

SEQ ID NO: 59252 - DNA, 20 bp, Artificial Sequence
  chemically synthesized
gatgattcaatgtcaggttt

SEQ ID NO: 59253 - DNA, 20 bp, Artificial Sequence
  chemically synthesized
tgattcaatgtcaggttttg

SEQ ID NO: 59254 - DNA, 20 bp, Artificial Sequence
  chemically synthesized
gagtgaaatctgtttaatcc

SEQ ID NO: 59255 - DNA, 20 bp, Artificial Sequence
  chemically synthesized
ttaatcccagacaaaacatt

SEQ ID NO: 59256 - DNA, 20 bp, Artificial Sequence
  chemically synthesized
taatcccagacaaaacattt

SEQ ID NO: 59257 - DNA, 20 bp, Artificial Sequence
  chemically synthesized
aaacatttaggattacatct

SEQ ID NO: 59258 - DNA, 20 bp, Artificial Sequence
  chemically synthesized
ggattacatctcagttttgt

SEQ ID NO: 59259 - DNA, 20 bp, Artificial Sequence
  chemically synthesized
tacatctcagttttgtaagc

SEQ ID NO: 59260 - DNA, 20 bp, Artificial Sequence
  chemically synthesized
atctcagttttgtaagcaag

SEQ ID NO: 59261 - DNA, 20 bp, Artificial Sequence
  chemically synthesized
gcaagtagctctgtgatttt

SEQ ID NO: 59262 - DNA, 20 bp, Artificial Sequence
  chemically synthesized
gtagctctgtgatttttagt

SEQ ID NO: 59263 - DNA, 20 bp, Artificial Sequence
  chemically synthesized
gtgagttatttaatgctctt

SEQ ID NO: 59264 - DNA, 20 bp, Artificial Sequence
  chemically synthesized
tgagttatttaatgctcttt

SEQ ID NO: 59265 - DNA, 20 bp, Artificial Sequence
  chemically synthesized
gagttatttaatgctctttg

SEQ ID NO: 59266 - DNA, 20 bp, Artificial Sequence
  chemically synthesized
caatttttctatctataaaa

SEQ ID NO: 59267 - DNA, 20 bp, Artificial Sequence
  chemically synthesized
aatttttctatctataaaat

SEQ ID NO: 59268 - DNA, 20 bp, Artificial Sequence
  chemically synthesized
atttttctatctataaaata

SEQ ID NO: 59269 - DNA, 20 bp, Artificial Sequence
  chemically synthesized
ggctaataatttgcacctta

SEQ ID NO: 59270 - DNA, 20 bp, Artificial Sequence
  chemically synthesized
gctaataatttgcaccttat

SEQ ID NO: 59271 - DNA, 20 bp, Artificial Sequence
  chemically synthesized
ctaataatttgcaccttata

SEQ ID NO: 59272 - DNA, 20 bp, Artificial Sequence
  chemically synthesized
taatttgcaccttatagggt

SEQ ID NO: 59273 - DNA, 20 bp, Artificial Sequence
  chemically synthesized
caccttatagggtaagcttt

SEQ ID NO: 59274 - DNA, 20 bp, Artificial Sequence
  chemically synthesized
accttatagggtaagctttg

SEQ ID NO: 59275 - DNA, 20 bp, Artificial Sequence
  chemically synthesized
tatagggtaagctttgagga

SEQ ID NO: 59276 - DNA, 20 bp, Artificial Sequence
  chemically synthesized
ggtaagctttgaggacagat

SEQ ID NO: 59277 - DNA, 20 bp, Artificial Sequence
  chemically synthesized
tgaggacagattagatgata

SEQ ID NO: 59278 - DNA, 20 bp, Artificial Sequence
  chemically synthesized
atacggtgcctgtaaaacac

SEQ ID NO: 59279 - DNA, 20 bp, Artificial Sequence
  chemically synthesized
tacggtgcctgtaaaacacc

SEQ ID NO: 59280 - DNA, 20 bp, Artificial Sequence
  chemically synthesized
gcctgtaaaacaccaggtgt

SEQ ID NO: 59281 - DNA, 20 bp, Artificial Sequence
  chemically synthesized
gtaaaacaccaggtgttagt

SEQ ID NO: 59282 - DNA, 20 bp, Artificial Sequence
  chemically synthesized
acaccaggtgttagtaagtg

SEQ ID NO: 59283 - DNA, 20 bp, Artificial Sequence
  chemically synthesized
gttagtaagtgtggcaatga

SEQ ID NO: 59284 - DNA, 20 bp, Artificial Sequence
  chemically synthesized
gtggcaatgatggtgacgct

SEQ ID NO: 59285 - DNA, 20 bp, Artificial Sequence
  chemically synthesized
tggcaatgatggtgacgctg

SEQ ID NO: 59286 - DNA, 20 bp, Artificial Sequence
  chemically synthesized
cgctgaggctgatgtttgct

SEQ ID NO: 59287 - DNA, 20 bp, Artificial Sequence
  chemically synthesized
aggctgatgtttgcttagca

SEQ ID NO: 59288 - DNA, 20 bp, Artificial Sequence
  chemically synthesized
ggctgatgtttgcttagcat

SEQ ID NO: 59289 - DNA, 20 bp, Artificial Sequence
  chemically synthesized
gctgatgtttgcttagcata

SEQ ID NO: 59290 - DNA, 20 bp, Artificial Sequence
  chemically synthesized
atgtttgcttagcatagggt

SEQ ID NO: 59291 - DNA, 20 bp, Artificial Sequence
  chemically synthesized
tgtttgcttagcatagggtt

SEQ ID NO: 59292 - DNA, 20 bp, Artificial Sequence
  chemically synthesized
ttgcttagcatagggttagg

SEQ ID NO: 59293 - DNA, 20 bp, Artificial Sequence
  chemically synthesized
ttagcatagggttaggcagc

SEQ ID NO: 59294 - DNA, 20 bp, Artificial Sequence
  chemically synthesized
gcatagggttaggcagctgg

SEQ ID NO: 59295 - DNA, 20 bp, Artificial Sequence
  chemically synthesized
catagggttaggcagctggc

SEQ ID NO: 59296 - DNA, 20 bp, Artificial Sequence
  chemically synthesized
agggttaggcagctggcagg

SEQ ID NO: 59297 - DNA, 20 bp, Artificial Sequence
  chemically synthesized
ggcagctggcaggcagtaaa

SEQ ID NO: 59298 - DNA, 20 bp, Artificial Sequence
  chemically synthesized
gctggcaggcagtaaacagt

SEQ ID NO: 59299 - DNA, 20 bp, Artificial Sequence
  chemically synthesized
taaacagttggataatttaa

SEQ ID NO: 59300 - DNA, 20 bp, Artificial Sequence
  chemically synthesized
aatggaaaatttgccaaact

SEQ ID NO: 59301 - DNA, 20 bp, Artificial Sequence
  chemically synthesized
ctcagatgctgttcactgct

SEQ ID NO: 59302 - DNA, 20 bp, Artificial Sequence
  chemically synthesized
agatgctgttcactgctgag

SEQ ID NO: 59303 - DNA, 20 bp, Artificial Sequence
  chemically synthesized
gatgctgttcactgctgagc

SEQ ID NO: 59304 - DNA, 20 bp, Artificial Sequence
  chemically synthesized
tgctgttcactgctgagcag

SEQ ID NO: 59305 - DNA, 20 bp, Artificial Sequence
  chemically synthesized
ggagccccttcctgctgaaa

SEQ ID NO: 59306 - DNA, 20 bp, Artificial Sequence
  chemically synthesized
ccttcctgctgaaatggtcc

SEQ ID NO: 59307 - DNA, 20 bp, Artificial Sequence
  chemically synthesized
cttcctgctgaaatggtcct

SEQ ID NO: 59308 - DNA, 20 bp, Artificial Sequence
  chemically synthesized
ttcctgctgaaatggtcctg

SEQ ID NO: 59309 - DNA, 20 bp, Artificial Sequence
  chemically synthesized
cctgctgaaatggtcctggg

SEQ ID NO: 59310 - DNA, 20 bp, Artificial Sequence
  chemically synthesized
tgaaatggtcctggggagtg

SEQ ID NO: 59311 - DNA, 20 bp, Artificial Sequence
  chemically synthesized
aatggtcctggggagtgcag

SEQ ID NO: 59312 - DNA, 20 bp, Artificial Sequence
  chemically synthesized
atggtcctggggagtgcagc

SEQ ID NO: 59313 - DNA, 20 bp, Artificial Sequence
  chemically synthesized
ggggagtgcagcaggctctc

SEQ ID NO: 59314 - DNA, 20 bp, Artificial Sequence
  chemically synthesized
gggagtgcagcaggctctcc

SEQ ID NO: 59315 - DNA, 20 bp, Artificial Sequence
  chemically synthesized
agtgcagcaggctctccggg

SEQ ID NO: 59316 - DNA, 20 bp, Artificial Sequence
  chemically synthesized
ggaagaaatctaccatctct

SEQ ID NO: 59317 - DNA, 20 bp, Artificial Sequence
  chemically synthesized
gaagaaatctaccatctctc

SEQ ID NO: 59318 - DNA, 20 bp, Artificial Sequence
  chemically synthesized
gaaatctaccatctctcggg

SEQ ID NO: 59319 - DNA, 20 bp, Artificial Sequence
  chemically synthesized
aaatctaccatctctcgggc

SEQ ID NO: 59320 - DNA, 20 bp, Artificial Sequence
  chemically synthesized
atctaccatctctcgggcag

SEQ ID NO: 59321 - DNA, 20 bp, Artificial Sequence
  chemically synthesized
gcaggagctcaacctgtgtg

SEQ ID NO: 59322 - DNA, 20 bp, Artificial Sequence
  chemically synthesized
caggagctcaacctgtgtgc

SEQ ID NO: 59323 - DNA, 20 bp, Artificial Sequence
  chemically synthesized
gctcaacctgtgtgcaggta

SEQ ID NO: 59324 - DNA, 20 bp, Artificial Sequence
  chemically synthesized
ctcaacctgtgtgcaggtac

SEQ ID NO: 59325 - DNA, 20 bp, Artificial Sequence
  chemically synthesized
tcaacctgtgtgcaggtaca

SEQ ID NO: 59326 - DNA, 20 bp, Artificial Sequence
  chemically synthesized
aacctgtgtgcaggtacagg

SEQ ID NO: 59327 - DNA, 20 bp, Artificial Sequence
  chemically synthesized
acctgtgtgcaggtacaggg

SEQ ID NO: 59328 - DNA, 20 bp, Artificial Sequence
  chemically synthesized
cctgtgtgcaggtacaggga

SEQ ID NO: 59329 - DNA, 20 bp, Artificial Sequence
  chemically synthesized
acagggagggcttcctcacc

SEQ ID NO: 59330 - DNA, 20 bp, Artificial Sequence
  chemically synthesized
tgcccactcatgcattacgt

SEQ ID NO: 59331 - DNA, 20 bp, Artificial Sequence
  chemically synthesized
ttattcctcatccctgtcca

SEQ ID NO: 59332 - DNA, 20 bp, Artificial Sequence
  chemically synthesized
tattcctcatccctgtccaa

SEQ ID NO: 59333 - DNA, 20 bp, Artificial Sequence
  chemically synthesized
ggattcttttctccattgta

SEQ ID NO: 59334 - DNA, 20 bp, Artificial Sequence
  chemically synthesized
ttctccattgtacagctatg

SEQ ID NO: 59335 - DNA, 20 bp, Artificial Sequence
  chemically synthesized
ccattgtacagctatgaagc

SEQ ID NO: 59336 - DNA, 20 bp, Artificial Sequence
  chemically synthesized
agctatgaagctagtgctca

SEQ ID NO: 59337 - DNA, 20 bp, Artificial Sequence
  chemically synthesized
tatgaagctagtgctcaaag

SEQ ID NO: 59338 - DNA, 20 bp, Artificial Sequence
  chemically synthesized
agctagtgctcaaagaagtg

SEQ ID NO: 59339 - DNA, 20 bp, Artificial Sequence
  chemically synthesized
agaagtgaagtcatttaccc

SEQ ID NO: 59340 - DNA, 20 bp, Artificial Sequence
  chemically synthesized
gaagtgaagtcatttacccc

SEQ ID NO: 59341 - DNA, 20 bp, Artificial Sequence
  chemically synthesized
atttaccccaggccccctgc

SEQ ID NO: 59342 - DNA, 20 bp, Artificial Sequence
  chemically synthesized
accccaggccccctgccagt

SEQ ID NO: 59343 - DNA, 20 bp, Artificial Sequence
  chemically synthesized
ggccccctgccagtaagtga

SEQ ID NO: 59344 - DNA, 20 bp, Artificial Sequence
  chemically synthesized
gccccctgccagtaagtgac

SEQ ID NO: 59345 - DNA, 20 bp, Artificial Sequence
  chemically synthesized
ccccctgccagtaagtgaca

SEQ ID NO: 59346 - DNA, 20 bp, Artificial Sequence
  chemically synthesized
tgccagtaagtgacagggcc

SEQ ID NO: 59347 - DNA, 20 bp, Artificial Sequence
  chemically synthesized
tgacagggcctggtcacact

SEQ ID NO: 59348 - DNA, 20 bp, Artificial Sequence
  chemically synthesized
gacagggcctggtcacactt

SEQ ID NO: 59349 - DNA, 20 bp, Artificial Sequence
  chemically synthesized
acttgggtttatttattgcc

SEQ ID NO: 59350 - DNA, 20 bp, Artificial Sequence
  chemically synthesized
ttatttattgcccagttcaa

SEQ ID NO: 59351 - DNA, 20 bp, Artificial Sequence
  chemically synthesized
tatttattgcccagttcaac

SEQ ID NO: 59352 - DNA, 20 bp, Artificial Sequence
  chemically synthesized
ttcaacaggttgtttgacca

SEQ ID NO: 59353 - DNA, 20 bp, Artificial Sequence
  chemically synthesized
tcaacaggttgtttgaccat

SEQ ID NO: 59354 - DNA, 20 bp, Artificial Sequence
  chemically synthesized
caggttgtttgaccataggc

SEQ ID NO: 59355 - DNA, 20 bp, Artificial Sequence
  chemically synthesized
ttctcttccctgcaccctgc

SEQ ID NO: 59356 - DNA, 20 bp, Artificial Sequence
  chemically synthesized
tctcttccctgcaccctgcc

SEQ ID NO: 59357 - DNA, 20 bp, Artificial Sequence
  chemically synthesized
gcaccctgccgggttgctct

SEQ ID NO: 59358 - DNA, 20 bp, Artificial Sequence
  chemically synthesized
ggtcccttattttatgctcc

SEQ ID NO: 59359 - DNA, 20 bp, Artificial Sequence
  chemically synthesized
gtcccttattttatgctccc

SEQ ID NO: 59360 - DNA, 20 bp, Artificial Sequence
  chemically synthesized
ccttattttatgctcccggg

SEQ ID NO: 59361 - DNA, 20 bp, Artificial Sequence
  chemically synthesized
tttatgctcccgggtagaaa

SEQ ID NO: 59362 - DNA, 20 bp, Artificial Sequence
  chemically synthesized
ctcccgggtagaaatggtgt

SEQ ID NO: 59363 - DNA, 20 bp, Artificial Sequence
  chemically synthesized
gggtagaaatggtgtgagat

SEQ ID NO: 59364 - DNA, 20 bp, Artificial Sequence
  chemically synthesized
ggtagaaatggtgtgagatt

SEQ ID NO: 59365 - DNA, 20 bp, Artificial Sequence
  chemically synthesized
agaaatggtgtgagattagg

SEQ ID NO: 59366 - DNA, 20 bp, Artificial Sequence
  chemically synthesized
gaaatggtgtgagattaggc

SEQ ID NO: 59367 - DNA, 20 bp, Artificial Sequence
  chemically synthesized
aaatggtgtgagattaggca

SEQ ID NO: 59368 - DNA, 20 bp, Artificial Sequence
  chemically synthesized
atggtgtgagattaggcagg

SEQ ID NO: 59369 - DNA, 20 bp, Artificial Sequence
  chemically synthesized
gtgtgagattaggcagggag

SEQ ID NO: 59370 - DNA, 20 bp, Artificial Sequence
  chemically synthesized
gtggctcgcttccctgtccc

SEQ ID NO: 59371 - DNA, 20 bp, Artificial Sequence
  chemically synthesized
tccctgtccctggccccgca

SEQ ID NO: 59372 - DNA, 20 bp, Artificial Sequence
  chemically synthesized
cctgtccctggccccgcaaa

SEQ ID NO: 59373 - DNA, 20 bp, Artificial Sequence
  chemically synthesized
gctcccacctgccccgatcc

SEQ ID NO: 59374 - DNA, 20 bp, Artificial Sequence
  chemically synthesized
atcccagaaatgtcaccatg

SEQ ID NO: 59375 - DNA, 20 bp, Artificial Sequence
  chemically synthesized
ccatgaagccttcattcttt

SEQ ID NO: 59376 - DNA, 20 bp, Artificial Sequence
  chemically synthesized
gccttcattcttttggttta

SEQ ID NO: 59377 - DNA, 20 bp, Artificial Sequence
  chemically synthesized
cattcttttggtttaaagct

SEQ ID NO: 59378 - DNA, 20 bp, Artificial Sequence
  chemically synthesized
tttggtttaaagcttggcct

SEQ ID NO: 59379 - DNA, 20 bp, Artificial Sequence
  chemically synthesized
gcctcagtgtccgtacacca

SEQ ID NO: 59380 - DNA, 20 bp, Artificial Sequence
  chemically synthesized
cctcagtgtccgtacaccat

SEQ ID NO: 59381 - DNA, 20 bp, Artificial Sequence
  chemically synthesized
ctcagtgtccgtacaccatg

SEQ ID NO: 59382 - DNA, 20 bp, Artificial Sequence
  chemically synthesized
tccgtacaccatggggtact

SEQ ID NO: 59383 - DNA, 20 bp, Artificial Sequence
  chemically synthesized
tacaccatggggtacttggc

SEQ ID NO: 59384 - DNA, 20 bp, Artificial Sequence
  chemically synthesized
ccatggggtacttggccaga

SEQ ID NO: 59385 - DNA, 20 bp, Artificial Sequence
  chemically synthesized
gatggcgactttctcctctc

SEQ ID NO: 59386 - DNA, 20 bp, Artificial Sequence
  chemically synthesized
ctcctctccagtcgccctcc

SEQ ID NO: 59387 - DNA, 20 bp, Artificial Sequence
  chemically synthesized
tcctctccagtcgccctccc

SEQ ID NO: 59388 - DNA, 20 bp, Artificial Sequence
  chemically synthesized
ccagtcgccctcccaggcac

SEQ ID NO: 59389 - DNA, 20 bp, Artificial Sequence
  chemically synthesized
ccctcccaggcactagcttt

SEQ ID NO: 59390 - DNA, 20 bp, Artificial Sequence
  chemically synthesized
cctcccaggcactagctttt

SEQ ID NO: 59391 - DNA, 20 bp, Artificial Sequence
  chemically synthesized
tcccaggcactagcttttag

SEQ ID NO: 59392 - DNA, 20 bp, Artificial Sequence
  chemically synthesized
ggcactagcttttaggagtg

SEQ ID NO: 59393 - DNA, 20 bp, Artificial Sequence
  chemically synthesized
gcactagcttttaggagtgc

SEQ ID NO: 59394 - DNA, 20 bp, Artificial Sequence
  chemically synthesized
cactagcttttaggagtgca

SEQ ID NO: 59395 - DNA, 20 bp, Artificial Sequence
  chemically synthesized
gtgcagggtgctgcctctga

SEQ ID NO: 59396 - DNA, 20 bp, Artificial Sequence
  chemically synthesized
cagggtgctgcctctgatag

SEQ ID NO: 59397 - DNA, 20 bp, Artificial Sequence
  chemically synthesized
agggtgctgcctctgataga

SEQ ID NO: 59398 - DNA, 20 bp, Artificial Sequence
  chemically synthesized
gggtgctgcctctgatagaa

SEQ ID NO: 59399 - DNA, 20 bp, Artificial Sequence
  chemically synthesized
gctgcctctgatagaagggc

SEQ ID NO: 59400 - DNA, 20 bp, Artificial Sequence
  chemically synthesized
ctgcctctgatagaagggcc

SEQ ID NO: 59401 - DNA, 20 bp, Artificial Sequence
  chemically synthesized
gcctctgatagaagggccag

SEQ ID NO: 59402 - DNA, 20 bp, Artificial Sequence
  chemically synthesized
ctctgatagaagggccagga

SEQ ID NO: 59403 - DNA, 20 bp, Artificial Sequence
  chemically synthesized
ctgatagaagggccaggaga

SEQ ID NO: 59404 - DNA, 20 bp, Artificial Sequence
  chemically synthesized
atagaagggccaggagagag

SEQ ID NO: 59405 - DNA, 20 bp, Artificial Sequence
  chemically synthesized
tagaagggccaggagagagc

SEQ ID NO: 59406 - DNA, 20 bp, Artificial Sequence
  chemically synthesized
ggccaggagagagcaggttt

SEQ ID NO: 59407 - DNA, 20 bp, Artificial Sequence
  chemically synthesized
ccaggagagagcaggttttg

SEQ ID NO: 59408 - DNA, 20 bp, Artificial Sequence
  chemically synthesized
ttttggagtcctgatgttat

SEQ ID NO: 59409 - DNA, 20 bp, Artificial Sequence
  chemically synthesized
tttggagtcctgatgttata

SEQ ID NO: 59410 - DNA, 20 bp, Artificial Sequence
  chemically synthesized
agtcctgatgttataaggaa

SEQ ID NO: 59411 - DNA, 20 bp, Artificial Sequence
  chemically synthesized
tgatgttataaggaacagct

SEQ ID NO: 59412 - DNA, 20 bp, Artificial Sequence
  chemically synthesized
gatgttataaggaacagctt

SEQ ID NO: 59413 - DNA, 20 bp, Artificial Sequence
  chemically synthesized
tgttataaggaacagcttgg

SEQ ID NO: 59414 - DNA, 20 bp, Artificial Sequence
  chemically synthesized
gttataaggaacagcttggg

SEQ ID NO: 59415 - DNA, 20 bp, Artificial Sequence
  chemically synthesized
atgaacccaacatgatgctt

SEQ ID NO: 59416 - DNA, 20 bp, Artificial Sequence
  chemically synthesized
gatgcttgagaccaatgtca

SEQ ID NO: 59417 - DNA, 20 bp, Artificial Sequence
  chemically synthesized
aattctgacattcatcatct

SEQ ID NO: 59418 - DNA, 20 bp, Artificial Sequence
  chemically synthesized
acattcatcatctgagatct

SEQ ID NO: 59419 - DNA, 20 bp, Artificial Sequence
  chemically synthesized
cattcatcatctgagatctg

SEQ ID NO: 59420 - DNA, 20 bp, Artificial Sequence
  chemically synthesized
tcatctgagatctgaggaca

SEQ ID NO: 59421 - DNA, 20 bp, Artificial Sequence
  chemically synthesized
atctgaggacacagctgtct

SEQ ID NO: 59422 - DNA, 20 bp, Artificial Sequence
  chemically synthesized
gctgtctcagttcatgatct

SEQ ID NO: 59423 - DNA, 20 bp, Artificial Sequence
  chemically synthesized
tcagttcatgatctgagtgc

SEQ ID NO: 59424 - DNA, 20 bp, Artificial Sequence
  chemically synthesized
cagttcatgatctgagtgct

SEQ ID NO: 59425 - DNA, 20 bp, Artificial Sequence
  chemically synthesized
tcatgatctgagtgctggga

SEQ ID NO: 59426 - DNA, 20 bp, Artificial Sequence
  chemically synthesized
atctgagtgctgggaaagcc

SEQ ID NO: 59427 - DNA, 20 bp, Artificial Sequence
  chemically synthesized
gggaaagccaagacttgttc

SEQ ID NO: 59428 - DNA, 20 bp, Artificial Sequence
  chemically synthesized
tttgtcactgacttgctgta

SEQ ID NO: 59429 - DNA, 20 bp, Artificial Sequence
  chemically synthesized
acttgctgtatagcctcaac

SEQ ID NO: 59430 - DNA, 20 bp, Artificial Sequence
  chemically synthesized
cttgctgtatagcctcaaca

SEQ ID NO: 59431 - DNA, 20 bp, Artificial Sequence
  chemically synthesized
aacaaggccctgaccctctc

SEQ ID NO: 59432 - DNA, 20 bp, Artificial Sequence
  chemically synthesized
acaaggccctgaccctctct

SEQ ID NO: 59433 - DNA, 20 bp, Artificial Sequence
  chemically synthesized
cttcaaactcttcactgtga

SEQ ID NO: 59434 - DNA, 20 bp, Artificial Sequence
  chemically synthesized
ttcaaactcttcactgtgaa

SEQ ID NO: 59435 - DNA, 20 bp, Artificial Sequence
  chemically synthesized
caaactcttcactgtgaaag

SEQ ID NO: 59436 - DNA, 20 bp, Artificial Sequence
  chemically synthesized
aaactcttcactgtgaaagg

SEQ ID NO: 59437 - DNA, 20 bp, Artificial Sequence
  chemically synthesized
tcactgtgaaaggaggaaac

SEQ ID NO: 59438 - DNA, 20 bp, Artificial Sequence
  chemically synthesized
actgtgaaaggaggaaacca

SEQ ID NO: 59439 - DNA, 20 bp, Artificial Sequence
  chemically synthesized
gtgaaaggaggaaaccagag

SEQ ID NO: 59440 - DNA, 20 bp, Artificial Sequence
  chemically synthesized
tgaaaggaggaaaccagagt

SEQ ID NO: 59441 - DNA, 20 bp, Artificial Sequence
  chemically synthesized
cagagtaggtgatgtgacac

SEQ ID NO: 59442 - DNA, 20 bp, Artificial Sequence
  chemically synthesized
agagtaggtgatgtgacacc

SEQ ID NO: 59443 - DNA, 20 bp, Artificial Sequence
  chemically synthesized
taggtgatgtgacaccagga

SEQ ID NO: 59444 - DNA, 20 bp, Artificial Sequence
  chemically synthesized
tgatgtgacaccaggaaaga

SEQ ID NO: 59445 - DNA, 20 bp, Artificial Sequence
  chemically synthesized
gtgacaccaggaaagatgga

SEQ ID NO: 59446 - DNA, 20 bp, Artificial Sequence
  chemically synthesized
tgacaccaggaaagatggat

SEQ ID NO: 59447 - DNA, 20 bp, Artificial Sequence
  chemically synthesized
ccaggaaagatggatgggtg

SEQ ID NO: 59448 - DNA, 20 bp, Artificial Sequence
  chemically synthesized
caggaaagatggatgggtgt

SEQ ID NO: 59449 - DNA, 20 bp, Artificial Sequence
  chemically synthesized
aggaaagatggatgggtgtg

SEQ ID NO: 59450 - DNA, 20 bp, Artificial Sequence
  chemically synthesized
ggaaagatggatgggtgtgg

SEQ ID NO: 59451 - DNA, 20 bp, Artificial Sequence
  chemically synthesized
gtgggggaatgtgctcctcc

SEQ ID NO: 59452 - DNA, 20 bp, Artificial Sequence
  chemically synthesized
cctcgccaccctccctgcac

SEQ ID NO: 59453 - DNA, 20 bp, Artificial Sequence
  chemically synthesized
ccagcctctccacctccttt

SEQ ID NO: 59454 - DNA, 20 bp, Artificial Sequence
  chemically synthesized
ctctccacctcctttgagcc

SEQ ID NO: 59455 - DNA, 20 bp, Artificial Sequence
  chemically synthesized
gagcccagaattcccctgtc

SEQ ID NO: 59456 - DNA, 20 bp, Artificial Sequence
  chemically synthesized
agcccagaattcccctgtct

SEQ ID NO: 59457 - DNA, 20 bp, Artificial Sequence
  chemically synthesized
cccagaattcccctgtctag

SEQ ID NO: 59458 - DNA, 20 bp, Artificial Sequence
  chemically synthesized
ccagaattcccctgtctagg

SEQ ID NO: 59459 - DNA, 20 bp, Artificial Sequence
  chemically synthesized
cagaattcccctgtctagga

SEQ ID NO: 59460 - DNA, 20 bp, Artificial Sequence
  chemically synthesized
gagggcacctgtctcatgcc

SEQ ID NO: 59461 - DNA, 20 bp, Artificial Sequence
  chemically synthesized
acctgtctcatgcctagcca

SEQ ID NO: 59462 - DNA, 20 bp, Artificial Sequence
  chemically synthesized
cctgtctcatgcctagccat

SEQ ID NO: 59463 - DNA, 20 bp, Artificial Sequence
  chemically synthesized
ctgttttgctacattgaacc

SEQ ID NO: 59464 - DNA, 20 bp, Artificial Sequence
  chemically synthesized
acccagatgccattctaacc

SEQ ID NO: 59465 - DNA, 20 bp, Artificial Sequence
  chemically synthesized
gccattctaaccaagaatcc

SEQ ID NO: 59466 - DNA, 20 bp, Artificial Sequence
  chemically synthesized
ttctaaccaagaatcctggc

SEQ ID NO: 59467 - DNA, 20 bp, Artificial Sequence
  chemically synthesized
tctaaccaagaatcctggct

SEQ ID NO: 59468 - DNA, 20 bp, Artificial Sequence
  chemically synthesized
ccaagaatcctggctgggtg

SEQ ID NO: 59469 - DNA, 20 bp, Artificial Sequence
  chemically synthesized
caagaatcctggctgggtgc

SEQ ID NO: 59470 - DNA, 20 bp, Artificial Sequence
  chemically synthesized
aagaatcctggctgggtgca

SEQ ID NO: 59471 - DNA, 20 bp, Artificial Sequence
  chemically synthesized
agaatcctggctgggtgcag

SEQ ID NO: 59472 - DNA, 20 bp, Artificial Sequence
  chemically synthesized
ggggctctcgcctgtaaccc

SEQ ID NO: 59473 - DNA, 20 bp, Artificial Sequence
  chemically synthesized
cgcctgtaaccccagcactt

SEQ ID NO: 59474 - DNA, 20 bp, Artificial Sequence
  chemically synthesized
gcctgtaaccccagcacttt

SEQ ID NO: 59475 - DNA, 20 bp, Artificial Sequence
  chemically synthesized
ctgtaaccccagcactttgg

SEQ ID NO: 59476 - DNA, 20 bp, Artificial Sequence
  chemically synthesized
tgtaaccccagcactttggg

SEQ ID NO: 59477 - DNA, 20 bp, Artificial Sequence
  chemically synthesized
ccccagcactttgggaggcc

SEQ ID NO: 59478 - DNA, 20 bp, Artificial Sequence
  chemically synthesized
cccagcactttgggaggcca

SEQ ID NO: 59479 - DNA, 20 bp, Artificial Sequence
  chemically synthesized
agcactttgggaggccaagg

SEQ ID NO: 59480 - DNA, 20 bp, Artificial Sequence
  chemically synthesized
gcactttgggaggccaaggc

SEQ ID NO: 59481 - DNA, 20 bp, Artificial Sequence
  chemically synthesized
ctttgggaggccaaggcagg

SEQ ID NO: 59482 - DNA, 20 bp, Artificial Sequence
  chemically synthesized
gaggccaaggcaggcggatc

SEQ ID NO: 59483 - DNA, 20 bp, Artificial Sequence
  chemically synthesized
ggccaaggcaggcggatcaa

SEQ ID NO: 59484 - DNA, 20 bp, Artificial Sequence
  chemically synthesized
gccaaggcaggcggatcaag

SEQ ID NO: 59485 - DNA, 20 bp, Artificial Sequence
  chemically synthesized
aggcaggcggatcaagaggt

SEQ ID NO: 59486 - DNA, 20 bp, Artificial Sequence
  chemically synthesized
ggcaggcggatcaagaggtc

SEQ ID NO: 59487 - DNA, 20 bp, Artificial Sequence
  chemically synthesized
caggcggatcaagaggtcag

SEQ ID NO: 59488 - DNA, 20 bp, Artificial Sequence
  chemically synthesized
gatcaagaggtcaggagttc

SEQ ID NO: 59489 - DNA, 20 bp, Artificial Sequence
  chemically synthesized
tcaggagttcaagacctgcc

SEQ ID NO: 59490 - DNA, 20 bp, Artificial Sequence
  chemically synthesized
caagacctgcctggccaaca

SEQ ID NO: 59491 - DNA, 20 bp, Artificial Sequence
  chemically synthesized
tggccaacacggtgaaacct

SEQ ID NO: 59492 - DNA, 20 bp, Artificial Sequence
  chemically synthesized
tctactaaaaatacaaaaat

SEQ ID NO: 59493 - DNA, 20 bp, Artificial Sequence
  chemically synthesized
ctaaaaatacaaaaattagc

SEQ ID NO: 59494 - DNA, 20 bp, Artificial Sequence
  chemically synthesized
taaaaatacaaaaattagcc

SEQ ID NO: 59495 - DNA, 20 bp, Artificial Sequence
  chemically synthesized
atacaaaaattagccaggcg

SEQ ID NO: 59496 - DNA, 20 bp, Artificial Sequence
  chemically synthesized
caaaaattagccaggcgtgg

SEQ ID NO: 59497 - DNA, 20 bp, Artificial Sequence
  chemically synthesized
gtggcacacgcctgtaatcc

SEQ ID NO: 59498 - DNA, 20 bp, Artificial Sequence
  chemically synthesized
cgcctgtaatcccagctatt

SEQ ID NO: 59499 - DNA, 20 bp, Artificial Sequence
  chemically synthesized
gcctgtaatcccagctattt

SEQ ID NO: 59500 - DNA, 20 bp, Artificial Sequence
  chemically synthesized
tgtaatcccagctatttggg

SEQ ID NO: 59501 - DNA, 20 bp, Artificial Sequence
  chemically synthesized
tcccagctatttgggaagct

SEQ ID NO: 59502 - DNA, 20 bp, Artificial Sequence
  chemically synthesized
agctatttgggaagctgaga

SEQ ID NO: 59503 - DNA, 20 bp, Artificial Sequence
  chemically synthesized
tatttgggaagctgagacag

SEQ ID NO: 59504 - DNA, 20 bp, Artificial Sequence
  chemically synthesized
acagaagaatttcttgaacc

SEQ ID NO: 59505 - DNA, 20 bp, Artificial Sequence
  chemically synthesized
cagaagaatttcttgaaccc

SEQ ID NO: 59506 - DNA, 20 bp, Artificial Sequence
  chemically synthesized
gaagaatttcttgaacccgg

SEQ ID NO: 59507 - DNA, 20 bp, Artificial Sequence
  chemically synthesized
aagaatttcttgaacccggg

SEQ ID NO: 59508 - DNA, 20 bp, Artificial Sequence
  chemically synthesized
aatttcttgaacccgggagg

SEQ ID NO: 59509 - DNA, 20 bp, Artificial Sequence
  chemically synthesized
tttcttgaacccgggaggtg

SEQ ID NO: 59510 - DNA, 20 bp, Artificial Sequence
  chemically synthesized
ttcttgaacccgggaggtgg

SEQ ID NO: 59511 - DNA, 20 bp, Artificial Sequence
  chemically synthesized
aacccgggaggtggaggttt

SEQ ID NO: 59512 - DNA, 20 bp, Artificial Sequence
  chemically synthesized
cgggaggtggaggtttcagt

SEQ ID NO: 59513 - DNA, 20 bp, Artificial Sequence
  chemically synthesized
ggtggaggtttcagtgagcc

SEQ ID NO: 59514 - DNA, 20 bp, Artificial Sequence
  chemically synthesized
cacgccactgcactccaccc

SEQ ID NO: 59515 - DNA, 20 bp, Artificial Sequence
  chemically synthesized
gccactgcactccaccctgg

SEQ ID NO: 59516 - DNA, 20 bp, Artificial Sequence
  chemically synthesized
gcactccaccctggcagata

SEQ ID NO: 59517 - DNA, 20 bp, Artificial Sequence
  chemically synthesized
tccaccctggcagataaagc

SEQ ID NO: 59518 - DNA, 20 bp, Artificial Sequence
  chemically synthesized
aaaaacccaaaaacctatgt

SEQ ID NO: 59519 - DNA, 20 bp, Artificial Sequence
  chemically synthesized
caaaaacctatgttagtgta

SEQ ID NO: 59520 - DNA, 20 bp, Artificial Sequence
  chemically synthesized
aaaacctatgttagtgtaca

SEQ ID NO: 59521 - DNA, 20 bp, Artificial Sequence
  chemically synthesized
aaacctatgttagtgtacag

SEQ ID NO: 59522 - DNA, 20 bp, Artificial Sequence
  chemically synthesized
aacctatgttagtgtacaga

SEQ ID NO: 59523 - DNA, 20 bp, Artificial Sequence
  chemically synthesized
tgttagtgtacagagggccc

SEQ ID NO: 59524 - DNA, 20 bp, Artificial Sequence
  chemically synthesized
gtgtacagagggccccagtg

SEQ ID NO: 59525 - DNA, 20 bp, Artificial Sequence
  chemically synthesized
gccccagtgaagtcttctcc

SEQ ID NO: 59526 - DNA, 20 bp, Artificial Sequence
  chemically synthesized
ccagccccactttgcacaac

SEQ ID NO: 59527 - DNA, 20 bp, Artificial Sequence
  chemically synthesized
cagccccactttgcacaact

SEQ ID NO: 59528 - DNA, 20 bp, Artificial Sequence
  chemically synthesized
agccccactttgcacaactg

SEQ ID NO: 59529 - DNA, 20 bp, Artificial Sequence
  chemically synthesized
ccccactttgcacaactggg

SEQ ID NO: 59530 - DNA, 20 bp, Artificial Sequence
  chemically synthesized
ccactttgcacaactgggga

SEQ ID NO: 59531 - DNA, 20 bp, Artificial Sequence
  chemically synthesized
tttgcacaactggggagagt

SEQ ID NO: 59532 - DNA, 20 bp, Artificial Sequence
  chemically synthesized
ttgcacaactggggagagtg

SEQ ID NO: 59533 - DNA, 20 bp, Artificial Sequence
  chemically synthesized
aactggggagagtgaggccc

SEQ ID NO: 59534 - DNA, 20 bp, Artificial Sequence
  chemically synthesized
actggggagagtgaggcccc

SEQ ID NO: 59535 - DNA, 20 bp, Artificial Sequence
  chemically synthesized
ggagagtgaggccccaggac

SEQ ID NO: 59536 - DNA, 20 bp, Artificial Sequence
  chemically synthesized
agagtgaggccccaggacca

SEQ ID NO: 59537 - DNA, 20 bp, Artificial Sequence
  chemically synthesized
gagtgaggccccaggaccag

SEQ ID NO: 59538 - DNA, 20 bp, Artificial Sequence
  chemically synthesized
ggaccagaggattcttgcta

SEQ ID NO: 59539 - DNA, 20 bp, Artificial Sequence
  chemically synthesized
gaccagaggattcttgctaa

SEQ ID NO: 59540 - DNA, 20 bp, Artificial Sequence
  chemically synthesized
gaggattcttgctaaaggcc

SEQ ID NO: 59541 - DNA, 20 bp, Artificial Sequence
  chemically synthesized
gattcttgctaaaggccaag

SEQ ID NO: 59542 - DNA, 20 bp, Artificial Sequence
  chemically synthesized
cttgctaaaggccaagtgga

SEQ ID NO: 59543 - DNA, 20 bp, Artificial Sequence
  chemically synthesized
aaaggccaagtggatagtga

SEQ ID NO: 59544 - DNA, 20 bp, Artificial Sequence
  chemically synthesized
gtggatagtgatggccctgc

SEQ ID NO: 59545 - DNA, 20 bp, Artificial Sequence
  chemically synthesized
tggatagtgatggccctgcc

SEQ ID NO: 59546 - DNA, 20 bp, Artificial Sequence
  chemically synthesized
ggatagtgatggccctgcca

SEQ ID NO: 59547 - DNA, 20 bp, Artificial Sequence
  chemically synthesized
agtgatggccctgccagggc

SEQ ID NO: 59548 - DNA, 20 bp, Artificial Sequence
  chemically synthesized
gatggccctgccagggctag

SEQ ID NO: 59549 - DNA, 20 bp, Artificial Sequence
  chemically synthesized
gggctagaagccacaacctc

SEQ ID NO: 59550 - DNA, 20 bp, Artificial Sequence
  chemically synthesized
aagccacaacctctggccct

SEQ ID NO: 59551 - DNA, 20 bp, Artificial Sequence
  chemically synthesized
agccacaacctctggccctg

SEQ ID NO: 59552 - DNA, 20 bp, Artificial Sequence
  chemically synthesized
cctctggccctgaggccact

SEQ ID NO: 59553 - DNA, 20 bp, Artificial Sequence
  chemically synthesized
ctgaggccactcagcatatt

SEQ ID NO: 59554 - DNA, 20 bp, Artificial Sequence
  chemically synthesized
tatttagtgtccccaccctg

SEQ ID NO: 59555 - DNA, 20 bp, Artificial Sequence
  chemically synthesized
tttagtgtccccaccctgca

SEQ ID NO: 59556 - DNA, 20 bp, Artificial Sequence
  chemically synthesized
ttagtgtccccaccctgcag

SEQ ID NO: 59557 - DNA, 20 bp, Artificial Sequence
  chemically synthesized
ccaactccctcctgaccact

SEQ ID NO: 59558 - DNA, 20 bp, Artificial Sequence
  chemically synthesized
accactgagccctgtaatga

SEQ ID NO: 59559 - DNA, 20 bp, Artificial Sequence
  chemically synthesized
ccactgagccctgtaatgat

SEQ ID NO: 59560 - DNA, 20 bp, Artificial Sequence
  chemically synthesized
cactgagccctgtaatgatg

SEQ ID NO: 59561 - DNA, 20 bp, Artificial Sequence
  chemically synthesized
actgagccctgtaatgatgg

SEQ ID NO: 59562 - DNA, 20 bp, Artificial Sequence
  chemically synthesized
aatgatgggggaatttccat

SEQ ID NO: 59563 - DNA, 20 bp, Artificial Sequence
  chemically synthesized
gggaatttccataagccatg

SEQ ID NO: 59564 - DNA, 20 bp, Artificial Sequence
  chemically synthesized
ggaatttccataagccatga

SEQ ID NO: 59565 - DNA, 20 bp, Artificial Sequence
  chemically synthesized
aagccatgaaggactgcaca

SEQ ID NO: 59566 - DNA, 20 bp, Artificial Sequence
  chemically synthesized
atgaaggactgcacaaagtt

SEQ ID NO: 59567 - DNA, 20 bp, Artificial Sequence
  chemically synthesized
aggactgcacaaagttcagt

SEQ ID NO: 59568 - DNA, 20 bp, Artificial Sequence
  chemically synthesized
ggactgcacaaagttcagtt

SEQ ID NO: 59569 - DNA, 20 bp, Artificial Sequence
  chemically synthesized
ctgcacaaagttcagttggg

SEQ ID NO: 59570 - DNA, 20 bp, Artificial Sequence
  chemically synthesized
aaagttcagttgggaagtga

SEQ ID NO: 59571 - DNA, 20 bp, Artificial Sequence
  chemically synthesized
agttcagttgggaagtgaaa

SEQ ID NO: 59572 - DNA, 20 bp, Artificial Sequence
  chemically synthesized
gggaagtgaaagagaaatta

SEQ ID NO: 59573 - DNA, 20 bp, Artificial Sequence
  chemically synthesized
ggaagtgaaagagaaattaa

SEQ ID NO: 59574 - DNA, 20 bp, Artificial Sequence
  chemically synthesized
gaagtgaaagagaaattaaa

SEQ ID NO: 59575 - DNA, 20 bp, Artificial Sequence
  chemically synthesized
agtgaaagagaaattaaagg

SEQ ID NO: 59576 - DNA, 20 bp, Artificial Sequence
  chemically synthesized
aaagagaaattaaagggaga

SEQ ID NO: 59577 - DNA, 20 bp, Artificial Sequence
  chemically synthesized
taaagggagatggaaatata

SEQ ID NO: 59578 - DNA, 20 bp, Artificial Sequence
  chemically synthesized
gaaatatacagcactaattt

SEQ ID NO: 59579 - DNA, 20 bp, Artificial Sequence
  chemically synthesized
actaattttagcaccgtctt

SEQ ID NO: 59580 - DNA, 20 bp, Artificial Sequence
  chemically synthesized
gtctttagttctaacaacac

SEQ ID NO: 59581 - DNA, 20 bp, Artificial Sequence
  chemically synthesized
ttagttctaacaacactagc

SEQ ID NO: 59582 - DNA, 20 bp, Artificial Sequence
  chemically synthesized
ctaacaacactagctagctg

SEQ ID NO: 59583 - DNA, 20 bp, Artificial Sequence
  chemically synthesized
aacatgtattatgtaatgtg

SEQ ID NO: 59584 - DNA, 20 bp, Artificial Sequence
  chemically synthesized
aatgtgtggtctgttccatt

SEQ ID NO: 59585 - DNA, 20 bp, Artificial Sequence
  chemically synthesized
tctgttccatttggattact

SEQ ID NO: 59586 - DNA, 20 bp, Artificial Sequence
  chemically synthesized
tgttccatttggattactta

SEQ ID NO: 59587 - DNA, 20 bp, Artificial Sequence
  chemically synthesized
gttccatttggattacttag

SEQ ID NO: 59588 - DNA, 20 bp, Artificial Sequence
  chemically synthesized
tttggattacttagaggcac

SEQ ID NO: 59589 - DNA, 20 bp, Artificial Sequence
  chemically synthesized
ttggattacttagaggcacg

SEQ ID NO: 59590 - DNA, 20 bp, Artificial Sequence
  chemically synthesized
tggattacttagaggcacga

SEQ ID NO: 59591 - DNA, 20 bp, Artificial Sequence
  chemically synthesized
ttacttagaggcacgagggc

SEQ ID NO: 59592 - DNA, 20 bp, Artificial Sequence
  chemically synthesized
tacttagaggcacgagggcc

SEQ ID NO: 59593 - DNA, 20 bp, Artificial Sequence
  chemically synthesized
cttagaggcacgagggccag

SEQ ID NO: 59594 - DNA, 20 bp, Artificial Sequence
  chemically synthesized
gaggcacgagggccaggaga

SEQ ID NO: 59595 - DNA, 20 bp, Artificial Sequence
  chemically synthesized
aggcacgagggccaggagaa

SEQ ID NO: 59596 - DNA, 20 bp, Artificial Sequence
  chemically synthesized
cacgagggccaggagaaagg

SEQ ID NO: 59597 - DNA, 20 bp, Artificial Sequence
  chemically synthesized
gagggccaggagaaaggtgg

SEQ ID NO: 59598 - DNA, 20 bp, Artificial Sequence
  chemically synthesized
gggccaggagaaaggtggtg

SEQ ID NO: 59599 - DNA, 20 bp, Artificial Sequence
  chemically synthesized
gccaggagaaaggtggtgga

SEQ ID NO: 59600 - DNA, 20 bp, Artificial Sequence
  chemically synthesized
gaaaggtggtggagagaaac

SEQ ID NO: 59601 - DNA, 20 bp, Artificial Sequence
  chemically synthesized
cacttcatttgttgctttat

SEQ ID NO: 59602 - DNA, 20 bp, Artificial Sequence
  chemically synthesized
ttcatttgttgctttattgg

SEQ ID NO: 59603 - DNA, 20 bp, Artificial Sequence
  chemically synthesized
tcatttgttgctttattgga

SEQ ID NO: 59604 - DNA, 20 bp, Artificial Sequence
  chemically synthesized
tattggaaggaaacttttaa

SEQ ID NO: 59605 - DNA, 20 bp, Artificial Sequence
  chemically synthesized
aaggaaacttttaaaagtcc

SEQ ID NO: 59606 - DNA, 20 bp, Artificial Sequence
  chemically synthesized
aggaaacttttaaaagtcca

SEQ ID NO: 59607 - DNA, 20 bp, Artificial Sequence
  chemically synthesized
ggaaacttttaaaagtccaa

SEQ ID NO: 59608 - DNA, 20 bp, Artificial Sequence
  chemically synthesized
gaaacttttaaaagtccaag

SEQ ID NO: 59609 - DNA, 20 bp, Artificial Sequence
  chemically synthesized
aaacttttaaaagtccaagg

SEQ ID NO: 59610 - DNA, 20 bp, Artificial Sequence
  chemically synthesized
ttaaaagtccaagggggttg

SEQ ID NO: 59611 - DNA, 20 bp, Artificial Sequence
  chemically synthesized
atctcaatatttgttatttc

SEQ ID NO: 59612 - DNA, 20 bp, Artificial Sequence
  chemically synthesized
tatttccagctttttttctc

SEQ ID NO: 59613 - DNA, 20 bp, Artificial Sequence
  chemically synthesized
gtttttcatttcccaaattc

SEQ ID NO: 59614 - DNA, 20 bp, Artificial Sequence
  chemically synthesized
tttttcatttcccaaattca

SEQ ID NO: 59615 - DNA, 20 bp, Artificial Sequence
  chemically synthesized
ctttttctttgtattttgtt

SEQ ID NO: 59616 - DNA, 20 bp, Artificial Sequence
  chemically synthesized
tttgtattttgttaagatga

SEQ ID NO: 59617 - DNA, 20 bp, Artificial Sequence
  chemically synthesized
ttttgttaagatgatggttt

SEQ ID NO: 59618 - DNA, 20 bp, Artificial Sequence
  chemically synthesized
gatggttttggttttgtgac

SEQ ID NO: 59619 - DNA, 20 bp, Artificial Sequence
  chemically synthesized
ggttttggttttgtgactag

SEQ ID NO: 59620 - DNA, 20 bp, Artificial Sequence
  chemically synthesized
gtgactagtagttaacaatg

SEQ ID NO: 59621 - DNA, 20 bp, Artificial Sequence
  chemically synthesized
gtagttaacaatgtggctgc

SEQ ID NO: 59622 - DNA, 20 bp, Artificial Sequence
  chemically synthesized
tagttaacaatgtggctgcc

SEQ ID NO: 59623 - DNA, 20 bp, Artificial Sequence
  chemically synthesized
gctgccgggcatattctcct

SEQ ID NO: 59624 - DNA, 20 bp, Artificial Sequence
  chemically synthesized
ccgggcatattctcctcagc

SEQ ID NO: 59625 - DNA, 20 bp, Artificial Sequence
  chemically synthesized
cgggcatattctcctcagct

SEQ ID NO: 59626 - DNA, 20 bp, Artificial Sequence
  chemically synthesized
attctcctcagctaggacct

SEQ ID NO: 59627 - DNA, 20 bp, Artificial Sequence
  chemically synthesized
cctcagttttcccatctgtg

SEQ ID NO: 59628 - DNA, 20 bp, Artificial Sequence
  chemically synthesized
agttttcccatctgtgaaga

SEQ ID NO: 59629 - DNA, 20 bp, Artificial Sequence
  chemically synthesized
tttcccatctgtgaagacgg

SEQ ID NO: 59630 - DNA, 20 bp, Artificial Sequence
  chemically synthesized
ttcccatctgtgaagacggc

SEQ ID NO: 59631 - DNA, 20 bp, Artificial Sequence
  chemically synthesized
tgaagacggcaggttctacc

SEQ ID NO: 59632 - DNA, 20 bp, Artificial Sequence
  chemically synthesized
gaagacggcaggttctacct

SEQ ID NO: 59633 - DNA, 20 bp, Artificial Sequence
  chemically synthesized
aagacggcaggttctaccta

SEQ ID NO: 59634 - DNA, 20 bp, Artificial Sequence
  chemically synthesized
agacggcaggttctacctag

SEQ ID NO: 59635 - DNA, 20 bp, Artificial Sequence
  chemically synthesized
gacggcaggttctacctagg

SEQ ID NO: 59636 - DNA, 20 bp, Artificial Sequence
  chemically synthesized
aggttctacctagggggctg

SEQ ID NO: 59637 - DNA, 20 bp, Artificial Sequence
  chemically synthesized
ggttctacctagggggctgc

SEQ ID NO: 59638 - DNA, 20 bp, Artificial Sequence
  chemically synthesized
ctacctagggggctgcaggc

SEQ ID NO: 59639 - DNA, 20 bp, Artificial Sequence
  chemically synthesized
cctagggggctgcaggctgg

SEQ ID NO: 59640 - DNA, 20 bp, Artificial Sequence
  chemically synthesized
ggctgcaggctggtggtccg

SEQ ID NO: 59641 - DNA, 20 bp, Artificial Sequence
  chemically synthesized
caggctggtggtccgaagcc

SEQ ID NO: 59642 - DNA, 20 bp, Artificial Sequence
  chemically synthesized
aggctggtggtccgaagcct

SEQ ID NO: 59643 - DNA, 20 bp, Artificial Sequence
  chemically synthesized
gtccgaagcctgggcatatc

SEQ ID NO: 59644 - DNA, 20 bp, Artificial Sequence
  chemically synthesized
ccgaagcctgggcatatctg

SEQ ID NO: 59645 - DNA, 20 bp, Artificial Sequence
  chemically synthesized
aagcctgggcatatctggag

SEQ ID NO: 59646 - DNA, 20 bp, Artificial Sequence
  chemically synthesized
cctgggcatatctggagtag

SEQ ID NO: 59647 - DNA, 20 bp, Artificial Sequence
  chemically synthesized
ctgggcatatctggagtaga

SEQ ID NO: 59648 - DNA, 20 bp, Artificial Sequence
  chemically synthesized
ctggagtagaaggatcactg

SEQ ID NO: 59649 - DNA, 20 bp, Artificial Sequence
  chemically synthesized
tggagtagaaggatcactgt

SEQ ID NO: 59650 - DNA, 20 bp, Artificial Sequence
  chemically synthesized
ggagtagaaggatcactgtg

SEQ ID NO: 59651 - DNA, 20 bp, Artificial Sequence
  chemically synthesized
gtagaaggatcactgtgggg

SEQ ID NO: 59652 - DNA, 20 bp, Artificial Sequence
  chemically synthesized
tagaaggatcactgtggggc

SEQ ID NO: 59653 - DNA, 20 bp, Artificial Sequence
  chemically synthesized
agaaggatcactgtggggca

SEQ ID NO: 59654 - DNA, 20 bp, Artificial Sequence
  chemically synthesized
aggatcactgtggggcaggg

SEQ ID NO: 59655 - DNA, 20 bp, Artificial Sequence
  chemically synthesized
ggatcactgtggggcagggc

SEQ ID NO: 59656 - DNA, 20 bp, Artificial Sequence
  chemically synthesized
gggcaggttctgtgttgctg

SEQ ID NO: 59657 - DNA, 20 bp, Artificial Sequence
  chemically synthesized
cgttgactttgaccattgct

SEQ ID NO: 59658 - DNA, 20 bp, Artificial Sequence
  chemically synthesized
tgactttgaccattgctcgg

SEQ ID NO: 59659 - DNA, 20 bp, Artificial Sequence
  chemically synthesized
actttgaccattgctcggca

SEQ ID NO: 59660 - DNA, 20 bp, Artificial Sequence
  chemically synthesized
tcggcagagcctgctctcgc

SEQ ID NO: 59661 - DNA, 20 bp, Artificial Sequence
  chemically synthesized
agagcctgctctcgctggtt

SEQ ID NO: 59662 - DNA, 20 bp, Artificial Sequence
  chemically synthesized
tgctctcgctggttcagcca

SEQ ID NO: 59663 - DNA, 20 bp, Artificial Sequence
  chemically synthesized
gctctcgctggttcagccac

SEQ ID NO: 59664 - DNA, 20 bp, Artificial Sequence
  chemically synthesized
cccaccactccctattgtct

SEQ ID NO: 59665 - DNA, 20 bp, Artificial Sequence
  chemically synthesized
actccctattgtctcagccc

SEQ ID NO: 59666 - DNA, 20 bp, Artificial Sequence
  chemically synthesized
ctccctattgtctcagcccc

SEQ ID NO: 59667 - DNA, 20 bp, Artificial Sequence
  chemically synthesized
atgaaacatgtattcctcac

SEQ ID NO: 59668 - DNA, 20 bp, Artificial Sequence
  chemically synthesized
cctcactggcctatcacctg

SEQ ID NO: 59669 - DNA, 20 bp, Artificial Sequence
  chemically synthesized
cctgccaacccctccctcaa

SEQ ID NO: 59670 - DNA, 20 bp, Artificial Sequence
  chemically synthesized
tgccaacccctccctcaaaa

SEQ ID NO: 59671 - DNA, 20 bp, Artificial Sequence
  chemically synthesized
cctcaaaagagttgccctct

SEQ ID NO: 59672 - DNA, 20 bp, Artificial Sequence
  chemically synthesized
ctctcagatccttttgatgt

SEQ ID NO: 59673 - DNA, 20 bp, Artificial Sequence
  chemically synthesized
tctcagatccttttgatgta

SEQ ID NO: 59674 - DNA, 20 bp, Artificial Sequence
  chemically synthesized
gatccttttgatgtaaggtt

SEQ ID NO: 59675 - DNA, 20 bp, Artificial Sequence
  chemically synthesized
ttgatgtaaggtttggtgtt

SEQ ID NO: 59676 - DNA, 20 bp, Artificial Sequence
  chemically synthesized
ataaacatcactttatgtat

SEQ ID NO: 59677 - DNA, 20 bp, Artificial Sequence
  chemically synthesized
taaacatcactttatgtatg

SEQ ID NO: 59678 - DNA, 20 bp, Artificial Sequence
  chemically synthesized
ctttatgtatgaggcaaaat

SEQ ID NO: 59679 - DNA, 20 bp, Artificial Sequence
  chemically synthesized
tttatgtatgaggcaaaatg

SEQ ID NO: 59680 - DNA, 20 bp, Artificial Sequence
  chemically synthesized
gtatgaggcaaaatgaggac

SEQ ID NO: 59681 - DNA, 20 bp, Artificial Sequence
  chemically synthesized
tatgaggcaaaatgaggacc

SEQ ID NO: 59682 - DNA, 20 bp, Artificial Sequence
  chemically synthesized
atgaggcaaaatgaggacca

SEQ ID NO: 59683 - DNA, 20 bp, Artificial Sequence
  chemically synthesized
gaggcaaaatgaggaccagg

SEQ ID NO: 59684 - DNA, 20 bp, Artificial Sequence
  chemically synthesized
gggagatgaatgacttgtcc

SEQ ID NO: 59685 - DNA, 20 bp, Artificial Sequence
  chemically synthesized
cttgtcctggctcatacacc

SEQ ID NO: 59686 - DNA, 20 bp, Artificial Sequence
  chemically synthesized
tcctggctcatacacctgga

SEQ ID NO: 59687 - DNA, 20 bp, Artificial Sequence
  chemically synthesized
ctcatacacctggaaagtga

SEQ ID NO: 59688 - DNA, 20 bp, Artificial Sequence
  chemically synthesized
catacacctggaaagtgaca

SEQ ID NO: 59689 - DNA, 20 bp, Artificial Sequence
  chemically synthesized
cacctggaaagtgacagagt

SEQ ID NO: 59690 - DNA, 20 bp, Artificial Sequence
  chemically synthesized
ggaaagtgacagagtcagat

SEQ ID NO: 59691 - DNA, 20 bp, Artificial Sequence
  chemically synthesized
gacagagtcagattagatcc

SEQ ID NO: 59692 - DNA, 20 bp, Artificial Sequence
  chemically synthesized
acagagtcagattagatccc

SEQ ID NO: 59693 - DNA, 20 bp, Artificial Sequence
  chemically synthesized
ttagatcccaggtctatctg

SEQ ID NO: 59694 - DNA, 20 bp, Artificial Sequence
  chemically synthesized
ccaggtctatctgaagttaa

SEQ ID NO: 59695 - DNA, 20 bp, Artificial Sequence
  chemically synthesized
aggtctatctgaagttaaaa

SEQ ID NO: 59696 - DNA, 20 bp, Artificial Sequence
  chemically synthesized
ggtctatctgaagttaaaag

SEQ ID NO: 59697 - DNA, 20 bp, Artificial Sequence
  chemically synthesized
cacctcctccatctacttta

SEQ ID NO: 59698 - DNA, 20 bp, Artificial Sequence
  chemically synthesized
ctcctccatctactttaaag

SEQ ID NO: 59699 - DNA, 20 bp, Artificial Sequence
  chemically synthesized
cagcacaaacccctgctttc

SEQ ID NO: 59700 - DNA, 20 bp, Artificial Sequence
  chemically synthesized
agcacaaacccctgctttca

SEQ ID NO: 59701 - DNA, 20 bp, Artificial Sequence
  chemically synthesized
cacaaacccctgctttcaag

SEQ ID NO: 59702 - DNA, 20 bp, Artificial Sequence
  chemically synthesized
caaacccctgctttcaagga

SEQ ID NO: 59703 - DNA, 20 bp, Artificial Sequence
  chemically synthesized
ccctgctttcaaggagagat

SEQ ID NO: 59704 - DNA, 20 bp, Artificial Sequence
  chemically synthesized
aggagagatgagcgtctcta

SEQ ID NO: 59705 - DNA, 20 bp, Artificial Sequence
  chemically synthesized
agcgtctctaaagcccctga

SEQ ID NO: 59706 - DNA, 20 bp, Artificial Sequence
  chemically synthesized
tctctaaagcccctgacagc

SEQ ID NO: 59707 - DNA, 20 bp, Artificial Sequence
  chemically synthesized
tctaaagcccctgacagcaa

SEQ ID NO: 59708 - DNA, 20 bp, Artificial Sequence
  chemically synthesized
agcccctgacagcaagagcc

SEQ ID NO: 59709 - DNA, 20 bp, Artificial Sequence
  chemically synthesized
tgacagcaagagcccagaac

SEQ ID NO: 59710 - DNA, 20 bp, Artificial Sequence
  chemically synthesized
gacagcaagagcccagaact

SEQ ID NO: 59711 - DNA, 20 bp, Artificial Sequence
  chemically synthesized
gcccagaactgggacaccat

SEQ ID NO: 59712 - DNA, 20 bp, Artificial Sequence
  chemically synthesized
ctgggacaccattagtgacc

SEQ ID NO: 59713 - DNA, 20 bp, Artificial Sequence
  chemically synthesized
gacaccattagtgacccaga

SEQ ID NO: 59714 - DNA, 20 bp, Artificial Sequence
  chemically synthesized
accattagtgacccagacgg

SEQ ID NO: 59715 - DNA, 20 bp, Artificial Sequence
  chemically synthesized
ccattagtgacccagacggc

SEQ ID NO: 59716 - DNA, 20 bp, Artificial Sequence
  chemically synthesized
tagtgacccagacggcaggt

SEQ ID NO: 59717 - DNA, 20 bp, Artificial Sequence
  chemically synthesized
gacggcaggtaagctgactg

SEQ ID NO: 59718 - DNA, 20 bp, Artificial Sequence
  chemically synthesized
acggcaggtaagctgactgc

SEQ ID NO: 59719 - DNA, 20 bp, Artificial Sequence
  chemically synthesized
ggcaggtaagctgactgcag

SEQ ID NO: 59720 - DNA, 20 bp, Artificial Sequence
  chemically synthesized
taagctgactgcaggagcat

SEQ ID NO: 59721 - DNA, 20 bp, Artificial Sequence
  chemically synthesized
catcagcctattcttgtgtc

SEQ ID NO: 59722 - DNA, 20 bp, Artificial Sequence
  chemically synthesized
atcagcctattcttgtgtct

SEQ ID NO: 59723 - DNA, 20 bp, Artificial Sequence
  chemically synthesized
tattcttgtgtctgggacca

SEQ ID NO: 59724 - DNA, 20 bp, Artificial Sequence
  chemically synthesized
ttcttgtgtctgggaccaca

SEQ ID NO: 59725 - DNA, 20 bp, Artificial Sequence
  chemically synthesized
tctgggaccacagagcattg

SEQ ID NO: 59726 - DNA, 20 bp, Artificial Sequence
  chemically synthesized
ctgggaccacagagcattgt

SEQ ID NO: 59727 - DNA, 20 bp, Artificial Sequence
  chemically synthesized
tgggaccacagagcattgtg

SEQ ID NO: 59728 - DNA, 20 bp, Artificial Sequence
  chemically synthesized
accacagagcattgtgggga

SEQ ID NO: 59729 - DNA, 20 bp, Artificial Sequence
  chemically synthesized
gtggggacagccccgtctct

SEQ ID NO: 59730 - DNA, 20 bp, Artificial Sequence
  chemically synthesized
tggggacagccccgtctctt

SEQ ID NO: 59731 - DNA, 20 bp, Artificial Sequence
  chemically synthesized
tctcttgggaaaaaaaccct

SEQ ID NO: 59732 - DNA, 20 bp, Artificial Sequence
  chemically synthesized
ctcttgggaaaaaaacccta

SEQ ID NO: 59733 - DNA, 20 bp, Artificial Sequence
  chemically synthesized
tcttgggaaaaaaaccctaa

SEQ ID NO: 59734 - DNA, 20 bp, Artificial Sequence
  chemically synthesized
ggaaaaaaaccctaagggct

SEQ ID NO: 59735 - DNA, 20 bp, Artificial Sequence
  chemically synthesized
gaaaaaaaccctaagggctg

SEQ ID NO: 59736 - DNA, 20 bp, Artificial Sequence
  chemically synthesized
taagggctgaggatccttgt

SEQ ID NO: 59737 - DNA, 20 bp, Artificial Sequence
  chemically synthesized
ctgaggatccttgtgagtgt

SEQ ID NO: 59738 - DNA, 20 bp, Artificial Sequence
  chemically synthesized
tgaggatccttgtgagtgtt

SEQ ID NO: 59739 - DNA, 20 bp, Artificial Sequence
  chemically synthesized
ggatccttgtgagtgttggg

SEQ ID NO: 59740 - DNA, 20 bp, Artificial Sequence
  chemically synthesized
gatccttgtgagtgttgggt

SEQ ID NO: 59741 - DNA, 20 bp, Artificial Sequence
  chemically synthesized
ttgtgagtgttgggtgggaa

SEQ ID NO: 59742 - DNA, 20 bp, Artificial Sequence
  chemically synthesized
tgttgggtgggaacagctcc

SEQ ID NO: 59743 - DNA, 20 bp, Artificial Sequence
  chemically synthesized
gttgggtgggaacagctccc

SEQ ID NO: 59744 - DNA, 20 bp, Artificial Sequence
  chemically synthesized
tgggtgggaacagctcccag

SEQ ID NO: 59745 - DNA, 20 bp, Artificial Sequence
  chemically synthesized
gggtgggaacagctcccagg

SEQ ID NO: 59746 - DNA, 20 bp, Artificial Sequence
  chemically synthesized
gctcccaggaggtttaatca

SEQ ID NO: 59747 - DNA, 20 bp, Artificial Sequence
  chemically synthesized
cacagcccctccatgctctc

SEQ ID NO: 59748 - DNA, 20 bp, Artificial Sequence
  chemically synthesized
tctagctgttgccattgtgc

SEQ ID NO: 59749 - DNA, 20 bp, Artificial Sequence
  chemically synthesized
agatgcatttcccttctgtg

SEQ ID NO: 59750 - DNA, 20 bp, Artificial Sequence
  chemically synthesized
tgcatttcccttctgtgcag

SEQ ID NO: 59751 - DNA, 20 bp, Artificial Sequence
  chemically synthesized
cttctgtgcagcagtttccc

SEQ ID NO: 59752 - DNA, 20 bp, Artificial Sequence
  chemically synthesized
cagtttccctggccactaaa

SEQ ID NO: 59753 - DNA, 20 bp, Artificial Sequence
  chemically synthesized
tttccctggccactaaatag

SEQ ID NO: 59754 - DNA, 20 bp, Artificial Sequence
  chemically synthesized
ttccctggccactaaatagt

SEQ ID NO: 59755 - DNA, 20 bp, Artificial Sequence
  chemically synthesized
tggccactaaatagtgggat

SEQ ID NO: 59756 - DNA, 20 bp, Artificial Sequence
  chemically synthesized
cactaaatagtgggattaga

SEQ ID NO: 59757 - DNA, 20 bp, Artificial Sequence
  chemically synthesized
taaatagtgggattagatag

SEQ ID NO: 59758 - DNA, 20 bp, Artificial Sequence
  chemically synthesized
ggattagatagaagccctcc

SEQ ID NO: 59759 - DNA, 20 bp, Artificial Sequence
  chemically synthesized
gattagatagaagccctcca

SEQ ID NO: 59760 - DNA, 20 bp, Artificial Sequence
  chemically synthesized
attagatagaagccctccaa

SEQ ID NO: 59761 - DNA, 20 bp, Artificial Sequence
  chemically synthesized
agaagccctccaagggcttc

SEQ ID NO: 59762 - DNA, 20 bp, Artificial Sequence
  chemically synthesized
catgattcttgattctgatc

SEQ ID NO: 59763 - DNA, 20 bp, Artificial Sequence
  chemically synthesized
ttctgatctggcccgattcc

SEQ ID NO: 59764 - DNA, 20 bp, Artificial Sequence
  chemically synthesized
gcccgattcctggataatcg

SEQ ID NO: 59765 - DNA, 20 bp, Artificial Sequence
  chemically synthesized
cccgattcctggataatcgt

SEQ ID NO: 59766 - DNA, 20 bp, Artificial Sequence
  chemically synthesized
gattcctggataatcgtggg

SEQ ID NO: 59767 - DNA, 20 bp, Artificial Sequence
  chemically synthesized
attcctggataatcgtgggc

SEQ ID NO: 59768 - DNA, 20 bp, Artificial Sequence
  chemically synthesized
tttcttcttttgtaaaacaa

SEQ ID NO: 59769 - DNA, 20 bp, Artificial Sequence
  chemically synthesized
tggctgtaccatttgcatct

SEQ ID NO: 59770 - DNA, 20 bp, Artificial Sequence
  chemically synthesized
ggctgtaccatttgcatctt

SEQ ID NO: 59771 - DNA, 20 bp, Artificial Sequence
  chemically synthesized
gctgtaccatttgcatctta

SEQ ID NO: 59772 - DNA, 20 bp, Artificial Sequence
  chemically synthesized
tttgcatcttagggtcattg

SEQ ID NO: 59773 - DNA, 20 bp, Artificial Sequence
  chemically synthesized
cttagggtcattgcagatgt

SEQ ID NO: 59774 - DNA, 20 bp, Artificial Sequence
  chemically synthesized
cagatgtaagtgttgctgtc

SEQ ID NO: 59775 - DNA, 20 bp, Artificial Sequence
  chemically synthesized
gatgtaagtgttgctgtcca

SEQ ID NO: 59776 - DNA, 20 bp, Artificial Sequence
  chemically synthesized
aagtgttgctgtccagagcc

SEQ ID NO: 59777 - DNA, 20 bp, Artificial Sequence
  chemically synthesized
agtgttgctgtccagagcct

SEQ ID NO: 59778 - DNA, 20 bp, Artificial Sequence
  chemically synthesized
tgctgtccagagcctgggtg

SEQ ID NO: 59779 - DNA, 20 bp, Artificial Sequence
  chemically synthesized
gctgtccagagcctgggtgc

SEQ ID NO: 59780 - DNA, 20 bp, Artificial Sequence
  chemically synthesized
cagagcctgggtgcaggacc

SEQ ID NO: 59781 - DNA, 20 bp, Artificial Sequence
  chemically synthesized
ctgggtgcaggacctagatg

SEQ ID NO: 59782 - DNA, 20 bp, Artificial Sequence
  chemically synthesized
tgggtgcaggacctagatgt

SEQ ID NO: 59783 - DNA, 20 bp, Artificial Sequence
  chemically synthesized
aggacctagatgtaggattc

SEQ ID NO: 59784 - DNA, 20 bp, Artificial Sequence
  chemically synthesized
ttctggttctgctacttcct

SEQ ID NO: 59785 - DNA, 20 bp, Artificial Sequence
  chemically synthesized
acttcctcagtgacattgaa

SEQ ID NO: 59786 - DNA, 20 bp, Artificial Sequence
  chemically synthesized
aatagctgacctaatctctc

SEQ ID NO: 59787 - DNA, 20 bp, Artificial Sequence
  chemically synthesized
tgacctaatctctctggctt

SEQ ID NO: 59788 - DNA, 20 bp, Artificial Sequence
  chemically synthesized
tttggtttcttcatctgtaa

SEQ ID NO: 59789 - DNA, 20 bp, Artificial Sequence
  chemically synthesized
ggtttcttcatctgtaaaag

SEQ ID NO: 59790 - DNA, 20 bp, Artificial Sequence
  chemically synthesized
gtttcttcatctgtaaaaga

SEQ ID NO: 59791 - DNA, 20 bp, Artificial Sequence
  chemically synthesized
catctgtaaaagaaggatat

SEQ ID NO: 59792 - DNA, 20 bp, Artificial Sequence
  chemically synthesized
taaaagaaggatattagcat

SEQ ID NO: 59793 - DNA, 20 bp, Artificial Sequence
  chemically synthesized
atattagcattagcacctca

SEQ ID NO: 59794 - DNA, 20 bp, Artificial Sequence
  chemically synthesized
tattagcattagcacctcac

SEQ ID NO: 59795 - DNA, 20 bp, Artificial Sequence
  chemically synthesized
gcacctcacgggattgttac

SEQ ID NO: 59796 - DNA, 20 bp, Artificial Sequence
  chemically synthesized
ctcacgggattgttacaaga

SEQ ID NO: 59797 - DNA, 20 bp, Artificial Sequence
  chemically synthesized
agcaatgaattaacacatgt

SEQ ID NO: 59798 - DNA, 20 bp, Artificial Sequence
  chemically synthesized
tgaattaacacatgtgagca

SEQ ID NO: 59799 - DNA, 20 bp, Artificial Sequence
  chemically synthesized
aattaacacatgtgagcacg

SEQ ID NO: 59800 - DNA, 20 bp, Artificial Sequence
  chemically synthesized
acacatgtgagcacggagaa

SEQ ID NO: 59801 - DNA, 20 bp, Artificial Sequence
  chemically synthesized
tgagcacggagaacagtgct

SEQ ID NO: 59802 - DNA, 20 bp, Artificial Sequence
  chemically synthesized
ggagaacagtgcttggcata

SEQ ID NO: 59803 - DNA, 20 bp, Artificial Sequence
  chemically synthesized
aacagtgcttggcatatggt

SEQ ID NO: 59804 - DNA, 20 bp, Artificial Sequence
  chemically synthesized
tgctattcttctgattcttt

SEQ ID NO: 59805 - DNA, 20 bp, Artificial Sequence
  chemically synthesized
tctttcagtgttactgatgt

SEQ ID NO: 59806 - DNA, 20 bp, Artificial Sequence
  chemically synthesized
tcagtgttactgatgtcggc

SEQ ID NO: 59807 - DNA, 20 bp, Artificial Sequence
  chemically synthesized
tactgatgtcggcaagtact

SEQ ID NO: 59808 - DNA, 20 bp, Artificial Sequence
  chemically synthesized
atgtcggcaagtacttggca

SEQ ID NO: 59809 - DNA, 20 bp, Artificial Sequence
  chemically synthesized
tgtcggcaagtacttggcac

SEQ ID NO: 59810 - DNA, 20 bp, Artificial Sequence
  chemically synthesized
ggcaagtacttggcacaggc

SEQ ID NO: 59811 - DNA, 20 bp, Artificial Sequence
  chemically synthesized
caggctggtttaataatccc

SEQ ID NO: 59812 - DNA, 20 bp, Artificial Sequence
  chemically synthesized
aggctggtttaataatccct

SEQ ID NO: 59813 - DNA, 20 bp, Artificial Sequence
  chemically synthesized
aatccctaggcacttccacg

SEQ ID NO: 59814 - DNA, 20 bp, Artificial Sequence
  chemically synthesized
tggtgtcaatccctgatcac

SEQ ID NO: 59815 - DNA, 20 bp, Artificial Sequence
  chemically synthesized
ggtgtcaatccctgatcact

SEQ ID NO: 59816 - DNA, 20 bp, Artificial Sequence
  chemically synthesized
tgtcaatccctgatcactgg

SEQ ID NO: 59817 - DNA, 20 bp, Artificial Sequence
  chemically synthesized
agtcatcatgtgccttgact

SEQ ID NO: 59818 - DNA, 20 bp, Artificial Sequence
  chemically synthesized
gtcatcatgtgccttgactc

SEQ ID NO: 59819 - DNA, 20 bp, Artificial Sequence
  chemically synthesized
tcatcatgtgccttgactcg

SEQ ID NO: 59820 - DNA, 20 bp, Artificial Sequence
  chemically synthesized
atgtgccttgactcggggcc

SEQ ID NO: 59821 - DNA, 20 bp, Artificial Sequence
  chemically synthesized
gcccccccatctctgtcttg

SEQ ID NO: 59822 - DNA, 20 bp, Artificial Sequence
  chemically synthesized
cccccccatctctgtcttgc

SEQ ID NO: 59823 - DNA, 20 bp, Artificial Sequence
  chemically synthesized
caatgccgtcttctgtctcg

SEQ ID NO: 59824 - DNA, 20 bp, Artificial Sequence
  chemically synthesized
aatgccgtcttctgtctcgt

SEQ ID NO: 59825 - DNA, 20 bp, Artificial Sequence
  chemically synthesized
atgccgtcttctgtctcgtg

SEQ ID NO: 59826 - DNA, 20 bp, Artificial Sequence
  chemically synthesized
ctcgtggggcatcctcctgc

SEQ ID NO: 59827 - DNA, 20 bp, Artificial Sequence
  chemically synthesized
gtggggcatcctcctgctgg

SEQ ID NO: 59828 - DNA, 20 bp, Artificial Sequence
  chemically synthesized
tggggcatcctcctgctggc

SEQ ID NO: 59829 - DNA, 20 bp, Artificial Sequence
  chemically synthesized
gctggcaggcctgtgctgcc

SEQ ID NO: 59830 - DNA, 20 bp, Artificial Sequence
  chemically synthesized
ctgcctggtccctgtctccc

SEQ ID NO: 59831 - DNA, 20 bp, Artificial Sequence
  chemically synthesized
tggtccctgtctccctggct

SEQ ID NO: 59832 - DNA, 20 bp, Artificial Sequence
  chemically synthesized
ggtccctgtctccctggctg

SEQ ID NO: 59833 - DNA, 20 bp, Artificial Sequence
  chemically synthesized
tctccctggctgaggatccc

SEQ ID NO: 59834 - DNA, 20 bp, Artificial Sequence
  chemically synthesized
ctccctggctgaggatcccc

SEQ ID NO: 59835 - DNA, 20 bp, Artificial Sequence
  chemically synthesized
tccctggctgaggatcccca

SEQ ID NO: 59836 - DNA, 20 bp, Artificial Sequence
  chemically synthesized
cctggctgaggatccccagg

SEQ ID NO: 59837 - DNA, 20 bp, Artificial Sequence
  chemically synthesized
atccccagggagatgctgcc

SEQ ID NO: 59838 - DNA, 20 bp, Artificial Sequence
  chemically synthesized
cccagggagatgctgcccag

SEQ ID NO: 59839 - DNA, 20 bp, Artificial Sequence
  chemically synthesized
gggagatgctgcccagaaga

SEQ ID NO: 59840 - DNA, 20 bp, Artificial Sequence
  chemically synthesized
cagatacatcccaccatgat

SEQ ID NO: 59841 - DNA, 20 bp, Artificial Sequence
  chemically synthesized
agatacatcccaccatgatc

SEQ ID NO: 59842 - DNA, 20 bp, Artificial Sequence
  chemically synthesized
aggatcacccaaccttcaac

SEQ ID NO: 59843 - DNA, 20 bp, Artificial Sequence
  chemically synthesized
caacaagatcacccccaacc

SEQ ID NO: 59844 - DNA, 20 bp, Artificial Sequence
  chemically synthesized
agatcacccccaacctggct

SEQ ID NO: 59845 - DNA, 20 bp, Artificial Sequence
  chemically synthesized
aacctggctgagttcgcctt

SEQ ID NO: 59846 - DNA, 20 bp, Artificial Sequence
  chemically synthesized
tcgccttcagcctataccgc

SEQ ID NO: 59847 - DNA, 20 bp, Artificial Sequence
  chemically synthesized
cttcagcctataccgccagc

SEQ ID NO: 59848 - DNA, 20 bp, Artificial Sequence
  chemically synthesized
tataccgccagctggcacac

SEQ ID NO: 59849 - DNA, 20 bp, Artificial Sequence
  chemically synthesized
cagctggcacaccagtccaa

SEQ ID NO: 59850 - DNA, 20 bp, Artificial Sequence
  chemically synthesized
caccaatatcttcttctccc

SEQ ID NO: 59851 - DNA, 20 bp, Artificial Sequence
  chemically synthesized
aatatcttcttctccccagt

SEQ ID NO: 59852 - DNA, 20 bp, Artificial Sequence
  chemically synthesized
ctccccagtgagcatcgcta

SEQ ID NO: 59853 - DNA, 20 bp, Artificial Sequence
  chemically synthesized
agcctttgcaatgctctccc

SEQ ID NO: 59854 - DNA, 20 bp, Artificial Sequence
  chemically synthesized
gcctttgcaatgctctccct

SEQ ID NO: 59855 - DNA, 20 bp, Artificial Sequence
  chemically synthesized
cctttgcaatgctctccctg

SEQ ID NO: 59856 - DNA, 20 bp, Artificial Sequence
  chemically synthesized
caatgctctccctggggacc

SEQ ID NO: 59857 - DNA, 20 bp, Artificial Sequence
  chemically synthesized
aatgctctccctggggacca

SEQ ID NO: 59858 - DNA, 20 bp, Artificial Sequence
  chemically synthesized
tgacactcacgatgaaatcc

SEQ ID NO: 59859 - DNA, 20 bp, Artificial Sequence
  chemically synthesized
acactcacgatgaaatcctg

SEQ ID NO: 59860 - DNA, 20 bp, Artificial Sequence
  chemically synthesized
cactcacgatgaaatcctgg

SEQ ID NO: 59861 - DNA, 20 bp, Artificial Sequence
  chemically synthesized
actcacgatgaaatcctgga

SEQ ID NO: 59862 - DNA, 20 bp, Artificial Sequence
  chemically synthesized
gggcctgaatttcaacctca

SEQ ID NO: 59863 - DNA, 20 bp, Artificial Sequence
  chemically synthesized
gcctgaatttcaacctcacg

SEQ ID NO: 59864 - DNA, 20 bp, Artificial Sequence
  chemically synthesized
tttcaacctcacggagattc

SEQ ID NO: 59865 - DNA, 20 bp, Artificial Sequence
  chemically synthesized
tcaacctcacggagattccg

SEQ ID NO: 59866 - DNA, 20 bp, Artificial Sequence
  chemically synthesized
caacctcacggagattccgg

SEQ ID NO: 59867 - DNA, 20 bp, Artificial Sequence
  chemically synthesized
tcacggagattccggaggct

SEQ ID NO: 59868 - DNA, 20 bp, Artificial Sequence
  chemically synthesized
tccggaggctcagatccatg

SEQ ID NO: 59869 - DNA, 20 bp, Artificial Sequence
  chemically synthesized
ccggaggctcagatccatga

SEQ ID NO: 59870 - DNA, 20 bp, Artificial Sequence
  chemically synthesized
ctcagatccatgaaggcttc

SEQ ID NO: 59871 - DNA, 20 bp, Artificial Sequence
  chemically synthesized
tcagatccatgaaggcttcc

SEQ ID NO: 59872 - DNA, 20 bp, Artificial Sequence
  chemically synthesized
aactcctccgtaccctcaac

SEQ ID NO: 59873 - DNA, 20 bp, Artificial Sequence
  chemically synthesized
cctccgtaccctcaaccagc

SEQ ID NO: 59874 - DNA, 20 bp, Artificial Sequence
  chemically synthesized
cgtaccctcaaccagccaga

SEQ ID NO: 59875 - DNA, 20 bp, Artificial Sequence
  chemically synthesized
ccctcaaccagccagacagc

SEQ ID NO: 59876 - DNA, 20 bp, Artificial Sequence
  chemically synthesized
accagccagacagccagctc

SEQ ID NO: 59877 - DNA, 20 bp, Artificial Sequence
  chemically synthesized
agccagctccagctgaccac

SEQ ID NO: 59878 - DNA, 20 bp, Artificial Sequence
  chemically synthesized
ctccagctgaccaccggcaa

SEQ ID NO: 59879 - DNA, 20 bp, Artificial Sequence
  chemically synthesized
accggcaatggcctgttcct

SEQ ID NO: 59880 - DNA, 20 bp, Artificial Sequence
  chemically synthesized
gcaatggcctgttcctcagc

SEQ ID NO: 59881 - DNA, 20 bp, Artificial Sequence
  chemically synthesized
caatggcctgttcctcagcg

SEQ ID NO: 59882 - DNA, 20 bp, Artificial Sequence
  chemically synthesized
aatggcctgttcctcagcga

SEQ ID NO: 59883 - DNA, 20 bp, Artificial Sequence
  chemically synthesized
tgttcctcagcgagggcctg

SEQ ID NO: 59884 - DNA, 20 bp, Artificial Sequence
  chemically synthesized
cctcagcgagggcctgaagc

SEQ ID NO: 59885 - DNA, 20 bp, Artificial Sequence
  chemically synthesized
cagcgagggcctgaagctag

SEQ ID NO: 59886 - DNA, 20 bp, Artificial Sequence
  chemically synthesized
agggcctgaagctagtggat

SEQ ID NO: 59887 - DNA, 20 bp, Artificial Sequence
  chemically synthesized
gaagctagtggataagtttt

SEQ ID NO: 59888 - DNA, 20 bp, Artificial Sequence
  chemically synthesized
agctagtggataagtttttg

SEQ ID NO: 59889 - DNA, 20 bp, Artificial Sequence
  chemically synthesized
gctagtggataagtttttgg

SEQ ID NO: 59890 - DNA, 20 bp, Artificial Sequence
  chemically synthesized
agtttttggaggatgttaaa

SEQ ID NO: 59891 - DNA, 20 bp, Artificial Sequence
  chemically synthesized
tgttaaaaagttgtaccact

SEQ ID NO: 59892 - DNA, 20 bp, Artificial Sequence
  chemically synthesized
taaaaagttgtaccactcag

SEQ ID NO: 59893 - DNA, 20 bp, Artificial Sequence
  chemically synthesized
gaagccttcactgtcaactt

SEQ ID NO: 59894 - DNA, 20 bp, Artificial Sequence
  chemically synthesized
aagccttcactgtcaacttc

SEQ ID NO: 59895 - DNA, 20 bp, Artificial Sequence
  chemically synthesized
agccttcactgtcaacttcg

SEQ ID NO: 59896 - DNA, 20 bp, Artificial Sequence
  chemically synthesized
tgtcaacttcggggacaccg

SEQ ID NO: 59897 - DNA, 20 bp, Artificial Sequence
  chemically synthesized
tcaacttcggggacaccgaa

SEQ ID NO: 59898 - DNA, 20 bp, Artificial Sequence
  chemically synthesized
caacttcggggacaccgaag

SEQ ID NO: 59899 - DNA, 20 bp, Artificial Sequence
  chemically synthesized
tcggggacaccgaagaggcc

SEQ ID NO: 59900 - DNA, 20 bp, Artificial Sequence
  chemically synthesized
acaccgaagaggccaagaaa

SEQ ID NO: 59901 - DNA, 20 bp, Artificial Sequence
  chemically synthesized
gaaacagatcaacgattacg

SEQ ID NO: 59902 - DNA, 20 bp, Artificial Sequence
  chemically synthesized
aacagatcaacgattacgtg

SEQ ID NO: 59903 - DNA, 20 bp, Artificial Sequence
  chemically synthesized
agatcaacgattacgtggag

SEQ ID NO: 59904 - DNA, 20 bp, Artificial Sequence
  chemically synthesized
gatcaacgattacgtggaga

SEQ ID NO: 59905 - DNA, 20 bp, Artificial Sequence
  chemically synthesized
atcaacgattacgtggagaa

SEQ ID NO: 59906 - DNA, 20 bp, Artificial Sequence
  chemically synthesized
ttacgtggagaagggtactc

SEQ ID NO: 59907 - DNA, 20 bp, Artificial Sequence
  chemically synthesized
tacgtggagaagggtactca

SEQ ID NO: 59908 - DNA, 20 bp, Artificial Sequence
  chemically synthesized
acgtggagaagggtactcaa

SEQ ID NO: 59909 - DNA, 20 bp, Artificial Sequence
  chemically synthesized
gggtactcaagggaaaattg

SEQ ID NO: 59910 - DNA, 20 bp, Artificial Sequence
  chemically synthesized
tcaagggaaaattgtggatt

SEQ ID NO: 59911 - DNA, 20 bp, Artificial Sequence
  chemically synthesized
ggaaaattgtggatttggtc

SEQ ID NO: 59912 - DNA, 20 bp, Artificial Sequence
  chemically synthesized
gaaaattgtggatttggtca

SEQ ID NO: 59913 - DNA, 20 bp, Artificial Sequence
  chemically synthesized
aaattgtggatttggtcaag

SEQ ID NO: 59914 - DNA, 20 bp, Artificial Sequence
  chemically synthesized
gatttggtcaaggagcttga

SEQ ID NO: 59915 - DNA, 20 bp, Artificial Sequence
  chemically synthesized
tttggtcaaggagcttgaca

SEQ ID NO: 59916 - DNA, 20 bp, Artificial Sequence
  chemically synthesized
caaggagcttgacagagaca

SEQ ID NO: 59917 - DNA, 20 bp, Artificial Sequence
  chemically synthesized
cagagacacagtttttgctc

SEQ ID NO: 59918 - DNA, 20 bp, Artificial Sequence
  chemically synthesized
ggtgaattacatcttcttta

SEQ ID NO: 59919 - DNA, 20 bp, Artificial Sequence
  chemically synthesized
gtgaattacatcttctttaa

SEQ ID NO: 59920 - DNA, 20 bp, Artificial Sequence
  chemically synthesized
attacatcttctttaaaggt

SEQ ID NO: 59921 - DNA, 20 bp, Artificial Sequence
  chemically synthesized
ttacatcttctttaaaggta

SEQ ID NO: 59922 - DNA, 20 bp, Artificial Sequence
  chemically synthesized
taaaggtaaggttgctcaac

SEQ ID NO: 59923 - DNA, 20 bp, Artificial Sequence
  chemically synthesized
taaggttgctcaaccagcct

SEQ ID NO: 59924 - DNA, 20 bp, Artificial Sequence
  chemically synthesized
accagcctgagctgttccca

SEQ ID NO: 59925 - DNA, 20 bp, Artificial Sequence
  chemically synthesized
tgagctgttcccatagaaac

SEQ ID NO: 59926 - DNA, 20 bp, Artificial Sequence
  chemically synthesized
caaaaatattctcaaaccat

SEQ ID NO: 59927 - DNA, 20 bp, Artificial Sequence
  chemically synthesized
atcagttcttgaactctcct

SEQ ID NO: 59928 - DNA, 20 bp, Artificial Sequence
  chemically synthesized
ctctccttggcaatgcatta

SEQ ID NO: 59929 - DNA, 20 bp, Artificial Sequence
  chemically synthesized
tctccttggcaatgcattat

SEQ ID NO: 59930 - DNA, 20 bp, Artificial Sequence
  chemically synthesized
tggcaatgcattatgggcca

SEQ ID NO: 59931 - DNA, 20 bp, Artificial Sequence
  chemically synthesized
tgggccatagcaatgctttt

SEQ ID NO: 59932 - DNA, 20 bp, Artificial Sequence
  chemically synthesized
catagcaatgcttttcagcg

SEQ ID NO: 59933 - DNA, 20 bp, Artificial Sequence
  chemically synthesized
gcttttcagcgtggattctt

SEQ ID NO: 59934 - DNA, 20 bp, Artificial Sequence
  chemically synthesized
ctaaaatgttttccatcatt

SEQ ID NO: 59935 - DNA, 20 bp, Artificial Sequence
  chemically synthesized
tttccatcattgagtaattt

SEQ ID NO: 59936 - DNA, 20 bp, Artificial Sequence
  chemically synthesized
ttccatcattgagtaatttg

SEQ ID NO: 59937 - DNA, 20 bp, Artificial Sequence
  chemically synthesized
tgagtaatttgaggaaataa

SEQ ID NO: 59938 - DNA, 20 bp, Artificial Sequence
  chemically synthesized
taaactgtcaaaactactga

SEQ ID NO: 59939 - DNA, 20 bp, Artificial Sequence
  chemically synthesized
caaaactactgacagctctg

SEQ ID NO: 59940 - DNA, 20 bp, Artificial Sequence
  chemically synthesized
gacagctctgcagaactttt

SEQ ID NO: 59941 - DNA, 20 bp, Artificial Sequence
  chemically synthesized
cagctctgcagaacttttca

SEQ ID NO: 59942 - DNA, 20 bp, Artificial Sequence
  chemically synthesized
ccttgtgtatactgtatatg

SEQ ID NO: 59943 - DNA, 20 bp, Artificial Sequence
  chemically synthesized
tatgtagaatatataatgct

SEQ ID NO: 59944 - DNA, 20 bp, Artificial Sequence
  chemically synthesized
atatataatgcttagaacta

SEQ ID NO: 59945 - DNA, 20 bp, Artificial Sequence
  chemically synthesized
aaattgtaatacactgcata

SEQ ID NO: 59946 - DNA, 20 bp, Artificial Sequence
  chemically synthesized
aattgtaatacactgcataa

SEQ ID NO: 59947 - DNA, 20 bp, Artificial Sequence
  chemically synthesized
attgtaatacactgcataaa

SEQ ID NO: 59948 - DNA, 20 bp, Artificial Sequence
  chemically synthesized
taatacactgcataaaggga

SEQ ID NO: 59949 - DNA, 20 bp, Artificial Sequence
  chemically synthesized
tgcataaagggatagtttca

SEQ ID NO: 59950 - DNA, 20 bp, Artificial Sequence
  chemically synthesized
gaacatactttacacgactc

SEQ ID NO: 59951 - DNA, 20 bp, Artificial Sequence
  chemically synthesized
tttacacgactctagtgtcc

SEQ ID NO: 59952 - DNA, 20 bp, Artificial Sequence
  chemically synthesized
cgactctagtgtcccagaat

SEQ ID NO: 59953 - DNA, 20 bp, Artificial Sequence
  chemically synthesized
tagtgtcccagaatcagtat

SEQ ID NO: 59954 - DNA, 20 bp, Artificial Sequence
  chemically synthesized
gtatcagttttgcaatctga

SEQ ID NO: 59955 - DNA, 20 bp, Artificial Sequence
  chemically synthesized
gttttgcaatctgaaagacc

SEQ ID NO: 59956 - DNA, 20 bp, Artificial Sequence
  chemically synthesized
ttttgcaatctgaaagacct

SEQ ID NO: 59957 - DNA, 20 bp, Artificial Sequence
  chemically synthesized
aatcctgcctctaacacaat

SEQ ID NO: 59958 - DNA, 20 bp, Artificial Sequence
  chemically synthesized
acaatgcattctacctcttt

SEQ ID NO: 59959 - DNA, 20 bp, Artificial Sequence
  chemically synthesized
caatgcattctacctctttg

SEQ ID NO: 59960 - DNA, 20 bp, Artificial Sequence
  chemically synthesized
gaggtgctaatttctcatct

SEQ ID NO: 59961 - DNA, 20 bp, Artificial Sequence
  chemically synthesized
gctaatttctcatcttagca

SEQ ID NO: 59962 - DNA, 20 bp, Artificial Sequence
  chemically synthesized
caaaataccattcttgctgt

SEQ ID NO: 59963 - DNA, 20 bp, Artificial Sequence
  chemically synthesized
aaaataccattcttgctgtc

SEQ ID NO: 59964 - DNA, 20 bp, Artificial Sequence
  chemically synthesized
ttcttgctgtcaggtttttt

SEQ ID NO: 59965 - DNA, 20 bp, Artificial Sequence
  chemically synthesized
tcttgctgtcaggttttttt

SEQ ID NO: 59966 - DNA, 20 bp, Artificial Sequence
  chemically synthesized
ttaggattaaacaaatgaca

SEQ ID NO: 59967 - DNA, 20 bp, Artificial Sequence
  chemically synthesized
taaacaaatgacaaagactg

SEQ ID NO: 59968 - DNA, 20 bp, Artificial Sequence
  chemically synthesized
aaacaaatgacaaagactgt

SEQ ID NO: 59969 - DNA, 20 bp, Artificial Sequence
  chemically synthesized
aacaaatgacaaagactgtg

SEQ ID NO: 59970 - DNA, 20 bp, Artificial Sequence
  chemically synthesized
aatgacaaagactgtgggga

SEQ ID NO: 59971 - DNA, 20 bp, Artificial Sequence
  chemically synthesized
aagactgtggggatggtgtg

SEQ ID NO: 59972 - DNA, 20 bp, Artificial Sequence
  chemically synthesized
tggggatggtgtgtggcata

SEQ ID NO: 59973 - DNA, 20 bp, Artificial Sequence
  chemically synthesized
ggatggtgtgtggcatacag

SEQ ID NO: 59974 - DNA, 20 bp, Artificial Sequence
  chemically synthesized
gatggtgtgtggcatacagc

SEQ ID NO: 59975 - DNA, 20 bp, Artificial Sequence
  chemically synthesized
gtgtggcatacagcaggtga

SEQ ID NO: 59976 - DNA, 20 bp, Artificial Sequence
  chemically synthesized
tgatggactcttctgtatct

SEQ ID NO: 59977 - DNA, 20 bp, Artificial Sequence
  chemically synthesized
gatggactcttctgtatctc

SEQ ID NO: 59978 - DNA, 20 bp, Artificial Sequence
  chemically synthesized
caggctgccttcctgcccct

SEQ ID NO: 59979 - DNA, 20 bp, Artificial Sequence
  chemically synthesized
aggctgccttcctgcccctg

SEQ ID NO: 59980 - DNA, 20 bp, Artificial Sequence
  chemically synthesized
ggctgccttcctgcccctga

SEQ ID NO: 59981 - DNA, 20 bp, Artificial Sequence
  chemically synthesized
gctgccttcctgcccctgag

SEQ ID NO: 59982 - DNA, 20 bp, Artificial Sequence
  chemically synthesized
cccctgaggggttaaaatgc

SEQ ID NO: 59983 - DNA, 20 bp, Artificial Sequence
  chemically synthesized
ccctgaggggttaaaatgcc

SEQ ID NO: 59984 - DNA, 20 bp, Artificial Sequence
  chemically synthesized
cctgaggggttaaaatgcca

SEQ ID NO: 59985 - DNA, 20 bp, Artificial Sequence
  chemically synthesized
gggttaaaatgccagggtcc

SEQ ID NO: 59986 - DNA, 20 bp, Artificial Sequence
  chemically synthesized
ggttaaaatgccagggtcct

SEQ ID NO: 59987 - DNA, 20 bp, Artificial Sequence
  chemically synthesized
gttaaaatgccagggtcctg

SEQ ID NO: 59988 - DNA, 20 bp, Artificial Sequence
  chemically synthesized
ttaaaatgccagggtcctgg

SEQ ID NO: 59989 - DNA, 20 bp, Artificial Sequence
  chemically synthesized
tgccagggtcctgggggccc

SEQ ID NO: 59990 - DNA, 20 bp, Artificial Sequence
  chemically synthesized
gccagggtcctgggggcccc

SEQ ID NO: 59991 - DNA, 20 bp, Artificial Sequence
  chemically synthesized
ccagggtcctgggggcccca

SEQ ID NO: 59992 - DNA, 20 bp, Artificial Sequence
  chemically synthesized
tgggggccccagggcattct

SEQ ID NO: 59993 - DNA, 20 bp, Artificial Sequence
  chemically synthesized
ggccccagggcattctaagc

SEQ ID NO: 59994 - DNA, 20 bp, Artificial Sequence
  chemically synthesized
taagccagctcccactgtcc

SEQ ID NO: 59995 - DNA, 20 bp, Artificial Sequence
  chemically synthesized
aagccagctcccactgtccc

SEQ ID NO: 59996 - DNA, 20 bp, Artificial Sequence
  chemically synthesized
ctcccactgtcccaggaaaa

SEQ ID NO: 59997 - DNA, 20 bp, Artificial Sequence
  chemically synthesized
actgtcccaggaaaacagca

SEQ ID NO: 59998 - DNA, 20 bp, Artificial Sequence
  chemically synthesized
ctgtcccaggaaaacagcat

SEQ ID NO: 59999 - DNA, 20 bp, Artificial Sequence
  chemically synthesized
tgtcccaggaaaacagcata

SEQ ID NO: 60000 - DNA, 20 bp, Artificial Sequence
  chemically synthesized
gtcccaggaaaacagcatag

SEQ ID NO: 60001 - DNA, 20 bp, Artificial Sequence
  chemically synthesized
cccaggaaaacagcataggg

SEQ ID NO: 60002 - DNA, 20 bp, Artificial Sequence
  chemically synthesized
ccaggaaaacagcatagggg

SEQ ID NO: 60003 - DNA, 20 bp, Artificial Sequence
  chemically synthesized
caggaaaacagcatagggga

SEQ ID NO: 60004 - DNA, 20 bp, Artificial Sequence
  chemically synthesized
aggaaaacagcataggggag

SEQ ID NO: 60005 - DNA, 20 bp, Artificial Sequence
  chemically synthesized
gaaaacagcataggggaggg

SEQ ID NO: 60006 - DNA, 20 bp, Artificial Sequence
  chemically synthesized
aaaacagcataggggagggg

SEQ ID NO: 60007 - DNA, 20 bp, Artificial Sequence
  chemically synthesized
acagcataggggaggggagg

SEQ ID NO: 60008 - DNA, 20 bp, Artificial Sequence
  chemically synthesized
cagcataggggaggggaggt

SEQ ID NO: 60009 - DNA, 20 bp, Artificial Sequence
  chemically synthesized
gcataggggaggggaggtgg

SEQ ID NO: 60010 - DNA, 20 bp, Artificial Sequence
  chemically synthesized
cataggggaggggaggtggg

SEQ ID NO: 60011 - DNA, 20 bp, Artificial Sequence
  chemically synthesized
ggggaggggaggtgggaggc

SEQ ID NO: 60012 - DNA, 20 bp, Artificial Sequence
  chemically synthesized
gggaggggaggtgggaggca

SEQ ID NO: 60013 - DNA, 20 bp, Artificial Sequence
  chemically synthesized
ggggaggtgggaggcaaggc

SEQ ID NO: 60014 - DNA, 20 bp, Artificial Sequence
  chemically synthesized
gggaggtgggaggcaaggcc

SEQ ID NO: 60015 - DNA, 20 bp, Artificial Sequence
  chemically synthesized
ggaggtgggaggcaaggcca

SEQ ID NO: 60016 - DNA, 20 bp, Artificial Sequence
  chemically synthesized
gaggtgggaggcaaggccag

SEQ ID NO: 60017 - DNA, 20 bp, Artificial Sequence
  chemically synthesized
ggggctgcttcctccactct

SEQ ID NO: 60018 - DNA, 20 bp, Artificial Sequence
  chemically synthesized
gggctgcttcctccactctg

SEQ ID NO: 60019 - DNA, 20 bp, Artificial Sequence
  chemically synthesized
tctgaggctcccttgctctt

SEQ ID NO: 60020 - DNA, 20 bp, Artificial Sequence
  chemically synthesized
ctgaggctcccttgctcttg

SEQ ID NO: 60021 - DNA, 20 bp, Artificial Sequence
  chemically synthesized
gctcccttgctcttgaggca

SEQ ID NO: 60022 - DNA, 20 bp, Artificial Sequence
  chemically synthesized
ctcccttgctcttgaggcaa

SEQ ID NO: 60023 - DNA, 20 bp, Artificial Sequence
  chemically synthesized
cccttgctcttgaggcaaag

SEQ ID NO: 60024 - DNA, 20 bp, Artificial Sequence
  chemically synthesized
ccttgctcttgaggcaaagg

SEQ ID NO: 60025 - DNA, 20 bp, Artificial Sequence
  chemically synthesized
cttgctcttgaggcaaagga

SEQ ID NO: 60026 - DNA, 20 bp, Artificial Sequence
  chemically synthesized
gctcttgaggcaaaggaggg

SEQ ID NO: 60027 - DNA, 20 bp, Artificial Sequence
  chemically synthesized
cttgaggcaaaggagggcag

SEQ ID NO: 60028 - DNA, 20 bp, Artificial Sequence
  chemically synthesized
tgaggcaaaggagggcagtg

SEQ ID NO: 60029 - DNA, 20 bp, Artificial Sequence
  chemically synthesized
aggcaaaggagggcagtgga

SEQ ID NO: 60030 - DNA, 20 bp, Artificial Sequence
  chemically synthesized
caaaggagggcagtggagag

SEQ ID NO: 60031 - DNA, 20 bp, Artificial Sequence
  chemically synthesized
ggagggcagtggagagcagc

SEQ ID NO: 60032 - DNA, 20 bp, Artificial Sequence
  chemically synthesized
gagggcagtggagagcagcc

SEQ ID NO: 60033 - DNA, 20 bp, Artificial Sequence
  chemically synthesized
agtggagagcagccaggctg

SEQ ID NO: 60034 - DNA, 20 bp, Artificial Sequence
  chemically synthesized
gagagcagccaggctgcagt

SEQ ID NO: 60035 - DNA, 20 bp, Artificial Sequence
  chemically synthesized
cagccaggctgcagtcagca

SEQ ID NO: 60036 - DNA, 20 bp, Artificial Sequence
  chemically synthesized
ggctgcagtcagcacagcta

SEQ ID NO: 60037 - DNA, 20 bp, Artificial Sequence
  chemically synthesized
agtcagcacagctaaagtcc

SEQ ID NO: 60038 - DNA, 20 bp, Artificial Sequence
  chemically synthesized
ctaaagtcctggctctgctg

SEQ ID NO: 60039 - DNA, 20 bp, Artificial Sequence
  chemically synthesized
tcctggctctgctgtggcct

SEQ ID NO: 60040 - DNA, 20 bp, Artificial Sequence
  chemically synthesized
tggctctgctgtggccttag

SEQ ID NO: 60041 - DNA, 20 bp, Artificial Sequence
  chemically synthesized
ggctctgctgtggccttagt

SEQ ID NO: 60042 - DNA, 20 bp, Artificial Sequence
  chemically synthesized
gctctgctgtggccttagtg

SEQ ID NO: 60043 - DNA, 20 bp, Artificial Sequence
  chemically synthesized
ctctgctgtggccttagtgg

SEQ ID NO: 60044 - DNA, 20 bp, Artificial Sequence
  chemically synthesized
ctgtggccttagtgggggcc

SEQ ID NO: 60045 - DNA, 20 bp, Artificial Sequence
  chemically synthesized
tgtggccttagtgggggccc

SEQ ID NO: 60046 - DNA, 20 bp, Artificial Sequence
  chemically synthesized
tgggggcccaggtccctctc

SEQ ID NO: 60047 - DNA, 20 bp, Artificial Sequence
  chemically synthesized
cccaggtccctctccagccc

SEQ ID NO: 60048 - DNA, 20 bp, Artificial Sequence
  chemically synthesized
gtctcctccttctgtccaat

SEQ ID NO: 60049 - DNA, 20 bp, Artificial Sequence
  chemically synthesized
cctccttctgtccaatgaga

SEQ ID NO: 60050 - DNA, 20 bp, Artificial Sequence
  chemically synthesized
cttctgtccaatgagaaagc

SEQ ID NO: 60051 - DNA, 20 bp, Artificial Sequence
  chemically synthesized
ttctgtccaatgagaaagct

SEQ ID NO: 60052 - DNA, 20 bp, Artificial Sequence
  chemically synthesized
tccaatgagaaagctgggat

SEQ ID NO: 60053 - DNA, 20 bp, Artificial Sequence
  chemically synthesized
ccaatgagaaagctgggatc

SEQ ID NO: 60054 - DNA, 20 bp, Artificial Sequence
  chemically synthesized
caatgagaaagctgggatca

SEQ ID NO: 60055 - DNA, 20 bp, Artificial Sequence
  chemically synthesized
aatgagaaagctgggatcag

SEQ ID NO: 60056 - DNA, 20 bp, Artificial Sequence
  chemically synthesized
agctgggatcaggggtccct

SEQ ID NO: 60057 - DNA, 20 bp, Artificial Sequence
  chemically synthesized
gctgggatcaggggtccctg

SEQ ID NO: 60058 - DNA, 20 bp, Artificial Sequence
  chemically synthesized
gtccactctgcatgcctcga

SEQ ID NO: 60059 - DNA, 20 bp, Artificial Sequence
  chemically synthesized
ctctgcatgcctcgatggtg

SEQ ID NO: 60060 - DNA, 20 bp, Artificial Sequence
  chemically synthesized
cctcgatggtgaagctctgt

SEQ ID NO: 60061 - DNA, 20 bp, Artificial Sequence
  chemically synthesized
atggtgaagctctgttggta

SEQ ID NO: 60062 - DNA, 20 bp, Artificial Sequence
  chemically synthesized
gtgaagctctgttggtatgg

SEQ ID NO: 60063 - DNA, 20 bp, Artificial Sequence
  chemically synthesized
gaagctctgttggtatggca

SEQ ID NO: 60064 - DNA, 20 bp, Artificial Sequence
  chemically synthesized
aagctctgttggtatggcag

SEQ ID NO: 60065 - DNA, 20 bp, Artificial Sequence
  chemically synthesized
agctctgttggtatggcaga

SEQ ID NO: 60066 - DNA, 20 bp, Artificial Sequence
  chemically synthesized
gctctgttggtatggcagag

SEQ ID NO: 60067 - DNA, 20 bp, Artificial Sequence
  chemically synthesized
tctgttggtatggcagaggg

SEQ ID NO: 60068 - DNA, 20 bp, Artificial Sequence
  chemically synthesized
ctgttggtatggcagagggg

SEQ ID NO: 60069 - DNA, 20 bp, Artificial Sequence
  chemically synthesized
atggcagaggggaggctgct

SEQ ID NO: 60070 - DNA, 20 bp, Artificial Sequence
  chemically synthesized
tggcagaggggaggctgctc

SEQ ID NO: 60071 - DNA, 20 bp, Artificial Sequence
  chemically synthesized
ctgcatttcccctgccaatc

SEQ ID NO: 60072 - DNA, 20 bp, Artificial Sequence
  chemically synthesized
gcatttcccctgccaatcta

SEQ ID NO: 60073 - DNA, 20 bp, Artificial Sequence
  chemically synthesized
catttcccctgccaatctag

SEQ ID NO: 60074 - DNA, 20 bp, Artificial Sequence
  chemically synthesized
cccctgccaatctagaggat

SEQ ID NO: 60075 - DNA, 20 bp, Artificial Sequence
  chemically synthesized
ccctgccaatctagaggatg

SEQ ID NO: 60076 - DNA, 20 bp, Artificial Sequence
  chemically synthesized
gccaatctagaggatgagga

SEQ ID NO: 60077 - DNA, 20 bp, Artificial Sequence
  chemically synthesized
tagaggatgaggaaagctct

SEQ ID NO: 60078 - DNA, 20 bp, Artificial Sequence
  chemically synthesized
agaggatgaggaaagctctc

SEQ ID NO: 60079 - DNA, 20 bp, Artificial Sequence
  chemically synthesized
atgaggaaagctctcaggaa

SEQ ID NO: 60080 - DNA, 20 bp, Artificial Sequence
  chemically synthesized
ggaaagctctcaggaatagt

SEQ ID NO: 60081 - DNA, 20 bp, Artificial Sequence
  chemically synthesized
aagctctcaggaatagtaag

SEQ ID NO: 60082 - DNA, 20 bp, Artificial Sequence
  chemically synthesized
agtaagcagaatgtttgccc

SEQ ID NO: 60083 - DNA, 20 bp, Artificial Sequence
  chemically synthesized
tttgccctggatgaataact

SEQ ID NO: 60084 - DNA, 20 bp, Artificial Sequence
  chemically synthesized
taactgagctgccaattaac

SEQ ID NO: 60085 - DNA, 20 bp, Artificial Sequence
  chemically synthesized
aactgagctgccaattaaca

SEQ ID NO: 60086 - DNA, 20 bp, Artificial Sequence
  chemically synthesized
actgagctgccaattaacaa

SEQ ID NO: 60087 - DNA, 20 bp, Artificial Sequence
  chemically synthesized
ctgagctgccaattaacaag

SEQ ID NO: 60088 - DNA, 20 bp, Artificial Sequence
  chemically synthesized
agctgccaattaacaagggg

SEQ ID NO: 60089 - DNA, 20 bp, Artificial Sequence
  chemically synthesized
gctgccaattaacaaggggc

SEQ ID NO: 60090 - DNA, 20 bp, Artificial Sequence
  chemically synthesized
ctgccaattaacaaggggca

SEQ ID NO: 60091 - DNA, 20 bp, Artificial Sequence
  chemically synthesized
gccaattaacaaggggcagg

SEQ ID NO: 60092 - DNA, 20 bp, Artificial Sequence
  chemically synthesized
taacaaggggcagggagcct

SEQ ID NO: 60093 - DNA, 20 bp, Artificial Sequence
  chemically synthesized
aaggggcagggagccttaga

SEQ ID NO: 60094 - DNA, 20 bp, Artificial Sequence
  chemically synthesized
gggcagggagccttagacag

SEQ ID NO: 60095 - DNA, 20 bp, Artificial Sequence
  chemically synthesized
ggcagggagccttagacaga

SEQ ID NO: 60096 - DNA, 20 bp, Artificial Sequence
  chemically synthesized
acattttatttgtaatatcc

SEQ ID NO: 60097 - DNA, 20 bp, Artificial Sequence
  chemically synthesized
atgattccaataaaaatgca

SEQ ID NO: 60098 - DNA, 20 bp, Artificial Sequence
  chemically synthesized
ataaaaatgcacagccacga

SEQ ID NO: 60099 - DNA, 20 bp, Artificial Sequence
  chemically synthesized
acagccacgatggcatctct

SEQ ID NO: 60100 - DNA, 20 bp, Artificial Sequence
  chemically synthesized
agcctgacatcgccacgatg

SEQ ID NO: 60101 - DNA, 20 bp, Artificial Sequence
  chemically synthesized
agaaattctgcatcttcctc

SEQ ID NO: 60102 - DNA, 20 bp, Artificial Sequence
  chemically synthesized
tatccccacacaatcttttt

SEQ ID NO: 60103 - DNA, 20 bp, Artificial Sequence
  chemically synthesized
ccccacacaatctttttcgg

SEQ ID NO: 60104 - DNA, 20 bp, Artificial Sequence
  chemically synthesized
cacaatctttttcggcagct

SEQ ID NO: 60105 - DNA, 20 bp, Artificial Sequence
  chemically synthesized
atctttttcggcagcttgga

SEQ ID NO: 60106 - DNA, 20 bp, Artificial Sequence
  chemically synthesized
ttttcggcagcttggatggt

SEQ ID NO: 60107 - DNA, 20 bp, Artificial Sequence
  chemically synthesized
gcagcttggatggtcagttt

SEQ ID NO: 60108 - DNA, 20 bp, Artificial Sequence
  chemically synthesized
gtcagtttcagcacctttta

SEQ ID NO: 60109 - DNA, 20 bp, Artificial Sequence
  chemically synthesized
agcaccttttacagatgatg

SEQ ID NO: 60110 - DNA, 20 bp, Artificial Sequence
  chemically synthesized
cttttacagatgatgaagct

SEQ ID NO: 60111 - DNA, 20 bp, Artificial Sequence
  chemically synthesized
agatgatgaagctgagcctc

SEQ ID NO: 60112 - DNA, 20 bp, Artificial Sequence
  chemically synthesized
gatgatgaagctgagcctcg

SEQ ID NO: 60113 - DNA, 20 bp, Artificial Sequence
  chemically synthesized
atgatgaagctgagcctcga

SEQ ID NO: 60114 - DNA, 20 bp, Artificial Sequence
  chemically synthesized
ctcgagggatgtgtgtcgtc

SEQ ID NO: 60115 - DNA, 20 bp, Artificial Sequence
  chemically synthesized
tcgagggatgtgtgtcgtca

SEQ ID NO: 60116 - DNA, 20 bp, Artificial Sequence
  chemically synthesized
cgagggatgtgtgtcgtcaa

SEQ ID NO: 60117 - DNA, 20 bp, Artificial Sequence
  chemically synthesized
gagggatgtgtgtcgtcaag

SEQ ID NO: 60118 - DNA, 20 bp, Artificial Sequence
  chemically synthesized
agggatgtgtgtcgtcaagg

SEQ ID NO: 60119 - DNA, 20 bp, Artificial Sequence
  chemically synthesized
tgtgtgtcgtcaagggggct

SEQ ID NO: 60120 - DNA, 20 bp, Artificial Sequence
  chemically synthesized
gtgtgtcgtcaagggggctc

SEQ ID NO: 60121 - DNA, 20 bp, Artificial Sequence
  chemically synthesized
tgtgtcgtcaagggggctca

SEQ ID NO: 60122 - DNA, 20 bp, Artificial Sequence
  chemically synthesized
caagggggctcagggcttct

SEQ ID NO: 60123 - DNA, 20 bp, Artificial Sequence
  chemically synthesized
aagggggctcagggcttctc

SEQ ID NO: 60124 - DNA, 20 bp, Artificial Sequence
  chemically synthesized
agggggctcagggcttctca

SEQ ID NO: 60125 - DNA, 20 bp, Artificial Sequence
  chemically synthesized
ggggctcagggcttctcagg

SEQ ID NO: 60126 - DNA, 20 bp, Artificial Sequence
  chemically synthesized
gggctcagggcttctcaggg

SEQ ID NO: 60127 - DNA, 20 bp, Artificial Sequence
  chemically synthesized
ggctcagggcttctcaggga

SEQ ID NO: 60128 - DNA, 20 bp, Artificial Sequence
  chemically synthesized
gctcagggcttctcagggag

SEQ ID NO: 60129 - DNA, 20 bp, Artificial Sequence
  chemically synthesized
cttctcagggaggggactca

SEQ ID NO: 60130 - DNA, 20 bp, Artificial Sequence
  chemically synthesized
tccaaaccttcactcacccc

SEQ ID NO: 60131 - DNA, 20 bp, Artificial Sequence
  chemically synthesized
tgcccaccttcccctctctc

SEQ ID NO: 60132 - DNA, 20 bp, Artificial Sequence
  chemically synthesized
gcccaccttcccctctctcc

SEQ ID NO: 60133 - DNA, 20 bp, Artificial Sequence
  chemically synthesized
ttcccctctctccaggcaaa

SEQ ID NO: 60134 - DNA, 20 bp, Artificial Sequence
  chemically synthesized
tcccctctctccaggcaaat

SEQ ID NO: 60135 - DNA, 20 bp, Artificial Sequence
  chemically synthesized
ccctctctccaggcaaatgg

SEQ ID NO: 60136 - DNA, 20 bp, Artificial Sequence
  chemically synthesized
ctctctccaggcaaatggga

SEQ ID NO: 60137 - DNA, 20 bp, Artificial Sequence
  chemically synthesized
caaatgggagagaccctttg

SEQ ID NO: 60138 - DNA, 20 bp, Artificial Sequence
  chemically synthesized
gggagagaccctttgaagtc

SEQ ID NO: 60139 - DNA, 20 bp, Artificial Sequence
  chemically synthesized
ggagagaccctttgaagtca

SEQ ID NO: 60140 - DNA, 20 bp, Artificial Sequence
  chemically synthesized
cctttgaagtcaaggacacc

SEQ ID NO: 60141 - DNA, 20 bp, Artificial Sequence
  chemically synthesized
ctttgaagtcaaggacaccg

SEQ ID NO: 60142 - DNA, 20 bp, Artificial Sequence
  chemically synthesized
tgaagtcaaggacaccgagg

SEQ ID NO: 60143 - DNA, 20 bp, Artificial Sequence
  chemically synthesized
aagtcaaggacaccgaggaa

SEQ ID NO: 60144 - DNA, 20 bp, Artificial Sequence
  chemically synthesized
agtcaaggacaccgaggaag

SEQ ID NO: 60145 - DNA, 20 bp, Artificial Sequence
  chemically synthesized
cgaggaagaggacttccacg

SEQ ID NO: 60146 - DNA, 20 bp, Artificial Sequence
  chemically synthesized
aagaggacttccacgtggac

SEQ ID NO: 60147 - DNA, 20 bp, Artificial Sequence
  chemically synthesized
agaggacttccacgtggacc

SEQ ID NO: 60148 - DNA, 20 bp, Artificial Sequence
  chemically synthesized
tggaccaggtgaccaccgtg

SEQ ID NO: 60149 - DNA, 20 bp, Artificial Sequence
  chemically synthesized
ggaccaggtgaccaccgtga

SEQ ID NO: 60150 - DNA, 20 bp, Artificial Sequence
  chemically synthesized
ccgtgaaggtgcctatgatg

SEQ ID NO: 60151 - DNA, 20 bp, Artificial Sequence
  chemically synthesized
ggtgcctatgatgaagcgtt

SEQ ID NO: 60152 - DNA, 20 bp, Artificial Sequence
  chemically synthesized
gtgcctatgatgaagcgttt

SEQ ID NO: 60153 - DNA, 20 bp, Artificial Sequence
  chemically synthesized
gtttaggcatgtttaacatc

SEQ ID NO: 60154 - DNA, 20 bp, Artificial Sequence
  chemically synthesized
tgtttaacatccagcactgt

SEQ ID NO: 60155 - DNA, 20 bp, Artificial Sequence
  chemically synthesized
ttaacatccagcactgtaag

SEQ ID NO: 60156 - DNA, 20 bp, Artificial Sequence
  chemically synthesized
cagcactgtaagaagctgtc

SEQ ID NO: 60157 - DNA, 20 bp, Artificial Sequence
  chemically synthesized
actgtaagaagctgtccagc

SEQ ID NO: 60158 - DNA, 20 bp, Artificial Sequence
  chemically synthesized
ctgtaagaagctgtccagct

SEQ ID NO: 60159 - DNA, 20 bp, Artificial Sequence
  chemically synthesized
ggtgctgctgatgaaatacc

SEQ ID NO: 60160 - DNA, 20 bp, Artificial Sequence
  chemically synthesized
gtgctgctgatgaaatacct

SEQ ID NO: 60161 - DNA, 20 bp, Artificial Sequence
  chemically synthesized
ccatcttcttcctgcctgat

SEQ ID NO: 60162 - DNA, 20 bp, Artificial Sequence
  chemically synthesized
catcttcttcctgcctgatg

SEQ ID NO: 60163 - DNA, 20 bp, Artificial Sequence
  chemically synthesized
atcttcttcctgcctgatga

SEQ ID NO: 60164 - DNA, 20 bp, Artificial Sequence
  chemically synthesized
tcttcttcctgcctgatgag

SEQ ID NO: 60165 - DNA, 20 bp, Artificial Sequence
  chemically synthesized
tgcctgatgaggggaaacta

SEQ ID NO: 60166 - DNA, 20 bp, Artificial Sequence
  chemically synthesized
tgaggggaaactacagcacc

SEQ ID NO: 60167 - DNA, 20 bp, Artificial Sequence
  chemically synthesized
tcacccacgatatcatcacc

SEQ ID NO: 60168 - DNA, 20 bp, Artificial Sequence
  chemically synthesized
cgatatcatcaccaagttcc

SEQ ID NO: 60169 - DNA, 20 bp, Artificial Sequence
  chemically synthesized
caccaagttcctggaaaatg

SEQ ID NO: 60170 - DNA, 20 bp, Artificial Sequence
  chemically synthesized
aagttcctggaaaatgaaga

SEQ ID NO: 60171 - DNA, 20 bp, Artificial Sequence
  chemically synthesized
ttcctggaaaatgaagacag

SEQ ID NO: 60172 - DNA, 20 bp, Artificial Sequence
  chemically synthesized
tcctggaaaatgaagacaga

SEQ ID NO: 60173 - DNA, 20 bp, Artificial Sequence
  chemically synthesized
agaaggtgattccccaacct

SEQ ID NO: 60174 - DNA, 20 bp, Artificial Sequence
  chemically synthesized
gaaggtgattccccaacctg

SEQ ID NO: 60175 - DNA, 20 bp, Artificial Sequence
  chemically synthesized
aaggtgattccccaacctga

SEQ ID NO: 60176 - DNA, 20 bp, Artificial Sequence
  chemically synthesized
tccccaacctgagggtgacc

SEQ ID NO: 60177 - DNA, 20 bp, Artificial Sequence
  chemically synthesized
ccaacctgagggtgaccaag

SEQ ID NO: 60178 - DNA, 20 bp, Artificial Sequence
  chemically synthesized
aagaagctgcccacacctct

SEQ ID NO: 60179 - DNA, 20 bp, Artificial Sequence
  chemically synthesized
cccacacctcttagccatgt

SEQ ID NO: 60180 - DNA, 20 bp, Artificial Sequence
  chemically synthesized
ccacacctcttagccatgtt

SEQ ID NO: 60181 - DNA, 20 bp, Artificial Sequence
  chemically synthesized
ctcttagccatgttgggact

SEQ ID NO: 60182 - DNA, 20 bp, Artificial Sequence
  chemically synthesized
tcttagccatgttgggactg

SEQ ID NO: 60183 - DNA, 20 bp, Artificial Sequence
  chemically synthesized
atgttgggactgaggcccat

SEQ ID NO: 60184 - DNA, 20 bp, Artificial Sequence
  chemically synthesized
tgttgggactgaggcccatc

SEQ ID NO: 60185 - DNA, 20 bp, Artificial Sequence
  chemically synthesized
ggactgaggcccatcaggac

SEQ ID NO: 60186 - DNA, 20 bp, Artificial Sequence
  chemically synthesized
tgaggcccatcaggactggc

SEQ ID NO: 60187 - DNA, 20 bp, Artificial Sequence
  chemically synthesized
aggcccatcaggactggcca

SEQ ID NO: 60188 - DNA, 20 bp, Artificial Sequence
  chemically synthesized
ggcccatcaggactggccag

SEQ ID NO: 60189 - DNA, 20 bp, Artificial Sequence
  chemically synthesized
gcccatcaggactggccaga

SEQ ID NO: 60190 - DNA, 20 bp, Artificial Sequence
  chemically synthesized
tcaggactggccagagggct

SEQ ID NO: 60191 - DNA, 20 bp, Artificial Sequence
  chemically synthesized
caggactggccagagggctg

SEQ ID NO: 60192 - DNA, 20 bp, Artificial Sequence
  chemically synthesized
ggactggccagagggctgag

SEQ ID NO: 60193 - DNA, 20 bp, Artificial Sequence
  chemically synthesized
gactggccagagggctgagg

SEQ ID NO: 60194 - DNA, 20 bp, Artificial Sequence
  chemically synthesized
actggccagagggctgagga

SEQ ID NO: 60195 - DNA, 20 bp, Artificial Sequence
  chemically synthesized
gagggtgaaccccacatccc

SEQ ID NO: 60196 - DNA, 20 bp, Artificial Sequence
  chemically synthesized
agggtgaaccccacatccct

SEQ ID NO: 60197 - DNA, 20 bp, Artificial Sequence
  chemically synthesized
actgctactctgtataaact

SEQ ID NO: 60198 - DNA, 20 bp, Artificial Sequence
  chemically synthesized
ctctgtataaacttggcttc

SEQ ID NO: 60199 - DNA, 20 bp, Artificial Sequence
  chemically synthesized
ataaacttggcttccagaat

SEQ ID NO: 60200 - DNA, 20 bp, Artificial Sequence
  chemically synthesized
taaacttggcttccagaatg

SEQ ID NO: 60201 - DNA, 20 bp, Artificial Sequence
  chemically synthesized
tccagaatgaggccaccact

SEQ ID NO: 60202 - DNA, 20 bp, Artificial Sequence
  chemically synthesized
aatgaggccaccactgagtt

SEQ ID NO: 60203 - DNA, 20 bp, Artificial Sequence
  chemically synthesized
atgaggccaccactgagttc

SEQ ID NO: 60204 - DNA, 20 bp, Artificial Sequence
  chemically synthesized
aggccaccactgagttcagg

SEQ ID NO: 60205 - DNA, 20 bp, Artificial Sequence
  chemically synthesized
cagcgccatccatgctccat

SEQ ID NO: 60206 - DNA, 20 bp, Artificial Sequence
  chemically synthesized
agcgccatccatgctccatg

SEQ ID NO: 60207 - DNA, 20 bp, Artificial Sequence
  chemically synthesized
cgccatccatgctccatgag

SEQ ID NO: 60208 - DNA, 20 bp, Artificial Sequence
  chemically synthesized
gccatccatgctccatgagg

SEQ ID NO: 60209 - DNA, 20 bp, Artificial Sequence
  chemically synthesized
tccatgctccatgaggagga

SEQ ID NO: 60210 - DNA, 20 bp, Artificial Sequence
  chemically synthesized
tccatgaggaggacagtacc

SEQ ID NO: 60211 - DNA, 20 bp, Artificial Sequence
  chemically synthesized
ccatgaggaggacagtaccc

SEQ ID NO: 60212 - DNA, 20 bp, Artificial Sequence
  chemically synthesized
catgaggaggacagtaccca

SEQ ID NO: 60213 - DNA, 20 bp, Artificial Sequence
  chemically synthesized
atgaggaggacagtacccag

SEQ ID NO: 60214 - DNA, 20 bp, Artificial Sequence
  chemically synthesized
ggaggacagtacccaggggt

SEQ ID NO: 60215 - DNA, 20 bp, Artificial Sequence
  chemically synthesized
gaggacagtacccaggggtg

SEQ ID NO: 60216 - DNA, 20 bp, Artificial Sequence
  chemically synthesized
ggacagtacccaggggtgag

SEQ ID NO: 60217 - DNA, 20 bp, Artificial Sequence
  chemically synthesized
gacagtacccaggggtgagg

SEQ ID NO: 60218 - DNA, 20 bp, Artificial Sequence
  chemically synthesized
tacccaggggtgaggaggta

SEQ ID NO: 60219 - DNA, 20 bp, Artificial Sequence
  chemically synthesized
acccaggggtgaggaggtaa

SEQ ID NO: 60220 - DNA, 20 bp, Artificial Sequence
  chemically synthesized
ggaggtaaaggtctcgtccc

SEQ ID NO: 60221 - DNA, 20 bp, Artificial Sequence
  chemically synthesized
gaggtaaaggtctcgtccct

SEQ ID NO: 60222 - DNA, 20 bp, Artificial Sequence
  chemically synthesized
aggtaaaggtctcgtccctg

SEQ ID NO: 60223 - DNA, 20 bp, Artificial Sequence
  chemically synthesized
tccctggggacttcccactc

SEQ ID NO: 60224 - DNA, 20 bp, Artificial Sequence
  chemically synthesized
ggggacttcccactccagtg

SEQ ID NO: 60225 - DNA, 20 bp, Artificial Sequence
  chemically synthesized
cactgtcccttcccaatatc

SEQ ID NO: 60226 - DNA, 20 bp, Artificial Sequence
  chemically synthesized
ccttcccaatatccagtgcc

SEQ ID NO: 60227 - DNA, 20 bp, Artificial Sequence
  chemically synthesized
cttcccaatatccagtgccc

SEQ ID NO: 60228 - DNA, 20 bp, Artificial Sequence
  chemically synthesized
ttcccaatatccagtgccca

SEQ ID NO: 60229 - DNA, 20 bp, Artificial Sequence
  chemically synthesized
ccaatatccagtgcccaggg

SEQ ID NO: 60230 - DNA, 20 bp, Artificial Sequence
  chemically synthesized
caatatccagtgcccagggc

SEQ ID NO: 60231 - DNA, 20 bp, Artificial Sequence
  chemically synthesized
aatatccagtgcccagggca

SEQ ID NO: 60232 - DNA, 20 bp, Artificial Sequence
  chemically synthesized
tccagtgcccagggcaggga

SEQ ID NO: 60233 - DNA, 20 bp, Artificial Sequence
  chemically synthesized
agtgcccagggcagggacag

SEQ ID NO: 60234 - DNA, 20 bp, Artificial Sequence
  chemically synthesized
agcagcaccaccacacgttc

SEQ ID NO: 60235 - DNA, 20 bp, Artificial Sequence
  chemically synthesized
agcaccaccacacgttctgg

SEQ ID NO: 60236 - DNA, 20 bp, Artificial Sequence
  chemically synthesized
cacgttctggcagaaccaaa

SEQ ID NO: 60237 - DNA, 20 bp, Artificial Sequence
  chemically synthesized
acgttctggcagaaccaaaa

SEQ ID NO: 60238 - DNA, 20 bp, Artificial Sequence
  chemically synthesized
ctggcagaaccaaaaaggaa

SEQ ID NO: 60239 - DNA, 20 bp, Artificial Sequence
  chemically synthesized
cagaaccaaaaaggaacaga

SEQ ID NO: 60240 - DNA, 20 bp, Artificial Sequence
  chemically synthesized
agaaccaaaaaggaacagat

SEQ ID NO: 60241 - DNA, 20 bp, Artificial Sequence
  chemically synthesized
aaaggaacagatgggcttcc

SEQ ID NO: 60242 - DNA, 20 bp, Artificial Sequence
  chemically synthesized
aacagatgggcttcctggca

SEQ ID NO: 60243 - DNA, 20 bp, Artificial Sequence
  chemically synthesized
acagatgggcttcctggcaa

SEQ ID NO: 60244 - DNA, 20 bp, Artificial Sequence
  chemically synthesized
gatgggcttcctggcaaagg

SEQ ID NO: 60245 - DNA, 20 bp, Artificial Sequence
  chemically synthesized
gggcttcctggcaaaggcag

SEQ ID NO: 60246 - DNA, 20 bp, Artificial Sequence
  chemically synthesized
cttcctggcaaaggcagcag

SEQ ID NO: 60247 - DNA, 20 bp, Artificial Sequence
  chemically synthesized
tcctggcaaaggcagcagtg

SEQ ID NO: 60248 - DNA, 20 bp, Artificial Sequence
  chemically synthesized
gcaaaggcagcagtggagtg

SEQ ID NO: 60249 - DNA, 20 bp, Artificial Sequence
  chemically synthesized
aaaggcagcagtggagtgtg

SEQ ID NO: 60250 - DNA, 20 bp, Artificial Sequence
  chemically synthesized
agcagtggagtgtggagttc

SEQ ID NO: 60251 - DNA, 20 bp, Artificial Sequence
  chemically synthesized
gcagtggagtgtggagttca

SEQ ID NO: 60252 - DNA, 20 bp, Artificial Sequence
  chemically synthesized
cagtggagtgtggagttcaa

SEQ ID NO: 60253 - DNA, 20 bp, Artificial Sequence
  chemically synthesized
tggagtgtggagttcaaggg

SEQ ID NO: 60254 - DNA, 20 bp, Artificial Sequence
  chemically synthesized
gttcaagggtagaatgtccc

SEQ ID NO: 60255 - DNA, 20 bp, Artificial Sequence
  chemically synthesized
ttcaagggtagaatgtccct

SEQ ID NO: 60256 - DNA, 20 bp, Artificial Sequence
  chemically synthesized
tcaagggtagaatgtccctg

SEQ ID NO: 60257 - DNA, 20 bp, Artificial Sequence
  chemically synthesized
caagggtagaatgtccctgg

SEQ ID NO: 60258 - DNA, 20 bp, Artificial Sequence
  chemically synthesized
aagggtagaatgtccctggg

SEQ ID NO: 60259 - DNA, 20 bp, Artificial Sequence
  chemically synthesized
gtagaatgtccctgggggga

SEQ ID NO: 60260 - DNA, 20 bp, Artificial Sequence
  chemically synthesized
tagaatgtccctggggggac

SEQ ID NO: 60261 - DNA, 20 bp, Artificial Sequence
  chemically synthesized
agaatgtccctggggggacg

SEQ ID NO: 60262 - DNA, 20 bp, Artificial Sequence
  chemically synthesized
gaatgtccctggggggacgg

SEQ ID NO: 60263 - DNA, 20 bp, Artificial Sequence
  chemically synthesized
tgtccctggggggacggggg

SEQ ID NO: 60264 - DNA, 20 bp, Artificial Sequence
  chemically synthesized
tccctggggggacgggggaa

SEQ ID NO: 60265 - DNA, 20 bp, Artificial Sequence
  chemically synthesized
ggacgggggaagagcctgtg

SEQ ID NO: 60266 - DNA, 20 bp, Artificial Sequence
  chemically synthesized
gggggaagagcctgtgtggc

SEQ ID NO: 60267 - DNA, 20 bp, Artificial Sequence
  chemically synthesized
ggggaagagcctgtgtggca

SEQ ID NO: 60268 - DNA, 20 bp, Artificial Sequence
  chemically synthesized
agagcctgtgtggcaaggcc

SEQ ID NO: 60269 - DNA, 20 bp, Artificial Sequence
  chemically synthesized
ctgtgtggcaaggcccagaa

SEQ ID NO: 60270 - DNA, 20 bp, Artificial Sequence
  chemically synthesized
gtggcaaggcccagaaaagc

SEQ ID NO: 60271 - DNA, 20 bp, Artificial Sequence
  chemically synthesized
tggcaaggcccagaaaagca

SEQ ID NO: 60272 - DNA, 20 bp, Artificial Sequence
  chemically synthesized
aggcccagaaaagcaaggtt

SEQ ID NO: 60273 - DNA, 20 bp, Artificial Sequence
  chemically synthesized
agaaaagcaaggttcggaat

SEQ ID NO: 60274 - DNA, 20 bp, Artificial Sequence
  chemically synthesized
agcaaggttcggaattggaa

SEQ ID NO: 60275 - DNA, 20 bp, Artificial Sequence
  chemically synthesized
aggttcggaattggaacagc

SEQ ID NO: 60276 - DNA, 20 bp, Artificial Sequence
  chemically synthesized
ggttcggaattggaacagcc

SEQ ID NO: 60277 - DNA, 20 bp, Artificial Sequence
  chemically synthesized
gaacagccaggccatgttcg

SEQ ID NO: 60278 - DNA, 20 bp, Artificial Sequence
  chemically synthesized
cagccaggccatgttcgcag

SEQ ID NO: 60279 - DNA, 20 bp, Artificial Sequence
  chemically synthesized
agccaggccatgttcgcaga

SEQ ID NO: 60280 - DNA, 20 bp, Artificial Sequence
  chemically synthesized
gcgtttctctgtcactttat

SEQ ID NO: 60281 - DNA, 20 bp, Artificial Sequence
  chemically synthesized
tgtcactttatcggtgctgt

SEQ ID NO: 60282 - DNA, 20 bp, Artificial Sequence
  chemically synthesized
ctttatcggtgctgttagat

SEQ ID NO: 60283 - DNA, 20 bp, Artificial Sequence
  chemically synthesized
tttatcggtgctgttagatt

SEQ ID NO: 60284 - DNA, 20 bp, Artificial Sequence
  chemically synthesized
ctgttagattgggtgtcctg

SEQ ID NO: 60285 - DNA, 20 bp, Artificial Sequence
  chemically synthesized
tagattgggtgtcctgtagt

SEQ ID NO: 60286 - DNA, 20 bp, Artificial Sequence
  chemically synthesized
agtaagtgatacttaaacat

SEQ ID NO: 60287 - DNA, 20 bp, Artificial Sequence
  chemically synthesized
cttaaacatgagccacacat

SEQ ID NO: 60288 - DNA, 20 bp, Artificial Sequence
  chemically synthesized
atgcccatgccctgctgatc

SEQ ID NO: 60289 - DNA, 20 bp, Artificial Sequence
  chemically synthesized
gttttgtacactgtaaaacc

SEQ ID NO: 60290 - DNA, 20 bp, Artificial Sequence
  chemically synthesized
aaaccaagatgaaaatacaa

SEQ ID NO: 60291 - DNA, 20 bp, Artificial Sequence
  chemically synthesized
aaccaagatgaaaatacaaa

SEQ ID NO: 60292 - DNA, 20 bp, Artificial Sequence
  chemically synthesized
gatgaaaatacaaaaggtgt

SEQ ID NO: 60293 - DNA, 20 bp, Artificial Sequence
  chemically synthesized
atgaaaatacaaaaggtgtc

SEQ ID NO: 60294 - DNA, 20 bp, Artificial Sequence
  chemically synthesized
aaaaggtgtcgggttcataa

SEQ ID NO: 60295 - DNA, 20 bp, Artificial Sequence
  chemically synthesized
aaaggtgtcgggttcataat

SEQ ID NO: 60296 - DNA, 20 bp, Artificial Sequence
  chemically synthesized
tcgggttcataataggaatc

SEQ ID NO: 60297 - DNA, 20 bp, Artificial Sequence
  chemically synthesized
cgggttcataataggaatcg

SEQ ID NO: 60298 - DNA, 20 bp, Artificial Sequence
  chemically synthesized
ttcataataggaatcgaggc

SEQ ID NO: 60299 - DNA, 20 bp, Artificial Sequence
  chemically synthesized
ggaatttctctgttccatgc

SEQ ID NO: 60300 - DNA, 20 bp, Artificial Sequence
  chemically synthesized
gttccatgccagcacctcct

SEQ ID NO: 60301 - DNA, 20 bp, Artificial Sequence
  chemically synthesized
ttccatgccagcacctcctg

SEQ ID NO: 60302 - DNA, 20 bp, Artificial Sequence
  chemically synthesized
acctcctgaggtctctgctc

SEQ ID NO: 60303 - DNA, 20 bp, Artificial Sequence
  chemically synthesized
cctcctgaggtctctgctcc

SEQ ID NO: 60304 - DNA, 20 bp, Artificial Sequence
  chemically synthesized
ctcctgaggtctctgctcca

SEQ ID NO: 60305 - DNA, 20 bp, Artificial Sequence
  chemically synthesized
tcctgaggtctctgctccag

SEQ ID NO: 60306 - DNA, 20 bp, Artificial Sequence
  chemically synthesized
aggtctctgctccaggggtt

SEQ ID NO: 60307 - DNA, 20 bp, Artificial Sequence
  chemically synthesized
ctctgctccaggggttgaga

SEQ ID NO: 60308 - DNA, 20 bp, Artificial Sequence
  chemically synthesized
ccaggggttgagaaagaaca

SEQ ID NO: 60309 - DNA, 20 bp, Artificial Sequence
  chemically synthesized
aggggttgagaaagaacaaa

SEQ ID NO: 60310 - DNA, 20 bp, Artificial Sequence
  chemically synthesized
ggggttgagaaagaacaaag

SEQ ID NO: 60311 - DNA, 20 bp, Artificial Sequence
  chemically synthesized
tgagaaagaacaaagaggct

SEQ ID NO: 60312 - DNA, 20 bp, Artificial Sequence
  chemically synthesized
agaaagaacaaagaggctga

SEQ ID NO: 60313 - DNA, 20 bp, Artificial Sequence
  chemically synthesized
gaaagaacaaagaggctgag

SEQ ID NO: 60314 - DNA, 20 bp, Artificial Sequence
  chemically synthesized
aaagaacaaagaggctgaga

SEQ ID NO: 60315 - DNA, 20 bp, Artificial Sequence
  chemically synthesized
caaagaggctgagagggtaa

SEQ ID NO: 60316 - DNA, 20 bp, Artificial Sequence
  chemically synthesized
aggctgagagggtaacggat

SEQ ID NO: 60317 - DNA, 20 bp, Artificial Sequence
  chemically synthesized
gctgagagggtaacggatca

SEQ ID NO: 60318 - DNA, 20 bp, Artificial Sequence
  chemically synthesized
tgagagggtaacggatcaga

SEQ ID NO: 60319 - DNA, 20 bp, Artificial Sequence
  chemically synthesized
gggtaacggatcagagagcc

SEQ ID NO: 60320 - DNA, 20 bp, Artificial Sequence
  chemically synthesized
gtaacggatcagagagccca

SEQ ID NO: 60321 - DNA, 20 bp, Artificial Sequence
  chemically synthesized
ggatcagagagcccagagcc

SEQ ID NO: 60322 - DNA, 20 bp, Artificial Sequence
  chemically synthesized
gccaagctgcccgctcacac

SEQ ID NO: 60323 - DNA, 20 bp, Artificial Sequence
  chemically synthesized
cgctcacaccagaccctgct

SEQ ID NO: 60324 - DNA, 20 bp, Artificial Sequence
  chemically synthesized
gctcacaccagaccctgctc

SEQ ID NO: 60325 - DNA, 20 bp, Artificial Sequence
  chemically synthesized
ctcacaccagaccctgctca

SEQ ID NO: 60326 - DNA, 20 bp, Artificial Sequence
  chemically synthesized
acaccagaccctgctcaggg

SEQ ID NO: 60327 - DNA, 20 bp, Artificial Sequence
  chemically synthesized
agggtggcattgtctcccca

SEQ ID NO: 60328 - DNA, 20 bp, Artificial Sequence
  chemically synthesized
attgtctccccatggaaaac

SEQ ID NO: 60329 - DNA, 20 bp, Artificial Sequence
  chemically synthesized
tgtctccccatggaaaacca

SEQ ID NO: 60330 - DNA, 20 bp, Artificial Sequence
  chemically synthesized
tctccccatggaaaaccaga

SEQ ID NO: 60331 - DNA, 20 bp, Artificial Sequence
  chemically synthesized
ctccccatggaaaaccagag

SEQ ID NO: 60332 - DNA, 20 bp, Artificial Sequence
  chemically synthesized
ccccatggaaaaccagagag

SEQ ID NO: 60333 - DNA, 20 bp, Artificial Sequence
  chemically synthesized
gaaaaccagagaggagcact

SEQ ID NO: 60334 - DNA, 20 bp, Artificial Sequence
  chemically synthesized
ccagagaggagcactcagcc

SEQ ID NO: 60335 - DNA, 20 bp, Artificial Sequence
  chemically synthesized
gaggagcactcagcctggtg

SEQ ID NO: 60336 - DNA, 20 bp, Artificial Sequence
  chemically synthesized
ctcttctcttatccactaaa

SEQ ID NO: 60337 - DNA, 20 bp, Artificial Sequence
  chemically synthesized
atccactaaacggttgtcac

SEQ ID NO: 60338 - DNA, 20 bp, Artificial Sequence
  chemically synthesized
tccactaaacggttgtcact

SEQ ID NO: 60339 - DNA, 20 bp, Artificial Sequence
  chemically synthesized
ttgtcactgggcactgccac

SEQ ID NO: 60340 - DNA, 20 bp, Artificial Sequence
  chemically synthesized
ccaccagccccgtgtttctc

SEQ ID NO: 60341 - DNA, 20 bp, Artificial Sequence
  chemically synthesized
caccagccccgtgtttctct

SEQ ID NO: 60342 - DNA, 20 bp, Artificial Sequence
  chemically synthesized
gccccgtgtttctctgggtg

SEQ ID NO: 60343 - DNA, 20 bp, Artificial Sequence
  chemically synthesized
ccccgtgtttctctgggtgt

SEQ ID NO: 60344 - DNA, 20 bp, Artificial Sequence
  chemically synthesized
cccgtgtttctctgggtgta

SEQ ID NO: 60345 - DNA, 20 bp, Artificial Sequence
  chemically synthesized
tttctctgggtgtagggccc

SEQ ID NO: 60346 - DNA, 20 bp, Artificial Sequence
  chemically synthesized
ttctctgggtgtagggccct

SEQ ID NO: 60347 - DNA, 20 bp, Artificial Sequence
  chemically synthesized
tctctgggtgtagggccctg

SEQ ID NO: 60348 - DNA, 20 bp, Artificial Sequence
  chemically synthesized
gtagggccctggggatgtta

SEQ ID NO: 60349 - DNA, 20 bp, Artificial Sequence
  chemically synthesized
tagggccctggggatgttac

SEQ ID NO: 60350 - DNA, 20 bp, Artificial Sequence
  chemically synthesized
gccctggggatgttacaggc

SEQ ID NO: 60351 - DNA, 20 bp, Artificial Sequence
  chemically synthesized
ccctggggatgttacaggct

SEQ ID NO: 60352 - DNA, 20 bp, Artificial Sequence
  chemically synthesized
cctggggatgttacaggctg

SEQ ID NO: 60353 - DNA, 20 bp, Artificial Sequence
  chemically synthesized
ctggggatgttacaggctgg

SEQ ID NO: 60354 - DNA, 20 bp, Artificial Sequence
  chemically synthesized
ggatgttacaggctgggggc

SEQ ID NO: 60355 - DNA, 20 bp, Artificial Sequence
  chemically synthesized
gatgttacaggctgggggcc

SEQ ID NO: 60356 - DNA, 20 bp, Artificial Sequence
  chemically synthesized
ggccaggtgacccaacacta

SEQ ID NO: 60357 - DNA, 20 bp, Artificial Sequence
  chemically synthesized
gccaggtgacccaacactac

SEQ ID NO: 60358 - DNA, 20 bp, Artificial Sequence
  chemically synthesized
ccaggtgacccaacactaca

SEQ ID NO: 60359 - DNA, 20 bp, Artificial Sequence
  chemically synthesized
gtgacccaacactacagggc

SEQ ID NO: 60360 - DNA, 20 bp, Artificial Sequence
  chemically synthesized
ccaacactacagggcaagat

SEQ ID NO: 60361 - DNA, 20 bp, Artificial Sequence
  chemically synthesized
cactacagggcaagatgaga

SEQ ID NO: 60362 - DNA, 20 bp, Artificial Sequence
  chemically synthesized
actacagggcaagatgagac

SEQ ID NO: 60363 - DNA, 20 bp, Artificial Sequence
  chemically synthesized
ggcaagatgagacaggcttc

SEQ ID NO: 60364 - DNA, 20 bp, Artificial Sequence
  chemically synthesized
gcaagatgagacaggcttcc

SEQ ID NO: 60365 - DNA, 20 bp, Artificial Sequence
  chemically synthesized
agacaggcttccaggacacc

SEQ ID NO: 60366 - DNA, 20 bp, Artificial Sequence
  chemically synthesized
ttccaggacacctagaatat

SEQ ID NO: 60367 - DNA, 20 bp, Artificial Sequence
  chemically synthesized
ccaggacacctagaatatca

SEQ ID NO: 60368 - DNA, 20 bp, Artificial Sequence
  chemically synthesized
caggacacctagaatatcag

SEQ ID NO: 60369 - DNA, 20 bp, Artificial Sequence
  chemically synthesized
ggacacctagaatatcagag

SEQ ID NO: 60370 - DNA, 20 bp, Artificial Sequence
  chemically synthesized
gacacctagaatatcagagg

SEQ ID NO: 60371 - DNA, 20 bp, Artificial Sequence
  chemically synthesized
acctagaatatcagaggagg

SEQ ID NO: 60372 - DNA, 20 bp, Artificial Sequence
  chemically synthesized
atcagaggaggtggcatttc

SEQ ID NO: 60373 - DNA, 20 bp, Artificial Sequence
  chemically synthesized
taacattctttgactcaatg

SEQ ID NO: 60374 - DNA, 20 bp, Artificial Sequence
  chemically synthesized
cattctttgactcaatgtag

SEQ ID NO: 60375 - DNA, 20 bp, Artificial Sequence
  chemically synthesized
ttctttgactcaatgtagaa

SEQ ID NO: 60376 - DNA, 20 bp, Artificial Sequence
  chemically synthesized
actcaatgtagaagagctaa

SEQ ID NO: 60377 - DNA, 20 bp, Artificial Sequence
  chemically synthesized
caatgtagaagagctaaaag

SEQ ID NO: 60378 - DNA, 20 bp, Artificial Sequence
  chemically synthesized
gctaaaagtagaacaaacca

SEQ ID NO: 60379 - DNA, 20 bp, Artificial Sequence
  chemically synthesized
aagtagaacaaaccaaagcc

SEQ ID NO: 60380 - DNA, 20 bp, Artificial Sequence
  chemically synthesized
ccaaagccgagttcccatct

SEQ ID NO: 60381 - DNA, 20 bp, Artificial Sequence
  chemically synthesized
gccgagttcccatcttagtg

SEQ ID NO: 60382 - DNA, 20 bp, Artificial Sequence
  chemically synthesized
ccgagttcccatcttagtgt

SEQ ID NO: 60383 - DNA, 20 bp, Artificial Sequence
  chemically synthesized
agttcccatcttagtgtggg

SEQ ID NO: 60384 - DNA, 20 bp, Artificial Sequence
  chemically synthesized
ttcccatcttagtgtgggtg

SEQ ID NO: 60385 - DNA, 20 bp, Artificial Sequence
  chemically synthesized
tcccatcttagtgtgggtgg

SEQ ID NO: 60386 - DNA, 20 bp, Artificial Sequence
  chemically synthesized
cttagtgtgggtggaggaca

SEQ ID NO: 60387 - DNA, 20 bp, Artificial Sequence
  chemically synthesized
ttagtgtgggtggaggacac

SEQ ID NO: 60388 - DNA, 20 bp, Artificial Sequence
  chemically synthesized
agtgtgggtggaggacacag

SEQ ID NO: 60389 - DNA, 20 bp, Artificial Sequence
  chemically synthesized
tgggtggaggacacaggagt

SEQ ID NO: 60390 - DNA, 20 bp, Artificial Sequence
  chemically synthesized
gtggaggacacaggagtaag

SEQ ID NO: 60391 - DNA, 20 bp, Artificial Sequence
  chemically synthesized
gaggacacaggagtaagtgg

SEQ ID NO: 60392 - DNA, 20 bp, Artificial Sequence
  chemically synthesized
gagtaagtggcagaaataat

SEQ ID NO: 60393 - DNA, 20 bp, Artificial Sequence
  chemically synthesized
agtggcagaaataatcagaa

SEQ ID NO: 60394 - DNA, 20 bp, Artificial Sequence
  chemically synthesized
aaaagaaaacacttgcactg

SEQ ID NO: 60395 - DNA, 20 bp, Artificial Sequence
  chemically synthesized
agaaaacacttgcactgtgg

SEQ ID NO: 60396 - DNA, 20 bp, Artificial Sequence
  chemically synthesized
gaaaacacttgcactgtggt

SEQ ID NO: 60397 - DNA, 20 bp, Artificial Sequence
  chemically synthesized
acttgcactgtggtgggtcc

SEQ ID NO: 60398 - DNA, 20 bp, Artificial Sequence
  chemically synthesized
tgcactgtggtgggtcccag

SEQ ID NO: 60399 - DNA, 20 bp, Artificial Sequence
  chemically synthesized
gtggtgggtcccagaagaac

SEQ ID NO: 60400 - DNA, 20 bp, Artificial Sequence
  chemically synthesized
ggtgggtcccagaagaacaa

SEQ ID NO: 60401 - DNA, 20 bp, Artificial Sequence
  chemically synthesized
gtgggtcccagaagaacaag

SEQ ID NO: 60402 - DNA, 20 bp, Artificial Sequence
  chemically synthesized
tgaatttcttttctgcacga

SEQ ID NO: 60403 - DNA, 20 bp, Artificial Sequence
  chemically synthesized
gaatttcttttctgcacgac

SEQ ID NO: 60404 - DNA, 20 bp, Artificial Sequence
  chemically synthesized
tttctgcacgacaggtctgc

SEQ ID NO: 60405 - DNA, 20 bp, Artificial Sequence
  chemically synthesized
ttacccaaactgtccattac

SEQ ID NO: 60406 - DNA, 20 bp, Artificial Sequence
  chemically synthesized
ttactggaacctatgatctg

SEQ ID NO: 60407 - DNA, 20 bp, Artificial Sequence
  chemically synthesized
actggaacctatgatctgaa

SEQ ID NO: 60408 - DNA, 20 bp, Artificial Sequence
  chemically synthesized
ctatgatctgaagagcgtcc

SEQ ID NO: 60409 - DNA, 20 bp, Artificial Sequence
  chemically synthesized
tatgatctgaagagcgtcct

SEQ ID NO: 60410 - DNA, 20 bp, Artificial Sequence
  chemically synthesized
gaagagcgtcctgggtcaac

SEQ ID NO: 60411 - DNA, 20 bp, Artificial Sequence
  chemically synthesized
aagagcgtcctgggtcaact

SEQ ID NO: 60412 - DNA, 20 bp, Artificial Sequence
  chemically synthesized
tgggtcaactgggcatcact

SEQ ID NO: 60413 - DNA, 20 bp, Artificial Sequence
  chemically synthesized
gggtcaactgggcatcacta

SEQ ID NO: 60414 - DNA, 20 bp, Artificial Sequence
  chemically synthesized
ctgggcatcactaaggtctt

SEQ ID NO: 60415 - DNA, 20 bp, Artificial Sequence
  chemically synthesized
atcactaaggtcttcagcaa

SEQ ID NO: 60416 - DNA, 20 bp, Artificial Sequence
  chemically synthesized
tcactaaggtcttcagcaat

SEQ ID NO: 60417 - DNA, 20 bp, Artificial Sequence
  chemically synthesized
cactaaggtcttcagcaatg

SEQ ID NO: 60418 - DNA, 20 bp, Artificial Sequence
  chemically synthesized
agcaatggggctgacctctc

SEQ ID NO: 60419 - DNA, 20 bp, Artificial Sequence
  chemically synthesized
gcaatggggctgacctctcc

SEQ ID NO: 60420 - DNA, 20 bp, Artificial Sequence
  chemically synthesized
caatggggctgacctctccg

SEQ ID NO: 60421 - DNA, 20 bp, Artificial Sequence
  chemically synthesized
ggctgacctctccggggtca

SEQ ID NO: 60422 - DNA, 20 bp, Artificial Sequence
  chemically synthesized
ctgacctctccggggtcaca

SEQ ID NO: 60423 - DNA, 20 bp, Artificial Sequence
  chemically synthesized
tgacctctccggggtcacag

SEQ ID NO: 60424 - DNA, 20 bp, Artificial Sequence
  chemically synthesized
acctctccggggtcacagag

SEQ ID NO: 60425 - DNA, 20 bp, Artificial Sequence
  chemically synthesized
cctctccggggtcacagagg

SEQ ID NO: 60426 - DNA, 20 bp, Artificial Sequence
  chemically synthesized
tcacagaggaggcacccctg

SEQ ID NO: 60427 - DNA, 20 bp, Artificial Sequence
  chemically synthesized
aggcacccctgaagctctcc

SEQ ID NO: 60428 - DNA, 20 bp, Artificial Sequence
  chemically synthesized
ggcacccctgaagctctcca

SEQ ID NO: 60429 - DNA, 20 bp, Artificial Sequence
  chemically synthesized
cccctgaagctctccaaggt

SEQ ID NO: 60430 - DNA, 20 bp, Artificial Sequence
  chemically synthesized
ctgacgaccttgttgcaccc

SEQ ID NO: 60431 - DNA, 20 bp, Artificial Sequence
  chemically synthesized
ttgttgcaccctggtatctg

SEQ ID NO: 60432 - DNA, 20 bp, Artificial Sequence
  chemically synthesized
tgttgcaccctggtatctgt

SEQ ID NO: 60433 - DNA, 20 bp, Artificial Sequence
  chemically synthesized
gttgcaccctggtatctgta

SEQ ID NO: 60434 - DNA, 20 bp, Artificial Sequence
  chemically synthesized
gcaccctggtatctgtaggg

SEQ ID NO: 60435 - DNA, 20 bp, Artificial Sequence
  chemically synthesized
tatctgtagggaagaatgtg

SEQ ID NO: 60436 - DNA, 20 bp, Artificial Sequence
  chemically synthesized
atctgtagggaagaatgtgt

SEQ ID NO: 60437 - DNA, 20 bp, Artificial Sequence
  chemically synthesized
tctgtagggaagaatgtgtg

SEQ ID NO: 60438 - DNA, 20 bp, Artificial Sequence
  chemically synthesized
ctgtagggaagaatgtgtgg

SEQ ID NO: 60439 - DNA, 20 bp, Artificial Sequence
  chemically synthesized
ggaagaatgtgtgggggctg

SEQ ID NO: 60440 - DNA, 20 bp, Artificial Sequence
  chemically synthesized
gggggctgcagctctgtcct

SEQ ID NO: 60441 - DNA, 20 bp, Artificial Sequence
  chemically synthesized
ggggctgcagctctgtcctg

SEQ ID NO: 60442 - DNA, 20 bp, Artificial Sequence
  chemically synthesized
tgcagctctgtcctgaggct

SEQ ID NO: 60443 - DNA, 20 bp, Artificial Sequence
  chemically synthesized
gcagctctgtcctgaggctg

SEQ ID NO: 60444 - DNA, 20 bp, Artificial Sequence
  chemically synthesized
gctctgtcctgaggctgagg

SEQ ID NO: 60445 - DNA, 20 bp, Artificial Sequence
  chemically synthesized
ctctgtcctgaggctgagga

SEQ ID NO: 60446 - DNA, 20 bp, Artificial Sequence
  chemically synthesized
tctgtcctgaggctgaggaa

SEQ ID NO: 60447 - DNA, 20 bp, Artificial Sequence
  chemically synthesized
ctgtcctgaggctgaggaag

SEQ ID NO: 60448 - DNA, 20 bp, Artificial Sequence
  chemically synthesized
ctgaggctgaggaaggggcc

SEQ ID NO: 60449 - DNA, 20 bp, Artificial Sequence
  chemically synthesized
tgaggctgaggaaggggccg

SEQ ID NO: 60450 - DNA, 20 bp, Artificial Sequence
  chemically synthesized
gaggctgaggaaggggccga

SEQ ID NO: 60451 - DNA, 20 bp, Artificial Sequence
  chemically synthesized
ggggccgagggaaacaaatg

SEQ ID NO: 60452 - DNA, 20 bp, Artificial Sequence
  chemically synthesized
gagggaaacaaatgaagacc

SEQ ID NO: 60453 - DNA, 20 bp, Artificial Sequence
  chemically synthesized
agggaaacaaatgaagaccc

SEQ ID NO: 60454 - DNA, 20 bp, Artificial Sequence
  chemically synthesized
aacaaatgaagacccaggct

SEQ ID NO: 60455 - DNA, 20 bp, Artificial Sequence
  chemically synthesized
agacccaggctgagctcctg

SEQ ID NO: 60456 - DNA, 20 bp, Artificial Sequence
  chemically synthesized
atgcccgtgattcactgaca

SEQ ID NO: 60457 - DNA, 20 bp, Artificial Sequence
  chemically synthesized
tgcccgtgattcactgacac

SEQ ID NO: 60458 - DNA, 20 bp, Artificial Sequence
  chemically synthesized
tgattcactgacacgggacg

SEQ ID NO: 60459 - DNA, 20 bp, Artificial Sequence
  chemically synthesized
tgacacgggacgtggtcaaa

SEQ ID NO: 60460 - DNA, 20 bp, Artificial Sequence
  chemically synthesized
cgggacgtggtcaaacagca

SEQ ID NO: 60461 - DNA, 20 bp, Artificial Sequence
  chemically synthesized
acgtggtcaaacagcaaagc

SEQ ID NO: 60462 - DNA, 20 bp, Artificial Sequence
  chemically synthesized
cgtggtcaaacagcaaagcc

SEQ ID NO: 60463 - DNA, 20 bp, Artificial Sequence
  chemically synthesized
ggtcaaacagcaaagccagg

SEQ ID NO: 60464 - DNA, 20 bp, Artificial Sequence
  chemically synthesized
gtcaaacagcaaagccaggc

SEQ ID NO: 60465 - DNA, 20 bp, Artificial Sequence
  chemically synthesized
tcaaacagcaaagccaggca

SEQ ID NO: 60466 - DNA, 20 bp, Artificial Sequence
  chemically synthesized
caaacagcaaagccaggcag

SEQ ID NO: 60467 - DNA, 20 bp, Artificial Sequence
  chemically synthesized
ccaggcaggggactgctgtg

SEQ ID NO: 60468 - DNA, 20 bp, Artificial Sequence
  chemically synthesized
gcaggggactgctgtgcagc

SEQ ID NO: 60469 - DNA, 20 bp, Artificial Sequence
  chemically synthesized
tgctgtgcagctggcacttt

SEQ ID NO: 60470 - DNA, 20 bp, Artificial Sequence
  chemically synthesized
gctgtgcagctggcactttc

SEQ ID NO: 60471 - DNA, 20 bp, Artificial Sequence
  chemically synthesized
ctgtgcagctggcactttcg

SEQ ID NO: 60472 - DNA, 20 bp, Artificial Sequence
  chemically synthesized
gcactttcggggcctccctt

SEQ ID NO: 60473 - DNA, 20 bp, Artificial Sequence
  chemically synthesized
cactttcggggcctcccttg

SEQ ID NO: 60474 - DNA, 20 bp, Artificial Sequence
  chemically synthesized
cctgaatttcaactttgccc

SEQ ID NO: 60475 - DNA, 20 bp, Artificial Sequence
  chemically synthesized
caactttgcccaagaccttc

SEQ ID NO: 60476 - DNA, 20 bp, Artificial Sequence
  chemically synthesized
gcccaagaccttctagacat

SEQ ID NO: 60477 - DNA, 20 bp, Artificial Sequence
  chemically synthesized
cccaagaccttctagacatt

SEQ ID NO: 60478 - DNA, 20 bp, Artificial Sequence
  chemically synthesized
ttgatttatccatactgaca

SEQ ID NO: 60479 - DNA, 20 bp, Artificial Sequence
  chemically synthesized
tttatccatactgacacaga

SEQ ID NO: 60480 - DNA, 20 bp, Artificial Sequence
  chemically synthesized
ttatccatactgacacagaa

SEQ ID NO: 60481 - DNA, 20 bp, Artificial Sequence
  chemically synthesized
catactgacacagaaaggtt

SEQ ID NO: 60482 - DNA, 20 bp, Artificial Sequence
  chemically synthesized
atactgacacagaaaggttt

SEQ ID NO: 60483 - DNA, 20 bp, Artificial Sequence
  chemically synthesized
gacacagaaaggtttgggct

SEQ ID NO: 60484 - DNA, 20 bp, Artificial Sequence
  chemically synthesized
gtttgggctaagttgtttca

SEQ ID NO: 60485 - DNA, 20 bp, Artificial Sequence
  chemically synthesized
tttgggctaagttgtttcaa

SEQ ID NO: 60486 - DNA, 20 bp, Artificial Sequence
  chemically synthesized
ttctgactccttcgatctgt

SEQ ID NO: 60487 - DNA, 20 bp, Artificial Sequence
  chemically synthesized
ctccttcgatctgtgagatt

SEQ ID NO: 60488 - DNA, 20 bp, Artificial Sequence
  chemically synthesized
tctgaattaatgaatgattt

SEQ ID NO: 60489 - DNA, 20 bp, Artificial Sequence
  chemically synthesized
ttaatgaatgatttcagcta

SEQ ID NO: 60490 - DNA, 20 bp, Artificial Sequence
  chemically synthesized
gctaaagatgacacttattt

SEQ ID NO: 60491 - DNA, 20 bp, Artificial Sequence
  chemically synthesized
acacttattttggaaaacta

SEQ ID NO: 60492 - DNA, 20 bp, Artificial Sequence
  chemically synthesized
cacttattttggaaaactaa

SEQ ID NO: 60493 - DNA, 20 bp, Artificial Sequence
  chemically synthesized
aggcgaccaatgaacaactg

SEQ ID NO: 60494 - DNA, 20 bp, Artificial Sequence
  chemically synthesized
aacaactgcagttccatgaa

SEQ ID NO: 60495 - DNA, 20 bp, Artificial Sequence
  chemically synthesized
catgaatggctgcattatct

SEQ ID NO: 60496 - DNA, 20 bp, Artificial Sequence
  chemically synthesized
atgaatggctgcattatctt

SEQ ID NO: 60497 - DNA, 20 bp, Artificial Sequence
  chemically synthesized
tgaatggctgcattatcttg

SEQ ID NO: 60498 - DNA, 20 bp, Artificial Sequence
  chemically synthesized
ggctgcattatcttggggtc

SEQ ID NO: 60499 - DNA, 20 bp, Artificial Sequence
  chemically synthesized
gctgcattatcttggggtct

SEQ ID NO: 60500 - DNA, 20 bp, Artificial Sequence
  chemically synthesized
cttggggtctgggcactgtg

SEQ ID NO: 60501 - DNA, 20 bp, Artificial Sequence
  chemically synthesized
ttggggtctgggcactgtga

SEQ ID NO: 60502 - DNA, 20 bp, Artificial Sequence
  chemically synthesized
ggcactgtgaaggtcactgc

SEQ ID NO: 60503 - DNA, 20 bp, Artificial Sequence
  chemically synthesized
gcactgtgaaggtcactgcc

SEQ ID NO: 60504 - DNA, 20 bp, Artificial Sequence
  chemically synthesized
cactgtgaaggtcactgcca

SEQ ID NO: 60505 - DNA, 20 bp, Artificial Sequence
  chemically synthesized
ctgccagggtccgtgtcctc

SEQ ID NO: 60506 - DNA, 20 bp, Artificial Sequence
  chemically synthesized
tgccagggtccgtgtcctca

SEQ ID NO: 60507 - DNA, 20 bp, Artificial Sequence
  chemically synthesized
ccagggtccgtgtcctcaag

SEQ ID NO: 60508 - DNA, 20 bp, Artificial Sequence
  chemically synthesized
ccgtgtcctcaaggagcttc

SEQ ID NO: 60509 - DNA, 20 bp, Artificial Sequence
  chemically synthesized
aggagcttcaagccgtgtac

SEQ ID NO: 60510 - DNA, 20 bp, Artificial Sequence
  chemically synthesized
gcttcaagccgtgtactaga

SEQ ID NO: 60511 - DNA, 20 bp, Artificial Sequence
  chemically synthesized
cttcaagccgtgtactagaa

SEQ ID NO: 60512 - DNA, 20 bp, Artificial Sequence
  chemically synthesized
tcaagccgtgtactagaaag

SEQ ID NO: 60513 - DNA, 20 bp, Artificial Sequence
  chemically synthesized
aagccgtgtactagaaagga

SEQ ID NO: 60514 - DNA, 20 bp, Artificial Sequence
  chemically synthesized
gccgtgtactagaaaggaga

SEQ ID NO: 60515 - DNA, 20 bp, Artificial Sequence
  chemically synthesized
tactagaaaggagagagccc

SEQ ID NO: 60516 - DNA, 20 bp, Artificial Sequence
  chemically synthesized
ctagaaaggagagagccctg

SEQ ID NO: 60517 - DNA, 20 bp, Artificial Sequence
  chemically synthesized
tagaaaggagagagccctgg

SEQ ID NO: 60518 - DNA, 20 bp, Artificial Sequence
  chemically synthesized
aaaggagagagccctggagg

SEQ ID NO: 60519 - DNA, 20 bp, Artificial Sequence
  chemically synthesized
gagagccctggaggcagacg

SEQ ID NO: 60520 - DNA, 20 bp, Artificial Sequence
  chemically synthesized
gagccctggaggcagacgtg

SEQ ID NO: 60521 - DNA, 20 bp, Artificial Sequence
  chemically synthesized
acgatgctcttccctgttct

SEQ ID NO: 60522 - DNA, 20 bp, Artificial Sequence
  chemically synthesized
ctcttccctgttctgagttg

SEQ ID NO: 60523 - DNA, 20 bp, Artificial Sequence
  chemically synthesized
tcttccctgttctgagttgt

SEQ ID NO: 60524 - DNA, 20 bp, Artificial Sequence
  chemically synthesized
tctgagttgtgggtgcacct

SEQ ID NO: 60525 - DNA, 20 bp, Artificial Sequence
  chemically synthesized
gagttgtgggtgcacctgag

SEQ ID NO: 60526 - DNA, 20 bp, Artificial Sequence
  chemically synthesized
agttgtgggtgcacctgagc

SEQ ID NO: 60527 - DNA, 20 bp, Artificial Sequence
  chemically synthesized
gttgtgggtgcacctgagca

SEQ ID NO: 60528 - DNA, 20 bp, Artificial Sequence
  chemically synthesized
ttgtgggtgcacctgagcag

SEQ ID NO: 60529 - DNA, 20 bp, Artificial Sequence
  chemically synthesized
tgtgggtgcacctgagcagg

SEQ ID NO: 60530 - DNA, 20 bp, Artificial Sequence
  chemically synthesized
tgggtgcacctgagcagggg

SEQ ID NO: 60531 - DNA, 20 bp, Artificial Sequence
  chemically synthesized
ggtgcacctgagcaggggga

SEQ ID NO: 60532 - DNA, 20 bp, Artificial Sequence
  chemically synthesized
gtgcacctgagcagggggag

SEQ ID NO: 60533 - DNA, 20 bp, Artificial Sequence
  chemically synthesized
gcagggggagaggcgcttgt

SEQ ID NO: 60534 - DNA, 20 bp, Artificial Sequence
  chemically synthesized
cagggggagaggcgcttgtc

SEQ ID NO: 60535 - DNA, 20 bp, Artificial Sequence
  chemically synthesized
ggggagaggcgcttgtcagg

SEQ ID NO: 60536 - DNA, 20 bp, Artificial Sequence
  chemically synthesized
agaggcgcttgtcaggaaga

SEQ ID NO: 60537 - DNA, 20 bp, Artificial Sequence
  chemically synthesized
gcgcttgtcaggaagatgga

SEQ ID NO: 60538 - DNA, 20 bp, Artificial Sequence
  chemically synthesized
gcttgtcaggaagatggaca

SEQ ID NO: 60539 - DNA, 20 bp, Artificial Sequence
  chemically synthesized
cttgtcaggaagatggacag

SEQ ID NO: 60540 - DNA, 20 bp, Artificial Sequence
  chemically synthesized
ttgtcaggaagatggacaga

SEQ ID NO: 60541 - DNA, 20 bp, Artificial Sequence
  chemically synthesized
tgtcaggaagatggacagag

SEQ ID NO: 60542 - DNA, 20 bp, Artificial Sequence
  chemically synthesized
tcaggaagatggacagaggg

SEQ ID NO: 60543 - DNA, 20 bp, Artificial Sequence
  chemically synthesized
gaagatggacagaggggagc

SEQ ID NO: 60544 - DNA, 20 bp, Artificial Sequence
  chemically synthesized
cagaggggagccagccccat

SEQ ID NO: 60545 - DNA, 20 bp, Artificial Sequence
  chemically synthesized
ggagccagccccatcagcca

SEQ ID NO: 60546 - DNA, 20 bp, Artificial Sequence
  chemically synthesized
gccccatcagccaaagcctt

SEQ ID NO: 60547 - DNA, 20 bp, Artificial Sequence
  chemically synthesized
ccccatcagccaaagccttg

SEQ ID NO: 60548 - DNA, 20 bp, Artificial Sequence
  chemically synthesized
ccatcagccaaagccttgag

SEQ ID NO: 60549 - DNA, 20 bp, Artificial Sequence
  chemically synthesized
catcagccaaagccttgagg

SEQ ID NO: 60550 - DNA, 20 bp, Artificial Sequence
  chemically synthesized
tcagccaaagccttgaggag

SEQ ID NO: 60551 - DNA, 20 bp, Artificial Sequence
  chemically synthesized
ccaaagccttgaggaggagc

SEQ ID NO: 60552 - DNA, 20 bp, Artificial Sequence
  chemically synthesized
caaagccttgaggaggagca

SEQ ID NO: 60553 - DNA, 20 bp, Artificial Sequence
  chemically synthesized
gaggagcaaggcctatgtga

SEQ ID NO: 60554 - DNA, 20 bp, Artificial Sequence
  chemically synthesized
aggagcaaggcctatgtgac

SEQ ID NO: 60555 - DNA, 20 bp, Artificial Sequence
  chemically synthesized
ggagcaaggcctatgtgaca

SEQ ID NO: 60556 - DNA, 20 bp, Artificial Sequence
  chemically synthesized
agcaaggcctatgtgacagg

SEQ ID NO: 60557 - DNA, 20 bp, Artificial Sequence
  chemically synthesized
gcaaggcctatgtgacaggg

SEQ ID NO: 60558 - DNA, 20 bp, Artificial Sequence
  chemically synthesized
caaggcctatgtgacaggga

SEQ ID NO: 60559 - DNA, 20 bp, Artificial Sequence
  chemically synthesized
aggcctatgtgacagggagg

SEQ ID NO: 60560 - DNA, 20 bp, Artificial Sequence
  chemically synthesized
gcctatgtgacagggaggga

SEQ ID NO: 60561 - DNA, 20 bp, Artificial Sequence
  chemically synthesized
cctatgtgacagggagggag

SEQ ID NO: 60562 - DNA, 20 bp, Artificial Sequence
  chemically synthesized
acagggagggagaggatgtg

SEQ ID NO: 60563 - DNA, 20 bp, Artificial Sequence
  chemically synthesized
cagggagggagaggatgtgc

SEQ ID NO: 60564 - DNA, 20 bp, Artificial Sequence
  chemically synthesized
agggagggagaggatgtgca

SEQ ID NO: 60565 - DNA, 20 bp, Artificial Sequence
  chemically synthesized
agggagaggatgtgcagggc

SEQ ID NO: 60566 - DNA, 20 bp, Artificial Sequence
  chemically synthesized
gggagaggatgtgcagggcc

SEQ ID NO: 60567 - DNA, 20 bp, Artificial Sequence
  chemically synthesized
ggagaggatgtgcagggcca

SEQ ID NO: 60568 - DNA, 20 bp, Artificial Sequence
  chemically synthesized
tgtgcagggccagggccgtc

SEQ ID NO: 60569 - DNA, 20 bp, Artificial Sequence
  chemically synthesized
gtgcagggccagggccgtcc

SEQ ID NO: 60570 - DNA, 20 bp, Artificial Sequence
  chemically synthesized
tgcagggccagggccgtcca

SEQ ID NO: 60571 - DNA, 20 bp, Artificial Sequence
  chemically synthesized
gcagggccagggccgtccag

SEQ ID NO: 60572 - DNA, 20 bp, Artificial Sequence
  chemically synthesized
cagggccagggccgtccagg

SEQ ID NO: 60573 - DNA, 20 bp, Artificial Sequence
  chemically synthesized
gggccagggccgtccagggg

SEQ ID NO: 60574 - DNA, 20 bp, Artificial Sequence
  chemically synthesized
cagggccgtccagggggagt

SEQ ID NO: 60575 - DNA, 20 bp, Artificial Sequence
  chemically synthesized
cagggggagtgagcgcttcc

SEQ ID NO: 60576 - DNA, 20 bp, Artificial Sequence
  chemically synthesized
agggggagtgagcgcttcct

SEQ ID NO: 60577 - DNA, 20 bp, Artificial Sequence
  chemically synthesized
ggggagtgagcgcttcctgg

SEQ ID NO: 60578 - DNA, 20 bp, Artificial Sequence
  chemically synthesized
gggagtgagcgcttcctggg

SEQ ID NO: 60579 - DNA, 20 bp, Artificial Sequence
  chemically synthesized
ttcctgggaggtgtccacgt

SEQ ID NO: 60580 - DNA, 20 bp, Artificial Sequence
  chemically synthesized
tgtccacgtgagccttgctc

SEQ ID NO: 60581 - DNA, 20 bp, Artificial Sequence
  chemically synthesized
gtccacgtgagccttgctcg

SEQ ID NO: 60582 - DNA, 20 bp, Artificial Sequence
  chemically synthesized
cgtgagccttgctcgaggcc

SEQ ID NO: 60583 - DNA, 20 bp, Artificial Sequence
  chemically synthesized
gtgagccttgctcgaggcct

SEQ ID NO: 60584 - DNA, 20 bp, Artificial Sequence
  chemically synthesized
ccttgctcgaggcctgggat

SEQ ID NO: 60585 - DNA, 20 bp, Artificial Sequence
  chemically synthesized
gtctctgcttctctcccctc

SEQ ID NO: 60586 - DNA, 20 bp, Artificial Sequence
  chemically synthesized
tctctgcttctctcccctcc

SEQ ID NO: 60587 - DNA, 20 bp, Artificial Sequence
  chemically synthesized
ctcccctccaggccgtgcat

SEQ ID NO: 60588 - DNA, 20 bp, Artificial Sequence
  chemically synthesized
tcccctccaggccgtgcata

SEQ ID NO: 60589 - DNA, 20 bp, Artificial Sequence
  chemically synthesized
aggctgtgctgaccatcgac

SEQ ID NO: 60590 - DNA, 20 bp, Artificial Sequence
  chemically synthesized
tgtgctgaccatcgacgaga

SEQ ID NO: 60591 - DNA, 20 bp, Artificial Sequence
  chemically synthesized
gtgctgaccatcgacgagaa

SEQ ID NO: 60592 - DNA, 20 bp, Artificial Sequence
  chemically synthesized
tgctgaccatcgacgagaaa

SEQ ID NO: 60593 - DNA, 20 bp, Artificial Sequence
  chemically synthesized
catcgacgagaaagggactg

SEQ ID NO: 60594 - DNA, 20 bp, Artificial Sequence
  chemically synthesized
gagaaagggactgaagctgc

SEQ ID NO: 60595 - DNA, 20 bp, Artificial Sequence
  chemically synthesized
agaaagggactgaagctgct

SEQ ID NO: 60596 - DNA, 20 bp, Artificial Sequence
  chemically synthesized
gaaagggactgaagctgctg

SEQ ID NO: 60597 - DNA, 20 bp, Artificial Sequence
  chemically synthesized
agctgctggggccatgtttt

SEQ ID NO: 60598 - DNA, 20 bp, Artificial Sequence
  chemically synthesized
ctgctggggccatgttttta

SEQ ID NO: 60599 - DNA, 20 bp, Artificial Sequence
  chemically synthesized
tgctggggccatgtttttag

SEQ ID NO: 60600 - DNA, 20 bp, Artificial Sequence
  chemically synthesized
tacccatgtctatccccccc

SEQ ID NO: 60601 - DNA, 20 bp, Artificial Sequence
  chemically synthesized
acccatgtctatcccccccg

SEQ ID NO: 60602 - DNA, 20 bp, Artificial Sequence
  chemically synthesized
tgtctatcccccccgaggtc

SEQ ID NO: 60603 - DNA, 20 bp, Artificial Sequence
  chemically synthesized
taatgattgaacaaaatacc

SEQ ID NO: 60604 - DNA, 20 bp, Artificial Sequence
  chemically synthesized
taccaagtctcccctcttca

SEQ ID NO: 60605 - DNA, 20 bp, Artificial Sequence
  chemically synthesized
accaagtctcccctcttcat

SEQ ID NO: 60606 - DNA, 20 bp, Artificial Sequence
  chemically synthesized
gtctcccctcttcatgggaa

SEQ ID NO: 60607 - DNA, 20 bp, Artificial Sequence
  chemically synthesized
tcccctcttcatgggaaaag

SEQ ID NO: 60608 - DNA, 20 bp, Artificial Sequence
  chemically synthesized
caacccctcccctccatccc

SEQ ID NO: 60609 - DNA, 20 bp, Artificial Sequence
  chemically synthesized
tccatccctggccccctccc

SEQ ID NO: 60610 - DNA, 20 bp, Artificial Sequence
  chemically synthesized
cccctccctggatgacatta

SEQ ID NO: 60611 - DNA, 20 bp, Artificial Sequence
  chemically synthesized
ctccctggatgacattaaag

SEQ ID NO: 60612 - DNA, 20 bp, Artificial Sequence
  chemically synthesized
tccctggatgacattaaaga

SEQ ID NO: 60613 - DNA, 20 bp, Artificial Sequence
  chemically synthesized
ccctggatgacattaaagaa

SEQ ID NO: 60614 - DNA, 20 bp, Artificial Sequence
  chemically synthesized
gatgacattaaagaagggtt

SEQ ID NO: 60615 - DNA, 20 bp, Artificial Sequence
  chemically synthesized
acattaaagaagggttgagc

SEQ ID NO: 60616 - DNA, 20 bp, Artificial Sequence
  chemically synthesized
atccctcccatgttttctct

SEQ ID NO: 60617 - DNA, 20 bp, Artificial Sequence
  chemically synthesized
tgagtctccctttgcctgct

SEQ ID NO: 60618 - DNA, 20 bp, Artificial Sequence
  chemically synthesized
gagtctccctttgcctgctg

SEQ ID NO: 60619 - DNA, 20 bp, Artificial Sequence
  chemically synthesized
ttgcctgctgaggctgtatg

SEQ ID NO: 60620 - DNA, 20 bp, Artificial Sequence
  chemically synthesized
tgcctgctgaggctgtatgt

SEQ ID NO: 60621 - DNA, 20 bp, Artificial Sequence
  chemically synthesized
ctgaggctgtatgtgggctc

SEQ ID NO: 60622 - DNA, 20 bp, Artificial Sequence
  chemically synthesized
tgaggctgtatgtgggctcc

SEQ ID NO: 60623 - DNA, 20 bp, Artificial Sequence
  chemically synthesized
tgtatgtgggctccaggtaa

SEQ ID NO: 60624 - DNA, 20 bp, Artificial Sequence
  chemically synthesized
ccaggtaacagtgctgtctt

SEQ ID NO: 60625 - DNA, 20 bp, Artificial Sequence
  chemically synthesized
caggtaacagtgctgtcttc

SEQ ID NO: 60626 - DNA, 20 bp, Artificial Sequence
  chemically synthesized
ggccccctgaactgtgttca

SEQ ID NO: 60627 - DNA, 20 bp, Artificial Sequence
  chemically synthesized
ccccctgaactgtgttcatg

SEQ ID NO: 60628 - DNA, 20 bp, Artificial Sequence
  chemically synthesized
aactgtgttcatggagcatc

SEQ ID NO: 60629 - DNA, 20 bp, Artificial Sequence
  chemically synthesized
gtgttcatggagcatctggc

SEQ ID NO: 60630 - DNA, 20 bp, Artificial Sequence
  chemically synthesized
tgttcatggagcatctggct

SEQ ID NO: 60631 - DNA, 20 bp, Artificial Sequence
  chemically synthesized
tcatggagcatctggctggg

SEQ ID NO: 60632 - DNA, 20 bp, Artificial Sequence
  chemically synthesized
catggagcatctggctgggt

SEQ ID NO: 60633 - DNA, 20 bp, Artificial Sequence
  chemically synthesized
ctggctgggtaggcacatgc

SEQ ID NO: 60634 - DNA, 20 bp, Artificial Sequence
  chemically synthesized
tggctgggtaggcacatgct

SEQ ID NO: 60635 - DNA, 20 bp, Artificial Sequence
  chemically synthesized
gcacatgctgggcttgaatc

SEQ ID NO: 60636 - DNA, 20 bp, Artificial Sequence
  chemically synthesized
cacatgctgggcttgaatcc

SEQ ID NO: 60637 - DNA, 20 bp, Artificial Sequence
  chemically synthesized
acatgctgggcttgaatcca

SEQ ID NO: 60638 - DNA, 20 bp, Artificial Sequence
  chemically synthesized
catgctgggcttgaatccag

SEQ ID NO: 60639 - DNA, 20 bp, Artificial Sequence
  chemically synthesized
atgctgggcttgaatccagg

SEQ ID NO: 60640 - DNA, 20 bp, Artificial Sequence
  chemically synthesized
tgctgggcttgaatccaggg

SEQ ID NO: 60641 - DNA, 20 bp, Artificial Sequence
  chemically synthesized
tccaggggggactgaatcct

SEQ ID NO: 60642 - DNA, 20 bp, Artificial Sequence
  chemically synthesized
gggactgaatcctcagctta

SEQ ID NO: 60643 - DNA, 20 bp, Artificial Sequence
  chemically synthesized
gaatcctcagcttacggacc

SEQ ID NO: 60644 - DNA, 20 bp, Artificial Sequence
  chemically synthesized
aatcctcagcttacggacct

SEQ ID NO: 60645 - DNA, 20 bp, Artificial Sequence
  chemically synthesized
gacctgggcccatctgtttc

SEQ ID NO: 60646 - DNA, 20 bp, Artificial Sequence
  chemically synthesized
cctgggcccatctgtttctg

SEQ ID NO: 60647 - DNA, 20 bp, Artificial Sequence
  chemically synthesized
ctgggcccatctgtttctgg

SEQ ID NO: 60648 - DNA, 20 bp, Artificial Sequence
  chemically synthesized
tgggcccatctgtttctgga

SEQ ID NO: 60649 - DNA, 20 bp, Artificial Sequence
  chemically synthesized
catctgtttctggagggctc

SEQ ID NO: 60650 - DNA, 20 bp, Artificial Sequence
  chemically synthesized
cagtcttccttgtcctgtct

SEQ ID NO: 60651 - DNA, 20 bp, Artificial Sequence
  chemically synthesized
gtcttccttgtcctgtcttg

SEQ ID NO: 60652 - DNA, 20 bp, Artificial Sequence
  chemically synthesized
tgtcctgtcttggagtcccc

SEQ ID NO: 60653 - DNA, 20 bp, Artificial Sequence
  chemically synthesized
cctgtcttggagtccccaag

SEQ ID NO: 60654 - DNA, 20 bp, Artificial Sequence
  chemically synthesized
ctgtcttggagtccccaaga

SEQ ID NO: 60655 - DNA, 20 bp, Artificial Sequence
  chemically synthesized
gagtccccaagaaggaatca

SEQ ID NO: 60656 - DNA, 20 bp, Artificial Sequence
  chemically synthesized
agtccccaagaaggaatcac

SEQ ID NO: 60657 - DNA, 20 bp, Artificial Sequence
  chemically synthesized
gtccccaagaaggaatcaca

SEQ ID NO: 60658 - DNA, 20 bp, Artificial Sequence
  chemically synthesized
tccccaagaaggaatcacag

SEQ ID NO: 60659 - DNA, 20 bp, Artificial Sequence
  chemically synthesized
cccaagaaggaatcacaggg

SEQ ID NO: 60660 - DNA, 20 bp, Artificial Sequence
  chemically synthesized
ccaagaaggaatcacagggg

SEQ ID NO: 60661 - DNA, 20 bp, Artificial Sequence
  chemically synthesized
aggaatcacaggggaggaac

SEQ ID NO: 60662 - DNA, 20 bp, Artificial Sequence
  chemically synthesized
acaggggaggaaccagatac

SEQ ID NO: 60663 - DNA, 20 bp, Artificial Sequence
  chemically synthesized
ccagataccagccatgaccc

SEQ ID NO: 60664 - DNA, 20 bp, Artificial Sequence
  chemically synthesized
cagataccagccatgacccc

SEQ ID NO: 60665 - DNA, 20 bp, Artificial Sequence
  chemically synthesized
ccatgaccccaggctccacc

SEQ ID NO: 60666 - DNA, 20 bp, Artificial Sequence
  chemically synthesized
atcccccactcccccccacc

SEQ ID NO: 60667 - DNA, 20 bp, Artificial Sequence
  chemically synthesized
cccccactcccccccaccca

SEQ ID NO: 60668 - DNA, 20 bp, Artificial Sequence
  chemically synthesized
cccagagttgctcatcctgc

SEQ ID NO: 60669 - DNA, 20 bp, Artificial Sequence
  chemically synthesized
ccagagttgctcatcctgcc

SEQ ID NO: 60670 - DNA, 20 bp, Artificial Sequence
  chemically synthesized
cagagttgctcatcctgcca

SEQ ID NO: 60671 - DNA, 20 bp, Artificial Sequence
  chemically synthesized
gttgctcatcctgccagggc

SEQ ID NO: 60672 - DNA, 20 bp, Artificial Sequence
  chemically synthesized
gggctggctgtgcccacccc

SEQ ID NO: 60673 - DNA, 20 bp, Artificial Sequence
  chemically synthesized
ggctggctgtgcccacccca

SEQ ID NO: 60674 - DNA, 20 bp, Artificial Sequence
  chemically synthesized
ccaccccaaggctgccctcc

SEQ ID NO: 60675 - DNA, 20 bp, Artificial Sequence
  chemically synthesized
caccccaaggctgccctcct

SEQ ID NO: 60676 - DNA, 20 bp, Artificial Sequence
  chemically synthesized
accccaaggctgccctcctg

SEQ ID NO: 60677 - DNA, 20 bp, Artificial Sequence
  chemically synthesized
ccccaaggctgccctcctgg

SEQ ID NO: 60678 - DNA, 20 bp, Artificial Sequence
  chemically synthesized
ggctgccctcctgggggccc

SEQ ID NO: 60679 - DNA, 20 bp, Artificial Sequence
  chemically synthesized
agaactgcctgatcgtgccg

SEQ ID NO: 60680 - DNA, 20 bp, Artificial Sequence
  chemically synthesized
tgcctgatcgtgccgtggcc

SEQ ID NO: 60681 - DNA, 20 bp, Artificial Sequence
  chemically synthesized
cgtgccgtggcccagttttg

SEQ ID NO: 60682 - DNA, 20 bp, Artificial Sequence
  chemically synthesized
gcccagttttgtggcatctg

SEQ ID NO: 60683 - DNA, 20 bp, Artificial Sequence
  chemically synthesized
tgtggcatctgcagcaacac

SEQ ID NO: 60684 - DNA, 20 bp, Artificial Sequence
  chemically synthesized
tggcatctgcagcaacacaa

SEQ ID NO: 60685 - DNA, 20 bp, Artificial Sequence
  chemically synthesized
gcatctgcagcaacacaaga

SEQ ID NO: 60686 - DNA, 20 bp, Artificial Sequence
  chemically synthesized
atctgcagcaacacaagaga

SEQ ID NO: 60687 - DNA, 20 bp, Artificial Sequence
  chemically synthesized
tctgcagcaacacaagagag

SEQ ID NO: 60688 - DNA, 20 bp, Artificial Sequence
  chemically synthesized
ttgacccgctgtcacctaac

SEQ ID NO: 60689 - DNA, 20 bp, Artificial Sequence
  chemically synthesized
cgctgtcacctaaccagact

SEQ ID NO: 60690 - DNA, 20 bp, Artificial Sequence
  chemically synthesized
gctgtcacctaaccagactc

SEQ ID NO: 60691 - DNA, 20 bp, Artificial Sequence
  chemically synthesized
gactcgggccctgcacctct

SEQ ID NO: 60692 - DNA, 20 bp, Artificial Sequence
  chemically synthesized
actcgggccctgcacctctc

SEQ ID NO: 60693 - DNA, 20 bp, Artificial Sequence
  chemically synthesized
ctgcacctctcaggcacttc

SEQ ID NO: 60694 - DNA, 20 bp, Artificial Sequence
  chemically synthesized
ggcacttctggaaaatgact

SEQ ID NO: 60695 - DNA, 20 bp, Artificial Sequence
  chemically synthesized
gcacttctggaaaatgactg

SEQ ID NO: 60696 - DNA, 20 bp, Artificial Sequence
  chemically synthesized
cttctggaaaatgactgagg

SEQ ID NO: 60697 - DNA, 20 bp, Artificial Sequence
  chemically synthesized
actgaggcagattcttcctg

SEQ ID NO: 60698 - DNA, 20 bp, Artificial Sequence
  chemically synthesized
ttcctgaagcccattctcca

SEQ ID NO: 60699 - DNA, 20 bp, Artificial Sequence
  chemically synthesized
tcctgaagcccattctccat

SEQ ID NO: 60700 - DNA, 20 bp, Artificial Sequence
  chemically synthesized
cctgaagcccattctccatg

SEQ ID NO: 60701 - DNA, 20 bp, Artificial Sequence
  chemically synthesized
cccattctccatggggcaac

SEQ ID NO: 60702 - DNA, 20 bp, Artificial Sequence
  chemically synthesized
ccattctccatggggcaaca

SEQ ID NO: 60703 - DNA, 20 bp, Artificial Sequence
  chemically synthesized
ttgtccttccatcgctgccc

SEQ ID NO: 60704 - DNA, 20 bp, Artificial Sequence
  chemically synthesized
ccttccatcgctgccccaga

SEQ ID NO: 60705 - DNA, 20 bp, Artificial Sequence
  chemically synthesized
aagcctcacatatctccgtt

SEQ ID NO: 60706 - DNA, 20 bp, Artificial Sequence
  chemically synthesized
cacatatctccgtttagaat

SEQ ID NO: 60707 - DNA, 20 bp, Artificial Sequence
  chemically synthesized
acatatctccgtttagaatc

SEQ ID NO: 60708 - DNA, 20 bp, Artificial Sequence
  chemically synthesized
agaatcaggtcccttctccc

SEQ ID NO: 60709 - DNA, 20 bp, Artificial Sequence
  chemically synthesized
aggtcccttctccccagatg

SEQ ID NO: 60710 - DNA, 20 bp, Artificial Sequence
  chemically synthesized
gtcccttctccccagatgaa

SEQ ID NO: 60711 - DNA, 20 bp, Artificial Sequence
  chemically synthesized
tcccttctccccagatgaag

SEQ ID NO: 60712 - DNA, 20 bp, Artificial Sequence
  chemically synthesized
ccttctccccagatgaagag

SEQ ID NO: 60713 - DNA, 20 bp, Artificial Sequence
  chemically synthesized
cttctccccagatgaagagg

SEQ ID NO: 60714 - DNA, 20 bp, Artificial Sequence
  chemically synthesized
ttctccccagatgaagagga

SEQ ID NO: 60715 - DNA, 20 bp, Artificial Sequence
  chemically synthesized
tgttttctctatctcctcct

SEQ ID NO: 60716 - DNA, 20 bp, Artificial Sequence
  chemically synthesized
atctcctcctcagacttgac

SEQ ID NO: 60717 - DNA, 20 bp, Artificial Sequence
  chemically synthesized
tctcctcctcagacttgacc

SEQ ID NO: 60718 - DNA, 20 bp, Artificial Sequence
  chemically synthesized
tcctcagacttgaccaggcc

SEQ ID NO: 60719 - DNA, 20 bp, Artificial Sequence
  chemically synthesized
tcagacttgaccaggcccag

SEQ ID NO: 60720 - DNA, 20 bp, Artificial Sequence
  chemically synthesized
cagacttgaccaggcccagc

SEQ ID NO: 60721 - DNA, 20 bp, Artificial Sequence
  chemically synthesized
tgaccaggcccagcaggccc

SEQ ID NO: 60722 - DNA, 20 bp, Artificial Sequence
  chemically synthesized
ccaggcccagcaggccccag

SEQ ID NO: 60723 - DNA, 20 bp, Artificial Sequence
  chemically synthesized
cctatatcccttctcctccc

SEQ ID NO: 60724 - DNA, 20 bp, Artificial Sequence
  chemically synthesized
ccttctcctccctagtcaca

SEQ ID NO: 60725 - DNA, 20 bp, Artificial Sequence
  chemically synthesized
cctccctagtcacatggcca

SEQ ID NO: 60726 - DNA, 20 bp, Artificial Sequence
  chemically synthesized
ctccctagtcacatggccat

SEQ ID NO: 60727 - DNA, 20 bp, Artificial Sequence
  chemically synthesized
catggccataggcctgctga

SEQ ID NO: 60728 - DNA, 20 bp, Artificial Sequence
  chemically synthesized
ccataggcctgctgatggct

SEQ ID NO: 60729 - DNA, 20 bp, Artificial Sequence
  chemically synthesized
cataggcctgctgatggctc

SEQ ID NO: 60730 - DNA, 20 bp, Artificial Sequence
  chemically synthesized
aggcctgctgatggctcagg

SEQ ID NO: 60731 - DNA, 20 bp, Artificial Sequence
  chemically synthesized
ggcctgctgatggctcagga

SEQ ID NO: 60732 - DNA, 20 bp, Artificial Sequence
  chemically synthesized
tggctcaggaaggccattgc

SEQ ID NO: 60733 - DNA, 20 bp, Artificial Sequence
  chemically synthesized
ggctcaggaaggccattgca

SEQ ID NO: 60734 - DNA, 20 bp, Artificial Sequence
  chemically synthesized
aggccattgcaaggactcct

SEQ ID NO: 60735 - DNA, 20 bp, Artificial Sequence
  chemically synthesized
ttgcaaggactcctcagcta

SEQ ID NO: 60736 - DNA, 20 bp, Artificial Sequence
  chemically synthesized
tgcaaggactcctcagctat

SEQ ID NO: 60737 - DNA, 20 bp, Artificial Sequence
  chemically synthesized
caaggactcctcagctatgg

SEQ ID NO: 60738 - DNA, 20 bp, Artificial Sequence
  chemically synthesized
aggactcctcagctatggga

SEQ ID NO: 60739 - DNA, 20 bp, Artificial Sequence
  chemically synthesized
ggactcctcagctatgggag

SEQ ID NO: 60740 - DNA, 20 bp, Artificial Sequence
  chemically synthesized
ctcctcagctatgggagagg

SEQ ID NO: 60741 - DNA, 20 bp, Artificial Sequence
  chemically synthesized
acccctccctttcctcctct

SEQ ID NO: 60742 - DNA, 20 bp, Artificial Sequence
  chemically synthesized
ttcctcctctgagtcccgac

SEQ ID NO: 60743 - DNA, 20 bp, Artificial Sequence
  chemically synthesized
tcctcctctgagtcccgact

SEQ ID NO: 60744 - DNA, 20 bp, Artificial Sequence
  chemically synthesized
cctcctctgagtcccgactg

SEQ ID NO: 60745 - DNA, 20 bp, Artificial Sequence
  chemically synthesized
gtcccgactggggccacatg

SEQ ID NO: 60746 - DNA, 20 bp, Artificial Sequence
  chemically synthesized
tgtgcctgttgctgtccctg

SEQ ID NO: 60747 - DNA, 20 bp, Artificial Sequence
  chemically synthesized
gttgctgtccctgcagtctt

SEQ ID NO: 60748 - DNA, 20 bp, Artificial Sequence
  chemically synthesized
tgctgtccctgcagtcttca

SEQ ID NO: 60749 - DNA, 20 bp, Artificial Sequence
  chemically synthesized
gctgtccctgcagtcttcag

SEQ ID NO: 60750 - DNA, 20 bp, Artificial Sequence
  chemically synthesized
ctgtccctgcagtcttcaga

SEQ ID NO: 60751 - DNA, 20 bp, Artificial Sequence
  chemically synthesized
cagtcttcagagggccaccg

SEQ ID NO: 60752 - DNA, 20 bp, Artificial Sequence
  chemically synthesized
tcagagggccaccgcagctc

SEQ ID NO: 60753 - DNA, 20 bp, Artificial Sequence
  chemically synthesized
ccaccgcagctccagtgcca

SEQ ID NO: 60754 - DNA, 20 bp, Artificial Sequence
  chemically synthesized
ccgcagctccagtgccacgg

SEQ ID NO: 60755 - DNA, 20 bp, Artificial Sequence
  chemically synthesized
cgcagctccagtgccacggc

SEQ ID NO: 60756 - DNA, 20 bp, Artificial Sequence
  chemically synthesized
cagctccagtgccacggcag

SEQ ID NO: 60757 - DNA, 20 bp, Artificial Sequence
  chemically synthesized
agctccagtgccacggcagg

SEQ ID NO: 60758 - DNA, 20 bp, Artificial Sequence
  chemically synthesized
ggcaggaggctgttcctgaa

SEQ ID NO: 60759 - DNA, 20 bp, Artificial Sequence
  chemically synthesized
ctgttcctgaatagcccctg

SEQ ID NO: 60760 - DNA, 20 bp, Artificial Sequence
  chemically synthesized
tcctgaatagcccctgtggt

SEQ ID NO: 60761 - DNA, 20 bp, Artificial Sequence
  chemically synthesized
cctgaatagcccctgtggta

SEQ ID NO: 60762 - DNA, 20 bp, Artificial Sequence
  chemically synthesized
ctgaatagcccctgtggtaa

SEQ ID NO: 60763 - DNA, 20 bp, Artificial Sequence
  chemically synthesized
atagcccctgtggtaagggc

SEQ ID NO: 60764 - DNA, 20 bp, Artificial Sequence
  chemically synthesized
tagcccctgtggtaagggcc

SEQ ID NO: 60765 - DNA, 20 bp, Artificial Sequence
  chemically synthesized
gcccctgtggtaagggccag

SEQ ID NO: 60766 - DNA, 20 bp, Artificial Sequence
  chemically synthesized
ccctgtggtaagggccagga

SEQ ID NO: 60767 - DNA, 20 bp, Artificial Sequence
  chemically synthesized
ggagagtccttccatcctcc

SEQ ID NO: 60768 - DNA, 20 bp, Artificial Sequence
  chemically synthesized
gagagtccttccatcctcca

SEQ ID NO: 60769 - DNA, 20 bp, Artificial Sequence
  chemically synthesized
catcctccaaggccctgcta

SEQ ID NO: 60770 - DNA, 20 bp, Artificial Sequence
  chemically synthesized
atcctccaaggccctgctaa

SEQ ID NO: 60771 - DNA, 20 bp, Artificial Sequence
  chemically synthesized
caaggccctgctaaaggaca

SEQ ID NO: 60772 - DNA, 20 bp, Artificial Sequence
  chemically synthesized
ggccctgctaaaggacacag

SEQ ID NO: 60773 - DNA, 20 bp, Artificial Sequence
  chemically synthesized
ctgctaaaggacacagcagc

SEQ ID NO: 60774 - DNA, 20 bp, Artificial Sequence
  chemically synthesized
tgctaaaggacacagcagcc

SEQ ID NO: 60775 - DNA, 20 bp, Artificial Sequence
  chemically synthesized
taaaggacacagcagccagg

SEQ ID NO: 60776 - DNA, 20 bp, Artificial Sequence
  chemically synthesized
acagcagccaggaagtcccc

SEQ ID NO: 60777 - DNA, 20 bp, Artificial Sequence
  chemically synthesized
cagcagccaggaagtcccct

SEQ ID NO: 60778 - DNA, 20 bp, Artificial Sequence
  chemically synthesized
caggaagtcccctgggcccc

SEQ ID NO: 60779 - DNA, 20 bp, Artificial Sequence
  chemically synthesized
gtcccctgggcccctagctg

SEQ ID NO: 60780 - DNA, 20 bp, Artificial Sequence
  chemically synthesized
tcccctgggcccctagctga

SEQ ID NO: 60781 - DNA, 20 bp, Artificial Sequence
  chemically synthesized
ctgggcccctagctgaagga

SEQ ID NO: 60782 - DNA, 20 bp, Artificial Sequence
  chemically synthesized
cctgctccctccgtctctac

SEQ ID NO: 60783 - DNA, 20 bp, Artificial Sequence
  chemically synthesized
ctgctccctccgtctctacc

SEQ ID NO: 60784 - DNA, 20 bp, Artificial Sequence
  chemically synthesized
ccctccgtctctaccaggaa

SEQ ID NO: 60785 - DNA, 20 bp, Artificial Sequence
  chemically synthesized
ccaggaatggccttgtccta

SEQ ID NO: 60786 - DNA, 20 bp, Artificial Sequence
  chemically synthesized
ggaatggccttgtcctatgg

SEQ ID NO: 60787 - DNA, 20 bp, Artificial Sequence
  chemically synthesized
gaatggccttgtcctatgga

SEQ ID NO: 60788 - DNA, 20 bp, Artificial Sequence
  chemically synthesized
tgccccatcccaaactaatc

SEQ ID NO: 60789 - DNA, 20 bp, Artificial Sequence
  chemically synthesized
gccccatcccaaactaatct

SEQ ID NO: 60790 - DNA, 20 bp, Artificial Sequence
  chemically synthesized
ctgtcatgaatgtgtactta

SEQ ID NO: 60791 - DNA, 20 bp, Artificial Sequence
  chemically synthesized
tgtcatgaatgtgtacttaa

SEQ ID NO: 60792 - DNA, 20 bp, Artificial Sequence
  chemically synthesized
tgaatgtgtacttaaaggat

SEQ ID NO: 60793 - DNA, 20 bp, Artificial Sequence
  chemically synthesized
gaatgtgtacttaaaggatg

SEQ ID NO: 60794 - DNA, 20 bp, Artificial Sequence
  chemically synthesized
tgtacttaaaggatgaggtt

SEQ ID NO: 60795 - DNA, 20 bp, Artificial Sequence
  chemically synthesized
tgaggttgagtcataccaaa

SEQ ID NO: 60796 - DNA, 20 bp, Artificial Sequence
  chemically synthesized
ataccaaatagtgatttcga

SEQ ID NO: 60797 - DNA, 20 bp, Artificial Sequence
  chemically synthesized
gtgatttcgatagttcaaaa

SEQ ID NO: 60798 - DNA, 20 bp, Artificial Sequence
  chemically synthesized
atagttcaaaatggtgaaat

SEQ ID NO: 60799 - DNA, 20 bp, Artificial Sequence
  chemically synthesized
attagcaattctacatgatt

SEQ ID NO: 60800 - DNA, 20 bp, Artificial Sequence
  chemically synthesized
acatgattcagtctaatcaa

SEQ ID NO: 60801 - DNA, 20 bp, Artificial Sequence
  chemically synthesized
ataccgactgtttcccacac

SEQ ID NO: 60802 - DNA, 20 bp, Artificial Sequence
  chemically synthesized
cacaagtctcctgttctctt

SEQ ID NO: 60803 - DNA, 20 bp, Artificial Sequence
  chemically synthesized
ctcttaagcttactcactga

SEQ ID NO: 60804 - DNA, 20 bp, Artificial Sequence
  chemically synthesized
cactctccacaaatacatta

SEQ ID NO: 60805 - DNA, 20 bp, Artificial Sequence
  chemically synthesized
ccacaaatacattaaagata

SEQ ID NO: 60806 - DNA, 20 bp, Artificial Sequence
  chemically synthesized
ttaaagatatggccatcacc

SEQ ID NO: 60807 - DNA, 20 bp, Artificial Sequence
  chemically synthesized
atggccatcaccaagccccc

SEQ ID NO: 60808 - DNA, 20 bp, Artificial Sequence
  chemically synthesized
tggccatcaccaagccccct

SEQ ID NO: 60809 - DNA, 20 bp, Artificial Sequence
  chemically synthesized
caagccccctaggatgacac

SEQ ID NO: 60810 - DNA, 20 bp, Artificial Sequence
  chemically synthesized
cctaggatgacaccagacct

SEQ ID NO: 60811 - DNA, 20 bp, Artificial Sequence
  chemically synthesized
taggatgacaccagacctga

SEQ ID NO: 60812 - DNA, 20 bp, Artificial Sequence
  chemically synthesized
acaccagacctgagagtctg

SEQ ID NO: 60813 - DNA, 20 bp, Artificial Sequence
  chemically synthesized
gacctgagagtctgaagacc

SEQ ID NO: 60814 - DNA, 20 bp, Artificial Sequence
  chemically synthesized
gagtctgaagacctggatcc

SEQ ID NO: 60815 - DNA, 20 bp, Artificial Sequence
  chemically synthesized
gttctgacttttccccctga

SEQ ID NO: 60816 - DNA, 20 bp, Artificial Sequence
  chemically synthesized
acagctgtgtgaccttcgtg

SEQ ID NO: 60817 - DNA, 20 bp, Artificial Sequence
  chemically synthesized
tgaagtcgccaaacctctct

SEQ ID NO: 60818 - DNA, 20 bp, Artificial Sequence
  chemically synthesized
cgccaaacctctctgagccc

SEQ ID NO: 60819 - DNA, 20 bp, Artificial Sequence
  chemically synthesized
ctctgagccccagtcattgc

SEQ ID NO: 60820 - DNA, 20 bp, Artificial Sequence
  chemically synthesized
gagccccagtcattgctagt

SEQ ID NO: 60821 - DNA, 20 bp, Artificial Sequence
  chemically synthesized
tgctagtaagacctgccttt

SEQ ID NO: 60822 - DNA, 20 bp, Artificial Sequence
  chemically synthesized
agtaagacctgcctttgagt

SEQ ID NO: 60823 - DNA, 20 bp, Artificial Sequence
  chemically synthesized
tttgagttggtatgatgttc

SEQ ID NO: 60824 - DNA, 20 bp, Artificial Sequence
  chemically synthesized
agttggtatgatgttcaagt

SEQ ID NO: 60825 - DNA, 20 bp, Artificial Sequence
  chemically synthesized
aacaaaatgtttatacccat

SEQ ID NO: 60826 - DNA, 20 bp, Artificial Sequence
  chemically synthesized
aatgtttatacccattagaa

SEQ ID NO: 60827 - DNA, 20 bp, Artificial Sequence
  chemically synthesized
tgtttatacccattagaaca

SEQ ID NO: 60828 - DNA, 20 bp, Artificial Sequence
  chemically synthesized
ccattagaacagagaataaa

SEQ ID NO: 60829 - DNA, 20 bp, Artificial Sequence
  chemically synthesized
actacatttcttgcacttat

SEQ ID NO: 60830 - DNA, 20 bp, Artificial Sequence
  chemically synthesized
cttatgagctttctgtgaat

SEQ ID NO: 60831 - DNA, 20 bp, Artificial Sequence
  chemically synthesized
gtgaatcagacatccctatg

SEQ ID NO: 60832 - DNA, 20 bp, Artificial Sequence
  chemically synthesized
tccctatgaagtacctcccc

SEQ ID NO: 60833 - DNA, 20 bp, Artificial Sequence
  chemically synthesized
tgtttctcatttactcactg

SEQ ID NO: 60834 - DNA, 20 bp, Artificial Sequence
  chemically synthesized
ttctcatttactcactgtag

SEQ ID NO: 60835 - DNA, 20 bp, Artificial Sequence
  chemically synthesized
gtagcagcactgcgatgtgt

SEQ ID NO: 60836 - DNA, 20 bp, Artificial Sequence
  chemically synthesized
tgctcttaaactccaaatct

SEQ ID NO: 60837 - DNA, 20 bp, Artificial Sequence
  chemically synthesized
gctcttaaactccaaatctg

SEQ ID NO: 60838 - DNA, 20 bp, Artificial Sequence
  chemically synthesized
actccaaatctgaggaaact

SEQ ID NO: 60839 - DNA, 20 bp, Artificial Sequence
  chemically synthesized
ctccaaatctgaggaaactg

SEQ ID NO: 60840 - DNA, 20 bp, Artificial Sequence
  chemically synthesized
aatctgaggaaactgaggct

SEQ ID NO: 60841 - DNA, 20 bp, Artificial Sequence
  chemically synthesized
tctgaggaaactgaggctca

SEQ ID NO: 60842 - DNA, 20 bp, Artificial Sequence
  chemically synthesized
tgaggaaactgaggctcaga

SEQ ID NO: 60843 - DNA, 20 bp, Artificial Sequence
  chemically synthesized
gaggaaactgaggctcagag

SEQ ID NO: 60844 - DNA, 20 bp, Artificial Sequence
  chemically synthesized
ctgaggctcagagaggctac

SEQ ID NO: 60845 - DNA, 20 bp, Artificial Sequence
  chemically synthesized
tggtctcccacaatgtcaca

SEQ ID NO: 60846 - DNA, 20 bp, Artificial Sequence
  chemically synthesized
cacaatgtcacacagctcat

SEQ ID NO: 60847 - DNA, 20 bp, Artificial Sequence
  chemically synthesized
aatgtcacacagctcataag

SEQ ID NO: 60848 - DNA, 20 bp, Artificial Sequence
  chemically synthesized
cacacagctcataagtggca

SEQ ID NO: 60849 - DNA, 20 bp, Artificial Sequence
  chemically synthesized
cagctcataagtggcaaagc

SEQ ID NO: 60850 - DNA, 20 bp, Artificial Sequence
  chemically synthesized
aagtggcaaagctggcttga

SEQ ID NO: 60851 - DNA, 20 bp, Artificial Sequence
  chemically synthesized
agtggcaaagctggcttgat

SEQ ID NO: 60852 - DNA, 20 bp, Artificial Sequence
  chemically synthesized
ctcaccacactctccccttc

SEQ ID NO: 60853 - DNA, 20 bp, Artificial Sequence
  chemically synthesized
tcaccacactctccccttcg

SEQ ID NO: 60854 - DNA, 20 bp, Artificial Sequence
  chemically synthesized
caccacactctccccttcga

SEQ ID NO: 60855 - DNA, 20 bp, Artificial Sequence
  chemically synthesized
agggtcacgctaaacttctg

SEQ ID NO: 60856 - DNA, 20 bp, Artificial Sequence
  chemically synthesized
ggtcacgctaaacttctgca

SEQ ID NO: 60857 - DNA, 20 bp, Artificial Sequence
  chemically synthesized
gtcacgctaaacttctgcag

SEQ ID NO: 60858 - DNA, 20 bp, Artificial Sequence
  chemically synthesized
gaggtaattcctccttaaac

SEQ ID NO: 60859 - DNA, 20 bp, Artificial Sequence
  chemically synthesized
gtaattcctccttaaaccag

SEQ ID NO: 60860 - DNA, 20 bp, Artificial Sequence
  chemically synthesized
taattcctccttaaaccaga

SEQ ID NO: 60861 - DNA, 20 bp, Artificial Sequence
  chemically synthesized
aattcctccttaaaccagaa

SEQ ID NO: 60862 - DNA, 20 bp, Artificial Sequence
  chemically synthesized
ccttaaaccagaagggttgc

SEQ ID NO: 60863 - DNA, 20 bp, Artificial Sequence
  chemically synthesized
taaaccagaagggttgctgg

SEQ ID NO: 60864 - DNA, 20 bp, Artificial Sequence
  chemically synthesized
gaagggttgctggtggccca

SEQ ID NO: 60865 - DNA, 20 bp, Artificial Sequence
  chemically synthesized
ggtggcccacagctcacgcc

SEQ ID NO: 60866 - DNA, 20 bp, Artificial Sequence
  chemically synthesized
tcacgcctagcacacttcat

SEQ ID NO: 60867 - DNA, 20 bp, Artificial Sequence
  chemically synthesized
tgagaaaaacaccctgtgcc

SEQ ID NO: 60868 - DNA, 20 bp, Artificial Sequence
  chemically synthesized
aaaacaccctgtgcccagtg

SEQ ID NO: 60869 - DNA, 20 bp, Artificial Sequence
  chemically synthesized
aacaccctgtgcccagtgtg

SEQ ID NO: 60870 - DNA, 20 bp, Artificial Sequence
  chemically synthesized
accctgtgcccagtgtggag

SEQ ID NO: 60871 - DNA, 20 bp, Artificial Sequence
  chemically synthesized
ccctgtgcccagtgtggagc

SEQ ID NO: 60872 - DNA, 20 bp, Artificial Sequence
  chemically synthesized
cccagtgtggagcaggcatt

SEQ ID NO: 60873 - DNA, 20 bp, Artificial Sequence
  chemically synthesized
gtggagcaggcattgagctg

SEQ ID NO: 60874 - DNA, 20 bp, Artificial Sequence
  chemically synthesized
tggagcaggcattgagctga

SEQ ID NO: 60875 - DNA, 20 bp, Artificial Sequence
  chemically synthesized
agcaggcattgagctgaagg

SEQ ID NO: 60876 - DNA, 20 bp, Artificial Sequence
  chemically synthesized
ggcattgagctgaaggtggt

SEQ ID NO: 60877 - DNA, 20 bp, Artificial Sequence
  chemically synthesized
attgagctgaaggtggtgag

SEQ ID NO: 60878 - DNA, 20 bp, Artificial Sequence
  chemically synthesized
gagctgaaggtggtgagcag

SEQ ID NO: 60879 - DNA, 20 bp, Artificial Sequence
  chemically synthesized
gtgagcagaagctcatccac

SEQ ID NO: 60880 - DNA, 20 bp, Artificial Sequence
  chemically synthesized
tcatccaccagatgttgaca

SEQ ID NO: 60881 - DNA, 20 bp, Artificial Sequence
  chemically synthesized
ccagatgttgacacagcccg

SEQ ID NO: 60882 - DNA, 20 bp, Artificial Sequence
  chemically synthesized
gttgacacagcccgcagcct

SEQ ID NO: 60883 - DNA, 20 bp, Artificial Sequence
  chemically synthesized
ttgacacagcccgcagcctt

SEQ ID NO: 60884 - DNA, 20 bp, Artificial Sequence
  chemically synthesized
ccgcagccttgggcgaccca

SEQ ID NO: 60885 - DNA, 20 bp, Artificial Sequence
  chemically synthesized
cgcagccttgggcgacccac

SEQ ID NO: 60886 - DNA, 20 bp, Artificial Sequence
  chemically synthesized
caggactcctcttatttaac

SEQ ID NO: 60887 - DNA, 20 bp, Artificial Sequence
  chemically synthesized
cctcttatttaactggcatt

SEQ ID NO: 60888 - DNA, 20 bp, Artificial Sequence
  chemically synthesized
cttatttaactggcatttgg

SEQ ID NO: 60889 - DNA, 20 bp, Artificial Sequence
  chemically synthesized
ttatttaactggcatttggt

SEQ ID NO: 60890 - DNA, 20 bp, Artificial Sequence
  chemically synthesized
atttaactggcatttggtag

SEQ ID NO: 60891 - DNA, 20 bp, Artificial Sequence
  chemically synthesized
actggcatttggtaggagaa

SEQ ID NO: 60892 - DNA, 20 bp, Artificial Sequence
  chemically synthesized
ctggcatttggtaggagaac

SEQ ID NO: 60893 - DNA, 20 bp, Artificial Sequence
  chemically synthesized
tggcatttggtaggagaaca

SEQ ID NO: 60894 - DNA, 20 bp, Artificial Sequence
  chemically synthesized
ggcatttggtaggagaacag

SEQ ID NO: 60895 - DNA, 20 bp, Artificial Sequence
  chemically synthesized
atttggtaggagaacagggg

SEQ ID NO: 60896 - DNA, 20 bp, Artificial Sequence
  chemically synthesized
ttggtaggagaacaggggca

SEQ ID NO: 60897 - DNA, 20 bp, Artificial Sequence
  chemically synthesized
ggagaacaggggcagagtca

SEQ ID NO: 60898 - DNA, 20 bp, Artificial Sequence
  chemically synthesized
acaggggcagagtcaaagac

SEQ ID NO: 60899 - DNA, 20 bp, Artificial Sequence
  chemically synthesized
gggcagagtcaaagacaagt

SEQ ID NO: 60900 - DNA, 20 bp, Artificial Sequence
  chemically synthesized
tcaaagacaagttggctttc

SEQ ID NO: 60901 - DNA, 20 bp, Artificial Sequence
  chemically synthesized
aaagacaagttggctttctg

SEQ ID NO: 60902 - DNA, 20 bp, Artificial Sequence
  chemically synthesized
agacaagttggctttctgga

SEQ ID NO: 60903 - DNA, 20 bp, Artificial Sequence
  chemically synthesized
agttggctttctggagagcc

SEQ ID NO: 60904 - DNA, 20 bp, Artificial Sequence
  chemically synthesized
gttggctttctggagagccc

SEQ ID NO: 60905 - DNA, 20 bp, Artificial Sequence
  chemically synthesized
ttggctttctggagagccca

SEQ ID NO: 60906 - DNA, 20 bp, Artificial Sequence
  chemically synthesized
gctttctggagagcccaggg

SEQ ID NO: 60907 - DNA, 20 bp, Artificial Sequence
  chemically synthesized
ctttctggagagcccagggc

SEQ ID NO: 60908 - DNA, 20 bp, Artificial Sequence
  chemically synthesized
tttctggagagcccagggca

SEQ ID NO: 60909 - DNA, 20 bp, Artificial Sequence
  chemically synthesized
ctggagagcccagggcaggg

SEQ ID NO: 60910 - DNA, 20 bp, Artificial Sequence
  chemically synthesized
tggagagcccagggcaggga

SEQ ID NO: 60911 - DNA, 20 bp, Artificial Sequence
  chemically synthesized
gagagcccagggcagggaag

SEQ ID NO: 60912 - DNA, 20 bp, Artificial Sequence
  chemically synthesized
agagcccagggcagggaagg

SEQ ID NO: 60913 - DNA, 20 bp, Artificial Sequence
  chemically synthesized
gcccagggcagggaaggagg

SEQ ID NO: 60914 - DNA, 20 bp, Artificial Sequence
  chemically synthesized
cagggcagggaaggaggtgg

SEQ ID NO: 60915 - DNA, 20 bp, Artificial Sequence
  chemically synthesized
gggaaggaggtggcagcgct

SEQ ID NO: 60916 - DNA, 20 bp, Artificial Sequence
  chemically synthesized
ggaaggaggtggcagcgctg

SEQ ID NO: 60917 - DNA, 20 bp, Artificial Sequence
  chemically synthesized
gaaggaggtggcagcgctga

SEQ ID NO: 60918 - DNA, 20 bp, Artificial Sequence
  chemically synthesized
ggaggtggcagcgctgaggg

SEQ ID NO: 60919 - DNA, 20 bp, Artificial Sequence
  chemically synthesized
agcgctgagggcggtcacct

SEQ ID NO: 60920 - DNA, 20 bp, Artificial Sequence
  chemically synthesized
gacaccatcgttttactttg

SEQ ID NO: 60921 - DNA, 20 bp, Artificial Sequence
  chemically synthesized
aagaattgtctgtcacacac

SEQ ID NO: 60922 - DNA, 20 bp, Artificial Sequence
  chemically synthesized
gtctgtcacacacgagttga

SEQ ID NO: 60923 - DNA, 20 bp, Artificial Sequence
  chemically synthesized
gtcacacacgagttgacagt

SEQ ID NO: 60924 - DNA, 20 bp, Artificial Sequence
  chemically synthesized
tcacacacgagttgacagtc

SEQ ID NO: 60925 - DNA, 20 bp, Artificial Sequence
  chemically synthesized
acacgagttgacagtcagga

SEQ ID NO: 60926 - DNA, 20 bp, Artificial Sequence
  chemically synthesized
cacgagttgacagtcaggat

SEQ ID NO: 60927 - DNA, 20 bp, Artificial Sequence
  chemically synthesized
cgagttgacagtcaggatgg

SEQ ID NO: 60928 - DNA, 20 bp, Artificial Sequence
  chemically synthesized
agttgacagtcaggatggga

SEQ ID NO: 60929 - DNA, 20 bp, Artificial Sequence
  chemically synthesized
gggagagaccccattcaaac

SEQ ID NO: 60930 - DNA, 20 bp, Artificial Sequence
  chemically synthesized
ttcaaactagcataacctcc

SEQ ID NO: 60931 - DNA, 20 bp, Artificial Sequence
  chemically synthesized
caaactagcataacctccca

SEQ ID NO: 60932 - DNA, 20 bp, Artificial Sequence
  chemically synthesized
aaactagcataacctcccag

SEQ ID NO: 60933 - DNA, 20 bp, Artificial Sequence
  chemically synthesized
aactagcataacctcccaga

SEQ ID NO: 60934 - DNA, 20 bp, Artificial Sequence
  chemically synthesized
aacctcccagagggaattcc

SEQ ID NO: 60935 - DNA, 20 bp, Artificial Sequence
  chemically synthesized
acctcccagagggaattcct

SEQ ID NO: 60936 - DNA, 20 bp, Artificial Sequence
  chemically synthesized
agggaattcctgggctcccc

SEQ ID NO: 60937 - DNA, 20 bp, Artificial Sequence
  chemically synthesized
gggaattcctgggctcccct

SEQ ID NO: 60938 - DNA, 20 bp, Artificial Sequence
  chemically synthesized
tgggctcccctgggaatcaa

SEQ ID NO: 60939 - DNA, 20 bp, Artificial Sequence
  chemically synthesized
gggctcccctgggaatcaac

SEQ ID NO: 60940 - DNA, 20 bp, Artificial Sequence
  chemically synthesized
ggctcccctgggaatcaaca

SEQ ID NO: 60941 - DNA, 20 bp, Artificial Sequence
  chemically synthesized
ccctgggaatcaacagggat

SEQ ID NO: 60942 - DNA, 20 bp, Artificial Sequence
  chemically synthesized
ggaatcaacagggatcagtc

SEQ ID NO: 60943 - DNA, 20 bp, Artificial Sequence
  chemically synthesized
gaatcaacagggatcagtca

SEQ ID NO: 60944 - DNA, 20 bp, Artificial Sequence
  chemically synthesized
caacagggatcagtcaagga

SEQ ID NO: 60945 - DNA, 20 bp, Artificial Sequence
  chemically synthesized
aacagggatcagtcaaggat

SEQ ID NO: 60946 - DNA, 20 bp, Artificial Sequence
  chemically synthesized
agggatcagtcaaggatggg

SEQ ID NO: 60947 - DNA, 20 bp, Artificial Sequence
  chemically synthesized
ggatcagtcaaggatgggca

SEQ ID NO: 60948 - DNA, 20 bp, Artificial Sequence
  chemically synthesized
tgtcatgacaacctcattat

SEQ ID NO: 60949 - DNA, 20 bp, Artificial Sequence
  chemically synthesized
gtcatgacaacctcattatg

SEQ ID NO: 60950 - DNA, 20 bp, Artificial Sequence
  chemically synthesized
atgacaacctcattatgagg

SEQ ID NO: 60951 - DNA, 20 bp, Artificial Sequence
  chemically synthesized
ggaagacaaatatatgtcac

SEQ ID NO: 60952 - DNA, 20 bp, Artificial Sequence
  chemically synthesized
tatatgtcacaagtccgtga

SEQ ID NO: 60953 - DNA, 20 bp, Artificial Sequence
  chemically synthesized
atatgtcacaagtccgtgat

SEQ ID NO: 60954 - DNA, 20 bp, Artificial Sequence
  chemically synthesized
gtccgtgatgggacaaccat

SEQ ID NO: 60955 - DNA, 20 bp, Artificial Sequence
  chemically synthesized
atgggacaaccataagacct

SEQ ID NO: 60956 - DNA, 20 bp, Artificial Sequence
  chemically synthesized
ctcagcttcactgtatcttc

SEQ ID NO: 60957 - DNA, 20 bp, Artificial Sequence
  chemically synthesized
cagcttcactgtatcttcca

SEQ ID NO: 60958 - DNA, 20 bp, Artificial Sequence
  chemically synthesized
cactgtccaacgtgatcctc

SEQ ID NO: 60959 - DNA, 20 bp, Artificial Sequence
  chemically synthesized
gtccaacgtgatcctccaga

SEQ ID NO: 60960 - DNA, 20 bp, Artificial Sequence
  chemically synthesized
tccaacgtgatcctccagac

SEQ ID NO: 60961 - DNA, 20 bp, Artificial Sequence
  chemically synthesized
gatcctccagacaggttctg

SEQ ID NO: 60962 - DNA, 20 bp, Artificial Sequence
  chemically synthesized
atcctccagacaggttctgc

SEQ ID NO: 60963 - DNA, 20 bp, Artificial Sequence
  chemically synthesized
cagacaggttctgcaggacg

SEQ ID NO: 60964 - DNA, 20 bp, Artificial Sequence
  chemically synthesized
aggttctgcaggacgcagcc

SEQ ID NO: 60965 - DNA, 20 bp, Artificial Sequence
  chemically synthesized
ggttctgcaggacgcagcct

SEQ ID NO: 60966 - DNA, 20 bp, Artificial Sequence
  chemically synthesized
cctaggactcattatcccca

SEQ ID NO: 60967 - DNA, 20 bp, Artificial Sequence
  chemically synthesized
cattatccccaaagtacaca

SEQ ID NO: 60968 - DNA, 20 bp, Artificial Sequence
  chemically synthesized
attatccccaaagtacacat

SEQ ID NO: 60969 - DNA, 20 bp, Artificial Sequence
  chemically synthesized
ttatccccaaagtacacatg

SEQ ID NO: 60970 - DNA, 20 bp, Artificial Sequence
  chemically synthesized
aaagtacacatggggaaact

SEQ ID NO: 60971 - DNA, 20 bp, Artificial Sequence
  chemically synthesized
aagtacacatggggaaactc

SEQ ID NO: 60972 - DNA, 20 bp, Artificial Sequence
  chemically synthesized
cacatggggaaactcaggcc

SEQ ID NO: 60973 - DNA, 20 bp, Artificial Sequence
  chemically synthesized
atggggaaactcaggcccag

SEQ ID NO: 60974 - DNA, 20 bp, Artificial Sequence
  chemically synthesized
tggggaaactcaggcccagc

SEQ ID NO: 60975 - DNA, 20 bp, Artificial Sequence
  chemically synthesized
agcaggtcaaatgctctgtc

SEQ ID NO: 60976 - DNA, 20 bp, Artificial Sequence
  chemically synthesized
gtcaaatgctctgtccagtg

SEQ ID NO: 60977 - DNA, 20 bp, Artificial Sequence
  chemically synthesized
tcaaatgctctgtccagtgt

SEQ ID NO: 60978 - DNA, 20 bp, Artificial Sequence
  chemically synthesized
tgctctgtccagtgtgggcc

SEQ ID NO: 60979 - DNA, 20 bp, Artificial Sequence
  chemically synthesized
tctgtccagtgtgggcctgg

SEQ ID NO: 60980 - DNA, 20 bp, Artificial Sequence
  chemically synthesized
ctgtccagtgtgggcctgga

SEQ ID NO: 60981 - DNA, 20 bp, Artificial Sequence
  chemically synthesized
tccagtgtgggcctggaagg

SEQ ID NO: 60982 - DNA, 20 bp, Artificial Sequence
  chemically synthesized
ccagtgtgggcctggaaggc

SEQ ID NO: 60983 - DNA, 20 bp, Artificial Sequence
  chemically synthesized
aggcaggtcttctccactgt

SEQ ID NO: 60984 - DNA, 20 bp, Artificial Sequence
  chemically synthesized
ggcaggtcttctccactgtt

SEQ ID NO: 60985 - DNA, 20 bp, Artificial Sequence
  chemically synthesized
gtcttctccactgttaggcc

SEQ ID NO: 60986 - DNA, 20 bp, Artificial Sequence
  chemically synthesized
ttaggcctggctgtccccaa

SEQ ID NO: 60987 - DNA, 20 bp, Artificial Sequence
  chemically synthesized
cccaacagcacatacttcct

SEQ ID NO: 60988 - DNA, 20 bp, Artificial Sequence
  chemically synthesized
acatacttcctcagtccata

SEQ ID NO: 60989 - DNA, 20 bp, Artificial Sequence
  chemically synthesized
catacttcctcagtccatat

SEQ ID NO: 60990 - DNA, 20 bp, Artificial Sequence
  chemically synthesized
cgataaacaactccatcctc

SEQ ID NO: 60991 - DNA, 20 bp, Artificial Sequence
  chemically synthesized
gataaacaactccatcctcc

SEQ ID NO: 60992 - DNA, 20 bp, Artificial Sequence
  chemically synthesized
aacctgctgtgccctaacat

SEQ ID NO: 60993 - DNA, 20 bp, Artificial Sequence
  chemically synthesized
ctgtgccctaacatcagctg

SEQ ID NO: 60994 - DNA, 20 bp, Artificial Sequence
  chemically synthesized
tgtgccctaacatcagctga

SEQ ID NO: 60995 - DNA, 20 bp, Artificial Sequence
  chemically synthesized
cctaacatcagctgaaggcc

SEQ ID NO: 60996 - DNA, 20 bp, Artificial Sequence
  chemically synthesized
atcagctgaaggccaagctg

SEQ ID NO: 60997 - DNA, 20 bp, Artificial Sequence
  chemically synthesized
tcagctgaaggccaagctgc

SEQ ID NO: 60998 - DNA, 20 bp, Artificial Sequence
  chemically synthesized
cagctgaaggccaagctgcg

SEQ ID NO: 60999 - DNA, 20 bp, Artificial Sequence
  chemically synthesized
ggccaagctgcggggcaccc

SEQ ID NO: 61000 - DNA, 20 bp, Artificial Sequence
  chemically synthesized
gccaagctgcggggcaccct

SEQ ID NO: 61001 - DNA, 20 bp, Artificial Sequence
  chemically synthesized
cggggcaccctgggtgttcc

SEQ ID NO: 61002 - DNA, 20 bp, Artificial Sequence
  chemically synthesized
tccaagtcactttccctctg

SEQ ID NO: 61003 - DNA, 20 bp, Artificial Sequence
  chemically synthesized
ccaagtcactttccctctgc

SEQ ID NO: 61004 - DNA, 20 bp, Artificial Sequence
  chemically synthesized
agtcactttccctctgcagg

SEQ ID NO: 61005 - DNA, 20 bp, Artificial Sequence
  chemically synthesized
gtcactttccctctgcaggc

SEQ ID NO: 61006 - DNA, 20 bp, Artificial Sequence
  chemically synthesized
aacctcatcctgctctgaaa

SEQ ID NO: 61007 - DNA, 20 bp, Artificial Sequence
  chemically synthesized
catcctgctctgaaacagat

SEQ ID NO: 61008 - DNA, 20 bp, Artificial Sequence
  chemically synthesized
tcctgctctgaaacagatga

SEQ ID NO: 61009 - DNA, 20 bp, Artificial Sequence
  chemically synthesized
cctgctctgaaacagatgag

SEQ ID NO: 61010 - DNA, 20 bp, Artificial Sequence
  chemically synthesized
ctgctctgaaacagatgaga

SEQ ID NO: 61011 - DNA, 20 bp, Artificial Sequence
  chemically synthesized
aaacagatgagagggaaacg

SEQ ID NO: 61012 - DNA, 20 bp, Artificial Sequence
  chemically synthesized
tgagagggaaacgcagaaaa

SEQ ID NO: 61013 - DNA, 20 bp, Artificial Sequence
  chemically synthesized
gaaacgcagaaaacagcttc

SEQ ID NO: 61014 - DNA, 20 bp, Artificial Sequence
  chemically synthesized
gcagaaaacagcttccagct

SEQ ID NO: 61015 - DNA, 20 bp, Artificial Sequence
  chemically synthesized
aaaacagcttccagctcagc

SEQ ID NO: 61016 - DNA, 20 bp, Artificial Sequence
  chemically synthesized
aaacagcttccagctcagcc

SEQ ID NO: 61017 - DNA, 20 bp, Artificial Sequence
  chemically synthesized
tccagctcagccaggaacct

SEQ ID NO: 61018 - DNA, 20 bp, Artificial Sequence
  chemically synthesized
cagctcagccaggaacctta

SEQ ID NO: 61019 - DNA, 20 bp, Artificial Sequence
  chemically synthesized
tcctgaccttttacctcgcc

SEQ ID NO: 61020 - DNA, 20 bp, Artificial Sequence
  chemically synthesized
cctgaccttttacctcgcct

SEQ ID NO: 61021 - DNA, 20 bp, Artificial Sequence
  chemically synthesized
tgaccttttacctcgcctag

SEQ ID NO: 61022 - DNA, 20 bp, Artificial Sequence
  chemically synthesized
ttacctcgcctaggagtttg

SEQ ID NO: 61023 - DNA, 20 bp, Artificial Sequence
  chemically synthesized
tacctcgcctaggagtttgc

SEQ ID NO: 61024 - DNA, 20 bp, Artificial Sequence
  chemically synthesized
acctcgcctaggagtttgca

SEQ ID NO: 61025 - DNA, 20 bp, Artificial Sequence
  chemically synthesized
cctcgcctaggagtttgcag

SEQ ID NO: 61026 - DNA, 20 bp, Artificial Sequence
  chemically synthesized
tcgcctaggagtttgcaggg

SEQ ID NO: 61027 - DNA, 20 bp, Artificial Sequence
  chemically synthesized
gcctaggagtttgcagggga

SEQ ID NO: 61028 - DNA, 20 bp, Artificial Sequence
  chemically synthesized
gggagagaacacacgaattt

SEQ ID NO: 61029 - DNA, 20 bp, Artificial Sequence
  chemically synthesized
acacacgaatttcggatttt

SEQ ID NO: 61030 - DNA, 20 bp, Artificial Sequence
  chemically synthesized
tcggattttaagcctaaata

SEQ ID NO: 61031 - DNA, 20 bp, Artificial Sequence
  chemically synthesized
cggattttaagcctaaataa

SEQ ID NO: 61032 - DNA, 20 bp, Artificial Sequence
  chemically synthesized
attttaagcctaaataaagg

SEQ ID NO: 61033 - DNA, 20 bp, Artificial Sequence
  chemically synthesized
agcctaaataaaggaagcct

SEQ ID NO: 61034 - DNA, 20 bp, Artificial Sequence
  chemically synthesized
ataaaggaagccttagtttg

SEQ ID NO: 61035 - DNA, 20 bp, Artificial Sequence
  chemically synthesized
gaagccttagtttgaagtgc

SEQ ID NO: 61036 - DNA, 20 bp, Artificial Sequence
  chemically synthesized
gtttgaagtgcaagctctgc

SEQ ID NO: 61037 - DNA, 20 bp, Artificial Sequence
  chemically synthesized
gaagtgcaagctctgccgga

SEQ ID NO: 61038 - DNA, 20 bp, Artificial Sequence
  chemically synthesized
aagtgcaagctctgccggac

SEQ ID NO: 61039 - DNA, 20 bp, Artificial Sequence
  chemically synthesized
agtgcaagctctgccggaca

SEQ ID NO: 61040 - DNA, 20 bp, Artificial Sequence
  chemically synthesized
gtgcaagctctgccggacag

SEQ ID NO: 61041 - DNA, 20 bp, Artificial Sequence
  chemically synthesized
tgcaagctctgccggacagg

SEQ ID NO: 61042 - DNA, 20 bp, Artificial Sequence
  chemically synthesized
ccggacagggggcaccctgt

SEQ ID NO: 61043 - DNA, 20 bp, Artificial Sequence
  chemically synthesized
ccctgtgagccccatttgtt

SEQ ID NO: 61044 - DNA, 20 bp, Artificial Sequence
  chemically synthesized
ctgtgagccccatttgttaa

SEQ ID NO: 61045 - DNA, 20 bp, Artificial Sequence
  chemically synthesized
tgtgagccccatttgttaag

SEQ ID NO: 61046 - DNA, 20 bp, Artificial Sequence
  chemically synthesized
cccatttgttaagaggacaa

SEQ ID NO: 61047 - DNA, 20 bp, Artificial Sequence
  chemically synthesized
tttgttaagaggacaatagt

SEQ ID NO: 61048 - DNA, 20 bp, Artificial Sequence
  chemically synthesized
tgttaagaggacaatagtca

SEQ ID NO: 61049 - DNA, 20 bp, Artificial Sequence
  chemically synthesized
ttaagaggacaatagtcaga

SEQ ID NO: 61050 - DNA, 20 bp, Artificial Sequence
  chemically synthesized
gacaatagtcagagagcttc

SEQ ID NO: 61051 - DNA, 20 bp, Artificial Sequence
  chemically synthesized
acaatagtcagagagcttcc

SEQ ID NO: 61052 - DNA, 20 bp, Artificial Sequence
  chemically synthesized
gagcttccaggctctcacac

SEQ ID NO: 61053 - DNA, 20 bp, Artificial Sequence
  chemically synthesized
ccaggctctcacaccagaaa

SEQ ID NO: 61054 - DNA, 20 bp, Artificial Sequence
  chemically synthesized
caggctctcacaccagaaac

SEQ ID NO: 61055 - DNA, 20 bp, Artificial Sequence
  chemically synthesized
cacaccagaaacaggaaata

SEQ ID NO: 61056 - DNA, 20 bp, Artificial Sequence
  chemically synthesized
tttcacactgatctccttcc

SEQ ID NO: 61057 - DNA, 20 bp, Artificial Sequence
  chemically synthesized
ttcacactgatctccttccc

SEQ ID NO: 61058 - DNA, 20 bp, Artificial Sequence
  chemically synthesized
cacactgatctccttcccag

SEQ ID NO: 61059 - DNA, 20 bp, Artificial Sequence
  chemically synthesized
ttgatcctctccataaatcc

SEQ ID NO: 61060 - DNA, 20 bp, Artificial Sequence
  chemically synthesized
atcctctccataaatccgag

SEQ ID NO: 61061 - DNA, 20 bp, Artificial Sequence
  chemically synthesized
tcctctccataaatccgagc

SEQ ID NO: 61062 - DNA, 20 bp, Artificial Sequence
  chemically synthesized
tctccataaatccgagcggg

SEQ ID NO: 61063 - DNA, 20 bp, Artificial Sequence
  chemically synthesized
catttatccaaacaacaaac

SEQ ID NO: 61064 - DNA, 20 bp, Artificial Sequence
  chemically synthesized
aacaacaaacaagcaaacat

SEQ ID NO: 61065 - DNA, 20 bp, Artificial Sequence
  chemically synthesized
aagcaaacatgagctgtgta

SEQ ID NO: 61066 - DNA, 20 bp, Artificial Sequence
  chemically synthesized
agcaaacatgagctgtgtat

SEQ ID NO: 61067 - DNA, 20 bp, Artificial Sequence
  chemically synthesized
gcaaacatgagctgtgtatg

SEQ ID NO: 61068 - DNA, 20 bp, Artificial Sequence
  chemically synthesized
caaacatgagctgtgtatgg

SEQ ID NO: 61069 - DNA, 20 bp, Artificial Sequence
  chemically synthesized
catgagctgtgtatggggga

SEQ ID NO: 61070 - DNA, 20 bp, Artificial Sequence
  chemically synthesized
tgagctgtgtatgggggata

SEQ ID NO: 61071 - DNA, 20 bp, Artificial Sequence
  chemically synthesized
agctgtgtatgggggataga

SEQ ID NO: 61072 - DNA, 20 bp, Artificial Sequence
  chemically synthesized
gggatagagagaatgaaacc

SEQ ID NO: 61073 - DNA, 20 bp, Artificial Sequence
  chemically synthesized
ggatagagagaatgaaaccc

SEQ ID NO: 61074 - DNA, 20 bp, Artificial Sequence
  chemically synthesized
aatgaaacccaggtccatcc

SEQ ID NO: 61075 - DNA, 20 bp, Artificial Sequence
  chemically synthesized
atgaaacccaggtccatccc

SEQ ID NO: 61076 - DNA, 20 bp, Artificial Sequence
  chemically synthesized
tgaaacccaggtccatcccg

SEQ ID NO: 61077 - DNA, 20 bp, Artificial Sequence
  chemically synthesized
aaacccaggtccatcccggg

SEQ ID NO: 61078 - DNA, 20 bp, Artificial Sequence
  chemically synthesized
gtccatcccggggagaatgc

SEQ ID NO: 61079 - DNA, 20 bp, Artificial Sequence
  chemically synthesized
ccggggagaatgctggtcta

SEQ ID NO: 61080 - DNA, 20 bp, Artificial Sequence
  chemically synthesized
gggagaatgctggtctatgg

SEQ ID NO: 61081 - DNA, 20 bp, Artificial Sequence
  chemically synthesized
agaatgctggtctatggcag

SEQ ID NO: 61082 - DNA, 20 bp, Artificial Sequence
  chemically synthesized
gaatgctggtctatggcagt

SEQ ID NO: 61083 - DNA, 20 bp, Artificial Sequence
  chemically synthesized
aatgctggtctatggcagtg

SEQ ID NO: 61084 - DNA, 20 bp, Artificial Sequence
  chemically synthesized
tgctggtctatggcagtggg

SEQ ID NO: 61085 - DNA, 20 bp, Artificial Sequence
  chemically synthesized
tggtctatggcagtggggag

SEQ ID NO: 61086 - DNA, 20 bp, Artificial Sequence
  chemically synthesized
gtggggagcagtgaataaat

SEQ ID NO: 61087 - DNA, 20 bp, Artificial Sequence
  chemically synthesized
tggggagcagtgaataaatg

SEQ ID NO: 61088 - DNA, 20 bp, Artificial Sequence
  chemically synthesized
ataaatgaggcgtacatcca

SEQ ID NO: 61089 - DNA, 20 bp, Artificial Sequence
  chemically synthesized
gaggcgtacatccatggatc

SEQ ID NO: 61090 - DNA, 20 bp, Artificial Sequence
  chemically synthesized
aggcgtacatccatggatct

SEQ ID NO: 61091 - DNA, 20 bp, Artificial Sequence
  chemically synthesized
cgtacatccatggatctggg

SEQ ID NO: 61092 - DNA, 20 bp, Artificial Sequence
  chemically synthesized
tacatccatggatctgggtg

SEQ ID NO: 61093 - DNA, 20 bp, Artificial Sequence
  chemically synthesized
catccatggatctgggtgga

SEQ ID NO: 61094 - DNA, 20 bp, Artificial Sequence
  chemically synthesized
atccatggatctgggtggag

SEQ ID NO: 61095 - DNA, 20 bp, Artificial Sequence
  chemically synthesized
tccatggatctgggtggaga

SEQ ID NO: 61096 - DNA, 20 bp, Artificial Sequence
  chemically synthesized
tggatctgggtggagagggt

SEQ ID NO: 61097 - DNA, 20 bp, Artificial Sequence
  chemically synthesized
ggatctgggtggagagggtc

SEQ ID NO: 61098 - DNA, 20 bp, Artificial Sequence
  chemically synthesized
gatctgggtggagagggtca

SEQ ID NO: 61099 - DNA, 20 bp, Artificial Sequence
  chemically synthesized
gagagggtcagggtgtaacc

SEQ ID NO: 61100 - DNA, 20 bp, Artificial Sequence
  chemically synthesized
agagggtcagggtgtaaccc

SEQ ID NO: 61101 - DNA, 20 bp, Artificial Sequence
  chemically synthesized
ggtgtaacccaggacctttc

SEQ ID NO: 61102 - DNA, 20 bp, Artificial Sequence
  chemically synthesized
tgtaacccaggacctttcca

SEQ ID NO: 61103 - DNA, 20 bp, Artificial Sequence
  chemically synthesized
gtaacccaggacctttccag

SEQ ID NO: 61104 - DNA, 20 bp, Artificial Sequence
  chemically synthesized
caggacctttccagaggcat

SEQ ID NO: 61105 - DNA, 20 bp, Artificial Sequence
  chemically synthesized
ctttccagaggcatgagaaa

SEQ ID NO: 61106 - DNA, 20 bp, Artificial Sequence
  chemically synthesized
ccagaggcatgagaaacagt

SEQ ID NO: 61107 - DNA, 20 bp, Artificial Sequence
  chemically synthesized
aaacagtcagcctacaccca

SEQ ID NO: 61108 - DNA, 20 bp, Artificial Sequence
  chemically synthesized
cagatgacctcaaacacccc

SEQ ID NO: 61109 - DNA, 20 bp, Artificial Sequence
  chemically synthesized
acaccccaagtgctccttga

SEQ ID NO: 61110 - DNA, 20 bp, Artificial Sequence
  chemically synthesized
caccccaagtgctccttgaa

SEQ ID NO: 61111 - DNA, 20 bp, Artificial Sequence
  chemically synthesized
caagtgctccttgaaaggct

SEQ ID NO: 61112 - DNA, 20 bp, Artificial Sequence
  chemically synthesized
aagtgctccttgaaaggctg

SEQ ID NO: 61113 - DNA, 20 bp, Artificial Sequence
  chemically synthesized
tgaggcttttgtgttgctct

SEQ ID NO: 61114 - DNA, 20 bp, Artificial Sequence
  chemically synthesized
gcttttgtgttgctcttggt

SEQ ID NO: 61115 - DNA, 20 bp, Artificial Sequence
  chemically synthesized
gctcttggttggattattca

SEQ ID NO: 61116 - DNA, 20 bp, Artificial Sequence
  chemically synthesized
ctcttggttggattattcac

SEQ ID NO: 61117 - DNA, 20 bp, Artificial Sequence
  chemically synthesized
tggattattcacaggcaatg

SEQ ID NO: 61118 - DNA, 20 bp, Artificial Sequence
  chemically synthesized
tcacaggcaatgaagtaaac

SEQ ID NO: 61119 - DNA, 20 bp, Artificial Sequence
  chemically synthesized
cacaggcaatgaagtaaaca

SEQ ID NO: 61120 - DNA, 20 bp, Artificial Sequence
  chemically synthesized
gaagtaaacaaggcacacca

SEQ ID NO: 61121 - DNA, 20 bp, Artificial Sequence
  chemically synthesized
aagtaaacaaggcacaccac

SEQ ID NO: 61122 - DNA, 20 bp, Artificial Sequence
  chemically synthesized
acaaggcacaccacaggact

SEQ ID NO: 61123 - DNA, 20 bp, Artificial Sequence
  chemically synthesized
cacaccacaggactcagaac

SEQ ID NO: 61124 - DNA, 20 bp, Artificial Sequence
  chemically synthesized
acaccacaggactcagaacc

SEQ ID NO: 61125 - DNA, 20 bp, Artificial Sequence
  chemically synthesized
caccacaggactcagaacca

SEQ ID NO: 61126 - DNA, 20 bp, Artificial Sequence
  chemically synthesized
acaggactcagaaccaggga

SEQ ID NO: 61127 - DNA, 20 bp, Artificial Sequence
  chemically synthesized
agaaccagggacagcttccg

SEQ ID NO: 61128 - DNA, 20 bp, Artificial Sequence
  chemically synthesized
gaaccagggacagcttccgc

SEQ ID NO: 61129 - DNA, 20 bp, Artificial Sequence
  chemically synthesized
ggacagcttccgcaggaacc

SEQ ID NO: 61130 - DNA, 20 bp, Artificial Sequence
  chemically synthesized
gacagcttccgcaggaacct

SEQ ID NO: 61131 - DNA, 20 bp, Artificial Sequence
  chemically synthesized
gcttccgcaggaacctgggt

SEQ ID NO: 61132 - DNA, 20 bp, Artificial Sequence
  chemically synthesized
ggaacctgggtcagttctaa

SEQ ID NO: 61133 - DNA, 20 bp, Artificial Sequence
  chemically synthesized
gaacctgggtcagttctaaa

SEQ ID NO: 61134 - DNA, 20 bp, Artificial Sequence
  chemically synthesized
gtcagttctaaaaggacaaa

SEQ ID NO: 61135 - DNA, 20 bp, Artificial Sequence
  chemically synthesized
aggacaaatggaatgaccct

SEQ ID NO: 61136 - DNA, 20 bp, Artificial Sequence
  chemically synthesized
acaaatggaatgaccctgag

SEQ ID NO: 61137 - DNA, 20 bp, Artificial Sequence
  chemically synthesized
aaatggaatgaccctgagta

SEQ ID NO: 61138 - DNA, 20 bp, Artificial Sequence
  chemically synthesized
tggaatgaccctgagtagag

SEQ ID NO: 61139 - DNA, 20 bp, Artificial Sequence
  chemically synthesized
atgaccctgagtagagaagt

SEQ ID NO: 61140 - DNA, 20 bp, Artificial Sequence
  chemically synthesized
gaccctgagtagagaagtca

SEQ ID NO: 61141 - DNA, 20 bp, Artificial Sequence
  chemically synthesized
ctgagtagagaagtcagaga

SEQ ID NO: 61142 - DNA, 20 bp, Artificial Sequence
  chemically synthesized
tgagtagagaagtcagagaa

SEQ ID NO: 61143 - DNA, 20 bp, Artificial Sequence
  chemically synthesized
cagagaaaggcactctcact

SEQ ID NO: 61144 - DNA, 20 bp, Artificial Sequence
  chemically synthesized
agagaaaggcactctcactg

SEQ ID NO: 61145 - DNA, 20 bp, Artificial Sequence
  chemically synthesized
actgaggcaaactccctccc

SEQ ID NO: 61146 - DNA, 20 bp, Artificial Sequence
  chemically synthesized
gaggcaaactccctccccag

SEQ ID NO: 61147 - DNA, 20 bp, Artificial Sequence
  chemically synthesized
aggcaaactccctccccagc

SEQ ID NO: 61148 - DNA, 20 bp, Artificial Sequence
  chemically synthesized
ggcaaactccctccccagca

SEQ ID NO: 61149 - DNA, 20 bp, Artificial Sequence
  chemically synthesized
ctccctccccagcagggacc

SEQ ID NO: 61150 - DNA, 20 bp, Artificial Sequence
  chemically synthesized
tccctccccagcagggaccc

SEQ ID NO: 61151 - DNA, 20 bp, Artificial Sequence
  chemically synthesized
ctccccagcagggacccagg

SEQ ID NO: 61152 - DNA, 20 bp, Artificial Sequence
  chemically synthesized
cagggacccaggcagcaact

SEQ ID NO: 61153 - DNA, 20 bp, Artificial Sequence
  chemically synthesized
acccaggcagcaactcggaa

SEQ ID NO: 61154 - DNA, 20 bp, Artificial Sequence
  chemically synthesized
caggcagcaactcggaaaag

SEQ ID NO: 61155 - DNA, 20 bp, Artificial Sequence
  chemically synthesized
aggcagcaactcggaaaagc

SEQ ID NO: 61156 - DNA, 20 bp, Artificial Sequence
  chemically synthesized
gcagcaactcggaaaagcag

SEQ ID NO: 61157 - DNA, 20 bp, Artificial Sequence
  chemically synthesized
agtgtcactattgtatcata

SEQ ID NO: 61158 - DNA, 20 bp, Artificial Sequence
  chemically synthesized
gtgtcactattgtatcatat

SEQ ID NO: 61159 - DNA, 20 bp, Artificial Sequence
  chemically synthesized
gtcactattgtatcatatgg

SEQ ID NO: 61160 - DNA, 20 bp, Artificial Sequence
  chemically synthesized
cactattgtatcatatggga

SEQ ID NO: 61161 - DNA, 20 bp, Artificial Sequence
  chemically synthesized
actattgtatcatatgggag

SEQ ID NO: 61162 - DNA, 20 bp, Artificial Sequence
  chemically synthesized
ctattgtatcatatgggaga

SEQ ID NO: 61163 - DNA, 20 bp, Artificial Sequence
  chemically synthesized
ttgtatcatatgggagaggg

SEQ ID NO: 61164 - DNA, 20 bp, Artificial Sequence
  chemically synthesized
tgtatcatatgggagagggc

SEQ ID NO: 61165 - DNA, 20 bp, Artificial Sequence
  chemically synthesized
gagggcaggctgtgtgctct

SEQ ID NO: 61166 - DNA, 20 bp, Artificial Sequence
  chemically synthesized
agggcaggctgtgtgctctc

SEQ ID NO: 61167 - DNA, 20 bp, Artificial Sequence
  chemically synthesized
gggcaggctgtgtgctctca

SEQ ID NO: 61168 - DNA, 20 bp, Artificial Sequence
  chemically synthesized
caggctgtgtgctctcaggg

SEQ ID NO: 61169 - DNA, 20 bp, Artificial Sequence
  chemically synthesized
tcctcaacttctctgtgccg

SEQ ID NO: 61170 - DNA, 20 bp, Artificial Sequence
  chemically synthesized
gcaaaatgtaaatcaaattt

SEQ ID NO: 61171 - DNA, 20 bp, Artificial Sequence
  chemically synthesized
caaaatgtaaatcaaatttg

SEQ ID NO: 61172 - DNA, 20 bp, Artificial Sequence
  chemically synthesized
tgcaatgacttatttctcta

SEQ ID NO: 61173 - DNA, 20 bp, Artificial Sequence
  chemically synthesized
ttccttgtccttgtcccatg

SEQ ID NO: 61174 - DNA, 20 bp, Artificial Sequence
  chemically synthesized
tgtccttgtcccatgtagcc

SEQ ID NO: 61175 - DNA, 20 bp, Artificial Sequence
  chemically synthesized
gtagcccagaaatcttcctc

SEQ ID NO: 61176 - DNA, 20 bp, Artificial Sequence
  chemically synthesized
ccagaaatcttcctctggcc

SEQ ID NO: 61177 - DNA, 20 bp, Artificial Sequence
  chemically synthesized
atcttcctctggcctagttg

SEQ ID NO: 61178 - DNA, 20 bp, Artificial Sequence
  chemically synthesized
cttcctctggcctagttgtg

SEQ ID NO: 61179 - DNA, 20 bp, Artificial Sequence
  chemically synthesized
tctggcctagttgtggagcc

SEQ ID NO: 61180 - DNA, 20 bp, Artificial Sequence
  chemically synthesized
ctagttgtggagcctggcct

SEQ ID NO: 61181 - DNA, 20 bp, Artificial Sequence
  chemically synthesized
tggcctaagtcgcacattgc

SEQ ID NO: 61182 - DNA, 20 bp, Artificial Sequence
  chemically synthesized
gcctaagtcgcacattgctg

SEQ ID NO: 61183 - DNA, 20 bp, Artificial Sequence
  chemically synthesized
aagtcgcacattgctggaga

SEQ ID NO: 61184 - DNA, 20 bp, Artificial Sequence
  chemically synthesized
gcacattgctggagatggtg

SEQ ID NO: 61185 - DNA, 20 bp, Artificial Sequence
  chemically synthesized
ctggagatggtgaagctgac

SEQ ID NO: 61186 - DNA, 20 bp, Artificial Sequence
  chemically synthesized
atggtgaagctgaccagcat

SEQ ID NO: 61187 - DNA, 20 bp, Artificial Sequence
  chemically synthesized
ggtgaagctgaccagcatga

SEQ ID NO: 61188 - DNA, 20 bp, Artificial Sequence
  chemically synthesized
gtgaagctgaccagcatgag

SEQ ID NO: 61189 - DNA, 20 bp, Artificial Sequence
  chemically synthesized
agctgaccagcatgagaggt

SEQ ID NO: 61190 - DNA, 20 bp, Artificial Sequence
  chemically synthesized
cagcatgagaggtcagtttc

SEQ ID NO: 61191 - DNA, 20 bp, Artificial Sequence
  chemically synthesized
catgagaggtcagtttctag

SEQ ID NO: 61192 - DNA, 20 bp, Artificial Sequence
  chemically synthesized
tctagaagcccaaatcccaa

SEQ ID NO: 61193 - DNA, 20 bp, Artificial Sequence
  chemically synthesized
ctagaagcccaaatcccaac

SEQ ID NO: 61194 - DNA, 20 bp, Artificial Sequence
  chemically synthesized
gcccaaatcccaacaggcat

SEQ ID NO: 61195 - DNA, 20 bp, Artificial Sequence
  chemically synthesized
taagcctcaccctccaatat

SEQ ID NO: 61196 - DNA, 20 bp, Artificial Sequence
  chemically synthesized
ccctccaatatcagctctat

SEQ ID NO: 61197 - DNA, 20 bp, Artificial Sequence
  chemically synthesized
catttgtccttttcctcaaa

SEQ ID NO: 61198 - DNA, 20 bp, Artificial Sequence
  chemically synthesized
atttgtccttttcctcaaat

SEQ ID NO: 61199 - DNA, 20 bp, Artificial Sequence
  chemically synthesized
tgtccttttcctcaaatggg

SEQ ID NO: 61200 - DNA, 20 bp, Artificial Sequence
  chemically synthesized
ttcctcaaatgggtggcact

SEQ ID NO: 61201 - DNA, 20 bp, Artificial Sequence
  chemically synthesized
tcctcaaatgggtggcactt

SEQ ID NO: 61202 - DNA, 20 bp, Artificial Sequence
  chemically synthesized
tcaaatgggtggcacttggg

SEQ ID NO: 61203 - DNA, 20 bp, Artificial Sequence
  chemically synthesized
caaatgggtggcacttgggc

SEQ ID NO: 61204 - DNA, 20 bp, Artificial Sequence
  chemically synthesized
aaatgggtggcacttgggca

SEQ ID NO: 61205 - DNA, 20 bp, Artificial Sequence
  chemically synthesized
tgggtggcacttgggcaggg

SEQ ID NO: 61206 - DNA, 20 bp, Artificial Sequence
  chemically synthesized
gtggcacttgggcagggcag

SEQ ID NO: 61207 - DNA, 20 bp, Artificial Sequence
  chemically synthesized
tggcacttgggcagggcaga

SEQ ID NO: 61208 - DNA, 20 bp, Artificial Sequence
  chemically synthesized
ggcacttgggcagggcagaa

SEQ ID NO: 61209 - DNA, 20 bp, Artificial Sequence
  chemically synthesized
cttgggcagggcagaagggc

SEQ ID NO: 61210 - DNA, 20 bp, Artificial Sequence
  chemically synthesized
ggcagaagggctggttatcc

SEQ ID NO: 61211 - DNA, 20 bp, Artificial Sequence
  chemically synthesized
aagggctggttatccaagct

SEQ ID NO: 61212 - DNA, 20 bp, Artificial Sequence
  chemically synthesized
ggctggttatccaagcttgg

SEQ ID NO: 61213 - DNA, 20 bp, Artificial Sequence
  chemically synthesized
ccaagcttggaagatgctga

SEQ ID NO: 61214 - DNA, 20 bp, Artificial Sequence
  chemically synthesized
agcttggaagatgctgacag

SEQ ID NO: 61215 - DNA, 20 bp, Artificial Sequence
  chemically synthesized
gctgacagcagacgcttcaa

SEQ ID NO: 61216 - DNA, 20 bp, Artificial Sequence
  chemically synthesized
gacagcagacgcttcaatgg

SEQ ID NO: 61217 - DNA, 20 bp, Artificial Sequence
  chemically synthesized
agcagacgcttcaatggcag

SEQ ID NO: 61218 - DNA, 20 bp, Artificial Sequence
  chemically synthesized
gcagacgcttcaatggcagt

SEQ ID NO: 61219 - DNA, 20 bp, Artificial Sequence
  chemically synthesized
agacgcttcaatggcagtag

SEQ ID NO: 61220 - DNA, 20 bp, Artificial Sequence
  chemically synthesized
agttttctgatcactgtcat

SEQ ID NO: 61221 - DNA, 20 bp, Artificial Sequence
  chemically synthesized
tactgttgaaatcgtgacat

SEQ ID NO: 61222 - DNA, 20 bp, Artificial Sequence
  chemically synthesized
actgttgaaatcgtgacatc

SEQ ID NO: 61223 - DNA, 20 bp, Artificial Sequence
  chemically synthesized
cgtgacatcaggaatgatga

SEQ ID NO: 61224 - DNA, 20 bp, Artificial Sequence
  chemically synthesized
gtgacatcaggaatgatgaa

SEQ ID NO: 61225 - DNA, 20 bp, Artificial Sequence
  chemically synthesized
tcaggaatgatgaaaggaac

SEQ ID NO: 61226 - DNA, 20 bp, Artificial Sequence
  chemically synthesized
aggaatgatgaaaggaacta

SEQ ID NO: 61227 - DNA, 20 bp, Artificial Sequence
  chemically synthesized
atgatgaaaggaactagagt

SEQ ID NO: 61228 - DNA, 20 bp, Artificial Sequence
  chemically synthesized
tgaaaggaactagagtcaga

SEQ ID NO: 61229 - DNA, 20 bp, Artificial Sequence
  chemically synthesized
ggaactagagtcagatggtc

SEQ ID NO: 61230 - DNA, 20 bp, Artificial Sequence
  chemically synthesized
aactagagtcagatggtctg

SEQ ID NO: 61231 - DNA, 20 bp, Artificial Sequence
  chemically synthesized
tagagtcagatggtctggag

SEQ ID NO: 61232 - DNA, 20 bp, Artificial Sequence
  chemically synthesized
agagtcagatggtctggagc

SEQ ID NO: 61233 - DNA, 20 bp, Artificial Sequence
  chemically synthesized
gagtcagatggtctggagcg

SEQ ID NO: 61234 - DNA, 20 bp, Artificial Sequence
  chemically synthesized
tcagatggtctggagcgggg

SEQ ID NO: 61235 - DNA, 20 bp, Artificial Sequence
  chemically synthesized
atggtctggagcggggaagt

SEQ ID NO: 61236 - DNA, 20 bp, Artificial Sequence
  chemically synthesized
tggtctggagcggggaagtg

SEQ ID NO: 61237 - DNA, 20 bp, Artificial Sequence
  chemically synthesized
gtctggagcggggaagtgag

SEQ ID NO: 61238 - DNA, 20 bp, Artificial Sequence
  chemically synthesized
tgaggagctgaaacctcctt

SEQ ID NO: 61239 - DNA, 20 bp, Artificial Sequence
  chemically synthesized
agctgaaacctccttcagtc

SEQ ID NO: 61240 - DNA, 20 bp, Artificial Sequence
  chemically synthesized
cagtctggttgctgtgtccc

SEQ ID NO: 61241 - DNA, 20 bp, Artificial Sequence
  chemically synthesized
agtctggttgctgtgtcccc

SEQ ID NO: 61242 - DNA, 20 bp, Artificial Sequence
  chemically synthesized
gtctggttgctgtgtcccca

SEQ ID NO: 61243 - DNA, 20 bp, Artificial Sequence
  chemically synthesized
tggttgctgtgtccccaggg

SEQ ID NO: 61244 - DNA, 20 bp, Artificial Sequence
  chemically synthesized
ggttgctgtgtccccagggt

SEQ ID NO: 61245 - DNA, 20 bp, Artificial Sequence
  chemically synthesized
tgctgtgtccccagggtggg

SEQ ID NO: 61246 - DNA, 20 bp, Artificial Sequence
  chemically synthesized
tcccctctgttcatcccaca

SEQ ID NO: 61247 - DNA, 20 bp, Artificial Sequence
  chemically synthesized
cccctctgttcatcccacat

SEQ ID NO: 61248 - DNA, 20 bp, Artificial Sequence
  chemically synthesized
ctgttcatcccacatgggac

SEQ ID NO: 61249 - DNA, 20 bp, Artificial Sequence
  chemically synthesized
ttcatcccacatgggacaag

SEQ ID NO: 61250 - DNA, 20 bp, Artificial Sequence
  chemically synthesized
catcccacatgggacaagta

SEQ ID NO: 61251 - DNA, 20 bp, Artificial Sequence
  chemically synthesized
cccacatgggacaagtagag

SEQ ID NO: 61252 - DNA, 20 bp, Artificial Sequence
  chemically synthesized
ccacatgggacaagtagagc

SEQ ID NO: 61253 - DNA, 20 bp, Artificial Sequence
  chemically synthesized
acatgggacaagtagagcgg

SEQ ID NO: 61254 - DNA, 20 bp, Artificial Sequence
  chemically synthesized
atgggacaagtagagcggga

SEQ ID NO: 61255 - DNA, 20 bp, Artificial Sequence
  chemically synthesized
tgggacaagtagagcgggag

SEQ ID NO: 61256 - DNA, 20 bp, Artificial Sequence
  chemically synthesized
agaggaatcaaccctttcta

SEQ ID NO: 61257 - DNA, 20 bp, Artificial Sequence
  chemically synthesized
gaggaatcaaccctttctaa

SEQ ID NO: 61258 - DNA, 20 bp, Artificial Sequence
  chemically synthesized
aggaatcaaccctttctaaa

SEQ ID NO: 61259 - DNA, 20 bp, Artificial Sequence
  chemically synthesized
caaccctttctaaagggttg

SEQ ID NO: 61260 - DNA, 20 bp, Artificial Sequence
  chemically synthesized
ttctaaagggttgaagcatt

SEQ ID NO: 61261 - DNA, 20 bp, Artificial Sequence
  chemically synthesized
gggttgaagcattgagctgt

SEQ ID NO: 61262 - DNA, 20 bp, Artificial Sequence
  chemically synthesized
gcattgagctgtgagcttct

SEQ ID NO: 61263 - DNA, 20 bp, Artificial Sequence
  chemically synthesized
tgtgagcttctcggttgctg

SEQ ID NO: 61264 - DNA, 20 bp, Artificial Sequence
  chemically synthesized
cccatcctgactgaaacaac

SEQ ID NO: 61265 - DNA, 20 bp, Artificial Sequence
  chemically synthesized
agaattcatgaaatgcatca

SEQ ID NO: 61266 - DNA, 20 bp, Artificial Sequence
  chemically synthesized
attcatgaaatgcatcaaag

SEQ ID NO: 61267 - DNA, 20 bp, Artificial Sequence
  chemically synthesized
gaagtcttcacctactacgc

SEQ ID NO: 61268 - DNA, 20 bp, Artificial Sequence
  chemically synthesized
cttcacctactacgcaagcc

SEQ ID NO: 61269 - DNA, 20 bp, Artificial Sequence
  chemically synthesized
cacctactacgcaagcctgg

SEQ ID NO: 61270 - DNA, 20 bp, Artificial Sequence
  chemically synthesized
acctactacgcaagcctgga

SEQ ID NO: 61271 - DNA, 20 bp, Artificial Sequence
  chemically synthesized
cctactacgcaagcctggaa

SEQ ID NO: 61272 - DNA, 20 bp, Artificial Sequence
  chemically synthesized
gcaagcctggaagggtgact

SEQ ID NO: 61273 - DNA, 20 bp, Artificial Sequence
  chemically synthesized
gactaagatctgaaaaacac

SEQ ID NO: 61274 - DNA, 20 bp, Artificial Sequence
  chemically synthesized
actaagatctgaaaaacacc

SEQ ID NO: 61275 - DNA, 20 bp, Artificial Sequence
  chemically synthesized
aagatctgaaaaacaccggg

SEQ ID NO: 61276 - DNA, 20 bp, Artificial Sequence
  chemically synthesized
agatctgaaaaacaccggga

SEQ ID NO: 61277 - DNA, 20 bp, Artificial Sequence
  chemically synthesized
gaaaaacaccgggaaggcta

SEQ ID NO: 61278 - DNA, 20 bp, Artificial Sequence
  chemically synthesized
aaaaacaccgggaaggctaa

SEQ ID NO: 61279 - DNA, 20 bp, Artificial Sequence
  chemically synthesized
aaggctaaaggaactcccac

SEQ ID NO: 61280 - DNA, 20 bp, Artificial Sequence
  chemically synthesized
aggctaaaggaactcccaca

SEQ ID NO: 61281 - DNA, 20 bp, Artificial Sequence
  chemically synthesized
ctcccacaaggaaaccccat

SEQ ID NO: 61282 - DNA, 20 bp, Artificial Sequence
  chemically synthesized
cacaaggaaaccccattaga

SEQ ID NO: 61283 - DNA, 20 bp, Artificial Sequence
  chemically synthesized
gaaaccccattagaaagttc

SEQ ID NO: 61284 - DNA, 20 bp, Artificial Sequence
  chemically synthesized
cattagaaagttctagttac

SEQ ID NO: 61285 - DNA, 20 bp, Artificial Sequence
  chemically synthesized
agttctagttacaagatgct

SEQ ID NO: 61286 - DNA, 20 bp, Artificial Sequence
  chemically synthesized
tagttacaagatgctcagca

SEQ ID NO: 61287 - DNA, 20 bp, Artificial Sequence
  chemically synthesized
agttacaagatgctcagcac

SEQ ID NO: 61288 - DNA, 20 bp, Artificial Sequence
  chemically synthesized
gatgctcagcacaggccatg

SEQ ID NO: 61289 - DNA, 20 bp, Artificial Sequence
  chemically synthesized
aggccatgcagaaatacgcc

SEQ ID NO: 61290 - DNA, 20 bp, Artificial Sequence
  chemically synthesized
tgcagaaatacgcccagatc

SEQ ID NO: 61291 - DNA, 20 bp, Artificial Sequence
  chemically synthesized
agaaatacgcccagatccgg

SEQ ID NO: 61292 - DNA, 20 bp, Artificial Sequence
  chemically synthesized
atacgcccagatccggtggt

SEQ ID NO: 61293 - DNA, 20 bp, Artificial Sequence
  chemically synthesized
gcccagatccggtggtgagc

SEQ ID NO: 61294 - DNA, 20 bp, Artificial Sequence
  chemically synthesized
cccagatccggtggtgagca

SEQ ID NO: 61295 - DNA, 20 bp, Artificial Sequence
  chemically synthesized
atccggtggtgagcaaggaa

SEQ ID NO: 61296 - DNA, 20 bp, Artificial Sequence
  chemically synthesized
cggtggtgagcaaggaacgg

SEQ ID NO: 61297 - DNA, 20 bp, Artificial Sequence
  chemically synthesized
ggtggtgagcaaggaacggt

SEQ ID NO: 61298 - DNA, 20 bp, Artificial Sequence
  chemically synthesized
gcaaggaacggtaggaatgt

SEQ ID NO: 61299 - DNA, 20 bp, Artificial Sequence
  chemically synthesized
acggtaggaatgtgagcact

SEQ ID NO: 61300 - DNA, 20 bp, Artificial Sequence
  chemically synthesized
aatgtgagcactgagtcacg

SEQ ID NO: 61301 - DNA, 20 bp, Artificial Sequence
  chemically synthesized
atgtgagcactgagtcacgc

SEQ ID NO: 61302 - DNA, 20 bp, Artificial Sequence
  chemically synthesized
gtgagcactgagtcacgcag

SEQ ID NO: 61303 - DNA, 20 bp, Artificial Sequence
  chemically synthesized
gagcactgagtcacgcagga

SEQ ID NO: 61304 - DNA, 20 bp, Artificial Sequence
  chemically synthesized
agtcacgcaggagagactca

SEQ ID NO: 61305 - DNA, 20 bp, Artificial Sequence
  chemically synthesized
gtcacgcaggagagactcat

SEQ ID NO: 61306 - DNA, 20 bp, Artificial Sequence
  chemically synthesized
tcacgcaggagagactcata

SEQ ID NO: 61307 - DNA, 20 bp, Artificial Sequence
  chemically synthesized
cacgcaggagagactcatag

SEQ ID NO: 61308 - DNA, 20 bp, Artificial Sequence
  chemically synthesized
ggagagactcataggggctc

SEQ ID NO: 61309 - DNA, 20 bp, Artificial Sequence
  chemically synthesized
agactcataggggctcaagc

SEQ ID NO: 61310 - DNA, 20 bp, Artificial Sequence
  chemically synthesized
tcataggggctcaagccagc

SEQ ID NO: 61311 - DNA, 20 bp, Artificial Sequence
  chemically synthesized
cataggggctcaagccagca

SEQ ID NO: 61312 - DNA, 20 bp, Artificial Sequence
  chemically synthesized
ataggggctcaagccagcaa

SEQ ID NO: 61313 - DNA, 20 bp, Artificial Sequence
  chemically synthesized
taggggctcaagccagcaag

SEQ ID NO: 61314 - DNA, 20 bp, Artificial Sequence
  chemically synthesized
ggctcaagccagcaagggga

SEQ ID NO: 61315 - DNA, 20 bp, Artificial Sequence
  chemically synthesized
gcctccaccccacgcactgt

SEQ ID NO: 61316 - DNA, 20 bp, Artificial Sequence
  chemically synthesized
ccccacgcactgttggccaa

SEQ ID NO: 61317 - DNA, 20 bp, Artificial Sequence
  chemically synthesized
cactgttggccaacagcttc

SEQ ID NO: 61318 - DNA, 20 bp, Artificial Sequence
  chemically synthesized
actgttggccaacagcttcc

SEQ ID NO: 61319 - DNA, 20 bp, Artificial Sequence
  chemically synthesized
ctgttggccaacagcttcca

SEQ ID NO: 61320 - DNA, 20 bp, Artificial Sequence
  chemically synthesized
tgttggccaacagcttccag

SEQ ID NO: 61321 - DNA, 20 bp, Artificial Sequence
  chemically synthesized
cttccaggggcatttgctct

SEQ ID NO: 61322 - DNA, 20 bp, Artificial Sequence
  chemically synthesized
ccaggggcatttgctctcag

SEQ ID NO: 61323 - DNA, 20 bp, Artificial Sequence
  chemically synthesized
gcatttgctctcagaagtca

SEQ ID NO: 61324 - DNA, 20 bp, Artificial Sequence
  chemically synthesized
aagctgattttccacaattg

SEQ ID NO: 61325 - DNA, 20 bp, Artificial Sequence
  chemically synthesized
agctgttggccaacagtgcg

SEQ ID NO: 61326 - DNA, 20 bp, Artificial Sequence
  chemically synthesized
ccttgctggcttgagcccct

SEQ ID NO: 61327 - DNA, 20 bp, Artificial Sequence
  chemically synthesized
ctaccgttccttgctcacca

SEQ ID NO: 61328 - DNA, 20 bp, Artificial Sequence
  chemically synthesized
ttgtaactagaactttctaa

SEQ ID NO: 61329 - DNA, 20 bp, Artificial Sequence
  chemically synthesized
ttctaatggggtttccttgt

SEQ ID NO: 61330 - DNA, 20 bp, Artificial Sequence
  chemically synthesized
agacttctttgatgcatttc

SEQ ID NO: 61331 - DNA, 20 bp, Artificial Sequence
  chemically synthesized
tgaattctggttgtttcagt

SEQ ID NO: 61332 - DNA, 20 bp, Artificial Sequence
  chemically synthesized
ttgtttcagtcaggatgggc

SEQ ID NO: 61333 - DNA, 20 bp, Artificial Sequence
  chemically synthesized
caatgcttcaaccctttaga

SEQ ID NO: 61334 - DNA, 20 bp, Artificial Sequence
  chemically synthesized
cccgctctacttgtcccatg

SEQ ID NO: 61335 - DNA, 20 bp, Artificial Sequence
  chemically synthesized
tcccatgtgggatgaacaga

SEQ ID NO: 61336 - DNA, 20 bp, Artificial Sequence
  chemically synthesized
gctgtcagcatcttccaagc

SEQ ID NO: 61337 - DNA, 20 bp, Artificial Sequence
  chemically synthesized
ccatttgaggaaaaggacaa

SEQ ID NO: 61338 - DNA, 20 bp, Artificial Sequence
  chemically synthesized
ttctgatagagctgatattg

SEQ ID NO: 61339 - DNA, 20 bp, Artificial Sequence
  chemically synthesized
agggtgaggcttatgcctgt

SEQ ID NO: 61340 - DNA, 20 bp, Artificial Sequence
  chemically synthesized
atagtgacactcctgctttt

SEQ ID NO: 61341 - DNA, 20 bp, Artificial Sequence
  chemically synthesized
ctgcttttccgagttgctgc

SEQ ID NO: 61342 - DNA, 20 bp, Artificial Sequence
  chemically synthesized
gcctgggtccctgctgggga

SEQ ID NO: 61343 - DNA, 20 bp, Artificial Sequence
  chemically synthesized
gggagggagtttgcctcagt

SEQ ID NO: 61344 - DNA, 20 bp, Artificial Sequence
  chemically synthesized
ctttctctgacttctctact

SEQ ID NO: 61345 - DNA, 20 bp, Artificial Sequence
  chemically synthesized
tgcggaagctgtccctggtt

SEQ ID NO: 61346 - DNA, 20 bp, Artificial Sequence
  chemically synthesized
ccttgtttacttcattgcct

SEQ ID NO: 61347 - DNA, 20 bp, Artificial Sequence
  chemically synthesized
tcagcctttcaaggagcact

SEQ ID NO: 61348 - DNA, 20 bp, Artificial Sequence
  chemically synthesized
tggggtgtttgaggtcatct

SEQ ID NO: 61349 - DNA, 20 bp, Artificial Sequence
  chemically synthesized
ctcatgcctctggaaaggtc

SEQ ID NO: 61350 - DNA, 20 bp, Artificial Sequence
  chemically synthesized
gaccctctccacccagatcc

SEQ ID NO: 61351 - DNA, 20 bp, Artificial Sequence
  chemically synthesized
ccatagaccagcattctccc

SEQ ID NO: 61352 - DNA, 20 bp, Artificial Sequence
  chemically synthesized
gcattctccccgggatggac

SEQ ID NO: 61353 - DNA, 20 bp, Artificial Sequence
  chemically synthesized
catgtttgcttgtttgttgt

SEQ ID NO: 61354 - DNA, 20 bp, Artificial Sequence
  chemically synthesized
tttggataaatgcttcccgc

SEQ ID NO: 61355 - DNA, 20 bp, Artificial Sequence
  chemically synthesized
ttcccgctcggatttatgga

SEQ ID NO: 61356 - DNA, 20 bp, Artificial Sequence
  chemically synthesized
ctcttaacaaatggggctca

SEQ ID NO: 61357 - DNA, 20 bp, Artificial Sequence
  chemically synthesized
ccctctcatctgtttcagag

SEQ ID NO: 61358 - DNA, 20 bp, Artificial Sequence
  chemically synthesized
ggaaagtgacttggaacacc

SEQ ID NO: 61359 - DNA, 20 bp, Artificial Sequence
  chemically synthesized
gttgatgcagtgtggtcctg

SEQ ID NO: 61360 - DNA, 20 bp, Artificial Sequence
  chemically synthesized
tgcagtgtggtcctggagga

SEQ ID NO: 61361 - DNA, 20 bp, Artificial Sequence
  chemically synthesized
gagcatttgacctgctgggc

SEQ ID NO: 61362 - DNA, 20 bp, Artificial Sequence
  chemically synthesized
agtttccccatgtgtacttt

SEQ ID NO: 61363 - DNA, 20 bp, Artificial Sequence
  chemically synthesized
ccatgtgtactttggggata

SEQ ID NO: 61364 - DNA, 20 bp, Artificial Sequence
  chemically synthesized
cgtcctgcagaacctgtctg

SEQ ID NO: 61365 - DNA, 20 bp, Artificial Sequence
  chemically synthesized
ctggaggatcacgttggaca

SEQ ID NO: 61366 - DNA, 20 bp, Artificial Sequence
  chemically synthesized
gttgattcccaggggagccc

SEQ ID NO: 61367 - DNA, 20 bp, Artificial Sequence
  chemically synthesized
ctctgggaggttatgctagt

SEQ ID NO: 61368 - DNA, 20 bp, Artificial Sequence
  chemically synthesized
ggaggttatgctagtttgaa

SEQ ID NO: 61369 - DNA, 20 bp, Artificial Sequence
  chemically synthesized
ccaaatgccagttaaataag

SEQ ID NO: 61370 - DNA, 20 bp, Artificial Sequence
  chemically synthesized
agttaaataagaggagtcct

SEQ ID NO: 61371 - DNA, 20 bp, Artificial Sequence
  chemically synthesized
gcgggctgtgtcaacatctg

SEQ ID NO: 61372 - DNA, 20 bp, Artificial Sequence
  chemically synthesized
tgcctgctccacactgggca

SEQ ID NO: 61373 - DNA, 20 bp, Artificial Sequence
  chemically synthesized
gcaacccttctggtttaagg

SEQ ID NO: 61374 - DNA, 20 bp, Artificial Sequence
  chemically synthesized
ttagcgtgaccctcgaaggg

SEQ ID NO: 61375 - DNA, 20 bp, Artificial Sequence
  chemically synthesized
agcctcagtttcctcagatt

SEQ ID NO: 61376 - DNA, 20 bp, Artificial Sequence
  chemically synthesized
cacatcgcagtgctgctaca

SEQ ID NO: 61377 - DNA, 20 bp, Artificial Sequence
  chemically synthesized
agccaggggaggtacttcat

SEQ ID NO: 61378 - DNA, 20 bp, Artificial Sequence
  chemically synthesized
tctatttattctctgttcta

SEQ ID NO: 61379 - DNA, 20 bp, Artificial Sequence
  chemically synthesized
tcagggggaaaagtcagaac

SEQ ID NO: 61380 - DNA, 20 bp, Artificial Sequence
  chemically synthesized
atatctttaatgtatttgtg

SEQ ID NO: 61381 - DNA, 20 bp, Artificial Sequence
  chemically synthesized
tggagagtgaaaggctgtca

SEQ ID NO: 61382 - DNA, 20 bp, Artificial Sequence
  chemically synthesized
gtcggtatccattgattaga

SEQ ID NO: 61383 - DNA, 20 bp, Artificial Sequence
  chemically synthesized
attgattagactgaatcatg

SEQ ID NO: 61384 - DNA, 20 bp, Artificial Sequence
  chemically synthesized
ttaagtacacattcatgaca

SEQ ID NO: 61385 - DNA, 20 bp, Artificial Sequence
  chemically synthesized
cagtgattcctagattagtt

SEQ ID NO: 61386 - DNA, 20 bp, Artificial Sequence
  chemically synthesized
tgtcctttagcagggccttg

SEQ ID NO: 61387 - DNA, 20 bp, Artificial Sequence
  chemically synthesized
ggactcagaggaggaaaggg

SEQ ID NO: 61388 - DNA, 20 bp, Artificial Sequence
  chemically synthesized
ggaggaaagggaggggttgc

SEQ ID NO: 61389 - DNA, 20 bp, Artificial Sequence
  chemically synthesized
gggaggggttgcgggggtca

SEQ ID NO: 61390 - DNA, 20 bp, Artificial Sequence
  chemically synthesized
tgcttcctctcccatagctg

SEQ ID NO: 61391 - DNA, 20 bp, Artificial Sequence
  chemically synthesized
ccatgtgactagggaggaga

SEQ ID NO: 61392 - DNA, 20 bp, Artificial Sequence
  chemically synthesized
actagggaggagaagggata

SEQ ID NO: 61393 - DNA, 20 bp, Artificial Sequence
  chemically synthesized
cagcgatggaaggacaagga

SEQ ID NO: 61394 - DNA, 20 bp, Artificial Sequence
  chemically synthesized
ggtgtccttgttgccccatg

SEQ ID NO: 61395 - DNA, 20 bp, Artificial Sequence
  chemically synthesized
catggagaatgggcttcagg

SEQ ID NO: 61396 - DNA, 20 bp, Artificial Sequence
  chemically synthesized
gtgcctgagaggtgcagggc

SEQ ID NO: 61397 - DNA, 20 bp, Artificial Sequence
  chemically synthesized
ccgagtctggttaggtgaca

SEQ ID NO: 61398 - DNA, 20 bp, Artificial Sequence
  chemically synthesized
ggcccccaggagggcagcct

SEQ ID NO: 61399 - DNA, 20 bp, Artificial Sequence
  chemically synthesized
gtgggcacagccagccctgg

SEQ ID NO: 61400 - DNA, 20 bp, Artificial Sequence
  chemically synthesized
ccctggcaggatgagcaact

SEQ ID NO: 61401 - DNA, 20 bp, Artificial Sequence
  chemically synthesized
atgagcaactctgggtgggg

SEQ ID NO: 61402 - DNA, 20 bp, Artificial Sequence
  chemically synthesized
actctgggtgggggggagtg

SEQ ID NO: 61403 - DNA, 20 bp, Artificial Sequence
  chemically synthesized
tgaagatgcttggtggagcc

SEQ ID NO: 61404 - DNA, 20 bp, Artificial Sequence
  chemically synthesized
tgggcccaggtccgtaagct

SEQ ID NO: 61405 - DNA, 20 bp, Artificial Sequence
  chemically synthesized
agctgaggattcagtccccc

SEQ ID NO: 61406 - DNA, 20 bp, Artificial Sequence
  chemically synthesized
agactcagagaaaacatggg

SEQ ID NO: 61407 - DNA, 20 bp, Artificial Sequence
  chemically synthesized
tgtcatccagggagggggcc

SEQ ID NO: 61408 - DNA, 20 bp, Artificial Sequence
  chemically synthesized
gggggccagggatggagggg

SEQ ID NO: 61409 - DNA, 20 bp, Artificial Sequence
  chemically synthesized
ggagcgagaggcagttattt

SEQ ID NO: 61410 - DNA, 20 bp, Artificial Sequence
  chemically synthesized
gagaggcagttatttttggg

SEQ ID NO: 61411 - DNA, 20 bp, Artificial Sequence
  chemically synthesized
gttcaatcattaagaagaca

SEQ ID NO: 61412 - DNA, 20 bp, Artificial Sequence
  chemically synthesized
ttgttgaacttgacctcggg

SEQ ID NO: 61413 - DNA, 20 bp, Artificial Sequence
  chemically synthesized
tgacctcgggggggatagac

SEQ ID NO: 61414 - DNA, 20 bp, Artificial Sequence
  chemically synthesized
caccaaatctcacagatcga

SEQ ID NO: 61415 - DNA, 20 bp, Artificial Sequence
  chemically synthesized
ccaaacctttctgtgtcagt

SEQ ID NO: 61416 - DNA, 20 bp, Artificial Sequence
  chemically synthesized
tcttgggcaaagttgaaatt

SEQ ID NO: 61417 - DNA, 20 bp, Artificial Sequence
  chemically synthesized
tttgaccacgtcccgtgtca

SEQ ID NO: 61418 - DNA, 20 bp, Artificial Sequence
  chemically synthesized
ggcatcttcaggagctcagc

SEQ ID NO: 61419 - DNA, 20 bp, Artificial Sequence
  chemically synthesized
acattcttccctacagatac

SEQ ID NO: 61420 - DNA, 20 bp, Artificial Sequence
  chemically synthesized
ccagggtgcaacaaggtcgt

SEQ ID NO: 61421 - DNA, 20 bp, Artificial Sequence
  chemically synthesized
atctcaccttggagagcttc

SEQ ID NO: 61422 - DNA, 20 bp, Artificial Sequence
  chemically synthesized
aggttccagtaatggacagt

SEQ ID NO: 61423 - DNA, 20 bp, Artificial Sequence
  chemically synthesized
ctacttttagctcttctaca

SEQ ID NO: 61424 - DNA, 20 bp, Artificial Sequence
  chemically synthesized
agctcttctacattgagtca

SEQ ID NO: 61425 - DNA, 20 bp, Artificial Sequence
  chemically synthesized
tgagtcaaagaatgttaaca

SEQ ID NO: 61426 - DNA, 20 bp, Artificial Sequence
  chemically synthesized
tcaaagaatgttaacatcga

SEQ ID NO: 61427 - DNA, 20 bp, Artificial Sequence
  chemically synthesized
tctcatcttgccctgtagtg

SEQ ID NO: 61428 - DNA, 20 bp, Artificial Sequence
  chemically synthesized
tgcccagtgacaaccgttta

SEQ ID NO: 61429 - DNA, 20 bp, Artificial Sequence
  chemically synthesized
aaccgtttagtggataagag

SEQ ID NO: 61430 - DNA, 20 bp, Artificial Sequence
  chemically synthesized
agaagagtgaccacaccagg

SEQ ID NO: 61431 - DNA, 20 bp, Artificial Sequence
  chemically synthesized
ggagacaatgccaccctgag

SEQ ID NO: 61432 - DNA, 20 bp, Artificial Sequence
  chemically synthesized
agcagggcatgggcataatc

SEQ ID NO: 61433 - DNA, 20 bp, Artificial Sequence
  chemically synthesized
tgctgtccctgccctgggca

SEQ ID NO: 61434 - DNA, 20 bp, Artificial Sequence
  chemically synthesized
ggaagggacagtgtccacac

SEQ ID NO: 61435 - DNA, 20 bp, Artificial Sequence
  chemically synthesized
agacctttacctcctcaccc

SEQ ID NO: 61436 - DNA, 20 bp, Artificial Sequence
  chemically synthesized
tactgtcctcctcatggagc

SEQ ID NO: 61437 - DNA, 20 bp, Artificial Sequence
  chemically synthesized
ttctggaagccaagtttata

SEQ ID NO: 61438 - DNA, 20 bp, Artificial Sequence
  chemically synthesized
atacagagtagcagtgaccc

SEQ ID NO: 61439 - DNA, 20 bp, Artificial Sequence
  chemically synthesized
gtagcagtgacccagggatg

SEQ ID NO: 61440 - DNA, 20 bp, Artificial Sequence
  chemically synthesized
tcttggtcaccctcaggttg

SEQ ID NO: 61441 - DNA, 20 bp, Artificial Sequence
  chemically synthesized
aggaacttggtgatgatatc

SEQ ID NO: 61442 - DNA, 20 bp, Artificial Sequence
  chemically synthesized
acttggtgatgatatcgtgg

SEQ ID NO: 61443 - DNA, 20 bp, Artificial Sequence
  chemically synthesized
ctggacagcttcttacagtg

SEQ ID NO: 61444 - DNA, 20 bp, Artificial Sequence
  chemically synthesized
cctcggtgtccttgacttca

SEQ ID NO: 61445 - DNA, 20 bp, Artificial Sequence
  chemically synthesized
aggggaaggtgggcatcacc

SEQ ID NO: 61446 - DNA, 20 bp, Artificial Sequence
  chemically synthesized
gaaggtgggcatcaccaggg

SEQ ID NO: 61447 - DNA, 20 bp, Artificial Sequence
  chemically synthesized
aggggtgagtgaaggtttgg

SEQ ID NO: 61448 - DNA, 20 bp, Artificial Sequence
  chemically synthesized
gaaggtttggaagagtgtag

SEQ ID NO: 61449 - DNA, 20 bp, Artificial Sequence
  chemically synthesized
tgtagcagaataaagaaacc

SEQ ID NO: 61450 - DNA, 20 bp, Artificial Sequence
  chemically synthesized
gctgccgaaaaagattgtgt

SEQ ID NO: 61451 - DNA, 20 bp, Artificial Sequence
  chemically synthesized
ttcaaaactagaggaagatg

SEQ ID NO: 61452 - DNA, 20 bp, Artificial Sequence
  chemically synthesized
tcgtggctgtgcatttttat

SEQ ID NO: 61453 - DNA, 20 bp, Artificial Sequence
  chemically synthesized
ttggaatcatatgtttattt

SEQ ID NO: 61454 - DNA, 20 bp, Artificial Sequence
  chemically synthesized
tatgtttatttgagggtgtc

SEQ ID NO: 61455 - DNA, 20 bp, Artificial Sequence
  chemically synthesized
agcttcaccatcgaggcatg

SEQ ID NO: 61456 - DNA, 20 bp, Artificial Sequence
  chemically synthesized
cctcaagagcaagggagcct

SEQ ID NO: 61457 - DNA, 20 bp, Artificial Sequence
  chemically synthesized
tgggacagtgggagctggct

SEQ ID NO: 61458 - DNA, 20 bp, Artificial Sequence
  chemically synthesized
gaaggcagcctgagatacag

SEQ ID NO: 61459 - DNA, 20 bp, Artificial Sequence
  chemically synthesized
tcctaaaaaaacctgacagc

SEQ ID NO: 61460 - DNA, 20 bp, Artificial Sequence
  chemically synthesized
aaattagcacctcaaagagg

SEQ ID NO: 61461 - DNA, 20 bp, Artificial Sequence
  chemically synthesized
aaagctaattgtgttagagg

SEQ ID NO: 61462 - DNA, 20 bp, Artificial Sequence
  chemically synthesized
tgatactgattctgggacac

SEQ ID NO: 61463 - DNA, 20 bp, Artificial Sequence
  chemically synthesized
tgtttgtgtgtagaaaactg

SEQ ID NO: 61464 - DNA, 20 bp, Artificial Sequence
  chemically synthesized
gcccataatgcattgccaag

SEQ ID NO: 61465 - DNA, 20 bp, Artificial Sequence
  chemically synthesized
agttcaagaactgatggttt

SEQ ID NO: 61466 - DNA, 20 bp, Artificial Sequence
  chemically synthesized
accaaatccacaattttccc

SEQ ID NO: 61467 - DNA, 20 bp, Artificial Sequence
  chemically synthesized
gaagttgacagtgaaggctt

SEQ ID NO: 61468 - DNA, 20 bp, Artificial Sequence
  chemically synthesized
agctggctgtctggctggtt

SEQ ID NO: 61469 - DNA, 20 bp, Artificial Sequence
  chemically synthesized
ctggctggttgagggtacgg

SEQ ID NO: 61470 - DNA, 20 bp, Artificial Sequence
  chemically synthesized
aggagttcctggaagccttc

SEQ ID NO: 61471 - DNA, 20 bp, Artificial Sequence
  chemically synthesized
ccttcatggatctgagcctc

SEQ ID NO: 61472 - DNA, 20 bp, Artificial Sequence
  chemically synthesized
aggttgaaattcaggccctc

SEQ ID NO: 61473 - DNA, 20 bp, Artificial Sequence
  chemically synthesized
aggccctccaggatttcatc

SEQ ID NO: 61474 - DNA, 20 bp, Artificial Sequence
  chemically synthesized
aaggcgaactcagccaggtt

SEQ ID NO: 61475 - DNA, 20 bp, Artificial Sequence
  chemically synthesized
gggggtgatcttgttgaagg

SEQ ID NO: 61476 - DNA, 20 bp, Artificial Sequence
  chemically synthesized
ttgggtgatcctgatcatgg

SEQ ID NO: 61477 - DNA, 20 bp, Artificial Sequence
  chemically synthesized
cttctgggcagcatctccct

SEQ ID NO: 61478 - DNA, 20 bp, Artificial Sequence
  chemically synthesized
cagcacaggcctgccagcag

SEQ ID NO: 61479 - DNA, 20 bp, Artificial Sequence
  chemically synthesized
agagatgggggggccaggcc

SEQ ID NO: 61480 - DNA, 20 bp, Artificial Sequence
  chemically synthesized
catgatgactcccagtgatc

SEQ ID NO: 61481 - DNA, 20 bp, Artificial Sequence
  chemically synthesized
gacaccacgtggaagtgcct

SEQ ID NO: 61482 - DNA, 20 bp, Artificial Sequence
  chemically synthesized
gccgacatcagtaacactga

SEQ ID NO: 61483 - DNA, 20 bp, Artificial Sequence
  chemically synthesized
agtaacactgaaagaatcag

SEQ ID NO: 61484 - DNA, 20 bp, Artificial Sequence
  chemically synthesized
cactgaggaagtagcagaac

SEQ ID NO: 61485 - DNA, 20 bp, Artificial Sequence
  chemically synthesized
agaaaatgaggcacaagaag

SEQ ID NO: 61486 - DNA, 20 bp, Artificial Sequence
  chemically synthesized
gggcctgcccacgattatcc

SEQ ID NO: 61487 - DNA, 20 bp, Artificial Sequence
  chemically synthesized
atccaggaatcgggccagat

SEQ ID NO: 61488 - DNA, 20 bp, Artificial Sequence
  chemically synthesized
aatcgggccagatcagaatc

SEQ ID NO: 61489 - DNA, 20 bp, Artificial Sequence
  chemically synthesized
tgttcccacccaacactcac

SEQ ID NO: 61490 - DNA, 20 bp, Artificial Sequence
  chemically synthesized
tcacaaggatcctcagccct

SEQ ID NO: 61491 - DNA, 20 bp, Artificial Sequence
  chemically synthesized
tgctctgtggtcccagacac

SEQ ID NO: 61492 - DNA, 20 bp, Artificial Sequence
  chemically synthesized
gcagtcagcttacctgccgt

SEQ ID NO: 61493 - DNA, 20 bp, Artificial Sequence
  chemically synthesized
gctcatctctccttgaaagc

SEQ ID NO: 61494 - DNA, 20 bp, Artificial Sequence
  chemically synthesized
cttttaacttcagatagacc

SEQ ID NO: 61495 - DNA, 20 bp, Artificial Sequence
  chemically synthesized
ataaagtgatgtttatgtat

SEQ ID NO: 61496 - DNA, 20 bp, Artificial Sequence
  chemically synthesized
aacaccaaaccttacatcaa

SEQ ID NO: 61497 - DNA, 20 bp, Artificial Sequence
  chemically synthesized
gagggcaactcttttgaggg

SEQ ID NO: 61498 - DNA, 20 bp, Artificial Sequence
  chemically synthesized
cttcaggtgataggccagtg

SEQ ID NO: 61499 - DNA, 20 bp, Artificial Sequence
  chemically synthesized
tacccggggctgagacaata

SEQ ID NO: 61500 - DNA, 20 bp, Artificial Sequence
  chemically synthesized
aaactgaggtcctagctgag

SEQ ID NO: 61501 - DNA, 20 bp, Artificial Sequence
  chemically synthesized
atacaaagaaaaaggtgtcc

SEQ ID NO: 61502 - DNA, 20 bp, Artificial Sequence
  chemically synthesized
acagggctcagtggtcagga

SEQ ID NO: 61503 - DNA, 20 bp, Artificial Sequence
  chemically synthesized
aggagggagttgggcctctg

SEQ ID NO: 61504 - DNA, 20 bp, Artificial Sequence
  chemically synthesized
gggtggggacactaaatatg

SEQ ID NO: 61505 - DNA, 20 bp, Artificial Sequence
  chemically synthesized
ctatccacttggcctttagc

SEQ ID NO: 61506 - DNA, 20 bp, Artificial Sequence
  chemically synthesized
ctgtacactaacataggttt

SEQ ID NO: 61507 - DNA, 20 bp, Artificial Sequence
  chemically synthesized
tttttgggttttttttgaga

SEQ ID NO: 61508 - DNA, 20 bp, Artificial Sequence
  chemically synthesized
cagagtctcgctttatctgc

SEQ ID NO: 61509 - DNA, 20 bp, Artificial Sequence
  chemically synthesized
tctcgctttatctgccaggg

SEQ ID NO: 61510 - DNA, 20 bp, Artificial Sequence
  chemically synthesized
ctcactgaaacctccacctc

SEQ ID NO: 61511 - DNA, 20 bp, Artificial Sequence
  chemically synthesized
gtctcagcttcccaaatagc

SEQ ID NO: 61512 - DNA, 20 bp, Artificial Sequence
  chemically synthesized
gccttggcctcccaaagtgc

SEQ ID NO: 61513 - DNA, 20 bp, Artificial Sequence
  chemically synthesized
cgagagcccctgcacccagc

SEQ ID NO: 61514 - DNA, 20 bp, Artificial Sequence
  chemically synthesized
acccagccaggattcttggt

SEQ ID NO: 61515 - DNA, 20 bp, Artificial Sequence
  chemically synthesized
attcttggttagaatggcat

SEQ ID NO: 61516 - DNA, 20 bp, Artificial Sequence
  chemically synthesized
tcaatgtagcaaaacagatg

SEQ ID NO: 61517 - DNA, 20 bp, Artificial Sequence
  chemically synthesized
acaggtgccctcctagacag

SEQ ID NO: 61518 - DNA, 20 bp, Artificial Sequence
  chemically synthesized
ggtggagaggctggtgcagg

SEQ ID NO: 61519 - DNA, 20 bp, Artificial Sequence
  chemically synthesized
tggtgcagggagggtggcga

SEQ ID NO: 61520 - DNA, 20 bp, Artificial Sequence
  chemically synthesized
ggtttcctcctttcacagtg

SEQ ID NO: 61521 - DNA, 20 bp, Artificial Sequence
  chemically synthesized
tgaagagtttgaagcccaga

SEQ ID NO: 61522 - DNA, 20 bp, Artificial Sequence
  chemically synthesized
gtgtcctcagatctcagatg

SEQ ID NO: 61523 - DNA, 20 bp, Artificial Sequence
  chemically synthesized
agatctcagatgatgaatgt

SEQ ID NO: 61524 - DNA, 20 bp, Artificial Sequence
  chemically synthesized
cattggtctcaagcatcatg

SEQ ID NO: 61525 - DNA, 20 bp, Artificial Sequence
  chemically synthesized
gaggccaagctttaaaccaa

SEQ ID NO: 61526 - DNA, 20 bp, Artificial Sequence
  chemically synthesized
aggcttcatggtgacatttc

SEQ ID NO: 61527 - DNA, 20 bp, Artificial Sequence
  chemically synthesized
agggaccaagagcaacccgg

SEQ ID NO: 61528 - DNA, 20 bp, Artificial Sequence
  chemically synthesized
acccggcagggtgcagggaa

SEQ ID NO: 61529 - DNA, 20 bp, Artificial Sequence
  chemically synthesized
tcacttactggcagggggcc

SEQ ID NO: 61530 - DNA, 20 bp, Artificial Sequence
  chemically synthesized
catagctgtacaatggagaa

SEQ ID NO: 61531 - DNA, 20 bp, Artificial Sequence
  chemically synthesized
gagaaaagaatcctttggac

SEQ ID NO: 61532 - DNA, 20 bp, Artificial Sequence
  chemically synthesized
gaatcctttggacagggatg

SEQ ID NO: 61533 - DNA, 20 bp, Artificial Sequence
  chemically synthesized
aggaataactgacgtaatgc

SEQ ID NO: 61534 - DNA, 20 bp, Artificial Sequence
  chemically synthesized
tgctcagcagtgaacagcat

SEQ ID NO: 61535 - DNA, 20 bp, Artificial Sequence
  chemically synthesized
gtaatcctaaatgttttgtc

SEQ ID NO: 61536 - DNA, 20 bp, Artificial Sequence
  chemically synthesized
tttcactccaaaacctgaca

SEQ ID NO: 61537 - DNA, 20 bp, Artificial Sequence
  chemically synthesized
caaagctgaagccagaagtc

SEQ ID NO: 61538 - DNA, 20 bp, Artificial Sequence
  chemically synthesized
ctgctgcgcagcaagttctc

SEQ ID NO: 61539 - DNA, 20 bp, Artificial Sequence
  chemically synthesized
caacacttcagagatcaagg

SEQ ID NO: 61540 - DNA, 20 bp, Artificial Sequence
  chemically synthesized
cttcagagatcaaggtcggg

SEQ ID NO: 61541 - DNA, 20 bp, Artificial Sequence
  chemically synthesized
gtgacactagggccaggttc

SEQ ID NO: 61542 - DNA, 20 bp, Artificial Sequence
  chemically synthesized
ctggagccaggtgcctgagc

SEQ ID NO: 61543 - DNA, 20 bp, Artificial Sequence
  chemically synthesized
caggtgcctgagcccgaatt

SEQ ID NO: 61544 - DNA, 20 bp, Artificial Sequence
  chemically synthesized
atcttcctcatctgtaaaat

SEQ ID NO: 61545 - DNA, 20 bp, Artificial Sequence
  chemically synthesized
tcacactagtaactgccttg

SEQ ID NO: 61546 - DNA, 20 bp, Artificial Sequence
  chemically synthesized
ctggtgcagagcgattattc

SEQ ID NO: 61547 - DNA, 20 bp, Artificial Sequence
  chemically synthesized
caggaatgccagcttgagcc

SEQ ID NO: 61548 - DNA, 20 bp, Artificial Sequence
  chemically synthesized
tgttcctggtcatatctgga

SEQ ID NO: 61549 - DNA, 20 bp, Artificial Sequence
  chemically synthesized
ggtcatatctggaggggatg

SEQ ID NO: 61550 - DNA, 20 bp, Artificial Sequence
  chemically synthesized
ttggctggtgtcccccatcc

SEQ ID NO: 61551 - DNA, 20 bp, Artificial Sequence
  chemically synthesized
tctgccctgcacctcagcag

SEQ ID NO: 61552 - DNA, 20 bp, Artificial Sequence
  chemically synthesized
tcctcgtccgtatttaagca

SEQ ID NO: 61553 - DNA, 20 bp, Artificial Sequence
  chemically synthesized
ggcaacgggggaggctgctg

SEQ ID NO: 61554 - DNA, 20 bp, Artificial Sequence
  chemically synthesized
caggggctaagtccactggc

SEQ ID NO: 61555 - DNA, 20 bp, Artificial Sequence
  chemically synthesized
ctaagtccactggctgggat

SEQ ID NO: 61556 - DNA, 20 bp, Artificial Sequence
  chemically synthesized
cttccactgcacttaccgaa

SEQ ID NO: 61557 - DNA, 20 bp, Artificial Sequence
  chemically synthesized
cgtcctgtgtccaaggtgga

SEQ ID NO: 61558 - DNA, 20 bp, Artificial Sequence
  chemically synthesized
tccaaggtggagggggtggc

SEQ ID NO: 61559 - DNA, 20 bp, Artificial Sequence
  chemically synthesized
gtgagtcagacagtctctgg

SEQ ID NO: 61560 - DNA, 20 bp, Artificial Sequence
  chemically synthesized
ctggccctctgctctcactg

SEQ ID NO: 61561 - DNA, 20 bp, Artificial Sequence
  chemically synthesized
gtagcaagatctaccattta

SEQ ID NO: 61562 - DNA, 20 bp, Artificial Sequence
  chemically synthesized
ttactgccgccctgggagat

SEQ ID NO: 61563 - DNA, 20 bp, Artificial Sequence
  chemically synthesized
tgccgccctgggagatcaga

SEQ ID NO: 61564 - DNA, 20 bp, Artificial Sequence
  chemically synthesized
tggcatggggggccgtgaga

SEQ ID NO: 61565 - DNA, 20 bp, Artificial Sequence
  chemically synthesized
actgtttcacctgcatccca

SEQ ID NO: 61566 - DNA, 20 bp, Artificial Sequence
  chemically synthesized
aagcatgcttgtgaagtgcc

SEQ ID NO: 61567 - DNA, 20 bp, Artificial Sequence
  chemically synthesized
gcacacagtaggctctttat

SEQ ID NO: 61568 - DNA, 20 bp, Artificial Sequence
  chemically synthesized
agtgtgatccgtatacagct

SEQ ID NO: 61569 - DNA, 20 bp, Artificial Sequence
  chemically synthesized
gtatacagcttggagtttct

SEQ ID NO: 61570 - DNA, 20 bp, Artificial Sequence
  chemically synthesized
tggatacatggcccccactc

SEQ ID NO: 61571 - DNA, 20 bp, Artificial Sequence
  chemically synthesized
ggaggcctttggagactgct

SEQ ID NO: 61572 - DNA, 20 bp, Artificial Sequence
  chemically synthesized
ggtggaggggaggggaggta

SEQ ID NO: 61573 - DNA, 20 bp, Artificial Sequence
  chemically synthesized
gtacgtgccgtagatacttg

SEQ ID NO: 61574 - DNA, 20 bp, Artificial Sequence
  chemically synthesized
gtgccgtagatacttgcaga

SEQ ID NO: 61575 - DNA, 20 bp, Artificial Sequence
  chemically synthesized
cgtagatacttgcagagtga

SEQ ID NO: 61576 - DNA, 20 bp, Artificial Sequence
  chemically synthesized
gatacttgcagagtgaatgg

SEQ ID NO: 61577 - DNA, 20 bp, Artificial Sequence
  chemically synthesized
ccaccttggggctctaccag

SEQ ID NO: 61578 - DNA, 20 bp, Artificial Sequence
  chemically synthesized
tctaccaggcgagtgaccca

SEQ ID NO: 61579 - DNA, 20 bp, Artificial Sequence
  chemically synthesized
tactggctgtgaggcctcag

SEQ ID NO: 61580 - DNA, 20 bp, Artificial Sequence
  chemically synthesized
aatttccctatctgtaaaat

SEQ ID NO: 61581 - DNA, 20 bp, Artificial Sequence
  chemically synthesized
gtaccttgttgagctgctgt

SEQ ID NO: 61582 - DNA, 20 bp, Artificial Sequence
  chemically synthesized
agttcaaggaaagctcagag

SEQ ID NO: 61583 - DNA, 20 bp, Artificial Sequence
  chemically synthesized
ggaaagctcagagacgggta

SEQ ID NO: 61584 - DNA, 20 bp, Artificial Sequence
  chemically synthesized
gtgtcaggggctggtgtcac

SEQ ID NO: 61585 - DNA, 20 bp, Artificial Sequence
  chemically synthesized
aggggctggtgtcactgggg

SEQ ID NO: 61586 - DNA, 20 bp, Artificial Sequence
  chemically synthesized
tcattcagttaccctgtgaa

SEQ ID NO: 61587 - DNA, 20 bp, Artificial Sequence
  chemically synthesized
ctgtccttcccctgagctgg

SEQ ID NO: 61588 - DNA, 20 bp, Artificial Sequence
  chemically synthesized
ccttcccctgagctggctga

SEQ ID NO: 61589 - DNA, 20 bp, Artificial Sequence
  chemically synthesized
tgtccctcccacctgtggaa

SEQ ID NO: 61590 - DNA, 20 bp, Artificial Sequence
  chemically synthesized
gtctcttctggcaggcacag

SEQ ID NO: 61591 - DNA, 20 bp, Artificial Sequence
  chemically synthesized
aggttgccgcccctccaacc

SEQ ID NO: 61592 - DNA, 20 bp, Artificial Sequence
  chemically synthesized
ttggttcagctcaggactct

SEQ ID NO: 61593 - DNA, 20 bp, Artificial Sequence
  chemically synthesized
gcccacccaggaagtagact

SEQ ID NO: 61594 - DNA, 20 bp, Artificial Sequence
  chemically synthesized
ggacaagtcaccctctccct

SEQ ID NO: 61595 - DNA, 20 bp, Artificial Sequence
  chemically synthesized
aggtacagtcacactgccca

SEQ ID NO: 61596 - DNA, 20 bp, Artificial Sequence
  chemically synthesized
gtgtgtgtcataggacctgg

SEQ ID NO: 61597 - DNA, 20 bp, Artificial Sequence
  chemically synthesized
aggacctggctgggtgcaga

SEQ ID NO: 61598 - DNA, 20 bp, Artificial Sequence
  chemically synthesized
ggagctggggcttttggagg

SEQ ID NO: 61599 - DNA, 20 bp, Artificial Sequence
  chemically synthesized
ggaggaggaatgaagaaagc

SEQ ID NO: 61600 - DNA, 20 bp, Artificial Sequence
  chemically synthesized
ggtgaggcaagtaaggggct

SEQ ID NO: 61601 - DNA, 20 bp, Artificial Sequence
  chemically synthesized
caagtaaggggctcagaatt

SEQ ID NO: 61602 - DNA, 20 bp, Artificial Sequence
  chemically synthesized
tccatcctgggaggaagggc

SEQ ID NO: 61603 - DNA, 20 bp, Artificial Sequence
  chemically synthesized
acgcaccaggacaaaatccc

SEQ ID NO: 61604 - DNA, 20 bp, Artificial Sequence
  chemically synthesized
atcccgggggttgtggtggg

SEQ ID NO: 61605 - DNA, 20 bp, Artificial Sequence
  chemically synthesized
ggggttgtggtgggaggggt

SEQ ID NO: 61606 - DNA, 20 bp, Artificial Sequence
  chemically synthesized
agtactcagtggccattcac

SEQ ID NO: 61607 - DNA, 20 bp, Artificial Sequence
  chemically synthesized
gaagatcctgtgagctggtc

SEQ ID NO: 61608 - DNA, 20 bp, Artificial Sequence
  chemically synthesized
tgggagcctcgtggtatggg

SEQ ID NO: 61609 - DNA, 20 bp, Artificial Sequence
  chemically synthesized
cctcgtggtatgggctggat

SEQ ID NO: 61610 - DNA, 20 bp, Artificial Sequence
  chemically synthesized
tatgggctggatagggatgt

SEQ ID NO: 61611 - DNA, 20 bp, Artificial Sequence
  chemically synthesized
gggatgtgagagtcgagatt

SEQ ID NO: 61612 - DNA, 20 bp, Artificial Sequence
  chemically synthesized
gagatttggggtctgcagca

SEQ ID NO: 61613 - DNA, 20 bp, Artificial Sequence
  chemically synthesized
ttggggtctgcagcaaggaa

SEQ ID NO: 61614 - DNA, 20 bp, Artificial Sequence
  chemically synthesized
tgcagcaaggaatcgggtaa

SEQ ID NO: 61615 - DNA, 20 bp, Artificial Sequence
  chemically synthesized
ctgggccaagtaaatcaaga

SEQ ID NO: 61616 - DNA, 20 bp, Artificial Sequence
  chemically synthesized
tcattggcaaagtgcccccg

SEQ ID NO: 61617 - DNA, 20 bp, Artificial Sequence
  chemically synthesized
aggcaccagcttccttcttt

SEQ ID NO: 61618 - DNA, 20 bp, Artificial Sequence
  chemically synthesized
tgcaggtcactggttaaggc

SEQ ID NO: 61619 - DNA, 20 bp, Artificial Sequence
  chemically synthesized
cactggttaaggcgtgggtt

SEQ ID NO: 61620 - DNA, 20 bp, Artificial Sequence
  chemically synthesized
tgagataggaagactctaag

SEQ ID NO: 61621 - DNA, 20 bp, Artificial Sequence
  chemically synthesized
ttccatcaggactgtgaaga

SEQ ID NO: 61622 - DNA, 20 bp, Artificial Sequence
  chemically synthesized
caccaaaggccatgaccttt

SEQ ID NO: 61623 - DNA, 20 bp, Artificial Sequence
  chemically synthesized
ggctctgaaaaaccatatag

SEQ ID NO: 61624 - DNA, 20 bp, Artificial Sequence
  chemically synthesized
aaaccatatagatgggtctc

SEQ ID NO: 61625 - DNA, 20 bp, Artificial Sequence
  chemically synthesized
ctgagcacctgtgacatgca

SEQ ID NO: 61626 - DNA, 20 bp, Artificial Sequence
  chemically synthesized
cctgtgacatgcagaggatg

SEQ ID NO: 61627 - DNA, 20 bp, Artificial Sequence
  chemically synthesized
gtgactgcagctaggtggac

SEQ ID NO: 61628 - DNA, 20 bp, Artificial Sequence
  chemically synthesized
ggtttcctcatctataaaat

SEQ ID NO: 61629 - DNA, 20 bp, Artificial Sequence
  chemically synthesized
cttagatgaggcgatgctgg

SEQ ID NO: 61630 - DNA, 20 bp, Artificial Sequence
  chemically synthesized
gtcttcttataactcattta

SEQ ID NO: 61631 - DNA, 20 bp, Artificial Sequence
  chemically synthesized
tcttataactcatttaatga

SEQ ID NO: 61632 - DNA, 20 bp, Artificial Sequence
  chemically synthesized
tgtgtgttggggaggggagg

SEQ ID NO: 61633 - DNA, 20 bp, Artificial Sequence
  chemically synthesized
ttttttttttttttttgaga

SEQ ID NO: 61634 - DNA, 20 bp, Artificial Sequence
  chemically synthesized
tctcactcagtcacccaggc

SEQ ID NO: 61635 - DNA, 20 bp, Artificial Sequence
  chemically synthesized
cttactgcaaactccacctc

SEQ ID NO: 61636 - DNA, 20 bp, Artificial Sequence
  chemically synthesized
aaactccacctctcgaattc

SEQ ID NO: 61637 - DNA, 20 bp, Artificial Sequence
  chemically synthesized
gattctcgtgcctcagcctc

SEQ ID NO: 61638 - DNA, 20 bp, Artificial Sequence
  chemically synthesized
ttttgtatttttagtagtga

SEQ ID NO: 61639 - DNA, 20 bp, Artificial Sequence
  chemically synthesized
gcctcggcctcccaaagtgc

SEQ ID NO: 61640 - DNA, 20 bp, Artificial Sequence
  chemically synthesized
ggggcaacatagttaaaaga

SEQ ID NO: 61641 - DNA, 20 bp, Artificial Sequence
  chemically synthesized
tatgggccttgatggtcatt

SEQ ID NO: 61642 - DNA, 20 bp, Artificial Sequence
  chemically synthesized
cttgccccaagacatggcac

SEQ ID NO: 61643 - DNA, 20 bp, Artificial Sequence
  chemically synthesized
ttcagaaatacatgccctgc

SEQ ID NO: 61644 - DNA, 20 bp, Artificial Sequence
  chemically synthesized
cccacgcagggcatgtattt

SEQ ID NO: 61645 - DNA, 20 bp, Artificial Sequence
  chemically synthesized
taataagccctcaagtcctg

SEQ ID NO: 61646 - DNA, 20 bp, Artificial Sequence
  chemically synthesized
gtctcccatagtccccacgc

SEQ ID NO: 61647 - DNA, 20 bp, Artificial Sequence
  chemically synthesized
cccatagtccccacgcaagg

SEQ ID NO: 61648 - DNA, 20 bp, Artificial Sequence
  chemically synthesized
acatcagcagagattgtcaa

SEQ ID NO: 61649 - DNA, 20 bp, Artificial Sequence
  chemically synthesized
gggataaagagataacttaa

SEQ ID NO: 61650 - DNA, 20 bp, Artificial Sequence
  chemically synthesized
ttatagttcaataggacaca

SEQ ID NO: 61651 - DNA, 20 bp, Artificial Sequence
  chemically synthesized
atcaaggcccataacctcaa

SEQ ID NO: 61652 - DNA, 20 bp, Artificial Sequence
  chemically synthesized
aaggttagctgcaataaaac

SEQ ID NO: 61653 - DNA, 20 bp, Artificial Sequence
  chemically synthesized
tttagtaattttaacaagaa

SEQ ID NO: 61654 - DNA, 20 bp, Artificial Sequence
  chemically synthesized
tttgccttatttttctctgt

SEQ ID NO: 61655 - DNA, 20 bp, Artificial Sequence
  chemically synthesized
ttatttttctctgtctgagt

SEQ ID NO: 61656 - DNA, 20 bp, Artificial Sequence
  chemically synthesized
tctctgtctgagtaaggata

SEQ ID NO: 61657 - DNA, 20 bp, Artificial Sequence
  chemically synthesized
cgggcagataacttgaggcc

SEQ ID NO: 61658 - DNA, 20 bp, Artificial Sequence
  chemically synthesized
ctaaaaatacaaaaattaac

SEQ ID NO: 61659 - DNA, 20 bp, Artificial Sequence
  chemically synthesized
tactctggaggctgaggcac

SEQ ID NO: 61660 - DNA, 20 bp, Artificial Sequence
  chemically synthesized
acgagaatcgctcgtaattc

SEQ ID NO: 61661 - DNA, 20 bp, Artificial Sequence
  chemically synthesized
taattccagaattcgagagg

SEQ ID NO: 61662 - DNA, 20 bp, Artificial Sequence
  chemically synthesized
ttgcgccactgtactccagc

SEQ ID NO: 61663 - DNA, 20 bp, Artificial Sequence
  chemically synthesized
ctgtactccagcctgggtga

SEQ ID NO: 61664 - DNA, 20 bp, Artificial Sequence
  chemically synthesized
aaaaaaaaaaagaagaagct

SEQ ID NO: 61665 - DNA, 20 bp, Artificial Sequence
  chemically synthesized
cagaaggaaagtgtgtctgc

SEQ ID NO: 61666 - DNA, 20 bp, Artificial Sequence
  chemically synthesized
aaacttcattcattcattaa

SEQ ID NO: 61667 - DNA, 20 bp, Artificial Sequence
  chemically synthesized
cagagaactgagggcctccc

SEQ ID NO: 61668 - DNA, 20 bp, Artificial Sequence
  chemically synthesized
atgagcacggcccctaaaga

SEQ ID NO: 61669 - DNA, 20 bp, Artificial Sequence
  chemically synthesized
tttctggaaaaaatggaagt

SEQ ID NO: 61670 - DNA, 20 bp, Artificial Sequence
  chemically synthesized
ctgatggaagtgactcttct

SEQ ID NO: 61671 - DNA, 20 bp, Artificial Sequence
  chemically synthesized
ggaagctggtgcctgggaag

SEQ ID NO: 61672 - DNA, 20 bp, Artificial Sequence
  chemically synthesized
tgggaaggagggtgcatagt

SEQ ID NO: 61673 - DNA, 20 bp, Artificial Sequence
  chemically synthesized
gtgcatagtgagggtgtgca

SEQ ID NO: 61674 - DNA, 20 bp, Artificial Sequence
  chemically synthesized
gcatggggtgtgtgtgtttg

SEQ ID NO: 61675 - DNA, 20 bp, Artificial Sequence
  chemically synthesized
tctccgggggcactttgcca

SEQ ID NO: 61676 - DNA, 20 bp, Artificial Sequence
  chemically synthesized
ccttactcatgaccagctca

SEQ ID NO: 61677 - DNA, 20 bp, Artificial Sequence
  chemically synthesized
ccatgatgcatttcctctgg

SEQ ID NO: 61678 - DNA, 20 bp, Artificial Sequence
  chemically synthesized
agactttccccctcatgtcc

SEQ ID NO: 61679 - DNA, 20 bp, Artificial Sequence
  chemically synthesized
cctgggggcacagtatcctt

SEQ ID NO: 61680 - DNA, 20 bp, Artificial Sequence
  chemically synthesized
agtatccttgtgaatggcca

SEQ ID NO: 61681 - DNA, 20 bp, Artificial Sequence
  chemically synthesized
acccctcccaccacaacccc

SEQ ID NO: 61682 - DNA, 20 bp, Artificial Sequence
  chemically synthesized
attatcctagcccttcctcc

SEQ ID NO: 61683 - DNA, 20 bp, Artificial Sequence
  chemically synthesized
tcctagcccttcctcccagg

SEQ ID NO: 61684 - DNA, 20 bp, Artificial Sequence
  chemically synthesized
cttgcggcaactcaaaggga

SEQ ID NO: 61685 - DNA, 20 bp, Artificial Sequence
  chemically synthesized
aagggagagggtgacttgtc

SEQ ID NO: 61686 - DNA, 20 bp, Artificial Sequence
  chemically synthesized
caggtgacatgccgggctgt

SEQ ID NO: 61687 - DNA, 20 bp, Artificial Sequence
  chemically synthesized
ctccacccgaagtctacttc

SEQ ID NO: 61688 - DNA, 20 bp, Artificial Sequence
  chemically synthesized
tgcctccacgcagcaaccct

SEQ ID NO: 61689 - DNA, 20 bp, Artificial Sequence
  chemically synthesized
agctgaaccaagaaggagga

SEQ ID NO: 61690 - DNA, 20 bp, Artificial Sequence
  chemically synthesized
gcctagccgctgctgctgcc

SEQ ID NO: 61691 - DNA, 20 bp, Artificial Sequence
  chemically synthesized
gtgggagggacagcagggct

SEQ ID NO: 61692 - DNA, 20 bp, Artificial Sequence
  chemically synthesized
gggacagcagggcttagagt

SEQ ID NO: 61693 - DNA, 20 bp, Artificial Sequence
  chemically synthesized
cacagcccagtgctggagct

SEQ ID NO: 61694 - DNA, 20 bp, Artificial Sequence
  chemically synthesized
gcccagtgctggagctgtga

SEQ ID NO: 61695 - DNA, 20 bp, Artificial Sequence
  chemically synthesized
tgtgagtggatgtagagcag

SEQ ID NO: 61696 - DNA, 20 bp, Artificial Sequence
  chemically synthesized
ggacaggggccctgaagcca

SEQ ID NO: 61697 - DNA, 20 bp, Artificial Sequence
  chemically synthesized
gagctcagagagaaggggag

SEQ ID NO: 61698 - DNA, 20 bp, Artificial Sequence
  chemically synthesized
agtttcccgctgcctgaaag

SEQ ID NO: 61699 - DNA, 20 bp, Artificial Sequence
  chemically synthesized
ggtggtacctactcccttca

SEQ ID NO: 61700 - DNA, 20 bp, Artificial Sequence
  chemically synthesized
ctactcccttcacagggtaa

SEQ ID NO: 61701 - DNA, 20 bp, Artificial Sequence
  chemically synthesized
tgaggcctcacagccagtaa

SEQ ID NO: 61702 - DNA, 20 bp, Artificial Sequence
  chemically synthesized
cagtaagtgggttccctggt

SEQ ID NO: 61703 - DNA, 20 bp, Artificial Sequence
  chemically synthesized
tggtctgaatgtgtgtgctg

SEQ ID NO: 61704 - DNA, 20 bp, Artificial Sequence
  chemically synthesized
tgtgtgtgctggaggatcct

SEQ ID NO: 61705 - DNA, 20 bp, Artificial Sequence
  chemically synthesized
tggaggcataaatgggactg

SEQ ID NO: 61706 - DNA, 20 bp, Artificial Sequence
  chemically synthesized
gccagctcccaagcaggttt

SEQ ID NO: 61707 - DNA, 20 bp, Artificial Sequence
  chemically synthesized
aatctgatttaggcttttaa

SEQ ID NO: 61708 - DNA, 20 bp, Artificial Sequence
  chemically synthesized
ccaaaggcctccaacaaccc

SEQ ID NO: 61709 - DNA, 20 bp, Artificial Sequence
  chemically synthesized
aaagaaactccaagctgtat

SEQ ID NO: 61710 - DNA, 20 bp, Artificial Sequence
  chemically synthesized
ggcacttcacaagcatgctt

SEQ ID NO: 61711 - DNA, 20 bp, Artificial Sequence
  chemically synthesized
gaatgaaacttccaactctt

SEQ ID NO: 61712 - DNA, 20 bp, Artificial Sequence
  chemically synthesized
ttttccatcgggaccatcaa

SEQ ID NO: 61713 - DNA, 20 bp, Artificial Sequence
  chemically synthesized
gtgtttgtgtctaaggctga

SEQ ID NO: 61714 - DNA, 20 bp, Artificial Sequence
  chemically synthesized
ctaaggctgactgggtaact

SEQ ID NO: 61715 - DNA, 20 bp, Artificial Sequence
  chemically synthesized
gtcttcagcatcaggcattt

SEQ ID NO: 61716 - DNA, 20 bp, Artificial Sequence
  chemically synthesized
ctaccagtggaacagccact

SEQ ID NO: 61717 - DNA, 20 bp, Artificial Sequence
  chemically synthesized
ctgtttgctcctccgataac

SEQ ID NO: 61718 - DNA, 20 bp, Artificial Sequence
  chemically synthesized
cagcctcccccgttgcccct

SEQ ID NO: 61719 - DNA, 20 bp, Artificial Sequence
  chemically synthesized
accaccactgacctgggaca

SEQ ID NO: 61720 - DNA, 20 bp, Artificial Sequence
  chemically synthesized
cagcaggtctggggcaggag

SEQ ID NO: 61721 - DNA, 20 bp, Artificial Sequence
  chemically synthesized
ctggggcaggaggggggttg

SEQ ID NO: 61722 - DNA, 20 bp, Artificial Sequence
  chemically synthesized
ggcaggaggggggttgtgga

SEQ ID NO: 61723 - DNA, 20 bp, Artificial Sequence
  chemically synthesized
ttcataataacagcagccat

SEQ ID NO: 61724 - DNA, 20 bp, Artificial Sequence
  chemically synthesized
tcccccctcggtacctcctg

SEQ ID NO: 61725 - DNA, 20 bp, Artificial Sequence
  chemically synthesized
actggttcctgtaagcagaa

SEQ ID NO: 61726 - DNA, 20 bp, Artificial Sequence
  chemically synthesized
tcctgtaagcagaagtggat

SEQ ID NO: 61727 - DNA, 20 bp, Artificial Sequence
  chemically synthesized
ggtctgcagtcctggcaccc

SEQ ID NO: 61728 - DNA, 20 bp, Artificial Sequence
  chemically synthesized
gaggaggttaaggtccagag

SEQ ID NO: 61729 - DNA, 20 bp, Artificial Sequence
  chemically synthesized
cagggctcaagctggcattc

SEQ ID NO: 61730 - DNA, 20 bp, Artificial Sequence
  chemically synthesized
aggaagatggggacagagag

SEQ ID NO: 61731 - DNA, 20 bp, Artificial Sequence
  chemically synthesized
ccctagtgtcactgtttctc

SEQ ID NO: 61732 - DNA, 20 bp, Artificial Sequence
  chemically synthesized
tttctcttgggtctcaggcg

SEQ ID NO: 61733 - DNA, 20 bp, Artificial Sequence
  chemically synthesized
cttgatctctgaagtgttgg

SEQ ID NO: 61734 - DNA, 20 bp, Artificial Sequence
  chemically synthesized
aggatttaatttttcctgca

SEQ ID NO: 61735 - DNA, 20 bp, Artificial Sequence
  chemically synthesized
gatgattcaatgtcaggttt

SEQ ID NO: 61736 - DNA, 20 bp, Artificial Sequence
  chemically synthesized
ttaatcccagacaaaacatt

SEQ ID NO: 61737 - DNA, 20 bp, Artificial Sequence
  chemically synthesized
aagtagctctgtgattttta

SEQ ID NO: 61738 - DNA, 20 bp, Artificial Sequence
  chemically synthesized
ggctaataatttgcacctta

SEQ ID NO: 61739 - DNA, 20 bp, Artificial Sequence
  chemically synthesized
aggctgatgtttgcttagca

SEQ ID NO: 61740 - DNA, 20 bp, Artificial Sequence
  chemically synthesized
agctggcaggcagtaaacag

SEQ ID NO: 61741 - DNA, 20 bp, Artificial Sequence
  chemically synthesized
ttcctgctgaaatggtcctg

SEQ ID NO: 61742 - DNA, 20 bp, Artificial Sequence
  chemically synthesized
ttattcctcatccctgtcca

SEQ ID NO: 61743 - DNA, 20 bp, Artificial Sequence
  chemically synthesized
gtgacagggcctggtcacac

SEQ ID NO: 61744 - DNA, 20 bp, Artificial Sequence
  chemically synthesized
attctcttccctgcaccctg

SEQ ID NO: 61745 - DNA, 20 bp, Artificial Sequence
  chemically synthesized
tggtcccttattttatgctc

SEQ ID NO: 61746 - DNA, 20 bp, Artificial Sequence
  chemically synthesized
aaatggtgtgagattaggca

SEQ ID NO: 61747 - DNA, 20 bp, Artificial Sequence
  chemically synthesized
tccctgtccctggccccgca

SEQ ID NO: 61748 - DNA, 20 bp, Artificial Sequence
  chemically synthesized
gcctcagtgtccgtacacca

SEQ ID NO: 61749 - DNA, 20 bp, Artificial Sequence
  chemically synthesized
cctcccaggcactagctttt

SEQ ID NO: 61750 - DNA, 20 bp, Artificial Sequence
  chemically synthesized
ggcactagcttttaggagtg

SEQ ID NO: 61751 - DNA, 20 bp, Artificial Sequence
  chemically synthesized
ggccaggagagagcaggttt

SEQ ID NO: 61752 - DNA, 20 bp, Artificial Sequence
  chemically synthesized
cagctgtctcagttcatgat

SEQ ID NO: 61753 - DNA, 20 bp, Artificial Sequence
  chemically synthesized
tcactgtgaaaggaggaaac

SEQ ID NO: 61754 - DNA, 20 bp, Artificial Sequence
  chemically synthesized
gtgatgtgacaccaggaaag

SEQ ID NO: 61755 - DNA, 20 bp, Artificial Sequence
  chemically synthesized
tgtgacaccaggaaagatgg

SEQ ID NO: 61756 - DNA, 20 bp, Artificial Sequence
  chemically synthesized
ggaaagatggatgggtgtgg

SEQ ID NO: 61757 - DNA, 20 bp, Artificial Sequence
  chemically synthesized
ctctccacctcctttgagcc

SEQ ID NO: 61758 - DNA, 20 bp, Artificial Sequence
  chemically synthesized
cctgtctcatgcctagccat

SEQ ID NO: 61759 - DNA, 20 bp, Artificial Sequence
  chemically synthesized
acccagatgccattctaacc

SEQ ID NO: 61760 - DNA, 20 bp, Artificial Sequence
  chemically synthesized
attctaaccaagaatcctgg

SEQ ID NO: 61761 - DNA, 20 bp, Artificial Sequence
  chemically synthesized
actttgggaggccaaggcag

SEQ ID NO: 61762 - DNA, 20 bp, Artificial Sequence
  chemically synthesized
ggcaggcggatcaagaggtc

SEQ ID NO: 61763 - DNA, 20 bp, Artificial Sequence
  chemically synthesized
tatttgggaagctgagacag

SEQ ID NO: 61764 - DNA, 20 bp, Artificial Sequence
  chemically synthesized
ccccactttgcacaactggg

SEQ ID NO: 61765 - DNA, 20 bp, Artificial Sequence
  chemically synthesized
agagtgaggccccaggacca

SEQ ID NO: 61766 - DNA, 20 bp, Artificial Sequence
  chemically synthesized
ggattcttgctaaaggccaa

SEQ ID NO: 61767 - DNA, 20 bp, Artificial Sequence
  chemically synthesized
actgagccctgtaatgatgg

SEQ ID NO: 61768 - DNA, 20 bp, Artificial Sequence
  chemically synthesized
taatgtgtggtctgttccat

SEQ ID NO: 61769 - DNA, 20 bp, Artificial Sequence
  chemically synthesized
ggaaacttttaaaagtccaa

SEQ ID NO: 61770 - DNA, 20 bp, Artificial Sequence
  chemically synthesized
ttaaaagtccaagggggttg

SEQ ID NO: 61771 - DNA, 20 bp, Artificial Sequence
  chemically synthesized
gtccgaagcctgggcatatc

SEQ ID NO: 61772 - DNA, 20 bp, Artificial Sequence
  chemically synthesized
cctgggcatatctggagtag

SEQ ID NO: 61773 - DNA, 20 bp, Artificial Sequence
  chemically synthesized
agggcaggttctgtgttgct

SEQ ID NO: 61774 - DNA, 20 bp, Artificial Sequence
  chemically synthesized
cactccctattgtctcagcc

SEQ ID NO: 61775 - DNA, 20 bp, Artificial Sequence
  chemically synthesized
tggcctatcacctgaagcct

SEQ ID NO: 61776 - DNA, 20 bp, Artificial Sequence
  chemically synthesized
cctgccaacccctccctcaa

SEQ ID NO: 61777 - DNA, 20 bp, Artificial Sequence
  chemically synthesized
gcaaaatgaggaccagggag

SEQ ID NO: 61778 - DNA, 20 bp, Artificial Sequence
  chemically synthesized
ctcatacacctggaaagtga

SEQ ID NO: 61779 - DNA, 20 bp, Artificial Sequence
  chemically synthesized
ggaaaaaaaccctaagggct

SEQ ID NO: 61780 - DNA, 20 bp, Artificial Sequence
  chemically synthesized
cctaagggctgaggatcctt

SEQ ID NO: 61781 - DNA, 20 bp, Artificial Sequence
  chemically synthesized
gctgaggatccttgtgagtg

SEQ ID NO: 61782 - DNA, 20 bp, Artificial Sequence
  chemically synthesized
tttccctggccactaaatag

SEQ ID NO: 61783 - DNA, 20 bp, Artificial Sequence
  chemically synthesized
attctgatctggcccgattc

SEQ ID NO: 61784 - DNA, 20 bp, Artificial Sequence
  chemically synthesized
tggctgtaccatttgcatct

SEQ ID NO: 61785 - DNA, 20 bp, Artificial Sequence
  chemically synthesized
taagtgttgctgtccagagc

SEQ ID NO: 61786 - DNA, 20 bp, Artificial Sequence
  chemically synthesized
ctgggtgcaggacctagatg

SEQ ID NO: 61787 - DNA, 20 bp, Artificial Sequence
  chemically synthesized
ctgctacttcctcagtgaca

SEQ ID NO: 61788 - DNA, 20 bp, Artificial Sequence
  chemically synthesized
ggtttcttcatctgtaaaag

SEQ ID NO: 61789 - DNA, 20 bp, Artificial Sequence
  chemically synthesized
atattagcattagcacctca

SEQ ID NO: 61790 - DNA, 20 bp, Artificial Sequence
  chemically synthesized
gggattgttacaagaaagca

SEQ ID NO: 61791 - DNA, 20 bp, Artificial Sequence
  chemically synthesized
ggtgtcaatccctgatcact

SEQ ID NO: 61792 - DNA, 20 bp, Artificial Sequence
  chemically synthesized
tggtccctgtctccctggct

SEQ ID NO: 61793 - DNA, 20 bp, Artificial Sequence
  chemically synthesized
cagatacatcccaccatgat

SEQ ID NO: 61794 - DNA, 20 bp, Artificial Sequence
  chemically synthesized
caagatcacccccaacctgg

SEQ ID NO: 61795 - DNA, 20 bp, Artificial Sequence
  chemically synthesized
acgatgaaatcctggagggc

SEQ ID NO: 61796 - DNA, 20 bp, Artificial Sequence
  chemically synthesized
tcagcgagggcctgaagcta

SEQ ID NO: 61797 - DNA, 20 bp, Artificial Sequence
  chemically synthesized
agctagtggataagtttttg

SEQ ID NO: 61798 - DNA, 20 bp, Artificial Sequence
  chemically synthesized
agatcaacgattacgtggag

SEQ ID NO: 61799 - DNA, 20 bp, Artificial Sequence
  chemically synthesized
agggtactcaagggaaaatt

SEQ ID NO: 61800 - DNA, 20 bp, Artificial Sequence
  chemically synthesized
gagacacagtttttgctctg

SEQ ID NO: 61801 - DNA, 20 bp, Artificial Sequence
  chemically synthesized
ccatagcaatgcttttcagc

SEQ ID NO: 61802 - DNA, 20 bp, Artificial Sequence
  chemically synthesized
cactaaaatgttttccatca

SEQ ID NO: 61803 - DNA, 20 bp, Artificial Sequence
  chemically synthesized
ccttgtgtatactgtatatg

SEQ ID NO: 61804 - DNA, 20 bp, Artificial Sequence
  chemically synthesized
aattgtaatacactgcataa

SEQ ID NO: 61805 - DNA, 20 bp, Artificial Sequence
  chemically synthesized
tttacacgactctagtgtcc

SEQ ID NO: 61806 - DNA, 20 bp, Artificial Sequence
  chemically synthesized
agttttgcaatctgaaagac

SEQ ID NO: 61807 - DNA, 20 bp, Artificial Sequence
  chemically synthesized
ttcttgctgtcaggtttttt

SEQ ID NO: 61808 - DNA, 20 bp, Artificial Sequence
  chemically synthesized
aaacaaatgacaaagactgt

SEQ ID NO: 61809 - DNA, 20 bp, Artificial Sequence
  chemically synthesized
aggctgccttcctgcccctg

SEQ ID NO: 61810 - DNA, 20 bp, Artificial Sequence
  chemically synthesized
cccctgaggggttaaaatgc

SEQ ID NO: 61811 - DNA, 20 bp, Artificial Sequence
  chemically synthesized
cttctgtccaatgagaaagc

SEQ ID NO: 61812 - DNA, 20 bp, Artificial Sequence
  chemically synthesized
ccaatgagaaagctgggatc

SEQ ID NO: 61813 - DNA, 20 bp, Artificial Sequence
  chemically synthesized
gcatttcccctgccaatcta

SEQ ID NO: 61814 - DNA, 20 bp, Artificial Sequence
  chemically synthesized
agaggatgaggaaagctctc

SEQ ID NO: 61815 - DNA, 20 bp, Artificial Sequence
  chemically synthesized
aagctctcaggaatagtaag

SEQ ID NO: 61816 - DNA, 20 bp, Artificial Sequence
  chemically synthesized
tagtaagcagaatgtttgcc

SEQ ID NO: 61817 - DNA, 20 bp, Artificial Sequence
  chemically synthesized
aagcagaatgtttgccctgg

SEQ ID NO: 61818 - DNA, 20 bp, Artificial Sequence
  chemically synthesized
ttctgcatcttcctctagtt

SEQ ID NO: 61819 - DNA, 20 bp, Artificial Sequence
  chemically synthesized
acacaatctttttcggcagc

SEQ ID NO: 61820 - DNA, 20 bp, Artificial Sequence
  chemically synthesized
gatgatgaagctgagcctcg

SEQ ID NO: 61821 - DNA, 20 bp, Artificial Sequence
  chemically synthesized
cactgtaagaagctgtccag

SEQ ID NO: 61822 - DNA, 20 bp, Artificial Sequence
  chemically synthesized
agaaggtgattccccaacct

SEQ ID NO: 61823 - DNA, 20 bp, Artificial Sequence
  chemically synthesized
ggactggccagagggctgag

SEQ ID NO: 61824 - DNA, 20 bp, Artificial Sequence
  chemically synthesized
ggagggtgaaccccacatcc

SEQ ID NO: 61825 - DNA, 20 bp, Artificial Sequence
  chemically synthesized
ctctgtataaacttggcttc

SEQ ID NO: 61826 - DNA, 20 bp, Artificial Sequence
  chemically synthesized
cttccagaatgaggccacca

SEQ ID NO: 61827 - DNA, 20 bp, Artificial Sequence
  chemically synthesized
ccatgaggaggacagtaccc

SEQ ID NO: 61828 - DNA, 20 bp, Artificial Sequence
  chemically synthesized
cttcctggcaaaggcagcag

SEQ ID NO: 61829 - DNA, 20 bp, Artificial Sequence
  chemically synthesized
gcaaaggcagcagtggagtg

SEQ ID NO: 61830 - DNA, 20 bp, Artificial Sequence
  chemically synthesized
agcagtggagtgtggagttc

SEQ ID NO: 61831 - DNA, 20 bp, Artificial Sequence
  chemically synthesized
tggagtgtggagttcaaggg

SEQ ID NO: 61832 - DNA, 20 bp, Artificial Sequence
  chemically synthesized
aggcccagaaaagcaaggtt

SEQ ID NO: 61833 - DNA, 20 bp, Artificial Sequence
  chemically synthesized
actttatcggtgctgttaga

SEQ ID NO: 61834 - DNA, 20 bp, Artificial Sequence
  chemically synthesized
agatgaaaatacaaaaggtg

SEQ ID NO: 61835 - DNA, 20 bp, Artificial Sequence
  chemically synthesized
aaaggtgtcgggttcataat

SEQ ID NO: 61836 - DNA, 20 bp, Artificial Sequence
  chemically synthesized
ttcataataggaatcgaggc

SEQ ID NO: 61837 - DNA, 20 bp, Artificial Sequence
  chemically synthesized
cctcctgaggtctctgctcc

SEQ ID NO: 61838 - DNA, 20 bp, Artificial Sequence
  chemically synthesized
agaaagaacaaagaggctga

SEQ ID NO: 61839 - DNA, 20 bp, Artificial Sequence
  chemically synthesized
acaaagaggctgagagggta

SEQ ID NO: 61840 - DNA, 20 bp, Artificial Sequence
  chemically synthesized
cgctcacaccagaccctgct

SEQ ID NO: 61841 - DNA, 20 bp, Artificial Sequence
  chemically synthesized
gccaccagccccgtgtttct

SEQ ID NO: 61842 - DNA, 20 bp, Artificial Sequence
  chemically synthesized
ttctctgggtgtagggccct

SEQ ID NO: 61843 - DNA, 20 bp, Artificial Sequence
  chemically synthesized
agacaggcttccaggacacc

SEQ ID NO: 61844 - DNA, 20 bp, Artificial Sequence
  chemically synthesized
aaaagtagaacaaaccaaag

SEQ ID NO: 61845 - DNA, 20 bp, Artificial Sequence
  chemically synthesized
agccgagttcccatcttagt

SEQ ID NO: 61846 - DNA, 20 bp, Artificial Sequence
  chemically synthesized
ttagtgtgggtggaggacac

SEQ ID NO: 61847 - DNA, 20 bp, Artificial Sequence
  chemically synthesized
aagaaaacacttgcactgtg

SEQ ID NO: 61848 - DNA, 20 bp, Artificial Sequence
  chemically synthesized
gtgggtcccagaagaacaag

SEQ ID NO: 61849 - DNA, 20 bp, Artificial Sequence
  chemically synthesized
gaggaatgctgtgccatgcc

SEQ ID NO: 61850 - DNA, 20 bp, Artificial Sequence
  chemically synthesized
cctatgatctgaagagcgtc

SEQ ID NO: 61851 - DNA, 20 bp, Artificial Sequence
  chemically synthesized
agcaatggggctgacctctc

SEQ ID NO: 61852 - DNA, 20 bp, Artificial Sequence
  chemically synthesized
gcaccctggtatctgtaggg

SEQ ID NO: 61853 - DNA, 20 bp, Artificial Sequence
  chemically synthesized
ttgaggttgtgtcactgacc

SEQ ID NO: 61854 - DNA, 20 bp, Artificial Sequence
  chemically synthesized
tttgggctaagttgtttcaa

SEQ ID NO: 61855 - DNA, 20 bp, Artificial Sequence
  chemically synthesized
cgatctgtgagatttggtgt

SEQ ID NO: 61856 - DNA, 20 bp, Artificial Sequence
  chemically synthesized
gagatttggtgtctgaatta

SEQ ID NO: 61857 - DNA, 20 bp, Artificial Sequence
  chemically synthesized
caatgaacaactgcagttcc

SEQ ID NO: 61858 - DNA, 20 bp, Artificial Sequence
  chemically synthesized
catgaatggctgcattatct

SEQ ID NO: 61859 - DNA, 20 bp, Artificial Sequence
  chemically synthesized
ggcactgtgaaggtcactgc

SEQ ID NO: 61860 - DNA, 20 bp, Artificial Sequence
  chemically synthesized
gagagccctggaggcagacg

SEQ ID NO: 61861 - DNA, 20 bp, Artificial Sequence
  chemically synthesized
tgacgatgctcttccctgtt

SEQ ID NO: 61862 - DNA, 20 bp, Artificial Sequence
  chemically synthesized
gctcttccctgttctgagtt

SEQ ID NO: 61863 - DNA, 20 bp, Artificial Sequence
  chemically synthesized
gcctatgtgacagggaggga

SEQ ID NO: 61864 - DNA, 20 bp, Artificial Sequence
  chemically synthesized
cagggccagggccgtccagg

SEQ ID NO: 61865 - DNA, 20 bp, Artificial Sequence
  chemically synthesized
cgtgagccttgctcgaggcc

SEQ ID NO: 61866 - DNA, 20 bp, Artificial Sequence
  chemically synthesized
ccctcttcatgggaaaagtg

SEQ ID NO: 61867 - DNA, 20 bp, Artificial Sequence
  chemically synthesized
ctccatccctggccccctcc

SEQ ID NO: 61868 - DNA, 20 bp, Artificial Sequence
  chemically synthesized
ctccctggatgacattaaag

SEQ ID NO: 61869 - DNA, 20 bp, Artificial Sequence
  chemically synthesized
aaatccctcccatgttttct

SEQ ID NO: 61870 - DNA, 20 bp, Artificial Sequence
  chemically synthesized
tgtgttcatggagcatctgg

SEQ ID NO: 61871 - DNA, 20 bp, Artificial Sequence
  chemically synthesized
tgggtaggcacatgctgggc

SEQ ID NO: 61872 - DNA, 20 bp, Artificial Sequence
  chemically synthesized
gggcttgaatccagggggga

SEQ ID NO: 61873 - DNA, 20 bp, Artificial Sequence
  chemically synthesized
cagtcttccttgtcctgtct

SEQ ID NO: 61874 - DNA, 20 bp, Artificial Sequence
  chemically synthesized
ctgtcttggagtccccaaga

SEQ ID NO: 61875 - DNA, 20 bp, Artificial Sequence
  chemically synthesized
atcccccactcccccccacc

SEQ ID NO: 61876 - DNA, 20 bp, Artificial Sequence
  chemically synthesized
aagcctcacatatctccgtt

SEQ ID NO: 61877 - DNA, 20 bp, Artificial Sequence
  chemically synthesized
ccttctccccagatgaagag

SEQ ID NO: 61878 - DNA, 20 bp, Artificial Sequence
  chemically synthesized
caacccctccctttcctcct

SEQ ID NO: 61879 - DNA, 20 bp, Artificial Sequence
  chemically synthesized
gccacggcaggaggctgttc

SEQ ID NO: 61880 - DNA, 20 bp, Artificial Sequence
  chemically synthesized
gcccctgtggtaagggccag

SEQ ID NO: 61881 - DNA, 20 bp, Artificial Sequence
  chemically synthesized
ctgctccctccgtctctacc

SEQ ID NO: 61882 - DNA, 20 bp, Artificial Sequence
  chemically synthesized
gccccatcccaaactaatct

SEQ ID NO: 61883 - DNA, 20 bp, Artificial Sequence
  chemically synthesized
ctgtctaaccactcactgtc

SEQ ID NO: 61884 - DNA, 20 bp, Artificial Sequence
  chemically synthesized
ctgtcatgaatgtgtactta

SEQ ID NO: 61885 - DNA, 20 bp, Artificial Sequence
  chemically synthesized
tgtgtacttaaaggatgagg

SEQ ID NO: 61886 - DNA, 20 bp, Artificial Sequence
  chemically synthesized
tacatgattcagtctaatca

SEQ ID NO: 61887 - DNA, 20 bp, Artificial Sequence
  chemically synthesized
atggccatcaccaagccccc

SEQ ID NO: 61888 - DNA, 20 bp, Artificial Sequence
  chemically synthesized
cctaggatgacaccagacct

SEQ ID NO: 61889 - DNA, 20 bp, Artificial Sequence
  chemically synthesized
agacctgagagtctgaagac

SEQ ID NO: 61890 - DNA, 20 bp, Artificial Sequence
  chemically synthesized
attgctagtaagacctgcct

SEQ ID NO: 61891 - DNA, 20 bp, Artificial Sequence
  chemically synthesized
tgtttatacccattagaaca

SEQ ID NO: 61892 - DNA, 20 bp, Artificial Sequence
  chemically synthesized
cttgcacttatgagctttct

SEQ ID NO: 61893 - DNA, 20 bp, Artificial Sequence
  chemically synthesized
ctgtagcagcactgcgatgt

SEQ ID NO: 61894 - DNA, 20 bp, Artificial Sequence
  chemically synthesized
ctcaccacactctccccttc

SEQ ID NO: 61895 - DNA, 20 bp, Artificial Sequence
  chemically synthesized
gtaattcctccttaaaccag

SEQ ID NO: 61896 - DNA, 20 bp, Artificial Sequence
  chemically synthesized
atttggtaggagaacagggg

SEQ ID NO: 61897 - DNA, 20 bp, Artificial Sequence
  chemically synthesized
gacaccatcgttttactttg

SEQ ID NO: 61898 - DNA, 20 bp, Artificial Sequence
  chemically synthesized
tgaagaattgtctgtcacac

SEQ ID NO: 61899 - DNA, 20 bp, Artificial Sequence
  chemically synthesized
gtcacacacgagttgacagt

SEQ ID NO: 61900 - DNA, 20 bp, Artificial Sequence
  chemically synthesized
aactagcataacctcccaga

SEQ ID NO: 61901 - DNA, 20 bp, Artificial Sequence
  chemically synthesized
gggaattcctgggctcccct

SEQ ID NO: 61902 - DNA, 20 bp, Artificial Sequence
  chemically synthesized
gggctcccctgggaatcaac

SEQ ID NO: 61903 - DNA, 20 bp, Artificial Sequence
  chemically synthesized
ggaatcaacagggatcagtc

SEQ ID NO: 61904 - DNA, 20 bp, Artificial Sequence
  chemically synthesized
agggatcagtcaaggatggg

SEQ ID NO: 61905 - DNA, 20 bp, Artificial Sequence
  chemically synthesized
ctcagcttcactgtatcttc

SEQ ID NO: 61906 - DNA, 20 bp, Artificial Sequence
  chemically synthesized
acatacttcctcagtccata

SEQ ID NO: 61907 - DNA, 20 bp, Artificial Sequence
  chemically synthesized
aggccaagctgcggggcacc

SEQ ID NO: 61908 - DNA, 20 bp, Artificial Sequence
  chemically synthesized
tccagctcagccaggaacct

SEQ ID NO: 61909 - DNA, 20 bp, Artificial Sequence
  chemically synthesized
cctgaccttttacctcgcct

SEQ ID NO: 61910 - DNA, 20 bp, Artificial Sequence
  chemically synthesized
gtttgcaggggagagaacac

SEQ ID NO: 61911 - DNA, 20 bp, Artificial Sequence
  chemically synthesized
ggggagagaacacacgaatt

SEQ ID NO: 61912 - DNA, 20 bp, Artificial Sequence
  chemically synthesized
gcaaacatgagctgtgtatg

SEQ ID NO: 61913 - DNA, 20 bp, Artificial Sequence
  chemically synthesized
agctgtgtatgggggataga

SEQ ID NO: 61914 - DNA, 20 bp, Artificial Sequence
  chemically synthesized
aaacccaggtccatcccggg

SEQ ID NO: 61915 - DNA, 20 bp, Artificial Sequence
  chemically synthesized
gtctatggcagtggggagca

SEQ ID NO: 61916 - DNA, 20 bp, Artificial Sequence
  chemically synthesized
aataaatgaggcgtacatcc

SEQ ID NO: 61917 - DNA, 20 bp, Artificial Sequence
  chemically synthesized
tgaggcgtacatccatggat

SEQ ID NO: 61918 - DNA, 20 bp, Artificial Sequence
  chemically synthesized
catccatggatctgggtgga

SEQ ID NO: 61919 - DNA, 20 bp, Artificial Sequence
  chemically synthesized
tggatctgggtggagagggt

SEQ ID NO: 61920 - DNA, 20 bp, Artificial Sequence
  chemically synthesized
ggcttttgtgttgctcttgg

SEQ ID NO: 61921 - DNA, 20 bp, Artificial Sequence
  chemically synthesized
gggacagcttccgcaggaac

SEQ ID NO: 61922 - DNA, 20 bp, Artificial Sequence
  chemically synthesized
gtcagttctaaaaggacaaa

SEQ ID NO: 61923 - DNA, 20 bp, Artificial Sequence
  chemically synthesized
aaaggacaaatggaatgacc

SEQ ID NO: 61924 - DNA, 20 bp, Artificial Sequence
  chemically synthesized
aggcagcaactcggaaaagc

SEQ ID NO: 61925 - DNA, 20 bp, Artificial Sequence
  chemically synthesized
tcatttgtccttttcctcaa

SEQ ID NO: 61926 - DNA, 20 bp, Artificial Sequence
  chemically synthesized
gcagacgcttcaatggcagt

SEQ ID NO: 61927 - DNA, 20 bp, Artificial Sequence
  chemically synthesized
actgttgaaatcgtgacatc

SEQ ID NO: 61928 - DNA, 20 bp, Artificial Sequence
  chemically synthesized
tcaggaatgatgaaaggaac

SEQ ID NO: 61929 - DNA, 20 bp, Artificial Sequence
  chemically synthesized
cagtctggttgctgtgtccc

SEQ ID NO: 61930 - DNA, 20 bp, Artificial Sequence
  chemically synthesized
ctggttgctgtgtccccagg

SEQ ID NO: 61931 - DNA, 20 bp, Artificial Sequence
  chemically synthesized
tgggacaagtagagcgggag

SEQ ID NO: 61932 - DNA, 20 bp, Artificial Sequence
  chemically synthesized
agaggaatcaaccctttcta

SEQ ID NO: 61933 - DNA, 20 bp, Artificial Sequence
  chemically synthesized
cccatcctgactgaaacaac

SEQ ID NO: 61934 - DNA, 20 bp, Artificial Sequence
  chemically synthesized
cacctactacgcaagcctgg

SEQ ID NO: 61935 - DNA, 20 bp, Artificial Sequence
  chemically synthesized
ggtggtgagcaaggaacggt

SEQ ID NO: 61936 - DNA, 20 bp, Artificial Sequence
  chemically synthesized
gaacggtaggaatgtgagca

SEQ ID NO: 61937 - DNA, 20 bp, Artificial Sequence
  chemically synthesized
cagctcaatgcttcaaccct

SEQ ID NO: 61938 - DNA, 20 bp, Artificial Sequence
  chemically synthesized
cgtgataccaatgacagtga

SEQ ID NO: 61939 - DNA, 20 bp, Artificial Sequence
  chemically synthesized
gcctgttgggatttgggctt

SEQ ID NO: 61940 - DNA, 20 bp, Artificial Sequence
  chemically synthesized
ggacaaggacaaggaacttt

SEQ ID NO: 61941 - DNA, 20 bp, Artificial Sequence
  chemically synthesized
ccttccctgccctgggctct

SEQ ID NO: 61942 - DNA, 20 bp, Artificial Sequence
  chemically synthesized
gtgctgctacagtgagtaaa

SEQ ID NO: 61943 - DNA, 20 bp, Artificial Sequence
  chemically synthesized
ttcatagggatgtctgattc

SEQ ID NO: 61944 - DNA, 20 bp, Artificial Sequence
  chemically synthesized
tcacagaaagctcataagtg

SEQ ID NO: 61945 - DNA, 20 bp, Artificial Sequence
  chemically synthesized
cattgattagactgaatcat

SEQ ID NO: 61946 - DNA, 20 bp, Artificial Sequence
  chemically synthesized
gtcaagtctgaggaggagat

SEQ ID NO: 61947 - DNA, 20 bp, Artificial Sequence
  chemically synthesized
gcagcgatggaaggacaagg

SEQ ID NO: 61948 - DNA, 20 bp, Artificial Sequence
  chemically synthesized
aggtgtccttgttgccccat

SEQ ID NO: 61949 - DNA, 20 bp, Artificial Sequence
  chemically synthesized
ccatggagaatgggcttcag

SEQ ID NO: 61950 - DNA, 20 bp, Artificial Sequence
  chemically synthesized
acaaggaagactggagccct

SEQ ID NO: 61951 - DNA, 20 bp, Artificial Sequence
  chemically synthesized
cagcaggcaaagggagactc

SEQ ID NO: 61952 - DNA, 20 bp, Artificial Sequence
  chemically synthesized
aatctcacagatcgaaggag

SEQ ID NO: 61953 - DNA, 20 bp, Artificial Sequence
  chemically synthesized
taagctggcagacctgtcgt

SEQ ID NO: 61954 - DNA, 20 bp, Artificial Sequence
  chemically synthesized
tggcagacctgtcgtgcaga

SEQ ID NO: 61955 - DNA, 20 bp, Artificial Sequence
  chemically synthesized
tagctcttctacattgagtc

SEQ ID NO: 61956 - DNA, 20 bp, Artificial Sequence
  chemically synthesized
atccccagggccctacaccc

SEQ ID NO: 61957 - DNA, 20 bp, Artificial Sequence
  chemically synthesized
aggaggtgctggcatggaac

SEQ ID NO: 61958 - DNA, 20 bp, Artificial Sequence
  chemically synthesized
aacagcaccgataaagtgac

SEQ ID NO: 61959 - DNA, 20 bp, Artificial Sequence
  chemically synthesized
tgaaggtttggaagagtgta

SEQ ID NO: 61960 - DNA, 20 bp, Artificial Sequence
  chemically synthesized
ttggaagagtgtagcagaat

SEQ ID NO: 61961 - DNA, 20 bp, Artificial Sequence
  chemically synthesized
attcaaaactagaggaagat

SEQ ID NO: 61962 - DNA, 20 bp, Artificial Sequence
  chemically synthesized
ctgggacagtgggagctggc

SEQ ID NO: 61963 - DNA, 20 bp, Artificial Sequence
  chemically synthesized
atcctaaaaaaacctgacag

SEQ ID NO: 61964 - DNA, 20 bp, Artificial Sequence
  chemically synthesized
gtattttgtccatgctaaga

SEQ ID NO: 61965 - DNA, 20 bp, Artificial Sequence
  chemically synthesized
gaaattagcacctcaaagag

SEQ ID NO: 61966 - DNA, 20 bp, Artificial Sequence
  chemically synthesized
aaacattttagtgtttgtgt

SEQ ID NO: 61967 - DNA, 20 bp, Artificial Sequence
  chemically synthesized
gtgtttgtgtgtagaaaact

SEQ ID NO: 61968 - DNA, 20 bp, Artificial Sequence
  chemically synthesized
gagttcaagaactgatggtt

SEQ ID NO: 61969 - DNA, 20 bp, Artificial Sequence
  chemically synthesized
tgccgacatcagtaacactg

SEQ ID NO: 61970 - DNA, 20 bp, Artificial Sequence
  chemically synthesized
cagtaacactgaaagaatca

SEQ ID NO: 61971 - DNA, 20 bp, Artificial Sequence
  chemically synthesized
aatatccttcttttacagat

SEQ ID NO: 61972 - DNA, 20 bp, Artificial Sequence
  chemically synthesized
tcactgaggaagtagcagaa

SEQ ID NO: 61973 - DNA, 20 bp, Artificial Sequence
  chemically synthesized
acagccattgttttacaaaa

SEQ ID NO: 61974 - DNA, 20 bp, Artificial Sequence
  chemically synthesized
tatccaggaatcgggccaga

SEQ ID NO: 61975 - DNA, 20 bp, Artificial Sequence
  chemically synthesized
gaatcgggccagatcagaat

SEQ ID NO: 61976 - DNA, 20 bp, Artificial Sequence
  chemically synthesized
atgctctgtggtcccagaca

SEQ ID NO: 61977 - DNA, 20 bp, Artificial Sequence
  chemically synthesized
cataaagtgatgtttatgta

SEQ ID NO: 61978 - DNA, 20 bp, Artificial Sequence
  chemically synthesized
aaaactgaggtcctagctga

SEQ ID NO: 61979 - DNA, 20 bp, Artificial Sequence
  chemically synthesized
ccatcatcttaacaaaatac

SEQ ID NO: 61980 - DNA, 20 bp, Artificial Sequence
  chemically synthesized
aatttgggaaatgaaaaact

SEQ ID NO: 61981 - DNA, 20 bp, Artificial Sequence
  chemically synthesized
actatccacttggcctttag

SEQ ID NO: 61982 - DNA, 20 bp, Artificial Sequence
  chemically synthesized
aaacctccacctcccgggtt

SEQ ID NO: 61983 - DNA, 20 bp, Artificial Sequence
  chemically synthesized
cacccagccaggattcttgg

SEQ ID NO: 61984 - DNA, 20 bp, Artificial Sequence
  chemically synthesized
ttcaatgtagcaaaacagat

SEQ ID NO: 61985 - DNA, 20 bp, Artificial Sequence
  chemically synthesized
cagatctcagatgatgaatg

SEQ ID NO: 61986 - DNA, 20 bp, Artificial Sequence
  chemically synthesized
cctgggagggcgactggaga

SEQ ID NO: 61987 - DNA, 20 bp, Artificial Sequence
  chemically synthesized
tgaggccaagctttaaacca

SEQ ID NO: 61988 - DNA, 20 bp, Artificial Sequence
  chemically synthesized
aacccggcagggtgcaggga

SEQ ID NO: 61989 - DNA, 20 bp, Artificial Sequence
  chemically synthesized
tagcttcatagctgtacaat

SEQ ID NO: 61990 - DNA, 20 bp, Artificial Sequence
  chemically synthesized
tcatagctgtacaatggaga

SEQ ID NO: 61991 - DNA, 20 bp, Artificial Sequence
  chemically synthesized
ttattagccctattttatag

SEQ ID NO: 61992 - DNA, 20 bp, Artificial Sequence
  chemically synthesized
ctgaagccagaagtcttgaa

SEQ ID NO: 61993 - DNA, 20 bp, Artificial Sequence
  chemically synthesized
gaacctcagtttcctggaga

SEQ ID NO: 61994 - DNA, 20 bp, Artificial Sequence
  chemically synthesized
cctgctgcgcagcaagttct

SEQ ID NO: 61995 - DNA, 20 bp, Artificial Sequence
  chemically synthesized
catccagcgcctgagaccca

SEQ ID NO: 61996 - DNA, 20 bp, Artificial Sequence
  chemically synthesized
tggtcatatctggaggggat

SEQ ID NO: 61997 - DNA, 20 bp, Artificial Sequence
  chemically synthesized
acctcctcatctatagaagg

SEQ ID NO: 61998 - DNA, 20 bp, Artificial Sequence
  chemically synthesized
cagacagaggagctgtgcaa

SEQ ID NO: 61999 - DNA, 20 bp, Artificial Sequence
  chemically synthesized
cagaggagctgtgcaaacag

SEQ ID NO: 62000 - DNA, 20 bp, Artificial Sequence
  chemically synthesized
aaggagtcattgtacctggc

SEQ ID NO: 62001 - DNA, 20 bp, Artificial Sequence
  chemically synthesized
gctggccctctgctctcact

SEQ ID NO: 62002 - DNA, 20 bp, Artificial Sequence
  chemically synthesized
gagacgggtactgggtgtgc

SEQ ID NO: 62003 - DNA, 20 bp, Artificial Sequence
  chemically synthesized
tcacactgcccagaggatta

SEQ ID NO: 62004 - DNA, 20 bp, Artificial Sequence
  chemically synthesized
ggggcttttggaggaggaat

SEQ ID NO: 62005 - DNA, 20 bp, Artificial Sequence
  chemically synthesized
aggtgaggcaagtaaggggc

SEQ ID NO: 62006 - DNA, 20 bp, Artificial Sequence
  chemically synthesized
gattcaaacttccatttttt

SEQ ID NO: 62007 - DNA, 20 bp, Artificial Sequence
  chemically synthesized
ctctttatccttactcagac

SEQ ID NO: 62008 - DNA, 20 bp, Artificial Sequence
  chemically synthesized
actggggtatcttccctggg

SEQ ID NO: 62009 - DNA, 20 bp, Artificial Sequence
  chemically synthesized
aggacttgagggcttattat

SEQ ID NO: 62010 - DNA, 20 bp, Artificial Sequence
  chemically synthesized
cagtgccatgtcttggggca

SEQ ID NO: 62011 - DNA, 20 bp, Artificial Sequence
  chemically synthesized
acatgaacatggtggccttg

SEQ ID NO: 62012 - DNA, 20 bp, Artificial Sequence
  chemically synthesized
gagtaaagttaaaataaagt

SEQ ID NO: 62013 - DNA, 20 bp, Artificial Sequence
  chemically synthesized
ctactctggaggctgaggca

SEQ ID NO: 62014 - DNA, 20 bp, Artificial Sequence
  chemically synthesized
cacgagaatcgctcgtaatt

SEQ ID NO: 62015 - DNA, 20 bp, Artificial Sequence
  chemically synthesized
tgtgagtaggccacatagtt

SEQ ID NO: 62016 - DNA, 20 bp, Artificial Sequence
  chemically synthesized
gccacatagttccagaaaat

SEQ ID NO: 62017 - DNA, 20 bp, Artificial Sequence
  chemically synthesized
cctcagaagagctatgtggg

SEQ ID NO: 62018 - DNA, 20 bp, Artificial Sequence
  chemically synthesized
cctctgcatgtcacaggtgc

SEQ ID NO: 62019 - DNA, 20 bp, Artificial Sequence
  chemically synthesized
tcttccctctgcagctggcc

SEQ ID NO: 62020 - DNA, 20 bp, Artificial Sequence
  chemically synthesized
aaacaaaggcccagagaggg

SEQ ID NO: 62021 - DNA, 20 bp, Artificial Sequence
  chemically synthesized
agagtgggggccatgtatcc

SEQ ID NO: 62022 - DNA, 20 bp, Artificial Sequence
  chemically synthesized
ctggttttccaggagcaaaa

SEQ ID NO: 62023 - DNA, 20 bp, Artificial Sequence
  chemically synthesized
gagtgcagcaggctctccgg

SEQ ID NO: 62024 - DNA, 20 bp, Artificial Sequence
  chemically synthesized
cccttattttatgctcccgg

SEQ ID NO: 62025 - DNA, 20 bp, Artificial Sequence
  chemically synthesized
tgctcccacctgccccgatc

SEQ ID NO: 62026 - DNA, 20 bp, Artificial Sequence
  chemically synthesized
cctctccacctcctttgagc

SEQ ID NO: 62027 - DNA, 20 bp, Artificial Sequence
  chemically synthesized
aacccagatgccattctaac

SEQ ID NO: 62028 - DNA, 20 bp, Artificial Sequence
  chemically synthesized
ctatttgggaagctgagaca

SEQ ID NO: 62029 - DNA, 20 bp, Artificial Sequence
  chemically synthesized
aagttcagttgggaagtgaa

SEQ ID NO: 62030 - DNA, 20 bp, Artificial Sequence
  chemically synthesized
tctaacaacactagctagct

SEQ ID NO: 62031 - DNA, 20 bp, Artificial Sequence
  chemically synthesized
acttagaggcacgagggcca

SEQ ID NO: 62032 - DNA, 20 bp, Artificial Sequence
  chemically synthesized
ggccaggagaaaggtggtgg

SEQ ID NO: 62033 - DNA, 20 bp, Artificial Sequence
  chemically synthesized
tttaaaagtccaagggggtt

SEQ ID NO: 62034 - DNA, 20 bp, Artificial Sequence
  chemically synthesized
agcacctcacgggattgtta

SEQ ID NO: 62035 - DNA, 20 bp, Artificial Sequence
  chemically synthesized
ttcggggacaccgaagaggc

SEQ ID NO: 62036 - DNA, 20 bp, Artificial Sequence
  chemically synthesized
aaccagcctgagctgttccc

SEQ ID NO: 62037 - DNA, 20 bp, Artificial Sequence
  chemically synthesized
tccttgtgtatactgtatat

SEQ ID NO: 62038 - DNA, 20 bp, Artificial Sequence
  chemically synthesized
ctttacacgactctagtgtc

SEQ ID NO: 62039 - DNA, 20 bp, Artificial Sequence
  chemically synthesized
agtctcctccttctgtccaa

SEQ ID NO: 62040 - DNA, 20 bp, Artificial Sequence
  chemically synthesized
aaagctctcaggaatagtaa

SEQ ID NO: 62041 - DNA, 20 bp, Artificial Sequence
  chemically synthesized
tagcctgacatcgccacgat

SEQ ID NO: 62042 - DNA, 20 bp, Artificial Sequence
  chemically synthesized
actctgtataaacttggctt

SEQ ID NO: 62043 - DNA, 20 bp, Artificial Sequence
  chemically synthesized
gtggagtgtggagttcaagg

SEQ ID NO: 62044 - DNA, 20 bp, Artificial Sequence
  chemically synthesized
aagagcctgtgtggcaaggc

SEQ ID NO: 62045 - DNA, 20 bp, Artificial Sequence
  chemically synthesized
gaggtctctgctccaggggt

SEQ ID NO: 62046 - DNA, 20 bp, Artificial Sequence
  chemically synthesized
gagacaggcttccaggacac

SEQ ID NO: 62047 - DNA, 20 bp, Artificial Sequence
  chemically synthesized
ggaggacacaggagtaagtg

SEQ ID NO: 62048 - DNA, 20 bp, Artificial Sequence
  chemically synthesized
ggagtaagtggcagaaataa

SEQ ID NO: 62049 - DNA, 20 bp, Artificial Sequence
  chemically synthesized
aagtggcagaaataatcaga

SEQ ID NO: 62050 - DNA, 20 bp, Artificial Sequence
  chemically synthesized
tgcaccctggtatctgtagg

SEQ ID NO: 62051 - DNA, 20 bp, Artificial Sequence
  chemically synthesized
cttgatttatccatactgac

SEQ ID NO: 62052 - DNA, 20 bp, Artificial Sequence
  chemically synthesized
aaggagcttcaagccgtgta

SEQ ID NO: 62053 - DNA, 20 bp, Artificial Sequence
  chemically synthesized
aaggctgtgctgaccatcga

SEQ ID NO: 62054 - DNA, 20 bp, Artificial Sequence
  chemically synthesized
cttgtccttccatcgctgcc

SEQ ID NO: 62055 - DNA, 20 bp, Artificial Sequence
  chemically synthesized
aaagcctcacatatctccgt

SEQ ID NO: 62056 - DNA, 20 bp, Artificial Sequence
  chemically synthesized
atgtttatacccattagaac

SEQ ID NO: 62057 - DNA, 20 bp, Artificial Sequence
  chemically synthesized
ctcacgcctagcacacttca

SEQ ID NO: 62058 - DNA, 20 bp, Artificial Sequence
  chemically synthesized
agacaccatcgttttacttt

SEQ ID NO: 62059 - DNA, 20 bp, Artificial Sequence
  chemically synthesized
gaaacagatgagagggaaac

SEQ ID NO: 62060 - DNA, 20 bp, Artificial Sequence
  chemically synthesized
agagcttccaggctctcaca

SEQ ID NO: 62061 - DNA, 20 bp, Artificial Sequence
  chemically synthesized
gagctgtgtatgggggatag

SEQ ID NO: 62062 - DNA, 20 bp, Artificial Sequence
  chemically synthesized
gaaacccaggtccatcccgg

SEQ ID NO: 62063 - DNA, 20 bp, Artificial Sequence
  chemically synthesized
ccaggacctttccagaggca

SEQ ID NO: 62064 - DNA, 20 bp, Artificial Sequence
  chemically synthesized
tgaccctgagtagagaagtc

SEQ ID NO: 62065 - DNA, 20 bp, Artificial Sequence
  chemically synthesized
ttgtccttgtcccatgtagc

SEQ ID NO: 62066 - DNA, 20 bp, Artificial Sequence
  chemically synthesized
accctccaatatcagctcta

SEQ ID NO: 62067 - DNA, 20 bp, Artificial Sequence
  chemically synthesized
gcccatcctgactgaaacaa

SEQ ID NO: 62068 - DNA, 20 bp, Artificial Sequence
  chemically synthesized
actcccacaaggaaacccca

SEQ ID NO: 62069 - DNA, 20 bp, Artificial Sequence
  chemically synthesized
agatgctcagcacaggccat

SEQ ID NO: 62070 - DNA, 20 bp, Artificial Sequence
  chemically synthesized
gataccaatgacagtgatca

SEQ ID NO: 62071 - DNA, 20 bp, Artificial Sequence
  chemically synthesized
ggacagtgaatacatttttt

SEQ ID NO: 62072 - DNA, 20 bp, Artificial Sequence
  chemically synthesized
tgacagacaattcttcaaag

SEQ ID NO: 62073 - DNA, 20 bp, Artificial Sequence
  chemically synthesized
aagtctgaggaggagataga

SEQ ID NO: 62074 - DNA, 20 bp, Artificial Sequence
  chemically synthesized
ttgtgttgctgcagatgcca

SEQ ID NO: 62075 - DNA, 20 bp, Artificial Sequence
  chemically synthesized
caggcaaagggagactcaga

SEQ ID NO: 62076 - DNA, 20 bp, Artificial Sequence
  chemically synthesized
tagacatgggtatggcctct

SEQ ID NO: 62077 - DNA, 20 bp, Artificial Sequence
  chemically synthesized
catcttggttttacagtgta

SEQ ID NO: 62078 - DNA, 20 bp, Artificial Sequence
  chemically synthesized
aagattgtgtggggataatt

SEQ ID NO: 62079 - DNA, 20 bp, Artificial Sequence
  chemically synthesized
tgtcatttgtttaatcctaa

SEQ ID NO: 62080 - DNA, 20 bp, Artificial Sequence
  chemically synthesized
aacccaggtctttcagattg

SEQ ID NO: 62081 - DNA, 20 bp, Artificial Sequence
  chemically synthesized
cctcaaattactcaatgatg

SEQ ID NO: 62082 - DNA, 20 bp, Artificial Sequence
  chemically synthesized
cattttagtgtttgtgtgta

SEQ ID NO: 62083 - DNA, 20 bp, Artificial Sequence
  chemically synthesized
aagatgtaattcaccagagc

SEQ ID NO: 62084 - DNA, 20 bp, Artificial Sequence
  chemically synthesized
acaactttttaacatcctcc

SEQ ID NO: 62085 - DNA, 20 bp, Artificial Sequence
  chemically synthesized
cctgccgtcttcacagatgg

SEQ ID NO: 62086 - DNA, 20 bp, Artificial Sequence
  chemically synthesized
acattgttaactactagtca

SEQ ID NO: 62087 - DNA, 20 bp, Artificial Sequence
  chemically synthesized
ttaactactagtcacaaaac

SEQ ID NO: 62088 - DNA, 20 bp, Artificial Sequence
  chemically synthesized
gtccttgaatttgggaaatg

SEQ ID NO: 62089 - DNA, 20 bp, Artificial Sequence
  chemically synthesized
ggcatctgggttcaatgtag

SEQ ID NO: 62090 - DNA, 20 bp, Artificial Sequence
  chemically synthesized
tccttataacatcaggactc

SEQ ID NO: 62091 - DNA, 20 bp, Artificial Sequence
  chemically synthesized
atcacagagctacttgctta

SEQ ID NO: 62092 - DNA, 20 bp, Artificial Sequence
  chemically synthesized
ggattaaacagatttcactc

SEQ ID NO: 62093 - DNA, 20 bp, Artificial Sequence
  chemically synthesized
aagccagaagtcttgaatca

SEQ ID NO: 62094 - DNA, 20 bp, Artificial Sequence
  chemically synthesized
tcatctttttgacctgtctc

SEQ ID NO: 62095 - DNA, 20 bp, Artificial Sequence
  chemically synthesized
tgtttctgtttttgctcctg

SEQ ID NO: 62096 - DNA, 20 bp, Artificial Sequence
  chemically synthesized
gaagggctaggataatctgg

SEQ ID NO: 62097 - DNA, 20 bp, Artificial Sequence
  chemically synthesized
ggggatgtgtcctggctctg

SEQ ID NO: 62098 - DNA, 20 bp, Artificial Sequence
  chemically synthesized
ctttcaaattagccaacttg

SEQ ID NO: 62099 - DNA, 20 bp, Artificial Sequence
  chemically synthesized
ccccttcttgttaaaattac

SEQ ID NO: 62100 - DNA, 20 bp, Artificial Sequence
  chemically synthesized
tcagaaaaggttagctgcaa

SEQ ID NO: 62101 - DNA, 20 bp, Artificial Sequence
  chemically synthesized
gggggtcattgtgcagatgg

SEQ ID NO: 62102 - DNA, 20 bp, Artificial Sequence
  chemically synthesized
cacactggttttccaggagc

SEQ ID NO: 62103 - DNA, 20 bp, Artificial Sequence
  chemically synthesized
aacctctctgttctcttggg

SEQ ID NO: 62104 - DNA, 20 bp, Artificial Sequence
  chemically synthesized
gaaatctgtttaatcccaga

SEQ ID NO: 62105 - DNA, 20 bp, Artificial Sequence
  chemically synthesized
attagatgatacggtgcctg

SEQ ID NO: 62106 - DNA, 20 bp, Artificial Sequence
  chemically synthesized
aagcgagactctgtctcaaa

SEQ ID NO: 62107 - DNA, 20 bp, Artificial Sequence
  chemically synthesized
ctctgtctcaaaaaaaaccc

SEQ ID NO: 62108 - DNA, 20 bp, Artificial Sequence
  chemically synthesized
acagccccgtctcttgggaa

SEQ ID NO: 62109 - DNA, 20 bp, Artificial Sequence
  chemically synthesized
tgcctcattttcttcttttg

SEQ ID NO: 62110 - DNA, 20 bp, Artificial Sequence
  chemically synthesized
gaaataatagattaaactgt

SEQ ID NO: 62111 - DNA, 20 bp, Artificial Sequence
  chemically synthesized
taacacaattagcttttgac

SEQ ID NO: 62112 - DNA, 20 bp, Artificial Sequence
  chemically synthesized
gccagctcccactgtcccag

SEQ ID NO: 62113 - DNA, 20 bp, Artificial Sequence
  chemically synthesized
ctagttcgttttgtacactg

SEQ ID NO: 62114 - DNA, 20 bp, Artificial Sequence
  chemically synthesized
ggtggcattgtctccccatg

SEQ ID NO: 62115 - DNA, 20 bp, Artificial Sequence
  chemically synthesized
tggcagaaataatcagaaaa

SEQ ID NO: 62116 - DNA, 20 bp, Artificial Sequence
  chemically synthesized
taaagatgacacttattttg

SEQ ID NO: 62117 - DNA, 20 bp, Artificial Sequence
  chemically synthesized
cgcctagcacacttcatgag

SEQ ID NO: 62118 - DNA, 20 bp, Artificial Sequence
  chemically synthesized
acagatgagagggaaacgca

SEQ ID NO: 62119 - DNA, 20 bp, Artificial Sequence
  chemically synthesized
tctatcagaaacaaacaaac

SEQ ID NO: 62120 - DNA, 20 bp, Artificial Sequence
  chemically synthesized
ggaagggtgactaagatctg

SEQ ID NO: 62121 - DNA, 20 bp, Artificial Sequence
  chemically synthesized
gagcacttcaattgtggaaa

SEQ ID NO: 62122 - DNA, 20 bp, Artificial Sequence
  chemically synthesized
ggggtggaggccgtcccctt

SEQ ID NO: 62123 - DNA, 20 bp, Artificial Sequence
  chemically synthesized
ttgtaactagaactttctaa

SEQ ID NO: 62124 - DNA, 20 bp, Artificial Sequence
  chemically synthesized
gggagttcctttagccttcc

SEQ ID NO: 62125 - DNA, 20 bp, Artificial Sequence
  chemically synthesized
ttcagatcttagtcaccctt

SEQ ID NO: 62126 - DNA, 20 bp, Artificial Sequence
  chemically synthesized
tgatgcatttcatgaattct

SEQ ID NO: 62127 - DNA, 20 bp, Artificial Sequence
  chemically synthesized
gttgtttcagtcaggatggg

SEQ ID NO: 62128 - DNA, 20 bp, Artificial Sequence
  chemically synthesized
caaccgagaagctcacagct

SEQ ID NO: 62129 - DNA, 20 bp, Artificial Sequence
  chemically synthesized
tgcttcaaccctttagaaag

SEQ ID NO: 62130 - DNA, 20 bp, Artificial Sequence
  chemically synthesized
gacacagcaaccagactgaa

SEQ ID NO: 62131 - DNA, 20 bp, Artificial Sequence
  chemically synthesized
tcctttcatcattcctgatg

SEQ ID NO: 62132 - DNA, 20 bp, Artificial Sequence
  chemically synthesized
gcgtctgctgtcagcatctt

SEQ ID NO: 62133 - DNA, 20 bp, Artificial Sequence
  chemically synthesized
gaaaaggacaaatgaataag

SEQ ID NO: 62134 - DNA, 20 bp, Artificial Sequence
  chemically synthesized
gacaaatgaataagacatgt

SEQ ID NO: 62135 - DNA, 20 bp, Artificial Sequence
  chemically synthesized
aatgaataagacatgttttt

SEQ ID NO: 62136 - DNA, 20 bp, Artificial Sequence
  chemically synthesized
aataagacatgtttttgttt

SEQ ID NO: 62137 - DNA, 20 bp, Artificial Sequence
  chemically synthesized
atagagctgatattggaggg

SEQ ID NO: 62138 - DNA, 20 bp, Artificial Sequence
  chemically synthesized
gagggtgaggcttatgcctg

SEQ ID NO: 62139 - DNA, 20 bp, Artificial Sequence
  chemically synthesized
aggcttatgcctgttgggat

SEQ ID NO: 62140 - DNA, 20 bp, Artificial Sequence
  chemically synthesized
gaaactgacctctcatgctg

SEQ ID NO: 62141 - DNA, 20 bp, Artificial Sequence
  chemically synthesized
ggctccacaactaggccaga

SEQ ID NO: 62142 - DNA, 20 bp, Artificial Sequence
  chemically synthesized
tcattgcattgaaacctcaa

SEQ ID NO: 62143 - DNA, 20 bp, Artificial Sequence
  chemically synthesized
atatgatacaatagtgacac

SEQ ID NO: 62144 - DNA, 20 bp, Artificial Sequence
  chemically synthesized
gcctgggtccctgctgggga

SEQ ID NO: 62145 - DNA, 20 bp, Artificial Sequence
  chemically synthesized
gttctgagtcctgtggtgtg

SEQ ID NO: 62146 - DNA, 20 bp, Artificial Sequence
  chemically synthesized
agcctttcaaggagcacttg

SEQ ID NO: 62147 - DNA, 20 bp, Artificial Sequence
  chemically synthesized
gtcatctgtgggtgtaggct

SEQ ID NO: 62148 - DNA, 20 bp, Artificial Sequence
  chemically synthesized
gcattctccccgggatggac

SEQ ID NO: 62149 - DNA, 20 bp, Artificial Sequence
  chemically synthesized
ctctatcccccatacacagc

SEQ ID NO: 62150 - DNA, 20 bp, Artificial Sequence
  chemically synthesized
atcccccatacacagctcat

SEQ ID NO: 62151 - DNA, 20 bp, Artificial Sequence
  chemically synthesized
cccatacacagctcatgttt

SEQ ID NO: 62152 - DNA, 20 bp, Artificial Sequence
  chemically synthesized
acagctcatgtttgcttgtt

SEQ ID NO: 62153 - DNA, 20 bp, Artificial Sequence
  chemically synthesized
tgcttgtttgttgtttggat

SEQ ID NO: 62154 - DNA, 20 bp, Artificial Sequence
  chemically synthesized
gtttggataaatgcttcccg

SEQ ID NO: 62155 - DNA, 20 bp, Artificial Sequence
  chemically synthesized
atcagtgtgaaatctgtatt

SEQ ID NO: 62156 - DNA, 20 bp, Artificial Sequence
  chemically synthesized
acagggtgccccctgtccgg

SEQ ID NO: 62157 - DNA, 20 bp, Artificial Sequence
  chemically synthesized
gcagagcttgcacttcaaac

SEQ ID NO: 62158 - DNA, 20 bp, Artificial Sequence
  chemically synthesized
caaactaaggcttcctttat

SEQ ID NO: 62159 - DNA, 20 bp, Artificial Sequence
  chemically synthesized
aggttcctggctgagctgga

SEQ ID NO: 62160 - DNA, 20 bp, Artificial Sequence
  chemically synthesized
gctgagctggaagctgtttt

SEQ ID NO: 62161 - DNA, 20 bp, Artificial Sequence
  chemically synthesized
gttttctgcgtttccctctc

SEQ ID NO: 62162 - DNA, 20 bp, Artificial Sequence
  chemically synthesized
ttggaacacccagggtgccc

SEQ ID NO: 62163 - DNA, 20 bp, Artificial Sequence
  chemically synthesized
agtgtggtcctggaggatgg

SEQ ID NO: 62164 - DNA, 20 bp, Artificial Sequence
  chemically synthesized
gagcatttgacctgctgggc

SEQ ID NO: 62165 - DNA, 20 bp, Artificial Sequence
  chemically synthesized
gcccatccttgactgatccc

SEQ ID NO: 62166 - DNA, 20 bp, Artificial Sequence
  chemically synthesized
aattccctctgggaggttat

SEQ ID NO: 62167 - DNA, 20 bp, Artificial Sequence
  chemically synthesized
gctgtgtcaacatctggtgg

SEQ ID NO: 62168 - DNA, 20 bp, Artificial Sequence
  chemically synthesized
cctgctccacactgggcaca

SEQ ID NO: 62169 - DNA, 20 bp, Artificial Sequence
  chemically synthesized
tgtgggccaccagcaaccct

SEQ ID NO: 62170 - DNA, 20 bp, Artificial Sequence
  chemically synthesized
taaggaggaattacctctgc

SEQ ID NO: 62171 - DNA, 20 bp, Artificial Sequence
  chemically synthesized
aggaacaagtagcccatcaa

SEQ ID NO: 62172 - DNA, 20 bp, Artificial Sequence
  chemically synthesized
gaccagtagcctctctgagc

SEQ ID NO: 62173 - DNA, 20 bp, Artificial Sequence
  chemically synthesized
cctctctgagcctcagtttc

SEQ ID NO: 62174 - DNA, 20 bp, Artificial Sequence
  chemically synthesized
agcctcagtttcctcagatt

SEQ ID NO: 62175 - DNA, 20 bp, Artificial Sequence
  chemically synthesized
gggaggtacttcatagggat

SEQ ID NO: 62176 - DNA, 20 bp, Artificial Sequence
  chemically synthesized
tagcaatgactggggctcag

SEQ ID NO: 62177 - DNA, 20 bp, Artificial Sequence
  chemically synthesized
tcaggtctggtgtcatccta

SEQ ID NO: 62178 - DNA, 20 bp, Artificial Sequence
  chemically synthesized
gagtgaaaggctgtcagtga

SEQ ID NO: 62179 - DNA, 20 bp, Artificial Sequence
  chemically synthesized
tgtgggaaacagtcggtatc

SEQ ID NO: 62180 - DNA, 20 bp, Artificial Sequence
  chemically synthesized
catgacagtgagtggttaga

SEQ ID NO: 62181 - DNA, 20 bp, Artificial Sequence
  chemically synthesized
tgagtggttagacagtgatt

SEQ ID NO: 62182 - DNA, 20 bp, Artificial Sequence
  chemically synthesized
ggttagacagtgattcctag

SEQ ID NO: 62183 - DNA, 20 bp, Artificial Sequence
  chemically synthesized
gttgcgggggtcaatgggtg

SEQ ID NO: 62184 - DNA, 20 bp, Artificial Sequence
  chemically synthesized
tcttcatctggggagaaggg

SEQ ID NO: 62185 - DNA, 20 bp, Artificial Sequence
  chemically synthesized
tgattctaaacggagatatg

SEQ ID NO: 62186 - DNA, 20 bp, Artificial Sequence
  chemically synthesized
tccttgttgccccatggaga

SEQ ID NO: 62187 - DNA, 20 bp, Artificial Sequence
  chemically synthesized
ggatgagcagggggacatga

SEQ ID NO: 62188 - DNA, 20 bp, Artificial Sequence
  chemically synthesized
gctggtatctggttcctccc

SEQ ID NO: 62189 - DNA, 20 bp, Artificial Sequence
  chemically synthesized
atgggcccaggtccgtaagc

SEQ ID NO: 62190 - DNA, 20 bp, Artificial Sequence
  chemically synthesized
aagctgaggattcagtcccc

SEQ ID NO: 62191 - DNA, 20 bp, Artificial Sequence
  chemically synthesized
gagactcagagaaaacatgg

SEQ ID NO: 62192 - DNA, 20 bp, Artificial Sequence
  chemically synthesized
cgagaggcagttatttttgg

SEQ ID NO: 62193 - DNA, 20 bp, Artificial Sequence
  chemically synthesized
gttcaatcattaagaagaca

SEQ ID NO: 62194 - DNA, 20 bp, Artificial Sequence
  chemically synthesized
gcctctaaaaacatggcccc

SEQ ID NO: 62195 - DNA, 20 bp, Artificial Sequence
  chemically synthesized
acataggccttgctcctcct

SEQ ID NO: 62196 - DNA, 20 bp, Artificial Sequence
  chemically synthesized
gggctctctcctttctagta

SEQ ID NO: 62197 - DNA, 20 bp, Artificial Sequence
  chemically synthesized
gcagttgttcattggtcgcc

SEQ ID NO: 62198 - DNA, 20 bp, Artificial Sequence
  chemically synthesized
agctgcacagcagtcccctg

SEQ ID NO: 62199 - DNA, 20 bp, Artificial Sequence
  chemically synthesized
agcagtcccctgcctggctt

SEQ ID NO: 62200 - DNA, 20 bp, Artificial Sequence
  chemically synthesized
ggagctcagcctgggtcttc

SEQ ID NO: 62201 - DNA, 20 bp, Artificial Sequence
  chemically synthesized
gtcagggtgatctcaccttg

SEQ ID NO: 62202 - DNA, 20 bp, Artificial Sequence
  chemically synthesized
gatcataggttccagtaatg

SEQ ID NO: 62203 - DNA, 20 bp, Artificial Sequence
  chemically synthesized
tctgggacccaccacagtgc

SEQ ID NO: 62204 - DNA, 20 bp, Artificial Sequence
  chemically synthesized
cacagtgcaagtgttttctt

SEQ ID NO: 62205 - DNA, 20 bp, Artificial Sequence
  chemically synthesized
cacccacactaagatgggaa

SEQ ID NO: 62206 - DNA, 20 bp, Artificial Sequence
  chemically synthesized
cactaagatgggaactcggc

SEQ ID NO: 62207 - DNA, 20 bp, Artificial Sequence
  chemically synthesized
gttaacatcgaatgaatcac

SEQ ID NO: 62208 - DNA, 20 bp, Artificial Sequence
  chemically synthesized
tggtggcagtgcccagtgac

SEQ ID NO: 62209 - DNA, 20 bp, Artificial Sequence
  chemically synthesized
caccaggctgagtgctcctc

SEQ ID NO: 62210 - DNA, 20 bp, Artificial Sequence
  chemically synthesized
agcagggtctggtgtgagcg

SEQ ID NO: 62211 - DNA, 20 bp, Artificial Sequence
  chemically synthesized
atggaacagagaaattccag

SEQ ID NO: 62212 - DNA, 20 bp, Artificial Sequence
  chemically synthesized
gacaccttttgtattttcat

SEQ ID NO: 62213 - DNA, 20 bp, Artificial Sequence
  chemically synthesized
cacatacactaatgtgtggc

SEQ ID NO: 62214 - DNA, 20 bp, Artificial Sequence
  chemically synthesized
ctggctgttccaattccgaa

SEQ ID NO: 62215 - DNA, 20 bp, Artificial Sequence
  chemically synthesized
tggtggcctcattctggaag

SEQ ID NO: 62216 - DNA, 20 bp, Artificial Sequence
  chemically synthesized
caacatggctaagaggtgtg

SEQ ID NO: 62217 - DNA, 20 bp, Artificial Sequence
  chemically synthesized
tgagttcattttccaggtgc

SEQ ID NO: 62218 - DNA, 20 bp, Artificial Sequence
  chemically synthesized
tcatcagcagcacccagctg

SEQ ID NO: 62219 - DNA, 20 bp, Artificial Sequence
  chemically synthesized
gctggatgttaaacatgcct

SEQ ID NO: 62220 - DNA, 20 bp, Artificial Sequence
  chemically synthesized
gggcatcaccaggggtgagt

SEQ ID NO: 62221 - DNA, 20 bp, Artificial Sequence
  chemically synthesized
acgacacacatccctcgagg

SEQ ID NO: 62222 - DNA, 20 bp, Artificial Sequence
  chemically synthesized
ctgaccatccaagctgccga

SEQ ID NO: 62223 - DNA, 20 bp, Artificial Sequence
  chemically synthesized
tgtgcatttttattggaatc

SEQ ID NO: 62224 - DNA, 20 bp, Artificial Sequence
  chemically synthesized
ttattcatccagggcaaaca

SEQ ID NO: 62225 - DNA, 20 bp, Artificial Sequence
  chemically synthesized
acattctgcttactattcct

SEQ ID NO: 62226 - DNA, 20 bp, Artificial Sequence
  chemically synthesized
cctgagagctttcctcatcc

SEQ ID NO: 62227 - DNA, 20 bp, Artificial Sequence
  chemically synthesized
cctcccctctgccataccaa

SEQ ID NO: 62228 - DNA, 20 bp, Artificial Sequence
  chemically synthesized
gggcctcagggacccctgat

SEQ ID NO: 62229 - DNA, 20 bp, Artificial Sequence
  chemically synthesized
ctcccacctcccctccccta

SEQ ID NO: 62230 - DNA, 20 bp, Artificial Sequence
  chemically synthesized
gttttcctgggacagtggga

SEQ ID NO: 62231 - DNA, 20 bp, Artificial Sequence
  chemically synthesized
ccatccccacagtctttgtc

SEQ ID NO: 62232 - DNA, 20 bp, Artificial Sequence
  chemically synthesized
cacctcaaagaggtagaatg

SEQ ID NO: 62233 - DNA, 20 bp, Artificial Sequence
  chemically synthesized
aaaagctaattgtgttagag

SEQ ID NO: 62234 - DNA, 20 bp, Artificial Sequence
  chemically synthesized
caggatttgaacccaggtct

SEQ ID NO: 62235 - DNA, 20 bp, Artificial Sequence
  chemically synthesized
ctttcagattgcaaaactga

SEQ ID NO: 62236 - DNA, 20 bp, Artificial Sequence
  chemically synthesized
aaaagttctgcagagctgtc

SEQ ID NO: 62237 - DNA, 20 bp, Artificial Sequence
  chemically synthesized
gcagagctgtcagtagtttt

SEQ ID NO: 62238 - DNA, 20 bp, Artificial Sequence
  chemically synthesized
ctcaatgatggaaaacattt

SEQ ID NO: 62239 - DNA, 20 bp, Artificial Sequence
  chemically synthesized
ccaaggagagttcaagaact

SEQ ID NO: 62240 - DNA, 20 bp, Artificial Sequence
  chemically synthesized
aactgatggtttgagaatat

SEQ ID NO: 62241 - DNA, 20 bp, Artificial Sequence
  chemically synthesized
gatggtttgagaatattttt

SEQ ID NO: 62242 - DNA, 20 bp, Artificial Sequence
  chemically synthesized
ccttctccacgtaatcgttg

SEQ ID NO: 62243 - DNA, 20 bp, Artificial Sequence
  chemically synthesized
gtgtccccgaagttgacagt

SEQ ID NO: 62244 - DNA, 20 bp, Artificial Sequence
  chemically synthesized
catcctccaaaaacttatcc

SEQ ID NO: 62245 - DNA, 20 bp, Artificial Sequence
  chemically synthesized
gaggttgaaattcaggccct

SEQ ID NO: 62246 - DNA, 20 bp, Artificial Sequence
  chemically synthesized
acatgatgactcccagtgat

SEQ ID NO: 62247 - DNA, 20 bp, Artificial Sequence
  chemically synthesized
tgacaccacgtggaagtgcc

SEQ ID NO: 62248 - DNA, 20 bp, Artificial Sequence
  chemically synthesized
gaagaatagcaaaatgtacg

SEQ ID NO: 62249 - DNA, 20 bp, Artificial Sequence
  chemically synthesized
cgtgctcacatgtgttaatt

SEQ ID NO: 62250 - DNA, 20 bp, Artificial Sequence
  chemically synthesized
agatgaagaaaccaaagcca

SEQ ID NO: 62251 - DNA, 20 bp, Artificial Sequence
  chemically synthesized
taagatgcaaatggtacagc

SEQ ID NO: 62252 - DNA, 20 bp, Artificial Sequence
  chemically synthesized
aagaagaggaatgggcctgc

SEQ ID NO: 62253 - DNA, 20 bp, Artificial Sequence
  chemically synthesized
tgtcaagctggaagcccttg

SEQ ID NO: 62254 - DNA, 20 bp, Artificial Sequence
  chemically synthesized
agctagagagcatggagggg

SEQ ID NO: 62255 - DNA, 20 bp, Artificial Sequence
  chemically synthesized
tcacaaggatcctcagccct

SEQ ID NO: 62256 - DNA, 20 bp, Artificial Sequence
  chemically synthesized
aataggctgatgctcctgca

SEQ ID NO: 62257 - DNA, 20 bp, Artificial Sequence
  chemically synthesized
agttctgggctcttgctgtc

SEQ ID NO: 62258 - DNA, 20 bp, Artificial Sequence
  chemically synthesized
gctcatctctccttgaaagc

SEQ ID NO: 62259 - DNA, 20 bp, Artificial Sequence
  chemically synthesized
tccttgaaagcaggggtttg

SEQ ID NO: 62260 - DNA, 20 bp, Artificial Sequence
  chemically synthesized
attttgcctcatacataaag

SEQ ID NO: 62261 - DNA, 20 bp, Artificial Sequence
  chemically synthesized
ttggcaggtgttgcaaattc

SEQ ID NO: 62262 - DNA, 20 bp, Artificial Sequence
  chemically synthesized
gtgataggccagtgaggaat

SEQ ID NO: 62263 - DNA, 20 bp, Artificial Sequence
  chemically synthesized
tccttctactccagatatgc

SEQ ID NO: 62264 - DNA, 20 bp, Artificial Sequence
  chemically synthesized
aaagctggaaataacaaata

SEQ ID NO: 62265 - DNA, 20 bp, Artificial Sequence
  chemically synthesized
ttcaacccccttggactttt

SEQ ID NO: 62266 - DNA, 20 bp, Artificial Sequence
  chemically synthesized
agcaacaaatgaagtgcaaa

SEQ ID NO: 62267 - DNA, 20 bp, Artificial Sequence
  chemically synthesized
cagaccacacattacataat

SEQ ID NO: 62268 - DNA, 20 bp, Artificial Sequence
  chemically synthesized
ctgaactttgtgcagtcctt

SEQ ID NO: 62269 - DNA, 20 bp, Artificial Sequence
  chemically synthesized
gtggcctcagggccagaggt

SEQ ID NO: 62270 - DNA, 20 bp, Artificial Sequence
  chemically synthesized
ggggccctctgtacactaac

SEQ ID NO: 62271 - DNA, 20 bp, Artificial Sequence
  chemically synthesized
ctgtacactaacataggttt

SEQ ID NO: 62272 - DNA, 20 bp, Artificial Sequence
  chemically synthesized
gggttttttttgagacagag

SEQ ID NO: 62273 - DNA, 20 bp, Artificial Sequence
  chemically synthesized
ggttcaagaaattcttctgt

SEQ ID NO: 62274 - DNA, 20 bp, Artificial Sequence
  chemically synthesized
tgtctcagcttcccaaatag

SEQ ID NO: 62275 - DNA, 20 bp, Artificial Sequence
  chemically synthesized
ttttgtatttttagtagagc

SEQ ID NO: 62276 - DNA, 20 bp, Artificial Sequence
  chemically synthesized
gcgagagcccctgcacccag

SEQ ID NO: 62277 - DNA, 20 bp, Artificial Sequence
  chemically synthesized
cctggtgtcacatcacctac

SEQ ID NO: 62278 - DNA, 20 bp, Artificial Sequence
  chemically synthesized
ggtttcctcctttcacagtg

SEQ ID NO: 62279 - DNA, 20 bp, Artificial Sequence
  chemically synthesized
gtgacaaagctggaacaagt

SEQ ID NO: 62280 - DNA, 20 bp, Artificial Sequence
  chemically synthesized
atggtgtacggacactgagg

SEQ ID NO: 62281 - DNA, 20 bp, Artificial Sequence
  chemically synthesized
aagctttaaaccaaaagaat

SEQ ID NO: 62282 - DNA, 20 bp, Artificial Sequence
  chemically synthesized
atgacttcacttctttgagc

SEQ ID NO: 62283 - DNA, 20 bp, Artificial Sequence
  chemically synthesized
tgagctcctgcccgagagat

SEQ ID NO: 62284 - DNA, 20 bp, Artificial Sequence
  chemically synthesized
tgctcagcagtgaacagcat

SEQ ID NO: 62285 - DNA, 20 bp, Artificial Sequence
  chemically synthesized
aattttccattaaattatcc

SEQ ID NO: 62286 - DNA, 20 bp, Artificial Sequence
  chemically synthesized
ttgccacacttactaacacc

SEQ ID NO: 62287 - DNA, 20 bp, Artificial Sequence
  chemically synthesized
cgtatcatctaatctgtcct

SEQ ID NO: 62288 - DNA, 20 bp, Artificial Sequence
  chemically synthesized
tcactaaaaatcacagagct

SEQ ID NO: 62289 - DNA, 20 bp, Artificial Sequence
  chemically synthesized
caaaactgagatgtaatcct

SEQ ID NO: 62290 - DNA, 20 bp, Artificial Sequence
  chemically synthesized
tgtaatcctaaatgttttgt

SEQ ID NO: 62291 - DNA, 20 bp, Artificial Sequence
  chemically synthesized
aaatgttttgtctgggatta

SEQ ID NO: 62292 - DNA, 20 bp, Artificial Sequence
  chemically synthesized
ctaaaattaaaggctctgag

SEQ ID NO: 62293 - DNA, 20 bp, Artificial Sequence
  chemically synthesized
gttacttaacctctctgaac

SEQ ID NO: 62294 - DNA, 20 bp, Artificial Sequence
  chemically synthesized
gggacagaagtcaaaggtta

SEQ ID NO: 62295 - DNA, 20 bp, Artificial Sequence
  chemically synthesized
agagaggcctcaagtccagc

SEQ ID NO: 62296 - DNA, 20 bp, Artificial Sequence
  chemically synthesized
gtgacactagggccaggttc

SEQ ID NO: 62297 - DNA, 20 bp, Artificial Sequence
  chemically synthesized
gagcccgaattatggatggt

SEQ ID NO: 62298 - DNA, 20 bp, Artificial Sequence
  chemically synthesized
gtaactgccttggagggtta

SEQ ID NO: 62299 - DNA, 20 bp, Artificial Sequence
  chemically synthesized
ttatgaggcttaatcacgca

SEQ ID NO: 62300 - DNA, 20 bp, Artificial Sequence
  chemically synthesized
cttagccgtggcctggtgca

SEQ ID NO: 62301 - DNA, 20 bp, Artificial Sequence
  chemically synthesized
cagagcgattattcaggaat

SEQ ID NO: 62302 - DNA, 20 bp, Artificial Sequence
  chemically synthesized
ccctgggtgacagtgcccct

SEQ ID NO: 62303 - DNA, 20 bp, Artificial Sequence
  chemically synthesized
ccaagcagtaggagaggtgg

SEQ ID NO: 62304 - DNA, 20 bp, Artificial Sequence
  chemically synthesized
gtgcaaacagaaagaaatgg

SEQ ID NO: 62305 - DNA, 20 bp, Artificial Sequence
  chemically synthesized
acctagacaccctcatccac

SEQ ID NO: 62306 - DNA, 20 bp, Artificial Sequence
  chemically synthesized
tctcgcagtgaaaggcatac

SEQ ID NO: 62307 - DNA, 20 bp, Artificial Sequence
  chemically synthesized
gtcgcccgcctacgctgccc

SEQ ID NO: 62308 - DNA, 20 bp, Artificial Sequence
  chemically synthesized
gacgctttgcctgggcagtg

SEQ ID NO: 62309 - DNA, 20 bp, Artificial Sequence
  chemically synthesized
gagctgtgctgcctcaggca

SEQ ID NO: 62310 - DNA, 20 bp, Artificial Sequence
  chemically synthesized
cttcacctctctgaaccagg

SEQ ID NO: 62311 - DNA, 20 bp, Artificial Sequence
  chemically synthesized
cacctgcatcccaaagagtt

SEQ ID NO: 62312 - DNA, 20 bp, Artificial Sequence
  chemically synthesized
gttggaagtttcattcccaa

SEQ ID NO: 62313 - DNA, 20 bp, Artificial Sequence
  chemically synthesized
ttatgtgggtctgcacagcc

SEQ ID NO: 62314 - DNA, 20 bp, Artificial Sequence
  chemically synthesized
tcaattttgaccagcctcag

SEQ ID NO: 62315 - DNA, 20 bp, Artificial Sequence
  chemically synthesized
ttgaccagcctcaggcctgt

SEQ ID NO: 62316 - DNA, 20 bp, Artificial Sequence
  chemically synthesized
gaaaaccagtgtgatccgta

SEQ ID NO: 62317 - DNA, 20 bp, Artificial Sequence
  chemically synthesized
agtgtgatccgtatacagct

SEQ ID NO: 62318 - DNA, 20 bp, Artificial Sequence
  chemically synthesized
gttgaggctagtggggcccc

SEQ ID NO: 62319 - DNA, 20 bp, Artificial Sequence
  chemically synthesized
caatccctttaaaagcctaa

SEQ ID NO: 62320 - DNA, 20 bp, Artificial Sequence
  chemically synthesized
gcccgctgtgcaacccgcaa

SEQ ID NO: 62321 - DNA, 20 bp, Artificial Sequence
  chemically synthesized
tggctgtgaggcctcaggtg

SEQ ID NO: 62322 - DNA, 20 bp, Artificial Sequence
  chemically synthesized
tgtaccttgttgagctgctg

SEQ ID NO: 62323 - DNA, 20 bp, Artificial Sequence
  chemically synthesized
ggtggggtgggccacacttg

SEQ ID NO: 62324 - DNA, 20 bp, Artificial Sequence
  chemically synthesized
ccttccctgcagctccatcc

SEQ ID NO: 62325 - DNA, 20 bp, Artificial Sequence
  chemically synthesized
atttcttcccctctctgggc

SEQ ID NO: 62326 - DNA, 20 bp, Artificial Sequence
  chemically synthesized
cagtaggctggggaggggcg

SEQ ID NO: 62327 - DNA, 20 bp, Artificial Sequence
  chemically synthesized
gaggtacagtcacactgccc

SEQ ID NO: 62328 - DNA, 20 bp, Artificial Sequence
  chemically synthesized
agacctggcaccaataactg

SEQ ID NO: 62329 - DNA, 20 bp, Artificial Sequence
  chemically synthesized
taggacctggctgggtgcag

SEQ ID NO: 62330 - DNA, 20 bp, Artificial Sequence
  chemically synthesized
aagggattgcagtggggagc

SEQ ID NO: 62331 - DNA, 20 bp, Artificial Sequence
  chemically synthesized
gctggatagggatgtgagag

SEQ ID NO: 62332 - DNA, 20 bp, Artificial Sequence
  chemically synthesized
atgcaccctccttcccaggc

SEQ ID NO: 62333 - DNA, 20 bp, Artificial Sequence
  chemically synthesized
gccacttaacctctctgtgc

SEQ ID NO: 62334 - DNA, 20 bp, Artificial Sequence
  chemically synthesized
tctaagtgggggaacaactg

SEQ ID NO: 62335 - DNA, 20 bp, Artificial Sequence
  chemically synthesized
gaacaactgctgcgtttggc

SEQ ID NO: 62336 - DNA, 20 bp, Artificial Sequence
  chemically synthesized
ctgttgttgagggacacctc

SEQ ID NO: 62337 - DNA, 20 bp, Artificial Sequence
  chemically synthesized
tctttaggggccgtgctcat

SEQ ID NO: 62338 - DNA, 20 bp, Artificial Sequence
  chemically synthesized
aggccctcagttctctgagc

SEQ ID NO: 62339 - DNA, 20 bp, Artificial Sequence
  chemically synthesized
ctcatctataaaatagggat

SEQ ID NO: 62340 - DNA, 20 bp, Artificial Sequence
  chemically synthesized
tctttcccacatagctcttc

SEQ ID NO: 62341 - DNA, 20 bp, Artificial Sequence
  chemically synthesized
tagatgaggcgatgctggtg

SEQ ID NO: 62342 - DNA, 20 bp, Artificial Sequence
  chemically synthesized
taactcatttaatgaatgaa

SEQ ID NO: 62343 - DNA, 20 bp, Artificial Sequence
  chemically synthesized
ctgtgtgttggggaggggag

SEQ ID NO: 62344 - DNA, 20 bp, Artificial Sequence
  chemically synthesized
ctggaactatgtggcctact

SEQ ID NO: 62345 - DNA, 20 bp, Artificial Sequence
  chemically synthesized
ctggagtacagtggcgcaat

SEQ ID NO: 62346 - DNA, 20 bp, Artificial Sequence
  chemically synthesized
ctctcgaattctggaattac

SEQ ID NO: 62347 - DNA, 20 bp, Artificial Sequence
  chemically synthesized
ttttgtatttttagtagtga

SEQ ID NO: 62348 - DNA, 20 bp, Artificial Sequence
  chemically synthesized
agaaggaataaaaatgcatc

SEQ ID NO: 62349 - DNA, 20 bp, Artificial Sequence
  chemically synthesized
cttgttaaaattactaaaac

SEQ ID NO: 62350 - DNA, 20 bp, Artificial Sequence
  chemically synthesized
ttatgggccttgatggtcat

SEQ ID NO: 62351 - DNA, 20 bp, Artificial Sequence
  chemically synthesized
cttgatggtcattacggatt

SEQ ID NO: 62352 - DNA, 20 bp, Artificial Sequence
  chemically synthesized
tgtgtcctattgaactataa

SEQ ID NO: 62353 - DNA, 20 bp, Artificial Sequence
  chemically synthesized
cctattgaactataattatg

SEQ ID NO: 62354 - DNA, 20 bp, Artificial Sequence
  chemically synthesized
atccctttgacaatctctgc

SEQ ID NO: 62355 - DNA, 20 bp, Artificial Sequence
  chemically synthesized
ctgatgtttcagcaacacac

SEQ ID NO: 62356 - DNA, 20 bp, Artificial Sequence
  chemically synthesized
tgggagacccagcaggactt

SEQ ID NO: 62357 - DNA, 20 bp, Artificial Sequence
  chemically synthesized
agaaatacatgccctgcgtg

SEQ ID NO: 62358 - DNA, 20 bp, Artificial Sequence
  chemically synthesized
cccagaaggcctctgtcact

SEQ ID NO: 62359 - DNA, 20 bp, Artificial Sequence
  chemically synthesized
gaaggcctctgtcactgcgt

SEQ ID NO: 62360 - DNA, 20 bp, Artificial Sequence
  chemically synthesized
gtgtgttgctgaaacatcag

SEQ ID NO: 62361 - DNA, 20 bp, Artificial Sequence
  chemically synthesized
taggacacattgagtctctt

SEQ ID NO: 62362 - DNA, 20 bp, Artificial Sequence
  chemically synthesized
aaggttagctgcaataaaac

SEQ ID NO: 62363 - DNA, 20 bp, Artificial Sequence
  chemically synthesized
ctatgttgccccttataatg

SEQ ID NO: 62364 - DNA, 20 bp, Artificial Sequence
  chemically synthesized
cgggcagataacttgaggcc

SEQ ID NO: 62365 - DNA, 20 bp, Artificial Sequence
  chemically synthesized
taattccagaattcgagagg

SEQ ID NO: 62366 - DNA, 20 bp, Artificial Sequence
  chemically synthesized
gaggtggagtttgcagtaag

SEQ ID NO: 62367 - DNA, 20 bp, Artificial Sequence
  chemically synthesized
caacacacaggaagtggctc

SEQ ID NO: 62368 - DNA, 20 bp, Artificial Sequence
  chemically synthesized
cagaaggaaagtgtgtctgc

SEQ ID NO: 62369 - DNA, 20 bp, Artificial Sequence
  chemically synthesized
aatgagcacggcccctaaag

SEQ ID NO: 62370 - DNA, 20 bp, Artificial Sequence
  chemically synthesized
cagccttttctggaaaaaat

SEQ ID NO: 62371 - DNA, 20 bp, Artificial Sequence
  chemically synthesized
agacccctgagacccatcta

SEQ ID NO: 62372 - DNA, 20 bp, Artificial Sequence
  chemically synthesized
cacatgccagaggctgcccg

SEQ ID NO: 62373 - DNA, 20 bp, Artificial Sequence
  chemically synthesized
accgaggcacagagaggtta

SEQ ID NO: 62374 - DNA, 20 bp, Artificial Sequence
  chemically synthesized
cacaaaaagagcgatggagc

SEQ ID NO: 62375 - DNA, 20 bp, Artificial Sequence
  chemically synthesized
tgagggtgtgcatggggtgt

SEQ ID NO: 62376 - DNA, 20 bp, Artificial Sequence
  chemically synthesized
tctcctgaccagccactcag

SEQ ID NO: 62377 - DNA, 20 bp, Artificial Sequence
  chemically synthesized
ctggcacacctcaccccctt

SEQ ID NO: 62378 - DNA, 20 bp, Artificial Sequence
  chemically synthesized
cacccctcccaccacaaccc

SEQ ID NO: 62379 - DNA, 20 bp, Artificial Sequence
  chemically synthesized
acccccgggattttgtcctg

SEQ ID NO: 62380 - DNA, 20 bp, Artificial Sequence
  chemically synthesized
attttgtcctggtgcgtttt

SEQ ID NO: 62381 - DNA, 20 bp, Artificial Sequence
  chemically synthesized
cttgcctcacctgctcccac

SEQ ID NO: 62382 - DNA, 20 bp, Artificial Sequence
  chemically synthesized
caggtgacatgccgggctgt

SEQ ID NO: 62383 - DNA, 20 bp, Artificial Sequence
  chemically synthesized
cctgtgcctgccagaagaga

SEQ ID NO: 62384 - DNA, 20 bp, Artificial Sequence
  chemically synthesized
cagaagagacagagcttgag

SEQ ID NO: 62385 - DNA, 20 bp, Artificial Sequence
  chemically synthesized
tccacaggtgggagggacag

SEQ ID NO: 62386 - DNA, 20 bp, Artificial Sequence
  chemically synthesized
gaaggggaggggagtctgag

SEQ ID NO: 62387 - DNA, 20 bp, Artificial Sequence
  chemically synthesized
ggagggagggcagcatcagg

SEQ ID NO: 62388 - DNA, 20 bp, Artificial Sequence
  chemically synthesized
ggcacacccagtacccgtct

SEQ ID NO: 62389 - DNA, 20 bp, Artificial Sequence
  chemically synthesized
gcacgtacgccagctcccaa

SEQ ID NO: 62390 - DNA, 20 bp, Artificial Sequence
  chemically synthesized
gttgcacagcgggcgatgca

SEQ ID NO: 62391 - DNA, 20 bp, Artificial Sequence
  chemically synthesized
agcgggcgatgcaatctgat

SEQ ID NO: 62392 - DNA, 20 bp, Artificial Sequence
  chemically synthesized
caatctgatttaggctttta

SEQ ID NO: 62393 - DNA, 20 bp, Artificial Sequence
  chemically synthesized
ccaagctgtatacggatcac

SEQ ID NO: 62394 - DNA, 20 bp, Artificial Sequence
  chemically synthesized
tcacccgaggcacttcacaa

SEQ ID NO: 62395 - DNA, 20 bp, Artificial Sequence
  chemically synthesized
agcacagctcttctttacag

SEQ ID NO: 62396 - DNA, 20 bp, Artificial Sequence
  chemically synthesized
ttccatcgggaccatcaaga

SEQ ID NO: 62397 - DNA, 20 bp, Artificial Sequence
  chemically synthesized
gagcggtctctccgctctga

SEQ ID NO: 62398 - DNA, 20 bp, Artificial Sequence
  chemically synthesized
gctaccagtggaacagccac

SEQ ID NO: 62399 - DNA, 20 bp, Artificial Sequence
  chemically synthesized
ccaccttggacacaggacgc

SEQ ID NO: 62400 - DNA, 20 bp, Artificial Sequence
  chemically synthesized
tcccagccagtggacttagc

SEQ ID NO: 62401 - DNA, 20 bp, Artificial Sequence
  chemically synthesized
ccccgttgcccctctggatc

SEQ ID NO: 62402 - DNA, 20 bp, Artificial Sequence
  chemically synthesized
cgaggacagggccctgtctc

SEQ ID NO: 62403 - DNA, 20 bp, Artificial Sequence
  chemically synthesized
ttcactgcgagaggttctgg

SEQ ID NO: 62404 - DNA, 20 bp, Artificial Sequence
  chemically synthesized
cagcagccatgagggttgtg

SEQ ID NO: 62405 - DNA, 20 bp, Artificial Sequence
  chemically synthesized
aacaaagcgcagccatttct

SEQ ID NO: 62406 - DNA, 20 bp, Artificial Sequence
  chemically synthesized
ataagcctcaccacctctcc

SEQ ID NO: 62407 - DNA, 20 bp, Artificial Sequence
  chemically synthesized
aggccacggctaagctcagt

SEQ ID NO: 62408 - DNA, 20 bp, Artificial Sequence
  chemically synthesized
accctccaaggcagttacta

SEQ ID NO: 62409 - DNA, 20 bp, Artificial Sequence
  chemically synthesized
cttgaacctggccctagtgt

SEQ ID NO: 62410 - DNA, 20 bp, Artificial Sequence
  chemically synthesized
ccttgatctctgaagtgttg

SEQ ID NO: 62411 - DNA, 20 bp, Artificial Sequence
  chemically synthesized
aggatttaatttttcctgca

SEQ ID NO: 62412 - DNA, 20 bp, Artificial Sequence
  chemically synthesized
agatgaccaaggccaaggtg

SEQ ID NO: 62413 - DNA, 20 bp, Artificial Sequence
  chemically synthesized
tcatttagccaggctgcctc

SEQ ID NO: 62414 - DNA, 20 bp, Artificial Sequence
  chemically synthesized
gccaggctgcctctgaagtt

SEQ ID NO: 62415 - DNA, 20 bp, Artificial Sequence
  chemically synthesized
aagttttctgattcaagact

SEQ ID NO: 62416 - DNA, 20 bp, Artificial Sequence
  chemically synthesized
tctgattcaagacttctggc

SEQ ID NO: 62417 - DNA, 20 bp, Artificial Sequence
  chemically synthesized
ggcttcagctttgtacacag

SEQ ID NO: 62418 - DNA, 20 bp, Artificial Sequence
  chemically synthesized
tacacagagatgattcaatg

SEQ ID NO: 62419 - DNA, 20 bp, Artificial Sequence
  chemically synthesized
atgtcaggttttggagtgaa

SEQ ID NO: 62420 - DNA, 20 bp, Artificial Sequence
  chemically synthesized
tttaatcccagacaaaacat

SEQ ID NO: 62421 - DNA, 20 bp, Artificial Sequence
  chemically synthesized
caaaacatttaggattacat

SEQ ID NO: 62422 - DNA, 20 bp, Artificial Sequence
  chemically synthesized
agttttgtaagcaagtagct

SEQ ID NO: 62423 - DNA, 20 bp, Artificial Sequence
  chemically synthesized
aataatttgcaccttatagg

SEQ ID NO: 62424 - DNA, 20 bp, Artificial Sequence
  chemically synthesized
cttatagggtaagctttgag

SEQ ID NO: 62425 - DNA, 20 bp, Artificial Sequence
  chemically synthesized
aatgatggtgacgctgaggc

SEQ ID NO: 62426 - DNA, 20 bp, Artificial Sequence
  chemically synthesized
atggtgacgctgaggctgat

SEQ ID NO: 62427 - DNA, 20 bp, Artificial Sequence
  chemically synthesized
aacctgtgtgcaggtacagg

SEQ ID NO: 62428 - DNA, 20 bp, Artificial Sequence
  chemically synthesized
gttattcctcatccctgtcc

SEQ ID NO: 62429 - DNA, 20 bp, Artificial Sequence
  chemically synthesized
gtgacagggcctggtcacac

SEQ ID NO: 62430 - DNA, 20 bp, Artificial Sequence
  chemically synthesized
atttattgcccagttcaaca

SEQ ID NO: 62431 - DNA, 20 bp, Artificial Sequence
  chemically synthesized
aacaggttgtttgaccatag

SEQ ID NO: 62432 - DNA, 20 bp, Artificial Sequence
  chemically synthesized
tgctcccgggtagaaatggt

SEQ ID NO: 62433 - DNA, 20 bp, Artificial Sequence
  chemically synthesized
gtgagattaggcagggagtg

SEQ ID NO: 62434 - DNA, 20 bp, Artificial Sequence
  chemically synthesized
caccatgaagccttcattct

SEQ ID NO: 62435 - DNA, 20 bp, Artificial Sequence
  chemically synthesized
aagccttcattcttttggtt

SEQ ID NO: 62436 - DNA, 20 bp, Artificial Sequence
  chemically synthesized
ctccagtcgccctcccaggc

SEQ ID NO: 62437 - DNA, 20 bp, Artificial Sequence
  chemically synthesized
gatagaagggccaggagaga

SEQ ID NO: 62438 - DNA, 20 bp, Artificial Sequence
  chemically synthesized
ggagtcctgatgttataagg

SEQ ID NO: 62439 - DNA, 20 bp, Artificial Sequence
  chemically synthesized
gaggcataatgaacccaaca

SEQ ID NO: 62440 - DNA, 20 bp, Artificial Sequence
  chemically synthesized
ctgggaaagccaagacttgt

SEQ ID NO: 62441 - DNA, 20 bp, Artificial Sequence
  chemically synthesized
caacaaggccctgaccctct

SEQ ID NO: 62442 - DNA, 20 bp, Artificial Sequence
  chemically synthesized
cctagccatgggaattctcc

SEQ ID NO: 62443 - DNA, 20 bp, Artificial Sequence
  chemically synthesized
atttcttgaacccgggaggt

SEQ ID NO: 62444 - DNA, 20 bp, Artificial Sequence
  chemically synthesized
gagagtgaggccccaggacc

SEQ ID NO: 62445 - DNA, 20 bp, Artificial Sequence
  chemically synthesized
gtaatgtgtggtctgttcca

SEQ ID NO: 62446 - DNA, 20 bp, Artificial Sequence
  chemically synthesized
gagaaaggtggtggagagaa

SEQ ID NO: 62447 - DNA, 20 bp, Artificial Sequence
  chemically synthesized
aaccagctttgcacttcatt

SEQ ID NO: 62448 - DNA, 20 bp, Artificial Sequence
  chemically synthesized
gaatctcaatatttgttatt

SEQ ID NO: 62449 - DNA, 20 bp, Artificial Sequence
  chemically synthesized
gttatttccagctttttttc

SEQ ID NO: 62450 - DNA, 20 bp, Artificial Sequence
  chemically synthesized
tctttgtattttgttaagat

SEQ ID NO: 62451 - DNA, 20 bp, Artificial Sequence
  chemically synthesized
tattttgttaagatgatggt

SEQ ID NO: 62452 - DNA, 20 bp, Artificial Sequence
  chemically synthesized
atattctcctcagctaggac

SEQ ID NO: 62453 - DNA, 20 bp, Artificial Sequence
  chemically synthesized
cctctcagatccttttgatg

SEQ ID NO: 62454 - DNA, 20 bp, Artificial Sequence
  chemically synthesized
tacacctggaaagtgacaga

SEQ ID NO: 62455 - DNA, 20 bp, Artificial Sequence
  chemically synthesized
tactttaaagcagcacaaac

SEQ ID NO: 62456 - DNA, 20 bp, Artificial Sequence
  chemically synthesized
ttgggtgggaacagctccca

SEQ ID NO: 62457 - DNA, 20 bp, Artificial Sequence
  chemically synthesized
gatgcatttcccttctgtgc

SEQ ID NO: 62458 - DNA, 20 bp, Artificial Sequence
  chemically synthesized
gtttccctggccactaaata

SEQ ID NO: 62459 - DNA, 20 bp, Artificial Sequence
  chemically synthesized
ggattagatagaagccctcc

SEQ ID NO: 62460 - DNA, 20 bp, Artificial Sequence
  chemically synthesized
atagaagccctccaagggct

SEQ ID NO: 62461 - DNA, 20 bp, Artificial Sequence
  chemically synthesized
ctccaagggcttccagcttg

SEQ ID NO: 62462 - DNA, 20 bp, Artificial Sequence
  chemically synthesized
ggcttccagcttgacatgat

SEQ ID NO: 62463 - DNA, 20 bp, Artificial Sequence
  chemically synthesized
tgattcttgattctgatctg

SEQ ID NO: 62464 - DNA, 20 bp, Artificial Sequence
  chemically synthesized
cctgggtgcaggacctagat

SEQ ID NO: 62465 - DNA, 20 bp, Artificial Sequence
  chemically synthesized
tgaatagctgacctaatctc

SEQ ID NO: 62466 - DNA, 20 bp, Artificial Sequence
  chemically synthesized
gctgacctaatctctctggc

SEQ ID NO: 62467 - DNA, 20 bp, Artificial Sequence
  chemically synthesized
gatattagcattagcacctc

SEQ ID NO: 62468 - DNA, 20 bp, Artificial Sequence
  chemically synthesized
acacatgtgagcacggagaa

SEQ ID NO: 62469 - DNA, 20 bp, Artificial Sequence
  chemically synthesized
ctacgtacattttgctattc

SEQ ID NO: 62470 - DNA, 20 bp, Artificial Sequence
  chemically synthesized
tcggcaagtacttggcacag

SEQ ID NO: 62471 - DNA, 20 bp, Artificial Sequence
  chemically synthesized
gggcctgaatttcaacctca

SEQ ID NO: 62472 - DNA, 20 bp, Artificial Sequence
  chemically synthesized
ttccggaggctcagatccat

SEQ ID NO: 62473 - DNA, 20 bp, Artificial Sequence
  chemically synthesized
cgagggcctgaagctagtgg

SEQ ID NO: 62474 - DNA, 20 bp, Artificial Sequence
  chemically synthesized
gaagaggccaagaaacagat

SEQ ID NO: 62475 - DNA, 20 bp, Artificial Sequence
  chemically synthesized
aagggtactcaagggaaaat

SEQ ID NO: 62476 - DNA, 20 bp, Artificial Sequence
  chemically synthesized
gaaaattgtggatttggtca

SEQ ID NO: 62477 - DNA, 20 bp, Artificial Sequence
  chemically synthesized
gtcaaggagcttgacagaga

SEQ ID NO: 62478 - DNA, 20 bp, Artificial Sequence
  chemically synthesized
caatgcattatgggccatag

SEQ ID NO: 62479 - DNA, 20 bp, Artificial Sequence
  chemically synthesized
gccatagcaatgcttttcag

SEQ ID NO: 62480 - DNA, 20 bp, Artificial Sequence
  chemically synthesized
atgcttttcagcgtggattc

SEQ ID NO: 62481 - DNA, 20 bp, Artificial Sequence
  chemically synthesized
ttttctacacacaaacacta

SEQ ID NO: 62482 - DNA, 20 bp, Artificial Sequence
  chemically synthesized
attgagtaatttgaggaaat

SEQ ID NO: 62483 - DNA, 20 bp, Artificial Sequence
  chemically synthesized
tactgtatatgtagaatata

SEQ ID NO: 62484 - DNA, 20 bp, Artificial Sequence
  chemically synthesized
tgtaatacactgcataaagg

SEQ ID NO: 62485 - DNA, 20 bp, Artificial Sequence
  chemically synthesized
tctagtgtcccagaatcagt

SEQ ID NO: 62486 - DNA, 20 bp, Artificial Sequence
  chemically synthesized
caaatcctgcctctaacaca

SEQ ID NO: 62487 - DNA, 20 bp, Artificial Sequence
  chemically synthesized
acaaaataccattcttgctg

SEQ ID NO: 62488 - DNA, 20 bp, Artificial Sequence
  chemically synthesized
attcttgctgtcaggttttt

SEQ ID NO: 62489 - DNA, 20 bp, Artificial Sequence
  chemically synthesized
aggtgggaggcaaggccagg

SEQ ID NO: 62490 - DNA, 20 bp, Artificial Sequence
  chemically synthesized
gctctcaggaatagtaagca

SEQ ID NO: 62491 - DNA, 20 bp, Artificial Sequence
  chemically synthesized
caagacaccctcaaataaac

SEQ ID NO: 62492 - DNA, 20 bp, Artificial Sequence
  chemically synthesized
gtagaaattctgcatcttcc

SEQ ID NO: 62493 - DNA, 20 bp, Artificial Sequence
  chemically synthesized
atccccacacaatctttttc

SEQ ID NO: 62494 - DNA, 20 bp, Artificial Sequence
  chemically synthesized
ctttttcggcagcttggatg

SEQ ID NO: 62495 - DNA, 20 bp, Artificial Sequence
  chemically synthesized
tgtgtgtcgtcaagggggct

SEQ ID NO: 62496 - DNA, 20 bp, Artificial Sequence
  chemically synthesized
ggcttctcagggaggggact

SEQ ID NO: 62497 - DNA, 20 bp, Artificial Sequence
  chemically synthesized
ccgtgaaggtgcctatgatg

SEQ ID NO: 62498 - DNA, 20 bp, Artificial Sequence
  chemically synthesized
gcctatgatgaagcgtttag

SEQ ID NO: 62499 - DNA, 20 bp, Artificial Sequence
  chemically synthesized
tcctggaaaatgaagacaga

SEQ ID NO: 62500 - DNA, 20 bp, Artificial Sequence
  chemically synthesized
tcactgctactctgtataaa

SEQ ID NO: 62501 - DNA, 20 bp, Artificial Sequence
  chemically synthesized
gcagaaccaaaaaggaacag

SEQ ID NO: 62502 - DNA, 20 bp, Artificial Sequence
  chemically synthesized
acagccaggccatgttcgca

SEQ ID NO: 62503 - DNA, 20 bp, Artificial Sequence
  chemically synthesized
aggccatgttcgcagaaggc

SEQ ID NO: 62504 - DNA, 20 bp, Artificial Sequence
  chemically synthesized
tctgtcactttatcggtgct

SEQ ID NO: 62505 - DNA, 20 bp, Artificial Sequence
  chemically synthesized
attagtgtatgtgtgtgcat

SEQ ID NO: 62506 - DNA, 20 bp, Artificial Sequence
  chemically synthesized
gcccatgccctgctgatcta

SEQ ID NO: 62507 - DNA, 20 bp, Artificial Sequence
  chemically synthesized
actgggcactgccaccagcc

SEQ ID NO: 62508 - DNA, 20 bp, Artificial Sequence
  chemically synthesized
acactacagggcaagatgag

SEQ ID NO: 62509 - DNA, 20 bp, Artificial Sequence
  chemically synthesized
atatcagaggaggtggcatt

SEQ ID NO: 62510 - DNA, 20 bp, Artificial Sequence
  chemically synthesized
ggaggtggcatttcaagctt

SEQ ID NO: 62511 - DNA, 20 bp, Artificial Sequence
  chemically synthesized
cttttctgcacgacaggtct

SEQ ID NO: 62512 - DNA, 20 bp, Artificial Sequence
  chemically synthesized
ggctgagctcctgaagatgc

SEQ ID NO: 62513 - DNA, 20 bp, Artificial Sequence
  chemically synthesized
aagaccttctagacattggg

SEQ ID NO: 62514 - DNA, 20 bp, Artificial Sequence
  chemically synthesized
atttatccatactgacacag

SEQ ID NO: 62515 - DNA, 20 bp, Artificial Sequence
  chemically synthesized
acacagaaaggtttgggcta

SEQ ID NO: 62516 - DNA, 20 bp, Artificial Sequence
  chemically synthesized
atttctgactccttcgatct

SEQ ID NO: 62517 - DNA, 20 bp, Artificial Sequence
  chemically synthesized
gatttggtgtctgaattaat

SEQ ID NO: 62518 - DNA, 20 bp, Artificial Sequence
  chemically synthesized
tgccagggtccgtgtcctca

SEQ ID NO: 62519 - DNA, 20 bp, Artificial Sequence
  chemically synthesized
gtgcacctgagcagggggag

SEQ ID NO: 62520 - DNA, 20 bp, Artificial Sequence
  chemically synthesized
cagggccgtccagggggagt

SEQ ID NO: 62521 - DNA, 20 bp, Artificial Sequence
  chemically synthesized
ggatcagccttacaacgtgt

SEQ ID NO: 62522 - DNA, 20 bp, Artificial Sequence
  chemically synthesized
agggactgaagctgctgggg

SEQ ID NO: 62523 - DNA, 20 bp, Artificial Sequence
  chemically synthesized
caacaaaccctttgtcttct

SEQ ID NO: 62524 - DNA, 20 bp, Artificial Sequence
  chemically synthesized
catgtgactgtaaatccctc

SEQ ID NO: 62525 - DNA, 20 bp, Artificial Sequence
  chemically synthesized
tctggctgggtaggcacatg

SEQ ID NO: 62526 - DNA, 20 bp, Artificial Sequence
  chemically synthesized
aatccaggggggactgaatc

SEQ ID NO: 62527 - DNA, 20 bp, Artificial Sequence
  chemically synthesized
cagcttacggacctgggccc

SEQ ID NO: 62528 - DNA, 20 bp, Artificial Sequence
  chemically synthesized
actgcctgatcgtgccgtgg

SEQ ID NO: 62529 - DNA, 20 bp, Artificial Sequence
  chemically synthesized
cacttctggaaaatgactga

SEQ ID NO: 62530 - DNA, 20 bp, Artificial Sequence
  chemically synthesized
ccccagaaagcctcacatat

SEQ ID NO: 62531 - DNA, 20 bp, Artificial Sequence
  chemically synthesized
ccccagatgaagaggagggt

SEQ ID NO: 62532 - DNA, 20 bp, Artificial Sequence
  chemically synthesized
gatgaagaggagggtctctg

SEQ ID NO: 62533 - DNA, 20 bp, Artificial Sequence
  chemically synthesized
tgaggttgagtcataccaaa

SEQ ID NO: 62534 - DNA, 20 bp, Artificial Sequence
  chemically synthesized
atggtgaaattagcaattct

SEQ ID NO: 62535 - DNA, 20 bp, Artificial Sequence
  chemically synthesized
cagtctaatcaatggatacc

SEQ ID NO: 62536 - DNA, 20 bp, Artificial Sequence
  chemically synthesized
cacacaagtctcctgttctc

SEQ ID NO: 62537 - DNA, 20 bp, Artificial Sequence
  chemically synthesized
gatgttcaagttagataaca

SEQ ID NO: 62538 - DNA, 20 bp, Artificial Sequence
  chemically synthesized
gaactacatttcttgcactt

SEQ ID NO: 62539 - DNA, 20 bp, Artificial Sequence
  chemically synthesized
ccctatgaagtacctcccct

SEQ ID NO: 62540 - DNA, 20 bp, Artificial Sequence
  chemically synthesized
cacagctcataagtggcaaa

SEQ ID NO: 62541 - DNA, 20 bp, Artificial Sequence
  chemically synthesized
aggggcagagtcaaagacaa

SEQ ID NO: 62542 - DNA, 20 bp, Artificial Sequence
  chemically synthesized
agggcggtcaccttagacac

SEQ ID NO: 62543 - DNA, 20 bp, Artificial Sequence
  chemically synthesized
tgatgggacaaccataagac

SEQ ID NO: 62544 - DNA, 20 bp, Artificial Sequence
  chemically synthesized
ctcagcttcactgtatcttc

SEQ ID NO: 62545 - DNA, 20 bp, Artificial Sequence
  chemically synthesized
gatgagagggaaacgcagaa

SEQ ID NO: 62546 - DNA, 20 bp, Artificial Sequence
  chemically synthesized
cctgaccttttacctcgcct

SEQ ID NO: 62547 - DNA, 20 bp, Artificial Sequence
  chemically synthesized
aggggagagaacacacgaat

SEQ ID NO: 62548 - DNA, 20 bp, Artificial Sequence
  chemically synthesized
taagcctaaataaaggaagc

SEQ ID NO: 62549 - DNA, 20 bp, Artificial Sequence
  chemically synthesized
tgttaagaggacaatagtca

SEQ ID NO: 62550 - DNA, 20 bp, Artificial Sequence
  chemically synthesized
ctcacaccagaaacaggaaa

SEQ ID NO: 62551 - DNA, 20 bp, Artificial Sequence
  chemically synthesized
ccaagtgctccttgaaaggc

SEQ ID NO: 62552 - DNA, 20 bp, Artificial Sequence
  chemically synthesized
aggcttttgtgttgctcttg

SEQ ID NO: 62553 - DNA, 20 bp, Artificial Sequence
  chemically synthesized
ccacaggactcagaaccagg

SEQ ID NO: 62554 - DNA, 20 bp, Artificial Sequence
  chemically synthesized
gttcctcaacttctctgtgc

SEQ ID NO: 62555 - DNA, 20 bp, Artificial Sequence
  chemically synthesized
tgcaaaatgtaaatcaaatt

SEQ ID NO: 62556 - DNA, 20 bp, Artificial Sequence
  chemically synthesized
gaagctgaccagcatgagag

SEQ ID NO: 62557 - DNA, 20 bp, Artificial Sequence
  chemically synthesized
agggcagaagggctggttat

SEQ ID NO: 62558 - DNA, 20 bp, Artificial Sequence
  chemically synthesized
gcttggaagatgctgacagc

SEQ ID NO: 62559 - DNA, 20 bp, Artificial Sequence
  chemically synthesized
gcagacgcttcaatggcagt

SEQ ID NO: 62560 - DNA, 20 bp, Artificial Sequence
  chemically synthesized
tctgatcactgtcattggta

SEQ ID NO: 62561 - DNA, 20 bp, Artificial Sequence
  chemically synthesized
aagggttgaagcattgagct

SEQ ID NO: 62562 - DNA, 20 bp, Artificial Sequence
  chemically synthesized
caccccacgcactgttggcc

SEQ ID NO: 62563 - DNA, 20 bp, Artificial Sequence
  chemically synthesized
catttgctctcagaagtcaa

SEQ ID NO: 62564 - DNA, 22 bp, Artificial Sequence
  chemically synthesized
caattgtggaaaatcagctttg

SEQ ID NO: 62565 - DNA, 22 bp, Artificial Sequence
  chemically synthesized
aattgtggaaaatcagctttga

SEQ ID NO: 62566 - DNA, 22 bp, Artificial Sequence
  chemically synthesized
tggaaaatcagctttgacttct

SEQ ID NO: 62567 - DNA, 22 bp, Artificial Sequence
  chemically synthesized
tgacttctgagagcaaatgccc

SEQ ID NO: 62568 - DNA, 22 bp, Artificial Sequence
  chemically synthesized
gacttctgagagcaaatgcccc

SEQ ID NO: 62569 - DNA, 22 bp, Artificial Sequence
  chemically synthesized
acttctgagagcaaatgcccct

SEQ ID NO: 62570 - DNA, 22 bp, Artificial Sequence
  chemically synthesized
ctgagagcaaatgcccctggaa

SEQ ID NO: 62571 - DNA, 22 bp, Artificial Sequence
  chemically synthesized
tgagagcaaatgcccctggaag

SEQ ID NO: 62572 - DNA, 22 bp, Artificial Sequence
  chemically synthesized
agagcaaatgcccctggaagct

SEQ ID NO: 62573 - DNA, 22 bp, Artificial Sequence
  chemically synthesized
gaagctgttggccaacagtgcg

SEQ ID NO: 62574 - DNA, 22 bp, Artificial Sequence
  chemically synthesized
ttggccaacagtgcgtggggtg

SEQ ID NO: 62575 - DNA, 22 bp, Artificial Sequence
  chemically synthesized
gccaacagtgcgtggggtggag

SEQ ID NO: 62576 - DNA, 22 bp, Artificial Sequence
  chemically synthesized
gctggcttgagcccctatgagt

SEQ ID NO: 62577 - DNA, 22 bp, Artificial Sequence
  chemically synthesized
ctggcttgagcccctatgagtc

SEQ ID NO: 62578 - DNA, 22 bp, Artificial Sequence
  chemically synthesized
gcttgagcccctatgagtctct

SEQ ID NO: 62579 - DNA, 22 bp, Artificial Sequence
  chemically synthesized
gagcccctatgagtctctcctg

SEQ ID NO: 62580 - DNA, 22 bp, Artificial Sequence
  chemically synthesized
agcccctatgagtctctcctgc

SEQ ID NO: 62581 - DNA, 22 bp, Artificial Sequence
  chemically synthesized
tgagtctctcctgcgtgactca

SEQ ID NO: 62582 - DNA, 22 bp, Artificial Sequence
  chemically synthesized
tcctgcgtgactcagtgctcac

SEQ ID NO: 62583 - DNA, 22 bp, Artificial Sequence
  chemically synthesized
ctgcgtgactcagtgctcacat

SEQ ID NO: 62584 - DNA, 22 bp, Artificial Sequence
  chemically synthesized
cgtgactcagtgctcacattcc

SEQ ID NO: 62585 - DNA, 22 bp, Artificial Sequence
  chemically synthesized
agtgctcacattcctaccgttc

SEQ ID NO: 62586 - DNA, 22 bp, Artificial Sequence
  chemically synthesized
acattcctaccgttccttgctc

SEQ ID NO: 62587 - DNA, 22 bp, Artificial Sequence
  chemically synthesized
ctaccgttccttgctcaccacc

SEQ ID NO: 62588 - DNA, 22 bp, Artificial Sequence
  chemically synthesized
ccgttccttgctcaccaccgga

SEQ ID NO: 62589 - DNA, 22 bp, Artificial Sequence
  chemically synthesized
cttgctcaccaccggatctggg

SEQ ID NO: 62590 - DNA, 22 bp, Artificial Sequence
  chemically synthesized
gctcaccaccggatctgggcgt

SEQ ID NO: 62591 - DNA, 22 bp, Artificial Sequence
  chemically synthesized
ctcaccaccggatctgggcgta

SEQ ID NO: 62592 - DNA, 22 bp, Artificial Sequence
  chemically synthesized
accaccggatctgggcgtattt

SEQ ID NO: 62593 - DNA, 22 bp, Artificial Sequence
  chemically synthesized
ggcgtatttctgcatggcctgt

SEQ ID NO: 62594 - DNA, 22 bp, Artificial Sequence
  chemically synthesized
ctgcatggcctgtgctgagcat

SEQ ID NO: 62595 - DNA, 22 bp, Artificial Sequence
  chemically synthesized
tgcatggcctgtgctgagcatc

SEQ ID NO: 62596 - DNA, 22 bp, Artificial Sequence
  chemically synthesized
catggcctgtgctgagcatctt

SEQ ID NO: 62597 - DNA, 22 bp, Artificial Sequence
  chemically synthesized
tgctgagcatcttgtaactaga

SEQ ID NO: 62598 - DNA, 22 bp, Artificial Sequence
  chemically synthesized
agcatcttgtaactagaacttt

SEQ ID NO: 62599 - DNA, 22 bp, Artificial Sequence
  chemically synthesized
gtaactagaactttctaatggg

SEQ ID NO: 62600 - DNA, 22 bp, Artificial Sequence
  chemically synthesized
taactagaactttctaatgggg

SEQ ID NO: 62601 - DNA, 22 bp, Artificial Sequence
  chemically synthesized
gaactttctaatggggtttcct

SEQ ID NO: 62602 - DNA, 22 bp, Artificial Sequence
  chemically synthesized
tctaatggggtttccttgtggg

SEQ ID NO: 62603 - DNA, 22 bp, Artificial Sequence
  chemically synthesized
ctaatggggtttccttgtggga

SEQ ID NO: 62604 - DNA, 22 bp, Artificial Sequence
  chemically synthesized
taatggggtttccttgtgggag

SEQ ID NO: 62605 - DNA, 22 bp, Artificial Sequence
  chemically synthesized
atggggtttccttgtgggagtt

SEQ ID NO: 62606 - DNA, 22 bp, Artificial Sequence
  chemically synthesized
ccttgtgggagttcctttagcc

SEQ ID NO: 62607 - DNA, 22 bp, Artificial Sequence
  chemically synthesized
cttgtgggagttcctttagcct

SEQ ID NO: 62608 - DNA, 22 bp, Artificial Sequence
  chemically synthesized
gtgggagttcctttagccttcc

SEQ ID NO: 62609 - DNA, 22 bp, Artificial Sequence
  chemically synthesized
tgggagttcctttagccttccc

SEQ ID NO: 62610 - DNA, 22 bp, Artificial Sequence
  chemically synthesized
ctttagccttcccggtgttttt

SEQ ID NO: 62611 - DNA, 22 bp, Artificial Sequence
  chemically synthesized
tagccttcccggtgtttttcag

SEQ ID NO: 62612 - DNA, 22 bp, Artificial Sequence
  chemically synthesized
agccttcccggtgtttttcaga

SEQ ID NO: 62613 - DNA, 22 bp, Artificial Sequence
  chemically synthesized
gccttcccggtgtttttcagat

SEQ ID NO: 62614 - DNA, 22 bp, Artificial Sequence
  chemically synthesized
cccggtgtttttcagatcttag

SEQ ID NO: 62615 - DNA, 22 bp, Artificial Sequence
  chemically synthesized
ccggtgtttttcagatcttagt

SEQ ID NO: 62616 - DNA, 22 bp, Artificial Sequence
  chemically synthesized
ttcagatcttagtcacccttcc

SEQ ID NO: 62617 - DNA, 22 bp, Artificial Sequence
  chemically synthesized
tcagatcttagtcacccttcca

SEQ ID NO: 62618 - DNA, 22 bp, Artificial Sequence
  chemically synthesized
cagatcttagtcacccttccag

SEQ ID NO: 62619 - DNA, 22 bp, Artificial Sequence
  chemically synthesized
agatcttagtcacccttccagg

SEQ ID NO: 62620 - DNA, 22 bp, Artificial Sequence
  chemically synthesized
agtcacccttccaggcttgcgt

SEQ ID NO: 62621 - DNA, 22 bp, Artificial Sequence
  chemically synthesized
gtcacccttccaggcttgcgta

SEQ ID NO: 62622 - DNA, 22 bp, Artificial Sequence
  chemically synthesized
ccaggcttgcgtagtaggtgaa

SEQ ID NO: 62623 - DNA, 22 bp, Artificial Sequence
  chemically synthesized
caggcttgcgtagtaggtgaag

SEQ ID NO: 62624 - DNA, 22 bp, Artificial Sequence
  chemically synthesized
gcgtagtaggtgaagacttctt

SEQ ID NO: 62625 - DNA, 22 bp, Artificial Sequence
  chemically synthesized
cgtagtaggtgaagacttcttt

SEQ ID NO: 62626 - DNA, 22 bp, Artificial Sequence
  chemically synthesized
ctttgatgcatttcatgaattc

SEQ ID NO: 62627 - DNA, 22 bp, Artificial Sequence
  chemically synthesized
tttgatgcatttcatgaattct

SEQ ID NO: 62628 - DNA, 22 bp, Artificial Sequence
  chemically synthesized
tgatgcatttcatgaattctgg

SEQ ID NO: 62629 - DNA, 22 bp, Artificial Sequence
  chemically synthesized
gatgcatttcatgaattctggt

SEQ ID NO: 62630 - DNA, 22 bp, Artificial Sequence
  chemically synthesized
atgcatttcatgaattctggtt

SEQ ID NO: 62631 - DNA, 22 bp, Artificial Sequence
  chemically synthesized
catgaattctggttgtttcagt

SEQ ID NO: 62632 - DNA, 22 bp, Artificial Sequence
  chemically synthesized
atgaattctggttgtttcagtc

SEQ ID NO: 62633 - DNA, 22 bp, Artificial Sequence
  chemically synthesized
tggttgtttcagtcaggatggg

SEQ ID NO: 62634 - DNA, 22 bp, Artificial Sequence
  chemically synthesized
gttgtttcagtcaggatgggca

SEQ ID NO: 62635 - DNA, 22 bp, Artificial Sequence
  chemically synthesized
tttcagtcaggatgggcaagga

SEQ ID NO: 62636 - DNA, 22 bp, Artificial Sequence
  chemically synthesized
cagtcaggatgggcaaggattg

SEQ ID NO: 62637 - DNA, 22 bp, Artificial Sequence
  chemically synthesized
agtcaggatgggcaaggattgt

SEQ ID NO: 62638 - DNA, 22 bp, Artificial Sequence
  chemically synthesized
tgctgcagcaaccgagaagctc

SEQ ID NO: 62639 - DNA, 22 bp, Artificial Sequence
  chemically synthesized
cagcaaccgagaagctcacagc

SEQ ID NO: 62640 - DNA, 22 bp, Artificial Sequence
  chemically synthesized
acagctcaatgcttcaaccctt

SEQ ID NO: 62641 - DNA, 22 bp, Artificial Sequence
  chemically synthesized
aatgcttcaaccctttagaaag

SEQ ID NO: 62642 - DNA, 22 bp, Artificial Sequence
  chemically synthesized
caaccctttagaaagggttgat

SEQ ID NO: 62643 - DNA, 22 bp, Artificial Sequence
  chemically synthesized
aaccctttagaaagggttgatt

SEQ ID NO: 62644 - DNA, 22 bp, Artificial Sequence
  chemically synthesized
tagaaagggttgattcctctcc

SEQ ID NO: 62645 - DNA, 22 bp, Artificial Sequence
  chemically synthesized
agaaagggttgattcctctccc

SEQ ID NO: 62646 - DNA, 22 bp, Artificial Sequence
  chemically synthesized
gaaagggttgattcctctcccg

SEQ ID NO: 62647 - DNA, 22 bp, Artificial Sequence
  chemically synthesized
attcctctcccgctctacttgt

SEQ ID NO: 62648 - DNA, 22 bp, Artificial Sequence
  chemically synthesized
ctctcccgctctacttgtccca

SEQ ID NO: 62649 - DNA, 22 bp, Artificial Sequence
  chemically synthesized
tcccgctctacttgtcccatgt

SEQ ID NO: 62650 - DNA, 22 bp, Artificial Sequence
  chemically synthesized
ccgctctacttgtcccatgtgg

SEQ ID NO: 62651 - DNA, 22 bp, Artificial Sequence
  chemically synthesized
tacttgtcccatgtgggatgaa

SEQ ID NO: 62652 - DNA, 22 bp, Artificial Sequence
  chemically synthesized
cttgtcccatgtgggatgaaca

SEQ ID NO: 62653 - DNA, 22 bp, Artificial Sequence
  chemically synthesized
gtcccatgtgggatgaacagag

SEQ ID NO: 62654 - DNA, 22 bp, Artificial Sequence
  chemically synthesized
tcccatgtgggatgaacagagg

SEQ ID NO: 62655 - DNA, 22 bp, Artificial Sequence
  chemically synthesized
cccaccctggggacacagcaac

SEQ ID NO: 62656 - DNA, 22 bp, Artificial Sequence
  chemically synthesized
gggacacagcaaccagactgaa

SEQ ID NO: 62657 - DNA, 22 bp, Artificial Sequence
  chemically synthesized
aaggaggtttcagctcctcact

SEQ ID NO: 62658 - DNA, 22 bp, Artificial Sequence
  chemically synthesized
cagctcctcacttccccgctcc

SEQ ID NO: 62659 - DNA, 22 bp, Artificial Sequence
  chemically synthesized
agctcctcacttccccgctcca

SEQ ID NO: 62660 - DNA, 22 bp, Artificial Sequence
  chemically synthesized
ctcacttccccgctccagacca

SEQ ID NO: 62661 - DNA, 22 bp, Artificial Sequence
  chemically synthesized
acttccccgctccagaccatct

SEQ ID NO: 62662 - DNA, 22 bp, Artificial Sequence
  chemically synthesized
ccccgctccagaccatctgact

SEQ ID NO: 62663 - DNA, 22 bp, Artificial Sequence
  chemically synthesized
cccgctccagaccatctgactc

SEQ ID NO: 62664 - DNA, 22 bp, Artificial Sequence
  chemically synthesized
cagaccatctgactctagttcc

SEQ ID NO: 62665 - DNA, 22 bp, Artificial Sequence
  chemically synthesized
actctagttcctttcatcattc

SEQ ID NO: 62666 - DNA, 22 bp, Artificial Sequence
  chemically synthesized
tagttcctttcatcattcctga

SEQ ID NO: 62667 - DNA, 22 bp, Artificial Sequence
  chemically synthesized
gttcctttcatcattcctgatg

SEQ ID NO: 62668 - DNA, 22 bp, Artificial Sequence
  chemically synthesized
ctttcatcattcctgatgtcac

SEQ ID NO: 62669 - DNA, 22 bp, Artificial Sequence
  chemically synthesized
tcatcattcctgatgtcacgat

SEQ ID NO: 62670 - DNA, 22 bp, Artificial Sequence
  chemically synthesized
catcattcctgatgtcacgatt

SEQ ID NO: 62671 - DNA, 22 bp, Artificial Sequence
  chemically synthesized
atcattcctgatgtcacgattt

SEQ ID NO: 62672 - DNA, 22 bp, Artificial Sequence
  chemically synthesized
ctgatgtcacgatttcaacagt

SEQ ID NO: 62673 - DNA, 22 bp, Artificial Sequence
  chemically synthesized
atgtcacgatttcaacagtaag

SEQ ID NO: 62674 - DNA, 22 bp, Artificial Sequence
  chemically synthesized
caacagtaagcgtgataccaat

SEQ ID NO: 62675 - DNA, 22 bp, Artificial Sequence
  chemically synthesized
aacagtaagcgtgataccaatg

SEQ ID NO: 62676 - DNA, 22 bp, Artificial Sequence
  chemically synthesized
ctactgccattgaagcgtctgc

SEQ ID NO: 62677 - DNA, 22 bp, Artificial Sequence
  chemically synthesized
ctgccattgaagcgtctgctgt

SEQ ID NO: 62678 - DNA, 22 bp, Artificial Sequence
  chemically synthesized
ccattgaagcgtctgctgtcag

SEQ ID NO: 62679 - DNA, 22 bp, Artificial Sequence
  chemically synthesized
aagcgtctgctgtcagcatctt

SEQ ID NO: 62680 - DNA, 22 bp, Artificial Sequence
  chemically synthesized
ctgtcagcatcttccaagcttg

SEQ ID NO: 62681 - DNA, 22 bp, Artificial Sequence
  chemically synthesized
tcagcatcttccaagcttggat

SEQ ID NO: 62682 - DNA, 22 bp, Artificial Sequence
  chemically synthesized
ccaagcttggataaccagccct

SEQ ID NO: 62683 - DNA, 22 bp, Artificial Sequence
  chemically synthesized
caagcttggataaccagccctt

SEQ ID NO: 62684 - DNA, 22 bp, Artificial Sequence
  chemically synthesized
ggataaccagcccttctgccct

SEQ ID NO: 62685 - DNA, 22 bp, Artificial Sequence
  chemically synthesized
gataaccagcccttctgccctg

SEQ ID NO: 62686 - DNA, 22 bp, Artificial Sequence
  chemically synthesized
ctgccctgcccaagtgccaccc

SEQ ID NO: 62687 - DNA, 22 bp, Artificial Sequence
  chemically synthesized
tgccctgcccaagtgccaccca

SEQ ID NO: 62688 - DNA, 22 bp, Artificial Sequence
  chemically synthesized
ccctgcccaagtgccacccatt

SEQ ID NO: 62689 - DNA, 22 bp, Artificial Sequence
  chemically synthesized
cccaagtgccacccatttgagg

SEQ ID NO: 62690 - DNA, 22 bp, Artificial Sequence
  chemically synthesized
gaggaaaaggacaaatgaataa

SEQ ID NO: 62691 - DNA, 22 bp, Artificial Sequence
  chemically synthesized
aggaaaaggacaaatgaataag

SEQ ID NO: 62692 - DNA, 22 bp, Artificial Sequence
  chemically synthesized
ttgtttgtttgtttctgataga

SEQ ID NO: 62693 - DNA, 22 bp, Artificial Sequence
  chemically synthesized
tgtttgtttgtttctgatagag

SEQ ID NO: 62694 - DNA, 22 bp, Artificial Sequence
  chemically synthesized
gtttgtttgtttctgatagagc

SEQ ID NO: 62695 - DNA, 22 bp, Artificial Sequence
  chemically synthesized
tttgtttgtttctgatagagct

SEQ ID NO: 62696 - DNA, 22 bp, Artificial Sequence
  chemically synthesized
gtttgtttctgatagagctgat

SEQ ID NO: 62697 - DNA, 22 bp, Artificial Sequence
  chemically synthesized
tttgtttctgatagagctgata

SEQ ID NO: 62698 - DNA, 22 bp, Artificial Sequence
  chemically synthesized
gtttctgatagagctgatattg

SEQ ID NO: 62699 - DNA, 22 bp, Artificial Sequence
  chemically synthesized
tttctgatagagctgatattgg

SEQ ID NO: 62700 - DNA, 22 bp, Artificial Sequence
  chemically synthesized
ctgatagagctgatattggagg

SEQ ID NO: 62701 - DNA, 22 bp, Artificial Sequence
  chemically synthesized
tgatagagctgatattggaggg

SEQ ID NO: 62702 - DNA, 22 bp, Artificial Sequence
  chemically synthesized
atagagctgatattggagggtg

SEQ ID NO: 62703 - DNA, 22 bp, Artificial Sequence
  chemically synthesized
atattggagggtgaggcttatg

SEQ ID NO: 62704 - DNA, 22 bp, Artificial Sequence
  chemically synthesized
gagggtgaggcttatgcctgtt

SEQ ID NO: 62705 - DNA, 22 bp, Artificial Sequence
  chemically synthesized
atgcctgttgggatttgggctt

SEQ ID NO: 62706 - DNA, 22 bp, Artificial Sequence
  chemically synthesized
tgcctgttgggatttgggcttc

SEQ ID NO: 62707 - DNA, 22 bp, Artificial Sequence
  chemically synthesized
ttgggatttgggcttctagaaa

SEQ ID NO: 62708 - DNA, 22 bp, Artificial Sequence
  chemically synthesized
ggatttgggcttctagaaactg

SEQ ID NO: 62709 - DNA, 22 bp, Artificial Sequence
  chemically synthesized
gggcttctagaaactgacctct

SEQ ID NO: 62710 - DNA, 22 bp, Artificial Sequence
  chemically synthesized
ggcttctagaaactgacctctc

SEQ ID NO: 62711 - DNA, 22 bp, Artificial Sequence
  chemically synthesized
ctagaaactgacctctcatgct

SEQ ID NO: 62712 - DNA, 22 bp, Artificial Sequence
  chemically synthesized
tagaaactgacctctcatgctg

SEQ ID NO: 62713 - DNA, 22 bp, Artificial Sequence
  chemically synthesized
gaaactgacctctcatgctggt

SEQ ID NO: 62714 - DNA, 22 bp, Artificial Sequence
  chemically synthesized
acctctcatgctggtcagcttc

SEQ ID NO: 62715 - DNA, 22 bp, Artificial Sequence
  chemically synthesized
tcatgctggtcagcttcaccat

SEQ ID NO: 62716 - DNA, 22 bp, Artificial Sequence
  chemically synthesized
atgctggtcagcttcaccatct

SEQ ID NO: 62717 - DNA, 22 bp, Artificial Sequence
  chemically synthesized
gtcagcttcaccatctccagca

SEQ ID NO: 62718 - DNA, 22 bp, Artificial Sequence
  chemically synthesized
caccatctccagcaatgtgcga

SEQ ID NO: 62719 - DNA, 22 bp, Artificial Sequence
  chemically synthesized
accatctccagcaatgtgcgac

SEQ ID NO: 62720 - DNA, 22 bp, Artificial Sequence
  chemically synthesized
cagcaatgtgcgacttaggcca

SEQ ID NO: 62721 - DNA, 22 bp, Artificial Sequence
  chemically synthesized
aggccaggctccacaactaggc

SEQ ID NO: 62722 - DNA, 22 bp, Artificial Sequence
  chemically synthesized
ggccaggctccacaactaggcc

SEQ ID NO: 62723 - DNA, 22 bp, Artificial Sequence
  chemically synthesized
cacaactaggccagaggaagat

SEQ ID NO: 62724 - DNA, 22 bp, Artificial Sequence
  chemically synthesized
ggccagaggaagatttctgggc

SEQ ID NO: 62725 - DNA, 22 bp, Artificial Sequence
  chemically synthesized
ctgggctacatgggacaaggac

SEQ ID NO: 62726 - DNA, 22 bp, Artificial Sequence
  chemically synthesized
tgggctacatgggacaaggaca

SEQ ID NO: 62727 - DNA, 22 bp, Artificial Sequence
  chemically synthesized
ggctacatgggacaaggacaag

SEQ ID NO: 62728 - DNA, 22 bp, Artificial Sequence
  chemically synthesized
catgggacaaggacaaggaact

SEQ ID NO: 62729 - DNA, 22 bp, Artificial Sequence
  chemically synthesized
tagagaaataagtcattgcatt

SEQ ID NO: 62730 - DNA, 22 bp, Artificial Sequence
  chemically synthesized
agagaaataagtcattgcattg

SEQ ID NO: 62731 - DNA, 22 bp, Artificial Sequence
  chemically synthesized
gagaaataagtcattgcattga

SEQ ID NO: 62732 - DNA, 22 bp, Artificial Sequence
  chemically synthesized
cattgaaacctcaaatttgatt

SEQ ID NO: 62733 - DNA, 22 bp, Artificial Sequence
  chemically synthesized
aaacctcaaatttgatttacat

SEQ ID NO: 62734 - DNA, 22 bp, Artificial Sequence
  chemically synthesized
aaatttgatttacattttgcag

SEQ ID NO: 62735 - DNA, 22 bp, Artificial Sequence
  chemically synthesized
gatttacattttgcagatgagg

SEQ ID NO: 62736 - DNA, 22 bp, Artificial Sequence
  chemically synthesized
atttacattttgcagatgagga

SEQ ID NO: 62737 - DNA, 22 bp, Artificial Sequence
  chemically synthesized
acattttgcagatgaggaaact

SEQ ID NO: 62738 - DNA, 22 bp, Artificial Sequence
  chemically synthesized
cattttgcagatgaggaaacta

SEQ ID NO: 62739 - DNA, 22 bp, Artificial Sequence
  chemically synthesized
tgcagatgaggaaactacggca

SEQ ID NO: 62740 - DNA, 22 bp, Artificial Sequence
  chemically synthesized
gcagatgaggaaactacggcac

SEQ ID NO: 62741 - DNA, 22 bp, Artificial Sequence
  chemically synthesized
cagatgaggaaactacggcaca

SEQ ID NO: 62742 - DNA, 22 bp, Artificial Sequence
  chemically synthesized
cggcacagagaagttgaggaac

SEQ ID NO: 62743 - DNA, 22 bp, Artificial Sequence
  chemically synthesized
aggaacttccctgagagcacac

SEQ ID NO: 62744 - DNA, 22 bp, Artificial Sequence
  chemically synthesized
ccctgagagcacacagcctgcc

SEQ ID NO: 62745 - DNA, 22 bp, Artificial Sequence
  chemically synthesized
cctgagagcacacagcctgccc

SEQ ID NO: 62746 - DNA, 22 bp, Artificial Sequence
  chemically synthesized
agagcacacagcctgccctctc

SEQ ID NO: 62747 - DNA, 22 bp, Artificial Sequence
  chemically synthesized
ccctctcccatatgatacaata

SEQ ID NO: 62748 - DNA, 22 bp, Artificial Sequence
  chemically synthesized
tcccatatgatacaatagtgac

SEQ ID NO: 62749 - DNA, 22 bp, Artificial Sequence
  chemically synthesized
ccatatgatacaatagtgacac

SEQ ID NO: 62750 - DNA, 22 bp, Artificial Sequence
  chemically synthesized
ctgcttttccgagttgctgcct

SEQ ID NO: 62751 - DNA, 22 bp, Artificial Sequence
  chemically synthesized
cttttccgagttgctgcctggg

SEQ ID NO: 62752 - DNA, 22 bp, Artificial Sequence
  chemically synthesized
ttccgagttgctgcctgggtcc

SEQ ID NO: 62753 - DNA, 22 bp, Artificial Sequence
  chemically synthesized
tccgagttgctgcctgggtccc

SEQ ID NO: 62754 - DNA, 22 bp, Artificial Sequence
  chemically synthesized
ccgagttgctgcctgggtccct

SEQ ID NO: 62755 - DNA, 22 bp, Artificial Sequence
  chemically synthesized
cgagttgctgcctgggtccctg

SEQ ID NO: 62756 - DNA, 22 bp, Artificial Sequence
  chemically synthesized
ctgcctgggtccctgctgggga

SEQ ID NO: 62757 - DNA, 22 bp, Artificial Sequence
  chemically synthesized
cctgggtccctgctggggaggg

SEQ ID NO: 62758 - DNA, 22 bp, Artificial Sequence
  chemically synthesized
ggtccctgctggggagggagtt

SEQ ID NO: 62759 - DNA, 22 bp, Artificial Sequence
  chemically synthesized
ctggggagggagtttgcctcag

SEQ ID NO: 62760 - DNA, 22 bp, Artificial Sequence
  chemically synthesized
gggagggagtttgcctcagtga

SEQ ID NO: 62761 - DNA, 22 bp, Artificial Sequence
  chemically synthesized
gcctcagtgagagtgcctttct

SEQ ID NO: 62762 - DNA, 22 bp, Artificial Sequence
  chemically synthesized
cctcagtgagagtgcctttctc

SEQ ID NO: 62763 - DNA, 22 bp, Artificial Sequence
  chemically synthesized
agtgagagtgcctttctctgac

SEQ ID NO: 62764 - DNA, 22 bp, Artificial Sequence
  chemically synthesized
tctctgacttctctactcaggg

SEQ ID NO: 62765 - DNA, 22 bp, Artificial Sequence
  chemically synthesized
ctctgacttctctactcagggt

SEQ ID NO: 62766 - DNA, 22 bp, Artificial Sequence
  chemically synthesized
tctgacttctctactcagggtc

SEQ ID NO: 62767 - DNA, 22 bp, Artificial Sequence
  chemically synthesized
tgacttctctactcagggtcat

SEQ ID NO: 62768 - DNA, 22 bp, Artificial Sequence
  chemically synthesized
acttctctactcagggtcattc

SEQ ID NO: 62769 - DNA, 22 bp, Artificial Sequence
  chemically synthesized
ctctactcagggtcattccatt

SEQ ID NO: 62770 - DNA, 22 bp, Artificial Sequence
  chemically synthesized
tctactcagggtcattccattt

SEQ ID NO: 62771 - DNA, 22 bp, Artificial Sequence
  chemically synthesized
tactcagggtcattccatttgt

SEQ ID NO: 62772 - DNA, 22 bp, Artificial Sequence
  chemically synthesized
ctcagggtcattccatttgtcc

SEQ ID NO: 62773 - DNA, 22 bp, Artificial Sequence
  chemically synthesized
agggtcattccatttgtccttt

SEQ ID NO: 62774 - DNA, 22 bp, Artificial Sequence
  chemically synthesized
catttgtccttttagaactgac

SEQ ID NO: 62775 - DNA, 22 bp, Artificial Sequence
  chemically synthesized
gtccttttagaactgacccagg

SEQ ID NO: 62776 - DNA, 22 bp, Artificial Sequence
  chemically synthesized
tccttttagaactgacccaggt

SEQ ID NO: 62777 - DNA, 22 bp, Artificial Sequence
  chemically synthesized
ttagaactgacccaggttcctg

SEQ ID NO: 62778 - DNA, 22 bp, Artificial Sequence
  chemically synthesized
tagaactgacccaggttcctgc

SEQ ID NO: 62779 - DNA, 22 bp, Artificial Sequence
  chemically synthesized
agaactgacccaggttcctgcg

SEQ ID NO: 62780 - DNA, 22 bp, Artificial Sequence
  chemically synthesized
gaactgacccaggttcctgcgg

SEQ ID NO: 62781 - DNA, 22 bp, Artificial Sequence
  chemically synthesized
acccaggttcctgcggaagctg

SEQ ID NO: 62782 - DNA, 22 bp, Artificial Sequence
  chemically synthesized
ctgcggaagctgtccctggttc

SEQ ID NO: 62783 - DNA, 22 bp, Artificial Sequence
  chemically synthesized
cggaagctgtccctggttctga

SEQ ID NO: 62784 - DNA, 22 bp, Artificial Sequence
  chemically synthesized
tccctggttctgagtcctgtgg

SEQ ID NO: 62785 - DNA, 22 bp, Artificial Sequence
  chemically synthesized
gttctgagtcctgtggtgtgcc

SEQ ID NO: 62786 - DNA, 22 bp, Artificial Sequence
  chemically synthesized
tgagtcctgtggtgtgccttgt

SEQ ID NO: 62787 - DNA, 22 bp, Artificial Sequence
  chemically synthesized
agtcctgtggtgtgccttgttt

SEQ ID NO: 62788 - DNA, 22 bp, Artificial Sequence
  chemically synthesized
tggtgtgccttgtttacttcat

SEQ ID NO: 62789 - DNA, 22 bp, Artificial Sequence
  chemically synthesized
gtttacttcattgcctgtgaat

SEQ ID NO: 62790 - DNA, 22 bp, Artificial Sequence
  chemically synthesized
tttacttcattgcctgtgaata

SEQ ID NO: 62791 - DNA, 22 bp, Artificial Sequence
  chemically synthesized
acttcattgcctgtgaataatc

SEQ ID NO: 62792 - DNA, 22 bp, Artificial Sequence
  chemically synthesized
cttcattgcctgtgaataatcc

SEQ ID NO: 62793 - DNA, 22 bp, Artificial Sequence
  chemically synthesized
cattgcctgtgaataatccaac

SEQ ID NO: 62794 - DNA, 22 bp, Artificial Sequence
  chemically synthesized
attgcctgtgaataatccaacc

SEQ ID NO: 62795 - DNA, 22 bp, Artificial Sequence
  chemically synthesized
cctgtgaataatccaaccaaga

SEQ ID NO: 62796 - DNA, 22 bp, Artificial Sequence
  chemically synthesized
tgaataatccaaccaagagcaa

SEQ ID NO: 62797 - DNA, 22 bp, Artificial Sequence
  chemically synthesized
agcctttcaaggagcacttggg

SEQ ID NO: 62798 - DNA, 22 bp, Artificial Sequence
  chemically synthesized
tcaaggagcacttggggtgttt

SEQ ID NO: 62799 - DNA, 22 bp, Artificial Sequence
  chemically synthesized
caaggagcacttggggtgtttg

SEQ ID NO: 62800 - DNA, 22 bp, Artificial Sequence
  chemically synthesized
aaggagcacttggggtgtttga

SEQ ID NO: 62801 - DNA, 22 bp, Artificial Sequence
  chemically synthesized
ggggtgtttgaggtcatctgtg

SEQ ID NO: 62802 - DNA, 22 bp, Artificial Sequence
  chemically synthesized
gggtgtttgaggtcatctgtgg

SEQ ID NO: 62803 - DNA, 22 bp, Artificial Sequence
  chemically synthesized
gaggtcatctgtgggtgtaggc

SEQ ID NO: 62804 - DNA, 22 bp, Artificial Sequence
  chemically synthesized
aggtcatctgtgggtgtaggct

SEQ ID NO: 62805 - DNA, 22 bp, Artificial Sequence
  chemically synthesized
tgggtgtaggctgactgtttct

SEQ ID NO: 62806 - DNA, 22 bp, Artificial Sequence
  chemically synthesized
actgtttctcatgcctctggaa

SEQ ID NO: 62807 - DNA, 22 bp, Artificial Sequence
  chemically synthesized
tttctcatgcctctggaaaggt

SEQ ID NO: 62808 - DNA, 22 bp, Artificial Sequence
  chemically synthesized
ctcatgcctctggaaaggtcct

SEQ ID NO: 62809 - DNA, 22 bp, Artificial Sequence
  chemically synthesized
tcatgcctctggaaaggtcctg

SEQ ID NO: 62810 - DNA, 22 bp, Artificial Sequence
  chemically synthesized
atgcctctggaaaggtcctggg

SEQ ID NO: 62811 - DNA, 22 bp, Artificial Sequence
  chemically synthesized
tggaaaggtcctgggttacacc

SEQ ID NO: 62812 - DNA, 22 bp, Artificial Sequence
  chemically synthesized
gaaaggtcctgggttacaccct

SEQ ID NO: 62813 - DNA, 22 bp, Artificial Sequence
  chemically synthesized
ggttacaccctgaccctctcca

SEQ ID NO: 62814 - DNA, 22 bp, Artificial Sequence
  chemically synthesized
caccctgaccctctccacccag

SEQ ID NO: 62815 - DNA, 22 bp, Artificial Sequence
  chemically synthesized
accctctccacccagatccatg

SEQ ID NO: 62816 - DNA, 22 bp, Artificial Sequence
  chemically synthesized
tccacccagatccatggatgta

SEQ ID NO: 62817 - DNA, 22 bp, Artificial Sequence
  chemically synthesized
cacccagatccatggatgtacg

SEQ ID NO: 62818 - DNA, 22 bp, Artificial Sequence
  chemically synthesized
atttattcactgctccccactg

SEQ ID NO: 62819 - DNA, 22 bp, Artificial Sequence
  chemically synthesized
attcactgctccccactgccat

SEQ ID NO: 62820 - DNA, 22 bp, Artificial Sequence
  chemically synthesized
ttcactgctccccactgccata

SEQ ID NO: 62821 - DNA, 22 bp, Artificial Sequence
  chemically synthesized
actgctccccactgccatagac

SEQ ID NO: 62822 - DNA, 22 bp, Artificial Sequence
  chemically synthesized
ctccccactgccatagaccagc

SEQ ID NO: 62823 - DNA, 22 bp, Artificial Sequence
  chemically synthesized
cccactgccatagaccagcatt

SEQ ID NO: 62824 - DNA, 22 bp, Artificial Sequence
  chemically synthesized
ccatagaccagcattctccccg

SEQ ID NO: 62825 - DNA, 22 bp, Artificial Sequence
  chemically synthesized
tccccgggatggacctgggttt

SEQ ID NO: 62826 - DNA, 22 bp, Artificial Sequence
  chemically synthesized
cccgggatggacctgggtttca

SEQ ID NO: 62827 - DNA, 22 bp, Artificial Sequence
  chemically synthesized
ggtttcattctctctatccccc

SEQ ID NO: 62828 - DNA, 22 bp, Artificial Sequence
  chemically synthesized
cattctctctatcccccataca

SEQ ID NO: 62829 - DNA, 22 bp, Artificial Sequence
  chemically synthesized
attctctctatcccccatacac

SEQ ID NO: 62830 - DNA, 22 bp, Artificial Sequence
  chemically synthesized
tctctatcccccatacacagct

SEQ ID NO: 62831 - DNA, 22 bp, Artificial Sequence
  chemically synthesized
tctatcccccatacacagctca

SEQ ID NO: 62832 - DNA, 22 bp, Artificial Sequence
  chemically synthesized
tatcccccatacacagctcatg

SEQ ID NO: 62833 - DNA, 22 bp, Artificial Sequence
  chemically synthesized
tcccccatacacagctcatgtt

SEQ ID NO: 62834 - DNA, 22 bp, Artificial Sequence
  chemically synthesized
atgtttgcttgtttgttgtttg

SEQ ID NO: 62835 - DNA, 22 bp, Artificial Sequence
  chemically synthesized
gcttgtttgttgtttggataaa

SEQ ID NO: 62836 - DNA, 22 bp, Artificial Sequence
  chemically synthesized
cttgtttgttgtttggataaat

SEQ ID NO: 62837 - DNA, 22 bp, Artificial Sequence
  chemically synthesized
gtttgttgtttggataaatgct

SEQ ID NO: 62838 - DNA, 22 bp, Artificial Sequence
  chemically synthesized
tttgttgtttggataaatgctt

SEQ ID NO: 62839 - DNA, 22 bp, Artificial Sequence
  chemically synthesized
gttgtttggataaatgcttccc

SEQ ID NO: 62840 - DNA, 22 bp, Artificial Sequence
  chemically synthesized
ttgtttggataaatgcttcccg

SEQ ID NO: 62841 - DNA, 22 bp, Artificial Sequence
  chemically synthesized
tttggataaatgcttcccgctc

SEQ ID NO: 62842 - DNA, 22 bp, Artificial Sequence
  chemically synthesized
ggataaatgcttcccgctcgga

SEQ ID NO: 62843 - DNA, 22 bp, Artificial Sequence
  chemically synthesized
gataaatgcttcccgctcggat

SEQ ID NO: 62844 - DNA, 22 bp, Artificial Sequence
  chemically synthesized
cccgctcggatttatggagagg

SEQ ID NO: 62845 - DNA, 22 bp, Artificial Sequence
  chemically synthesized
ccgctcggatttatggagagga

SEQ ID NO: 62846 - DNA, 22 bp, Artificial Sequence
  chemically synthesized
ggatttatggagaggatcaagt

SEQ ID NO: 62847 - DNA, 22 bp, Artificial Sequence
  chemically synthesized
atggagaggatcaagttgctcc

SEQ ID NO: 62848 - DNA, 22 bp, Artificial Sequence
  chemically synthesized
tggagaggatcaagttgctcct

SEQ ID NO: 62849 - DNA, 22 bp, Artificial Sequence
  chemically synthesized
ctcctgggaaggagatcagtgt

SEQ ID NO: 62850 - DNA, 22 bp, Artificial Sequence
  chemically synthesized
ctgggaaggagatcagtgtgaa

SEQ ID NO: 62851 - DNA, 22 bp, Artificial Sequence
  chemically synthesized
ggaaggagatcagtgtgaaatc

SEQ ID NO: 62852 - DNA, 22 bp, Artificial Sequence
  chemically synthesized
tatttcctgtttctggtgtgag

SEQ ID NO: 62853 - DNA, 22 bp, Artificial Sequence
  chemically synthesized
cctgtttctggtgtgagagcct

SEQ ID NO: 62854 - DNA, 22 bp, Artificial Sequence
  chemically synthesized
ctgtttctggtgtgagagcctg

SEQ ID NO: 62855 - DNA, 22 bp, Artificial Sequence
  chemically synthesized
tttctggtgtgagagcctggaa

SEQ ID NO: 62856 - DNA, 22 bp, Artificial Sequence
  chemically synthesized
ctggtgtgagagcctggaagct

SEQ ID NO: 62857 - DNA, 22 bp, Artificial Sequence
  chemically synthesized
tggtgtgagagcctggaagctc

SEQ ID NO: 62858 - DNA, 22 bp, Artificial Sequence
  chemically synthesized
gtgtgagagcctggaagctctc

SEQ ID NO: 62859 - DNA, 22 bp, Artificial Sequence
  chemically synthesized
gaagctctctgactattgtcct

SEQ ID NO: 62860 - DNA, 22 bp, Artificial Sequence
  chemically synthesized
tctgactattgtcctcttaaca

SEQ ID NO: 62861 - DNA, 22 bp, Artificial Sequence
  chemically synthesized
tgactattgtcctcttaacaaa

SEQ ID NO: 62862 - DNA, 22 bp, Artificial Sequence
  chemically synthesized
actattgtcctcttaacaaatg

SEQ ID NO: 62863 - DNA, 22 bp, Artificial Sequence
  chemically synthesized
ttgtcctcttaacaaatggggc

SEQ ID NO: 62864 - DNA, 22 bp, Artificial Sequence
  chemically synthesized
tcctcttaacaaatggggctca

SEQ ID NO: 62865 - DNA, 22 bp, Artificial Sequence
  chemically synthesized
ttaacaaatggggctcacaggg

SEQ ID NO: 62866 - DNA, 22 bp, Artificial Sequence
  chemically synthesized
aacaaatggggctcacagggtg

SEQ ID NO: 62867 - DNA, 22 bp, Artificial Sequence
  chemically synthesized
acaaatggggctcacagggtgc

SEQ ID NO: 62868 - DNA, 22 bp, Artificial Sequence
  chemically synthesized
acagggtgccccctgtccggca

SEQ ID NO: 62869 - DNA, 22 bp, Artificial Sequence
  chemically synthesized
tccggcagagcttgcacttcaa

SEQ ID NO: 62870 - DNA, 22 bp, Artificial Sequence
  chemically synthesized
gcacttcaaactaaggcttcct

SEQ ID NO: 62871 - DNA, 22 bp, Artificial Sequence
  chemically synthesized
cacttcaaactaaggcttcctt

SEQ ID NO: 62872 - DNA, 22 bp, Artificial Sequence
  chemically synthesized
caaactaaggcttcctttattt

SEQ ID NO: 62873 - DNA, 22 bp, Artificial Sequence
  chemically synthesized
aaactaaggcttcctttattta

SEQ ID NO: 62874 - DNA, 22 bp, Artificial Sequence
  chemically synthesized
aggcttcctttatttaggctta

SEQ ID NO: 62875 - DNA, 22 bp, Artificial Sequence
  chemically synthesized
cctttatttaggcttaaaatcc

SEQ ID NO: 62876 - DNA, 22 bp, Artificial Sequence
  chemically synthesized
ctttatttaggcttaaaatccg

SEQ ID NO: 62877 - DNA, 22 bp, Artificial Sequence
  chemically synthesized
tatttaggcttaaaatccgaaa

SEQ ID NO: 62878 - DNA, 22 bp, Artificial Sequence
  chemically synthesized
atttaggcttaaaatccgaaat

SEQ ID NO: 62879 - DNA, 22 bp, Artificial Sequence
  chemically synthesized
tttaggcttaaaatccgaaatt

SEQ ID NO: 62880 - DNA, 22 bp, Artificial Sequence
  chemically synthesized
aggcttaaaatccgaaattcgt

SEQ ID NO: 62881 - DNA, 22 bp, Artificial Sequence
  chemically synthesized
ggcttaaaatccgaaattcgtg

SEQ ID NO: 62882 - DNA, 22 bp, Artificial Sequence
  chemically synthesized
aaaatccgaaattcgtgtgttc

SEQ ID NO: 62883 - DNA, 22 bp, Artificial Sequence
  chemically synthesized
aaatccgaaattcgtgtgttct

SEQ ID NO: 62884 - DNA, 22 bp, Artificial Sequence
  chemically synthesized
gtgtgttctctcccctgcaaac

SEQ ID NO: 62885 - DNA, 22 bp, Artificial Sequence
  chemically synthesized
tctcccctgcaaactcctaggc

SEQ ID NO: 62886 - DNA, 22 bp, Artificial Sequence
  chemically synthesized
tcccctgcaaactcctaggcga

SEQ ID NO: 62887 - DNA, 22 bp, Artificial Sequence
  chemically synthesized
ccctgcaaactcctaggcgagg

SEQ ID NO: 62888 - DNA, 22 bp, Artificial Sequence
  chemically synthesized
caaactcctaggcgaggtaaaa

SEQ ID NO: 62889 - DNA, 22 bp, Artificial Sequence
  chemically synthesized
ctaggcgaggtaaaaggtcagg

SEQ ID NO: 62890 - DNA, 22 bp, Artificial Sequence
  chemically synthesized
ggcgaggtaaaaggtcaggact

SEQ ID NO: 62891 - DNA, 22 bp, Artificial Sequence
  chemically synthesized
taaggttcctggctgagctgga

SEQ ID NO: 62892 - DNA, 22 bp, Artificial Sequence
  chemically synthesized
aggttcctggctgagctggaag

SEQ ID NO: 62893 - DNA, 22 bp, Artificial Sequence
  chemically synthesized
ctggctgagctggaagctgttt

SEQ ID NO: 62894 - DNA, 22 bp, Artificial Sequence
  chemically synthesized
gctgagctggaagctgttttct

SEQ ID NO: 62895 - DNA, 22 bp, Artificial Sequence
  chemically synthesized
agctggaagctgttttctgcgt

SEQ ID NO: 62896 - DNA, 22 bp, Artificial Sequence
  chemically synthesized
gaagctgttttctgcgtttccc

SEQ ID NO: 62897 - DNA, 22 bp, Artificial Sequence
  chemically synthesized
ttttctgcgtttccctctcatc

SEQ ID NO: 62898 - DNA, 22 bp, Artificial Sequence
  chemically synthesized
tctgcgtttccctctcatctgt

SEQ ID NO: 62899 - DNA, 22 bp, Artificial Sequence
  chemically synthesized
ctgcgtttccctctcatctgtt

SEQ ID NO: 62900 - DNA, 22 bp, Artificial Sequence
  chemically synthesized
tgcgtttccctctcatctgttt

SEQ ID NO: 62901 - DNA, 22 bp, Artificial Sequence
  chemically synthesized
cgtttccctctcatctgtttca

SEQ ID NO: 62902 - DNA, 22 bp, Artificial Sequence
  chemically synthesized
ccctctcatctgtttcagagca

SEQ ID NO: 62903 - DNA, 22 bp, Artificial Sequence
  chemically synthesized
cctctcatctgtttcagagcag

SEQ ID NO: 62904 - DNA, 22 bp, Artificial Sequence
  chemically synthesized
tcatctgtttcagagcaggatg

SEQ ID NO: 62905 - DNA, 22 bp, Artificial Sequence
  chemically synthesized
atctgtttcagagcaggatgag

SEQ ID NO: 62906 - DNA, 22 bp, Artificial Sequence
  chemically synthesized
tttcagagcaggatgaggttcc

SEQ ID NO: 62907 - DNA, 22 bp, Artificial Sequence
  chemically synthesized
cagagcaggatgaggttcctgc

SEQ ID NO: 62908 - DNA, 22 bp, Artificial Sequence
  chemically synthesized
agagcaggatgaggttcctgcc

SEQ ID NO: 62909 - DNA, 22 bp, Artificial Sequence
  chemically synthesized
ctgcctgcagagggaaagtgac

SEQ ID NO: 62910 - DNA, 22 bp, Artificial Sequence
  chemically synthesized
cctgcagagggaaagtgacttg

SEQ ID NO: 62911 - DNA, 22 bp, Artificial Sequence
  chemically synthesized
cagagggaaagtgacttggaac

SEQ ID NO: 62912 - DNA, 22 bp, Artificial Sequence
  chemically synthesized
ggaacacccagggtgccccgca

SEQ ID NO: 62913 - DNA, 22 bp, Artificial Sequence
  chemically synthesized
gaacacccagggtgccccgcag

SEQ ID NO: 62914 - DNA, 22 bp, Artificial Sequence
  chemically synthesized
ggccttcagctgatgttagggc

SEQ ID NO: 62915 - DNA, 22 bp, Artificial Sequence
  chemically synthesized
gccttcagctgatgttagggca

SEQ ID NO: 62916 - DNA, 22 bp, Artificial Sequence
  chemically synthesized
cagctgatgttagggcacagca

SEQ ID NO: 62917 - DNA, 22 bp, Artificial Sequence
  chemically synthesized
agctgatgttagggcacagcag

SEQ ID NO: 62918 - DNA, 22 bp, Artificial Sequence
  chemically synthesized
atgttagggcacagcaggttga

SEQ ID NO: 62919 - DNA, 22 bp, Artificial Sequence
  chemically synthesized
gggcacagcaggttgatgcagt

SEQ ID NO: 62920 - DNA, 22 bp, Artificial Sequence
  chemically synthesized
atgcagtgtggtcctggaggat

SEQ ID NO: 62921 - DNA, 22 bp, Artificial Sequence
  chemically synthesized
gaggatggagttgtttatcgtg

SEQ ID NO: 62922 - DNA, 22 bp, Artificial Sequence
  chemically synthesized
tttatcgtgatcccatatggac

SEQ ID NO: 62923 - DNA, 22 bp, Artificial Sequence
  chemically synthesized
atcgtgatcccatatggactga

SEQ ID NO: 62924 - DNA, 22 bp, Artificial Sequence
  chemically synthesized
tcgtgatcccatatggactgag

SEQ ID NO: 62925 - DNA, 22 bp, Artificial Sequence
  chemically synthesized
aggaagtatgtgctgttgggga

SEQ ID NO: 62926 - DNA, 22 bp, Artificial Sequence
  chemically synthesized
ttggggacagccaggcctaaca

SEQ ID NO: 62927 - DNA, 22 bp, Artificial Sequence
  chemically synthesized
gggacagccaggcctaacagtg

SEQ ID NO: 62928 - DNA, 22 bp, Artificial Sequence
  chemically synthesized
acagtggagaagacctgccttc

SEQ ID NO: 62929 - DNA, 22 bp, Artificial Sequence
  chemically synthesized
ccttccaggcccacactggaca

SEQ ID NO: 62930 - DNA, 22 bp, Artificial Sequence
  chemically synthesized
ccaggcccacactggacagagc

SEQ ID NO: 62931 - DNA, 22 bp, Artificial Sequence
  chemically synthesized
caggcccacactggacagagca

SEQ ID NO: 62932 - DNA, 22 bp, Artificial Sequence
  chemically synthesized
gacagagcatttgacctgctgg

SEQ ID NO: 62933 - DNA, 22 bp, Artificial Sequence
  chemically synthesized
gacctgctgggcctgagtttcc

SEQ ID NO: 62934 - DNA, 22 bp, Artificial Sequence
  chemically synthesized
acctgctgggcctgagtttccc

SEQ ID NO: 62935 - DNA, 22 bp, Artificial Sequence
  chemically synthesized
ctgggcctgagtttccccatgt

SEQ ID NO: 62936 - DNA, 22 bp, Artificial Sequence
  chemically synthesized
ggcctgagtttccccatgtgta

SEQ ID NO: 62937 - DNA, 22 bp, Artificial Sequence
  chemically synthesized
agtttccccatgtgtactttgg

SEQ ID NO: 62938 - DNA, 22 bp, Artificial Sequence
  chemically synthesized
ccccatgtgtactttggggata

SEQ ID NO: 62939 - DNA, 22 bp, Artificial Sequence
  chemically synthesized
cccatgtgtactttggggataa

SEQ ID NO: 62940 - DNA, 22 bp, Artificial Sequence
  chemically synthesized
tggggataatgagtcctaggct

SEQ ID NO: 62941 - DNA, 22 bp, Artificial Sequence
  chemically synthesized
ggggataatgagtcctaggctg

SEQ ID NO: 62942 - DNA, 22 bp, Artificial Sequence
  chemically synthesized
gggataatgagtcctaggctgc

SEQ ID NO: 62943 - DNA, 22 bp, Artificial Sequence
  chemically synthesized
ggctgcgtcctgcagaacctgt

SEQ ID NO: 62944 - DNA, 22 bp, Artificial Sequence
  chemically synthesized
cgtcctgcagaacctgtctgga

SEQ ID NO: 62945 - DNA, 22 bp, Artificial Sequence
  chemically synthesized
cagaacctgtctggaggatcac

SEQ ID NO: 62946 - DNA, 22 bp, Artificial Sequence
  chemically synthesized
tctggaggatcacgttggacag

SEQ ID NO: 62947 - DNA, 22 bp, Artificial Sequence
  chemically synthesized
gaggatcacgttggacagtgaa

SEQ ID NO: 62948 - DNA, 22 bp, Artificial Sequence
  chemically synthesized
gacagtgaatacatttttttaa

SEQ ID NO: 62949 - DNA, 22 bp, Artificial Sequence
  chemically synthesized
ttttaaaactctggaagataca

SEQ ID NO: 62950 - DNA, 22 bp, Artificial Sequence
  chemically synthesized
tttaaaactctggaagatacag

SEQ ID NO: 62951 - DNA, 22 bp, Artificial Sequence
  chemically synthesized
ttaaaactctggaagatacagt

SEQ ID NO: 62952 - DNA, 22 bp, Artificial Sequence
  chemically synthesized
taaaactctggaagatacagtg

SEQ ID NO: 62953 - DNA, 22 bp, Artificial Sequence
  chemically synthesized
aaaactctggaagatacagtga

SEQ ID NO: 62954 - DNA, 22 bp, Artificial Sequence
  chemically synthesized
aaactctggaagatacagtgaa

SEQ ID NO: 62955 - DNA, 22 bp, Artificial Sequence
  chemically synthesized
tggaagatacagtgaagctgag

SEQ ID NO: 62956 - DNA, 22 bp, Artificial Sequence
  chemically synthesized
gaagatacagtgaagctgaggt

SEQ ID NO: 62957 - DNA, 22 bp, Artificial Sequence
  chemically synthesized
aggtcttatggttgtcccatca

SEQ ID NO: 62958 - DNA, 22 bp, Artificial Sequence
  chemically synthesized
atggttgtcccatcacggactt

SEQ ID NO: 62959 - DNA, 22 bp, Artificial Sequence
  chemically synthesized
tggttgtcccatcacggacttg

SEQ ID NO: 62960 - DNA, 22 bp, Artificial Sequence
  chemically synthesized
tcccatcacggacttgtgacat

SEQ ID NO: 62961 - DNA, 22 bp, Artificial Sequence
  chemically synthesized
gtgacatatatttgtcttcctc

SEQ ID NO: 62962 - DNA, 22 bp, Artificial Sequence
  chemically synthesized
tgacatatatttgtcttcctca

SEQ ID NO: 62963 - DNA, 22 bp, Artificial Sequence
  chemically synthesized
gtcttcctcataatgaggttgt

SEQ ID NO: 62964 - DNA, 22 bp, Artificial Sequence
  chemically synthesized
tcttcctcataatgaggttgtc

SEQ ID NO: 62965 - DNA, 22 bp, Artificial Sequence
  chemically synthesized
cctcataatgaggttgtcatga

SEQ ID NO: 62966 - DNA, 22 bp, Artificial Sequence
  chemically synthesized
ctcataatgaggttgtcatgac

SEQ ID NO: 62967 - DNA, 22 bp, Artificial Sequence
  chemically synthesized
ataatgaggttgtcatgacact

SEQ ID NO: 62968 - DNA, 22 bp, Artificial Sequence
  chemically synthesized
tcatgacactctgcccatcctt

SEQ ID NO: 62969 - DNA, 22 bp, Artificial Sequence
  chemically synthesized
tgcccatccttgactgatccct

SEQ ID NO: 62970 - DNA, 22 bp, Artificial Sequence
  chemically synthesized
cccatccttgactgatccctgt

SEQ ID NO: 62971 - DNA, 22 bp, Artificial Sequence
  chemically synthesized
gactgatccctgttgattccca

SEQ ID NO: 62972 - DNA, 22 bp, Artificial Sequence
  chemically synthesized
actgatccctgttgattcccag

SEQ ID NO: 62973 - DNA, 22 bp, Artificial Sequence
  chemically synthesized
atccctgttgattcccagggga

SEQ ID NO: 62974 - DNA, 22 bp, Artificial Sequence
  chemically synthesized
ttgattcccaggggagcccagg

SEQ ID NO: 62975 - DNA, 22 bp, Artificial Sequence
  chemically synthesized
attcccaggggagcccaggaat

SEQ ID NO: 62976 - DNA, 22 bp, Artificial Sequence
  chemically synthesized
ccaggggagcccaggaattccc

SEQ ID NO: 62977 - DNA, 22 bp, Artificial Sequence
  chemically synthesized
cctctgggaggttatgctagtt

SEQ ID NO: 62978 - DNA, 22 bp, Artificial Sequence
  chemically synthesized
tgggaggttatgctagtttgaa

SEQ ID NO: 62979 - DNA, 22 bp, Artificial Sequence
  chemically synthesized
ggaggttatgctagtttgaatg

SEQ ID NO: 62980 - DNA, 22 bp, Artificial Sequence
  chemically synthesized
tgctagtttgaatggggtctct

SEQ ID NO: 62981 - DNA, 22 bp, Artificial Sequence
  chemically synthesized
gtttgaatggggtctctcccat

SEQ ID NO: 62982 - DNA, 22 bp, Artificial Sequence
  chemically synthesized
gaatggggtctctcccatcctg

SEQ ID NO: 62983 - DNA, 22 bp, Artificial Sequence
  chemically synthesized
aatggggtctctcccatcctga

SEQ ID NO: 62984 - DNA, 22 bp, Artificial Sequence
  chemically synthesized
tcccatcctgactgtcaactcg

SEQ ID NO: 62985 - DNA, 22 bp, Artificial Sequence
  chemically synthesized
ccatcctgactgtcaactcgtg

SEQ ID NO: 62986 - DNA, 22 bp, Artificial Sequence
  chemically synthesized
actgtcaactcgtgtgtgacag

SEQ ID NO: 62987 - DNA, 22 bp, Artificial Sequence
  chemically synthesized
tcaactcgtgtgtgacagacaa

SEQ ID NO: 62988 - DNA, 22 bp, Artificial Sequence
  chemically synthesized
gtgtgtgacagacaattcttca

SEQ ID NO: 62989 - DNA, 22 bp, Artificial Sequence
  chemically synthesized
ttcaaagtaaaacgatggtgtc

SEQ ID NO: 62990 - DNA, 22 bp, Artificial Sequence
  chemically synthesized
caaagtaaaacgatggtgtcta

SEQ ID NO: 62991 - DNA, 22 bp, Artificial Sequence
  chemically synthesized
aaagtaaaacgatggtgtctaa

SEQ ID NO: 62992 - DNA, 22 bp, Artificial Sequence
  chemically synthesized
aggtgaccgccctcagcgctgc

SEQ ID NO: 62993 - DNA, 22 bp, Artificial Sequence
  chemically synthesized
agcgctgccacctccttccctg

SEQ ID NO: 62994 - DNA, 22 bp, Artificial Sequence
  chemically synthesized
ccacctccttccctgccctggg

SEQ ID NO: 62995 - DNA, 22 bp, Artificial Sequence
  chemically synthesized
cttccctgccctgggctctcca

SEQ ID NO: 62996 - DNA, 22 bp, Artificial Sequence
  chemically synthesized
ccctgccctgggctctccagaa

SEQ ID NO: 62997 - DNA, 22 bp, Artificial Sequence
  chemically synthesized
cctgccctgggctctccagaaa

SEQ ID NO: 62998 - DNA, 22 bp, Artificial Sequence
  chemically synthesized
ccctgggctctccagaaagcca

SEQ ID NO: 62999 - DNA, 22 bp, Artificial Sequence
  chemically synthesized
ggctctccagaaagccaacttg

SEQ ID NO: 63000 - DNA, 22 bp, Artificial Sequence
  chemically synthesized
tccagaaagccaacttgtcttt

SEQ ID NO: 63001 - DNA, 22 bp, Artificial Sequence
  chemically synthesized
cagaaagccaacttgtctttga

SEQ ID NO: 63002 - DNA, 22 bp, Artificial Sequence
  chemically synthesized
gtctttgactctgcccctgttc

SEQ ID NO: 63003 - DNA, 22 bp, Artificial Sequence
  chemically synthesized
tctttgactctgcccctgttct

SEQ ID NO: 63004 - DNA, 22 bp, Artificial Sequence
  chemically synthesized
tgactctgcccctgttctccta

SEQ ID NO: 63005 - DNA, 22 bp, Artificial Sequence
  chemically synthesized
gactctgcccctgttctcctac

SEQ ID NO: 63006 - DNA, 22 bp, Artificial Sequence
  chemically synthesized
actctgcccctgttctcctacc

SEQ ID NO: 63007 - DNA, 22 bp, Artificial Sequence
  chemically synthesized
tgcccctgttctcctaccaaat

SEQ ID NO: 63008 - DNA, 22 bp, Artificial Sequence
  chemically synthesized
cccctgttctcctaccaaatgc

SEQ ID NO: 63009 - DNA, 22 bp, Artificial Sequence
  chemically synthesized
ttctcctaccaaatgccagtta

SEQ ID NO: 63010 - DNA, 22 bp, Artificial Sequence
  chemically synthesized
tcctaccaaatgccagttaaat

SEQ ID NO: 63011 - DNA, 22 bp, Artificial Sequence
  chemically synthesized
ctaccaaatgccagttaaataa

SEQ ID NO: 63012 - DNA, 22 bp, Artificial Sequence
  chemically synthesized
ccaaatgccagttaaataagag

SEQ ID NO: 63013 - DNA, 22 bp, Artificial Sequence
  chemically synthesized
aataagaggagtcctgtgggtc

SEQ ID NO: 63014 - DNA, 22 bp, Artificial Sequence
  chemically synthesized
tgggtcgcccaaggctgcgggc

SEQ ID NO: 63015 - DNA, 22 bp, Artificial Sequence
  chemically synthesized
cgggctgtgtcaacatctggtg

SEQ ID NO: 63016 - DNA, 22 bp, Artificial Sequence
  chemically synthesized
tgtcaacatctggtggatgagc

SEQ ID NO: 63017 - DNA, 22 bp, Artificial Sequence
  chemically synthesized
gtggatgagcttctgctcacca

SEQ ID NO: 63018 - DNA, 22 bp, Artificial Sequence
  chemically synthesized
ctgctcaccaccttcagctcaa

SEQ ID NO: 63019 - DNA, 22 bp, Artificial Sequence
  chemically synthesized
tgctcaccaccttcagctcaat

SEQ ID NO: 63020 - DNA, 22 bp, Artificial Sequence
  chemically synthesized
ctcaccaccttcagctcaatgc

SEQ ID NO: 63021 - DNA, 22 bp, Artificial Sequence
  chemically synthesized
accaccttcagctcaatgcctg

SEQ ID NO: 63022 - DNA, 22 bp, Artificial Sequence
  chemically synthesized
cagctcaatgcctgctccacac

SEQ ID NO: 63023 - DNA, 22 bp, Artificial Sequence
  chemically synthesized
agctcaatgcctgctccacact

SEQ ID NO: 63024 - DNA, 22 bp, Artificial Sequence
  chemically synthesized
aatgcctgctccacactgggca

SEQ ID NO: 63025 - DNA, 22 bp, Artificial Sequence
  chemically synthesized
ctccacactgggcacagggtgt

SEQ ID NO: 63026 - DNA, 22 bp, Artificial Sequence
  chemically synthesized
cacactgggcacagggtgtttt

SEQ ID NO: 63027 - DNA, 22 bp, Artificial Sequence
  chemically synthesized
ggcacagggtgtttttctcatg

SEQ ID NO: 63028 - DNA, 22 bp, Artificial Sequence
  chemically synthesized
ttctcatgaagtgtgctaggcg

SEQ ID NO: 63029 - DNA, 22 bp, Artificial Sequence
  chemically synthesized
tctcatgaagtgtgctaggcgt

SEQ ID NO: 63030 - DNA, 22 bp, Artificial Sequence
  chemically synthesized
ctcatgaagtgtgctaggcgtg

SEQ ID NO: 63031 - DNA, 22 bp, Artificial Sequence
  chemically synthesized
tcatgaagtgtgctaggcgtga

SEQ ID NO: 63032 - DNA, 22 bp, Artificial Sequence
  chemically synthesized
atgaagtgtgctaggcgtgagc

SEQ ID NO: 63033 - DNA, 22 bp, Artificial Sequence
  chemically synthesized
ggcgtgagctgtgggccaccag

SEQ ID NO: 63034 - DNA, 22 bp, Artificial Sequence
  chemically synthesized
tgggccaccagcaacccttctg

SEQ ID NO: 63035 - DNA, 22 bp, Artificial Sequence
  chemically synthesized
ctggtttaaggaggaattacct

SEQ ID NO: 63036 - DNA, 22 bp, Artificial Sequence
  chemically synthesized
tggtttaaggaggaattacctc

SEQ ID NO: 63037 - DNA, 22 bp, Artificial Sequence
  chemically synthesized
gtttaaggaggaattacctctg

SEQ ID NO: 63038 - DNA, 22 bp, Artificial Sequence
  chemically synthesized
aaggaggaattacctctgcaga

SEQ ID NO: 63039 - DNA, 22 bp, Artificial Sequence
  chemically synthesized
aggaggaattacctctgcagaa

SEQ ID NO: 63040 - DNA, 22 bp, Artificial Sequence
  chemically synthesized
cctctgcagaagtttagcgtga

SEQ ID NO: 63041 - DNA, 22 bp, Artificial Sequence
  chemically synthesized
tgcagaagtttagcgtgaccct

SEQ ID NO: 63042 - DNA, 22 bp, Artificial Sequence
  chemically synthesized
cagaagtttagcgtgaccctcg

SEQ ID NO: 63043 - DNA, 22 bp, Artificial Sequence
  chemically synthesized
agcgtgaccctcgaaggggaga

SEQ ID NO: 63044 - DNA, 22 bp, Artificial Sequence
  chemically synthesized
gcgtgaccctcgaaggggagag

SEQ ID NO: 63045 - DNA, 22 bp, Artificial Sequence
  chemically synthesized
gaaggggagagtgtggtgaggt

SEQ ID NO: 63046 - DNA, 22 bp, Artificial Sequence
  chemically synthesized
agaggaacaagtagcccatcaa

SEQ ID NO: 63047 - DNA, 22 bp, Artificial Sequence
  chemically synthesized
tgccacttatgagctgtgtgac

SEQ ID NO: 63048 - DNA, 22 bp, Artificial Sequence
  chemically synthesized
gccacttatgagctgtgtgaca

SEQ ID NO: 63049 - DNA, 22 bp, Artificial Sequence
  chemically synthesized
ccacttatgagctgtgtgacat

SEQ ID NO: 63050 - DNA, 22 bp, Artificial Sequence
  chemically synthesized
atgagctgtgtgacattgtggg

SEQ ID NO: 63051 - DNA, 22 bp, Artificial Sequence
  chemically synthesized
tgagctgtgtgacattgtggga

SEQ ID NO: 63052 - DNA, 22 bp, Artificial Sequence
  chemically synthesized
tgtgacattgtgggagaccagt

SEQ ID NO: 63053 - DNA, 22 bp, Artificial Sequence
  chemically synthesized
tgggagaccagtagcctctctg

SEQ ID NO: 63054 - DNA, 22 bp, Artificial Sequence
  chemically synthesized
tctgagcctcagtttcctcaga

SEQ ID NO: 63055 - DNA, 22 bp, Artificial Sequence
  chemically synthesized
tgagcctcagtttcctcagatt

SEQ ID NO: 63056 - DNA, 22 bp, Artificial Sequence
  chemically synthesized
agcctcagtttcctcagatttg

SEQ ID NO: 63057 - DNA, 22 bp, Artificial Sequence
  chemically synthesized
agtttcctcagatttggagttt

SEQ ID NO: 63058 - DNA, 22 bp, Artificial Sequence
  chemically synthesized
cctcagatttggagtttaagag

SEQ ID NO: 63059 - DNA, 22 bp, Artificial Sequence
  chemically synthesized
ctcagatttggagtttaagagc

SEQ ID NO: 63060 - DNA, 22 bp, Artificial Sequence
  chemically synthesized
agatttggagtttaagagcaca

SEQ ID NO: 63061 - DNA, 22 bp, Artificial Sequence
  chemically synthesized
ggagtttaagagcacagcagat

SEQ ID NO: 63062 - DNA, 22 bp, Artificial Sequence
  chemically synthesized
gagtttaagagcacagcagata

SEQ ID NO: 63063 - DNA, 22 bp, Artificial Sequence
  chemically synthesized
aagagcacagcagatatactca

SEQ ID NO: 63064 - DNA, 22 bp, Artificial Sequence
  chemically synthesized
agagcacagcagatatactcac

SEQ ID NO: 63065 - DNA, 22 bp, Artificial Sequence
  chemically synthesized
acacatcgcagtgctgctacag

SEQ ID NO: 63066 - DNA, 22 bp, Artificial Sequence
  chemically synthesized
ctacagtgagtaaatgagaaac

SEQ ID NO: 63067 - DNA, 22 bp, Artificial Sequence
  chemically synthesized
cagtgagtaaatgagaaacagc

SEQ ID NO: 63068 - DNA, 22 bp, Artificial Sequence
  chemically synthesized
catagggatgtctgattcacag

SEQ ID NO: 63069 - DNA, 22 bp, Artificial Sequence
  chemically synthesized
atagggatgtctgattcacaga

SEQ ID NO: 63070 - DNA, 22 bp, Artificial Sequence
  chemically synthesized
attcacagaaagctcataagtg

SEQ ID NO: 63071 - DNA, 22 bp, Artificial Sequence
  chemically synthesized
acagaaagctcataagtgcaag

SEQ ID NO: 63072 - DNA, 22 bp, Artificial Sequence
  chemically synthesized
ataagtgcaagaaatgtagttc

SEQ ID NO: 63073 - DNA, 22 bp, Artificial Sequence
  chemically synthesized
tatttattctctgttctaatgg

SEQ ID NO: 63074 - DNA, 22 bp, Artificial Sequence
  chemically synthesized
tttattctctgttctaatgggt

SEQ ID NO: 63075 - DNA, 22 bp, Artificial Sequence
  chemically synthesized
attctctgttctaatgggtata

SEQ ID NO: 63076 - DNA, 22 bp, Artificial Sequence
  chemically synthesized
ttctctgttctaatgggtataa

SEQ ID NO: 63077 - DNA, 22 bp, Artificial Sequence
  chemically synthesized
tctgttctaatgggtataaaca

SEQ ID NO: 63078 - DNA, 22 bp, Artificial Sequence
  chemically synthesized
tgttctaatgggtataaacatt

SEQ ID NO: 63079 - DNA, 22 bp, Artificial Sequence
  chemically synthesized
ttctaatgggtataaacatttt

SEQ ID NO: 63080 - DNA, 22 bp, Artificial Sequence
  chemically synthesized
taatgggtataaacattttgtt

SEQ ID NO: 63081 - DNA, 22 bp, Artificial Sequence
  chemically synthesized
atgggtataaacattttgttat

SEQ ID NO: 63082 - DNA, 22 bp, Artificial Sequence
  chemically synthesized
tgttatctaacttgaacatcat

SEQ ID NO: 63083 - DNA, 22 bp, Artificial Sequence
  chemically synthesized
gttatctaacttgaacatcata

SEQ ID NO: 63084 - DNA, 22 bp, Artificial Sequence
  chemically synthesized
ttatctaacttgaacatcatac

SEQ ID NO: 63085 - DNA, 22 bp, Artificial Sequence
  chemically synthesized
tctaacttgaacatcataccaa

SEQ ID NO: 63086 - DNA, 22 bp, Artificial Sequence
  chemically synthesized
acttgaacatcataccaactca

SEQ ID NO: 63087 - DNA, 22 bp, Artificial Sequence
  chemically synthesized
gaacatcataccaactcaaagg

SEQ ID NO: 63088 - DNA, 22 bp, Artificial Sequence
  chemically synthesized
aacatcataccaactcaaaggc

SEQ ID NO: 63089 - DNA, 22 bp, Artificial Sequence
  chemically synthesized
aaaggcaggtcttactagcaat

SEQ ID NO: 63090 - DNA, 22 bp, Artificial Sequence
  chemically synthesized
actagcaatgactggggctcag

SEQ ID NO: 63091 - DNA, 22 bp, Artificial Sequence
  chemically synthesized
ctagcaatgactggggctcaga

SEQ ID NO: 63092 - DNA, 22 bp, Artificial Sequence
  chemically synthesized
gcaatgactggggctcagagag

SEQ ID NO: 63093 - DNA, 22 bp, Artificial Sequence
  chemically synthesized
gggctcagagaggtttggcgac

SEQ ID NO: 63094 - DNA, 22 bp, Artificial Sequence
  chemically synthesized
agagaggtttggcgacttcacg

SEQ ID NO: 63095 - DNA, 22 bp, Artificial Sequence
  chemically synthesized
ggcgacttcacgaaggtcacac

SEQ ID NO: 63096 - DNA, 22 bp, Artificial Sequence
  chemically synthesized
gcgacttcacgaaggtcacaca

SEQ ID NO: 63097 - DNA, 22 bp, Artificial Sequence
  chemically synthesized
cacgaaggtcacacagctgtca

SEQ ID NO: 63098 - DNA, 22 bp, Artificial Sequence
  chemically synthesized
acgaaggtcacacagctgtcag

SEQ ID NO: 63099 - DNA, 22 bp, Artificial Sequence
  chemically synthesized
tcagggggaaaagtcagaactt

SEQ ID NO: 63100 - DNA, 22 bp, Artificial Sequence
  chemically synthesized
ggatccaggtcttcagactctc

SEQ ID NO: 63101 - DNA, 22 bp, Artificial Sequence
  chemically synthesized
gatccaggtcttcagactctca

SEQ ID NO: 63102 - DNA, 22 bp, Artificial Sequence
  chemically synthesized
cagactctcaggtctggtgtca

SEQ ID NO: 63103 - DNA, 22 bp, Artificial Sequence
  chemically synthesized
agactctcaggtctggtgtcat

SEQ ID NO: 63104 - DNA, 22 bp, Artificial Sequence
  chemically synthesized
tcaggtctggtgtcatcctagg

SEQ ID NO: 63105 - DNA, 22 bp, Artificial Sequence
  chemically synthesized
aggtctggtgtcatcctagggg

SEQ ID NO: 63106 - DNA, 22 bp, Artificial Sequence
  chemically synthesized
gtgtcatcctagggggcttggt

SEQ ID NO: 63107 - DNA, 22 bp, Artificial Sequence
  chemically synthesized
gggggcttggtgatggccatat

SEQ ID NO: 63108 - DNA, 22 bp, Artificial Sequence
  chemically synthesized
ggtgatggccatatctttaatg

SEQ ID NO: 63109 - DNA, 22 bp, Artificial Sequence
  chemically synthesized
gtgatggccatatctttaatgt

SEQ ID NO: 63110 - DNA, 22 bp, Artificial Sequence
  chemically synthesized
taatgtatttgtggagagtgaa

SEQ ID NO: 63111 - DNA, 22 bp, Artificial Sequence
  chemically synthesized
aatgtatttgtggagagtgaaa

SEQ ID NO: 63112 - DNA, 22 bp, Artificial Sequence
  chemically synthesized
atgtatttgtggagagtgaaag

SEQ ID NO: 63113 - DNA, 22 bp, Artificial Sequence
  chemically synthesized
gtggagagtgaaaggctgtcag

SEQ ID NO: 63114 - DNA, 22 bp, Artificial Sequence
  chemically synthesized
tggagagtgaaaggctgtcagt

SEQ ID NO: 63115 - DNA, 22 bp, Artificial Sequence
  chemically synthesized
tcagtgagtaagcttaagagaa

SEQ ID NO: 63116 - DNA, 22 bp, Artificial Sequence
  chemically synthesized
aagagaacaggagacttgtgtg

SEQ ID NO: 63117 - DNA, 22 bp, Artificial Sequence
  chemically synthesized
agagaacaggagacttgtgtgg

SEQ ID NO: 63118 - DNA, 22 bp, Artificial Sequence
  chemically synthesized
gtgtgggaaacagtcggtatcc

SEQ ID NO: 63119 - DNA, 22 bp, Artificial Sequence
  chemically synthesized
tgtgggaaacagtcggtatcca

SEQ ID NO: 63120 - DNA, 22 bp, Artificial Sequence
  chemically synthesized
attagactgaatcatgtagaat

SEQ ID NO: 63121 - DNA, 22 bp, Artificial Sequence
  chemically synthesized
gactgaatcatgtagaattgct

SEQ ID NO: 63122 - DNA, 22 bp, Artificial Sequence
  chemically synthesized
aatcatgtagaattgctaattt

SEQ ID NO: 63123 - DNA, 22 bp, Artificial Sequence
  chemically synthesized
ctaatttcaccattttgaacta

SEQ ID NO: 63124 - DNA, 22 bp, Artificial Sequence
  chemically synthesized
atttcaccattttgaactatcg

SEQ ID NO: 63125 - DNA, 22 bp, Artificial Sequence
  chemically synthesized
caccattttgaactatcgaaat

SEQ ID NO: 63126 - DNA, 22 bp, Artificial Sequence
  chemically synthesized
accattttgaactatcgaaatc

SEQ ID NO: 63127 - DNA, 22 bp, Artificial Sequence
  chemically synthesized
tgaactatcgaaatcactattt

SEQ ID NO: 63128 - DNA, 22 bp, Artificial Sequence
  chemically synthesized
gaactatcgaaatcactatttg

SEQ ID NO: 63129 - DNA, 22 bp, Artificial Sequence
  chemically synthesized
aactatcgaaatcactatttgg

SEQ ID NO: 63130 - DNA, 22 bp, Artificial Sequence
  chemically synthesized
tcgaaatcactatttggtatga

SEQ ID NO: 63131 - DNA, 22 bp, Artificial Sequence
  chemically synthesized
tttggtatgactcaacctcatc

SEQ ID NO: 63132 - DNA, 22 bp, Artificial Sequence
  chemically synthesized
ggtatgactcaacctcatcctt

SEQ ID NO: 63133 - DNA, 22 bp, Artificial Sequence
  chemically synthesized
gtatgactcaacctcatccttt

SEQ ID NO: 63134 - DNA, 22 bp, Artificial Sequence
  chemically synthesized
aacctcatcctttaagtacaca

SEQ ID NO: 63135 - DNA, 22 bp, Artificial Sequence
  chemically synthesized
atcctttaagtacacattcatg

SEQ ID NO: 63136 - DNA, 22 bp, Artificial Sequence
  chemically synthesized
taagtacacattcatgacagtg

SEQ ID NO: 63137 - DNA, 22 bp, Artificial Sequence
  chemically synthesized
aagtacacattcatgacagtga

SEQ ID NO: 63138 - DNA, 22 bp, Artificial Sequence
  chemically synthesized
agtacacattcatgacagtgag

SEQ ID NO: 63139 - DNA, 22 bp, Artificial Sequence
  chemically synthesized
atgacagtgagtggttagacag

SEQ ID NO: 63140 - DNA, 22 bp, Artificial Sequence
  chemically synthesized
gacagtgattcctagattagtt

SEQ ID NO: 63141 - DNA, 22 bp, Artificial Sequence
  chemically synthesized
ctagattagtttgggatggggc

SEQ ID NO: 63142 - DNA, 22 bp, Artificial Sequence
  chemically synthesized
gattagtttgggatggggcagt

SEQ ID NO: 63143 - DNA, 22 bp, Artificial Sequence
  chemically synthesized
gtttgggatggggcagtgcctt

SEQ ID NO: 63144 - DNA, 22 bp, Artificial Sequence
  chemically synthesized
gggatggggcagtgccttccat

SEQ ID NO: 63145 - DNA, 22 bp, Artificial Sequence
  chemically synthesized
ggatggggcagtgccttccata

SEQ ID NO: 63146 - DNA, 22 bp, Artificial Sequence
  chemically synthesized
ccataggacaaggccattcctg

SEQ ID NO: 63147 - DNA, 22 bp, Artificial Sequence
  chemically synthesized
cataggacaaggccattcctgg

SEQ ID NO: 63148 - DNA, 22 bp, Artificial Sequence
  chemically synthesized
ctggtagagacggagggagcag

SEQ ID NO: 63149 - DNA, 22 bp, Artificial Sequence
  chemically synthesized
gtagagacggagggagcaggct

SEQ ID NO: 63150 - DNA, 22 bp, Artificial Sequence
  chemically synthesized
tccttcagctaggggcccaggg

SEQ ID NO: 63151 - DNA, 22 bp, Artificial Sequence
  chemically synthesized
cagctaggggcccaggggactt

SEQ ID NO: 63152 - DNA, 22 bp, Artificial Sequence
  chemically synthesized
agctaggggcccaggggacttc

SEQ ID NO: 63153 - DNA, 22 bp, Artificial Sequence
  chemically synthesized
ggggcccaggggacttcctggc

SEQ ID NO: 63154 - DNA, 22 bp, Artificial Sequence
  chemically synthesized
cctggctgctgtgtcctttagc

SEQ ID NO: 63155 - DNA, 22 bp, Artificial Sequence
  chemically synthesized
ctggctgctgtgtcctttagca

SEQ ID NO: 63156 - DNA, 22 bp, Artificial Sequence
  chemically synthesized
gctgctgtgtcctttagcaggg

SEQ ID NO: 63157 - DNA, 22 bp, Artificial Sequence
  chemically synthesized
ctgtgtcctttagcagggcctt

SEQ ID NO: 63158 - DNA, 22 bp, Artificial Sequence
  chemically synthesized
tgtcctttagcagggccttgga

SEQ ID NO: 63159 - DNA, 22 bp, Artificial Sequence
  chemically synthesized
tagcagggccttggaggatgga

SEQ ID NO: 63160 - DNA, 22 bp, Artificial Sequence
  chemically synthesized
agcagggccttggaggatggaa

SEQ ID NO: 63161 - DNA, 22 bp, Artificial Sequence
  chemically synthesized
gcagggccttggaggatggaag

SEQ ID NO: 63162 - DNA, 22 bp, Artificial Sequence
  chemically synthesized
ggaggatggaaggactctcctg

SEQ ID NO: 63163 - DNA, 22 bp, Artificial Sequence
  chemically synthesized
gaggatggaaggactctcctgg

SEQ ID NO: 63164 - DNA, 22 bp, Artificial Sequence
  chemically synthesized
tcctggcccttaccacaggggc

SEQ ID NO: 63165 - DNA, 22 bp, Artificial Sequence
  chemically synthesized
ctggcccttaccacaggggcta

SEQ ID NO: 63166 - DNA, 22 bp, Artificial Sequence
  chemically synthesized
gcccttaccacaggggctattc

SEQ ID NO: 63167 - DNA, 22 bp, Artificial Sequence
  chemically synthesized
accacaggggctattcaggaac

SEQ ID NO: 63168 - DNA, 22 bp, Artificial Sequence
  chemically synthesized
ccacaggggctattcaggaaca

SEQ ID NO: 63169 - DNA, 22 bp, Artificial Sequence
  chemically synthesized
ttcaggaacagcctcctgccgt

SEQ ID NO: 63170 - DNA, 22 bp, Artificial Sequence
  chemically synthesized
aggaacagcctcctgccgtggc

SEQ ID NO: 63171 - DNA, 22 bp, Artificial Sequence
  chemically synthesized
ctgccgtggcactggagctgcg

SEQ ID NO: 63172 - DNA, 22 bp, Artificial Sequence
  chemically synthesized
ccgtggcactggagctgcggtg

SEQ ID NO: 63173 - DNA, 22 bp, Artificial Sequence
  chemically synthesized
gagctgcggtggccctctgaag

SEQ ID NO: 63174 - DNA, 22 bp, Artificial Sequence
  chemically synthesized
cggtggccctctgaagactgca

SEQ ID NO: 63175 - DNA, 22 bp, Artificial Sequence
  chemically synthesized
tgaagactgcagggacagcaac

SEQ ID NO: 63176 - DNA, 22 bp, Artificial Sequence
  chemically synthesized
aagactgcagggacagcaacag

SEQ ID NO: 63177 - DNA, 22 bp, Artificial Sequence
  chemically synthesized
cagggacagcaacaggcacaaa

SEQ ID NO: 63178 - DNA, 22 bp, Artificial Sequence
  chemically synthesized
catgtggccccagtcgggactc

SEQ ID NO: 63179 - DNA, 22 bp, Artificial Sequence
  chemically synthesized
agaggaggaaagggaggggttg

SEQ ID NO: 63180 - DNA, 22 bp, Artificial Sequence
  chemically synthesized
cgggggtcaatgggtgatgtgc

SEQ ID NO: 63181 - DNA, 22 bp, Artificial Sequence
  chemically synthesized
cctctcccatagctgaggagtc

SEQ ID NO: 63182 - DNA, 22 bp, Artificial Sequence
  chemically synthesized
ctctcccatagctgaggagtcc

SEQ ID NO: 63183 - DNA, 22 bp, Artificial Sequence
  chemically synthesized
tcccatagctgaggagtccttg

SEQ ID NO: 63184 - DNA, 22 bp, Artificial Sequence
  chemically synthesized
ccatagctgaggagtccttgca

SEQ ID NO: 63185 - DNA, 22 bp, Artificial Sequence
  chemically synthesized
aggagtccttgcaatggccttc

SEQ ID NO: 63186 - DNA, 22 bp, Artificial Sequence
  chemically synthesized
gcaatggccttcctgagccatc

SEQ ID NO: 63187 - DNA, 22 bp, Artificial Sequence
  chemically synthesized
caatggccttcctgagccatca

SEQ ID NO: 63188 - DNA, 22 bp, Artificial Sequence
  chemically synthesized
cctgagccatcagcaggcctat

SEQ ID NO: 63189 - DNA, 22 bp, Artificial Sequence
  chemically synthesized
ctgagccatcagcaggcctatg

SEQ ID NO: 63190 - DNA, 22 bp, Artificial Sequence
  chemically synthesized
agccatcagcaggcctatggcc

SEQ ID NO: 63191 - DNA, 22 bp, Artificial Sequence
  chemically synthesized
tggccatgtgactagggaggag

SEQ ID NO: 63192 - DNA, 22 bp, Artificial Sequence
  chemically synthesized
gggaggagaagggatatagggt

SEQ ID NO: 63193 - DNA, 22 bp, Artificial Sequence
  chemically synthesized
ctggggcctgctgggcctggtc

SEQ ID NO: 63194 - DNA, 22 bp, Artificial Sequence
  chemically synthesized
tggggcctgctgggcctggtca

SEQ ID NO: 63195 - DNA, 22 bp, Artificial Sequence
  chemically synthesized
gggcctgctgggcctggtcaag

SEQ ID NO: 63196 - DNA, 22 bp, Artificial Sequence
  chemically synthesized
ctgggcctggtcaagtctgagg

SEQ ID NO: 63197 - DNA, 22 bp, Artificial Sequence
  chemically synthesized
ggcctggtcaagtctgaggagg

SEQ ID NO: 63198 - DNA, 22 bp, Artificial Sequence
  chemically synthesized
gtcaagtctgaggaggagatag

SEQ ID NO: 63199 - DNA, 22 bp, Artificial Sequence
  chemically synthesized
aggaggagatagagaaaacaaa

SEQ ID NO: 63200 - DNA, 22 bp, Artificial Sequence
  chemically synthesized
ctcttcatctggggagaaggga

SEQ ID NO: 63201 - DNA, 22 bp, Artificial Sequence
  chemically synthesized
ttcatctggggagaagggacct

SEQ ID NO: 63202 - DNA, 22 bp, Artificial Sequence
  chemically synthesized
catctggggagaagggacctga

SEQ ID NO: 63203 - DNA, 22 bp, Artificial Sequence
  chemically synthesized
atctggggagaagggacctgat

SEQ ID NO: 63204 - DNA, 22 bp, Artificial Sequence
  chemically synthesized
gggagaagggacctgattctaa

SEQ ID NO: 63205 - DNA, 22 bp, Artificial Sequence
  chemically synthesized
attctaaacggagatatgtgag

SEQ ID NO: 63206 - DNA, 22 bp, Artificial Sequence
  chemically synthesized
taaacggagatatgtgaggctt

SEQ ID NO: 63207 - DNA, 22 bp, Artificial Sequence
  chemically synthesized
aacggagatatgtgaggctttc

SEQ ID NO: 63208 - DNA, 22 bp, Artificial Sequence
  chemically synthesized
tctggggcagcgatggaaggac

SEQ ID NO: 63209 - DNA, 22 bp, Artificial Sequence
  chemically synthesized
ctggggcagcgatggaaggaca

SEQ ID NO: 63210 - DNA, 22 bp, Artificial Sequence
  chemically synthesized
tggggcagcgatggaaggacaa

SEQ ID NO: 63211 - DNA, 22 bp, Artificial Sequence
  chemically synthesized
gggcagcgatggaaggacaagg

SEQ ID NO: 63212 - DNA, 22 bp, Artificial Sequence
  chemically synthesized
gttgccccatggagaatgggct

SEQ ID NO: 63213 - DNA, 22 bp, Artificial Sequence
  chemically synthesized
ttgccccatggagaatgggctt

SEQ ID NO: 63214 - DNA, 22 bp, Artificial Sequence
  chemically synthesized
ccccatggagaatgggcttcag

SEQ ID NO: 63215 - DNA, 22 bp, Artificial Sequence
  chemically synthesized
caggaagaatctgcctcagtca

SEQ ID NO: 63216 - DNA, 22 bp, Artificial Sequence
  chemically synthesized
aggaagaatctgcctcagtcat

SEQ ID NO: 63217 - DNA, 22 bp, Artificial Sequence
  chemically synthesized
cctcagtcattttccagaagtg

SEQ ID NO: 63218 - DNA, 22 bp, Artificial Sequence
  chemically synthesized
agtcattttccagaagtgcctg

SEQ ID NO: 63219 - DNA, 22 bp, Artificial Sequence
  chemically synthesized
tccagaagtgcctgagaggtgc

SEQ ID NO: 63220 - DNA, 22 bp, Artificial Sequence
  chemically synthesized
ccagaagtgcctgagaggtgca

SEQ ID NO: 63221 - DNA, 22 bp, Artificial Sequence
  chemically synthesized
cagaagtgcctgagaggtgcag

SEQ ID NO: 63222 - DNA, 22 bp, Artificial Sequence
  chemically synthesized
agaggtgcagggcccgagtctg

SEQ ID NO: 63223 - DNA, 22 bp, Artificial Sequence
  chemically synthesized
gttaggtgacagcgggtcaaga

SEQ ID NO: 63224 - DNA, 22 bp, Artificial Sequence
  chemically synthesized
ggtgacagcgggtcaagaggag

SEQ ID NO: 63225 - DNA, 22 bp, Artificial Sequence
  chemically synthesized
tcctctctcttgtgttgctgca

SEQ ID NO: 63226 - DNA, 22 bp, Artificial Sequence
  chemically synthesized
tctcttgtgttgctgcagatgc

SEQ ID NO: 63227 - DNA, 22 bp, Artificial Sequence
  chemically synthesized
tcttgtgttgctgcagatgcca

SEQ ID NO: 63228 - DNA, 22 bp, Artificial Sequence
  chemically synthesized
ttgtgttgctgcagatgccaca

SEQ ID NO: 63229 - DNA, 22 bp, Artificial Sequence
  chemically synthesized
gtgttgctgcagatgccacaaa

SEQ ID NO: 63230 - DNA, 22 bp, Artificial Sequence
  chemically synthesized
tgttgctgcagatgccacaaaa

SEQ ID NO: 63231 - DNA, 22 bp, Artificial Sequence
  chemically synthesized
ctgcagatgccacaaaactggg

SEQ ID NO: 63232 - DNA, 22 bp, Artificial Sequence
  chemically synthesized
cagatgccacaaaactgggcca

SEQ ID NO: 63233 - DNA, 22 bp, Artificial Sequence
  chemically synthesized
ggccacggcacgatcaggcagt

SEQ ID NO: 63234 - DNA, 22 bp, Artificial Sequence
  chemically synthesized
tggggcccccaggagggcagcc

SEQ ID NO: 63235 - DNA, 22 bp, Artificial Sequence
  chemically synthesized
gggcccccaggagggcagcctt

SEQ ID NO: 63236 - DNA, 22 bp, Artificial Sequence
  chemically synthesized
ggggtgggcacagccagccctg

SEQ ID NO: 63237 - DNA, 22 bp, Artificial Sequence
  chemically synthesized
gggtgggcacagccagccctgg

SEQ ID NO: 63238 - DNA, 22 bp, Artificial Sequence
  chemically synthesized
gcaggatgagcaactctgggtg

SEQ ID NO: 63239 - DNA, 22 bp, Artificial Sequence
  chemically synthesized
tgggtgggggggagtgggggat

SEQ ID NO: 63240 - DNA, 22 bp, Artificial Sequence
  chemically synthesized
ggtgggggggagtgggggatga

SEQ ID NO: 63241 - DNA, 22 bp, Artificial Sequence
  chemically synthesized
ggtggagcctggggtcatggct

SEQ ID NO: 63242 - DNA, 22 bp, Artificial Sequence
  chemically synthesized
gtggagcctggggtcatggctg

SEQ ID NO: 63243 - DNA, 22 bp, Artificial Sequence
  chemically synthesized
gggtcatggctggtatctggtt

SEQ ID NO: 63244 - DNA, 22 bp, Artificial Sequence
  chemically synthesized
gtatctggttcctcccctgtga

SEQ ID NO: 63245 - DNA, 22 bp, Artificial Sequence
  chemically synthesized
gttcctcccctgtgattccttc

SEQ ID NO: 63246 - DNA, 22 bp, Artificial Sequence
  chemically synthesized
ctcccctgtgattccttcttgg

SEQ ID NO: 63247 - DNA, 22 bp, Artificial Sequence
  chemically synthesized
ccctgtgattccttcttgggga

SEQ ID NO: 63248 - DNA, 22 bp, Artificial Sequence
  chemically synthesized
tgattccttcttggggactcca

SEQ ID NO: 63249 - DNA, 22 bp, Artificial Sequence
  chemically synthesized
cttcttggggactccaagacag

SEQ ID NO: 63250 - DNA, 22 bp, Artificial Sequence
  chemically synthesized
cttggggactccaagacaggac

SEQ ID NO: 63251 - DNA, 22 bp, Artificial Sequence
  chemically synthesized
ttggggactccaagacaggaca

SEQ ID NO: 63252 - DNA, 22 bp, Artificial Sequence
  chemically synthesized
ggggactccaagacaggacaag

SEQ ID NO: 63253 - DNA, 22 bp, Artificial Sequence
  chemically synthesized
gggactccaagacaggacaagg

SEQ ID NO: 63254 - DNA, 22 bp, Artificial Sequence
  chemically synthesized
caagacaggacaaggaagactg

SEQ ID NO: 63255 - DNA, 22 bp, Artificial Sequence
  chemically synthesized
gagccctccagaaacagatggg

SEQ ID NO: 63256 - DNA, 22 bp, Artificial Sequence
  chemically synthesized
cagaaacagatgggcccaggtc

SEQ ID NO: 63257 - DNA, 22 bp, Artificial Sequence
  chemically synthesized
aggattcagtcccccctggatt

SEQ ID NO: 63258 - DNA, 22 bp, Artificial Sequence
  chemically synthesized
agtcccccctggattcaagccc

SEQ ID NO: 63259 - DNA, 22 bp, Artificial Sequence
  chemically synthesized
gattcaagcccagcatgtgcct

SEQ ID NO: 63260 - DNA, 22 bp, Artificial Sequence
  chemically synthesized
aagcccagcatgtgcctaccca

SEQ ID NO: 63261 - DNA, 22 bp, Artificial Sequence
  chemically synthesized
cccagccagatgctccatgaac

SEQ ID NO: 63262 - DNA, 22 bp, Artificial Sequence
  chemically synthesized
catgaacacagttcagggggcc

SEQ ID NO: 63263 - DNA, 22 bp, Artificial Sequence
  chemically synthesized
agggggcccgaagacagcactg

SEQ ID NO: 63264 - DNA, 22 bp, Artificial Sequence
  chemically synthesized
ttacctggagcccacatacagc

SEQ ID NO: 63265 - DNA, 22 bp, Artificial Sequence
  chemically synthesized
cctggagcccacatacagcctc

SEQ ID NO: 63266 - DNA, 22 bp, Artificial Sequence
  chemically synthesized
gagcccacatacagcctcagca

SEQ ID NO: 63267 - DNA, 22 bp, Artificial Sequence
  chemically synthesized
agcaggcaaagggagactcaga

SEQ ID NO: 63268 - DNA, 22 bp, Artificial Sequence
  chemically synthesized
agagaaaacatgggagggattt

SEQ ID NO: 63269 - DNA, 22 bp, Artificial Sequence
  chemically synthesized
acagtcacatgcaggcagggac

SEQ ID NO: 63270 - DNA, 22 bp, Artificial Sequence
  chemically synthesized
cagtcacatgcaggcagggacc

SEQ ID NO: 63271 - DNA, 22 bp, Artificial Sequence
  chemically synthesized
aacccttctttaatgtcatcca

SEQ ID NO: 63272 - DNA, 22 bp, Artificial Sequence
  chemically synthesized
ctttaatgtcatccagggaggg

SEQ ID NO: 63273 - DNA, 22 bp, Artificial Sequence
  chemically synthesized
tttaatgtcatccagggagggg

SEQ ID NO: 63274 - DNA, 22 bp, Artificial Sequence
  chemically synthesized
taatgtcatccagggagggggc

SEQ ID NO: 63275 - DNA, 22 bp, Artificial Sequence
  chemically synthesized
aatgtcatccagggagggggcc

SEQ ID NO: 63276 - DNA, 22 bp, Artificial Sequence
  chemically synthesized
atgtcatccagggagggggcca

SEQ ID NO: 63277 - DNA, 22 bp, Artificial Sequence
  chemically synthesized
aggagcgagaggcagttatttt

SEQ ID NO: 63278 - DNA, 22 bp, Artificial Sequence
  chemically synthesized
tttttgggtgggattcaccact

SEQ ID NO: 63279 - DNA, 22 bp, Artificial Sequence
  chemically synthesized
ttgggtgggattcaccactttt

SEQ ID NO: 63280 - DNA, 22 bp, Artificial Sequence
  chemically synthesized
tgggtgggattcaccacttttc

SEQ ID NO: 63281 - DNA, 22 bp, Artificial Sequence
  chemically synthesized
gggtgggattcaccacttttcc

SEQ ID NO: 63282 - DNA, 22 bp, Artificial Sequence
  chemically synthesized
ggtgggattcaccacttttccc

SEQ ID NO: 63283 - DNA, 22 bp, Artificial Sequence
  chemically synthesized
accacttttcccatgaagaggg

SEQ ID NO: 63284 - DNA, 22 bp, Artificial Sequence
  chemically synthesized
ttcccatgaagaggggagactt

SEQ ID NO: 63285 - DNA, 22 bp, Artificial Sequence
  chemically synthesized
tcccatgaagaggggagacttg

SEQ ID NO: 63286 - DNA, 22 bp, Artificial Sequence
  chemically synthesized
cccatgaagaggggagacttgg

SEQ ID NO: 63287 - DNA, 22 bp, Artificial Sequence
  chemically synthesized
ccatgaagaggggagacttggt

SEQ ID NO: 63288 - DNA, 22 bp, Artificial Sequence
  chemically synthesized
ggtattttgttcaatcattaag

SEQ ID NO: 63289 - DNA, 22 bp, Artificial Sequence
  chemically synthesized
gtattttgttcaatcattaaga

SEQ ID NO: 63290 - DNA, 22 bp, Artificial Sequence
  chemically synthesized
tgttcaatcattaagaagacaa

SEQ ID NO: 63291 - DNA, 22 bp, Artificial Sequence
  chemically synthesized
gttcaatcattaagaagacaaa

SEQ ID NO: 63292 - DNA, 22 bp, Artificial Sequence
  chemically synthesized
ttcaatcattaagaagacaaag

SEQ ID NO: 63293 - DNA, 22 bp, Artificial Sequence
  chemically synthesized
aatcattaagaagacaaagggt

SEQ ID NO: 63294 - DNA, 22 bp, Artificial Sequence
  chemically synthesized
agaagacaaagggtttgttgaa

SEQ ID NO: 63295 - DNA, 22 bp, Artificial Sequence
  chemically synthesized
gttgaacttgacctcggggggg

SEQ ID NO: 63296 - DNA, 22 bp, Artificial Sequence
  chemically synthesized
ttgaacttgacctcggggggga

SEQ ID NO: 63297 - DNA, 22 bp, Artificial Sequence
  chemically synthesized
aacttgacctcgggggggatag

SEQ ID NO: 63298 - DNA, 22 bp, Artificial Sequence
  chemically synthesized
gacctcgggggggatagacatg

SEQ ID NO: 63299 - DNA, 22 bp, Artificial Sequence
  chemically synthesized
acctcgggggggatagacatgg

SEQ ID NO: 63300 - DNA, 22 bp, Artificial Sequence
  chemically synthesized
gggggggatagacatgggtatg

SEQ ID NO: 63301 - DNA, 22 bp, Artificial Sequence
  chemically synthesized
taaaaacatggccccagcagct

SEQ ID NO: 63302 - DNA, 22 bp, Artificial Sequence
  chemically synthesized
aaaacatggccccagcagcttc

SEQ ID NO: 63303 - DNA, 22 bp, Artificial Sequence
  chemically synthesized
cagtccctttctcgtcgatggt

SEQ ID NO: 63304 - DNA, 22 bp, Artificial Sequence
  chemically synthesized
agtccctttctcgtcgatggtc

SEQ ID NO: 63305 - DNA, 22 bp, Artificial Sequence
  chemically synthesized
tctcgtcgatggtcagcacagc

SEQ ID NO: 63306 - DNA, 22 bp, Artificial Sequence
  chemically synthesized
ctcgtcgatggtcagcacagcc

SEQ ID NO: 63307 - DNA, 22 bp, Artificial Sequence
  chemically synthesized
tcgtcgatggtcagcacagcct

SEQ ID NO: 63308 - DNA, 22 bp, Artificial Sequence
  chemically synthesized
gtcgatggtcagcacagcctta

SEQ ID NO: 63309 - DNA, 22 bp, Artificial Sequence
  chemically synthesized
atgcacggcctggaggggagag

SEQ ID NO: 63310 - DNA, 22 bp, Artificial Sequence
  chemically synthesized
tgcacggcctggaggggagaga

SEQ ID NO: 63311 - DNA, 22 bp, Artificial Sequence
  chemically synthesized
gaggggagagaagcagagacac

SEQ ID NO: 63312 - DNA, 22 bp, Artificial Sequence
  chemically synthesized
taaggctgatcccaggcctcga

SEQ ID NO: 63313 - DNA, 22 bp, Artificial Sequence
  chemically synthesized
atcccaggcctcgagcaaggct

SEQ ID NO: 63314 - DNA, 22 bp, Artificial Sequence
  chemically synthesized
gagcaaggctcacgtggacacc

SEQ ID NO: 63315 - DNA, 22 bp, Artificial Sequence
  chemically synthesized
acgtggacacctcccaggaagc

SEQ ID NO: 63316 - DNA, 22 bp, Artificial Sequence
  chemically synthesized
ccaggaagcgctcactccccct

SEQ ID NO: 63317 - DNA, 22 bp, Artificial Sequence
  chemically synthesized
actccccctggacggccctggc

SEQ ID NO: 63318 - DNA, 22 bp, Artificial Sequence
  chemically synthesized
cccctggacggccctggccctg

SEQ ID NO: 63319 - DNA, 22 bp, Artificial Sequence
  chemically synthesized
gacggccctggccctgcacatc

SEQ ID NO: 63320 - DNA, 22 bp, Artificial Sequence
  chemically synthesized
gccctgcacatcctctccctcc

SEQ ID NO: 63321 - DNA, 22 bp, Artificial Sequence
  chemically synthesized
cacatcctctccctccctgtca

SEQ ID NO: 63322 - DNA, 22 bp, Artificial Sequence
  chemically synthesized
tccctccctgtcacataggcct

SEQ ID NO: 63323 - DNA, 22 bp, Artificial Sequence
  chemically synthesized
cctccctgtcacataggccttg

SEQ ID NO: 63324 - DNA, 22 bp, Artificial Sequence
  chemically synthesized
cctgtcacataggccttgctcc

SEQ ID NO: 63325 - DNA, 22 bp, Artificial Sequence
  chemically synthesized
tcacataggccttgctcctcct

SEQ ID NO: 63326 - DNA, 22 bp, Artificial Sequence
  chemically synthesized
gctcctcctcaaggctttggct

SEQ ID NO: 63327 - DNA, 22 bp, Artificial Sequence
  chemically synthesized
ctcctcctcaaggctttggctg

SEQ ID NO: 63328 - DNA, 22 bp, Artificial Sequence
  chemically synthesized
ctcctcaaggctttggctgatg

SEQ ID NO: 63329 - DNA, 22 bp, Artificial Sequence
  chemically synthesized
ctcaaggctttggctgatgggg

SEQ ID NO: 63330 - DNA, 22 bp, Artificial Sequence
  chemically synthesized
aaggctttggctgatggggctg

SEQ ID NO: 63331 - DNA, 22 bp, Artificial Sequence
  chemically synthesized
tggctgatggggctggctcccc

SEQ ID NO: 63332 - DNA, 22 bp, Artificial Sequence
  chemically synthesized
ggctgatggggctggctcccct

SEQ ID NO: 63333 - DNA, 22 bp, Artificial Sequence
  chemically synthesized
gctgatggggctggctcccctc

SEQ ID NO: 63334 - DNA, 22 bp, Artificial Sequence
  chemically synthesized
atggggctggctcccctctgtc

SEQ ID NO: 63335 - DNA, 22 bp, Artificial Sequence
  chemically synthesized
gctcccctctgtccatcttcct

SEQ ID NO: 63336 - DNA, 22 bp, Artificial Sequence
  chemically synthesized
ccctctgtccatcttcctgaca

SEQ ID NO: 63337 - DNA, 22 bp, Artificial Sequence
  chemically synthesized
tgtccatcttcctgacaagcgc

SEQ ID NO: 63338 - DNA, 22 bp, Artificial Sequence
  chemically synthesized
tccatcttcctgacaagcgcct

SEQ ID NO: 63339 - DNA, 22 bp, Artificial Sequence
  chemically synthesized
cctgacaagcgcctctccccct

SEQ ID NO: 63340 - DNA, 22 bp, Artificial Sequence
  chemically synthesized
ctgacaagcgcctctccccctg

SEQ ID NO: 63341 - DNA, 22 bp, Artificial Sequence
  chemically synthesized
acaagcgcctctccccctgctc

SEQ ID NO: 63342 - DNA, 22 bp, Artificial Sequence
  chemically synthesized
tccccctgctcaggtgcaccca

SEQ ID NO: 63343 - DNA, 22 bp, Artificial Sequence
  chemically synthesized
cccctgctcaggtgcacccaca

SEQ ID NO: 63344 - DNA, 22 bp, Artificial Sequence
  chemically synthesized
ctcaggtgcacccacaactcag

SEQ ID NO: 63345 - DNA, 22 bp, Artificial Sequence
  chemically synthesized
aggtgcacccacaactcagaac

SEQ ID NO: 63346 - DNA, 22 bp, Artificial Sequence
  chemically synthesized
agaacagggaagagcatcgtca

SEQ ID NO: 63347 - DNA, 22 bp, Artificial Sequence
  chemically synthesized
cacgtctgcctccagggctctc

SEQ ID NO: 63348 - DNA, 22 bp, Artificial Sequence
  chemically synthesized
cctccagggctctctcctttct

SEQ ID NO: 63349 - DNA, 22 bp, Artificial Sequence
  chemically synthesized
cagggctctctcctttctagta

SEQ ID NO: 63350 - DNA, 22 bp, Artificial Sequence
  chemically synthesized
tctcctttctagtacacggctt

SEQ ID NO: 63351 - DNA, 22 bp, Artificial Sequence
  chemically synthesized
tcctttctagtacacggcttga

SEQ ID NO: 63352 - DNA, 22 bp, Artificial Sequence
  chemically synthesized
ctttctagtacacggcttgaag

SEQ ID NO: 63353 - DNA, 22 bp, Artificial Sequence
  chemically synthesized
tctagtacacggcttgaagctc

SEQ ID NO: 63354 - DNA, 22 bp, Artificial Sequence
  chemically synthesized
ctagtacacggcttgaagctcc

SEQ ID NO: 63355 - DNA, 22 bp, Artificial Sequence
  chemically synthesized
tagtacacggcttgaagctcct

SEQ ID NO: 63356 - DNA, 22 bp, Artificial Sequence
  chemically synthesized
gtacacggcttgaagctccttg

SEQ ID NO: 63357 - DNA, 22 bp, Artificial Sequence
  chemically synthesized
gaagctccttgaggacacggac

SEQ ID NO: 63358 - DNA, 22 bp, Artificial Sequence
  chemically synthesized
aagctccttgaggacacggacc

SEQ ID NO: 63359 - DNA, 22 bp, Artificial Sequence
  chemically synthesized
cttgaggacacggaccctggca

SEQ ID NO: 63360 - DNA, 22 bp, Artificial Sequence
  chemically synthesized
gaggacacggaccctggcagtg

SEQ ID NO: 63361 - DNA, 22 bp, Artificial Sequence
  chemically synthesized
aggacacggaccctggcagtga

SEQ ID NO: 63362 - DNA, 22 bp, Artificial Sequence
  chemically synthesized
gcagtgaccttcacagtgccca

SEQ ID NO: 63363 - DNA, 22 bp, Artificial Sequence
  chemically synthesized
cacagtgcccagaccccaagat

SEQ ID NO: 63364 - DNA, 22 bp, Artificial Sequence
  chemically synthesized
acagtgcccagaccccaagata

SEQ ID NO: 63365 - DNA, 22 bp, Artificial Sequence
  chemically synthesized
atggaactgcagttgttcattg

SEQ ID NO: 63366 - DNA, 22 bp, Artificial Sequence
  chemically synthesized
cagttgttcattggtcgccttt

SEQ ID NO: 63367 - DNA, 22 bp, Artificial Sequence
  chemically synthesized
ttcattggtcgcctttagtttt

SEQ ID NO: 63368 - DNA, 22 bp, Artificial Sequence
  chemically synthesized
attggtcgcctttagttttcca

SEQ ID NO: 63369 - DNA, 22 bp, Artificial Sequence
  chemically synthesized
gtcgcctttagttttccaaaat

SEQ ID NO: 63370 - DNA, 22 bp, Artificial Sequence
  chemically synthesized
tagttttccaaaataagtgtca

SEQ ID NO: 63371 - DNA, 22 bp, Artificial Sequence
  chemically synthesized
agttttccaaaataagtgtcat

SEQ ID NO: 63372 - DNA, 22 bp, Artificial Sequence
  chemically synthesized
gttttccaaaataagtgtcatc

SEQ ID NO: 63373 - DNA, 22 bp, Artificial Sequence
  chemically synthesized
tccaaaataagtgtcatcttta

SEQ ID NO: 63374 - DNA, 22 bp, Artificial Sequence
  chemically synthesized
ccaaaataagtgtcatctttag

SEQ ID NO: 63375 - DNA, 22 bp, Artificial Sequence
  chemically synthesized
caaaataagtgtcatctttagc

SEQ ID NO: 63376 - DNA, 22 bp, Artificial Sequence
  chemically synthesized
tagctgaaatcattcattaatt

SEQ ID NO: 63377 - DNA, 22 bp, Artificial Sequence
  chemically synthesized
agctgaaatcattcattaattc

SEQ ID NO: 63378 - DNA, 22 bp, Artificial Sequence
  chemically synthesized
gctgaaatcattcattaattca

SEQ ID NO: 63379 - DNA, 22 bp, Artificial Sequence
  chemically synthesized
aaatcattcattaattcagaca

SEQ ID NO: 63380 - DNA, 22 bp, Artificial Sequence
  chemically synthesized
attaattcagacaccaaatctc

SEQ ID NO: 63381 - DNA, 22 bp, Artificial Sequence
  chemically synthesized
attcagacaccaaatctcacag

SEQ ID NO: 63382 - DNA, 22 bp, Artificial Sequence
  chemically synthesized
agacaccaaatctcacagatcg

SEQ ID NO: 63383 - DNA, 22 bp, Artificial Sequence
  chemically synthesized
acagatcgaaggagtcagaaat

SEQ ID NO: 63384 - DNA, 22 bp, Artificial Sequence
  chemically synthesized
ctttgaaacaacttagcccaaa

SEQ ID NO: 63385 - DNA, 22 bp, Artificial Sequence
  chemically synthesized
tgaaacaacttagcccaaacct

SEQ ID NO: 63386 - DNA, 22 bp, Artificial Sequence
  chemically synthesized
gaaacaacttagcccaaacctt

SEQ ID NO: 63387 - DNA, 22 bp, Artificial Sequence
  chemically synthesized
aaacaacttagcccaaaccttt

SEQ ID NO: 63388 - DNA, 22 bp, Artificial Sequence
  chemically synthesized
agcccaaacctttctgtgtcag

SEQ ID NO: 63389 - DNA, 22 bp, Artificial Sequence
  chemically synthesized
gcccaaacctttctgtgtcagt

SEQ ID NO: 63390 - DNA, 22 bp, Artificial Sequence
  chemically synthesized
tctgtgtcagtatggataaatc

SEQ ID NO: 63391 - DNA, 22 bp, Artificial Sequence
  chemically synthesized
ctgtgtcagtatggataaatca

SEQ ID NO: 63392 - DNA, 22 bp, Artificial Sequence
  chemically synthesized
tgtgtcagtatggataaatcaa

SEQ ID NO: 63393 - DNA, 22 bp, Artificial Sequence
  chemically synthesized
tgtcagtatggataaatcaagg

SEQ ID NO: 63394 - DNA, 22 bp, Artificial Sequence
  chemically synthesized
gaaggtcttgggcaaagttgaa

SEQ ID NO: 63395 - DNA, 22 bp, Artificial Sequence
  chemically synthesized
gggcaaagttgaaattcagggt

SEQ ID NO: 63396 - DNA, 22 bp, Artificial Sequence
  chemically synthesized
ggcaaagttgaaattcagggtc

SEQ ID NO: 63397 - DNA, 22 bp, Artificial Sequence
  chemically synthesized
aaattcagggtcagtgacacaa

SEQ ID NO: 63398 - DNA, 22 bp, Artificial Sequence
  chemically synthesized
agggtcagtgacacaacctcaa

SEQ ID NO: 63399 - DNA, 22 bp, Artificial Sequence
  chemically synthesized
aagggaggccccgaaagtgcca

SEQ ID NO: 63400 - DNA, 22 bp, Artificial Sequence
  chemically synthesized
cacagcagtcccctgcctggct

SEQ ID NO: 63401 - DNA, 22 bp, Artificial Sequence
  chemically synthesized
cctggctttgctgtttgaccac

SEQ ID NO: 63402 - DNA, 22 bp, Artificial Sequence
  chemically synthesized
gctttgctgtttgaccacgtcc

SEQ ID NO: 63403 - DNA, 22 bp, Artificial Sequence
  chemically synthesized
tgctgtttgaccacgtcccgtg

SEQ ID NO: 63404 - DNA, 22 bp, Artificial Sequence
  chemically synthesized
gctgtttgaccacgtcccgtgt

SEQ ID NO: 63405 - DNA, 22 bp, Artificial Sequence
  chemically synthesized
ctgtttgaccacgtcccgtgtc

SEQ ID NO: 63406 - DNA, 22 bp, Artificial Sequence
  chemically synthesized
tttgaccacgtcccgtgtcagt

SEQ ID NO: 63407 - DNA, 22 bp, Artificial Sequence
  chemically synthesized
gaccacgtcccgtgtcagtgaa

SEQ ID NO: 63408 - DNA, 22 bp, Artificial Sequence
  chemically synthesized
accacgtcccgtgtcagtgaat

SEQ ID NO: 63409 - DNA, 22 bp, Artificial Sequence
  chemically synthesized
caggagctcagcctgggtcttc

SEQ ID NO: 63410 - DNA, 22 bp, Artificial Sequence
  chemically synthesized
aggagctcagcctgggtcttca

SEQ ID NO: 63411 - DNA, 22 bp, Artificial Sequence
  chemically synthesized
agcctgggtcttcatttgtttc

SEQ ID NO: 63412 - DNA, 22 bp, Artificial Sequence
  chemically synthesized
ggtcttcatttgtttccctcgg

SEQ ID NO: 63413 - DNA, 22 bp, Artificial Sequence
  chemically synthesized
catttgtttccctcggcccctt

SEQ ID NO: 63414 - DNA, 22 bp, Artificial Sequence
  chemically synthesized
atttgtttccctcggccccttc

SEQ ID NO: 63415 - DNA, 22 bp, Artificial Sequence
  chemically synthesized
gtttccctcggccccttcctca

SEQ ID NO: 63416 - DNA, 22 bp, Artificial Sequence
  chemically synthesized
tttccctcggccccttcctcag

SEQ ID NO: 63417 - DNA, 22 bp, Artificial Sequence
  chemically synthesized
ccctcggccccttcctcagcct

SEQ ID NO: 63418 - DNA, 22 bp, Artificial Sequence
  chemically synthesized
cctcggccccttcctcagcctc

SEQ ID NO: 63419 - DNA, 22 bp, Artificial Sequence
  chemically synthesized
ggccccttcctcagcctcagga

SEQ ID NO: 63420 - DNA, 22 bp, Artificial Sequence
  chemically synthesized
cctcagcctcaggacagagctg

SEQ ID NO: 63421 - DNA, 22 bp, Artificial Sequence
  chemically synthesized
ctcagcctcaggacagagctgc

SEQ ID NO: 63422 - DNA, 22 bp, Artificial Sequence
  chemically synthesized
agcctcaggacagagctgcagc

SEQ ID NO: 63423 - DNA, 22 bp, Artificial Sequence
  chemically synthesized
aggacagagctgcagcccccac

SEQ ID NO: 63424 - DNA, 22 bp, Artificial Sequence
  chemically synthesized
cagcccccacacattcttccct

SEQ ID NO: 63425 - DNA, 22 bp, Artificial Sequence
  chemically synthesized
ttccctacagataccagggtgc

SEQ ID NO: 63426 - DNA, 22 bp, Artificial Sequence
  chemically synthesized
ccctacagataccagggtgcaa

SEQ ID NO: 63427 - DNA, 22 bp, Artificial Sequence
  chemically synthesized
cctacagataccagggtgcaac

SEQ ID NO: 63428 - DNA, 22 bp, Artificial Sequence
  chemically synthesized
cagataccagggtgcaacaagg

SEQ ID NO: 63429 - DNA, 22 bp, Artificial Sequence
  chemically synthesized
accttggagagcttcaggggtg

SEQ ID NO: 63430 - DNA, 22 bp, Artificial Sequence
  chemically synthesized
ggagagcttcaggggtgcctcc

SEQ ID NO: 63431 - DNA, 22 bp, Artificial Sequence
  chemically synthesized
gagagcttcaggggtgcctcct

SEQ ID NO: 63432 - DNA, 22 bp, Artificial Sequence
  chemically synthesized
caggggtgcctcctctgtgacc

SEQ ID NO: 63433 - DNA, 22 bp, Artificial Sequence
  chemically synthesized
aggggtgcctcctctgtgaccc

SEQ ID NO: 63434 - DNA, 22 bp, Artificial Sequence
  chemically synthesized
ctctgtgaccccggagaggtca

SEQ ID NO: 63435 - DNA, 22 bp, Artificial Sequence
  chemically synthesized
tgtgaccccggagaggtcagcc

SEQ ID NO: 63436 - DNA, 22 bp, Artificial Sequence
  chemically synthesized
tgaccccggagaggtcagcccc

SEQ ID NO: 63437 - DNA, 22 bp, Artificial Sequence
  chemically synthesized
ctgaagaccttagtgatgccca

SEQ ID NO: 63438 - DNA, 22 bp, Artificial Sequence
  chemically synthesized
aagaccttagtgatgcccagtt

SEQ ID NO: 63439 - DNA, 22 bp, Artificial Sequence
  chemically synthesized
agtgatgcccagttgacccagg

SEQ ID NO: 63440 - DNA, 22 bp, Artificial Sequence
  chemically synthesized
gtgatgcccagttgacccagga

SEQ ID NO: 63441 - DNA, 22 bp, Artificial Sequence
  chemically synthesized
acccaggacgctcttcagatca

SEQ ID NO: 63442 - DNA, 22 bp, Artificial Sequence
  chemically synthesized
ttcagatcataggttccagtaa

SEQ ID NO: 63443 - DNA, 22 bp, Artificial Sequence
  chemically synthesized
cagatcataggttccagtaatg

SEQ ID NO: 63444 - DNA, 22 bp, Artificial Sequence
  chemically synthesized
agatcataggttccagtaatgg

SEQ ID NO: 63445 - DNA, 22 bp, Artificial Sequence
  chemically synthesized
cagtaatggacagtttgggtaa

SEQ ID NO: 63446 - DNA, 22 bp, Artificial Sequence
  chemically synthesized
gggtaaatgtaagctggcagac

SEQ ID NO: 63447 - DNA, 22 bp, Artificial Sequence
  chemically synthesized
ggtaaatgtaagctggcagacc

SEQ ID NO: 63448 - DNA, 22 bp, Artificial Sequence
  chemically synthesized
gcagacctgtcgtgcagaaaag

SEQ ID NO: 63449 - DNA, 22 bp, Artificial Sequence
  chemically synthesized
tcgtgcagaaaagaaattcaag

SEQ ID NO: 63450 - DNA, 22 bp, Artificial Sequence
  chemically synthesized
aaggcatggcacagcattcctc

SEQ ID NO: 63451 - DNA, 22 bp, Artificial Sequence
  chemically synthesized
ctcttgttcttctgggacccac

SEQ ID NO: 63452 - DNA, 22 bp, Artificial Sequence
  chemically synthesized
ttgttcttctgggacccaccac

SEQ ID NO: 63453 - DNA, 22 bp, Artificial Sequence
  chemically synthesized
gttcttctgggacccaccacag

SEQ ID NO: 63454 - DNA, 22 bp, Artificial Sequence
  chemically synthesized
ttcttctgggacccaccacagt

SEQ ID NO: 63455 - DNA, 22 bp, Artificial Sequence
  chemically synthesized
ttctgggacccaccacagtgca

SEQ ID NO: 63456 - DNA, 22 bp, Artificial Sequence
  chemically synthesized
ctgggacccaccacagtgcaag

SEQ ID NO: 63457 - DNA, 22 bp, Artificial Sequence
  chemically synthesized
tgggacccaccacagtgcaagt

SEQ ID NO: 63458 - DNA, 22 bp, Artificial Sequence
  chemically synthesized
ggacccaccacagtgcaagtgt

SEQ ID NO: 63459 - DNA, 22 bp, Artificial Sequence
  chemically synthesized
tcttttctgattatttctgcca

SEQ ID NO: 63460 - DNA, 22 bp, Artificial Sequence
  chemically synthesized
cttttctgattatttctgccac

SEQ ID NO: 63461 - DNA, 22 bp, Artificial Sequence
  chemically synthesized
ttttctgattatttctgccact

SEQ ID NO: 63462 - DNA, 22 bp, Artificial Sequence
  chemically synthesized
ttctgattatttctgccactta

SEQ ID NO: 63463 - DNA, 22 bp, Artificial Sequence
  chemically synthesized
tctgattatttctgccacttac

SEQ ID NO: 63464 - DNA, 22 bp, Artificial Sequence
  chemically synthesized
ctgattatttctgccacttact

SEQ ID NO: 63465 - DNA, 22 bp, Artificial Sequence
  chemically synthesized
tgattatttctgccacttactc

SEQ ID NO: 63466 - DNA, 22 bp, Artificial Sequence
  chemically synthesized
attatttctgccacttactcct

SEQ ID NO: 63467 - DNA, 22 bp, Artificial Sequence
  chemically synthesized
tttctgccacttactcctgtgt

SEQ ID NO: 63468 - DNA, 22 bp, Artificial Sequence
  chemically synthesized
ctgccacttactcctgtgtcct

SEQ ID NO: 63469 - DNA, 22 bp, Artificial Sequence
  chemically synthesized
tgccacttactcctgtgtcctc

SEQ ID NO: 63470 - DNA, 22 bp, Artificial Sequence
  chemically synthesized
ccacttactcctgtgtcctcca

SEQ ID NO: 63471 - DNA, 22 bp, Artificial Sequence
  chemically synthesized
actcctgtgtcctccacccaca

SEQ ID NO: 63472 - DNA, 22 bp, Artificial Sequence
  chemically synthesized
ctcctgtgtcctccacccacac

SEQ ID NO: 63473 - DNA, 22 bp, Artificial Sequence
  chemically synthesized
ctgtgtcctccacccacactaa

SEQ ID NO: 63474 - DNA, 22 bp, Artificial Sequence
  chemically synthesized
tgtcctccacccacactaagat

SEQ ID NO: 63475 - DNA, 22 bp, Artificial Sequence
  chemically synthesized
cacccacactaagatgggaact

SEQ ID NO: 63476 - DNA, 22 bp, Artificial Sequence
  chemically synthesized
agatgggaactcggctttggtt

SEQ ID NO: 63477 - DNA, 22 bp, Artificial Sequence
  chemically synthesized
ggctttggtttgttctactttt

SEQ ID NO: 63478 - DNA, 22 bp, Artificial Sequence
  chemically synthesized
tggtttgttctacttttagctc

SEQ ID NO: 63479 - DNA, 22 bp, Artificial Sequence
  chemically synthesized
ggtttgttctacttttagctct

SEQ ID NO: 63480 - DNA, 22 bp, Artificial Sequence
  chemically synthesized
gtttgttctacttttagctctt

SEQ ID NO: 63481 - DNA, 22 bp, Artificial Sequence
  chemically synthesized
gttctacttttagctcttctac

SEQ ID NO: 63482 - DNA, 22 bp, Artificial Sequence
  chemically synthesized
ttctacttttagctcttctaca

SEQ ID NO: 63483 - DNA, 22 bp, Artificial Sequence
  chemically synthesized
tacttttagctcttctacattg

SEQ ID NO: 63484 - DNA, 22 bp, Artificial Sequence
  chemically synthesized
cttttagctcttctacattgag

SEQ ID NO: 63485 - DNA, 22 bp, Artificial Sequence
  chemically synthesized
ttagctcttctacattgagtca

SEQ ID NO: 63486 - DNA, 22 bp, Artificial Sequence
  chemically synthesized
tagctcttctacattgagtcaa

SEQ ID NO: 63487 - DNA, 22 bp, Artificial Sequence
  chemically synthesized
agctcttctacattgagtcaaa

SEQ ID NO: 63488 - DNA, 22 bp, Artificial Sequence
  chemically synthesized
gctcttctacattgagtcaaag

SEQ ID NO: 63489 - DNA, 22 bp, Artificial Sequence
  chemically synthesized
ttctacattgagtcaaagaatg

SEQ ID NO: 63490 - DNA, 22 bp, Artificial Sequence
  chemically synthesized
ctacattgagtcaaagaatgtt

SEQ ID NO: 63491 - DNA, 22 bp, Artificial Sequence
  chemically synthesized
tacattgagtcaaagaatgtta

SEQ ID NO: 63492 - DNA, 22 bp, Artificial Sequence
  chemically synthesized
cattgagtcaaagaatgttaac

SEQ ID NO: 63493 - DNA, 22 bp, Artificial Sequence
  chemically synthesized
agtcaaagaatgttaacatcga

SEQ ID NO: 63494 - DNA, 22 bp, Artificial Sequence
  chemically synthesized
acatcgaatgaatcacaaaagc

SEQ ID NO: 63495 - DNA, 22 bp, Artificial Sequence
  chemically synthesized
gaaatgccacctcctctgatat

SEQ ID NO: 63496 - DNA, 22 bp, Artificial Sequence
  chemically synthesized
aaatgccacctcctctgatatt

SEQ ID NO: 63497 - DNA, 22 bp, Artificial Sequence
  chemically synthesized
ctctgatattctaggtgtcctg

SEQ ID NO: 63498 - DNA, 22 bp, Artificial Sequence
  chemically synthesized
tgatattctaggtgtcctggaa

SEQ ID NO: 63499 - DNA, 22 bp, Artificial Sequence
  chemically synthesized
atattctaggtgtcctggaagc

SEQ ID NO: 63500 - DNA, 22 bp, Artificial Sequence
  chemically synthesized
taggtgtcctggaagcctgtct

SEQ ID NO: 63501 - DNA, 22 bp, Artificial Sequence
  chemically synthesized
ggtgtcctggaagcctgtctca

SEQ ID NO: 63502 - DNA, 22 bp, Artificial Sequence
  chemically synthesized
gaagcctgtctcatcttgccct

SEQ ID NO: 63503 - DNA, 22 bp, Artificial Sequence
  chemically synthesized
tctcatcttgccctgtagtgtt

SEQ ID NO: 63504 - DNA, 22 bp, Artificial Sequence
  chemically synthesized
atcttgccctgtagtgttgggt

SEQ ID NO: 63505 - DNA, 22 bp, Artificial Sequence
  chemically synthesized
gccctgtagtgttgggtcacct

SEQ ID NO: 63506 - DNA, 22 bp, Artificial Sequence
  chemically synthesized
ccctgtagtgttgggtcacctg

SEQ ID NO: 63507 - DNA, 22 bp, Artificial Sequence
  chemically synthesized
tagtgttgggtcacctggcccc

SEQ ID NO: 63508 - DNA, 22 bp, Artificial Sequence
  chemically synthesized
ggtcacctggcccccagcctgt

SEQ ID NO: 63509 - DNA, 22 bp, Artificial Sequence
  chemically synthesized
gcccccagcctgtaacatcccc

SEQ ID NO: 63510 - DNA, 22 bp, Artificial Sequence
  chemically synthesized
taacatccccagggccctacac

SEQ ID NO: 63511 - DNA, 22 bp, Artificial Sequence
  chemically synthesized
cacccagagaaacacggggctg

SEQ ID NO: 63512 - DNA, 22 bp, Artificial Sequence
  chemically synthesized
gtggcagtgcccagtgacaacc

SEQ ID NO: 63513 - DNA, 22 bp, Artificial Sequence
  chemically synthesized
agtggataagagaagagtgacc

SEQ ID NO: 63514 - DNA, 22 bp, Artificial Sequence
  chemically synthesized
gtggataagagaagagtgacca

SEQ ID NO: 63515 - DNA, 22 bp, Artificial Sequence
  chemically synthesized
agtgctcctctctggttttcca

SEQ ID NO: 63516 - DNA, 22 bp, Artificial Sequence
  chemically synthesized
ctctctggttttccatggggag

SEQ ID NO: 63517 - DNA, 22 bp, Artificial Sequence
  chemically synthesized
tctggttttccatggggagaca

SEQ ID NO: 63518 - DNA, 22 bp, Artificial Sequence
  chemically synthesized
tggttttccatggggagacaat

SEQ ID NO: 63519 - DNA, 22 bp, Artificial Sequence
  chemically synthesized
gttttccatggggagacaatgc

SEQ ID NO: 63520 - DNA, 22 bp, Artificial Sequence
  chemically synthesized
tccatggggagacaatgccacc

SEQ ID NO: 63521 - DNA, 22 bp, Artificial Sequence
  chemically synthesized
ccatggggagacaatgccaccc

SEQ ID NO: 63522 - DNA, 22 bp, Artificial Sequence
  chemically synthesized
catggggagacaatgccaccct

SEQ ID NO: 63523 - DNA, 22 bp, Artificial Sequence
  chemically synthesized
agcagggtctggtgtgagcggg

SEQ ID NO: 63524 - DNA, 22 bp, Artificial Sequence
  chemically synthesized
gtgtgagcgggcagcttggctc

SEQ ID NO: 63525 - DNA, 22 bp, Artificial Sequence
  chemically synthesized
ggctctgggctctctgatccgt

SEQ ID NO: 63526 - DNA, 22 bp, Artificial Sequence
  chemically synthesized
gctctgggctctctgatccgtt

SEQ ID NO: 63527 - DNA, 22 bp, Artificial Sequence
  chemically synthesized
tgggctctctgatccgttaccc

SEQ ID NO: 63528 - DNA, 22 bp, Artificial Sequence
  chemically synthesized
ggctctctgatccgttaccctc

SEQ ID NO: 63529 - DNA, 22 bp, Artificial Sequence
  chemically synthesized
tctgatccgttaccctctcagc

SEQ ID NO: 63530 - DNA, 22 bp, Artificial Sequence
  chemically synthesized
tgatccgttaccctctcagcct

SEQ ID NO: 63531 - DNA, 22 bp, Artificial Sequence
  chemically synthesized
atccgttaccctctcagcctct

SEQ ID NO: 63532 - DNA, 22 bp, Artificial Sequence
  chemically synthesized
ccctctcagcctctttgttctt

SEQ ID NO: 63533 - DNA, 22 bp, Artificial Sequence
  chemically synthesized
tcagcctctttgttctttctca

SEQ ID NO: 63534 - DNA, 22 bp, Artificial Sequence
  chemically synthesized
agcctctttgttctttctcaac

SEQ ID NO: 63535 - DNA, 22 bp, Artificial Sequence
  chemically synthesized
tttgttctttctcaacccctgg

SEQ ID NO: 63536 - DNA, 22 bp, Artificial Sequence
  chemically synthesized
tgttctttctcaacccctggag

SEQ ID NO: 63537 - DNA, 22 bp, Artificial Sequence
  chemically synthesized
gttctttctcaacccctggagc

SEQ ID NO: 63538 - DNA, 22 bp, Artificial Sequence
  chemically synthesized
ttctttctcaacccctggagca

SEQ ID NO: 63539 - DNA, 22 bp, Artificial Sequence
  chemically synthesized
tttctcaacccctggagcagag

SEQ ID NO: 63540 - DNA, 22 bp, Artificial Sequence
  chemically synthesized
tctcaacccctggagcagagac

SEQ ID NO: 63541 - DNA, 22 bp, Artificial Sequence
  chemically synthesized
ctcaacccctggagcagagacc

SEQ ID NO: 63542 - DNA, 22 bp, Artificial Sequence
  chemically synthesized
tcaacccctggagcagagacct

SEQ ID NO: 63543 - DNA, 22 bp, Artificial Sequence
  chemically synthesized
aacccctggagcagagacctca

SEQ ID NO: 63544 - DNA, 22 bp, Artificial Sequence
  chemically synthesized
gagcagagacctcaggaggtgc

SEQ ID NO: 63545 - DNA, 22 bp, Artificial Sequence
  chemically synthesized
aggaggtgctggcatggaacag

SEQ ID NO: 63546 - DNA, 22 bp, Artificial Sequence
  chemically synthesized
gcatggaacagagaaattccag

SEQ ID NO: 63547 - DNA, 22 bp, Artificial Sequence
  chemically synthesized
cagcctcgattcctattatgaa

SEQ ID NO: 63548 - DNA, 22 bp, Artificial Sequence
  chemically synthesized
gattcctattatgaacccgaca

SEQ ID NO: 63549 - DNA, 22 bp, Artificial Sequence
  chemically synthesized
ctattatgaacccgacaccttt

SEQ ID NO: 63550 - DNA, 22 bp, Artificial Sequence
  chemically synthesized
ttatgaacccgacaccttttgt

SEQ ID NO: 63551 - DNA, 22 bp, Artificial Sequence
  chemically synthesized
tgaacccgacaccttttgtatt

SEQ ID NO: 63552 - DNA, 22 bp, Artificial Sequence
  chemically synthesized
ttgtattttcatcttggtttta

SEQ ID NO: 63553 - DNA, 22 bp, Artificial Sequence
  chemically synthesized
tgtattttcatcttggttttac

SEQ ID NO: 63554 - DNA, 22 bp, Artificial Sequence
  chemically synthesized
gtattttcatcttggttttaca

SEQ ID NO: 63555 - DNA, 22 bp, Artificial Sequence
  chemically synthesized
tattttcatcttggttttacag

SEQ ID NO: 63556 - DNA, 22 bp, Artificial Sequence
  chemically synthesized
tcatcttggttttacagtgtac

SEQ ID NO: 63557 - DNA, 22 bp, Artificial Sequence
  chemically synthesized
catcttggttttacagtgtaca

SEQ ID NO: 63558 - DNA, 22 bp, Artificial Sequence
  chemically synthesized
atcttggttttacagtgtacaa

SEQ ID NO: 63559 - DNA, 22 bp, Artificial Sequence
  chemically synthesized
ggttttacagtgtacaaaacga

SEQ ID NO: 63560 - DNA, 22 bp, Artificial Sequence
  chemically synthesized
gttttacagtgtacaaaacgaa

SEQ ID NO: 63561 - DNA, 22 bp, Artificial Sequence
  chemically synthesized
tacagtgtacaaaacgaactag

SEQ ID NO: 63562 - DNA, 22 bp, Artificial Sequence
  chemically synthesized
acagtgtacaaaacgaactaga

SEQ ID NO: 63563 - DNA, 22 bp, Artificial Sequence
  chemically synthesized
cagtgtacaaaacgaactagat

SEQ ID NO: 63564 - DNA, 22 bp, Artificial Sequence
  chemically synthesized
gatcagcagggcatgggcataa

SEQ ID NO: 63565 - DNA, 22 bp, Artificial Sequence
  chemically synthesized
atgtgtggctcatgtttaagta

SEQ ID NO: 63566 - DNA, 22 bp, Artificial Sequence
  chemically synthesized
atgtttaagtatcacttactac

SEQ ID NO: 63567 - DNA, 22 bp, Artificial Sequence
  chemically synthesized
aagtatcacttactacaggaca

SEQ ID NO: 63568 - DNA, 22 bp, Artificial Sequence
  chemically synthesized
agtatcacttactacaggacac

SEQ ID NO: 63569 - DNA, 22 bp, Artificial Sequence
  chemically synthesized
actacaggacacccaatctaac

SEQ ID NO: 63570 - DNA, 22 bp, Artificial Sequence
  chemically synthesized
ctacaggacacccaatctaaca

SEQ ID NO: 63571 - DNA, 22 bp, Artificial Sequence
  chemically synthesized
caggacacccaatctaacagca

SEQ ID NO: 63572 - DNA, 22 bp, Artificial Sequence
  chemically synthesized
acagcaccgataaagtgacaga

SEQ ID NO: 63573 - DNA, 22 bp, Artificial Sequence
  chemically synthesized
ctgcgaacatggcctggctgtt

SEQ ID NO: 63574 - DNA, 22 bp, Artificial Sequence
  chemically synthesized
tgcgaacatggcctggctgttc

SEQ ID NO: 63575 - DNA, 22 bp, Artificial Sequence
  chemically synthesized
cgaacatggcctggctgttcca

SEQ ID NO: 63576 - DNA, 22 bp, Artificial Sequence
  chemically synthesized
gctgttccaattccgaaccttg

SEQ ID NO: 63577 - DNA, 22 bp, Artificial Sequence
  chemically synthesized
ttccaattccgaaccttgcttt

SEQ ID NO: 63578 - DNA, 22 bp, Artificial Sequence
  chemically synthesized
caattccgaaccttgcttttct

SEQ ID NO: 63579 - DNA, 22 bp, Artificial Sequence
  chemically synthesized
cgaaccttgcttttctgggcct

SEQ ID NO: 63580 - DNA, 22 bp, Artificial Sequence
  chemically synthesized
gcttttctgggccttgccacac

SEQ ID NO: 63581 - DNA, 22 bp, Artificial Sequence
  chemically synthesized
cttttctgggccttgccacaca

SEQ ID NO: 63582 - DNA, 22 bp, Artificial Sequence
  chemically synthesized
ttctgggccttgccacacaggc

SEQ ID NO: 63583 - DNA, 22 bp, Artificial Sequence
  chemically synthesized
tctgggccttgccacacaggct

SEQ ID NO: 63584 - DNA, 22 bp, Artificial Sequence
  chemically synthesized
ctgggccttgccacacaggctc

SEQ ID NO: 63585 - DNA, 22 bp, Artificial Sequence
  chemically synthesized
tgggccttgccacacaggctct

SEQ ID NO: 63586 - DNA, 22 bp, Artificial Sequence
  chemically synthesized
ggccttgccacacaggctcttc

SEQ ID NO: 63587 - DNA, 22 bp, Artificial Sequence
  chemically synthesized
gccacacaggctcttcccccgt

SEQ ID NO: 63588 - DNA, 22 bp, Artificial Sequence
  chemically synthesized
ccacacaggctcttcccccgtc

SEQ ID NO: 63589 - DNA, 22 bp, Artificial Sequence
  chemically synthesized
ttcccccgtccccccagggaca

SEQ ID NO: 63590 - DNA, 22 bp, Artificial Sequence
  chemically synthesized
cccccgtccccccagggacatt

SEQ ID NO: 63591 - DNA, 22 bp, Artificial Sequence
  chemically synthesized
ccccgtccccccagggacattc

SEQ ID NO: 63592 - DNA, 22 bp, Artificial Sequence
  chemically synthesized
tacccttgaactccacactcca

SEQ ID NO: 63593 - DNA, 22 bp, Artificial Sequence
  chemically synthesized
cccttgaactccacactccact

SEQ ID NO: 63594 - DNA, 22 bp, Artificial Sequence
  chemically synthesized
gaactccacactccactgctgc

SEQ ID NO: 63595 - DNA, 22 bp, Artificial Sequence
  chemically synthesized
aactccacactccactgctgcc

SEQ ID NO: 63596 - DNA, 22 bp, Artificial Sequence
  chemically synthesized
cacactccactgctgcctttgc

SEQ ID NO: 63597 - DNA, 22 bp, Artificial Sequence
  chemically synthesized
cactgctgcctttgccaggaag

SEQ ID NO: 63598 - DNA, 22 bp, Artificial Sequence
  chemically synthesized
ctgcctttgccaggaagcccat

SEQ ID NO: 63599 - DNA, 22 bp, Artificial Sequence
  chemically synthesized
cctttgccaggaagcccatctg

SEQ ID NO: 63600 - DNA, 22 bp, Artificial Sequence
  chemically synthesized
tgccaggaagcccatctgttcc

SEQ ID NO: 63601 - DNA, 22 bp, Artificial Sequence
  chemically synthesized
gccaggaagcccatctgttcct

SEQ ID NO: 63602 - DNA, 22 bp, Artificial Sequence
  chemically synthesized
ccaggaagcccatctgttcctt

SEQ ID NO: 63603 - DNA, 22 bp, Artificial Sequence
  chemically synthesized
ttcctttttggttctgccagaa

SEQ ID NO: 63604 - DNA, 22 bp, Artificial Sequence
  chemically synthesized
ctttttggttctgccagaacgt

SEQ ID NO: 63605 - DNA, 22 bp, Artificial Sequence
  chemically synthesized
tttggttctgccagaacgtgtg

SEQ ID NO: 63606 - DNA, 22 bp, Artificial Sequence
  chemically synthesized
ttggttctgccagaacgtgtgg

SEQ ID NO: 63607 - DNA, 22 bp, Artificial Sequence
  chemically synthesized
tggttctgccagaacgtgtggt

SEQ ID NO: 63608 - DNA, 22 bp, Artificial Sequence
  chemically synthesized
ggttctgccagaacgtgtggtg

SEQ ID NO: 63609 - DNA, 22 bp, Artificial Sequence
  chemically synthesized
gttctgccagaacgtgtggtgg

SEQ ID NO: 63610 - DNA, 22 bp, Artificial Sequence
  chemically synthesized
tgccagaacgtgtggtggtgct

SEQ ID NO: 63611 - DNA, 22 bp, Artificial Sequence
  chemically synthesized
ccagaacgtgtggtggtgctgc

SEQ ID NO: 63612 - DNA, 22 bp, Artificial Sequence
  chemically synthesized
ctgtccctgccctgggcactgg

SEQ ID NO: 63613 - DNA, 22 bp, Artificial Sequence
  chemically synthesized
tccctgccctgggcactggata

SEQ ID NO: 63614 - DNA, 22 bp, Artificial Sequence
  chemically synthesized
ccctgggcactggatattggga

SEQ ID NO: 63615 - DNA, 22 bp, Artificial Sequence
  chemically synthesized
ggcactggatattgggaaggga

SEQ ID NO: 63616 - DNA, 22 bp, Artificial Sequence
  chemically synthesized
gatattgggaagggacagtgtc

SEQ ID NO: 63617 - DNA, 22 bp, Artificial Sequence
  chemically synthesized
ggaagggacagtgtccacactg

SEQ ID NO: 63618 - DNA, 22 bp, Artificial Sequence
  chemically synthesized
gagtgggaagtccccagggacg

SEQ ID NO: 63619 - DNA, 22 bp, Artificial Sequence
  chemically synthesized
tacctcctcacccctgggtact

SEQ ID NO: 63620 - DNA, 22 bp, Artificial Sequence
  chemically synthesized
acctcctcacccctgggtactg

SEQ ID NO: 63621 - DNA, 22 bp, Artificial Sequence
  chemically synthesized
cctcctcacccctgggtactgt

SEQ ID NO: 63622 - DNA, 22 bp, Artificial Sequence
  chemically synthesized
ctcacccctgggtactgtcctc

SEQ ID NO: 63623 - DNA, 22 bp, Artificial Sequence
  chemically synthesized
acccctgggtactgtcctcctc

SEQ ID NO: 63624 - DNA, 22 bp, Artificial Sequence
  chemically synthesized
ggtactgtcctcctcatggagc

SEQ ID NO: 63625 - DNA, 22 bp, Artificial Sequence
  chemically synthesized
tcctcctcatggagcatggatg

SEQ ID NO: 63626 - DNA, 22 bp, Artificial Sequence
  chemically synthesized
ctcatggagcatggatggcgct

SEQ ID NO: 63627 - DNA, 22 bp, Artificial Sequence
  chemically synthesized
atggagcatggatggcgctgcc

SEQ ID NO: 63628 - DNA, 22 bp, Artificial Sequence
  chemically synthesized
cctgaactcagtggtggcctca

SEQ ID NO: 63629 - DNA, 22 bp, Artificial Sequence
  chemically synthesized
aactcagtggtggcctcattct

SEQ ID NO: 63630 - DNA, 22 bp, Artificial Sequence
  chemically synthesized
agtggtggcctcattctggaag

SEQ ID NO: 63631 - DNA, 22 bp, Artificial Sequence
  chemically synthesized
attctggaagccaagtttatac

SEQ ID NO: 63632 - DNA, 22 bp, Artificial Sequence
  chemically synthesized
tggaagccaagtttatacagag

SEQ ID NO: 63633 - DNA, 22 bp, Artificial Sequence
  chemically synthesized
gaagccaagtttatacagagta

SEQ ID NO: 63634 - DNA, 22 bp, Artificial Sequence
  chemically synthesized
atacagagtagcagtgacccag

SEQ ID NO: 63635 - DNA, 22 bp, Artificial Sequence
  chemically synthesized
tacagagtagcagtgacccagg

SEQ ID NO: 63636 - DNA, 22 bp, Artificial Sequence
  chemically synthesized
accctcctcagccctctggcca

SEQ ID NO: 63637 - DNA, 22 bp, Artificial Sequence
  chemically synthesized
ctcagccctctggccagtcctg

SEQ ID NO: 63638 - DNA, 22 bp, Artificial Sequence
  chemically synthesized
agccctctggccagtcctgatg

SEQ ID NO: 63639 - DNA, 22 bp, Artificial Sequence
  chemically synthesized
tggccagtcctgatgggcctca

SEQ ID NO: 63640 - DNA, 22 bp, Artificial Sequence
  chemically synthesized
gccagtcctgatgggcctcagt

SEQ ID NO: 63641 - DNA, 22 bp, Artificial Sequence
  chemically synthesized
atgggcctcagtcccaacatgg

SEQ ID NO: 63642 - DNA, 22 bp, Artificial Sequence
  chemically synthesized
agtcccaacatggctaagaggt

SEQ ID NO: 63643 - DNA, 22 bp, Artificial Sequence
  chemically synthesized
agaggtgtgggcagcttcttgg

SEQ ID NO: 63644 - DNA, 22 bp, Artificial Sequence
  chemically synthesized
cttggtcaccctcaggttgggg

SEQ ID NO: 63645 - DNA, 22 bp, Artificial Sequence
  chemically synthesized
ttggtcaccctcaggttgggga

SEQ ID NO: 63646 - DNA, 22 bp, Artificial Sequence
  chemically synthesized
ggtcaccctcaggttggggaat

SEQ ID NO: 63647 - DNA, 22 bp, Artificial Sequence
  chemically synthesized
gtcaccctcaggttggggaatc

SEQ ID NO: 63648 - DNA, 22 bp, Artificial Sequence
  chemically synthesized
aggttggggaatcaccttctgt

SEQ ID NO: 63649 - DNA, 22 bp, Artificial Sequence
  chemically synthesized
gggaatcaccttctgtcttcat

SEQ ID NO: 63650 - DNA, 22 bp, Artificial Sequence
  chemically synthesized
ctgtcttcattttccaggaact

SEQ ID NO: 63651 - DNA, 22 bp, Artificial Sequence
  chemically synthesized
tgtcttcattttccaggaactt

SEQ ID NO: 63652 - DNA, 22 bp, Artificial Sequence
  chemically synthesized
tcttcattttccaggaacttgg

SEQ ID NO: 63653 - DNA, 22 bp, Artificial Sequence
  chemically synthesized
cattttccaggaacttggtgat

SEQ ID NO: 63654 - DNA, 22 bp, Artificial Sequence
  chemically synthesized
attttccaggaacttggtgatg

SEQ ID NO: 63655 - DNA, 22 bp, Artificial Sequence
  chemically synthesized
tccaggaacttggtgatgatat

SEQ ID NO: 63656 - DNA, 22 bp, Artificial Sequence
  chemically synthesized
ccaggaacttggtgatgatatc

SEQ ID NO: 63657 - DNA, 22 bp, Artificial Sequence
  chemically synthesized
caggaacttggtgatgatatcg

SEQ ID NO: 63658 - DNA, 22 bp, Artificial Sequence
  chemically synthesized
ggtgatgatatcgtgggtgagt

SEQ ID NO: 63659 - DNA, 22 bp, Artificial Sequence
  chemically synthesized
gtgatgatatcgtgggtgagtt

SEQ ID NO: 63660 - DNA, 22 bp, Artificial Sequence
  chemically synthesized
attttccaggtgctgtagtttc

SEQ ID NO: 63661 - DNA, 22 bp, Artificial Sequence
  chemically synthesized
tccaggtgctgtagtttcccct

SEQ ID NO: 63662 - DNA, 22 bp, Artificial Sequence
  chemically synthesized
ccaggtgctgtagtttcccctc

SEQ ID NO: 63663 - DNA, 22 bp, Artificial Sequence
  chemically synthesized
caggtgctgtagtttcccctca

SEQ ID NO: 63664 - DNA, 22 bp, Artificial Sequence
  chemically synthesized
tagtttcccctcatcaggcagg

SEQ ID NO: 63665 - DNA, 22 bp, Artificial Sequence
  chemically synthesized
cccctcatcaggcaggaagaag

SEQ ID NO: 63666 - DNA, 22 bp, Artificial Sequence
  chemically synthesized
ccctcatcaggcaggaagaaga

SEQ ID NO: 63667 - DNA, 22 bp, Artificial Sequence
  chemically synthesized
atcaggcaggaagaagatggcg

SEQ ID NO: 63668 - DNA, 22 bp, Artificial Sequence
  chemically synthesized
cccaggtatttcatcagcagca

SEQ ID NO: 63669 - DNA, 22 bp, Artificial Sequence
  chemically synthesized
catcagcagcacccagctggac

SEQ ID NO: 63670 - DNA, 22 bp, Artificial Sequence
  chemically synthesized
atcagcagcacccagctggaca

SEQ ID NO: 63671 - DNA, 22 bp, Artificial Sequence
  chemically synthesized
gacagcttcttacagtgctgga

SEQ ID NO: 63672 - DNA, 22 bp, Artificial Sequence
  chemically synthesized
cttacagtgctggatgttaaac

SEQ ID NO: 63673 - DNA, 22 bp, Artificial Sequence
  chemically synthesized
ttacagtgctggatgttaaaca

SEQ ID NO: 63674 - DNA, 22 bp, Artificial Sequence
  chemically synthesized
acagtgctggatgttaaacatg

SEQ ID NO: 63675 - DNA, 22 bp, Artificial Sequence
  chemically synthesized
cagtgctggatgttaaacatgc

SEQ ID NO: 63676 - DNA, 22 bp, Artificial Sequence
  chemically synthesized
gatgttaaacatgcctaaacgc

SEQ ID NO: 63677 - DNA, 22 bp, Artificial Sequence
  chemically synthesized
aacatgcctaaacgcttcatca

SEQ ID NO: 63678 - DNA, 22 bp, Artificial Sequence
  chemically synthesized
aacgcttcatcataggcacctt

SEQ ID NO: 63679 - DNA, 22 bp, Artificial Sequence
  chemically synthesized
catcataggcaccttcacggtg

SEQ ID NO: 63680 - DNA, 22 bp, Artificial Sequence
  chemically synthesized
atcataggcaccttcacggtgg

SEQ ID NO: 63681 - DNA, 22 bp, Artificial Sequence
  chemically synthesized
cacggtggtcacctggtccacg

SEQ ID NO: 63682 - DNA, 22 bp, Artificial Sequence
  chemically synthesized
acggtggtcacctggtccacgt

SEQ ID NO: 63683 - DNA, 22 bp, Artificial Sequence
  chemically synthesized
gtccacgtggaagtcctcttcc

SEQ ID NO: 63684 - DNA, 22 bp, Artificial Sequence
  chemically synthesized
ttcctcggtgtccttgacttca

SEQ ID NO: 63685 - DNA, 22 bp, Artificial Sequence
  chemically synthesized
cctcggtgtccttgacttcaaa

SEQ ID NO: 63686 - DNA, 22 bp, Artificial Sequence
  chemically synthesized
ctcggtgtccttgacttcaaag

SEQ ID NO: 63687 - DNA, 22 bp, Artificial Sequence
  chemically synthesized
ggtgtccttgacttcaaagggt

SEQ ID NO: 63688 - DNA, 22 bp, Artificial Sequence
  chemically synthesized
gacttcaaagggtctctcccat

SEQ ID NO: 63689 - DNA, 22 bp, Artificial Sequence
  chemically synthesized
acttcaaagggtctctcccatt

SEQ ID NO: 63690 - DNA, 22 bp, Artificial Sequence
  chemically synthesized
caaagggtctctcccatttgcc

SEQ ID NO: 63691 - DNA, 22 bp, Artificial Sequence
  chemically synthesized
aaagggtctctcccatttgcct

SEQ ID NO: 63692 - DNA, 22 bp, Artificial Sequence
  chemically synthesized
tcccatttgcctggagagaggg

SEQ ID NO: 63693 - DNA, 22 bp, Artificial Sequence
  chemically synthesized
ccatttgcctggagagagggga

SEQ ID NO: 63694 - DNA, 22 bp, Artificial Sequence
  chemically synthesized
gcctggagagaggggaaggtgg

SEQ ID NO: 63695 - DNA, 22 bp, Artificial Sequence
  chemically synthesized
cctggagagaggggaaggtggg

SEQ ID NO: 63696 - DNA, 22 bp, Artificial Sequence
  chemically synthesized
gagagaggggaaggtgggcatc

SEQ ID NO: 63697 - DNA, 22 bp, Artificial Sequence
  chemically synthesized
ggaagagtgtagcagaataaag

SEQ ID NO: 63698 - DNA, 22 bp, Artificial Sequence
  chemically synthesized
gaagagtgtagcagaataaaga

SEQ ID NO: 63699 - DNA, 22 bp, Artificial Sequence
  chemically synthesized
cctgagaagccctgagccccct

SEQ ID NO: 63700 - DNA, 22 bp, Artificial Sequence
  chemically synthesized
agaagccctgagcccccttgac

SEQ ID NO: 63701 - DNA, 22 bp, Artificial Sequence
  chemically synthesized
agcccccttgacgacacacatc

SEQ ID NO: 63702 - DNA, 22 bp, Artificial Sequence
  chemically synthesized
gacgacacacatccctcgaggc

SEQ ID NO: 63703 - DNA, 22 bp, Artificial Sequence
  chemically synthesized
acgacacacatccctcgaggct

SEQ ID NO: 63704 - DNA, 22 bp, Artificial Sequence
  chemically synthesized
gaggctcagcttcatcatctgt

SEQ ID NO: 63705 - DNA, 22 bp, Artificial Sequence
  chemically synthesized
agcttcatcatctgtaaaaggt

SEQ ID NO: 63706 - DNA, 22 bp, Artificial Sequence
  chemically synthesized
catcatctgtaaaaggtgctga

SEQ ID NO: 63707 - DNA, 22 bp, Artificial Sequence
  chemically synthesized
atcatctgtaaaaggtgctgaa

SEQ ID NO: 63708 - DNA, 22 bp, Artificial Sequence
  chemically synthesized
taaaaggtgctgaaactgacca

SEQ ID NO: 63709 - DNA, 22 bp, Artificial Sequence
  chemically synthesized
aaactgaccatccaagctgccg

SEQ ID NO: 63710 - DNA, 22 bp, Artificial Sequence
  chemically synthesized
accatccaagctgccgaaaaag

SEQ ID NO: 63711 - DNA, 22 bp, Artificial Sequence
  chemically synthesized
ccgaaaaagattgtgtggggat

SEQ ID NO: 63712 - DNA, 22 bp, Artificial Sequence
  chemically synthesized
tgtggggataattcaaaactag

SEQ ID NO: 63713 - DNA, 22 bp, Artificial Sequence
  chemically synthesized
aaaactagaggaagatgcagaa

SEQ ID NO: 63714 - DNA, 22 bp, Artificial Sequence
  chemically synthesized
gaggaagatgcagaatttctac

SEQ ID NO: 63715 - DNA, 22 bp, Artificial Sequence
  chemically synthesized
ctacatcgtggcgatgtcaggc

SEQ ID NO: 63716 - DNA, 22 bp, Artificial Sequence
  chemically synthesized
tacatcgtggcgatgtcaggct

SEQ ID NO: 63717 - DNA, 22 bp, Artificial Sequence
  chemically synthesized
catcgtggcgatgtcaggctaa

SEQ ID NO: 63718 - DNA, 22 bp, Artificial Sequence
  chemically synthesized
agagatgccatcgtggctgtgc

SEQ ID NO: 63719 - DNA, 22 bp, Artificial Sequence
  chemically synthesized
tgcatttttattggaatcatat

SEQ ID NO: 63720 - DNA, 22 bp, Artificial Sequence
  chemically synthesized
ttattggaatcatatgtttatt

SEQ ID NO: 63721 - DNA, 22 bp, Artificial Sequence
  chemically synthesized
tattggaatcatatgtttattt

SEQ ID NO: 63722 - DNA, 22 bp, Artificial Sequence
  chemically synthesized
attggaatcatatgtttatttg

SEQ ID NO: 63723 - DNA, 22 bp, Artificial Sequence
  chemically synthesized
ttggaatcatatgtttatttga

SEQ ID NO: 63724 - DNA, 22 bp, Artificial Sequence
  chemically synthesized
gaatcatatgtttatttgaggg

SEQ ID NO: 63725 - DNA, 22 bp, Artificial Sequence
  chemically synthesized
atttgagggtgtcttggatatt

SEQ ID NO: 63726 - DNA, 22 bp, Artificial Sequence
  chemically synthesized
tttgagggtgtcttggatatta

SEQ ID NO: 63727 - DNA, 22 bp, Artificial Sequence
  chemically synthesized
gagggtgtcttggatattacaa

SEQ ID NO: 63728 - DNA, 22 bp, Artificial Sequence
  chemically synthesized
agggtgtcttggatattacaaa

SEQ ID NO: 63729 - DNA, 22 bp, Artificial Sequence
  chemically synthesized
ggatattacaaataaaatgttg

SEQ ID NO: 63730 - DNA, 22 bp, Artificial Sequence
  chemically synthesized
gatattacaaataaaatgttgg

SEQ ID NO: 63731 - DNA, 22 bp, Artificial Sequence
  chemically synthesized
caaataaaatgttggagcatca

SEQ ID NO: 63732 - DNA, 22 bp, Artificial Sequence
  chemically synthesized
gagcatcaggcatatttggtac

SEQ ID NO: 63733 - DNA, 22 bp, Artificial Sequence
  chemically synthesized
ggtaccttctgtctaaggctcc

SEQ ID NO: 63734 - DNA, 22 bp, Artificial Sequence
  chemically synthesized
gtaccttctgtctaaggctccc

SEQ ID NO: 63735 - DNA, 22 bp, Artificial Sequence
  chemically synthesized
ctgtctaaggctccctgcccct

SEQ ID NO: 63736 - DNA, 22 bp, Artificial Sequence
  chemically synthesized
tgtctaaggctccctgcccctt

SEQ ID NO: 63737 - DNA, 22 bp, Artificial Sequence
  chemically synthesized
tctaaggctccctgccccttgt

SEQ ID NO: 63738 - DNA, 22 bp, Artificial Sequence
  chemically synthesized
aggctccctgccccttgttaat

SEQ ID NO: 63739 - DNA, 22 bp, Artificial Sequence
  chemically synthesized
cctgccccttgttaattggcag

SEQ ID NO: 63740 - DNA, 22 bp, Artificial Sequence
  chemically synthesized
ccccttgttaattggcagctca

SEQ ID NO: 63741 - DNA, 22 bp, Artificial Sequence
  chemically synthesized
gttaattggcagctcagttatt

SEQ ID NO: 63742 - DNA, 22 bp, Artificial Sequence
  chemically synthesized
ttaattggcagctcagttattc

SEQ ID NO: 63743 - DNA, 22 bp, Artificial Sequence
  chemically synthesized
attggcagctcagttattcatc

SEQ ID NO: 63744 - DNA, 22 bp, Artificial Sequence
  chemically synthesized
gcagctcagttattcatccagg

SEQ ID NO: 63745 - DNA, 22 bp, Artificial Sequence
  chemically synthesized
agttattcatccagggcaaaca

SEQ ID NO: 63746 - DNA, 22 bp, Artificial Sequence
  chemically synthesized
ttcatccagggcaaacattctg

SEQ ID NO: 63747 - DNA, 22 bp, Artificial Sequence
  chemically synthesized
atccagggcaaacattctgctt

SEQ ID NO: 63748 - DNA, 22 bp, Artificial Sequence
  chemically synthesized
tgcttactattcctgagagctt

SEQ ID NO: 63749 - DNA, 22 bp, Artificial Sequence
  chemically synthesized
cttactattcctgagagctttc

SEQ ID NO: 63750 - DNA, 22 bp, Artificial Sequence
  chemically synthesized
actattcctgagagctttcctc

SEQ ID NO: 63751 - DNA, 22 bp, Artificial Sequence
  chemically synthesized
ctattcctgagagctttcctca

SEQ ID NO: 63752 - DNA, 22 bp, Artificial Sequence
  chemically synthesized
ttcctgagagctttcctcatcc

SEQ ID NO: 63753 - DNA, 22 bp, Artificial Sequence
  chemically synthesized
ctgagagctttcctcatcctct

SEQ ID NO: 63754 - DNA, 22 bp, Artificial Sequence
  chemically synthesized
agagctttcctcatcctctaga

SEQ ID NO: 63755 - DNA, 22 bp, Artificial Sequence
  chemically synthesized
tcctcatcctctagattggcag

SEQ ID NO: 63756 - DNA, 22 bp, Artificial Sequence
  chemically synthesized
cctcatcctctagattggcagg

SEQ ID NO: 63757 - DNA, 22 bp, Artificial Sequence
  chemically synthesized
ctcatcctctagattggcaggg

SEQ ID NO: 63758 - DNA, 22 bp, Artificial Sequence
  chemically synthesized
atcctctagattggcaggggaa

SEQ ID NO: 63759 - DNA, 22 bp, Artificial Sequence
  chemically synthesized
tagattggcaggggaaatgcag

SEQ ID NO: 63760 - DNA, 22 bp, Artificial Sequence
  chemically synthesized
gattggcaggggaaatgcagat

SEQ ID NO: 63761 - DNA, 22 bp, Artificial Sequence
  chemically synthesized
gcaggggaaatgcagatgcctg

SEQ ID NO: 63762 - DNA, 22 bp, Artificial Sequence
  chemically synthesized
agcagcctcccctctgccatac

SEQ ID NO: 63763 - DNA, 22 bp, Artificial Sequence
  chemically synthesized
ccctctgccataccaacagagc

SEQ ID NO: 63764 - DNA, 22 bp, Artificial Sequence
  chemically synthesized
tgccataccaacagagcttcac

SEQ ID NO: 63765 - DNA, 22 bp, Artificial Sequence
  chemically synthesized
ccataccaacagagcttcacca

SEQ ID NO: 63766 - DNA, 22 bp, Artificial Sequence
  chemically synthesized
caccatcgaggcatgcagagtg

SEQ ID NO: 63767 - DNA, 22 bp, Artificial Sequence
  chemically synthesized
accatcgaggcatgcagagtgg

SEQ ID NO: 63768 - DNA, 22 bp, Artificial Sequence
  chemically synthesized
agggacccctgatcccagcttt

SEQ ID NO: 63769 - DNA, 22 bp, Artificial Sequence
  chemically synthesized
atcccagctttctcattggaca

SEQ ID NO: 63770 - DNA, 22 bp, Artificial Sequence
  chemically synthesized
tctcattggacagaaggaggag

SEQ ID NO: 63771 - DNA, 22 bp, Artificial Sequence
  chemically synthesized
ctcattggacagaaggaggaga

SEQ ID NO: 63772 - DNA, 22 bp, Artificial Sequence
  chemically synthesized
tcattggacagaaggaggagac

SEQ ID NO: 63773 - DNA, 22 bp, Artificial Sequence
  chemically synthesized
attggacagaaggaggagactg

SEQ ID NO: 63774 - DNA, 22 bp, Artificial Sequence
  chemically synthesized
gacagaaggaggagactggggc

SEQ ID NO: 63775 - DNA, 22 bp, Artificial Sequence
  chemically synthesized
gggctggagagggacctgggcc

SEQ ID NO: 63776 - DNA, 22 bp, Artificial Sequence
  chemically synthesized
gagagggacctgggcccccact

SEQ ID NO: 63777 - DNA, 22 bp, Artificial Sequence
  chemically synthesized
ggcccccactaaggccacagca

SEQ ID NO: 63778 - DNA, 22 bp, Artificial Sequence
  chemically synthesized
aggccacagcagagccaggact

SEQ ID NO: 63779 - DNA, 22 bp, Artificial Sequence
  chemically synthesized
tagctgtgctgactgcagcctg

SEQ ID NO: 63780 - DNA, 22 bp, Artificial Sequence
  chemically synthesized
agctgtgctgactgcagcctgg

SEQ ID NO: 63781 - DNA, 22 bp, Artificial Sequence
  chemically synthesized
gctgtgctgactgcagcctggc

SEQ ID NO: 63782 - DNA, 22 bp, Artificial Sequence
  chemically synthesized
tgctgactgcagcctggctgct

SEQ ID NO: 63783 - DNA, 22 bp, Artificial Sequence
  chemically synthesized
actgcagcctggctgctctcca

SEQ ID NO: 63784 - DNA, 22 bp, Artificial Sequence
  chemically synthesized
cagcctggctgctctccactgc

SEQ ID NO: 63785 - DNA, 22 bp, Artificial Sequence
  chemically synthesized
gctgctctccactgccctcctt

SEQ ID NO: 63786 - DNA, 22 bp, Artificial Sequence
  chemically synthesized
ctctccactgccctcctttgcc

SEQ ID NO: 63787 - DNA, 22 bp, Artificial Sequence
  chemically synthesized
tccactgccctcctttgcctca

SEQ ID NO: 63788 - DNA, 22 bp, Artificial Sequence
  chemically synthesized
cactgccctcctttgcctcaag

SEQ ID NO: 63789 - DNA, 22 bp, Artificial Sequence
  chemically synthesized
ccctcctttgcctcaagagcaa

SEQ ID NO: 63790 - DNA, 22 bp, Artificial Sequence
  chemically synthesized
ctttgcctcaagagcaagggag

SEQ ID NO: 63791 - DNA, 22 bp, Artificial Sequence
  chemically synthesized
tgcctcaagagcaagggagcct

SEQ ID NO: 63792 - DNA, 22 bp, Artificial Sequence
  chemically synthesized
gcctcaagagcaagggagcctc

SEQ ID NO: 63793 - DNA, 22 bp, Artificial Sequence
  chemically synthesized
cctcaagagcaagggagcctca

SEQ ID NO: 63794 - DNA, 22 bp, Artificial Sequence
  chemically synthesized
aagagcaagggagcctcagagt

SEQ ID NO: 63795 - DNA, 22 bp, Artificial Sequence
  chemically synthesized
agagtggaggaagcagcccctg

SEQ ID NO: 63796 - DNA, 22 bp, Artificial Sequence
  chemically synthesized
gccttgcctcccacctcccctc

SEQ ID NO: 63797 - DNA, 22 bp, Artificial Sequence
  chemically synthesized
gcctcccacctcccctccccta

SEQ ID NO: 63798 - DNA, 22 bp, Artificial Sequence
  chemically synthesized
cctcccacctcccctcccctat

SEQ ID NO: 63799 - DNA, 22 bp, Artificial Sequence
  chemically synthesized
ccacctcccctcccctatgctg

SEQ ID NO: 63800 - DNA, 22 bp, Artificial Sequence
  chemically synthesized
ccctcccctatgctgttttcct

SEQ ID NO: 63801 - DNA, 22 bp, Artificial Sequence
  chemically synthesized
ccctatgctgttttcctgggac

SEQ ID NO: 63802 - DNA, 22 bp, Artificial Sequence
  chemically synthesized
tgctgttttcctgggacagtgg

SEQ ID NO: 63803 - DNA, 22 bp, Artificial Sequence
  chemically synthesized
ttttcctgggacagtgggagct

SEQ ID NO: 63804 - DNA, 22 bp, Artificial Sequence
  chemically synthesized
tcctgggacagtgggagctggc

SEQ ID NO: 63805 - DNA, 22 bp, Artificial Sequence
  chemically synthesized
cctgggacagtgggagctggct

SEQ ID NO: 63806 - DNA, 22 bp, Artificial Sequence
  chemically synthesized
ctgggacagtgggagctggctt

SEQ ID NO: 63807 - DNA, 22 bp, Artificial Sequence
  chemically synthesized
ggacagtgggagctggcttaga

SEQ ID NO: 63808 - DNA, 22 bp, Artificial Sequence
  chemically synthesized
gcttagaatgccctggggcccc

SEQ ID NO: 63809 - DNA, 22 bp, Artificial Sequence
  chemically synthesized
agaatgccctggggcccccagg

SEQ ID NO: 63810 - DNA, 22 bp, Artificial Sequence
  chemically synthesized
gaatgccctggggcccccagga

SEQ ID NO: 63811 - DNA, 22 bp, Artificial Sequence
  chemically synthesized
gggcccccaggaccctggcatt

SEQ ID NO: 63812 - DNA, 22 bp, Artificial Sequence
  chemically synthesized
gcattttaacccctcaggggca

SEQ ID NO: 63813 - DNA, 22 bp, Artificial Sequence
  chemically synthesized
taacccctcaggggcaggaagg

SEQ ID NO: 63814 - DNA, 22 bp, Artificial Sequence
  chemically synthesized
aacccctcaggggcaggaaggc

SEQ ID NO: 63815 - DNA, 22 bp, Artificial Sequence
  chemically synthesized
acccctcaggggcaggaaggca

SEQ ID NO: 63816 - DNA, 22 bp, Artificial Sequence
  chemically synthesized
aggggcaggaaggcagcctgag

SEQ ID NO: 63817 - DNA, 22 bp, Artificial Sequence
  chemically synthesized
agatacagaagagtccatcacc

SEQ ID NO: 63818 - DNA, 22 bp, Artificial Sequence
  chemically synthesized
ctgtatgccacacaccatcccc

SEQ ID NO: 63819 - DNA, 22 bp, Artificial Sequence
  chemically synthesized
tatgccacacaccatccccaca

SEQ ID NO: 63820 - DNA, 22 bp, Artificial Sequence
  chemically synthesized
tgtcatttgtttaatcctaaaa

SEQ ID NO: 63821 - DNA, 22 bp, Artificial Sequence
  chemically synthesized
gtcatttgtttaatcctaaaaa

SEQ ID NO: 63822 - DNA, 22 bp, Artificial Sequence
  chemically synthesized
tcatttgtttaatcctaaaaaa

SEQ ID NO: 63823 - DNA, 22 bp, Artificial Sequence
  chemically synthesized
gtttaatcctaaaaaaacctga

SEQ ID NO: 63824 - DNA, 22 bp, Artificial Sequence
  chemically synthesized
tttaatcctaaaaaaacctgac

SEQ ID NO: 63825 - DNA, 22 bp, Artificial Sequence
  chemically synthesized
aatcctaaaaaaacctgacagc

SEQ ID NO: 63826 - DNA, 22 bp, Artificial Sequence
  chemically synthesized
atcctaaaaaaacctgacagca

SEQ ID NO: 63827 - DNA, 22 bp, Artificial Sequence
  chemically synthesized
aaaaaacctgacagcaagaatg

SEQ ID NO: 63828 - DNA, 22 bp, Artificial Sequence
  chemically synthesized
acagcaagaatggtattttgtc

SEQ ID NO: 63829 - DNA, 22 bp, Artificial Sequence
  chemically synthesized
tgtccatgctaagatgagaaat

SEQ ID NO: 63830 - DNA, 22 bp, Artificial Sequence
  chemically synthesized
gtccatgctaagatgagaaatt

SEQ ID NO: 63831 - DNA, 22 bp, Artificial Sequence
  chemically synthesized
tccatgctaagatgagaaatta

SEQ ID NO: 63832 - DNA, 22 bp, Artificial Sequence
  chemically synthesized
agatgagaaattagcacctcaa

SEQ ID NO: 63833 - DNA, 22 bp, Artificial Sequence
  chemically synthesized
gcacctcaaagaggtagaatgc

SEQ ID NO: 63834 - DNA, 22 bp, Artificial Sequence
  chemically synthesized
aaagaggtagaatgcattgttt

SEQ ID NO: 63835 - DNA, 22 bp, Artificial Sequence
  chemically synthesized
tttttgtcaaaagctaattgtg

SEQ ID NO: 63836 - DNA, 22 bp, Artificial Sequence
  chemically synthesized
ttgtcaaaagctaattgtgtta

SEQ ID NO: 63837 - DNA, 22 bp, Artificial Sequence
  chemically synthesized
tgtcaaaagctaattgtgttag

SEQ ID NO: 63838 - DNA, 22 bp, Artificial Sequence
  chemically synthesized
gtcaaaagctaattgtgttaga

SEQ ID NO: 63839 - DNA, 22 bp, Artificial Sequence
  chemically synthesized
tcaaaagctaattgtgttagag

SEQ ID NO: 63840 - DNA, 22 bp, Artificial Sequence
  chemically synthesized
attgtgttagaggcaggatttg

SEQ ID NO: 63841 - DNA, 22 bp, Artificial Sequence
  chemically synthesized
tgttagaggcaggatttgaacc

SEQ ID NO: 63842 - DNA, 22 bp, Artificial Sequence
  chemically synthesized
gaggcaggatttgaacccaggt

SEQ ID NO: 63843 - DNA, 22 bp, Artificial Sequence
  chemically synthesized
gaacccaggtctttcagattgc

SEQ ID NO: 63844 - DNA, 22 bp, Artificial Sequence
  chemically synthesized
aacccaggtctttcagattgca

SEQ ID NO: 63845 - DNA, 22 bp, Artificial Sequence
  chemically synthesized
tcagattgcaaaactgatactg

SEQ ID NO: 63846 - DNA, 22 bp, Artificial Sequence
  chemically synthesized
cagattgcaaaactgatactga

SEQ ID NO: 63847 - DNA, 22 bp, Artificial Sequence
  chemically synthesized
agattgcaaaactgatactgat

SEQ ID NO: 63848 - DNA, 22 bp, Artificial Sequence
  chemically synthesized
caaaactgatactgattctggg

SEQ ID NO: 63849 - DNA, 22 bp, Artificial Sequence
  chemically synthesized
atactgattctgggacactaga

SEQ ID NO: 63850 - DNA, 22 bp, Artificial Sequence
  chemically synthesized
attctgggacactagagtcgtg

SEQ ID NO: 63851 - DNA, 22 bp, Artificial Sequence
  chemically synthesized
tgggacactagagtcgtgtaaa

SEQ ID NO: 63852 - DNA, 22 bp, Artificial Sequence
  chemically synthesized
ggacactagagtcgtgtaaagt

SEQ ID NO: 63853 - DNA, 22 bp, Artificial Sequence
  chemically synthesized
gagtcgtgtaaagtatgttcca

SEQ ID NO: 63854 - DNA, 22 bp, Artificial Sequence
  chemically synthesized
catgaaactatccctttatgca

SEQ ID NO: 63855 - DNA, 22 bp, Artificial Sequence
  chemically synthesized
tccctttatgcagtgtattaca

SEQ ID NO: 63856 - DNA, 22 bp, Artificial Sequence
  chemically synthesized
tatgcagtgtattacaatttgt

SEQ ID NO: 63857 - DNA, 22 bp, Artificial Sequence
  chemically synthesized
atgcagtgtattacaatttgtt

SEQ ID NO: 63858 - DNA, 22 bp, Artificial Sequence
  chemically synthesized
tgcagtgtattacaatttgttc

SEQ ID NO: 63859 - DNA, 22 bp, Artificial Sequence
  chemically synthesized
caatttgttctatagttctaag

SEQ ID NO: 63860 - DNA, 22 bp, Artificial Sequence
  chemically synthesized
gttctatagttctaagcattat

SEQ ID NO: 63861 - DNA, 22 bp, Artificial Sequence
  chemically synthesized
ttctatagttctaagcattata

SEQ ID NO: 63862 - DNA, 22 bp, Artificial Sequence
  chemically synthesized
tatagttctaagcattatatat

SEQ ID NO: 63863 - DNA, 22 bp, Artificial Sequence
  chemically synthesized
tagttctaagcattatatattc

SEQ ID NO: 63864 - DNA, 22 bp, Artificial Sequence
  chemically synthesized
taagcattatatattctacata

SEQ ID NO: 63865 - DNA, 22 bp, Artificial Sequence
  chemically synthesized
agcattatatattctacatata

SEQ ID NO: 63866 - DNA, 22 bp, Artificial Sequence
  chemically synthesized
tatattctacatatacagtata

SEQ ID NO: 63867 - DNA, 22 bp, Artificial Sequence
  chemically synthesized
tacatatacagtatacacaagg

SEQ ID NO: 63868 - DNA, 22 bp, Artificial Sequence
  chemically synthesized
catatacagtatacacaaggac

SEQ ID NO: 63869 - DNA, 22 bp, Artificial Sequence
  chemically synthesized
aaggctctgaaaagttctgcag

SEQ ID NO: 63870 - DNA, 22 bp, Artificial Sequence
  chemically synthesized
tgaaaagttctgcagagctgtc

SEQ ID NO: 63871 - DNA, 22 bp, Artificial Sequence
  chemically synthesized
aaaagttctgcagagctgtcag

SEQ ID NO: 63872 - DNA, 22 bp, Artificial Sequence
  chemically synthesized
tgcagagctgtcagtagttttg

SEQ ID NO: 63873 - DNA, 22 bp, Artificial Sequence
  chemically synthesized
cagagctgtcagtagttttgac

SEQ ID NO: 63874 - DNA, 22 bp, Artificial Sequence
  chemically synthesized
tcagtagttttgacagtttaat

SEQ ID NO: 63875 - DNA, 22 bp, Artificial Sequence
  chemically synthesized
tgacagtttaatctattatttc

SEQ ID NO: 63876 - DNA, 22 bp, Artificial Sequence
  chemically synthesized
gacagtttaatctattatttcc

SEQ ID NO: 63877 - DNA, 22 bp, Artificial Sequence
  chemically synthesized
acagtttaatctattatttcct

SEQ ID NO: 63878 - DNA, 22 bp, Artificial Sequence
  chemically synthesized
aatctattatttcctcaaatta

SEQ ID NO: 63879 - DNA, 22 bp, Artificial Sequence
  chemically synthesized
atctattatttcctcaaattac

SEQ ID NO: 63880 - DNA, 22 bp, Artificial Sequence
  chemically synthesized
ttatttcctcaaattactcaat

SEQ ID NO: 63881 - DNA, 22 bp, Artificial Sequence
  chemically synthesized
tttcctcaaattactcaatgat

SEQ ID NO: 63882 - DNA, 22 bp, Artificial Sequence
  chemically synthesized
cctcaaattactcaatgatgga

SEQ ID NO: 63883 - DNA, 22 bp, Artificial Sequence
  chemically synthesized
ctcaaattactcaatgatggaa

SEQ ID NO: 63884 - DNA, 22 bp, Artificial Sequence
  chemically synthesized
aaattactcaatgatggaaaac

SEQ ID NO: 63885 - DNA, 22 bp, Artificial Sequence
  chemically synthesized
ctcaatgatggaaaacatttta

SEQ ID NO: 63886 - DNA, 22 bp, Artificial Sequence
  chemically synthesized
aatgatggaaaacattttagtg

SEQ ID NO: 63887 - DNA, 22 bp, Artificial Sequence
  chemically synthesized
tagtgtttgtgtgtagaaaact

SEQ ID NO: 63888 - DNA, 22 bp, Artificial Sequence
  chemically synthesized
agtgtttgtgtgtagaaaactg

SEQ ID NO: 63889 - DNA, 22 bp, Artificial Sequence
  chemically synthesized
gtgtttgtgtgtagaaaactga

SEQ ID NO: 63890 - DNA, 22 bp, Artificial Sequence
  chemically synthesized
gtgtgtagaaaactgaagaatc

SEQ ID NO: 63891 - DNA, 22 bp, Artificial Sequence
  chemically synthesized
tgtgtagaaaactgaagaatcc

SEQ ID NO: 63892 - DNA, 22 bp, Artificial Sequence
  chemically synthesized
aagaatccacgctgaaaagcat

SEQ ID NO: 63893 - DNA, 22 bp, Artificial Sequence
  chemically synthesized
aaaagcattgctatggcccata

SEQ ID NO: 63894 - DNA, 22 bp, Artificial Sequence
  chemically synthesized
ctatggcccataatgcattgcc

SEQ ID NO: 63895 - DNA, 22 bp, Artificial Sequence
  chemically synthesized
tggcccataatgcattgccaag

SEQ ID NO: 63896 - DNA, 22 bp, Artificial Sequence
  chemically synthesized
ccaaggagagttcaagaactga

SEQ ID NO: 63897 - DNA, 22 bp, Artificial Sequence
  chemically synthesized
aagaactgatggtttgagaata

SEQ ID NO: 63898 - DNA, 22 bp, Artificial Sequence
  chemically synthesized
atggtttgagaatatttttgct

SEQ ID NO: 63899 - DNA, 22 bp, Artificial Sequence
  chemically synthesized
gagaatatttttgcttgtttct

SEQ ID NO: 63900 - DNA, 22 bp, Artificial Sequence
  chemically synthesized
agaatatttttgcttgtttcta

SEQ ID NO: 63901 - DNA, 22 bp, Artificial Sequence
  chemically synthesized
ttgcttgtttctatgggaacag

SEQ ID NO: 63902 - DNA, 22 bp, Artificial Sequence
  chemically synthesized
tgcttgtttctatgggaacagc

SEQ ID NO: 63903 - DNA, 22 bp, Artificial Sequence
  chemically synthesized
gcttgtttctatgggaacagct

SEQ ID NO: 63904 - DNA, 22 bp, Artificial Sequence
  chemically synthesized
cttgtttctatgggaacagctc

SEQ ID NO: 63905 - DNA, 22 bp, Artificial Sequence
  chemically synthesized
gtttctatgggaacagctcagg

SEQ ID NO: 63906 - DNA, 22 bp, Artificial Sequence
  chemically synthesized
tttctatgggaacagctcaggc

SEQ ID NO: 63907 - DNA, 22 bp, Artificial Sequence
  chemically synthesized
ctatgggaacagctcaggctgg

SEQ ID NO: 63908 - DNA, 22 bp, Artificial Sequence
  chemically synthesized
tatgggaacagctcaggctggt

SEQ ID NO: 63909 - DNA, 22 bp, Artificial Sequence
  chemically synthesized
tgggaacagctcaggctggttg

SEQ ID NO: 63910 - DNA, 22 bp, Artificial Sequence
  chemically synthesized
aggctggttgagcaaccttacc

SEQ ID NO: 63911 - DNA, 22 bp, Artificial Sequence
  chemically synthesized
gttgagcaaccttacctttaaa

SEQ ID NO: 63912 - DNA, 22 bp, Artificial Sequence
  chemically synthesized
agcaaccttacctttaaagaag

SEQ ID NO: 63913 - DNA, 22 bp, Artificial Sequence
  chemically synthesized
acctttaaagaagatgtaattc

SEQ ID NO: 63914 - DNA, 22 bp, Artificial Sequence
  chemically synthesized
cctttaaagaagatgtaattca

SEQ ID NO: 63915 - DNA, 22 bp, Artificial Sequence
  chemically synthesized
taaagaagatgtaattcaccag

SEQ ID NO: 63916 - DNA, 22 bp, Artificial Sequence
  chemically synthesized
aaagaagatgtaattcaccaga

SEQ ID NO: 63917 - DNA, 22 bp, Artificial Sequence
  chemically synthesized
aagaagatgtaattcaccagag

SEQ ID NO: 63918 - DNA, 22 bp, Artificial Sequence
  chemically synthesized
accagagcaaaaactgtgtctc

SEQ ID NO: 63919 - DNA, 22 bp, Artificial Sequence
  chemically synthesized
tgtctctgtcaagctccttgac

SEQ ID NO: 63920 - DNA, 22 bp, Artificial Sequence
  chemically synthesized
tgtcaagctccttgaccaaatc

SEQ ID NO: 63921 - DNA, 22 bp, Artificial Sequence
  chemically synthesized
tcaagctccttgaccaaatcca

SEQ ID NO: 63922 - DNA, 22 bp, Artificial Sequence
  chemically synthesized
cttgaccaaatccacaattttc

SEQ ID NO: 63923 - DNA, 22 bp, Artificial Sequence
  chemically synthesized
gaccaaatccacaattttccct

SEQ ID NO: 63924 - DNA, 22 bp, Artificial Sequence
  chemically synthesized
accaaatccacaattttccctt

SEQ ID NO: 63925 - DNA, 22 bp, Artificial Sequence
  chemically synthesized
tcccttgagtacccttctccac

SEQ ID NO: 63926 - DNA, 22 bp, Artificial Sequence
  chemically synthesized
cccttgagtacccttctccacg

SEQ ID NO: 63927 - DNA, 22 bp, Artificial Sequence
  chemically synthesized
ccttgagtacccttctccacgt

SEQ ID NO: 63928 - DNA, 22 bp, Artificial Sequence
  chemically synthesized
gagtacccttctccacgtaatc

SEQ ID NO: 63929 - DNA, 22 bp, Artificial Sequence
  chemically synthesized
agtacccttctccacgtaatcg

SEQ ID NO: 63930 - DNA, 22 bp, Artificial Sequence
  chemically synthesized
ctccacgtaatcgttgatctgt

SEQ ID NO: 63931 - DNA, 22 bp, Artificial Sequence
  chemically synthesized
tccacgtaatcgttgatctgtt

SEQ ID NO: 63932 - DNA, 22 bp, Artificial Sequence
  chemically synthesized
cacgtaatcgttgatctgtttc

SEQ ID NO: 63933 - DNA, 22 bp, Artificial Sequence
  chemically synthesized
atctgtttcttggcctcttcgg

SEQ ID NO: 63934 - DNA, 22 bp, Artificial Sequence
  chemically synthesized
tttcttggcctcttcggtgtcc

SEQ ID NO: 63935 - DNA, 22 bp, Artificial Sequence
  chemically synthesized
cttggcctcttcggtgtccccg

SEQ ID NO: 63936 - DNA, 22 bp, Artificial Sequence
  chemically synthesized
ttggcctcttcggtgtccccga

SEQ ID NO: 63937 - DNA, 22 bp, Artificial Sequence
  chemically synthesized
ggcctcttcggtgtccccgaag

SEQ ID NO: 63938 - DNA, 22 bp, Artificial Sequence
  chemically synthesized
gcctcttcggtgtccccgaagt

SEQ ID NO: 63939 - DNA, 22 bp, Artificial Sequence
  chemically synthesized
ttcggtgtccccgaagttgaca

SEQ ID NO: 63940 - DNA, 22 bp, Artificial Sequence
  chemically synthesized
cggtgtccccgaagttgacagt

SEQ ID NO: 63941 - DNA, 22 bp, Artificial Sequence
  chemically synthesized
ggtgtccccgaagttgacagtg

SEQ ID NO: 63942 - DNA, 22 bp, Artificial Sequence
  chemically synthesized
acagtgaaggcttctgagtggt

SEQ ID NO: 63943 - DNA, 22 bp, Artificial Sequence
  chemically synthesized
ctgagtggtacaactttttaac

SEQ ID NO: 63944 - DNA, 22 bp, Artificial Sequence
  chemically synthesized
tgagtggtacaactttttaaca

SEQ ID NO: 63945 - DNA, 22 bp, Artificial Sequence
  chemically synthesized
agtggtacaactttttaacatc

SEQ ID NO: 63946 - DNA, 22 bp, Artificial Sequence
  chemically synthesized
tttaacatcctccaaaaactta

SEQ ID NO: 63947 - DNA, 22 bp, Artificial Sequence
  chemically synthesized
ttaacatcctccaaaaacttat

SEQ ID NO: 63948 - DNA, 22 bp, Artificial Sequence
  chemically synthesized
taacatcctccaaaaacttatc

SEQ ID NO: 63949 - DNA, 22 bp, Artificial Sequence
  chemically synthesized
aacatcctccaaaaacttatcc

SEQ ID NO: 63950 - DNA, 22 bp, Artificial Sequence
  chemically synthesized
acatcctccaaaaacttatcca

SEQ ID NO: 63951 - DNA, 22 bp, Artificial Sequence
  chemically synthesized
caaaaacttatccactagcttc

SEQ ID NO: 63952 - DNA, 22 bp, Artificial Sequence
  chemically synthesized
atccactagcttcaggccctcg

SEQ ID NO: 63953 - DNA, 22 bp, Artificial Sequence
  chemically synthesized
tccactagcttcaggccctcgc

SEQ ID NO: 63954 - DNA, 22 bp, Artificial Sequence
  chemically synthesized
gcttcaggccctcgctgaggaa

SEQ ID NO: 63955 - DNA, 22 bp, Artificial Sequence
  chemically synthesized
caggccctcgctgaggaacagg

SEQ ID NO: 63956 - DNA, 22 bp, Artificial Sequence
  chemically synthesized
aggccctcgctgaggaacaggc

SEQ ID NO: 63957 - DNA, 22 bp, Artificial Sequence
  chemically synthesized
gctgaggaacaggccattgccg

SEQ ID NO: 63958 - DNA, 22 bp, Artificial Sequence
  chemically synthesized
aggaacaggccattgccggtgg

SEQ ID NO: 63959 - DNA, 22 bp, Artificial Sequence
  chemically synthesized
ccggtggtcagctggagctggc

SEQ ID NO: 63960 - DNA, 22 bp, Artificial Sequence
  chemically synthesized
gagctggctgtctggctggttg

SEQ ID NO: 63961 - DNA, 22 bp, Artificial Sequence
  chemically synthesized
gctgtctggctggttgagggta

SEQ ID NO: 63962 - DNA, 22 bp, Artificial Sequence
  chemically synthesized
tctggctggttgagggtacgga

SEQ ID NO: 63963 - DNA, 22 bp, Artificial Sequence
  chemically synthesized
gctggttgagggtacggaggag

SEQ ID NO: 63964 - DNA, 22 bp, Artificial Sequence
  chemically synthesized
gttgagggtacggaggagttcc

SEQ ID NO: 63965 - DNA, 22 bp, Artificial Sequence
  chemically synthesized
agggtacggaggagttcctgga

SEQ ID NO: 63966 - DNA, 22 bp, Artificial Sequence
  chemically synthesized
ctggaagccttcatggatctga

SEQ ID NO: 63967 - DNA, 22 bp, Artificial Sequence
  chemically synthesized
gaagccttcatggatctgagcc

SEQ ID NO: 63968 - DNA, 22 bp, Artificial Sequence
  chemically synthesized
catggatctgagcctccggaat

SEQ ID NO: 63969 - DNA, 22 bp, Artificial Sequence
  chemically synthesized
atggatctgagcctccggaatc

SEQ ID NO: 63970 - DNA, 22 bp, Artificial Sequence
  chemically synthesized
agcctccggaatctccgtgagg

SEQ ID NO: 63971 - DNA, 22 bp, Artificial Sequence
  chemically synthesized
cggaatctccgtgaggttgaaa

SEQ ID NO: 63972 - DNA, 22 bp, Artificial Sequence
  chemically synthesized
cgtgaggttgaaattcaggccc

SEQ ID NO: 63973 - DNA, 22 bp, Artificial Sequence
  chemically synthesized
aaattcaggccctccaggattt

SEQ ID NO: 63974 - DNA, 22 bp, Artificial Sequence
  chemically synthesized
aggccctccaggatttcatcgt

SEQ ID NO: 63975 - DNA, 22 bp, Artificial Sequence
  chemically synthesized
caggatttcatcgtgagtgtca

SEQ ID NO: 63976 - DNA, 22 bp, Artificial Sequence
  chemically synthesized
catcgtgagtgtcagccttggt

SEQ ID NO: 63977 - DNA, 22 bp, Artificial Sequence
  chemically synthesized
atcgtgagtgtcagccttggtc

SEQ ID NO: 63978 - DNA, 22 bp, Artificial Sequence
  chemically synthesized
ggtccccagggagagcattgca

SEQ ID NO: 63979 - DNA, 22 bp, Artificial Sequence
  chemically synthesized
gtccccagggagagcattgcaa

SEQ ID NO: 63980 - DNA, 22 bp, Artificial Sequence
  chemically synthesized
caaaggctgtagcgatgctcac

SEQ ID NO: 63981 - DNA, 22 bp, Artificial Sequence
  chemically synthesized
tagcgatgctcactggggagaa

SEQ ID NO: 63982 - DNA, 22 bp, Artificial Sequence
  chemically synthesized
actggggagaagaagatattgg

SEQ ID NO: 63983 - DNA, 22 bp, Artificial Sequence
  chemically synthesized
gggagaagaagatattggtgct

SEQ ID NO: 63984 - DNA, 22 bp, Artificial Sequence
  chemically synthesized
gtgctgttggactggtgtgcca

SEQ ID NO: 63985 - DNA, 22 bp, Artificial Sequence
  chemically synthesized
ttggactggtgtgccagctggc

SEQ ID NO: 63986 - DNA, 22 bp, Artificial Sequence
  chemically synthesized
gactggtgtgccagctggcggt

SEQ ID NO: 63987 - DNA, 22 bp, Artificial Sequence
  chemically synthesized
gtgtgccagctggcggtatagg

SEQ ID NO: 63988 - DNA, 22 bp, Artificial Sequence
  chemically synthesized
gcggtataggctgaaggcgaac

SEQ ID NO: 63989 - DNA, 22 bp, Artificial Sequence
  chemically synthesized
aaggcgaactcagccaggttgg

SEQ ID NO: 63990 - DNA, 22 bp, Artificial Sequence
  chemically synthesized
agccaggttgggggtgatcttg

SEQ ID NO: 63991 - DNA, 22 bp, Artificial Sequence
  chemically synthesized
ggggtgatcttgttgaaggttg

SEQ ID NO: 63992 - DNA, 22 bp, Artificial Sequence
  chemically synthesized
gttgaaggttgggtgatcctga

SEQ ID NO: 63993 - DNA, 22 bp, Artificial Sequence
  chemically synthesized
ttgaaggttgggtgatcctgat

SEQ ID NO: 63994 - DNA, 22 bp, Artificial Sequence
  chemically synthesized
aaggttgggtgatcctgatcat

SEQ ID NO: 63995 - DNA, 22 bp, Artificial Sequence
  chemically synthesized
ggtgatcctgatcatggtggga

SEQ ID NO: 63996 - DNA, 22 bp, Artificial Sequence
  chemically synthesized
atcatggtgggatgtatctgtc

SEQ ID NO: 63997 - DNA, 22 bp, Artificial Sequence
  chemically synthesized
tcttctgggcagcatctccctg

SEQ ID NO: 63998 - DNA, 22 bp, Artificial Sequence
  chemically synthesized
ctgggcagcatctccctgggga

SEQ ID NO: 63999 - DNA, 22 bp, Artificial Sequence
  chemically synthesized
tgggcagcatctccctggggat

SEQ ID NO: 64000 - DNA, 22 bp, Artificial Sequence
  chemically synthesized
ggcagcatctccctggggatcc

SEQ ID NO: 64001 - DNA, 22 bp, Artificial Sequence
  chemically synthesized
cctggggatcctcagccaggga

SEQ ID NO: 64002 - DNA, 22 bp, Artificial Sequence
  chemically synthesized
gggatcctcagccagggagaca

SEQ ID NO: 64003 - DNA, 22 bp, Artificial Sequence
  chemically synthesized
agccagggagacagggaccagg

SEQ ID NO: 64004 - DNA, 22 bp, Artificial Sequence
  chemically synthesized
ccagcaggaggatgccccacga

SEQ ID NO: 64005 - DNA, 22 bp, Artificial Sequence
  chemically synthesized
tcctgcaagacagagatggggg

SEQ ID NO: 64006 - DNA, 22 bp, Artificial Sequence
  chemically synthesized
caagacagagatgggggggcca

SEQ ID NO: 64007 - DNA, 22 bp, Artificial Sequence
  chemically synthesized
ccagtgatcagggattgacacc

SEQ ID NO: 64008 - DNA, 22 bp, Artificial Sequence
  chemically synthesized
acaccacgtggaagtgcctagg

SEQ ID NO: 64009 - DNA, 22 bp, Artificial Sequence
  chemically synthesized
gggattattaaaccagcctgtg

SEQ ID NO: 64010 - DNA, 22 bp, Artificial Sequence
  chemically synthesized
ttaaaccagcctgtgccaagta

SEQ ID NO: 64011 - DNA, 22 bp, Artificial Sequence
  chemically synthesized
aaccagcctgtgccaagtactt

SEQ ID NO: 64012 - DNA, 22 bp, Artificial Sequence
  chemically synthesized
tgccaagtacttgccgacatca

SEQ ID NO: 64013 - DNA, 22 bp, Artificial Sequence
  chemically synthesized
gccgacatcagtaacactgaaa

SEQ ID NO: 64014 - DNA, 22 bp, Artificial Sequence
  chemically synthesized
ccgacatcagtaacactgaaag

SEQ ID NO: 64015 - DNA, 22 bp, Artificial Sequence
  chemically synthesized
aaagaatcagaagaatagcaaa

SEQ ID NO: 64016 - DNA, 22 bp, Artificial Sequence
  chemically synthesized
accatatgccaagcactgttct

SEQ ID NO: 64017 - DNA, 22 bp, Artificial Sequence
  chemically synthesized
ccatatgccaagcactgttctc

SEQ ID NO: 64018 - DNA, 22 bp, Artificial Sequence
  chemically synthesized
ttctccgtgctcacatgtgtta

SEQ ID NO: 64019 - DNA, 22 bp, Artificial Sequence
  chemically synthesized
tccgtgctcacatgtgttaatt

SEQ ID NO: 64020 - DNA, 22 bp, Artificial Sequence
  chemically synthesized
cgtgctcacatgtgttaattca

SEQ ID NO: 64021 - DNA, 22 bp, Artificial Sequence
  chemically synthesized
acatgtgttaattcattgcttt

SEQ ID NO: 64022 - DNA, 22 bp, Artificial Sequence
  chemically synthesized
attcattgctttcttgtaacaa

SEQ ID NO: 64023 - DNA, 22 bp, Artificial Sequence
  chemically synthesized
attgctttcttgtaacaatccc

SEQ ID NO: 64024 - DNA, 22 bp, Artificial Sequence
  chemically synthesized
ctttcttgtaacaatcccgtga

SEQ ID NO: 64025 - DNA, 22 bp, Artificial Sequence
  chemically synthesized
tcttgtaacaatcccgtgaggt

SEQ ID NO: 64026 - DNA, 22 bp, Artificial Sequence
  chemically synthesized
cttgtaacaatcccgtgaggtg

SEQ ID NO: 64027 - DNA, 22 bp, Artificial Sequence
  chemically synthesized
ttgtaacaatcccgtgaggtgc

SEQ ID NO: 64028 - DNA, 22 bp, Artificial Sequence
  chemically synthesized
gtaacaatcccgtgaggtgcta

SEQ ID NO: 64029 - DNA, 22 bp, Artificial Sequence
  chemically synthesized
taacaatcccgtgaggtgctaa

SEQ ID NO: 64030 - DNA, 22 bp, Artificial Sequence
  chemically synthesized
atgctaatatccttcttttaca

SEQ ID NO: 64031 - DNA, 22 bp, Artificial Sequence
  chemically synthesized
atatccttcttttacagatgaa

SEQ ID NO: 64032 - DNA, 22 bp, Artificial Sequence
  chemically synthesized
cttttacagatgaagaaaccaa

SEQ ID NO: 64033 - DNA, 22 bp, Artificial Sequence
  chemically synthesized
ttttacagatgaagaaaccaaa

SEQ ID NO: 64034 - DNA, 22 bp, Artificial Sequence
  chemically synthesized
ttacagatgaagaaaccaaagc

SEQ ID NO: 64035 - DNA, 22 bp, Artificial Sequence
  chemically synthesized
tacagatgaagaaaccaaagcc

SEQ ID NO: 64036 - DNA, 22 bp, Artificial Sequence
  chemically synthesized
acagatgaagaaaccaaagcca

SEQ ID NO: 64037 - DNA, 22 bp, Artificial Sequence
  chemically synthesized
cagatgaagaaaccaaagccag

SEQ ID NO: 64038 - DNA, 22 bp, Artificial Sequence
  chemically synthesized
ggtcagctattcaatgtcactg

SEQ ID NO: 64039 - DNA, 22 bp, Artificial Sequence
  chemically synthesized
ttcaatgtcactgaggaagtag

SEQ ID NO: 64040 - DNA, 22 bp, Artificial Sequence
  chemically synthesized
aatgtcactgaggaagtagcag

SEQ ID NO: 64041 - DNA, 22 bp, Artificial Sequence
  chemically synthesized
aggaagtagcagaaccagaatc

SEQ ID NO: 64042 - DNA, 22 bp, Artificial Sequence
  chemically synthesized
catctaggtcctgcacccaggc

SEQ ID NO: 64043 - DNA, 22 bp, Artificial Sequence
  chemically synthesized
ggtcctgcacccaggctctgga

SEQ ID NO: 64044 - DNA, 22 bp, Artificial Sequence
  chemically synthesized
cacccaggctctggacagcaac

SEQ ID NO: 64045 - DNA, 22 bp, Artificial Sequence
  chemically synthesized
tggacagcaacacttacatctg

SEQ ID NO: 64046 - DNA, 22 bp, Artificial Sequence
  chemically synthesized
gacagcaacacttacatctgca

SEQ ID NO: 64047 - DNA, 22 bp, Artificial Sequence
  chemically synthesized
acatctgcaatgaccctaagat

SEQ ID NO: 64048 - DNA, 22 bp, Artificial Sequence
  chemically synthesized
catctgcaatgaccctaagatg

SEQ ID NO: 64049 - DNA, 22 bp, Artificial Sequence
  chemically synthesized
caatgaccctaagatgcaaatg

SEQ ID NO: 64050 - DNA, 22 bp, Artificial Sequence
  chemically synthesized
agatgcaaatggtacagccatt

SEQ ID NO: 64051 - DNA, 22 bp, Artificial Sequence
  chemically synthesized
ttttacaaaagaagaaaatgag

SEQ ID NO: 64052 - DNA, 22 bp, Artificial Sequence
  chemically synthesized
tacaaaagaagaaaatgaggca

SEQ ID NO: 64053 - DNA, 22 bp, Artificial Sequence
  chemically synthesized
acaaaagaagaaaatgaggcac

SEQ ID NO: 64054 - DNA, 22 bp, Artificial Sequence
  chemically synthesized
caaaagaagaaaatgaggcaca

SEQ ID NO: 64055 - DNA, 22 bp, Artificial Sequence
  chemically synthesized
cccacgattatccaggaatcgg

SEQ ID NO: 64056 - DNA, 22 bp, Artificial Sequence
  chemically synthesized
tccaggaatcgggccagatcag

SEQ ID NO: 64057 - DNA, 22 bp, Artificial Sequence
  chemically synthesized
gaagcccttggagggcttctat

SEQ ID NO: 64058 - DNA, 22 bp, Artificial Sequence
  chemically synthesized
ggagggcttctatctaatccca

SEQ ID NO: 64059 - DNA, 22 bp, Artificial Sequence
  chemically synthesized
gagggcttctatctaatcccac

SEQ ID NO: 64060 - DNA, 22 bp, Artificial Sequence
  chemically synthesized
ctatctaatcccactatttagt

SEQ ID NO: 64061 - DNA, 22 bp, Artificial Sequence
  chemically synthesized
tatctaatcccactatttagtg

SEQ ID NO: 64062 - DNA, 22 bp, Artificial Sequence
  chemically synthesized
tctaatcccactatttagtggc

SEQ ID NO: 64063 - DNA, 22 bp, Artificial Sequence
  chemically synthesized
atcccactatttagtggccagg

SEQ ID NO: 64064 - DNA, 22 bp, Artificial Sequence
  chemically synthesized
tttagtggccagggaaactgct

SEQ ID NO: 64065 - DNA, 22 bp, Artificial Sequence
  chemically synthesized
agtggccagggaaactgctgca

SEQ ID NO: 64066 - DNA, 22 bp, Artificial Sequence
  chemically synthesized
gtggccagggaaactgctgcac

SEQ ID NO: 64067 - DNA, 22 bp, Artificial Sequence
  chemically synthesized
ctgcacagaagggaaatgcatc

SEQ ID NO: 64068 - DNA, 22 bp, Artificial Sequence
  chemically synthesized
cacagaagggaaatgcatcttg

SEQ ID NO: 64069 - DNA, 22 bp, Artificial Sequence
  chemically synthesized
gcacaatggcaacagctagaga

SEQ ID NO: 64070 - DNA, 22 bp, Artificial Sequence
  chemically synthesized
cacaatggcaacagctagagag

SEQ ID NO: 64071 - DNA, 22 bp, Artificial Sequence
  chemically synthesized
gagagcatggaggggctgtgat

SEQ ID NO: 64072 - DNA, 22 bp, Artificial Sequence
  chemically synthesized
tgattaaacctcctgggagctg

SEQ ID NO: 64073 - DNA, 22 bp, Artificial Sequence
  chemically synthesized
aacctcctgggagctgttccca

SEQ ID NO: 64074 - DNA, 22 bp, Artificial Sequence
  chemically synthesized
ctgggagctgttcccacccaac

SEQ ID NO: 64075 - DNA, 22 bp, Artificial Sequence
  chemically synthesized
ggagctgttcccacccaacact

SEQ ID NO: 64076 - DNA, 22 bp, Artificial Sequence
  chemically synthesized
ttcccacccaacactcacaagg

SEQ ID NO: 64077 - DNA, 22 bp, Artificial Sequence
  chemically synthesized
ccacccaacactcacaaggatc

SEQ ID NO: 64078 - DNA, 22 bp, Artificial Sequence
  chemically synthesized
acaaggatcctcagcccttagg

SEQ ID NO: 64079 - DNA, 22 bp, Artificial Sequence
  chemically synthesized
agcccttagggtttttttccca

SEQ ID NO: 64080 - DNA, 22 bp, Artificial Sequence
  chemically synthesized
agggtttttttcccaagagacg

SEQ ID NO: 64081 - DNA, 22 bp, Artificial Sequence
  chemically synthesized
gggtttttttcccaagagacgg

SEQ ID NO: 64082 - DNA, 22 bp, Artificial Sequence
  chemically synthesized
ttttcccaagagacggggctgt

SEQ ID NO: 64083 - DNA, 22 bp, Artificial Sequence
  chemically synthesized
tttcccaagagacggggctgtc

SEQ ID NO: 64084 - DNA, 22 bp, Artificial Sequence
  chemically synthesized
ttcccaagagacggggctgtcc

SEQ ID NO: 64085 - DNA, 22 bp, Artificial Sequence
  chemically synthesized
tcccaagagacggggctgtccc

SEQ ID NO: 64086 - DNA, 22 bp, Artificial Sequence
  chemically synthesized
cccaagagacggggctgtcccc

SEQ ID NO: 64087 - DNA, 22 bp, Artificial Sequence
  chemically synthesized
ccaagagacggggctgtcccca

SEQ ID NO: 64088 - DNA, 22 bp, Artificial Sequence
  chemically synthesized
tccccacaatgctctgtggtcc

SEQ ID NO: 64089 - DNA, 22 bp, Artificial Sequence
  chemically synthesized
tgtggtcccagacacaagaata

SEQ ID NO: 64090 - DNA, 22 bp, Artificial Sequence
  chemically synthesized
tggtcccagacacaagaatagg

SEQ ID NO: 64091 - DNA, 22 bp, Artificial Sequence
  chemically synthesized
atgctcctgcagtcagcttacc

SEQ ID NO: 64092 - DNA, 22 bp, Artificial Sequence
  chemically synthesized
ctgcagtcagcttacctgccgt

SEQ ID NO: 64093 - DNA, 22 bp, Artificial Sequence
  chemically synthesized
cagtcagcttacctgccgtctg

SEQ ID NO: 64094 - DNA, 22 bp, Artificial Sequence
  chemically synthesized
acctgccgtctgggtcactaat

SEQ ID NO: 64095 - DNA, 22 bp, Artificial Sequence
  chemically synthesized
cctgccgtctgggtcactaatg

SEQ ID NO: 64096 - DNA, 22 bp, Artificial Sequence
  chemically synthesized
ccgtctgggtcactaatggtgt

SEQ ID NO: 64097 - DNA, 22 bp, Artificial Sequence
  chemically synthesized
ggtcactaatggtgtcccagtt

SEQ ID NO: 64098 - DNA, 22 bp, Artificial Sequence
  chemically synthesized
atggtgtcccagttctgggctc

SEQ ID NO: 64099 - DNA, 22 bp, Artificial Sequence
  chemically synthesized
tgggctcttgctgtcaggggct

SEQ ID NO: 64100 - DNA, 22 bp, Artificial Sequence
  chemically synthesized
ggctcttgctgtcaggggcttt

SEQ ID NO: 64101 - DNA, 22 bp, Artificial Sequence
  chemically synthesized
ttgctgtcaggggctttagaga

SEQ ID NO: 64102 - DNA, 22 bp, Artificial Sequence
  chemically synthesized
gctgtcaggggctttagagacg

SEQ ID NO: 64103 - DNA, 22 bp, Artificial Sequence
  chemically synthesized
ctgtcaggggctttagagacgc

SEQ ID NO: 64104 - DNA, 22 bp, Artificial Sequence
  chemically synthesized
tcaggggctttagagacgctca

SEQ ID NO: 64105 - DNA, 22 bp, Artificial Sequence
  chemically synthesized
tagagacgctcatctctccttg

SEQ ID NO: 64106 - DNA, 22 bp, Artificial Sequence
  chemically synthesized
agagacgctcatctctccttga

SEQ ID NO: 64107 - DNA, 22 bp, Artificial Sequence
  chemically synthesized
gagacgctcatctctccttgaa

SEQ ID NO: 64108 - DNA, 22 bp, Artificial Sequence
  chemically synthesized
atctctccttgaaagcaggggt

SEQ ID NO: 64109 - DNA, 22 bp, Artificial Sequence
  chemically synthesized
tccttgaaagcaggggtttgtg

SEQ ID NO: 64110 - DNA, 22 bp, Artificial Sequence
  chemically synthesized
cttgaaagcaggggtttgtgct

SEQ ID NO: 64111 - DNA, 22 bp, Artificial Sequence
  chemically synthesized
gaaagcaggggtttgtgctgct

SEQ ID NO: 64112 - DNA, 22 bp, Artificial Sequence
  chemically synthesized
aaagcaggggtttgtgctgctt

SEQ ID NO: 64113 - DNA, 22 bp, Artificial Sequence
  chemically synthesized
gtgctgctttaaagtagatgga

SEQ ID NO: 64114 - DNA, 22 bp, Artificial Sequence
  chemically synthesized
tgctgctttaaagtagatggag

SEQ ID NO: 64115 - DNA, 22 bp, Artificial Sequence
  chemically synthesized
ctttaaagtagatggaggaggt

SEQ ID NO: 64116 - DNA, 22 bp, Artificial Sequence
  chemically synthesized
taaagtagatggaggaggtggg

SEQ ID NO: 64117 - DNA, 22 bp, Artificial Sequence
  chemically synthesized
aaagtagatggaggaggtggga

SEQ ID NO: 64118 - DNA, 22 bp, Artificial Sequence
  chemically synthesized
aagtagatggaggaggtgggaa

SEQ ID NO: 64119 - DNA, 22 bp, Artificial Sequence
  chemically synthesized
ttttaacttcagatagacctgg

SEQ ID NO: 64120 - DNA, 22 bp, Artificial Sequence
  chemically synthesized
ttaacttcagatagacctggga

SEQ ID NO: 64121 - DNA, 22 bp, Artificial Sequence
  chemically synthesized
taacttcagatagacctgggat

SEQ ID NO: 64122 - DNA, 22 bp, Artificial Sequence
  chemically synthesized
aacttcagatagacctgggatc

SEQ ID NO: 64123 - DNA, 22 bp, Artificial Sequence
  chemically synthesized
acttcagatagacctgggatct

SEQ ID NO: 64124 - DNA, 22 bp, Artificial Sequence
  chemically synthesized
cagatagacctgggatctaatc

SEQ ID NO: 64125 - DNA, 22 bp, Artificial Sequence
  chemically synthesized
agatagacctgggatctaatct

SEQ ID NO: 64126 - DNA, 22 bp, Artificial Sequence
  chemically synthesized
ggatctaatctgactctgtcac

SEQ ID NO: 64127 - DNA, 22 bp, Artificial Sequence
  chemically synthesized
atctgactctgtcactttccag

SEQ ID NO: 64128 - DNA, 22 bp, Artificial Sequence
  chemically synthesized
actctgtcactttccaggtgta

SEQ ID NO: 64129 - DNA, 22 bp, Artificial Sequence
  chemically synthesized
tgtcactttccaggtgtatgag

SEQ ID NO: 64130 - DNA, 22 bp, Artificial Sequence
  chemically synthesized
tcactttccaggtgtatgagcc

SEQ ID NO: 64131 - DNA, 22 bp, Artificial Sequence
  chemically synthesized
tccaggtgtatgagccaggaca

SEQ ID NO: 64132 - DNA, 22 bp, Artificial Sequence
  chemically synthesized
ccaggtgtatgagccaggacaa

SEQ ID NO: 64133 - DNA, 22 bp, Artificial Sequence
  chemically synthesized
caggtgtatgagccaggacaag

SEQ ID NO: 64134 - DNA, 22 bp, Artificial Sequence
  chemically synthesized
atctccctggtcctcattttgc

SEQ ID NO: 64135 - DNA, 22 bp, Artificial Sequence
  chemically synthesized
cctggtcctcattttgcctcat

SEQ ID NO: 64136 - DNA, 22 bp, Artificial Sequence
  chemically synthesized
gtcctcattttgcctcatacat

SEQ ID NO: 64137 - DNA, 22 bp, Artificial Sequence
  chemically synthesized
attttgcctcatacataaagtg

SEQ ID NO: 64138 - DNA, 22 bp, Artificial Sequence
  chemically synthesized
tgcctcatacataaagtgatgt

SEQ ID NO: 64139 - DNA, 22 bp, Artificial Sequence
  chemically synthesized
gcctcatacataaagtgatgtt

SEQ ID NO: 64140 - DNA, 22 bp, Artificial Sequence
  chemically synthesized
cctcatacataaagtgatgttt

SEQ ID NO: 64141 - DNA, 22 bp, Artificial Sequence
  chemically synthesized
atacataaagtgatgtttatgt

SEQ ID NO: 64142 - DNA, 22 bp, Artificial Sequence
  chemically synthesized
atgtatgagaatttagtgaaat

SEQ ID NO: 64143 - DNA, 22 bp, Artificial Sequence
  chemically synthesized
tgtatgagaatttagtgaaata

SEQ ID NO: 64144 - DNA, 22 bp, Artificial Sequence
  chemically synthesized
agtgaaataagtctcaacacca

SEQ ID NO: 64145 - DNA, 22 bp, Artificial Sequence
  chemically synthesized
gtgaaataagtctcaacaccaa

SEQ ID NO: 64146 - DNA, 22 bp, Artificial Sequence
  chemically synthesized
aacaccaaaccttacatcaaaa

SEQ ID NO: 64147 - DNA, 22 bp, Artificial Sequence
  chemically synthesized
acatcaaaaggatctgagaggg

SEQ ID NO: 64148 - DNA, 22 bp, Artificial Sequence
  chemically synthesized
catcaaaaggatctgagagggc

SEQ ID NO: 64149 - DNA, 22 bp, Artificial Sequence
  chemically synthesized
agagggcaactcttttgaggga

SEQ ID NO: 64150 - DNA, 22 bp, Artificial Sequence
  chemically synthesized
ttttgagggaggggttggcagg

SEQ ID NO: 64151 - DNA, 22 bp, Artificial Sequence
  chemically synthesized
ttgagggaggggttggcaggtg

SEQ ID NO: 64152 - DNA, 22 bp, Artificial Sequence
  chemically synthesized
tgagggaggggttggcaggtgt

SEQ ID NO: 64153 - DNA, 22 bp, Artificial Sequence
  chemically synthesized
gagggaggggttggcaggtgtt

SEQ ID NO: 64154 - DNA, 22 bp, Artificial Sequence
  chemically synthesized
agggaggggttggcaggtgttg

SEQ ID NO: 64155 - DNA, 22 bp, Artificial Sequence
  chemically synthesized
gcaggtgttgcaaattcaaagg

SEQ ID NO: 64156 - DNA, 22 bp, Artificial Sequence
  chemically synthesized
caaattcaaaggcttcaggtga

SEQ ID NO: 64157 - DNA, 22 bp, Artificial Sequence
  chemically synthesized
aaaggcttcaggtgataggcca

SEQ ID NO: 64158 - DNA, 22 bp, Artificial Sequence
  chemically synthesized
caggtgataggccagtgaggaa

SEQ ID NO: 64159 - DNA, 22 bp, Artificial Sequence
  chemically synthesized
aggtgataggccagtgaggaat

SEQ ID NO: 64160 - DNA, 22 bp, Artificial Sequence
  chemically synthesized
catacccggggctgagacaata

SEQ ID NO: 64161 - DNA, 22 bp, Artificial Sequence
  chemically synthesized
atacccggggctgagacaatag

SEQ ID NO: 64162 - DNA, 22 bp, Artificial Sequence
  chemically synthesized
agacaatagggagtggtggggc

SEQ ID NO: 64163 - DNA, 22 bp, Artificial Sequence
  chemically synthesized
tggctgaaccagcgagagcagg

SEQ ID NO: 64164 - DNA, 22 bp, Artificial Sequence
  chemically synthesized
aaccagcgagagcaggctctgc

SEQ ID NO: 64165 - DNA, 22 bp, Artificial Sequence
  chemically synthesized
tgccgagcaatggtcaaagtca

SEQ ID NO: 64166 - DNA, 22 bp, Artificial Sequence
  chemically synthesized
ccgagcaatggtcaaagtcaac

SEQ ID NO: 64167 - DNA, 22 bp, Artificial Sequence
  chemically synthesized
ccctgccccacagtgatccttc

SEQ ID NO: 64168 - DNA, 22 bp, Artificial Sequence
  chemically synthesized
ccccacagtgatccttctactc

SEQ ID NO: 64169 - DNA, 22 bp, Artificial Sequence
  chemically synthesized
ctactccagatatgcccaggct

SEQ ID NO: 64170 - DNA, 22 bp, Artificial Sequence
  chemically synthesized
tactccagatatgcccaggctt

SEQ ID NO: 64171 - DNA, 22 bp, Artificial Sequence
  chemically synthesized
ctccagatatgcccaggcttcg

SEQ ID NO: 64172 - DNA, 22 bp, Artificial Sequence
  chemically synthesized
cagatatgcccaggcttcggac

SEQ ID NO: 64173 - DNA, 22 bp, Artificial Sequence
  chemically synthesized
cggaccaccagcctgcagcccc

SEQ ID NO: 64174 - DNA, 22 bp, Artificial Sequence
  chemically synthesized
ggaccaccagcctgcagccccc

SEQ ID NO: 64175 - DNA, 22 bp, Artificial Sequence
  chemically synthesized
cagccccctaggtagaacctgc

SEQ ID NO: 64176 - DNA, 22 bp, Artificial Sequence
  chemically synthesized
ggtagaacctgccgtcttcaca

SEQ ID NO: 64177 - DNA, 22 bp, Artificial Sequence
  chemically synthesized
ccgtcttcacagatgggaaaac

SEQ ID NO: 64178 - DNA, 22 bp, Artificial Sequence
  chemically synthesized
cacagatgggaaaactgaggtc

SEQ ID NO: 64179 - DNA, 22 bp, Artificial Sequence
  chemically synthesized
acagatgggaaaactgaggtcc

SEQ ID NO: 64180 - DNA, 22 bp, Artificial Sequence
  chemically synthesized
aggtcctagctgaggagaatat

SEQ ID NO: 64181 - DNA, 22 bp, Artificial Sequence
  chemically synthesized
gctgaggagaatatgcccggca

SEQ ID NO: 64182 - DNA, 22 bp, Artificial Sequence
  chemically synthesized
aggagaatatgcccggcagcca

SEQ ID NO: 64183 - DNA, 22 bp, Artificial Sequence
  chemically synthesized
ttaactactagtcacaaaacca

SEQ ID NO: 64184 - DNA, 22 bp, Artificial Sequence
  chemically synthesized
actactagtcacaaaaccaaaa

SEQ ID NO: 64185 - DNA, 22 bp, Artificial Sequence
  chemically synthesized
ctagtcacaaaaccaaaaccat

SEQ ID NO: 64186 - DNA, 22 bp, Artificial Sequence
  chemically synthesized
gtcacaaaaccaaaaccatcat

SEQ ID NO: 64187 - DNA, 22 bp, Artificial Sequence
  chemically synthesized
aacaaaatacaaagaaaaaggt

SEQ ID NO: 64188 - DNA, 22 bp, Artificial Sequence
  chemically synthesized
acaaaatacaaagaaaaaggtg

SEQ ID NO: 64189 - DNA, 22 bp, Artificial Sequence
  chemically synthesized
gaatttgggaaatgaaaaactg

SEQ ID NO: 64190 - DNA, 22 bp, Artificial Sequence
  chemically synthesized
aatttgggaaatgaaaaactgg

SEQ ID NO: 64191 - DNA, 22 bp, Artificial Sequence
  chemically synthesized
gggaaatgaaaaactggagaaa

SEQ ID NO: 64192 - DNA, 22 bp, Artificial Sequence
  chemically synthesized
ggaaatgaaaaactggagaaaa

SEQ ID NO: 64193 - DNA, 22 bp, Artificial Sequence
  chemically synthesized
gagaaaaaaagctggaaataac

SEQ ID NO: 64194 - DNA, 22 bp, Artificial Sequence
  chemically synthesized
gaaataacaaatattgagattc

SEQ ID NO: 64195 - DNA, 22 bp, Artificial Sequence
  chemically synthesized
agattcttcaacccccttggac

SEQ ID NO: 64196 - DNA, 22 bp, Artificial Sequence
  chemically synthesized
ttcaacccccttggacttttaa

SEQ ID NO: 64197 - DNA, 22 bp, Artificial Sequence
  chemically synthesized
caacccccttggacttttaaaa

SEQ ID NO: 64198 - DNA, 22 bp, Artificial Sequence
  chemically synthesized
aacccccttggacttttaaaag

SEQ ID NO: 64199 - DNA, 22 bp, Artificial Sequence
  chemically synthesized
ggacttttaaaagtttccttcc

SEQ ID NO: 64200 - DNA, 22 bp, Artificial Sequence
  chemically synthesized
gacttttaaaagtttccttcca

SEQ ID NO: 64201 - DNA, 22 bp, Artificial Sequence
  chemically synthesized
ttaaaagtttccttccaataaa

SEQ ID NO: 64202 - DNA, 22 bp, Artificial Sequence
  chemically synthesized
taaaagtttccttccaataaag

SEQ ID NO: 64203 - DNA, 22 bp, Artificial Sequence
  chemically synthesized
aaaagtttccttccaataaagc

SEQ ID NO: 64204 - DNA, 22 bp, Artificial Sequence
  chemically synthesized
aaagtttccttccaataaagca

SEQ ID NO: 64205 - DNA, 22 bp, Artificial Sequence
  chemically synthesized
ccttccaataaagcaacaaatg

SEQ ID NO: 64206 - DNA, 22 bp, Artificial Sequence
  chemically synthesized
cttccaataaagcaacaaatga

SEQ ID NO: 64207 - DNA, 22 bp, Artificial Sequence
  chemically synthesized
ccaataaagcaacaaatgaagt

SEQ ID NO: 64208 - DNA, 22 bp, Artificial Sequence
  chemically synthesized
caataaagcaacaaatgaagtg

SEQ ID NO: 64209 - DNA, 22 bp, Artificial Sequence
  chemically synthesized
gtttctctccaccacctttctc

SEQ ID NO: 64210 - DNA, 22 bp, Artificial Sequence
  chemically synthesized
ctctccaccacctttctcctgg

SEQ ID NO: 64211 - DNA, 22 bp, Artificial Sequence
  chemically synthesized
tctccaccacctttctcctggc

SEQ ID NO: 64212 - DNA, 22 bp, Artificial Sequence
  chemically synthesized
tccaccacctttctcctggccc

SEQ ID NO: 64213 - DNA, 22 bp, Artificial Sequence
  chemically synthesized
caccacctttctcctggccctc

SEQ ID NO: 64214 - DNA, 22 bp, Artificial Sequence
  chemically synthesized
tctcctggccctcgtgcctcta

SEQ ID NO: 64215 - DNA, 22 bp, Artificial Sequence
  chemically synthesized
ctcctggccctcgtgcctctaa

SEQ ID NO: 64216 - DNA, 22 bp, Artificial Sequence
  chemically synthesized
tcctggccctcgtgcctctaag

SEQ ID NO: 64217 - DNA, 22 bp, Artificial Sequence
  chemically synthesized
ctggccctcgtgcctctaagta

SEQ ID NO: 64218 - DNA, 22 bp, Artificial Sequence
  chemically synthesized
gccctcgtgcctctaagtaatc

SEQ ID NO: 64219 - DNA, 22 bp, Artificial Sequence
  chemically synthesized
gtgcctctaagtaatccaaatg

SEQ ID NO: 64220 - DNA, 22 bp, Artificial Sequence
  chemically synthesized
taagtaatccaaatggaacaga

SEQ ID NO: 64221 - DNA, 22 bp, Artificial Sequence
  chemically synthesized
agtaatccaaatggaacagacc

SEQ ID NO: 64222 - DNA, 22 bp, Artificial Sequence
  chemically synthesized
cataatacatgtttgtattttt

SEQ ID NO: 64223 - DNA, 22 bp, Artificial Sequence
  chemically synthesized
gtatttttcttcagctagctag

SEQ ID NO: 64224 - DNA, 22 bp, Artificial Sequence
  chemically synthesized
tatttttcttcagctagctagt

SEQ ID NO: 64225 - DNA, 22 bp, Artificial Sequence
  chemically synthesized
ttcttcagctagctagtgttgt

SEQ ID NO: 64226 - DNA, 22 bp, Artificial Sequence
  chemically synthesized
tcttcagctagctagtgttgtt

SEQ ID NO: 64227 - DNA, 22 bp, Artificial Sequence
  chemically synthesized
cttcagctagctagtgttgtta

SEQ ID NO: 64228 - DNA, 22 bp, Artificial Sequence
  chemically synthesized
ttcagctagctagtgttgttag

SEQ ID NO: 64229 - DNA, 22 bp, Artificial Sequence
  chemically synthesized
cagctagctagtgttgttagaa

SEQ ID NO: 64230 - DNA, 22 bp, Artificial Sequence
  chemically synthesized
agctagctagtgttgttagaac

SEQ ID NO: 64231 - DNA, 22 bp, Artificial Sequence
  chemically synthesized
gctagtgttgttagaactaaag

SEQ ID NO: 64232 - DNA, 22 bp, Artificial Sequence
  chemically synthesized
gtgttgttagaactaaagacgg

SEQ ID NO: 64233 - DNA, 22 bp, Artificial Sequence
  chemically synthesized
ttagaactaaagacggtgctaa

SEQ ID NO: 64234 - DNA, 22 bp, Artificial Sequence
  chemically synthesized
gaactaaagacggtgctaaaat

SEQ ID NO: 64235 - DNA, 22 bp, Artificial Sequence
  chemically synthesized
aagacggtgctaaaattagtgc

SEQ ID NO: 64236 - DNA, 22 bp, Artificial Sequence
  chemically synthesized
aaattagtgctgtatatttcca

SEQ ID NO: 64237 - DNA, 22 bp, Artificial Sequence
  chemically synthesized
gtgctgtatatttccatctccc

SEQ ID NO: 64238 - DNA, 22 bp, Artificial Sequence
  chemically synthesized
tatatttccatctccctttaat

SEQ ID NO: 64239 - DNA, 22 bp, Artificial Sequence
  chemically synthesized
ccatctccctttaatttctctt

SEQ ID NO: 64240 - DNA, 22 bp, Artificial Sequence
  chemically synthesized
catctccctttaatttctcttt

SEQ ID NO: 64241 - DNA, 22 bp, Artificial Sequence
  chemically synthesized
cctttaatttctctttcacttc

SEQ ID NO: 64242 - DNA, 22 bp, Artificial Sequence
  chemically synthesized
taatttctctttcacttcccaa

SEQ ID NO: 64243 - DNA, 22 bp, Artificial Sequence
  chemically synthesized
aatttctctttcacttcccaac

SEQ ID NO: 64244 - DNA, 22 bp, Artificial Sequence
  chemically synthesized
atttctctttcacttcccaact

SEQ ID NO: 64245 - DNA, 22 bp, Artificial Sequence
  chemically synthesized
ctctttcacttcccaactgaac

SEQ ID NO: 64246 - DNA, 22 bp, Artificial Sequence
  chemically synthesized
tctttcacttcccaactgaact

SEQ ID NO: 64247 - DNA, 22 bp, Artificial Sequence
  chemically synthesized
tttcacttcccaactgaacttt

SEQ ID NO: 64248 - DNA, 22 bp, Artificial Sequence
  chemically synthesized
tcacttcccaactgaactttgt

SEQ ID NO: 64249 - DNA, 22 bp, Artificial Sequence
  chemically synthesized
cacttcccaactgaactttgtg

SEQ ID NO: 64250 - DNA, 22 bp, Artificial Sequence
  chemically synthesized
acttcccaactgaactttgtgc

SEQ ID NO: 64251 - DNA, 22 bp, Artificial Sequence
  chemically synthesized
cccaactgaactttgtgcagtc

SEQ ID NO: 64252 - DNA, 22 bp, Artificial Sequence
  chemically synthesized
ccaactgaactttgtgcagtcc

SEQ ID NO: 64253 - DNA, 22 bp, Artificial Sequence
  chemically synthesized
aactttgtgcagtccttcatgg

SEQ ID NO: 64254 - DNA, 22 bp, Artificial Sequence
  chemically synthesized
tgtgcagtccttcatggcttat

SEQ ID NO: 64255 - DNA, 22 bp, Artificial Sequence
  chemically synthesized
gtgcagtccttcatggcttatg

SEQ ID NO: 64256 - DNA, 22 bp, Artificial Sequence
  chemically synthesized
tgcagtccttcatggcttatgg

SEQ ID NO: 64257 - DNA, 22 bp, Artificial Sequence
  chemically synthesized
catggcttatggaaattccccc

SEQ ID NO: 64258 - DNA, 22 bp, Artificial Sequence
  chemically synthesized
atggcttatggaaattccccca

SEQ ID NO: 64259 - DNA, 22 bp, Artificial Sequence
  chemically synthesized
atggaaattcccccatcattac

SEQ ID NO: 64260 - DNA, 22 bp, Artificial Sequence
  chemically synthesized
tggaaattcccccatcattaca

SEQ ID NO: 64261 - DNA, 22 bp, Artificial Sequence
  chemically synthesized
ccccatcattacagggctcagt

SEQ ID NO: 64262 - DNA, 22 bp, Artificial Sequence
  chemically synthesized
cagggctcagtggtcaggaggg

SEQ ID NO: 64263 - DNA, 22 bp, Artificial Sequence
  chemically synthesized
agtggtcaggagggagttgggc

SEQ ID NO: 64264 - DNA, 22 bp, Artificial Sequence
  chemically synthesized
ggcctctgcagggtggggacac

SEQ ID NO: 64265 - DNA, 22 bp, Artificial Sequence
  chemically synthesized
tgcagggtggggacactaaata

SEQ ID NO: 64266 - DNA, 22 bp, Artificial Sequence
  chemically synthesized
cagggtggggacactaaatatg

SEQ ID NO: 64267 - DNA, 22 bp, Artificial Sequence
  chemically synthesized
aatatgctgagtggcctcaggg

SEQ ID NO: 64268 - DNA, 22 bp, Artificial Sequence
  chemically synthesized
agtggcctcagggccagaggtt

SEQ ID NO: 64269 - DNA, 22 bp, Artificial Sequence
  chemically synthesized
agggccagaggttgtggcttct

SEQ ID NO: 64270 - DNA, 22 bp, Artificial Sequence
  chemically synthesized
tggcttctagccctggcagggc

SEQ ID NO: 64271 - DNA, 22 bp, Artificial Sequence
  chemically synthesized
ctagccctggcagggccatcac

SEQ ID NO: 64272 - DNA, 22 bp, Artificial Sequence
  chemically synthesized
tagccctggcagggccatcact

SEQ ID NO: 64273 - DNA, 22 bp, Artificial Sequence
  chemically synthesized
gccctggcagggccatcactat

SEQ ID NO: 64274 - DNA, 22 bp, Artificial Sequence
  chemically synthesized
gcagggccatcactatccactt

SEQ ID NO: 64275 - DNA, 22 bp, Artificial Sequence
  chemically synthesized
tccacttggcctttagcaagaa

SEQ ID NO: 64276 - DNA, 22 bp, Artificial Sequence
  chemically synthesized
ggcctttagcaagaatcctctg

SEQ ID NO: 64277 - DNA, 22 bp, Artificial Sequence
  chemically synthesized
gcctttagcaagaatcctctgg

SEQ ID NO: 64278 - DNA, 22 bp, Artificial Sequence
  chemically synthesized
tagcaagaatcctctggtcctg

SEQ ID NO: 64279 - DNA, 22 bp, Artificial Sequence
  chemically synthesized
agcaagaatcctctggtcctgg

SEQ ID NO: 64280 - DNA, 22 bp, Artificial Sequence
  chemically synthesized
gcaagaatcctctggtcctggg

SEQ ID NO: 64281 - DNA, 22 bp, Artificial Sequence
  chemically synthesized
tggtcctggggcctcactctcc

SEQ ID NO: 64282 - DNA, 22 bp, Artificial Sequence
  chemically synthesized
gtcctggggcctcactctcccc

SEQ ID NO: 64283 - DNA, 22 bp, Artificial Sequence
  chemically synthesized
gggcctcactctccccagttgt

SEQ ID NO: 64284 - DNA, 22 bp, Artificial Sequence
  chemically synthesized
actctccccagttgtgcaaagt

SEQ ID NO: 64285 - DNA, 22 bp, Artificial Sequence
  chemically synthesized
tccccagttgtgcaaagtgggg

SEQ ID NO: 64286 - DNA, 22 bp, Artificial Sequence
  chemically synthesized
cccagttgtgcaaagtggggct

SEQ ID NO: 64287 - DNA, 22 bp, Artificial Sequence
  chemically synthesized
tgcaaagtggggctgggagaag

SEQ ID NO: 64288 - DNA, 22 bp, Artificial Sequence
  chemically synthesized
ggagaagacttcactggggccc

SEQ ID NO: 64289 - DNA, 22 bp, Artificial Sequence
  chemically synthesized
cactggggccctctgtacacta

SEQ ID NO: 64290 - DNA, 22 bp, Artificial Sequence
  chemically synthesized
actggggccctctgtacactaa

SEQ ID NO: 64291 - DNA, 22 bp, Artificial Sequence
  chemically synthesized
gggccctctgtacactaacata

SEQ ID NO: 64292 - DNA, 22 bp, Artificial Sequence
  chemically synthesized
tgtacactaacataggtttttg

SEQ ID NO: 64293 - DNA, 22 bp, Artificial Sequence
  chemically synthesized
tacactaacataggtttttggg

SEQ ID NO: 64294 - DNA, 22 bp, Artificial Sequence
  chemically synthesized
acataggtttttgggttttttt

SEQ ID NO: 64295 - DNA, 22 bp, Artificial Sequence
  chemically synthesized
ttgggttttttttgagacagag

SEQ ID NO: 64296 - DNA, 22 bp, Artificial Sequence
  chemically synthesized
tgggttttttttgagacagagt

SEQ ID NO: 64297 - DNA, 22 bp, Artificial Sequence
  chemically synthesized
gggttttttttgagacagagtc

SEQ ID NO: 64298 - DNA, 22 bp, Artificial Sequence
  chemically synthesized
ggttttttttgagacagagtct

SEQ ID NO: 64299 - DNA, 22 bp, Artificial Sequence
  chemically synthesized
tttttgagacagagtctcgctt

SEQ ID NO: 64300 - DNA, 22 bp, Artificial Sequence
  chemically synthesized
ttttgagacagagtctcgcttt

SEQ ID NO: 64301 - DNA, 22 bp, Artificial Sequence
  chemically synthesized
tttgagacagagtctcgcttta

SEQ ID NO: 64302 - DNA, 22 bp, Artificial Sequence
  chemically synthesized
ttgagacagagtctcgctttat

SEQ ID NO: 64303 - DNA, 22 bp, Artificial Sequence
  chemically synthesized
tgagacagagtctcgctttatc

SEQ ID NO: 64304 - DNA, 22 bp, Artificial Sequence
  chemically synthesized
gagacagagtctcgctttatct

SEQ ID NO: 64305 - DNA, 22 bp, Artificial Sequence
  chemically synthesized
agacagagtctcgctttatctg

SEQ ID NO: 64306 - DNA, 22 bp, Artificial Sequence
  chemically synthesized
gctttatctgccagggtggagt

SEQ ID NO: 64307 - DNA, 22 bp, Artificial Sequence
  chemically synthesized
tatctgccagggtggagtgcag

SEQ ID NO: 64308 - DNA, 22 bp, Artificial Sequence
  chemically synthesized
atctgccagggtggagtgcagt

SEQ ID NO: 64309 - DNA, 22 bp, Artificial Sequence
  chemically synthesized
tctgccagggtggagtgcagtg

SEQ ID NO: 64310 - DNA, 22 bp, Artificial Sequence
  chemically synthesized
ccagggtggagtgcagtggcgt

SEQ ID NO: 64311 - DNA, 22 bp, Artificial Sequence
  chemically synthesized
ggctcactgaaacctccacctc

SEQ ID NO: 64312 - DNA, 22 bp, Artificial Sequence
  chemically synthesized
actgaaacctccacctcccggg

SEQ ID NO: 64313 - DNA, 22 bp, Artificial Sequence
  chemically synthesized
aaacctccacctcccgggttca

SEQ ID NO: 64314 - DNA, 22 bp, Artificial Sequence
  chemically synthesized
cacctcccgggttcaagaaatt

SEQ ID NO: 64315 - DNA, 22 bp, Artificial Sequence
  chemically synthesized
ccgggttcaagaaattcttctg

SEQ ID NO: 64316 - DNA, 22 bp, Artificial Sequence
  chemically synthesized
aagaaattcttctgtctcagct

SEQ ID NO: 64317 - DNA, 22 bp, Artificial Sequence
  chemically synthesized
ttctgtctcagcttcccaaata

SEQ ID NO: 64318 - DNA, 22 bp, Artificial Sequence
  chemically synthesized
ctgtctcagcttcccaaatagc

SEQ ID NO: 64319 - DNA, 22 bp, Artificial Sequence
  chemically synthesized
tgtctcagcttcccaaatagct

SEQ ID NO: 64320 - DNA, 22 bp, Artificial Sequence
  chemically synthesized
tctcagcttcccaaatagctgg

SEQ ID NO: 64321 - DNA, 22 bp, Artificial Sequence
  chemically synthesized
agcttcccaaatagctgggatt

SEQ ID NO: 64322 - DNA, 22 bp, Artificial Sequence
  chemically synthesized
cccaaatagctgggattacagg

SEQ ID NO: 64323 - DNA, 22 bp, Artificial Sequence
  chemically synthesized
ccaaatagctgggattacaggc

SEQ ID NO: 64324 - DNA, 22 bp, Artificial Sequence
  chemically synthesized
ggattacaggcgtgtgccacca

SEQ ID NO: 64325 - DNA, 22 bp, Artificial Sequence
  chemically synthesized
caggcgtgtgccaccacgcctg

SEQ ID NO: 64326 - DNA, 22 bp, Artificial Sequence
  chemically synthesized
gctaatttttgtatttttagta

SEQ ID NO: 64327 - DNA, 22 bp, Artificial Sequence
  chemically synthesized
atttttgtatttttagtagagc

SEQ ID NO: 64328 - DNA, 22 bp, Artificial Sequence
  chemically synthesized
ttgtatttttagtagagctgag

SEQ ID NO: 64329 - DNA, 22 bp, Artificial Sequence
  chemically synthesized
tgtatttttagtagagctgagg

SEQ ID NO: 64330 - DNA, 22 bp, Artificial Sequence
  chemically synthesized
gtatttttagtagagctgaggt

SEQ ID NO: 64331 - DNA, 22 bp, Artificial Sequence
  chemically synthesized
tatttttagtagagctgaggtt

SEQ ID NO: 64332 - DNA, 22 bp, Artificial Sequence
  chemically synthesized
ttagtagagctgaggtttcacc

SEQ ID NO: 64333 - DNA, 22 bp, Artificial Sequence
  chemically synthesized
tagtagagctgaggtttcaccg

SEQ ID NO: 64334 - DNA, 22 bp, Artificial Sequence
  chemically synthesized
agtagagctgaggtttcaccgt

SEQ ID NO: 64335 - DNA, 22 bp, Artificial Sequence
  chemically synthesized
gtagagctgaggtttcaccgtg

SEQ ID NO: 64336 - DNA, 22 bp, Artificial Sequence
  chemically synthesized
aggtttcaccgtgttggccagg

SEQ ID NO: 64337 - DNA, 22 bp, Artificial Sequence
  chemically synthesized
caccgtgttggccaggcaggtc

SEQ ID NO: 64338 - DNA, 22 bp, Artificial Sequence
  chemically synthesized
accgtgttggccaggcaggtct

SEQ ID NO: 64339 - DNA, 22 bp, Artificial Sequence
  chemically synthesized
gccaggcaggtcttgaactcct

SEQ ID NO: 64340 - DNA, 22 bp, Artificial Sequence
  chemically synthesized
gaactcctgacctcttgatccg

SEQ ID NO: 64341 - DNA, 22 bp, Artificial Sequence
  chemically synthesized
aactcctgacctcttgatccgc

SEQ ID NO: 64342 - DNA, 22 bp, Artificial Sequence
  chemically synthesized
ctgacctcttgatccgcctgcc

SEQ ID NO: 64343 - DNA, 22 bp, Artificial Sequence
  chemically synthesized
acctcttgatccgcctgccttg

SEQ ID NO: 64344 - DNA, 22 bp, Artificial Sequence
  chemically synthesized
ttgatccgcctgccttggcctc

SEQ ID NO: 64345 - DNA, 22 bp, Artificial Sequence
  chemically synthesized
gatccgcctgccttggcctccc

SEQ ID NO: 64346 - DNA, 22 bp, Artificial Sequence
  chemically synthesized
atccgcctgccttggcctccca

SEQ ID NO: 64347 - DNA, 22 bp, Artificial Sequence
  chemically synthesized
ccttggcctcccaaagtgctgg

SEQ ID NO: 64348 - DNA, 22 bp, Artificial Sequence
  chemically synthesized
ggcctcccaaagtgctggggtt

SEQ ID NO: 64349 - DNA, 22 bp, Artificial Sequence
  chemically synthesized
gcctcccaaagtgctggggtta

SEQ ID NO: 64350 - DNA, 22 bp, Artificial Sequence
  chemically synthesized
ccaaagtgctggggttacaggc

SEQ ID NO: 64351 - DNA, 22 bp, Artificial Sequence
  chemically synthesized
gggttacaggcgagagcccctg

SEQ ID NO: 64352 - DNA, 22 bp, Artificial Sequence
  chemically synthesized
caggcgagagcccctgcaccca

SEQ ID NO: 64353 - DNA, 22 bp, Artificial Sequence
  chemically synthesized
cacccagccaggattcttggtt

SEQ ID NO: 64354 - DNA, 22 bp, Artificial Sequence
  chemically synthesized
ttggttagaatggcatctgggt

SEQ ID NO: 64355 - DNA, 22 bp, Artificial Sequence
  chemically synthesized
ggttagaatggcatctgggttc

SEQ ID NO: 64356 - DNA, 22 bp, Artificial Sequence
  chemically synthesized
gttagaatggcatctgggttca

SEQ ID NO: 64357 - DNA, 22 bp, Artificial Sequence
  chemically synthesized
gaatggcatctgggttcaatgt

SEQ ID NO: 64358 - DNA, 22 bp, Artificial Sequence
  chemically synthesized
ggttcaatgtagcaaaacagat

SEQ ID NO: 64359 - DNA, 22 bp, Artificial Sequence
  chemically synthesized
aatgtagcaaaacagatggaga

SEQ ID NO: 64360 - DNA, 22 bp, Artificial Sequence
  chemically synthesized
ccatggctaggcatgagacagg

SEQ ID NO: 64361 - DNA, 22 bp, Artificial Sequence
  chemically synthesized
ggcatgagacaggtgccctcct

SEQ ID NO: 64362 - DNA, 22 bp, Artificial Sequence
  chemically synthesized
ctagacaggggaattctgggct

SEQ ID NO: 64363 - DNA, 22 bp, Artificial Sequence
  chemically synthesized
gacaggggaattctgggctcaa

SEQ ID NO: 64364 - DNA, 22 bp, Artificial Sequence
  chemically synthesized
tgggctcaaaggaggtggagag

SEQ ID NO: 64365 - DNA, 22 bp, Artificial Sequence
  chemically synthesized
ggctcaaaggaggtggagaggc

SEQ ID NO: 64366 - DNA, 22 bp, Artificial Sequence
  chemically synthesized
aaaggaggtggagaggctggtg

SEQ ID NO: 64367 - DNA, 22 bp, Artificial Sequence
  chemically synthesized
gtgcagggagggtggcgagggg

SEQ ID NO: 64368 - DNA, 22 bp, Artificial Sequence
  chemically synthesized
ggaggagcacattcccccacac

SEQ ID NO: 64369 - DNA, 22 bp, Artificial Sequence
  chemically synthesized
ccccacacccatccatctttcc

SEQ ID NO: 64370 - DNA, 22 bp, Artificial Sequence
  chemically synthesized
tcctggtgtcacatcacctact

SEQ ID NO: 64371 - DNA, 22 bp, Artificial Sequence
  chemically synthesized
cctggtgtcacatcacctactc

SEQ ID NO: 64372 - DNA, 22 bp, Artificial Sequence
  chemically synthesized
ctggtgtcacatcacctactct

SEQ ID NO: 64373 - DNA, 22 bp, Artificial Sequence
  chemically synthesized
gtgtcacatcacctactctggt

SEQ ID NO: 64374 - DNA, 22 bp, Artificial Sequence
  chemically synthesized
ctctggtttcctcctttcacag

SEQ ID NO: 64375 - DNA, 22 bp, Artificial Sequence
  chemically synthesized
tggtttcctcctttcacagtga

SEQ ID NO: 64376 - DNA, 22 bp, Artificial Sequence
  chemically synthesized
gtttcctcctttcacagtgaag

SEQ ID NO: 64377 - DNA, 22 bp, Artificial Sequence
  chemically synthesized
cctcctttcacagtgaagagtt

SEQ ID NO: 64378 - DNA, 22 bp, Artificial Sequence
  chemically synthesized
ctcctttcacagtgaagagttt

SEQ ID NO: 64379 - DNA, 22 bp, Artificial Sequence
  chemically synthesized
ctttcacagtgaagagtttgaa

SEQ ID NO: 64380 - DNA, 22 bp, Artificial Sequence
  chemically synthesized
tcacagtgaagagtttgaagcc

SEQ ID NO: 64381 - DNA, 22 bp, Artificial Sequence
  chemically synthesized
cacagtgaagagtttgaagccc

SEQ ID NO: 64382 - DNA, 22 bp, Artificial Sequence
  chemically synthesized
acagtgaagagtttgaagccca

SEQ ID NO: 64383 - DNA, 22 bp, Artificial Sequence
  chemically synthesized
gaagcccagagagggtcagggc

SEQ ID NO: 64384 - DNA, 22 bp, Artificial Sequence
  chemically synthesized
aagcccagagagggtcagggcc

SEQ ID NO: 64385 - DNA, 22 bp, Artificial Sequence
  chemically synthesized
gttgaggctatacagcaagtca

SEQ ID NO: 64386 - DNA, 22 bp, Artificial Sequence
  chemically synthesized
ttgaggctatacagcaagtcag

SEQ ID NO: 64387 - DNA, 22 bp, Artificial Sequence
  chemically synthesized
aggctatacagcaagtcagtga

SEQ ID NO: 64388 - DNA, 22 bp, Artificial Sequence
  chemically synthesized
tacagcaagtcagtgacaaagc

SEQ ID NO: 64389 - DNA, 22 bp, Artificial Sequence
  chemically synthesized
gaacaagtcttggctttcccag

SEQ ID NO: 64390 - DNA, 22 bp, Artificial Sequence
  chemically synthesized
ggctttcccagcactcagatca

SEQ ID NO: 64391 - DNA, 22 bp, Artificial Sequence
  chemically synthesized
gctttcccagcactcagatcat

SEQ ID NO: 64392 - DNA, 22 bp, Artificial Sequence
  chemically synthesized
tcccagcactcagatcatgaac

SEQ ID NO: 64393 - DNA, 22 bp, Artificial Sequence
  chemically synthesized
cccagcactcagatcatgaact

SEQ ID NO: 64394 - DNA, 22 bp, Artificial Sequence
  chemically synthesized
ccagcactcagatcatgaactg

SEQ ID NO: 64395 - DNA, 22 bp, Artificial Sequence
  chemically synthesized
agatcatgaactgagacagctg

SEQ ID NO: 64396 - DNA, 22 bp, Artificial Sequence
  chemically synthesized
agacagctgtgtcctcagatct

SEQ ID NO: 64397 - DNA, 22 bp, Artificial Sequence
  chemically synthesized
tgtcctcagatctcagatgatg

SEQ ID NO: 64398 - DNA, 22 bp, Artificial Sequence
  chemically synthesized
agatctcagatgatgaatgtca

SEQ ID NO: 64399 - DNA, 22 bp, Artificial Sequence
  chemically synthesized
agatgatgaatgtcagaattgg

SEQ ID NO: 64400 - DNA, 22 bp, Artificial Sequence
  chemically synthesized
ggctgtgacattggtctcaagc

SEQ ID NO: 64401 - DNA, 22 bp, Artificial Sequence
  chemically synthesized
tgacattggtctcaagcatcat

SEQ ID NO: 64402 - DNA, 22 bp, Artificial Sequence
  chemically synthesized
gtctcaagcatcatgttgggtt

SEQ ID NO: 64403 - DNA, 22 bp, Artificial Sequence
  chemically synthesized
aagcatcatgttgggttcatta

SEQ ID NO: 64404 - DNA, 22 bp, Artificial Sequence
  chemically synthesized
ggttcattatgcctcccaagct

SEQ ID NO: 64405 - DNA, 22 bp, Artificial Sequence
  chemically synthesized
attatgcctcccaagctgttcc

SEQ ID NO: 64406 - DNA, 22 bp, Artificial Sequence
  chemically synthesized
tgcctcccaagctgttccttat

SEQ ID NO: 64407 - DNA, 22 bp, Artificial Sequence
  chemically synthesized
ccaagctgttccttataacatc

SEQ ID NO: 64408 - DNA, 22 bp, Artificial Sequence
  chemically synthesized
ttccttataacatcaggactcc

SEQ ID NO: 64409 - DNA, 22 bp, Artificial Sequence
  chemically synthesized
cttataacatcaggactccaaa

SEQ ID NO: 64410 - DNA, 22 bp, Artificial Sequence
  chemically synthesized
ataacatcaggactccaaaacc

SEQ ID NO: 64411 - DNA, 22 bp, Artificial Sequence
  chemically synthesized
taacatcaggactccaaaacct

SEQ ID NO: 64412 - DNA, 22 bp, Artificial Sequence
  chemically synthesized
caaaacctgctctctcctggcc

SEQ ID NO: 64413 - DNA, 22 bp, Artificial Sequence
  chemically synthesized
ctctctcctggcccttctatca

SEQ ID NO: 64414 - DNA, 22 bp, Artificial Sequence
  chemically synthesized
tctcctggcccttctatcagag

SEQ ID NO: 64415 - DNA, 22 bp, Artificial Sequence
  chemically synthesized
tcctggcccttctatcagaggc

SEQ ID NO: 64416 - DNA, 22 bp, Artificial Sequence
  chemically synthesized
ctggcccttctatcagaggcag

SEQ ID NO: 64417 - DNA, 22 bp, Artificial Sequence
  chemically synthesized
gcccttctatcagaggcagcac

SEQ ID NO: 64418 - DNA, 22 bp, Artificial Sequence
  chemically synthesized
ctatcagaggcagcaccctgca

SEQ ID NO: 64419 - DNA, 22 bp, Artificial Sequence
  chemically synthesized
tatcagaggcagcaccctgcac

SEQ ID NO: 64420 - DNA, 22 bp, Artificial Sequence
  chemically synthesized
tcagaggcagcaccctgcactc

SEQ ID NO: 64421 - DNA, 22 bp, Artificial Sequence
  chemically synthesized
cactcctaaaagctagtgcctg

SEQ ID NO: 64422 - DNA, 22 bp, Artificial Sequence
  chemically synthesized
ctaaaagctagtgcctgggagg

SEQ ID NO: 64423 - DNA, 22 bp, Artificial Sequence
  chemically synthesized
aaagctagtgcctgggagggcg

SEQ ID NO: 64424 - DNA, 22 bp, Artificial Sequence
  chemically synthesized
gtgcctgggagggcgactggag

SEQ ID NO: 64425 - DNA, 22 bp, Artificial Sequence
  chemically synthesized
ggagggcgactggagaggagaa

SEQ ID NO: 64426 - DNA, 22 bp, Artificial Sequence
  chemically synthesized
gagaggagaaagtcgccatctg

SEQ ID NO: 64427 - DNA, 22 bp, Artificial Sequence
  chemically synthesized
gccaagtaccccatggtgtacg

SEQ ID NO: 64428 - DNA, 22 bp, Artificial Sequence
  chemically synthesized
aggccaagctttaaaccaaaag

SEQ ID NO: 64429 - DNA, 22 bp, Artificial Sequence
  chemically synthesized
taaaccaaaagaatgaaggctt

SEQ ID NO: 64430 - DNA, 22 bp, Artificial Sequence
  chemically synthesized
aaaccaaaagaatgaaggcttc

SEQ ID NO: 64431 - DNA, 22 bp, Artificial Sequence
  chemically synthesized
aaccaaaagaatgaaggcttca

SEQ ID NO: 64432 - DNA, 22 bp, Artificial Sequence
  chemically synthesized
catggtgacatttctgggatcg

SEQ ID NO: 64433 - DNA, 22 bp, Artificial Sequence
  chemically synthesized
atggtgacatttctgggatcgg

SEQ ID NO: 64434 - DNA, 22 bp, Artificial Sequence
  chemically synthesized
ctgggatcggggcaggtgggag

SEQ ID NO: 64435 - DNA, 22 bp, Artificial Sequence
  chemically synthesized
tgggatcggggcaggtgggagc

SEQ ID NO: 64436 - DNA, 22 bp, Artificial Sequence
  chemically synthesized
ggatcggggcaggtgggagcac

SEQ ID NO: 64437 - DNA, 22 bp, Artificial Sequence
  chemically synthesized
tttgcggggccagggacaggga

SEQ ID NO: 64438 - DNA, 22 bp, Artificial Sequence
  chemically synthesized
tgcggggccagggacagggaag

SEQ ID NO: 64439 - DNA, 22 bp, Artificial Sequence
  chemically synthesized
gcggggccagggacagggaagc

SEQ ID NO: 64440 - DNA, 22 bp, Artificial Sequence
  chemically synthesized
cggggccagggacagggaagcg

SEQ ID NO: 64441 - DNA, 22 bp, Artificial Sequence
  chemically synthesized
cctgcctaatctcacaccattt

SEQ ID NO: 64442 - DNA, 22 bp, Artificial Sequence
  chemically synthesized
cctaatctcacaccatttctac

SEQ ID NO: 64443 - DNA, 22 bp, Artificial Sequence
  chemically synthesized
atctcacaccatttctacccgg

SEQ ID NO: 64444 - DNA, 22 bp, Artificial Sequence
  chemically synthesized
acaccatttctacccgggagca

SEQ ID NO: 64445 - DNA, 22 bp, Artificial Sequence
  chemically synthesized
ctacccgggagcataaaataag

SEQ ID NO: 64446 - DNA, 22 bp, Artificial Sequence
  chemically synthesized
tacccgggagcataaaataagg

SEQ ID NO: 64447 - DNA, 22 bp, Artificial Sequence
  chemically synthesized
cccgggagcataaaataaggga

SEQ ID NO: 64448 - DNA, 22 bp, Artificial Sequence
  chemically synthesized
gcctatggtcaaacaacctgtt

SEQ ID NO: 64449 - DNA, 22 bp, Artificial Sequence
  chemically synthesized
tggtcaaacaacctgttgaact

SEQ ID NO: 64450 - DNA, 22 bp, Artificial Sequence
  chemically synthesized
ttgaactgggcaataaataaac

SEQ ID NO: 64451 - DNA, 22 bp, Artificial Sequence
  chemically synthesized
aactgggcaataaataaaccca

SEQ ID NO: 64452 - DNA, 22 bp, Artificial Sequence
  chemically synthesized
ggcaataaataaacccaagtgt

SEQ ID NO: 64453 - DNA, 22 bp, Artificial Sequence
  chemically synthesized
tcacttactggcagggggcctg

SEQ ID NO: 64454 - DNA, 22 bp, Artificial Sequence
  chemically synthesized
actggcagggggcctggggtaa

SEQ ID NO: 64455 - DNA, 22 bp, Artificial Sequence
  chemically synthesized
ctggcagggggcctggggtaaa

SEQ ID NO: 64456 - DNA, 22 bp, Artificial Sequence
  chemically synthesized
gcagggggcctggggtaaatga

SEQ ID NO: 64457 - DNA, 22 bp, Artificial Sequence
  chemically synthesized
gggtaaatgacttcacttcttt

SEQ ID NO: 64458 - DNA, 22 bp, Artificial Sequence
  chemically synthesized
cacttctttgagcactagcttc

SEQ ID NO: 64459 - DNA, 22 bp, Artificial Sequence
  chemically synthesized
acttctttgagcactagcttca

SEQ ID NO: 64460 - DNA, 22 bp, Artificial Sequence
  chemically synthesized
ctttgagcactagcttcatagc

SEQ ID NO: 64461 - DNA, 22 bp, Artificial Sequence
  chemically synthesized
tttgagcactagcttcatagct

SEQ ID NO: 64462 - DNA, 22 bp, Artificial Sequence
  chemically synthesized
tgagcactagcttcatagctgt

SEQ ID NO: 64463 - DNA, 22 bp, Artificial Sequence
  chemically synthesized
gagcactagcttcatagctgta

SEQ ID NO: 64464 - DNA, 22 bp, Artificial Sequence
  chemically synthesized
agcactagcttcatagctgtac

SEQ ID NO: 64465 - DNA, 22 bp, Artificial Sequence
  chemically synthesized
gcttcatagctgtacaatggag

SEQ ID NO: 64466 - DNA, 22 bp, Artificial Sequence
  chemically synthesized
catagctgtacaatggagaaaa

SEQ ID NO: 64467 - DNA, 22 bp, Artificial Sequence
  chemically synthesized
atagctgtacaatggagaaaag

SEQ ID NO: 64468 - DNA, 22 bp, Artificial Sequence
  chemically synthesized
tacaatggagaaaagaatcctt

SEQ ID NO: 64469 - DNA, 22 bp, Artificial Sequence
  chemically synthesized
tggacagggatgaggaataact

SEQ ID NO: 64470 - DNA, 22 bp, Artificial Sequence
  chemically synthesized
ggacagggatgaggaataactg

SEQ ID NO: 64471 - DNA, 22 bp, Artificial Sequence
  chemically synthesized
gacagggatgaggaataactga

SEQ ID NO: 64472 - DNA, 22 bp, Artificial Sequence
  chemically synthesized
acgtaatgcatgagtgggcacc

SEQ ID NO: 64473 - DNA, 22 bp, Artificial Sequence
  chemically synthesized
cctgtacctgcacacaggttga

SEQ ID NO: 64474 - DNA, 22 bp, Artificial Sequence
  chemically synthesized
tacctgcacacaggttgagctc

SEQ ID NO: 64475 - DNA, 22 bp, Artificial Sequence
  chemically synthesized
cacacaggttgagctcctgccc

SEQ ID NO: 64476 - DNA, 22 bp, Artificial Sequence
  chemically synthesized
agctcctgcccgagagatggta

SEQ ID NO: 64477 - DNA, 22 bp, Artificial Sequence
  chemically synthesized
ctgcccgagagatggtagattt

SEQ ID NO: 64478 - DNA, 22 bp, Artificial Sequence
  chemically synthesized
cccgagagatggtagatttctt

SEQ ID NO: 64479 - DNA, 22 bp, Artificial Sequence
  chemically synthesized
cttcccggagagcctgctgcac

SEQ ID NO: 64480 - DNA, 22 bp, Artificial Sequence
  chemically synthesized
ttcccggagagcctgctgcact

SEQ ID NO: 64481 - DNA, 22 bp, Artificial Sequence
  chemically synthesized
cccggagagcctgctgcactcc

SEQ ID NO: 64482 - DNA, 22 bp, Artificial Sequence
  chemically synthesized
ccggagagcctgctgcactccc

SEQ ID NO: 64483 - DNA, 22 bp, Artificial Sequence
  chemically synthesized
ctgcactccccaggaccatttc

SEQ ID NO: 64484 - DNA, 22 bp, Artificial Sequence
  chemically synthesized
cactccccaggaccatttcagc

SEQ ID NO: 64485 - DNA, 22 bp, Artificial Sequence
  chemically synthesized
cccaggaccatttcagcaggaa

SEQ ID NO: 64486 - DNA, 22 bp, Artificial Sequence
  chemically synthesized
cagcaggaaggggctcctgctc

SEQ ID NO: 64487 - DNA, 22 bp, Artificial Sequence
  chemically synthesized
agcaggaaggggctcctgctca

SEQ ID NO: 64488 - DNA, 22 bp, Artificial Sequence
  chemically synthesized
ctgctcagcagtgaacagcatc

SEQ ID NO: 64489 - DNA, 22 bp, Artificial Sequence
  chemically synthesized
ctcagcagtgaacagcatctga

SEQ ID NO: 64490 - DNA, 22 bp, Artificial Sequence
  chemically synthesized
agcagtgaacagcatctgagtt

SEQ ID NO: 64491 - DNA, 22 bp, Artificial Sequence
  chemically synthesized
agtttggcaaattttccattaa

SEQ ID NO: 64492 - DNA, 22 bp, Artificial Sequence
  chemically synthesized
ggcaaattttccattaaattat

SEQ ID NO: 64493 - DNA, 22 bp, Artificial Sequence
  chemically synthesized
gcaaattttccattaaattatc

SEQ ID NO: 64494 - DNA, 22 bp, Artificial Sequence
  chemically synthesized
tccattaaattatccaactgtt

SEQ ID NO: 64495 - DNA, 22 bp, Artificial Sequence
  chemically synthesized
ccattaaattatccaactgttt

SEQ ID NO: 64496 - DNA, 22 bp, Artificial Sequence
  chemically synthesized
cattaaattatccaactgttta

SEQ ID NO: 64497 - DNA, 22 bp, Artificial Sequence
  chemically synthesized
aattatccaactgtttactgcc

SEQ ID NO: 64498 - DNA, 22 bp, Artificial Sequence
  chemically synthesized
tccaactgtttactgcctgcca

SEQ ID NO: 64499 - DNA, 22 bp, Artificial Sequence
  chemically synthesized
tttactgcctgccagctgccta

SEQ ID NO: 64500 - DNA, 22 bp, Artificial Sequence
  chemically synthesized
actgcctgccagctgcctaacc

SEQ ID NO: 64501 - DNA, 22 bp, Artificial Sequence
  chemically synthesized
ctgcctgccagctgcctaaccc

SEQ ID NO: 64502 - DNA, 22 bp, Artificial Sequence
  chemically synthesized
cctgccagctgcctaaccctat

SEQ ID NO: 64503 - DNA, 22 bp, Artificial Sequence
  chemically synthesized
ccagctgcctaaccctatgcta

SEQ ID NO: 64504 - DNA, 22 bp, Artificial Sequence
  chemically synthesized
cctaaccctatgctaagcaaac

SEQ ID NO: 64505 - DNA, 22 bp, Artificial Sequence
  chemically synthesized
accctatgctaagcaaacatca

SEQ ID NO: 64506 - DNA, 22 bp, Artificial Sequence
  chemically synthesized
tgctaagcaaacatcagcctca

SEQ ID NO: 64507 - DNA, 22 bp, Artificial Sequence
  chemically synthesized
agcaaacatcagcctcagcgtc

SEQ ID NO: 64508 - DNA, 22 bp, Artificial Sequence
  chemically synthesized
agcgtcaccatcattgccacac

SEQ ID NO: 64509 - DNA, 22 bp, Artificial Sequence
  chemically synthesized
ccacacttactaacacctggtg

SEQ ID NO: 64510 - DNA, 22 bp, Artificial Sequence
  chemically synthesized
actaacacctggtgttttacag

SEQ ID NO: 64511 - DNA, 22 bp, Artificial Sequence
  chemically synthesized
ctaacacctggtgttttacagg

SEQ ID NO: 64512 - DNA, 22 bp, Artificial Sequence
  chemically synthesized
acacctggtgttttacaggcac

SEQ ID NO: 64513 - DNA, 22 bp, Artificial Sequence
  chemically synthesized
gtgttttacaggcaccgtatca

SEQ ID NO: 64514 - DNA, 22 bp, Artificial Sequence
  chemically synthesized
tacaggcaccgtatcatctaat

SEQ ID NO: 64515 - DNA, 22 bp, Artificial Sequence
  chemically synthesized
acaggcaccgtatcatctaatc

SEQ ID NO: 64516 - DNA, 22 bp, Artificial Sequence
  chemically synthesized
caggcaccgtatcatctaatct

SEQ ID NO: 64517 - DNA, 22 bp, Artificial Sequence
  chemically synthesized
atctgtcctcaaagcttaccct

SEQ ID NO: 64518 - DNA, 22 bp, Artificial Sequence
  chemically synthesized
tcctcaaagcttaccctataag

SEQ ID NO: 64519 - DNA, 22 bp, Artificial Sequence
  chemically synthesized
aaagcttaccctataaggtgca

SEQ ID NO: 64520 - DNA, 22 bp, Artificial Sequence
  chemically synthesized
accctataaggtgcaaattatt

SEQ ID NO: 64521 - DNA, 22 bp, Artificial Sequence
  chemically synthesized
ccctataaggtgcaaattatta

SEQ ID NO: 64522 - DNA, 22 bp, Artificial Sequence
  chemically synthesized
taaggtgcaaattattagccct

SEQ ID NO: 64523 - DNA, 22 bp, Artificial Sequence
  chemically synthesized
ttagccctattttatagataga

SEQ ID NO: 64524 - DNA, 22 bp, Artificial Sequence
  chemically synthesized
gccctattttatagatagaaaa

SEQ ID NO: 64525 - DNA, 22 bp, Artificial Sequence
  chemically synthesized
ttttatagatagaaaaattgag

SEQ ID NO: 64526 - DNA, 22 bp, Artificial Sequence
  chemically synthesized
tatagatagaaaaattgagccc

SEQ ID NO: 64527 - DNA, 22 bp, Artificial Sequence
  chemically synthesized
atagatagaaaaattgagcccc

SEQ ID NO: 64528 - DNA, 22 bp, Artificial Sequence
  chemically synthesized
tagatagaaaaattgagcccca

SEQ ID NO: 64529 - DNA, 22 bp, Artificial Sequence
  chemically synthesized
agccccaaagagcattaaataa

SEQ ID NO: 64530 - DNA, 22 bp, Artificial Sequence
  chemically synthesized
aataactcactaaaaatcacag

SEQ ID NO: 64531 - DNA, 22 bp, Artificial Sequence
  chemically synthesized
actaaaaatcacagagctactt

SEQ ID NO: 64532 - DNA, 22 bp, Artificial Sequence
  chemically synthesized
aaaatcacagagctacttgctt

SEQ ID NO: 64533 - DNA, 22 bp, Artificial Sequence
  chemically synthesized
cttgcttacaaaactgagatgt

SEQ ID NO: 64534 - DNA, 22 bp, Artificial Sequence
  chemically synthesized
gcttacaaaactgagatgtaat

SEQ ID NO: 64535 - DNA, 22 bp, Artificial Sequence
  chemically synthesized
cttacaaaactgagatgtaatc

SEQ ID NO: 64536 - DNA, 22 bp, Artificial Sequence
  chemically synthesized
acaaaactgagatgtaatccta

SEQ ID NO: 64537 - DNA, 22 bp, Artificial Sequence
  chemically synthesized
caaaactgagatgtaatcctaa

SEQ ID NO: 64538 - DNA, 22 bp, Artificial Sequence
  chemically synthesized
agatgtaatcctaaatgttttg

SEQ ID NO: 64539 - DNA, 22 bp, Artificial Sequence
  chemically synthesized
aatgttttgtctgggattaaac

SEQ ID NO: 64540 - DNA, 22 bp, Artificial Sequence
  chemically synthesized
tgtctgggattaaacagatttc

SEQ ID NO: 64541 - DNA, 22 bp, Artificial Sequence
  chemically synthesized
gtctgggattaaacagatttca

SEQ ID NO: 64542 - DNA, 22 bp, Artificial Sequence
  chemically synthesized
tctgggattaaacagatttcac

SEQ ID NO: 64543 - DNA, 22 bp, Artificial Sequence
  chemically synthesized
ggattaaacagatttcactcca

SEQ ID NO: 64544 - DNA, 22 bp, Artificial Sequence
  chemically synthesized
aacagatttcactccaaaacct

SEQ ID NO: 64545 - DNA, 22 bp, Artificial Sequence
  chemically synthesized
cactccaaaacctgacattgaa

SEQ ID NO: 64546 - DNA, 22 bp, Artificial Sequence
  chemically synthesized
actccaaaacctgacattgaat

SEQ ID NO: 64547 - DNA, 22 bp, Artificial Sequence
  chemically synthesized
caaaacctgacattgaatcatc

SEQ ID NO: 64548 - DNA, 22 bp, Artificial Sequence
  chemically synthesized
acattgaatcatctctgtgtac

SEQ ID NO: 64549 - DNA, 22 bp, Artificial Sequence
  chemically synthesized
aatcatctctgtgtacaaagct

SEQ ID NO: 64550 - DNA, 22 bp, Artificial Sequence
  chemically synthesized
tgtgtacaaagctgaagccaga

SEQ ID NO: 64551 - DNA, 22 bp, Artificial Sequence
  chemically synthesized
tgtacaaagctgaagccagaag

SEQ ID NO: 64552 - DNA, 22 bp, Artificial Sequence
  chemically synthesized
aagccagaagtcttgaatcaga

SEQ ID NO: 64553 - DNA, 22 bp, Artificial Sequence
  chemically synthesized
gaatcagaaaacttcagaggca

SEQ ID NO: 64554 - DNA, 22 bp, Artificial Sequence
  chemically synthesized
aatcagaaaacttcagaggcag

SEQ ID NO: 64555 - DNA, 22 bp, Artificial Sequence
  chemically synthesized
cagaggcagcctggctaaatga

SEQ ID NO: 64556 - DNA, 22 bp, Artificial Sequence
  chemically synthesized
agaggcagcctggctaaatgaa

SEQ ID NO: 64557 - DNA, 22 bp, Artificial Sequence
  chemically synthesized
gctaaatgaagaggggagcatc

SEQ ID NO: 64558 - DNA, 22 bp, Artificial Sequence
  chemically synthesized
aatgaagaggggagcatcagtc

SEQ ID NO: 64559 - DNA, 22 bp, Artificial Sequence
  chemically synthesized
tggctaaaattaaaggctctga

SEQ ID NO: 64560 - DNA, 22 bp, Artificial Sequence
  chemically synthesized
aaattaaaggctctgaggccag

SEQ ID NO: 64561 - DNA, 22 bp, Artificial Sequence
  chemically synthesized
aaggctctgaggccagattgct

SEQ ID NO: 64562 - DNA, 22 bp, Artificial Sequence
  chemically synthesized
tgaggccagattgctccacgtc

SEQ ID NO: 64563 - DNA, 22 bp, Artificial Sequence
  chemically synthesized
aggccagattgctccacgtcaa

SEQ ID NO: 64564 - DNA, 22 bp, Artificial Sequence
  chemically synthesized
ctccacgtcaacttgctattag

SEQ ID NO: 64565 - DNA, 22 bp, Artificial Sequence
  chemically synthesized
cacgtcaacttgctattagctg

SEQ ID NO: 64566 - DNA, 22 bp, Artificial Sequence
  chemically synthesized
gctattagctgtgtgaccttgg

SEQ ID NO: 64567 - DNA, 22 bp, Artificial Sequence
  chemically synthesized
ctattagctgtgtgaccttgga

SEQ ID NO: 64568 - DNA, 22 bp, Artificial Sequence
  chemically synthesized
ttagctgtgtgaccttggacaa

SEQ ID NO: 64569 - DNA, 22 bp, Artificial Sequence
  chemically synthesized
gctgtgtgaccttggacaagtt

SEQ ID NO: 64570 - DNA, 22 bp, Artificial Sequence
  chemically synthesized
tgtgaccttggacaagttactt

SEQ ID NO: 64571 - DNA, 22 bp, Artificial Sequence
  chemically synthesized
ggacaagttacttaacctctct

SEQ ID NO: 64572 - DNA, 22 bp, Artificial Sequence
  chemically synthesized
gacaagttacttaacctctctg

SEQ ID NO: 64573 - DNA, 22 bp, Artificial Sequence
  chemically synthesized
cttaacctctctgaacctcagt

SEQ ID NO: 64574 - DNA, 22 bp, Artificial Sequence
  chemically synthesized
aacctctctgaacctcagtttc

SEQ ID NO: 64575 - DNA, 22 bp, Artificial Sequence
  chemically synthesized
acctctctgaacctcagtttcc

SEQ ID NO: 64576 - DNA, 22 bp, Artificial Sequence
  chemically synthesized
tctgaacctcagtttcctggag

SEQ ID NO: 64577 - DNA, 22 bp, Artificial Sequence
  chemically synthesized
tgaacctcagtttcctggagat

SEQ ID NO: 64578 - DNA, 22 bp, Artificial Sequence
  chemically synthesized
aacctcagtttcctggagatga

SEQ ID NO: 64579 - DNA, 22 bp, Artificial Sequence
  chemically synthesized
agtttcctggagatgagaaagg

SEQ ID NO: 64580 - DNA, 22 bp, Artificial Sequence
  chemically synthesized
cctggagatgagaaaggtggac

SEQ ID NO: 64581 - DNA, 22 bp, Artificial Sequence
  chemically synthesized
ctggagatgagaaaggtggact

SEQ ID NO: 64582 - DNA, 22 bp, Artificial Sequence
  chemically synthesized
gagatgagaaaggtggactttg

SEQ ID NO: 64583 - DNA, 22 bp, Artificial Sequence
  chemically synthesized
tgtcatagagctattgtgaaat

SEQ ID NO: 64584 - DNA, 22 bp, Artificial Sequence
  chemically synthesized
gtcatagagctattgtgaaatt

SEQ ID NO: 64585 - DNA, 22 bp, Artificial Sequence
  chemically synthesized
tcatagagctattgtgaaatta

SEQ ID NO: 64586 - DNA, 22 bp, Artificial Sequence
  chemically synthesized
ttgtgaaattaaatacacataa

SEQ ID NO: 64587 - DNA, 22 bp, Artificial Sequence
  chemically synthesized
tgaaattaaatacacataaaat

SEQ ID NO: 64588 - DNA, 22 bp, Artificial Sequence
  chemically synthesized
aatacacataaaatgccaagaa

SEQ ID NO: 64589 - DNA, 22 bp, Artificial Sequence
  chemically synthesized
ctgcgcagcaagttctcgagaa

SEQ ID NO: 64590 - DNA, 22 bp, Artificial Sequence
  chemically synthesized
cgcagcaagttctcgagaatac

SEQ ID NO: 64591 - DNA, 22 bp, Artificial Sequence
  chemically synthesized
tcgagaataccagttcttgctg

SEQ ID NO: 64592 - DNA, 22 bp, Artificial Sequence
  chemically synthesized
gagaataccagttcttgctgct

SEQ ID NO: 64593 - DNA, 22 bp, Artificial Sequence
  chemically synthesized
ttgctgctattgctgcaggtct

SEQ ID NO: 64594 - DNA, 22 bp, Artificial Sequence
  chemically synthesized
gctgctattgctgcaggtcttt

SEQ ID NO: 64595 - DNA, 22 bp, Artificial Sequence
  chemically synthesized
ctgctattgctgcaggtctttt

SEQ ID NO: 64596 - DNA, 22 bp, Artificial Sequence
  chemically synthesized
ctattgctgcaggtcttttaga

SEQ ID NO: 64597 - DNA, 22 bp, Artificial Sequence
  chemically synthesized
ttgctgcaggtcttttagaggc

SEQ ID NO: 64598 - DNA, 22 bp, Artificial Sequence
  chemically synthesized
ctgcaggtcttttagaggcgtt

SEQ ID NO: 64599 - DNA, 22 bp, Artificial Sequence
  chemically synthesized
caggtcttttagaggcgttcta

SEQ ID NO: 64600 - DNA, 22 bp, Artificial Sequence
  chemically synthesized
ttagaggcgttctataggaaac

SEQ ID NO: 64601 - DNA, 22 bp, Artificial Sequence
  chemically synthesized
tagaggcgttctataggaaact

SEQ ID NO: 64602 - DNA, 22 bp, Artificial Sequence
  chemically synthesized
agaggcgttctataggaaactg

SEQ ID NO: 64603 - DNA, 22 bp, Artificial Sequence
  chemically synthesized
gaggcgttctataggaaactgg

SEQ ID NO: 64604 - DNA, 22 bp, Artificial Sequence
  chemically synthesized
tataggaaactggccaccttgg

SEQ ID NO: 64605 - DNA, 22 bp, Artificial Sequence
  chemically synthesized
taggaaactggccaccttggcc

SEQ ID NO: 64606 - DNA, 22 bp, Artificial Sequence
  chemically synthesized
gccaccttggccttggtcatct

SEQ ID NO: 64607 - DNA, 22 bp, Artificial Sequence
  chemically synthesized
ggccttggtcatctttttgacc

SEQ ID NO: 64608 - DNA, 22 bp, Artificial Sequence
  chemically synthesized
gccttggtcatctttttgacct

SEQ ID NO: 64609 - DNA, 22 bp, Artificial Sequence
  chemically synthesized
ggtcatctttttgacctgtctc

SEQ ID NO: 64610 - DNA, 22 bp, Artificial Sequence
  chemically synthesized
gtcatctttttgacctgtctcc

SEQ ID NO: 64611 - DNA, 22 bp, Artificial Sequence
  chemically synthesized
tttgacctgtctccaaaactca

SEQ ID NO: 64612 - DNA, 22 bp, Artificial Sequence
  chemically synthesized
ttgacctgtctccaaaactcag

SEQ ID NO: 64613 - DNA, 22 bp, Artificial Sequence
  chemically synthesized
tgacctgtctccaaaactcagt

SEQ ID NO: 64614 - DNA, 22 bp, Artificial Sequence
  chemically synthesized
gacctgtctccaaaactcagtg

SEQ ID NO: 64615 - DNA, 22 bp, Artificial Sequence
  chemically synthesized
acctgtctccaaaactcagtgc

SEQ ID NO: 64616 - DNA, 22 bp, Artificial Sequence
  chemically synthesized
tctccaaaactcagtgcaggaa

SEQ ID NO: 64617 - DNA, 22 bp, Artificial Sequence
  chemically synthesized
caaaactcagtgcaggaaaaat

SEQ ID NO: 64618 - DNA, 22 bp, Artificial Sequence
  chemically synthesized
agtgcaggaaaaattaaatcct

SEQ ID NO: 64619 - DNA, 22 bp, Artificial Sequence
  chemically synthesized
aatccttccaacacttcagaga

SEQ ID NO: 64620 - DNA, 22 bp, Artificial Sequence
  chemically synthesized
ccaacacttcagagatcaaggt

SEQ ID NO: 64621 - DNA, 22 bp, Artificial Sequence
  chemically synthesized
caacacttcagagatcaaggtc

SEQ ID NO: 64622 - DNA, 22 bp, Artificial Sequence
  chemically synthesized
cagagatcaaggtcgggtgggg

SEQ ID NO: 64623 - DNA, 22 bp, Artificial Sequence
  chemically synthesized
agagatcaaggtcgggtggggt

SEQ ID NO: 64624 - DNA, 22 bp, Artificial Sequence
  chemically synthesized
tcatgttttgcccaagagaaca

SEQ ID NO: 64625 - DNA, 22 bp, Artificial Sequence
  chemically synthesized
tgcccaagagaacagagaggtt

SEQ ID NO: 64626 - DNA, 22 bp, Artificial Sequence
  chemically synthesized
gcccaagagaacagagaggttg

SEQ ID NO: 64627 - DNA, 22 bp, Artificial Sequence
  chemically synthesized
cccaagagaacagagaggttga

SEQ ID NO: 64628 - DNA, 22 bp, Artificial Sequence
  chemically synthesized
agcaactgtctgaagtcaccga

SEQ ID NO: 64629 - DNA, 22 bp, Artificial Sequence
  chemically synthesized
tctgaagtcaccgagcatcaga

SEQ ID NO: 64630 - DNA, 22 bp, Artificial Sequence
  chemically synthesized
aagtcaccgagcatcagagagg

SEQ ID NO: 64631 - DNA, 22 bp, Artificial Sequence
  chemically synthesized
aagtccagcccaggtttcctgt

SEQ ID NO: 64632 - DNA, 22 bp, Artificial Sequence
  chemically synthesized
cctgttccccatccagcgcctg

SEQ ID NO: 64633 - DNA, 22 bp, Artificial Sequence
  chemically synthesized
ctgttccccatccagcgcctga

SEQ ID NO: 64634 - DNA, 22 bp, Artificial Sequence
  chemically synthesized
ttccccatccagcgcctgagac

SEQ ID NO: 64635 - DNA, 22 bp, Artificial Sequence
  chemically synthesized
cccatccagcgcctgagaccca

SEQ ID NO: 64636 - DNA, 22 bp, Artificial Sequence
  chemically synthesized
agacccaagagaaacagtgaca

SEQ ID NO: 64637 - DNA, 22 bp, Artificial Sequence
  chemically synthesized
gggccaggttcaagagtttggg

SEQ ID NO: 64638 - DNA, 22 bp, Artificial Sequence
  chemically synthesized
aagagtttggggactggagcca

SEQ ID NO: 64639 - DNA, 22 bp, Artificial Sequence
  chemically synthesized
ggggactggagccaggtgcctg

SEQ ID NO: 64640 - DNA, 22 bp, Artificial Sequence
  chemically synthesized
gggactggagccaggtgcctga

SEQ ID NO: 64641 - DNA, 22 bp, Artificial Sequence
  chemically synthesized
gagccaggtgcctgagcccgaa

SEQ ID NO: 64642 - DNA, 22 bp, Artificial Sequence
  chemically synthesized
agcccgaattatggatggtgtg

SEQ ID NO: 64643 - DNA, 22 bp, Artificial Sequence
  chemically synthesized
tggatggtgtgtgatttggggc

SEQ ID NO: 64644 - DNA, 22 bp, Artificial Sequence
  chemically synthesized
ggggccagttattcacctctct

SEQ ID NO: 64645 - DNA, 22 bp, Artificial Sequence
  chemically synthesized
gggccagttattcacctctctg

SEQ ID NO: 64646 - DNA, 22 bp, Artificial Sequence
  chemically synthesized
ttcacctctctgtccccatctt

SEQ ID NO: 64647 - DNA, 22 bp, Artificial Sequence
  chemically synthesized
acctctctgtccccatcttcct

SEQ ID NO: 64648 - DNA, 22 bp, Artificial Sequence
  chemically synthesized
tctgtccccatcttcctcatct

SEQ ID NO: 64649 - DNA, 22 bp, Artificial Sequence
  chemically synthesized
tgtccccatcttcctcatctgt

SEQ ID NO: 64650 - DNA, 22 bp, Artificial Sequence
  chemically synthesized
tccccatcttcctcatctgtaa

SEQ ID NO: 64651 - DNA, 22 bp, Artificial Sequence
  chemically synthesized
cctcatctgtaaaatgggaatc

SEQ ID NO: 64652 - DNA, 22 bp, Artificial Sequence
  chemically synthesized
ctcatctgtaaaatgggaatca

SEQ ID NO: 64653 - DNA, 22 bp, Artificial Sequence
  chemically synthesized
atctgtaaaatgggaatcacac

SEQ ID NO: 64654 - DNA, 22 bp, Artificial Sequence
  chemically synthesized
taaaatgggaatcacactagta

SEQ ID NO: 64655 - DNA, 22 bp, Artificial Sequence
  chemically synthesized
gtaactgccttggagggttatg

SEQ ID NO: 64656 - DNA, 22 bp, Artificial Sequence
  chemically synthesized
ccttggagggttatgaggctta

SEQ ID NO: 64657 - DNA, 22 bp, Artificial Sequence
  chemically synthesized
ggagggttatgaggcttaatca

SEQ ID NO: 64658 - DNA, 22 bp, Artificial Sequence
  chemically synthesized
gagggttatgaggcttaatcac

SEQ ID NO: 64659 - DNA, 22 bp, Artificial Sequence
  chemically synthesized
tgaggcttaatcacgcactgag

SEQ ID NO: 64660 - DNA, 22 bp, Artificial Sequence
  chemically synthesized
aatcacgcactgagcttagccg

SEQ ID NO: 64661 - DNA, 22 bp, Artificial Sequence
  chemically synthesized
atcacgcactgagcttagccgt

SEQ ID NO: 64662 - DNA, 22 bp, Artificial Sequence
  chemically synthesized
agcttagccgtggcctggtgca

SEQ ID NO: 64663 - DNA, 22 bp, Artificial Sequence
  chemically synthesized
agccgtggcctggtgcagagcg

SEQ ID NO: 64664 - DNA, 22 bp, Artificial Sequence
  chemically synthesized
gccgtggcctggtgcagagcga

SEQ ID NO: 64665 - DNA, 22 bp, Artificial Sequence
  chemically synthesized
gtgcagagcgattattcaggaa

SEQ ID NO: 64666 - DNA, 22 bp, Artificial Sequence
  chemically synthesized
ttcaggaatgccagcttgagcc

SEQ ID NO: 64667 - DNA, 22 bp, Artificial Sequence
  chemically synthesized
aggaatgccagcttgagccctg

SEQ ID NO: 64668 - DNA, 22 bp, Artificial Sequence
  chemically synthesized
gagccctgggtgacagtgcccc

SEQ ID NO: 64669 - DNA, 22 bp, Artificial Sequence
  chemically synthesized
agccctgggtgacagtgcccct

SEQ ID NO: 64670 - DNA, 22 bp, Artificial Sequence
  chemically synthesized
ggtgacagtgcccctcacagct

SEQ ID NO: 64671 - DNA, 22 bp, Artificial Sequence
  chemically synthesized
acagcttcctgtcctccactgg

SEQ ID NO: 64672 - DNA, 22 bp, Artificial Sequence
  chemically synthesized
cctgtcctccactgggacagga

SEQ ID NO: 64673 - DNA, 22 bp, Artificial Sequence
  chemically synthesized
ctgtcctccactgggacaggag

SEQ ID NO: 64674 - DNA, 22 bp, Artificial Sequence
  chemically synthesized
tcctccactgggacaggagggc

SEQ ID NO: 64675 - DNA, 22 bp, Artificial Sequence
  chemically synthesized
cactgggacaggagggcccaga

SEQ ID NO: 64676 - DNA, 22 bp, Artificial Sequence
  chemically synthesized
ggacaggagggcccagaggtcc

SEQ ID NO: 64677 - DNA, 22 bp, Artificial Sequence
  chemically synthesized
tgatgtaaggctgaggcctggc

SEQ ID NO: 64678 - DNA, 22 bp, Artificial Sequence
  chemically synthesized
gatgtaaggctgaggcctggca

SEQ ID NO: 64679 - DNA, 22 bp, Artificial Sequence
  chemically synthesized
atgtaaggctgaggcctggcac

SEQ ID NO: 64680 - DNA, 22 bp, Artificial Sequence
  chemically synthesized
aggcctggcacaggtctgttcc

SEQ ID NO: 64681 - DNA, 22 bp, Artificial Sequence
  chemically synthesized
gcacaggtctgttcctggtcat

SEQ ID NO: 64682 - DNA, 22 bp, Artificial Sequence
  chemically synthesized
ttcctggtcatatctggagggg

SEQ ID NO: 64683 - DNA, 22 bp, Artificial Sequence
  chemically synthesized
ctggtcatatctggaggggatg

SEQ ID NO: 64684 - DNA, 22 bp, Artificial Sequence
  chemically synthesized
gtcatatctggaggggatggag

SEQ ID NO: 64685 - DNA, 22 bp, Artificial Sequence
  chemically synthesized
gaggggatggagaatgtgagcc

SEQ ID NO: 64686 - DNA, 22 bp, Artificial Sequence
  chemically synthesized
ctccccacccctctctggacct

SEQ ID NO: 64687 - DNA, 22 bp, Artificial Sequence
  chemically synthesized
cccacccctctctggaccttaa

SEQ ID NO: 64688 - DNA, 22 bp, Artificial Sequence
  chemically synthesized
tctggaccttaacctcctcatc

SEQ ID NO: 64689 - DNA, 22 bp, Artificial Sequence
  chemically synthesized
tggaccttaacctcctcatcta

SEQ ID NO: 64690 - DNA, 22 bp, Artificial Sequence
  chemically synthesized
gaccttaacctcctcatctata

SEQ ID NO: 64691 - DNA, 22 bp, Artificial Sequence
  chemically synthesized
aacctcctcatctatagaaggg

SEQ ID NO: 64692 - DNA, 22 bp, Artificial Sequence
  chemically synthesized
acctcctcatctatagaagggg

SEQ ID NO: 64693 - DNA, 22 bp, Artificial Sequence
  chemically synthesized
ctcatctatagaaggggagaaa

SEQ ID NO: 64694 - DNA, 22 bp, Artificial Sequence
  chemically synthesized
atctatagaaggggagaaagat

SEQ ID NO: 64695 - DNA, 22 bp, Artificial Sequence
  chemically synthesized
tagaaggggagaaagatgcatg

SEQ ID NO: 64696 - DNA, 22 bp, Artificial Sequence
  chemically synthesized
ataggagacaacagacaggagc

SEQ ID NO: 64697 - DNA, 22 bp, Artificial Sequence
  chemically synthesized
taggagacaacagacaggagcc

SEQ ID NO: 64698 - DNA, 22 bp, Artificial Sequence
  chemically synthesized
tgcaaacagaaagaaatggctg

SEQ ID NO: 64699 - DNA, 22 bp, Artificial Sequence
  chemically synthesized
cgctttgttgctgttgctgtat

SEQ ID NO: 64700 - DNA, 22 bp, Artificial Sequence
  chemically synthesized
tgttgctgttgctgtatcttgg

SEQ ID NO: 64701 - DNA, 22 bp, Artificial Sequence
  chemically synthesized
gttgctgttgctgtatcttggc

SEQ ID NO: 64702 - DNA, 22 bp, Artificial Sequence
  chemically synthesized
ttgctgttgctgtatcttggct

SEQ ID NO: 64703 - DNA, 22 bp, Artificial Sequence
  chemically synthesized
ctgttgctgtatcttggctggt

SEQ ID NO: 64704 - DNA, 22 bp, Artificial Sequence
  chemically synthesized
ttgctgtatcttggctggtgtc

SEQ ID NO: 64705 - DNA, 22 bp, Artificial Sequence
  chemically synthesized
ctgtatcttggctggtgtcccc

SEQ ID NO: 64706 - DNA, 22 bp, Artificial Sequence
  chemically synthesized
tatcttggctggtgtcccccat

SEQ ID NO: 64707 - DNA, 22 bp, Artificial Sequence
  chemically synthesized
ggctggtgtcccccatcctggg

SEQ ID NO: 64708 - DNA, 22 bp, Artificial Sequence
  chemically synthesized
gctggtgtcccccatcctgggg

SEQ ID NO: 64709 - DNA, 22 bp, Artificial Sequence
  chemically synthesized
gtgtcccccatcctggggtgcc

SEQ ID NO: 64710 - DNA, 22 bp, Artificial Sequence
  chemically synthesized
gggtgccaggactgcagaccta

SEQ ID NO: 64711 - DNA, 22 bp, Artificial Sequence
  chemically synthesized
cagacctagacaccctcatcca

SEQ ID NO: 64712 - DNA, 22 bp, Artificial Sequence
  chemically synthesized
gacaccctcatccacttctgct

SEQ ID NO: 64713 - DNA, 22 bp, Artificial Sequence
  chemically synthesized
atccacttctgcttacaggaac

SEQ ID NO: 64714 - DNA, 22 bp, Artificial Sequence
  chemically synthesized
ctgcttacaggaaccagtgtat

SEQ ID NO: 64715 - DNA, 22 bp, Artificial Sequence
  chemically synthesized
tgcttacaggaaccagtgtatc

SEQ ID NO: 64716 - DNA, 22 bp, Artificial Sequence
  chemically synthesized
cttacaggaaccagtgtatcca

SEQ ID NO: 64717 - DNA, 22 bp, Artificial Sequence
  chemically synthesized
acaggaaccagtgtatccacca

SEQ ID NO: 64718 - DNA, 22 bp, Artificial Sequence
  chemically synthesized
caggaaccagtgtatccaccag

SEQ ID NO: 64719 - DNA, 22 bp, Artificial Sequence
  chemically synthesized
ggaaacaggacacaaccctcat

SEQ ID NO: 64720 - DNA, 22 bp, Artificial Sequence
  chemically synthesized
atggctgctgttattatgaaaa

SEQ ID NO: 64721 - DNA, 22 bp, Artificial Sequence
  chemically synthesized
ctgttattatgaaaataggagc

SEQ ID NO: 64722 - DNA, 22 bp, Artificial Sequence
  chemically synthesized
ttattatgaaaataggagctca

SEQ ID NO: 64723 - DNA, 22 bp, Artificial Sequence
  chemically synthesized
ttatgaaaataggagctcagct

SEQ ID NO: 64724 - DNA, 22 bp, Artificial Sequence
  chemically synthesized
tgaaaataggagctcagctgca

SEQ ID NO: 64725 - DNA, 22 bp, Artificial Sequence
  chemically synthesized
agctgcagcctctccatctgcc

SEQ ID NO: 64726 - DNA, 22 bp, Artificial Sequence
  chemically synthesized
cagcctctccatctgccctgca

SEQ ID NO: 64727 - DNA, 22 bp, Artificial Sequence
  chemically synthesized
tccatctgccctgcacctcagc

SEQ ID NO: 64728 - DNA, 22 bp, Artificial Sequence
  chemically synthesized
catctgccctgcacctcagcag

SEQ ID NO: 64729 - DNA, 22 bp, Artificial Sequence
  chemically synthesized
ccctgcacctcagcaggcggat

SEQ ID NO: 64730 - DNA, 22 bp, Artificial Sequence
  chemically synthesized
cacctcagcaggcggataccca

SEQ ID NO: 64731 - DNA, 22 bp, Artificial Sequence
  chemically synthesized
agcaggcggatacccactccac

SEQ ID NO: 64732 - DNA, 22 bp, Artificial Sequence
  chemically synthesized
cacaacccccctcctgccccag

SEQ ID NO: 64733 - DNA, 22 bp, Artificial Sequence
  chemically synthesized
ctgccccagacctgctgcctgc

SEQ ID NO: 64734 - DNA, 22 bp, Artificial Sequence
  chemically synthesized
ccccagacctgctgcctgcctg

SEQ ID NO: 64735 - DNA, 22 bp, Artificial Sequence
  chemically synthesized
ctgcctgcctgggccatgggga

SEQ ID NO: 64736 - DNA, 22 bp, Artificial Sequence
  chemically synthesized
cctgcctgggccatggggagct

SEQ ID NO: 64737 - DNA, 22 bp, Artificial Sequence
  chemically synthesized
cctgggccatggggagctcaga

SEQ ID NO: 64738 - DNA, 22 bp, Artificial Sequence
  chemically synthesized
ggccatggggagctcagaagcc

SEQ ID NO: 64739 - DNA, 22 bp, Artificial Sequence
  chemically synthesized
agaagcctctccagaacctctc

SEQ ID NO: 64740 - DNA, 22 bp, Artificial Sequence
  chemically synthesized
tccagaacctctcgcagtgaaa

SEQ ID NO: 64741 - DNA, 22 bp, Artificial Sequence
  chemically synthesized
cagaacctctcgcagtgaaagg

SEQ ID NO: 64742 - DNA, 22 bp, Artificial Sequence
  chemically synthesized
tcgcagtgaaaggcatacttac

SEQ ID NO: 64743 - DNA, 22 bp, Artificial Sequence
  chemically synthesized
gcagtgaaaggcatacttacga

SEQ ID NO: 64744 - DNA, 22 bp, Artificial Sequence
  chemically synthesized
acgattcactgtcccaggtcag

SEQ ID NO: 64745 - DNA, 22 bp, Artificial Sequence
  chemically synthesized
cgattcactgtcccaggtcagt

SEQ ID NO: 64746 - DNA, 22 bp, Artificial Sequence
  chemically synthesized
actgtcccaggtcagtggtggt

SEQ ID NO: 64747 - DNA, 22 bp, Artificial Sequence
  chemically synthesized
tcccaggtcagtggtggtgcct

SEQ ID NO: 64748 - DNA, 22 bp, Artificial Sequence
  chemically synthesized
aagctgaggagacagggccctg

SEQ ID NO: 64749 - DNA, 22 bp, Artificial Sequence
  chemically synthesized
aggagacagggccctgtcctcg

SEQ ID NO: 64750 - DNA, 22 bp, Artificial Sequence
  chemically synthesized
tcctcgtccgtatttaagcagt

SEQ ID NO: 64751 - DNA, 22 bp, Artificial Sequence
  chemically synthesized
gtccgtatttaagcagtggatc

SEQ ID NO: 64752 - DNA, 22 bp, Artificial Sequence
  chemically synthesized
aagcagtggatccagaggggca

SEQ ID NO: 64753 - DNA, 22 bp, Artificial Sequence
  chemically synthesized
agcagtggatccagaggggcaa

SEQ ID NO: 64754 - DNA, 22 bp, Artificial Sequence
  chemically synthesized
ctggtgaatattaaccaaggtc

SEQ ID NO: 64755 - DNA, 22 bp, Artificial Sequence
  chemically synthesized
gtgaatattaaccaaggtcacc

SEQ ID NO: 64756 - DNA, 22 bp, Artificial Sequence
  chemically synthesized
accaaggtcaccccagttatcg

SEQ ID NO: 64757 - DNA, 22 bp, Artificial Sequence
  chemically synthesized
tcggaggagcaaacaggggcta

SEQ ID NO: 64758 - DNA, 22 bp, Artificial Sequence
  chemically synthesized
agtccactggctgggatctgag

SEQ ID NO: 64759 - DNA, 22 bp, Artificial Sequence
  chemically synthesized
gctgggatctgagtcgcccgcc

SEQ ID NO: 64760 - DNA, 22 bp, Artificial Sequence
  chemically synthesized
ggatctgagtcgcccgcctacg

SEQ ID NO: 64761 - DNA, 22 bp, Artificial Sequence
  chemically synthesized
agtcgcccgcctacgctgcccg

SEQ ID NO: 64762 - DNA, 22 bp, Artificial Sequence
  chemically synthesized
cgctgcccggacgctttgcctg

SEQ ID NO: 64763 - DNA, 22 bp, Artificial Sequence
  chemically synthesized
cccggacgctttgcctgggcag

SEQ ID NO: 64764 - DNA, 22 bp, Artificial Sequence
  chemically synthesized
tgcctgggcagtgtacagcttc

SEQ ID NO: 64765 - DNA, 22 bp, Artificial Sequence
  chemically synthesized
gcctgggcagtgtacagcttcc

SEQ ID NO: 64766 - DNA, 22 bp, Artificial Sequence
  chemically synthesized
cctgggcagtgtacagcttcca

SEQ ID NO: 64767 - DNA, 22 bp, Artificial Sequence
  chemically synthesized
ggcagtgtacagcttccactgc

SEQ ID NO: 64768 - DNA, 22 bp, Artificial Sequence
  chemically synthesized
ccactgcacttaccgaaaggag

SEQ ID NO: 64769 - DNA, 22 bp, Artificial Sequence
  chemically synthesized
cactgcacttaccgaaaggagt

SEQ ID NO: 64770 - DNA, 22 bp, Artificial Sequence
  chemically synthesized
cacttaccgaaaggagtcattg

SEQ ID NO: 64771 - DNA, 22 bp, Artificial Sequence
  chemically synthesized
accgaaaggagtcattgtacct

SEQ ID NO: 64772 - DNA, 22 bp, Artificial Sequence
  chemically synthesized
ccgaaaggagtcattgtacctg

SEQ ID NO: 64773 - DNA, 22 bp, Artificial Sequence
  chemically synthesized
tacctggctcagaaaccacagc

SEQ ID NO: 64774 - DNA, 22 bp, Artificial Sequence
  chemically synthesized
gctcagaaaccacagcgtcctg

SEQ ID NO: 64775 - DNA, 22 bp, Artificial Sequence
  chemically synthesized
agaaaccacagcgtcctgtgtc

SEQ ID NO: 64776 - DNA, 22 bp, Artificial Sequence
  chemically synthesized
tgtccaaggtggagggggtggc

SEQ ID NO: 64777 - DNA, 22 bp, Artificial Sequence
  chemically synthesized
tgggagagtaccacttagctgg

SEQ ID NO: 64778 - DNA, 22 bp, Artificial Sequence
  chemically synthesized
ggagagtaccacttagctggcc

SEQ ID NO: 64779 - DNA, 22 bp, Artificial Sequence
  chemically synthesized
agctggccctctgctctcactg

SEQ ID NO: 64780 - DNA, 22 bp, Artificial Sequence
  chemically synthesized
gctggccctctgctctcactgc

SEQ ID NO: 64781 - DNA, 22 bp, Artificial Sequence
  chemically synthesized
gccctctgctctcactgcagaa

SEQ ID NO: 64782 - DNA, 22 bp, Artificial Sequence
  chemically synthesized
tgctctcactgcagaatcctta

SEQ ID NO: 64783 - DNA, 22 bp, Artificial Sequence
  chemically synthesized
ctctcactgcagaatccttagt

SEQ ID NO: 64784 - DNA, 22 bp, Artificial Sequence
  chemically synthesized
tcactgcagaatccttagtggc

SEQ ID NO: 64785 - DNA, 22 bp, Artificial Sequence
  chemically synthesized
actgcagaatccttagtggctg

SEQ ID NO: 64786 - DNA, 22 bp, Artificial Sequence
  chemically synthesized
cagaatccttagtggctgttcc

SEQ ID NO: 64787 - DNA, 22 bp, Artificial Sequence
  chemically synthesized
agtggctgttccactggtagca

SEQ ID NO: 64788 - DNA, 22 bp, Artificial Sequence
  chemically synthesized
gtggctgttccactggtagcaa

SEQ ID NO: 64789 - DNA, 22 bp, Artificial Sequence
  chemically synthesized
ttccactggtagcaagatctac

SEQ ID NO: 64790 - DNA, 22 bp, Artificial Sequence
  chemically synthesized
cactggtagcaagatctaccat

SEQ ID NO: 64791 - DNA, 22 bp, Artificial Sequence
  chemically synthesized
gtagcaagatctaccatttact

SEQ ID NO: 64792 - DNA, 22 bp, Artificial Sequence
  chemically synthesized
ccatttactgagtcaccccaaa

SEQ ID NO: 64793 - DNA, 22 bp, Artificial Sequence
  chemically synthesized
actgagtcaccccaaaatgcct

SEQ ID NO: 64794 - DNA, 22 bp, Artificial Sequence
  chemically synthesized
ctgagtcaccccaaaatgcctg

SEQ ID NO: 64795 - DNA, 22 bp, Artificial Sequence
  chemically synthesized
agtcaccccaaaatgcctgatg

SEQ ID NO: 64796 - DNA, 22 bp, Artificial Sequence
  chemically synthesized
atgctgaagacttactgccgcc

SEQ ID NO: 64797 - DNA, 22 bp, Artificial Sequence
  chemically synthesized
aagacttactgccgccctggga

SEQ ID NO: 64798 - DNA, 22 bp, Artificial Sequence
  chemically synthesized
actgccgccctgggagatcaga

SEQ ID NO: 64799 - DNA, 22 bp, Artificial Sequence
  chemically synthesized
ctgccgccctgggagatcagag

SEQ ID NO: 64800 - DNA, 22 bp, Artificial Sequence
  chemically synthesized
ccgccctgggagatcagagtgg

SEQ ID NO: 64801 - DNA, 22 bp, Artificial Sequence
  chemically synthesized
ggagatcagagtgggttagagc

SEQ ID NO: 64802 - DNA, 22 bp, Artificial Sequence
  chemically synthesized
gagcccatttgacagatgagga

SEQ ID NO: 64803 - DNA, 22 bp, Artificial Sequence
  chemically synthesized
gacagatgaggaaacaggctca

SEQ ID NO: 64804 - DNA, 22 bp, Artificial Sequence
  chemically synthesized
acagatgaggaaacaggctcag

SEQ ID NO: 64805 - DNA, 22 bp, Artificial Sequence
  chemically synthesized
agagcggagagaccgctcatcc

SEQ ID NO: 64806 - DNA, 22 bp, Artificial Sequence
  chemically synthesized
atccaaagttacccagtcagcc

SEQ ID NO: 64807 - DNA, 22 bp, Artificial Sequence
  chemically synthesized
cccagtcagccttagacacaaa

SEQ ID NO: 64808 - DNA, 22 bp, Artificial Sequence
  chemically synthesized
agacacaaacaccctcttgatg

SEQ ID NO: 64809 - DNA, 22 bp, Artificial Sequence
  chemically synthesized
gacacaaacaccctcttgatgg

SEQ ID NO: 64810 - DNA, 22 bp, Artificial Sequence
  chemically synthesized
ttgatggtcccgatggaaaaat

SEQ ID NO: 64811 - DNA, 22 bp, Artificial Sequence
  chemically synthesized
gatggtcccgatggaaaaatgg

SEQ ID NO: 64812 - DNA, 22 bp, Artificial Sequence
  chemically synthesized
atggtcccgatggaaaaatgga

SEQ ID NO: 64813 - DNA, 22 bp, Artificial Sequence
  chemically synthesized
aggcagacacaaccgtcaggct

SEQ ID NO: 64814 - DNA, 22 bp, Artificial Sequence
  chemically synthesized
gcatggggggccgtgagacagg

SEQ ID NO: 64815 - DNA, 22 bp, Artificial Sequence
  chemically synthesized
taaagaagagctgtgctgcctc

SEQ ID NO: 64816 - DNA, 22 bp, Artificial Sequence
  chemically synthesized
tgctgcctcaggcaggccgctt

SEQ ID NO: 64817 - DNA, 22 bp, Artificial Sequence
  chemically synthesized
cctcaggcaggccgcttcacct

SEQ ID NO: 64818 - DNA, 22 bp, Artificial Sequence
  chemically synthesized
aggcaggccgcttcacctctct

SEQ ID NO: 64819 - DNA, 22 bp, Artificial Sequence
  chemically synthesized
cacctctctgaaccaggaactg

SEQ ID NO: 64820 - DNA, 22 bp, Artificial Sequence
  chemically synthesized
acctctctgaaccaggaactgt

SEQ ID NO: 64821 - DNA, 22 bp, Artificial Sequence
  chemically synthesized
tctgaaccaggaactgtttcac

SEQ ID NO: 64822 - DNA, 22 bp, Artificial Sequence
  chemically synthesized
tgaaccaggaactgtttcacct

SEQ ID NO: 64823 - DNA, 22 bp, Artificial Sequence
  chemically synthesized
aaccaggaactgtttcacctgc

SEQ ID NO: 64824 - DNA, 22 bp, Artificial Sequence
  chemically synthesized
tttcacctgcatcccaaagagt

SEQ ID NO: 64825 - DNA, 22 bp, Artificial Sequence
  chemically synthesized
cacctgcatcccaaagagttgg

SEQ ID NO: 64826 - DNA, 22 bp, Artificial Sequence
  chemically synthesized
acctgcatcccaaagagttgga

SEQ ID NO: 64827 - DNA, 22 bp, Artificial Sequence
  chemically synthesized
catcccaaagagttggaagttt

SEQ ID NO: 64828 - DNA, 22 bp, Artificial Sequence
  chemically synthesized
gaagtttcattcccaagcatgc

SEQ ID NO: 64829 - DNA, 22 bp, Artificial Sequence
  chemically synthesized
cattcccaagcatgcttgtgaa

SEQ ID NO: 64830 - DNA, 22 bp, Artificial Sequence
  chemically synthesized
attcccaagcatgcttgtgaag

SEQ ID NO: 64831 - DNA, 22 bp, Artificial Sequence
  chemically synthesized
ccaagcatgcttgtgaagtgcc

SEQ ID NO: 64832 - DNA, 22 bp, Artificial Sequence
  chemically synthesized
gtgaagtgcctcgggtgaagtg

SEQ ID NO: 64833 - DNA, 22 bp, Artificial Sequence
  chemically synthesized
tgaagtgcctcgggtgaagtgc

SEQ ID NO: 64834 - DNA, 22 bp, Artificial Sequence
  chemically synthesized
gggtgaagtgcctggcacacag

SEQ ID NO: 64835 - DNA, 22 bp, Artificial Sequence
  chemically synthesized
gcacacagtaggctctttatgt

SEQ ID NO: 64836 - DNA, 22 bp, Artificial Sequence
  chemically synthesized
tttatgtgggtctgcacagccc

SEQ ID NO: 64837 - DNA, 22 bp, Artificial Sequence
  chemically synthesized
tatgtgggtctgcacagccctc

SEQ ID NO: 64838 - DNA, 22 bp, Artificial Sequence
  chemically synthesized
atgtgggtctgcacagccctct

SEQ ID NO: 64839 - DNA, 22 bp, Artificial Sequence
  chemically synthesized
tgtgggtctgcacagccctctg

SEQ ID NO: 64840 - DNA, 22 bp, Artificial Sequence
  chemically synthesized
cacagccctctgcttagtctgc

SEQ ID NO: 64841 - DNA, 22 bp, Artificial Sequence
  chemically synthesized
tgcttagtctgccccccaggct

SEQ ID NO: 64842 - DNA, 22 bp, Artificial Sequence
  chemically synthesized
cttagtctgccccccaggctgc

SEQ ID NO: 64843 - DNA, 22 bp, Artificial Sequence
  chemically synthesized
agtctgccccccaggctgctca

SEQ ID NO: 64844 - DNA, 22 bp, Artificial Sequence
  chemically synthesized
gtctgccccccaggctgctcag

SEQ ID NO: 64845 - DNA, 22 bp, Artificial Sequence
  chemically synthesized
ccccccaggctgctcagagcag

SEQ ID NO: 64846 - DNA, 22 bp, Artificial Sequence
  chemically synthesized
ctcagagcaggaggaggttcaa

SEQ ID NO: 64847 - DNA, 22 bp, Artificial Sequence
  chemically synthesized
agagcaggaggaggttcaattt

SEQ ID NO: 64848 - DNA, 22 bp, Artificial Sequence
  chemically synthesized
aattttgaccagcctcaggcct

SEQ ID NO: 64849 - DNA, 22 bp, Artificial Sequence
  chemically synthesized
tgaccagcctcaggcctgtttc

SEQ ID NO: 64850 - DNA, 22 bp, Artificial Sequence
  chemically synthesized
gaccagcctcaggcctgtttct

SEQ ID NO: 64851 - DNA, 22 bp, Artificial Sequence
  chemically synthesized
accagcctcaggcctgtttctg

SEQ ID NO: 64852 - DNA, 22 bp, Artificial Sequence
  chemically synthesized
aggcctgtttctgtttttgctc

SEQ ID NO: 64853 - DNA, 22 bp, Artificial Sequence
  chemically synthesized
tttctgtttttgctcctggaaa

SEQ ID NO: 64854 - DNA, 22 bp, Artificial Sequence
  chemically synthesized
ctgtttttgctcctggaaaacc

SEQ ID NO: 64855 - DNA, 22 bp, Artificial Sequence
  chemically synthesized
tgtttttgctcctggaaaacca

SEQ ID NO: 64856 - DNA, 22 bp, Artificial Sequence
  chemically synthesized
tttttgctcctggaaaaccagt

SEQ ID NO: 64857 - DNA, 22 bp, Artificial Sequence
  chemically synthesized
ttgctcctggaaaaccagtgtg

SEQ ID NO: 64858 - DNA, 22 bp, Artificial Sequence
  chemically synthesized
tgctcctggaaaaccagtgtga

SEQ ID NO: 64859 - DNA, 22 bp, Artificial Sequence
  chemically synthesized
gctcctggaaaaccagtgtgat

SEQ ID NO: 64860 - DNA, 22 bp, Artificial Sequence
  chemically synthesized
ctcctggaaaaccagtgtgatc

SEQ ID NO: 64861 - DNA, 22 bp, Artificial Sequence
  chemically synthesized
ctggaaaaccagtgtgatccgt

SEQ ID NO: 64862 - DNA, 22 bp, Artificial Sequence
  chemically synthesized
gaaaaccagtgtgatccgtata

SEQ ID NO: 64863 - DNA, 22 bp, Artificial Sequence
  chemically synthesized
ggagtttctttggatacatggc

SEQ ID NO: 64864 - DNA, 22 bp, Artificial Sequence
  chemically synthesized
gagtttctttggatacatggcc

SEQ ID NO: 64865 - DNA, 22 bp, Artificial Sequence
  chemically synthesized
ctttggatacatggcccccact

SEQ ID NO: 64866 - DNA, 22 bp, Artificial Sequence
  chemically synthesized
tttggatacatggcccccactc

SEQ ID NO: 64867 - DNA, 22 bp, Artificial Sequence
  chemically synthesized
tggatacatggcccccactctg

SEQ ID NO: 64868 - DNA, 22 bp, Artificial Sequence
  chemically synthesized
ggatacatggcccccactctgg

SEQ ID NO: 64869 - DNA, 22 bp, Artificial Sequence
  chemically synthesized
gatacatggcccccactctggg

SEQ ID NO: 64870 - DNA, 22 bp, Artificial Sequence
  chemically synthesized
tggggttgttggaggcctttgg

SEQ ID NO: 64871 - DNA, 22 bp, Artificial Sequence
  chemically synthesized
gggttgttggaggcctttggag

SEQ ID NO: 64872 - DNA, 22 bp, Artificial Sequence
  chemically synthesized
ttggaggcctttggagactgct

SEQ ID NO: 64873 - DNA, 22 bp, Artificial Sequence
  chemically synthesized
gaggcctttggagactgctggg

SEQ ID NO: 64874 - DNA, 22 bp, Artificial Sequence
  chemically synthesized
tggagactgctgggggtggagg

SEQ ID NO: 64875 - DNA, 22 bp, Artificial Sequence
  chemically synthesized
ggagactgctgggggtggaggg

SEQ ID NO: 64876 - DNA, 22 bp, Artificial Sequence
  chemically synthesized
gagactgctgggggtggagggg

SEQ ID NO: 64877 - DNA, 22 bp, Artificial Sequence
  chemically synthesized
ctgggggtggaggggaggggag

SEQ ID NO: 64878 - DNA, 22 bp, Artificial Sequence
  chemically synthesized
ggggtggaggggaggggaggta

SEQ ID NO: 64879 - DNA, 22 bp, Artificial Sequence
  chemically synthesized
aggctagtggggccccacttga

SEQ ID NO: 64880 - DNA, 22 bp, Artificial Sequence
  chemically synthesized
gtggggccccacttgattgcaa

SEQ ID NO: 64881 - DNA, 22 bp, Artificial Sequence
  chemically synthesized
gattgcaatccctttaaaagcc

SEQ ID NO: 64882 - DNA, 22 bp, Artificial Sequence
  chemically synthesized
attgcaatccctttaaaagcct

SEQ ID NO: 64883 - DNA, 22 bp, Artificial Sequence
  chemically synthesized
caatccctttaaaagcctaaat

SEQ ID NO: 64884 - DNA, 22 bp, Artificial Sequence
  chemically synthesized
taaaagcctaaatcagattgca

SEQ ID NO: 64885 - DNA, 22 bp, Artificial Sequence
  chemically synthesized
aaaagcctaaatcagattgcat

SEQ ID NO: 64886 - DNA, 22 bp, Artificial Sequence
  chemically synthesized
aaagcctaaatcagattgcatc

SEQ ID NO: 64887 - DNA, 22 bp, Artificial Sequence
  chemically synthesized
aatcagattgcatcgcccgctg

SEQ ID NO: 64888 - DNA, 22 bp, Artificial Sequence
  chemically synthesized
catcgcccgctgtgcaacccgc

SEQ ID NO: 64889 - DNA, 22 bp, Artificial Sequence
  chemically synthesized
tgcaacccgcaaacctgcttgg

SEQ ID NO: 64890 - DNA, 22 bp, Artificial Sequence
  chemically synthesized
cttgggagctggcgtacgtgcc

SEQ ID NO: 64891 - DNA, 22 bp, Artificial Sequence
  chemically synthesized
gggagctggcgtacgtgccgta

SEQ ID NO: 64892 - DNA, 22 bp, Artificial Sequence
  chemically synthesized
ggagctggcgtacgtgccgtag

SEQ ID NO: 64893 - DNA, 22 bp, Artificial Sequence
  chemically synthesized
gcgtacgtgccgtagatacttg

SEQ ID NO: 64894 - DNA, 22 bp, Artificial Sequence
  chemically synthesized
gcagagtgaatggatgagtgca

SEQ ID NO: 64895 - DNA, 22 bp, Artificial Sequence
  chemically synthesized
cagagtgaatggatgagtgcat

SEQ ID NO: 64896 - DNA, 22 bp, Artificial Sequence
  chemically synthesized
ttgccccttctgtcattcacca

SEQ ID NO: 64897 - DNA, 22 bp, Artificial Sequence
  chemically synthesized
tgccccttctgtcattcaccag

SEQ ID NO: 64898 - DNA, 22 bp, Artificial Sequence
  chemically synthesized
gccccttctgtcattcaccagt

SEQ ID NO: 64899 - DNA, 22 bp, Artificial Sequence
  chemically synthesized
ccccttctgtcattcaccagtc

SEQ ID NO: 64900 - DNA, 22 bp, Artificial Sequence
  chemically synthesized
ctgtcattcaccagtcccattt

SEQ ID NO: 64901 - DNA, 22 bp, Artificial Sequence
  chemically synthesized
tgtcattcaccagtcccattta

SEQ ID NO: 64902 - DNA, 22 bp, Artificial Sequence
  chemically synthesized
tcattcaccagtcccatttatg

SEQ ID NO: 64903 - DNA, 22 bp, Artificial Sequence
  chemically synthesized
accagtcccatttatgcctcca

SEQ ID NO: 64904 - DNA, 22 bp, Artificial Sequence
  chemically synthesized
atgcctccaccttggggctcta

SEQ ID NO: 64905 - DNA, 22 bp, Artificial Sequence
  chemically synthesized
tgcctccaccttggggctctac

SEQ ID NO: 64906 - DNA, 22 bp, Artificial Sequence
  chemically synthesized
caccttggggctctaccaggcg

SEQ ID NO: 64907 - DNA, 22 bp, Artificial Sequence
  chemically synthesized
ggggctctaccaggcgagtgac

SEQ ID NO: 64908 - DNA, 22 bp, Artificial Sequence
  chemically synthesized
gggctctaccaggcgagtgacc

SEQ ID NO: 64909 - DNA, 22 bp, Artificial Sequence
  chemically synthesized
taccaggcgagtgacccacagg

SEQ ID NO: 64910 - DNA, 22 bp, Artificial Sequence
  chemically synthesized
ccaggcgagtgacccacaggat

SEQ ID NO: 64911 - DNA, 22 bp, Artificial Sequence
  chemically synthesized
cagcacacacattcagaccagg

SEQ ID NO: 64912 - DNA, 22 bp, Artificial Sequence
  chemically synthesized
agaccagggaacccacttactg

SEQ ID NO: 64913 - DNA, 22 bp, Artificial Sequence
  chemically synthesized
actggctgtgaggcctcaggtg

SEQ ID NO: 64914 - DNA, 22 bp, Artificial Sequence
  chemically synthesized
ctggctgtgaggcctcaggtga

SEQ ID NO: 64915 - DNA, 22 bp, Artificial Sequence
  chemically synthesized
gctgtgaggcctcaggtgagtt

SEQ ID NO: 64916 - DNA, 22 bp, Artificial Sequence
  chemically synthesized
tgaggcctcaggtgagttgttt

SEQ ID NO: 64917 - DNA, 22 bp, Artificial Sequence
  chemically synthesized
aggtgagttgtttaaccgctcc

SEQ ID NO: 64918 - DNA, 22 bp, Artificial Sequence
  chemically synthesized
tttaaccgctccgagcctcaat

SEQ ID NO: 64919 - DNA, 22 bp, Artificial Sequence
  chemically synthesized
aaccgctccgagcctcaatttc

SEQ ID NO: 64920 - DNA, 22 bp, Artificial Sequence
  chemically synthesized
accgctccgagcctcaatttcc

SEQ ID NO: 64921 - DNA, 22 bp, Artificial Sequence
  chemically synthesized
cgagcctcaatttccctatctg

SEQ ID NO: 64922 - DNA, 22 bp, Artificial Sequence
  chemically synthesized
aatttccctatctgtaaaatgg

SEQ ID NO: 64923 - DNA, 22 bp, Artificial Sequence
  chemically synthesized
ccctatctgtaaaatggggatg

SEQ ID NO: 64924 - DNA, 22 bp, Artificial Sequence
  chemically synthesized
cctatctgtaaaatggggatgg

SEQ ID NO: 64925 - DNA, 22 bp, Artificial Sequence
  chemically synthesized
tctgtaaaatggggatggtgac

SEQ ID NO: 64926 - DNA, 22 bp, Artificial Sequence
  chemically synthesized
taaaatggggatggtgacggta

SEQ ID NO: 64927 - DNA, 22 bp, Artificial Sequence
  chemically synthesized
gttgagctgctgtgaggattaa

SEQ ID NO: 64928 - DNA, 22 bp, Artificial Sequence
  chemically synthesized
ttgagctgctgtgaggattaaa

SEQ ID NO: 64929 - DNA, 22 bp, Artificial Sequence
  chemically synthesized
agctgctgtgaggattaaaatg

SEQ ID NO: 64930 - DNA, 22 bp, Artificial Sequence
  chemically synthesized
ctgtgaggattaaaatgcaaca

SEQ ID NO: 64931 - DNA, 22 bp, Artificial Sequence
  chemically synthesized
tgaggattaaaatgcaacagtt

SEQ ID NO: 64932 - DNA, 22 bp, Artificial Sequence
  chemically synthesized
aaatgcaacagttcaaggaaag

SEQ ID NO: 64933 - DNA, 22 bp, Artificial Sequence
  chemically synthesized
aaggaaagctcagagacgggta

SEQ ID NO: 64934 - DNA, 22 bp, Artificial Sequence
  chemically synthesized
agagacgggtactgggtgtgcc

SEQ ID NO: 64935 - DNA, 22 bp, Artificial Sequence
  chemically synthesized
ggtgtgcccagaaagcccctcc

SEQ ID NO: 64936 - DNA, 22 bp, Artificial Sequence
  chemically synthesized
ctgatgctgccctccctccccc

SEQ ID NO: 64937 - DNA, 22 bp, Artificial Sequence
  chemically synthesized
atgctgccctccctcccccgtg

SEQ ID NO: 64938 - DNA, 22 bp, Artificial Sequence
  chemically synthesized
ccctccctcccccgtgtcaggg

SEQ ID NO: 64939 - DNA, 22 bp, Artificial Sequence
  chemically synthesized
cctcccccgtgtcaggggctgg

SEQ ID NO: 64940 - DNA, 22 bp, Artificial Sequence
  chemically synthesized
ccccgtgtcaggggctggtgtc

SEQ ID NO: 64941 - DNA, 22 bp, Artificial Sequence
  chemically synthesized
gtgtcactggggtggggtgggc

SEQ ID NO: 64942 - DNA, 22 bp, Artificial Sequence
  chemically synthesized
gggtggggtgggccacacttga

SEQ ID NO: 64943 - DNA, 22 bp, Artificial Sequence
  chemically synthesized
gaagagctttcctccaggcagt

SEQ ID NO: 64944 - DNA, 22 bp, Artificial Sequence
  chemically synthesized
aagagctttcctccaggcagtc

SEQ ID NO: 64945 - DNA, 22 bp, Artificial Sequence
  chemically synthesized
tcctccaggcagtctctcattc

SEQ ID NO: 64946 - DNA, 22 bp, Artificial Sequence
  chemically synthesized
cctccaggcagtctctcattca

SEQ ID NO: 64947 - DNA, 22 bp, Artificial Sequence
  chemically synthesized
ctccaggcagtctctcattcag

SEQ ID NO: 64948 - DNA, 22 bp, Artificial Sequence
  chemically synthesized
caggcagtctctcattcagtta

SEQ ID NO: 64949 - DNA, 22 bp, Artificial Sequence
  chemically synthesized
tcattcagttaccctgtgaagg

SEQ ID NO: 64950 - DNA, 22 bp, Artificial Sequence
  chemically synthesized
attcagttaccctgtgaaggga

SEQ ID NO: 64951 - DNA, 22 bp, Artificial Sequence
  chemically synthesized
agttaccctgtgaagggagtag

SEQ ID NO: 64952 - DNA, 22 bp, Artificial Sequence
  chemically synthesized
ccctgtgaagggagtaggtacc

SEQ ID NO: 64953 - DNA, 22 bp, Artificial Sequence
  chemically synthesized
tgaagggagtaggtaccaccct

SEQ ID NO: 64954 - DNA, 22 bp, Artificial Sequence
  chemically synthesized
ctttcaggcagcgggaaactga

SEQ ID NO: 64955 - DNA, 22 bp, Artificial Sequence
  chemically synthesized
tcaggcagcgggaaactgagct

SEQ ID NO: 64956 - DNA, 22 bp, Artificial Sequence
  chemically synthesized
caggcagcgggaaactgagctc

SEQ ID NO: 64957 - DNA, 22 bp, Artificial Sequence
  chemically synthesized
aggcagcgggaaactgagctca

SEQ ID NO: 64958 - DNA, 22 bp, Artificial Sequence
  chemically synthesized
agctcagactcccctccccttc

SEQ ID NO: 64959 - DNA, 22 bp, Artificial Sequence
  chemically synthesized
agactcccctccccttctctct

SEQ ID NO: 64960 - DNA, 22 bp, Artificial Sequence
  chemically synthesized
ccctccccttctctctgagctc

SEQ ID NO: 64961 - DNA, 22 bp, Artificial Sequence
  chemically synthesized
cccttctctctgagctcccttc

SEQ ID NO: 64962 - DNA, 22 bp, Artificial Sequence
  chemically synthesized
ctctctgagctcccttccctgc

SEQ ID NO: 64963 - DNA, 22 bp, Artificial Sequence
  chemically synthesized
tctctgagctcccttccctgca

SEQ ID NO: 64964 - DNA, 22 bp, Artificial Sequence
  chemically synthesized
tctgagctcccttccctgcagc

SEQ ID NO: 64965 - DNA, 22 bp, Artificial Sequence
  chemically synthesized
tgagctcccttccctgcagctc

SEQ ID NO: 64966 - DNA, 22 bp, Artificial Sequence
  chemically synthesized
agctcccttccctgcagctcca

SEQ ID NO: 64967 - DNA, 22 bp, Artificial Sequence
  chemically synthesized
ccttccctgcagctccatcccc

SEQ ID NO: 64968 - DNA, 22 bp, Artificial Sequence
  chemically synthesized
ccctgcagctccatcccctggc

SEQ ID NO: 64969 - DNA, 22 bp, Artificial Sequence
  chemically synthesized
cctgcagctccatcccctggct

SEQ ID NO: 64970 - DNA, 22 bp, Artificial Sequence
  chemically synthesized
cagctccatcccctggcttcag

SEQ ID NO: 64971 - DNA, 22 bp, Artificial Sequence
  chemically synthesized
catcccctggcttcagggcccc

SEQ ID NO: 64972 - DNA, 22 bp, Artificial Sequence
  chemically synthesized
gcttcagggcccctgtccttcc

SEQ ID NO: 64973 - DNA, 22 bp, Artificial Sequence
  chemically synthesized
cagggcccctgtccttcccctg

SEQ ID NO: 64974 - DNA, 22 bp, Artificial Sequence
  chemically synthesized
agggcccctgtccttcccctga

SEQ ID NO: 64975 - DNA, 22 bp, Artificial Sequence
  chemically synthesized
tccttcccctgagctggctgaa

SEQ ID NO: 64976 - DNA, 22 bp, Artificial Sequence
  chemically synthesized
cccctgagctggctgaatggat

SEQ ID NO: 64977 - DNA, 22 bp, Artificial Sequence
  chemically synthesized
ccctgagctggctgaatggata

SEQ ID NO: 64978 - DNA, 22 bp, Artificial Sequence
  chemically synthesized
agctggctgaatggatattccg

SEQ ID NO: 64979 - DNA, 22 bp, Artificial Sequence
  chemically synthesized
gctgaatggatattccgctgct

SEQ ID NO: 64980 - DNA, 22 bp, Artificial Sequence
  chemically synthesized
aatggatattccgctgctctac

SEQ ID NO: 64981 - DNA, 22 bp, Artificial Sequence
  chemically synthesized
cgctgctctacatccactcaca

SEQ ID NO: 64982 - DNA, 22 bp, Artificial Sequence
  chemically synthesized
ctctacatccactcacagctcc

SEQ ID NO: 64983 - DNA, 22 bp, Artificial Sequence
  chemically synthesized
tacatccactcacagctccagc

SEQ ID NO: 64984 - DNA, 22 bp, Artificial Sequence
  chemically synthesized
catccactcacagctccagcac

SEQ ID NO: 64985 - DNA, 22 bp, Artificial Sequence
  chemically synthesized
acagctccagcactgggctgtg

SEQ ID NO: 64986 - DNA, 22 bp, Artificial Sequence
  chemically synthesized
cagcactgggctgtggttgagg

SEQ ID NO: 64987 - DNA, 22 bp, Artificial Sequence
  chemically synthesized
ggctgtggttgaggtcgcctgc

SEQ ID NO: 64988 - DNA, 22 bp, Artificial Sequence
  chemically synthesized
tggttgaggtcgcctgccctcg

SEQ ID NO: 64989 - DNA, 22 bp, Artificial Sequence
  chemically synthesized
aggtcgcctgccctcggtagct

SEQ ID NO: 64990 - DNA, 22 bp, Artificial Sequence
  chemically synthesized
ccctcggtagctcctgggcatt

SEQ ID NO: 64991 - DNA, 22 bp, Artificial Sequence
  chemically synthesized
ggtagctcctgggcatttcttc

SEQ ID NO: 64992 - DNA, 22 bp, Artificial Sequence
  chemically synthesized
ctgggcatttcttcccctctct

SEQ ID NO: 64993 - DNA, 22 bp, Artificial Sequence
  chemically synthesized
ggcatttcttcccctctctggg

SEQ ID NO: 64994 - DNA, 22 bp, Artificial Sequence
  chemically synthesized
cttcccctctctgggcctttgt

SEQ ID NO: 64995 - DNA, 22 bp, Artificial Sequence
  chemically synthesized
ttcccctctctgggcctttgtt

SEQ ID NO: 64996 - DNA, 22 bp, Artificial Sequence
  chemically synthesized
cccctctctgggcctttgtttt

SEQ ID NO: 64997 - DNA, 22 bp, Artificial Sequence
  chemically synthesized
ccctctctgggcctttgttttc

SEQ ID NO: 64998 - DNA, 22 bp, Artificial Sequence
  chemically synthesized
tctgggcctttgttttcccatc

SEQ ID NO: 64999 - DNA, 22 bp, Artificial Sequence
  chemically synthesized
tgggcctttgttttcccatctg

SEQ ID NO: 65000 - DNA, 22 bp, Artificial Sequence
  chemically synthesized
ggcctttgttttcccatctgca

SEQ ID NO: 65001 - DNA, 22 bp, Artificial Sequence
  chemically synthesized
tgttttcccatctgcacaatga

SEQ ID NO: 65002 - DNA, 22 bp, Artificial Sequence
  chemically synthesized
gttttcccatctgcacaatgac

SEQ ID NO: 65003 - DNA, 22 bp, Artificial Sequence
  chemically synthesized
ttttcccatctgcacaatgacc

SEQ ID NO: 65004 - DNA, 22 bp, Artificial Sequence
  chemically synthesized
tcccatctgcacaatgaccccc

SEQ ID NO: 65005 - DNA, 22 bp, Artificial Sequence
  chemically synthesized
cccatctgcacaatgaccccca

SEQ ID NO: 65006 - DNA, 22 bp, Artificial Sequence
  chemically synthesized
ccatctgcacaatgacccccac

SEQ ID NO: 65007 - DNA, 22 bp, Artificial Sequence
  chemically synthesized
cacaatgacccccactctaagc

SEQ ID NO: 65008 - DNA, 22 bp, Artificial Sequence
  chemically synthesized
taagccctgctgtccctcccac

SEQ ID NO: 65009 - DNA, 22 bp, Artificial Sequence
  chemically synthesized
agccctgctgtccctcccacct

SEQ ID NO: 65010 - DNA, 22 bp, Artificial Sequence
  chemically synthesized
ctgtccctcccacctgtggaac

SEQ ID NO: 65011 - DNA, 22 bp, Artificial Sequence
  chemically synthesized
tccctcccacctgtggaactga

SEQ ID NO: 65012 - DNA, 22 bp, Artificial Sequence
  chemically synthesized
ccacctgtggaactgagtgagc

SEQ ID NO: 65013 - DNA, 22 bp, Artificial Sequence
  chemically synthesized
tggaactgagtgagcagcagca

SEQ ID NO: 65014 - DNA, 22 bp, Artificial Sequence
  chemically synthesized
agtgagcagcagcagcaatgtc

SEQ ID NO: 65015 - DNA, 22 bp, Artificial Sequence
  chemically synthesized
tcctgctctcctcaagctctcc

SEQ ID NO: 65016 - DNA, 22 bp, Artificial Sequence
  chemically synthesized
cctgctctcctcaagctctcct

SEQ ID NO: 65017 - DNA, 22 bp, Artificial Sequence
  chemically synthesized
ctgctctcctcaagctctcctc

SEQ ID NO: 65018 - DNA, 22 bp, Artificial Sequence
  chemically synthesized
ctctcctcaagctctcctcaag

SEQ ID NO: 65019 - DNA, 22 bp, Artificial Sequence
  chemically synthesized
tcctcaagctctcctcaagctc

SEQ ID NO: 65020 - DNA, 22 bp, Artificial Sequence
  chemically synthesized
ctcaagctctcctcaagctctg

SEQ ID NO: 65021 - DNA, 22 bp, Artificial Sequence
  chemically synthesized
aagctctcctcaagctctgtct

SEQ ID NO: 65022 - DNA, 22 bp, Artificial Sequence
  chemically synthesized
tcctcaagctctgtctcttctg

SEQ ID NO: 65023 - DNA, 22 bp, Artificial Sequence
  chemically synthesized
ctcaagctctgtctcttctggc

SEQ ID NO: 65024 - DNA, 22 bp, Artificial Sequence
  chemically synthesized
aagctctgtctcttctggcagg

SEQ ID NO: 65025 - DNA, 22 bp, Artificial Sequence
  chemically synthesized
tgtctcttctggcaggcacagg

SEQ ID NO: 65026 - DNA, 22 bp, Artificial Sequence
  chemically synthesized
tctcttctggcaggcacaggag

SEQ ID NO: 65027 - DNA, 22 bp, Artificial Sequence
  chemically synthesized
ttctggcaggcacaggagagtg

SEQ ID NO: 65028 - DNA, 22 bp, Artificial Sequence
  chemically synthesized
ctggcaggcacaggagagtggc

SEQ ID NO: 65029 - DNA, 22 bp, Artificial Sequence
  chemically synthesized
tggcaggcacaggagagtggcc

SEQ ID NO: 65030 - DNA, 22 bp, Artificial Sequence
  chemically synthesized
gcaggcacaggagagtggcctg

SEQ ID NO: 65031 - DNA, 22 bp, Artificial Sequence
  chemically synthesized
aaggctggcaggaggttgccgc

SEQ ID NO: 65032 - DNA, 22 bp, Artificial Sequence
  chemically synthesized
gcaggaggttgccgcccctcca

SEQ ID NO: 65033 - DNA, 22 bp, Artificial Sequence
  chemically synthesized
ccgcccctccaacctggaattc

SEQ ID NO: 65034 - DNA, 22 bp, Artificial Sequence
  chemically synthesized
caacctggaattcctggcagca

SEQ ID NO: 65035 - DNA, 22 bp, Artificial Sequence
  chemically synthesized
gaattcctggcagcagcagcgg

SEQ ID NO: 65036 - DNA, 22 bp, Artificial Sequence
  chemically synthesized
ctggcagcagcagcggctaggc

SEQ ID NO: 65037 - DNA, 22 bp, Artificial Sequence
  chemically synthesized
gcagcagcagcggctaggcctt

SEQ ID NO: 65038 - DNA, 22 bp, Artificial Sequence
  chemically synthesized
ggccttcctcggaggcccgacc

SEQ ID NO: 65039 - DNA, 22 bp, Artificial Sequence
  chemically synthesized
cctcggaggcccgaccccctcc

SEQ ID NO: 65040 - DNA, 22 bp, Artificial Sequence
  chemically synthesized
ctcggaggcccgaccccctcct

SEQ ID NO: 65041 - DNA, 22 bp, Artificial Sequence
  chemically synthesized
ggaggcccgaccccctcctcct

SEQ ID NO: 65042 - DNA, 22 bp, Artificial Sequence
  chemically synthesized
ctccttcttggttcagctcagg

SEQ ID NO: 65043 - DNA, 22 bp, Artificial Sequence
  chemically synthesized
cttcttggttcagctcaggact

SEQ ID NO: 65044 - DNA, 22 bp, Artificial Sequence
  chemically synthesized
cttggttcagctcaggactctg

SEQ ID NO: 65045 - DNA, 22 bp, Artificial Sequence
  chemically synthesized
ttggttcagctcaggactctga

SEQ ID NO: 65046 - DNA, 22 bp, Artificial Sequence
  chemically synthesized
ggttcagctcaggactctgagg

SEQ ID NO: 65047 - DNA, 22 bp, Artificial Sequence
  chemically synthesized
gttcagctcaggactctgaggg

SEQ ID NO: 65048 - DNA, 22 bp, Artificial Sequence
  chemically synthesized
agctcaggactctgagggttgc

SEQ ID NO: 65049 - DNA, 22 bp, Artificial Sequence
  chemically synthesized
aggactctgagggttgctgcgt

SEQ ID NO: 65050 - DNA, 22 bp, Artificial Sequence
  chemically synthesized
tgagggttgctgcgtggaggca

SEQ ID NO: 65051 - DNA, 22 bp, Artificial Sequence
  chemically synthesized
agggttgctgcgtggaggcagt

SEQ ID NO: 65052 - DNA, 22 bp, Artificial Sequence
  chemically synthesized
ctgcgtggaggcagtgcatgcc

SEQ ID NO: 65053 - DNA, 22 bp, Artificial Sequence
  chemically synthesized
cgtggaggcagtgcatgccctg

SEQ ID NO: 65054 - DNA, 22 bp, Artificial Sequence
  chemically synthesized
ggcacagtgcccagttcctgcc

SEQ ID NO: 65055 - DNA, 22 bp, Artificial Sequence
  chemically synthesized
ctgcccacccaggaagtagact

SEQ ID NO: 65056 - DNA, 22 bp, Artificial Sequence
  chemically synthesized
cccacccaggaagtagacttcg

SEQ ID NO: 65057 - DNA, 22 bp, Artificial Sequence
  chemically synthesized
cgggtggaggcagtaggctggg

SEQ ID NO: 65058 - DNA, 22 bp, Artificial Sequence
  chemically synthesized
gggtggaggcagtaggctgggg

SEQ ID NO: 65059 - DNA, 22 bp, Artificial Sequence
  chemically synthesized
gggaggggcggggagcttggac

SEQ ID NO: 65060 - DNA, 22 bp, Artificial Sequence
  chemically synthesized
ggacaggaaggagccttgctca

SEQ ID NO: 65061 - DNA, 22 bp, Artificial Sequence
  chemically synthesized
gacaggaaggagccttgctcat

SEQ ID NO: 65062 - DNA, 22 bp, Artificial Sequence
  chemically synthesized
gctcattgcccggcagacacaa

SEQ ID NO: 65063 - DNA, 22 bp, Artificial Sequence
  chemically synthesized
ctcattgcccggcagacacaag

SEQ ID NO: 65064 - DNA, 22 bp, Artificial Sequence
  chemically synthesized
attgcccggcagacacaagact

SEQ ID NO: 65065 - DNA, 22 bp, Artificial Sequence
  chemically synthesized
cccggcagacacaagactgggc

SEQ ID NO: 65066 - DNA, 22 bp, Artificial Sequence
  chemically synthesized
ggccctcataaactcagacagc

SEQ ID NO: 65067 - DNA, 22 bp, Artificial Sequence
  chemically synthesized
ataaactcagacagcccggcat

SEQ ID NO: 65068 - DNA, 22 bp, Artificial Sequence
  chemically synthesized
agacagcccggcatgtcacctg

SEQ ID NO: 65069 - DNA, 22 bp, Artificial Sequence
  chemically synthesized
ttgtacctgccctttcagctct

SEQ ID NO: 65070 - DNA, 22 bp, Artificial Sequence
  chemically synthesized
tacctgccctttcagctctgtg

SEQ ID NO: 65071 - DNA, 22 bp, Artificial Sequence
  chemically synthesized
ccctttcagctctgtgacccgg

SEQ ID NO: 65072 - DNA, 22 bp, Artificial Sequence
  chemically synthesized
tcagctctgtgacccgggacaa

SEQ ID NO: 65073 - DNA, 22 bp, Artificial Sequence
  chemically synthesized
cagctctgtgacccgggacaag

SEQ ID NO: 65074 - DNA, 22 bp, Artificial Sequence
  chemically synthesized
agctctgtgacccgggacaagt

SEQ ID NO: 65075 - DNA, 22 bp, Artificial Sequence
  chemically synthesized
tgtgacccgggacaagtcaccc

SEQ ID NO: 65076 - DNA, 22 bp, Artificial Sequence
  chemically synthesized
tgacccgggacaagtcaccctc

SEQ ID NO: 65077 - DNA, 22 bp, Artificial Sequence
  chemically synthesized
tccctttgagttgccgcaagag

SEQ ID NO: 65078 - DNA, 22 bp, Artificial Sequence
  chemically synthesized
cctttgagttgccgcaagaggt

SEQ ID NO: 65079 - DNA, 22 bp, Artificial Sequence
  chemically synthesized
tgagttgccgcaagaggtacag

SEQ ID NO: 65080 - DNA, 22 bp, Artificial Sequence
  chemically synthesized
gagttgccgcaagaggtacagt

SEQ ID NO: 65081 - DNA, 22 bp, Artificial Sequence
  chemically synthesized
agttgccgcaagaggtacagtc

SEQ ID NO: 65082 - DNA, 22 bp, Artificial Sequence
  chemically synthesized
ccgcaagaggtacagtcacact

SEQ ID NO: 65083 - DNA, 22 bp, Artificial Sequence
  chemically synthesized
cccagaggattactagaaatga

SEQ ID NO: 65084 - DNA, 22 bp, Artificial Sequence
  chemically synthesized
ctagaaatgacaggcctcgccc

SEQ ID NO: 65085 - DNA, 22 bp, Artificial Sequence
  chemically synthesized
gaaatgacaggcctcgccctcc

SEQ ID NO: 65086 - DNA, 22 bp, Artificial Sequence
  chemically synthesized
gccctcctggcacagacctggc

SEQ ID NO: 65087 - DNA, 22 bp, Artificial Sequence
  chemically synthesized
ctggcacagacctggcaccaat

SEQ ID NO: 65088 - DNA, 22 bp, Artificial Sequence
  chemically synthesized
gcacagacctggcaccaataac

SEQ ID NO: 65089 - DNA, 22 bp, Artificial Sequence
  chemically synthesized
gcaccaataactggcaggtttc

SEQ ID NO: 65090 - DNA, 22 bp, Artificial Sequence
  chemically synthesized
gcaggtttctggggccagctgc

SEQ ID NO: 65091 - DNA, 22 bp, Artificial Sequence
  chemically synthesized
ctggggccagctgcagagggaa

SEQ ID NO: 65092 - DNA, 22 bp, Artificial Sequence
  chemically synthesized
tggggccagctgcagagggaag

SEQ ID NO: 65093 - DNA, 22 bp, Artificial Sequence
  chemically synthesized
gggccagctgcagagggaagag

SEQ ID NO: 65094 - DNA, 22 bp, Artificial Sequence
  chemically synthesized
cagagggaagaggactgagcca

SEQ ID NO: 65095 - DNA, 22 bp, Artificial Sequence
  chemically synthesized
agccacctatgaaatgcccagt

SEQ ID NO: 65096 - DNA, 22 bp, Artificial Sequence
  chemically synthesized
tgaaatgcccagtgggcagccc

SEQ ID NO: 65097 - DNA, 22 bp, Artificial Sequence
  chemically synthesized
ggcaggtctgtgtgcactgggg

SEQ ID NO: 65098 - DNA, 22 bp, Artificial Sequence
  chemically synthesized
tgtgcactggggaggtgtgtgt

SEQ ID NO: 65099 - DNA, 22 bp, Artificial Sequence
  chemically synthesized
gggaggtgtgtgtcataggacc

SEQ ID NO: 65100 - DNA, 22 bp, Artificial Sequence
  chemically synthesized
gctgggtgcagaagggattgca

SEQ ID NO: 65101 - DNA, 22 bp, Artificial Sequence
  chemically synthesized
ggtgcagaagggattgcagtgg

SEQ ID NO: 65102 - DNA, 22 bp, Artificial Sequence
  chemically synthesized
cagtggggagctggggcttttg

SEQ ID NO: 65103 - DNA, 22 bp, Artificial Sequence
  chemically synthesized
gggcttttggaggaggaatgaa

SEQ ID NO: 65104 - DNA, 22 bp, Artificial Sequence
  chemically synthesized
ttggaggaggaatgaagaaagc

SEQ ID NO: 65105 - DNA, 22 bp, Artificial Sequence
  chemically synthesized
tggaggaggaatgaagaaagca

SEQ ID NO: 65106 - DNA, 22 bp, Artificial Sequence
  chemically synthesized
ggaggaggaatgaagaaagcat

SEQ ID NO: 65107 - DNA, 22 bp, Artificial Sequence
  chemically synthesized
gaggaggaatgaagaaagcatg

SEQ ID NO: 65108 - DNA, 22 bp, Artificial Sequence
  chemically synthesized
agaatttggggtcctgctcttt

SEQ ID NO: 65109 - DNA, 22 bp, Artificial Sequence
  chemically synthesized
ggggtcctgctcttttggcagg

SEQ ID NO: 65110 - DNA, 22 bp, Artificial Sequence
  chemically synthesized
gggtcctgctcttttggcaggg

SEQ ID NO: 65111 - DNA, 22 bp, Artificial Sequence
  chemically synthesized
ctcttttggcagggctctaggc

SEQ ID NO: 65112 - DNA, 22 bp, Artificial Sequence
  chemically synthesized
ttttggcagggctctaggctca

SEQ ID NO: 65113 - DNA, 22 bp, Artificial Sequence
  chemically synthesized
ttggcagggctctaggctcagc

SEQ ID NO: 65114 - DNA, 22 bp, Artificial Sequence
  chemically synthesized
tggcagggctctaggctcagcc

SEQ ID NO: 65115 - DNA, 22 bp, Artificial Sequence
  chemically synthesized
ggcagggctctaggctcagccc

SEQ ID NO: 65116 - DNA, 22 bp, Artificial Sequence
  chemically synthesized
gcagggctctaggctcagcccc

SEQ ID NO: 65117 - DNA, 22 bp, Artificial Sequence
  chemically synthesized
taggctcagcccccgccctgct

SEQ ID NO: 65118 - DNA, 22 bp, Artificial Sequence
  chemically synthesized
ggctcagcccccgccctgctct

SEQ ID NO: 65119 - DNA, 22 bp, Artificial Sequence
  chemically synthesized
agcccccgccctgctctggaca

SEQ ID NO: 65120 - DNA, 22 bp, Artificial Sequence
  chemically synthesized
ctctggacatccatcctgggag

SEQ ID NO: 65121 - DNA, 22 bp, Artificial Sequence
  chemically synthesized
tggacatccatcctgggaggaa

SEQ ID NO: 65122 - DNA, 22 bp, Artificial Sequence
  chemically synthesized
gacatccatcctgggaggaagg

SEQ ID NO: 65123 - DNA, 22 bp, Artificial Sequence
  chemically synthesized
ggaggaagggctaggataatct

SEQ ID NO: 65124 - DNA, 22 bp, Artificial Sequence
  chemically synthesized
ggataatctggaaaaacgcacc

SEQ ID NO: 65125 - DNA, 22 bp, Artificial Sequence
  chemically synthesized
gaaaaacgcaccaggacaaaat

SEQ ID NO: 65126 - DNA, 22 bp, Artificial Sequence
  chemically synthesized
tggtgggaggggtgggagtact

SEQ ID NO: 65127 - DNA, 22 bp, Artificial Sequence
  chemically synthesized
agtggccattcacaaggatact

SEQ ID NO: 65128 - DNA, 22 bp, Artificial Sequence
  chemically synthesized
acaaggatactgtgcccccagg

SEQ ID NO: 65129 - DNA, 22 bp, Artificial Sequence
  chemically synthesized
tgcccccaggaaccccaggaca

SEQ ID NO: 65130 - DNA, 22 bp, Artificial Sequence
  chemically synthesized
gtccacctggttacttccacaa

SEQ ID NO: 65131 - DNA, 22 bp, Artificial Sequence
  chemically synthesized
tccacctggttacttccacaat

SEQ ID NO: 65132 - DNA, 22 bp, Artificial Sequence
  chemically synthesized
gttacttccacaattgtctatt

SEQ ID NO: 65133 - DNA, 22 bp, Artificial Sequence
  chemically synthesized
cttccacaattgtctattgcag

SEQ ID NO: 65134 - DNA, 22 bp, Artificial Sequence
  chemically synthesized
ccacaattgtctattgcagcat

SEQ ID NO: 65135 - DNA, 22 bp, Artificial Sequence
  chemically synthesized
cacaattgtctattgcagcatc

SEQ ID NO: 65136 - DNA, 22 bp, Artificial Sequence
  chemically synthesized
tctattgcagcatctgggctga

SEQ ID NO: 65137 - DNA, 22 bp, Artificial Sequence
  chemically synthesized
ttgcagcatctgggctgatccc

SEQ ID NO: 65138 - DNA, 22 bp, Artificial Sequence
  chemically synthesized
cagcatctgggctgatcccccc

SEQ ID NO: 65139 - DNA, 22 bp, Artificial Sequence
  chemically synthesized
ggctgatccccccagaggaaat

SEQ ID NO: 65140 - DNA, 22 bp, Artificial Sequence
  chemically synthesized
atccccccagaggaaatgcatc

SEQ ID NO: 65141 - DNA, 22 bp, Artificial Sequence
  chemically synthesized
tgagctggtcatgagtaagggg

SEQ ID NO: 65142 - DNA, 22 bp, Artificial Sequence
  chemically synthesized
gtcatgagtaaggggcatctgg

SEQ ID NO: 65143 - DNA, 22 bp, Artificial Sequence
  chemically synthesized
ggggaggccctgccccaccaca

SEQ ID NO: 65144 - DNA, 22 bp, Artificial Sequence
  chemically synthesized
ccccaccacagggccctgcctg

SEQ ID NO: 65145 - DNA, 22 bp, Artificial Sequence
  chemically synthesized
cctggagatgggagcctcgtgg

SEQ ID NO: 65146 - DNA, 22 bp, Artificial Sequence
  chemically synthesized
gagatgggagcctcgtggtatg

SEQ ID NO: 65147 - DNA, 22 bp, Artificial Sequence
  chemically synthesized
gtggtatgggctggatagggat

SEQ ID NO: 65148 - DNA, 22 bp, Artificial Sequence
  chemically synthesized
gatagggatgtgagagtcgaga

SEQ ID NO: 65149 - DNA, 22 bp, Artificial Sequence
  chemically synthesized
ggggtctgcagcaaggaatcgg

SEQ ID NO: 65150 - DNA, 22 bp, Artificial Sequence
  chemically synthesized
gggtctgcagcaaggaatcggg

SEQ ID NO: 65151 - DNA, 22 bp, Artificial Sequence
  chemically synthesized
cagcaaggaatcgggtaagggg

SEQ ID NO: 65152 - DNA, 22 bp, Artificial Sequence
  chemically synthesized
ggccaagtaaatcaagactgag

SEQ ID NO: 65153 - DNA, 22 bp, Artificial Sequence
  chemically synthesized
agtggctggtcaggagaacaac

SEQ ID NO: 65154 - DNA, 22 bp, Artificial Sequence
  chemically synthesized
gtcaggagaacaacagtggact

SEQ ID NO: 65155 - DNA, 22 bp, Artificial Sequence
  chemically synthesized
catgggagctgaactcattggc

SEQ ID NO: 65156 - DNA, 22 bp, Artificial Sequence
  chemically synthesized
atgggagctgaactcattggca

SEQ ID NO: 65157 - DNA, 22 bp, Artificial Sequence
  chemically synthesized
aactcattggcaaagtgccccc

SEQ ID NO: 65158 - DNA, 22 bp, Artificial Sequence
  chemically synthesized
attggcaaagtgcccccggaga

SEQ ID NO: 65159 - DNA, 22 bp, Artificial Sequence
  chemically synthesized
gcaaagtgcccccggagagtgc

SEQ ID NO: 65160 - DNA, 22 bp, Artificial Sequence
  chemically synthesized
gccaccccacaaacacacacac

SEQ ID NO: 65161 - DNA, 22 bp, Artificial Sequence
  chemically synthesized
actatgcaccctccttcccagg

SEQ ID NO: 65162 - DNA, 22 bp, Artificial Sequence
  chemically synthesized
tgcaccctccttcccaggcacc

SEQ ID NO: 65163 - DNA, 22 bp, Artificial Sequence
  chemically synthesized
cttcccaggcaccagcttcctt

SEQ ID NO: 65164 - DNA, 22 bp, Artificial Sequence
  chemically synthesized
cccaggcaccagcttccttctt

SEQ ID NO: 65165 - DNA, 22 bp, Artificial Sequence
  chemically synthesized
ccaggcaccagcttccttcttt

SEQ ID NO: 65166 - DNA, 22 bp, Artificial Sequence
  chemically synthesized
ccttctttgagagtcagtgcag

SEQ ID NO: 65167 - DNA, 22 bp, Artificial Sequence
  chemically synthesized
cttctttgagagtcagtgcagg

SEQ ID NO: 65168 - DNA, 22 bp, Artificial Sequence
  chemically synthesized
ctttgagagtcagtgcaggtca

SEQ ID NO: 65169 - DNA, 22 bp, Artificial Sequence
  chemically synthesized
tttgagagtcagtgcaggtcac

SEQ ID NO: 65170 - DNA, 22 bp, Artificial Sequence
  chemically synthesized
tgagagtcagtgcaggtcactg

SEQ ID NO: 65171 - DNA, 22 bp, Artificial Sequence
  chemically synthesized
gagagtcagtgcaggtcactgg

SEQ ID NO: 65172 - DNA, 22 bp, Artificial Sequence
  chemically synthesized
agagtcagtgcaggtcactggt

SEQ ID NO: 65173 - DNA, 22 bp, Artificial Sequence
  chemically synthesized
gttaaggcgtgggttcgggatc

SEQ ID NO: 65174 - DNA, 22 bp, Artificial Sequence
  chemically synthesized
aggcgtgggttcgggatctaat

SEQ ID NO: 65175 - DNA, 22 bp, Artificial Sequence
  chemically synthesized
gggatctaatatctggggccaa

SEQ ID NO: 65176 - DNA, 22 bp, Artificial Sequence
  chemically synthesized
atatctggggccaagccttagc

SEQ ID NO: 65177 - DNA, 22 bp, Artificial Sequence
  chemically synthesized
gggccaagccttagctccatcg

SEQ ID NO: 65178 - DNA, 22 bp, Artificial Sequence
  chemically synthesized
agctccatcgctctttttgtga

SEQ ID NO: 65179 - DNA, 22 bp, Artificial Sequence
  chemically synthesized
gctccatcgctctttttgtgag

SEQ ID NO: 65180 - DNA, 22 bp, Artificial Sequence
  chemically synthesized
catcgctctttttgtgagctct

SEQ ID NO: 65181 - DNA, 22 bp, Artificial Sequence
  chemically synthesized
tttttgtgagctcttagacaag

SEQ ID NO: 65182 - DNA, 22 bp, Artificial Sequence
  chemically synthesized
tttgtgagctcttagacaagcc

SEQ ID NO: 65183 - DNA, 22 bp, Artificial Sequence
  chemically synthesized
ttgtgagctcttagacaagcca

SEQ ID NO: 65184 - DNA, 22 bp, Artificial Sequence
  chemically synthesized
tgtgagctcttagacaagccac

SEQ ID NO: 65185 - DNA, 22 bp, Artificial Sequence
  chemically synthesized
gtgagctcttagacaagccact

SEQ ID NO: 65186 - DNA, 22 bp, Artificial Sequence
  chemically synthesized
tgagctcttagacaagccactt

SEQ ID NO: 65187 - DNA, 22 bp, Artificial Sequence
  chemically synthesized
ttagacaagccacttaacctct

SEQ ID NO: 65188 - DNA, 22 bp, Artificial Sequence
  chemically synthesized
agacaagccacttaacctctct

SEQ ID NO: 65189 - DNA, 22 bp, Artificial Sequence
  chemically synthesized
gacaagccacttaacctctctg

SEQ ID NO: 65190 - DNA, 22 bp, Artificial Sequence
  chemically synthesized
aacctctctgtgcctcggtttc

SEQ ID NO: 65191 - DNA, 22 bp, Artificial Sequence
  chemically synthesized
acctctctgtgcctcggtttcc

SEQ ID NO: 65192 - DNA, 22 bp, Artificial Sequence
  chemically synthesized
tctgtgcctcggtttcctcatc

SEQ ID NO: 65193 - DNA, 22 bp, Artificial Sequence
  chemically synthesized
tgtgcctcggtttcctcatctg

SEQ ID NO: 65194 - DNA, 22 bp, Artificial Sequence
  chemically synthesized
tgcctcggtttcctcatctgtg

SEQ ID NO: 65195 - DNA, 22 bp, Artificial Sequence
  chemically synthesized
ggtttcctcatctgtgagatag

SEQ ID NO: 65196 - DNA, 22 bp, Artificial Sequence
  chemically synthesized
cctcatctgtgagataggaaga

SEQ ID NO: 65197 - DNA, 22 bp, Artificial Sequence
  chemically synthesized
ctcatctgtgagataggaagac

SEQ ID NO: 65198 - DNA, 22 bp, Artificial Sequence
  chemically synthesized
atctgtgagataggaagactct

SEQ ID NO: 65199 - DNA, 22 bp, Artificial Sequence
  chemically synthesized
tgagataggaagactctaagaa

SEQ ID NO: 65200 - DNA, 22 bp, Artificial Sequence
  chemically synthesized
taagaagagtcacttccatcag

SEQ ID NO: 65201 - DNA, 22 bp, Artificial Sequence
  chemically synthesized
agaagagtcacttccatcagga

SEQ ID NO: 65202 - DNA, 22 bp, Artificial Sequence
  chemically synthesized
ccatcaggactgtgaagatcga

SEQ ID NO: 65203 - DNA, 22 bp, Artificial Sequence
  chemically synthesized
catcaggactgtgaagatcgaa

SEQ ID NO: 65204 - DNA, 22 bp, Artificial Sequence
  chemically synthesized
tgaagatcgaatgagataataa

SEQ ID NO: 65205 - DNA, 22 bp, Artificial Sequence
  chemically synthesized
aagcacttcgggcagcctctgg

SEQ ID NO: 65206 - DNA, 22 bp, Artificial Sequence
  chemically synthesized
agcacttcgggcagcctctggc

SEQ ID NO: 65207 - DNA, 22 bp, Artificial Sequence
  chemically synthesized
cgggcagcctctggcatgtgat

SEQ ID NO: 65208 - DNA, 22 bp, Artificial Sequence
  chemically synthesized
gggcagcctctggcatgtgatg

SEQ ID NO: 65209 - DNA, 22 bp, Artificial Sequence
  chemically synthesized
tggcatgtgatgggccccaagt

SEQ ID NO: 65210 - DNA, 22 bp, Artificial Sequence
  chemically synthesized
gcatgtgatgggccccaagtca

SEQ ID NO: 65211 - DNA, 22 bp, Artificial Sequence
  chemically synthesized
accaccaaaggccatgaccttt

SEQ ID NO: 65212 - DNA, 22 bp, Artificial Sequence
  chemically synthesized
tggggatgtgtcctggctctga

SEQ ID NO: 65213 - DNA, 22 bp, Artificial Sequence
  chemically synthesized
ggggatgtgtcctggctctgaa

SEQ ID NO: 65214 - DNA, 22 bp, Artificial Sequence
  chemically synthesized
gggatgtgtcctggctctgaaa

SEQ ID NO: 65215 - DNA, 22 bp, Artificial Sequence
  chemically synthesized
gctctgaaaaaccatatagatg

SEQ ID NO: 65216 - DNA, 22 bp, Artificial Sequence
  chemically synthesized
tgaaaaaccatatagatgggtc

SEQ ID NO: 65217 - DNA, 22 bp, Artificial Sequence
  chemically synthesized
aaaaaccatatagatgggtctc

SEQ ID NO: 65218 - DNA, 22 bp, Artificial Sequence
  chemically synthesized
aggggtctaagtgggggaacaa

SEQ ID NO: 65219 - DNA, 22 bp, Artificial Sequence
  chemically synthesized
agtgggggaacaactgctgcgt

SEQ ID NO: 65220 - DNA, 22 bp, Artificial Sequence
  chemically synthesized
ctgcgtttggccccagatttgg

SEQ ID NO: 65221 - DNA, 22 bp, Artificial Sequence
  chemically synthesized
cgtttggccccagatttgggga

SEQ ID NO: 65222 - DNA, 22 bp, Artificial Sequence
  chemically synthesized
ggccccagatttggggagcagc

SEQ ID NO: 65223 - DNA, 22 bp, Artificial Sequence
  chemically synthesized
gccccagatttggggagcagca

SEQ ID NO: 65224 - DNA, 22 bp, Artificial Sequence
  chemically synthesized
ggggagcagcacctgttgttga

SEQ ID NO: 65225 - DNA, 22 bp, Artificial Sequence
  chemically synthesized
gggagcagcacctgttgttgag

SEQ ID NO: 65226 - DNA, 22 bp, Artificial Sequence
  chemically synthesized
ttgttgagggacacctcctcag

SEQ ID NO: 65227 - DNA, 22 bp, Artificial Sequence
  chemically synthesized
ttgagggacacctcctcagatt

SEQ ID NO: 65228 - DNA, 22 bp, Artificial Sequence
  chemically synthesized
agggacacctcctcagattcaa

SEQ ID NO: 65229 - DNA, 22 bp, Artificial Sequence
  chemically synthesized
ctcagattcaaacttccatttt

SEQ ID NO: 65230 - DNA, 22 bp, Artificial Sequence
  chemically synthesized
agattcaaacttccattttttc

SEQ ID NO: 65231 - DNA, 22 bp, Artificial Sequence
  chemically synthesized
aaacttccattttttccagaaa

SEQ ID NO: 65232 - DNA, 22 bp, Artificial Sequence
  chemically synthesized
ccattttttccagaaaaggctg

SEQ ID NO: 65233 - DNA, 22 bp, Artificial Sequence
  chemically synthesized
cattttttccagaaaaggctgt

SEQ ID NO: 65234 - DNA, 22 bp, Artificial Sequence
  chemically synthesized
tttccagaaaaggctgtcaatc

SEQ ID NO: 65235 - DNA, 22 bp, Artificial Sequence
  chemically synthesized
ttccagaaaaggctgtcaatcc

SEQ ID NO: 65236 - DNA, 22 bp, Artificial Sequence
  chemically synthesized
tccagaaaaggctgtcaatccc

SEQ ID NO: 65237 - DNA, 22 bp, Artificial Sequence
  chemically synthesized
ccagaaaaggctgtcaatcccc

SEQ ID NO: 65238 - DNA, 22 bp, Artificial Sequence
  chemically synthesized
cagaaaaggctgtcaatcccct

SEQ ID NO: 65239 - DNA, 22 bp, Artificial Sequence
  chemically synthesized
tcaatcccctctttaggggccg

SEQ ID NO: 65240 - DNA, 22 bp, Artificial Sequence
  chemically synthesized
tttaggggccgtgctcattttg

SEQ ID NO: 65241 - DNA, 22 bp, Artificial Sequence
  chemically synthesized
taggggccgtgctcattttggc

SEQ ID NO: 65242 - DNA, 22 bp, Artificial Sequence
  chemically synthesized
aggggccgtgctcattttggct

SEQ ID NO: 65243 - DNA, 22 bp, Artificial Sequence
  chemically synthesized
ggggccgtgctcattttggctt

SEQ ID NO: 65244 - DNA, 22 bp, Artificial Sequence
  chemically synthesized
attttggctttccgaaggtgaa

SEQ ID NO: 65245 - DNA, 22 bp, Artificial Sequence
  chemically synthesized
tggctttccgaaggtgaagggc

SEQ ID NO: 65246 - DNA, 22 bp, Artificial Sequence
  chemically synthesized
ggctttccgaaggtgaagggcc

SEQ ID NO: 65247 - DNA, 22 bp, Artificial Sequence
  chemically synthesized
gctttccgaaggtgaagggcca

SEQ ID NO: 65248 - DNA, 22 bp, Artificial Sequence
  chemically synthesized
tccgaaggtgaagggccaggtg

SEQ ID NO: 65249 - DNA, 22 bp, Artificial Sequence
  chemically synthesized
ccgaaggtgaagggccaggtgc

SEQ ID NO: 65250 - DNA, 22 bp, Artificial Sequence
  chemically synthesized
cgaaggtgaagggccaggtgcc

SEQ ID NO: 65251 - DNA, 22 bp, Artificial Sequence
  chemically synthesized
cagcatctttctgagcacctgt

SEQ ID NO: 65252 - DNA, 22 bp, Artificial Sequence
  chemically synthesized
agcatctttctgagcacctgtg

SEQ ID NO: 65253 - DNA, 22 bp, Artificial Sequence
  chemically synthesized
tctgagcacctgtgacatgcag

SEQ ID NO: 65254 - DNA, 22 bp, Artificial Sequence
  chemically synthesized
ctgagcacctgtgacatgcaga

SEQ ID NO: 65255 - DNA, 22 bp, Artificial Sequence
  chemically synthesized
tgagcacctgtgacatgcagag

SEQ ID NO: 65256 - DNA, 22 bp, Artificial Sequence
  chemically synthesized
agcacctgtgacatgcagagga

SEQ ID NO: 65257 - DNA, 22 bp, Artificial Sequence
  chemically synthesized
tgacatgcagaggatgtggggt

SEQ ID NO: 65258 - DNA, 22 bp, Artificial Sequence
  chemically synthesized
cagctaggtggacttggatccg

SEQ ID NO: 65259 - DNA, 22 bp, Artificial Sequence
  chemically synthesized
ggtggacttggatccgggggag

SEQ ID NO: 65260 - DNA, 22 bp, Artificial Sequence
  chemically synthesized
ggatccgggggaggccctcagt

SEQ ID NO: 65261 - DNA, 22 bp, Artificial Sequence
  chemically synthesized
gatccgggggaggccctcagtt

SEQ ID NO: 65262 - DNA, 22 bp, Artificial Sequence
  chemically synthesized
agttctctgagccttggtttcc

SEQ ID NO: 65263 - DNA, 22 bp, Artificial Sequence
  chemically synthesized
tctgagccttggtttcctcatc

SEQ ID NO: 65264 - DNA, 22 bp, Artificial Sequence
  chemically synthesized
tgagccttggtttcctcatcta

SEQ ID NO: 65265 - DNA, 22 bp, Artificial Sequence
  chemically synthesized
agccttggtttcctcatctata

SEQ ID NO: 65266 - DNA, 22 bp, Artificial Sequence
  chemically synthesized
ggtttcctcatctataaaatag

SEQ ID NO: 65267 - DNA, 22 bp, Artificial Sequence
  chemically synthesized
gtttcctcatctataaaatagg

SEQ ID NO: 65268 - DNA, 22 bp, Artificial Sequence
  chemically synthesized
cctcatctataaaatagggata

SEQ ID NO: 65269 - DNA, 22 bp, Artificial Sequence
  chemically synthesized
ctcatctataaaatagggataa

SEQ ID NO: 65270 - DNA, 22 bp, Artificial Sequence
  chemically synthesized
atctataaaatagggataaaag

SEQ ID NO: 65271 - DNA, 22 bp, Artificial Sequence
  chemically synthesized
taaaatagggataaaagtttct

SEQ ID NO: 65272 - DNA, 22 bp, Artificial Sequence
  chemically synthesized
ctttcccacatagctcttctga

SEQ ID NO: 65273 - DNA, 22 bp, Artificial Sequence
  chemically synthesized
tttcccacatagctcttctgag

SEQ ID NO: 65274 - DNA, 22 bp, Artificial Sequence
  chemically synthesized
tcccacatagctcttctgaggc

SEQ ID NO: 65275 - DNA, 22 bp, Artificial Sequence
  chemically synthesized
cccacatagctcttctgaggct

SEQ ID NO: 65276 - DNA, 22 bp, Artificial Sequence
  chemically synthesized
ccacatagctcttctgaggctt

SEQ ID NO: 65277 - DNA, 22 bp, Artificial Sequence
  chemically synthesized
ttctgaggcttagatgaggcga

SEQ ID NO: 65278 - DNA, 22 bp, Artificial Sequence
  chemically synthesized
ctgaggcttagatgaggcgatg

SEQ ID NO: 65279 - DNA, 22 bp, Artificial Sequence
  chemically synthesized
tgaggcttagatgaggcgatgc

SEQ ID NO: 65280 - DNA, 22 bp, Artificial Sequence
  chemically synthesized
aggcttagatgaggcgatgctg

SEQ ID NO: 65281 - DNA, 22 bp, Artificial Sequence
  chemically synthesized
agatgaggcgatgctggtgggg

SEQ ID NO: 65282 - DNA, 22 bp, Artificial Sequence
  chemically synthesized
gatgaggcgatgctggtggggt

SEQ ID NO: 65283 - DNA, 22 bp, Artificial Sequence
  chemically synthesized
gtggggtgtttaacacagagct

SEQ ID NO: 65284 - DNA, 22 bp, Artificial Sequence
  chemically synthesized
aacacagagctctgttagcata

SEQ ID NO: 65285 - DNA, 22 bp, Artificial Sequence
  chemically synthesized
acacagagctctgttagcataa

SEQ ID NO: 65286 - DNA, 22 bp, Artificial Sequence
  chemically synthesized
tgttagcataatggacacttgt

SEQ ID NO: 65287 - DNA, 22 bp, Artificial Sequence
  chemically synthesized
ttagcataatggacacttgtgt

SEQ ID NO: 65288 - DNA, 22 bp, Artificial Sequence
  chemically synthesized
gcataatggacacttgtgtctg

SEQ ID NO: 65289 - DNA, 22 bp, Artificial Sequence
  chemically synthesized
gtgtctgtcttcttataactca

SEQ ID NO: 65290 - DNA, 22 bp, Artificial Sequence
  chemically synthesized
tgtctgtcttcttataactcat

SEQ ID NO: 65291 - DNA, 22 bp, Artificial Sequence
  chemically synthesized
tcttcttataactcatttaatg

SEQ ID NO: 65292 - DNA, 22 bp, Artificial Sequence
  chemically synthesized
cttataactcatttaatgaatg

SEQ ID NO: 65293 - DNA, 22 bp, Artificial Sequence
  chemically synthesized
ttataactcatttaatgaatga

SEQ ID NO: 65294 - DNA, 22 bp, Artificial Sequence
  chemically synthesized
ataactcatttaatgaatgaat

SEQ ID NO: 65295 - DNA, 22 bp, Artificial Sequence
  chemically synthesized
taactcatttaatgaatgaatg

SEQ ID NO: 65296 - DNA, 22 bp, Artificial Sequence
  chemically synthesized
atttaatgaatgaatgaagttt

SEQ ID NO: 65297 - DNA, 22 bp, Artificial Sequence
  chemically synthesized
aatgaatgaatgaagtttgcac

SEQ ID NO: 65298 - DNA, 22 bp, Artificial Sequence
  chemically synthesized
atgaatgaatgaagtttgcacc

SEQ ID NO: 65299 - DNA, 22 bp, Artificial Sequence
  chemically synthesized
gcaccattttttcacctcctcc

SEQ ID NO: 65300 - DNA, 22 bp, Artificial Sequence
  chemically synthesized
caccattttttcacctcctcca

SEQ ID NO: 65301 - DNA, 22 bp, Artificial Sequence
  chemically synthesized
tttcacctcctccagtcacctt

SEQ ID NO: 65302 - DNA, 22 bp, Artificial Sequence
  chemically synthesized
ttcacctcctccagtcaccttt

SEQ ID NO: 65303 - DNA, 22 bp, Artificial Sequence
  chemically synthesized
tcacctcctccagtcacctttc

SEQ ID NO: 65304 - DNA, 22 bp, Artificial Sequence
  chemically synthesized
cacctcctccagtcacctttca

SEQ ID NO: 65305 - DNA, 22 bp, Artificial Sequence
  chemically synthesized
acctcctccagtcacctttcaa

SEQ ID NO: 65306 - DNA, 22 bp, Artificial Sequence
  chemically synthesized
ctccagtcacctttcaaattag

SEQ ID NO: 65307 - DNA, 22 bp, Artificial Sequence
  chemically synthesized
cagtcacctttcaaattagcca

SEQ ID NO: 65308 - DNA, 22 bp, Artificial Sequence
  chemically synthesized
tcaaattagccaacttgcaaaa

SEQ ID NO: 65309 - DNA, 22 bp, Artificial Sequence
  chemically synthesized
caaattagccaacttgcaaaac

SEQ ID NO: 65310 - DNA, 22 bp, Artificial Sequence
  chemically synthesized
aaattagccaacttgcaaaacc

SEQ ID NO: 65311 - DNA, 22 bp, Artificial Sequence
  chemically synthesized
gccaacttgcaaaaccccagca

SEQ ID NO: 65312 - DNA, 22 bp, Artificial Sequence
  chemically synthesized
gcaaaaccccagcagacacact

SEQ ID NO: 65313 - DNA, 22 bp, Artificial Sequence
  chemically synthesized
caaaaccccagcagacacactt

SEQ ID NO: 65314 - DNA, 22 bp, Artificial Sequence
  chemically synthesized
tccttctgtgtgtaatctcctg

SEQ ID NO: 65315 - DNA, 22 bp, Artificial Sequence
  chemically synthesized
ccttctgtgtgtaatctcctga

SEQ ID NO: 65316 - DNA, 22 bp, Artificial Sequence
  chemically synthesized
cttctgtgtgtaatctcctgag

SEQ ID NO: 65317 - DNA, 22 bp, Artificial Sequence
  chemically synthesized
ctgtgtgtaatctcctgagcca

SEQ ID NO: 65318 - DNA, 22 bp, Artificial Sequence
  chemically synthesized
tgtgtgtaatctcctgagccac

SEQ ID NO: 65319 - DNA, 22 bp, Artificial Sequence
  chemically synthesized
tgtgtaatctcctgagccactt

SEQ ID NO: 65320 - DNA, 22 bp, Artificial Sequence
  chemically synthesized
ctgagccacttcctgtgtgttg

SEQ ID NO: 65321 - DNA, 22 bp, Artificial Sequence
  chemically synthesized
agccacttcctgtgtgttgggg

SEQ ID NO: 65322 - DNA, 22 bp, Artificial Sequence
  chemically synthesized
cctgtgtgttggggaggggagg

SEQ ID NO: 65323 - DNA, 22 bp, Artificial Sequence
  chemically synthesized
ctgtgtgttggggaggggaggg

SEQ ID NO: 65324 - DNA, 22 bp, Artificial Sequence
  chemically synthesized
tgtgttggggaggggagggggg

SEQ ID NO: 65325 - DNA, 22 bp, Artificial Sequence
  chemically synthesized
gggaggggaggggggatttctg

SEQ ID NO: 65326 - DNA, 22 bp, Artificial Sequence
  chemically synthesized
ctgcattttctggaactatgtg

SEQ ID NO: 65327 - DNA, 22 bp, Artificial Sequence
  chemically synthesized
tgcattttctggaactatgtgg

SEQ ID NO: 65328 - DNA, 22 bp, Artificial Sequence
  chemically synthesized
cattttctggaactatgtggcc

SEQ ID NO: 65329 - DNA, 22 bp, Artificial Sequence
  chemically synthesized
tctggaactatgtggcctactc

SEQ ID NO: 65330 - DNA, 22 bp, Artificial Sequence
  chemically synthesized
ctggaactatgtggcctactca

SEQ ID NO: 65331 - DNA, 22 bp, Artificial Sequence
  chemically synthesized
tggaactatgtggcctactcac

SEQ ID NO: 65332 - DNA, 22 bp, Artificial Sequence
  chemically synthesized
gaactatgtggcctactcacag

SEQ ID NO: 65333 - DNA, 22 bp, Artificial Sequence
  chemically synthesized
tgtggcctactcacagcttctt

SEQ ID NO: 65334 - DNA, 22 bp, Artificial Sequence
  chemically synthesized
ctcacagcttcttctttttttt

SEQ ID NO: 65335 - DNA, 22 bp, Artificial Sequence
  chemically synthesized
acagcttcttcttttttttttt

SEQ ID NO: 65336 - DNA, 22 bp, Artificial Sequence
  chemically synthesized
cttctttttttttttttttttg

SEQ ID NO: 65337 - DNA, 22 bp, Artificial Sequence
  chemically synthesized
ttctttttttttttttttttga

SEQ ID NO: 65338 - DNA, 22 bp, Artificial Sequence
  chemically synthesized
ctttttttttttttttttgaga

SEQ ID NO: 65339 - DNA, 22 bp, Artificial Sequence
  chemically synthesized
tttttttttttttttttgagac

SEQ ID NO: 65340 - DNA, 22 bp, Artificial Sequence
  chemically synthesized
tttttttttttttttgagacag

SEQ ID NO: 65341 - DNA, 22 bp, Artificial Sequence
  chemically synthesized
ttttttttttttttgagacaga

SEQ ID NO: 65342 - DNA, 22 bp, Artificial Sequence
  chemically synthesized
tttttttttttttgagacagag

SEQ ID NO: 65343 - DNA, 22 bp, Artificial Sequence
  chemically synthesized
ttttttttttttgagacagagt

SEQ ID NO: 65344 - DNA, 22 bp, Artificial Sequence
  chemically synthesized
tttttttttttgagacagagtc

SEQ ID NO: 65345 - DNA, 22 bp, Artificial Sequence
  chemically synthesized
ttttttttttgagacagagtct

SEQ ID NO: 65346 - DNA, 22 bp, Artificial Sequence
  chemically synthesized
tttttttttgagacagagtctc

SEQ ID NO: 65347 - DNA, 22 bp, Artificial Sequence
  chemically synthesized
ttttttttgagacagagtctca

SEQ ID NO: 65348 - DNA, 22 bp, Artificial Sequence
  chemically synthesized
tttttttgagacagagtctcac

SEQ ID NO: 65349 - DNA, 22 bp, Artificial Sequence
  chemically synthesized
ttttttgagacagagtctcact

SEQ ID NO: 65350 - DNA, 22 bp, Artificial Sequence
  chemically synthesized
tttttgagacagagtctcactc

SEQ ID NO: 65351 - DNA, 22 bp, Artificial Sequence
  chemically synthesized
ttttgagacagagtctcactca

SEQ ID NO: 65352 - DNA, 22 bp, Artificial Sequence
  chemically synthesized
tttgagacagagtctcactcag

SEQ ID NO: 65353 - DNA, 22 bp, Artificial Sequence
  chemically synthesized
ttgagacagagtctcactcagt

SEQ ID NO: 65354 - DNA, 22 bp, Artificial Sequence
  chemically synthesized
tgagacagagtctcactcagtc

SEQ ID NO: 65355 - DNA, 22 bp, Artificial Sequence
  chemically synthesized
gagacagagtctcactcagtca

SEQ ID NO: 65356 - DNA, 22 bp, Artificial Sequence
  chemically synthesized
agacagagtctcactcagtcac

SEQ ID NO: 65357 - DNA, 22 bp, Artificial Sequence
  chemically synthesized
actcagtcacccaggctggagt

SEQ ID NO: 65358 - DNA, 22 bp, Artificial Sequence
  chemically synthesized
agtcacccaggctggagtacag

SEQ ID NO: 65359 - DNA, 22 bp, Artificial Sequence
  chemically synthesized
gagtacagtggcgcaatcttgg

SEQ ID NO: 65360 - DNA, 22 bp, Artificial Sequence
  chemically synthesized
ggcttactgcaaactccacctc

SEQ ID NO: 65361 - DNA, 22 bp, Artificial Sequence
  chemically synthesized
gcttactgcaaactccacctct

SEQ ID NO: 65362 - DNA, 22 bp, Artificial Sequence
  chemically synthesized
actgcaaactccacctctcgaa

SEQ ID NO: 65363 - DNA, 22 bp, Artificial Sequence
  chemically synthesized
ctgcaaactccacctctcgaat

SEQ ID NO: 65364 - DNA, 22 bp, Artificial Sequence
  chemically synthesized
caaactccacctctcgaattct

SEQ ID NO: 65365 - DNA, 22 bp, Artificial Sequence
  chemically synthesized
cacctctcgaattctggaatta

SEQ ID NO: 65366 - DNA, 22 bp, Artificial Sequence
  chemically synthesized
tcgaattctggaattacgagcg

SEQ ID NO: 65367 - DNA, 22 bp, Artificial Sequence
  chemically synthesized
gaattctggaattacgagcgat

SEQ ID NO: 65368 - DNA, 22 bp, Artificial Sequence
  chemically synthesized
tggaattacgagcgattctcgt

SEQ ID NO: 65369 - DNA, 22 bp, Artificial Sequence
  chemically synthesized
gaattacgagcgattctcgtgc

SEQ ID NO: 65370 - DNA, 22 bp, Artificial Sequence
  chemically synthesized
cgagcgattctcgtgcctcagc

SEQ ID NO: 65371 - DNA, 22 bp, Artificial Sequence
  chemically synthesized
tcgtgcctcagcctccagagta

SEQ ID NO: 65372 - DNA, 22 bp, Artificial Sequence
  chemically synthesized
gtgcctcagcctccagagtagc

SEQ ID NO: 65373 - DNA, 22 bp, Artificial Sequence
  chemically synthesized
agcctccagagtagctggcatt

SEQ ID NO: 65374 - DNA, 22 bp, Artificial Sequence
  chemically synthesized
cagagtagctggcattacaggc

SEQ ID NO: 65375 - DNA, 22 bp, Artificial Sequence
  chemically synthesized
gcattacaggcatgtgctacca

SEQ ID NO: 65376 - DNA, 22 bp, Artificial Sequence
  chemically synthesized
caggcatgtgctaccaattcca

SEQ ID NO: 65377 - DNA, 22 bp, Artificial Sequence
  chemically synthesized
ccaattccagttaatttttgta

SEQ ID NO: 65378 - DNA, 22 bp, Artificial Sequence
  chemically synthesized
cagttaatttttgtatttttag

SEQ ID NO: 65379 - DNA, 22 bp, Artificial Sequence
  chemically synthesized
atttttgtatttttagtagtga

SEQ ID NO: 65380 - DNA, 22 bp, Artificial Sequence
  chemically synthesized
ttgtatttttagtagtgacagg

SEQ ID NO: 65381 - DNA, 22 bp, Artificial Sequence
  chemically synthesized
tgtatttttagtagtgacaggg

SEQ ID NO: 65382 - DNA, 22 bp, Artificial Sequence
  chemically synthesized
gtatttttagtagtgacagggt

SEQ ID NO: 65383 - DNA, 22 bp, Artificial Sequence
  chemically synthesized
tatttttagtagtgacagggtt

SEQ ID NO: 65384 - DNA, 22 bp, Artificial Sequence
  chemically synthesized
ttagtagtgacagggtttcacc

SEQ ID NO: 65385 - DNA, 22 bp, Artificial Sequence
  chemically synthesized
tagtagtgacagggtttcacca

SEQ ID NO: 65386 - DNA, 22 bp, Artificial Sequence
  chemically synthesized
agtagtgacagggtttcaccat

SEQ ID NO: 65387 - DNA, 22 bp, Artificial Sequence
  chemically synthesized
gtagtgacagggtttcaccatg

SEQ ID NO: 65388 - DNA, 22 bp, Artificial Sequence
  chemically synthesized
caccatgttggccaggctggtc

SEQ ID NO: 65389 - DNA, 22 bp, Artificial Sequence
  chemically synthesized
accatgttggccaggctggtct

SEQ ID NO: 65390 - DNA, 22 bp, Artificial Sequence
  chemically synthesized
gccaggctggtctcaaactcct

SEQ ID NO: 65391 - DNA, 22 bp, Artificial Sequence
  chemically synthesized
gtctcaaactcctggcctcaag

SEQ ID NO: 65392 - DNA, 22 bp, Artificial Sequence
  chemically synthesized
aaactcctggcctcaagttatc

SEQ ID NO: 65393 - DNA, 22 bp, Artificial Sequence
  chemically synthesized
ctggcctcaagttatctgcccg

SEQ ID NO: 65394 - DNA, 22 bp, Artificial Sequence
  chemically synthesized
gcctcaagttatctgcccgcct

SEQ ID NO: 65395 - DNA, 22 bp, Artificial Sequence
  chemically synthesized
aagttatctgcccgcctcggcc

SEQ ID NO: 65396 - DNA, 22 bp, Artificial Sequence
  chemically synthesized
tctgcccgcctcggcctcccaa

SEQ ID NO: 65397 - DNA, 22 bp, Artificial Sequence
  chemically synthesized
cccgcctcggcctcccaaagtg

SEQ ID NO: 65398 - DNA, 22 bp, Artificial Sequence
  chemically synthesized
ggcctcccaaagtgctggaatt

SEQ ID NO: 65399 - DNA, 22 bp, Artificial Sequence
  chemically synthesized
ccaaagtgctggaattacaggt

SEQ ID NO: 65400 - DNA, 22 bp, Artificial Sequence
  chemically synthesized
gaattacaggtgtgagccactg

SEQ ID NO: 65401 - DNA, 22 bp, Artificial Sequence
  chemically synthesized
caggtgtgagccactgtgcctg

SEQ ID NO: 65402 - DNA, 22 bp, Artificial Sequence
  chemically synthesized
tgcctggcctttactctttatc

SEQ ID NO: 65403 - DNA, 22 bp, Artificial Sequence
  chemically synthesized
gcctttactctttatccttact

SEQ ID NO: 65404 - DNA, 22 bp, Artificial Sequence
  chemically synthesized
tactctttatccttactcagac

SEQ ID NO: 65405 - DNA, 22 bp, Artificial Sequence
  chemically synthesized
actctttatccttactcagaca

SEQ ID NO: 65406 - DNA, 22 bp, Artificial Sequence
  chemically synthesized
ctctttatccttactcagacag

SEQ ID NO: 65407 - DNA, 22 bp, Artificial Sequence
  chemically synthesized
tttatccttactcagacagaga

SEQ ID NO: 65408 - DNA, 22 bp, Artificial Sequence
  chemically synthesized
tatccttactcagacagagaaa

SEQ ID NO: 65409 - DNA, 22 bp, Artificial Sequence
  chemically synthesized
atccttactcagacagagaaaa

SEQ ID NO: 65410 - DNA, 22 bp, Artificial Sequence
  chemically synthesized
tccttactcagacagagaaaaa

SEQ ID NO: 65411 - DNA, 22 bp, Artificial Sequence
  chemically synthesized
actcagacagagaaaaataagg

SEQ ID NO: 65412 - DNA, 22 bp, Artificial Sequence
  chemically synthesized
ctcagacagagaaaaataaggc

SEQ ID NO: 65413 - DNA, 22 bp, Artificial Sequence
  chemically synthesized
agacagagaaaaataaggcaaa

SEQ ID NO: 65414 - DNA, 22 bp, Artificial Sequence
  chemically synthesized
tacattataaggggcaacatag

SEQ ID NO: 65415 - DNA, 22 bp, Artificial Sequence
  chemically synthesized
taaggggcaacatagttaaaag

SEQ ID NO: 65416 - DNA, 22 bp, Artificial Sequence
  chemically synthesized
aaagaaggaataaaaatgcatc

SEQ ID NO: 65417 - DNA, 22 bp, Artificial Sequence
  chemically synthesized
tagcttcatccccttcttgtta

SEQ ID NO: 65418 - DNA, 22 bp, Artificial Sequence
  chemically synthesized
catccccttcttgttaaaatta

SEQ ID NO: 65419 - DNA, 22 bp, Artificial Sequence
  chemically synthesized
atccccttcttgttaaaattac

SEQ ID NO: 65420 - DNA, 22 bp, Artificial Sequence
  chemically synthesized
cttgttaaaattactaaaactc

SEQ ID NO: 65421 - DNA, 22 bp, Artificial Sequence
  chemically synthesized
ttgttaaaattactaaaactca

SEQ ID NO: 65422 - DNA, 22 bp, Artificial Sequence
  chemically synthesized
gttaaaattactaaaactcatg

SEQ ID NO: 65423 - DNA, 22 bp, Artificial Sequence
  chemically synthesized
ttaaaattactaaaactcatgt

SEQ ID NO: 65424 - DNA, 22 bp, Artificial Sequence
  chemically synthesized
aaattactaaaactcatgtttt

SEQ ID NO: 65425 - DNA, 22 bp, Artificial Sequence
  chemically synthesized
ctaaaactcatgttttattgca

SEQ ID NO: 65426 - DNA, 22 bp, Artificial Sequence
  chemically synthesized
aaactcatgttttattgcagct

SEQ ID NO: 65427 - DNA, 22 bp, Artificial Sequence
  chemically synthesized
atgttttattgcagctaacctt

SEQ ID NO: 65428 - DNA, 22 bp, Artificial Sequence
  chemically synthesized
tattgcagctaaccttttctga

SEQ ID NO: 65429 - DNA, 22 bp, Artificial Sequence
  chemically synthesized
attgcagctaaccttttctgaa

SEQ ID NO: 65430 - DNA, 22 bp, Artificial Sequence
  chemically synthesized
ttgcagctaaccttttctgaac

SEQ ID NO: 65431 - DNA, 22 bp, Artificial Sequence
  chemically synthesized
cagctaaccttttctgaacttt

SEQ ID NO: 65432 - DNA, 22 bp, Artificial Sequence
  chemically synthesized
accttttctgaactttatttta

SEQ ID NO: 65433 - DNA, 22 bp, Artificial Sequence
  chemically synthesized
ttctgaactttattttaacttt

SEQ ID NO: 65434 - DNA, 22 bp, Artificial Sequence
  chemically synthesized
tctgaactttattttaacttta

SEQ ID NO: 65435 - DNA, 22 bp, Artificial Sequence
  chemically synthesized
ctgaactttattttaactttac

SEQ ID NO: 65436 - DNA, 22 bp, Artificial Sequence
  chemically synthesized
tgaactttattttaactttact

SEQ ID NO: 65437 - DNA, 22 bp, Artificial Sequence
  chemically synthesized
aactttattttaactttactct

SEQ ID NO: 65438 - DNA, 22 bp, Artificial Sequence
  chemically synthesized
tattttaactttactcttttga

SEQ ID NO: 65439 - DNA, 22 bp, Artificial Sequence
  chemically synthesized
attttaactttactcttttgag

SEQ ID NO: 65440 - DNA, 22 bp, Artificial Sequence
  chemically synthesized
ttttaactttactcttttgagg

SEQ ID NO: 65441 - DNA, 22 bp, Artificial Sequence
  chemically synthesized
taactttactcttttgaggtta

SEQ ID NO: 65442 - DNA, 22 bp, Artificial Sequence
  chemically synthesized
aactttactcttttgaggttat

SEQ ID NO: 65443 - DNA, 22 bp, Artificial Sequence
  chemically synthesized
actttactcttttgaggttatg

SEQ ID NO: 65444 - DNA, 22 bp, Artificial Sequence
  chemically synthesized
tactcttttgaggttatgggcc

SEQ ID NO: 65445 - DNA, 22 bp, Artificial Sequence
  chemically synthesized
actcttttgaggttatgggcct

SEQ ID NO: 65446 - DNA, 22 bp, Artificial Sequence
  chemically synthesized
ctcttttgaggttatgggcctt

SEQ ID NO: 65447 - DNA, 22 bp, Artificial Sequence
  chemically synthesized
ttttgaggttatgggccttgat

SEQ ID NO: 65448 - DNA, 22 bp, Artificial Sequence
  chemically synthesized
ttgaggttatgggccttgatgg

SEQ ID NO: 65449 - DNA, 22 bp, Artificial Sequence
  chemically synthesized
tgaggttatgggccttgatggt

SEQ ID NO: 65450 - DNA, 22 bp, Artificial Sequence
  chemically synthesized
gaggttatgggccttgatggtc

SEQ ID NO: 65451 - DNA, 22 bp, Artificial Sequence
  chemically synthesized
aggttatgggccttgatggtca

SEQ ID NO: 65452 - DNA, 22 bp, Artificial Sequence
  chemically synthesized
tgggccttgatggtcattacgg

SEQ ID NO: 65453 - DNA, 22 bp, Artificial Sequence
  chemically synthesized
gatggtcattacggattggaag

SEQ ID NO: 65454 - DNA, 22 bp, Artificial Sequence
  chemically synthesized
atggtcattacggattggaagc

SEQ ID NO: 65455 - DNA, 22 bp, Artificial Sequence
  chemically synthesized
cggattggaagcttttaagaga

SEQ ID NO: 65456 - DNA, 22 bp, Artificial Sequence
  chemically synthesized
gaagcttttaagagactcaatg

SEQ ID NO: 65457 - DNA, 22 bp, Artificial Sequence
  chemically synthesized
ttaagagactcaatgtgtccta

SEQ ID NO: 65458 - DNA, 22 bp, Artificial Sequence
  chemically synthesized
taagagactcaatgtgtcctat

SEQ ID NO: 65459 - DNA, 22 bp, Artificial Sequence
  chemically synthesized
aagagactcaatgtgtcctatt

SEQ ID NO: 65460 - DNA, 22 bp, Artificial Sequence
  chemically synthesized
agagactcaatgtgtcctattg

SEQ ID NO: 65461 - DNA, 22 bp, Artificial Sequence
  chemically synthesized
aatgtgtcctattgaactataa

SEQ ID NO: 65462 - DNA, 22 bp, Artificial Sequence
  chemically synthesized
ttgaactataattatgatttga

SEQ ID NO: 65463 - DNA, 22 bp, Artificial Sequence
  chemically synthesized
aactataattatgatttgattt

SEQ ID NO: 65464 - DNA, 22 bp, Artificial Sequence
  chemically synthesized
taattatgatttgattttagat

SEQ ID NO: 65465 - DNA, 22 bp, Artificial Sequence
  chemically synthesized
tgatttgattttagatggtcaa

SEQ ID NO: 65466 - DNA, 22 bp, Artificial Sequence
  chemically synthesized
gattttagatggtcaacttgtc

SEQ ID NO: 65467 - DNA, 22 bp, Artificial Sequence
  chemically synthesized
attttagatggtcaacttgtcg

SEQ ID NO: 65468 - DNA, 22 bp, Artificial Sequence
  chemically synthesized
tagatggtcaacttgtcgcatt

SEQ ID NO: 65469 - DNA, 22 bp, Artificial Sequence
  chemically synthesized
agatggtcaacttgtcgcattt

SEQ ID NO: 65470 - DNA, 22 bp, Artificial Sequence
  chemically synthesized
gatggtcaacttgtcgcatttt

SEQ ID NO: 65471 - DNA, 22 bp, Artificial Sequence
  chemically synthesized
gtcgcattttggtcaataggaa

SEQ ID NO: 65472 - DNA, 22 bp, Artificial Sequence
  chemically synthesized
tcgcattttggtcaataggaac

SEQ ID NO: 65473 - DNA, 22 bp, Artificial Sequence
  chemically synthesized
tggtcaataggaacccttttaa

SEQ ID NO: 65474 - DNA, 22 bp, Artificial Sequence
  chemically synthesized
ggtcaataggaacccttttaag

SEQ ID NO: 65475 - DNA, 22 bp, Artificial Sequence
  chemically synthesized
gtcaataggaacccttttaagt

SEQ ID NO: 65476 - DNA, 22 bp, Artificial Sequence
  chemically synthesized
ttaagttatctctttatccctt

SEQ ID NO: 65477 - DNA, 22 bp, Artificial Sequence
  chemically synthesized
taagttatctctttatcccttt

SEQ ID NO: 65478 - DNA, 22 bp, Artificial Sequence
  chemically synthesized
aagttatctctttatccctttg

SEQ ID NO: 65479 - DNA, 22 bp, Artificial Sequence
  chemically synthesized
agttatctctttatccctttga

SEQ ID NO: 65480 - DNA, 22 bp, Artificial Sequence
  chemically synthesized
tctctttatccctttgacaatc

SEQ ID NO: 65481 - DNA, 22 bp, Artificial Sequence
  chemically synthesized
tttatccctttgacaatctctg

SEQ ID NO: 65482 - DNA, 22 bp, Artificial Sequence
  chemically synthesized
tatccctttgacaatctctgct

SEQ ID NO: 65483 - DNA, 22 bp, Artificial Sequence
  chemically synthesized
atccctttgacaatctctgctg

SEQ ID NO: 65484 - DNA, 22 bp, Artificial Sequence
  chemically synthesized
tccctttgacaatctctgctga

SEQ ID NO: 65485 - DNA, 22 bp, Artificial Sequence
  chemically synthesized
tgacaatctctgctgatgtttc

SEQ ID NO: 65486 - DNA, 22 bp, Artificial Sequence
  chemically synthesized
gacaatctctgctgatgtttca

SEQ ID NO: 65487 - DNA, 22 bp, Artificial Sequence
  chemically synthesized
acaatctctgctgatgtttcag

SEQ ID NO: 65488 - DNA, 22 bp, Artificial Sequence
  chemically synthesized
tgctgatgtttcagcaacacac

SEQ ID NO: 65489 - DNA, 22 bp, Artificial Sequence
  chemically synthesized
ctgatgtttcagcaacacacac

SEQ ID NO: 65490 - DNA, 22 bp, Artificial Sequence
  chemically synthesized
atgtttcagcaacacacacttg

SEQ ID NO: 65491 - DNA, 22 bp, Artificial Sequence
  chemically synthesized
cagcaacacacacttgctttct

SEQ ID NO: 65492 - DNA, 22 bp, Artificial Sequence
  chemically synthesized
agcaacacacacttgctttctg

SEQ ID NO: 65493 - DNA, 22 bp, Artificial Sequence
  chemically synthesized
gctttctggcaaggccaccatg

SEQ ID NO: 65494 - DNA, 22 bp, Artificial Sequence
  chemically synthesized
ctttctggcaaggccaccatgt

SEQ ID NO: 65495 - DNA, 22 bp, Artificial Sequence
  chemically synthesized
tctggcaaggccaccatgttca

SEQ ID NO: 65496 - DNA, 22 bp, Artificial Sequence
  chemically synthesized
ctggcaaggccaccatgttcat

SEQ ID NO: 65497 - DNA, 22 bp, Artificial Sequence
  chemically synthesized
tggcaaggccaccatgttcatg

SEQ ID NO: 65498 - DNA, 22 bp, Artificial Sequence
  chemically synthesized
gcaaggccaccatgttcatgtt

SEQ ID NO: 65499 - DNA, 22 bp, Artificial Sequence
  chemically synthesized
atgttccaggtctgtcttcatt

SEQ ID NO: 65500 - DNA, 22 bp, Artificial Sequence
  chemically synthesized
caggtctgtcttcattttctct

SEQ ID NO: 65501 - DNA, 22 bp, Artificial Sequence
  chemically synthesized
tcttcattttctcttgccccaa

SEQ ID NO: 65502 - DNA, 22 bp, Artificial Sequence
  chemically synthesized
cattttctcttgccccaagaca

SEQ ID NO: 65503 - DNA, 22 bp, Artificial Sequence
  chemically synthesized
attttctcttgccccaagacat

SEQ ID NO: 65504 - DNA, 22 bp, Artificial Sequence
  chemically synthesized
tctcttgccccaagacatggca

SEQ ID NO: 65505 - DNA, 22 bp, Artificial Sequence
  chemically synthesized
ctcttgccccaagacatggcac

SEQ ID NO: 65506 - DNA, 22 bp, Artificial Sequence
  chemically synthesized
tcttgccccaagacatggcact

SEQ ID NO: 65507 - DNA, 22 bp, Artificial Sequence
  chemically synthesized
ttgccccaagacatggcactgg

SEQ ID NO: 65508 - DNA, 22 bp, Artificial Sequence
  chemically synthesized
gccccaagacatggcactgggg

SEQ ID NO: 65509 - DNA, 22 bp, Artificial Sequence
  chemically synthesized
ccccaagacatggcactggggt

SEQ ID NO: 65510 - DNA, 22 bp, Artificial Sequence
  chemically synthesized
gggtatcttccctgggagagaa

SEQ ID NO: 65511 - DNA, 22 bp, Artificial Sequence
  chemically synthesized
ccctgggagagaaagcaagcac

SEQ ID NO: 65512 - DNA, 22 bp, Artificial Sequence
  chemically synthesized
cctgggagagaaagcaagcacg

SEQ ID NO: 65513 - DNA, 22 bp, Artificial Sequence
  chemically synthesized
ggagagaaagcaagcacgcagt

SEQ ID NO: 65514 - DNA, 22 bp, Artificial Sequence
  chemically synthesized
ctgggaaccacaggcagggctg

SEQ ID NO: 65515 - DNA, 22 bp, Artificial Sequence
  chemically synthesized
tgggaaccacaggcagggctga

SEQ ID NO: 65516 - DNA, 22 bp, Artificial Sequence
  chemically synthesized
ggaaccacaggcagggctgagc

SEQ ID NO: 65517 - DNA, 22 bp, Artificial Sequence
  chemically synthesized
agcgtgcaagactcacccttgc

SEQ ID NO: 65518 - DNA, 22 bp, Artificial Sequence
  chemically synthesized
acccttgcgtggggactatggg

SEQ ID NO: 65519 - DNA, 22 bp, Artificial Sequence
  chemically synthesized
gcgtggggactatgggagaccc

SEQ ID NO: 65520 - DNA, 22 bp, Artificial Sequence
  chemically synthesized
cgtggggactatgggagaccca

SEQ ID NO: 65521 - DNA, 22 bp, Artificial Sequence
  chemically synthesized
tgggagacccagcaggacttga

SEQ ID NO: 65522 - DNA, 22 bp, Artificial Sequence
  chemically synthesized
gagggcttattattcagaaata

SEQ ID NO: 65523 - DNA, 22 bp, Artificial Sequence
  chemically synthesized
agggcttattattcagaaatac

SEQ ID NO: 65524 - DNA, 22 bp, Artificial Sequence
  chemically synthesized
attattcagaaatacatgccct

SEQ ID NO: 65525 - DNA, 22 bp, Artificial Sequence
  chemically synthesized
ttattcagaaatacatgccctg

SEQ ID NO: 65526 - DNA, 22 bp, Artificial Sequence
  chemically synthesized
ttcagaaatacatgccctgcgt

SEQ ID NO: 65527 - DNA, 22 bp, Artificial Sequence
  chemically synthesized
agaaatacatgccctgcgtggg

SEQ ID NO: 65528 - DNA, 22 bp, Artificial Sequence
  chemically synthesized
cgtgggtggcttagataacaga

SEQ ID NO: 65529 - DNA, 22 bp, Artificial Sequence
  chemically synthesized
agataacagagagcaatagggc

SEQ ID NO: 65530 - DNA, 22 bp, Artificial Sequence
  chemically synthesized
gataacagagagcaatagggct

SEQ ID NO: 65531 - DNA, 22 bp, Artificial Sequence
  chemically synthesized
agagccctattgctctctgtta

SEQ ID NO: 65532 - DNA, 22 bp, Artificial Sequence
  chemically synthesized
ttgctctctgttatctaagcca

SEQ ID NO: 65533 - DNA, 22 bp, Artificial Sequence
  chemically synthesized
ctctctgttatctaagccaccc

SEQ ID NO: 65534 - DNA, 22 bp, Artificial Sequence
  chemically synthesized
tctgttatctaagccacccacg

SEQ ID NO: 65535 - DNA, 22 bp, Artificial Sequence
  chemically synthesized
tgttatctaagccacccacgca

SEQ ID NO: 65536 - DNA, 22 bp, Artificial Sequence
  chemically synthesized
ttatctaagccacccacgcagg

SEQ ID NO: 65537 - DNA, 22 bp, Artificial Sequence
  chemically synthesized
tctaagccacccacgcagggca

SEQ ID NO: 65538 - DNA, 22 bp, Artificial Sequence
  chemically synthesized
agccacccacgcagggcatgta

SEQ ID NO: 65539 - DNA, 22 bp, Artificial Sequence
  chemically synthesized
ctgaataataagccctcaagtc

SEQ ID NO: 65540 - DNA, 22 bp, Artificial Sequence
  chemically synthesized
tgaataataagccctcaagtcc

SEQ ID NO: 65541 - DNA, 22 bp, Artificial Sequence
  chemically synthesized
aataataagccctcaagtcctg

SEQ ID NO: 65542 - DNA, 22 bp, Artificial Sequence
  chemically synthesized
aagtcctgctgggtctcccata

SEQ ID NO: 65543 - DNA, 22 bp, Artificial Sequence
  chemically synthesized
ctgggtctcccatagtccccac

SEQ ID NO: 65544 - DNA, 22 bp, Artificial Sequence
  chemically synthesized
ggtctcccatagtccccacgca

SEQ ID NO: 65545 - DNA, 22 bp, Artificial Sequence
  chemically synthesized
ccatagtccccacgcaagggtg

SEQ ID NO: 65546 - DNA, 22 bp, Artificial Sequence
  chemically synthesized
gcacgctcagccctgcctgtgg

SEQ ID NO: 65547 - DNA, 22 bp, Artificial Sequence
  chemically synthesized
cacgctcagccctgcctgtggt

SEQ ID NO: 65548 - DNA, 22 bp, Artificial Sequence
  chemically synthesized
agccctgcctgtggttcccaga

SEQ ID NO: 65549 - DNA, 22 bp, Artificial Sequence
  chemically synthesized
cctgtggttcccagaaggcctc

SEQ ID NO: 65550 - DNA, 22 bp, Artificial Sequence
  chemically synthesized
tggttcccagaaggcctctgtc

SEQ ID NO: 65551 - DNA, 22 bp, Artificial Sequence
  chemically synthesized
ccagaaggcctctgtcactgcg

SEQ ID NO: 65552 - DNA, 22 bp, Artificial Sequence
  chemically synthesized
tgtcactgcgtgcttgctttct

SEQ ID NO: 65553 - DNA, 22 bp, Artificial Sequence
  chemically synthesized
tcactgcgtgcttgctttctct

SEQ ID NO: 65554 - DNA, 22 bp, Artificial Sequence
  chemically synthesized
cgtgcttgctttctctcccagg

SEQ ID NO: 65555 - DNA, 22 bp, Artificial Sequence
  chemically synthesized
gctttctctcccagggaagata

SEQ ID NO: 65556 - DNA, 22 bp, Artificial Sequence
  chemically synthesized
ctttctctcccagggaagatac

SEQ ID NO: 65557 - DNA, 22 bp, Artificial Sequence
  chemically synthesized
tctctcccagggaagatacccc

SEQ ID NO: 65558 - DNA, 22 bp, Artificial Sequence
  chemically synthesized
ctctcccagggaagatacccca

SEQ ID NO: 65559 - DNA, 22 bp, Artificial Sequence
  chemically synthesized
tctcccagggaagataccccag

SEQ ID NO: 65560 - DNA, 22 bp, Artificial Sequence
  chemically synthesized
tcccagggaagataccccagtg

SEQ ID NO: 65561 - DNA, 22 bp, Artificial Sequence
  chemically synthesized
ccagggaagataccccagtgcc

SEQ ID NO: 65562 - DNA, 22 bp, Artificial Sequence
  chemically synthesized
ggggcaagagaaaatgaagaca

SEQ ID NO: 65563 - DNA, 22 bp, Artificial Sequence
  chemically synthesized
gggcaagagaaaatgaagacag

SEQ ID NO: 65564 - DNA, 22 bp, Artificial Sequence
  chemically synthesized
gaacatgaacatggtggccttg

SEQ ID NO: 65565 - DNA, 22 bp, Artificial Sequence
  chemically synthesized
gccagaaagcaagtgtgtgttg

SEQ ID NO: 65566 - DNA, 22 bp, Artificial Sequence
  chemically synthesized
ccagaaagcaagtgtgtgttgc

SEQ ID NO: 65567 - DNA, 22 bp, Artificial Sequence
  chemically synthesized
ctgaaacatcagcagagattgt

SEQ ID NO: 65568 - DNA, 22 bp, Artificial Sequence
  chemically synthesized
aaacatcagcagagattgtcaa

SEQ ID NO: 65569 - DNA, 22 bp, Artificial Sequence
  chemically synthesized
tcaaagggataaagagataact

SEQ ID NO: 65570 - DNA, 22 bp, Artificial Sequence
  chemically synthesized
aaaagggttcctattgaccaaa

SEQ ID NO: 65571 - DNA, 22 bp, Artificial Sequence
  chemically synthesized
aaagggttcctattgaccaaaa
